United States Patent 11,254,933 (CRISPR/CAS TRANSCRIPTIONAL MODULATION) - sequence listing, part 7

SEQ ID NO: 279299 - DNA, 20 bp, human
gatggagcgggtttgagtgg

SEQ ID NO: 279300 - DNA, 20 bp, human
ggcgcaaccacggagaacgc

SEQ ID NO: 279301 - DNA, 20 bp, human
gacgcccccggcgttctccg

SEQ ID NO: 279302 - DNA, 20 bp, human
gcagctgtgagtggggtgta

SEQ ID NO: 279303 - DNA, 20 bp, human
gtaaaacggatggttaggtt

SEQ ID NO: 279304 - DNA, 20 bp, human
gcccgctaaaacggatggtt

SEQ ID NO: 279305 - DNA, 20 bp, human
gggtgggggtcaaggcggag

SEQ ID NO: 279306 - DNA, 20 bp, human
gggagcttgaagccttaaag

SEQ ID NO: 279307 - DNA, 20 bp, human
gctcaagccttgtcagggaa

SEQ ID NO: 279308 - DNA, 20 bp, human
gcgccactcaagccttgtca

SEQ ID NO: 279309 - DNA, 20 bp, human
gtgagtggcgggcgagagca

SEQ ID NO: 279310 - DNA, 20 bp, human
gtccacgcccttccctgaca

SEQ ID NO: 279311 - DNA, 20 bp, human
ggaagtgacaccccgcccga

SEQ ID NO: 279312 - DNA, 20 bp, human
gcggaagtgctcgcggaacc

SEQ ID NO: 279313 - DNA, 20 bp, human
ggacaccccgcccgagggac

SEQ ID NO: 279314 - DNA, 20 bp, human
ggcgcctgtccaccacttta

SEQ ID NO: 279315 - DNA, 20 bp, human
ggcctcccgtccctcgggcg

SEQ ID NO: 279316 - DNA, 20 bp, human
ggtaggtggtggccgtgaga

SEQ ID NO: 279317 - DNA, 20 bp, human
gaaggggtggttaaactatt

SEQ ID NO: 279318 - DNA, 20 bp, human
ggggctacgggtcgggagaa

SEQ ID NO: 279319 - DNA, 20 bp, human
gcagagcagggctacgggtc

SEQ ID NO: 279320 - DNA, 20 bp, human
gtacctaggaaaagtctcat

SEQ ID NO: 279321 - DNA, 20 bp, human
gtgctctgctacgactgcgt

SEQ ID NO: 279322 - DNA, 20 bp, human
gcgcaaagcacgtgacgtat

SEQ ID NO: 279323 - DNA, 20 bp, human
ggaaggtagccgtgagaagg

SEQ ID NO: 279324 - DNA, 20 bp, human
gcgtagcagagcagggctac

SEQ ID NO: 279325 - DNA, 20 bp, human
gcgagtcaacgtaactacct

SEQ ID NO: 279326 - DNA, 20 bp, human
gaggaacaggcgttaaccca

SEQ ID NO: 279327 - DNA, 20 bp, human
gaagacagtcacgctccgag

SEQ ID NO: 279328 - DNA, 20 bp, human
ggagtggccaatgaaattga

SEQ ID NO: 279329 - DNA, 20 bp, human
gagtggcaagatggcgtccc

SEQ ID NO: 279330 - DNA, 20 bp, human
gaagctaaggggagggttac

SEQ ID NO: 279331 - DNA, 20 bp, human
ggggtgaaggtactggtgtt

SEQ ID NO: 279332 - DNA, 20 bp, human
gagtaccttcacccgatcca

SEQ ID NO: 279333 - DNA, 20 bp, human
ggcgtgactgtcttgatcga

SEQ ID NO: 279334 - DNA, 20 bp, human
ggcggcttaccctacctctg

SEQ ID NO: 279335 - DNA, 20 bp, human
gtgcttccccagctggtcgc

SEQ ID NO: 279336 - DNA, 20 bp, human
gccgagaaggggactgaagt

SEQ ID NO: 279337 - DNA, 20 bp, human
gctggggtggggccgagaag

SEQ ID NO: 279338 - DNA, 20 bp, human
gcacccgatcgggaagtggc

SEQ ID NO: 279339 - DNA, 20 bp, human
gggggcctccatgacaacga

SEQ ID NO: 279340 - DNA, 20 bp, human
gctccatgacaacgagggaa

SEQ ID NO: 279341 - DNA, 20 bp, human
gtcccgcggcaccagaggcg

SEQ ID NO: 279342 - DNA, 20 bp, human
ggaggcggcgccactgaaga

SEQ ID NO: 279343 - DNA, 20 bp, human
gtgccccgcctctggtgccg

SEQ ID NO: 279344 - DNA, 20 bp, human
gcattgaaagatagcgtcgt

SEQ ID NO: 279345 - DNA, 20 bp, human
ggagcggaactatcccgctc

SEQ ID NO: 279346 - DNA, 20 bp, human
gggtgctgacgtcacgagag

SEQ ID NO: 279347 - DNA, 20 bp, human
ggcaaccttcttagcgactg

SEQ ID NO: 279348 - DNA, 20 bp, human
ggtggccacagtcgctaaga

SEQ ID NO: 279349 - DNA, 20 bp, human
gtcagcacccaaggaccgtg

SEQ ID NO: 279350 - DNA, 20 bp, human
gcttctgcggccgcctaacc

SEQ ID NO: 279351 - DNA, 20 bp, human
ggaccgtggggcatcctggg

SEQ ID NO: 279352 - DNA, 20 bp, human
ggaccgcggtggaccttttg

SEQ ID NO: 279353 - DNA, 20 bp, human
gtcgcgacgcggctgctcga

SEQ ID NO: 279354 - DNA, 20 bp, human
gcggctatggtcacctcaaa

SEQ ID NO: 279355 - DNA, 20 bp, human
gaaggaccgtggggcatcct

SEQ ID NO: 279356 - DNA, 20 bp, human
gagggattaaaacgtagggt

SEQ ID NO: 279357 - DNA, 20 bp, human
gtccgcgatgtctgcatctg

SEQ ID NO: 279358 - DNA, 20 bp, human
gtctgagggattaaaacgta

SEQ ID NO: 279359 - DNA, 20 bp, human
gccctcagatgcagacatcg

SEQ ID NO: 279360 - DNA, 20 bp, human
gtactgacgtagcagtgcgc

SEQ ID NO: 279361 - DNA, 20 bp, human
gcagtgcgcaggcgcagtcc

SEQ ID NO: 279362 - DNA, 20 bp, human
gaaaagaggaacacgccgcc

SEQ ID NO: 279363 - DNA, 20 bp, human
ggcagacaaactttctgttt

SEQ ID NO: 279364 - DNA, 20 bp, human
gcagggtcagggtagtaaat

SEQ ID NO: 279365 - DNA, 20 bp, human
ggaacacgccgccaggagcc

SEQ ID NO: 279366 - DNA, 20 bp, human
gaaacaggcgggaacccgtg

SEQ ID NO: 279367 - DNA, 20 bp, human
ggtcgcgattacgctctcta

SEQ ID NO: 279368 - DNA, 20 bp, human
gacacggcgccgactggaac

SEQ ID NO: 279369 - DNA, 20 bp, human
gccgttgcgggctggagaca

SEQ ID NO: 279370 - DNA, 20 bp, human
gggcacgtgactcaagagcg

SEQ ID NO: 279371 - DNA, 20 bp, human
gtcgagcggcgaagggtcct

SEQ ID NO: 279372 - DNA, 20 bp, human
gacccttcgccgctcgagac

SEQ ID NO: 279373 - DNA, 20 bp, human
ggtccctccccctcaggccg

SEQ ID NO: 279374 - DNA, 20 bp, human
gctccggtctcgagcggcga

SEQ ID NO: 279375 - DNA, 20 bp, human
gctagcggaaggtgtcatgg

SEQ ID NO: 279376 - DNA, 20 bp, human
gcggccacgccgaaacgttc

SEQ ID NO: 279377 - DNA, 20 bp, human
ggctctgcagccatcgacct

SEQ ID NO: 279378 - DNA, 20 bp, human
gagcggggcgctcaggtgca

SEQ ID NO: 279379 - DNA, 20 bp, human
ggagtgtcgggcggagtttc

SEQ ID NO: 279380 - DNA, 20 bp, human
gcgcggcggaatgacttccg

SEQ ID NO: 279381 - DNA, 20 bp, human
gcatggcctccgctgagttg

SEQ ID NO: 279382 - DNA, 20 bp, human
gttccggggcgcccctaaag

SEQ ID NO: 279383 - DNA, 20 bp, human
gaagcggcggagaggagtgt

SEQ ID NO: 279384 - DNA, 20 bp, human
gcggggcgcccctaaagcgg

SEQ ID NO: 279385 - DNA, 20 bp, human
gctgagttggggcgcggaaa

SEQ ID NO: 279386 - DNA, 20 bp, human
gtgaaatggtgataatgctg

SEQ ID NO: 279387 - DNA, 20 bp, human
gtcttcatactgactcccct

SEQ ID NO: 279388 - DNA, 20 bp, human
gaaacatatactatatgaaa

SEQ ID NO: 279389 - DNA, 20 bp, human
gtactgactccccttggaga

SEQ ID NO: 279390 - DNA, 20 bp, human
ggctctgcagccatcgacct

SEQ ID NO: 279391 - DNA, 20 bp, human
gcggccacgccgaaacgttc

SEQ ID NO: 279392 - DNA, 20 bp, human
gcatggcctccgctgagttg

SEQ ID NO: 279393 - DNA, 20 bp, human
gcgcggcggaatgacttccg

SEQ ID NO: 279394 - DNA, 20 bp, human
gaagcggcggagaggagtgt

SEQ ID NO: 279395 - DNA, 20 bp, human
gctgagttggggcgcggaaa

SEQ ID NO: 279396 - DNA, 20 bp, human
gtgaaatggtgataatgctg

SEQ ID NO: 279397 - DNA, 20 bp, human
gtcttcatactgactcccct

SEQ ID NO: 279398 - DNA, 20 bp, human
gaaacatatactatatgaaa

SEQ ID NO: 279399 - DNA, 20 bp, human
gtactgactccccttggaga

SEQ ID NO: 279400 - DNA, 20 bp, human
ggctctgcagccatcgacct

SEQ ID NO: 279401 - DNA, 20 bp, human
gcggccacgccgaaacgttc

SEQ ID NO: 279402 - DNA, 20 bp, human
gcatggcctccgctgagttg

SEQ ID NO: 279403 - DNA, 20 bp, human
gcgcggcggaatgacttccg

SEQ ID NO: 279404 - DNA, 20 bp, human
gaagcggcggagaggagtgt

SEQ ID NO: 279405 - DNA, 20 bp, human
gctgagttggggcgcggaaa

SEQ ID NO: 279406 - DNA, 20 bp, human
gcgcccgcgctgtctcgaac

SEQ ID NO: 279407 - DNA, 20 bp, human
ggtgcagcgcgctgtcagac

SEQ ID NO: 279408 - DNA, 20 bp, human
gaatctgcggaagtggagtg

SEQ ID NO: 279409 - DNA, 20 bp, human
ggtgccagccccctaatctg

SEQ ID NO: 279410 - DNA, 20 bp, human
ggacccgttcgagacagcgc

SEQ ID NO: 279411 - DNA, 20 bp, human
gtccacttccgcagattagg

SEQ ID NO: 279412 - DNA, 20 bp, human
gcggaagtgcgccggaagtg

SEQ ID NO: 279413 - DNA, 20 bp, human
ggtgcgccggaagaggggta

SEQ ID NO: 279414 - DNA, 20 bp, human
gcggggagtgcgccggaaga

SEQ ID NO: 279415 - DNA, 20 bp, human
gtggagtgcggggagtgcgc

SEQ ID NO: 279416 - DNA, 20 bp, human
ggcaccgtggggaagccgaa

SEQ ID NO: 279417 - DNA, 20 bp, human
gaatcccgaaaggcaccgtg

SEQ ID NO: 279418 - DNA, 20 bp, human
gctggcttttaattgagcga

SEQ ID NO: 279419 - DNA, 20 bp, human
gggaccagttggttccgcga

SEQ ID NO: 279420 - DNA, 20 bp, human
gtctcctttcggcttcccca

SEQ ID NO: 279421 - DNA, 20 bp, human
gctgccttcgcggaaccaac

SEQ ID NO: 279422 - DNA, 20 bp, human
gccggctctaaggagagcaa

SEQ ID NO: 279423 - DNA, 20 bp, human
gtgctaacggcgcgtgtaac

SEQ ID NO: 279424 - DNA, 20 bp, human
gcgcgcttcagccggctcta

SEQ ID NO: 279425 - DNA, 20 bp, human
ggcgccgttagcagcgtggg

SEQ ID NO: 279426 - DNA, 20 bp, human
gccgacgagcagttgggcac

SEQ ID NO: 279427 - DNA, 20 bp, human
ggcgctagggacgctattgt

SEQ ID NO: 279428 - DNA, 20 bp, human
ggggagccctactctttccg

SEQ ID NO: 279429 - DNA, 20 bp, human
gccgatacgccatcgcgcta

SEQ ID NO: 279430 - DNA, 20 bp, human
gcgggagccgcggaaagagt

SEQ ID NO: 279431 - DNA, 20 bp, human
gaggtaggacgtgaaggcag

SEQ ID NO: 279432 - DNA, 20 bp, human
gagtagggctccccagacaa

SEQ ID NO: 279433 - DNA, 20 bp, human
ggccgccgggtggagggtcc

SEQ ID NO: 279434 - DNA, 20 bp, human
gcgtcggaccccgttgtctg

SEQ ID NO: 279435 - DNA, 20 bp, human
gctagggacgctattgtggg

SEQ ID NO: 279436 - DNA, 20 bp, human
gaccgccgccgccgcgttga

SEQ ID NO: 279437 - DNA, 20 bp, human
gccggctagccccgaacccg

SEQ ID NO: 279438 - DNA, 20 bp, human
gagccggcgcggtgcttcct

SEQ ID NO: 279439 - DNA, 20 bp, human
gcaggcgcaacgcgccttcg

SEQ ID NO: 279440 - DNA, 20 bp, human
gcgaaactacaactcccgct

SEQ ID NO: 279441 - DNA, 20 bp, human
ggccgcgcttgcctcgtcct

SEQ ID NO: 279442 - DNA, 20 bp, human
gagccccgaacccgaggacg

SEQ ID NO: 279443 - DNA, 20 bp, human
gcagcaagggctgtcaatgg

SEQ ID NO: 279444 - DNA, 20 bp, human
gttccccgtcaacgcggcgg

SEQ ID NO: 279445 - DNA, 20 bp, human
gctccagcaagggctgtcaa

SEQ ID NO: 279446 - DNA, 20 bp, human
ggggcgctgggtagcaaggg

SEQ ID NO: 279447 - DNA, 20 bp, human
gcaggggcgctgggtagcaa

SEQ ID NO: 279448 - DNA, 20 bp, human
ggtaaatggcagccaatgga

SEQ ID NO: 279449 - DNA, 20 bp, human
gggctaatcccgtatgtaaa

SEQ ID NO: 279450 - DNA, 20 bp, human
gggacctgggcaccgcggtg

SEQ ID NO: 279451 - DNA, 20 bp, human
ggcgcaacaccaccctccat

SEQ ID NO: 279452 - DNA, 20 bp, human
gacccagcgcccctgcgtcc

SEQ ID NO: 279453 - DNA, 20 bp, human
gaatggcagccaatggaggg

SEQ ID NO: 279454 - DNA, 20 bp, human
gccccgggacgcaggggcgc

SEQ ID NO: 279455 - DNA, 20 bp, human
gcccgcaggtccggggccga

SEQ ID NO: 279456 - DNA, 20 bp, human
ggctgcggacacacgagtcg

SEQ ID NO: 279457 - DNA, 20 bp, human
ggcgctgtgcatttgcttgg

SEQ ID NO: 279458 - DNA, 20 bp, human
gggtctggacctcgcgggac

SEQ ID NO: 279459 - DNA, 20 bp, human
gcaactgcatgcacgtctgg

SEQ ID NO: 279460 - DNA, 20 bp, human
gccacaatcagcgatggctg

SEQ ID NO: 279461 - DNA, 20 bp, human
gaaacggcgactcccacttg

SEQ ID NO: 279462 - DNA, 20 bp, human
gactcccacttggggcgctg

SEQ ID NO: 279463 - DNA, 20 bp, human
gcaatcagcgatggctgagg

SEQ ID NO: 279464 - DNA, 20 bp, human
ggccatcgctgattgtggga

SEQ ID NO: 279465 - DNA, 20 bp, human
gtccatcccacaatcagcga

SEQ ID NO: 279466 - DNA, 20 bp, human
gtgggctggagatgaatatt

SEQ ID NO: 279467 - DNA, 20 bp, human
ggccaggttacattttcata

SEQ ID NO: 279468 - DNA, 20 bp, human
gaccatatgaaaatgtaacc

SEQ ID NO: 279469 - DNA, 20 bp, human
gaatgtaacctggccggccg

SEQ ID NO: 279470 - DNA, 20 bp, human
ggcgctgtgcatttgcttgg

SEQ ID NO: 279471 - DNA, 20 bp, human
gggtctggacctcgcgggac

SEQ ID NO: 279472 - DNA, 20 bp, human
gcaactgcatgcacgtctgg

SEQ ID NO: 279473 - DNA, 20 bp, human
ggctgcggacacacgagtcg

SEQ ID NO: 279474 - DNA, 20 bp, human
gccacaatcagcgatggctg

SEQ ID NO: 279475 - DNA, 20 bp, human
gaaacggcgactcccacttg

SEQ ID NO: 279476 - DNA, 20 bp, human
gctctcatccagggctgaca

SEQ ID NO: 279477 - DNA, 20 bp, human
gcacgggccgcgagccgcgg

SEQ ID NO: 279478 - DNA, 20 bp, human
gccgctgctgcgcatgctcc

SEQ ID NO: 279479 - DNA, 20 bp, human
gaaacccccgcctctcatcc

SEQ ID NO: 279480 - DNA, 20 bp, human
ggtcgcgcgaaggttcagca

SEQ ID NO: 279481 - DNA, 20 bp, human
gagatcgcgcatgcgccagg

SEQ ID NO: 279482 - DNA, 20 bp, human
gcagcagcggcgccgacgcg

SEQ ID NO: 279483 - DNA, 20 bp, human
gccgaggcactgcttaaatg

SEQ ID NO: 279484 - DNA, 20 bp, human
gcagcggcgccgacgcgggg

SEQ ID NO: 279485 - DNA, 20 bp, human
gtggcgcatgcgcgatctcc

SEQ ID NO: 279486 - DNA, 20 bp, human
gcggggccccggaccaatga

SEQ ID NO: 279487 - DNA, 20 bp, human
gggtcagacccagggttcgg

SEQ ID NO: 279488 - DNA, 20 bp, human
gggccccggaccaatgacgg

SEQ ID NO: 279489 - DNA, 20 bp, human
gcggcatgacgtcactcccc

SEQ ID NO: 279490 - DNA, 20 bp, human
gccggggccccgcagtaacc

SEQ ID NO: 279491 - DNA, 20 bp, human
gagtggagctccaccgtcat

SEQ ID NO: 279492 - DNA, 20 bp, human
gaggaggagttccagcgcgc

SEQ ID NO: 279493 - DNA, 20 bp, human
gcagacccagggttcggagg

SEQ ID NO: 279494 - DNA, 20 bp, human
gcgcctgcgcacaacgatcc

SEQ ID NO: 279495 - DNA, 20 bp, human
ggccccggatcgttgtgcgc

SEQ ID NO: 279496 - DNA, 20 bp, human
gcggccaacgggatcccacg

SEQ ID NO: 279497 - DNA, 20 bp, human
gtcggagggctcggtgactc

SEQ ID NO: 279498 - DNA, 20 bp, human
gggaactcggctggcttcgg

SEQ ID NO: 279499 - DNA, 20 bp, human
gagagcttggaaagaggaca

SEQ ID NO: 279500 - DNA, 20 bp, human
gggagttgcagtgtcaaaaa

SEQ ID NO: 279501 - DNA, 20 bp, human
ggctcccgtcgaggccgcgt

SEQ ID NO: 279502 - DNA, 20 bp, human
gggatcccacgcggcctcga

SEQ ID NO: 279503 - DNA, 20 bp, human
gctactcccggctcccgtcg

SEQ ID NO: 279504 - DNA, 20 bp, human
gcggctggcttcggagggct

SEQ ID NO: 279505 - DNA, 20 bp, human
gagtaggcggactcccaggc

SEQ ID NO: 279506 - DNA, 20 bp, human
gcagaccgggacgtataaat

SEQ ID NO: 279507 - DNA, 20 bp, human
gcggcctagggagtcagcat

SEQ ID NO: 279508 - DNA, 20 bp, human
gcgacccatgctgactccct

SEQ ID NO: 279509 - DNA, 20 bp, human
gtccgcgtgcgcgccagacc

SEQ ID NO: 279510 - DNA, 20 bp, human
ggggctgaaagacgcggcct

SEQ ID NO: 279511 - DNA, 20 bp, human
gcaacgagggctgaaagacg

SEQ ID NO: 279512 - DNA, 20 bp, human
gaccgggacgtataaatggg

SEQ ID NO: 279513 - DNA, 20 bp, human
ggcctcccatttatacgtcc

SEQ ID NO: 279514 - DNA, 20 bp, human
gtccttctgggaaactcgcc

SEQ ID NO: 279515 - DNA, 20 bp, human
gaccgggcgagtttcccaga

SEQ ID NO: 279516 - DNA, 20 bp, human
gtcgaagagcgaaccgtcgg

SEQ ID NO: 279517 - DNA, 20 bp, human
ggaaacgcacggggcggtaa

SEQ ID NO: 279518 - DNA, 20 bp, human
ggctctggagctcaatccct

SEQ ID NO: 279519 - DNA, 20 bp, human
ggcaacgcggccctaccagg

SEQ ID NO: 279520 - DNA, 20 bp, human
gcggtaaaggggaggctcgt

SEQ ID NO: 279521 - DNA, 20 bp, human
gtcctcgcgcgtcccacgtg

SEQ ID NO: 279522 - DNA, 20 bp, human
gcggcggcaccgggcgggta

SEQ ID NO: 279523 - DNA, 20 bp, human
ggcccagcagtctgcgcacc

SEQ ID NO: 279524 - DNA, 20 bp, human
gtaaccggaacaccacccgc

SEQ ID NO: 279525 - DNA, 20 bp, human
gcggccctaccaggtggcca

SEQ ID NO: 279526 - DNA, 20 bp, human
ggggtggaatacccagaaga

SEQ ID NO: 279527 - DNA, 20 bp, human
gtcggccctcggattctcat

SEQ ID NO: 279528 - DNA, 20 bp, human
gtcagccaatgagaatccga

SEQ ID NO: 279529 - DNA, 20 bp, human
gtatcctccgggtccctcgc

SEQ ID NO: 279530 - DNA, 20 bp, human
gtagccagcgagggacccgg

SEQ ID NO: 279531 - DNA, 20 bp, human
gtctcattggctgaagtcga

SEQ ID NO: 279532 - DNA, 20 bp, human
gccacccaatgacacctcgg

SEQ ID NO: 279533 - DNA, 20 bp, human
gcttcctccggacttctcat

SEQ ID NO: 279534 - DNA, 20 bp, human
ggctggctagtaggagagac

SEQ ID NO: 279535 - DNA, 20 bp, human
gcgggccagaggcagacttc

SEQ ID NO: 279536 - DNA, 20 bp, human
ggagagcgccggtacccacg

SEQ ID NO: 279537 - DNA, 20 bp, human
gtccggcgggcgggtggcta

SEQ ID NO: 279538 - DNA, 20 bp, human
gccgtggcgagtctccacgt

SEQ ID NO: 279539 - DNA, 20 bp, human
ggaggcaccgagaaacgagg

SEQ ID NO: 279540 - DNA, 20 bp, human
ggactcttgcgtgaccgagc

SEQ ID NO: 279541 - DNA, 20 bp, human
ggggctctcggccccgctgg

SEQ ID NO: 279542 - DNA, 20 bp, human
gggtgggctgccgtaggcag

SEQ ID NO: 279543 - DNA, 20 bp, human
gtctgaggcaccgagaaacg

SEQ ID NO: 279544 - DNA, 20 bp, human
gaagcccgtactcaagatgg

SEQ ID NO: 279545 - DNA, 20 bp, human
gctacgggcgccgagagcgc

SEQ ID NO: 279546 - DNA, 20 bp, human
gaaagctctgcagggattgg

SEQ ID NO: 279547 - DNA, 20 bp, human
gccctgctcccagcttggga

SEQ ID NO: 279548 - DNA, 20 bp, human
gggtacttgaaagctctgca

SEQ ID NO: 279549 - DNA, 20 bp, human
ggccccgccccgctccttat

SEQ ID NO: 279550 - DNA, 20 bp, human
gaaggcttcaggcgggtagc

SEQ ID NO: 279551 - DNA, 20 bp, human
gagctaagaaacagtcgact

SEQ ID NO: 279552 - DNA, 20 bp, human
gtggaaacaaggagagtgaa

SEQ ID NO: 279553 - DNA, 20 bp, human
gcaggcgggtagcggggact

SEQ ID NO: 279554 - DNA, 20 bp, human
ggtacgtgtcacccagtacg

SEQ ID NO: 279555 - DNA, 20 bp, human
gttgaaagctctgcagggat

SEQ ID NO: 279556 - DNA, 20 bp, human
gggtgcaaagcacagcgcat

SEQ ID NO: 279557 - DNA, 20 bp, human
gtctcctccgcccacacctg

SEQ ID NO: 279558 - DNA, 20 bp, human
gacaaaggacagtagggcgt

SEQ ID NO: 279559 - DNA, 20 bp, human
ggcacagcgcatggggctgg

SEQ ID NO: 279560 - DNA, 20 bp, human
gaacgcatgcgccagtccgc

SEQ ID NO: 279561 - DNA, 20 bp, human
gtgcgccagtccgcaggtgt

SEQ ID NO: 279562 - DNA, 20 bp, human
gggaggagaaatcgcgtcgg

SEQ ID NO: 279563 - DNA, 20 bp, human
ggctttgcaccccacgggtg

SEQ ID NO: 279564 - DNA, 20 bp, human
gggcggaggagaaatcgcgt

SEQ ID NO: 279565 - DNA, 20 bp, human
ggccagtccgcaggtgtggg

SEQ ID NO: 279566 - DNA, 20 bp, human
gaaacagccgcggggcacca

SEQ ID NO: 279567 - DNA, 20 bp, human
gtggccgcgggagtcgtcgg

SEQ ID NO: 279568 - DNA, 20 bp, human
gaagtggccgcgggagtcgt

SEQ ID NO: 279569 - DNA, 20 bp, human
gcgggagtcgtcggaggcgt

SEQ ID NO: 279570 - DNA, 20 bp, human
gacggcagtggcagtaaggg

SEQ ID NO: 279571 - DNA, 20 bp, human
ggatgcctcctgggagttgt

SEQ ID NO: 279572 - DNA, 20 bp, human
gtcgccgccctacaactccc

SEQ ID NO: 279573 - DNA, 20 bp, human
gttgcgccgcgatgcctcct

SEQ ID NO: 279574 - DNA, 20 bp, human
gttggcgcgcaaaggcttaa

SEQ ID NO: 279575 - DNA, 20 bp, human
gctggggactctatatcccg

SEQ ID NO: 279576 - DNA, 20 bp, human
gggagcgggaggcggtatgg

SEQ ID NO: 279577 - DNA, 20 bp, human
ggtagcgaaatgttgttccc

SEQ ID NO: 279578 - DNA, 20 bp, human
gtgaagatactcgcttccat

SEQ ID NO: 279579 - DNA, 20 bp, human
ggaggctgacaataggaata

SEQ ID NO: 279580 - DNA, 20 bp, human
gggaagcgagtatcttcaga

SEQ ID NO: 279581 - DNA, 20 bp, human
gagcatctcggtgaccggga

SEQ ID NO: 279582 - DNA, 20 bp, human
ggcgcagcgaggctgacaat

SEQ ID NO: 279583 - DNA, 20 bp, human
gacggcagaagggaacgctg

SEQ ID NO: 279584 - DNA, 20 bp, human
ggaccaccattgggtatctt

SEQ ID NO: 279585 - DNA, 20 bp, human
ggcttccattggctggtgca

SEQ ID NO: 279586 - DNA, 20 bp, human
gagagcacgcagaacacgat

SEQ ID NO: 279587 - DNA, 20 bp, human
gggccctcacacgccctccg

SEQ ID NO: 279588 - DNA, 20 bp, human
ggtgagggcctcaggagcga

SEQ ID NO: 279589 - DNA, 20 bp, human
gcagccacggagggcgtgtg

SEQ ID NO: 279590 - DNA, 20 bp, human
gctcaggagcgagggtacag

SEQ ID NO: 279591 - DNA, 20 bp, human
gaggacgcccgggttttagg

SEQ ID NO: 279592 - DNA, 20 bp, human
ggcttggaggtcagccacgg

SEQ ID NO: 279593 - DNA, 20 bp, human
gtgggacttccactgtcggg

SEQ ID NO: 279594 - DNA, 20 bp, human
gacagcgcacccgcccggct

SEQ ID NO: 279595 - DNA, 20 bp, human
ggctgacctccaagccgggc

SEQ ID NO: 279596 - DNA, 20 bp, human
gtggtgccgtacgacagctg

SEQ ID NO: 279597 - DNA, 20 bp, human
gcccccgggcgagtcctcac

SEQ ID NO: 279598 - DNA, 20 bp, human
gggggtccctgtcgtctcag

SEQ ID NO: 279599 - DNA, 20 bp, human
gtcaccggtgaggactcgcc

SEQ ID NO: 279600 - DNA, 20 bp, human
gccaggggaggggccttccg

SEQ ID NO: 279601 - DNA, 20 bp, human
gtggtggggtacaccaactg

SEQ ID NO: 279602 - DNA, 20 bp, human
gtccgcggtctccgtgtcac

SEQ ID NO: 279603 - DNA, 20 bp, human
gcggcaccactgagacgaca

SEQ ID NO: 279604 - DNA, 20 bp, human
gcatgggaaccccctctcct

SEQ ID NO: 279605 - DNA, 20 bp, human
gggcccccgcagaccctccg

SEQ ID NO: 279606 - DNA, 20 bp, human
gctgcggggaacagctcact

SEQ ID NO: 279607 - DNA, 20 bp, human
gccttcagtgcgcgggagga

SEQ ID NO: 279608 - DNA, 20 bp, human
ggaaggcaaaacacttagac

SEQ ID NO: 279609 - DNA, 20 bp, human
gaggcaggcggtgacctgcg

SEQ ID NO: 279610 - DNA, 20 bp, human
gcacgcgcaacccaggccac

SEQ ID NO: 279611 - DNA, 20 bp, human
gtgggagttgttgtctcctc

SEQ ID NO: 279612 - DNA, 20 bp, human
gttactggaaggatgtttaa

SEQ ID NO: 279613 - DNA, 20 bp, human
gtgggtttctttaacaccgt

SEQ ID NO: 279614 - DNA, 20 bp, human
gcaactcccagcaggcgtcg

SEQ ID NO: 279615 - DNA, 20 bp, human
gcctctggcctcgctcgttc

SEQ ID NO: 279616 - DNA, 20 bp, human
gtggggtgagggagcatgat

SEQ ID NO: 279617 - DNA, 20 bp, human
gcaagaccagactgcttccg

SEQ ID NO: 279618 - DNA, 20 bp, human
gatagaccccggaagcagtc

SEQ ID NO: 279619 - DNA, 20 bp, human
gatgtgatgtaaactagctg

SEQ ID NO: 279620 - DNA, 20 bp, human
gcagaaggtggtatagaccc

SEQ ID NO: 279621 - DNA, 20 bp, human
gggcgagagagagcctatga

SEQ ID NO: 279622 - DNA, 20 bp, human
gtggcaaatgtgaaatgtga

SEQ ID NO: 279623 - DNA, 20 bp, human
gctgtaatccccaaatctca

SEQ ID NO: 279624 - DNA, 20 bp, human
gacctccttcccttgagatt

SEQ ID NO: 279625 - DNA, 20 bp, human
ggggacaaaaccacagaagg

SEQ ID NO: 279626 - DNA, 20 bp, human
ggatacctagtgacacttgg

SEQ ID NO: 279627 - DNA, 20 bp, human
gcctcaggccttggcggttg

SEQ ID NO: 279628 - DNA, 20 bp, human
gcttccgggtgggtgatccc

SEQ ID NO: 279629 - DNA, 20 bp, human
ggcgccagggatcacccacc

SEQ ID NO: 279630 - DNA, 20 bp, human
gtgaaaagggctccgagagg

SEQ ID NO: 279631 - DNA, 20 bp, human
gatagcagctccttgtgtgt

SEQ ID NO: 279632 - DNA, 20 bp, human
gcgattggtcggtttgaaaa

SEQ ID NO: 279633 - DNA, 20 bp, human
ggccaggccgggcagacttc

SEQ ID NO: 279634 - DNA, 20 bp, human
gggaagcccgccaagggcga

SEQ ID NO: 279635 - DNA, 20 bp, human
gacccacccggaagtctgcc

SEQ ID NO: 279636 - DNA, 20 bp, human
gccaaggaggagatcctcgt

SEQ ID NO: 279637 - DNA, 20 bp, human
gtgactgggagtctcggttc

SEQ ID NO: 279638 - DNA, 20 bp, human
gtcgtgggaaagggtcatca

SEQ ID NO: 279639 - DNA, 20 bp, human
gcccaaagatggggtgccca

SEQ ID NO: 279640 - DNA, 20 bp, human
gaacaacagtggccttgaga

SEQ ID NO: 279641 - DNA, 20 bp, human
ggctgaccctaggggctcac

SEQ ID NO: 279642 - DNA, 20 bp, human
gcagatgagcacttagaaat

SEQ ID NO: 279643 - DNA, 20 bp, human
gaggagatcctcgtgggaaa

SEQ ID NO: 279644 - DNA, 20 bp, human
gatcagggagctgaccctag

SEQ ID NO: 279645 - DNA, 20 bp, human
gggaggatggccccaaagat

SEQ ID NO: 279646 - DNA, 20 bp, human
gaggctattgtgcactgctt

SEQ ID NO: 279647 - DNA, 20 bp, human
gattgtgcactgcttgggag

SEQ ID NO: 279648 - DNA, 20 bp, human
gagcctcttcctgatgactt

SEQ ID NO: 279649 - DNA, 20 bp, human
gcagtcaccggtggtcacaa

SEQ ID NO: 279650 - DNA, 20 bp, human
gatgggcagcctaagtcatc

SEQ ID NO: 279651 - DNA, 20 bp, human
gtcaagcggctgtgggtttt

SEQ ID NO: 279652 - DNA, 20 bp, human
ggatgtcaagctgcagtcac

SEQ ID NO: 279653 - DNA, 20 bp, human
gcacagcagcctagtctcct

SEQ ID NO: 279654 - DNA, 20 bp, human
ggtcaagctgcagtcaccgg

SEQ ID NO: 279655 - DNA, 20 bp, human
gtccgtgagtcaagcggctg

SEQ ID NO: 279656 - DNA, 20 bp, human
ggaaccctaaaactgtgggc

SEQ ID NO: 279657 - DNA, 20 bp, human
ggaagagggaatagcatagt

SEQ ID NO: 279658 - DNA, 20 bp, human
gcacagttttagggttctat

SEQ ID NO: 279659 - DNA, 20 bp, human
gcctggcctcatgtctcctt

SEQ ID NO: 279660 - DNA, 20 bp, human
gcctcctgcccacagtttta

SEQ ID NO: 279661 - DNA, 20 bp, human
gtcaggaaggaaatgtacct

SEQ ID NO: 279662 - DNA, 20 bp, human
ggacagtgatattgggacat

SEQ ID NO: 279663 - DNA, 20 bp, human
gtccttcctgacagtgatat

SEQ ID NO: 279664 - DNA, 20 bp, human
gtagggttctatgggtttgt

SEQ ID NO: 279665 - DNA, 20 bp, human
gtgggacatggggggatatt

SEQ ID NO: 279666 - DNA, 20 bp, human
gcactccgtggtggtaagaa

SEQ ID NO: 279667 - DNA, 20 bp, human
gctagctgacacccactccg

SEQ ID NO: 279668 - DNA, 20 bp, human
gcaactgtgggctcttgaca

SEQ ID NO: 279669 - DNA, 20 bp, human
ggcccacagttggccatctc

SEQ ID NO: 279670 - DNA, 20 bp, human
gtggggctgcaaggatttag

SEQ ID NO: 279671 - DNA, 20 bp, human
gtccagagatggccaactgt

SEQ ID NO: 279672 - DNA, 20 bp, human
gtaatcccttcttaccacca

SEQ ID NO: 279673 - DNA, 20 bp, human
gttagagaagcagagtcctt

SEQ ID NO: 279674 - DNA, 20 bp, human
gggattagaagattgcaaac

SEQ ID NO: 279675 - DNA, 20 bp, human
gctgctgtgtacagttatcc

SEQ ID NO: 279676 - DNA, 20 bp, human
gtggcaagggaggtgggtcc

SEQ ID NO: 279677 - DNA, 20 bp, human
gaggctggaggagtttaggc

SEQ ID NO: 279678 - DNA, 20 bp, human
ggccctggtagactctgaag

SEQ ID NO: 279679 - DNA, 20 bp, human
gacctcttcagagtctacca

SEQ ID NO: 279680 - DNA, 20 bp, human
gtggaggtcagaacttcctg

SEQ ID NO: 279681 - DNA, 20 bp, human
gtattagaagattccccagg

SEQ ID NO: 279682 - DNA, 20 bp, human
ggactattagaagattcccc

SEQ ID NO: 279683 - DNA, 20 bp, human
gtgttgacaaggctaaggga

SEQ ID NO: 279684 - DNA, 20 bp, human
gcttggttgctttgttgaca

SEQ ID NO: 279685 - DNA, 20 bp, human
ggctttgttgacaaggctaa

SEQ ID NO: 279686 - DNA, 20 bp, human
gggaactttgagttgcaatc

SEQ ID NO: 279687 - DNA, 20 bp, human
gaccaagtgccaagtgacct

SEQ ID NO: 279688 - DNA, 20 bp, human
gaacacgcaatattttagag

SEQ ID NO: 279689 - DNA, 20 bp, human
gttagccttcagttttagtg

SEQ ID NO: 279690 - DNA, 20 bp, human
ggtacagtgggtctaatggc

SEQ ID NO: 279691 - DNA, 20 bp, human
gataatgtaggcaaaattta

SEQ ID NO: 279692 - DNA, 20 bp, human
gagtggtacagtgggtctaa

SEQ ID NO: 279693 - DNA, 20 bp, human
gctgcccagttttaaaacca

SEQ ID NO: 279694 - DNA, 20 bp, human
ggcagataagttaatctcac

SEQ ID NO: 279695 - DNA, 20 bp, human
gaccaaggtcacttggcact

SEQ ID NO: 279696 - DNA, 20 bp, human
ggctgggcccccctcctcaa

SEQ ID NO: 279697 - DNA, 20 bp, human
gcagcccgacagtgaaacgc

SEQ ID NO: 279698 - DNA, 20 bp, human
ggtgaaacgcagggcgatta

SEQ ID NO: 279699 - DNA, 20 bp, human
gaactgggcagtaggtggaa

SEQ ID NO: 279700 - DNA, 20 bp, human
ggcctggctcttatctccta

SEQ ID NO: 279701 - DNA, 20 bp, human
gggaacccaggctgtgcgga

SEQ ID NO: 279702 - DNA, 20 bp, human
gaacgcagggcgattagggt

SEQ ID NO: 279703 - DNA, 20 bp, human
gggcccccctcctcaagggc

SEQ ID NO: 279704 - DNA, 20 bp, human
ggccctaggagataagagcc

SEQ ID NO: 279705 - DNA, 20 bp, human
ggaagccctccgcacagcct

SEQ ID NO: 279706 - DNA, 20 bp, human
gggcaggagcccagagtcta

SEQ ID NO: 279707 - DNA, 20 bp, human
gcggggctggttcctaggaa

SEQ ID NO: 279708 - DNA, 20 bp, human
gactgtgttcccatagactc

SEQ ID NO: 279709 - DNA, 20 bp, human
gcatgtgccgggctctccat

SEQ ID NO: 279710 - DNA, 20 bp, human
gcacccacacaggtgtcttg

SEQ ID NO: 279711 - DNA, 20 bp, human
gcccccagagaaaggaccat

SEQ ID NO: 279712 - DNA, 20 bp, human
gctggctctctgacaagccg

SEQ ID NO: 279713 - DNA, 20 bp, human
gaaggcccccatggagagcc

SEQ ID NO: 279714 - DNA, 20 bp, human
gtgtcttgaggagtgaatga

SEQ ID NO: 279715 - DNA, 20 bp, human
gggtggggttgacagctagc

SEQ ID NO: 279716 - DNA, 20 bp, human
ggtggggccactcaacgctg

SEQ ID NO: 279717 - DNA, 20 bp, human
ggggccactcaacgctgagg

SEQ ID NO: 279718 - DNA, 20 bp, human
ggggcggggctcaaagaaag

SEQ ID NO: 279719 - DNA, 20 bp, human
gagaggcggggcttgccgaa

SEQ ID NO: 279720 - DNA, 20 bp, human
gcgcccgtccccagcctcac

SEQ ID NO: 279721 - DNA, 20 bp, human
ggcgaaagatgctacggcga

SEQ ID NO: 279722 - DNA, 20 bp, human
gtgcgcgtctgcgcgaggat

SEQ ID NO: 279723 - DNA, 20 bp, human
gtcaacgctgaggcggcgaa

SEQ ID NO: 279724 - DNA, 20 bp, human
gggagcagacttaaatcaag

SEQ ID NO: 279725 - DNA, 20 bp, human
ggagaccgcgctcaacactg

SEQ ID NO: 279726 - DNA, 20 bp, human
ggggacccatctgctcccga

SEQ ID NO: 279727 - DNA, 20 bp, human
gaaagcgtctcctctggagt

SEQ ID NO: 279728 - DNA, 20 bp, human
gggggggggcggggggataa

SEQ ID NO: 279729 - DNA, 20 bp, human
gtcccgcggagggagagcat

SEQ ID NO: 279730 - DNA, 20 bp, human
gcgccctccctgctccgagg

SEQ ID NO: 279731 - DNA, 20 bp, human
ggtgtcgccatcatactcat

SEQ ID NO: 279732 - DNA, 20 bp, human
gggagagcatgggggggggc

SEQ ID NO: 279733 - DNA, 20 bp, human
ggccgaggataaggcgtttg

SEQ ID NO: 279734 - DNA, 20 bp, human
gtgaaacgtggcgacaggcg

SEQ ID NO: 279735 - DNA, 20 bp, human
gagactcccaatgagtatga

SEQ ID NO: 279736 - DNA, 20 bp, human
ggtgtggagacagagaccta

SEQ ID NO: 279737 - DNA, 20 bp, human
gacccactaggctcagacta

SEQ ID NO: 279738 - DNA, 20 bp, human
ggagctgagtcccacccact

SEQ ID NO: 279739 - DNA, 20 bp, human
gaaaaattggaggggactcc

SEQ ID NO: 279740 - DNA, 20 bp, human
gcataacagaaatcactgtg

SEQ ID NO: 279741 - DNA, 20 bp, human
gactaggctcagactagggc

SEQ ID NO: 279742 - DNA, 20 bp, human
gttctgttatggcgattggg

SEQ ID NO: 279743 - DNA, 20 bp, human
gtaagtgtgccaaattttcc

SEQ ID NO: 279744 - DNA, 20 bp, human
gtgtcttctccactatgcac

SEQ ID NO: 279745 - DNA, 20 bp, human
gtaactaaatgcactgaacc

SEQ ID NO: 279746 - DNA, 20 bp, human
gcccagttcttcaaccaatc

SEQ ID NO: 279747 - DNA, 20 bp, human
gggcgggggcgggaaggcac

SEQ ID NO: 279748 - DNA, 20 bp, human
gaaggccttgtcaccaggcg

SEQ ID NO: 279749 - DNA, 20 bp, human
ggtgctccttgcatgaattc

SEQ ID NO: 279750 - DNA, 20 bp, human
gctgcggctcgactcgccat

SEQ ID NO: 279751 - DNA, 20 bp, human
gccgcccccgcctggtgaca

SEQ ID NO: 279752 - DNA, 20 bp, human
ggagtcgagccgcagggggc

SEQ ID NO: 279753 - DNA, 20 bp, human
gcggggaggcagcatcgagc

SEQ ID NO: 279754 - DNA, 20 bp, human
gccctgattggttgaagaac

SEQ ID NO: 279755 - DNA, 20 bp, human
gggagcgagaacagccgcct

SEQ ID NO: 279756 - DNA, 20 bp, human
gcatgcccaactggtcacat

SEQ ID NO: 279757 - DNA, 20 bp, human
gacggcccatgtgaccagtt

SEQ ID NO: 279758 - DNA, 20 bp, human
gctctctggtcatgcccaac

SEQ ID NO: 279759 - DNA, 20 bp, human
gtttgtgtttgcacccagaa

SEQ ID NO: 279760 - DNA, 20 bp, human
gctgctaattactggcaagc

SEQ ID NO: 279761 - DNA, 20 bp, human
gatgaccagagagaagcgtg

SEQ ID NO: 279762 - DNA, 20 bp, human
ggtaattagcagctacgtta

SEQ ID NO: 279763 - DNA, 20 bp, human
gtttatagctctgacctttc

SEQ ID NO: 279764 - DNA, 20 bp, human
ggtgatgcatcactgggaag

SEQ ID NO: 279765 - DNA, 20 bp, human
ggtggaaaataaaggtcaaa

SEQ ID NO: 279766 - DNA, 20 bp, human
ggggaggggcgggctagtgg

SEQ ID NO: 279767 - DNA, 20 bp, human
ggtgtggccgacggctgaaa

SEQ ID NO: 279768 - DNA, 20 bp, human
ggcctgcccgtggacagctg

SEQ ID NO: 279769 - DNA, 20 bp, human
gccccagaaaggcgcagtag

SEQ ID NO: 279770 - DNA, 20 bp, human
gtctaggcatggagaagcag

SEQ ID NO: 279771 - DNA, 20 bp, human
ggaggtcagggaatcaagtg

SEQ ID NO: 279772 - DNA, 20 bp, human
gctgcggctgcttttgtgca

SEQ ID NO: 279773 - DNA, 20 bp, human
gatcagcttggggagattaa

SEQ ID NO: 279774 - DNA, 20 bp, human
ggacagatcccaccccagaa

SEQ ID NO: 279775 - DNA, 20 bp, human
gttcctgagggtggttttct

SEQ ID NO: 279776 - DNA, 20 bp, human
ggaagtagggagtctctctt

SEQ ID NO: 279777 - DNA, 20 bp, human
gtagaactgtcctggagaaa

SEQ ID NO: 279778 - DNA, 20 bp, human
gctggagaaagggcgattgg

SEQ ID NO: 279779 - DNA, 20 bp, human
gtctctgtacaaaggtgtag

SEQ ID NO: 279780 - DNA, 20 bp, human
gcaaaggtgtagagggaagt

SEQ ID NO: 279781 - DNA, 20 bp, human
gacaggtgggatcaatttaa

SEQ ID NO: 279782 - DNA, 20 bp, human
gaaggcagtgaaggcactta

SEQ ID NO: 279783 - DNA, 20 bp, human
ggagtctctcttgggaggaa

SEQ ID NO: 279784 - DNA, 20 bp, human
ggacagagagggacttctta

SEQ ID NO: 279785 - DNA, 20 bp, human
gttggcatttagaactgtcc

SEQ ID NO: 279786 - DNA, 20 bp, human
ggcccaggagctcacaggtg

SEQ ID NO: 279787 - DNA, 20 bp, human
gagtggagtggtcacgtgag

SEQ ID NO: 279788 - DNA, 20 bp, human
gcggcggaggcgtcaggaga

SEQ ID NO: 279789 - DNA, 20 bp, human
ggcaagctgcgccgccgctt

SEQ ID NO: 279790 - DNA, 20 bp, human
gcggaagcaacccgaagcgg

SEQ ID NO: 279791 - DNA, 20 bp, human
gagggtccacatgacccggg

SEQ ID NO: 279792 - DNA, 20 bp, human
ggcgtcttggcgccgggtag

SEQ ID NO: 279793 - DNA, 20 bp, human
gtgtctacaccctgcgtttt

SEQ ID NO: 279794 - DNA, 20 bp, human
gctgatgtcacgacagcgtg

SEQ ID NO: 279795 - DNA, 20 bp, human
gtaccccccgtaggatccgg

SEQ ID NO: 279796 - DNA, 20 bp, human
gtgacgcagcgggagaagac

SEQ ID NO: 279797 - DNA, 20 bp, human
gagaacgagtgagacatggg

SEQ ID NO: 279798 - DNA, 20 bp, human
gaggtaagtacttccctaag

SEQ ID NO: 279799 - DNA, 20 bp, human
gcggggctagcgaggcactg

SEQ ID NO: 279800 - DNA, 20 bp, human
ggggaagaacgagtgagaca

SEQ ID NO: 279801 - DNA, 20 bp, human
gtggcctgtcgcgaccgcag

SEQ ID NO: 279802 - DNA, 20 bp, human
ggctgtgctgaacgcccctg

SEQ ID NO: 279803 - DNA, 20 bp, human
ggggacaagtacgccgtggg

SEQ ID NO: 279804 - DNA, 20 bp, human
ggcgtggcgctgtgacgcag

SEQ ID NO: 279805 - DNA, 20 bp, human
gcggtgcggcgctgtcacgt

SEQ ID NO: 279806 - DNA, 20 bp, human
gacccaggagcgaacttcca

SEQ ID NO: 279807 - DNA, 20 bp, human
gagggtgcgtggatcagact

SEQ ID NO: 279808 - DNA, 20 bp, human
gtgcacgcggaaccggaggt

SEQ ID NO: 279809 - DNA, 20 bp, human
gaacgccgggctccccctct

SEQ ID NO: 279810 - DNA, 20 bp, human
gctgaagactgagtaaggta

SEQ ID NO: 279811 - DNA, 20 bp, human
gtgagcaggcaagtcatcgt

SEQ ID NO: 279812 - DNA, 20 bp, human
gagggggagcccggcgttcc

SEQ ID NO: 279813 - DNA, 20 bp, human
gtgggagggcccaaaggaag

SEQ ID NO: 279814 - DNA, 20 bp, human
gaaacccatccgcagaagga

SEQ ID NO: 279815 - DNA, 20 bp, human
gcggaaccggaggtgggtgg

SEQ ID NO: 279816 - DNA, 20 bp, human
gacctcgcccttatcggctg

SEQ ID NO: 279817 - DNA, 20 bp, human
gggccgggcgctgcccggta

SEQ ID NO: 279818 - DNA, 20 bp, human
gcgctgcccggtagggcttg

SEQ ID NO: 279819 - DNA, 20 bp, human
gttggttgaggacgagtgcc

SEQ ID NO: 279820 - DNA, 20 bp, human
ggcgctaagaaaagcgcggg

SEQ ID NO: 279821 - DNA, 20 bp, human
gatccgcgccatcttggttg

SEQ ID NO: 279822 - DNA, 20 bp, human
ggaagccatccgcgccatct

SEQ ID NO: 279823 - DNA, 20 bp, human
ggccccagccgataagggcg

SEQ ID NO: 279824 - DNA, 20 bp, human
gccctcagccccagccgata

SEQ ID NO: 279825 - DNA, 20 bp, human
gttccagccacaagccctac

SEQ ID NO: 279826 - DNA, 20 bp, human
ggctcctgctcctccatggt

SEQ ID NO: 279827 - DNA, 20 bp, human
gtggaacctggatcacatag

SEQ ID NO: 279828 - DNA, 20 bp, human
gcttctggcacatggagcgg

SEQ ID NO: 279829 - DNA, 20 bp, human
ggactggagcttctggcaca

SEQ ID NO: 279830 - DNA, 20 bp, human
gctgcacagactggagcttc

SEQ ID NO: 279831 - DNA, 20 bp, human
gcccgattttggaataagtc

SEQ ID NO: 279832 - DNA, 20 bp, human
gtgccagggtcccttcgaca

SEQ ID NO: 279833 - DNA, 20 bp, human
ggacggcagctatacaacag

SEQ ID NO: 279834 - DNA, 20 bp, human
gtatacaacagaggagccaa

SEQ ID NO: 279835 - DNA, 20 bp, human
gtccagtctgtgcagtacga

SEQ ID NO: 279836 - DNA, 20 bp, human
gggccgacgcgcaggtgaat

SEQ ID NO: 279837 - DNA, 20 bp, human
gttcgcgtgggagggacgca

SEQ ID NO: 279838 - DNA, 20 bp, human
gtctgccgccgcgcgctcaa

SEQ ID NO: 279839 - DNA, 20 bp, human
gaggtgaatgggagccctgt

SEQ ID NO: 279840 - DNA, 20 bp, human
gcctcccacgcgaactgcgc

SEQ ID NO: 279841 - DNA, 20 bp, human
ggcgccggcgcagttcgcgt

SEQ ID NO: 279842 - DNA, 20 bp, human
gtcggcggtcgagacccaca

SEQ ID NO: 279843 - DNA, 20 bp, human
gctagcgcaggccgacgcgc

SEQ ID NO: 279844 - DNA, 20 bp, human
gccgcgcgctcaagggtcag

SEQ ID NO: 279845 - DNA, 20 bp, human
ggggtctcgaccgccgagag

SEQ ID NO: 279846 - DNA, 20 bp, human
gaatcagcgggaacagtgga

SEQ ID NO: 279847 - DNA, 20 bp, human
gctactccacacagtacggt

SEQ ID NO: 279848 - DNA, 20 bp, human
gcacacagtacggtaggcgc

SEQ ID NO: 279849 - DNA, 20 bp, human
ggtgagagctgggttacagg

SEQ ID NO: 279850 - DNA, 20 bp, human
gtaccagaagcccgagagcc

SEQ ID NO: 279851 - DNA, 20 bp, human
gagggggaggcggtgagagc

SEQ ID NO: 279852 - DNA, 20 bp, human
ggcggctactccacacagta

SEQ ID NO: 279853 - DNA, 20 bp, human
gagagaatcagcgggaacag

SEQ ID NO: 279854 - DNA, 20 bp, human
gccgcccgcccgccggggac

SEQ ID NO: 279855 - DNA, 20 bp, human
ggcggtgagagctgggttac

SEQ ID NO: 279856 - DNA, 20 bp, human
ggaagtaggagcaggggcgc

SEQ ID NO: 279857 - DNA, 20 bp, human
gccccggggaagtaggagca

SEQ ID NO: 279858 - DNA, 20 bp, human
gagcgtgcgcggccacgtga

SEQ ID NO: 279859 - DNA, 20 bp, human
ggcaggcgccccggggaagt

SEQ ID NO: 279860 - DNA, 20 bp, human
ggaggagccgagggagacgc

SEQ ID NO: 279861 - DNA, 20 bp, human
gttgacaagggcaggcgccc

SEQ ID NO: 279862 - DNA, 20 bp, human
ggggggcgcgcggttgacaa

SEQ ID NO: 279863 - DNA, 20 bp, human
gacggcagcgagagcgtgcg

SEQ ID NO: 279864 - DNA, 20 bp, human
gcccaagaagccaagggtta

SEQ ID NO: 279865 - DNA, 20 bp, human
gccagctgcgcggccggcag

SEQ ID NO: 279866 - DNA, 20 bp, human
gctgccgggaagagagaccc

SEQ ID NO: 279867 - DNA, 20 bp, human
ggcagcccccggcggttccc

SEQ ID NO: 279868 - DNA, 20 bp, human
gcggccccttcggcagtcgg

SEQ ID NO: 279869 - DNA, 20 bp, human
gaaaccgccgactgccgaag

SEQ ID NO: 279870 - DNA, 20 bp, human
gcagcgcgcagcaagagtgg

SEQ ID NO: 279871 - DNA, 20 bp, human
gcgtggatcgcagcccccgg

SEQ ID NO: 279872 - DNA, 20 bp, human
gtcggcagtcggcggtttct

SEQ ID NO: 279873 - DNA, 20 bp, human
gggccagcgcgcagcaagag

SEQ ID NO: 279874 - DNA, 20 bp, human
gagagagacccgggaaccgc

SEQ ID NO: 279875 - DNA, 20 bp, human
gtttggggctggctgattaa

SEQ ID NO: 279876 - DNA, 20 bp, human
ggacactggcccctcccctt

SEQ ID NO: 279877 - DNA, 20 bp, human
ggcccccgaagcccccttct

SEQ ID NO: 279878 - DNA, 20 bp, human
gtcccaccaggacgagggga

SEQ ID NO: 279879 - DNA, 20 bp, human
ggggcggggtgacccccccg

SEQ ID NO: 279880 - DNA, 20 bp, human
gtcgcgggctggggaaccgt

SEQ ID NO: 279881 - DNA, 20 bp, human
gggccagggtgcgggaacca

SEQ ID NO: 279882 - DNA, 20 bp, human
gcgggagctcgacacgaggg

SEQ ID NO: 279883 - DNA, 20 bp, human
gggctcaggtttcacctcag

SEQ ID NO: 279884 - DNA, 20 bp, human
gatcccgggcccggggacac

SEQ ID NO: 279885 - DNA, 20 bp, human
gcccttgggccggcatccga

SEQ ID NO: 279886 - DNA, 20 bp, human
gttagaaatgagaaggtcca

SEQ ID NO: 279887 - DNA, 20 bp, human
gtgtctcttacattgctgtg

SEQ ID NO: 279888 - DNA, 20 bp, human
gaactttgcatcagttaagt

SEQ ID NO: 279889 - DNA, 20 bp, human
gtgcatcagttaagtgggca

SEQ ID NO: 279890 - DNA, 20 bp, human
gcactttcatttggaccact

SEQ ID NO: 279891 - DNA, 20 bp, human
gatgatggccgcaggaaggt

SEQ ID NO: 279892 - DNA, 20 bp, human
gtatcttggggctatgaaag

SEQ ID NO: 279893 - DNA, 20 bp, human
gtgaggccagggcacgtgcc

SEQ ID NO: 279894 - DNA, 20 bp, human
ggcatggtaaggtggtagac

SEQ ID NO: 279895 - DNA, 20 bp, human
gcagttaagtgggcatggta

SEQ ID NO: 279896 - DNA, 20 bp, human
gaactttgcataagttaaat

SEQ ID NO: 279897 - DNA, 20 bp, human
gtcagacagaaacagctcac

SEQ ID NO: 279898 - DNA, 20 bp, human
gtgcataagttaaatgggca

SEQ ID NO: 279899 - DNA, 20 bp, human
gaagttaaatgggcatggta

SEQ ID NO: 279900 - DNA, 20 bp, human
gtatcttggggctgtgaaag

SEQ ID NO: 279901 - DNA, 20 bp, human
gttaaatgggcatggtaagg

SEQ ID NO: 279902 - DNA, 20 bp, human
ggcatggtaaggtggtagac

SEQ ID NO: 279903 - DNA, 20 bp, human
gtttcactgcaaggaacagg

SEQ ID NO: 279904 - DNA, 20 bp, human
gtgaggccagggcacgtgcc

SEQ ID NO: 279905 - DNA, 20 bp, human
gtagacaggagccacccaac

SEQ ID NO: 279906 - DNA, 20 bp, human
ggcctggcccagcactgtcg

SEQ ID NO: 279907 - DNA, 20 bp, human
gggttcttgcgcaggaaagt

SEQ ID NO: 279908 - DNA, 20 bp, human
gcaaagaagagttcagaagt

SEQ ID NO: 279909 - DNA, 20 bp, human
gcggggatggtgaccaaata

SEQ ID NO: 279910 - DNA, 20 bp, human
gaggccgcccagctatccag

SEQ ID NO: 279911 - DNA, 20 bp, human
gaaaagcgtggttcttgcgc

SEQ ID NO: 279912 - DNA, 20 bp, human
gcggccgctggatagctggg

SEQ ID NO: 279913 - DNA, 20 bp, human
gctaccggatacagaggttg

SEQ ID NO: 279914 - DNA, 20 bp, human
gggcccagcactgtcgggga

SEQ ID NO: 279915 - DNA, 20 bp, human
gccaggccatcatgtcacat

SEQ ID NO: 279916 - DNA, 20 bp, human
gatcagctgatgatggccac

SEQ ID NO: 279917 - DNA, 20 bp, human
gataggaagtcactttcatc

SEQ ID NO: 279918 - DNA, 20 bp, human
gaactgcaagtgtcagtgtc

SEQ ID NO: 279919 - DNA, 20 bp, human
gaactttgcatcagttaagt

SEQ ID NO: 279920 - DNA, 20 bp, human
gtgcatcagttaagtgggca

SEQ ID NO: 279921 - DNA, 20 bp, human
gcactttcatctggaccacc

SEQ ID NO: 279922 - DNA, 20 bp, human
gtatcttggggctatgaaag

SEQ ID NO: 279923 - DNA, 20 bp, human
gatgatggccacaggaaggt

SEQ ID NO: 279924 - DNA, 20 bp, human
gcctgcctatcagctgatga

SEQ ID NO: 279925 - DNA, 20 bp, human
ggctgatgatggccacagga

SEQ ID NO: 279926 - DNA, 20 bp, human
gcggccgtgagacctccagg

SEQ ID NO: 279927 - DNA, 20 bp, human
ggagctggaggcctcaaagt

SEQ ID NO: 279928 - DNA, 20 bp, human
gaggtctcacggccgaggcg

SEQ ID NO: 279929 - DNA, 20 bp, human
gcgcgaggagcgagatgttc

SEQ ID NO: 279930 - DNA, 20 bp, human
gccgtgagacctccaggggg

SEQ ID NO: 279931 - DNA, 20 bp, human
ggggcgtgggccaatggcgc

SEQ ID NO: 279932 - DNA, 20 bp, human
gccaacccgttccaccaatg

SEQ ID NO: 279933 - DNA, 20 bp, human
gaaggagcgtggaggacgtg

SEQ ID NO: 279934 - DNA, 20 bp, human
gcctcccaccgaggctgcgc

SEQ ID NO: 279935 - DNA, 20 bp, human
gagcttgccgctgcgcttta

SEQ ID NO: 279936 - DNA, 20 bp, human
ggaggcctgcaaacttaatg

SEQ ID NO: 279937 - DNA, 20 bp, human
gtcagtctacatgtaatcta

SEQ ID NO: 279938 - DNA, 20 bp, human
ggggctaaaaggctgaactt

SEQ ID NO: 279939 - DNA, 20 bp, human
ggtctacatgtaatctaagg

SEQ ID NO: 279940 - DNA, 20 bp, human
ggagtctggtcaaaaggaca

SEQ ID NO: 279941 - DNA, 20 bp, human
gtgccaatattgtatcactt

SEQ ID NO: 279942 - DNA, 20 bp, human
ggtcatgccctgcctatccc

SEQ ID NO: 279943 - DNA, 20 bp, human
gggtaagcacttcctgggat

SEQ ID NO: 279944 - DNA, 20 bp, human
gctcccctcattaagtttgc

SEQ ID NO: 279945 - DNA, 20 bp, human
gttgacagctctggattgtt

SEQ ID NO: 279946 - DNA, 20 bp, human
gccccagcagcctgcggtca

SEQ ID NO: 279947 - DNA, 20 bp, human
gggcgggtgacgcaatgcgg

SEQ ID NO: 279948 - DNA, 20 bp, human
gcgctccgccgcccgacgtg

SEQ ID NO: 279949 - DNA, 20 bp, human
gtgagccacacgtcgggcgg

SEQ ID NO: 279950 - DNA, 20 bp, human
ggctgcggcacgccacaggg

SEQ ID NO: 279951 - DNA, 20 bp, human
gtcgggcggcggagcggttc

SEQ ID NO: 279952 - DNA, 20 bp, human
gcgcaggccttggctcgcgg

SEQ ID NO: 279953 - DNA, 20 bp, human
gtgcggccagaagcccggaa

SEQ ID NO: 279954 - DNA, 20 bp, human
gacgtcgctgtctcctgcgc

SEQ ID NO: 279955 - DNA, 20 bp, human
ggcctgcagcgaccaatcgg

SEQ ID NO: 279956 - DNA, 20 bp, human
gggggcgctggaattctaca

SEQ ID NO: 279957 - DNA, 20 bp, human
gccctcagcagtcctagcaa

SEQ ID NO: 279958 - DNA, 20 bp, human
gaattctacagggtaggaga

SEQ ID NO: 279959 - DNA, 20 bp, human
gttgccatcagagtacacca

SEQ ID NO: 279960 - DNA, 20 bp, human
gggactgctgaggggggcgc

SEQ ID NO: 279961 - DNA, 20 bp, human
ggtggcaggtgtgggaacat

SEQ ID NO: 279962 - DNA, 20 bp, human
gtcctttgctaggactgctg

SEQ ID NO: 279963 - DNA, 20 bp, human
gtccaccattctcacttatt

SEQ ID NO: 279964 - DNA, 20 bp, human
gcttccctggtgtactctga

SEQ ID NO: 279965 - DNA, 20 bp, human
gactcaccacaaagtgggga

SEQ ID NO: 279966 - DNA, 20 bp, human
ggcacccagaggacgtcatc

SEQ ID NO: 279967 - DNA, 20 bp, human
gagaggacgtcatcaggcag

SEQ ID NO: 279968 - DNA, 20 bp, human
gtcagctgtgggtgatgatg

SEQ ID NO: 279969 - DNA, 20 bp, human
gactctgagtcatcagctgt

SEQ ID NO: 279970 - DNA, 20 bp, human
gctgctctgggctgaatagg

SEQ ID NO: 279971 - DNA, 20 bp, human
ggtcatcaggcagaggcagt

SEQ ID NO: 279972 - DNA, 20 bp, human
gggtgctccagtacctctac

SEQ ID NO: 279973 - DNA, 20 bp, human
gttcctgctctgggctgaat

SEQ ID NO: 279974 - DNA, 20 bp, human
gcattggcggttctatcact

SEQ ID NO: 279975 - DNA, 20 bp, human
gttctcacacaagcacccag

SEQ ID NO: 279976 - DNA, 20 bp, human
gggtggagctgttgaagctg

SEQ ID NO: 279977 - DNA, 20 bp, human
gctaaccatcaattcttcaa

SEQ ID NO: 279978 - DNA, 20 bp, human
ggcaagaataaagaacaagg

SEQ ID NO: 279979 - DNA, 20 bp, human
ggcctgttggtgtgagacgg

SEQ ID NO: 279980 - DNA, 20 bp, human
gagaaggggacaagtctagg

SEQ ID NO: 279981 - DNA, 20 bp, human
gggtggggaaatctgcctgt

SEQ ID NO: 279982 - DNA, 20 bp, human
gcttgcccttgaagaattga

SEQ ID NO: 279983 - DNA, 20 bp, human
ggacacccatcaaaaccaga

SEQ ID NO: 279984 - DNA, 20 bp, human
gttagagcacaagatggtaa

SEQ ID NO: 279985 - DNA, 20 bp, human
ggcctccgtctcacaccaac

SEQ ID NO: 279986 - DNA, 20 bp, human
gtatcagtttggggactttc

SEQ ID NO: 279987 - DNA, 20 bp, human
gtctcaccacaggtgctcta

SEQ ID NO: 279988 - DNA, 20 bp, human
gctgatacaggtattagaga

SEQ ID NO: 279989 - DNA, 20 bp, human
gatacataacgtttacacct

SEQ ID NO: 279990 - DNA, 20 bp, human
gagcataagtactctgatac

SEQ ID NO: 279991 - DNA, 20 bp, human
gattgcttttagcacttttt

SEQ ID NO: 279992 - DNA, 20 bp, human
ggccataaagaactcatatc

SEQ ID NO: 279993 - DNA, 20 bp, human
gaacgttatgtatcagtttg

SEQ ID NO: 279994 - DNA, 20 bp, human
gaagattttttttcacacct

SEQ ID NO: 279995 - DNA, 20 bp, human
gcaatacttactatttttcc

SEQ ID NO: 279996 - DNA, 20 bp, human
gtaaaatgctcaaggatgga

SEQ ID NO: 279997 - DNA, 20 bp, human
gcccacaggaagcgcgtgtg

SEQ ID NO: 279998 - DNA, 20 bp, human
gacaggaagcgcgtgtgggg

SEQ ID NO: 279999 - DNA, 20 bp, human
gaggtgtgatgatggtagtg

SEQ ID NO: 280000 - DNA, 20 bp, human
ggtggagggtgtgcagcggt

SEQ ID NO: 280001 - DNA, 20 bp, human
gtggtctctagggacctccc

SEQ ID NO: 280002 - DNA, 20 bp, human
gcacacaggacctgttgcgt

SEQ ID NO: 280003 - DNA, 20 bp, human
gtgtggggaggctcggggcc

SEQ ID NO: 280004 - DNA, 20 bp, human
gtccctagagaccaattcag

SEQ ID NO: 280005 - DNA, 20 bp, human
ggcgcgtgtggggaggctcg

SEQ ID NO: 280006 - DNA, 20 bp, human
gaaaggtcggatttgctcgg

SEQ ID NO: 280007 - DNA, 20 bp, human
ggggaaaggtcggatttgct

SEQ ID NO: 280008 - DNA, 20 bp, human
ggggctagggagcctcggtg

SEQ ID NO: 280009 - DNA, 20 bp, human
ggcgcagcgccattccgggc

SEQ ID NO: 280010 - DNA, 20 bp, human
ggagcccccggtagcctcag

SEQ ID NO: 280011 - DNA, 20 bp, human
gagcaggaaggcccgggccg

SEQ ID NO: 280012 - DNA, 20 bp, human
ggggtccggtcacctctcgg

SEQ ID NO: 280013 - DNA, 20 bp, human
gtctcccctgaggctaccgg

SEQ ID NO: 280014 - DNA, 20 bp, human
gcgcggagctgggaaaaggg

SEQ ID NO: 280015 - DNA, 20 bp, human
ggcccgccacgcaccccaaa

SEQ ID NO: 280016 - DNA, 20 bp, human
gaggcgctgaagacttggat

SEQ ID NO: 280017 - DNA, 20 bp, human
gtggacaggcgctgaagact

SEQ ID NO: 280018 - DNA, 20 bp, human
gctataggtaggtgactgtt

SEQ ID NO: 280019 - DNA, 20 bp, human
ggggctggcatatctcaccc

SEQ ID NO: 280020 - DNA, 20 bp, human
gaatagccgactaaagaaag

SEQ ID NO: 280021 - DNA, 20 bp, human
gggcatatctcacccgggga

SEQ ID NO: 280022 - DNA, 20 bp, human
gatatgccagccccataatt

SEQ ID NO: 280023 - DNA, 20 bp, human
ggaaggaagtggcatttgat

SEQ ID NO: 280024 - DNA, 20 bp, human
gtctacctcagctatggaac

SEQ ID NO: 280025 - DNA, 20 bp, human
gaaaaccctggagactctat

SEQ ID NO: 280026 - DNA, 20 bp, human
ggtccctgaggtattcctgg

SEQ ID NO: 280027 - DNA, 20 bp, human
ggacccagcaatgacaagtc

SEQ ID NO: 280028 - DNA, 20 bp, human
gagccaccaggaatacctca

SEQ ID NO: 280029 - DNA, 20 bp, human
gacaagtcaggccgtgggtc

SEQ ID NO: 280030 - DNA, 20 bp, human
gtaccccaagccggtccctg

SEQ ID NO: 280031 - DNA, 20 bp, human
gcaatgacaagtcaggccgt

SEQ ID NO: 280032 - DNA, 20 bp, human
ggccgtgggtctggtccctg

SEQ ID NO: 280033 - DNA, 20 bp, human
ggatgacagtcctgatgttg

SEQ ID NO: 280034 - DNA, 20 bp, human
gggaagttaggcaagatgca

SEQ ID NO: 280035 - DNA, 20 bp, human
gacctcagggaccagaccca

SEQ ID NO: 280036 - DNA, 20 bp, human
gcagcggggcgccccggaca

SEQ ID NO: 280037 - DNA, 20 bp, human
gggagctcaggccctgtccg

SEQ ID NO: 280038 - DNA, 20 bp, human
gctgcgggagcgcgagagga

SEQ ID NO: 280039 - DNA, 20 bp, human
gttggcgctggccccggacc

SEQ ID NO: 280040 - DNA, 20 bp, human
gggcgacttgcgtcctggaa

SEQ ID NO: 280041 - DNA, 20 bp, human
gggtccgagaagccagcggc

SEQ ID NO: 280042 - DNA, 20 bp, human
gtgcgctaggacatcctcgg

SEQ ID NO: 280043 - DNA, 20 bp, human
gacaacaacagcctggtccg

SEQ ID NO: 280044 - DNA, 20 bp, human
gaagaagcacaagttggcgc

SEQ ID NO: 280045 - DNA, 20 bp, human
gagaggtgcaccctaggctg

SEQ ID NO: 280046 - DNA, 20 bp, human
gagggtgtgggggctggtag

SEQ ID NO: 280047 - DNA, 20 bp, human
ggtagtggtggtgtggaagg

SEQ ID NO: 280048 - DNA, 20 bp, human
ggcggcaagtgactgcttat

SEQ ID NO: 280049 - DNA, 20 bp, human
gtgtgggagggtgtgggggc

SEQ ID NO: 280050 - DNA, 20 bp, human
gtggtgtggaaggaggcgtg

SEQ ID NO: 280051 - DNA, 20 bp, human
ggtgtgggggctggtagtgg

SEQ ID NO: 280052 - DNA, 20 bp, human
ggacgtgtgtcccttgtgag

SEQ ID NO: 280053 - DNA, 20 bp, human
gtggtgacggcccctcacaa

SEQ ID NO: 280054 - DNA, 20 bp, human
gcccagcccctcattggcta

SEQ ID NO: 280055 - DNA, 20 bp, human
gtgtgcgtgcccattggtct

SEQ ID NO: 280056 - DNA, 20 bp, human
gagggtgtgggggctggtag

SEQ ID NO: 280057 - DNA, 20 bp, human
ggtagtggtggtgtggaagg

SEQ ID NO: 280058 - DNA, 20 bp, human
ggcggcaagtgactgcttat

SEQ ID NO: 280059 - DNA, 20 bp, human
gtgtgggagggtgtgggggc

SEQ ID NO: 280060 - DNA, 20 bp, human
gtggtgtggaaggaggcgtg

SEQ ID NO: 280061 - DNA, 20 bp, human
ggtgtgggggctggtagtgg

SEQ ID NO: 280062 - DNA, 20 bp, human
ggacgtgtgtcccttgtgag

SEQ ID NO: 280063 - DNA, 20 bp, human
gtggtgacggcccctcacaa

SEQ ID NO: 280064 - DNA, 20 bp, human
gcccagcccctcattggcta

SEQ ID NO: 280065 - DNA, 20 bp, human
gtgtgcgtgcccattggtct

SEQ ID NO: 280066 - DNA, 20 bp, human
gagggtgtgggggctggtag

SEQ ID NO: 280067 - DNA, 20 bp, human
ggtagtggtggtgtggaagg

SEQ ID NO: 280068 - DNA, 20 bp, human
ggcggcaagtgactgcttat

SEQ ID NO: 280069 - DNA, 20 bp, human
gtgtgggagggtgtgggggc

SEQ ID NO: 280070 - DNA, 20 bp, human
gtggtgtggaaggaggcgtg

SEQ ID NO: 280071 - DNA, 20 bp, human
ggtgtgggggctggtagtgg

SEQ ID NO: 280072 - DNA, 20 bp, human
ggacgtgtgtcccttgtgag

SEQ ID NO: 280073 - DNA, 20 bp, human
gtggtgacggcccctcacaa

SEQ ID NO: 280074 - DNA, 20 bp, human
gcccagcccctcattggcta

SEQ ID NO: 280075 - DNA, 20 bp, human
gtgtgcgtgcccattggtct

SEQ ID NO: 280076 - DNA, 20 bp, human
ggggacccagatgaatttag

SEQ ID NO: 280077 - DNA, 20 bp, human
gggaccctgcggggagacca

SEQ ID NO: 280078 - DNA, 20 bp, human
gccgctcccaactagcgctc

SEQ ID NO: 280079 - DNA, 20 bp, human
ggtaaccgctaaattcatct

SEQ ID NO: 280080 - DNA, 20 bp, human
gggctctggtgaccaatgac

SEQ ID NO: 280081 - DNA, 20 bp, human
ggtgagcggctatgtaaatg

SEQ ID NO: 280082 - DNA, 20 bp, human
gtccaagcacataaactcgt

SEQ ID NO: 280083 - DNA, 20 bp, human
ggtctccccgcagggtcctg

SEQ ID NO: 280084 - DNA, 20 bp, human
gcgcggcagcccctttccat

SEQ ID NO: 280085 - DNA, 20 bp, human
ggtcaccagagccaatggaa

SEQ ID NO: 280086 - DNA, 20 bp, human
gagagagcgcgtcactattg

SEQ ID NO: 280087 - DNA, 20 bp, human
ggcgaggcgtccaatctcat

SEQ ID NO: 280088 - DNA, 20 bp, human
gagcgcgtcactattggggc

SEQ ID NO: 280089 - DNA, 20 bp, human
ggggaggcgggccactggga

SEQ ID NO: 280090 - DNA, 20 bp, human
gggcccgcctcccttgctcg

SEQ ID NO: 280091 - DNA, 20 bp, human
gaaaggcaaaccaatgagat

SEQ ID NO: 280092 - DNA, 20 bp, human
gagcaagggaggcgggccac

SEQ ID NO: 280093 - DNA, 20 bp, human
gggcttgggcgcctggtgaa

SEQ ID NO: 280094 - DNA, 20 bp, human
gggggcggggtctggctaga

SEQ ID NO: 280095 - DNA, 20 bp, human
gtgcacacggcacgcggagg

SEQ ID NO: 280096 - DNA, 20 bp, human
gagggagcgcgcccgctgat

SEQ ID NO: 280097 - DNA, 20 bp, human
ggcgcagaggtgtgtcctgg

SEQ ID NO: 280098 - DNA, 20 bp, human
gagaaaagagccaatcagga

SEQ ID NO: 280099 - DNA, 20 bp, human
ggccgagccgcgacacccaa

SEQ ID NO: 280100 - DNA, 20 bp, human
gggctacatcagcggatagt

SEQ ID NO: 280101 - DNA, 20 bp, human
gcaaggattggctacatcag

SEQ ID NO: 280102 - DNA, 20 bp, human
gggtgtcgcggctcggctga

SEQ ID NO: 280103 - DNA, 20 bp, human
gaccaaccggaggcgggtat

SEQ ID NO: 280104 - DNA, 20 bp, human
gagggcgcagaggtgtgtcc

SEQ ID NO: 280105 - DNA, 20 bp, human
gacccgcctccggttggttg

SEQ ID NO: 280106 - DNA, 20 bp, human
gcggccggcgtcaacgggta

SEQ ID NO: 280107 - DNA, 20 bp, human
gtgggcgtccccggggtcat

SEQ ID NO: 280108 - DNA, 20 bp, human
ggggtcagacctcgcgtccg

SEQ ID NO: 280109 - DNA, 20 bp, human
gcagagcggccggcgtcaac

SEQ ID NO: 280110 - DNA, 20 bp, human
gcggacgctcggggccgcga

SEQ ID NO: 280111 - DNA, 20 bp, human
gctggcccttcccaaggact

SEQ ID NO: 280112 - DNA, 20 bp, human
gcgcccagagcccagtcctt

SEQ ID NO: 280113 - DNA, 20 bp, human
gagacctcgcgtccggggtg

SEQ ID NO: 280114 - DNA, 20 bp, human
gagagcccagtccttgggaa

SEQ ID NO: 280115 - DNA, 20 bp, human
ggcggcgcgctgtgcattgt

SEQ ID NO: 280116 - DNA, 20 bp, human
gcggacccgtcgcggagcct

SEQ ID NO: 280117 - DNA, 20 bp, human
ggccagcccaggctccgcga

SEQ ID NO: 280118 - DNA, 20 bp, human
gtctccacataaccacctct

SEQ ID NO: 280119 - DNA, 20 bp, human
ggaaagccccggacccgtcg

SEQ ID NO: 280120 - DNA, 20 bp, human
gagatcggccaagtacgcgg

SEQ ID NO: 280121 - DNA, 20 bp, human
ggggccgcggatagtagcgg

SEQ ID NO: 280122 - DNA, 20 bp, human
gcctcctagaggtggttatg

SEQ ID NO: 280123 - DNA, 20 bp, human
gactgggcacaaacgcgcta

SEQ ID NO: 280124 - DNA, 20 bp, human
gagggccactcgctaacatg

SEQ ID NO: 280125 - DNA, 20 bp, human
ggatctgcgagacgagccga

SEQ ID NO: 280126 - DNA, 20 bp, human
gaatgagcaagcgaagaaaa

SEQ ID NO: 280127 - DNA, 20 bp, human
gcaagccgcgattggggcgt

SEQ ID NO: 280128 - DNA, 20 bp, human
gtccccccacgccccaatcg

SEQ ID NO: 280129 - DNA, 20 bp, human
gcaaggacgcgtcccgaggg

SEQ ID NO: 280130 - DNA, 20 bp, human
gaagcgaagaaaagggtgga

SEQ ID NO: 280131 - DNA, 20 bp, human
gaggcggagggatgggaacg

SEQ ID NO: 280132 - DNA, 20 bp, human
gtctcaaggacgcgtcccga

SEQ ID NO: 280133 - DNA, 20 bp, human
ggagcaagcgaagaaaaggg

SEQ ID NO: 280134 - DNA, 20 bp, human
gggtctctagagccctgcta

SEQ ID NO: 280135 - DNA, 20 bp, human
gcggctgcgatcacgtgcct

SEQ ID NO: 280136 - DNA, 20 bp, human
ggcaacccggccacttaggc

SEQ ID NO: 280137 - DNA, 20 bp, human
ggtaggcaacccggccactt

SEQ ID NO: 280138 - DNA, 20 bp, human
gtctgcccgcctaagtggcc

SEQ ID NO: 280139 - DNA, 20 bp, human
gtccctccattgaaggtgat

SEQ ID NO: 280140 - DNA, 20 bp, human
gggttgcctacctcagacaa

SEQ ID NO: 280141 - DNA, 20 bp, human
ggggcgtctgcccgcctaag

SEQ ID NO: 280142 - DNA, 20 bp, human
gtccgatcaccttcaatgga

SEQ ID NO: 280143 - DNA, 20 bp, human
ggcaatcttccctccattga

SEQ ID NO: 280144 - DNA, 20 bp, human
gatcatccgatcaccttcaa

SEQ ID NO: 280145 - DNA, 20 bp, human
gattggatgaagtgtcacca

SEQ ID NO: 280146 - DNA, 20 bp, human
gtctccgagctgggccacaa

SEQ ID NO: 280147 - DNA, 20 bp, human
gtgggccacaaggggcgctt

SEQ ID NO: 280148 - DNA, 20 bp, human
gcgggcctaagcgccccttg

SEQ ID NO: 280149 - DNA, 20 bp, human
gggcatggatcagctgagaa

SEQ ID NO: 280150 - DNA, 20 bp, human
gaatcacagtgggcgtctgc

SEQ ID NO: 280151 - DNA, 20 bp, human
ggatgcgcttttgccccgtg

SEQ ID NO: 280152 - DNA, 20 bp, human
gtgcgttgaaggtgactgga

SEQ ID NO: 280153 - DNA, 20 bp, human
gtgacgagatgccacgcaac

SEQ ID NO: 280154 - DNA, 20 bp, human
gatggatcagctgagaaggg

SEQ ID NO: 280155 - DNA, 20 bp, human
gtgggcatcaaaggacctag

SEQ ID NO: 280156 - DNA, 20 bp, human
gtttgtacacacacggcgcg

SEQ ID NO: 280157 - DNA, 20 bp, human
gacgccgtgcgcacacggag

SEQ ID NO: 280158 - DNA, 20 bp, human
gccagcgaacgggcgcgcgg

SEQ ID NO: 280159 - DNA, 20 bp, human
gtgcgaacacaattgaaaga

SEQ ID NO: 280160 - DNA, 20 bp, human
ggccgcccgggtctcctcgg

SEQ ID NO: 280161 - DNA, 20 bp, human
gggggcgcgagaggagctat

SEQ ID NO: 280162 - DNA, 20 bp, human
ggcgagaggagctatggggg

SEQ ID NO: 280163 - DNA, 20 bp, human
gtgcgcacacggagcgggat

SEQ ID NO: 280164 - DNA, 20 bp, human
ggggcggggcggcgtgtgtt

SEQ ID NO: 280165 - DNA, 20 bp, human
ggtacacacacggcgcgagg

SEQ ID NO: 280166 - DNA, 20 bp, human
gcgacacaaaggccgtgctt

SEQ ID NO: 280167 - DNA, 20 bp, human
gctgacatcccccgacacaa

SEQ ID NO: 280168 - DNA, 20 bp, human
gcgtagatatgcaccaatca

SEQ ID NO: 280169 - DNA, 20 bp, human
gcaccaatagaaaaagtcgt

SEQ ID NO: 280170 - DNA, 20 bp, human
gtgaagcgtgcctataaaaa

SEQ ID NO: 280171 - DNA, 20 bp, human
gagcaggagtctaaactcac

SEQ ID NO: 280172 - DNA, 20 bp, human
gttcggcactgttccatgat

SEQ ID NO: 280173 - DNA, 20 bp, human
gtcgggggatgtcagcgcgt

SEQ ID NO: 280174 - DNA, 20 bp, human
gaagtggcctaatgattgga

SEQ ID NO: 280175 - DNA, 20 bp, human
gcgctgattggctgttaaag

SEQ ID NO: 280176 - DNA, 20 bp, human
gaaaaacgaaacaccgaaat

SEQ ID NO: 280177 - DNA, 20 bp, human
gaggagggcgcagagcggtt

SEQ ID NO: 280178 - DNA, 20 bp, human
gggttcttcgctcgcgactg

SEQ ID NO: 280179 - DNA, 20 bp, human
gaatgctttgtgacggaggt

SEQ ID NO: 280180 - DNA, 20 bp, human
ggaagaatgctttgtgacgg

SEQ ID NO: 280181 - DNA, 20 bp, human
ggcgagcgaagaaccgacac

SEQ ID NO: 280182 - DNA, 20 bp, human
gaaaaggatgaaaacgaagg

SEQ ID NO: 280183 - DNA, 20 bp, human
ggctgaagaatgctttgtga

SEQ ID NO: 280184 - DNA, 20 bp, human
gcattcttcaaagcccattt

SEQ ID NO: 280185 - DNA, 20 bp, human
gtcgttcgttggaccagtgt

SEQ ID NO: 280186 - DNA, 20 bp, human
gaggccacgccctccgctgg

SEQ ID NO: 280187 - DNA, 20 bp, human
ggggacccagaagtggccga

SEQ ID NO: 280188 - DNA, 20 bp, human
gctaggacgcacggccacca

SEQ ID NO: 280189 - DNA, 20 bp, human
gcgcgcgcgggacccagaag

SEQ ID NO: 280190 - DNA, 20 bp, human
gcccggcggccgccagcgga

SEQ ID NO: 280191 - DNA, 20 bp, human
gcggggcctcggagcttccg

SEQ ID NO: 280192 - DNA, 20 bp, human
gcccgcgcgcgtctcggacg

SEQ ID NO: 280193 - DNA, 20 bp, human
gaccagggggccgaagggaa

SEQ ID NO: 280194 - DNA, 20 bp, human
ggagggacgtggttgtgtcg

SEQ ID NO: 280195 - DNA, 20 bp, human
gaggacagctctaggacgca

SEQ ID NO: 280196 - DNA, 20 bp, human
gatgcccagcagacaagggg

SEQ ID NO: 280197 - DNA, 20 bp, human
gagagaggagcgggaggtaa

SEQ ID NO: 280198 - DNA, 20 bp, human
gcctctatgcccagcagaca

SEQ ID NO: 280199 - DNA, 20 bp, human
ggggacaaaagcttccagat

SEQ ID NO: 280200 - DNA, 20 bp, human
gtaaaaaattccaaactcat

SEQ ID NO: 280201 - DNA, 20 bp, human
gggtgcctaaagatgggatg

SEQ ID NO: 280202 - DNA, 20 bp, human
gcttctgtgcgccaggcagg

SEQ ID NO: 280203 - DNA, 20 bp, human
gtctcccaccccttgtctgc

SEQ ID NO: 280204 - DNA, 20 bp, human
gttgatgggttcagcataaa

SEQ ID NO: 280205 - DNA, 20 bp, human
gggcagtgaatgcagatcag

SEQ ID NO: 280206 - DNA, 20 bp, human
gtagagggaaggaacgtctg

SEQ ID NO: 280207 - DNA, 20 bp, human
gccccaccacggggtcgcgg

SEQ ID NO: 280208 - DNA, 20 bp, human
gggggacaagcgtccaggaa

SEQ ID NO: 280209 - DNA, 20 bp, human
gcggtccccgccaccgtctc

SEQ ID NO: 280210 - DNA, 20 bp, human
gcaggccctggcgagcgcgg

SEQ ID NO: 280211 - DNA, 20 bp, human
gacgccccgaggggaatccc

SEQ ID NO: 280212 - DNA, 20 bp, human
gaacccccgcgaccccgtgg

SEQ ID NO: 280213 - DNA, 20 bp, human
gtgccccgcggagaagcaga

SEQ ID NO: 280214 - DNA, 20 bp, human
gcaagcgtccaggaagggtc

SEQ ID NO: 280215 - DNA, 20 bp, human
gccctcggggcgtagaggga

SEQ ID NO: 280216 - DNA, 20 bp, human
ggctgggctgagtcatgaag

SEQ ID NO: 280217 - DNA, 20 bp, human
gcatgtgcaccgtggagcca

SEQ ID NO: 280218 - DNA, 20 bp, human
gctatgtcagctactttctt

SEQ ID NO: 280219 - DNA, 20 bp, human
gtggcagaggcctgtggcac

SEQ ID NO: 280220 - DNA, 20 bp, human
ggctgctgggtgttccgagc

SEQ ID NO: 280221 - DNA, 20 bp, human
gcacctgatcttttatcctg

SEQ ID NO: 280222 - DNA, 20 bp, human
gggatgctagtcacgctgtc

SEQ ID NO: 280223 - DNA, 20 bp, human
gtgaagtggtttctcttctg

SEQ ID NO: 280224 - DNA, 20 bp, human
gagtagctgacatagccccc

SEQ ID NO: 280225 - DNA, 20 bp, human
gggtgcacatgacagctgct

SEQ ID NO: 280226 - DNA, 20 bp, human
gtggagacccaatcaccgac

SEQ ID NO: 280227 - DNA, 20 bp, human
gcaggcgcgccgtgtcggaa

SEQ ID NO: 280228 - DNA, 20 bp, human
gggcccaggggcggagctac

SEQ ID NO: 280229 - DNA, 20 bp, human
gcgacgaagcggtggggtct

SEQ ID NO: 280230 - DNA, 20 bp, human
gcgcacccgcgcgcgctgac

SEQ ID NO: 280231 - DNA, 20 bp, human
gcaggggcggagctactggc

SEQ ID NO: 280232 - DNA, 20 bp, human
ggcgcgccgtgtcggaaagg

SEQ ID NO: 280233 - DNA, 20 bp, human
gacagccagtcagcgcgcgc

SEQ ID NO: 280234 - DNA, 20 bp, human
gacagcagccggtcggtgat

SEQ ID NO: 280235 - DNA, 20 bp, human
ggtaggggccggacagggta

SEQ ID NO: 280236 - DNA, 20 bp, human
gtggcagaacggagcgccct

SEQ ID NO: 280237 - DNA, 20 bp, human
gctgggcggagtcacgttgg

SEQ ID NO: 280238 - DNA, 20 bp, human
gctagagcactgagctgcga

SEQ ID NO: 280239 - DNA, 20 bp, human
ggggcgcagggctgagtatg

SEQ ID NO: 280240 - DNA, 20 bp, human
gagtacgcccagtcgctgcg

SEQ ID NO: 280241 - DNA, 20 bp, human
gcgggcccaggcgagatgta

SEQ ID NO: 280242 - DNA, 20 bp, human
ggggaagccacgcagcgact

SEQ ID NO: 280243 - DNA, 20 bp, human
gaatgcctttccagaagctt

SEQ ID NO: 280244 - DNA, 20 bp, human
ggcggcgggtgtactgtagg

SEQ ID NO: 280245 - DNA, 20 bp, human
ggggccacgtcctgcgtccg

SEQ ID NO: 280246 - DNA, 20 bp, human
gctaagagcaggtacggagg

SEQ ID NO: 280247 - DNA, 20 bp, human
gcgcgcgccagaatgccaga

SEQ ID NO: 280248 - DNA, 20 bp, human
gcagaactgcgctctcttct

SEQ ID NO: 280249 - DNA, 20 bp, human
gtggcattctggcgcgcgaa

SEQ ID NO: 280250 - DNA, 20 bp, human
gaagagagcgcagttctgat

SEQ ID NO: 280251 - DNA, 20 bp, human
ggcgccagaatgccagaggg

SEQ ID NO: 280252 - DNA, 20 bp, human
gttaaacaacgggaaggaag

SEQ ID NO: 280253 - DNA, 20 bp, human
gcattctggcgcgcgaatgg

SEQ ID NO: 280254 - DNA, 20 bp, human
gcggggctgtaaagggagaa

SEQ ID NO: 280255 - DNA, 20 bp, human
gcgcggagggggtgtggtaa

SEQ ID NO: 280256 - DNA, 20 bp, human
gtgagcgggtatacacgcgc

SEQ ID NO: 280257 - DNA, 20 bp, human
gccggagcccgagtgagcgc

SEQ ID NO: 280258 - DNA, 20 bp, human
gcggctggcgttctggtgtg

SEQ ID NO: 280259 - DNA, 20 bp, human
gtccccgtgacgccacaagg

SEQ ID NO: 280260 - DNA, 20 bp, human
gtaacgtcccagcgttgagc

SEQ ID NO: 280261 - DNA, 20 bp, human
gcgctgggacgttacagcca

SEQ ID NO: 280262 - DNA, 20 bp, human
gcgcggaaagccagactctg

SEQ ID NO: 280263 - DNA, 20 bp, human
gccgtgacgccacaaggcgg

SEQ ID NO: 280264 - DNA, 20 bp, human
gtgacgccacaaggcggggg

SEQ ID NO: 280265 - DNA, 20 bp, human
gtgtatacccgctcaacgct

SEQ ID NO: 280266 - DNA, 20 bp, human
ggggcccctcaccccgcggg

SEQ ID NO: 280267 - DNA, 20 bp, human
ggcctttgggaaagcccggg

SEQ ID NO: 280268 - DNA, 20 bp, human
gcggtcagggccgttcttga

SEQ ID NO: 280269 - DNA, 20 bp, human
ggccgaaaggtcgtattctc

SEQ ID NO: 280270 - DNA, 20 bp, human
gaaagggcccctcaccccgc

SEQ ID NO: 280271 - DNA, 20 bp, human
ggctctgcgggaccaagggg

SEQ ID NO: 280272 - DNA, 20 bp, human
ggctcggccgcacccgttag

SEQ ID NO: 280273 - DNA, 20 bp, human
ggaaaggtcgtattctccgg

SEQ ID NO: 280274 - DNA, 20 bp, human
gggcagggctaaggggccgg

SEQ ID NO: 280275 - DNA, 20 bp, human
gctgaccgcccgcggggtga

SEQ ID NO: 280276 - DNA, 20 bp, human
gcggtcagggccgttcttga

SEQ ID NO: 280277 - DNA, 20 bp, human
ggctcggccgcacccgttag

SEQ ID NO: 280278 - DNA, 20 bp, human
gagagcgcctctaacgggtg

SEQ ID NO: 280279 - DNA, 20 bp, human
ggccgaaaggtcgtattctc

SEQ ID NO: 280280 - DNA, 20 bp, human
ggaaaggtcgtattctccgg

SEQ ID NO: 280281 - DNA, 20 bp, human
gggcagggctaaggggccgg

SEQ ID NO: 280282 - DNA, 20 bp, human
gaaagggcccctcaccccgc

SEQ ID NO: 280283 - DNA, 20 bp, human
ggctctgcgggaccaagggg

SEQ ID NO: 280284 - DNA, 20 bp, human
gagtggagagcgcctctaac

SEQ ID NO: 280285 - DNA, 20 bp, human
gcccgcagagccttggtact

SEQ ID NO: 280286 - DNA, 20 bp, human
gtcccggcccgtggcagtcg

SEQ ID NO: 280287 - DNA, 20 bp, human
gcggcccgggtcatggtggt

SEQ ID NO: 280288 - DNA, 20 bp, human
gctggactgccgagctgccc

SEQ ID NO: 280289 - DNA, 20 bp, human
gcgcgagcgcgttgattggt

SEQ ID NO: 280290 - DNA, 20 bp, human
gtgagcgcgagcgcgttgat

SEQ ID NO: 280291 - DNA, 20 bp, human
gctctcccggcgcagctctc

SEQ ID NO: 280292 - DNA, 20 bp, human
ggtgcgaggtggacgctgat

SEQ ID NO: 280293 - DNA, 20 bp, human
ggactgcaaaacaccggcgt

SEQ ID NO: 280294 - DNA, 20 bp, human
gcgctcccaggcccgtctcc

SEQ ID NO: 280295 - DNA, 20 bp, human
gagtgcccctgtagtcacgt

SEQ ID NO: 280296 - DNA, 20 bp, human
gagaccacaaggcccgccgg

SEQ ID NO: 280297 - DNA, 20 bp, human
gcgtgcgcgtggcgccccac

SEQ ID NO: 280298 - DNA, 20 bp, human
gggcggtgcgcgtgcccggt

SEQ ID NO: 280299 - DNA, 20 bp, human
gtcagtccggaccccgtgac

SEQ ID NO: 280300 - DNA, 20 bp, human
gggcctcggccgccggtcac

SEQ ID NO: 280301 - DNA, 20 bp, human
gaacgcggctgtcccgggtc

SEQ ID NO: 280302 - DNA, 20 bp, human
gcgggcacgcgcaccgccgg

SEQ ID NO: 280303 - DNA, 20 bp, human
gccgaaggacagactgacgg

SEQ ID NO: 280304 - DNA, 20 bp, human
gcgggtcaggggtcttgcgg

SEQ ID NO: 280305 - DNA, 20 bp, human
gcacctctggcctgagaaga

SEQ ID NO: 280306 - DNA, 20 bp, human
gtggggaccctgaagaaagg

SEQ ID NO: 280307 - DNA, 20 bp, human
ggaacagcacctcccagggt

SEQ ID NO: 280308 - DNA, 20 bp, human
gagaacacagacagaaacga

SEQ ID NO: 280309 - DNA, 20 bp, human
gtatgcaggagtggctaccg

SEQ ID NO: 280310 - DNA, 20 bp, human
gcccaggcctttctggcagc

SEQ ID NO: 280311 - DNA, 20 bp, human
gctaccggggtgtggtcagc

SEQ ID NO: 280312 - DNA, 20 bp, human
gaactgtgacactgggagtg

SEQ ID NO: 280313 - DNA, 20 bp, human
gagagctggactctcatcca

SEQ ID NO: 280314 - DNA, 20 bp, human
gggagagctttatgcaggag

SEQ ID NO: 280315 - DNA, 20 bp, human
ggaatgagtaaaggtgaagg

SEQ ID NO: 280316 - DNA, 20 bp, human
gcccctgaacacacctctgc

SEQ ID NO: 280317 - DNA, 20 bp, human
gaacacacctctgccggctg

SEQ ID NO: 280318 - DNA, 20 bp, human
gaacagagcgacagggaaca

SEQ ID NO: 280319 - DNA, 20 bp, human
ggccggcagaggtgtgttca

SEQ ID NO: 280320 - DNA, 20 bp, human
gaaaggcgggagagataagc

SEQ ID NO: 280321 - DNA, 20 bp, human
ggggttgtgtcaccctcagc

SEQ ID NO: 280322 - DNA, 20 bp, human
gaagcgggaacagagcgaca

SEQ ID NO: 280323 - DNA, 20 bp, human
gagcagaatgacatcgtgat

SEQ ID NO: 280324 - DNA, 20 bp, human
gcccgtgtgcatgtaggcga

SEQ ID NO: 280325 - DNA, 20 bp, human
gggtggtggcgccgaaaagg

SEQ ID NO: 280326 - DNA, 20 bp, human
gagcagggagctgagtggga

SEQ ID NO: 280327 - DNA, 20 bp, human
ggggtggcagcaacagtcca

SEQ ID NO: 280328 - DNA, 20 bp, human
gccactctagtccgccagca

SEQ ID NO: 280329 - DNA, 20 bp, human
gtcccgggagccaatggcag

SEQ ID NO: 280330 - DNA, 20 bp, human
gtggcggactagagtggcgc

SEQ ID NO: 280331 - DNA, 20 bp, human
gtagtccgccagcagggact

SEQ ID NO: 280332 - DNA, 20 bp, human
gggcggggataaggaaaagg

SEQ ID NO: 280333 - DNA, 20 bp, human
gggttcccagtccctgctgg

SEQ ID NO: 280334 - DNA, 20 bp, human
gctgctctgcgggcttaggg

SEQ ID NO: 280335 - DNA, 20 bp, human
gcccccctgccattggctcc

SEQ ID NO: 280336 - DNA, 20 bp, human
gccgccccgggattggcgtg

SEQ ID NO: 280337 - DNA, 20 bp, human
ggccaatcccggggcggcag

SEQ ID NO: 280338 - DNA, 20 bp, human
ggctcctcacgccaatcccg

SEQ ID NO: 280339 - DNA, 20 bp, human
ggggcggcgcctcgagctct

SEQ ID NO: 280340 - DNA, 20 bp, human
gattgccgaggtcctcttcc

SEQ ID NO: 280341 - DNA, 20 bp, human
gttcacgttgctaattgccg

SEQ ID NO: 280342 - DNA, 20 bp, human
gacgaggagcggctggagaa

SEQ ID NO: 280343 - DNA, 20 bp, human
gcaatcctggaagaggacct

SEQ ID NO: 280344 - DNA, 20 bp, human
gatgaggaggtagccaatcc

SEQ ID NO: 280345 - DNA, 20 bp, human
gggttaatatatgtcgtcag

SEQ ID NO: 280346 - DNA, 20 bp, human
gagggccatgctgtagtcgg

SEQ ID NO: 280347 - DNA, 20 bp, human
gaggagaacccctacttcca

SEQ ID NO: 280348 - DNA, 20 bp, human
ggaagtaggggttctcctca

SEQ ID NO: 280349 - DNA, 20 bp, human
gggcgccgctggcatactcg

SEQ ID NO: 280350 - DNA, 20 bp, human
gtagtcggggggcgacatct

SEQ ID NO: 280351 - DNA, 20 bp, human
gcacccccccgtaatgggag

SEQ ID NO: 280352 - DNA, 20 bp, human
gtggaccactcccattacgg

SEQ ID NO: 280353 - DNA, 20 bp, human
gggggggcgacatctcgggg

SEQ ID NO: 280354 - DNA, 20 bp, human
gggcggcacccccccgtaat

SEQ ID NO: 280355 - DNA, 20 bp, human
gtactcggggctgtaggaca

SEQ ID NO: 280356 - DNA, 20 bp, human
gtagtgacttcggtgttctt

SEQ ID NO: 280357 - DNA, 20 bp, human
gccaaagaacaccaaagttg

SEQ ID NO: 280358 - DNA, 20 bp, human
ggccttcccaacctcaactt

SEQ ID NO: 280359 - DNA, 20 bp, human
gtgtctatcacattaaaaag

SEQ ID NO: 280360 - DNA, 20 bp, human
gggggcatccgtgaaattca

SEQ ID NO: 280361 - DNA, 20 bp, human
gggcaaaactgaaccaagag

SEQ ID NO: 280362 - DNA, 20 bp, human
gagagcttatgaactgaacg

SEQ ID NO: 280363 - DNA, 20 bp, human
gaccaaagttgaggttggga

SEQ ID NO: 280364 - DNA, 20 bp, human
gggtatcaagcaaagagcac

SEQ ID NO: 280365 - DNA, 20 bp, human
gaccaagagtggtttcatac

SEQ ID NO: 280366 - DNA, 20 bp, human
ggctcatcacagattgttag

SEQ ID NO: 280367 - DNA, 20 bp, human
gtcacagattgttagaggta

SEQ ID NO: 280368 - DNA, 20 bp, human
gacaaaagtccccgggttgg

SEQ ID NO: 280369 - DNA, 20 bp, human
gagcctgggagcccatgggc

SEQ ID NO: 280370 - DNA, 20 bp, human
gttccccagaacagttctgt

SEQ ID NO: 280371 - DNA, 20 bp, human
gaggggctttttgtggtgat

SEQ ID NO: 280372 - DNA, 20 bp, human
ggcacagcctgggagcccat

SEQ ID NO: 280373 - DNA, 20 bp, human
gccactgctgtcctgcccat

SEQ ID NO: 280374 - DNA, 20 bp, human
ggagctttggggattttgga

SEQ ID NO: 280375 - DNA, 20 bp, human
gaagtttgaatttagaggta

SEQ ID NO: 280376 - DNA, 20 bp, human
gggcgagtgcaagttccgga

SEQ ID NO: 280377 - DNA, 20 bp, human
gaaccccggcgcggcagctg

SEQ ID NO: 280378 - DNA, 20 bp, human
gttccggatggctccgagtt

SEQ ID NO: 280379 - DNA, 20 bp, human
ggccgggccggaccacgcgt

SEQ ID NO: 280380 - DNA, 20 bp, human
gtaagaaaagcagggcaaga

SEQ ID NO: 280381 - DNA, 20 bp, human
gcggaccacgcgtaggggtg

SEQ ID NO: 280382 - DNA, 20 bp, human
ggactcagagccgcgcggga

SEQ ID NO: 280383 - DNA, 20 bp, human
ggaagggcgagtgcaagttc

SEQ ID NO: 280384 - DNA, 20 bp, human
ggatggctccgagttgggat

SEQ ID NO: 280385 - DNA, 20 bp, human
ggcggctgccccagcactcg

SEQ ID NO: 280386 - DNA, 20 bp, human
gaccccagagcgggatactc

SEQ ID NO: 280387 - DNA, 20 bp, human
gatactcgggatctgagcag

SEQ ID NO: 280388 - DNA, 20 bp, human
gtggcagaggtcctgatcct

SEQ ID NO: 280389 - DNA, 20 bp, human
gatcccgagtatcccgctct

SEQ ID NO: 280390 - DNA, 20 bp, human
gtccagaagggatgggacaa

SEQ ID NO: 280391 - DNA, 20 bp, human
ggggtctgtggaatgatctg

SEQ ID NO: 280392 - DNA, 20 bp, human
gactgatgagggttcgggtt

SEQ ID NO: 280393 - DNA, 20 bp, human
gggtcctgatcctgggaaga

SEQ ID NO: 280394 - DNA, 20 bp, human
gtgtaattaggggatttggg

SEQ ID NO: 280395 - DNA, 20 bp, human
gccgaaccctcatcagtcct

SEQ ID NO: 280396 - DNA, 20 bp, human
gtgtcaacagctggggatgt

SEQ ID NO: 280397 - DNA, 20 bp, human
gaatgaaatgtcaacagctg

SEQ ID NO: 280398 - DNA, 20 bp, human
gggaaattgtgcttccgatg

SEQ ID NO: 280399 - DNA, 20 bp, human
gtggcacataccaccggaaa

SEQ ID NO: 280400 - DNA, 20 bp, human
gagctggggatgtgggatgc

SEQ ID NO: 280401 - DNA, 20 bp, human
gaccggaaaagggcctgggt

SEQ ID NO: 280402 - DNA, 20 bp, human
gaccggctggcacataccac

SEQ ID NO: 280403 - DNA, 20 bp, human
gtaccaccggaaaagggcct

SEQ ID NO: 280404 - DNA, 20 bp, human
gcagagaacggatggtgaaa

SEQ ID NO: 280405 - DNA, 20 bp, human
gggccctgttattcaacaat

SEQ ID NO: 280406 - DNA, 20 bp, human
gcggtggttcccagcgagtc

SEQ ID NO: 280407 - DNA, 20 bp, human
ggagctgctgcaggcttgag

SEQ ID NO: 280408 - DNA, 20 bp, human
gaagggctgggctcgaaggg

SEQ ID NO: 280409 - DNA, 20 bp, human
gctgggaaccaccgcaaaga

SEQ ID NO: 280410 - DNA, 20 bp, human
gtcaccccttccacaatcaa

SEQ ID NO: 280411 - DNA, 20 bp, human
gtcttgggaaaggagagtag

SEQ ID NO: 280412 - DNA, 20 bp, human
gcgccagaccagccccttaa

SEQ ID NO: 280413 - DNA, 20 bp, human
gcccacctttgattgtggaa

SEQ ID NO: 280414 - DNA, 20 bp, human
ggttgaggccctcacgtctt

SEQ ID NO: 280415 - DNA, 20 bp, human
gtcccaagggctgggctcga

SEQ ID NO: 280416 - DNA, 20 bp, human
gcaccctggcatgaggagat

SEQ ID NO: 280417 - DNA, 20 bp, human
ggcagaggggatgtgggccc

SEQ ID NO: 280418 - DNA, 20 bp, human
ggcaagcgagtgagtggtgt

SEQ ID NO: 280419 - DNA, 20 bp, human
gggcccatctcctcatgcca

SEQ ID NO: 280420 - DNA, 20 bp, human
gtcagggagctgtaccccga

SEQ ID NO: 280421 - DNA, 20 bp, human
gcagctccgggaacagcgtc

SEQ ID NO: 280422 - DNA, 20 bp, human
gttgctcaacagctcactgc

SEQ ID NO: 280423 - DNA, 20 bp, human
gagcctggcccgggtcaccc

SEQ ID NO: 280424 - DNA, 20 bp, human
ggtgagtggtgttggagcag

SEQ ID NO: 280425 - DNA, 20 bp, human
gtcctcatgccagggtgacc

SEQ ID NO: 280426 - DNA, 20 bp, human
gggaacacgcagggcggtca

SEQ ID NO: 280427 - DNA, 20 bp, human
gaccgccctgcgtgttccca

SEQ ID NO: 280428 - DNA, 20 bp, human
gggacggccattggagacga

SEQ ID NO: 280429 - DNA, 20 bp, human
gcgagggtgtcgatggtgag

SEQ ID NO: 280430 - DNA, 20 bp, human
gggctccctgggaacacgca

SEQ ID NO: 280431 - DNA, 20 bp, human
gtgagtagcgggacggccat

SEQ ID NO: 280432 - DNA, 20 bp, human
ggtggggatgggaaactctg

SEQ ID NO: 280433 - DNA, 20 bp, human
ggtcgatggtgaggggcgaa

SEQ ID NO: 280434 - DNA, 20 bp, human
gagggacccgccccgcacaa

SEQ ID NO: 280435 - DNA, 20 bp, human
gggctgggacacaacacctc

SEQ ID NO: 280436 - DNA, 20 bp, human
gcgaggcggggtgtattaaa

SEQ ID NO: 280437 - DNA, 20 bp, human
gcaccctgctagctgaactt

SEQ ID NO: 280438 - DNA, 20 bp, human
gggagcagtggctggagcgc

SEQ ID NO: 280439 - DNA, 20 bp, human
gcactgctccaggggagcgt

SEQ ID NO: 280440 - DNA, 20 bp, human
gggggctgagtcttctatct

SEQ ID NO: 280441 - DNA, 20 bp, human
ggaggggcagacttgaattg

SEQ ID NO: 280442 - DNA, 20 bp, human
ggaaagaagcgctctggact

SEQ ID NO: 280443 - DNA, 20 bp, human
gtcccggcgtctgcctgcaa

SEQ ID NO: 280444 - DNA, 20 bp, human
gtgactacccaatggacagg

SEQ ID NO: 280445 - DNA, 20 bp, human
ggctagctgaacttaggcca

SEQ ID NO: 280446 - DNA, 20 bp, human
gggcccaggggattgaaccg

SEQ ID NO: 280447 - DNA, 20 bp, human
gcccccggccattaccgaag

SEQ ID NO: 280448 - DNA, 20 bp, human
gagagagagagagaccgttt

SEQ ID NO: 280449 - DNA, 20 bp, human
gaaacaagcaggggccaacg

SEQ ID NO: 280450 - DNA, 20 bp, human
gaaccctcagccaggaggcg

SEQ ID NO: 280451 - DNA, 20 bp, human
ggatgaaccgcaggtagccg

SEQ ID NO: 280452 - DNA, 20 bp, human
gtgaagagcgccagtcgacg

SEQ ID NO: 280453 - DNA, 20 bp, human
gcgaaagtgcgactaaggtt

SEQ ID NO: 280454 - DNA, 20 bp, human
gagccacggttcaatcccct

SEQ ID NO: 280455 - DNA, 20 bp, human
ggggtgaaagagggctacgg

SEQ ID NO: 280456 - DNA, 20 bp, human
gcgcacctcactagtcacga

SEQ ID NO: 280457 - DNA, 20 bp, human
ggctactaagggaacttggg

SEQ ID NO: 280458 - DNA, 20 bp, human
gctggctactaagggaactt

SEQ ID NO: 280459 - DNA, 20 bp, human
gaggctggggcaaccaccgc

SEQ ID NO: 280460 - DNA, 20 bp, human
gtcagccttcgtgactagtg

SEQ ID NO: 280461 - DNA, 20 bp, human
gctcccggaagtgccgaagc

SEQ ID NO: 280462 - DNA, 20 bp, human
gtgccgaagctggctactaa

SEQ ID NO: 280463 - DNA, 20 bp, human
gctagtcacgaaggctgagg

SEQ ID NO: 280464 - DNA, 20 bp, human
gagccagcttcggcacttcc

SEQ ID NO: 280465 - DNA, 20 bp, human
ggtggagggcactgcaaagg

SEQ ID NO: 280466 - DNA, 20 bp, human
gaggctggggcaaccaccgc

SEQ ID NO: 280467 - DNA, 20 bp, human
gctcaagtggacagccggga

SEQ ID NO: 280468 - DNA, 20 bp, human
gggttgccccagcctcagca

SEQ ID NO: 280469 - DNA, 20 bp, human
gatggcagagcgtgcggcgc

SEQ ID NO: 280470 - DNA, 20 bp, human
gcgcacctcactagtcacga

SEQ ID NO: 280471 - DNA, 20 bp, human
gggcggctcaagtggacagc

SEQ ID NO: 280472 - DNA, 20 bp, human
ggctactaagggaacttggg

SEQ ID NO: 280473 - DNA, 20 bp, human
gctggctactaagggaactt

SEQ ID NO: 280474 - DNA, 20 bp, human
ggacccagcgactcgatagc

SEQ ID NO: 280475 - DNA, 20 bp, human
ggcagagcgtgcggcgctgg

SEQ ID NO: 280476 - DNA, 20 bp, human
ggaggggcgcgggtagacat

SEQ ID NO: 280477 - DNA, 20 bp, human
ggggagacaagggacgagag

SEQ ID NO: 280478 - DNA, 20 bp, human
gctgggaagggaggcccgtc

SEQ ID NO: 280479 - DNA, 20 bp, human
gtgatggcagagaggactag

SEQ ID NO: 280480 - DNA, 20 bp, human
ggggagtaatagcgggaagc

SEQ ID NO: 280481 - DNA, 20 bp, human
gtgaagaccagcgcaggcgg

SEQ ID NO: 280482 - DNA, 20 bp, human
gacaagggacgagagggggg

SEQ ID NO: 280483 - DNA, 20 bp, human
gccacccccctcagccagac

SEQ ID NO: 280484 - DNA, 20 bp, human
ggagaagaagacatagagga

SEQ ID NO: 280485 - DNA, 20 bp, human
ggcgagcgctgacgtcagtc

SEQ ID NO: 280486 - DNA, 20 bp, human
gccgccgccgcgggttccca

SEQ ID NO: 280487 - DNA, 20 bp, human
ggaccccgccacgtacgtgt

SEQ ID NO: 280488 - DNA, 20 bp, human
gcggctgcgcgtcctcatgg

SEQ ID NO: 280489 - DNA, 20 bp, human
gccgccacgtacgtgtggga

SEQ ID NO: 280490 - DNA, 20 bp, human
gtccacctcccgataggctc

SEQ ID NO: 280491 - DNA, 20 bp, human
gtacgcggggtcctcctggt

SEQ ID NO: 280492 - DNA, 20 bp, human
gcgcgcgcgcgggtacagca

SEQ ID NO: 280493 - DNA, 20 bp, human
gggcgccggagcctatcggg

SEQ ID NO: 280494 - DNA, 20 bp, human
gcgcgggtacagcagggcgc

SEQ ID NO: 280495 - DNA, 20 bp, human
gcaccagccctgggaacccg

SEQ ID NO: 280496 - DNA, 20 bp, human
ggtggactggggaaccctga

SEQ ID NO: 280497 - DNA, 20 bp, human
gggaggcagaagggcaacaa

SEQ ID NO: 280498 - DNA, 20 bp, human
gggcagaagggcaacaacgg

SEQ ID NO: 280499 - DNA, 20 bp, human
ggacccaaggaggaacagtt

SEQ ID NO: 280500 - DNA, 20 bp, human
gctgcctcctccaacttaag

SEQ ID NO: 280501 - DNA, 20 bp, human
gagggcaacaacggcgggga

SEQ ID NO: 280502 - DNA, 20 bp, human
gccaaggaggaacagttggg

SEQ ID NO: 280503 - DNA, 20 bp, human
gaaagtaaggaatcaggtgg

SEQ ID NO: 280504 - DNA, 20 bp, human
gaaggagaagtcaagacgtc

SEQ ID NO: 280505 - DNA, 20 bp, human
ggagaaatgcaagacacata

SEQ ID NO: 280506 - DNA, 20 bp, human
gggcggggacgcctagtccc

SEQ ID NO: 280507 - DNA, 20 bp, human
gaagctgggtcccccgagtg

SEQ ID NO: 280508 - DNA, 20 bp, human
gagttggggtgcactggggt

SEQ ID NO: 280509 - DNA, 20 bp, human
gtggccttcggccccactcg

SEQ ID NO: 280510 - DNA, 20 bp, human
gggggacccagcttcggaga

SEQ ID NO: 280511 - DNA, 20 bp, human
gggtggggtgagatcgagga

SEQ ID NO: 280512 - DNA, 20 bp, human
gggcgctgatgactttaagg

SEQ ID NO: 280513 - DNA, 20 bp, human
gaggcgtccccgccgagcgc

SEQ ID NO: 280514 - DNA, 20 bp, human
ggggcagttcgctgtctagg

SEQ ID NO: 280515 - DNA, 20 bp, human
gagcgccacaagccagcgct

SEQ ID NO: 280516 - DNA, 20 bp, human
ggcggaagcgcctcaagagg

SEQ ID NO: 280517 - DNA, 20 bp, human
gcggctgacggcattcgcag

SEQ ID NO: 280518 - DNA, 20 bp, human
gaacgccgagaagtctgcgc

SEQ ID NO: 280519 - DNA, 20 bp, human
gctaacgtcacgctgggagt

SEQ ID NO: 280520 - DNA, 20 bp, human
ggcggcggaagcgcctcaag

SEQ ID NO: 280521 - DNA, 20 bp, human
gcgtgacgttagccaattaa

SEQ ID NO: 280522 - DNA, 20 bp, human
ggacgttagccaattaaagg

SEQ ID NO: 280523 - DNA, 20 bp, human
ggacggcattcgcagtggct

SEQ ID NO: 280524 - DNA, 20 bp, human
gaggcctgcaaagcggctga

SEQ ID NO: 280525 - DNA, 20 bp, human
ggcgttagccccgcctcttg

SEQ ID NO: 280526 - DNA, 20 bp, human
gcctgtgcaaggctggtcga

SEQ ID NO: 280527 - DNA, 20 bp, human
ggggaagtggcaacgaagcg

SEQ ID NO: 280528 - DNA, 20 bp, human
gctcaacggccaggagtctc

SEQ ID NO: 280529 - DNA, 20 bp, human
gcaaggctggtcgaaggctc

SEQ ID NO: 280530 - DNA, 20 bp, human
ggccgttgagcccctgtgca

SEQ ID NO: 280531 - DNA, 20 bp, human
gcgccgggcccgggatttct

SEQ ID NO: 280532 - DNA, 20 bp, human
gggcgaggggcgggtgccaa

SEQ ID NO: 280533 - DNA, 20 bp, human
gttgagcccctgtgcaaggc

SEQ ID NO: 280534 - DNA, 20 bp, human
ggcgggtgccaacggcgtgt

SEQ ID NO: 280535 - DNA, 20 bp, human
gaaaacaacctggttctagg

SEQ ID NO: 280536 - DNA, 20 bp, human
gggtcctgggtcttcacctg

SEQ ID NO: 280537 - DNA, 20 bp, human
ggggagcctacggaagatca

SEQ ID NO: 280538 - DNA, 20 bp, human
gcccgcccgggactaagccg

SEQ ID NO: 280539 - DNA, 20 bp, human
ggcggtgggaggcgagtccg

SEQ ID NO: 280540 - DNA, 20 bp, human
ggagccttacggcagctgag

SEQ ID NO: 280541 - DNA, 20 bp, human
gcgctccccggcttagtccc

SEQ ID NO: 280542 - DNA, 20 bp, human
gacccaggacccgcagtagc

SEQ ID NO: 280543 - DNA, 20 bp, human
gcagagctgcaaaggcggca

SEQ ID NO: 280544 - DNA, 20 bp, human
gggatcgcagggcgaacgca

SEQ ID NO: 280545 - DNA, 20 bp, human
ggctccgcaggtgaagaccc

SEQ ID NO: 280546 - DNA, 20 bp, human
gagtcggcgaggctggacta

SEQ ID NO: 280547 - DNA, 20 bp, human
ggcgaggctggactatgggg

SEQ ID NO: 280548 - DNA, 20 bp, human
ggcgcctcgcactgcctcac

SEQ ID NO: 280549 - DNA, 20 bp, human
gcaatgaatggggtgcagag

SEQ ID NO: 280550 - DNA, 20 bp, human
gtgcggtggggcgccctctg

SEQ ID NO: 280551 - DNA, 20 bp, human
ggcggagcctgggcaatgaa

SEQ ID NO: 280552 - DNA, 20 bp, human
ggcgtccaggcgctcccgtg

SEQ ID NO: 280553 - DNA, 20 bp, human
ggcatcctgcctcctgggcg

SEQ ID NO: 280554 - DNA, 20 bp, human
gaaaagaggcggagtcggcg

SEQ ID NO: 280555 - DNA, 20 bp, human
ggtgtcaaaagaggcggagt

SEQ ID NO: 280556 - DNA, 20 bp, human
gggaacccggactgggaaac

SEQ ID NO: 280557 - DNA, 20 bp, human
ggtagtgcctgactcatcgt

SEQ ID NO: 280558 - DNA, 20 bp, human
gcatgcgaacccagggcgtt

SEQ ID NO: 280559 - DNA, 20 bp, human
gccctcgacgggtgcgcgct

SEQ ID NO: 280560 - DNA, 20 bp, human
ggctgggttcccaacgccct

SEQ ID NO: 280561 - DNA, 20 bp, human
gctgggaaacaggatggtct

SEQ ID NO: 280562 - DNA, 20 bp, human
gtggggaggcactaatgaga

SEQ ID NO: 280563 - DNA, 20 bp, human
ggggtggtggaacccggact

SEQ ID NO: 280564 - DNA, 20 bp, human
gaaacaggatggtctcggaa

SEQ ID NO: 280565 - DNA, 20 bp, human
ggccctgggttcgcatgctc

SEQ ID NO: 280566 - DNA, 20 bp, human
gcactcaaggagacctacct

SEQ ID NO: 280567 - DNA, 20 bp, human
ggtagtgagcgggagaacga

SEQ ID NO: 280568 - DNA, 20 bp, human
ggcgggcgccacacttgaag

SEQ ID NO: 280569 - DNA, 20 bp, human
gggcgcgcccgtgacgtcag

SEQ ID NO: 280570 - DNA, 20 bp, human
ggcgccaacagtgacgtcat

SEQ ID NO: 280571 - DNA, 20 bp, human
gcgggagaacgagggaaggc

SEQ ID NO: 280572 - DNA, 20 bp, human
gcccgagcccgctgtctgcc

SEQ ID NO: 280573 - DNA, 20 bp, human
ggggttagctggtagtgagc

SEQ ID NO: 280574 - DNA, 20 bp, human
gcggttgccgggcagacagc

SEQ ID NO: 280575 - DNA, 20 bp, human
ggcgcccgtgacgtcagagg

SEQ ID NO: 280576 - DNA, 20 bp, human
gtggccgcgcaatgcccggt

SEQ ID NO: 280577 - DNA, 20 bp, human
gcaagcgcagagcaagtcgc

SEQ ID NO: 280578 - DNA, 20 bp, human
gggcgccgccaggcgtccga

SEQ ID NO: 280579 - DNA, 20 bp, human
gagaaggacgcattgcatgg

SEQ ID NO: 280580 - DNA, 20 bp, human
gctgtcgtgcccagatcctc

SEQ ID NO: 280581 - DNA, 20 bp, human
gagacccaccgggcattgcg

SEQ ID NO: 280582 - DNA, 20 bp, human
gccttcgggtttctgattct

SEQ ID NO: 280583 - DNA, 20 bp, human
gagaaactgcaagacccacc

SEQ ID NO: 280584 - DNA, 20 bp, human
gctgggcatggccggaaggg

SEQ ID NO: 280585 - DNA, 20 bp, human
ggtcacagtgagcatagcgg

SEQ ID NO: 280586 - DNA, 20 bp, human
ggggaagggtcggtcgggaa

SEQ ID NO: 280587 - DNA, 20 bp, human
gtgggcgggaagaacgctgg

SEQ ID NO: 280588 - DNA, 20 bp, human
gaggcaggaccacagtgaag

SEQ ID NO: 280589 - DNA, 20 bp, human
ggagatgtcgcccaatggga

SEQ ID NO: 280590 - DNA, 20 bp, human
gccgaccgacccttcccatt

SEQ ID NO: 280591 - DNA, 20 bp, human
gaacgctggaggttgattgg

SEQ ID NO: 280592 - DNA, 20 bp, human
ggtcgcccaatgggaagggt

SEQ ID NO: 280593 - DNA, 20 bp, human
gagcccggggcccgcgcagg

SEQ ID NO: 280594 - DNA, 20 bp, human
gggcggagatgtcgcccaat

SEQ ID NO: 280595 - DNA, 20 bp, human
gaagaacgctggaggttgat

SEQ ID NO: 280596 - DNA, 20 bp, human
gtagaggcagagcattaacc

SEQ ID NO: 280597 - DNA, 20 bp, human
ggagcgaggaacatctgggc

SEQ ID NO: 280598 - DNA, 20 bp, human
gaggcagagcattaacctgg

SEQ ID NO: 280599 - DNA, 20 bp, human
ggagcgagcgaggaacatct

SEQ ID NO: 280600 - DNA, 20 bp, human
ggctgcaagggccctgactg

SEQ ID NO: 280601 - DNA, 20 bp, human
gtgaggccagtccttggcat

SEQ ID NO: 280602 - DNA, 20 bp, human
gttggactgggactcagaat

SEQ ID NO: 280603 - DNA, 20 bp, human
gggcccgggttgggtcggat

SEQ ID NO: 280604 - DNA, 20 bp, human
gaacatctgggcagggtgcc

SEQ ID NO: 280605 - DNA, 20 bp, human
ggggttgggtcggatcgggg

SEQ ID NO: 280606 - DNA, 20 bp, human
gtgtggagacgcaggagggg

SEQ ID NO: 280607 - DNA, 20 bp, human
gtggtctcgcccaccatcgg

SEQ ID NO: 280608 - DNA, 20 bp, human
ggggcgagaccaagtgcgag

SEQ ID NO: 280609 - DNA, 20 bp, human
gaggcagcgccggctaagtg

SEQ ID NO: 280610 - DNA, 20 bp, human
gcaggcgaagcgcgcgtctg

SEQ ID NO: 280611 - DNA, 20 bp, human
gacccactaccgccgatggt

SEQ ID NO: 280612 - DNA, 20 bp, human
gcatcggcggtagtgggtag

SEQ ID NO: 280613 - DNA, 20 bp, human
gtgggtgggacctgatctgt

SEQ ID NO: 280614 - DNA, 20 bp, human
gcgagaccaagtgcgagggg

SEQ ID NO: 280615 - DNA, 20 bp, human
gcggcggtagtgggtagggg

SEQ ID NO: 280616 - DNA, 20 bp, human
gaaagctccacgtccaccag

SEQ ID NO: 280617 - DNA, 20 bp, human
gggctagggataagtcgttg

SEQ ID NO: 280618 - DNA, 20 bp, human
gaattcagtaacttccaagg

SEQ ID NO: 280619 - DNA, 20 bp, human
gcagctcatgacagggttca

SEQ ID NO: 280620 - DNA, 20 bp, human
gcacccacatgcgttaaatc

SEQ ID NO: 280621 - DNA, 20 bp, human
gtatcttgcagctcatgaca

SEQ ID NO: 280622 - DNA, 20 bp, human
gaagcttactcatgtttgta

SEQ ID NO: 280623 - DNA, 20 bp, human
gcagcccgatttaacgcatg

SEQ ID NO: 280624 - DNA, 20 bp, human
gtaaaaattcatttcttgac

SEQ ID NO: 280625 - DNA, 20 bp, human
ggacagggttcatggggaag

SEQ ID NO: 280626 - DNA, 20 bp, human
gcccctaccccaagaggctt

SEQ ID NO: 280627 - DNA, 20 bp, human
ggccaaagcctcttggggta

SEQ ID NO: 280628 - DNA, 20 bp, human
gtctactcagagtagaggaa

SEQ ID NO: 280629 - DNA, 20 bp, human
gtaagctgttacctcagtta

SEQ ID NO: 280630 - DNA, 20 bp, human
gggtcacactcccagagctg

SEQ ID NO: 280631 - DNA, 20 bp, human
gaaaagggaagtgagctcac

SEQ ID NO: 280632 - DNA, 20 bp, human
ggtgaatgacaaagaaactc

SEQ ID NO: 280633 - DNA, 20 bp, human
gtcagttatgggagtgtggc

SEQ ID NO: 280634 - DNA, 20 bp, human
gagtagaattaaggggatct

SEQ ID NO: 280635 - DNA, 20 bp, human
gtacctcagttatgggagtg

SEQ ID NO: 280636 - DNA, 20 bp, human
gaaactggtctctgaaaggt

SEQ ID NO: 280637 - DNA, 20 bp, human
gccactcccgtcacggaaac

SEQ ID NO: 280638 - DNA, 20 bp, human
gacgacagtgtcaggatcgc

SEQ ID NO: 280639 - DNA, 20 bp, human
gttaggaggaaggcggtcat

SEQ ID NO: 280640 - DNA, 20 bp, human
gcccagccgcacaaatggac

SEQ ID NO: 280641 - DNA, 20 bp, human
gtaagccggacgtgaaatgg

SEQ ID NO: 280642 - DNA, 20 bp, human
gacggaaactggtctctgaa

SEQ ID NO: 280643 - DNA, 20 bp, human
gccgcgggtggggtggttga

SEQ ID NO: 280644 - DNA, 20 bp, human
ggatttcgagggtttgactc

SEQ ID NO: 280645 - DNA, 20 bp, human
ggccctctggcggctttatc

SEQ ID NO: 280646 - DNA, 20 bp, human
gagcgaggctggagagcagg

SEQ ID NO: 280647 - DNA, 20 bp, human
gaattcttttgagttcctat

SEQ ID NO: 280648 - DNA, 20 bp, human
gtttgagttcctatgggcca

SEQ ID NO: 280649 - DNA, 20 bp, human
gcgagcgagtgcgagccggg

SEQ ID NO: 280650 - DNA, 20 bp, human
ggggcgagcgagtgcgagcc

SEQ ID NO: 280651 - DNA, 20 bp, human
gcgggctcggcctcccctgg

SEQ ID NO: 280652 - DNA, 20 bp, human
ggccccgcgtgcacccccag

SEQ ID NO: 280653 - DNA, 20 bp, human
gccgcgtgcacccccagggg

SEQ ID NO: 280654 - DNA, 20 bp, human
ggggatgggcgggagtggag

SEQ ID NO: 280655 - DNA, 20 bp, human
ggtggagggtggagacgtcc

SEQ ID NO: 280656 - DNA, 20 bp, human
gaggattgggcgaagccctc

SEQ ID NO: 280657 - DNA, 20 bp, human
gaattcttttgagttcctat

SEQ ID NO: 280658 - DNA, 20 bp, human
gtttgagttcctatgggcca

SEQ ID NO: 280659 - DNA, 20 bp, human
gcgagcgagtgcgagccgga

SEQ ID NO: 280660 - DNA, 20 bp, human
gcgggctcggcctcccctgg

SEQ ID NO: 280661 - DNA, 20 bp, human
ggccccgcgtgcacccccag

SEQ ID NO: 280662 - DNA, 20 bp, human
gccgcgtgcacccccagggg

SEQ ID NO: 280663 - DNA, 20 bp, human
ggggatgggcgggagtggag

SEQ ID NO: 280664 - DNA, 20 bp, human
ggtggagggtggagacgtcc

SEQ ID NO: 280665 - DNA, 20 bp, human
gcccgcccgggactcccctg

SEQ ID NO: 280666 - DNA, 20 bp, human
gagcgaggctggagagcagg

SEQ ID NO: 280667 - DNA, 20 bp, human
gaattcttttgagttcctat

SEQ ID NO: 280668 - DNA, 20 bp, human
gtttgagttcctatgggcca

SEQ ID NO: 280669 - DNA, 20 bp, human
gcgagcgagtgcgagccggg

SEQ ID NO: 280670 - DNA, 20 bp, human
ggggcgagcgagtgcgagcc

SEQ ID NO: 280671 - DNA, 20 bp, human
gcgggctcggcctcccctgg

SEQ ID NO: 280672 - DNA, 20 bp, human
ggccccgcgtgcacccccag

SEQ ID NO: 280673 - DNA, 20 bp, human
gccgcgtgcacccccagggg

SEQ ID NO: 280674 - DNA, 20 bp, human
ggggatgggcgggagtggag

SEQ ID NO: 280675 - DNA, 20 bp, human
ggtggagggtggagacgtcc

SEQ ID NO: 280676 - DNA, 20 bp, human
gaggattgggcgaagccctc

SEQ ID NO: 280677 - DNA, 20 bp, human
gaattcttttgagttcctat

SEQ ID NO: 280678 - DNA, 20 bp, human
gtttgagttcctatgggcca

SEQ ID NO: 280679 - DNA, 20 bp, human
gcgagcgagtgcgagccgga

SEQ ID NO: 280680 - DNA, 20 bp, human
gcgggctcggcctcccctgg

SEQ ID NO: 280681 - DNA, 20 bp, human
ggccccgcgtgcacccccag

SEQ ID NO: 280682 - DNA, 20 bp, human
gccgcgtgcacccccagggg

SEQ ID NO: 280683 - DNA, 20 bp, human
ggggatgggcgggagtggag

SEQ ID NO: 280684 - DNA, 20 bp, human
ggtggagggtggagacgtcc

SEQ ID NO: 280685 - DNA, 20 bp, human
gcccgcccgggactcccctg

SEQ ID NO: 280686 - DNA, 20 bp, human
ggaagagccaaggacaggta

SEQ ID NO: 280687 - DNA, 20 bp, human
gccaagagatatatcttaga

SEQ ID NO: 280688 - DNA, 20 bp, human
gcctgtggagccacacccta

SEQ ID NO: 280689 - DNA, 20 bp, human
gagtagattggccaacccta

SEQ ID NO: 280690 - DNA, 20 bp, human
gggttggccaatctactccc

SEQ ID NO: 280691 - DNA, 20 bp, human
gcctgctcctgggagtagat

SEQ ID NO: 280692 - DNA, 20 bp, human
gctggcactggcttaggagt

SEQ ID NO: 280693 - DNA, 20 bp, human
ggctcttctggcactggctt

SEQ ID NO: 280694 - DNA, 20 bp, human
gtgacagccgtacctgtcct

SEQ ID NO: 280695 - DNA, 20 bp, human
gtacgtaaatacacttgcaa

SEQ ID NO: 280696 - DNA, 20 bp, human
ggcggtggggagatatgtag

SEQ ID NO: 280697 - DNA, 20 bp, human
gtaagggaatagtggaatga

SEQ ID NO: 280698 - DNA, 20 bp, human
gactgctgaaagagatgcgg

SEQ ID NO: 280699 - DNA, 20 bp, human
ggacagaacagccaatctca

SEQ ID NO: 280700 - DNA, 20 bp, human
gacaactgctgaaagagatg

SEQ ID NO: 280701 - DNA, 20 bp, human
gcaatctcagggcaagttaa

SEQ ID NO: 280702 - DNA, 20 bp, human
ggagatatgtagaggagaac

SEQ ID NO: 280703 - DNA, 20 bp, human
ggggcaagttaagggaatag

SEQ ID NO: 280704 - DNA, 20 bp, human
gctgcaaaaatgaaactagg

SEQ ID NO: 280705 - DNA, 20 bp, human
gtggagacaaaaatctctag

SEQ ID NO: 280706 - DNA, 20 bp, human
ggcggtggggagatatgtag

SEQ ID NO: 280707 - DNA, 20 bp, human
gtaagggaatagtggaatga

SEQ ID NO: 280708 - DNA, 20 bp, human
ggacagaacagccaatctca

SEQ ID NO: 280709 - DNA, 20 bp, human
gcaatctcagggcaagttaa

SEQ ID NO: 280710 - DNA, 20 bp, human
ggggcaagttaagggaatag

SEQ ID NO: 280711 - DNA, 20 bp, human
ggagatatgtagaggagaac

SEQ ID NO: 280712 - DNA, 20 bp, human
gtgctgaaagagatgcggtg

SEQ ID NO: 280713 - DNA, 20 bp, human
gaggaccagcataaaaggca

SEQ ID NO: 280714 - DNA, 20 bp, human
gacaactgctgaaagagatg

SEQ ID NO: 280715 - DNA, 20 bp, human
gggttggtttaagataagca

SEQ ID NO: 280716 - DNA, 20 bp, human
ggagggtcagcagtgatgga

SEQ ID NO: 280717 - DNA, 20 bp, human
ggtggagtcaggtccggaga

SEQ ID NO: 280718 - DNA, 20 bp, human
ggtccctcaggggtggagtc

SEQ ID NO: 280719 - DNA, 20 bp, human
ggacctgactccacccctga

SEQ ID NO: 280720 - DNA, 20 bp, human
gcggagagggtcagcagtga

SEQ ID NO: 280721 - DNA, 20 bp, human
ggctgacctgtgtccctcag

SEQ ID NO: 280722 - DNA, 20 bp, human
ggatgaagagggtaaaaaag

SEQ ID NO: 280723 - DNA, 20 bp, human
gctccacccctgagggacac

SEQ ID NO: 280724 - DNA, 20 bp, human
gtctggccccctgttctcca

SEQ ID NO: 280725 - DNA, 20 bp, human
gtcctgaggctcttttttgt

SEQ ID NO: 280726 - DNA, 20 bp, human
ggcagccgcggcctgattgt

SEQ ID NO: 280727 - DNA, 20 bp, human
gcctacccacaatcaggccg

SEQ ID NO: 280728 - DNA, 20 bp, human
gggcgcggcggaggactggg

SEQ ID NO: 280729 - DNA, 20 bp, human
gcctcctggagccttattcc

SEQ ID NO: 280730 - DNA, 20 bp, human
gtgtgggtagggctactgac

SEQ ID NO: 280731 - DNA, 20 bp, human
gagggctactgaccggcagg

SEQ ID NO: 280732 - DNA, 20 bp, human
ggctactgaccggcaggtgg

SEQ ID NO: 280733 - DNA, 20 bp, human
gagtagccctacccacaatc

SEQ ID NO: 280734 - DNA, 20 bp, human
gtgggcttctgaaacttaga

SEQ ID NO: 280735 - DNA, 20 bp, human
gaataaggctccaggaggcg

SEQ ID NO: 280736 - DNA, 20 bp, human
gcttcagcctacaacataca

SEQ ID NO: 280737 - DNA, 20 bp, human
ggccagtgactagtgcttga

SEQ ID NO: 280738 - DNA, 20 bp, human
gcccttcaagcactagtcac

SEQ ID NO: 280739 - DNA, 20 bp, human
gggagctctcagctcactat

SEQ ID NO: 280740 - DNA, 20 bp, human
gaatgggaaggcaaaatctc

SEQ ID NO: 280741 - DNA, 20 bp, human
gttggtgtgtagttatctgg

SEQ ID NO: 280742 - DNA, 20 bp, human
gtgggggcaaagtatgtcca

SEQ ID NO: 280743 - DNA, 20 bp, human
gtgagctgagagctccagcc

SEQ ID NO: 280744 - DNA, 20 bp, human
gcagtggtatctggaggaca

SEQ ID NO: 280745 - DNA, 20 bp, human
gcaggagctgttgagatgaa

SEQ ID NO: 280746 - DNA, 20 bp, human
gttaagcagcagtatcctct

SEQ ID NO: 280747 - DNA, 20 bp, human
gtcctggtatcttctatggt

SEQ ID NO: 280748 - DNA, 20 bp, human
ggaagtcctggtatcttcta

SEQ ID NO: 280749 - DNA, 20 bp, human
gtcccaccatagaagatacc

SEQ ID NO: 280750 - DNA, 20 bp, human
gaagtatagcacttcttatt

SEQ ID NO: 280751 - DNA, 20 bp, human
gagtctcatttagtaagcat

SEQ ID NO: 280752 - DNA, 20 bp, human
gcgtgtcccatcaaaaatcc

SEQ ID NO: 280753 - DNA, 20 bp, human
ggcaaggctggccaacccat

SEQ ID NO: 280754 - DNA, 20 bp, human
gcatgggtggagtttagcca

SEQ ID NO: 280755 - DNA, 20 bp, human
gaggctggccaacccatggg

SEQ ID NO: 280756 - DNA, 20 bp, human
gtgcccacgcgcaacggcgt

SEQ ID NO: 280757 - DNA, 20 bp, human
ggacccacgccgttgcgcgt

SEQ ID NO: 280758 - DNA, 20 bp, human
gtaaaggtgcccacgcgcaa

SEQ ID NO: 280759 - DNA, 20 bp, human
gggaccctcggcctgcgccg

SEQ ID NO: 280760 - DNA, 20 bp, human
gtccacacagacgggaaccc

SEQ ID NO: 280761 - DNA, 20 bp, human
gggtgcccggaggctctata

SEQ ID NO: 280762 - DNA, 20 bp, human
gcccctaaagtctgcagtaa

SEQ ID NO: 280763 - DNA, 20 bp, human
gccaggagggagcacatggg

SEQ ID NO: 280764 - DNA, 20 bp, human
ggcccccagagcacgtcagg

SEQ ID NO: 280765 - DNA, 20 bp, human
gcgctcgggccgataaggac

SEQ ID NO: 280766 - DNA, 20 bp, human
gggaaaggggaagaaccgaa

SEQ ID NO: 280767 - DNA, 20 bp, human
ggtaccacccaatgggaaag

SEQ ID NO: 280768 - DNA, 20 bp, human
ggaccacggtaccacccaat

SEQ ID NO: 280769 - DNA, 20 bp, human
gtgtccccgaaatggattgt

SEQ ID NO: 280770 - DNA, 20 bp, human
ggggcggggctcaaccccca

SEQ ID NO: 280771 - DNA, 20 bp, human
gcggggacaaagtttggctt

SEQ ID NO: 280772 - DNA, 20 bp, human
gtggtaccgtggtccgtctc

SEQ ID NO: 280773 - DNA, 20 bp, human
gcgccccccgagacggacca

SEQ ID NO: 280774 - DNA, 20 bp, human
gggttcttcccctttcccat

SEQ ID NO: 280775 - DNA, 20 bp, human
gaagagtaagtgcttcggat

SEQ ID NO: 280776 - DNA, 20 bp, human
gggtcccgggatctccgacg

SEQ ID NO: 280777 - DNA, 20 bp, human
gttcgccgcccgggggtcca

SEQ ID NO: 280778 - DNA, 20 bp, human
gcgcctgcgcggaccggcca

SEQ ID NO: 280779 - DNA, 20 bp, human
ggggcctcgtcggagatccc

SEQ ID NO: 280780 - DNA, 20 bp, human
gcgggggtccagggcctcgt

SEQ ID NO: 280781 - DNA, 20 bp, human
gaggggtcccgcggcctcca

SEQ ID NO: 280782 - DNA, 20 bp, human
gggatccagggcgattcaga

SEQ ID NO: 280783 - DNA, 20 bp, human
gacccctggccggtccgcgc

SEQ ID NO: 280784 - DNA, 20 bp, human
gatccaaggccccccgtctt

SEQ ID NO: 280785 - DNA, 20 bp, human
gtctccgacagctccgaccg

SEQ ID NO: 280786 - DNA, 20 bp, human
ggctgtgcatggcgggacga

SEQ ID NO: 280787 - DNA, 20 bp, human
gccacccaaaggttgggcga

SEQ ID NO: 280788 - DNA, 20 bp, human
gtcactgtccgcctccctga

SEQ ID NO: 280789 - DNA, 20 bp, human
gtgcgcatgcgccctcaggg

SEQ ID NO: 280790 - DNA, 20 bp, human
gacgaggggagggagcgttt

SEQ ID NO: 280791 - DNA, 20 bp, human
gcccaaaggttgggcgacgg

SEQ ID NO: 280792 - DNA, 20 bp, human
gccctccgtcgcccaacctt

SEQ ID NO: 280793 - DNA, 20 bp, human
ggtggccccacccaaaggtt

SEQ ID NO: 280794 - DNA, 20 bp, human
ggcgcgacggcaatgcctca

SEQ ID NO: 280795 - DNA, 20 bp, human
gtgcgcactgctgtgcatgg

SEQ ID NO: 280796 - DNA, 20 bp, human
gtacatctcccctcagcgct

SEQ ID NO: 280797 - DNA, 20 bp, human
ggcagcaggtccggggacaa

SEQ ID NO: 280798 - DNA, 20 bp, human
gaaggccacaggagaggaac

SEQ ID NO: 280799 - DNA, 20 bp, human
gaataaggacggtgcagaac

SEQ ID NO: 280800 - DNA, 20 bp, human
gctggccaacaccccctgta

SEQ ID NO: 280801 - DNA, 20 bp, human
gagactctgtggtcagactc

SEQ ID NO: 280802 - DNA, 20 bp, human
gacagagtctaggagagata

SEQ ID NO: 280803 - DNA, 20 bp, human
gaatgcaggagtgacttcct

SEQ ID NO: 280804 - DNA, 20 bp, human
gtgggaccaagccccacggt

SEQ ID NO: 280805 - DNA, 20 bp, human
gctctcctgtggccttacag

SEQ ID NO: 280806 - DNA, 20 bp, human
gggagtgccccgtgggatga

SEQ ID NO: 280807 - DNA, 20 bp, human
gcccacggggcactcccatg

SEQ ID NO: 280808 - DNA, 20 bp, human
gtcccagcagagggggaaac

SEQ ID NO: 280809 - DNA, 20 bp, human
ggtcaggcaaaggttacggg

SEQ ID NO: 280810 - DNA, 20 bp, human
gcccatgcggtgccagagag

SEQ ID NO: 280811 - DNA, 20 bp, human
gggaggtgggaatagagcgg

SEQ ID NO: 280812 - DNA, 20 bp, human
gaccgcatgggagtgccccg

SEQ ID NO: 280813 - DNA, 20 bp, human
ggcagtcaggcaaaggttac

SEQ ID NO: 280814 - DNA, 20 bp, human
gcaaaaattggaggagtctg

SEQ ID NO: 280815 - DNA, 20 bp, human
ggggaaaccggctcccaaag

SEQ ID NO: 280816 - DNA, 20 bp, human
ggtgggttcccgtctgccca

SEQ ID NO: 280817 - DNA, 20 bp, human
gtagagatttcgtagtttcc

SEQ ID NO: 280818 - DNA, 20 bp, human
gaagaatcccctgggcagac

SEQ ID NO: 280819 - DNA, 20 bp, human
gaaaggtagcataggaaaag

SEQ ID NO: 280820 - DNA, 20 bp, human
gcagtctgtcctcatcaaac

SEQ ID NO: 280821 - DNA, 20 bp, human
gagtagttgcctgtttgatg

SEQ ID NO: 280822 - DNA, 20 bp, human
gcaagtaataagaatcccct

SEQ ID NO: 280823 - DNA, 20 bp, human
gttacatttaagacattttg

SEQ ID NO: 280824 - DNA, 20 bp, human
gagatgactgaatggttacc

SEQ ID NO: 280825 - DNA, 20 bp, human
gcaatagcaataacaatttt

SEQ ID NO: 280826 - DNA, 20 bp, human
gggtgggttcctgtatgccc

SEQ ID NO: 280827 - DNA, 20 bp, human
gatatgacataaacagtagc

SEQ ID NO: 280828 - DNA, 20 bp, human
gaaaaatcccctgggcatac

SEQ ID NO: 280829 - DNA, 20 bp, human
gaaaggtagcataggaaaag

SEQ ID NO: 280830 - DNA, 20 bp, human
gcagtctgtcctcatcaaac

SEQ ID NO: 280831 - DNA, 20 bp, human
gagtagttgcctgtttgatg

SEQ ID NO: 280832 - DNA, 20 bp, human
gttacatttaagacatttgg

SEQ ID NO: 280833 - DNA, 20 bp, human
gagatgactgaatggttatc

SEQ ID NO: 280834 - DNA, 20 bp, human
ggcaacgttgagtactcagt

SEQ ID NO: 280835 - DNA, 20 bp, human
gtgaaggacatccctttgga

SEQ ID NO: 280836 - DNA, 20 bp, human
gttacaggccggggcgagga

SEQ ID NO: 280837 - DNA, 20 bp, human
gcggcccccgcagcagttac

SEQ ID NO: 280838 - DNA, 20 bp, human
gccccggcctgtaactgctg

SEQ ID NO: 280839 - DNA, 20 bp, human
ggaggggcgggcccagaaag

SEQ ID NO: 280840 - DNA, 20 bp, human
gtaggggtgcgtgagaacgc

SEQ ID NO: 280841 - DNA, 20 bp, human
gccccgcagcagttacaggc

SEQ ID NO: 280842 - DNA, 20 bp, human
gcggtgaccgagtgagagga

SEQ ID NO: 280843 - DNA, 20 bp, human
gacccgctctccgtgattga

SEQ ID NO: 280844 - DNA, 20 bp, human
gtaggtgcccataacttcgg

SEQ ID NO: 280845 - DNA, 20 bp, human
gtctcactcggtcaccgctg

SEQ ID NO: 280846 - DNA, 20 bp, human
gcctcgcaccgcttcgcccc

SEQ ID NO: 280847 - DNA, 20 bp, human
gagcgcaggggtcctttaag

SEQ ID NO: 280848 - DNA, 20 bp, human
gcccttgggaacggtctctc

SEQ ID NO: 280849 - DNA, 20 bp, human
gctgggcccaagcctcttaa

SEQ ID NO: 280850 - DNA, 20 bp, human
gcgggacggtctcaagatgg

SEQ ID NO: 280851 - DNA, 20 bp, human
ggtggaggctcgcccggtgg

SEQ ID NO: 280852 - DNA, 20 bp, human
gggccagtgctggggacttg

SEQ ID NO: 280853 - DNA, 20 bp, human
gcactggccggcttccgggg

SEQ ID NO: 280854 - DNA, 20 bp, human
gctcgagtcgcgctcagatc

SEQ ID NO: 280855 - DNA, 20 bp, human
gagtcataaggcgggaagtg

SEQ ID NO: 280856 - DNA, 20 bp, human
gacaggggaggagtctctga

SEQ ID NO: 280857 - DNA, 20 bp, human
gcgcgggcgcggaagacggg

SEQ ID NO: 280858 - DNA, 20 bp, human
ggcggcgcgtggcggaaggc

SEQ ID NO: 280859 - DNA, 20 bp, human
gggagggtatccggcttaag

SEQ ID NO: 280860 - DNA, 20 bp, human
gcaggcttgctcctcggggt

SEQ ID NO: 280861 - DNA, 20 bp, human
ggaagacgggcggcgcgtgg

SEQ ID NO: 280862 - DNA, 20 bp, human
gggaaggcaggcttgctcct

SEQ ID NO: 280863 - DNA, 20 bp, human
ggcgcccgcgcagaacctcg

SEQ ID NO: 280864 - DNA, 20 bp, human
gacgggcggcgcgtggcgga

SEQ ID NO: 280865 - DNA, 20 bp, human
gaggccttacgtgcctagag

SEQ ID NO: 280866 - DNA, 20 bp, human
ggggcagtggagagacgctg

SEQ ID NO: 280867 - DNA, 20 bp, human
ggtggagagacgctggggaa

SEQ ID NO: 280868 - DNA, 20 bp, human
ggacccgcctccagctgtgc

SEQ ID NO: 280869 - DNA, 20 bp, human
gtggccaagtcgcctggggt

SEQ ID NO: 280870 - DNA, 20 bp, human
gcgggtccccgccctcccca

SEQ ID NO: 280871 - DNA, 20 bp, human
gcgaacgggaggctctgggt

SEQ ID NO: 280872 - DNA, 20 bp, human
gacccggagcaacgcacctt

SEQ ID NO: 280873 - DNA, 20 bp, human
ggccgctggccaagtcgcct

SEQ ID NO: 280874 - DNA, 20 bp, human
gcagccggttgaggcgggag

SEQ ID NO: 280875 - DNA, 20 bp, human
ggatgggagacgtggtcagt

SEQ ID NO: 280876 - DNA, 20 bp, human
ggccaccccaggatcctaac

SEQ ID NO: 280877 - DNA, 20 bp, human
gaaccccagcacccgctcca

SEQ ID NO: 280878 - DNA, 20 bp, human
ggggtggcgtctgaatcttc

SEQ ID NO: 280879 - DNA, 20 bp, human
ggtcctaccccagtctccaa

SEQ ID NO: 280880 - DNA, 20 bp, human
ggatcctaaccggctccccg

SEQ ID NO: 280881 - DNA, 20 bp, human
gacctccgtctcctgcaaga

SEQ ID NO: 280882 - DNA, 20 bp, human
gggaggtgttaggacacttg

SEQ ID NO: 280883 - DNA, 20 bp, human
gaaagtggagcggaagggat

SEQ ID NO: 280884 - DNA, 20 bp, human
ggaatcttcggggaggtgtt

SEQ ID NO: 280885 - DNA, 20 bp, human
gacggaggttatgaccctcg

SEQ ID NO: 280886 - DNA, 20 bp, human
gtgcaaggttttgacaatgg

SEQ ID NO: 280887 - DNA, 20 bp, human
gaggaactgactcaaatttc

SEQ ID NO: 280888 - DNA, 20 bp, human
gaattcagagcatttggtat

SEQ ID NO: 280889 - DNA, 20 bp, human
gagtgctgtgggtaatatag

SEQ ID NO: 280890 - DNA, 20 bp, human
gcattctctaatgtgttttc

SEQ ID NO: 280891 - DNA, 20 bp, human
gggaaaagtgatttatatgt

SEQ ID NO: 280892 - DNA, 20 bp, human
gagaagagaataactcatga

SEQ ID NO: 280893 - DNA, 20 bp, human
gtacccacagcacttaaaag

SEQ ID NO: 280894 - DNA, 20 bp, human
gcagcattgtgtcctaaata

SEQ ID NO: 280895 - DNA, 20 bp, human
gtcatcaagaaaggctttat

SEQ ID NO: 280896 - DNA, 20 bp, human
ggggaggcgctggggcgcga

SEQ ID NO: 280897 - DNA, 20 bp, human
gtgaactcaagagccctcgg

SEQ ID NO: 280898 - DNA, 20 bp, human
gcctcggaggagacattcat

SEQ ID NO: 280899 - DNA, 20 bp, human
ggacggggagagaccctttc

SEQ ID NO: 280900 - DNA, 20 bp, human
gcatgtgtggagagcggacg

SEQ ID NO: 280901 - DNA, 20 bp, human
gtgaactagcgagtgtgtgt

SEQ ID NO: 280902 - DNA, 20 bp, human
gaggctgccggagctaggcg

SEQ ID NO: 280903 - DNA, 20 bp, human
gaccctttctggccaacaga

SEQ ID NO: 280904 - DNA, 20 bp, human
gacagagggcagccgagggg

SEQ ID NO: 280905 - DNA, 20 bp, human
gccaacagagggcagccgag

SEQ ID NO: 280906 - DNA, 20 bp, human
gaggcctcggagccccgcgc

SEQ ID NO: 280907 - DNA, 20 bp, human
ggaaactcgggccgcggggt

SEQ ID NO: 280908 - DNA, 20 bp, human
ggccgccggccggagcccga

SEQ ID NO: 280909 - DNA, 20 bp, human
gctcgggccgcgtgaccttg

SEQ ID NO: 280910 - DNA, 20 bp, human
gagcggggcccggtgacctt

SEQ ID NO: 280911 - DNA, 20 bp, human
ggcggcctctcccgtctccc

SEQ ID NO: 280912 - DNA, 20 bp, human
gggggcgccccaaggtcacg

SEQ ID NO: 280913 - DNA, 20 bp, human
gctgaggcccgcgacgtgta

SEQ ID NO: 280914 - DNA, 20 bp, human
gcgccgggaaactcgggccg

SEQ ID NO: 280915 - DNA, 20 bp, human
gggtgccctccggacagagg

SEQ ID NO: 280916 - DNA, 20 bp, human
ggccgcgccaagaccgggcg

SEQ ID NO: 280917 - DNA, 20 bp, human
ggcgcggcgccccctggcga

SEQ ID NO: 280918 - DNA, 20 bp, human
gcctggaggaactccgagag

SEQ ID NO: 280919 - DNA, 20 bp, human
gcctcctccctggttctcag

SEQ ID NO: 280920 - DNA, 20 bp, human
gtggcgggaaaatcggacgc

SEQ ID NO: 280921 - DNA, 20 bp, human
gagagggcgtggcctagcgt

SEQ ID NO: 280922 - DNA, 20 bp, human
gtgggacgccgggatcctgg

SEQ ID NO: 280923 - DNA, 20 bp, human
ggaaggacttgggagggaga

SEQ ID NO: 280924 - DNA, 20 bp, human
gcatccactgagaaccaggg

SEQ ID NO: 280925 - DNA, 20 bp, human
gtcccagccccgcccggtct

SEQ ID NO: 280926 - DNA, 20 bp, human
gcctacctgggcttcttaaa

SEQ ID NO: 280927 - DNA, 20 bp, human
gcacgggccgggggctggaa

SEQ ID NO: 280928 - DNA, 20 bp, human
gggccccgaaggtctagcga

SEQ ID NO: 280929 - DNA, 20 bp, human
gtaaaggggcagcggcgcac

SEQ ID NO: 280930 - DNA, 20 bp, human
gcgccccaagtctgaagctc

SEQ ID NO: 280931 - DNA, 20 bp, human
gccttcggggccggggtgag

SEQ ID NO: 280932 - DNA, 20 bp, human
ggaagccggagcttcagact

SEQ ID NO: 280933 - DNA, 20 bp, human
gctaacctgggccccttgcc

SEQ ID NO: 280934 - DNA, 20 bp, human
gggaagccccctctccagga

SEQ ID NO: 280935 - DNA, 20 bp, human
ggaaatgcgccgcgtcgggg

SEQ ID NO: 280936 - DNA, 20 bp, human
ggccgcagcggccattcctt

SEQ ID NO: 280937 - DNA, 20 bp, human
gggagcagatagacagacaa

SEQ ID NO: 280938 - DNA, 20 bp, human
ggacagacaagggggtgatc

SEQ ID NO: 280939 - DNA, 20 bp, human
gggagaccgccccatctcca

SEQ ID NO: 280940 - DNA, 20 bp, human
gcggtctccgggcactaatg

SEQ ID NO: 280941 - DNA, 20 bp, human
gggagcagcgacaagaagca

SEQ ID NO: 280942 - DNA, 20 bp, human
gctgcggcgttcagaggcca

SEQ ID NO: 280943 - DNA, 20 bp, human
ggcccaaggaatggccgctg

SEQ ID NO: 280944 - DNA, 20 bp, human
gaccttgcacccaggaatct

SEQ ID NO: 280945 - DNA, 20 bp, human
gctggcctgggacaatatgg

SEQ ID NO: 280946 - DNA, 20 bp, human
gtggacgcatgaatggaggt

SEQ ID NO: 280947 - DNA, 20 bp, human
gcggatggacgcatgaatgg

SEQ ID NO: 280948 - DNA, 20 bp, human
gccgagacccgcagggcgga

SEQ ID NO: 280949 - DNA, 20 bp, human
gtcagagggccacagtgcag

SEQ ID NO: 280950 - DNA, 20 bp, human
gagggagccaagaccgtctg

SEQ ID NO: 280951 - DNA, 20 bp, human
gctgcctcacctaactgagg

SEQ ID NO: 280952 - DNA, 20 bp, human
gtaagtgcgcccagaatgcg

SEQ ID NO: 280953 - DNA, 20 bp, human
ggggagcccccagacggtct

SEQ ID NO: 280954 - DNA, 20 bp, human
gcgggcctggcagcttcaga

SEQ ID NO: 280955 - DNA, 20 bp, human
gtgggggcagataggatggg

SEQ ID NO: 280956 - DNA, 20 bp, human
gaggaggagaaagctacgtc

SEQ ID NO: 280957 - DNA, 20 bp, human
gaggctgcagcaatgacacc

SEQ ID NO: 280958 - DNA, 20 bp, human
gtgggctgcggactgagtgc

SEQ ID NO: 280959 - DNA, 20 bp, human
gggaactagggacccggcac

SEQ ID NO: 280960 - DNA, 20 bp, human
gactagggacccggcactgg

SEQ ID NO: 280961 - DNA, 20 bp, human
gataggcagctgaggaacta

SEQ ID NO: 280962 - DNA, 20 bp, human
gacagcctcctccctcgctg

SEQ ID NO: 280963 - DNA, 20 bp, human
gttcagctctccctcagcga

SEQ ID NO: 280964 - DNA, 20 bp, human
gctgcagcaatgacaccagg

SEQ ID NO: 280965 - DNA, 20 bp, human
gttctgccgggcaacttctg

SEQ ID NO: 280966 - DNA, 20 bp, human
gggcaagggtgtgcaggcta

SEQ ID NO: 280967 - DNA, 20 bp, human
gtgcttcctgtgtgtgttga

SEQ ID NO: 280968 - DNA, 20 bp, human
gggtgaacgaactcaggggg

SEQ ID NO: 280969 - DNA, 20 bp, human
gtggtccaagtgggaatgac

SEQ ID NO: 280970 - DNA, 20 bp, human
ggtctgctggcagagatgaa

SEQ ID NO: 280971 - DNA, 20 bp, human
gccctgagttcgttcaccaa

SEQ ID NO: 280972 - DNA, 20 bp, human
gatagcggatgtcaccctgc

SEQ ID NO: 280973 - DNA, 20 bp, human
gtgtgcaggctagggagatc

SEQ ID NO: 280974 - DNA, 20 bp, human
ggcctttggtgaacgaactc

SEQ ID NO: 280975 - DNA, 20 bp, human
gtcaggggataaggctggtc

SEQ ID NO: 280976 - DNA, 20 bp, human
gaggccgccgagggccccct

SEQ ID NO: 280977 - DNA, 20 bp, human
gggaccgtaccatcagtccc

SEQ ID NO: 280978 - DNA, 20 bp, human
gcgggcccggaactcggcag

SEQ ID NO: 280979 - DNA, 20 bp, human
gtctgcgcaagctgattggc

SEQ ID NO: 280980 - DNA, 20 bp, human
gcgtgtctgcgcaagctgat

SEQ ID NO: 280981 - DNA, 20 bp, human
gtcccccgggactgatggta

SEQ ID NO: 280982 - DNA, 20 bp, human
gcgcggctataggtgagccc

SEQ ID NO: 280983 - DNA, 20 bp, human
gaggcccagggggccctcgg

SEQ ID NO: 280984 - DNA, 20 bp, human
gaaggtctgcgacagatggg

SEQ ID NO: 280985 - DNA, 20 bp, human
ggaaaagcgtgcttggagat

SEQ ID NO: 280986 - DNA, 20 bp, human
gagccgcagcgcagctccga

SEQ ID NO: 280987 - DNA, 20 bp, human
gggaccccgcccctcttgga

SEQ ID NO: 280988 - DNA, 20 bp, human
gcccggagcgaggaaccagc

SEQ ID NO: 280989 - DNA, 20 bp, human
gagcgaggaaccagcgggcg

SEQ ID NO: 280990 - DNA, 20 bp, human
gaccactcgcctaaggccgg

SEQ ID NO: 280991 - DNA, 20 bp, human
gggccacgggcgttcgggtg

SEQ ID NO: 280992 - DNA, 20 bp, human
gtgcggctccgcctccccat

SEQ ID NO: 280993 - DNA, 20 bp, human
gccagcgggcgcggaagcct

SEQ ID NO: 280994 - DNA, 20 bp, human
ggccccgatcccctccaaga

SEQ ID NO: 280995 - DNA, 20 bp, human
gacccagctggtgcagaacg

SEQ ID NO: 280996 - DNA, 20 bp, human
gcgggcttgatgggcgttgg

SEQ ID NO: 280997 - DNA, 20 bp, human
gtccgcaggcaaatacccgg

SEQ ID NO: 280998 - DNA, 20 bp, human
gaagcccgggggcgtgtcct

SEQ ID NO: 280999 - DNA, 20 bp, human
gtcaccccggcctcgcggaa

SEQ ID NO: 281000 - DNA, 20 bp, human
gcggagcttccgaaccaggc

SEQ ID NO: 281001 - DNA, 20 bp, human
ggctctgcccccagaggacg

SEQ ID NO: 281002 - DNA, 20 bp, human
gccgcccggtcgcggagctg

SEQ ID NO: 281003 - DNA, 20 bp, human
ggcgggacttcgggcttgat

SEQ ID NO: 281004 - DNA, 20 bp, human
gctggcggggcgggccaaat

SEQ ID NO: 281005 - DNA, 20 bp, human
gtagaaacggcgagaggctg

SEQ ID NO: 281006 - DNA, 20 bp, human
gactgcgcgcagacctgagg

SEQ ID NO: 281007 - DNA, 20 bp, human
gcacccggctgcacgctccc

SEQ ID NO: 281008 - DNA, 20 bp, human
ggaggtgagcgcatccactg

SEQ ID NO: 281009 - DNA, 20 bp, human
gaccactgcgcgcagacctg

SEQ ID NO: 281010 - DNA, 20 bp, human
gactgcgcaggctcggggac

SEQ ID NO: 281011 - DNA, 20 bp, human
gtcgctgcgcaagtagatcc

SEQ ID NO: 281012 - DNA, 20 bp, human
gggaggggtccagaccgcca

SEQ ID NO: 281013 - DNA, 20 bp, human
ggaggttagaggccctgtta

SEQ ID NO: 281014 - DNA, 20 bp, human
gcgggctcgcggcacgtggt

SEQ ID NO: 281015 - DNA, 20 bp, human
gcggcgcctcgtagccttgg

SEQ ID NO: 281016 - DNA, 20 bp, human
gtcagctctcccggtatctg

SEQ ID NO: 281017 - DNA, 20 bp, human
gaggggcggagctcccctgg

SEQ ID NO: 281018 - DNA, 20 bp, human
ggcgaggggcggagctcccc

SEQ ID NO: 281019 - DNA, 20 bp, human
ggctttgagcgtcccgggtt

SEQ ID NO: 281020 - DNA, 20 bp, human
gacccccggccggagacaaa

SEQ ID NO: 281021 - DNA, 20 bp, human
gaactggcagcatagctcct

SEQ ID NO: 281022 - DNA, 20 bp, human
gcgctcaaagccccagatac

SEQ ID NO: 281023 - DNA, 20 bp, human
gttggggcaagcggctggat

SEQ ID NO: 281024 - DNA, 20 bp, human
gccgccactccgtccctcaa

SEQ ID NO: 281025 - DNA, 20 bp, human
gttcccgaggatctgacccc

SEQ ID NO: 281026 - DNA, 20 bp, human
ggggccggatgccctatgag

SEQ ID NO: 281027 - DNA, 20 bp, human
gggagggcggggcccgcaag

SEQ ID NO: 281028 - DNA, 20 bp, human
gcacgcgtcctggacctcat

SEQ ID NO: 281029 - DNA, 20 bp, human
gcgcctggccggccttccat

SEQ ID NO: 281030 - DNA, 20 bp, human
gttgagcagccgctgggcga

SEQ ID NO: 281031 - DNA, 20 bp, human
gcgcaaggggaggtgacgca

SEQ ID NO: 281032 - DNA, 20 bp, human
gccggcggctcgccaaccat

SEQ ID NO: 281033 - DNA, 20 bp, human
gtgccctatgagcggcagag

SEQ ID NO: 281034 - DNA, 20 bp, human
gaggacgcgtgcggggaggc

SEQ ID NO: 281035 - DNA, 20 bp, human
ggaacgcggccgtgagggtg

SEQ ID NO: 281036 - DNA, 20 bp, human
gcggccgagacggggtggaa

SEQ ID NO: 281037 - DNA, 20 bp, human
gacagggttcggccgagacg

SEQ ID NO: 281038 - DNA, 20 bp, human
gcggggagggccgagaggca

SEQ ID NO: 281039 - DNA, 20 bp, human
ggctgcgggcaaggggaagg

SEQ ID NO: 281040 - DNA, 20 bp, human
ggggccgagtatggatgctg

SEQ ID NO: 281041 - DNA, 20 bp, human
gtctcggccgaaccctgtgc

SEQ ID NO: 281042 - DNA, 20 bp, human
gcccctgggaatctatcccc

SEQ ID NO: 281043 - DNA, 20 bp, human
gcgccctcccgcggtcgggg

SEQ ID NO: 281044 - DNA, 20 bp, human
gcccctccccgaccgcggga

SEQ ID NO: 281045 - DNA, 20 bp, human
ggctgtcacgatggcgtcgc

SEQ ID NO: 281046 - DNA, 20 bp, human
gcgcctgtgagctcgcggtg

SEQ ID NO: 281047 - DNA, 20 bp, human
gagccacaccgcgagctcac

SEQ ID NO: 281048 - DNA, 20 bp, human
gggtgagtacagcgcgtcga

SEQ ID NO: 281049 - DNA, 20 bp, human
gtcgacggcggaggcgggaa

SEQ ID NO: 281050 - DNA, 20 bp, human
gaagggcggagtttgagaaa

SEQ ID NO: 281051 - DNA, 20 bp, human
gaggggctgcgtccaatgag

SEQ ID NO: 281052 - DNA, 20 bp, human
ggctagggactggctgaaga

SEQ ID NO: 281053 - DNA, 20 bp, human
gaccgaaggcggctagggac

SEQ ID NO: 281054 - DNA, 20 bp, human
gggcggaggccgaccgaagg

SEQ ID NO: 281055 - DNA, 20 bp, human
gtacagcgcgtcgacggcgg

SEQ ID NO: 281056 - DNA, 20 bp, human
ggtcccccagtgcattacag

SEQ ID NO: 281057 - DNA, 20 bp, human
ggccctgggacacaccaccc

SEQ ID NO: 281058 - DNA, 20 bp, human
gcggccgggtaggatgacaa

SEQ ID NO: 281059 - DNA, 20 bp, human
gtggccgcgcgcggtgtctg

SEQ ID NO: 281060 - DNA, 20 bp, human
gggtgcagtgtctgccgggg

SEQ ID NO: 281061 - DNA, 20 bp, human
ggcaccgcgcggcgcacagg

SEQ ID NO: 281062 - DNA, 20 bp, human
ggccggggtggtgtgtccca

SEQ ID NO: 281063 - DNA, 20 bp, human
gcgcgcggtgcagtgtctgc

SEQ ID NO: 281064 - DNA, 20 bp, human
ggggccgcagacaccgcgcg

SEQ ID NO: 281065 - DNA, 20 bp, human
gaccgcgcgcggccagatcg

SEQ ID NO: 281066 - DNA, 20 bp, human
gccccatcctattgaaggaa

SEQ ID NO: 281067 - DNA, 20 bp, human
gcaccgctgcggccgatcag

SEQ ID NO: 281068 - DNA, 20 bp, human
gccccgtagggcaacaagga

SEQ ID NO: 281069 - DNA, 20 bp, human
gtcccagcatgctgtgaaac

SEQ ID NO: 281070 - DNA, 20 bp, human
gaactgtggtcactaaatga

SEQ ID NO: 281071 - DNA, 20 bp, human
gggcgatctcaagaatagga

SEQ ID NO: 281072 - DNA, 20 bp, human
gaaatgaggggagtctggtc

SEQ ID NO: 281073 - DNA, 20 bp, human
gccttcaataggatggggag

SEQ ID NO: 281074 - DNA, 20 bp, human
gcgatcagaggagcaggaac

SEQ ID NO: 281075 - DNA, 20 bp, human
gtcatctcaaatggccccgt

SEQ ID NO: 281076 - DNA, 20 bp, human
gtcaagcatggccgagtgat

SEQ ID NO: 281077 - DNA, 20 bp, human
ggtcggcctgagccaaaaat

SEQ ID NO: 281078 - DNA, 20 bp, human
gcaacaacagcatggcccac

SEQ ID NO: 281079 - DNA, 20 bp, human
gtggacagctgggtttgctg

SEQ ID NO: 281080 - DNA, 20 bp, human
ggtaaagcaagcttcgagag

SEQ ID NO: 281081 - DNA, 20 bp, human
gaagaatcataattctaaga

SEQ ID NO: 281082 - DNA, 20 bp, human
ggccatgcttgacctatttt

SEQ ID NO: 281083 - DNA, 20 bp, human
ggccctgcgatagagaatta

SEQ ID NO: 281084 - DNA, 20 bp, human
gacagaaatagaacaatggt

SEQ ID NO: 281085 - DNA, 20 bp, human
gcttgacctatttttggctc

SEQ ID NO: 281086 - DNA, 20 bp, human
gagaccaattggaatgttga

SEQ ID NO: 281087 - DNA, 20 bp, human
gccacaaggcagaagttaag

SEQ ID NO: 281088 - DNA, 20 bp, human
gaacttctgccttgtggaag

SEQ ID NO: 281089 - DNA, 20 bp, human
ggtggggaagcctttatcaa

SEQ ID NO: 281090 - DNA, 20 bp, human
gtcacaaagcataatgtgtg

SEQ ID NO: 281091 - DNA, 20 bp, human
gtgggtaggtgggagaacca

SEQ ID NO: 281092 - DNA, 20 bp, human
ggttgagggaaaaccccatg

SEQ ID NO: 281093 - DNA, 20 bp, human
gagcacaattagaatagagc

SEQ ID NO: 281094 - DNA, 20 bp, human
ggaagcctttatcaatgggt

SEQ ID NO: 281095 - DNA, 20 bp, human
gtcgtcgttgggttagcaac

SEQ ID NO: 281096 - DNA, 20 bp, human
gtagaccagaataaggccaa

SEQ ID NO: 281097 - DNA, 20 bp, human
gtcaagagagccaggataaa

SEQ ID NO: 281098 - DNA, 20 bp, human
gactttgaagggcggagcta

SEQ ID NO: 281099 - DNA, 20 bp, human
gttagaagcgccttttatcc

SEQ ID NO: 281100 - DNA, 20 bp, human
gctggaggaagggactttga

SEQ ID NO: 281101 - DNA, 20 bp, human
gaggaagggactttgaaggg

SEQ ID NO: 281102 - DNA, 20 bp, human
ggctctattgtctgaatcca

SEQ ID NO: 281103 - DNA, 20 bp, human
ggccccctgtgcccaggaac

SEQ ID NO: 281104 - DNA, 20 bp, human
gtggaattaattaaacctgg

SEQ ID NO: 281105 - DNA, 20 bp, human
gttgactggtcaagagagcc

SEQ ID NO: 281106 - DNA, 20 bp, human
ggccatgcggccaccgaccc

SEQ ID NO: 281107 - DNA, 20 bp, human
gacggggaggagcttcgccg

SEQ ID NO: 281108 - DNA, 20 bp, human
gaccgtgagaatatggagga

SEQ ID NO: 281109 - DNA, 20 bp, human
ggtcggtggccgcatggctt

SEQ ID NO: 281110 - DNA, 20 bp, human
ggaaaaccgtgagaatatgg

SEQ ID NO: 281111 - DNA, 20 bp, human
ggcggcctgctccgcccagc

SEQ ID NO: 281112 - DNA, 20 bp, human
ggcccaagcagcggacacca

SEQ ID NO: 281113 - DNA, 20 bp, human
gtgagaaaaccgtgagaata

SEQ ID NO: 281114 - DNA, 20 bp, human
ggcaaggtgtctgccactga

SEQ ID NO: 281115 - DNA, 20 bp, human
gttgggcattgctccgtcag

SEQ ID NO: 281116 - DNA, 20 bp, human
gctctgactctgagggtgtg

SEQ ID NO: 281117 - DNA, 20 bp, human
gcccctgcggccgcagtcgt

SEQ ID NO: 281118 - DNA, 20 bp, human
gctccagaggaattcatctg

SEQ ID NO: 281119 - DNA, 20 bp, human
gtgccccagatgaattcctc

SEQ ID NO: 281120 - DNA, 20 bp, human
ggcgcagagagcaagtgatg

SEQ ID NO: 281121 - DNA, 20 bp, human
gatcgtggaggctaattcag

SEQ ID NO: 281122 - DNA, 20 bp, human
gcgcgcgatgggctctgagg

SEQ ID NO: 281123 - DNA, 20 bp, human
gcggatggggccgacgactg

SEQ ID NO: 281124 - DNA, 20 bp, human
gacagagcacactgagctgg

SEQ ID NO: 281125 - DNA, 20 bp, human
gcggggaggcccggggatcg

SEQ ID NO: 281126 - DNA, 20 bp, human
gccaacccggagccgcctga

SEQ ID NO: 281127 - DNA, 20 bp, human
gtgcacgcatcaaaccgccg

SEQ ID NO: 281128 - DNA, 20 bp, human
ggcgggagggagcgcgaggt

SEQ ID NO: 281129 - DNA, 20 bp, human
gtgacggcgcgtggcggcac

SEQ ID NO: 281130 - DNA, 20 bp, human
ggcggctccgggttgggcgt

SEQ ID NO: 281131 - DNA, 20 bp, human
ggccgccacgcgccgtcagg

SEQ ID NO: 281132 - DNA, 20 bp, human
ggcatcaaaccgccgcggga

SEQ ID NO: 281133 - DNA, 20 bp, human
gtgcagcttcttgacgccca

SEQ ID NO: 281134 - DNA, 20 bp, human
gttgggcgttgggccgtggc

SEQ ID NO: 281135 - DNA, 20 bp, human
gcacggcccaacgcccaacc

SEQ ID NO: 281136 - DNA, 20 bp, human
ggggaccggcgccacctaat

SEQ ID NO: 281137 - DNA, 20 bp, human
gaatgggcgggcaacgctcg

SEQ ID NO: 281138 - DNA, 20 bp, human
gtgcgcgcgcgcagtaaggg

SEQ ID NO: 281139 - DNA, 20 bp, human
ggtccgagggtgggtccaac

SEQ ID NO: 281140 - DNA, 20 bp, human
gctagacatcatggcgtccg

SEQ ID NO: 281141 - DNA, 20 bp, human
ggcgttgcccgcccattagg

SEQ ID NO: 281142 - DNA, 20 bp, human
gccaacgggcttcgagtgtt

SEQ ID NO: 281143 - DNA, 20 bp, human
gagcccgttggacccaccct

SEQ ID NO: 281144 - DNA, 20 bp, human
gccagagcggcctagaaagg

SEQ ID NO: 281145 - DNA, 20 bp, human
gagctgggatggccgggtgg

SEQ ID NO: 281146 - DNA, 20 bp, human
ggactctaatgggaggttat

SEQ ID NO: 281147 - DNA, 20 bp, human
ggtaacccagagactctaat

SEQ ID NO: 281148 - DNA, 20 bp, human
gacgctctaagggagtgaag

SEQ ID NO: 281149 - DNA, 20 bp, human
ggagacgaacagacgctcta

SEQ ID NO: 281150 - DNA, 20 bp, human
gttggagcacagcagttaac

SEQ ID NO: 281151 - DNA, 20 bp, human
gccggcccgtgacggccgga

SEQ ID NO: 281152 - DNA, 20 bp, human
gtcagccctccggccgtcac

SEQ ID NO: 281153 - DNA, 20 bp, human
ggccggcaaagccgtcgatc

SEQ ID NO: 281154 - DNA, 20 bp, human
gaggcgaccaataagaacag

SEQ ID NO: 281155 - DNA, 20 bp, human
gtcgatcaggaccacgtgca

SEQ ID NO: 281156 - DNA, 20 bp, human
gaggactatgacccagagga

SEQ ID NO: 281157 - DNA, 20 bp, human
ggcgcgtcaccaccagtcgt

SEQ ID NO: 281158 - DNA, 20 bp, human
gtcactgccgtcggcggggt

SEQ ID NO: 281159 - DNA, 20 bp, human
gccgtcggcggggttggcct

SEQ ID NO: 281160 - DNA, 20 bp, human
gcgtcaccaccagtcgtggg

SEQ ID NO: 281161 - DNA, 20 bp, human
ggaaatccacccacgactgg

SEQ ID NO: 281162 - DNA, 20 bp, human
gggcttcagggttaaacctg

SEQ ID NO: 281163 - DNA, 20 bp, human
gggggaaatccacccacgac

SEQ ID NO: 281164 - DNA, 20 bp, human
ggacggcagtgacgctgacg

SEQ ID NO: 281165 - DNA, 20 bp, human
gtcggcggggttggcctcgg

SEQ ID NO: 281166 - DNA, 20 bp, human
gggggcggccgggtggtgat

SEQ ID NO: 281167 - DNA, 20 bp, human
gcggcccgcgcgggagggaa

SEQ ID NO: 281168 - DNA, 20 bp, human
gcgcgggccggttaattcct

SEQ ID NO: 281169 - DNA, 20 bp, human
gcaggagagggtcgagtcag

SEQ ID NO: 281170 - DNA, 20 bp, human
gacccccagagtggcacgga

SEQ ID NO: 281171 - DNA, 20 bp, human
gttaaccggcccgcgcggga

SEQ ID NO: 281172 - DNA, 20 bp, human
gagagtggcacggacgggag

SEQ ID NO: 281173 - DNA, 20 bp, human
gaaggtcgctgactccggag

SEQ ID NO: 281174 - DNA, 20 bp, human
ggagaacccccagagtggca

SEQ ID NO: 281175 - DNA, 20 bp, human
gggcgagcgccgaacggccg

SEQ ID NO: 281176 - DNA, 20 bp, human
gtaggcagcccaggacgcgc

SEQ ID NO: 281177 - DNA, 20 bp, human
gcagctgcggcgaaagccca

SEQ ID NO: 281178 - DNA, 20 bp, human
gtacaaggggctgtagagtg

SEQ ID NO: 281179 - DNA, 20 bp, human
gccttccgcggcccctcgcc

SEQ ID NO: 281180 - DNA, 20 bp, human
ggagcgccactaggcagccc

SEQ ID NO: 281181 - DNA, 20 bp, human
ggtccaggaccgcaaggagg

SEQ ID NO: 281182 - DNA, 20 bp, human
gtggatcaggggtgtgaatg

SEQ ID NO: 281183 - DNA, 20 bp, human
gtctgcgcacgcgccttccg

SEQ ID NO: 281184 - DNA, 20 bp, human
gcccccagtccctggaccgt

SEQ ID NO: 281185 - DNA, 20 bp, human
gaagtgaggaggaattgatg

SEQ ID NO: 281186 - DNA, 20 bp, human
gggaaagcgggtctccagaa

SEQ ID NO: 281187 - DNA, 20 bp, human
gtggagacccgctttcccaa

SEQ ID NO: 281188 - DNA, 20 bp, human
ggaaatcccgggcgaagggg

SEQ ID NO: 281189 - DNA, 20 bp, human
gcccaagggcgcggcctcct

SEQ ID NO: 281190 - DNA, 20 bp, human
gccgcctcggcggaaatccc

SEQ ID NO: 281191 - DNA, 20 bp, human
gaacccgctgccacactcgt

SEQ ID NO: 281192 - DNA, 20 bp, human
gaggaaggcacggcccgtag

SEQ ID NO: 281193 - DNA, 20 bp, human
ggtaacgctcggttcagcag

SEQ ID NO: 281194 - DNA, 20 bp, human
gccggaagccccggatttcc

SEQ ID NO: 281195 - DNA, 20 bp, human
ggagggacgtcgctgcccga

SEQ ID NO: 281196 - DNA, 20 bp, human
gcagtgaaggcgggtgacag

SEQ ID NO: 281197 - DNA, 20 bp, human
gtgcacagtgagacgaagga

SEQ ID NO: 281198 - DNA, 20 bp, human
gagggtgcggggagggaata

SEQ ID NO: 281199 - DNA, 20 bp, human
ggcgagggcgacgggagatg

SEQ ID NO: 281200 - DNA, 20 bp, human
ggcgaaggtgagggggataa

SEQ ID NO: 281201 - DNA, 20 bp, human
gaggggacggcgagggcgac

SEQ ID NO: 281202 - DNA, 20 bp, human
gtaacggaggcgcgcagtga

SEQ ID NO: 281203 - DNA, 20 bp, human
gcgggagagggcgaaggtga

SEQ ID NO: 281204 - DNA, 20 bp, human
ggctgcggagcggaagggtg

SEQ ID NO: 281205 - DNA, 20 bp, human
gggaggcgcgcagtgaaggc

SEQ ID NO: 281206 - DNA, 20 bp, human
gcgccccgcaagaacccgag

SEQ ID NO: 281207 - DNA, 20 bp, human
ggaaggcggtgccgaggagt

SEQ ID NO: 281208 - DNA, 20 bp, human
gcagaaccacgcctgcagtt

SEQ ID NO: 281209 - DNA, 20 bp, human
ggcaggaaggacggctgctc

SEQ ID NO: 281210 - DNA, 20 bp, human
ggccttccccacccgaaaaa

SEQ ID NO: 281211 - DNA, 20 bp, human
gctgctccctttctggtctt

SEQ ID NO: 281212 - DNA, 20 bp, human
gaccacgcctgcagttgggt

SEQ ID NO: 281213 - DNA, 20 bp, human
gttggggaggtgggcggtac

SEQ ID NO: 281214 - DNA, 20 bp, human
gaacaaccgaagaccagaaa

SEQ ID NO: 281215 - DNA, 20 bp, human
gggcggggaccccagcggcg

SEQ ID NO: 281216 - DNA, 20 bp, human
gtcggaagccggccgcatgg

SEQ ID NO: 281217 - DNA, 20 bp, human
ggaagccggccgcatggggg

SEQ ID NO: 281218 - DNA, 20 bp, human
gggacaacgcggacgactct

SEQ ID NO: 281219 - DNA, 20 bp, human
gtgcgcagaggcggacaacg

SEQ ID NO: 281220 - DNA, 20 bp, human
gggcttgcgcactcggaagc

SEQ ID NO: 281221 - DNA, 20 bp, human
ggcaaaggggcggggtgacg

SEQ ID NO: 281222 - DNA, 20 bp, human
gtcggtcggcgcctgttctc

SEQ ID NO: 281223 - DNA, 20 bp, human
gcactcggaagccggccgca

SEQ ID NO: 281224 - DNA, 20 bp, human
ggccccgcccagcgcgcagg

SEQ ID NO: 281225 - DNA, 20 bp, human
gagcagttggcaaaggggcg

SEQ ID NO: 281226 - DNA, 20 bp, human
gactgtcctgagctgatcgc

SEQ ID NO: 281227 - DNA, 20 bp, human
gatcagctcaggacagtccc

SEQ ID NO: 281228 - DNA, 20 bp, human
gagcccagaacccaagagtt

SEQ ID NO: 281229 - DNA, 20 bp, human
ggtgacgtcacaaaagacag

SEQ ID NO: 281230 - DNA, 20 bp, human
ggaagaggcagtccagttgc

SEQ ID NO: 281231 - DNA, 20 bp, human
ggggagcctgcgatcagctc

SEQ ID NO: 281232 - DNA, 20 bp, human
gcctcccaactcttgggttc

SEQ ID NO: 281233 - DNA, 20 bp, human
gcacaaatcagctacatcta

SEQ ID NO: 281234 - DNA, 20 bp, human
gagagatggctgcctgcaac

SEQ ID NO: 281235 - DNA, 20 bp, human
ggatgtagctgatttgtgtg

SEQ ID NO: 281236 - DNA, 20 bp, human
gccctcagcccgccggactc

SEQ ID NO: 281237 - DNA, 20 bp, human
gaggggcgggctttcgtctc

SEQ ID NO: 281238 - DNA, 20 bp, human
gtcagacttgagcctgagtc

SEQ ID NO: 281239 - DNA, 20 bp, human
ggcagagcagaccgctaaac

SEQ ID NO: 281240 - DNA, 20 bp, human
gggcgctacggcaagtgaag

SEQ ID NO: 281241 - DNA, 20 bp, human
gcgctaaaccggagctacag

SEQ ID NO: 281242 - DNA, 20 bp, human
gacttgagcctgagtccggc

SEQ ID NO: 281243 - DNA, 20 bp, human
ggaagaggttcaagcttgcc

SEQ ID NO: 281244 - DNA, 20 bp, human
gagcttcgcctctgtagctc

SEQ ID NO: 281245 - DNA, 20 bp, human
ggcgtagtgttgaaagctat

SEQ ID NO: 281246 - DNA, 20 bp, human
gcacaggcccacgtgcgcac

SEQ ID NO: 281247 - DNA, 20 bp, human
gtccccgccggtgcgcacgt

SEQ ID NO: 281248 - DNA, 20 bp, human
gcccgcgtcgccggtcacta

SEQ ID NO: 281249 - DNA, 20 bp, human
ggtacagatggggaaggtct

SEQ ID NO: 281250 - DNA, 20 bp, human
ggcgggggttccggcgacag

SEQ ID NO: 281251 - DNA, 20 bp, human
ggccgtggcggccccacacc

SEQ ID NO: 281252 - DNA, 20 bp, human
gaggcccacgtgcgcaccgg

SEQ ID NO: 281253 - DNA, 20 bp, human
ggggaaggacgctggttctg

SEQ ID NO: 281254 - DNA, 20 bp, human
gcgctgtccccctctgtcgc

SEQ ID NO: 281255 - DNA, 20 bp, human
gggacaggacaaggcccagc

SEQ ID NO: 281256 - DNA, 20 bp, human
ggcggggccagcttcggcaa

SEQ ID NO: 281257 - DNA, 20 bp, human
gagcgcgcaggcgtggaaga

SEQ ID NO: 281258 - DNA, 20 bp, human
gggtttaccgggtaagtagg

SEQ ID NO: 281259 - DNA, 20 bp, human
gcgtggaagagggcataggc

SEQ ID NO: 281260 - DNA, 20 bp, human
gtagaatagtaacgccgacc

SEQ ID NO: 281261 - DNA, 20 bp, human
gcggagccttgtgggtttac

SEQ ID NO: 281262 - DNA, 20 bp, human
gcgtctgccgggtcggggtt

SEQ ID NO: 281263 - DNA, 20 bp, human
gactggcgcacggagcgcgc

SEQ ID NO: 281264 - DNA, 20 bp, human
ggcgcgtcgtctgccgggtc

SEQ ID NO: 281265 - DNA, 20 bp, human
gcgcacggcgcgtcgtctgc

SEQ ID NO: 281266 - DNA, 20 bp, human
gactaaaagtacaattagtg

SEQ ID NO: 281267 - DNA, 20 bp, human
gatgaccaagaggctaggtg

SEQ ID NO: 281268 - DNA, 20 bp, human
gtgaaaaataaacctcagcc

SEQ ID NO: 281269 - DNA, 20 bp, human
gttttcaaagaatgaccaag

SEQ ID NO: 281270 - DNA, 20 bp, human
ggccaccacacctagcctct

SEQ ID NO: 281271 - DNA, 20 bp, human
gaacttgtgggttcagtcgg

SEQ ID NO: 281272 - DNA, 20 bp, human
gtggtgtggcctgtaatggg

SEQ ID NO: 281273 - DNA, 20 bp, human
gagtctactcagagaacttg

SEQ ID NO: 281274 - DNA, 20 bp, human
gtggtggtgtggcctgtaat

SEQ ID NO: 281275 - DNA, 20 bp, human
gagttctctgagtagactca

SEQ ID NO: 281276 - DNA, 20 bp, human
gtgggcgctcgatggctcgg

SEQ ID NO: 281277 - DNA, 20 bp, human
gtgccagagtgggcgctcga

SEQ ID NO: 281278 - DNA, 20 bp, human
gtggcggggccttggaccag

SEQ ID NO: 281279 - DNA, 20 bp, human
ggtggccggaaagctctcag

SEQ ID NO: 281280 - DNA, 20 bp, human
gggtccaaggccccgccagc

SEQ ID NO: 281281 - DNA, 20 bp, human
gcagctctgggacacctaaa

SEQ ID NO: 281282 - DNA, 20 bp, human
ggcgccgggccgctggtcca

SEQ ID NO: 281283 - DNA, 20 bp, human
gcagtcacgcctgccagagt

SEQ ID NO: 281284 - DNA, 20 bp, human
gcaccgcgggagctagcgat

SEQ ID NO: 281285 - DNA, 20 bp, human
gtgcggcccaagttaggatt

SEQ ID NO: 281286 - DNA, 20 bp, human
gtctgcactaggaaactggt

SEQ ID NO: 281287 - DNA, 20 bp, human
gaagtccgacgctggtcggt

SEQ ID NO: 281288 - DNA, 20 bp, human
gaggtccggaagtccgacgc

SEQ ID NO: 281289 - DNA, 20 bp, human
gtggaaattcgcggcgggtg

SEQ ID NO: 281290 - DNA, 20 bp, human
ggctctacggcgctgaaccg

SEQ ID NO: 281291 - DNA, 20 bp, human
gtgcgcccaccgaccagcgt

SEQ ID NO: 281292 - DNA, 20 bp, human
gggaagagcgcttgcgcgga

SEQ ID NO: 281293 - DNA, 20 bp, human
ggggtggggataggaggacg

SEQ ID NO: 281294 - DNA, 20 bp, human
ggtaagagagctgtcaggta

SEQ ID NO: 281295 - DNA, 20 bp, human
ggggcatccgggtctcttgg

SEQ ID NO: 281296 - DNA, 20 bp, human
gactacgggactcctccgac

SEQ ID NO: 281297 - DNA, 20 bp, human
gcggaggagtcccgtagtca

SEQ ID NO: 281298 - DNA, 20 bp, human
gccccagtccggtctaaaaa

SEQ ID NO: 281299 - DNA, 20 bp, human
gagaggggtttccatgacta

SEQ ID NO: 281300 - DNA, 20 bp, human
ggcatctgcagggtaccggt

SEQ ID NO: 281301 - DNA, 20 bp, human
gctagagcgcgcggaacggg

SEQ ID NO: 281302 - DNA, 20 bp, human
ggaactagagcgcgcggaac

SEQ ID NO: 281303 - DNA, 20 bp, human
gtctgcagggtaccggtcgg

SEQ ID NO: 281304 - DNA, 20 bp, human
gagaccggactggggctcag

SEQ ID NO: 281305 - DNA, 20 bp, human
gacaagcatctgcagggtac

SEQ ID NO: 281306 - DNA, 20 bp, human
gcagcccggcggtgaggcaa

SEQ ID NO: 281307 - DNA, 20 bp, human
ggggcgggacggcgaggtga

SEQ ID NO: 281308 - DNA, 20 bp, human
gggcgggtcagtgatgcgaa

SEQ ID NO: 281309 - DNA, 20 bp, human
gcagcagtgcggtgaggcga

SEQ ID NO: 281310 - DNA, 20 bp, human
ggcggggcggcaattcagcc

SEQ ID NO: 281311 - DNA, 20 bp, human
ggggtcagtgatgcgaaggg

SEQ ID NO: 281312 - DNA, 20 bp, human
ggtgaggcgagggtgcgagg

SEQ ID NO: 281313 - DNA, 20 bp, human
ggccagagggcgtggctaga

SEQ ID NO: 281314 - DNA, 20 bp, human
ggggcggcaattcagcccgg

SEQ ID NO: 281315 - DNA, 20 bp, human
gagagggcgtggctagaggg

SEQ ID NO: 281316 - DNA, 20 bp, human
gggacctaggacaacttctt

SEQ ID NO: 281317 - DNA, 20 bp, human
ggaagtgcctcaaaagaagg

SEQ ID NO: 281318 - DNA, 20 bp, human
ggctccctgtcgccgcggag

SEQ ID NO: 281319 - DNA, 20 bp, human
gcggggccggctcacgaccc

SEQ ID NO: 281320 - DNA, 20 bp, human
gggtccagaggcagacgcat

SEQ ID NO: 281321 - DNA, 20 bp, human
ggcccctgcccgcactcctg

SEQ ID NO: 281322 - DNA, 20 bp, human
ggtggccccgcgggcagtag

SEQ ID NO: 281323 - DNA, 20 bp, human
gcgctgggacaccctcgagg

SEQ ID NO: 281324 - DNA, 20 bp, human
gggcgggccgaagcgaggtg

SEQ ID NO: 281325 - DNA, 20 bp, human
gagggtctggggtcctgtcg

SEQ ID NO: 281326 - DNA, 20 bp, human
gaggcccgggtggggacgcc

SEQ ID NO: 281327 - DNA, 20 bp, human
gccctcccgtgacgacactg

SEQ ID NO: 281328 - DNA, 20 bp, human
ggggcgtgacgtcacgcggg

SEQ ID NO: 281329 - DNA, 20 bp, human
gcagccgtgaggtcacctgg

SEQ ID NO: 281330 - DNA, 20 bp, human
gcgtgacgacactggggatt

SEQ ID NO: 281331 - DNA, 20 bp, human
gcatccaggcgtccccaccc

SEQ ID NO: 281332 - DNA, 20 bp, human
ggcggggcgtgacgtcacgc

SEQ ID NO: 281333 - DNA, 20 bp, human
ggagtccaggaggcccgggt

SEQ ID NO: 281334 - DNA, 20 bp, human
gggcatgtggagttcttcgg

SEQ ID NO: 281335 - DNA, 20 bp, human
gggcggtcccgtcagccgtg

SEQ ID NO: 281336 - DNA, 20 bp, human
gacggccgaccgccgcgcag

SEQ ID NO: 281337 - DNA, 20 bp, human
gcgacgcggcgtacccggtt

SEQ ID NO: 281338 - DNA, 20 bp, human
ggcgcgaggagggaagatcg

SEQ ID NO: 281339 - DNA, 20 bp, human
ggacggcgacgcggcgtacc

SEQ ID NO: 281340 - DNA, 20 bp, human
gactgacagggaagcgaaaa

SEQ ID NO: 281341 - DNA, 20 bp, human
ggtttggcgcccctgcgcgg

SEQ ID NO: 281342 - DNA, 20 bp, human
ggaagtgcgtcgcgtaagga

SEQ ID NO: 281343 - DNA, 20 bp, human
gcacgcacgtccagcttgct

SEQ ID NO: 281344 - DNA, 20 bp, human
ggccgtgcgacgccctccgc

SEQ ID NO: 281345 - DNA, 20 bp, human
gcggagcaaatccactcccc

SEQ ID NO: 281346 - DNA, 20 bp, human
ggggccctcggggttgacga

SEQ ID NO: 281347 - DNA, 20 bp, human
gcgcgccagccccgcggacg

SEQ ID NO: 281348 - DNA, 20 bp, human
gcccggggctcgcgcgtcgc

SEQ ID NO: 281349 - DNA, 20 bp, human
gtccccctcgtcaaccccga

SEQ ID NO: 281350 - DNA, 20 bp, human
ggaaacctgtgggacctgtg

SEQ ID NO: 281351 - DNA, 20 bp, human
ggcgagagcaagaaacctgt

SEQ ID NO: 281352 - DNA, 20 bp, human
gggccagggccgtccgtgaa

SEQ ID NO: 281353 - DNA, 20 bp, human
gcggcagcggcggctagaag

SEQ ID NO: 281354 - DNA, 20 bp, human
gctcctgcgcggcccgggtg

SEQ ID NO: 281355 - DNA, 20 bp, human
ggtggggagccgcgtccgcg

SEQ ID NO: 281356 - DNA, 20 bp, human
gggcacagagataagtaata

SEQ ID NO: 281357 - DNA, 20 bp, human
gaccccagctctcactgtat

SEQ ID NO: 281358 - DNA, 20 bp, human
gaagtaatatggttgagtgt

SEQ ID NO: 281359 - DNA, 20 bp, human
gagtccagaacatacggcaa

SEQ ID NO: 281360 - DNA, 20 bp, human
gtggtgggaagctctgtccg

SEQ ID NO: 281361 - DNA, 20 bp, human
gcagcagattcgctgggagt

SEQ ID NO: 281362 - DNA, 20 bp, human
gtccaatacagtgagagctg

SEQ ID NO: 281363 - DNA, 20 bp, human
gtagaatggtgacttgaatg

SEQ ID NO: 281364 - DNA, 20 bp, human
ggggagtccagcagattcgc

SEQ ID NO: 281365 - DNA, 20 bp, human
ggggtttggtcggctgggtt

SEQ ID NO: 281366 - DNA, 20 bp, human
gccggcggaggtcaggccga

SEQ ID NO: 281367 - DNA, 20 bp, human
ggggctcccggcatgcctcg

SEQ ID NO: 281368 - DNA, 20 bp, human
ggaagcggcgtcctcttccc

SEQ ID NO: 281369 - DNA, 20 bp, human
gaagggctaggcggacgtcc

SEQ ID NO: 281370 - DNA, 20 bp, human
gacccgggtggcctcgtccg

SEQ ID NO: 281371 - DNA, 20 bp, human
gcaggcggcagcgaagggct

SEQ ID NO: 281372 - DNA, 20 bp, human
gtccgcggacgaggccaccc

SEQ ID NO: 281373 - DNA, 20 bp, human
gctggcgcgctgcaaagcca

SEQ ID NO: 281374 - DNA, 20 bp, human
ggctaccctgaatggccagg

SEQ ID NO: 281375 - DNA, 20 bp, human
gaagccagggctaccctgaa

SEQ ID NO: 281376 - DNA, 20 bp, human
gtaggcgggtaccctgtgac

SEQ ID NO: 281377 - DNA, 20 bp, human
gaggaaagtgtctaagacag

SEQ ID NO: 281378 - DNA, 20 bp, human
ggccaagaacacctgtcaca

SEQ ID NO: 281379 - DNA, 20 bp, human
gcaaaagggccgaggagcca

SEQ ID NO: 281380 - DNA, 20 bp, human
gcggtacagacactctaggc

SEQ ID NO: 281381 - DNA, 20 bp, human
ggatgcggtacagacactct

SEQ ID NO: 281382 - DNA, 20 bp, human
gagcaagcccggcttgtggt

SEQ ID NO: 281383 - DNA, 20 bp, human
ggaggagccagggttggtgt

SEQ ID NO: 281384 - DNA, 20 bp, human
gtgctgggtgttggaaggat

SEQ ID NO: 281385 - DNA, 20 bp, human
gaacacccagcacgcgtact

SEQ ID NO: 281386 - DNA, 20 bp, human
gccctggagccggggatgga

SEQ ID NO: 281387 - DNA, 20 bp, human
gtcaccgcccgggaacgtgg

SEQ ID NO: 281388 - DNA, 20 bp, human
gccccctacgcgctgaaatt

SEQ ID NO: 281389 - DNA, 20 bp, human
gaatgccctggagccgggga

SEQ ID NO: 281390 - DNA, 20 bp, human
gacaatgcagcaaaatccga

SEQ ID NO: 281391 - DNA, 20 bp, human
gacagagacaccgcgcatca

SEQ ID NO: 281392 - DNA, 20 bp, human
gtacgcgctgaaattcggca

SEQ ID NO: 281393 - DNA, 20 bp, human
gctacccccacgttcccggg

SEQ ID NO: 281394 - DNA, 20 bp, human
gctgctacccccacgttccc

SEQ ID NO: 281395 - DNA, 20 bp, human
gttcggcagggaagaagtta

SEQ ID NO: 281396 - DNA, 20 bp, human
ggggccgtggcgtaacccgg

SEQ ID NO: 281397 - DNA, 20 bp, human
gctcccgcccgcgctcggga

SEQ ID NO: 281398 - DNA, 20 bp, human
gtcggccacaaacctcccgg

SEQ ID NO: 281399 - DNA, 20 bp, human
gacaaacctcccggaggcgc

SEQ ID NO: 281400 - DNA, 20 bp, human
gtcggcgcctggagagcgag

SEQ ID NO: 281401 - DNA, 20 bp, human
gcggacgcccggcacccggg

SEQ ID NO: 281402 - DNA, 20 bp, human
gggtggcgacgcaggcgggt

SEQ ID NO: 281403 - DNA, 20 bp, human
ggctgactcgacacaatcgg

SEQ ID NO: 281404 - DNA, 20 bp, human
gccggcgccctcccgagcgc

SEQ ID NO: 281405 - DNA, 20 bp, human
gcgctcggccacaaacctcc

SEQ ID NO: 281406 - DNA, 20 bp, human
ggccagccagcgacccgccc

SEQ ID NO: 281407 - DNA, 20 bp, human
ggctacatgctaattagccc

SEQ ID NO: 281408 - DNA, 20 bp, human
gacatgctaattagcccggg

SEQ ID NO: 281409 - DNA, 20 bp, human
gggcccgggacagcgggatg

SEQ ID NO: 281410 - DNA, 20 bp, human
gcggctcccgataacttttg

SEQ ID NO: 281411 - DNA, 20 bp, human
gtgacatcaccggccccgcg

SEQ ID NO: 281412 - DNA, 20 bp, human
gagccgcgggagggctgccg

SEQ ID NO: 281413 - DNA, 20 bp, human
gattagcccgggcgggtcgc

SEQ ID NO: 281414 - DNA, 20 bp, human
gtgacctcatcccgctgtcc

SEQ ID NO: 281415 - DNA, 20 bp, human
ggctccagagtcttctgaat

SEQ ID NO: 281416 - DNA, 20 bp, human
ggcggggcaaggcgggttag

SEQ ID NO: 281417 - DNA, 20 bp, human
ggaggggagggcatgtggaa

SEQ ID NO: 281418 - DNA, 20 bp, human
ggggcaaggcgggttagggg

SEQ ID NO: 281419 - DNA, 20 bp, human
gagcgtacataaaacctgaa

SEQ ID NO: 281420 - DNA, 20 bp, human
gccaggaattgccgagggga

SEQ ID NO: 281421 - DNA, 20 bp, human
ggtgctgggcggtgattatc

SEQ ID NO: 281422 - DNA, 20 bp, human
gtgggacgaaatcagcgctg

SEQ ID NO: 281423 - DNA, 20 bp, human
gggcaattcctggaaacttg

SEQ ID NO: 281424 - DNA, 20 bp, human
gctcctgcggagagagaacg

SEQ ID NO: 281425 - DNA, 20 bp, human
gttacagtcgtagaactgat

SEQ ID NO: 281426 - DNA, 20 bp, human
gagggcgggtggggaatgta

SEQ ID NO: 281427 - DNA, 20 bp, human
gccacctcgcccaatctcac

SEQ ID NO: 281428 - DNA, 20 bp, human
gaaatctcgcgcagcggggc

SEQ ID NO: 281429 - DNA, 20 bp, human
gtacaggctgagttcggcag

SEQ ID NO: 281430 - DNA, 20 bp, human
gaatctcacaggatagttac

SEQ ID NO: 281431 - DNA, 20 bp, human
gtctctacctacaggatcat

SEQ ID NO: 281432 - DNA, 20 bp, human
gaggtccaggtaaaggttta

SEQ ID NO: 281433 - DNA, 20 bp, human
ggcagcttgcggttttcgtc

SEQ ID NO: 281434 - DNA, 20 bp, human
gctgagagaggtccaggtaa

SEQ ID NO: 281435 - DNA, 20 bp, human
gcgctagcccatgatcctgt

SEQ ID NO: 281436 - DNA, 20 bp, human
gggtcctcagcgttctcctg

SEQ ID NO: 281437 - DNA, 20 bp, human
ggtgacctgccgcgtaggga

SEQ ID NO: 281438 - DNA, 20 bp, human
gctcctgcggaacctttgaa

SEQ ID NO: 281439 - DNA, 20 bp, human
gctacgcggcaggtcacgtg

SEQ ID NO: 281440 - DNA, 20 bp, human
gaaacctcacctactctcgc

SEQ ID NO: 281441 - DNA, 20 bp, human
gagcagcggaaggggccttt

SEQ ID NO: 281442 - DNA, 20 bp, human
gcaggggaagagcagcggaa

SEQ ID NO: 281443 - DNA, 20 bp, human
gggacccgcgagagtaggtg

SEQ ID NO: 281444 - DNA, 20 bp, human
gggggtactcgagcccacag

SEQ ID NO: 281445 - DNA, 20 bp, human
ggtcacgtgaggcttatgat

SEQ ID NO: 281446 - DNA, 20 bp, human
gtcagcggtgggactaaaag

SEQ ID NO: 281447 - DNA, 20 bp, human
gaaaaggaggcggtaaactg

SEQ ID NO: 281448 - DNA, 20 bp, human
gcaagcgcctgcagcagtcg

SEQ ID NO: 281449 - DNA, 20 bp, human
gaatccacgtggcccttcaa

SEQ ID NO: 281450 - DNA, 20 bp, human
gaggcgacactgttttgtga

SEQ ID NO: 281451 - DNA, 20 bp, human
gcactcggcgctgggacggc

SEQ ID NO: 281452 - DNA, 20 bp, human
gctcgggcgggaaaaggagg

SEQ ID NO: 281453 - DNA, 20 bp, human
gcggcggaacagcctattaa

SEQ ID NO: 281454 - DNA, 20 bp, human
ggcccccagctcgcccccct

SEQ ID NO: 281455 - DNA, 20 bp, human
gatcatgtgagactcagcgg

SEQ ID NO: 281456 - DNA, 20 bp, human
gccacccggggcaactttcc

SEQ ID NO: 281457 - DNA, 20 bp, human
gccgcccggaaagttgcccc

SEQ ID NO: 281458 - DNA, 20 bp, human
gcggggtcggcagtccaccc

SEQ ID NO: 281459 - DNA, 20 bp, human
ggccccggggcggtttccca

SEQ ID NO: 281460 - DNA, 20 bp, human
gcgggcggcaaggaaacctc

SEQ ID NO: 281461 - DNA, 20 bp, human
gaggcgagaggaccgggcgt

SEQ ID NO: 281462 - DNA, 20 bp, human
ggcggcgaggcgagaggacc

SEQ ID NO: 281463 - DNA, 20 bp, human
gcctcgccgcgttcctgccc

SEQ ID NO: 281464 - DNA, 20 bp, human
gcggcctctgaaggcgaccc

SEQ ID NO: 281465 - DNA, 20 bp, human
ggtctgcccgggcaggaacg

SEQ ID NO: 281466 - DNA, 20 bp, human
ggggaagcgccagcgagcag

SEQ ID NO: 281467 - DNA, 20 bp, human
ggaagggccagcgccgtcga

SEQ ID NO: 281468 - DNA, 20 bp, human
gcccgctgcgagggaacctc

SEQ ID NO: 281469 - DNA, 20 bp, human
ggaggacgcccctccctgaa

SEQ ID NO: 281470 - DNA, 20 bp, human
ggggccagcgccgtcgaagg

SEQ ID NO: 281471 - DNA, 20 bp, human
gggcgctggcccttcaggga

SEQ ID NO: 281472 - DNA, 20 bp, human
gaggggcgtcctctgctcgc

SEQ ID NO: 281473 - DNA, 20 bp, human
gggcgtctctggtgtgtgaa

SEQ ID NO: 281474 - DNA, 20 bp, human
gtggacggggcgtggggccc

SEQ ID NO: 281475 - DNA, 20 bp, human
gccagcgccgtcgaaggcgg

SEQ ID NO: 281476 - DNA, 20 bp, human
ggcggcccacatcatggtga

SEQ ID NO: 281477 - DNA, 20 bp, human
gccagggtgccgtcctcgtc

SEQ ID NO: 281478 - DNA, 20 bp, human
ggtgctggctgccaccgcag

SEQ ID NO: 281479 - DNA, 20 bp, human
gctgtcctacgaggaggcgg

SEQ ID NO: 281480 - DNA, 20 bp, human
ggctgcgccggcaccgcctg

SEQ ID NO: 281481 - DNA, 20 bp, human
ggccctgtgtgagaagcatg

SEQ ID NO: 281482 - DNA, 20 bp, human
gtccccatgcttctcacaca

SEQ ID NO: 281483 - DNA, 20 bp, human
ggtgcagtgacaggggcacc

SEQ ID NO: 281484 - DNA, 20 bp, human
gacctcctccgcctcctcgt

SEQ ID NO: 281485 - DNA, 20 bp, human
ggtgggccgcgcggaagccc

SEQ ID NO: 281486 - DNA, 20 bp, human
gacactgcacaggtgtgagt

SEQ ID NO: 281487 - DNA, 20 bp, human
gaggcgggaagtcaagtgac

SEQ ID NO: 281488 - DNA, 20 bp, human
gtgtgagtaggggaaatggc

SEQ ID NO: 281489 - DNA, 20 bp, human
gtaaatagcaacctatgcta

SEQ ID NO: 281490 - DNA, 20 bp, human
gccaaaagagtgctgactag

SEQ ID NO: 281491 - DNA, 20 bp, human
gtgctagcaacccctagcat

SEQ ID NO: 281492 - DNA, 20 bp, human
gcccgcctaaaagttttatc

SEQ ID NO: 281493 - DNA, 20 bp, human
gctggttggaccacaactgc

SEQ ID NO: 281494 - DNA, 20 bp, human
gatcggatccagacacttcc

SEQ ID NO: 281495 - DNA, 20 bp, human
gctagaggctgtgccatgcc

SEQ ID NO: 281496 - DNA, 20 bp, human
ggagacccctgcggatgggt

SEQ ID NO: 281497 - DNA, 20 bp, human
gcctccccacccatccgcag

SEQ ID NO: 281498 - DNA, 20 bp, human
gccaggagacccctgcggat

SEQ ID NO: 281499 - DNA, 20 bp, human
ggggcgggttccagtgttga

SEQ ID NO: 281500 - DNA, 20 bp, human
gagctcggagcaatcccctt

SEQ ID NO: 281501 - DNA, 20 bp, human
gccggcggggaccagatgtc

SEQ ID NO: 281502 - DNA, 20 bp, human
ggggtggagctgtgcatggg

SEQ ID NO: 281503 - DNA, 20 bp, human
ggcaggcctgcgagcgtaga

SEQ ID NO: 281504 - DNA, 20 bp, human
ggcggggaccagatgtccgg

SEQ ID NO: 281505 - DNA, 20 bp, human
gagtcggccgaccccctggt

SEQ ID NO: 281506 - DNA, 20 bp, human
gtgctctgggatgaaagcgg

SEQ ID NO: 281507 - DNA, 20 bp, human
gggcgcaggggtcctcgcca

SEQ ID NO: 281508 - DNA, 20 bp, human
gcgccgagctccgtccctct

SEQ ID NO: 281509 - DNA, 20 bp, human
gcggacgcgctcggagttgg

SEQ ID NO: 281510 - DNA, 20 bp, human
gcagaccgcgagccggaagg

SEQ ID NO: 281511 - DNA, 20 bp, human
gcagtccacgggggccttaa

SEQ ID NO: 281512 - DNA, 20 bp, human
gaggcccccgtggactgctc

SEQ ID NO: 281513 - DNA, 20 bp, human
gcggagctcggcgcaccatg

SEQ ID NO: 281514 - DNA, 20 bp, human
gagcctagagggacggagct

SEQ ID NO: 281515 - DNA, 20 bp, human
gctagcgtgcggctgcgacg

SEQ ID NO: 281516 - DNA, 20 bp, human
gcttccaaactggggatgta

SEQ ID NO: 281517 - DNA, 20 bp, human
gtgggctcagagcactgagc

SEQ ID NO: 281518 - DNA, 20 bp, human
gctcagggagaaggagtgtt

SEQ ID NO: 281519 - DNA, 20 bp, human
gctagaaaatgccaggtctg

SEQ ID NO: 281520 - DNA, 20 bp, human
gctgccggtgccccccatgt

SEQ ID NO: 281521 - DNA, 20 bp, human
gagttggcagggttgtgttc

SEQ ID NO: 281522 - DNA, 20 bp, human
gcagagctctgtgtattcag

SEQ ID NO: 281523 - DNA, 20 bp, human
gtccaactcaggttccaaca

SEQ ID NO: 281524 - DNA, 20 bp, human
gaagccctacatccccagtt

SEQ ID NO: 281525 - DNA, 20 bp, human
gtggaagcaggtatctgctt

SEQ ID NO: 281526 - DNA, 20 bp, human
ggagcacaggatagtcacgg

SEQ ID NO: 281527 - DNA, 20 bp, human
gcactcaggcatttgttcag

SEQ ID NO: 281528 - DNA, 20 bp, human
gagcatgcgcagacggaggc

SEQ ID NO: 281529 - DNA, 20 bp, human
gagctccctaggaagagcac

SEQ ID NO: 281530 - DNA, 20 bp, human
gtctggcccaatacccaaaa

SEQ ID NO: 281531 - DNA, 20 bp, human
gtatgagcatgcgcagacgg

SEQ ID NO: 281532 - DNA, 20 bp, human
gaatctatgtggtcctaaga

SEQ ID NO: 281533 - DNA, 20 bp, human
gggaggcggcagtgttgata

SEQ ID NO: 281534 - DNA, 20 bp, human
gctatcctgtgctcttccta

SEQ ID NO: 281535 - DNA, 20 bp, human
gcaggatagtcacgggggtt

SEQ ID NO: 281536 - DNA, 20 bp, human
gtgtgtatacaaaggacaca

SEQ ID NO: 281537 - DNA, 20 bp, human
ggctgctggtttatttgcta

SEQ ID NO: 281538 - DNA, 20 bp, human
ggctagggaaattagcagtg

SEQ ID NO: 281539 - DNA, 20 bp, human
gttcagtaaagtcacgcaaa

SEQ ID NO: 281540 - DNA, 20 bp, human
gagaagcaagaggcaagata

SEQ ID NO: 281541 - DNA, 20 bp, human
gtacaaaggacacagggagt

SEQ ID NO: 281542 - DNA, 20 bp, human
gagaatgaatgtgtatacaa

SEQ ID NO: 281543 - DNA, 20 bp, human
ggaaatatatagacaattac

SEQ ID NO: 281544 - DNA, 20 bp, human
gttattaaaaaatcacatga

SEQ ID NO: 281545 - DNA, 20 bp, human
ggcgtgactttactgaaaaa

SEQ ID NO: 281546 - DNA, 20 bp, human
ggctacggaataatgggaaa

SEQ ID NO: 281547 - DNA, 20 bp, human
gctggttgcacaagataaaa

SEQ ID NO: 281548 - DNA, 20 bp, human
gtgcaaccagcacggtcttt

SEQ ID NO: 281549 - DNA, 20 bp, human
gaggagcatgataagatatg

SEQ ID NO: 281550 - DNA, 20 bp, human
gaaccagcacggtctttggg

SEQ ID NO: 281551 - DNA, 20 bp, human
gctccacccaaagaccgtgc

SEQ ID NO: 281552 - DNA, 20 bp, human
gccaaccagatgcctgttct

SEQ ID NO: 281553 - DNA, 20 bp, human
gtacgattgctacggaataa

SEQ ID NO: 281554 - DNA, 20 bp, human
gttatcttgtgcaaccagca

SEQ ID NO: 281555 - DNA, 20 bp, human
gtttaagtgcagaaggtttc

SEQ ID NO: 281556 - DNA, 20 bp, human
ggtggccagccaaagctcat

SEQ ID NO: 281557 - DNA, 20 bp, human
gatctcaggaggaattacaa

SEQ ID NO: 281558 - DNA, 20 bp, human
ggggttgtacttctgttatc

SEQ ID NO: 281559 - DNA, 20 bp, human
gggaatgtcctgttcctctg

SEQ ID NO: 281560 - DNA, 20 bp, human
gtggcagggtttactgggat

SEQ ID NO: 281561 - DNA, 20 bp, human
gggaggaattacaagggggt

SEQ ID NO: 281562 - DNA, 20 bp, human
ggaaatctacccatgagctt

SEQ ID NO: 281563 - DNA, 20 bp, human
gaaatcctggttaggatctc

SEQ ID NO: 281564 - DNA, 20 bp, human
gtcctcctgagatcctaacc

SEQ ID NO: 281565 - DNA, 20 bp, human
gttgtaaaacacccggatat

SEQ ID NO: 281566 - DNA, 20 bp, human
gcatccgagaaatgtgtgac

SEQ ID NO: 281567 - DNA, 20 bp, human
gggggaagaggcaaaggctg

SEQ ID NO: 281568 - DNA, 20 bp, human
ggagccagtcacacatttct

SEQ ID NO: 281569 - DNA, 20 bp, human
gcccaagctacctgaggagg

SEQ ID NO: 281570 - DNA, 20 bp, human
gaaacccaagctacctgagg

SEQ ID NO: 281571 - DNA, 20 bp, human
ggtaagcaaagcaagctcga

SEQ ID NO: 281572 - DNA, 20 bp, human
gtaccgaaacgtatagaaac

SEQ ID NO: 281573 - DNA, 20 bp, human
ggaaacaggcctgttggctt

SEQ ID NO: 281574 - DNA, 20 bp, human
gcccaaacccaagctacctg

SEQ ID NO: 281575 - DNA, 20 bp, human
gcgtatagaaacaggcctgt

SEQ ID NO: 281576 - DNA, 20 bp, human
gacagggcctagtccatggt

SEQ ID NO: 281577 - DNA, 20 bp, human
gcgggtaagtgattttggaa

SEQ ID NO: 281578 - DNA, 20 bp, human
ggatacagcataactatgtc

SEQ ID NO: 281579 - DNA, 20 bp, human
gtggaagtgcaagacacgat

SEQ ID NO: 281580 - DNA, 20 bp, human
gcacgatgggggggaattca

SEQ ID NO: 281581 - DNA, 20 bp, human
gtgtttacctaccatggact

SEQ ID NO: 281582 - DNA, 20 bp, human
gaatggcagaagtagataca

SEQ ID NO: 281583 - DNA, 20 bp, human
gaatttggggtttggaaaga

SEQ ID NO: 281584 - DNA, 20 bp, human
gtctaagaaagactcaactc

SEQ ID NO: 281585 - DNA, 20 bp, human
gagtgcaagacacgatgggg

SEQ ID NO: 281586 - DNA, 20 bp, human
gcccagcgcgggaggtgaaa

SEQ ID NO: 281587 - DNA, 20 bp, human
gaccgagaggaaggcggctg

SEQ ID NO: 281588 - DNA, 20 bp, human
ggaaaggggaaccgagagga

SEQ ID NO: 281589 - DNA, 20 bp, human
gaggcggctgaggtggagtt

SEQ ID NO: 281590 - DNA, 20 bp, human
gagccctcgccccgcccaac

SEQ ID NO: 281591 - DNA, 20 bp, human
gggtgcgaggcggagataaa

SEQ ID NO: 281592 - DNA, 20 bp, human
gccgcgacggctgaagggtg

SEQ ID NO: 281593 - DNA, 20 bp, human
gcgaaaaggggaaagggatt

SEQ ID NO: 281594 - DNA, 20 bp, human
gggaaagacgtaagaggcgg

SEQ ID NO: 281595 - DNA, 20 bp, human
gttgggggttgagcgaaaag

SEQ ID NO: 281596 - DNA, 20 bp, human
gctgtgcagggaatcgaaga

SEQ ID NO: 281597 - DNA, 20 bp, human
gaattttgttttgtggtcgc

SEQ ID NO: 281598 - DNA, 20 bp, human
ggttcttcaattttgttttg

SEQ ID NO: 281599 - DNA, 20 bp, human
gtttgttttgtggtcgctgg

SEQ ID NO: 281600 - DNA, 20 bp, human
gcgggagtgcgtgcgtgtgg

SEQ ID NO: 281601 - DNA, 20 bp, human
gcacgggagactgcttggct

SEQ ID NO: 281602 - DNA, 20 bp, human
gatcacgccgcggcgggtgg

SEQ ID NO: 281603 - DNA, 20 bp, human
ggctgtggaagcactgtgca

SEQ ID NO: 281604 - DNA, 20 bp, human
gagcgctcttgatcacgccg

SEQ ID NO: 281605 - DNA, 20 bp, human
ggctcttgatcacgccgcgg

SEQ ID NO: 281606 - DNA, 20 bp, human
ggcaggctgcccgaggtgac

SEQ ID NO: 281607 - DNA, 20 bp, human
ggcgcgggcccatcccagaa

SEQ ID NO: 281608 - DNA, 20 bp, human
gcgggtgtgtcagccgaaat

SEQ ID NO: 281609 - DNA, 20 bp, human
gccgcctccagcccgtgcca

SEQ ID NO: 281610 - DNA, 20 bp, human
gaatgggcgccgttctggga

SEQ ID NO: 281611 - DNA, 20 bp, human
ggcggggcggcaaggtccgc

SEQ ID NO: 281612 - DNA, 20 bp, human
ggcggaatgcgctgggtgaa

SEQ ID NO: 281613 - DNA, 20 bp, human
gccgccgcccgcaggcttgc

SEQ ID NO: 281614 - DNA, 20 bp, human
ggatgggcccgcgccaatgg

SEQ ID NO: 281615 - DNA, 20 bp, human
gccgaggtgacaggactcga

SEQ ID NO: 281616 - DNA, 20 bp, human
gggctcgcgcgcgtgctctg

SEQ ID NO: 281617 - DNA, 20 bp, human
gcctgcgccgaatcttccgg

SEQ ID NO: 281618 - DNA, 20 bp, human
gcccccccccccggaagatt

SEQ ID NO: 281619 - DNA, 20 bp, human
ggcaaagcggcacactgcgc

SEQ ID NO: 281620 - DNA, 20 bp, human
ggcgcctgcgccgaatcttc

SEQ ID NO: 281621 - DNA, 20 bp, human
ggggaagaacgggaggcaag

SEQ ID NO: 281622 - DNA, 20 bp, human
ggtgctctgcggttcacttc

SEQ ID NO: 281623 - DNA, 20 bp, human
gggaggtggccacgcgaggg

SEQ ID NO: 281624 - DNA, 20 bp, human
ggcgccgaatcttccggggg

SEQ ID NO: 281625 - DNA, 20 bp, human
gcacactgcgcaggcgcctg

SEQ ID NO: 281626 - DNA, 20 bp, human
gaggtcgttggctggggtaa

SEQ ID NO: 281627 - DNA, 20 bp, human
gggcaacaggtcgttggctg

SEQ ID NO: 281628 - DNA, 20 bp, human
gggctggggtaaaggccgat

SEQ ID NO: 281629 - DNA, 20 bp, human
gccccccacgtgctgtttgg

SEQ ID NO: 281630 - DNA, 20 bp, human
gccgcccccaaacagcacgt

SEQ ID NO: 281631 - DNA, 20 bp, human
gggcggaatcgaaaaggaaa

SEQ ID NO: 281632 - DNA, 20 bp, human
gttagggggcggaatcgaaa

SEQ ID NO: 281633 - DNA, 20 bp, human
gactgagaaagtgtcccggg

SEQ ID NO: 281634 - DNA, 20 bp, human
ggccaacgacctgttgcctt

SEQ ID NO: 281635 - DNA, 20 bp, human
gaactgtaatgagagtgact

SEQ ID NO: 281636 - DNA, 20 bp, human
gcctggggcgggttgaagac

SEQ ID NO: 281637 - DNA, 20 bp, human
ggaatccggagcaggcgaca

SEQ ID NO: 281638 - DNA, 20 bp, human
gcgcctgctccggattccgt

SEQ ID NO: 281639 - DNA, 20 bp, human
ggaccgacggaatccggagc

SEQ ID NO: 281640 - DNA, 20 bp, human
gtgttggggcgccgactcca

SEQ ID NO: 281641 - DNA, 20 bp, human
gaagcgggatgtacttctgt

SEQ ID NO: 281642 - DNA, 20 bp, human
gcacccagtcaccagcgttc

SEQ ID NO: 281643 - DNA, 20 bp, human
gctgcagcgccggaggacgg

SEQ ID NO: 281644 - DNA, 20 bp, human
gcagcgggaccgacggaatc

SEQ ID NO: 281645 - DNA, 20 bp, human
gccgtcggtcccgctgcgac

SEQ ID NO: 281646 - DNA, 20 bp, human
gcggctgtgccccgggaacc

SEQ ID NO: 281647 - DNA, 20 bp, human
gccatgtttgggtgcgctgc

SEQ ID NO: 281648 - DNA, 20 bp, human
gcctctgggtgacgcagacg

SEQ ID NO: 281649 - DNA, 20 bp, human
gtccggatccgggtggcaga

SEQ ID NO: 281650 - DNA, 20 bp, human
gcccaatcggcgtccggatc

SEQ ID NO: 281651 - DNA, 20 bp, human
ggacgccgattgggccacgt

SEQ ID NO: 281652 - DNA, 20 bp, human
gtctcccaacgtggcccaat

SEQ ID NO: 281653 - DNA, 20 bp, human
gcggaccgagcacgtgggca

SEQ ID NO: 281654 - DNA, 20 bp, human
gctgggtgacgcagacgcgg

SEQ ID NO: 281655 - DNA, 20 bp, human
gtgccccgggaacccgggtt

SEQ ID NO: 281656 - DNA, 20 bp, human
ggcgactacaggtagcagga

SEQ ID NO: 281657 - DNA, 20 bp, human
gtaagccggaacaggcaggg

SEQ ID NO: 281658 - DNA, 20 bp, human
gcagggcggaagtgcgtcac

SEQ ID NO: 281659 - DNA, 20 bp, human
gactacaggtagcaggaggg

SEQ ID NO: 281660 - DNA, 20 bp, human
gcggcagcaacaggatcggc

SEQ ID NO: 281661 - DNA, 20 bp, human
gacaggatcggcagggatgg

SEQ ID NO: 281662 - DNA, 20 bp, human
ggcaacaggatcggcaggga

SEQ ID NO: 281663 - DNA, 20 bp, human
ggggcggcccaggcgactac

SEQ ID NO: 281664 - DNA, 20 bp, human
ggggggaggtccatgtgcag

SEQ ID NO: 281665 - DNA, 20 bp, human
gtgggcgacgcgaagcctgg

SEQ ID NO: 281666 - DNA, 20 bp, human
gcacaaggtctggcggccaa

SEQ ID NO: 281667 - DNA, 20 bp, human
gggccgccaggcacaaggtc

SEQ ID NO: 281668 - DNA, 20 bp, human
gtgcctggcggccaatgggg

SEQ ID NO: 281669 - DNA, 20 bp, human
ggtggaccgcgcccccccat

SEQ ID NO: 281670 - DNA, 20 bp, human
ggtaactttcagccaatggg

SEQ ID NO: 281671 - DNA, 20 bp, human
gagacacgcggcaccgctcg

SEQ ID NO: 281672 - DNA, 20 bp, human
ggcgtgtctcctcctcccat

SEQ ID NO: 281673 - DNA, 20 bp, human
gtggcgcgcgcctgagccca

SEQ ID NO: 281674 - DNA, 20 bp, human
gcattggctgaaagttactg

SEQ ID NO: 281675 - DNA, 20 bp, human
gccattggccgccaggcaca

SEQ ID NO: 281676 - DNA, 20 bp, human
gccaccctgcgcaggaacaa

SEQ ID NO: 281677 - DNA, 20 bp, human
ggcggggagcgggatccccg

SEQ ID NO: 281678 - DNA, 20 bp, human
ggcgtcgcggtctcccctcc

SEQ ID NO: 281679 - DNA, 20 bp, human
gaggtgctcggggaaaactg

SEQ ID NO: 281680 - DNA, 20 bp, human
gggagaccgcgacgcccccg

SEQ ID NO: 281681 - DNA, 20 bp, human
gcgcggtagacaggacgcaa

SEQ ID NO: 281682 - DNA, 20 bp, human
ggtagacaggacgcaaaggc

SEQ ID NO: 281683 - DNA, 20 bp, human
gaagggcagcattggagagg

SEQ ID NO: 281684 - DNA, 20 bp, human
gagggaccgtagctccagtc

SEQ ID NO: 281685 - DNA, 20 bp, human
gccgccctgggccgcagcag

SEQ ID NO: 281686 - DNA, 20 bp, human
ggcggccgtcggggatctgc

SEQ ID NO: 281687 - DNA, 20 bp, human
gagcgccaggcagcgcggag

SEQ ID NO: 281688 - DNA, 20 bp, human
ggggctccggccccagagcg

SEQ ID NO: 281689 - DNA, 20 bp, human
gagcccgcggtgcggccgtc

SEQ ID NO: 281690 - DNA, 20 bp, human
gccgtcggggatctgcgggc

SEQ ID NO: 281691 - DNA, 20 bp, human
gaacacgtgcatggcgtcct

SEQ ID NO: 281692 - DNA, 20 bp, human
gggacgccggcttaagactc

SEQ ID NO: 281693 - DNA, 20 bp, human
gtccccgacggccgcaccgc

SEQ ID NO: 281694 - DNA, 20 bp, human
gctccgccgcgctctggggc

SEQ ID NO: 281695 - DNA, 20 bp, human
gccagcgggtcgcgcagcga

SEQ ID NO: 281696 - DNA, 20 bp, human
ggtccctcgggagacagggg

SEQ ID NO: 281697 - DNA, 20 bp, human
gaagcctaggctatgggagg

SEQ ID NO: 281698 - DNA, 20 bp, human
gaggaagcctaggctatggg

SEQ ID NO: 281699 - DNA, 20 bp, human
gtgggactggagaacttacg

SEQ ID NO: 281700 - DNA, 20 bp, human
ggagacagggggggtcctga

SEQ ID NO: 281701 - DNA, 20 bp, human
ggggacaggatgggcatgga

SEQ ID NO: 281702 - DNA, 20 bp, human
gacggggattgggacaggat

SEQ ID NO: 281703 - DNA, 20 bp, human
ggaccccccctgtctcccga

SEQ ID NO: 281704 - DNA, 20 bp, human
gaggacttggcaagtgggac

SEQ ID NO: 281705 - DNA, 20 bp, human
gtaaacgagggtccctataa

SEQ ID NO: 281706 - DNA, 20 bp, human
ggctccgggcgcggcctccg

SEQ ID NO: 281707 - DNA, 20 bp, human
gcccccctccgacaccgctg

SEQ ID NO: 281708 - DNA, 20 bp, human
gcggcctccgcgggcgacaa

SEQ ID NO: 281709 - DNA, 20 bp, human
gtccccagcggtgtcggagg

SEQ ID NO: 281710 - DNA, 20 bp, human
gctgtccccagcggtgtcgg

SEQ ID NO: 281711 - DNA, 20 bp, human
gcgtgactgacagcgagcgg

SEQ ID NO: 281712 - DNA, 20 bp, human
gactcgccccagccaatcga

SEQ ID NO: 281713 - DNA, 20 bp, human
gctcgctgtcagtcacgcct

SEQ ID NO: 281714 - DNA, 20 bp, human
ggaggagcgcggccgtcgat

SEQ ID NO: 281715 - DNA, 20 bp, human
gcgggcgacaatggcatgcg

SEQ ID NO: 281716 - DNA, 20 bp, human
gaggccccgggatgctaatg

SEQ ID NO: 281717 - DNA, 20 bp, human
gcggccgttcccacactccg

SEQ ID NO: 281718 - DNA, 20 bp, human
ggcaaggccaagcgcgtccc

SEQ ID NO: 281719 - DNA, 20 bp, human
gtgtgcccgcgccaattcac

SEQ ID NO: 281720 - DNA, 20 bp, human
ggcggcccacctgctccttg

SEQ ID NO: 281721 - DNA, 20 bp, human
gggccgcgcggcacaatgtc

SEQ ID NO: 281722 - DNA, 20 bp, human
gcccgcccggccattggccg

SEQ ID NO: 281723 - DNA, 20 bp, human
gcggcctggcgcctggagtc

SEQ ID NO: 281724 - DNA, 20 bp, human
gccgccgcccgcgcctatat

SEQ ID NO: 281725 - DNA, 20 bp, human
gggctcccggcatcaggccc

SEQ ID NO: 281726 - DNA, 20 bp, human
gcaaataagcggctataaaa

SEQ ID NO: 281727 - DNA, 20 bp, human
gcgcacgcgcggcagatcag

SEQ ID NO: 281728 - DNA, 20 bp, human
gaggcgcgctgcagccaatc

SEQ ID NO: 281729 - DNA, 20 bp, human
gccgcccccgcgggggtcta

SEQ ID NO: 281730 - DNA, 20 bp, human
ggctctggcggtcgggcagc

SEQ ID NO: 281731 - DNA, 20 bp, human
ggcccagcggctctggcggt

SEQ ID NO: 281732 - DNA, 20 bp, human
gccgggcccgcgcggccaat

SEQ ID NO: 281733 - DNA, 20 bp, human
gggcagggccgcagctaccc

SEQ ID NO: 281734 - DNA, 20 bp, human
gcgggggtctagggaaggcc

SEQ ID NO: 281735 - DNA, 20 bp, human
gcgccccggtgccgcccccg

SEQ ID NO: 281736 - DNA, 20 bp, human
gattctgcccctctaggacc

SEQ ID NO: 281737 - DNA, 20 bp, human
gccctctaggacccggcacg

SEQ ID NO: 281738 - DNA, 20 bp, human
gccgcggcccaagggtagga

SEQ ID NO: 281739 - DNA, 20 bp, human
ggcacgaggctcccggaaag

SEQ ID NO: 281740 - DNA, 20 bp, human
ggcctcgtgccgggtcctag

SEQ ID NO: 281741 - DNA, 20 bp, human
ggaggcgggacccagctgaa

SEQ ID NO: 281742 - DNA, 20 bp, human
ggcgggacccagctgaaagg

SEQ ID NO: 281743 - DNA, 20 bp, human
ggcccaagggtaggagggat

SEQ ID NO: 281744 - DNA, 20 bp, human
gcaacctcccggcagagctt

SEQ ID NO: 281745 - DNA, 20 bp, human
gttggggcagagctcgcttg

SEQ ID NO: 281746 - DNA, 20 bp, human
gcaactaatggctacaccag

SEQ ID NO: 281747 - DNA, 20 bp, human
gaatccagcccccttgtcag

SEQ ID NO: 281748 - DNA, 20 bp, human
gtatagctccgctgacaagg

SEQ ID NO: 281749 - DNA, 20 bp, human
gtaacactttttgtccctgt

SEQ ID NO: 281750 - DNA, 20 bp, human
ggctccgctgacaagggggc

SEQ ID NO: 281751 - DNA, 20 bp, human
gttgcccagccagcagctta

SEQ ID NO: 281752 - DNA, 20 bp, human
ggtatcttgcctgtatgttt

SEQ ID NO: 281753 - DNA, 20 bp, human
gcactttttgtccctgtagg

SEQ ID NO: 281754 - DNA, 20 bp, human
gctgaagtttatactttcat

SEQ ID NO: 281755 - DNA, 20 bp, human
ggcaagtaattagcaactaa

SEQ ID NO: 281756 - DNA, 20 bp, human
gggctgataaacaatctaag

SEQ ID NO: 281757 - DNA, 20 bp, human
gcgagccagggtgacaggtt

SEQ ID NO: 281758 - DNA, 20 bp, human
gaaaaactaaagaactcttc

SEQ ID NO: 281759 - DNA, 20 bp, human
gcctggttccacagatacat

SEQ ID NO: 281760 - DNA, 20 bp, human
gcagagacataaacgagcca

SEQ ID NO: 281761 - DNA, 20 bp, human
gagttcttacaatgagttaa

SEQ ID NO: 281762 - DNA, 20 bp, human
gtatgtctctgtatagttgt

SEQ ID NO: 281763 - DNA, 20 bp, human
gttttctttcaagagatcat

SEQ ID NO: 281764 - DNA, 20 bp, human
gaatggattggtggaattaa

SEQ ID NO: 281765 - DNA, 20 bp, human
gtgaaaatggaatggattgg

SEQ ID NO: 281766 - DNA, 20 bp, human
ggcagggtgtgggtcctcct

SEQ ID NO: 281767 - DNA, 20 bp, human
gggtccaggccggaagtgaa

SEQ ID NO: 281768 - DNA, 20 bp, human
gcacttccggcctggacctg

SEQ ID NO: 281769 - DNA, 20 bp, human
ggactcgagaagaacggggt

SEQ ID NO: 281770 - DNA, 20 bp, human
ggggcgccgctcacctgacc

SEQ ID NO: 281771 - DNA, 20 bp, human
gtgggtcctcctggggtcgc

SEQ ID NO: 281772 - DNA, 20 bp, human
ggagctgtctagttccatca

SEQ ID NO: 281773 - DNA, 20 bp, human
gcggcgcccccgtgacttat

SEQ ID NO: 281774 - DNA, 20 bp, human
ggtggggaggcgaggacgca

SEQ ID NO: 281775 - DNA, 20 bp, human
gggctcgccagactgttcac

SEQ ID NO: 281776 - DNA, 20 bp, human
gtccaggggtgccctcgggt

SEQ ID NO: 281777 - DNA, 20 bp, human
gcccctggaggaaattctcg

SEQ ID NO: 281778 - DNA, 20 bp, human
gtctcgaggtgacctggaca

SEQ ID NO: 281779 - DNA, 20 bp, human
gttcctccaggggtgccctc

SEQ ID NO: 281780 - DNA, 20 bp, human
gcgcgcgcagtcatctgact

SEQ ID NO: 281781 - DNA, 20 bp, human
gacctcgagaatttcctcca

SEQ ID NO: 281782 - DNA, 20 bp, human
gcccgcccggcccggatcag

SEQ ID NO: 281783 - DNA, 20 bp, human
gtgggctctgctcctacccg

SEQ ID NO: 281784 - DNA, 20 bp, human
gggctgggcgaggacgctcc

SEQ ID NO: 281785 - DNA, 20 bp, human
gcgactccgcctccaggccc

SEQ ID NO: 281786 - DNA, 20 bp, human
gtggcccgacccgggtgggg

SEQ ID NO: 281787 - DNA, 20 bp, human
gcctctgccgtcggctaccg

SEQ ID NO: 281788 - DNA, 20 bp, human
gataggtgggcctctgccgt

SEQ ID NO: 281789 - DNA, 20 bp, human
ggcggacagggccatggagt

SEQ ID NO: 281790 - DNA, 20 bp, human
gtctcctgcccctctgggat

SEQ ID NO: 281791 - DNA, 20 bp, human
gccacctatcccagaggggc

SEQ ID NO: 281792 - DNA, 20 bp, human
gcatggagtgggcgggactg

SEQ ID NO: 281793 - DNA, 20 bp, human
gggcctggcccgacccgggt

SEQ ID NO: 281794 - DNA, 20 bp, human
gggtctaccgcagcccatgc

SEQ ID NO: 281795 - DNA, 20 bp, human
ggctccgggaacctgccgtt

SEQ ID NO: 281796 - DNA, 20 bp, human
gactggtatggagggttctc

SEQ ID NO: 281797 - DNA, 20 bp, human
gcaaacgtgctggaatgtca

SEQ ID NO: 281798 - DNA, 20 bp, human
gcccctacgcgtcctgggat

SEQ ID NO: 281799 - DNA, 20 bp, human
gaggtctaagcgatggaagg

SEQ ID NO: 281800 - DNA, 20 bp, human
ggtgcgacgtagccaatccc

SEQ ID NO: 281801 - DNA, 20 bp, human
gcggaagaggagctgtggga

SEQ ID NO: 281802 - DNA, 20 bp, human
gtaaaaggggcgcagaggac

SEQ ID NO: 281803 - DNA, 20 bp, human
gagccaatcccaggacgcgt

SEQ ID NO: 281804 - DNA, 20 bp, human
gtacgtcgcacggcgcgcga

SEQ ID NO: 281805 - DNA, 20 bp, human
gacgactcgctgaggaagga

SEQ ID NO: 281806 - DNA, 20 bp, human
gcccccgcgcaagggtagat

SEQ ID NO: 281807 - DNA, 20 bp, human
gggcctgaaaagcgatccaa

SEQ ID NO: 281808 - DNA, 20 bp, human
gcgcaagggtagatgggttt

SEQ ID NO: 281809 - DNA, 20 bp, human
gctggggattgtagttcttc

SEQ ID NO: 281810 - DNA, 20 bp, human
ggggagaggccgggccgagt

SEQ ID NO: 281811 - DNA, 20 bp, human
ggtgtggctgttgacgttac

SEQ ID NO: 281812 - DNA, 20 bp, human
ggaaggcagtgatgcgcgcg

SEQ ID NO: 281813 - DNA, 20 bp, human
gcatcactgccttctttgat

SEQ ID NO: 281814 - DNA, 20 bp, human
gaagcgagaatattggcaga

SEQ ID NO: 281815 - DNA, 20 bp, human
gacggggcagaaaatagatc

SEQ ID NO: 281816 - DNA, 20 bp, human
gcacaaagtcggagtcgctg

SEQ ID NO: 281817 - DNA, 20 bp, human
gttgatgaagcatacgaaat

SEQ ID NO: 281818 - DNA, 20 bp, human
gaaatggctgccctcctaga

SEQ ID NO: 281819 - DNA, 20 bp, human
gggcaactccgtttctattt

SEQ ID NO: 281820 - DNA, 20 bp, human
gtgcggctccgaaatagaaa

SEQ ID NO: 281821 - DNA, 20 bp, human
gtgtgccccaaccctgtaaa

SEQ ID NO: 281822 - DNA, 20 bp, human
ggtaaactttcaagagaagt

SEQ ID NO: 281823 - DNA, 20 bp, human
ggtagttcgtttttccctct

SEQ ID NO: 281824 - DNA, 20 bp, human
gacaaagattacattggaat

SEQ ID NO: 281825 - DNA, 20 bp, human
gtacacaacttttagagaaa

SEQ ID NO: 281826 - DNA, 20 bp, human
gtggcagccgctccggggag

SEQ ID NO: 281827 - DNA, 20 bp, human
gcggagcggctgccaatcag

SEQ ID NO: 281828 - DNA, 20 bp, human
ggcggcgcgagaaaccggat

SEQ ID NO: 281829 - DNA, 20 bp, human
ggaggcggggcggcaactcc

SEQ ID NO: 281830 - DNA, 20 bp, human
gaggctggacagagcccccg

SEQ ID NO: 281831 - DNA, 20 bp, human
ggagaaaccggattggccgg

SEQ ID NO: 281832 - DNA, 20 bp, human
ggcgaggccgagggctctag

SEQ ID NO: 281833 - DNA, 20 bp, human
gctgcccggcggcggtgcgt

SEQ ID NO: 281834 - DNA, 20 bp, human
gggagccgacgcaccgccgc

SEQ ID NO: 281835 - DNA, 20 bp, human
gcgccggcgggcttgtgtcc

SEQ ID NO: 281836 - DNA, 20 bp, human
ggagccacgccgaccagcga

SEQ ID NO: 281837 - DNA, 20 bp, human
gggtcggcgtggctcgcgat

SEQ ID NO: 281838 - DNA, 20 bp, human
gcccccccctcgagcgggtg

SEQ ID NO: 281839 - DNA, 20 bp, human
gcagccgaggcgtgggaacg

SEQ ID NO: 281840 - DNA, 20 bp, human
gctctggggtaccaggtccg

SEQ ID NO: 281841 - DNA, 20 bp, human
gaaggctccagccgaggcgt

SEQ ID NO: 281842 - DNA, 20 bp, human
gctcgccaatgcccgccgca

SEQ ID NO: 281843 - DNA, 20 bp, human
gtggccccacccgctcgagg

SEQ ID NO: 281844 - DNA, 20 bp, human
gcgccgcaaggctccagccg

SEQ ID NO: 281845 - DNA, 20 bp, human
gccggcccaggccttccgcc

SEQ ID NO: 281846 - DNA, 20 bp, human
gcggtcgccgccttcatcga

SEQ ID NO: 281847 - DNA, 20 bp, human
gcggcggcgcgtcaccgcgg

SEQ ID NO: 281848 - DNA, 20 bp, human
ggctcggcggcgcgtcaccg

SEQ ID NO: 281849 - DNA, 20 bp, human
gcggagctgcggcgcaggaa

SEQ ID NO: 281850 - DNA, 20 bp, human
gacctcccagccgtcgatga

SEQ ID NO: 281851 - DNA, 20 bp, human
gcgtcaccgcgggggcgagg

SEQ ID NO: 281852 - DNA, 20 bp, human
gcgagccgtgggaaggccct

SEQ ID NO: 281853 - DNA, 20 bp, human
gtgaaggcggcgaccgccta

SEQ ID NO: 281854 - DNA, 20 bp, human
gtgccctgggaggccccgcg

SEQ ID NO: 281855 - DNA, 20 bp, human
gtgacgcgccgccgagccgt

SEQ ID NO: 281856 - DNA, 20 bp, human
gctgaaggggtgttgttgat

SEQ ID NO: 281857 - DNA, 20 bp, human
gcaccctacagctattgcct

SEQ ID NO: 281858 - DNA, 20 bp, human
gtaagacataagttggtcta

SEQ ID NO: 281859 - DNA, 20 bp, human
gtaaaaaccaagggggacac

SEQ ID NO: 281860 - DNA, 20 bp, human
ggatgcccagtaaaacttcc

SEQ ID NO: 281861 - DNA, 20 bp, human
gttcaccaggaagttttact

SEQ ID NO: 281862 - DNA, 20 bp, human
gagcctaggcaatagctgta

SEQ ID NO: 281863 - DNA, 20 bp, human
gtaaatctccgcttcttttg

SEQ ID NO: 281864 - DNA, 20 bp, human
gcaggatttaaaaaccaagg

SEQ ID NO: 281865 - DNA, 20 bp, human
gatagctgtagggtgacttc

SEQ ID NO: 281866 - DNA, 20 bp, human
gattccaggaacgttggtgg

SEQ ID NO: 281867 - DNA, 20 bp, human
ggagtattgagtgccaagtc

SEQ ID NO: 281868 - DNA, 20 bp, human
gtagaggattagaaagaata

SEQ ID NO: 281869 - DNA, 20 bp, human
ggaggtggctactgagttga

SEQ ID NO: 281870 - DNA, 20 bp, human
gctacccccaccaacgttcc

SEQ ID NO: 281871 - DNA, 20 bp, human
gggggggaagggggagtata

SEQ ID NO: 281872 - DNA, 20 bp, human
gtccaaaattccaggaacgt

SEQ ID NO: 281873 - DNA, 20 bp, human
gggaagggggagtatatggc

SEQ ID NO: 281874 - DNA, 20 bp, human
gccccataccaaaccttctc

SEQ ID NO: 281875 - DNA, 20 bp, human
gatatggctggccagagtac

SEQ ID NO: 281876 - DNA, 20 bp, human
gcaggcttggcggtcctcag

SEQ ID NO: 281877 - DNA, 20 bp, human
gagcaggttagcttagggaa

SEQ ID NO: 281878 - DNA, 20 bp, human
gtagagaagcaggttagctt

SEQ ID NO: 281879 - DNA, 20 bp, human
ggcaggttggggtatgtttg

SEQ ID NO: 281880 - DNA, 20 bp, human
gctcagaggggctgataaat

SEQ ID NO: 281881 - DNA, 20 bp, human
gctcctaatcctgggttcta

SEQ ID NO: 281882 - DNA, 20 bp, human
gtttgtggagtggtggttgt

SEQ ID NO: 281883 - DNA, 20 bp, human
gttctccgaaagtttataac

SEQ ID NO: 281884 - DNA, 20 bp, human
gagggcaataatgtgttctt

SEQ ID NO: 281885 - DNA, 20 bp, human
gtagtagacccttagaaccc

SEQ ID NO: 281886 - DNA, 20 bp, human
gaggcctgggagaatcgggt

SEQ ID NO: 281887 - DNA, 20 bp, human
ggagcccagtgcggctgagt

SEQ ID NO: 281888 - DNA, 20 bp, human
gcctccgcgtggagcctctg

SEQ ID NO: 281889 - DNA, 20 bp, human
gcccagtgcggctgagtggg

SEQ ID NO: 281890 - DNA, 20 bp, human
ggtgggctggaggctttcac

SEQ ID NO: 281891 - DNA, 20 bp, human
gagatcaccagggaagtcca

SEQ ID NO: 281892 - DNA, 20 bp, human
ggacctgtcccctctcgtct

SEQ ID NO: 281893 - DNA, 20 bp, human
gcgcggaggcctgggagaat

SEQ ID NO: 281894 - DNA, 20 bp, human
gcagcccacccgattctccc

SEQ ID NO: 281895 - DNA, 20 bp, human
gaggctccacgcggaggcct

SEQ ID NO: 281896 - DNA, 20 bp, human
gtgttcctaagtgtttccag

SEQ ID NO: 281897 - DNA, 20 bp, human
gctatcggggaaaggaactg

SEQ ID NO: 281898 - DNA, 20 bp, human
gctcaggctaggaaggaaca

SEQ ID NO: 281899 - DNA, 20 bp, human
gctctgctcagtcctgactc

SEQ ID NO: 281900 - DNA, 20 bp, human
gtgaagaggaaccaagcctc

SEQ ID NO: 281901 - DNA, 20 bp, human
gcttggttcctcttcacctg

SEQ ID NO: 281902 - DNA, 20 bp, human
gttccttcctagcctgagtc

SEQ ID NO: 281903 - DNA, 20 bp, human
gccaaaggcaattgtgtaac

SEQ ID NO: 281904 - DNA, 20 bp, human
gaaccggaatatccaaagag

SEQ ID NO: 281905 - DNA, 20 bp, human
gctcagtcctgactcaggct

SEQ ID NO: 281906 - DNA, 20 bp, human
gctggagctccagatcccag

SEQ ID NO: 281907 - DNA, 20 bp, human
gtccccccaaccccacgctt

SEQ ID NO: 281908 - DNA, 20 bp, human
ggataggagccactgggatc

SEQ ID NO: 281909 - DNA, 20 bp, human
ggttgaagggggggcgagtg

SEQ ID NO: 281910 - DNA, 20 bp, human
ggggggctggaagagagtaa

SEQ ID NO: 281911 - DNA, 20 bp, human
gttcctaagcgtggggttgg

SEQ ID NO: 281912 - DNA, 20 bp, human
ggctcctatccgagtaagga

SEQ ID NO: 281913 - DNA, 20 bp, human
ggagcccaatggctaaatca

SEQ ID NO: 281914 - DNA, 20 bp, human
gcctgaggccagcttcaatt

SEQ ID NO: 281915 - DNA, 20 bp, human
gctcccttccttactcggat

SEQ ID NO: 281916 - DNA, 20 bp, human
ggactcggggacttcctctc

SEQ ID NO: 281917 - DNA, 20 bp, human
ggaggcccaaggaccatgtc

SEQ ID NO: 281918 - DNA, 20 bp, human
gtgggcccgcctgacgtggg

SEQ ID NO: 281919 - DNA, 20 bp, human
gtccaggtagggtcaaagtg

SEQ ID NO: 281920 - DNA, 20 bp, human
gcaggcgggcccagccggag

SEQ ID NO: 281921 - DNA, 20 bp, human
gtcaaagtgaggtgggcagc

SEQ ID NO: 281922 - DNA, 20 bp, human
gctagacctgacatggtcct

SEQ ID NO: 281923 - DNA, 20 bp, human
ggaggagaggggccacgcaa

SEQ ID NO: 281924 - DNA, 20 bp, human
gcggctgggcccgcctgacg

SEQ ID NO: 281925 - DNA, 20 bp, human
gctgacgtgggaggcagcca

SEQ ID NO: 281926 - DNA, 20 bp, human
ggagccgcggcgccgagcta

SEQ ID NO: 281927 - DNA, 20 bp, human
gcggctcaaggcccgcccac

SEQ ID NO: 281928 - DNA, 20 bp, human
gtgcgcgcactggagggaaa

SEQ ID NO: 281929 - DNA, 20 bp, human
ggcccaccggccactctcat

SEQ ID NO: 281930 - DNA, 20 bp, human
gaattagcgcgcagcgttag

SEQ ID NO: 281931 - DNA, 20 bp, human
gcacgcgcacgtcaccgcgc

SEQ ID NO: 281932 - DNA, 20 bp, human
ggagaactatccaatgagag

SEQ ID NO: 281933 - DNA, 20 bp, human
gcgcagcgttagcgggagag

SEQ ID NO: 281934 - DNA, 20 bp, human
ggaaccaatgagaagtccga

SEQ ID NO: 281935 - DNA, 20 bp, human
ggaagacgctgctggtgaaa

SEQ ID NO: 281936 - DNA, 20 bp, human
gcctcccgcggtgactcagg

SEQ ID NO: 281937 - DNA, 20 bp, human
gcgcgggcgggggaacctag

SEQ ID NO: 281938 - DNA, 20 bp, human
ggctggagaaggtggggcga

SEQ ID NO: 281939 - DNA, 20 bp, human
gaggctctgcgcccctgcgt

SEQ ID NO: 281940 - DNA, 20 bp, human
ggtgactcaggcggcggtga

SEQ ID NO: 281941 - DNA, 20 bp, human
gatgctaggccctgccttga

SEQ ID NO: 281942 - DNA, 20 bp, human
gaccgccgcctgagtcaccg

SEQ ID NO: 281943 - DNA, 20 bp, human
ggcagcggagggggcgatga

SEQ ID NO: 281944 - DNA, 20 bp, human
gccgcctcccgcggtgactc

SEQ ID NO: 281945 - DNA, 20 bp, human
gctaacacccgtgcggaggg

SEQ ID NO: 281946 - DNA, 20 bp, human
ggccgccggcggggcaaacg

SEQ ID NO: 281947 - DNA, 20 bp, human
ggcagccctggcagcttcga

SEQ ID NO: 281948 - DNA, 20 bp, human
gaacagccgaggggtgagcg

SEQ ID NO: 281949 - DNA, 20 bp, human
ggggagagatatgcacgcca

SEQ ID NO: 281950 - DNA, 20 bp, human
ggggaacccgcggcgctctc

SEQ ID NO: 281951 - DNA, 20 bp, human
gacggcccacctcgagtttc

SEQ ID NO: 281952 - DNA, 20 bp, human
gtgcaatgaacacacgggtg

SEQ ID NO: 281953 - DNA, 20 bp, human
gcgaggggtgagcggggcta

SEQ ID NO: 281954 - DNA, 20 bp, human
gtgagcggggctaggggccc

SEQ ID NO: 281955 - DNA, 20 bp, human
gtaagccctcgaagctgcca

SEQ ID NO: 281956 - DNA, 20 bp, human
gagggaggatccttgaaggg

SEQ ID NO: 281957 - DNA, 20 bp, human
gccgcagggaggatccttga

SEQ ID NO: 281958 - DNA, 20 bp, human
ggccacagggagccgcaggg

SEQ ID NO: 281959 - DNA, 20 bp, human
gcctggaagagggaagtcct

SEQ ID NO: 281960 - DNA, 20 bp, human
gggaactggcatgggacatg

SEQ ID NO: 281961 - DNA, 20 bp, human
gcagcacccgccccccttca

SEQ ID NO: 281962 - DNA, 20 bp, human
gaccgctcataacctcaagg

SEQ ID NO: 281963 - DNA, 20 bp, human
gtcctccctgcggctccctg

SEQ ID NO: 281964 - DNA, 20 bp, human
gatgaaaaggaccaggtcat

SEQ ID NO: 281965 - DNA, 20 bp, human
gtgcatcagtgcctgaggga

SEQ ID NO: 281966 - DNA, 20 bp, human
gcaccagggcgccagttccc

SEQ ID NO: 281967 - DNA, 20 bp, human
gagcaagcgcgtcccggggg

SEQ ID NO: 281968 - DNA, 20 bp, human
gggtagcaagcgcgtcccgg

SEQ ID NO: 281969 - DNA, 20 bp, human
ggcgccctggtgccccgccg

SEQ ID NO: 281970 - DNA, 20 bp, human
gggccggcggagcctatcgc

SEQ ID NO: 281971 - DNA, 20 bp, human
gcggccgaggacgccctcga

SEQ ID NO: 281972 - DNA, 20 bp, human
gcctgggccgcgtccgtcgg

SEQ ID NO: 281973 - DNA, 20 bp, human
gggcccagggcttccctcga

SEQ ID NO: 281974 - DNA, 20 bp, human
gcgcttgctaccaggctccg

SEQ ID NO: 281975 - DNA, 20 bp, human
gaggaaggggccagcgagcg

SEQ ID NO: 281976 - DNA, 20 bp, human
gccttcggaaccagcctcga

SEQ ID NO: 281977 - DNA, 20 bp, human
gcgagaagcggtgacgtcaa

SEQ ID NO: 281978 - DNA, 20 bp, human
gctcgccgcggcccccgggt

SEQ ID NO: 281979 - DNA, 20 bp, human
gtaacgggagttgtttaggt

SEQ ID NO: 281980 - DNA, 20 bp, human
gacagtagcaggaacagaaa

SEQ ID NO: 281981 - DNA, 20 bp, human
ggggcggctagccgcgacgg

SEQ ID NO: 281982 - DNA, 20 bp, human
gggttcagcaccctcgaggc

SEQ ID NO: 281983 - DNA, 20 bp, human
gtgggctctagatgatgctg

SEQ ID NO: 281984 - DNA, 20 bp, human
ggccgtggacgcccccaccc

SEQ ID NO: 281985 - DNA, 20 bp, human
ggcccctccccgccgcagca

SEQ ID NO: 281986 - DNA, 20 bp, human
gcctcccggggcgctcgcgg

SEQ ID NO: 281987 - DNA, 20 bp, human
gaggccctgcgtgtagggaa

SEQ ID NO: 281988 - DNA, 20 bp, human
gtcccctcccggggcgctcg

SEQ ID NO: 281989 - DNA, 20 bp, human
gctgccgccgcgagcgcccc

SEQ ID NO: 281990 - DNA, 20 bp, human
ggggccactcccatcgaatt

SEQ ID NO: 281991 - DNA, 20 bp, human
gcagaggtgacctcctagaa

SEQ ID NO: 281992 - DNA, 20 bp, human
ggctcgcggcggcagggaag

SEQ ID NO: 281993 - DNA, 20 bp, human
gccgcgggggaagaggcgga

SEQ ID NO: 281994 - DNA, 20 bp, human
gtaaagagcgccctgtgggg

SEQ ID NO: 281995 - DNA, 20 bp, human
gtgaaacctggcgtaggggt

SEQ ID NO: 281996 - DNA, 20 bp, human
ggaaaacagggtggagtagg

SEQ ID NO: 281997 - DNA, 20 bp, human
gacactagcagcactagagt

SEQ ID NO: 281998 - DNA, 20 bp, human
gctagtgctgctagtgttat

SEQ ID NO: 281999 - DNA, 20 bp, human
gtgagcagtgtcccttctgt

SEQ ID NO: 282000 - DNA, 20 bp, human
gggctccctttgaaagcagt

SEQ ID NO: 282001 - DNA, 20 bp, human
gttcatgtttagatgggttg

SEQ ID NO: 282002 - DNA, 20 bp, human
gaaaagtgtagtggtgtcaa

SEQ ID NO: 282003 - DNA, 20 bp, human
gtctacagagtgtgaagtct

SEQ ID NO: 282004 - DNA, 20 bp, human
gctcagaaactacctcagca

SEQ ID NO: 282005 - DNA, 20 bp, human
gagaaactacctcagcaggg

SEQ ID NO: 282006 - DNA, 20 bp, human
gtactaggttaggagaggtt

SEQ ID NO: 282007 - DNA, 20 bp, human
gcctcacgcactgttctcaa

SEQ ID NO: 282008 - DNA, 20 bp, human
gagtgaatcaaagtctaagg

SEQ ID NO: 282009 - DNA, 20 bp, human
gaggagaggttaggaagcta

SEQ ID NO: 282010 - DNA, 20 bp, human
gtgccaaagcacttaagagt

SEQ ID NO: 282011 - DNA, 20 bp, human
gatagtggaactccattaac

SEQ ID NO: 282012 - DNA, 20 bp, human
gtaaaatcacaatctgaaaa

SEQ ID NO: 282013 - DNA, 20 bp, human
gttgccacatggagaactat

SEQ ID NO: 282014 - DNA, 20 bp, human
gaaaggctttgtactaggtt

SEQ ID NO: 282015 - DNA, 20 bp, human
gaaaactgggaatgtagagg

SEQ ID NO: 282016 - DNA, 20 bp, human
gctgtgggagcagtggactc

SEQ ID NO: 282017 - DNA, 20 bp, human
gtgggtggggcttagtttga

SEQ ID NO: 282018 - DNA, 20 bp, human
ggtggggcttagtttgaagg

SEQ ID NO: 282019 - DNA, 20 bp, human
ggtactgactcagatctggg

SEQ ID NO: 282020 - DNA, 20 bp, human
gtctgtactgactcagatct

SEQ ID NO: 282021 - DNA, 20 bp, human
gtctcagagagtaaagtcca

SEQ ID NO: 282022 - DNA, 20 bp, human
gtcacaggcagtccaacctc

SEQ ID NO: 282023 - DNA, 20 bp, human
gcaggcagtccaacctcagg

SEQ ID NO: 282024 - DNA, 20 bp, human
gacaggcaacctcctgaggt

SEQ ID NO: 282025 - DNA, 20 bp, human
gagcaagctagacaggtcac

SEQ ID NO: 282026 - DNA, 20 bp, human
gctctcgcgagaggagcaag

SEQ ID NO: 282027 - DNA, 20 bp, human
gcggtgtaaggcagcgacgg

SEQ ID NO: 282028 - DNA, 20 bp, human
gctgggaatagaaggtgcga

SEQ ID NO: 282029 - DNA, 20 bp, human
ggggagtgcgggttcggggt

SEQ ID NO: 282030 - DNA, 20 bp, human
gctgggggagctctcgcgag

SEQ ID NO: 282031 - DNA, 20 bp, human
gactgagatcctggtgtcgt

SEQ ID NO: 282032 - DNA, 20 bp, human
ggggacaaacgcatctcccg

SEQ ID NO: 282033 - DNA, 20 bp, human
gggaatagaaggtgcgaggg

SEQ ID NO: 282034 - DNA, 20 bp, human
gcggaaacacactgcctcgg

SEQ ID NO: 282035 - DNA, 20 bp, human
gcacaaggcgattagagcgg

SEQ ID NO: 282036 - DNA, 20 bp, human
gaggggcggggcccgctcgt

SEQ ID NO: 282037 - DNA, 20 bp, human
gggtaaccgcgggctcgcgt

SEQ ID NO: 282038 - DNA, 20 bp, human
gcgcgcggctactgtagagt

SEQ ID NO: 282039 - DNA, 20 bp, human
ggcgcggccagggtaaccgc

SEQ ID NO: 282040 - DNA, 20 bp, human
ggggcggtatcacgcgggag

SEQ ID NO: 282041 - DNA, 20 bp, human
ggggcggggcggtatcacgc

SEQ ID NO: 282042 - DNA, 20 bp, human
gccggagcacgaagttgtac

SEQ ID NO: 282043 - DNA, 20 bp, human
gtacagtagccgcgcggcca

SEQ ID NO: 282044 - DNA, 20 bp, human
gcggctactgtagagtgggc

SEQ ID NO: 282045 - DNA, 20 bp, human
gtccctcatctgctgaagaa

SEQ ID NO: 282046 - DNA, 20 bp, human
gtgcccggcgccggcctgtg

SEQ ID NO: 282047 - DNA, 20 bp, human
gctggactgaggctagcaag

SEQ ID NO: 282048 - DNA, 20 bp, human
ggaaatataaaaaagcctac

SEQ ID NO: 282049 - DNA, 20 bp, human
gataaaaaagcctacaggcc

SEQ ID NO: 282050 - DNA, 20 bp, human
ggccaccgctccaggcctgt

SEQ ID NO: 282051 - DNA, 20 bp, human
ggcctacaggcctggagcgg

SEQ ID NO: 282052 - DNA, 20 bp, human
gttttttatatttcagtatt

SEQ ID NO: 282053 - DNA, 20 bp, human
ggaggctagcaagcggggag

SEQ ID NO: 282054 - DNA, 20 bp, human
gcctccccacaggccggcgc

SEQ ID NO: 282055 - DNA, 20 bp, human
gggagctgaggtgcggggcg

SEQ ID NO: 282056 - DNA, 20 bp, human
gcaggtccgcagctgtgcga

SEQ ID NO: 282057 - DNA, 20 bp, human
ggtaaatgaggcacgagctt

SEQ ID NO: 282058 - DNA, 20 bp, human
ggggcctgtcaatcccttta

SEQ ID NO: 282059 - DNA, 20 bp, human
gcacgcgctctcaccgctcg

SEQ ID NO: 282060 - DNA, 20 bp, human
gtgtggggacaaggtttccg

SEQ ID NO: 282061 - DNA, 20 bp, human
gcgagcgtgtgcagcgggac

SEQ ID NO: 282062 - DNA, 20 bp, human
gaggagcggcctgacgcggc

SEQ ID NO: 282063 - DNA, 20 bp, human
gaaagcagagggcgtgtggg

SEQ ID NO: 282064 - DNA, 20 bp, human
gcgcgcgcgcccttctccgt

SEQ ID NO: 282065 - DNA, 20 bp, human
gcgcccgcaggctgtaaatg

SEQ ID NO: 282066 - DNA, 20 bp, human
ggtagcggaaacggtcgctc

SEQ ID NO: 282067 - DNA, 20 bp, human
gtccgctacgcgacggggaa

SEQ ID NO: 282068 - DNA, 20 bp, human
ggggaggatagaacggacta

SEQ ID NO: 282069 - DNA, 20 bp, human
gcgcctggaggaaatagttg

SEQ ID NO: 282070 - DNA, 20 bp, human
gctacgcgacggggaagggc

SEQ ID NO: 282071 - DNA, 20 bp, human
gccccgtcgcgtagcggaaa

SEQ ID NO: 282072 - DNA, 20 bp, human
ggagggagaggaagggatcg

SEQ ID NO: 282073 - DNA, 20 bp, human
ggcggggcaagaacgacgcc

SEQ ID NO: 282074 - DNA, 20 bp, human
gagaggaagggatcggggac

SEQ ID NO: 282075 - DNA, 20 bp, human
ggggcaagaacgacgcctgg

SEQ ID NO: 282076 - DNA, 20 bp, human
ggtcccaggtgggtacaggt

SEQ ID NO: 282077 - DNA, 20 bp, human
gcggggtcggggtcccaggt

SEQ ID NO: 282078 - DNA, 20 bp, human
gagggtgggcccctccccgc

SEQ ID NO: 282079 - DNA, 20 bp, human
gaggggcccaccctacccgc

SEQ ID NO: 282080 - DNA, 20 bp, human
gaggaagagctgcgagccga

SEQ ID NO: 282081 - DNA, 20 bp, human
gagcacgggactcgggtggt

SEQ ID NO: 282082 - DNA, 20 bp, human
gctgagacgcgaccaggacg

SEQ ID NO: 282083 - DNA, 20 bp, human
gggagggcgaacctgcgggt

SEQ ID NO: 282084 - DNA, 20 bp, human
ggcggggctgagacgcgacc

SEQ ID NO: 282085 - DNA, 20 bp, human
ggcgagtcccagaaaccctg

SEQ ID NO: 282086 - DNA, 20 bp, human
gctcctggggaagcccgggc

SEQ ID NO: 282087 - DNA, 20 bp, human
gtgggctcctggggaagccc

SEQ ID NO: 282088 - DNA, 20 bp, human
ggcagtgactgcaagctcgg

SEQ ID NO: 282089 - DNA, 20 bp, human
gactgcaagctcgggggtct

SEQ ID NO: 282090 - DNA, 20 bp, human
gccagcagtgactgcaagct

SEQ ID NO: 282091 - DNA, 20 bp, human
gctcgggggtctgggctcct

SEQ ID NO: 282092 - DNA, 20 bp, human
gagcccgccccgcctagtgc

SEQ ID NO: 282093 - DNA, 20 bp, human
gtaggcggggcgggctgccg

SEQ ID NO: 282094 - DNA, 20 bp, human
gacctcgcccctgaaatacc

SEQ ID NO: 282095 - DNA, 20 bp, human
ggcggtcccagcactaggcg

SEQ ID NO: 282096 - DNA, 20 bp, human
ggcccccagtacctgatccc

SEQ ID NO: 282097 - DNA, 20 bp, human
gtctcccagggatcaggtac

SEQ ID NO: 282098 - DNA, 20 bp, human
gcccagggatcaggtactgg

SEQ ID NO: 282099 - DNA, 20 bp, human
gcctgatccctgggagagtg

SEQ ID NO: 282100 - DNA, 20 bp, human
ggatcaggtactgggggcag

SEQ ID NO: 282101 - DNA, 20 bp, human
gcccattgtagaaacccggc

SEQ ID NO: 282102 - DNA, 20 bp, human
gtcctgccgggtttctacaa

SEQ ID NO: 282103 - DNA, 20 bp, human
gcagtgattgactctcctgc

SEQ ID NO: 282104 - DNA, 20 bp, human
gagcgcagagggcatagcgg

SEQ ID NO: 282105 - DNA, 20 bp, human
gcggagcgcagagggcatag

SEQ ID NO: 282106 - DNA, 20 bp, human
gcgaagacccgcggagtcgg

SEQ ID NO: 282107 - DNA, 20 bp, human
ggagccggagcggagatgaa

SEQ ID NO: 282108 - DNA, 20 bp, human
gcgccgaagacccgcggagt

SEQ ID NO: 282109 - DNA, 20 bp, human
gaggaagagcgtcgaggctc

SEQ ID NO: 282110 - DNA, 20 bp, human
gctccgggtgggacctgaga

SEQ ID NO: 282111 - DNA, 20 bp, human
gagagggccagctgagacgt

SEQ ID NO: 282112 - DNA, 20 bp, human
gggctctcgcaggagacaag

SEQ ID NO: 282113 - DNA, 20 bp, human
ggacgctcttccttctgcgt

SEQ ID NO: 282114 - DNA, 20 bp, human
gggagcggagatgaagggtg

SEQ ID NO: 282115 - DNA, 20 bp, human
gtgagaaggcacccggcgtg

SEQ ID NO: 282116 - DNA, 20 bp, human
gcaccgccttccttcggaga

SEQ ID NO: 282117 - DNA, 20 bp, human
ggactctgcgccttctccga

SEQ ID NO: 282118 - DNA, 20 bp, human
gcgcaagcccgcctcacctg

SEQ ID NO: 282119 - DNA, 20 bp, human
gccgctctcagccaatcagg

SEQ ID NO: 282120 - DNA, 20 bp, human
ggattggctgagagcggcgt

SEQ ID NO: 282121 - DNA, 20 bp, human
gcagctgaccgcctcctgat

SEQ ID NO: 282122 - DNA, 20 bp, human
gcgcctgcgtcgctcgccat

SEQ ID NO: 282123 - DNA, 20 bp, human
gcgggttcctcgagatccaa

SEQ ID NO: 282124 - DNA, 20 bp, human
gcccgcctcacctgaggtgg

SEQ ID NO: 282125 - DNA, 20 bp, human
gaggagctgaggcagcgtca

SEQ ID NO: 282126 - DNA, 20 bp, human
ggatgagctgcgagagagag

SEQ ID NO: 282127 - DNA, 20 bp, human
ggggctagacactagtccca

SEQ ID NO: 282128 - DNA, 20 bp, human
gtccagagacataaagaacg

SEQ ID NO: 282129 - DNA, 20 bp, human
gctgagggtgcgcctcctaa

SEQ ID NO: 282130 - DNA, 20 bp, human
gcatctctatggtttccgtt

SEQ ID NO: 282131 - DNA, 20 bp, human
ggctccactgctgaagaaat

SEQ ID NO: 282132 - DNA, 20 bp, human
gacactagtcccacggaata

SEQ ID NO: 282133 - DNA, 20 bp, human
ggtatgcagctctacatcct

SEQ ID NO: 282134 - DNA, 20 bp, human
gcataaagaacgcggagccg

SEQ ID NO: 282135 - DNA, 20 bp, human
gtccgcgttctttatgtctc

SEQ ID NO: 282136 - DNA, 20 bp, human
gaacgacagctggcccaaaa

SEQ ID NO: 282137 - DNA, 20 bp, human
gagggcctggaatagagtag

SEQ ID NO: 282138 - DNA, 20 bp, human
gtggaatagagtaggggaca

SEQ ID NO: 282139 - DNA, 20 bp, human
gggtgtgcatggatccaatc

SEQ ID NO: 282140 - DNA, 20 bp, human
ggggtgcctcacattggaca

SEQ ID NO: 282141 - DNA, 20 bp, human
gcgccccctcctggctgggt

SEQ ID NO: 282142 - DNA, 20 bp, human
gaactctatcccaccccttt

SEQ ID NO: 282143 - DNA, 20 bp, human
gcttgttaggcccagagcca

SEQ ID NO: 282144 - DNA, 20 bp, human
ggggggcggttagaaacatg

SEQ ID NO: 282145 - DNA, 20 bp, human
ggagggggcgctgagagggg

SEQ ID NO: 282146 - DNA, 20 bp, human
gagagcagagtgaactgagt

SEQ ID NO: 282147 - DNA, 20 bp, human
gacactgccgaggaagtccg

SEQ ID NO: 282148 - DNA, 20 bp, human
gcggcgaggggcgtggttgg

SEQ ID NO: 282149 - DNA, 20 bp, human
ggaaagacttggaaaggcaa

SEQ ID NO: 282150 - DNA, 20 bp, human
ggaaaaggaggcggaaccag

SEQ ID NO: 282151 - DNA, 20 bp, human
gccctcgccgcggacttcct

SEQ ID NO: 282152 - DNA, 20 bp, human
gggaaccagagggaaagact

SEQ ID NO: 282153 - DNA, 20 bp, human
gtgaggctctgattgggcaa

SEQ ID NO: 282154 - DNA, 20 bp, human
gcctccccacgccgcgcggt

SEQ ID NO: 282155 - DNA, 20 bp, human
gggtcagaggggctcaactg

SEQ ID NO: 282156 - DNA, 20 bp, human
gtaccccggctctagcgtac

SEQ ID NO: 282157 - DNA, 20 bp, human
gacgctagagccggggtagt

SEQ ID NO: 282158 - DNA, 20 bp, human
gtgcagagcgggtcctggat

SEQ ID NO: 282159 - DNA, 20 bp, human
ggcggccgctggcctctgat

SEQ ID NO: 282160 - DNA, 20 bp, human
ggagtgctggcccactaccc

SEQ ID NO: 282161 - DNA, 20 bp, human
ggtagtgggccagcactcac

SEQ ID NO: 282162 - DNA, 20 bp, human
gtccgccagtacgctagagc

SEQ ID NO: 282163 - DNA, 20 bp, human
ggtgcccgggcgcgaacccc

SEQ ID NO: 282164 - DNA, 20 bp, human
gtccgctgcccgaggggaaa

SEQ ID NO: 282165 - DNA, 20 bp, human
gagaggccagcggccgcaaa

SEQ ID NO: 282166 - DNA, 20 bp, human
gacagaccaaaggccagcgg

SEQ ID NO: 282167 - DNA, 20 bp, human
gcccccatctgcatccctat

SEQ ID NO: 282168 - DNA, 20 bp, human
gtggaaaagtccacagatgg

SEQ ID NO: 282169 - DNA, 20 bp, human
gcacccatagggatgcagat

SEQ ID NO: 282170 - DNA, 20 bp, human
gcctgtgggagctacagagc

SEQ ID NO: 282171 - DNA, 20 bp, human
ggcccaaggatcacacccat

SEQ ID NO: 282172 - DNA, 20 bp, human
gatctggtctaggacatttc

SEQ ID NO: 282173 - DNA, 20 bp, human
gccctatgggtgtgatcctt

SEQ ID NO: 282174 - DNA, 20 bp, human
gaaagtccacagatggtggt

SEQ ID NO: 282175 - DNA, 20 bp, human
gaactggctaccttcatccc

SEQ ID NO: 282176 - DNA, 20 bp, human
ggcttgtggaagaagtcctg

SEQ ID NO: 282177 - DNA, 20 bp, human
gtgagatcactgggaacctc

SEQ ID NO: 282178 - DNA, 20 bp, human
gcctgcaaaatgaaaaaatt

SEQ ID NO: 282179 - DNA, 20 bp, human
gtagcctggcttgtctacat

SEQ ID NO: 282180 - DNA, 20 bp, human
gagtatggcagtgccaacat

SEQ ID NO: 282181 - DNA, 20 bp, human
gtcggtagtgaaaagtgtga

SEQ ID NO: 282182 - DNA, 20 bp, human
gcttccagatttacaggtat

SEQ ID NO: 282183 - DNA, 20 bp, human
gcattgtctagcatagcaac

SEQ ID NO: 282184 - DNA, 20 bp, human
ggaagtatttttgcctatgt

SEQ ID NO: 282185 - DNA, 20 bp, human
gcaactctgcagaatgtgca

SEQ ID NO: 282186 - DNA, 20 bp, human
gaagccttgtgcacgccttc

SEQ ID NO: 282187 - DNA, 20 bp, human
ggtaacaaactccttccgga

SEQ ID NO: 282188 - DNA, 20 bp, human
gtcccggtgaaggtcatgaa

SEQ ID NO: 282189 - DNA, 20 bp, human
gggaaggagtttgttacacg

SEQ ID NO: 282190 - DNA, 20 bp, human
gtctgaaccggaatgctcga

SEQ ID NO: 282191 - DNA, 20 bp, human
gtgaaggtcatgaaaggggc

SEQ ID NO: 282192 - DNA, 20 bp, human
gcaaatgctcgttgcatcct

SEQ ID NO: 282193 - DNA, 20 bp, human
gcacgaggtctgagagacag

SEQ ID NO: 282194 - DNA, 20 bp, human
gagcacggtagtgctacaaa

SEQ ID NO: 282195 - DNA, 20 bp, human
gcttgtgcacgccttccgga

SEQ ID NO: 282196 - DNA, 20 bp, human
gaagccccgccgtgaagggt

SEQ ID NO: 282197 - DNA, 20 bp, human
gtgtcccgggtgctctcccg

SEQ ID NO: 282198 - DNA, 20 bp, human
gcgcgtgcgcgtaccctcct

SEQ ID NO: 282199 - DNA, 20 bp, human
gccgcgggcaacggggtttg

SEQ ID NO: 282200 - DNA, 20 bp, human
ggcccgggacgcacacgacg

SEQ ID NO: 282201 - DNA, 20 bp, human
gacgacgtggcgcacgtccg

SEQ ID NO: 282202 - DNA, 20 bp, human
ggccccaccccgcgggcaac

SEQ ID NO: 282203 - DNA, 20 bp, human
gtgctcgcggctataagggg

SEQ ID NO: 282204 - DNA, 20 bp, human
ggccacgtcgtgtgcgtccc

SEQ ID NO: 282205 - DNA, 20 bp, human
gccccgttgcccgcggggtg

SEQ ID NO: 282206 - DNA, 20 bp, human
ggggtggggctaggcgtccc

SEQ ID NO: 282207 - DNA, 20 bp, human
ggctgctcagggcaacgcaa

SEQ ID NO: 282208 - DNA, 20 bp, human
gggcgtcccgggcggacaga

SEQ ID NO: 282209 - DNA, 20 bp, human
gtgcgcaccaaaacacggaa

SEQ ID NO: 282210 - DNA, 20 bp, human
gtaggggaactcaggcccat

SEQ ID NO: 282211 - DNA, 20 bp, human
gagccctgcgcatgcccgtt

SEQ ID NO: 282212 - DNA, 20 bp, human
ggcaaaggcggggagcctat

SEQ ID NO: 282213 - DNA, 20 bp, human
ggccgagcctgcgcagttag

SEQ ID NO: 282214 - DNA, 20 bp, human
gtcggcctccgggacccaac

SEQ ID NO: 282215 - DNA, 20 bp, human
gtggggctaggcgtcccggg

SEQ ID NO: 282216 - DNA, 20 bp, human
gcgcacgcgcaagattaggt

SEQ ID NO: 282217 - DNA, 20 bp, human
gagagccggggcacctgcgc

SEQ ID NO: 282218 - DNA, 20 bp, human
gcaagcctgcgcaggtgccc

SEQ ID NO: 282219 - DNA, 20 bp, human
ggagaggctcggaagaaggg

SEQ ID NO: 282220 - DNA, 20 bp, human
gccccaggagacaagaaagg

SEQ ID NO: 282221 - DNA, 20 bp, human
gcagcgcgctagagcgcctc

SEQ ID NO: 282222 - DNA, 20 bp, human
gtaatcttgcgcgtgcgcac

SEQ ID NO: 282223 - DNA, 20 bp, human
gcctcagggacctccggctt

SEQ ID NO: 282224 - DNA, 20 bp, human
ggcgtgcgcactggcgacct

SEQ ID NO: 282225 - DNA, 20 bp, human
gtccggcttggggaagttcc

SEQ ID NO: 282226 - DNA, 20 bp, human
gcggggaagcggggtagtgg

SEQ ID NO: 282227 - DNA, 20 bp, human
gaaagtggctgcagaggcaa

SEQ ID NO: 282228 - DNA, 20 bp, human
gactagtaaggggatccaat

SEQ ID NO: 282229 - DNA, 20 bp, human
gtcacagagaaactagtaag

SEQ ID NO: 282230 - DNA, 20 bp, human
gcgggctcttttcatctcat

SEQ ID NO: 282231 - DNA, 20 bp, human
ggactagaagacgaaaccaa

SEQ ID NO: 282232 - DNA, 20 bp, human
ggtggggctaaaggtgaacg

SEQ ID NO: 282233 - DNA, 20 bp, human
gaaagagcccgcctccaaag

SEQ ID NO: 282234 - DNA, 20 bp, human
gcgcccggagtccccaccca

SEQ ID NO: 282235 - DNA, 20 bp, human
ggcgcggggaagcggggtag

SEQ ID NO: 282236 - DNA, 20 bp, human
gccaacgaggcgcaggggtc

SEQ ID NO: 282237 - DNA, 20 bp, human
gggtgacatcacagaggcgc

SEQ ID NO: 282238 - DNA, 20 bp, human
gcgctgggcgctctgcgact

SEQ ID NO: 282239 - DNA, 20 bp, human
gcaggggtcaggacgactct

SEQ ID NO: 282240 - DNA, 20 bp, human
gtgacataatggagcttgtt

SEQ ID NO: 282241 - DNA, 20 bp, human
gcggaggccggcctcaaaac

SEQ ID NO: 282242 - DNA, 20 bp, human
gcagagcgcccagcgcgtcg

SEQ ID NO: 282243 - DNA, 20 bp, human
gaaaaccggctgccactaga

SEQ ID NO: 282244 - DNA, 20 bp, human
ggcgggagcgtttgacataa

SEQ ID NO: 282245 - DNA, 20 bp, human
gcttgttgggtgttctggac

SEQ ID NO: 282246 - DNA, 20 bp, human
gcggggaagccgttcggcga

SEQ ID NO: 282247 - DNA, 20 bp, human
gcgggaccacggtgactgac

SEQ ID NO: 282248 - DNA, 20 bp, human
gggccccgagaggctagtcg

SEQ ID NO: 282249 - DNA, 20 bp, human
gcggggccgagccagcggag

SEQ ID NO: 282250 - DNA, 20 bp, human
gggcgggcggggaagccgtt

SEQ ID NO: 282251 - DNA, 20 bp, human
gcctcgaggcgcgtggtgac

SEQ ID NO: 282252 - DNA, 20 bp, human
gaggcgcgtggtgactggtc

SEQ ID NO: 282253 - DNA, 20 bp, human
gggcgagcgagggcatatca

SEQ ID NO: 282254 - DNA, 20 bp, human
ggaagccgttcggcgagggg

SEQ ID NO: 282255 - DNA, 20 bp, human
gacggggcgaggcctggatg

SEQ ID NO: 282256 - DNA, 20 bp, human
ggcaccgcctgcctgtaagg

SEQ ID NO: 282257 - DNA, 20 bp, human
gagtctcactagggagacaa

SEQ ID NO: 282258 - DNA, 20 bp, human
gcgtgtcccgagatcgcggg

SEQ ID NO: 282259 - DNA, 20 bp, human
gtaaacccggaggggagggt

SEQ ID NO: 282260 - DNA, 20 bp, human
gacaagggtcaggattacgt

SEQ ID NO: 282261 - DNA, 20 bp, human
gaggccgggcgctgttaggc

SEQ ID NO: 282262 - DNA, 20 bp, human
gtcccgagatcgcggggggt

SEQ ID NO: 282263 - DNA, 20 bp, human
gtccacatctgcattccgat

SEQ ID NO: 282264 - DNA, 20 bp, human
ggaggcgtttgcgggcgcgg

SEQ ID NO: 282265 - DNA, 20 bp, human
gcggtggcctcgcggtgcct

SEQ ID NO: 282266 - DNA, 20 bp, human
gcggggcgggtgaatagttc

SEQ ID NO: 282267 - DNA, 20 bp, human
ggcagctgaatggactctct

SEQ ID NO: 282268 - DNA, 20 bp, human
gcgggtgaatagttccggcg

SEQ ID NO: 282269 - DNA, 20 bp, human
gcgcgccatgacacctactg

SEQ ID NO: 282270 - DNA, 20 bp, human
gggccggccgggttgaggga

SEQ ID NO: 282271 - DNA, 20 bp, human
gagccagcgtggatcgagtg

SEQ ID NO: 282272 - DNA, 20 bp, human
gaacggcggctgcggagcaa

SEQ ID NO: 282273 - DNA, 20 bp, human
ggcggggccggccgggttga

SEQ ID NO: 282274 - DNA, 20 bp, human
gaggtgtcatggcgcggggc

SEQ ID NO: 282275 - DNA, 20 bp, human
gtcggtgggcctcgagtagg

SEQ ID NO: 282276 - DNA, 20 bp, human
gcggggaaggccgaaccgaa

SEQ ID NO: 282277 - DNA, 20 bp, human
gcgaggggaccgcgctggga

SEQ ID NO: 282278 - DNA, 20 bp, human
gcaatcgagcgccgatggca

SEQ ID NO: 282279 - DNA, 20 bp, human
gccggcgcggctctgccctt

SEQ ID NO: 282280 - DNA, 20 bp, human
gcctccgcggatccgctcgg

SEQ ID NO: 282281 - DNA, 20 bp, human
gagggcgggccccgggtagt

SEQ ID NO: 282282 - DNA, 20 bp, human
gccccgggtagtgggtgaga

SEQ ID NO: 282283 - DNA, 20 bp, human
gcgatggcacggatgcgagg

SEQ ID NO: 282284 - DNA, 20 bp, human
ggcggctctgcccttcggtt

SEQ ID NO: 282285 - DNA, 20 bp, human
gcgtgtgtgcccaggtgcga

SEQ ID NO: 282286 - DNA, 20 bp, human
ggactggcgggcggaccccg

SEQ ID NO: 282287 - DNA, 20 bp, human
ggctccgggcaacaagggcg

SEQ ID NO: 282288 - DNA, 20 bp, human
ggcccctcctccgcgctcgt

SEQ ID NO: 282289 - DNA, 20 bp, human
gggcgcggctgcggactggc

SEQ ID NO: 282290 - DNA, 20 bp, human
gctccgggttggggccgcac

SEQ ID NO: 282291 - DNA, 20 bp, human
ggcccgcctgccagcccgtg

SEQ ID NO: 282292 - DNA, 20 bp, human
gcctccgcgctcgtcggcct

SEQ ID NO: 282293 - DNA, 20 bp, human
ggccgacgagcgcggaggag

SEQ ID NO: 282294 - DNA, 20 bp, human
ggcttggcttgcgggactcc

SEQ ID NO: 282295 - DNA, 20 bp, human
ggcggctgcggactggcggg

SEQ ID NO: 282296 - DNA, 20 bp, human
ggggaagagaggctccccgt

SEQ ID NO: 282297 - DNA, 20 bp, human
gccctgccaaggttgcgcaa

SEQ ID NO: 282298 - DNA, 20 bp, human
ggccctgggccgccggacgc

SEQ ID NO: 282299 - DNA, 20 bp, human
gcgggcctctaggaaggtaa

SEQ ID NO: 282300 - DNA, 20 bp, human
gaggctacggcccccgcgtc

SEQ ID NO: 282301 - DNA, 20 bp, human
gtacggcctaggactgcgga

SEQ ID NO: 282302 - DNA, 20 bp, human
gctacggcccccgcgtccgg

SEQ ID NO: 282303 - DNA, 20 bp, human
gagcgctggggatgcggatg

SEQ ID NO: 282304 - DNA, 20 bp, human
gcacgagagcgctggggatg

SEQ ID NO: 282305 - DNA, 20 bp, human
gcgcggcttcccggaggcta

SEQ ID NO: 282306 - DNA, 20 bp, human
ggggtctaatcgtgggcctt

SEQ ID NO: 282307 - DNA, 20 bp, human
gacaggaatggggataaggc

SEQ ID NO: 282308 - DNA, 20 bp, human
gcaggtgaagtgttgacaga

SEQ ID NO: 282309 - DNA, 20 bp, human
gcagaggggggtctaatcgt

SEQ ID NO: 282310 - DNA, 20 bp, human
ggcatacaggaatggggata

SEQ ID NO: 282311 - DNA, 20 bp, human
ggtgaagtgttgacagaggg

SEQ ID NO: 282312 - DNA, 20 bp, human
gcccacagtagccacagact

SEQ ID NO: 282313 - DNA, 20 bp, human
gcccctcccccgcccagtgg

SEQ ID NO: 282314 - DNA, 20 bp, human
gggccttgggcatacaggaa

SEQ ID NO: 282315 - DNA, 20 bp, human
gccccattcctgtatgccca

SEQ ID NO: 282316 - DNA, 20 bp, human
ggggtcgcagggtaaatccg

SEQ ID NO: 282317 - DNA, 20 bp, human
gaaccaatagcaaccgaggg

SEQ ID NO: 282318 - DNA, 20 bp, human
gacgacagcgccattcaccc

SEQ ID NO: 282319 - DNA, 20 bp, human
gaagacgtgattgaatgtgt

SEQ ID NO: 282320 - DNA, 20 bp, human
gtgtcggcgcttctcgaaga

SEQ ID NO: 282321 - DNA, 20 bp, human
gagccgccctcggttgctat

SEQ ID NO: 282322 - DNA, 20 bp, human
gcggcgcttctcgaagaagg

SEQ ID NO: 282323 - DNA, 20 bp, human
gccgcctggcccggggtgaa

SEQ ID NO: 282324 - DNA, 20 bp, human
gagcaaccaatagcaaccga

SEQ ID NO: 282325 - DNA, 20 bp, human
gttgagaggcggctgacgta

SEQ ID NO: 282326 - DNA, 20 bp, human
gaaagggcggttcgcctgga

SEQ ID NO: 282327 - DNA, 20 bp, human
gccgaagcccctgccagcgg

SEQ ID NO: 282328 - DNA, 20 bp, human
ggctggcaggggcttcgggt

SEQ ID NO: 282329 - DNA, 20 bp, human
gagcgcgtgttgatgaatga

SEQ ID NO: 282330 - DNA, 20 bp, human
ggggcggcccagtccgcgtg

SEQ ID NO: 282331 - DNA, 20 bp, human
gcagaccgaccaaccggcta

SEQ ID NO: 282332 - DNA, 20 bp, human
gaggcagagctggtgacggg

SEQ ID NO: 282333 - DNA, 20 bp, human
gcaggcgaaccgccctttct

SEQ ID NO: 282334 - DNA, 20 bp, human
gggacggcggacagcgagcg

SEQ ID NO: 282335 - DNA, 20 bp, human
gcgcacctgccaaatcgccc

SEQ ID NO: 282336 - DNA, 20 bp, human
gctcaggggcgtcaccgcac

SEQ ID NO: 282337 - DNA, 20 bp, human
gctgcggcaacgtggggcga

SEQ ID NO: 282338 - DNA, 20 bp, human
gccttggccgcggaccgcgt

SEQ ID NO: 282339 - DNA, 20 bp, human
gcgcagtgctgcggcaacgt

SEQ ID NO: 282340 - DNA, 20 bp, human
gctcccgctaccccaagcag

SEQ ID NO: 282341 - DNA, 20 bp, human
gcggtgacgcccctgagcgc

SEQ ID NO: 282342 - DNA, 20 bp, human
ggtgagaaaggcagcgtcgc

SEQ ID NO: 282343 - DNA, 20 bp, human
ggcacgggccgacctcccgg

SEQ ID NO: 282344 - DNA, 20 bp, human
gcacagccttgcagcgtctc

SEQ ID NO: 282345 - DNA, 20 bp, human
ggaccgttggcccttggccg

SEQ ID NO: 282346 - DNA, 20 bp, human
ggccccctgcgcgctgccga

SEQ ID NO: 282347 - DNA, 20 bp, human
gaaaccctcggcagcgcgca

SEQ ID NO: 282348 - DNA, 20 bp, human
gtgggggcctctagggccta

SEQ ID NO: 282349 - DNA, 20 bp, human
gttagggagtaggttgagag

SEQ ID NO: 282350 - DNA, 20 bp, human
gtgagactgggcgaaaccct

SEQ ID NO: 282351 - DNA, 20 bp, human
gaccctctgatgttactggg

SEQ ID NO: 282352 - DNA, 20 bp, human
ggcaggaccataggccctag

SEQ ID NO: 282353 - DNA, 20 bp, human
gcacacagaaaaagccgctc

SEQ ID NO: 282354 - DNA, 20 bp, human
ggggggcgctagggcgcgag

SEQ ID NO: 282355 - DNA, 20 bp, human
ggccgcccagtaacatcaga

SEQ ID NO: 282356 - DNA, 20 bp, human
gtggacgctccaccaatcac

SEQ ID NO: 282357 - DNA, 20 bp, human
gcggccagagggcggtggat

SEQ ID NO: 282358 - DNA, 20 bp, human
gtggcactttgaagctccaa

SEQ ID NO: 282359 - DNA, 20 bp, human
gggagtccaaccgcgagcgg

SEQ ID NO: 282360 - DNA, 20 bp, human
gaacaagtatgtgaacctgg

SEQ ID NO: 282361 - DNA, 20 bp, human
ggccggcgctgccctgtgat

SEQ ID NO: 282362 - DNA, 20 bp, human
gcgccggcttatataagccc

SEQ ID NO: 282363 - DNA, 20 bp, human
gaaaacaatggtacagaatt

SEQ ID NO: 282364 - DNA, 20 bp, human
ggcgagcggcggcggccaga

SEQ ID NO: 282365 - DNA, 20 bp, human
gcgtccaatccaccgccctc

SEQ ID NO: 282366 - DNA, 20 bp, human
gtccccgcaccaaatcactt

SEQ ID NO: 282367 - DNA, 20 bp, human
gcaacttgggagcagcgcag

SEQ ID NO: 282368 - DNA, 20 bp, human
gaaacccaagtgatttggtg

SEQ ID NO: 282369 - DNA, 20 bp, human
gtgaccaaacccaagtgatt

SEQ ID NO: 282370 - DNA, 20 bp, human
gggtgctctggtcgcccgcc

SEQ ID NO: 282371 - DNA, 20 bp, human
gggtcgcccgcctggctggc

SEQ ID NO: 282372 - DNA, 20 bp, human
gagcgcaggcgcgctctgat

SEQ ID NO: 282373 - DNA, 20 bp, human
gcgcgctctgattggtgctc

SEQ ID NO: 282374 - DNA, 20 bp, human
gccaattcccccaactccga

SEQ ID NO: 282375 - DNA, 20 bp, human
gtgcagtcgcacaggaactg

SEQ ID NO: 282376 - DNA, 20 bp, human
gcagcagcgcggtagatacg

SEQ ID NO: 282377 - DNA, 20 bp, human
gagagacgctgagtgatgat

SEQ ID NO: 282378 - DNA, 20 bp, human
gaatgaagcccgaactctct

SEQ ID NO: 282379 - DNA, 20 bp, human
gaaactgatccgagagagtt

SEQ ID NO: 282380 - DNA, 20 bp, human
gcagcgccgcgcatggagca

SEQ ID NO: 282381 - DNA, 20 bp, human
gtgcgcggcgctgctggaaa

SEQ ID NO: 282382 - DNA, 20 bp, human
gagtaaaaatataagaaatc

SEQ ID NO: 282383 - DNA, 20 bp, human
gttcgcaggaacaatagcac

SEQ ID NO: 282384 - DNA, 20 bp, human
gggcaacaaacacagcagcg

SEQ ID NO: 282385 - DNA, 20 bp, human
gaaactatgcatagaaacaa

SEQ ID NO: 282386 - DNA, 20 bp, human
gctggacagcgcaccaatca

SEQ ID NO: 282387 - DNA, 20 bp, human
gacacaactcgggatccgag

SEQ ID NO: 282388 - DNA, 20 bp, human
gtgagaaaaaccgggcagtt

SEQ ID NO: 282389 - DNA, 20 bp, human
gtctgcggctgccagcgagg

SEQ ID NO: 282390 - DNA, 20 bp, human
gtgcgtgaagcctgagggtt

SEQ ID NO: 282391 - DNA, 20 bp, human
gtaagtgagggaagtaacac

SEQ ID NO: 282392 - DNA, 20 bp, human
gagctccgccctatataaac

SEQ ID NO: 282393 - DNA, 20 bp, human
gtaatgatccccgaaccctc

SEQ ID NO: 282394 - DNA, 20 bp, human
gggtgtaacaaacacaactc

SEQ ID NO: 282395 - DNA, 20 bp, human
ggagatctgcgtgaagcctg

SEQ ID NO: 282396 - DNA, 20 bp, human
gcgcccccgccccttggagg

SEQ ID NO: 282397 - DNA, 20 bp, human
gactcctcctccaaggggcg

SEQ ID NO: 282398 - DNA, 20 bp, human
ggggctttctcgaatagttt

SEQ ID NO: 282399 - DNA, 20 bp, human
ggggtagggcgcgctgtgat

SEQ ID NO: 282400 - DNA, 20 bp, human
gctgggagattctgtaaaga

SEQ ID NO: 282401 - DNA, 20 bp, human
ggcgcgccctaccctatata

SEQ ID NO: 282402 - DNA, 20 bp, human
ggatagcttcaaatcggtag

SEQ ID NO: 282403 - DNA, 20 bp, human
gcaaatggatagcttcaaat

SEQ ID NO: 282404 - DNA, 20 bp, human
gattattcagcactagaccc

SEQ ID NO: 282405 - DNA, 20 bp, human
gtgtgattggtgcatcacct

SEQ ID NO: 282406 - DNA, 20 bp, human
ggcgagcgaggcatcacgtt

SEQ ID NO: 282407 - DNA, 20 bp, human
gggccctcaaacgccgcgtt

SEQ ID NO: 282408 - DNA, 20 bp, human
gccaagtaaacaaacagaac

SEQ ID NO: 282409 - DNA, 20 bp, human
gttggcatttgctatctgat

SEQ ID NO: 282410 - DNA, 20 bp, human
gggaaagtgctgtgtaaccc

SEQ ID NO: 282411 - DNA, 20 bp, human
gcaaaatctgattggacaat

SEQ ID NO: 282412 - DNA, 20 bp, human
gctgattggacaatgggaag

SEQ ID NO: 282413 - DNA, 20 bp, human
gtcggtatccaaaatctgat

SEQ ID NO: 282414 - DNA, 20 bp, human
gtcaaagatatcagtgacga

SEQ ID NO: 282415 - DNA, 20 bp, human
gcctatttatagtctgactg

SEQ ID NO: 282416 - DNA, 20 bp, human
gaatccttccgtctggtgta

SEQ ID NO: 282417 - DNA, 20 bp, human
gaatccgggaaaagcacgag

SEQ ID NO: 282418 - DNA, 20 bp, human
gtcaagccagactggggatt

SEQ ID NO: 282419 - DNA, 20 bp, human
gaaaccttacaccagacgga

SEQ ID NO: 282420 - DNA, 20 bp, human
gctgtgaggaattctcccat

SEQ ID NO: 282421 - DNA, 20 bp, human
gaaggctcgtcaagccagac

SEQ ID NO: 282422 - DNA, 20 bp, human
gtgcatgtaatccttccgtc

SEQ ID NO: 282423 - DNA, 20 bp, human
gtgactggaggtaggctgtg

SEQ ID NO: 282424 - DNA, 20 bp, human
gaagtatttatactgactgg

SEQ ID NO: 282425 - DNA, 20 bp, human
gcagccgctcgtgcttttcc

SEQ ID NO: 282426 - DNA, 20 bp, human
gagagtacctcttagttaat

SEQ ID NO: 282427 - DNA, 20 bp, human
gctgcacagttgtcatccgt

SEQ ID NO: 282428 - DNA, 20 bp, human
gagggcttttatgctaatga

SEQ ID NO: 282429 - DNA, 20 bp, human
gcaactacgcagagcgggtt

SEQ ID NO: 282430 - DNA, 20 bp, human
gcggatttctgctacttata

SEQ ID NO: 282431 - DNA, 20 bp, human
gtaaaggcaactacgcagag

SEQ ID NO: 282432 - DNA, 20 bp, human
ggaaagtacagcttttctat

SEQ ID NO: 282433 - DNA, 20 bp, human
gtgtcttccaattaactaag

SEQ ID NO: 282434 - DNA, 20 bp, human
ggtaaatccgactttttgat

SEQ ID NO: 282435 - DNA, 20 bp, human
gtaccgaccaatcaaaaagt

SEQ ID NO: 282436 - DNA, 20 bp, human
ggtaaataacgctatttgat

SEQ ID NO: 282437 - DNA, 20 bp, human
ggccctgtggtatgcaaatt

SEQ ID NO: 282438 - DNA, 20 bp, human
gtctagcgtttctttgcaat

SEQ ID NO: 282439 - DNA, 20 bp, human
gccgctcctgctccaaaaaa

SEQ ID NO: 282440 - DNA, 20 bp, human
gcacctaatttgcataccac

SEQ ID NO: 282441 - DNA, 20 bp, human
gattgtctctgtgtgccctg

SEQ ID NO: 282442 - DNA, 20 bp, human
gttaaatgccagtttacgat

SEQ ID NO: 282443 - DNA, 20 bp, human
gtagagctcctatcgtaaac

SEQ ID NO: 282444 - DNA, 20 bp, human
ggagcggacttagcaggttc

SEQ ID NO: 282445 - DNA, 20 bp, human
ggcgtttctttgcaattggt

SEQ ID NO: 282446 - DNA, 20 bp, human
gtcagctcctgctccgaaga

SEQ ID NO: 282447 - DNA, 20 bp, human
ggtgaaaggcgcaatttgat

SEQ ID NO: 282448 - DNA, 20 bp, human
gcaaaatatccagctctgat

SEQ ID NO: 282449 - DNA, 20 bp, human
gtgcatgaaaggcctataaa

SEQ ID NO: 282450 - DNA, 20 bp, human
gtggaacccttcttcggagc

SEQ ID NO: 282451 - DNA, 20 bp, human
gaagcgcaagcgcagtcgta

SEQ ID NO: 282452 - DNA, 20 bp, human
gtcatcggtagaattgtgaa

SEQ ID NO: 282453 - DNA, 20 bp, human
gacgagccaaccaattagaa

SEQ ID NO: 282454 - DNA, 20 bp, human
gctagagtctctccttttat

SEQ ID NO: 282455 - DNA, 20 bp, human
gggatgagatgccagtatcg

SEQ ID NO: 282456 - DNA, 20 bp, human
gcagggtaacgtcagaggtc

SEQ ID NO: 282457 - DNA, 20 bp, human
gaggtcaggtctgcccaatc

SEQ ID NO: 282458 - DNA, 20 bp, human
gccagaagacgcactactat

SEQ ID NO: 282459 - DNA, 20 bp, human
gttgaagtcttgtgtctgat

SEQ ID NO: 282460 - DNA, 20 bp, human
gtctgattggtagttattca

SEQ ID NO: 282461 - DNA, 20 bp, human
gggatttgcgaatcctgatt

SEQ ID NO: 282462 - DNA, 20 bp, human
gagaagacgtgttgttggtt

SEQ ID NO: 282463 - DNA, 20 bp, human
ggcgtgagcagggtatgaca

SEQ ID NO: 282464 - DNA, 20 bp, human
gaggaaaaacagcgtgagca

SEQ ID NO: 282465 - DNA, 20 bp, human
gggacgaaatgccggtgtca

SEQ ID NO: 282466 - DNA, 20 bp, human
gaggtgacgcgggatgatac

SEQ ID NO: 282467 - DNA, 20 bp, human
ggaaaaagaagatatgtcat

SEQ ID NO: 282468 - DNA, 20 bp, human
gtatctgattggtggttatt

SEQ ID NO: 282469 - DNA, 20 bp, human
gaggacctctcatgcaaata

SEQ ID NO: 282470 - DNA, 20 bp, human
ggtaatgggagcaaggtacc

SEQ ID NO: 282471 - DNA, 20 bp, human
gagaagatatgtcattggtt

SEQ ID NO: 282472 - DNA, 20 bp, human
gccaaaagacgtacttccat

SEQ ID NO: 282473 - DNA, 20 bp, human
ggaaagtagccaacgaggaa

SEQ ID NO: 282474 - DNA, 20 bp, human
gaggcgctgcctttcctcgt

SEQ ID NO: 282475 - DNA, 20 bp, human
gaagtcctgtatctgattgg

SEQ ID NO: 282476 - DNA, 20 bp, human
gtgggaaggtctctgctgat

SEQ ID NO: 282477 - DNA, 20 bp, human
gagagaccttcccactacct

SEQ ID NO: 282478 - DNA, 20 bp, human
gtttatgcggccgaggtagt

SEQ ID NO: 282479 - DNA, 20 bp, human
gaaaaggcctattatctata

SEQ ID NO: 282480 - DNA, 20 bp, human
ggagcagacttggccagctc

SEQ ID NO: 282481 - DNA, 20 bp, human
gggagaccgacttcttgttt

SEQ ID NO: 282482 - DNA, 20 bp, human
gtcttgaccgtatagataat

SEQ ID NO: 282483 - DNA, 20 bp, human
gataatagtttatgcggccg

SEQ ID NO: 282484 - DNA, 20 bp, human
gttttatataatagtttatg

SEQ ID NO: 282485 - DNA, 20 bp, human
gtgtttcattatgcccgagc

SEQ ID NO: 282486 - DNA, 20 bp, human
gagaataggtcagtgctgat

SEQ ID NO: 282487 - DNA, 20 bp, human
gaaaataaaagacaacctta

SEQ ID NO: 282488 - DNA, 20 bp, human
ggccggagaagcgtcacgcc

SEQ ID NO: 282489 - DNA, 20 bp, human
gagaggacgaaacagcccta

SEQ ID NO: 282490 - DNA, 20 bp, human
gcttcttggagcctttttta

SEQ ID NO: 282491 - DNA, 20 bp, human
gggactggagcagatttgac

SEQ ID NO: 282492 - DNA, 20 bp, human
ggagcagatttgactggttc

SEQ ID NO: 282493 - DNA, 20 bp, human
ggccaggcgtgacgcttctc

SEQ ID NO: 282494 - DNA, 20 bp, human
gtggagccttttttagggac

SEQ ID NO: 282495 - DNA, 20 bp, human
gttcttctgagccttgttaa

SEQ ID NO: 282496 - DNA, 20 bp, human
ggaagcagtgaataagcggt

SEQ ID NO: 282497 - DNA, 20 bp, human
gaagttgtgcgtttaaccag

SEQ ID NO: 282498 - DNA, 20 bp, human
gttaagaagcagtgaataag

SEQ ID NO: 282499 - DNA, 20 bp, human
ggaaaactaagctgtgctat

SEQ ID NO: 282500 - DNA, 20 bp, human
gcactgcttcttaacgcaag

SEQ ID NO: 282501 - DNA, 20 bp, human
ggctttaaccaatgggattg

SEQ ID NO: 282502 - DNA, 20 bp, human
gtttaaccagtggtgagtcc

SEQ ID NO: 282503 - DNA, 20 bp, human
gtccaagaaggcagtgacaa

SEQ ID NO: 282504 - DNA, 20 bp, human
gggagtaactgccggaaaat

SEQ ID NO: 282505 - DNA, 20 bp, human
ggtaactgccggaaaattgg

SEQ ID NO: 282506 - DNA, 20 bp, human
ggaaacatgcttctttggat

SEQ ID NO: 282507 - DNA, 20 bp, human
gtgcataagaattcgtgaac

SEQ ID NO: 282508 - DNA, 20 bp, human
ggaaaataaagctgtgccat

SEQ ID NO: 282509 - DNA, 20 bp, human
gacagggtctccctctcgcc

SEQ ID NO: 282510 - DNA, 20 bp, human
gactacttatagtcaatact

SEQ ID NO: 282511 - DNA, 20 bp, human
gttcataacagcgattccat

SEQ ID NO: 282512 - DNA, 20 bp, human
gacgaattcttatgcaaatg

SEQ ID NO: 282513 - DNA, 20 bp, human
gaaactgtaatttgagccaa

SEQ ID NO: 282514 - DNA, 20 bp, human
ggagcggacgttgcagcgac

SEQ ID NO: 282515 - DNA, 20 bp, human
ggattaataaaatagtgtgt

SEQ ID NO: 282516 - DNA, 20 bp, human
gctgggcgcgaaaaagaagc

SEQ ID NO: 282517 - DNA, 20 bp, human
gagaaattcttctgtctgat

SEQ ID NO: 282518 - DNA, 20 bp, human
gtcctccgccatgcccgacc

SEQ ID NO: 282519 - DNA, 20 bp, human
gggagcagatttagccgggt

SEQ ID NO: 282520 - DNA, 20 bp, human
ggatttagccgggtcgggca

SEQ ID NO: 282521 - DNA, 20 bp, human
gggcaggagcagatttagcc

SEQ ID NO: 282522 - DNA, 20 bp, human
gtgaatatacgtgttttgat

SEQ ID NO: 282523 - DNA, 20 bp, human
gtccaagaaagccgtaacca

SEQ ID NO: 282524 - DNA, 20 bp, human
gcgcattttatagcagctgc

SEQ ID NO: 282525 - DNA, 20 bp, human
gttagccgggtcgggcatgg

SEQ ID NO: 282526 - DNA, 20 bp, human
gttggcatttgctatctgat

SEQ ID NO: 282527 - DNA, 20 bp, human
gcgaggagatgtctggacga

SEQ ID NO: 282528 - DNA, 20 bp, human
gcctatttatagtctgactg

SEQ ID NO: 282529 - DNA, 20 bp, human
gtgtctggacgagggaagca

SEQ ID NO: 282530 - DNA, 20 bp, human
gaaactatgcagagcggata

SEQ ID NO: 282531 - DNA, 20 bp, human
gcaaaatctgattggacaat

SEQ ID NO: 282532 - DNA, 20 bp, human
gctgattggacaatgggaag

SEQ ID NO: 282533 - DNA, 20 bp, human
gcacgagaaccacatttcta

SEQ ID NO: 282534 - DNA, 20 bp, human
gccaagtaaacaaacagaac

SEQ ID NO: 282535 - DNA, 20 bp, human
gagtggcgtgaatgcaaatg

SEQ ID NO: 282536 - DNA, 20 bp, human
gcaataggaagctatcctat

SEQ ID NO: 282537 - DNA, 20 bp, human
gaagaaacacggtttcactg

SEQ ID NO: 282538 - DNA, 20 bp, human
gatgacggactctgccctat

SEQ ID NO: 282539 - DNA, 20 bp, human
gcccaccagttctaagatct

SEQ ID NO: 282540 - DNA, 20 bp, human
gtgtaagtacactggcgcac

SEQ ID NO: 282541 - DNA, 20 bp, human
gcgggcttgcagttcccaat

SEQ ID NO: 282542 - DNA, 20 bp, human
gccaaacataattgaccaat

SEQ ID NO: 282543 - DNA, 20 bp, human
gcacggtttcactgaggggt

SEQ ID NO: 282544 - DNA, 20 bp, human
gctggcgcaccggctccgac

SEQ ID NO: 282545 - DNA, 20 bp, human
gggtggggtttatgcaaata

SEQ ID NO: 282546 - DNA, 20 bp, human
gctgcacagttgtcatccgt

SEQ ID NO: 282547 - DNA, 20 bp, human
gcaactacgcagagcgggtt

SEQ ID NO: 282548 - DNA, 20 bp, human
ggtaaatccgactttttgat

SEQ ID NO: 282549 - DNA, 20 bp, human
ggaaagtacagcttttctat

SEQ ID NO: 282550 - DNA, 20 bp, human
gtaccgaccaatcaaaaagt

SEQ ID NO: 282551 - DNA, 20 bp, human
gagagtacctcttagttaat

SEQ ID NO: 282552 - DNA, 20 bp, human
gagggcttttatgctaatga

SEQ ID NO: 282553 - DNA, 20 bp, human
gaaaacatggccgcttttat

SEQ ID NO: 282554 - DNA, 20 bp, human
ggcttttataggtagttcct

SEQ ID NO: 282555 - DNA, 20 bp, human
gtaaaggcaactacgcagag

SEQ ID NO: 282556 - DNA, 20 bp, human
gctggtctgggctttctcat

SEQ ID NO: 282557 - DNA, 20 bp, human
ggcctcgggtagtctggtct

SEQ ID NO: 282558 - DNA, 20 bp, human
gtctcattgggtacaagtaa

SEQ ID NO: 282559 - DNA, 20 bp, human
ggcccagaccagactacccg

SEQ ID NO: 282560 - DNA, 20 bp, human
gacccgaggctactataaat

SEQ ID NO: 282561 - DNA, 20 bp, human
gatagtagcctcgggtagtc

SEQ ID NO: 282562 - DNA, 20 bp, human
gaaaactgacagacttgggg

SEQ ID NO: 282563 - DNA, 20 bp, human
gacagctgtcttgcctaaag

SEQ ID NO: 282564 - DNA, 20 bp, human
ggacagctgtgcacttcgct

SEQ ID NO: 282565 - DNA, 20 bp, human
gtagatgcggtattcaaatg

SEQ ID NO: 282566 - DNA, 20 bp, human
ggctctcaggatatgaccaa

SEQ ID NO: 282567 - DNA, 20 bp, human
gtgagagcagttttcgagca

SEQ ID NO: 282568 - DNA, 20 bp, human
ggcaggagatacctgaagaa

SEQ ID NO: 282569 - DNA, 20 bp, human
gacattgtctacaaattccg

SEQ ID NO: 282570 - DNA, 20 bp, human
gggcgatcacccacacaatc

SEQ ID NO: 282571 - DNA, 20 bp, human
gtctacaaattccgaggatc

SEQ ID NO: 282572 - DNA, 20 bp, human
gagtgggaaacactgttctc

SEQ ID NO: 282573 - DNA, 20 bp, human
ggccagggagacaaagctcc

SEQ ID NO: 282574 - DNA, 20 bp, human
gcaaaataacgaatcagagt

SEQ ID NO: 282575 - DNA, 20 bp, human
gcatagaagagagcaacttc

SEQ ID NO: 282576 - DNA, 20 bp, human
ggtaaataacgctatttgat

SEQ ID NO: 282577 - DNA, 20 bp, human
ggcggagcaagcggtgtacg

SEQ ID NO: 282578 - DNA, 20 bp, human
gggcggaaaggcccgagcta

SEQ ID NO: 282579 - DNA, 20 bp, human
gtctagcgtttctttgcaat

SEQ ID NO: 282580 - DNA, 20 bp, human
gcgcggcaagcaaggcggaa

SEQ ID NO: 282581 - DNA, 20 bp, human
ggagaaactattatacttgg

SEQ ID NO: 282582 - DNA, 20 bp, human
ggctaagacccgctcttcgc

SEQ ID NO: 282583 - DNA, 20 bp, human
ggccctgtggtatgcaaatt

SEQ ID NO: 282584 - DNA, 20 bp, human
gagtgagaaactattatact

SEQ ID NO: 282585 - DNA, 20 bp, human
ggcgtttctttgcaattggt

SEQ ID NO: 282586 - DNA, 20 bp, human
ggtgaaaggcgcaatttgat

SEQ ID NO: 282587 - DNA, 20 bp, human
gagaagctagttatagtcat

SEQ ID NO: 282588 - DNA, 20 bp, human
gtcatcggtagaattgtgaa

SEQ ID NO: 282589 - DNA, 20 bp, human
gaaaagaatgggctcgatgg

SEQ ID NO: 282590 - DNA, 20 bp, human
gagaaaaagaatgggctcga

SEQ ID NO: 282591 - DNA, 20 bp, human
gacgagccaaccaattagaa

SEQ ID NO: 282592 - DNA, 20 bp, human
ggctaaaacgcgttcttcca

SEQ ID NO: 282593 - DNA, 20 bp, human
gggaaactgaagaccggccc

SEQ ID NO: 282594 - DNA, 20 bp, human
ggttaggaagccactatgtc

SEQ ID NO: 282595 - DNA, 20 bp, human
gaagccactatgtctggacg

SEQ ID NO: 282596 - DNA, 20 bp, human
ggtagaaaaggatttagggt

SEQ ID NO: 282597 - DNA, 20 bp, human
gaatccttttctacacctcc

SEQ ID NO: 282598 - DNA, 20 bp, human
gccttttctacacctcccgg

SEQ ID NO: 282599 - DNA, 20 bp, human
gccggaagctgcaatttggt

SEQ ID NO: 282600 - DNA, 20 bp, human
gctacgttttttcccccggg

SEQ ID NO: 282601 - DNA, 20 bp, human
gggctgatttggtccaatca

SEQ ID NO: 282602 - DNA, 20 bp, human
gcccctaggaacggagtgtc

SEQ ID NO: 282603 - DNA, 20 bp, human
gaaaactacgttttttcccc

SEQ ID NO: 282604 - DNA, 20 bp, human
gtaggtagatgttactggca

SEQ ID NO: 282605 - DNA, 20 bp, human
gtgggattttaatatcccct

SEQ ID NO: 282606 - DNA, 20 bp, human
gtatgcaaggttgagcttct

SEQ ID NO: 282607 - DNA, 20 bp, human
gcgtctggatgtggaatgca

SEQ ID NO: 282608 - DNA, 20 bp, human
ggggagagccgatgagattt

SEQ ID NO: 282609 - DNA, 20 bp, human
gctggtctccagttttctgt

SEQ ID NO: 282610 - DNA, 20 bp, human
ggctaaaacgcactcttcca

SEQ ID NO: 282611 - DNA, 20 bp, human
gctgaactcctaaatctcat

SEQ ID NO: 282612 - DNA, 20 bp, human
gcactcggcccacagaaaac

SEQ ID NO: 282613 - DNA, 20 bp, human
gtacacgaggtaaataatga

SEQ ID NO: 282614 - DNA, 20 bp, human
gacgccaagcgggtccgggc

SEQ ID NO: 282615 - DNA, 20 bp, human
gttggctgaaatctgtgttc

SEQ ID NO: 282616 - DNA, 20 bp, human
gccagaagacgcactactat

SEQ ID NO: 282617 - DNA, 20 bp, human
gaggtcaggtctgcccaatc

SEQ ID NO: 282618 - DNA, 20 bp, human
gcagggtaacgtcagaggtc

SEQ ID NO: 282619 - DNA, 20 bp, human
gagaagacgtgttgttggtt

SEQ ID NO: 282620 - DNA, 20 bp, human
ggccaagactcgctcttcta

SEQ ID NO: 282621 - DNA, 20 bp, human
gacaaagtgaacgggaaagg

SEQ ID NO: 282622 - DNA, 20 bp, human
gggatttgcgaatcctgatt

SEQ ID NO: 282623 - DNA, 20 bp, human
gcgagcaaccacaaagtgaa

SEQ ID NO: 282624 - DNA, 20 bp, human
gaccacaaagtgaacgggaa

SEQ ID NO: 282625 - DNA, 20 bp, human
gttgaagtcttgtgtctgat

SEQ ID NO: 282626 - DNA, 20 bp, human
ggaaaaagaagatatgtcat

SEQ ID NO: 282627 - DNA, 20 bp, human
gtatctgattggtggttatt

SEQ ID NO: 282628 - DNA, 20 bp, human
gaggacctctcatgcaaata

SEQ ID NO: 282629 - DNA, 20 bp, human
gagaagatatgtcattggtt

SEQ ID NO: 282630 - DNA, 20 bp, human
gccaaaagacgtacttccat

SEQ ID NO: 282631 - DNA, 20 bp, human
ggtaatgggagcaaggtacc

SEQ ID NO: 282632 - DNA, 20 bp, human
ggaaagtagccaacgaggaa

SEQ ID NO: 282633 - DNA, 20 bp, human
gaggcgctgcctttcctcgt

SEQ ID NO: 282634 - DNA, 20 bp, human
ggtagcttagttttaaccaa

SEQ ID NO: 282635 - DNA, 20 bp, human
gaggtgacgcgggatgatac

SEQ ID NO: 282636 - DNA, 20 bp, human
gaaaaggcctattatctata

SEQ ID NO: 282637 - DNA, 20 bp, human
gtgggaaggtctctgctgat

SEQ ID NO: 282638 - DNA, 20 bp, human
gagagaccttcccactacct

SEQ ID NO: 282639 - DNA, 20 bp, human
gtttatgcggccgaggtagt

SEQ ID NO: 282640 - DNA, 20 bp, human
ggagcagacttggccagctc

SEQ ID NO: 282641 - DNA, 20 bp, human
gggagaccgacttcttgttt

SEQ ID NO: 282642 - DNA, 20 bp, human
gtcttgaccgtatagataat

SEQ ID NO: 282643 - DNA, 20 bp, human
gataatagtttatgcggccg

SEQ ID NO: 282644 - DNA, 20 bp, human
gtgtttcattatgcccgagc

SEQ ID NO: 282645 - DNA, 20 bp, human
gttttatataatagtttatg

SEQ ID NO: 282646 - DNA, 20 bp, human
gagaataggtcagtgctgat

SEQ ID NO: 282647 - DNA, 20 bp, human
gaaaataaaagacaacctta

SEQ ID NO: 282648 - DNA, 20 bp, human
gagaggacgaaacagcccta

SEQ ID NO: 282649 - DNA, 20 bp, human
gggactggagcagatttgac

SEQ ID NO: 282650 - DNA, 20 bp, human
gcagtctttcttgaccgtaa

SEQ ID NO: 282651 - DNA, 20 bp, human
ggagcagatttgactggttc

SEQ ID NO: 282652 - DNA, 20 bp, human
gttgactggttcaggcatgg

SEQ ID NO: 282653 - DNA, 20 bp, human
gtgcaaattaggagtagaat

SEQ ID NO: 282654 - DNA, 20 bp, human
gaaatgttattatgcaaatt

SEQ ID NO: 282655 - DNA, 20 bp, human
gcaataggactcgagtatgc

SEQ ID NO: 282656 - DNA, 20 bp, human
ggctaagacccgttcttcaa

SEQ ID NO: 282657 - DNA, 20 bp, human
ggaaaactaagctgtgctat

SEQ ID NO: 282658 - DNA, 20 bp, human
gttagcgttacgtcagtctc

SEQ ID NO: 282659 - DNA, 20 bp, human
gcgggtcttcagttcccagt

SEQ ID NO: 282660 - DNA, 20 bp, human
gaagacccgcccttgaagaa

SEQ ID NO: 282661 - DNA, 20 bp, human
gaagacccgttcttcaaggg

SEQ ID NO: 282662 - DNA, 20 bp, human
gcgctacttatagtcaacag

SEQ ID NO: 282663 - DNA, 20 bp, human
ggctttaaccaatgggattg

SEQ ID NO: 282664 - DNA, 20 bp, human
gaggccaagggcaagtagcg

SEQ ID NO: 282665 - DNA, 20 bp, human
gttcaaaaccgcaatcccat

SEQ ID NO: 282666 - DNA, 20 bp, human
gctgggcgcgaaaaagaagc

SEQ ID NO: 282667 - DNA, 20 bp, human
ggagcccagctctagaggag

SEQ ID NO: 282668 - DNA, 20 bp, human
gataaaatgcgcgtccctgt

SEQ ID NO: 282669 - DNA, 20 bp, human
gcaaagctaagggcaagtaa

SEQ ID NO: 282670 - DNA, 20 bp, human
gagagccaccacaaagctaa

SEQ ID NO: 282671 - DNA, 20 bp, human
gcactcgtcctacaggaaat

SEQ ID NO: 282672 - DNA, 20 bp, human
gagaaattcttctgtctgat

SEQ ID NO: 282673 - DNA, 20 bp, human
gggggaggggagaaatctct

SEQ ID NO: 282674 - DNA, 20 bp, human
gagacccaggacagtttgtg

SEQ ID NO: 282675 - DNA, 20 bp, human
gtcggccacaaatttctgat

SEQ ID NO: 282676 - DNA, 20 bp, human
ggtgtgtaaagtgcagtgat

SEQ ID NO: 282677 - DNA, 20 bp, human
gtataaatagagcagctcat

SEQ ID NO: 282678 - DNA, 20 bp, human
gaacaatcgtgcagtttcac

SEQ ID NO: 282679 - DNA, 20 bp, human
ggaaactgcacgattgttgc

SEQ ID NO: 282680 - DNA, 20 bp, human
gtgacgttacacactctgat

SEQ ID NO: 282681 - DNA, 20 bp, human
gcggaagtctactggtggca

SEQ ID NO: 282682 - DNA, 20 bp, human
gggcgtatttgcgctagtgt

SEQ ID NO: 282683 - DNA, 20 bp, human
gaaggcgccacgcaaacagt

SEQ ID NO: 282684 - DNA, 20 bp, human
gctgctcggaagtctactgg

SEQ ID NO: 282685 - DNA, 20 bp, human
gtggaatagaatatagtagc

SEQ ID NO: 282686 - DNA, 20 bp, human
gcctggttgcagattaagag

SEQ ID NO: 282687 - DNA, 20 bp, human
gagtggatatagcagctaag

SEQ ID NO: 282688 - DNA, 20 bp, human
gagatggaccaatccaagaa

SEQ ID NO: 282689 - DNA, 20 bp, human
gaaaatccccgcgcccttct

SEQ ID NO: 282690 - DNA, 20 bp, human
ggaccaatccaagaagggcg

SEQ ID NO: 282691 - DNA, 20 bp, human
gtactcagaaggctgtcaag

SEQ ID NO: 282692 - DNA, 20 bp, human
ggagtcagaccaccaactat

SEQ ID NO: 282693 - DNA, 20 bp, human
ggggtgtcgcataagaagtg

SEQ ID NO: 282694 - DNA, 20 bp, human
gagaatattggagacgatta

SEQ ID NO: 282695 - DNA, 20 bp, human
gctgtggacaagtcttgtac

SEQ ID NO: 282696 - DNA, 20 bp, human
gtcccgcgcgataaaatcat

SEQ ID NO: 282697 - DNA, 20 bp, human
ggcagataactgaaacgaaa

SEQ ID NO: 282698 - DNA, 20 bp, human
gtgtgtgctctcattgcaaa

SEQ ID NO: 282699 - DNA, 20 bp, human
ggtggccggagcgctcttac

SEQ ID NO: 282700 - DNA, 20 bp, human
gtaactgaaacgaaaaggac

SEQ ID NO: 282701 - DNA, 20 bp, human
ggataacttgcgagactgtc

SEQ ID NO: 282702 - DNA, 20 bp, human
ggaaacgttcagactcatgt

SEQ ID NO: 282703 - DNA, 20 bp, human
gagtaatgaaccaatcagtc

SEQ ID NO: 282704 - DNA, 20 bp, human
gacactctgttctttgggac

SEQ ID NO: 282705 - DNA, 20 bp, human
ggtagtgaactgagagcaag

SEQ ID NO: 282706 - DNA, 20 bp, human
ggtaaataacgctatttgat

SEQ ID NO: 282707 - DNA, 20 bp, human
ggccctgtggtatgcaaatt

SEQ ID NO: 282708 - DNA, 20 bp, human
gtctagcgtttctttgcaat

SEQ ID NO: 282709 - DNA, 20 bp, human
gccgctcctgctccaaaaaa

SEQ ID NO: 282710 - DNA, 20 bp, human
gcacctaatttgcataccac

SEQ ID NO: 282711 - DNA, 20 bp, human
gattgtctctgtgtgccctg

SEQ ID NO: 282712 - DNA, 20 bp, human
gttaaatgccagtttacgat

SEQ ID NO: 282713 - DNA, 20 bp, human
gtagagctcctatcgtaaac

SEQ ID NO: 282714 - DNA, 20 bp, human
ggagcggacttagcaggttc

SEQ ID NO: 282715 - DNA, 20 bp, human
ggcgtttctttgcaattggt

SEQ ID NO: 282716 - DNA, 20 bp, human
gggaacagaatcactctgat

SEQ ID NO: 282717 - DNA, 20 bp, human
gtagcaaccgatcactaaca

SEQ ID NO: 282718 - DNA, 20 bp, human
gaaccaatcgtgaatctcta

SEQ ID NO: 282719 - DNA, 20 bp, human
ggacgatccctgttagtgat

SEQ ID NO: 282720 - DNA, 20 bp, human
gggccgtagagattcacgat

SEQ ID NO: 282721 - DNA, 20 bp, human
gttactttgcagatgaacta

SEQ ID NO: 282722 - DNA, 20 bp, human
gggttgctaaattccggaag

SEQ ID NO: 282723 - DNA, 20 bp, human
gaatcactctgattggattg

SEQ ID NO: 282724 - DNA, 20 bp, human
gttcagtgcaagattctgat

SEQ ID NO: 282725 - DNA, 20 bp, human
gggtgccagggcggtagcga

SEQ ID NO: 282726 - DNA, 20 bp, human
ggaaggtacgtaatacaggt

SEQ ID NO: 282727 - DNA, 20 bp, human
ggggaaaaaagcatttagat

SEQ ID NO: 282728 - DNA, 20 bp, human
gggcgcgaaactggaagatt

SEQ ID NO: 282729 - DNA, 20 bp, human
gctgaattatgtagtgtgat

SEQ ID NO: 282730 - DNA, 20 bp, human
gcaatgaaggtacgtaatac

SEQ ID NO: 282731 - DNA, 20 bp, human
gcccctaggaacggagtgtc

SEQ ID NO: 282732 - DNA, 20 bp, human
gataaaatgtaaggaactag

SEQ ID NO: 282733 - DNA, 20 bp, human
gataattcagggcgcgaaac

SEQ ID NO: 282734 - DNA, 20 bp, human
ggaccaatcactctcaaacg

SEQ ID NO: 282735 - DNA, 20 bp, human
gggacttgtgatcagctact

SEQ ID NO: 282736 - DNA, 20 bp, human
ggatgtgattggtgaattac

SEQ ID NO: 282737 - DNA, 20 bp, human
ggcagactaaccgagaagag

SEQ ID NO: 282738 - DNA, 20 bp, human
gacccgcgcaacaaaaccat

SEQ ID NO: 282739 - DNA, 20 bp, human
gaattcaccaatcacatcgt

SEQ ID NO: 282740 - DNA, 20 bp, human
gaagagtccaacgatgtgat

SEQ ID NO: 282741 - DNA, 20 bp, human
ggttgtggggccagattcgg

SEQ ID NO: 282742 - DNA, 20 bp, human
gttccagctagcagcagtcc

SEQ ID NO: 282743 - DNA, 20 bp, human
gcctgccttataatggtcaa

SEQ ID NO: 282744 - DNA, 20 bp, human
gtttaagaagttaacgttct

SEQ ID NO: 282745 - DNA, 20 bp, human
gcgttggactcttcagccaa

SEQ ID NO: 282746 - DNA, 20 bp, human
ggaactgctaagtctgtcag

SEQ ID NO: 282747 - DNA, 20 bp, human
gtacccaacagtaaccggat

SEQ ID NO: 282748 - DNA, 20 bp, human
gtaccaggccgatagcgatg

SEQ ID NO: 282749 - DNA, 20 bp, human
gcgccaatccggttactgtt

SEQ ID NO: 282750 - DNA, 20 bp, human
ggaagtgaatctagctctga

SEQ ID NO: 282751 - DNA, 20 bp, human
gagccccatcgctatcggcc

SEQ ID NO: 282752 - DNA, 20 bp, human
ggaatctagctctgaaggca

SEQ ID NO: 282753 - DNA, 20 bp, human
gttggacaaaagtatgctga

SEQ ID NO: 282754 - DNA, 20 bp, human
ggactctcactataaataag

SEQ ID NO: 282755 - DNA, 20 bp, human
gcaagaagccccatcgctat

SEQ ID NO: 282756 - DNA, 20 bp, human
gcgagggcagctataaatac

SEQ ID NO: 282757 - DNA, 20 bp, human
gcacgtctcacacacggaat

SEQ ID NO: 282758 - DNA, 20 bp, human
gctgtccaatcagaacgcga

SEQ ID NO: 282759 - DNA, 20 bp, human
gtgggtcaagaaacgtaaaa

SEQ ID NO: 282760 - DNA, 20 bp, human
gccgtgtgtgagacgtggca

SEQ ID NO: 282761 - DNA, 20 bp, human
ggctgccctcgcgttctgat

SEQ ID NO: 282762 - DNA, 20 bp, human
gagacattccgcctctgttt

SEQ ID NO: 282763 - DNA, 20 bp, human
gtttaccgctaccaatgcga

SEQ ID NO: 282764 - DNA, 20 bp, human
gacagccctcgcattggtag

SEQ ID NO: 282765 - DNA, 20 bp, human
gctgtgtaactatgacactg

SEQ ID NO: 282766 - DNA, 20 bp, human
ggacagaattagaagccgtc

SEQ ID NO: 282767 - DNA, 20 bp, human
gacaacagttctgaccaatc

SEQ ID NO: 282768 - DNA, 20 bp, human
gacgatgatctgatcctgat

SEQ ID NO: 282769 - DNA, 20 bp, human
gataaataaaagtggcgcgg

SEQ ID NO: 282770 - DNA, 20 bp, human
gagatcatcgttataaattc

SEQ ID NO: 282771 - DNA, 20 bp, human
gactgacctacacaaattct

SEQ ID NO: 282772 - DNA, 20 bp, human
gacaataaataaaagtggcg

SEQ ID NO: 282773 - DNA, 20 bp, human
gtctgacctagaatttgtgt

SEQ ID NO: 282774 - DNA, 20 bp, human
ggtcagattatcttttcatt

SEQ ID NO: 282775 - DNA, 20 bp, human
gtgggtcatttttcctattt

SEQ ID NO: 282776 - DNA, 20 bp, human
gctgctcccgccatttcctg

SEQ ID NO: 282777 - DNA, 20 bp, human
ggatgagggtgggaccaagc

SEQ ID NO: 282778 - DNA, 20 bp, human
ggggagcagcgattggggga

SEQ ID NO: 282779 - DNA, 20 bp, human
gaaatggcgggagcagcgat

SEQ ID NO: 282780 - DNA, 20 bp, human
gaccaagcaggcttgaccaa

SEQ ID NO: 282781 - DNA, 20 bp, human
gtctgggcgacagagagatt

SEQ ID NO: 282782 - DNA, 20 bp, human
gaatcccagctacactctga

SEQ ID NO: 282783 - DNA, 20 bp, human
gctacaggctttgaggaact

SEQ ID NO: 282784 - DNA, 20 bp, human
gtggcgggagcagcgattgg

SEQ ID NO: 282785 - DNA, 20 bp, human
gccaagccccaggaaatggc

SEQ ID NO: 282786 - DNA, 20 bp, human
gctcgaggggcagtgaccta

SEQ ID NO: 282787 - DNA, 20 bp, human
gaggggcggagcaaaaagtg

SEQ ID NO: 282788 - DNA, 20 bp, human
gagtgacctaaggactgcga

SEQ ID NO: 282789 - DNA, 20 bp, human
ggaaagcgggagcgaggata

SEQ ID NO: 282790 - DNA, 20 bp, human
gagtagtgtcgtaaacggga

SEQ ID NO: 282791 - DNA, 20 bp, human
gcaaatagtagtgtcgtaaa

SEQ ID NO: 282792 - DNA, 20 bp, human
ggtcactgcccctcgagggg

SEQ ID NO: 282793 - DNA, 20 bp, human
gacgggagggaaaaactaaa

SEQ ID NO: 282794 - DNA, 20 bp, human
gagaactgaaagcgggagcg

SEQ ID NO: 282795 - DNA, 20 bp, human
gtttttgctccgcccctcga

SEQ ID NO: 282796 - DNA, 20 bp, human
gtgctctttgtgggagtgga

SEQ ID NO: 282797 - DNA, 20 bp, human
gaagaaaaactgtttcatta

SEQ ID NO: 282798 - DNA, 20 bp, human
gtatggttcattgttttgat

SEQ ID NO: 282799 - DNA, 20 bp, human
gtcaaatttggtcaccaagt

SEQ ID NO: 282800 - DNA, 20 bp, human
gtccgccaagtttgtattta

SEQ ID NO: 282801 - DNA, 20 bp, human
gttagcgtcattaagctgac

SEQ ID NO: 282802 - DNA, 20 bp, human
ggattgaaaacaacatgagt

SEQ ID NO: 282803 - DNA, 20 bp, human
gaatttggtcaccaagtggg

SEQ ID NO: 282804 - DNA, 20 bp, human
gtaaaggaggtcagatttat

SEQ ID NO: 282805 - DNA, 20 bp, human
ggctggacaaggtataagtt

SEQ ID NO: 282806 - DNA, 20 bp, human
gaaaaaaaaagcaccctgtg

SEQ ID NO: 282807 - DNA, 20 bp, human
ggaactgatggctcagttaa

SEQ ID NO: 282808 - DNA, 20 bp, human
ggatattctgggaaaagtgg

SEQ ID NO: 282809 - DNA, 20 bp, human
gttagtactgtttccctcac

SEQ ID NO: 282810 - DNA, 20 bp, human
gatactttgaaagcacctta

SEQ ID NO: 282811 - DNA, 20 bp, human
gaaagtgggggacaattgtc

SEQ ID NO: 282812 - DNA, 20 bp, human
gtcgagaccatcctggccta

SEQ ID NO: 282813 - DNA, 20 bp, human
gttgaaagcaccttatggcc

SEQ ID NO: 282814 - DNA, 20 bp, human
gtcgaaagtttatgaactga

SEQ ID NO: 282815 - DNA, 20 bp, human
gtactaattatttgatattc

SEQ ID NO: 282816 - DNA, 20 bp, human
gggactctgccggcgggaac

SEQ ID NO: 282817 - DNA, 20 bp, human
gcggcgggaactggagtcgt

SEQ ID NO: 282818 - DNA, 20 bp, human
gcggcagagtccgctctcca

SEQ ID NO: 282819 - DNA, 20 bp, human
gtcccagtctgatctgtgaa

SEQ ID NO: 282820 - DNA, 20 bp, human
ggacgattgaacaggagctt

SEQ ID NO: 282821 - DNA, 20 bp, human
gacccttcacagatcagact

SEQ ID NO: 282822 - DNA, 20 bp, human
gaaggagattactgcagttc

SEQ ID NO: 282823 - DNA, 20 bp, human
gaagactgaaaacgcgcata

SEQ ID NO: 282824 - DNA, 20 bp, human
ggttcccaaagaggaaattt

SEQ ID NO: 282825 - DNA, 20 bp, human
gtgtgaagggtagggccagc

SEQ ID NO: 282826 - DNA, 20 bp, human
gaaagggggcggtgagggta

SEQ ID NO: 282827 - DNA, 20 bp, human
ggtcccctacactattgcct

SEQ ID NO: 282828 - DNA, 20 bp, human
ggcccagtaagttacggaaa

SEQ ID NO: 282829 - DNA, 20 bp, human
gttcccaaggcaatagtgta

SEQ ID NO: 282830 - DNA, 20 bp, human
gggggacgcccagtaagtta

SEQ ID NO: 282831 - DNA, 20 bp, human
gtatcagttcgagagcccac

SEQ ID NO: 282832 - DNA, 20 bp, human
gtcttctagtccagtgcctg

SEQ ID NO: 282833 - DNA, 20 bp, human
gctattgccttgggaaggaa

SEQ ID NO: 282834 - DNA, 20 bp, human
gcagtaagttacggaaaagg

SEQ ID NO: 282835 - DNA, 20 bp, human
gtgtagttgcagctactgca

SEQ ID NO: 282836 - DNA, 20 bp, human
gtgctggcatttagagaata

SEQ ID NO: 282837 - DNA, 20 bp, human
gaatcgagatactttcctct

SEQ ID NO: 282838 - DNA, 20 bp, human
ggtgtcaaacatgtacctag

SEQ ID NO: 282839 - DNA, 20 bp, human
gtactagaagtagatgagcg

SEQ ID NO: 282840 - DNA, 20 bp, human
gacgggcttcgcccttgccc

SEQ ID NO: 282841 - DNA, 20 bp, human
gtaagaaattctcttgtagt

SEQ ID NO: 282842 - DNA, 20 bp, human
gactgaaagaccaggaaagg

SEQ ID NO: 282843 - DNA, 20 bp, human
gttaaagatttactcctggc

SEQ ID NO: 282844 - DNA, 20 bp, human
ggtgtttaaagatttactcc

SEQ ID NO: 282845 - DNA, 20 bp, human
gtacgttttcccgcctttcc

SEQ ID NO: 282846 - DNA, 20 bp, human
gtgccaaaggctggagtcgt

SEQ ID NO: 282847 - DNA, 20 bp, human
gggctgggctatgcggggtg

SEQ ID NO: 282848 - DNA, 20 bp, human
gtcgttggtgacgtcatcca

SEQ ID NO: 282849 - DNA, 20 bp, human
ggccggcgctcagatgccaa

SEQ ID NO: 282850 - DNA, 20 bp, human
gcatccagggctgggctatg

SEQ ID NO: 282851 - DNA, 20 bp, human
ggcgctcagatgccaaaggc

SEQ ID NO: 282852 - DNA, 20 bp, human
gggacaaagctgcactcctc

SEQ ID NO: 282853 - DNA, 20 bp, human
gagagacgcctccgcggagc

SEQ ID NO: 282854 - DNA, 20 bp, human
gcaccaacgactccagcctt

SEQ ID NO: 282855 - DNA, 20 bp, human
gagaagcaggaccaaagttc

SEQ ID NO: 282856 - DNA, 20 bp, human
ggcgggaagtccctctgcat

SEQ ID NO: 282857 - DNA, 20 bp, human
gtgggggaggggacctaaaa

SEQ ID NO: 282858 - DNA, 20 bp, human
gtaggtcttgaggattaaaa

SEQ ID NO: 282859 - DNA, 20 bp, human
gagtccctctgcattggggg

SEQ ID NO: 282860 - DNA, 20 bp, human
gtgcggaccagactgaaaac

SEQ ID NO: 282861 - DNA, 20 bp, human
ggtcccctcccccaatgcag

SEQ ID NO: 282862 - DNA, 20 bp, human
gcttcccgccaaagctcttc

SEQ ID NO: 282863 - DNA, 20 bp, human
gctgaaaaccggaagagctt

SEQ ID NO: 282864 - DNA, 20 bp, human
gcttttatgggtaacctctg

SEQ ID NO: 282865 - DNA, 20 bp, human
ggcaggcctgtttccctttt

SEQ ID NO: 282866 - DNA, 20 bp, human
ggggccaaaccgaaataggg

SEQ ID NO: 282867 - DNA, 20 bp, human
gccgagatgggagtgtacct

SEQ ID NO: 282868 - DNA, 20 bp, human
gaaaaagtgaccgggctcgg

SEQ ID NO: 282869 - DNA, 20 bp, human
ggggagtgtacctgggcgtc

SEQ ID NO: 282870 - DNA, 20 bp, human
gtctcaaactcctgacgccc

SEQ ID NO: 282871 - DNA, 20 bp, human
ggatatacatcaatactgtg

SEQ ID NO: 282872 - DNA, 20 bp, human
gccatctcggcctcctaaaa

SEQ ID NO: 282873 - DNA, 20 bp, human
gggaatacaaaaaagtgacc

SEQ ID NO: 282874 - DNA, 20 bp, human
gacaaaaaagtgaccgggct

SEQ ID NO: 282875 - DNA, 20 bp, human
ggtccctttctatcaataaa

SEQ ID NO: 282876 - DNA, 20 bp, human
gcaacgctttgtgaggactc

SEQ ID NO: 282877 - DNA, 20 bp, human
ggtccctttctatcaacaaa

SEQ ID NO: 282878 - DNA, 20 bp, human
gggaagtcccgccccggtgg

SEQ ID NO: 282879 - DNA, 20 bp, human
ggcaccctctacggtttcgg

SEQ ID NO: 282880 - DNA, 20 bp, human
gagaacctgaaagaagtcgg

SEQ ID NO: 282881 - DNA, 20 bp, human
ggggggaggggaaatctaaa

SEQ ID NO: 282882 - DNA, 20 bp, human
ggcgtgctctgtataggtca

SEQ ID NO: 282883 - DNA, 20 bp, human
gcaaccaccgaaaccgtaga

SEQ ID NO: 282884 - DNA, 20 bp, human
gtaaagggccaaaccgaaat

SEQ ID NO: 282885 - DNA, 20 bp, human
gatctccggcctcatctacg

SEQ ID NO: 282886 - DNA, 20 bp, human
gcacaccagctgcatccggt

SEQ ID NO: 282887 - DNA, 20 bp, human
ggtaataaatcggacctgat

SEQ ID NO: 282888 - DNA, 20 bp, human
ggtgtggagagttcccaatc

SEQ ID NO: 282889 - DNA, 20 bp, human
ggcgccctgcccacgacttc

SEQ ID NO: 282890 - DNA, 20 bp, human
gtcggccgaccggatgcagc

SEQ ID NO: 282891 - DNA, 20 bp, human
gaagtgatcagcctatggag

SEQ ID NO: 282892 - DNA, 20 bp, human
gggtctgtgaatcggccgac

SEQ ID NO: 282893 - DNA, 20 bp, human
gcccagacaatggaatgcag

SEQ ID NO: 282894 - DNA, 20 bp, human
gcagcctaaaacactgtaga

SEQ ID NO: 282895 - DNA, 20 bp, human
gagacaatggaatgcagcgg

SEQ ID NO: 282896 - DNA, 20 bp, human
gagaacgcaagcagagcggt

SEQ ID NO: 282897 - DNA, 20 bp, human
gtccgcggcgcgcaatgcga

SEQ ID NO: 282898 - DNA, 20 bp, human
gcggtaggctcggggtctac

SEQ ID NO: 282899 - DNA, 20 bp, human
ggctctgcttgcgttctcgg

SEQ ID NO: 282900 - DNA, 20 bp, human
gcaagcagagcggtaggctc

SEQ ID NO: 282901 - DNA, 20 bp, human
ggtccacggagcactttgat

SEQ ID NO: 282902 - DNA, 20 bp, human
gaacgactgtgtacttacag

SEQ ID NO: 282903 - DNA, 20 bp, human
gtatgtaaatgagtggattc

SEQ ID NO: 282904 - DNA, 20 bp, human
gtcgcgccggctcccaagaa

SEQ ID NO: 282905 - DNA, 20 bp, human
gacagaacggcgattgtcca

SEQ ID NO: 282906 - DNA, 20 bp, human
gtccgcggcgcgcaatgcga

SEQ ID NO: 282907 - DNA, 20 bp, human
gagaacgcaagcagagcggt

SEQ ID NO: 282908 - DNA, 20 bp, human
gcggtaggctcggggtctac

SEQ ID NO: 282909 - DNA, 20 bp, human
gaacgactgtgtacttacag

SEQ ID NO: 282910 - DNA, 20 bp, human
ggctctgcttgcgttctcgg

SEQ ID NO: 282911 - DNA, 20 bp, human
gcaagcagagcggtaggctc

SEQ ID NO: 282912 - DNA, 20 bp, human
gtgcgcatgacgctgcgtta

SEQ ID NO: 282913 - DNA, 20 bp, human
ggtccacggagcactttgat

SEQ ID NO: 282914 - DNA, 20 bp, human
gtatgtaaatgagtggattc

SEQ ID NO: 282915 - DNA, 20 bp, human
gatggttcgcgagttttccg

SEQ ID NO: 282916 - DNA, 20 bp, human
gcaaataaggggctttaatg

SEQ ID NO: 282917 - DNA, 20 bp, human
gtagagctcaaggggatcat

SEQ ID NO: 282918 - DNA, 20 bp, human
gtggctgtgacgagacagaa

SEQ ID NO: 282919 - DNA, 20 bp, human
gtcggtcaaaccggattccg

SEQ ID NO: 282920 - DNA, 20 bp, human
gcaggacgcaaaccaagagg

SEQ ID NO: 282921 - DNA, 20 bp, human
ggggcggagacacgccgctg

SEQ ID NO: 282922 - DNA, 20 bp, human
gcccacccgcctgcactcct

SEQ ID NO: 282923 - DNA, 20 bp, human
gtgcgggcgacttaagttta

SEQ ID NO: 282924 - DNA, 20 bp, human
gtgaagggaagtcgtttgat

SEQ ID NO: 282925 - DNA, 20 bp, human
gtagagatgggcagtggcat

SEQ ID NO: 282926 - DNA, 20 bp, human
gataagctttcctaggggtg

SEQ ID NO: 282927 - DNA, 20 bp, human
ggactcttgacttgattggc

SEQ ID NO: 282928 - DNA, 20 bp, human
gcccctaggaaagcttataa

SEQ ID NO: 282929 - DNA, 20 bp, human
ggtaagacacagtacaaacg

SEQ ID NO: 282930 - DNA, 20 bp, human
gccagacatgactgaaatca

SEQ ID NO: 282931 - DNA, 20 bp, human
gtcaagaacgagtttttcat

SEQ ID NO: 282932 - DNA, 20 bp, human
gaggtccgcacacggaccaa

SEQ ID NO: 282933 - DNA, 20 bp, human
gcctaatatggcttcagaac

SEQ ID NO: 282934 - DNA, 20 bp, human
gaaaacgcaaggtccgcaca

SEQ ID NO: 282935 - DNA, 20 bp, human
gcaccgactcttgacttgat

SEQ ID NO: 282936 - DNA, 20 bp, human
gataagctttcctaggggtg

SEQ ID NO: 282937 - DNA, 20 bp, human
ggactcttgacttgattggc

SEQ ID NO: 282938 - DNA, 20 bp, human
ggtaagacacagtacaaacg

SEQ ID NO: 282939 - DNA, 20 bp, human
gtcaagaacgagtttttcat

SEQ ID NO: 282940 - DNA, 20 bp, human
gcctaatatggcttcagaac

SEQ ID NO: 282941 - DNA, 20 bp, human
gaggtccgcacacggaccaa

SEQ ID NO: 282942 - DNA, 20 bp, human
gaaaacgcaaggtccgcaca

SEQ ID NO: 282943 - DNA, 20 bp, human
gcctttataagctttcctag

SEQ ID NO: 282944 - DNA, 20 bp, human
gcaccgactcttgacttgat

SEQ ID NO: 282945 - DNA, 20 bp, human
gacgcattgctgaaaacgca

SEQ ID NO: 282946 - DNA, 20 bp, human
gacggcttggggttttttct

SEQ ID NO: 282947 - DNA, 20 bp, human
ggcgatagtttctacggctt

SEQ ID NO: 282948 - DNA, 20 bp, human
gcgatttttaaaaatgggtg

SEQ ID NO: 282949 - DNA, 20 bp, human
gggtgaagcgatagtttcta

SEQ ID NO: 282950 - DNA, 20 bp, human
gcaaagtgctgcgctttcat

SEQ ID NO: 282951 - DNA, 20 bp, human
gtcttgttatcctatcagaa

SEQ ID NO: 282952 - DNA, 20 bp, human
gaacgggtttataattttta

SEQ ID NO: 282953 - DNA, 20 bp, human
gatctggcgatttttaaaaa

SEQ ID NO: 282954 - DNA, 20 bp, human
gcccgtttcctggtttattt

SEQ ID NO: 282955 - DNA, 20 bp, human
gtcctaaataaaccaggaaa

SEQ ID NO: 282956 - DNA, 20 bp, human
ggccctggcggcggagagta

SEQ ID NO: 282957 - DNA, 20 bp, human
gctccgccgccagggcgctt

SEQ ID NO: 282958 - DNA, 20 bp, human
gttccaaagcgccctggcgg

SEQ ID NO: 282959 - DNA, 20 bp, human
ggttttccaaagcgccctgg

SEQ ID NO: 282960 - DNA, 20 bp, human
gtttgttttccaaagcgccc

SEQ ID NO: 282961 - DNA, 20 bp, human
gtcacccgtcctaaagtcac

SEQ ID NO: 282962 - DNA, 20 bp, human
gggggtgggcgggattaggg

SEQ ID NO: 282963 - DNA, 20 bp, human
gaactggtaagtagaaagtg

SEQ ID NO: 282964 - DNA, 20 bp, human
ggggcgcagcaagaaagggg

SEQ ID NO: 282965 - DNA, 20 bp, human
gccaaccggtgactttagga

SEQ ID NO: 282966 - DNA, 20 bp, human
ggccctggcggcggagagta

SEQ ID NO: 282967 - DNA, 20 bp, human
gctccgccgccagggcgctt

SEQ ID NO: 282968 - DNA, 20 bp, human
gttccaaagcgccctggcgg

SEQ ID NO: 282969 - DNA, 20 bp, human
ggttttccaaagcgccctgg

SEQ ID NO: 282970 - DNA, 20 bp, human
gtttgttttccaaagcgccc

SEQ ID NO: 282971 - DNA, 20 bp, human
gtcacccgtcctaaagtcac

SEQ ID NO: 282972 - DNA, 20 bp, human
gccaaccggtgactttagga

SEQ ID NO: 282973 - DNA, 20 bp, human
gggggtgggcgggattaggg

SEQ ID NO: 282974 - DNA, 20 bp, human
gcaagccaaccggtgacttt

SEQ ID NO: 282975 - DNA, 20 bp, human
gaggcggggtgggcgggatt

SEQ ID NO: 282976 - DNA, 20 bp, human
gtacccacatgaaatggctt

SEQ ID NO: 282977 - DNA, 20 bp, human
gagccaaagccatttcatgt

SEQ ID NO: 282978 - DNA, 20 bp, human
gtggctttggctgggttcca

SEQ ID NO: 282979 - DNA, 20 bp, human
ggcacactacccacatgaaa

SEQ ID NO: 282980 - DNA, 20 bp, human
ggatcttatttacttgacct

SEQ ID NO: 282981 - DNA, 20 bp, human
ggtaacaggtaacctgaaac

SEQ ID NO: 282982 - DNA, 20 bp, human
gaggaaagggggaaataata

SEQ ID NO: 282983 - DNA, 20 bp, human
gaggctgatagctcatagaa

SEQ ID NO: 282984 - DNA, 20 bp, human
ggtagaagagctacagtaac

SEQ ID NO: 282985 - DNA, 20 bp, human
ggaagggcatgcttgaattc

SEQ ID NO: 282986 - DNA, 20 bp, human
gagcctggagccaggaatta

SEQ ID NO: 282987 - DNA, 20 bp, human
gccagggatctgtgcgccaa

SEQ ID NO: 282988 - DNA, 20 bp, human
gtctgtgcgccaagggagga

SEQ ID NO: 282989 - DNA, 20 bp, human
gagctcacacaggagaattc

SEQ ID NO: 282990 - DNA, 20 bp, human
gtgtgtgagctaaaatacag

SEQ ID NO: 282991 - DNA, 20 bp, human
ggcaggttcgccataattcc

SEQ ID NO: 282992 - DNA, 20 bp, human
gcaaaacagagcctggagcc

SEQ ID NO: 282993 - DNA, 20 bp, human
ggagctaaaatacagtggct

SEQ ID NO: 282994 - DNA, 20 bp, human
gtgggatctgaattctcccg

SEQ ID NO: 282995 - DNA, 20 bp, human
gagggacctgagcagagtgg

SEQ ID NO: 282996 - DNA, 20 bp, human
gccagggatctgtgcgccaa

SEQ ID NO: 282997 - DNA, 20 bp, human
gtctgtgcgccaagggagga

SEQ ID NO: 282998 - DNA, 20 bp, human
ggacctgagcagagtggagg

SEQ ID NO: 282999 - DNA, 20 bp, human
gagggacctgagcagagtgg

SEQ ID NO: 283000 - DNA, 20 bp, human
gacgaaatgtcgagagggcg

SEQ ID NO: 283001 - DNA, 20 bp, human
gtgggatctgaattctcccg

SEQ ID NO: 283002 - DNA, 20 bp, human
gaaatgacgaaatgtcgaga

SEQ ID NO: 283003 - DNA, 20 bp, human
gcccggggactgtggcgtag

SEQ ID NO: 283004 - DNA, 20 bp, human
ggagagggacctgagcagag

SEQ ID NO: 283005 - DNA, 20 bp, human
ggaatccggaagccccggtt

SEQ ID NO: 283006 - DNA, 20 bp, human
gcccaagaagggttctaaaa

SEQ ID NO: 283007 - DNA, 20 bp, human
ggcgttcgattggatggcta

SEQ ID NO: 283008 - DNA, 20 bp, human
gatgccagacccgtccaaat

SEQ ID NO: 283009 - DNA, 20 bp, human
ggccagcgagcccttatgta

SEQ ID NO: 283010 - DNA, 20 bp, human
gggaaaggaatacgcaaatt

SEQ ID NO: 283011 - DNA, 20 bp, human
gtctacgtcatcgctgggaa

SEQ ID NO: 283012 - DNA, 20 bp, human
gctagaccgcggcgttcgat

SEQ ID NO: 283013 - DNA, 20 bp, human
gagcgccgcgcgtttctgtt

SEQ ID NO: 283014 - DNA, 20 bp, human
gacagaggtaggctagaccg

SEQ ID NO: 283015 - DNA, 20 bp, human
gtacctctgtaccatacata

SEQ ID NO: 283016 - DNA, 20 bp, human
ggcgttcgattggatggcta

SEQ ID NO: 283017 - DNA, 20 bp, human
ggccagcgagcccttatgta

SEQ ID NO: 283018 - DNA, 20 bp, human
gctagaccgcggcgttcgat

SEQ ID NO: 283019 - DNA, 20 bp, human
gacagaggtaggctagaccg

SEQ ID NO: 283020 - DNA, 20 bp, human
gagcgagactaaaaacaaga

SEQ ID NO: 283021 - DNA, 20 bp, human
gggaaaggaatacgcaaatt

SEQ ID NO: 283022 - DNA, 20 bp, human
gtacctctgtaccatacata

SEQ ID NO: 283023 - DNA, 20 bp, human
gaccgcggcgttcgattgga

SEQ ID NO: 283024 - DNA, 20 bp, human
gtctacgtcatcgctgggaa

SEQ ID NO: 283025 - DNA, 20 bp, human
ggcaccgcggccagatagac

SEQ ID NO: 283026 - DNA, 20 bp, human
gccacccaagtcatggggaa

SEQ ID NO: 283027 - DNA, 20 bp, human
gaccaacaggcatgaatata

SEQ ID NO: 283028 - DNA, 20 bp, human
gcccacagggaactccactc

SEQ ID NO: 283029 - DNA, 20 bp, human
ggggccaatcagagagcagt

SEQ ID NO: 283030 - DNA, 20 bp, human
gcgggtaggccgcggtggtg

SEQ ID NO: 283031 - DNA, 20 bp, human
gaggccagccaatgggaacg

SEQ ID NO: 283032 - DNA, 20 bp, human
gcagactgcgcgcaagtcaa

SEQ ID NO: 283033 - DNA, 20 bp, human
gccacctgaggccagccaat

SEQ ID NO: 283034 - DNA, 20 bp, human
gaccgcggggccaacagttt

SEQ ID NO: 283035 - DNA, 20 bp, human
gaaaagcgagcaatccgctg

SEQ ID NO: 283036 - DNA, 20 bp, human
gatagcatgtctccagaggt

SEQ ID NO: 283037 - DNA, 20 bp, human
gcagaacaaggaacgtgcat

SEQ ID NO: 283038 - DNA, 20 bp, human
gaaggaacgtgcataggatc

SEQ ID NO: 283039 - DNA, 20 bp, human
gttgaaaacatcaaaaaagt

SEQ ID NO: 283040 - DNA, 20 bp, human
gcttctgaagacatagtagg

SEQ ID NO: 283041 - DNA, 20 bp, human
gggcttatagtctctcgatg

SEQ ID NO: 283042 - DNA, 20 bp, human
gggtttcgctgactgcttcc

SEQ ID NO: 283043 - DNA, 20 bp, human
gtggagtgtaggtgggggac

SEQ ID NO: 283044 - DNA, 20 bp, human
gctcggatgtaaagcttttc

SEQ ID NO: 283045 - DNA, 20 bp, human
gatgtttggagaaaggttca

SEQ ID NO: 283046 - DNA, 20 bp, human
ggggaaccagcacacggcgg

SEQ ID NO: 283047 - DNA, 20 bp, human
gcagtcacgcggccccggga

SEQ ID NO: 283048 - DNA, 20 bp, human
ggcggggccggcgcggtctg

SEQ ID NO: 283049 - DNA, 20 bp, human
ggccgcgggcggcgacgcgt

SEQ ID NO: 283050 - DNA, 20 bp, human
ggaggcagggcgaaggtcgg

SEQ ID NO: 283051 - DNA, 20 bp, human
gccagctctgaccgggtgta

SEQ ID NO: 283052 - DNA, 20 bp, human
gaccgggtgtagggactgga

SEQ ID NO: 283053 - DNA, 20 bp, human
ggcgggcggcgacgcgtggg

SEQ ID NO: 283054 - DNA, 20 bp, human
gtggcggggtcgctcagttg

SEQ ID NO: 283055 - DNA, 20 bp, human
gcgtccccctcccgtccctg

SEQ ID NO: 283056 - DNA, 20 bp, human
gaccctcgggccaccgggaa

SEQ ID NO: 283057 - DNA, 20 bp, human
gggaggggtgtcgggcgcgt

SEQ ID NO: 283058 - DNA, 20 bp, human
ggagaccgcgggaggggtgt

SEQ ID NO: 283059 - DNA, 20 bp, human
gccctcctcggctcggtaag

SEQ ID NO: 283060 - DNA, 20 bp, human
gagcgggggacggagttcgg

SEQ ID NO: 283061 - DNA, 20 bp, human
ggcgcccgacacccctcccg

SEQ ID NO: 283062 - DNA, 20 bp, human
gtcccagcgccgaaggaggc

SEQ ID NO: 283063 - DNA, 20 bp, human
gaagctcccagcgccgaagg

SEQ ID NO: 283064 - DNA, 20 bp, human
ggcccgagggtgagggtcgg

SEQ ID NO: 283065 - DNA, 20 bp, human
ggagcccagagcaacttgga

SEQ ID NO: 283066 - DNA, 20 bp, human
gatacctgtggggttcctca

SEQ ID NO: 283067 - DNA, 20 bp, human
gctgccctgaggaaccccac

SEQ ID NO: 283068 - DNA, 20 bp, human
gtgaaaaaggcacccaaaaa

SEQ ID NO: 283069 - DNA, 20 bp, human
gggtcaagatcaggtccctg

SEQ ID NO: 283070 - DNA, 20 bp, human
gaggaaccccacaggtatgc

SEQ ID NO: 283071 - DNA, 20 bp, human
gctctaacatggttatgacg

SEQ ID NO: 283072 - DNA, 20 bp, human
gacaggaccagcatacctgt

SEQ ID NO: 283073 - DNA, 20 bp, human
gttatgacgaggtcaagatc

SEQ ID NO: 283074 - DNA, 20 bp, human
ggctctgtactggggttttg

SEQ ID NO: 283075 - DNA, 20 bp, human
gcggggaaaacaccctttgt

SEQ ID NO: 283076 - DNA, 20 bp, human
ggaaaagacaagcgaggcat

SEQ ID NO: 283077 - DNA, 20 bp, human
gagacaagcgaggcatgggt

SEQ ID NO: 283078 - DNA, 20 bp, human
gaaaaggtctggactcctag

SEQ ID NO: 283079 - DNA, 20 bp, human
gctagtggaaaagacaagcg

SEQ ID NO: 283080 - DNA, 20 bp, human
ggcgaggcatgggttggctc

SEQ ID NO: 283081 - DNA, 20 bp, human
gcagcagcacgaattcaaga

SEQ ID NO: 283082 - DNA, 20 bp, human
gagtccagaccttttttgaa

SEQ ID NO: 283083 - DNA, 20 bp, human
gaagccagtcccatgcctaa

SEQ ID NO: 283084 - DNA, 20 bp, human
gaagagggatgcttctgttt

SEQ ID NO: 283085 - DNA, 20 bp, human
gtagctgtcactcccagcgc

SEQ ID NO: 283086 - DNA, 20 bp, human
gaagccagtcccatgcctaa

SEQ ID NO: 283087 - DNA, 20 bp, human
ggaaaagacaagcgaggcat

SEQ ID NO: 283088 - DNA, 20 bp, human
gtagctgtcactcccagcgc

SEQ ID NO: 283089 - DNA, 20 bp, human
ggtgcctttaggcatgggac

SEQ ID NO: 283090 - DNA, 20 bp, human
gccatgcctaaaggcacagt

SEQ ID NO: 283091 - DNA, 20 bp, human
gaaaaggtctggactcctag

SEQ ID NO: 283092 - DNA, 20 bp, human
gagacaagcgaggcatgggt

SEQ ID NO: 283093 - DNA, 20 bp, human
gctagtggaaaagacaagcg

SEQ ID NO: 283094 - DNA, 20 bp, human
gagtccagaccttttttgaa

SEQ ID NO: 283095 - DNA, 20 bp, human
gagcctcaacagtgcctgaa

SEQ ID NO: 283096 - DNA, 20 bp, human
gggggcgtggctggaaactc

SEQ ID NO: 283097 - DNA, 20 bp, human
ggccacgccccaatgtccgg

SEQ ID NO: 283098 - DNA, 20 bp, human
ggtgctgtgcgagatccggt

SEQ ID NO: 283099 - DNA, 20 bp, human
gaactcgggagtggattggc

SEQ ID NO: 283100 - DNA, 20 bp, human
ggagaagccgggcactgatt

SEQ ID NO: 283101 - DNA, 20 bp, human
gtggaaactcgggagtggat

SEQ ID NO: 283102 - DNA, 20 bp, human
gccaatgtccggcggaaggg

SEQ ID NO: 283103 - DNA, 20 bp, human
gttggcgcttgggtactggc

SEQ ID NO: 283104 - DNA, 20 bp, human
gtccgccggacattggggcg

SEQ ID NO: 283105 - DNA, 20 bp, human
gtccaggccgcacttatctc

SEQ ID NO: 283106 - DNA, 20 bp, human
ggaggcgcgccgcaaccaat

SEQ ID NO: 283107 - DNA, 20 bp, human
gcctctgcaacgcccggcgg

SEQ ID NO: 283108 - DNA, 20 bp, human
gtggcggctgtcaccctcca

SEQ ID NO: 283109 - DNA, 20 bp, human
gcaaccaatgggcgtggagg

SEQ ID NO: 283110 - DNA, 20 bp, human
gccctcctgcgccggaaagg

SEQ ID NO: 283111 - DNA, 20 bp, human
gccgcaaccaatgggcgtgg

SEQ ID NO: 283112 - DNA, 20 bp, human
gcaatgggcgtggaggaggt

SEQ ID NO: 283113 - DNA, 20 bp, human
ggcgacagctcgcgcgctcc

SEQ ID NO: 283114 - DNA, 20 bp, human
ggctgtcaccctccagggga

SEQ ID NO: 283115 - DNA, 20 bp, human
gccgcgctcccgtcccctgg

SEQ ID NO: 283116 - DNA, 20 bp, human
gtgggtgactgtcttctagg

SEQ ID NO: 283117 - DNA, 20 bp, human
gggacacagcagtgcagcat

SEQ ID NO: 283118 - DNA, 20 bp, human
gcctcaggaagctgtctgat

SEQ ID NO: 283119 - DNA, 20 bp, human
gtgaggcccaggttgcatga

SEQ ID NO: 283120 - DNA, 20 bp, human
gacagtcacccatatcagtt

SEQ ID NO: 283121 - DNA, 20 bp, human
gctgtctgattggggcagat

SEQ ID NO: 283122 - DNA, 20 bp, human
gactcagtgttacttatctg

SEQ ID NO: 283123 - DNA, 20 bp, human
ggcactggaacaacagagag

SEQ ID NO: 283124 - DNA, 20 bp, human
gctggctgggcatcaggact

SEQ ID NO: 283125 - DNA, 20 bp, human
gccaacccctcatgcaacct

SEQ ID NO: 283126 - DNA, 20 bp, human
gacgtgtggtccgtggctaa

SEQ ID NO: 283127 - DNA, 20 bp, human
ggctaaaggctgggacggaa

SEQ ID NO: 283128 - DNA, 20 bp, human
ggcgcctgagatgggacgtg

SEQ ID NO: 283129 - DNA, 20 bp, human
gggcgcggccgctcagacac

SEQ ID NO: 283130 - DNA, 20 bp, human
ggccgctcagacaccggagc

SEQ ID NO: 283131 - DNA, 20 bp, human
ggcgagccgtgagcgatgat

SEQ ID NO: 283132 - DNA, 20 bp, human
gggaccacacgtcccatctc

SEQ ID NO: 283133 - DNA, 20 bp, human
gcgtgcgcacgtcactgatc

SEQ ID NO: 283134 - DNA, 20 bp, human
gacggcggcgggcggtccgt

SEQ ID NO: 283135 - DNA, 20 bp, human
gaggggcggggcgcctgaga

SEQ ID NO: 283136 - DNA, 20 bp, human
gcagccctcagcattgtaga

SEQ ID NO: 283137 - DNA, 20 bp, human
gcctgccctaagagtagccc

SEQ ID NO: 283138 - DNA, 20 bp, human
gctagcctgggctactctta

SEQ ID NO: 283139 - DNA, 20 bp, human
gcccaggctaggcaaggctg

SEQ ID NO: 283140 - DNA, 20 bp, human
ggcgaagtggagcgttgaac

SEQ ID NO: 283141 - DNA, 20 bp, human
gatagtgagttctgaggtgg

SEQ ID NO: 283142 - DNA, 20 bp, human
ggtggtggctcgcccctaga

SEQ ID NO: 283143 - DNA, 20 bp, human
gattccctctacaatgctga

SEQ ID NO: 283144 - DNA, 20 bp, human
ggaagagggtacaccaaggt

SEQ ID NO: 283145 - DNA, 20 bp, human
gtgtgggagcacaagcggaa

SEQ ID NO: 283146 - DNA, 20 bp, human
ggcagagccccggcttgaga

SEQ ID NO: 283147 - DNA, 20 bp, human
gggggaagcagggtattgat

SEQ ID NO: 283148 - DNA, 20 bp, human
ggatggtagctgaggtttag

SEQ ID NO: 283149 - DNA, 20 bp, human
gaagcaaccctctcaagccg

SEQ ID NO: 283150 - DNA, 20 bp, human
gtgcttgactacttgagaat

SEQ ID NO: 283151 - DNA, 20 bp, human
gcacttgattgtctaatagg

SEQ ID NO: 283152 - DNA, 20 bp, human
gagctccaccggttgaaagt

SEQ ID NO: 283153 - DNA, 20 bp, human
gacacacttgattgtctaat

SEQ ID NO: 283154 - DNA, 20 bp, human
gcaatcaagtgtgtgccaga

SEQ ID NO: 283155 - DNA, 20 bp, human
gcttcgcagaagattttcct

SEQ ID NO: 283156 - DNA, 20 bp, human
gaacgcgatcagatgttagt

SEQ ID NO: 283157 - DNA, 20 bp, human
ggcgatcagatgttagtagg

SEQ ID NO: 283158 - DNA, 20 bp, human
gcaaaaggaagggacgctct

SEQ ID NO: 283159 - DNA, 20 bp, human
gtgtttccaggcaacacaaa

SEQ ID NO: 283160 - DNA, 20 bp, human
gttcttgcgcatttcagcgc

SEQ ID NO: 283161 - DNA, 20 bp, human
gaggtgggcattggccaggt

SEQ ID NO: 283162 - DNA, 20 bp, human
gttttgctgcgcatgtaggc

SEQ ID NO: 283163 - DNA, 20 bp, human
gactggcggtgcacaaagtt

SEQ ID NO: 283164 - DNA, 20 bp, human
ggatgctgtttcctgcactt

SEQ ID NO: 283165 - DNA, 20 bp, human
gtctgtgttcaccgggaggt

SEQ ID NO: 283166 - DNA, 20 bp, human
ggctacagaggcggagaagt

SEQ ID NO: 283167 - DNA, 20 bp, human
gcacactgaagggtagggag

SEQ ID NO: 283168 - DNA, 20 bp, human
gcagtcccgcgatgccttcg

SEQ ID NO: 283169 - DNA, 20 bp, human
gcggctttgcccaccacaca

SEQ ID NO: 283170 - DNA, 20 bp, human
ggtcagtcaccctgtgtggt

SEQ ID NO: 283171 - DNA, 20 bp, human
gagggagagacgatgctctg

SEQ ID NO: 283172 - DNA, 20 bp, human
ggtcgggacagacgcggctc

SEQ ID NO: 283173 - DNA, 20 bp, human
gagggaagggcgcatcaggg

SEQ ID NO: 283174 - DNA, 20 bp, human
gcgcggtcagcagatctcat

SEQ ID NO: 283175 - DNA, 20 bp, human
ggtcaacgctacacactgaa

SEQ ID NO: 283176 - DNA, 20 bp, human
gaggatgaaggaccctacgt

SEQ ID NO: 283177 - DNA, 20 bp, human
gaccctacgtaggttgggag

SEQ ID NO: 283178 - DNA, 20 bp, human
gaaaagaaactgcggagttg

SEQ ID NO: 283179 - DNA, 20 bp, human
gtcgtgagtatccaggatga

SEQ ID NO: 283180 - DNA, 20 bp, human
gtggaaacccgacacccaat

SEQ ID NO: 283181 - DNA, 20 bp, human
gcgaccgcgacgacactgat

SEQ ID NO: 283182 - DNA, 20 bp, human
gcagccccgaccaacccggg

SEQ ID NO: 283183 - DNA, 20 bp, human
gtgaaggaccctacgtaggt

SEQ ID NO: 283184 - DNA, 20 bp, human
gcccctcatcccccacggac

SEQ ID NO: 283185 - DNA, 20 bp, human
gcctctgcggggagaagcaa

SEQ ID NO: 283186 - DNA, 20 bp, human
gtcacgagtatcctggaaga

SEQ ID NO: 283187 - DNA, 20 bp, human
gatggggaggcgcagcgttg

SEQ ID NO: 283188 - DNA, 20 bp, human
gggccgcgtctgcaatgggg

SEQ ID NO: 283189 - DNA, 20 bp, human
gcgagggccgcgtctgcaat

SEQ ID NO: 283190 - DNA, 20 bp, human
gcacaagagtccaagaggag

SEQ ID NO: 283191 - DNA, 20 bp, human
gcgcctccccattgcagacg

SEQ ID NO: 283192 - DNA, 20 bp, human
gggacgcgtcacgagtatcc

SEQ ID NO: 283193 - DNA, 20 bp, human
gtagatatccaatacccaat

SEQ ID NO: 283194 - DNA, 20 bp, human
gtgtagggaaactgagcacg

SEQ ID NO: 283195 - DNA, 20 bp, human
gttctctgaaggcaccgcat

SEQ ID NO: 283196 - DNA, 20 bp, human
gggccgtgtctgcattgggg

SEQ ID NO: 283197 - DNA, 20 bp, human
gtctggggagaatgtgagtc

SEQ ID NO: 283198 - DNA, 20 bp, human
gctagaacccgacacccaat

SEQ ID NO: 283199 - DNA, 20 bp, human
ggttgggagaagtgaaactc

SEQ ID NO: 283200 - DNA, 20 bp, human
gggacgcgtcatgagtattc

SEQ ID NO: 283201 - DNA, 20 bp, human
gccaagggccgtgtctgcat

SEQ ID NO: 283202 - DNA, 20 bp, human
gcgaggggccctcccggcga

SEQ ID NO: 283203 - DNA, 20 bp, human
gcattggggaggcgccgcgt

SEQ ID NO: 283204 - DNA, 20 bp, human
gtccctgtacaagagtccaa

SEQ ID NO: 283205 - DNA, 20 bp, human
gcacttctcccaacctgcgt

SEQ ID NO: 283206 - DNA, 20 bp, human
gagtcactggggagacgcct

SEQ ID NO: 283207 - DNA, 20 bp, human
ggatctaaggccaccctctc

SEQ ID NO: 283208 - DNA, 20 bp, human
gcagagtatggcatgtaact

SEQ ID NO: 283209 - DNA, 20 bp, human
ggctggtcgcttacagactg

SEQ ID NO: 283210 - DNA, 20 bp, human
ggagccctgggggtttactt

SEQ ID NO: 283211 - DNA, 20 bp, human
gagggtccgaagagccctgg

SEQ ID NO: 283212 - DNA, 20 bp, human
gggtttagacaaaatgacaa

SEQ ID NO: 283213 - DNA, 20 bp, human
gttccccaagtaaaccccca

SEQ ID NO: 283214 - DNA, 20 bp, human
gaccctctcggggagggagt

SEQ ID NO: 283215 - DNA, 20 bp, human
gtaaggccaccctctcgggg

SEQ ID NO: 283216 - DNA, 20 bp, human
gactgcgggataggaagctg

SEQ ID NO: 283217 - DNA, 20 bp, human
gtcgtatggagaggcgagtg

SEQ ID NO: 283218 - DNA, 20 bp, human
gcaagggtgcgccctgactg

SEQ ID NO: 283219 - DNA, 20 bp, human
gatgctgaactcgtatggag

SEQ ID NO: 283220 - DNA, 20 bp, human
gtcgcgccaaggggccaagg

SEQ ID NO: 283221 - DNA, 20 bp, human
gcagccatgctgaactcgta

SEQ ID NO: 283222 - DNA, 20 bp, human
ggagtccaggactgcgggat

SEQ ID NO: 283223 - DNA, 20 bp, human
ggaccccggtcagccaatct

SEQ ID NO: 283224 - DNA, 20 bp, human
gcccccagcccgttcgggaa

SEQ ID NO: 283225 - DNA, 20 bp, human
gaatctgggtgctgctgacg

SEQ ID NO: 283226 - DNA, 20 bp, human
ggtcccaaacagggacagat

SEQ ID NO: 283227 - DNA, 20 bp, human
gcccaggctgcatacatcct

SEQ ID NO: 283228 - DNA, 20 bp, human
gagggacagattggctaggt

SEQ ID NO: 283229 - DNA, 20 bp, human
gtgccttagtcttagacaac

SEQ ID NO: 283230 - DNA, 20 bp, human
ggacctgttgtctaagacta

SEQ ID NO: 283231 - DNA, 20 bp, human
ggagtccagtgtcccaaaca

SEQ ID NO: 283232 - DNA, 20 bp, human
gaactgatgatgctaggctg

SEQ ID NO: 283233 - DNA, 20 bp, human
gtagccaatctgtccctgtt

SEQ ID NO: 283234 - DNA, 20 bp, human
gtaacctccctgtaaggaat

SEQ ID NO: 283235 - DNA, 20 bp, human
gacagattggctaggtaggc

SEQ ID NO: 283236 - DNA, 20 bp, human
gagaaggtggaaggattcac

SEQ ID NO: 283237 - DNA, 20 bp, human
ggagaggccagaggaagttt

SEQ ID NO: 283238 - DNA, 20 bp, human
ggtaaagagggaaagagccg

SEQ ID NO: 283239 - DNA, 20 bp, human
gaaaacagattcgaggatgg

SEQ ID NO: 283240 - DNA, 20 bp, human
gaagaaaacagattcgagga

SEQ ID NO: 283241 - DNA, 20 bp, human
gcagctgcgcggtgctctga

SEQ ID NO: 283242 - DNA, 20 bp, human
gcatcctccaaaacttcctc

SEQ ID NO: 283243 - DNA, 20 bp, human
gagctcccgtggactccccg

SEQ ID NO: 283244 - DNA, 20 bp, human
gcccgtggactccccgagga

SEQ ID NO: 283245 - DNA, 20 bp, human
gtcagggggtcccttcttgg

SEQ ID NO: 283246 - DNA, 20 bp, human
gagtctgcctagttcttcta

SEQ ID NO: 283247 - DNA, 20 bp, human
gtattggtcagaacaggcca

SEQ ID NO: 283248 - DNA, 20 bp, human
ggagacctattggtcagaac

SEQ ID NO: 283249 - DNA, 20 bp, human
gatggggccctagaagaact

SEQ ID NO: 283250 - DNA, 20 bp, human
gtgattctgcaggcaaacaa

SEQ ID NO: 283251 - DNA, 20 bp, human
ggggtgttgacattgccgac

SEQ ID NO: 283252 - DNA, 20 bp, human
gaataagaagggagacctat

SEQ ID NO: 283253 - DNA, 20 bp, human
gggtatactaaaaatgggct

SEQ ID NO: 283254 - DNA, 20 bp, human
gttgattggttgtcaatctg

SEQ ID NO: 283255 - DNA, 20 bp, human
ggttttgcatcatcaggtac

SEQ ID NO: 283256 - DNA, 20 bp, human
ggcactggaaatgggtggag

SEQ ID NO: 283257 - DNA, 20 bp, human
ggaagagatgggagaatttt

SEQ ID NO: 283258 - DNA, 20 bp, human
ggggcctctagcactggaaa

SEQ ID NO: 283259 - DNA, 20 bp, human
gctcgggagaaggaacataa

SEQ ID NO: 283260 - DNA, 20 bp, human
gcagatgagactgaaactgt

SEQ ID NO: 283261 - DNA, 20 bp, human
gctctagcactggaaatggg

SEQ ID NO: 283262 - DNA, 20 bp, human
ggctgacattctctgttgct

SEQ ID NO: 283263 - DNA, 20 bp, human
gcatctgactgtctgggatg

SEQ ID NO: 283264 - DNA, 20 bp, human
gaaagatcatctgactgtct

SEQ ID NO: 283265 - DNA, 20 bp, human
gctgaaaatgaactgtgaac

SEQ ID NO: 283266 - DNA, 20 bp, human
ggcagcgccgaggtgagtga

SEQ ID NO: 283267 - DNA, 20 bp, human
gctcggcgctgcagggtcat

SEQ ID NO: 283268 - DNA, 20 bp, human
gccaaagccctcactcacct

SEQ ID NO: 283269 - DNA, 20 bp, human
ggaagcgggcagtgccggac

SEQ ID NO: 283270 - DNA, 20 bp, human
gcccctgacaagctccagat

SEQ ID NO: 283271 - DNA, 20 bp, human
gtgtgtctgcacatcctgtc

SEQ ID NO: 283272 - DNA, 20 bp, human
ggctcctgcgccctgggcac

SEQ ID NO: 283273 - DNA, 20 bp, human
ggagcagccgggttggccta

SEQ ID NO: 283274 - DNA, 20 bp, human
gctttgggccggcggtccca

SEQ ID NO: 283275 - DNA, 20 bp, human
gaggcctgatgaagtcccgg

SEQ ID NO: 283276 - DNA, 20 bp, human
gtcagactctgtccaatccc

SEQ ID NO: 283277 - DNA, 20 bp, human
gggcagaaagttagtatgaa

SEQ ID NO: 283278 - DNA, 20 bp, human
ggtcatcttaagtgcatcac

SEQ ID NO: 283279 - DNA, 20 bp, human
ggatgcacttaagatgacgg

SEQ ID NO: 283280 - DNA, 20 bp, human
gcagataagtcatgatgttt

SEQ ID NO: 283281 - DNA, 20 bp, human
gcgcaggactcacagacctc

SEQ ID NO: 283282 - DNA, 20 bp, human
gctaatcttaaacacaccct

SEQ ID NO: 283283 - DNA, 20 bp, human
gcctcatttgagttctgaga

SEQ ID NO: 283284 - DNA, 20 bp, human
gcatatttactttctcccag

SEQ ID NO: 283285 - DNA, 20 bp, human
ggggagaaagtaaatatgaa

SEQ ID NO: 283286 - DNA, 20 bp, human
gtcagtcagggagttaagta

SEQ ID NO: 283287 - DNA, 20 bp, human
gaggcggagacgtttcacgt

SEQ ID NO: 283288 - DNA, 20 bp, human
gtcactgggagaaaaaacag

SEQ ID NO: 283289 - DNA, 20 bp, human
gcaggatggaaatgtcagtc

SEQ ID NO: 283290 - DNA, 20 bp, human
gctgggagaaaaaacagggg

SEQ ID NO: 283291 - DNA, 20 bp, human
gacgtttcacgtggggtcac

SEQ ID NO: 283292 - DNA, 20 bp, human
gagtcccttctgctggtggc

SEQ ID NO: 283293 - DNA, 20 bp, human
gacaacaaccagggacctgt

SEQ ID NO: 283294 - DNA, 20 bp, human
gctcctacatgcaaaacaac

SEQ ID NO: 283295 - DNA, 20 bp, human
gtgtgggggtagagtccttt

SEQ ID NO: 283296 - DNA, 20 bp, human
ggtagaggctgcatcacaag

SEQ ID NO: 283297 - DNA, 20 bp, human
gtcaagtccactctgagtag

SEQ ID NO: 283298 - DNA, 20 bp, human
gaactgagatgtcaccatag

SEQ ID NO: 283299 - DNA, 20 bp, human
ggattgccccgtctccttcc

SEQ ID NO: 283300 - DNA, 20 bp, human
ggaattgttctatgaataaa

SEQ ID NO: 283301 - DNA, 20 bp, human
gtgccagtcgcaagagggat

SEQ ID NO: 283302 - DNA, 20 bp, human
gcacccatccctcttgcgac

SEQ ID NO: 283303 - DNA, 20 bp, human
gcatgtctgccagtcgcaag

SEQ ID NO: 283304 - DNA, 20 bp, human
gttgtattaagagccctgga

SEQ ID NO: 283305 - DNA, 20 bp, human
gattaaattggaatcttctc

SEQ ID NO: 283306 - DNA, 20 bp, human
gtcctcaagaccatgctgtg

SEQ ID NO: 283307 - DNA, 20 bp, human
gtgtctgctagtgtcaagag

SEQ ID NO: 283308 - DNA, 20 bp, human
gagggaggaaaatcacttca

SEQ ID NO: 283309 - DNA, 20 bp, human
gacacatcctccacacagca

SEQ ID NO: 283310 - DNA, 20 bp, human
gtctgagcagccgcttggat

SEQ ID NO: 283311 - DNA, 20 bp, human
gatgaccttacctatccaag

SEQ ID NO: 283312 - DNA, 20 bp, human
gggtaaggtcatcaataata

SEQ ID NO: 283313 - DNA, 20 bp, human
ggtggggtcaagtcaaaatt

SEQ ID NO: 283314 - DNA, 20 bp, human
ggggaataccatatacacta

SEQ ID NO: 283315 - DNA, 20 bp, human
gtccacacagcatggtcttg

SEQ ID NO: 283316 - DNA, 20 bp, human
gtgtactggatgaacatctg

SEQ ID NO: 283317 - DNA, 20 bp, human
gatgcctcggggattttgag

SEQ ID NO: 283318 - DNA, 20 bp, human
gtgacgtcttcaaattgtac

SEQ ID NO: 283319 - DNA, 20 bp, human
gcatccaatcctgccactca

SEQ ID NO: 283320 - DNA, 20 bp, human
ggctgattggttcttttccg

SEQ ID NO: 283321 - DNA, 20 bp, human
gcactcacggaaacatccac

SEQ ID NO: 283322 - DNA, 20 bp, human
gctgaagaacgaatgcctcg

SEQ ID NO: 283323 - DNA, 20 bp, human
gttgaagacgtcacagtgcc

SEQ ID NO: 283324 - DNA, 20 bp, human
gtgaagagccttaagtcctg

SEQ ID NO: 283325 - DNA, 20 bp, human
ggcagacattttttttgtga

SEQ ID NO: 283326 - DNA, 20 bp, human
gaatcaccggccggtcagtc

SEQ ID NO: 283327 - DNA, 20 bp, human
ggctccaggccgggtcaggg

SEQ ID NO: 283328 - DNA, 20 bp, human
gtctgcggggaatcaccggc

SEQ ID NO: 283329 - DNA, 20 bp, human
gtggaacacgaaatcctctg

SEQ ID NO: 283330 - DNA, 20 bp, human
gatcctctgcggggaatcac

SEQ ID NO: 283331 - DNA, 20 bp, human
ggaagcgcgcgtactcctct

SEQ ID NO: 283332 - DNA, 20 bp, human
gcggttccacagctccaggc

SEQ ID NO: 283333 - DNA, 20 bp, human
gcgggaactggaggtcgcgc

SEQ ID NO: 283334 - DNA, 20 bp, human
ggaactggaggtcgcgcggg

SEQ ID NO: 283335 - DNA, 20 bp, human
gagacctgggatcctcccgg

SEQ ID NO: 283336 - DNA, 20 bp, human
gcagaaaaacgtctgcccag

SEQ ID NO: 283337 - DNA, 20 bp, human
gtgcactagatgaacatttg

SEQ ID NO: 283338 - DNA, 20 bp, human
gattggggagtccctaggaa

SEQ ID NO: 283339 - DNA, 20 bp, human
gcacacatggaaacatccag

SEQ ID NO: 283340 - DNA, 20 bp, human
ggctgaagattgaatggctt

SEQ ID NO: 283341 - DNA, 20 bp, human
gggatgtttccatgtgtggt

SEQ ID NO: 283342 - DNA, 20 bp, human
gctgattggttcctttccta

SEQ ID NO: 283343 - DNA, 20 bp, human
gtgaatagctgaagattgaa

SEQ ID NO: 283344 - DNA, 20 bp, human
gacacttgggatttttagta

SEQ ID NO: 283345 - DNA, 20 bp, human
gtagtagggcaaattaagtg

SEQ ID NO: 283346 - DNA, 20 bp, human
gaggggaagggttcttgcaa

SEQ ID NO: 283347 - DNA, 20 bp, human
ggcatctgttgctaggggaa

SEQ ID NO: 283348 - DNA, 20 bp, human
gaacggagtatcttgtgtcc

SEQ ID NO: 283349 - DNA, 20 bp, human
gcacaagatactccgttcat

SEQ ID NO: 283350 - DNA, 20 bp, human
gatgacgcatctgttgctag

SEQ ID NO: 283351 - DNA, 20 bp, human
ggggttcttgcaaagggtcc

SEQ ID NO: 283352 - DNA, 20 bp, human
gcctgtctagaagtcagatt

SEQ ID NO: 283353 - DNA, 20 bp, human
gatgcaaatcaattactctt

SEQ ID NO: 283354 - DNA, 20 bp, human
ggtaaagttcttaaacaaac

SEQ ID NO: 283355 - DNA, 20 bp, human
gtaagactgttagtcaatca

SEQ ID NO: 283356 - DNA, 20 bp, human
gaagacaaggtctgggtgaa

SEQ ID NO: 283357 - DNA, 20 bp, human
ggaaagaatgatggcgagta

SEQ ID NO: 283358 - DNA, 20 bp, human
gagggatgagtgacaagaca

SEQ ID NO: 283359 - DNA, 20 bp, human
gtgagtgacaagacaaggtc

SEQ ID NO: 283360 - DNA, 20 bp, human
gaacctacatacatgtaggc

SEQ ID NO: 283361 - DNA, 20 bp, human
gaaacataaactcgcctgat

SEQ ID NO: 283362 - DNA, 20 bp, human
gctgctgaacaaagctggga

SEQ ID NO: 283363 - DNA, 20 bp, human
gattcagatagaactcggcc

SEQ ID NO: 283364 - DNA, 20 bp, human
gtataaagagggtggattga

SEQ ID NO: 283365 - DNA, 20 bp, human
gttcctgcctacatgtatgt

SEQ ID NO: 283366 - DNA, 20 bp, human
gacccacattccaagttata

SEQ ID NO: 283367 - DNA, 20 bp, human
gtacaatagctccccaatta

SEQ ID NO: 283368 - DNA, 20 bp, human
gcacattccaagttataggg

SEQ ID NO: 283369 - DNA, 20 bp, human
ggggaacatggccgcaaatc

SEQ ID NO: 283370 - DNA, 20 bp, human
gtaacttcctccctataact

SEQ ID NO: 283371 - DNA, 20 bp, human
gcagaatgacagctgttgac

SEQ ID NO: 283372 - DNA, 20 bp, human
gactagaaaatgtgattctg

SEQ ID NO: 283373 - DNA, 20 bp, human
gtgattctgtggatgcctca

SEQ ID NO: 283374 - DNA, 20 bp, human
ggaaggcaccatgatctttc

SEQ ID NO: 283375 - DNA, 20 bp, human
gcctcaaggagcagcagctc

SEQ ID NO: 283376 - DNA, 20 bp, human
gacagagctggctcacgata

SEQ ID NO: 283377 - DNA, 20 bp, human
gcgagagtacccaaaccagg

SEQ ID NO: 283378 - DNA, 20 bp, human
ggatttccttcctcctggtt

SEQ ID NO: 283379 - DNA, 20 bp, human
gacacgagagtacccaaacc

SEQ ID NO: 283380 - DNA, 20 bp, human
ggcacgtaaaacactttaac

SEQ ID NO: 283381 - DNA, 20 bp, human
gggacaatgctgtgattctg

SEQ ID NO: 283382 - DNA, 20 bp, human
gctttcaggtctttcaatac

SEQ ID NO: 283383 - DNA, 20 bp, human
gtgattctgtggacgcctga

SEQ ID NO: 283384 - DNA, 20 bp, human
gagtacccaaaccaggagga

SEQ ID NO: 283385 - DNA, 20 bp, human
gacagaatttccttatttaa

SEQ ID NO: 283386 - DNA, 20 bp, human
gggaagaaggacacatgacc

SEQ ID NO: 283387 - DNA, 20 bp, human
gaccaggttacgagaggaac

SEQ ID NO: 283388 - DNA, 20 bp, human
ggagtcgtggcgacgctgat

SEQ ID NO: 283389 - DNA, 20 bp, human
gactcagttctcattcccaa

SEQ ID NO: 283390 - DNA, 20 bp, human
gttaagaactgctgattgct

SEQ ID NO: 283391 - DNA, 20 bp, human
gcacatgaccaggttacgag

SEQ ID NO: 283392 - DNA, 20 bp, human
gtagaaacccgacacccatt

SEQ ID NO: 283393 - DNA, 20 bp, human
gtcccgttcctctcgtaacc

SEQ ID NO: 283394 - DNA, 20 bp, human
gactttatagtcgggagtcg

SEQ ID NO: 283395 - DNA, 20 bp, human
gcaaataaattttgtttctg

SEQ ID NO: 283396 - DNA, 20 bp, human
gggccccgaggcggtgtctg

SEQ ID NO: 283397 - DNA, 20 bp, human
gggagagaaagagaaactct

SEQ ID NO: 283398 - DNA, 20 bp, human
gagaaggacctgacacgggt

SEQ ID NO: 283399 - DNA, 20 bp, human
gccaaccccagacaccgcct

SEQ ID NO: 283400 - DNA, 20 bp, human
gagggggagggcaaagtccc

SEQ ID NO: 283401 - DNA, 20 bp, human
gagcccccgggcgaagactc

SEQ ID NO: 283402 - DNA, 20 bp, human
gagtccggggagtccaggta

SEQ ID NO: 283403 - DNA, 20 bp, human
gagacacaccctgcacagga

SEQ ID NO: 283404 - DNA, 20 bp, human
ggcccttgagagccactcct

SEQ ID NO: 283405 - DNA, 20 bp, human
gaggcagaaagttcaatcaa

SEQ ID NO: 283406 - DNA, 20 bp, human
gccaacccatacaccgcctg

SEQ ID NO: 283407 - DNA, 20 bp, human
gggccccacaggcggtgtat

SEQ ID NO: 283408 - DNA, 20 bp, human
gaaaccctcggcaaggtccc

SEQ ID NO: 283409 - DNA, 20 bp, human
gggttggggaggccccgcgt

SEQ ID NO: 283410 - DNA, 20 bp, human
ggggccagggaccttgccga

SEQ ID NO: 283411 - DNA, 20 bp, human
gttcctggatactcaccggg

SEQ ID NO: 283412 - DNA, 20 bp, human
gtagaagagtacaggaggac

SEQ ID NO: 283413 - DNA, 20 bp, human
gggagagaatccccaacgcg

SEQ ID NO: 283414 - DNA, 20 bp, human
ggcttggcacaagagtagcg

SEQ ID NO: 283415 - DNA, 20 bp, human
ggagctcgccctgggattgt

SEQ ID NO: 283416 - DNA, 20 bp, human
ggggacccggaaggtgacgc

SEQ ID NO: 283417 - DNA, 20 bp, human
gcgcgcccggctgtgtgatg

SEQ ID NO: 283418 - DNA, 20 bp, human
ggtgtgatggggagctccgg

SEQ ID NO: 283419 - DNA, 20 bp, human
gcggggctgcacccggagag

SEQ ID NO: 283420 - DNA, 20 bp, human
gacccggagagggggctcga

SEQ ID NO: 283421 - DNA, 20 bp, human
gccccggcgtcccctgaccc

SEQ ID NO: 283422 - DNA, 20 bp, human
gccggcctcccttccttgga

SEQ ID NO: 283423 - DNA, 20 bp, human
ggctccggaggccgcgccca

SEQ ID NO: 283424 - DNA, 20 bp, human
ggggtgtgcaccggggtcag

SEQ ID NO: 283425 - DNA, 20 bp, human
ggggcggggggtgtgcaccg

SEQ ID NO: 283426 - DNA, 20 bp, human
gagcgtgggcgagagaggac

SEQ ID NO: 283427 - DNA, 20 bp, human
gcaggcagcgtgggcgagag

SEQ ID NO: 283428 - DNA, 20 bp, human
gctcgcccacgctgcctggg

SEQ ID NO: 283429 - DNA, 20 bp, human
gagcgagcgcggcaagaagg

SEQ ID NO: 283430 - DNA, 20 bp, human
ggccgcgcgctcgggaacgc

SEQ ID NO: 283431 - DNA, 20 bp, human
gaggtcgtcgatgctggaaa

SEQ ID NO: 283432 - DNA, 20 bp, human
gcccgcctggtggtgcaact

SEQ ID NO: 283433 - DNA, 20 bp, human
gcgcgcctcccaggcagcgt

SEQ ID NO: 283434 - DNA, 20 bp, human
gcctgtaaggccgcaggagt

SEQ ID NO: 283435 - DNA, 20 bp, human
gtgtaggcctgccttccgca

SEQ ID NO: 283436 - DNA, 20 bp, human
gagcggcgacgctaaacacg

SEQ ID NO: 283437 - DNA, 20 bp, human
gttcggggaccttgcagcac

SEQ ID NO: 283438 - DNA, 20 bp, human
gggcgacgctaaacacgcgg

SEQ ID NO: 283439 - DNA, 20 bp, human
ggacgctaaacacgcggcgg

SEQ ID NO: 283440 - DNA, 20 bp, human
gctgcaaggtccccgaaaat

SEQ ID NO: 283441 - DNA, 20 bp, human
gcccgcccccgcacgcctat

SEQ ID NO: 283442 - DNA, 20 bp, human
gaacctctgcggtgctatca

SEQ ID NO: 283443 - DNA, 20 bp, human
ggccgctcgcgccgattttc

SEQ ID NO: 283444 - DNA, 20 bp, human
gccccgaaaatcggcgcgag

SEQ ID NO: 283445 - DNA, 20 bp, human
gtccggccgcccatgtgccg

SEQ ID NO: 283446 - DNA, 20 bp, human
ggtccttggggcagggctac

SEQ ID NO: 283447 - DNA, 20 bp, human
gcagggctacaggctgatct

SEQ ID NO: 283448 - DNA, 20 bp, human
gaataacttaaacctaaaat

SEQ ID NO: 283449 - DNA, 20 bp, human
gcaggcttgaattatcttcc

SEQ ID NO: 283450 - DNA, 20 bp, human
gggcactagtccttggggca

SEQ ID NO: 283451 - DNA, 20 bp, human
gatgtgctgagactgttctc

SEQ ID NO: 283452 - DNA, 20 bp, human
gaaaacaacagccaataacc

SEQ ID NO: 283453 - DNA, 20 bp, human
ggaaagaaggcactagtcct

SEQ ID NO: 283454 - DNA, 20 bp, human
gcggaggctctgagacttga

SEQ ID NO: 283455 - DNA, 20 bp, human
gctctgccaacatgaggcat

SEQ ID NO: 283456 - DNA, 20 bp, human
gaccccccgccgtctttgaa

SEQ ID NO: 283457 - DNA, 20 bp, human
gcaaagacggcggggggtcc

SEQ ID NO: 283458 - DNA, 20 bp, human
gctgcaagggtggttccatc

SEQ ID NO: 283459 - DNA, 20 bp, human
gtggaaccacccttgcagcc

SEQ ID NO: 283460 - DNA, 20 bp, human
gtgccattcaaagacggcgg

SEQ ID NO: 283461 - DNA, 20 bp, human
gttgggggcggggaagaacc

SEQ ID NO: 283462 - DNA, 20 bp, human
gcgcgcgcccgccttggggg

SEQ ID NO: 283463 - DNA, 20 bp, human
ggcaccgcagtcgcactcct

SEQ ID NO: 283464 - DNA, 20 bp, human
gcggggggtccgggctgcaa

SEQ ID NO: 283465 - DNA, 20 bp, human
gggaaagcccaatcacgaag

SEQ ID NO: 283466 - DNA, 20 bp, human
gggtcatcctcgtgaccaat

SEQ ID NO: 283467 - DNA, 20 bp, human
gccggaccctagccacgccc

SEQ ID NO: 283468 - DNA, 20 bp, human
ggagtcagagccctccggag

SEQ ID NO: 283469 - DNA, 20 bp, human
gcgtggccggggcgtggcta

SEQ ID NO: 283470 - DNA, 20 bp, human
ggccaggcagccgctccgga

SEQ ID NO: 283471 - DNA, 20 bp, human
gcggggagtggaggggaatt

SEQ ID NO: 283472 - DNA, 20 bp, human
gcacgccaaagtttttgctg

SEQ ID NO: 283473 - DNA, 20 bp, human
ggcggccgcagcaaaaactt

SEQ ID NO: 283474 - DNA, 20 bp, human
gttcgagtcaggcccggggt

SEQ ID NO: 283475 - DNA, 20 bp, human
gcccgctcccattggtcacg

SEQ ID NO: 283476 - DNA, 20 bp, human
gggccctcggccaccgctag

SEQ ID NO: 283477 - DNA, 20 bp, human
ggtggcccagagcccctgtc

SEQ ID NO: 283478 - DNA, 20 bp, human
ggccaccgctagagggcgag

SEQ ID NO: 283479 - DNA, 20 bp, human
gggctctgggccactgcggt

SEQ ID NO: 283480 - DNA, 20 bp, human
gcgccctctagcggtggccg

SEQ ID NO: 283481 - DNA, 20 bp, human
gccgcccgctcgccctctag

SEQ ID NO: 283482 - DNA, 20 bp, human
gggaaagccacgttccccta

SEQ ID NO: 283483 - DNA, 20 bp, human
gggtcgcatgcccaccgcag

SEQ ID NO: 283484 - DNA, 20 bp, human
gcggtccggacaggggctct

SEQ ID NO: 283485 - DNA, 20 bp, human
gttgttagcggtccggacag

SEQ ID NO: 283486 - DNA, 20 bp, human
ggagagggaggatgcattgg

SEQ ID NO: 283487 - DNA, 20 bp, human
gctggggcccatggtgttct

SEQ ID NO: 283488 - DNA, 20 bp, human
gttccctcctcccaaaggga

SEQ ID NO: 283489 - DNA, 20 bp, human
ggcccatccgccttcccttt

SEQ ID NO: 283490 - DNA, 20 bp, human
gacgcccggcggcagcaggt

SEQ ID NO: 283491 - DNA, 20 bp, human
ggaggcgttcggagaggaaa

SEQ ID NO: 283492 - DNA, 20 bp, human
ggggaaggcggatgggcacg

SEQ ID NO: 283493 - DNA, 20 bp, human
ggagacaagggaggtttttc

SEQ ID NO: 283494 - DNA, 20 bp, human
gctcccaaagggaaggcgga

SEQ ID NO: 283495 - DNA, 20 bp, human
gccggcgcctagagggccaa

SEQ ID NO: 283496 - DNA, 20 bp, human
ggggaatggggtggtcgaat

SEQ ID NO: 283497 - DNA, 20 bp, human
gcctccctctgggcgggaat

SEQ ID NO: 283498 - DNA, 20 bp, human
gcatgtcacagctggggaat

SEQ ID NO: 283499 - DNA, 20 bp, human
gccggcgccctccctcgaag

SEQ ID NO: 283500 - DNA, 20 bp, human
gcttgctcatgtcacagctg

SEQ ID NO: 283501 - DNA, 20 bp, human
gaaggggaggtccctccctc

SEQ ID NO: 283502 - DNA, 20 bp, human
gatggggtggtcgaatgggg

SEQ ID NO: 283503 - DNA, 20 bp, human
ggcgccctccctcgaagggg

SEQ ID NO: 283504 - DNA, 20 bp, human
gaattggaacattgcgacag

SEQ ID NO: 283505 - DNA, 20 bp, human
ggggacctccccttcgaggg

SEQ ID NO: 283506 - DNA, 20 bp, human
gggaacctgtgctgagtcac

SEQ ID NO: 283507 - DNA, 20 bp, human
gagggcagccaggaccacac

SEQ ID NO: 283508 - DNA, 20 bp, human
gaggttccccagtgtggtcc

SEQ ID NO: 283509 - DNA, 20 bp, human
gtcctccagtgactcagcac

SEQ ID NO: 283510 - DNA, 20 bp, human
gactccatgtggcatctgga

SEQ ID NO: 283511 - DNA, 20 bp, human
gtgaccaaggcagttgtcag

SEQ ID NO: 283512 - DNA, 20 bp, human
gacctgtgctgagtcactgg

SEQ ID NO: 283513 - DNA, 20 bp, human
gaggatgaagatcccacagt

SEQ ID NO: 283514 - DNA, 20 bp, human
gacaactgccttggtcaagg

SEQ ID NO: 283515 - DNA, 20 bp, human
gtagtcttatggaacatctg

SEQ ID NO: 283516 - DNA, 20 bp, human
ggaggcggggctgacgtgag

SEQ ID NO: 283517 - DNA, 20 bp, human
gtgccctcgggccccggagg

SEQ ID NO: 283518 - DNA, 20 bp, human
ggcggggctgacgtgagggg

SEQ ID NO: 283519 - DNA, 20 bp, human
ggggagaagacgccgcctcc

SEQ ID NO: 283520 - DNA, 20 bp, human
ggggaaccaagggcccttgg

SEQ ID NO: 283521 - DNA, 20 bp, human
gaaccaagggcccttggggg

SEQ ID NO: 283522 - DNA, 20 bp, human
gaaggcagtcactgtctcct

SEQ ID NO: 283523 - DNA, 20 bp, human
gggcggtcggggtatggcga

SEQ ID NO: 283524 - DNA, 20 bp, human
gcgccgcctccggggcccga

SEQ ID NO: 283525 - DNA, 20 bp, human
gagggcaccgcgggaaccaa

SEQ ID NO: 283526 - DNA, 20 bp, human
ggctctggaggcccccccgg

SEQ ID NO: 283527 - DNA, 20 bp, human
ggaaaagtcaccctccgggg

SEQ ID NO: 283528 - DNA, 20 bp, human
ggacaccgtaagcgcttccc

SEQ ID NO: 283529 - DNA, 20 bp, human
gtgaccctacaatcagtgga

SEQ ID NO: 283530 - DNA, 20 bp, human
gcctggctgggccgagttgt

SEQ ID NO: 283531 - DNA, 20 bp, human
ggtgtcagctcggttcccac

SEQ ID NO: 283532 - DNA, 20 bp, human
gagggaaaagtcaccctccg

SEQ ID NO: 283533 - DNA, 20 bp, human
ggtagggtcaattcagtccc

SEQ ID NO: 283534 - DNA, 20 bp, human
gggacggcaactggccaatc

SEQ ID NO: 283535 - DNA, 20 bp, human
gtggggcgtcttgacttttg

SEQ ID NO: 283536 - DNA, 20 bp, human
gtggctgggcggacggggac

SEQ ID NO: 283537 - DNA, 20 bp, human
gctgggcctgggcacgactg

SEQ ID NO: 283538 - DNA, 20 bp, human
gcccgtccgcccagccacaa

SEQ ID NO: 283539 - DNA, 20 bp, human
gcggccatctgcaggtccac

SEQ ID NO: 283540 - DNA, 20 bp, human
gtcgtcactggggttggaga

SEQ ID NO: 283541 - DNA, 20 bp, human
gggcccagatgaggtccctt

SEQ ID NO: 283542 - DNA, 20 bp, human
gaccccagtgacgaagggga

SEQ ID NO: 283543 - DNA, 20 bp, human
gtaacacgggcagtgtgggt

SEQ ID NO: 283544 - DNA, 20 bp, human
gcactcagggggaccctccc

SEQ ID NO: 283545 - DNA, 20 bp, human
gccagccacaaagggtcctg

SEQ ID NO: 283546 - DNA, 20 bp, human
gagggcggggctaagacaag

SEQ ID NO: 283547 - DNA, 20 bp, human
ggagacctgggagacgaccg

SEQ ID NO: 283548 - DNA, 20 bp, human
ggaaaagaccaggggagtct

SEQ ID NO: 283549 - DNA, 20 bp, human
ggacctaaagggtgcctgat

SEQ ID NO: 283550 - DNA, 20 bp, human
gcggtaagaggagttacctg

SEQ ID NO: 283551 - DNA, 20 bp, human
gagaccttgggcccgcgtga

SEQ ID NO: 283552 - DNA, 20 bp, human
gcccgcgtgagggaaaattt

SEQ ID NO: 283553 - DNA, 20 bp, human
gccgcagaggaaaagaccag

SEQ ID NO: 283554 - DNA, 20 bp, human
gtccagaggacgagacctaa

SEQ ID NO: 283555 - DNA, 20 bp, human
gaggactacgtggttacgca

SEQ ID NO: 283556 - DNA, 20 bp, human
gcgccgatcggtatctgcat

SEQ ID NO: 283557 - DNA, 20 bp, human
gcctcggcgaacggtcccat

SEQ ID NO: 283558 - DNA, 20 bp, human
ggcgggcggtgcgtcaagtt

SEQ ID NO: 283559 - DNA, 20 bp, human
gggccggcgattggttgggg

SEQ ID NO: 283560 - DNA, 20 bp, human
ggctgagtcgcgtgggaggt

SEQ ID NO: 283561 - DNA, 20 bp, human
gtatctgcatgggctcgccc

SEQ ID NO: 283562 - DNA, 20 bp, human
ggccgcgctcgggaccaatc

SEQ ID NO: 283563 - DNA, 20 bp, human
gcgccggccggcgattggtt

SEQ ID NO: 283564 - DNA, 20 bp, human
gtccgccactcgctcccgat

SEQ ID NO: 283565 - DNA, 20 bp, human
gggaggttgctgagtcgcgt

SEQ ID NO: 283566 - DNA, 20 bp, human
gcccggaaaagatggaggta

SEQ ID NO: 283567 - DNA, 20 bp, human
gtcagcagtcgggacacggt

SEQ ID NO: 283568 - DNA, 20 bp, human
gaagaacccggaaaagatgg

SEQ ID NO: 283569 - DNA, 20 bp, human
ggggccgaggtttgagtaca

SEQ ID NO: 283570 - DNA, 20 bp, human
gaacgcgtatgggcggggat

SEQ ID NO: 283571 - DNA, 20 bp, human
ggggtgccgcccccaaggag

SEQ ID NO: 283572 - DNA, 20 bp, human
gccggtcagcagtcgggaca

SEQ ID NO: 283573 - DNA, 20 bp, human
ggccagctctgcccactcta

SEQ ID NO: 283574 - DNA, 20 bp, human
gtagagggatccctggccag

SEQ ID NO: 283575 - DNA, 20 bp, human
gatcccctcacccctggcca

SEQ ID NO: 283576 - DNA, 20 bp, human
gcgggactgcgaggagtggg

SEQ ID NO: 283577 - DNA, 20 bp, human
gcgggtgggtgctgacggca

SEQ ID NO: 283578 - DNA, 20 bp, human
gtcctcgcagtcccggacgg

SEQ ID NO: 283579 - DNA, 20 bp, human
gcgcgccagccgtgtcactc

SEQ ID NO: 283580 - DNA, 20 bp, human
gccgtcagcacccacccgcg

SEQ ID NO: 283581 - DNA, 20 bp, human
gtgagcccggggatttaaaa

SEQ ID NO: 283582 - DNA, 20 bp, human
gcacgaaggagcttctggcg

SEQ ID NO: 283583 - DNA, 20 bp, human
ggcacccacccgcgcggcag

SEQ ID NO: 283584 - DNA, 20 bp, human
ggccagccgtgtcactcagg

SEQ ID NO: 283585 - DNA, 20 bp, human
gtcccggacggaggaggtgt

SEQ ID NO: 283586 - DNA, 20 bp, human
gtcgcagaggctcctctcgc

SEQ ID NO: 283587 - DNA, 20 bp, human
ggaggctcctctcgcgggtt

SEQ ID NO: 283588 - DNA, 20 bp, human
gtccccgcctaacatttcaa

SEQ ID NO: 283589 - DNA, 20 bp, human
gcggctgccaaaaagagaag

SEQ ID NO: 283590 - DNA, 20 bp, human
gagaggctttgaggtcgcag

SEQ ID NO: 283591 - DNA, 20 bp, human
gcctgatcccaacccgcgag

SEQ ID NO: 283592 - DNA, 20 bp, human
gactccgccgggatagggtc

SEQ ID NO: 283593 - DNA, 20 bp, human
ggtgcccgaccctatcccgg

SEQ ID NO: 283594 - DNA, 20 bp, human
ggggagactccgccgggata

SEQ ID NO: 283595 - DNA, 20 bp, human
gctctctctcgcagggtggg

SEQ ID NO: 283596 - DNA, 20 bp, human
ggggctctggtcaggacaat

SEQ ID NO: 283597 - DNA, 20 bp, human
gccgggcaaagaggctgagg

SEQ ID NO: 283598 - DNA, 20 bp, human
gtggctaccgccaactcacg

SEQ ID NO: 283599 - DNA, 20 bp, human
gaccagagcccgtttgctat

SEQ ID NO: 283600 - DNA, 20 bp, human
ggcggccgccggagcgaaaa

SEQ ID NO: 283601 - DNA, 20 bp, human
gcaggacaatgggaggtatc

SEQ ID NO: 283602 - DNA, 20 bp, human
gcagaggcagcagctgctac

SEQ ID NO: 283603 - DNA, 20 bp, human
ggtgtgtatgccgggcaaag

SEQ ID NO: 283604 - DNA, 20 bp, human
gacgggaaagcagagctcta

SEQ ID NO: 283605 - DNA, 20 bp, human
gatgccgggcaaagaggctg

SEQ ID NO: 283606 - DNA, 20 bp, human
gtgagcccgccatgtgtgag

SEQ ID NO: 283607 - DNA, 20 bp, human
gcgactgcggcgacgaggag

SEQ ID NO: 283608 - DNA, 20 bp, human
gctgctggaaagcgcccgag

SEQ ID NO: 283609 - DNA, 20 bp, human
ggcagacgcagttgcgactg

SEQ ID NO: 283610 - DNA, 20 bp, human
ggggttgaacgttgcaacta

SEQ ID NO: 283611 - DNA, 20 bp, human
gccagccactcacacatggc

SEQ ID NO: 283612 - DNA, 20 bp, human
gtttggggaggcgacgtttc

SEQ ID NO: 283613 - DNA, 20 bp, human
gacagccacgcctctgcgga

SEQ ID NO: 283614 - DNA, 20 bp, human
ggctgggcctgaaaggacgg

SEQ ID NO: 283615 - DNA, 20 bp, human
gtgaaaggacggtggcgtgg

SEQ ID NO: 283616 - DNA, 20 bp, human
gaacctgctaggctggggcg

SEQ ID NO: 283617 - DNA, 20 bp, human
ggcgacccaccgaacctgct

SEQ ID NO: 283618 - DNA, 20 bp, human
gcaccgaacctgctaggctg

SEQ ID NO: 283619 - DNA, 20 bp, human
gaagggggcggggactatct

SEQ ID NO: 283620 - DNA, 20 bp, human
gtgccacggaggctaacgat

SEQ ID NO: 283621 - DNA, 20 bp, human
gagaaccaatcagattagtg

SEQ ID NO: 283622 - DNA, 20 bp, human
gagacccgttagaaccggtc

SEQ ID NO: 283623 - DNA, 20 bp, human
ggggctgtaaacggtgggag

SEQ ID NO: 283624 - DNA, 20 bp, human
gggtctgggagttaacgacc

SEQ ID NO: 283625 - DNA, 20 bp, human
ggagaactctgcaaaacaag

SEQ ID NO: 283626 - DNA, 20 bp, human
ggacccgccggcgccggcta

SEQ ID NO: 283627 - DNA, 20 bp, human
gcccagcagccgcgcccaat

SEQ ID NO: 283628 - DNA, 20 bp, human
gggcctcatgcatattaagc

SEQ ID NO: 283629 - DNA, 20 bp, human
gcgtggacgcccattgggcg

SEQ ID NO: 283630 - DNA, 20 bp, human
gccggctacggaggccaaac

SEQ ID NO: 283631 - DNA, 20 bp, human
ggcgaggaggctgttttaaa

SEQ ID NO: 283632 - DNA, 20 bp, human
gccccctcggggaacagaac

SEQ ID NO: 283633 - DNA, 20 bp, human
gtggcctccgtagccggcgc

SEQ ID NO: 283634 - DNA, 20 bp, human
gagcaggcgtggacgcccat

SEQ ID NO: 283635 - DNA, 20 bp, human
gccgccggcgccggctacgg

SEQ ID NO: 283636 - DNA, 20 bp, human
gaaccatcatctttcatgag

SEQ ID NO: 283637 - DNA, 20 bp, human
gaatcccagccaacacctgt

SEQ ID NO: 283638 - DNA, 20 bp, human
gtgtgtacaggtgctcgtat

SEQ ID NO: 283639 - DNA, 20 bp, human
gggcctgtcactacagccta

SEQ ID NO: 283640 - DNA, 20 bp, human
ggtattggttggttacttga

SEQ ID NO: 283641 - DNA, 20 bp, human
gggggaggtggatagatcca

SEQ ID NO: 283642 - DNA, 20 bp, human
gccaaggagaattatttctg

SEQ ID NO: 283643 - DNA, 20 bp, human
gaatgccatcagcactgaaa

SEQ ID NO: 283644 - DNA, 20 bp, human
gatgatggttcattcatagt

SEQ ID NO: 283645 - DNA, 20 bp, human
gtacaggtgctcgtattggt

SEQ ID NO: 283646 - DNA, 20 bp, human
gccaggccaagtgagacgct

SEQ ID NO: 283647 - DNA, 20 bp, human
gtcaaaacggagagaggctg

SEQ ID NO: 283648 - DNA, 20 bp, human
gtcggaatcaaaacggagag

SEQ ID NO: 283649 - DNA, 20 bp, human
gccagcttcggaagtcacgg

SEQ ID NO: 283650 - DNA, 20 bp, human
ggagccagcttcggaagtca

SEQ ID NO: 283651 - DNA, 20 bp, human
ggcttcggaagtcacggcgg

SEQ ID NO: 283652 - DNA, 20 bp, human
gtgaccgatggctcgtctgg

SEQ ID NO: 283653 - DNA, 20 bp, human
gaagatgaacagaatcagcc

SEQ ID NO: 283654 - DNA, 20 bp, human
gctggcatggaagaggcgct

SEQ ID NO: 283655 - DNA, 20 bp, human
gcgcccaccagacgagccat

SEQ ID NO: 283656 - DNA, 20 bp, human
ggcagtgcgcagaacagctc

SEQ ID NO: 283657 - DNA, 20 bp, human
gcactgcggcggcgccgaga

SEQ ID NO: 283658 - DNA, 20 bp, human
gtgagccagaggatgtccag

SEQ ID NO: 283659 - DNA, 20 bp, human
ggctgttctgcgcactgcgg

SEQ ID NO: 283660 - DNA, 20 bp, human
gctgggcgctcagtgtagtg

SEQ ID NO: 283661 - DNA, 20 bp, human
ggcggcagtcggcgagggga

SEQ ID NO: 283662 - DNA, 20 bp, human
gtctatgccaggtgagaagt

SEQ ID NO: 283663 - DNA, 20 bp, human
gctggggcggcagtcggcga

SEQ ID NO: 283664 - DNA, 20 bp, human
gctggggcagcgggtgcacg

SEQ ID NO: 283665 - DNA, 20 bp, human
gtggcaggtggccgcgcctg

SEQ ID NO: 283666 - DNA, 20 bp, human
ggactcgaacggctattggt

SEQ ID NO: 283667 - DNA, 20 bp, human
gcgttcgagtcccagcacta

SEQ ID NO: 283668 - DNA, 20 bp, human
gccgagcgtgcgtaaggtga

SEQ ID NO: 283669 - DNA, 20 bp, human
ggctgtgatagtacagtagg

SEQ ID NO: 283670 - DNA, 20 bp, human
ggacggcgctacgtcacgaa

SEQ ID NO: 283671 - DNA, 20 bp, human
ggccgagccgtggtgagaga

SEQ ID NO: 283672 - DNA, 20 bp, human
gtctctgcagggccaagaac

SEQ ID NO: 283673 - DNA, 20 bp, human
gcgagcagcccccaggcgat

SEQ ID NO: 283674 - DNA, 20 bp, human
gtcccctatcgcctccgcct

SEQ ID NO: 283675 - DNA, 20 bp, human
ggcctaggcggaggcgatag

SEQ ID NO: 283676 - DNA, 20 bp, human
gaggcggggacaaagtctca

SEQ ID NO: 283677 - DNA, 20 bp, human
gcagcgcccgccccccagtc

SEQ ID NO: 283678 - DNA, 20 bp, human
gccaacgggagcggagtgag

SEQ ID NO: 283679 - DNA, 20 bp, human
gccggcttctaccaatcaaa

SEQ ID NO: 283680 - DNA, 20 bp, human
gcggcgagagccaacgggag

SEQ ID NO: 283681 - DNA, 20 bp, human
gcaactctaccggccgcgat

SEQ ID NO: 283682 - DNA, 20 bp, human
gtcgctgggaggcgggacgg

SEQ ID NO: 283683 - DNA, 20 bp, human
ggggttggcggctataaagc

SEQ ID NO: 283684 - DNA, 20 bp, human
gaccgccgagagtcgctggg

SEQ ID NO: 283685 - DNA, 20 bp, human
gggtgtgagagactgacgtg

SEQ ID NO: 283686 - DNA, 20 bp, human
gagggcagctatgtacatgt

SEQ ID NO: 283687 - DNA, 20 bp, human
gaggtagctgggcagaatca

SEQ ID NO: 283688 - DNA, 20 bp, human
gtgagcagaggcggggctta

SEQ ID NO: 283689 - DNA, 20 bp, human
gggtctaaaacaagacacat

SEQ ID NO: 283690 - DNA, 20 bp, human
gtcctgagcatgtgtgggaa

SEQ ID NO: 283691 - DNA, 20 bp, human
gtagagctgtacaagtaaaa

SEQ ID NO: 283692 - DNA, 20 bp, human
gagacacatagggttacctt

SEQ ID NO: 283693 - DNA, 20 bp, human
gcctgctcctgagcatgtgt

SEQ ID NO: 283694 - DNA, 20 bp, human
gccacagagcctgatggagt

SEQ ID NO: 283695 - DNA, 20 bp, human
gaggctgccacagagcctga

SEQ ID NO: 283696 - DNA, 20 bp, human
gccccgcgagacggcggaaa

SEQ ID NO: 283697 - DNA, 20 bp, human
ggccccagacccaggcgaag

SEQ ID NO: 283698 - DNA, 20 bp, human
gagacggcggaaaggggtgg

SEQ ID NO: 283699 - DNA, 20 bp, human
gcccgcgcccggaataggtg

SEQ ID NO: 283700 - DNA, 20 bp, human
gcacccccgcccattggcta

SEQ ID NO: 283701 - DNA, 20 bp, human
gggtctggggccccgcgaga

SEQ ID NO: 283702 - DNA, 20 bp, human
gcccccttcgcctgggtctg

SEQ ID NO: 283703 - DNA, 20 bp, human
ggagtcccgtagccaatggg

SEQ ID NO: 283704 - DNA, 20 bp, human
gctgctgagacccacagcgg

SEQ ID NO: 283705 - DNA, 20 bp, human
gggcccgcctcacctattcc

SEQ ID NO: 283706 - DNA, 20 bp, human
gtcggggtggcgcgcgtcga

SEQ ID NO: 283707 - DNA, 20 bp, human
gggcccagctggggtcacgt

SEQ ID NO: 283708 - DNA, 20 bp, human
ggggtagtgcgcggagacgg

SEQ ID NO: 283709 - DNA, 20 bp, human
gcagctgggccaatgaacgg

SEQ ID NO: 283710 - DNA, 20 bp, human
gtcgcacggcttggagaagt

SEQ ID NO: 283711 - DNA, 20 bp, human
gtgggccaatgaacggcggc

SEQ ID NO: 283712 - DNA, 20 bp, human
gcgaaggcagtaaatgagga

SEQ ID NO: 283713 - DNA, 20 bp, human
gatgcgccgtgagtgtcgca

SEQ ID NO: 283714 - DNA, 20 bp, human
gacctcccgccgccgttcat

SEQ ID NO: 283715 - DNA, 20 bp, human
ggaggggtgcgcgagtcggc

SEQ ID NO: 283716 - DNA, 20 bp, human
gcgcgaggccccattggctg

SEQ ID NO: 283717 - DNA, 20 bp, human
gggctggcggggctcctcat

SEQ ID NO: 283718 - DNA, 20 bp, human
gtcgccaggcagattttttt

SEQ ID NO: 283719 - DNA, 20 bp, human
ggccggccgcgaggccccat

SEQ ID NO: 283720 - DNA, 20 bp, human
ggcgtaccgcgcgcggaggt

SEQ ID NO: 283721 - DNA, 20 bp, human
gcacctccgcggctccctct

SEQ ID NO: 283722 - DNA, 20 bp, human
gggaggctactagttgaact

SEQ ID NO: 283723 - DNA, 20 bp, human
gaacgttctaaattccacga

SEQ ID NO: 283724 - DNA, 20 bp, human
gcctcattggagcagcaggg

SEQ ID NO: 283725 - DNA, 20 bp, human
ggccaatggggcctcgcggc

SEQ ID NO: 283726 - DNA, 20 bp, human
gagtccaagccggagagagc

SEQ ID NO: 283727 - DNA, 20 bp, human
gtgcttagggcgggcctcag

SEQ ID NO: 283728 - DNA, 20 bp, human
ggctcacacacgtatcgcca

SEQ ID NO: 283729 - DNA, 20 bp, human
gagccgccccgagtccaagc

SEQ ID NO: 283730 - DNA, 20 bp, human
gctggccctgcccacgccta

SEQ ID NO: 283731 - DNA, 20 bp, human
gctccggcttggactcgggg

SEQ ID NO: 283732 - DNA, 20 bp, human
gatacgtgtgtgagcctctg

SEQ ID NO: 283733 - DNA, 20 bp, human
gaaggtgaggatgcgcttcc

SEQ ID NO: 283734 - DNA, 20 bp, human
gtctctccggcttggactcg

SEQ ID NO: 283735 - DNA, 20 bp, human
ggatcggggcagcagtgctt

SEQ ID NO: 283736 - DNA, 20 bp, human
gtaggggctgaaacagcggt

SEQ ID NO: 283737 - DNA, 20 bp, human
gtggaagctgctaaaggcgg

SEQ ID NO: 283738 - DNA, 20 bp, human
gcggtggaagctgctaaagg

SEQ ID NO: 283739 - DNA, 20 bp, human
gaaacagcggttggcagaga

SEQ ID NO: 283740 - DNA, 20 bp, human
gaaccgcagccgctgttccc

SEQ ID NO: 283741 - DNA, 20 bp, human
gaagctgctaaaggcggagg

SEQ ID NO: 283742 - DNA, 20 bp, human
gccaaaaccccggaaggaac

SEQ ID NO: 283743 - DNA, 20 bp, human
gcagcagaggactggtgtgt

SEQ ID NO: 283744 - DNA, 20 bp, human
ggctcggtggaagctgctaa

SEQ ID NO: 283745 - DNA, 20 bp, human
gtacagcggtaaggagagtg

SEQ ID NO: 283746 - DNA, 20 bp, human
gacccacacgaactgctcaa

SEQ ID NO: 283747 - DNA, 20 bp, human
gtgggtccgctcccaagcta

SEQ ID NO: 283748 - DNA, 20 bp, human
ggcttggagcgggtctagta

SEQ ID NO: 283749 - DNA, 20 bp, human
gggccggggcgtcccaccgc

SEQ ID NO: 283750 - DNA, 20 bp, human
gaaggcgaacggactgcttc

SEQ ID NO: 283751 - DNA, 20 bp, human
gtccgctcccaagctagggc

SEQ ID NO: 283752 - DNA, 20 bp, human
ggtggggcgttcaggtaaca

SEQ ID NO: 283753 - DNA, 20 bp, human
gcctcgcggcgcaccggaag

SEQ ID NO: 283754 - DNA, 20 bp, human
ggagagggaaagactgagac

SEQ ID NO: 283755 - DNA, 20 bp, human
gctcctccgcccgggacctc

SEQ ID NO: 283756 - DNA, 20 bp, human
ggagcccagagcgcagactc

SEQ ID NO: 283757 - DNA, 20 bp, human
gtgcgctctgggctcgactg

SEQ ID NO: 283758 - DNA, 20 bp, human
ggagcgcatcgaataaaact

SEQ ID NO: 283759 - DNA, 20 bp, human
ggagcccgagtctgcgctct

SEQ ID NO: 283760 - DNA, 20 bp, human
gtcggcgctcttggtcgagc

SEQ ID NO: 283761 - DNA, 20 bp, human
gtcgagcgggattccccctc

SEQ ID NO: 283762 - DNA, 20 bp, human
gccaaggatacacaggtagt

SEQ ID NO: 283763 - DNA, 20 bp, human
gctcttctgcaaaatgcgac

SEQ ID NO: 283764 - DNA, 20 bp, human
gaagcttctagggcaaggct

SEQ ID NO: 283765 - DNA, 20 bp, human
ggaagacttggagtaatact

SEQ ID NO: 283766 - DNA, 20 bp, human
gagccgcgccgctcgcgggg

SEQ ID NO: 283767 - DNA, 20 bp, human
gcacggggcggccgactgca

SEQ ID NO: 283768 - DNA, 20 bp, human
gtccgcagagccgcaggctg

SEQ ID NO: 283769 - DNA, 20 bp, human
gctcccgaaggcggaagcgg

SEQ ID NO: 283770 - DNA, 20 bp, human
ggcccactccgcagagccgc

SEQ ID NO: 283771 - DNA, 20 bp, human
gggctccgagctcccgaagg

SEQ ID NO: 283772 - DNA, 20 bp, human
ggcccgccagcgtcaggcag

SEQ ID NO: 283773 - DNA, 20 bp, human
gcgcggctccgagctcccga

SEQ ID NO: 283774 - DNA, 20 bp, human
gtcggagccgcgccgctcgc

SEQ ID NO: 283775 - DNA, 20 bp, human
gagcccctgcctgacgctgg

SEQ ID NO: 283776 - DNA, 20 bp, human
ggctctaggggtccttgcaa

SEQ ID NO: 283777 - DNA, 20 bp, human
gctggcagcttggacccgag

SEQ ID NO: 283778 - DNA, 20 bp, human
gtgccccgcatctcagaagc

SEQ ID NO: 283779 - DNA, 20 bp, human
gcatctgcatcccaccactc

SEQ ID NO: 283780 - DNA, 20 bp, human
gcaacacaatgtaacagaac

SEQ ID NO: 283781 - DNA, 20 bp, human
gatagcaggaggctgctcta

SEQ ID NO: 283782 - DNA, 20 bp, human
ggatgaggaaaccacatccc

SEQ ID NO: 283783 - DNA, 20 bp, human
gaattggaccagaatgactc

SEQ ID NO: 283784 - DNA, 20 bp, human
gagagacctccaatagcagg

SEQ ID NO: 283785 - DNA, 20 bp, human
gagcagcctcctgctattgg

SEQ ID NO: 283786 - DNA, 20 bp, human
ggtggggcggggaacagtaa

SEQ ID NO: 283787 - DNA, 20 bp, human
gaacagtaacggtctcctat

SEQ ID NO: 283788 - DNA, 20 bp, human
gaacacgaagaaagaatgct

SEQ ID NO: 283789 - DNA, 20 bp, human
ggggcacaccaatcccgcac

SEQ ID NO: 283790 - DNA, 20 bp, human
gactccgggaatgactgggt

SEQ ID NO: 283791 - DNA, 20 bp, human
ggatggcagcctaaactcgc

SEQ ID NO: 283792 - DNA, 20 bp, human
gaactcgcaggccagctaat

SEQ ID NO: 283793 - DNA, 20 bp, human
ggtaacggtctcctattgga

SEQ ID NO: 283794 - DNA, 20 bp, human
gcaccccggcgttagccaat

SEQ ID NO: 283795 - DNA, 20 bp, human
ggctaacgccggggtgggtg

SEQ ID NO: 283796 - DNA, 20 bp, human
gggggtgcatcaagtcccaa

SEQ ID NO: 283797 - DNA, 20 bp, human
gtccaccccacactggcccg

SEQ ID NO: 283798 - DNA, 20 bp, human
gggagcagtcatatgaccct

SEQ ID NO: 283799 - DNA, 20 bp, human
gtatgctcggcgggtcacgt

SEQ ID NO: 283800 - DNA, 20 bp, human
ggcccgccccgggccagtgt

SEQ ID NO: 283801 - DNA, 20 bp, human
ggctcagagcaatagcctgg

SEQ ID NO: 283802 - DNA, 20 bp, human
ggggcgttgcaacacccgca

SEQ ID NO: 283803 - DNA, 20 bp, human
gggaaacaaagtctggccat

SEQ ID NO: 283804 - DNA, 20 bp, human
gatcaagtcccaaggggaca

SEQ ID NO: 283805 - DNA, 20 bp, human
ggcttctcagatttccttaa

SEQ ID NO: 283806 - DNA, 20 bp, human
gaggtagcgggtgtaggcgt

SEQ ID NO: 283807 - DNA, 20 bp, human
ggggcccgtaccagaaggcc

SEQ ID NO: 283808 - DNA, 20 bp, human
gtcttctgggaagtagacag

SEQ ID NO: 283809 - DNA, 20 bp, human
gcagcggggcccgtaccaga

SEQ ID NO: 283810 - DNA, 20 bp, human
gctgcatggctggtgtgtag

SEQ ID NO: 283811 - DNA, 20 bp, human
gtcacatagcgctgcatggc

SEQ ID NO: 283812 - DNA, 20 bp, human
gcatgcagcgctatgtgaag

SEQ ID NO: 283813 - DNA, 20 bp, human
gaaagcagagtgagcaggtc

SEQ ID NO: 283814 - DNA, 20 bp, human
gacctgggtgacctgtctgg

SEQ ID NO: 283815 - DNA, 20 bp, human
gaggacctggccttctggta

SEQ ID NO: 283816 - DNA, 20 bp, human
ggggcgggaagcggagtatg

SEQ ID NO: 283817 - DNA, 20 bp, human
gagggcgtgtcagctacaag

SEQ ID NO: 283818 - DNA, 20 bp, human
gctctggaggttgcaggctc

SEQ ID NO: 283819 - DNA, 20 bp, human
ggcaacgtgggcacgcagcg

SEQ ID NO: 283820 - DNA, 20 bp, human
gcctgcaacctccagagacc

SEQ ID NO: 283821 - DNA, 20 bp, human
gggggtaagtaggcgtgctt

SEQ ID NO: 283822 - DNA, 20 bp, human
gagctgacacgcccttgccg

SEQ ID NO: 283823 - DNA, 20 bp, human
ggacacgcccttgccggggg

SEQ ID NO: 283824 - DNA, 20 bp, human
gcggcctcgcgccagtccgc

SEQ ID NO: 283825 - DNA, 20 bp, human
gtaagtaggcgtgcttcggc

SEQ ID NO: 283826 - DNA, 20 bp, human
gcacggaagcccagcgtcgg

SEQ ID NO: 283827 - DNA, 20 bp, human
gcaggaggagccaactgcgc

SEQ ID NO: 283828 - DNA, 20 bp, human
ggacgctgggcttccgtgag

SEQ ID NO: 283829 - DNA, 20 bp, human
gtgcctggggcgggcaaacc

SEQ ID NO: 283830 - DNA, 20 bp, human
gtgcgccggaggaggggttt

SEQ ID NO: 283831 - DNA, 20 bp, human
gtcggccgaaacccctcctc

SEQ ID NO: 283832 - DNA, 20 bp, human
gtccactgcagaggcgggga

SEQ ID NO: 283833 - DNA, 20 bp, human
ggagtcccgcgggatccagg

SEQ ID NO: 283834 - DNA, 20 bp, human
ggagcggcgctctgccaggt

SEQ ID NO: 283835 - DNA, 20 bp, human
ggaggagccaactgcgccgg

SEQ ID NO: 283836 - DNA, 20 bp, human
gttgtcccgtgcagtggttg

SEQ ID NO: 283837 - DNA, 20 bp, human
gtgggagcgcgttccccggt

SEQ ID NO: 283838 - DNA, 20 bp, human
gggtgtgggagcgcgttccc

SEQ ID NO: 283839 - DNA, 20 bp, human
gagcgcgttccccggtagga

SEQ ID NO: 283840 - DNA, 20 bp, human
gaccactgcacgggacaaaa

SEQ ID NO: 283841 - DNA, 20 bp, human
ggccatgcataagaaacagc

SEQ ID NO: 283842 - DNA, 20 bp, human
gtcccacaccatctgtcatc

SEQ ID NO: 283843 - DNA, 20 bp, human
gtcaaggattacttgttata

SEQ ID NO: 283844 - DNA, 20 bp, human
gagagcaggcgtgagcgagc

SEQ ID NO: 283845 - DNA, 20 bp, human
gatggccacaaccactgcac

SEQ ID NO: 283846 - DNA, 20 bp, human
gccagccaggcaccacctag

SEQ ID NO: 283847 - DNA, 20 bp, human
gaagtggccaatctctgtgc

SEQ ID NO: 283848 - DNA, 20 bp, human
gggaaaaagccccaactgtc

SEQ ID NO: 283849 - DNA, 20 bp, human
gtctcctgatgtgcaggaag

SEQ ID NO: 283850 - DNA, 20 bp, human
gcgcccgcctccccattcac

SEQ ID NO: 283851 - DNA, 20 bp, human
gtgcccaggcgcccgctagg

SEQ ID NO: 283852 - DNA, 20 bp, human
ggcgcccgctaggtggtgcc

SEQ ID NO: 283853 - DNA, 20 bp, human
ggaaaactcccggacagttg

SEQ ID NO: 283854 - DNA, 20 bp, human
ggcacatcaggagatccccg

SEQ ID NO: 283855 - DNA, 20 bp, human
gaggagatccccgcggcctg

SEQ ID NO: 283856 - DNA, 20 bp, human
gggccggcgcagcgtcctcg

SEQ ID NO: 283857 - DNA, 20 bp, human
gtggctgtggggccccgatg

SEQ ID NO: 283858 - DNA, 20 bp, human
gagccccgaggacgctgcgc

SEQ ID NO: 283859 - DNA, 20 bp, human
gtgcccgcgcgctcaggtct

SEQ ID NO: 283860 - DNA, 20 bp, human
gtggccagcccgttcctcat

SEQ ID NO: 283861 - DNA, 20 bp, human
ggtggggccccgatgaggaa

SEQ ID NO: 283862 - DNA, 20 bp, human
gggaactgatcacgcgggat

SEQ ID NO: 283863 - DNA, 20 bp, human
gcccgagcgcggccgctgcc

SEQ ID NO: 283864 - DNA, 20 bp, human
gcccgcgccacccgctccgt

SEQ ID NO: 283865 - DNA, 20 bp, human
ggggcagcgtctcccggcag

SEQ ID NO: 283866 - DNA, 20 bp, human
gaggccctcggcgcgctctg

SEQ ID NO: 283867 - DNA, 20 bp, human
gcgcccccagagcgcgccga

SEQ ID NO: 283868 - DNA, 20 bp, human
gcaatcgcagcgccgccgag

SEQ ID NO: 283869 - DNA, 20 bp, human
gcatcagcggcgtctaacca

SEQ ID NO: 283870 - DNA, 20 bp, human
ggaagggtccaaggggtcca

SEQ ID NO: 283871 - DNA, 20 bp, human
gggaccgtggcgccctgcgt

SEQ ID NO: 283872 - DNA, 20 bp, human
gtctggagagaagggtccaa

SEQ ID NO: 283873 - DNA, 20 bp, human
gaggtctgcagacggggaag

SEQ ID NO: 283874 - DNA, 20 bp, human
gcagctgcagattctagccc

SEQ ID NO: 283875 - DNA, 20 bp, human
ggctgcgattggccgcgttc

SEQ ID NO: 283876 - DNA, 20 bp, human
gggcgggctcgcatgaggga

SEQ ID NO: 283877 - DNA, 20 bp, human
gcatgagggaggggtgcgga

SEQ ID NO: 283878 - DNA, 20 bp, human
gcggcaccgagggatcgagg

SEQ ID NO: 283879 - DNA, 20 bp, human
ggacgggcgggctcgcatga

SEQ ID NO: 283880 - DNA, 20 bp, human
gccgcggcaccgagggatcg

SEQ ID NO: 283881 - DNA, 20 bp, human
gggccctgccgcggcaccga

SEQ ID NO: 283882 - DNA, 20 bp, human
gagtgaggacccagacgggc

SEQ ID NO: 283883 - DNA, 20 bp, human
ggcggagtgaggacccagac

SEQ ID NO: 283884 - DNA, 20 bp, human
ggcggggagcggccctgccg

SEQ ID NO: 283885 - DNA, 20 bp, human
gctacggggcgcaaagtcgg

SEQ ID NO: 283886 - DNA, 20 bp, human
gcaccatgcggcattacgat

SEQ ID NO: 283887 - DNA, 20 bp, human
gtcggcgatgattggacgga

SEQ ID NO: 283888 - DNA, 20 bp, human
gcatcgccgagattttgggg

SEQ ID NO: 283889 - DNA, 20 bp, human
gcccgcccccttcctggact

SEQ ID NO: 283890 - DNA, 20 bp, human
gggccttcccagtccaggaa

SEQ ID NO: 283891 - DNA, 20 bp, human
ggcggcattacgatgggctg

SEQ ID NO: 283892 - DNA, 20 bp, human
gcgccgagattttggggtgg

SEQ ID NO: 283893 - DNA, 20 bp, human
gccccctaacccgccggcat

SEQ ID NO: 283894 - DNA, 20 bp, human
gctcccccaccccaaaatct

SEQ ID NO: 283895 - DNA, 20 bp, human
gaatctcggcgatgattgga

SEQ ID NO: 283896 - DNA, 20 bp, human
ggcccgcagccgattgggga

SEQ ID NO: 283897 - DNA, 20 bp, human
gcgcccacccccgacgactt

SEQ ID NO: 283898 - DNA, 20 bp, human
gccgcgcccgcagccgattg

SEQ ID NO: 283899 - DNA, 20 bp, human
gcggcgtcgccttccccaat

SEQ ID NO: 283900 - DNA, 20 bp, human
gtcaaagcctaagtcgtcgg

SEQ ID NO: 283901 - DNA, 20 bp, human
gcgttcaaagcctaagtcgt

SEQ ID NO: 283902 - DNA, 20 bp, human
gagaccgggcttcctcccga

SEQ ID NO: 283903 - DNA, 20 bp, human
gcgctgagataggctgcgga

SEQ ID NO: 283904 - DNA, 20 bp, human
ggccgcgctgagataggctg

SEQ ID NO: 283905 - DNA, 20 bp, human
ggcgacgccgctcgcggagg

SEQ ID NO: 283906 - DNA, 20 bp, human
gtatggcctgcgatgggagt

SEQ ID NO: 283907 - DNA, 20 bp, human
ggagctggggaaattctcca

SEQ ID NO: 283908 - DNA, 20 bp, human
ggggagctatggcctgcgat

SEQ ID NO: 283909 - DNA, 20 bp, human
gcccctacaaggttctttcg

SEQ ID NO: 283910 - DNA, 20 bp, human
gtacgagagcggcagcagca

SEQ ID NO: 283911 - DNA, 20 bp, human
gggcaggggccctgattcac

SEQ ID NO: 283912 - DNA, 20 bp, human
gggaagggtcccaaaatgga

SEQ ID NO: 283913 - DNA, 20 bp, human
gatggcagcggagagggaca

SEQ ID NO: 283914 - DNA, 20 bp, human
gtagcgaagggactgaactt

SEQ ID NO: 283915 - DNA, 20 bp, human
gccccagcggcccgtgaatc

SEQ ID NO: 283916 - DNA, 20 bp, human
gccaaaggttaggtgaagtt

SEQ ID NO: 283917 - DNA, 20 bp, human
gagggggaaacccggagaga

SEQ ID NO: 283918 - DNA, 20 bp, human
gcctggagagcagaagacct

SEQ ID NO: 283919 - DNA, 20 bp, human
gctaaagcggaactgagaac

SEQ ID NO: 283920 - DNA, 20 bp, human
gccccccagcgtgagtacaa

SEQ ID NO: 283921 - DNA, 20 bp, human
gggctggatgcaaatgatgg

SEQ ID NO: 283922 - DNA, 20 bp, human
ggtggtgagcatgccctgga

SEQ ID NO: 283923 - DNA, 20 bp, human
gcgcctaggctgcaaggcac

SEQ ID NO: 283924 - DNA, 20 bp, human
ggctagagaccttcttttac

SEQ ID NO: 283925 - DNA, 20 bp, human
gttcggctggatgcaaatga

SEQ ID NO: 283926 - DNA, 20 bp, human
gccagcctatccaccggcgg

SEQ ID NO: 283927 - DNA, 20 bp, human
ggtgctaattacaactgctg

SEQ ID NO: 283928 - DNA, 20 bp, human
ggggaaccgggaaactgcgg

SEQ ID NO: 283929 - DNA, 20 bp, human
ggcctgacttggggtgacaa

SEQ ID NO: 283930 - DNA, 20 bp, human
gaaactgcgggggaactgga

SEQ ID NO: 283931 - DNA, 20 bp, human
gtggttaatcggtcccccgc

SEQ ID NO: 283932 - DNA, 20 bp, human
gggcaggcatcatgactcac

SEQ ID NO: 283933 - DNA, 20 bp, human
gccccgcccagcctatccac

SEQ ID NO: 283934 - DNA, 20 bp, human
gagcctccaccccttcacag

SEQ ID NO: 283935 - DNA, 20 bp, human
gcctagcctctgtgaagggg

SEQ ID NO: 283936 - DNA, 20 bp, human
ggggctccccagggtgtagg

SEQ ID NO: 283937 - DNA, 20 bp, human
gcggcctcccgagaccgcag

SEQ ID NO: 283938 - DNA, 20 bp, human
gtccctgttcccaaggcccc

SEQ ID NO: 283939 - DNA, 20 bp, human
ggccccgcgctggaccgctc

SEQ ID NO: 283940 - DNA, 20 bp, human
gggaccgctcggggctagag

SEQ ID NO: 283941 - DNA, 20 bp, human
ggagccgctgcggtctcggg

SEQ ID NO: 283942 - DNA, 20 bp, human
ggcccgaccgccagtcgccc

SEQ ID NO: 283943 - DNA, 20 bp, human
gtcaccgcctggctgccccg

SEQ ID NO: 283944 - DNA, 20 bp, human
gcgggcgagtcgccccgcgc

SEQ ID NO: 283945 - DNA, 20 bp, human
gctccccagggtgtaggagg

SEQ ID NO: 283946 - DNA, 20 bp, human
gagtgacttaagagctgcaa

SEQ ID NO: 283947 - DNA, 20 bp, human
gcaattccttgtgataatct

SEQ ID NO: 283948 - DNA, 20 bp, human
gataatcttggaatgcttca

SEQ ID NO: 283949 - DNA, 20 bp, human
ggaatatggcctgctgaaga

SEQ ID NO: 283950 - DNA, 20 bp, human
gacttaagagctgcaatggg

SEQ ID NO: 283951 - DNA, 20 bp, human
gcatataagggttacgccta

SEQ ID NO: 283952 - DNA, 20 bp, human
ggcattccaagattatcaca

SEQ ID NO: 283953 - DNA, 20 bp, human
gcatatcctgacagccccct

SEQ ID NO: 283954 - DNA, 20 bp, human
gacctcatattctgaaaaat

SEQ ID NO: 283955 - DNA, 20 bp, human
gttacgcctagggggctgtc

SEQ ID NO: 283956 - DNA, 20 bp, human
gctctacaagccagcctttg

SEQ ID NO: 283957 - DNA, 20 bp, human
gggaaagtgactgttcgaag

SEQ ID NO: 283958 - DNA, 20 bp, human
gcccacttggaacttacttg

SEQ ID NO: 283959 - DNA, 20 bp, human
gactgagtcaatatttgaac

SEQ ID NO: 283960 - DNA, 20 bp, human
ggtggctttgctgacaaaac

SEQ ID NO: 283961 - DNA, 20 bp, human
ggccacaagtaagttccaag

SEQ ID NO: 283962 - DNA, 20 bp, human
gtcttacaaaacaaccgtat

SEQ ID NO: 283963 - DNA, 20 bp, human
gtcagaaaacaagctcctca

SEQ ID NO: 283964 - DNA, 20 bp, human
gtcatggaagatgccatatt

SEQ ID NO: 283965 - DNA, 20 bp, human
gaatcccgtagaaagcacag

SEQ ID NO: 283966 - DNA, 20 bp, human
gggcttgaatagaccgcgga

SEQ ID NO: 283967 - DNA, 20 bp, human
ggcgcggtaggcgggattaa

SEQ ID NO: 283968 - DNA, 20 bp, human
gccactgcggagttgggcga

SEQ ID NO: 283969 - DNA, 20 bp, human
ggggagtccgtgatctagag

SEQ ID NO: 283970 - DNA, 20 bp, human
ggaggggatgagtaaagggg

SEQ ID NO: 283971 - DNA, 20 bp, human
gaatcgcggtggtgcgcgga

SEQ ID NO: 283972 - DNA, 20 bp, human
gcgcgggcttgaatagaccg

SEQ ID NO: 283973 - DNA, 20 bp, human
gagggagggacccatgtcaa

SEQ ID NO: 283974 - DNA, 20 bp, human
gcgggagcggcacaggccgc

SEQ ID NO: 283975 - DNA, 20 bp, human
gagggtgcgcgcgcgttcag

SEQ ID NO: 283976 - DNA, 20 bp, human
gggaaccaatggactccaag

SEQ ID NO: 283977 - DNA, 20 bp, human
ggacggcgtagaacgaccga

SEQ ID NO: 283978 - DNA, 20 bp, human
gaggcggggtaaaaaagaga

SEQ ID NO: 283979 - DNA, 20 bp, human
gctacgccgtctccacccct

SEQ ID NO: 283980 - DNA, 20 bp, human
gcaccacaggccaatagcag

SEQ ID NO: 283981 - DNA, 20 bp, human
gaccaatggactccaagggg

SEQ ID NO: 283982 - DNA, 20 bp, human
ggtcggttggccaatcagac

SEQ ID NO: 283983 - DNA, 20 bp, human
ggccctggaacagctctgat

SEQ ID NO: 283984 - DNA, 20 bp, human
gcgtagtgggcggagaaaaa

SEQ ID NO: 283985 - DNA, 20 bp, human
gctgtgtaacgtcattcctt

SEQ ID NO: 283986 - DNA, 20 bp, human
gtcacagcaaggaagaaggg

SEQ ID NO: 283987 - DNA, 20 bp, human
gccaatatggccaacaatgt

SEQ ID NO: 283988 - DNA, 20 bp, human
gggcttcacagcaaggaaga

SEQ ID NO: 283989 - DNA, 20 bp, human
gatcaccaaccccacattgt

SEQ ID NO: 283990 - DNA, 20 bp, human
gacctcatgcatggcccaat

SEQ ID NO: 283991 - DNA, 20 bp, human
gtcccacatcccacattgtt

SEQ ID NO: 283992 - DNA, 20 bp, human
ggagtatttggatgagattc

SEQ ID NO: 283993 - DNA, 20 bp, human
gccaggatggctattgctaa

SEQ ID NO: 283994 - DNA, 20 bp, human
gcttctgggttggttaactc

SEQ ID NO: 283995 - DNA, 20 bp, human
gaaattagggcttcacagca

SEQ ID NO: 283996 - DNA, 20 bp, human
gaatagaatcgcggggtagg

SEQ ID NO: 283997 - DNA, 20 bp, human
gcggggtaggtggggtcgtc

SEQ ID NO: 283998 - DNA, 20 bp, human
ggaggtgggtaactgtattc

SEQ ID NO: 283999 - DNA, 20 bp, human
gttccggtgggcaactgagg

SEQ ID NO: 284000 - DNA, 20 bp, human
gacccacctcagttgcccac

SEQ ID NO: 284001 - DNA, 20 bp, human
gttcggcggtctcggcggtc

SEQ ID NO: 284002 - DNA, 20 bp, human
gcccgcgattctattcctag

SEQ ID NO: 284003 - DNA, 20 bp, human
gtcctcgccagtgttcagta

SEQ ID NO: 284004 - DNA, 20 bp, human
gggtaggtggggtcgtctgg

SEQ ID NO: 284005 - DNA, 20 bp, human
gagaccgccgaacaagatag

SEQ ID NO: 284006 - DNA, 20 bp, human
gccctatccgccgccaatgg

SEQ ID NO: 284007 - DNA, 20 bp, human
gaaattaacgccgacgggag

SEQ ID NO: 284008 - DNA, 20 bp, human
gccaagaggtagtaactagc

SEQ ID NO: 284009 - DNA, 20 bp, human
gtaacgtcgggtactgtctc

SEQ ID NO: 284010 - DNA, 20 bp, human
ggtactgtctctggccgcaa

SEQ ID NO: 284011 - DNA, 20 bp, human
gtgtctctggccgcaagggt

SEQ ID NO: 284012 - DNA, 20 bp, human
gcgtactcctcccacccttg

SEQ ID NO: 284013 - DNA, 20 bp, human
ggtagcggaagacgcgttag

SEQ ID NO: 284014 - DNA, 20 bp, human
gggcgggaccctattccaag

SEQ ID NO: 284015 - DNA, 20 bp, human
gagagccttcccgccattgg

SEQ ID NO: 284016 - DNA, 20 bp, human
gagccaagcgggcgcgaaga

SEQ ID NO: 284017 - DNA, 20 bp, human
gcgaagagggactggaccag

SEQ ID NO: 284018 - DNA, 20 bp, human
gctgacgcgaacggcggcaa

SEQ ID NO: 284019 - DNA, 20 bp, human
ggggaggagcgaattgggaa

SEQ ID NO: 284020 - DNA, 20 bp, human
gcgcgcgccgccagtctgtt

SEQ ID NO: 284021 - DNA, 20 bp, human
gcgcgcctcgccagctttca

SEQ ID NO: 284022 - DNA, 20 bp, human
gagggactggaccagcgggt

SEQ ID NO: 284023 - DNA, 20 bp, human
gaggcctgcgtggggaatga

SEQ ID NO: 284024 - DNA, 20 bp, human
gcctccgcccgccaacccgc

SEQ ID NO: 284025 - DNA, 20 bp, human
gctacgtggacgctcaccat

SEQ ID NO: 284026 - DNA, 20 bp, human
gcttcgggagccctccgtag

SEQ ID NO: 284027 - DNA, 20 bp, human
gggcagctacagcacatcgg

SEQ ID NO: 284028 - DNA, 20 bp, human
gcgggacggcgccgggtcca

SEQ ID NO: 284029 - DNA, 20 bp, human
ggcgccgtcccgcccggctt

SEQ ID NO: 284030 - DNA, 20 bp, human
gcgagtccggccgctacgga

SEQ ID NO: 284031 - DNA, 20 bp, human
gccaatgggacgctgaagct

SEQ ID NO: 284032 - DNA, 20 bp, human
ggcgcgcgcgctctagacct

SEQ ID NO: 284033 - DNA, 20 bp, human
gctgaagctaggttgagtga

SEQ ID NO: 284034 - DNA, 20 bp, human
ggacccggcgccgtcccgcc

SEQ ID NO: 284035 - DNA, 20 bp, human
gcgcgcgagtccggccgcta

SEQ ID NO: 284036 - DNA, 20 bp, human
ggcagtgggttagactaagc

SEQ ID NO: 284037 - DNA, 20 bp, human
gtctccaggcaataaatgac

SEQ ID NO: 284038 - DNA, 20 bp, human
gaggaagattctcaggaatg

SEQ ID NO: 284039 - DNA, 20 bp, human
gtgaactgtctaattaggag

SEQ ID NO: 284040 - DNA, 20 bp, human
gtcacatccgggtatctggg

SEQ ID NO: 284041 - DNA, 20 bp, human
gcactctaaggggcagcgat

SEQ ID NO: 284042 - DNA, 20 bp, human
gcagatacccggatgtgaga

SEQ ID NO: 284043 - DNA, 20 bp, human
ggagacggtgcgcgatacaa

SEQ ID NO: 284044 - DNA, 20 bp, human
gttctactaggcactctaag

SEQ ID NO: 284045 - DNA, 20 bp, human
gcacgggacgaccctctggg

SEQ ID NO: 284046 - DNA, 20 bp, human
gtatagttctgtgccgtcgt

SEQ ID NO: 284047 - DNA, 20 bp, human
gctggtaagtcactaatttc

SEQ ID NO: 284048 - DNA, 20 bp, human
gaagactaatggattgaacc

SEQ ID NO: 284049 - DNA, 20 bp, human
ggagctacaactacaaccag

SEQ ID NO: 284050 - DNA, 20 bp, human
gtggttgtagtttagacctc

SEQ ID NO: 284051 - DNA, 20 bp, human
gtgtgatatgaatggatacc

SEQ ID NO: 284052 - DNA, 20 bp, human
gtagcagcggatatgtggag

SEQ ID NO: 284053 - DNA, 20 bp, human
ggaagctagcagcggatatg

SEQ ID NO: 284054 - DNA, 20 bp, human
gcactgtcaccgttctagac

SEQ ID NO: 284055 - DNA, 20 bp, human
gacagtcagccggtctagaa

SEQ ID NO: 284056 - DNA, 20 bp, human
ggagcagcagcgttaggccg

SEQ ID NO: 284057 - DNA, 20 bp, human
gtccgcgttgcacagccttg

SEQ ID NO: 284058 - DNA, 20 bp, human
gcgtgagaggaaggtataaa

SEQ ID NO: 284059 - DNA, 20 bp, human
ggcggggaccatcgagaaca

SEQ ID NO: 284060 - DNA, 20 bp, human
ggtgcaacgcggagcgtgag

SEQ ID NO: 284061 - DNA, 20 bp, human
ggctcccgccgctactggag

SEQ ID NO: 284062 - DNA, 20 bp, human
gcccccaaggctgtgcaacg

SEQ ID NO: 284063 - DNA, 20 bp, human
gaacgcggagcgtgagagga

SEQ ID NO: 284064 - DNA, 20 bp, human
ggagctaagacagtcgcgcg

SEQ ID NO: 284065 - DNA, 20 bp, human
gataaagggtagcgagaggg

SEQ ID NO: 284066 - DNA, 20 bp, human
gcggaggggaacaatggcgg

SEQ ID NO: 284067 - DNA, 20 bp, human
gggagctgggagcgagcgaa

SEQ ID NO: 284068 - DNA, 20 bp, human
gtgcgggaggctaaagtagc

SEQ ID NO: 284069 - DNA, 20 bp, human
ggaggctaaagtagcgggag

SEQ ID NO: 284070 - DNA, 20 bp, human
gcgggagcggaggggaacaa

SEQ ID NO: 284071 - DNA, 20 bp, human
gcggggcggctataaaggga

SEQ ID NO: 284072 - DNA, 20 bp, human
gccccgcccgccaatcggga

SEQ ID NO: 284073 - DNA, 20 bp, human
ggccctcccggcaaggagag

SEQ ID NO: 284074 - DNA, 20 bp, human
ggccacgcgtgaggggacgc

SEQ ID NO: 284075 - DNA, 20 bp, human
gggcggccgcggccgccaat

SEQ ID NO: 284076 - DNA, 20 bp, human
gggccctggaggaaggacac

SEQ ID NO: 284077 - DNA, 20 bp, human
ggcagagccgacacggctgg

SEQ ID NO: 284078 - DNA, 20 bp, human
gcctcccccgccagccgtgt

SEQ ID NO: 284079 - DNA, 20 bp, human
gggacaagcgaggacgtttc

SEQ ID NO: 284080 - DNA, 20 bp, human
gagcgaggacgtttctggag

SEQ ID NO: 284081 - DNA, 20 bp, human
gggagcagagccgacacggc

SEQ ID NO: 284082 - DNA, 20 bp, human
ggagccgacacggctggcgg

SEQ ID NO: 284083 - DNA, 20 bp, human
gcggtggaggcggacaagcg

SEQ ID NO: 284084 - DNA, 20 bp, human
gcgcacatttcagtgtcctg

SEQ ID NO: 284085 - DNA, 20 bp, human
gcttccatcaggcgtccttt

SEQ ID NO: 284086 - DNA, 20 bp, human
ggggagggtcgcttgctctg

SEQ ID NO: 284087 - DNA, 20 bp, human
gggagctggcgactgccgga

SEQ ID NO: 284088 - DNA, 20 bp, human
gtacgggaaccgggcgtggg

SEQ ID NO: 284089 - DNA, 20 bp, human
ggcggagccaactccccaca

SEQ ID NO: 284090 - DNA, 20 bp, human
gcgcgcgctcacgtggctgc

SEQ ID NO: 284091 - DNA, 20 bp, human
gagctaaggctacgggaacc

SEQ ID NO: 284092 - DNA, 20 bp, human
gcgcggctttcattttactc

SEQ ID NO: 284093 - DNA, 20 bp, human
gcccacgcggtgagcaccgc

SEQ ID NO: 284094 - DNA, 20 bp, human
ggtcgcttgctctgaggtcg

SEQ ID NO: 284095 - DNA, 20 bp, human
gacggccgggtgcgttagtc

SEQ ID NO: 284096 - DNA, 20 bp, human
ggagcaggcagggtgaatga

SEQ ID NO: 284097 - DNA, 20 bp, human
gtgcacatggggtgacccgg

SEQ ID NO: 284098 - DNA, 20 bp, human
ggcggccgcctgttccctat

SEQ ID NO: 284099 - DNA, 20 bp, human
ggcccggcgggtttatgggt

SEQ ID NO: 284100 - DNA, 20 bp, human
gaaaactcttgctggatgtg

SEQ ID NO: 284101 - DNA, 20 bp, human
gaaaaagcccggcgggttta

SEQ ID NO: 284102 - DNA, 20 bp, human
gccagcccacctcccgccgg

SEQ ID NO: 284103 - DNA, 20 bp, human
gcaagcctgagtgccaccct

SEQ ID NO: 284104 - DNA, 20 bp, human
gcaagcgtgtaataatccgc

SEQ ID NO: 284105 - DNA, 20 bp, human
gtgtaaaggaaaactcttgc

SEQ ID NO: 284106 - DNA, 20 bp, human
gggcgggtcaatatcaagaa

SEQ ID NO: 284107 - DNA, 20 bp, human
gcaactctcggcttaaactc

SEQ ID NO: 284108 - DNA, 20 bp, human
gcaccgtgacaatgcagctg

SEQ ID NO: 284109 - DNA, 20 bp, human
ggggctagagcactggacaa

SEQ ID NO: 284110 - DNA, 20 bp, human
ggtcttacgtgactgattat

SEQ ID NO: 284111 - DNA, 20 bp, human
gggtgattggtccgcccctg

SEQ ID NO: 284112 - DNA, 20 bp, human
gtctggtatggaaatagggc

SEQ ID NO: 284113 - DNA, 20 bp, human
gcctacgtcatgtgagatct

SEQ ID NO: 284114 - DNA, 20 bp, human
gggacagcataaatttccgc

SEQ ID NO: 284115 - DNA, 20 bp, human
ggattattggtctacctctg

SEQ ID NO: 284116 - DNA, 20 bp, human
ggtgggttgcgcagctgttg

SEQ ID NO: 284117 - DNA, 20 bp, human
gggcgaggtagaccgagcag

SEQ ID NO: 284118 - DNA, 20 bp, human
gagcgcgcctgcgcggtggt

SEQ ID NO: 284119 - DNA, 20 bp, human
ggagggaacgagcaagaagt

SEQ ID NO: 284120 - DNA, 20 bp, human
gcggccccactctcgcgaga

SEQ ID NO: 284121 - DNA, 20 bp, human
gtgcgcagctgttgggggcg

SEQ ID NO: 284122 - DNA, 20 bp, human
gttcccgtctcgcgagagtg

SEQ ID NO: 284123 - DNA, 20 bp, human
gaactggaacagcctctgct

SEQ ID NO: 284124 - DNA, 20 bp, human
gcgggaaagtcggtttcgca

SEQ ID NO: 284125 - DNA, 20 bp, human
gtttgccggtcgaaccacgt

SEQ ID NO: 284126 - DNA, 20 bp, human
gcgggctgggaggccactaa

SEQ ID NO: 284127 - DNA, 20 bp, human
ggccacgtcaatcaaggcga

SEQ ID NO: 284128 - DNA, 20 bp, human
gaaccccaaaggactccttc

SEQ ID NO: 284129 - DNA, 20 bp, human
gtcaatcaaggcgacggagg

SEQ ID NO: 284130 - DNA, 20 bp, human
gagtggcctcccagcccgaa

SEQ ID NO: 284131 - DNA, 20 bp, human
gacgtcaatcaaggcgacgg

SEQ ID NO: 284132 - DNA, 20 bp, human
gccagcccgaagggaggcgc

SEQ ID NO: 284133 - DNA, 20 bp, human
gagcgcgcggcaaatcgggc

SEQ ID NO: 284134 - DNA, 20 bp, human
gcggggaggacgcgagaagg

SEQ ID NO: 284135 - DNA, 20 bp, human
gggcttcagcgatggtgcga

SEQ ID NO: 284136 - DNA, 20 bp, human
gccctcctgcagaacggcgt

SEQ ID NO: 284137 - DNA, 20 bp, human
gaagcgcgcaaggcgtgtgg

SEQ ID NO: 284138 - DNA, 20 bp, human
gggcgggccctcctgcagaa

SEQ ID NO: 284139 - DNA, 20 bp, human
ggccactggtcccgccgcgg

SEQ ID NO: 284140 - DNA, 20 bp, human
ggcggggtcgacggaaagac

SEQ ID NO: 284141 - DNA, 20 bp, human
gggaaggtcgtcattgtgac

SEQ ID NO: 284142 - DNA, 20 bp, human
gggaggcggagattcttggg

SEQ ID NO: 284143 - DNA, 20 bp, human
ggccgcccccacccgatagg

SEQ ID NO: 284144 - DNA, 20 bp, human
ggagaccaatgaaagtggga

SEQ ID NO: 284145 - DNA, 20 bp, human
gcagaaagcgaccacctata

SEQ ID NO: 284146 - DNA, 20 bp, human
gtcgccccgcgggggaatgg

SEQ ID NO: 284147 - DNA, 20 bp, human
gaccgagggtcgccccgcgg

SEQ ID NO: 284148 - DNA, 20 bp, human
gggacacggcaggagaccga

SEQ ID NO: 284149 - DNA, 20 bp, human
gacgcggagcccgaacaccg

SEQ ID NO: 284150 - DNA, 20 bp, human
ggaaaggagcgggaagacct

SEQ ID NO: 284151 - DNA, 20 bp, human
gaaaccaggcgagaaaggag

SEQ ID NO: 284152 - DNA, 20 bp, human
gccttggagccgcggtgttc

SEQ ID NO: 284153 - DNA, 20 bp, human
gtggctgaggcaagtgtttg

SEQ ID NO: 284154 - DNA, 20 bp, human
gcgggaagaccttggagccg

SEQ ID NO: 284155 - DNA, 20 bp, human
gcccccacggggctgaaaaa

SEQ ID NO: 284156 - DNA, 20 bp, human
ggggcgcttcccgcaggctg

SEQ ID NO: 284157 - DNA, 20 bp, human
ggcttcccgcaggctgcggc

SEQ ID NO: 284158 - DNA, 20 bp, human
gcccgggttctgctccctat

SEQ ID NO: 284159 - DNA, 20 bp, human
gtttcccgcccctgccaata

SEQ ID NO: 284160 - DNA, 20 bp, human
ggcccggaggagcgaatcta

SEQ ID NO: 284161 - DNA, 20 bp, human
gcagggagcggagacggagg

SEQ ID NO: 284162 - DNA, 20 bp, human
gaactcgccgcggtcctggg

SEQ ID NO: 284163 - DNA, 20 bp, human
ggttctgctccctattggca

SEQ ID NO: 284164 - DNA, 20 bp, human
ggaatccagccgcagcctgc

SEQ ID NO: 284165 - DNA, 20 bp, human
gaggagcgaatctaaggatg

SEQ ID NO: 284166 - DNA, 20 bp, human
gcgcgccgggaacagccagt

SEQ ID NO: 284167 - DNA, 20 bp, human
ggcgtggcccggggcgagtg

SEQ ID NO: 284168 - DNA, 20 bp, human
gggactcagaggacgcgcgc

SEQ ID NO: 284169 - DNA, 20 bp, human
gcctcctctatcggactcag

SEQ ID NO: 284170 - DNA, 20 bp, human
gtggttgcgtcgggtcacgt

SEQ ID NO: 284171 - DNA, 20 bp, human
gcgtcctctgagtccgatag

SEQ ID NO: 284172 - DNA, 20 bp, human
gcggcgggcgcaggtgttac

SEQ ID NO: 284173 - DNA, 20 bp, human
gactcgcgttaggcaccgac

SEQ ID NO: 284174 - DNA, 20 bp, human
gccaaggaggcagccgggag

SEQ ID NO: 284175 - DNA, 20 bp, human
gggggagatgcctcctctat

SEQ ID NO: 284176 - DNA, 20 bp, human
gctgaggtcactggtgggtg

SEQ ID NO: 284177 - DNA, 20 bp, human
gagcaaaccttgaccctcaa

SEQ ID NO: 284178 - DNA, 20 bp, human
gtctcaagaatcttagtgtg

SEQ ID NO: 284179 - DNA, 20 bp, human
gtatcccaaacgccggaaca

SEQ ID NO: 284180 - DNA, 20 bp, human
gggacacccaggatgttgat

SEQ ID NO: 284181 - DNA, 20 bp, human
gggtgactcaagacatcagg

SEQ ID NO: 284182 - DNA, 20 bp, human
ggggtcaaggtttgctaaat

SEQ ID NO: 284183 - DNA, 20 bp, human
gaggcggctgaaaaccaaca

SEQ ID NO: 284184 - DNA, 20 bp, human
gagaactgtctgatcaaaaa

SEQ ID NO: 284185 - DNA, 20 bp, human
gaccagccaatcaacatcct

SEQ ID NO: 284186 - DNA, 20 bp, human
gcatcggcggcagacgaaga

SEQ ID NO: 284187 - DNA, 20 bp, human
gcaggcaaaacggaccacgc

SEQ ID NO: 284188 - DNA, 20 bp, human
gctgccggctgaaccaatga

SEQ ID NO: 284189 - DNA, 20 bp, human
gccggaggcgccccagccag

SEQ ID NO: 284190 - DNA, 20 bp, human
gcacacaaaggggtctgtgg

SEQ ID NO: 284191 - DNA, 20 bp, human
ggtcgtctgagctgcctgtc

SEQ ID NO: 284192 - DNA, 20 bp, human
gcagacgaccagtagtatcc

SEQ ID NO: 284193 - DNA, 20 bp, human
gaggcacacaaaggggtctg

SEQ ID NO: 284194 - DNA, 20 bp, human
ggagctacggggcaatcgct

SEQ ID NO: 284195 - DNA, 20 bp, human
gagccaatcgatgaagctgc

SEQ ID NO: 284196 - DNA, 20 bp, human
gtctcggcccgggttcggcg

SEQ ID NO: 284197 - DNA, 20 bp, human
gaggtaagtacggtaatggg

SEQ ID NO: 284198 - DNA, 20 bp, human
ggggaggtaagtacggtaat

SEQ ID NO: 284199 - DNA, 20 bp, human
gcgcgcagtgcgcttccaat

SEQ ID NO: 284200 - DNA, 20 bp, human
gccgcccccacgccgaaccc

SEQ ID NO: 284201 - DNA, 20 bp, human
ggctgacgggagcactgcgc

SEQ ID NO: 284202 - DNA, 20 bp, human
gcgcgctctcggcccgggtt

SEQ ID NO: 284203 - DNA, 20 bp, human
ggacgggagcactgcgcagg

SEQ ID NO: 284204 - DNA, 20 bp, human
ggccccgccccctgcgctga

SEQ ID NO: 284205 - DNA, 20 bp, human
gggcgccgcgcacgtaatat

SEQ ID NO: 284206 - DNA, 20 bp, human
ggccccacgcactgaccaat

SEQ ID NO: 284207 - DNA, 20 bp, human
gagaaggcctaggagctact

SEQ ID NO: 284208 - DNA, 20 bp, human
gccggcctcggcttcgacgt

SEQ ID NO: 284209 - DNA, 20 bp, human
gggtcagtgcgtggggcaac

SEQ ID NO: 284210 - DNA, 20 bp, human
gtgcgtggggcaacgggcgc

SEQ ID NO: 284211 - DNA, 20 bp, human
gtcggacgaggcacgagtga

SEQ ID NO: 284212 - DNA, 20 bp, human
ggacgaggcacgagtgaggg

SEQ ID NO: 284213 - DNA, 20 bp, human
ggccaattggtcagtgcgtg

SEQ ID NO: 284214 - DNA, 20 bp, human
gacccgctcggactcctcaa

SEQ ID NO: 284215 - DNA, 20 bp, human
gcaaaacaacggccacgaga

SEQ ID NO: 284216 - DNA, 20 bp, human
gcccgcggctggggaaccaa

SEQ ID NO: 284217 - DNA, 20 bp, human
gccgcagtggagtccaagac

SEQ ID NO: 284218 - DNA, 20 bp, human
ggtggagtccaagacgggca

SEQ ID NO: 284219 - DNA, 20 bp, human
ggctggaagtactgaaagac

SEQ ID NO: 284220 - DNA, 20 bp, human
ggcatggcatcggggagctc

SEQ ID NO: 284221 - DNA, 20 bp, human
gctccctgctgcgttgtttt

SEQ ID NO: 284222 - DNA, 20 bp, human
gggcatcggggagctccggg

SEQ ID NO: 284223 - DNA, 20 bp, human
gcacacgcttccgtgctacg

SEQ ID NO: 284224 - DNA, 20 bp, human
gggaagtcagacggaagtaa

SEQ ID NO: 284225 - DNA, 20 bp, human
gggctccgtgagccgaaagg

SEQ ID NO: 284226 - DNA, 20 bp, human
gtggccctggagatgtgaga

SEQ ID NO: 284227 - DNA, 20 bp, human
ggggatggacagcctgtcac

SEQ ID NO: 284228 - DNA, 20 bp, human
ggccaggcttggcccctgca

SEQ ID NO: 284229 - DNA, 20 bp, human
gggctgtgagtggctagcac

SEQ ID NO: 284230 - DNA, 20 bp, human
gaccaagtcaatccatgcag

SEQ ID NO: 284231 - DNA, 20 bp, human
ggcaagaagctgcctgtgac

SEQ ID NO: 284232 - DNA, 20 bp, human
ggaaaagttgagtggcaggg

SEQ ID NO: 284233 - DNA, 20 bp, human
gtgagcaggtcctgccctgt

SEQ ID NO: 284234 - DNA, 20 bp, human
gaggggctgggtagctggct

SEQ ID NO: 284235 - DNA, 20 bp, human
gccacagtaaagaagctgca

SEQ ID NO: 284236 - DNA, 20 bp, human
gaggagctcgaacaaggaag

SEQ ID NO: 284237 - DNA, 20 bp, human
gcggaagtactgctaaatta

SEQ ID NO: 284238 - DNA, 20 bp, human
gtcacgtcaccgaggtgcgg

SEQ ID NO: 284239 - DNA, 20 bp, human
gagtactgctaaattaggga

SEQ ID NO: 284240 - DNA, 20 bp, human
gagccagccgccagcctcta

SEQ ID NO: 284241 - DNA, 20 bp, human
gagctcacgtcaccgaggtg

SEQ ID NO: 284242 - DNA, 20 bp, human
gcccgagaggagctcgaaca

SEQ ID NO: 284243 - DNA, 20 bp, human
gagctcgaacaaggaagcgg

SEQ ID NO: 284244 - DNA, 20 bp, human
gtgctctcacttctccttaa

SEQ ID NO: 284245 - DNA, 20 bp, human
gacagcgcgagcacctggtg

SEQ ID NO: 284246 - DNA, 20 bp, human
ggagaaaagcggcgactgcg

SEQ ID NO: 284247 - DNA, 20 bp, human
gacacctggcggggacttta

SEQ ID NO: 284248 - DNA, 20 bp, human
gcagtcgccgcttttctccc

SEQ ID NO: 284249 - DNA, 20 bp, human
gtacgtaaggagccgggcgg

SEQ ID NO: 284250 - DNA, 20 bp, human
gtagccctaaagtccccgcc

SEQ ID NO: 284251 - DNA, 20 bp, human
gaccgaggactgggtggccc

SEQ ID NO: 284252 - DNA, 20 bp, human
ggccacccagtcctcggtgc

SEQ ID NO: 284253 - DNA, 20 bp, human
ggggctgggcggccgcgctg

SEQ ID NO: 284254 - DNA, 20 bp, human
gtcccgggccacccagtcct

SEQ ID NO: 284255 - DNA, 20 bp, human
gcaacgcggggccggcaccg

SEQ ID NO: 284256 - DNA, 20 bp, human
gggaagggacggaggattga

SEQ ID NO: 284257 - DNA, 20 bp, human
gggacggaggattgagggag

SEQ ID NO: 284258 - DNA, 20 bp, human
gcagacggagagggacatct

SEQ ID NO: 284259 - DNA, 20 bp, human
gccctgccggctttttgcac

SEQ ID NO: 284260 - DNA, 20 bp, human
gggctttttgcactgggaga

SEQ ID NO: 284261 - DNA, 20 bp, human
ggggagacaggcggagagat

SEQ ID NO: 284262 - DNA, 20 bp, human
ggccgcctccggtcccatcg

SEQ ID NO: 284263 - DNA, 20 bp, human
gttgcactgggagagggtat

SEQ ID NO: 284264 - DNA, 20 bp, human
ggcggcggccgcgtcgggac

SEQ ID NO: 284265 - DNA, 20 bp, human
ggggacctgacctccctcac

SEQ ID NO: 284266 - DNA, 20 bp, human
ggccgataggtcgacggtag

SEQ ID NO: 284267 - DNA, 20 bp, human
gggcacgggcgaagcgcact

SEQ ID NO: 284268 - DNA, 20 bp, human
gctcggctgaagtcaggtat

SEQ ID NO: 284269 - DNA, 20 bp, human
gcactgcagcttggccccag

SEQ ID NO: 284270 - DNA, 20 bp, human
gtccggcgccgataggtcga

SEQ ID NO: 284271 - DNA, 20 bp, human
gagcgcactgggctggccat

SEQ ID NO: 284272 - DNA, 20 bp, human
gggctggccattggctgcgt

SEQ ID NO: 284273 - DNA, 20 bp, human
gctattggatgcgtggggca

SEQ ID NO: 284274 - DNA, 20 bp, human
gtggaggcggggcggatggg

SEQ ID NO: 284275 - DNA, 20 bp, human
gccattggctgcgtgggtct

SEQ ID NO: 284276 - DNA, 20 bp, human
gagacggtaggtacccgggg

SEQ ID NO: 284277 - DNA, 20 bp, human
gagtgggcaggacgggtggg

SEQ ID NO: 284278 - DNA, 20 bp, human
ggcggcggggcgaggtgtgc

SEQ ID NO: 284279 - DNA, 20 bp, human
ggggagtgggcaggacgggt

SEQ ID NO: 284280 - DNA, 20 bp, human
ggccaggtcactcagggcgg

SEQ ID NO: 284281 - DNA, 20 bp, human
gaaccgggataggttgcgca

SEQ ID NO: 284282 - DNA, 20 bp, human
ggggcgggaagaaccgggat

SEQ ID NO: 284283 - DNA, 20 bp, human
gcaccagtcacagagacggt

SEQ ID NO: 284284 - DNA, 20 bp, human
ggcggccaggtcactcaggg

SEQ ID NO: 284285 - DNA, 20 bp, human
gcacagagacggtaggtacc

SEQ ID NO: 284286 - DNA, 20 bp, human
gacggtgcccggatccaaga

SEQ ID NO: 284287 - DNA, 20 bp, human
gggcgcccgccctgccgcta

SEQ ID NO: 284288 - DNA, 20 bp, human
ggtgcccggatccaagatgg

SEQ ID NO: 284289 - DNA, 20 bp, human
gggaggcaagagcgggcgta

SEQ ID NO: 284290 - DNA, 20 bp, human
ggcccagccttgtgcatccg

SEQ ID NO: 284291 - DNA, 20 bp, human
gttggatccgggcaccgttc

SEQ ID NO: 284292 - DNA, 20 bp, human
gcgggcgcccgaacggtgcc

SEQ ID NO: 284293 - DNA, 20 bp, human
ggccccgccatcttggatcc

SEQ ID NO: 284294 - DNA, 20 bp, human
gctgccgctaggggtcagcc

SEQ ID NO: 284295 - DNA, 20 bp, human
ggaccaccctcggatgcaca

SEQ ID NO: 284296 - DNA, 20 bp, human
gggattcgaacagctgggat

SEQ ID NO: 284297 - DNA, 20 bp, human
gagctctaagctgggatagt

SEQ ID NO: 284298 - DNA, 20 bp, human
gtctaagctgggatagtggg

SEQ ID NO: 284299 - DNA, 20 bp, human
gagagtggattcgaacagct

SEQ ID NO: 284300 - DNA, 20 bp, human
gggatgggactgctggaaag

SEQ ID NO: 284301 - DNA, 20 bp, human
gaggatgggacagtttttcg

SEQ ID NO: 284302 - DNA, 20 bp, human
gagtggacggagctctaagc

SEQ ID NO: 284303 - DNA, 20 bp, human
gaccgcgcccggtcgttttt

SEQ ID NO: 284304 - DNA, 20 bp, human
gaaaaacccgaaaaacgacc

SEQ ID NO: 284305 - DNA, 20 bp, human
gcccgaaaaacgaccgggcg

SEQ ID NO: 284306 - DNA, 20 bp, human
gggggcgcgagcgtgcgcag

SEQ ID NO: 284307 - DNA, 20 bp, human
gagcgtgcgcagtggctcct

SEQ ID NO: 284308 - DNA, 20 bp, human
gtcgacacgcagcgaactgg

SEQ ID NO: 284309 - DNA, 20 bp, human
ggcgctggggaggagcggtg

SEQ ID NO: 284310 - DNA, 20 bp, human
gcccgtcgccgcagcctcca

SEQ ID NO: 284311 - DNA, 20 bp, human
gcagccgcggggcgattctg

SEQ ID NO: 284312 - DNA, 20 bp, human
gacacgcagcgaactggtgg

SEQ ID NO: 284313 - DNA, 20 bp, human
gcactgccgagcttccgcga

SEQ ID NO: 284314 - DNA, 20 bp, human
gcgagggcgcgaccggacgg

SEQ ID NO: 284315 - DNA, 20 bp, human
gtagaaaggggacgtctagt

SEQ ID NO: 284316 - DNA, 20 bp, human
gatgtggctgagagaagacg

SEQ ID NO: 284317 - DNA, 20 bp, human
gccagcccagctatttaagc

SEQ ID NO: 284318 - DNA, 20 bp, human
gaccaggagagacgtaacct

SEQ ID NO: 284319 - DNA, 20 bp, human
gcaagcttcttcaccaagat

SEQ ID NO: 284320 - DNA, 20 bp, human
gctcgctcaaagtaaggaag

SEQ ID NO: 284321 - DNA, 20 bp, human
gaagtggatgagaagactca

SEQ ID NO: 284322 - DNA, 20 bp, human
gttattcaggtttgatgttc

SEQ ID NO: 284323 - DNA, 20 bp, human
gtgctcgagtgtgtgctcat

SEQ ID NO: 284324 - DNA, 20 bp, human
gaaccactgaaagtatgccg

SEQ ID NO: 284325 - DNA, 20 bp, human
gaacctgcagcgtgggcagg

SEQ ID NO: 284326 - DNA, 20 bp, human
gcgcaacagcgctcagtcca

SEQ ID NO: 284327 - DNA, 20 bp, human
gttcctgcaaggggtcccgg

SEQ ID NO: 284328 - DNA, 20 bp, human
gccacggccgcgcaagtccc

SEQ ID NO: 284329 - DNA, 20 bp, human
gcagggagggaggcccgggt

SEQ ID NO: 284330 - DNA, 20 bp, human
gtagagccggaggtcggtga

SEQ ID NO: 284331 - DNA, 20 bp, human
ggcgggaggcgcaggacgct

SEQ ID NO: 284332 - DNA, 20 bp, human
gaacagcgctcagtccaggg

SEQ ID NO: 284333 - DNA, 20 bp, human
gcggccgtggcaccgctgga

SEQ ID NO: 284334 - DNA, 20 bp, human
gcagcgaaggaaggcggtcg

SEQ ID NO: 284335 - DNA, 20 bp, human
gcggccttctgtctccgcag

SEQ ID NO: 284336 - DNA, 20 bp, human
gagcctcagcgccacgtctc

SEQ ID NO: 284337 - DNA, 20 bp, human
ggcgctgcgcttggcgggaa

SEQ ID NO: 284338 - DNA, 20 bp, human
gacccgctggggcgcgacag

SEQ ID NO: 284339 - DNA, 20 bp, human
gtaaccttcccccttctgtc

SEQ ID NO: 284340 - DNA, 20 bp, human
gcccagcgggtgaccgttga

SEQ ID NO: 284341 - DNA, 20 bp, human
gtgcctgagacgtggcgctg

SEQ ID NO: 284342 - DNA, 20 bp, human
ggcgcagcgcaaggcgcact

SEQ ID NO: 284343 - DNA, 20 bp, human
gttttccactgcctgagacg

SEQ ID NO: 284344 - DNA, 20 bp, human
ggccttgcgctgcgcttggc

SEQ ID NO: 284345 - DNA, 20 bp, human
gtccttcaacggtcacccgc

SEQ ID NO: 284346 - DNA, 20 bp, human
ggctggcggcccctgaccga

SEQ ID NO: 284347 - DNA, 20 bp, human
ggcaaagcaggggcgaacgg

SEQ ID NO: 284348 - DNA, 20 bp, human
gccaccgcgccgcacttctc

SEQ ID NO: 284349 - DNA, 20 bp, human
gacaacgacagcctgctccg

SEQ ID NO: 284350 - DNA, 20 bp, human
gccctgaccgaaggtcgcgt

SEQ ID NO: 284351 - DNA, 20 bp, human
gtgcctgccccgccgaggtt

SEQ ID NO: 284352 - DNA, 20 bp, human
gctagcgaggccggtcgccc

SEQ ID NO: 284353 - DNA, 20 bp, human
gcgcccaggctagccgtgga

SEQ ID NO: 284354 - DNA, 20 bp, human
gcggtcgcccaggctagccg

SEQ ID NO: 284355 - DNA, 20 bp, human
gcgggtcagtgtgcagcccg

SEQ ID NO: 284356 - DNA, 20 bp, human
gcgactgcgcgtcacctaga

SEQ ID NO: 284357 - DNA, 20 bp, human
ggctgctgcggcgactgcaa

SEQ ID NO: 284358 - DNA, 20 bp, human
gccccaggcagcctaggcgg

SEQ ID NO: 284359 - DNA, 20 bp, human
gctgcgcgtcacctagacgg

SEQ ID NO: 284360 - DNA, 20 bp, human
gcccccccaggcagcctagg

SEQ ID NO: 284361 - DNA, 20 bp, human
ggcgactgcaaaggccgatt

SEQ ID NO: 284362 - DNA, 20 bp, human
gacgtgacggtgtcagccaa

SEQ ID NO: 284363 - DNA, 20 bp, human
ggacgcgcagtcgccccccc

SEQ ID NO: 284364 - DNA, 20 bp, human
gccccggcgctccgccgtct

SEQ ID NO: 284365 - DNA, 20 bp, human
gcacctagacggcggagcgc

SEQ ID NO: 284366 - DNA, 20 bp, human
gccccccaccagccacgttg

SEQ ID NO: 284367 - DNA, 20 bp, human
ggcgcggggccgctctccga

SEQ ID NO: 284368 - DNA, 20 bp, human
gctgccccaacgtggctggt

SEQ ID NO: 284369 - DNA, 20 bp, human
ggggcccaagggcccttcta

SEQ ID NO: 284370 - DNA, 20 bp, human
ggagacgcaccccgacacct

SEQ ID NO: 284371 - DNA, 20 bp, human
gggaaactctggctcgggat

SEQ ID NO: 284372 - DNA, 20 bp, human
gatggggctcacgtccgggt

SEQ ID NO: 284373 - DNA, 20 bp, human
gtgagggcgccctcggagag

SEQ ID NO: 284374 - DNA, 20 bp, human
gtctaagggaccccggtatg

SEQ ID NO: 284375 - DNA, 20 bp, human
gcggggcgagcccaatggcc

SEQ ID NO: 284376 - DNA, 20 bp, human
ggagcacaagcatgctgcat

SEQ ID NO: 284377 - DNA, 20 bp, human
gctgaggtggctacaaagaa

SEQ ID NO: 284378 - DNA, 20 bp, human
gggagggggactgcgaagaa

SEQ ID NO: 284379 - DNA, 20 bp, human
gcacctccctgctaaggatg

SEQ ID NO: 284380 - DNA, 20 bp, human
ggtaactcatgttggctggg

SEQ ID NO: 284381 - DNA, 20 bp, human
gggctacaaagaaaggaagc

SEQ ID NO: 284382 - DNA, 20 bp, human
ggctgtgtggcctgtggtct

SEQ ID NO: 284383 - DNA, 20 bp, human
ggaagcaacagatcgtcact

SEQ ID NO: 284384 - DNA, 20 bp, human
ggacaagctgctagctagtc

SEQ ID NO: 284385 - DNA, 20 bp, human
gttctcgagtgtgcagaggg

SEQ ID NO: 284386 - DNA, 20 bp, human
gggcccagacccgcgcaacc

SEQ ID NO: 284387 - DNA, 20 bp, human
gcgcgggtctgggccccact

SEQ ID NO: 284388 - DNA, 20 bp, human
gcggccgcgcaccattcacc

SEQ ID NO: 284389 - DNA, 20 bp, human
gacggcgtatgcaaagcggg

SEQ ID NO: 284390 - DNA, 20 bp, human
ggcggaggaacgtgcgggtg

SEQ ID NO: 284391 - DNA, 20 bp, human
ggcccacggcgtatgcaaag

SEQ ID NO: 284392 - DNA, 20 bp, human
gggagaggcggaggaacgtg

SEQ ID NO: 284393 - DNA, 20 bp, human
gcatacgccgtgggcggagc

SEQ ID NO: 284394 - DNA, 20 bp, human
gcgccccgcggggtcgcgcc

SEQ ID NO: 284395 - DNA, 20 bp, human
gcccgcgcaaccaggcgggg

SEQ ID NO: 284396 - DNA, 20 bp, human
ggggatgtcccggagtacgt

SEQ ID NO: 284397 - DNA, 20 bp, human
gtcgggaaggaacgcctcat

SEQ ID NO: 284398 - DNA, 20 bp, human
gccctcgcccccacgtactc

SEQ ID NO: 284399 - DNA, 20 bp, human
gggaaggaacgcctcattgg

SEQ ID NO: 284400 - DNA, 20 bp, human
gcatatatgttggtgtgggt

SEQ ID NO: 284401 - DNA, 20 bp, human
gaccggcgggaccgacagca

SEQ ID NO: 284402 - DNA, 20 bp, human
gtgatccaaaaaagtcggga

SEQ ID NO: 284403 - DNA, 20 bp, human
ggcctcgctggcccccaatg

SEQ ID NO: 284404 - DNA, 20 bp, human
gacaatgcgcggagtgtgcg

SEQ ID NO: 284405 - DNA, 20 bp, human
gaatacatatatgttggtgt

SEQ ID NO: 284406 - DNA, 20 bp, human
gtcctctcagtgatggggaa

SEQ ID NO: 284407 - DNA, 20 bp, human
gcaagtcggggcggcctcgg

SEQ ID NO: 284408 - DNA, 20 bp, human
gaccgacagcggccaatgga

SEQ ID NO: 284409 - DNA, 20 bp, human
ggggctgggcccgcttctta

SEQ ID NO: 284410 - DNA, 20 bp, human
gggcggcctcggtggtaaga

SEQ ID NO: 284411 - DNA, 20 bp, human
ggcgaggggtgaaggtccag

SEQ ID NO: 284412 - DNA, 20 bp, human
gaccctggggccccctcgcc

SEQ ID NO: 284413 - DNA, 20 bp, human
gctcggtggtaagatggcgc

SEQ ID NO: 284414 - DNA, 20 bp, human
ggctgcctcctctcagtgat

SEQ ID NO: 284415 - DNA, 20 bp, human
ggcagctggatgcggggaag

SEQ ID NO: 284416 - DNA, 20 bp, human
ggggctagtggcaccgactt

SEQ ID NO: 284417 - DNA, 20 bp, human
ggaagcgcgggctggtgtgg

SEQ ID NO: 284418 - DNA, 20 bp, human
gggagcagcgtctggtccgg

SEQ ID NO: 284419 - DNA, 20 bp, human
gataagcgctagtgcggcgc

SEQ ID NO: 284420 - DNA, 20 bp, human
gcggctgctgccctcgggaa

SEQ ID NO: 284421 - DNA, 20 bp, human
gccggagataagcgctagtg

SEQ ID NO: 284422 - DNA, 20 bp, human
gcgggctctgcctgggctag

SEQ ID NO: 284423 - DNA, 20 bp, human
gcgccccctgcccttcccga

SEQ ID NO: 284424 - DNA, 20 bp, human
gaggggagaccaaggcggct

SEQ ID NO: 284425 - DNA, 20 bp, human
gggagctcggcggtggcggg

SEQ ID NO: 284426 - DNA, 20 bp, human
gagtgggcacttgacagcgg

SEQ ID NO: 284427 - DNA, 20 bp, human
gggtggcggcgtctgcggga

SEQ ID NO: 284428 - DNA, 20 bp, human
gggtgggggcgctgcacgtg

SEQ ID NO: 284429 - DNA, 20 bp, human
ggtgcagcgcccccaccaat

SEQ ID NO: 284430 - DNA, 20 bp, human
ggcggtgcgcccattggtgg

SEQ ID NO: 284431 - DNA, 20 bp, human
gggcgctgcacgtggggcac

SEQ ID NO: 284432 - DNA, 20 bp, human
gtcaggctgtaggtcctctc

SEQ ID NO: 284433 - DNA, 20 bp, human
ggaaacgcgcgggtgcgtga

SEQ ID NO: 284434 - DNA, 20 bp, human
gtaggcctcgggctgtctgg

SEQ ID NO: 284435 - DNA, 20 bp, human
gggagcggctcgaactttgg

SEQ ID NO: 284436 - DNA, 20 bp, human
gcactaataggggagttggg

SEQ ID NO: 284437 - DNA, 20 bp, human
ggaacggcggcaactggcgg

SEQ ID NO: 284438 - DNA, 20 bp, human
gctcgagtccggctgaacgg

SEQ ID NO: 284439 - DNA, 20 bp, human
gtaaactcgtgcactaatag

SEQ ID NO: 284440 - DNA, 20 bp, human
gcgtgcactaataggggagt

SEQ ID NO: 284441 - DNA, 20 bp, human
gagcgggtggcgctcgagtc

SEQ ID NO: 284442 - DNA, 20 bp, human
gaagggccggggtcgaattg

SEQ ID NO: 284443 - DNA, 20 bp, human
ggctgaacggcggcaactgg

SEQ ID NO: 284444 - DNA, 20 bp, human
gtcgcccagcttccgaccgg

SEQ ID NO: 284445 - DNA, 20 bp, human
gggcgaggatgcagaggatt

SEQ ID NO: 284446 - DNA, 20 bp, human
ggcagccgcagtcaggaagg

SEQ ID NO: 284447 - DNA, 20 bp, human
ggcgctcggggcggataaag

SEQ ID NO: 284448 - DNA, 20 bp, human
ggggacgcaaggggacctgg

SEQ ID NO: 284449 - DNA, 20 bp, human
gcgtgctctgcgtgcgctcg

SEQ ID NO: 284450 - DNA, 20 bp, human
gctggcgccggtcccggcga

SEQ ID NO: 284451 - DNA, 20 bp, human
gttcccggccatataggctc

SEQ ID NO: 284452 - DNA, 20 bp, human
gcacggtcgcaataaataat

SEQ ID NO: 284453 - DNA, 20 bp, human
gtccgccgccttcctgactg

SEQ ID NO: 284454 - DNA, 20 bp, human
gtggcagggtcccgcagcta

SEQ ID NO: 284455 - DNA, 20 bp, human
gccggtcccggcgacggcca

SEQ ID NO: 284456 - DNA, 20 bp, human
gcggagcgagaccacctgtg

SEQ ID NO: 284457 - DNA, 20 bp, human
gcgggcgcgggcggattctt

SEQ ID NO: 284458 - DNA, 20 bp, human
gcccgcggaaaaagacctgg

SEQ ID NO: 284459 - DNA, 20 bp, human
gtggcggccaacctccgcac

SEQ ID NO: 284460 - DNA, 20 bp, human
ggctcactagcaggagtcgg

SEQ ID NO: 284461 - DNA, 20 bp, human
ggcggggcaggctgttgcgg

SEQ ID NO: 284462 - DNA, 20 bp, human
ggcctccaggtctttttccg

SEQ ID NO: 284463 - DNA, 20 bp, human
gaccgcggggcaggctgttg

SEQ ID NO: 284464 - DNA, 20 bp, human
gcactagcaggagtcggcgg

SEQ ID NO: 284465 - DNA, 20 bp, human
gcgcagccgcctagaatgga

SEQ ID NO: 284466 - DNA, 20 bp, human
ggggacccgcgccttcttga

SEQ ID NO: 284467 - DNA, 20 bp, human
gcgggcgccggcaacttatt

SEQ ID NO: 284468 - DNA, 20 bp, human
ggatcgtgccgctctacgat

SEQ ID NO: 284469 - DNA, 20 bp, human
gtgtgtatggggggggagac

SEQ ID NO: 284470 - DNA, 20 bp, human
gcgggtcccgcgtgcgagtg

SEQ ID NO: 284471 - DNA, 20 bp, human
gcgcttaagaagtgtgtgta

SEQ ID NO: 284472 - DNA, 20 bp, human
gaacaaaccccatcgtagag

SEQ ID NO: 284473 - DNA, 20 bp, human
ggtgacgcgcacggccaatg

SEQ ID NO: 284474 - DNA, 20 bp, human
ggacgggcacgtgacgcgca

SEQ ID NO: 284475 - DNA, 20 bp, human
gaacaacttggtggcaccgg

SEQ ID NO: 284476 - DNA, 20 bp, human
gctctcagatggatgggctg

SEQ ID NO: 284477 - DNA, 20 bp, human
ggggtgatggatgggcgctg

SEQ ID NO: 284478 - DNA, 20 bp, human
gggcacatgtgatctctccc

SEQ ID NO: 284479 - DNA, 20 bp, human
gtgatctctcccaggccaat

SEQ ID NO: 284480 - DNA, 20 bp, human
gcaagcgcttccctaggaag

SEQ ID NO: 284481 - DNA, 20 bp, human
gaacccccaaggccttcaat

SEQ ID NO: 284482 - DNA, 20 bp, human
ggggtgaggtatgttatctt

SEQ ID NO: 284483 - DNA, 20 bp, human
gcatccatctgagagcgaca

SEQ ID NO: 284484 - DNA, 20 bp, human
gactccctacccccttccta

SEQ ID NO: 284485 - DNA, 20 bp, human
gcgctggggctgccaaactc

SEQ ID NO: 284486 - DNA, 20 bp, human
gcccgggcacgcgcgctgat

SEQ ID NO: 284487 - DNA, 20 bp, human
gcaaactggaaagcagcgaa

SEQ ID NO: 284488 - DNA, 20 bp, human
gggagacagaaagctaggga

SEQ ID NO: 284489 - DNA, 20 bp, human
gcgctgattggctgcggcct

SEQ ID NO: 284490 - DNA, 20 bp, human
gcgcaggagacagaaagcta

SEQ ID NO: 284491 - DNA, 20 bp, human
gtaaatgagactctgcaaac

SEQ ID NO: 284492 - DNA, 20 bp, human
ggtcttgacgcaagagacgc

SEQ ID NO: 284493 - DNA, 20 bp, human
ggccaatcagcgcgcgtgcc

SEQ ID NO: 284494 - DNA, 20 bp, human
gataaagtgtccatctcctg

SEQ ID NO: 284495 - DNA, 20 bp, human
gttattagcttctctccccc

SEQ ID NO: 284496 - DNA, 20 bp, human
ggtctccaagacagcgggga

SEQ ID NO: 284497 - DNA, 20 bp, human
gggggggggcgtcaggaggg

SEQ ID NO: 284498 - DNA, 20 bp, human
gtcaggagggaggatcggaa

SEQ ID NO: 284499 - DNA, 20 bp, human
gggcagagcaggcccatctt

SEQ ID NO: 284500 - DNA, 20 bp, human
gtggggaaggtttgctcgaa

SEQ ID NO: 284501 - DNA, 20 bp, human
gccaaaagcgagccgaagat

SEQ ID NO: 284502 - DNA, 20 bp, human
gacttccttccccgctgtct

SEQ ID NO: 284503 - DNA, 20 bp, human
gtgaatttgagagggagatt

SEQ ID NO: 284504 - DNA, 20 bp, human
gccagacgagcgattggcgg

SEQ ID NO: 284505 - DNA, 20 bp, human
gggaaggtttgctcgaaagg

SEQ ID NO: 284506 - DNA, 20 bp, human
gaggaagccgagggtcgtgg

SEQ ID NO: 284507 - DNA, 20 bp, human
ggtagagcctccacgaccct

SEQ ID NO: 284508 - DNA, 20 bp, human
gggctcgagaaagtcacgtg

SEQ ID NO: 284509 - DNA, 20 bp, human
ggacaaagtcaaggggtgaa

SEQ ID NO: 284510 - DNA, 20 bp, human
gataagggtagggaaggctg

SEQ ID NO: 284511 - DNA, 20 bp, human
gcaagctggaagggattgac

SEQ ID NO: 284512 - DNA, 20 bp, human
gaaagggagacaaagtcaag

SEQ ID NO: 284513 - DNA, 20 bp, human
gccttccctacccttatcaa

SEQ ID NO: 284514 - DNA, 20 bp, human
gtggaggctgacttggatgg

SEQ ID NO: 284515 - DNA, 20 bp, human
gtgagcacaagagtcaagtc

SEQ ID NO: 284516 - DNA, 20 bp, human
ggtaaatcctggtgttgggt

SEQ ID NO: 284517 - DNA, 20 bp, human
gcgcgcaggttgcgactgga

SEQ ID NO: 284518 - DNA, 20 bp, human
gccaacaccaggatttacat

SEQ ID NO: 284519 - DNA, 20 bp, human
gagcgcgcgcaggttgcgac

SEQ ID NO: 284520 - DNA, 20 bp, human
gaaggggaaataaacctctt

SEQ ID NO: 284521 - DNA, 20 bp, human
gaacctctttggctggagtg

SEQ ID NO: 284522 - DNA, 20 bp, human
gtgagcagatttccttatcc

SEQ ID NO: 284523 - DNA, 20 bp, human
gcagaacaggagggctacac

SEQ ID NO: 284524 - DNA, 20 bp, human
gtctgatcccggagagagcg

SEQ ID NO: 284525 - DNA, 20 bp, human
gccgccccgcctgcgattcc

SEQ ID NO: 284526 - DNA, 20 bp, human
ggacgatccgagaatcgtta

SEQ ID NO: 284527 - DNA, 20 bp, human
gcaatgcgagcctccgagag

SEQ ID NO: 284528 - DNA, 20 bp, human
gtcggaggctcgcattgaat

SEQ ID NO: 284529 - DNA, 20 bp, human
gccacctcccggcgaccgac

SEQ ID NO: 284530 - DNA, 20 bp, human
gccgcgctcccgtcggtcgc

SEQ ID NO: 284531 - DNA, 20 bp, human
gaatcggccctaacgattct

SEQ ID NO: 284532 - DNA, 20 bp, human
gcgtgagaccgccatggcgg

SEQ ID NO: 284533 - DNA, 20 bp, human
gtgcgagcctccgagagagg

SEQ ID NO: 284534 - DNA, 20 bp, human
gtatgcggccaaatatgggg

SEQ ID NO: 284535 - DNA, 20 bp, human
gagaggtaattcatgctcta

SEQ ID NO: 284536 - DNA, 20 bp, human
gaagatggcgactgagaaaa

SEQ ID NO: 284537 - DNA, 20 bp, human
gagtggttgaatccagcgat

SEQ ID NO: 284538 - DNA, 20 bp, human
gccggcgccggtcatgtggc

SEQ ID NO: 284539 - DNA, 20 bp, human
gaatgagggggccagttcag

SEQ ID NO: 284540 - DNA, 20 bp, human
gcagagctcctgtggagagt

SEQ ID NO: 284541 - DNA, 20 bp, human
ggggaaaccccaatctgaga

SEQ ID NO: 284542 - DNA, 20 bp, human
ggctcctgtggagagtgggg

SEQ ID NO: 284543 - DNA, 20 bp, human
ggatcgcccggccacatgac

SEQ ID NO: 284544 - DNA, 20 bp, human
gtaacggtacagctgggaag

SEQ ID NO: 284545 - DNA, 20 bp, human
gctcaccccttctcagattg

SEQ ID NO: 284546 - DNA, 20 bp, human
gaggagcgcagcccgcacga

SEQ ID NO: 284547 - DNA, 20 bp, human
gcgtcctgttccacctacgt

SEQ ID NO: 284548 - DNA, 20 bp, human
gaggacgcgttgtgttgttg

SEQ ID NO: 284549 - DNA, 20 bp, human
gtgtgcgcgggtccctcgtg

SEQ ID NO: 284550 - DNA, 20 bp, human
gtacgtaggatctgtgaaac

SEQ ID NO: 284551 - DNA, 20 bp, human
gttgtcaaatagcacccagg

SEQ ID NO: 284552 - DNA, 20 bp, human
gtaatcacccgggagtgggg

SEQ ID NO: 284553 - DNA, 20 bp, human
gtccaatcctgcgtggggtg

SEQ ID NO: 284554 - DNA, 20 bp, human
gggatggcgaggtgccagtg

SEQ ID NO: 284555 - DNA, 20 bp, human
gctgatccaacactgaccaa

SEQ ID NO: 284556 - DNA, 20 bp, human
gtgggcggggtcacgtggtc

SEQ ID NO: 284557 - DNA, 20 bp, human
gtggccgggccgtctcccca

SEQ ID NO: 284558 - DNA, 20 bp, human
gggcggaggggacgtcacgt

SEQ ID NO: 284559 - DNA, 20 bp, human
gacggcccggccattggcgg

SEQ ID NO: 284560 - DNA, 20 bp, human
gaaagccgagccctgtggat

SEQ ID NO: 284561 - DNA, 20 bp, human
ggggccgctgccgactcccg

SEQ ID NO: 284562 - DNA, 20 bp, human
ggagacggcccggccattgg

SEQ ID NO: 284563 - DNA, 20 bp, human
gcccacggctcccggtaatg

SEQ ID NO: 284564 - DNA, 20 bp, human
gcccccagccccaatccaca

SEQ ID NO: 284565 - DNA, 20 bp, human
gagcccgcgggagtcggcag

SEQ ID NO: 284566 - DNA, 20 bp, human
gcgcccccgcacggggtaga

SEQ ID NO: 284567 - DNA, 20 bp, human
ggggcagggacggagaaggt

SEQ ID NO: 284568 - DNA, 20 bp, human
gggaccttctaccccgtgcg

SEQ ID NO: 284569 - DNA, 20 bp, human
gtgggagaccattataataa

SEQ ID NO: 284570 - DNA, 20 bp, human
gggcgcaagaaggccgcggt

SEQ ID NO: 284571 - DNA, 20 bp, human
ggaatctaagggagccagaa

SEQ ID NO: 284572 - DNA, 20 bp, human
gtagacacaagtgaatctaa

SEQ ID NO: 284573 - DNA, 20 bp, human
gaactctggtgctggttacc

SEQ ID NO: 284574 - DNA, 20 bp, human
gtcccctgcccttattataa

SEQ ID NO: 284575 - DNA, 20 bp, human
gcctcctcctccgccgaccg

SEQ ID NO: 284576 - DNA, 20 bp, human
gcggacagaacgcagagcga

SEQ ID NO: 284577 - DNA, 20 bp, human
gctagagcgagagagcgcca

SEQ ID NO: 284578 - DNA, 20 bp, human
ggctctgcgttctgtccggg

SEQ ID NO: 284579 - DNA, 20 bp, human
gaagaagccaataggatgcg

SEQ ID NO: 284580 - DNA, 20 bp, human
gcccccacatcagtctttgg

SEQ ID NO: 284581 - DNA, 20 bp, human
gtaggatgcggggtctctaa

SEQ ID NO: 284582 - DNA, 20 bp, human
gactcccccacatcagtctt

SEQ ID NO: 284583 - DNA, 20 bp, human
gggcttcttcgtactcctcc

SEQ ID NO: 284584 - DNA, 20 bp, human
gcacccccaaagactgatgt

SEQ ID NO: 284585 - DNA, 20 bp, human
gagagatatctcattaatgt

SEQ ID NO: 284586 - DNA, 20 bp, human
gcgcaccgcactccatatcg

SEQ ID NO: 284587 - DNA, 20 bp, human
gggcctctatggcttctccc

SEQ ID NO: 284588 - DNA, 20 bp, human
gatatggagtgcggtgcgga

SEQ ID NO: 284589 - DNA, 20 bp, human
ggcaatgtgctatcacgtca

SEQ ID NO: 284590 - DNA, 20 bp, human
gccgcactccatatcgagga

SEQ ID NO: 284591 - DNA, 20 bp, human
gcggccggtagctggggctg

SEQ ID NO: 284592 - DNA, 20 bp, human
gtatcacgtcagggctccgg

SEQ ID NO: 284593 - DNA, 20 bp, human
gaccgggcggccggtagctg

SEQ ID NO: 284594 - DNA, 20 bp, human
gtcgcccgattgatttatgt

SEQ ID NO: 284595 - DNA, 20 bp, human
gttgcaaggagagctgagac

SEQ ID NO: 284596 - DNA, 20 bp, human
gcagacggccgtgacgtcag

SEQ ID NO: 284597 - DNA, 20 bp, human
gtagcagctgcctcggggta

SEQ ID NO: 284598 - DNA, 20 bp, human
ggtcagcggggtcaagttgt

SEQ ID NO: 284599 - DNA, 20 bp, human
gccccgaggcagctgctaga

SEQ ID NO: 284600 - DNA, 20 bp, human
ggggtcaagttgtcggcagg

SEQ ID NO: 284601 - DNA, 20 bp, human
ggcggggtcaagttgtcggc

SEQ ID NO: 284602 - DNA, 20 bp, human
gtgttcgcggggaagggctc

SEQ ID NO: 284603 - DNA, 20 bp, human
gaacaaaggaagcgcccccc

SEQ ID NO: 284604 - DNA, 20 bp, human
ggggcgcttcctttgttcgc

SEQ ID NO: 284605 - DNA, 20 bp, human
gcgccatctagcagctgcct

SEQ ID NO: 284606 - DNA, 20 bp, human
ggtaggaggggttctctctt

SEQ ID NO: 284607 - DNA, 20 bp, human
gcataccacagcacgagcaa

SEQ ID NO: 284608 - DNA, 20 bp, human
gtgggcggtgggatgggcga

SEQ ID NO: 284609 - DNA, 20 bp, human
ggcacttcgcagacgtagga

SEQ ID NO: 284610 - DNA, 20 bp, human
gcggagcacttcgcagacgt

SEQ ID NO: 284611 - DNA, 20 bp, human
gtcctcctttgctcgtgctg

SEQ ID NO: 284612 - DNA, 20 bp, human
gaggagggctctcatgtatg

SEQ ID NO: 284613 - DNA, 20 bp, human
gtctctcttaggtaagatcg

SEQ ID NO: 284614 - DNA, 20 bp, human
gtcggggacgttcaggcgat

SEQ ID NO: 284615 - DNA, 20 bp, human
gggtaagatcggggacgttc

SEQ ID NO: 284616 - DNA, 20 bp, human
gcacccccaggattggggaa

SEQ ID NO: 284617 - DNA, 20 bp, human
gggggtgagtggggtaacaa

SEQ ID NO: 284618 - DNA, 20 bp, human
gggaagttagagtgcgggat

SEQ ID NO: 284619 - DNA, 20 bp, human
gcccaatcctgggggtgagt

SEQ ID NO: 284620 - DNA, 20 bp, human
gcacgtgggcacggccgcca

SEQ ID NO: 284621 - DNA, 20 bp, human
ggcggccgtgcccacgtgag

SEQ ID NO: 284622 - DNA, 20 bp, human
gtgagtggggtaacaaaggg

SEQ ID NO: 284623 - DNA, 20 bp, human
gggggggggtgcaggttata

SEQ ID NO: 284624 - DNA, 20 bp, human
ggtggggtaacaaagggcgg

SEQ ID NO: 284625 - DNA, 20 bp, human
ggataagataatatatgggg

SEQ ID NO: 284626 - DNA, 20 bp, human
ggccgacgcaaaggggtgta

SEQ ID NO: 284627 - DNA, 20 bp, human
gacatcctatgcctaggcgg

SEQ ID NO: 284628 - DNA, 20 bp, human
gggtcacgtgggcgcgggag

SEQ ID NO: 284629 - DNA, 20 bp, human
ggggaggtggaagcactagg

SEQ ID NO: 284630 - DNA, 20 bp, human
ggggcatcacgtgcgcagag

SEQ ID NO: 284631 - DNA, 20 bp, human
gcatgcgtagagggaatgta

SEQ ID NO: 284632 - DNA, 20 bp, human
gcgcacgtgatgccccggcc

SEQ ID NO: 284633 - DNA, 20 bp, human
gggtagggggtctgtctctc

SEQ ID NO: 284634 - DNA, 20 bp, human
gccgccccacctcgagggga

SEQ ID NO: 284635 - DNA, 20 bp, human
ggaggtggggcggggcgaaa

SEQ ID NO: 284636 - DNA, 20 bp, human
gcgggggtgggtggtgatgt

SEQ ID NO: 284637 - DNA, 20 bp, human
ggggtcgctagctagtagga

SEQ ID NO: 284638 - DNA, 20 bp, human
ggcaacccagtccccggata

SEQ ID NO: 284639 - DNA, 20 bp, human
gtcccccaatgcccgggctt

SEQ ID NO: 284640 - DNA, 20 bp, human
gaaaggagatgggaagctcc

SEQ ID NO: 284641 - DNA, 20 bp, human
gcggttccttatccggggac

SEQ ID NO: 284642 - DNA, 20 bp, human
gatgtggggttagctagcag

SEQ ID NO: 284643 - DNA, 20 bp, human
gagtctggcgggatgtgcac

SEQ ID NO: 284644 - DNA, 20 bp, human
gccctccaaagcccgggcat

SEQ ID NO: 284645 - DNA, 20 bp, human
gggcagcgcccctctttcgc

SEQ ID NO: 284646 - DNA, 20 bp, human
gctccctctatgagagaatt

SEQ ID NO: 284647 - DNA, 20 bp, human
gcagcctggcccgtggggag

SEQ ID NO: 284648 - DNA, 20 bp, human
gtacccaattctctcataga

SEQ ID NO: 284649 - DNA, 20 bp, human
gcgagcgcagaaagagctga

SEQ ID NO: 284650 - DNA, 20 bp, human
gcgtgtgcaaatgggcgccg

SEQ ID NO: 284651 - DNA, 20 bp, human
gaaaagttcacgttcatgga

SEQ ID NO: 284652 - DNA, 20 bp, human
gttgtgtagcgtgtgcaaat

SEQ ID NO: 284653 - DNA, 20 bp, human
gcacaaatgcatcgcattcc

SEQ ID NO: 284654 - DNA, 20 bp, human
gctgcagcagcctggcccgt

SEQ ID NO: 284655 - DNA, 20 bp, human
gtgtggccttgaggcagtga

SEQ ID NO: 284656 - DNA, 20 bp, human
gctccctctatgagagaatt

SEQ ID NO: 284657 - DNA, 20 bp, human
gcagcctggcccgtggggag

SEQ ID NO: 284658 - DNA, 20 bp, human
gtacccaattctctcataga

SEQ ID NO: 284659 - DNA, 20 bp, human
gcgagcgcagaaagagctga

SEQ ID NO: 284660 - DNA, 20 bp, human
gcgtgtgcaaatgggcgccg

SEQ ID NO: 284661 - DNA, 20 bp, human
gaaaagttcacgttcatgga

SEQ ID NO: 284662 - DNA, 20 bp, human
gttgtgtagcgtgtgcaaat

SEQ ID NO: 284663 - DNA, 20 bp, human
gcacaaatgcatcgcattcc

SEQ ID NO: 284664 - DNA, 20 bp, human
gctgcagcagcctggcccgt

SEQ ID NO: 284665 - DNA, 20 bp, human
gtgtggccttgaggcagtga

SEQ ID NO: 284666 - DNA, 20 bp, human
ggagtctgaggaattcgcct

SEQ ID NO: 284667 - DNA, 20 bp, human
gcaatccacgacatgaagac

SEQ ID NO: 284668 - DNA, 20 bp, human
gcgccaccgccgggagtctg

SEQ ID NO: 284669 - DNA, 20 bp, human
gggcccctaacccaaaagat

SEQ ID NO: 284670 - DNA, 20 bp, human
ggtgagccagccccagctaa

SEQ ID NO: 284671 - DNA, 20 bp, human
gcaaaagatgggcttcctag

SEQ ID NO: 284672 - DNA, 20 bp, human
gccagccccagctaatggct

SEQ ID NO: 284673 - DNA, 20 bp, human
gtggctggggccagttttcc

SEQ ID NO: 284674 - DNA, 20 bp, human
ggaattcctcagactcccgg

SEQ ID NO: 284675 - DNA, 20 bp, human
gaattcgcctgggctgttag

SEQ ID NO: 284676 - DNA, 20 bp, human
ggagctaggagccgtcctga

SEQ ID NO: 284677 - DNA, 20 bp, human
gtcggctcgcgcagagactg

SEQ ID NO: 284678 - DNA, 20 bp, human
gggcgcggatcaatgcgcag

SEQ ID NO: 284679 - DNA, 20 bp, human
gcggacccccaggaaatcgc

SEQ ID NO: 284680 - DNA, 20 bp, human
ggcgacctgcgatttcctgg

SEQ ID NO: 284681 - DNA, 20 bp, human
gagagactgcgggagcgtcg

SEQ ID NO: 284682 - DNA, 20 bp, human
gaactctggacccaaggcac

SEQ ID NO: 284683 - DNA, 20 bp, human
gtgatccgcgccgtattttt

SEQ ID NO: 284684 - DNA, 20 bp, human
ggcgtcggggccgacagaga

SEQ ID NO: 284685 - DNA, 20 bp, human
gaggcaccggtcaccccctc

SEQ ID NO: 284686 - DNA, 20 bp, human
gggagagccgtcgcgaccgg

SEQ ID NO: 284687 - DNA, 20 bp, human
ggggggggctagtccctcga

SEQ ID NO: 284688 - DNA, 20 bp, human
gaggcagcccccggtcgcga

SEQ ID NO: 284689 - DNA, 20 bp, human
ggtcgcgacggctctcctcg

SEQ ID NO: 284690 - DNA, 20 bp, human
gggctctcctcggggctcgg

SEQ ID NO: 284691 - DNA, 20 bp, human
ggggcgagccgcttctgctc

SEQ ID NO: 284692 - DNA, 20 bp, human
gtccctcgagggcggagtgt

SEQ ID NO: 284693 - DNA, 20 bp, human
gtggcctaatataccggcgg

SEQ ID NO: 284694 - DNA, 20 bp, human
ggacaggtattgggcgaggt

SEQ ID NO: 284695 - DNA, 20 bp, human
ggggcgtcgcggcatggaaa

SEQ ID NO: 284696 - DNA, 20 bp, human
gggcaaggcaggctctaaac

SEQ ID NO: 284697 - DNA, 20 bp, human
gccggtgtatgcactcacac

SEQ ID NO: 284698 - DNA, 20 bp, human
gagtcaagcagatgccccgg

SEQ ID NO: 284699 - DNA, 20 bp, human
gacagagcctggcacggagg

SEQ ID NO: 284700 - DNA, 20 bp, human
ggctctaaactggaacctga

SEQ ID NO: 284701 - DNA, 20 bp, human
ggggttgctagataccatgg

SEQ ID NO: 284702 - DNA, 20 bp, human
ggacaagagcaggcccgccg

SEQ ID NO: 284703 - DNA, 20 bp, human
ggggcttaaggtagacttcg

SEQ ID NO: 284704 - DNA, 20 bp, human
gagcggcgcgcgtcagctag

SEQ ID NO: 284705 - DNA, 20 bp, human
gccggagcctcctgctttta

SEQ ID NO: 284706 - DNA, 20 bp, human
gccggccggccgggtaagca

SEQ ID NO: 284707 - DNA, 20 bp, human
gctccagcgcgcactatcgc

SEQ ID NO: 284708 - DNA, 20 bp, human
gcggccggccggccaggctc

SEQ ID NO: 284709 - DNA, 20 bp, human
gagtgcgcgctggagacaac

SEQ ID NO: 284710 - DNA, 20 bp, human
gctggagcacgtgacccgag

SEQ ID NO: 284711 - DNA, 20 bp, human
gggagaggcggacaggaggg

SEQ ID NO: 284712 - DNA, 20 bp, human
ggagccctggagaggcggac

SEQ ID NO: 284713 - DNA, 20 bp, human
gggcccaggggccgaagcgg

SEQ ID NO: 284714 - DNA, 20 bp, human
gttgtccgtgcttacccggc

SEQ ID NO: 284715 - DNA, 20 bp, human
ggggctggccgagcgagccc

SEQ ID NO: 284716 - DNA, 20 bp, human
ggtaaaagctgactggggaa

SEQ ID NO: 284717 - DNA, 20 bp, human
gctctcgtaaaagctgactg

SEQ ID NO: 284718 - DNA, 20 bp, human
gcccccctcagtgatagtgg

SEQ ID NO: 284719 - DNA, 20 bp, human
gaacgtgaacagacactgtc

SEQ ID NO: 284720 - DNA, 20 bp, human
gtcagggcgcccctggtatc

SEQ ID NO: 284721 - DNA, 20 bp, human
ggggagatcacctttgtcta

SEQ ID NO: 284722 - DNA, 20 bp, human
ggtagggaaggaactggctc

SEQ ID NO: 284723 - DNA, 20 bp, human
gcctcccccactatcactga

SEQ ID NO: 284724 - DNA, 20 bp, human
ggggcgccctgacaaagtta

SEQ ID NO: 284725 - DNA, 20 bp, human
ggactggagaacaaaaatat

SEQ ID NO: 284726 - DNA, 20 bp, human
gctctgaagggggggaaaac

SEQ ID NO: 284727 - DNA, 20 bp, human
ggggggggaaaacgggtcgg

SEQ ID NO: 284728 - DNA, 20 bp, human
gtctacagagcgggctatgt

SEQ ID NO: 284729 - DNA, 20 bp, human
ggccgcgcgggtaggagata

SEQ ID NO: 284730 - DNA, 20 bp, human
gcaaccgggaataagaggac

SEQ ID NO: 284731 - DNA, 20 bp, human
gagagtcccaggggacactt

SEQ ID NO: 284732 - DNA, 20 bp, human
gaaacgggtcggggggatgt

SEQ ID NO: 284733 - DNA, 20 bp, human
gctggggacatcgggcaaga

SEQ ID NO: 284734 - DNA, 20 bp, human
gtgttcgatggcgaaggacg

SEQ ID NO: 284735 - DNA, 20 bp, human
gccttcgccatcgaacattg

SEQ ID NO: 284736 - DNA, 20 bp, human
gccacgtgggggtaggaacg

SEQ ID NO: 284737 - DNA, 20 bp, human
ggctgcgcgcggccacgtgg

SEQ ID NO: 284738 - DNA, 20 bp, human
ggggccgcctcccgccccga

SEQ ID NO: 284739 - DNA, 20 bp, human
gtgggaggtggaccctgcaa

SEQ ID NO: 284740 - DNA, 20 bp, human
gggagtgggtgggtccagcc

SEQ ID NO: 284741 - DNA, 20 bp, human
gcgtgggggtaggaacgcgg

SEQ ID NO: 284742 - DNA, 20 bp, human
gcccgccgggggcgtgccat

SEQ ID NO: 284743 - DNA, 20 bp, human
gcccgcctcagtcgcagaca

SEQ ID NO: 284744 - DNA, 20 bp, human
gcgcgcggccacgtgggggt

SEQ ID NO: 284745 - DNA, 20 bp, human
ggccctgtctgcgactgagg

SEQ ID NO: 284746 - DNA, 20 bp, human
gagggagggaagaaccacga

SEQ ID NO: 284747 - DNA, 20 bp, human
ggctgcggctggtcatgtgc

SEQ ID NO: 284748 - DNA, 20 bp, human
gttgcggtcgtcattggctg

SEQ ID NO: 284749 - DNA, 20 bp, human
gctgggaaagcagaatgcgg

SEQ ID NO: 284750 - DNA, 20 bp, human
gaatgcggggggaaattcgc

SEQ ID NO: 284751 - DNA, 20 bp, human
gctagcacagggtgagagat

SEQ ID NO: 284752 - DNA, 20 bp, human
gccgcaaataggtcataaaa

SEQ ID NO: 284753 - DNA, 20 bp, human
ggctctgggaaagcagaatg

SEQ ID NO: 284754 - DNA, 20 bp, human
gacctatttgcggtcgtcat

SEQ ID NO: 284755 - DNA, 20 bp, human
ggcacagggtgagagatggg

SEQ ID NO: 284756 - DNA, 20 bp, human
ggagggagcaagtttatcac

SEQ ID NO: 284757 - DNA, 20 bp, human
gtgggattacctgaggggaa

SEQ ID NO: 284758 - DNA, 20 bp, human
gagcaagtttatcaccgggt

SEQ ID NO: 284759 - DNA, 20 bp, human
gccgccccccgacaccaagt

SEQ ID NO: 284760 - DNA, 20 bp, human
gaaacttgctccctcgccat

SEQ ID NO: 284761 - DNA, 20 bp, human
gttgctccctcgccattggc

SEQ ID NO: 284762 - DNA, 20 bp, human
ggtaatcaagtagcttgcta

SEQ ID NO: 284763 - DNA, 20 bp, human
gtggaagggccacggaaggt

SEQ ID NO: 284764 - DNA, 20 bp, human
gccaagtaggcacagctcaa

SEQ ID NO: 284765 - DNA, 20 bp, human
gaccaggccagccaatggcg

SEQ ID NO: 284766 - DNA, 20 bp, human
gcctccgccggccttaaagg

SEQ ID NO: 284767 - DNA, 20 bp, human
gaggccggcggaggcatctc

SEQ ID NO: 284768 - DNA, 20 bp, human
gcggcccgagatgcctccgc

SEQ ID NO: 284769 - DNA, 20 bp, human
gggacgaggagccccgcgga

SEQ ID NO: 284770 - DNA, 20 bp, human
gtatgggccccctttaaggc

SEQ ID NO: 284771 - DNA, 20 bp, human
gatgcctccgccggccttaa

SEQ ID NO: 284772 - DNA, 20 bp, human
gcaggcttgcggtgcgtcaa

SEQ ID NO: 284773 - DNA, 20 bp, human
ggcgcgcagttcagtcgcta

SEQ ID NO: 284774 - DNA, 20 bp, human
gcacggaaagtcagcgtgac

SEQ ID NO: 284775 - DNA, 20 bp, human
gaagggctccgtgtgccccg

SEQ ID NO: 284776 - DNA, 20 bp, human
ggagccgggcacatggacct

SEQ ID NO: 284777 - DNA, 20 bp, human
gggcccgactgcgggaccga

SEQ ID NO: 284778 - DNA, 20 bp, human
ggccgcgcgaccaatggtgg

SEQ ID NO: 284779 - DNA, 20 bp, human
gtgggccgcgcgaccaatgg

SEQ ID NO: 284780 - DNA, 20 bp, human
ggggccaggccaggtcgggc

SEQ ID NO: 284781 - DNA, 20 bp, human
gaagctggagagtcagcgac

SEQ ID NO: 284782 - DNA, 20 bp, human
gggcctgcgggctctaattg

SEQ ID NO: 284783 - DNA, 20 bp, human
ggcgctaggggccgccccga

SEQ ID NO: 284784 - DNA, 20 bp, human
gcagcctgcgaactagtcgg

SEQ ID NO: 284785 - DNA, 20 bp, human
gacgcgaccgcatccagagg

SEQ ID NO: 284786 - DNA, 20 bp, human
ggaaaggcacataggtggag

SEQ ID NO: 284787 - DNA, 20 bp, human
gagaaaagaaagtcgatata

SEQ ID NO: 284788 - DNA, 20 bp, human
gaagctgctaaagtgtgtat

SEQ ID NO: 284789 - DNA, 20 bp, human
ggaggggtgggctcagtttc

SEQ ID NO: 284790 - DNA, 20 bp, human
gaggcacataggtggagggg

SEQ ID NO: 284791 - DNA, 20 bp, human
gccagcaagccctgtcctgc

SEQ ID NO: 284792 - DNA, 20 bp, human
gagtgtgtatgggcaggtgt

SEQ ID NO: 284793 - DNA, 20 bp, human
gaactcagagatgggaactt

SEQ ID NO: 284794 - DNA, 20 bp, human
gagtacattggcaataatac

SEQ ID NO: 284795 - DNA, 20 bp, human
gactatctttgcggtgtctg

SEQ ID NO: 284796 - DNA, 20 bp, human
gggaaagcggcgcccctccg

SEQ ID NO: 284797 - DNA, 20 bp, human
gcgttcccggcgctgcgtgg

SEQ ID NO: 284798 - DNA, 20 bp, human
gtcccgcgcgtggggtgcga

SEQ ID NO: 284799 - DNA, 20 bp, human
gacaccgccccgccacgcca

SEQ ID NO: 284800 - DNA, 20 bp, human
gagagctcggcggctgggac

SEQ ID NO: 284801 - DNA, 20 bp, human
gagaaagcgaaggttagcgg

SEQ ID NO: 284802 - DNA, 20 bp, human
gccgccggcatctttcgaac

SEQ ID NO: 284803 - DNA, 20 bp, human
ggggctaggtcgcaggagag

SEQ ID NO: 284804 - DNA, 20 bp, human
ggggcgccaccacgcagcgc

SEQ ID NO: 284805 - DNA, 20 bp, human
ggcaccccacgcgcgggagg

SEQ ID NO: 284806 - DNA, 20 bp, human
gatcgcggcgcccctctcct

SEQ ID NO: 284807 - DNA, 20 bp, human
ggggtccccgccagccctgg

SEQ ID NO: 284808 - DNA, 20 bp, human
gggggcgggcgggactgcga

SEQ ID NO: 284809 - DNA, 20 bp, human
ggggcagggtgctccctcga

SEQ ID NO: 284810 - DNA, 20 bp, human
gcggccctcgaagcgacgtg

SEQ ID NO: 284811 - DNA, 20 bp, human
ggcacctcggctctggtggc

SEQ ID NO: 284812 - DNA, 20 bp, human
ggttccccggtccccctcga

SEQ ID NO: 284813 - DNA, 20 bp, human
gtccccttctctccggggcg

SEQ ID NO: 284814 - DNA, 20 bp, human
gggctggcggggaccccccc

SEQ ID NO: 284815 - DNA, 20 bp, human
ggggcgtccccttctctccg

SEQ ID NO: 284816 - DNA, 20 bp, human
gcctgtcccgaaagccactg

SEQ ID NO: 284817 - DNA, 20 bp, human
ggagccgggcgctgagggtc

SEQ ID NO: 284818 - DNA, 20 bp, human
gtggcctgctggtatagaag

SEQ ID NO: 284819 - DNA, 20 bp, human
ggggcgctgagggtccggca

SEQ ID NO: 284820 - DNA, 20 bp, human
gccgcctgccagctccggga

SEQ ID NO: 284821 - DNA, 20 bp, human
ggggccgagccgggcgctga

SEQ ID NO: 284822 - DNA, 20 bp, human
ggcggcggcgggcagcggac

SEQ ID NO: 284823 - DNA, 20 bp, human
gccgaggagcagcgaggtgc

SEQ ID NO: 284824 - DNA, 20 bp, human
gacctggaggcgggacccgg

SEQ ID NO: 284825 - DNA, 20 bp, human
gcgggcgctcaagtttccta

SEQ ID NO: 284826 - DNA, 20 bp, human
gggcaggcggggtttcaggt

SEQ ID NO: 284827 - DNA, 20 bp, human
gtacaagtctggggtggaaa

SEQ ID NO: 284828 - DNA, 20 bp, human
gactccgggaaggtcagcgc

SEQ ID NO: 284829 - DNA, 20 bp, human
gagcccccggcttacaagtc

SEQ ID NO: 284830 - DNA, 20 bp, human
ggagtggcaggcggggtttc

SEQ ID NO: 284831 - DNA, 20 bp, human
gctgaccttcccggagtcgc

SEQ ID NO: 284832 - DNA, 20 bp, human
gcccacccatgctggggccc

SEQ ID NO: 284833 - DNA, 20 bp, human
ggggcaggttgcacggctat

SEQ ID NO: 284834 - DNA, 20 bp, human
gcaggtggggaccgggtggc

SEQ ID NO: 284835 - DNA, 20 bp, human
ggaaaggaagcttagagatt

SEQ ID NO: 284836 - DNA, 20 bp, human
gaacaccatcctgttcaatg

SEQ ID NO: 284837 - DNA, 20 bp, human
gacgtccactagtcagtggg

SEQ ID NO: 284838 - DNA, 20 bp, human
gagccgcagcctcattgaac

SEQ ID NO: 284839 - DNA, 20 bp, human
ggcagcctcattgaacagga

SEQ ID NO: 284840 - DNA, 20 bp, human
gaggcctcctggcctacctg

SEQ ID NO: 284841 - DNA, 20 bp, human
gagtgacgtccactagtcag

SEQ ID NO: 284842 - DNA, 20 bp, human
gtcctggaaaagcttgccct

SEQ ID NO: 284843 - DNA, 20 bp, human
ggccccctcaaatttcctct

SEQ ID NO: 284844 - DNA, 20 bp, human
gttcctctaggcaagagttc

SEQ ID NO: 284845 - DNA, 20 bp, human
ggccgtgcctctcagagcta

SEQ ID NO: 284846 - DNA, 20 bp, human
gcacgcctggtcacatcctt

SEQ ID NO: 284847 - DNA, 20 bp, human
ggtgaccaggcgtgaggccc

SEQ ID NO: 284848 - DNA, 20 bp, human
gccagcccaggaactcacaa

SEQ ID NO: 284849 - DNA, 20 bp, human
gtatccgaggcgacagggtg

SEQ ID NO: 284850 - DNA, 20 bp, human
ggcagccattgtgagttcct

SEQ ID NO: 284851 - DNA, 20 bp, human
ggagtcaaaggcggagtcac

SEQ ID NO: 284852 - DNA, 20 bp, human
gagtgcctggcgccgagtga

SEQ ID NO: 284853 - DNA, 20 bp, human
gggcgaccccgcagtatccg

SEQ ID NO: 284854 - DNA, 20 bp, human
gccccccaacctcacagcga

SEQ ID NO: 284855 - DNA, 20 bp, human
gcccccacaccctgtcgcct

SEQ ID NO: 284856 - DNA, 20 bp, human
ggggcaggtgacacagtcgt

SEQ ID NO: 284857 - DNA, 20 bp, human
gtggcgctccagaacgctca

SEQ ID NO: 284858 - DNA, 20 bp, human
gctgaggggaggctttgagc

SEQ ID NO: 284859 - DNA, 20 bp, human
gcagcctctggctccgtgat

SEQ ID NO: 284860 - DNA, 20 bp, human
gttgagccggtctgcgagtc

SEQ ID NO: 284861 - DNA, 20 bp, human
gtgcacgcgcgcgcgcgcag

SEQ ID NO: 284862 - DNA, 20 bp, human
ggacacagtcgtgggttccc

SEQ ID NO: 284863 - DNA, 20 bp, human
ggctcccctgccagtgggcg

SEQ ID NO: 284864 - DNA, 20 bp, human
gctgccaatcacggagccag

SEQ ID NO: 284865 - DNA, 20 bp, human
gacagtcgtgggttccccgg

SEQ ID NO: 284866 - DNA, 20 bp, human
gtataaccagcagtcttcgc

SEQ ID NO: 284867 - DNA, 20 bp, human
gcacgagccagtgagaggac

SEQ ID NO: 284868 - DNA, 20 bp, human
gaggaagagcgttaggtaga

SEQ ID NO: 284869 - DNA, 20 bp, human
gttgttagacactgcctcga

SEQ ID NO: 284870 - DNA, 20 bp, human
gataatcacgagccagtgag

SEQ ID NO: 284871 - DNA, 20 bp, human
gtaagtgaacatgtaacagt

SEQ ID NO: 284872 - DNA, 20 bp, human
ggctggttatacaggatatc

SEQ ID NO: 284873 - DNA, 20 bp, human
gtactcgtcatataaaccca

SEQ ID NO: 284874 - DNA, 20 bp, human
gttcgcaggcttgaactgcc

SEQ ID NO: 284875 - DNA, 20 bp, human
gcctcgaaggaacatacagc

SEQ ID NO: 284876 - DNA, 20 bp, human
gccaggcgggcccagctacg

SEQ ID NO: 284877 - DNA, 20 bp, human
gtctgcggggatgtgggaac

SEQ ID NO: 284878 - DNA, 20 bp, human
gtgcctgtctgcggggatgt

SEQ ID NO: 284879 - DNA, 20 bp, human
ggggtccccctggaggtcca

SEQ ID NO: 284880 - DNA, 20 bp, human
ggatggggccgggcttgtgg

SEQ ID NO: 284881 - DNA, 20 bp, human
gcccgcagacaggcacacct

SEQ ID NO: 284882 - DNA, 20 bp, human
gaggggccggaccattcgat

SEQ ID NO: 284883 - DNA, 20 bp, human
gggcttgccttggacctcca

SEQ ID NO: 284884 - DNA, 20 bp, human
gccaaggcaagccccgtagc

SEQ ID NO: 284885 - DNA, 20 bp, human
gacttgtaggaagccagcgg

SEQ ID NO: 284886 - DNA, 20 bp, human
gcaaaagcacagtgtcactg

SEQ ID NO: 284887 - DNA, 20 bp, human
gctcccagctggaaccctgg

SEQ ID NO: 284888 - DNA, 20 bp, human
gctcccccagggttccagct

SEQ ID NO: 284889 - DNA, 20 bp, human
gccaggaaagtgcagggcgg

SEQ ID NO: 284890 - DNA, 20 bp, human
gaccctgccgcaatgaggac

SEQ ID NO: 284891 - DNA, 20 bp, human
gcggaggtggagaccgtggc

SEQ ID NO: 284892 - DNA, 20 bp, human
ggccatgcccccctcccagc

SEQ ID NO: 284893 - DNA, 20 bp, human
ggggaagagagctaccaaga

SEQ ID NO: 284894 - DNA, 20 bp, human
gtaagtgccaggaaagtgca

SEQ ID NO: 284895 - DNA, 20 bp, human
gcccggggccagcagttgac

SEQ ID NO: 284896 - DNA, 20 bp, human
gtcagcaactgggcaggaca

SEQ ID NO: 284897 - DNA, 20 bp, human
gctgcagcctagcttaggtg

SEQ ID NO: 284898 - DNA, 20 bp, human
ggctgcagaaatgtctacaa

SEQ ID NO: 284899 - DNA, 20 bp, human
gagggagatggccacacaca

SEQ ID NO: 284900 - DNA, 20 bp, human
gttagagccccacctaagct

SEQ ID NO: 284901 - DNA, 20 bp, human
gctgaaatcagcaactgggc

SEQ ID NO: 284902 - DNA, 20 bp, human
gtgacacagactatactcaa

SEQ ID NO: 284903 - DNA, 20 bp, human
gtcaatctgtctctttatct

SEQ ID NO: 284904 - DNA, 20 bp, human
gttacaaatcccaagaaacc

SEQ ID NO: 284905 - DNA, 20 bp, human
gggagagcttttaagcaata

SEQ ID NO: 284906 - DNA, 20 bp, human
gcccgcccgcgcgcctacgc

SEQ ID NO: 284907 - DNA, 20 bp, human
gccggcgcctaccagtttgc

SEQ ID NO: 284908 - DNA, 20 bp, human
gaactggtaggcgccggcgt

SEQ ID NO: 284909 - DNA, 20 bp, human
gagccctcaggcgaacctct

SEQ ID NO: 284910 - DNA, 20 bp, human
gagtgagcctgcaaactggt

SEQ ID NO: 284911 - DNA, 20 bp, human
gaagccgagaggttcgcctg

SEQ ID NO: 284912 - DNA, 20 bp, human
gggcgcgcgttgcttcatgg

SEQ ID NO: 284913 - DNA, 20 bp, human
gacaggtagtgcaaggtctt

SEQ ID NO: 284914 - DNA, 20 bp, human
ggggccaagagtcaggaaaa

SEQ ID NO: 284915 - DNA, 20 bp, human
gccggtaggtttgggaatca

SEQ ID NO: 284916 - DNA, 20 bp, human
gaacccgcggaaggcgacgg

SEQ ID NO: 284917 - DNA, 20 bp, human
ggagccgccgtcgccttccg

SEQ ID NO: 284918 - DNA, 20 bp, human
ggtgaccgcccgccccggga

SEQ ID NO: 284919 - DNA, 20 bp, human
gtcgaacccgcggaaggcga

SEQ ID NO: 284920 - DNA, 20 bp, human
ggtaaaatggggcatgggca

SEQ ID NO: 284921 - DNA, 20 bp, human
gcccgggcgcgcttccgggt

SEQ ID NO: 284922 - DNA, 20 bp, human
ggtggcacccaggcactgag

SEQ ID NO: 284923 - DNA, 20 bp, human
gcgcacgtgaccgcccgccc

SEQ ID NO: 284924 - DNA, 20 bp, human
gcagggagagcagtcacaaa

SEQ ID NO: 284925 - DNA, 20 bp, human
gcttgctgagggtccgaacc

SEQ ID NO: 284926 - DNA, 20 bp, human
ggcggggcgtggcaggcgtc

SEQ ID NO: 284927 - DNA, 20 bp, human
gcactgcagcgccagagcgc

SEQ ID NO: 284928 - DNA, 20 bp, human
ggagcagtggcaagctcgcg

SEQ ID NO: 284929 - DNA, 20 bp, human
gcagtggcaagctcgcgcgg

SEQ ID NO: 284930 - DNA, 20 bp, human
ggccagagcgcgggctgacc

SEQ ID NO: 284931 - DNA, 20 bp, human
gcaaagcagtaaaagacgaa

SEQ ID NO: 284932 - DNA, 20 bp, human
gcgagcgagccaatgacgcc

SEQ ID NO: 284933 - DNA, 20 bp, human
gcaagctcgcgcggcggagt

SEQ ID NO: 284934 - DNA, 20 bp, human
gtcacgtgacccggcgtcat

SEQ ID NO: 284935 - DNA, 20 bp, human
gcggcggcctctttaagtag

SEQ ID NO: 284936 - DNA, 20 bp, human
gcgctgacgtcagagaccaa

SEQ ID NO: 284937 - DNA, 20 bp, human
gctccgcggctcgacggccg

SEQ ID NO: 284938 - DNA, 20 bp, human
ggcggcgctggaatcctggc

SEQ ID NO: 284939 - DNA, 20 bp, human
gcgccgcggccgtcgagccg

SEQ ID NO: 284940 - DNA, 20 bp, human
gcggagttcgagtctgacag

SEQ ID NO: 284941 - DNA, 20 bp, human
ggggcgcaaagattccatca

SEQ ID NO: 284942 - DNA, 20 bp, human
gcgtcagagaccaatggctg

SEQ ID NO: 284943 - DNA, 20 bp, human
ggtgcttcgtcgcatctggg

SEQ ID NO: 284944 - DNA, 20 bp, human
ggattccagcgccgcagctg

SEQ ID NO: 284945 - DNA, 20 bp, human
gagtgcaggctcggccctga

SEQ ID NO: 284946 - DNA, 20 bp, human
ggtcgcgattacgctctcta

SEQ ID NO: 284947 - DNA, 20 bp, human
gaaacaggcgggaacccgtg

SEQ ID NO: 284948 - DNA, 20 bp, human
ggtccctccccctcaggccg

SEQ ID NO: 284949 - DNA, 20 bp, human
gccgttgcgggctggagaca

SEQ ID NO: 284950 - DNA, 20 bp, human
ggagggaccacgcggaagga

SEQ ID NO: 284951 - DNA, 20 bp, human
gacacggcgccgactggaac

SEQ ID NO: 284952 - DNA, 20 bp, human
gggcacgtgactcaagagcg

SEQ ID NO: 284953 - DNA, 20 bp, human
ggagagcgtaatcgcgaccg

SEQ ID NO: 284954 - DNA, 20 bp, human
gcgcgtggtccctccccctc

SEQ ID NO: 284955 - DNA, 20 bp, human
gtaatcgcgaccgcggcctg

SEQ ID NO: 284956 - DNA, 20 bp, human
gcccggcgggcgtgtagtgt

SEQ ID NO: 284957 - DNA, 20 bp, human
ggagccacgggagcgcccca

SEQ ID NO: 284958 - DNA, 20 bp, human
gggcgaggcccgattctcgg

SEQ ID NO: 284959 - DNA, 20 bp, human
gcctgcgccgagagcgtgcc

SEQ ID NO: 284960 - DNA, 20 bp, human
ggccactgggcggcgtcctg

SEQ ID NO: 284961 - DNA, 20 bp, human
ggccgacactacacgcccgc

SEQ ID NO: 284962 - DNA, 20 bp, human
ggcggggcggagtcgacgct

SEQ ID NO: 284963 - DNA, 20 bp, human
gggggtgaaattcttgggag

SEQ ID NO: 284964 - DNA, 20 bp, human
gcgggcctcgccctgctggg

SEQ ID NO: 284965 - DNA, 20 bp, human
gcagggcgaggcccgattct

SEQ ID NO: 284966 - DNA, 20 bp, human
gaggcggggcggggttggat

SEQ ID NO: 284967 - DNA, 20 bp, human
gaggaggcgtaacggggcgg

SEQ ID NO: 284968 - DNA, 20 bp, human
gcacttgaagggtgcggaga

SEQ ID NO: 284969 - DNA, 20 bp, human
ggggttggattgggagcagt

SEQ ID NO: 284970 - DNA, 20 bp, human
ggtgaggaggcgtaacgggg

SEQ ID NO: 284971 - DNA, 20 bp, human
ggatggagggcgcagtggga

SEQ ID NO: 284972 - DNA, 20 bp, human
gtcacccacacccacttgaa

SEQ ID NO: 284973 - DNA, 20 bp, human
gctcgctttcccctcggtgg

SEQ ID NO: 284974 - DNA, 20 bp, human
gcgcacccttcaagtgggtg

SEQ ID NO: 284975 - DNA, 20 bp, human
gtgaacgtgaccgccaccga

SEQ ID NO: 284976 - DNA, 20 bp, human
gtcacggggaaggctggcta

SEQ ID NO: 284977 - DNA, 20 bp, human
ggtcactagcgagacccagt

SEQ ID NO: 284978 - DNA, 20 bp, human
gaatcagagggattgaatga

SEQ ID NO: 284979 - DNA, 20 bp, human
gcagacacacactttagata

SEQ ID NO: 284980 - DNA, 20 bp, human
ggccccgggggctctctact

SEQ ID NO: 284981 - DNA, 20 bp, human
gcccccgcgtgcctagcccc

SEQ ID NO: 284982 - DNA, 20 bp, human
gttggcaagagtcacgggga

SEQ ID NO: 284983 - DNA, 20 bp, human
ggagggcatggcttcaggga

SEQ ID NO: 284984 - DNA, 20 bp, human
gtgctggagggcatggcttc

SEQ ID NO: 284985 - DNA, 20 bp, human
ggaccctagagggttaaatt

SEQ ID NO: 284986 - DNA, 20 bp, human
gtccaggcatccataagtca

SEQ ID NO: 284987 - DNA, 20 bp, human
gtcccagtagagttggaggt

SEQ ID NO: 284988 - DNA, 20 bp, human
gtcacactggcaatgggtcc

SEQ ID NO: 284989 - DNA, 20 bp, human
gcccaggactaagccaatat

SEQ ID NO: 284990 - DNA, 20 bp, human
gatcactgcaaataaggtca

SEQ ID NO: 284991 - DNA, 20 bp, human
gtactcacttccctgactta

SEQ ID NO: 284992 - DNA, 20 bp, human
ggccaatattggcttagtcc

SEQ ID NO: 284993 - DNA, 20 bp, human
gtgactctcacactggcaat

SEQ ID NO: 284994 - DNA, 20 bp, human
gctgctgccaactctatata

SEQ ID NO: 284995 - DNA, 20 bp, human
gccccacctccaactctact

SEQ ID NO: 284996 - DNA, 20 bp, human
ggatgccaccggctgcgcac

SEQ ID NO: 284997 - DNA, 20 bp, human
ggccgagagaggctcccccg

SEQ ID NO: 284998 - DNA, 20 bp, human
gaacgccccggcgatgccac

SEQ ID NO: 284999 - DNA, 20 bp, human
ggcgcagccggtggcatcgc

SEQ ID NO: 285000 - DNA, 20 bp, human
gcccgggcgcctgccgagag

SEQ ID NO: 285001 - DNA, 20 bp, human
gagctggcacgctgccccgg

SEQ ID NO: 285002 - DNA, 20 bp, human
gcggggccgggcccacggga

SEQ ID NO: 285003 - DNA, 20 bp, human
ggcgttggcggaagcccccg

SEQ ID NO: 285004 - DNA, 20 bp, human
gggggcttccgccaacgccc

SEQ ID NO: 285005 - DNA, 20 bp, human
ggaaacaggagcccgtgatt

SEQ ID NO: 285006 - DNA, 20 bp, human
gggtcccgggagaattcgcc

SEQ ID NO: 285007 - DNA, 20 bp, human
gcccaccaggcgttgccaca

SEQ ID NO: 285008 - DNA, 20 bp, human
gacggccgcgtgtgtgggag

SEQ ID NO: 285009 - DNA, 20 bp, human
gaattctcccgggacccgcg

SEQ ID NO: 285010 - DNA, 20 bp, human
ggggcacccacgtcagagcg

SEQ ID NO: 285011 - DNA, 20 bp, human
gcccagacggccgcgtgtgt

SEQ ID NO: 285012 - DNA, 20 bp, human
gataccaggcgaattctccc

SEQ ID NO: 285013 - DNA, 20 bp, human
gtggggatgcgtttggaacc

SEQ ID NO: 285014 - DNA, 20 bp, human
ggcagggctaggtgcccaga

SEQ ID NO: 285015 - DNA, 20 bp, human
gaccctgtggcaacgcctgg

SEQ ID NO: 285016 - DNA, 20 bp, human
gcttccgggagcaacgcggg

SEQ ID NO: 285017 - DNA, 20 bp, human
ggcaaccccgagctcggctc

SEQ ID NO: 285018 - DNA, 20 bp, human
ggccgcggcctctcggggtt

SEQ ID NO: 285019 - DNA, 20 bp, human
ggcgggaggcggagccagta

SEQ ID NO: 285020 - DNA, 20 bp, human
ggggcttccgggagcaacgc

SEQ ID NO: 285021 - DNA, 20 bp, human
gggagaccggagccgagctc

SEQ ID NO: 285022 - DNA, 20 bp, human
gcgagaggccgcggccctac

SEQ ID NO: 285023 - DNA, 20 bp, human
gcccaccccggttggctgag

SEQ ID NO: 285024 - DNA, 20 bp, human
ggggcggcggagactcgggc

SEQ ID NO: 285025 - DNA, 20 bp, human
ggccagggagccggtgtctg

SEQ ID NO: 285026 - DNA, 20 bp, human
gcgggggctcgggttccgtg

SEQ ID NO: 285027 - DNA, 20 bp, human
gtggaggtggagggcgccca

SEQ ID NO: 285028 - DNA, 20 bp, human
gcctagcgaccgttgctaag

SEQ ID NO: 285029 - DNA, 20 bp, human
gagcaacggtcgctagggcg

SEQ ID NO: 285030 - DNA, 20 bp, human
gtataagtcgccgggggctc

SEQ ID NO: 285031 - DNA, 20 bp, human
gcgcccaggccgcaaccccg

SEQ ID NO: 285032 - DNA, 20 bp, human
gcggaagaacagcctggagt

SEQ ID NO: 285033 - DNA, 20 bp, human
gcctgctgcgggcgatccca

SEQ ID NO: 285034 - DNA, 20 bp, human
gctgccagggccggacacct

SEQ ID NO: 285035 - DNA, 20 bp, human
gggcctggctcccgttgcta

SEQ ID NO: 285036 - DNA, 20 bp, human
ggctgcgtcggggcgcgaga

SEQ ID NO: 285037 - DNA, 20 bp, human
gcgcgcggaggcggctgcgt

SEQ ID NO: 285038 - DNA, 20 bp, human
gcgggcgggcgggcgaagct

SEQ ID NO: 285039 - DNA, 20 bp, human
gttcccgcagccaacgttta

SEQ ID NO: 285040 - DNA, 20 bp, human
ggagccgggggcggaataac

SEQ ID NO: 285041 - DNA, 20 bp, human
gcgcctggtgccctaaacgt

SEQ ID NO: 285042 - DNA, 20 bp, human
gggtgtacccgaacattcct

SEQ ID NO: 285043 - DNA, 20 bp, human
gaacgtccgagacgcgggtg

SEQ ID NO: 285044 - DNA, 20 bp, human
ggcgggaacgtccgagacgc

SEQ ID NO: 285045 - DNA, 20 bp, human
gtgcgcggcgctttgaccgt

SEQ ID NO: 285046 - DNA, 20 bp, human
ggaaatggcgtcaacccagt

SEQ ID NO: 285047 - DNA, 20 bp, human
gttctgaaatagttgtatat

SEQ ID NO: 285048 - DNA, 20 bp, human
gcagaggccgaggcaggaaa

SEQ ID NO: 285049 - DNA, 20 bp, human
gtgtatatgggctgggtcac

SEQ ID NO: 285050 - DNA, 20 bp, human
gctgcccctgtttgaagaca

SEQ ID NO: 285051 - DNA, 20 bp, human
gtagattgagaaggacttag

SEQ ID NO: 285052 - DNA, 20 bp, human
ggaaatagttgtatatgggc

SEQ ID NO: 285053 - DNA, 20 bp, human
gaaaaacagaacatagatca

SEQ ID NO: 285054 - DNA, 20 bp, human
gctcaggatatagattgaga

SEQ ID NO: 285055 - DNA, 20 bp, human
ggcttgttccacctgaaact

SEQ ID NO: 285056 - DNA, 20 bp, human
gcccctggcgagttcccagt

SEQ ID NO: 285057 - DNA, 20 bp, human
gtagaggcccgggaatctgt

SEQ ID NO: 285058 - DNA, 20 bp, human
gaacagaatgggacgaaacg

SEQ ID NO: 285059 - DNA, 20 bp, human
gggggtggcgacagtggcgc

SEQ ID NO: 285060 - DNA, 20 bp, human
gccttgggaggcacaatcag

SEQ ID NO: 285061 - DNA, 20 bp, human
gcccctggtcggcggagccg

SEQ ID NO: 285062 - DNA, 20 bp, human
gaacagaggcgtgacttgga

SEQ ID NO: 285063 - DNA, 20 bp, human
gaatctgtgggtcttttagg

SEQ ID NO: 285064 - DNA, 20 bp, human
gaggggcgtagtcccctgca

SEQ ID NO: 285065 - DNA, 20 bp, human
gaccaggggccgcgccgact

SEQ ID NO: 285066 - DNA, 20 bp, human
gactgacccagaataactca

SEQ ID NO: 285067 - DNA, 20 bp, human
gctggggaggggaccagtga

SEQ ID NO: 285068 - DNA, 20 bp, human
ggaccctattggctggggaa

SEQ ID NO: 285069 - DNA, 20 bp, human
ggggaggggaaggaccctat

SEQ ID NO: 285070 - DNA, 20 bp, human
gtctctccctggccaggaga

SEQ ID NO: 285071 - DNA, 20 bp, human
gggaaggaccctattggctg

SEQ ID NO: 285072 - DNA, 20 bp, human
gcccccagatctgagttcca

SEQ ID NO: 285073 - DNA, 20 bp, human
gggccaccgtctcctggcca

SEQ ID NO: 285074 - DNA, 20 bp, human
gctccctggccaggagacgg

SEQ ID NO: 285075 - DNA, 20 bp, human
ggagccccctgacccccctc

SEQ ID NO: 285076 - DNA, 20 bp, human
gtcaggctggatctggttga

SEQ ID NO: 285077 - DNA, 20 bp, human
gcaggccgctgttaactctg

SEQ ID NO: 285078 - DNA, 20 bp, human
gaggcttcgcccacattccc

SEQ ID NO: 285079 - DNA, 20 bp, human
gggagctgtcaggctggatc

SEQ ID NO: 285080 - DNA, 20 bp, human
ggacagaggagctgtcaggc

SEQ ID NO: 285081 - DNA, 20 bp, human
gcagcctgcagagccctccg

SEQ ID NO: 285082 - DNA, 20 bp, human
gggagactgaagtgcggaga

SEQ ID NO: 285083 - DNA, 20 bp, human
gaatgtgggcgaagcctgtt

SEQ ID NO: 285084 - DNA, 20 bp, human
ggcctcctcagagttaacag

SEQ ID NO: 285085 - DNA, 20 bp, human
gtcagagcaagtgagtggcg

SEQ ID NO: 285086 - DNA, 20 bp, human
gccaccccctacaccaacat

SEQ ID NO: 285087 - DNA, 20 bp, human
gtaaatgattagtgggtcct

SEQ ID NO: 285088 - DNA, 20 bp, human
gagggtgttcaccttgaccc

SEQ ID NO: 285089 - DNA, 20 bp, human
ggcagtgcctatgttggtgt

SEQ ID NO: 285090 - DNA, 20 bp, human
gttgatggttatttgaaccc

SEQ ID NO: 285091 - DNA, 20 bp, human
gaatctccatcatcagtcag

SEQ ID NO: 285092 - DNA, 20 bp, human
gcaagctgtaaatgattagt

SEQ ID NO: 285093 - DNA, 20 bp, human
gtcagtggactgatggatca

SEQ ID NO: 285094 - DNA, 20 bp, human
ggcagctgcattatctaagc

SEQ ID NO: 285095 - DNA, 20 bp, human
gacacaacaaaaatgtatca

SEQ ID NO: 285096 - DNA, 20 bp, human
gtatgggcagaagacaaatc

SEQ ID NO: 285097 - DNA, 20 bp, human
ggcaacatgtgagtagcaca

SEQ ID NO: 285098 - DNA, 20 bp, human
ggtgccactgacaaagacga

SEQ ID NO: 285099 - DNA, 20 bp, human
gcacaactacaaggacagat

SEQ ID NO: 285100 - DNA, 20 bp, human
gggcagtggtggtttagcgg

SEQ ID NO: 285101 - DNA, 20 bp, human
ggtagcacatggaaacctag

SEQ ID NO: 285102 - DNA, 20 bp, human
gtatacttccaggcatgcgt

SEQ ID NO: 285103 - DNA, 20 bp, human
ggttgcttttggcattcctc

SEQ ID NO: 285104 - DNA, 20 bp, human
ggcaagaggacacaactaca

SEQ ID NO: 285105 - DNA, 20 bp, human
gactcattgaagctatgtat

SEQ ID NO: 285106 - DNA, 20 bp, human
ggccctgggcgcgtggaacc

SEQ ID NO: 285107 - DNA, 20 bp, human
gggcgcgtggaaccgggtgc

SEQ ID NO: 285108 - DNA, 20 bp, human
gtgtgtgcccgcaggtgcgt

SEQ ID NO: 285109 - DNA, 20 bp, human
gccgctgggtacccgggctc

SEQ ID NO: 285110 - DNA, 20 bp, human
ggggcgccggggagctctcg

SEQ ID NO: 285111 - DNA, 20 bp, human
gccaaacctggggcgcgagc

SEQ ID NO: 285112 - DNA, 20 bp, human
ggcgggtgggcccctcggag

SEQ ID NO: 285113 - DNA, 20 bp, human
gggaggaggagccgctccga

SEQ ID NO: 285114 - DNA, 20 bp, human
gtgctcgcgggtgggcccct

SEQ ID NO: 285115 - DNA, 20 bp, human
gttccccgctgctcgcgggt

SEQ ID NO: 285116 - DNA, 20 bp, human
gataaagctgggttgtggtc

SEQ ID NO: 285117 - DNA, 20 bp, human
gtagccccgagggatgatca

SEQ ID NO: 285118 - DNA, 20 bp, human
ggcactccaggtagccccga

SEQ ID NO: 285119 - DNA, 20 bp, human
gcccttataaagctgggttg

SEQ ID NO: 285120 - DNA, 20 bp, human
gtaattcacttccttctcca

SEQ ID NO: 285121 - DNA, 20 bp, human
gtcatccgtccctctgggct

SEQ ID NO: 285122 - DNA, 20 bp, human
ggactgtgggtgtcacatgt

SEQ ID NO: 285123 - DNA, 20 bp, human
gtgaattaacccagcccaga

SEQ ID NO: 285124 - DNA, 20 bp, human
gtttataagggttgtaattg

SEQ ID NO: 285125 - DNA, 20 bp, human
gagacaggtgaatgcctctt

SEQ ID NO: 285126 - DNA, 20 bp, human
gagaaagtgggtgagaccgt

SEQ ID NO: 285127 - DNA, 20 bp, human
gagagtcggcgagatgagga

SEQ ID NO: 285128 - DNA, 20 bp, human
ggagactgggggagaaaatg

SEQ ID NO: 285129 - DNA, 20 bp, human
ggggctcacaatctgcgggg

SEQ ID NO: 285130 - DNA, 20 bp, human
gggcgggctcacaatctgcg

SEQ ID NO: 285131 - DNA, 20 bp, human
gaggaagtgggtgcgaggcg

SEQ ID NO: 285132 - DNA, 20 bp, human
ggtggcggttgcccggtcaa

SEQ ID NO: 285133 - DNA, 20 bp, human
gggggcggagacgaggaagt

SEQ ID NO: 285134 - DNA, 20 bp, human
gtgtcagagtcggcgagatg

SEQ ID NO: 285135 - DNA, 20 bp, human
gagacgaggaagtgggtgcg

SEQ ID NO: 285136 - DNA, 20 bp, human
gccagctgctgtgagcgcag

SEQ ID NO: 285137 - DNA, 20 bp, human
gacccggtcaagccccggcc

SEQ ID NO: 285138 - DNA, 20 bp, human
gagcccggccggggcttgac

SEQ ID NO: 285139 - DNA, 20 bp, human
gctggctgggagcccggccg

SEQ ID NO: 285140 - DNA, 20 bp, human
gcccagacccggtcaagccc

SEQ ID NO: 285141 - DNA, 20 bp, human
gcctgtggggacccggggtg

SEQ ID NO: 285142 - DNA, 20 bp, human
gtcaccagggccgagggcac

SEQ ID NO: 285143 - DNA, 20 bp, human
ggctgggcgcggggcgcact

SEQ ID NO: 285144 - DNA, 20 bp, human
gtccgtggtgctgccggcgc

SEQ ID NO: 285145 - DNA, 20 bp, human
gcgcactcggagccggggtc

SEQ ID NO: 285146 - DNA, 20 bp, human
ggaggccactgatgtgagct

SEQ ID NO: 285147 - DNA, 20 bp, human
gctttctcagtgtcagttaa

SEQ ID NO: 285148 - DNA, 20 bp, human
gtgagccgagctcacatcag

SEQ ID NO: 285149 - DNA, 20 bp, human
gattatacaggaaataaatt

SEQ ID NO: 285150 - DNA, 20 bp, human
gaaaacagtgttgttttgag

SEQ ID NO: 285151 - DNA, 20 bp, human
gaaaacatttcactgttttt

SEQ ID NO: 285152 - DNA, 20 bp, human
gtaaaatataatcattatac

SEQ ID NO: 285153 - DNA, 20 bp, human
ggcttactttatcaagaatc

SEQ ID NO: 285154 - DNA, 20 bp, human
gaataaattgggctcacaca

SEQ ID NO: 285155 - DNA, 20 bp, human
gcatcacagtaaaatgttta

SEQ ID NO: 285156 - DNA, 20 bp, human
ggcgcgaggtttgggagacg

SEQ ID NO: 285157 - DNA, 20 bp, human
ggcgagaaggctccccgcag

SEQ ID NO: 285158 - DNA, 20 bp, human
gccggcagctagggagcgcg

SEQ ID NO: 285159 - DNA, 20 bp, human
gaagcccaggacctccgctg

SEQ ID NO: 285160 - DNA, 20 bp, human
gcgagctgaattcaggaaaa

SEQ ID NO: 285161 - DNA, 20 bp, human
ggctagggagcgcgaggttt

SEQ ID NO: 285162 - DNA, 20 bp, human
gctagctgccggcgccgcta

SEQ ID NO: 285163 - DNA, 20 bp, human
ggcgctccgcgcctccgcgg

SEQ ID NO: 285164 - DNA, 20 bp, human
gcggaactcgagctgaattc

SEQ ID NO: 285165 - DNA, 20 bp, human
gggcacgggcacatgaccgc

SEQ ID NO: 285166 - DNA, 20 bp, human
gccccacctgccaaagggtc

SEQ ID NO: 285167 - DNA, 20 bp, human
gaagaaggtaaacacctggg

SEQ ID NO: 285168 - DNA, 20 bp, human
gctgagagtagcccagattt

SEQ ID NO: 285169 - DNA, 20 bp, human
gggaataatggtccctctta

SEQ ID NO: 285170 - DNA, 20 bp, human
gaaggtaaacacctgggagg

SEQ ID NO: 285171 - DNA, 20 bp, human
gagtgtgtgcagggacatca

SEQ ID NO: 285172 - DNA, 20 bp, human
gtagcaactcctccctaaga

SEQ ID NO: 285173 - DNA, 20 bp, human
gaatcttaggtgaacctgta

SEQ ID NO: 285174 - DNA, 20 bp, human
gtcctgaccctttggcaggt

SEQ ID NO: 285175 - DNA, 20 bp, human
gcaggaagaaggtaaacacc

SEQ ID NO: 285176 - DNA, 20 bp, human
gagacgctgtgaggaatccc

SEQ ID NO: 285177 - DNA, 20 bp, human
gaccgggcgcttcctccacg

SEQ ID NO: 285178 - DNA, 20 bp, human
ggcgcgctctccaggagctt

SEQ ID NO: 285179 - DNA, 20 bp, human
gtcggtgggtactgtcgcgg

SEQ ID NO: 285180 - DNA, 20 bp, human
gggctcggtgggtactgtcg

SEQ ID NO: 285181 - DNA, 20 bp, human
gcccaccgagccaaagctcc

SEQ ID NO: 285182 - DNA, 20 bp, human
gtggaggccgtcctgggaat

SEQ ID NO: 285183 - DNA, 20 bp, human
gcgggctcgtgcggcattct

SEQ ID NO: 285184 - DNA, 20 bp, human
ggacgctccaggccacgtgg

SEQ ID NO: 285185 - DNA, 20 bp, human
gctctccaggagctttggct

SEQ ID NO: 285186 - DNA, 20 bp, human
gggtcccgcacggtcgccgt

SEQ ID NO: 285187 - DNA, 20 bp, human
gcaggccgacggcgaccgtg

SEQ ID NO: 285188 - DNA, 20 bp, human
gcagaggcggggcggaagcg

SEQ ID NO: 285189 - DNA, 20 bp, human
gtccgagcagcgcaggccga

SEQ ID NO: 285190 - DNA, 20 bp, human
ggcacacggtgaaccttaat

SEQ ID NO: 285191 - DNA, 20 bp, human
gagttcgcgcctgtggccag

SEQ ID NO: 285192 - DNA, 20 bp, human
ggggcggggcgcgcagtcac

SEQ ID NO: 285193 - DNA, 20 bp, human
gctgcgctgctcggagcttc

SEQ ID NO: 285194 - DNA, 20 bp, human
gggcggggacgcggtgacgc

SEQ ID NO: 285195 - DNA, 20 bp, human
gtaaggttcaccgtgtgcca

SEQ ID NO: 285196 - DNA, 20 bp, human
gcgtgcgcgtggtggcggag

SEQ ID NO: 285197 - DNA, 20 bp, human
gcagccgcagcgccggtgga

SEQ ID NO: 285198 - DNA, 20 bp, human
gcgcccctccaccggcgctg

SEQ ID NO: 285199 - DNA, 20 bp, human
ggcggggctaaaactggcga

SEQ ID NO: 285200 - DNA, 20 bp, human
gcgtggtggcggagggggat

SEQ ID NO: 285201 - DNA, 20 bp, human
gggctcttccgtccaataag

SEQ ID NO: 285202 - DNA, 20 bp, human
gggttgccgagcagcgtacg

SEQ ID NO: 285203 - DNA, 20 bp, human
gcggacccgaacggggggag

SEQ ID NO: 285204 - DNA, 20 bp, human
gaataagcggacccgaacgg

SEQ ID NO: 285205 - DNA, 20 bp, human
gtggcgaaggcgtggcttct

SEQ ID NO: 285206 - DNA, 20 bp, human
ggggagagcgcgttgggcag

SEQ ID NO: 285207 - DNA, 20 bp, human
gactctgggcggcacccgag

SEQ ID NO: 285208 - DNA, 20 bp, human
gcccggagggagagcgcgtt

SEQ ID NO: 285209 - DNA, 20 bp, human
gagagcgcgttgggcagagg

SEQ ID NO: 285210 - DNA, 20 bp, human
gcacctagcgggccggactc

SEQ ID NO: 285211 - DNA, 20 bp, human
gcggagcaccaggcacctag

SEQ ID NO: 285212 - DNA, 20 bp, human
gtagcgggccggactctggg

SEQ ID NO: 285213 - DNA, 20 bp, human
gcggctggtcgggtagtagt

SEQ ID NO: 285214 - DNA, 20 bp, human
gcggtcccgcccacccggtg

SEQ ID NO: 285215 - DNA, 20 bp, human
gcccttggactgaaacccca

SEQ ID NO: 285216 - DNA, 20 bp, human
ggacccgcgcggctgacgtc

SEQ ID NO: 285217 - DNA, 20 bp, human
gcctggggctccgtagggag

SEQ ID NO: 285218 - DNA, 20 bp, human
gtcaaggcatagtactcctc

SEQ ID NO: 285219 - DNA, 20 bp, human
gccatgcaggccactcccta

SEQ ID NO: 285220 - DNA, 20 bp, human
ggctggcctggggctccgta

SEQ ID NO: 285221 - DNA, 20 bp, human
gcatccagggacacgaatcc

SEQ ID NO: 285222 - DNA, 20 bp, human
ggggccacctcagccgcgga

SEQ ID NO: 285223 - DNA, 20 bp, human
gggcccgcgtgctgtgtttc

SEQ ID NO: 285224 - DNA, 20 bp, human
gctttggggcggtgaaacga

SEQ ID NO: 285225 - DNA, 20 bp, human
gtcggcccggagggatcaca

SEQ ID NO: 285226 - DNA, 20 bp, human
gccccgctgcgctcgtccgg

SEQ ID NO: 285227 - DNA, 20 bp, human
gaaggccggccggatctctg

SEQ ID NO: 285228 - DNA, 20 bp, human
ggaagccgcggggaggaatg

SEQ ID NO: 285229 - DNA, 20 bp, human
gccgcccaatggcactggag

SEQ ID NO: 285230 - DNA, 20 bp, human
gctccgcagcagccgcccaa

SEQ ID NO: 285231 - DNA, 20 bp, human
gacaccggatccactggaag

SEQ ID NO: 285232 - DNA, 20 bp, human
ggccacacgtgggacgccga

SEQ ID NO: 285233 - DNA, 20 bp, human
gccagtggatccggtgtctg

SEQ ID NO: 285234 - DNA, 20 bp, human
gagcccccggacgagcgcag

SEQ ID NO: 285235 - DNA, 20 bp, human
gtgccattgggcggctgctg

SEQ ID NO: 285236 - DNA, 20 bp, human
gaacccgctcccaggacgag

SEQ ID NO: 285237 - DNA, 20 bp, human
ggggcggtgtagggcggtca

SEQ ID NO: 285238 - DNA, 20 bp, human
ggcccaaaggggcggagtta

SEQ ID NO: 285239 - DNA, 20 bp, human
gaaggcttctgggcggtgta

SEQ ID NO: 285240 - DNA, 20 bp, human
gcagcagccaacccgctccc

SEQ ID NO: 285241 - DNA, 20 bp, human
gacaaggggcgggcccaaag

SEQ ID NO: 285242 - DNA, 20 bp, human
gtgggagcgcaccactcagt

SEQ ID NO: 285243 - DNA, 20 bp, human
gcaggggttgctattggctt

SEQ ID NO: 285244 - DNA, 20 bp, human
gggcggtcaggggttgctat

SEQ ID NO: 285245 - DNA, 20 bp, human
gcaccccctcgtcctgggag

SEQ ID NO: 285246 - DNA, 20 bp, human
gagaagggagggtcggggat

SEQ ID NO: 285247 - DNA, 20 bp, human
gggagcggaggcgtgcgcta

SEQ ID NO: 285248 - DNA, 20 bp, human
ggaggggagtaaacgaggtg

SEQ ID NO: 285249 - DNA, 20 bp, human
gcgtcccgagctcccaaggg

SEQ ID NO: 285250 - DNA, 20 bp, human
gcaagggaggggagtaaacg

SEQ ID NO: 285251 - DNA, 20 bp, human
ggcccggcgccgccgaggga

SEQ ID NO: 285252 - DNA, 20 bp, human
gttctcttgaagctcctgat

SEQ ID NO: 285253 - DNA, 20 bp, human
gcgcgcgcctgcgaaggggg

SEQ ID NO: 285254 - DNA, 20 bp, human
ggcgcctgcgaagggggcgg

SEQ ID NO: 285255 - DNA, 20 bp, human
gcggcgtcccgagctcccaa

SEQ ID NO: 285256 - DNA, 20 bp, human
ggaagcgcaggtgtcttcgg

SEQ ID NO: 285257 - DNA, 20 bp, human
gaaggaagcgcaggtgtctt

SEQ ID NO: 285258 - DNA, 20 bp, human
gagaaaccgcagcgaaaggg

SEQ ID NO: 285259 - DNA, 20 bp, human
ggggaaggcgaggaggagta

SEQ ID NO: 285260 - DNA, 20 bp, human
gcggagggacccaattgctg

SEQ ID NO: 285261 - DNA, 20 bp, human
gcggagaaaccgcagcgaaa

SEQ ID NO: 285262 - DNA, 20 bp, human
ggccgctcccgagctcccaa

SEQ ID NO: 285263 - DNA, 20 bp, human
gaggaggaggatttacccgg

SEQ ID NO: 285264 - DNA, 20 bp, human
ggcgcgcccaagtgatggag

SEQ ID NO: 285265 - DNA, 20 bp, human
ggggccccacacgcaggcgg

SEQ ID NO: 285266 - DNA, 20 bp, human
gcgcctccgaggccactgcc

SEQ ID NO: 285267 - DNA, 20 bp, human
ggccctggctcgcttgactc

SEQ ID NO: 285268 - DNA, 20 bp, human
gaacgtgtggggggagtctg

SEQ ID NO: 285269 - DNA, 20 bp, human
gcacgtcccggagtggggtg

SEQ ID NO: 285270 - DNA, 20 bp, human
gagggatcccagaacgtgtg

SEQ ID NO: 285271 - DNA, 20 bp, human
gcggagcaggagcgtcctgg

SEQ ID NO: 285272 - DNA, 20 bp, human
gcgggcgcgactcgagctgc

SEQ ID NO: 285273 - DNA, 20 bp, human
ggactccccccacacgttct

SEQ ID NO: 285274 - DNA, 20 bp, human
ggccggcagccgccaccacc

SEQ ID NO: 285275 - DNA, 20 bp, human
ggcaccctagtgtgcagaga

SEQ ID NO: 285276 - DNA, 20 bp, human
gaaccccggcactccggagg

SEQ ID NO: 285277 - DNA, 20 bp, human
ggcgaaccccggcactccgg

SEQ ID NO: 285278 - DNA, 20 bp, human
gggagtgccggggttcgccg

SEQ ID NO: 285279 - DNA, 20 bp, human
gcggggccgaggatcggcgc

SEQ ID NO: 285280 - DNA, 20 bp, human
gaggcgggcagccagcgact

SEQ ID NO: 285281 - DNA, 20 bp, human
gacggcaagagacgccacgg

SEQ ID NO: 285282 - DNA, 20 bp, human
gccccgcctccggagtgccg

SEQ ID NO: 285283 - DNA, 20 bp, human
gcggtggcgaggccgctagc

SEQ ID NO: 285284 - DNA, 20 bp, human
ggcgacggcaagagacgcca

SEQ ID NO: 285285 - DNA, 20 bp, human
gaggagagcctcccacgcct

SEQ ID NO: 285286 - DNA, 20 bp, human
gccgcggcggctcgaactcc

SEQ ID NO: 285287 - DNA, 20 bp, human
gccccccttcaggcaactca

SEQ ID NO: 285288 - DNA, 20 bp, human
gttcgcgcgggccctcctag

SEQ ID NO: 285289 - DNA, 20 bp, human
gggagggcccgcgcgaactg

SEQ ID NO: 285290 - DNA, 20 bp, human
gggggacaggtggtgcggac

SEQ ID NO: 285291 - DNA, 20 bp, human
gctcgctccggttgccgcgg

SEQ ID NO: 285292 - DNA, 20 bp, human
gactcccggactgcacacgc

SEQ ID NO: 285293 - DNA, 20 bp, human
gaccctgagttgcctgaagg

SEQ ID NO: 285294 - DNA, 20 bp, human
gcaggcaactcagggtacta

SEQ ID NO: 285295 - DNA, 20 bp, human
gtccgctggagaatggaaat

SEQ ID NO: 285296 - DNA, 20 bp, human
gggcccgcgggaaggagtcg

SEQ ID NO: 285297 - DNA, 20 bp, human
gtggggctaaaccccgtgga

SEQ ID NO: 285298 - DNA, 20 bp, human
gagtactcggtgcggagggg

SEQ ID NO: 285299 - DNA, 20 bp, human
ggccgccgccgtggagtact

SEQ ID NO: 285300 - DNA, 20 bp, human
gtcccccagcgtcgggaaca

SEQ ID NO: 285301 - DNA, 20 bp, human
gggcgcagcagcggctccag

SEQ ID NO: 285302 - DNA, 20 bp, human
ggtggagtactcggtgcgga

SEQ ID NO: 285303 - DNA, 20 bp, human
ggaggggctccggggagctc

SEQ ID NO: 285304 - DNA, 20 bp, human
gtccccccgccagagctctc

SEQ ID NO: 285305 - DNA, 20 bp, human
gtgtctcgctccactctcgg

SEQ ID NO: 285306 - DNA, 20 bp, human
gcgcctgccggcctgagagc

SEQ ID NO: 285307 - DNA, 20 bp, human
gcgtcaggggcatggaggaa

SEQ ID NO: 285308 - DNA, 20 bp, human
gctcaggccggcaggcgaag

SEQ ID NO: 285309 - DNA, 20 bp, human
gaggccggcaggcgaagcgg

SEQ ID NO: 285310 - DNA, 20 bp, human
gcggcctgagagcgggacca

SEQ ID NO: 285311 - DNA, 20 bp, human
ggagcgggaccatggatgaa

SEQ ID NO: 285312 - DNA, 20 bp, human
gcccctgacgccgaggcgtg

SEQ ID NO: 285313 - DNA, 20 bp, human
gcaggggcatggaggaacgg

SEQ ID NO: 285314 - DNA, 20 bp, human
gagtccgcgaaacttccgag

SEQ ID NO: 285315 - DNA, 20 bp, human
gccgccgccgcttcgcctgc

SEQ ID NO: 285316 - DNA, 20 bp, human
ggggcggggcatagagggag

SEQ ID NO: 285317 - DNA, 20 bp, human
ggtgaggggcggggcataga

SEQ ID NO: 285318 - DNA, 20 bp, human
gaaagaaggcggggagagtg

SEQ ID NO: 285319 - DNA, 20 bp, human
gggaggggctatgcgaaaga

SEQ ID NO: 285320 - DNA, 20 bp, human
ggccgcgcgcttccgttcca

SEQ ID NO: 285321 - DNA, 20 bp, human
gcggggcatagagggagggg

SEQ ID NO: 285322 - DNA, 20 bp, human
gtcacgcagcgcgccgtcag

SEQ ID NO: 285323 - DNA, 20 bp, human
gcggcgcgctgcgtgagggg

SEQ ID NO: 285324 - DNA, 20 bp, human
gcctcgaggcccttccggtg

SEQ ID NO: 285325 - DNA, 20 bp, human
gcgggaccgcggggcattat

SEQ ID NO: 285326 - DNA, 20 bp, human
gccgtcccggggcctcggct

SEQ ID NO: 285327 - DNA, 20 bp, human
gggcgcggaccagtcctccg

SEQ ID NO: 285328 - DNA, 20 bp, human
ggggacgcaatgtcaccgag

SEQ ID NO: 285329 - DNA, 20 bp, human
gtgcccgtgcggagcgtttt

SEQ ID NO: 285330 - DNA, 20 bp, human
gagcgcgctgcgttccaggg

SEQ ID NO: 285331 - DNA, 20 bp, human
gccacgggccctcttgagta

SEQ ID NO: 285332 - DNA, 20 bp, human
gaacgcagcaggggtgaccg

SEQ ID NO: 285333 - DNA, 20 bp, human
gcggagccgccttactcaag

SEQ ID NO: 285334 - DNA, 20 bp, human
gcggagcgcgctgcgttcca

SEQ ID NO: 285335 - DNA, 20 bp, human
gctgcgttccagggcggagg

SEQ ID NO: 285336 - DNA, 20 bp, human
gccctgccgccggaccaatg

SEQ ID NO: 285337 - DNA, 20 bp, human
gagggggcgggatcacccga

SEQ ID NO: 285338 - DNA, 20 bp, human
gggccgccggccagatgtgg

SEQ ID NO: 285339 - DNA, 20 bp, human
gagagcggaacttagaaccc

SEQ ID NO: 285340 - DNA, 20 bp, human
gtgggagttgtagtttagaa

SEQ ID NO: 285341 - DNA, 20 bp, human
ggatcacccgaggggaaccc

SEQ ID NO: 285342 - DNA, 20 bp, human
gttagaacccgggttcccct

SEQ ID NO: 285343 - DNA, 20 bp, human
ggcgccgcctcaatgcctcc

SEQ ID NO: 285344 - DNA, 20 bp, human
gctcacgcggtgagtcatat

SEQ ID NO: 285345 - DNA, 20 bp, human
gattggctggggagtcgagg

SEQ ID NO: 285346 - DNA, 20 bp, human
ggactcgggtagggatgctc

SEQ ID NO: 285347 - DNA, 20 bp, human
gagagagaggagtgcatgta

SEQ ID NO: 285348 - DNA, 20 bp, human
ggggaggctggagtagtctc

SEQ ID NO: 285349 - DNA, 20 bp, human
gagtaagatggactcgggta

SEQ ID NO: 285350 - DNA, 20 bp, human
ggccaagctcatgactgtac

SEQ ID NO: 285351 - DNA, 20 bp, human
gtcagagcagcgattggctt

SEQ ID NO: 285352 - DNA, 20 bp, human
gcaggctgccagggacgaat

SEQ ID NO: 285353 - DNA, 20 bp, human
gccctgatgtcacaattcag

SEQ ID NO: 285354 - DNA, 20 bp, human
ggtgacatcagggacggggg

SEQ ID NO: 285355 - DNA, 20 bp, human
gagtgcatgtagggcttctg

SEQ ID NO: 285356 - DNA, 20 bp, human
gcgcccgcgcgggggaccaa

SEQ ID NO: 285357 - DNA, 20 bp, human
gcccggccctggcaccgtga

SEQ ID NO: 285358 - DNA, 20 bp, human
ggggcgcgggtggatctctc

SEQ ID NO: 285359 - DNA, 20 bp, human
ggtcacggcaacgagagggc

SEQ ID NO: 285360 - DNA, 20 bp, human
ggaaagaggcgtcaggtgcc

SEQ ID NO: 285361 - DNA, 20 bp, human
gggcccttggtcccccgcgc

SEQ ID NO: 285362 - DNA, 20 bp, human
gcggttgtcacggcaacgag

SEQ ID NO: 285363 - DNA, 20 bp, human
gcctccgaatcgatcacgtg

SEQ ID NO: 285364 - DNA, 20 bp, human
gtggtcttcgcctcccagca

SEQ ID NO: 285365 - DNA, 20 bp, human
gccccctcacgtgatcgatt

SEQ ID NO: 285366 - DNA, 20 bp, human
gccctggcgcacacacccta

SEQ ID NO: 285367 - DNA, 20 bp, human
gccctcgaccagattcgatt

SEQ ID NO: 285368 - DNA, 20 bp, human
ggggcccgtcggtccagccc

SEQ ID NO: 285369 - DNA, 20 bp, human
gctggcgcagccgaccacgt

SEQ ID NO: 285370 - DNA, 20 bp, human
gggggtgggccataagtaat

SEQ ID NO: 285371 - DNA, 20 bp, human
gcgccgcactcccacgtggt

SEQ ID NO: 285372 - DNA, 20 bp, human
ggcacccgggctggaccgac

SEQ ID NO: 285373 - DNA, 20 bp, human
gtgggagtgcggcgcgtgta

SEQ ID NO: 285374 - DNA, 20 bp, human
gtgtcccgaacaagcgtgag

SEQ ID NO: 285375 - DNA, 20 bp, human
gggccccgggcgtgtgggtg

SEQ ID NO: 285376 - DNA, 20 bp, human
ggaggggaggctttacaagc

SEQ ID NO: 285377 - DNA, 20 bp, human
gagaaggtcagagagacgaa

SEQ ID NO: 285378 - DNA, 20 bp, human
ggggcagctgaaaagaggac

SEQ ID NO: 285379 - DNA, 20 bp, human
ggccttgggcagctgaaaag

SEQ ID NO: 285380 - DNA, 20 bp, human
gaacaaactgtcctggttgc

SEQ ID NO: 285381 - DNA, 20 bp, human
gaggactctaatctgattgt

SEQ ID NO: 285382 - DNA, 20 bp, human
gctgaaaagaggacaggaga

SEQ ID NO: 285383 - DNA, 20 bp, human
gtaatctgattgtgggttgt

SEQ ID NO: 285384 - DNA, 20 bp, human
gtgtcctggttgctggtcag

SEQ ID NO: 285385 - DNA, 20 bp, human
gaggctttacaagcaggtgt

SEQ ID NO: 285386 - DNA, 20 bp, human
gcccagttgaaataactctg

SEQ ID NO: 285387 - DNA, 20 bp, human
gccgctgccgcatgagacgt

SEQ ID NO: 285388 - DNA, 20 bp, human
ggggcggattccgcctgcta

SEQ ID NO: 285389 - DNA, 20 bp, human
ggaatccgccctctggccaa

SEQ ID NO: 285390 - DNA, 20 bp, human
gcagctagagagtagggcga

SEQ ID NO: 285391 - DNA, 20 bp, human
ggcggaaggggcggatgcga

SEQ ID NO: 285392 - DNA, 20 bp, human
gcacgcccccacgtctcatg

SEQ ID NO: 285393 - DNA, 20 bp, human
gcgaggcgaagcggcggaag

SEQ ID NO: 285394 - DNA, 20 bp, human
gggcgcgggcgctcgttgat

SEQ ID NO: 285395 - DNA, 20 bp, human
ggccaaaggactagcgtacc

SEQ ID NO: 285396 - DNA, 20 bp, human
gctagctcagagatctggga

SEQ ID NO: 285397 - DNA, 20 bp, human
ggaactaggaagctttgctc

SEQ ID NO: 285398 - DNA, 20 bp, human
ggcggccacacaccgcgtgg

SEQ ID NO: 285399 - DNA, 20 bp, human
gcttgctagctcagagatct

SEQ ID NO: 285400 - DNA, 20 bp, human
gccagcggaaggaacggttt

SEQ ID NO: 285401 - DNA, 20 bp, human
gcaaggccggctcacgacac

SEQ ID NO: 285402 - DNA, 20 bp, human
ggcagcccccacgcggtgtg

SEQ ID NO: 285403 - DNA, 20 bp, human
gggctgcgcaaagcagaact

SEQ ID NO: 285404 - DNA, 20 bp, human
gcccagcccagcggaaggaa

SEQ ID NO: 285405 - DNA, 20 bp, human
ggtcgtgagccggccttgga

SEQ ID NO: 285406 - DNA, 20 bp, human
gctcactggcggaaccccgg

SEQ ID NO: 285407 - DNA, 20 bp, human
gtggaactggagtcagctaa

SEQ ID NO: 285408 - DNA, 20 bp, human
ggcctcggtggggtgagaca

SEQ ID NO: 285409 - DNA, 20 bp, human
ggagacagggcgctcactgg

SEQ ID NO: 285410 - DNA, 20 bp, human
gaggcgccccggtctctcat

SEQ ID NO: 285411 - DNA, 20 bp, human
gtacgcgcagagggaaagac

SEQ ID NO: 285412 - DNA, 20 bp, human
gccccgggggacgcggtgat

SEQ ID NO: 285413 - DNA, 20 bp, human
gggcgccggccgtgacggtg

SEQ ID NO: 285414 - DNA, 20 bp, human
ggctgacgcactacgcgcag

SEQ ID NO: 285415 - DNA, 20 bp, human
ggctgcagccaatgagagac

SEQ ID NO: 285416 - DNA, 20 bp, human
gggtgtgcccagttgttaat

SEQ ID NO: 285417 - DNA, 20 bp, human
gggaagccagctttggaagc

SEQ ID NO: 285418 - DNA, 20 bp, human
gctgtctacacagagctcta

SEQ ID NO: 285419 - DNA, 20 bp, human
gtgttaatgggactaccaga

SEQ ID NO: 285420 - DNA, 20 bp, human
gtggtagtcccattaacaac

SEQ ID NO: 285421 - DNA, 20 bp, human
gttgtgctcttggcatcact

SEQ ID NO: 285422 - DNA, 20 bp, human
gtagacagtacctcctccct

SEQ ID NO: 285423 - DNA, 20 bp, human
gcctctagaaacaattctag

SEQ ID NO: 285424 - DNA, 20 bp, human
ggcacactctcttgtgctct

SEQ ID NO: 285425 - DNA, 20 bp, human
gccttgttcacgtgttctaa

SEQ ID NO: 285426 - DNA, 20 bp, human
gaggggcagagctggagtcg

SEQ ID NO: 285427 - DNA, 20 bp, human
gccctccactctcagaccga

SEQ ID NO: 285428 - DNA, 20 bp, human
ggccaggaaggctagagacc

SEQ ID NO: 285429 - DNA, 20 bp, human
gacagggggcttggacttat

SEQ ID NO: 285430 - DNA, 20 bp, human
ggatcctggaagtccggcct

SEQ ID NO: 285431 - DNA, 20 bp, human
gtcggggggcgttgccagga

SEQ ID NO: 285432 - DNA, 20 bp, human
gctggaagtccggcctcggg

SEQ ID NO: 285433 - DNA, 20 bp, human
gactctcagaccgagggatc

SEQ ID NO: 285434 - DNA, 20 bp, human
ggatagagaacctgatccct

SEQ ID NO: 285435 - DNA, 20 bp, human
gtggcaacgccccccgaggc

SEQ ID NO: 285436 - DNA, 20 bp, human
gggggcgagagcggtcaaat

SEQ ID NO: 285437 - DNA, 20 bp, human
gcatgtgttgtgtatgcagg

SEQ ID NO: 285438 - DNA, 20 bp, human
gaacagagagtcaagaaggg

SEQ ID NO: 285439 - DNA, 20 bp, human
ggagagggatatgaaagtag

SEQ ID NO: 285440 - DNA, 20 bp, human
gctctggagcgatgactaac

SEQ ID NO: 285441 - DNA, 20 bp, human
ggtgttgtgtatgcaggggg

SEQ ID NO: 285442 - DNA, 20 bp, human
gtgctcagttgaaaggggct

SEQ ID NO: 285443 - DNA, 20 bp, human
gaagctatggaccagatcag

SEQ ID NO: 285444 - DNA, 20 bp, human
gaatctatgctcagttgaaa

SEQ ID NO: 285445 - DNA, 20 bp, human
gtgtaggagtcctgaagcta

SEQ ID NO: 285446 - DNA, 20 bp, human
ggagctggtgaaaaagtaaa

SEQ ID NO: 285447 - DNA, 20 bp, human
gctggtgaaaaagtaaaagg

SEQ ID NO: 285448 - DNA, 20 bp, human
gagaggggactccacctggt

SEQ ID NO: 285449 - DNA, 20 bp, human
gaattcagggagagaactgt

SEQ ID NO: 285450 - DNA, 20 bp, human
gactcacaggcctttgaata

SEQ ID NO: 285451 - DNA, 20 bp, human
ggacgtgttccatcaagtca

SEQ ID NO: 285452 - DNA, 20 bp, human
gttcaagaggggactccacc

SEQ ID NO: 285453 - DNA, 20 bp, human
gaaggcttttgttactgtgg

SEQ ID NO: 285454 - DNA, 20 bp, human
gttcctaatgccttcaagag

SEQ ID NO: 285455 - DNA, 20 bp, human
gaagtaaaaggtggacatga

SEQ ID NO: 285456 - DNA, 20 bp, human
gcgcagaaatggcccctgga

SEQ ID NO: 285457 - DNA, 20 bp, human
gcgcggctcccttggaatcc

SEQ ID NO: 285458 - DNA, 20 bp, human
gtaagagtgactccactcgc

SEQ ID NO: 285459 - DNA, 20 bp, human
gaatggcgggggcgggacga

SEQ ID NO: 285460 - DNA, 20 bp, human
gccgactgcgggacaggagg

SEQ ID NO: 285461 - DNA, 20 bp, human
gtggacgccgactgcgggac

SEQ ID NO: 285462 - DNA, 20 bp, human
gtgacttgccgatttctggt

SEQ ID NO: 285463 - DNA, 20 bp, human
ggaggaggcggggaatggcg

SEQ ID NO: 285464 - DNA, 20 bp, human
gggaaggaaagtccccctta

SEQ ID NO: 285465 - DNA, 20 bp, human
gtggaagcccctcaaggata

SEQ ID NO: 285466 - DNA, 20 bp, human
gaggagcatacaagactctc

SEQ ID NO: 285467 - DNA, 20 bp, human
gcatacaagactctctggtc

SEQ ID NO: 285468 - DNA, 20 bp, human
ggctgcttcactccctcata

SEQ ID NO: 285469 - DNA, 20 bp, human
ggactcttaccacaagaggg

SEQ ID NO: 285470 - DNA, 20 bp, human
gataagagcaatgcagaggt

SEQ ID NO: 285471 - DNA, 20 bp, human
gcactggtgagaaccctatg

SEQ ID NO: 285472 - DNA, 20 bp, human
gcctggactcttaccacaag

SEQ ID NO: 285473 - DNA, 20 bp, human
gtgttataagagcaatgcag

SEQ ID NO: 285474 - DNA, 20 bp, human
gttataacacctccctcttg

SEQ ID NO: 285475 - DNA, 20 bp, human
ggtctcagtaattaaataga

SEQ ID NO: 285476 - DNA, 20 bp, human
gtgtttcccagctgtatgtc

SEQ ID NO: 285477 - DNA, 20 bp, human
ggagcacctgacatacagct

SEQ ID NO: 285478 - DNA, 20 bp, human
gttagaataccataaaaaac

SEQ ID NO: 285479 - DNA, 20 bp, human
ggtgctctgaccagtaggtt

SEQ ID NO: 285480 - DNA, 20 bp, human
gcagacaactaatgtttcct

SEQ ID NO: 285481 - DNA, 20 bp, human
gtcgttactcattagtgtag

SEQ ID NO: 285482 - DNA, 20 bp, human
gtggggggatgaaaggtaag

SEQ ID NO: 285483 - DNA, 20 bp, human
gcaggagaattcttatttat

SEQ ID NO: 285484 - DNA, 20 bp, human
gtcaaaatgttcttgctaat

SEQ ID NO: 285485 - DNA, 20 bp, human
gtgagtaacgagaatctccc

SEQ ID NO: 285486 - DNA, 20 bp, human
gacagacacctgcgcctagg

SEQ ID NO: 285487 - DNA, 20 bp, human
gtctcgctccgcctaggcgc

SEQ ID NO: 285488 - DNA, 20 bp, human
ggtgacagacacctgcgcct

SEQ ID NO: 285489 - DNA, 20 bp, human
ggagattggcacttctttgc

SEQ ID NO: 285490 - DNA, 20 bp, human
gcaaaccttttctctaaaat

SEQ ID NO: 285491 - DNA, 20 bp, human
gtccgagggcagggaacggt

SEQ ID NO: 285492 - DNA, 20 bp, human
gtcacccgacgccgtctccg

SEQ ID NO: 285493 - DNA, 20 bp, human
gagacggcgtcgggtgagat

SEQ ID NO: 285494 - DNA, 20 bp, human
gctgccctcggagacggcgt

SEQ ID NO: 285495 - DNA, 20 bp, human
gttggcggactgagattgga

SEQ ID NO: 285496 - DNA, 20 bp, human
gacaaagactgcatgtgggg

SEQ ID NO: 285497 - DNA, 20 bp, human
ggccacgccccctcggtggg

SEQ ID NO: 285498 - DNA, 20 bp, human
gggccgacctcccaccgagg

SEQ ID NO: 285499 - DNA, 20 bp, human
gcgggtgtggagaagacaag

SEQ ID NO: 285500 - DNA, 20 bp, human
ggcaggccgacctcccaccg

SEQ ID NO: 285501 - DNA, 20 bp, human
gcatctgcggccaccagcgc

SEQ ID NO: 285502 - DNA, 20 bp, human
gactgctgcttaggggcccc

SEQ ID NO: 285503 - DNA, 20 bp, human
ggcccgacactgctgcttag

SEQ ID NO: 285504 - DNA, 20 bp, human
gggtggccgcagatggccta

SEQ ID NO: 285505 - DNA, 20 bp, human
gtgcttaggggccccgggtg

SEQ ID NO: 285506 - DNA, 20 bp, human
gtctgagataaggatcccat

SEQ ID NO: 285507 - DNA, 20 bp, human
gggagagagcaatgagtaca

SEQ ID NO: 285508 - DNA, 20 bp, human
gccacactgcagcattagga

SEQ ID NO: 285509 - DNA, 20 bp, human
gcaggggcaaatgaccattg

SEQ ID NO: 285510 - DNA, 20 bp, human
ggatcaaagtgataagggtt

SEQ ID NO: 285511 - DNA, 20 bp, human
gtgtgaacttaaactagacc

SEQ ID NO: 285512 - DNA, 20 bp, human
ggagataaggatcccatagg

SEQ ID NO: 285513 - DNA, 20 bp, human
gtgcacttgcagatttctcc

SEQ ID NO: 285514 - DNA, 20 bp, human
ggttcagtaaatccatctgg

SEQ ID NO: 285515 - DNA, 20 bp, human
gcccttatcactttgatctc

SEQ ID NO: 285516 - DNA, 20 bp, human
gcaggagttcaaggtaataa

SEQ ID NO: 285517 - DNA, 20 bp, human
gctctcagagagttgataat

SEQ ID NO: 285518 - DNA, 20 bp, human
gcaggtggatttactgtaca

SEQ ID NO: 285519 - DNA, 20 bp, human
gcacactgtggccttaagat

SEQ ID NO: 285520 - DNA, 20 bp, human
ggagagctctgggttcctaa

SEQ ID NO: 285521 - DNA, 20 bp, human
gacagtgtgataaagagtct

SEQ ID NO: 285522 - DNA, 20 bp, human
gtgtgaacttaaaccaaact

SEQ ID NO: 285523 - DNA, 20 bp, human
gaaatagatctccctccagg

SEQ ID NO: 285524 - DNA, 20 bp, human
gactgaccagtgttctgtta

SEQ ID NO: 285525 - DNA, 20 bp, human
gattctgagaaaagggattc

SEQ ID NO: 285526 - DNA, 20 bp, human
ggtccagcggagaacttggt

SEQ ID NO: 285527 - DNA, 20 bp, human
gaggcctgaggtcacactgt

SEQ ID NO: 285528 - DNA, 20 bp, human
gctgggtccagcggagaact

SEQ ID NO: 285529 - DNA, 20 bp, human
gtgtgggatgaggtcaccgc

SEQ ID NO: 285530 - DNA, 20 bp, human
gcactggcatctgggtccag

SEQ ID NO: 285531 - DNA, 20 bp, human
ggccttggggcaagagtggt

SEQ ID NO: 285532 - DNA, 20 bp, human
ggaagctcgaacttgcagag

SEQ ID NO: 285533 - DNA, 20 bp, human
gtccccaccaagttctccgc

SEQ ID NO: 285534 - DNA, 20 bp, human
gccagcggaaggacggtgtg

SEQ ID NO: 285535 - DNA, 20 bp, human
gaacttgcagagtgggctga

SEQ ID NO: 285536 - DNA, 20 bp, human
gaaggaaagagggtactctc

SEQ ID NO: 285537 - DNA, 20 bp, human
gcgttgggctgtaaagacta

SEQ ID NO: 285538 - DNA, 20 bp, human
ggggcgaccggggaagcgtt

SEQ ID NO: 285539 - DNA, 20 bp, human
ggtaaagactagggcgccag

SEQ ID NO: 285540 - DNA, 20 bp, human
gcacctgtcgcaggctccga

SEQ ID NO: 285541 - DNA, 20 bp, human
gtgcgcacgcgcactcggga

SEQ ID NO: 285542 - DNA, 20 bp, human
gccgcccccggcgcgtacgc

SEQ ID NO: 285543 - DNA, 20 bp, human
gacgcgcactcgggacggac

SEQ ID NO: 285544 - DNA, 20 bp, human
gggggggcccaggttcgcgg

SEQ ID NO: 285545 - DNA, 20 bp, human
gttacagcccaacgcttccc

SEQ ID NO: 285546 - DNA, 20 bp, human
ggagcctgcaatcagggacc

SEQ ID NO: 285547 - DNA, 20 bp, human
gatcagggaccaggcttggg

SEQ ID NO: 285548 - DNA, 20 bp, human
gtggtcgtacggtgacaatc

SEQ ID NO: 285549 - DNA, 20 bp, human
gcgcggagagcctgcaatca

SEQ ID NO: 285550 - DNA, 20 bp, human
gtctccgcgcaggcgctttg

SEQ ID NO: 285551 - DNA, 20 bp, human
gggcttgggaggcgacgaag

SEQ ID NO: 285552 - DNA, 20 bp, human
ggcaatcagggaccaggctt

SEQ ID NO: 285553 - DNA, 20 bp, human
gtcaccgtacgaccagtgag

SEQ ID NO: 285554 - DNA, 20 bp, human
gaggcgacgaagaggaacgc

SEQ ID NO: 285555 - DNA, 20 bp, human
gagggaaaaggtggacgtag

SEQ ID NO: 285556 - DNA, 20 bp, human
gccagcccggccccgattgg

SEQ ID NO: 285557 - DNA, 20 bp, human
ggcccggtcgctgtcggaag

SEQ ID NO: 285558 - DNA, 20 bp, human
gaccgggccgcgtgcgcagg

SEQ ID NO: 285559 - DNA, 20 bp, human
gcacgcggcccggtcgctgt

SEQ ID NO: 285560 - DNA, 20 bp, human
ggccccgattggcgggtgga

SEQ ID NO: 285561 - DNA, 20 bp, human
ggggtgggaccaacacgcgc

SEQ ID NO: 285562 - DNA, 20 bp, human
gtcctcctgcgcacgcggcc

SEQ ID NO: 285563 - DNA, 20 bp, human
ggtggggcatggcgggttcg

SEQ ID NO: 285564 - DNA, 20 bp, human
ggccgcttccgacagcgacc

SEQ ID NO: 285565 - DNA, 20 bp, human
gggcctgcgtgctcgcgccg

SEQ ID NO: 285566 - DNA, 20 bp, human
gggctgctgctgacatgaag

SEQ ID NO: 285567 - DNA, 20 bp, human
ggattggccagggacgggac

SEQ ID NO: 285568 - DNA, 20 bp, human
ggaaccactgcgcgcacagg

SEQ ID NO: 285569 - DNA, 20 bp, human
gcacgacagagaaaagcgat

SEQ ID NO: 285570 - DNA, 20 bp, human
ggctccgcctgtgcgcgcag

SEQ ID NO: 285571 - DNA, 20 bp, human
ggccgggcggccgcacgtga

SEQ ID NO: 285572 - DNA, 20 bp, human
ggagacttgtccgtcacgtg

SEQ ID NO: 285573 - DNA, 20 bp, human
gtgcagtcggctcctgggat

SEQ ID NO: 285574 - DNA, 20 bp, human
ggcggaaccactgcgcgcac

SEQ ID NO: 285575 - DNA, 20 bp, human
gctgctgacatgaagggggt

SEQ ID NO: 285576 - DNA, 20 bp, human
gcgggccgcgactgcacaga

SEQ ID NO: 285577 - DNA, 20 bp, human
ggcgcccgctggagcatccc

SEQ ID NO: 285578 - DNA, 20 bp, human
gcggccggggatgctccagc

SEQ ID NO: 285579 - DNA, 20 bp, human
gcgggctgatggcgtcacaa

SEQ ID NO: 285580 - DNA, 20 bp, human
ggggcaaattggatctcggc

SEQ ID NO: 285581 - DNA, 20 bp, human
gggctggcgtccagcgagaa

SEQ ID NO: 285582 - DNA, 20 bp, human
gctggctgcagcggcaccgc

SEQ ID NO: 285583 - DNA, 20 bp, human
ggccgcgactgcacagaagg

SEQ ID NO: 285584 - DNA, 20 bp, human
gcgctgggcaaattggatct

SEQ ID NO: 285585 - DNA, 20 bp, human
gagggccccggcacggaatg

SEQ ID NO: 285586 - DNA, 20 bp, human
gccttggcgaggtccctctt

SEQ ID NO: 285587 - DNA, 20 bp, human
gaggccactcctcgctctct

SEQ ID NO: 285588 - DNA, 20 bp, human
ggggaacgaatccacgccgg

SEQ ID NO: 285589 - DNA, 20 bp, human
gggcgaggaatgctacacta

SEQ ID NO: 285590 - DNA, 20 bp, human
gtacttgacacttacatcag

SEQ ID NO: 285591 - DNA, 20 bp, human
gagggggactgcgttcaaat

SEQ ID NO: 285592 - DNA, 20 bp, human
ggcgaggagtggccttggcg

SEQ ID NO: 285593 - DNA, 20 bp, human
gggtcctttcctgtttggcg

SEQ ID NO: 285594 - DNA, 20 bp, human
gagaatttgcgcagtattct

SEQ ID NO: 285595 - DNA, 20 bp, human
ggaggaatgctacactaagg

SEQ ID NO: 285596 - DNA, 20 bp, human
gcagaaaaggctggctggat

SEQ ID NO: 285597 - DNA, 20 bp, human
gcggggcggggctcggacag

SEQ ID NO: 285598 - DNA, 20 bp, human
gctggatgggatgtgtggag

SEQ ID NO: 285599 - DNA, 20 bp, human
gggggtggggtgagatgagt

SEQ ID NO: 285600 - DNA, 20 bp, human
gcagcggccgaggcaccagc

SEQ ID NO: 285601 - DNA, 20 bp, human
gcacgtgcaagcccgcgggg

SEQ ID NO: 285602 - DNA, 20 bp, human
ggggccacgtgcaagcccgc

SEQ ID NO: 285603 - DNA, 20 bp, human
gggaaatagagggaccgaga

SEQ ID NO: 285604 - DNA, 20 bp, human
gggggctcggacagcggccg

SEQ ID NO: 285605 - DNA, 20 bp, human
gccggtgcgcgacctggtgt

SEQ ID NO: 285606 - DNA, 20 bp, human
gtctgggaacgcctggggaa

SEQ ID NO: 285607 - DNA, 20 bp, human
gtgaagtctgggaacgcctg

SEQ ID NO: 285608 - DNA, 20 bp, human
gcgttcccagacttcaggcc

SEQ ID NO: 285609 - DNA, 20 bp, human
gcctcccagcgcggccaatg

SEQ ID NO: 285610 - DNA, 20 bp, human
ggcctcttggtattccacgg

SEQ ID NO: 285611 - DNA, 20 bp, human
gcccagacttcaggccggga

SEQ ID NO: 285612 - DNA, 20 bp, human
gcagccaactagtggagact

SEQ ID NO: 285613 - DNA, 20 bp, human
ggtgggcacctccccctcgg

SEQ ID NO: 285614 - DNA, 20 bp, human
gccgggaaggctgtctgccg

SEQ ID NO: 285615 - DNA, 20 bp, human
ggtcaggacttagaacaccc

SEQ ID NO: 285616 - DNA, 20 bp, human
gaggagacagaggccgagag

SEQ ID NO: 285617 - DNA, 20 bp, human
gtgctactactcttatcccc

SEQ ID NO: 285618 - DNA, 20 bp, human
gtactactcttatccccggg

SEQ ID NO: 285619 - DNA, 20 bp, human
gcagacacccggggtgtaga

SEQ ID NO: 285620 - DNA, 20 bp, human
gcagaggtggccctgtgtgt

SEQ ID NO: 285621 - DNA, 20 bp, human
gtctctggagacactggcca

SEQ ID NO: 285622 - DNA, 20 bp, human
ggaaaacaaaacatgctcga

SEQ ID NO: 285623 - DNA, 20 bp, human
gatgtgaccgcagacacccg

SEQ ID NO: 285624 - DNA, 20 bp, human
gtgctaggaggtcacgggag

SEQ ID NO: 285625 - DNA, 20 bp, human
ggtgcccagaatcgagtcgg

SEQ ID NO: 285626 - DNA, 20 bp, human
gaggagacagaggccgagag

SEQ ID NO: 285627 - DNA, 20 bp, human
gtgctactactcttatcccc

SEQ ID NO: 285628 - DNA, 20 bp, human
gtactactcttatccccggg

SEQ ID NO: 285629 - DNA, 20 bp, human
gcagaggtggccctgtgtgt

SEQ ID NO: 285630 - DNA, 20 bp, human
gcagacacccggggtgtaga

SEQ ID NO: 285631 - DNA, 20 bp, human
gtctctggagacactggcca

SEQ ID NO: 285632 - DNA, 20 bp, human
ggaaaacaaaacatgctcga

SEQ ID NO: 285633 - DNA, 20 bp, human
ggtgcccagaatcgagtcgg

SEQ ID NO: 285634 - DNA, 20 bp, human
gccaaggcgcactggctcag

SEQ ID NO: 285635 - DNA, 20 bp, human
gtctccagagaaacgcacgt

SEQ ID NO: 285636 - DNA, 20 bp, human
gttgggcaatagaaatattt

SEQ ID NO: 285637 - DNA, 20 bp, human
ggagataaaaggtaggttac

SEQ ID NO: 285638 - DNA, 20 bp, human
gaacaaaattctagcccaaa

SEQ ID NO: 285639 - DNA, 20 bp, human
gtagttataatgagtgtgtc

SEQ ID NO: 285640 - DNA, 20 bp, human
gggtaggttacgggttgtca

SEQ ID NO: 285641 - DNA, 20 bp, human
ggaacattggatttatttca

SEQ ID NO: 285642 - DNA, 20 bp, human
ggattgggaaggaaaccctt

SEQ ID NO: 285643 - DNA, 20 bp, human
gaatgattttaaaactagtt

SEQ ID NO: 285644 - DNA, 20 bp, human
gggccatagagataaaaggt

SEQ ID NO: 285645 - DNA, 20 bp, human
gacatggccatagagataaa

SEQ ID NO: 285646 - DNA, 20 bp, human
gttgggcaatagaaatattt

SEQ ID NO: 285647 - DNA, 20 bp, human
ggagataaaaggtaggttac

SEQ ID NO: 285648 - DNA, 20 bp, human
gaacaaaattctagcccaaa

SEQ ID NO: 285649 - DNA, 20 bp, human
gtagttataatgagtgtgtc

SEQ ID NO: 285650 - DNA, 20 bp, human
gggtaggttacgggttgtca

SEQ ID NO: 285651 - DNA, 20 bp, human
ggaacattggatttatttca

SEQ ID NO: 285652 - DNA, 20 bp, human
ggattgggaaggaaaccctt

SEQ ID NO: 285653 - DNA, 20 bp, human
gaatgattttaaaactagtt

SEQ ID NO: 285654 - DNA, 20 bp, human
gggccatagagataaaaggt

SEQ ID NO: 285655 - DNA, 20 bp, human
gacatggccatagagataaa

SEQ ID NO: 285656 - DNA, 20 bp, human
ggagccctgggggcggaaca

SEQ ID NO: 285657 - DNA, 20 bp, human
gtctgcacgtcaatggggcg

SEQ ID NO: 285658 - DNA, 20 bp, human
ggtgacacggagacaggtgc

SEQ ID NO: 285659 - DNA, 20 bp, human
gtcaagcaggtgagccctgg

SEQ ID NO: 285660 - DNA, 20 bp, human
ggtggcaccagatgctttgt

SEQ ID NO: 285661 - DNA, 20 bp, human
gtgtccttgttccgccccca

SEQ ID NO: 285662 - DNA, 20 bp, human
gctttgttggactgcagaca

SEQ ID NO: 285663 - DNA, 20 bp, human
gtatagatgccaggagtcag

SEQ ID NO: 285664 - DNA, 20 bp, human
gcaaggtctgcacgtcaatg

SEQ ID NO: 285665 - DNA, 20 bp, human
ggctcaataacaacttgctg

SEQ ID NO: 285666 - DNA, 20 bp, human
gcgcggcggcgattgaggga

SEQ ID NO: 285667 - DNA, 20 bp, human
gcgattgagggaaggttgcc

SEQ ID NO: 285668 - DNA, 20 bp, human
gggcgcgcggcggcgattga

SEQ ID NO: 285669 - DNA, 20 bp, human
ggggcggggtgccgcggcaa

SEQ ID NO: 285670 - DNA, 20 bp, human
gcggctggggagggttcttc

SEQ ID NO: 285671 - DNA, 20 bp, human
gtacgcatgcgccgttgccg

SEQ ID NO: 285672 - DNA, 20 bp, human
gcggcccggaattctcggga

SEQ ID NO: 285673 - DNA, 20 bp, human
gccgcccccgcgccttcctg

SEQ ID NO: 285674 - DNA, 20 bp, human
gtggggagggttcttccgga

SEQ ID NO: 285675 - DNA, 20 bp, human
gccgggccgggccacgagca

SEQ ID NO: 285676 - DNA, 20 bp, human
gtgatcacaagcaaatgtgt

SEQ ID NO: 285677 - DNA, 20 bp, human
gcggaccatgacgtcaaggt

SEQ ID NO: 285678 - DNA, 20 bp, human
gtgtgggcggatccgttgct

SEQ ID NO: 285679 - DNA, 20 bp, human
gttaaggcggagggatctac

SEQ ID NO: 285680 - DNA, 20 bp, human
gaggcggagggatctacagg

SEQ ID NO: 285681 - DNA, 20 bp, human
gtcatggtccgaaaaaaaga

SEQ ID NO: 285682 - DNA, 20 bp, human
gtcgggacgcgagatgtgta

SEQ ID NO: 285683 - DNA, 20 bp, human
ggtcctagacgtgaaactat

SEQ ID NO: 285684 - DNA, 20 bp, human
gtccatcaagagcggggatg

SEQ ID NO: 285685 - DNA, 20 bp, human
gccagcccaccttgacgtca

SEQ ID NO: 285686 - DNA, 20 bp, human
gaatcggagctgtccaggtg

SEQ ID NO: 285687 - DNA, 20 bp, human
ggggcggtcccacgtgtgag

SEQ ID NO: 285688 - DNA, 20 bp, human
gccaccaatcggagctgtcc

SEQ ID NO: 285689 - DNA, 20 bp, human
gggctccttccgattggtca

SEQ ID NO: 285690 - DNA, 20 bp, human
ggtgaccgatgcccgaagcg

SEQ ID NO: 285691 - DNA, 20 bp, human
gggggcggaagtccaccaat

SEQ ID NO: 285692 - DNA, 20 bp, human
ggcacccacggcacccaatg

SEQ ID NO: 285693 - DNA, 20 bp, human
gcacccaatgaggattcgtg

SEQ ID NO: 285694 - DNA, 20 bp, human
ggcgccgcaccacgcaccca

SEQ ID NO: 285695 - DNA, 20 bp, human
gccccctcacgaatcctcat

SEQ ID NO: 285696 - DNA, 20 bp, human
gggccgggaaaggtcgggga

SEQ ID NO: 285697 - DNA, 20 bp, human
gtcggcgggccgctctgggc

SEQ ID NO: 285698 - DNA, 20 bp, human
gcgggaaaggtcggggaagg

SEQ ID NO: 285699 - DNA, 20 bp, human
ggggccggccgggaaaggtc

SEQ ID NO: 285700 - DNA, 20 bp, human
ggggcctcggcgggccgctc

SEQ ID NO: 285701 - DNA, 20 bp, human
gcccccgccgcggtcgactg

SEQ ID NO: 285702 - DNA, 20 bp, human
gcgcgccactacccccgccg

SEQ ID NO: 285703 - DNA, 20 bp, human
gcggccggcccgagctcgga

SEQ ID NO: 285704 - DNA, 20 bp, human
gaccgctcggtcccgaagcc

SEQ ID NO: 285705 - DNA, 20 bp, human
ggcggggaactgcctggctc

SEQ ID NO: 285706 - DNA, 20 bp, human
ggcccaacagcggaggggga

SEQ ID NO: 285707 - DNA, 20 bp, human
gcctgcgcgggcctccgccg

SEQ ID NO: 285708 - DNA, 20 bp, human
gctcccggcccagatgtgcg

SEQ ID NO: 285709 - DNA, 20 bp, human
gtgggctgctaggggagcgg

SEQ ID NO: 285710 - DNA, 20 bp, human
gagggccgggcgcacgtcga

SEQ ID NO: 285711 - DNA, 20 bp, human
gcagcctggtcccgcgtcca

SEQ ID NO: 285712 - DNA, 20 bp, human
gcggcctcgcacatctgggc

SEQ ID NO: 285713 - DNA, 20 bp, human
gcagatgtgcgaggccgggg

SEQ ID NO: 285714 - DNA, 20 bp, human
ggaccgcaggaggccgacca

SEQ ID NO: 285715 - DNA, 20 bp, human
gccaccccctgggctgctag

SEQ ID NO: 285716 - DNA, 20 bp, human
gactggcagcggttgaatgg

SEQ ID NO: 285717 - DNA, 20 bp, human
ggtcactggcagcggttgaa

SEQ ID NO: 285718 - DNA, 20 bp, human
gactcagtcgtcactggcag

SEQ ID NO: 285719 - DNA, 20 bp, human
ggcaggaccagtgagactga

SEQ ID NO: 285720 - DNA, 20 bp, human
ggtcccgcgatcctacttga

SEQ ID NO: 285721 - DNA, 20 bp, human
gctgccggccgttgcgtgga

SEQ ID NO: 285722 - DNA, 20 bp, human
gtcctccccctcagtctcac

SEQ ID NO: 285723 - DNA, 20 bp, human
gccctcccgcggaaagagaa

SEQ ID NO: 285724 - DNA, 20 bp, human
ggagtcccccttccacgcaa

SEQ ID NO: 285725 - DNA, 20 bp, human
gagggggactcagtcgtcac

SEQ ID NO: 285726 - DNA, 20 bp, human
gtgcgcacgcgcaaccgggg

SEQ ID NO: 285727 - DNA, 20 bp, human
gcgcgcaaccggggagggac

SEQ ID NO: 285728 - DNA, 20 bp, human
ggcgcactgtgcagtttccg

SEQ ID NO: 285729 - DNA, 20 bp, human
ggcggactgcgcgtgaagaa

SEQ ID NO: 285730 - DNA, 20 bp, human
gctcaaggaagggataggaa

SEQ ID NO: 285731 - DNA, 20 bp, human
ggacgcgctgaagctactcg

SEQ ID NO: 285732 - DNA, 20 bp, human
ggactgcgcgtgaagaaagg

SEQ ID NO: 285733 - DNA, 20 bp, human
gcagtgcgcacgcgcaaccg

SEQ ID NO: 285734 - DNA, 20 bp, human
gtcgccgccaatcagcgtga

SEQ ID NO: 285735 - DNA, 20 bp, human
ggaaccttcacgctgattgg

SEQ ID NO: 285736 - DNA, 20 bp, human
gccgacccttcctgtcaatt

SEQ ID NO: 285737 - DNA, 20 bp, human
gcccctgcccacaactgcgc

SEQ ID NO: 285738 - DNA, 20 bp, human
ggttacgcgcgtccagggga

SEQ ID NO: 285739 - DNA, 20 bp, human
ggctgggcttttaattgtgg

SEQ ID NO: 285740 - DNA, 20 bp, human
gagcgggttacgcgcgtcca

SEQ ID NO: 285741 - DNA, 20 bp, human
gttaggcgctgaagcgcagg

SEQ ID NO: 285742 - DNA, 20 bp, human
gagcgcctaattgacaggaa

SEQ ID NO: 285743 - DNA, 20 bp, human
ggacaggaagggtcggcgct

SEQ ID NO: 285744 - DNA, 20 bp, human
ggcttcagcgcctaattgac

SEQ ID NO: 285745 - DNA, 20 bp, human
gtgacgacttataaaagccc

SEQ ID NO: 285746 - DNA, 20 bp, human
gcttccttggaccaatcaga

SEQ ID NO: 285747 - DNA, 20 bp, human
ggacaggaagggcccgctct

SEQ ID NO: 285748 - DNA, 20 bp, human
gtgggcggtgcgagattggt

SEQ ID NO: 285749 - DNA, 20 bp, human
gttggaccaatcagagggca

SEQ ID NO: 285750 - DNA, 20 bp, human
ggctctgggcggtgcgagat

SEQ ID NO: 285751 - DNA, 20 bp, human
ggcggtgcatcgatgtgcct

SEQ ID NO: 285752 - DNA, 20 bp, human
gtggccgcctgcccttcagt

SEQ ID NO: 285753 - DNA, 20 bp, human
gggactgtgtctgtgaagga

SEQ ID NO: 285754 - DNA, 20 bp, human
gagtaggtaattgacaggaa

SEQ ID NO: 285755 - DNA, 20 bp, human
gcaggtcgggaatattccag

SEQ ID NO: 285756 - DNA, 20 bp, human
gccgacccttcctgtcaatt

SEQ ID NO: 285757 - DNA, 20 bp, human
gcccctgcccacaactgcgc

SEQ ID NO: 285758 - DNA, 20 bp, human
ggttacgcgcgtccagggga

SEQ ID NO: 285759 - DNA, 20 bp, human
ggctgggcttttaattgtgg

SEQ ID NO: 285760 - DNA, 20 bp, human
gagcgggttacgcgcgtcca

SEQ ID NO: 285761 - DNA, 20 bp, human
gttaggcgctgaagcgcagg

SEQ ID NO: 285762 - DNA, 20 bp, human
gagcgcctaattgacaggaa

SEQ ID NO: 285763 - DNA, 20 bp, human
ggacaggaagggtcggcgct

SEQ ID NO: 285764 - DNA, 20 bp, human
ggcttcagcgcctaattgac

SEQ ID NO: 285765 - DNA, 20 bp, human
gtgacgacttataaaagccc

SEQ ID NO: 285766 - DNA, 20 bp, human
gcttccttggaccaatcaga

SEQ ID NO: 285767 - DNA, 20 bp, human
ggacaggaagggcccgctct

SEQ ID NO: 285768 - DNA, 20 bp, human
gtgggcggtgcgagattggt

SEQ ID NO: 285769 - DNA, 20 bp, human
gttggaccaatcagagggca

SEQ ID NO: 285770 - DNA, 20 bp, human
ggctctgggcggtgcgagat

SEQ ID NO: 285771 - DNA, 20 bp, human
ggcggtgcatcgatgtgcct

SEQ ID NO: 285772 - DNA, 20 bp, human
gtggccgcctgcccttcagt

SEQ ID NO: 285773 - DNA, 20 bp, human
gggactgtgtctgtgaagga

SEQ ID NO: 285774 - DNA, 20 bp, human
gagtaggtaattgacaggaa

SEQ ID NO: 285775 - DNA, 20 bp, human
gcaggtcgggaatattccag

SEQ ID NO: 285776 - DNA, 20 bp, human
ggggcaagcggtccggataa

SEQ ID NO: 285777 - DNA, 20 bp, human
gagcccaggggcaagcggtc

SEQ ID NO: 285778 - DNA, 20 bp, human
gtcactctcgaaaaaggtag

SEQ ID NO: 285779 - DNA, 20 bp, human
gcctcaggctagccgttatc

SEQ ID NO: 285780 - DNA, 20 bp, human
gcgggagtcactctcgaaaa

SEQ ID NO: 285781 - DNA, 20 bp, human
gagtgactcccgttgtccca

SEQ ID NO: 285782 - DNA, 20 bp, human
gataaaagcccaggggcaag

SEQ ID NO: 285783 - DNA, 20 bp, human
gatccggaccgcttgcccct

SEQ ID NO: 285784 - DNA, 20 bp, human
gtgacgacttataaaagccc

SEQ ID NO: 285785 - DNA, 20 bp, human
gccgacagagagcagggaac

SEQ ID NO: 285786 - DNA, 20 bp, human
gccgtccaaggggagggaat

SEQ ID NO: 285787 - DNA, 20 bp, human
ggcctggcggccgagagtca

SEQ ID NO: 285788 - DNA, 20 bp, human
ggacccaacagatttcaagt

SEQ ID NO: 285789 - DNA, 20 bp, human
gtggcggccgagagtcaggg

SEQ ID NO: 285790 - DNA, 20 bp, human
gttgcctaggtcggagtgac

SEQ ID NO: 285791 - DNA, 20 bp, human
gttgaaatctgttgggtcac

SEQ ID NO: 285792 - DNA, 20 bp, human
gcggggaggaggcgtggaag

SEQ ID NO: 285793 - DNA, 20 bp, human
ggcgaggcaccacggcctgg

SEQ ID NO: 285794 - DNA, 20 bp, human
gctgccaatccgatgcacgt

SEQ ID NO: 285795 - DNA, 20 bp, human
gggcggccgttatgtaaatg

SEQ ID NO: 285796 - DNA, 20 bp, human
gcgtcctggctcgagaacct

SEQ ID NO: 285797 - DNA, 20 bp, human
gtctcgcgatatcccggctc

SEQ ID NO: 285798 - DNA, 20 bp, human
gaggggaaaagcgcctgagc

SEQ ID NO: 285799 - DNA, 20 bp, human
gcaccagagctacgaaagaa

SEQ ID NO: 285800 - DNA, 20 bp, human
gtattcagacgtactggggg

SEQ ID NO: 285801 - DNA, 20 bp, human
ggacgtattcagacgtactg

SEQ ID NO: 285802 - DNA, 20 bp, human
gagctcgaggcactatactg

SEQ ID NO: 285803 - DNA, 20 bp, human
gggatgttctcgcgatatcc

SEQ ID NO: 285804 - DNA, 20 bp, human
gcgccgcaggttccatgcgc

SEQ ID NO: 285805 - DNA, 20 bp, human
gagcctgcgcatggaacctg

SEQ ID NO: 285806 - DNA, 20 bp, human
gtccgtcagcactcgggcaa

SEQ ID NO: 285807 - DNA, 20 bp, human
gctcgaacccgcagcttctt

SEQ ID NO: 285808 - DNA, 20 bp, human
gcagctccgggcccggactt

SEQ ID NO: 285809 - DNA, 20 bp, human
gccgcgcccgagccagctcc

SEQ ID NO: 285810 - DNA, 20 bp, human
ggacggaagcggccgaagtc

SEQ ID NO: 285811 - DNA, 20 bp, human
gggcggggcggggaggatcg

SEQ ID NO: 285812 - DNA, 20 bp, human
gtatccgggggcgggagaag

SEQ ID NO: 285813 - DNA, 20 bp, human
ggccgcttccgtcagcactc

SEQ ID NO: 285814 - DNA, 20 bp, human
gggggaggatcggggaaagg

SEQ ID NO: 285815 - DNA, 20 bp, human
gacgtcctactgccgagcga

SEQ ID NO: 285816 - DNA, 20 bp, human
ggcagccaatgaatcagctg

SEQ ID NO: 285817 - DNA, 20 bp, human
gcctcggggtcagaagtcgc

SEQ ID NO: 285818 - DNA, 20 bp, human
gccaatgggaccagcggatg

SEQ ID NO: 285819 - DNA, 20 bp, human
gcgtttctaacgttcaccaa

SEQ ID NO: 285820 - DNA, 20 bp, human
gggccgccgccgattcgaag

SEQ ID NO: 285821 - DNA, 20 bp, human
gtggtgaaggccctgctcgt

SEQ ID NO: 285822 - DNA, 20 bp, human
ggacctactccgacccccta

SEQ ID NO: 285823 - DNA, 20 bp, human
gagtgaaggcgggacttgtg

SEQ ID NO: 285824 - DNA, 20 bp, human
gggagcagtgacgtttattg

SEQ ID NO: 285825 - DNA, 20 bp, human
gcccctagggccgggagtga

SEQ ID NO: 285826 - DNA, 20 bp, human
gagaaggttcgggcagatcg

SEQ ID NO: 285827 - DNA, 20 bp, human
gcgggcgagaggctctcaac

SEQ ID NO: 285828 - DNA, 20 bp, human
ggcgtagccgcccagcctcg

SEQ ID NO: 285829 - DNA, 20 bp, human
ggagagcctctcgcccgccc

SEQ ID NO: 285830 - DNA, 20 bp, human
ggaaaggaggacgcagagta

SEQ ID NO: 285831 - DNA, 20 bp, human
gtatctctggccattcacta

SEQ ID NO: 285832 - DNA, 20 bp, human
gctgactcagccgggtggcg

SEQ ID NO: 285833 - DNA, 20 bp, human
ggatcggggcatgagccgcg

SEQ ID NO: 285834 - DNA, 20 bp, human
gggaggacgcagagtacggt

SEQ ID NO: 285835 - DNA, 20 bp, human
ggggtcgggtgaggcgcaaa

SEQ ID NO: 285836 - DNA, 20 bp, human
gaggcggagcgcggtggggt

SEQ ID NO: 285837 - DNA, 20 bp, human
gcggtggggtgggtgcggaa

SEQ ID NO: 285838 - DNA, 20 bp, human
gcatgcgcccccagcttccg

SEQ ID NO: 285839 - DNA, 20 bp, human
gaagcccggctccactcctc

SEQ ID NO: 285840 - DNA, 20 bp, human
gcccccgcccggggtaactg

SEQ ID NO: 285841 - DNA, 20 bp, human
gaagtggagcgaggacaaaa

SEQ ID NO: 285842 - DNA, 20 bp, human
gcctgccattacggcttccc

SEQ ID NO: 285843 - DNA, 20 bp, human
gtggagccgggcttgtgatt

SEQ ID NO: 285844 - DNA, 20 bp, human
gtctgtgccggccaagatcc

SEQ ID NO: 285845 - DNA, 20 bp, human
gttggccggcacagaactgg

SEQ ID NO: 285846 - DNA, 20 bp, human
ggacgcaagaagactgtaat

SEQ ID NO: 285847 - DNA, 20 bp, human
gaccggggctgtccgagata

SEQ ID NO: 285848 - DNA, 20 bp, human
gtgcacgccagcgttccctg

SEQ ID NO: 285849 - DNA, 20 bp, human
gcggcgcctcagcggaagag

SEQ ID NO: 285850 - DNA, 20 bp, human
gctcagaaagagtccagggg

SEQ ID NO: 285851 - DNA, 20 bp, human
gggcgcgggcggcgcctcag

SEQ ID NO: 285852 - DNA, 20 bp, human
ggcccgcgccgcctgaccag

SEQ ID NO: 285853 - DNA, 20 bp, human
gggaacgctggcgtgcactc

SEQ ID NO: 285854 - DNA, 20 bp, human
gtgctccgcagcatgatggt

SEQ ID NO: 285855 - DNA, 20 bp, human
gtcccggagccagggcgtac

SEQ ID NO: 285856 - DNA, 20 bp, human
ggggaggggcggccctcaaa

SEQ ID NO: 285857 - DNA, 20 bp, human
gccacggcccctgaacgctg

SEQ ID NO: 285858 - DNA, 20 bp, human
gcactcctcccccagcgttc

SEQ ID NO: 285859 - DNA, 20 bp, human
gaggacagagccagacaggt

SEQ ID NO: 285860 - DNA, 20 bp, human
gaaggaggacagagccagac

SEQ ID NO: 285861 - DNA, 20 bp, human
ggctaaaaatacccgactgg

SEQ ID NO: 285862 - DNA, 20 bp, human
gcagggccgtccttctgtta

SEQ ID NO: 285863 - DNA, 20 bp, human
gcgagtgccctgccgtggca

SEQ ID NO: 285864 - DNA, 20 bp, human
ggaattcgagagcgcgacgc

SEQ ID NO: 285865 - DNA, 20 bp, human
gcgacgctggagccgtgcca

SEQ ID NO: 285866 - DNA, 20 bp, human
gggggcgtgcccgccggtct

SEQ ID NO: 285867 - DNA, 20 bp, human
gggaactccccgcttatctg

SEQ ID NO: 285868 - DNA, 20 bp, human
gctggtagggattaacagag

SEQ ID NO: 285869 - DNA, 20 bp, human
gtctgagagcccagaccggc

SEQ ID NO: 285870 - DNA, 20 bp, human
gcgcgcacacgcccactcag

SEQ ID NO: 285871 - DNA, 20 bp, human
gccactcagcggctagaaac

SEQ ID NO: 285872 - DNA, 20 bp, human
gttcttcgattcagagtttt

SEQ ID NO: 285873 - DNA, 20 bp, human
ggggatgggggcgtgcccgc

SEQ ID NO: 285874 - DNA, 20 bp, human
gttttgggaggaacggagca

SEQ ID NO: 285875 - DNA, 20 bp, human
gccaggactgcaggctggta

SEQ ID NO: 285876 - DNA, 20 bp, human
gaactcggtggaggccgcgg

SEQ ID NO: 285877 - DNA, 20 bp, human
gcgcgcgcccggaaactcag

SEQ ID NO: 285878 - DNA, 20 bp, human
ggcgcccggaaactcagcgg

SEQ ID NO: 285879 - DNA, 20 bp, human
gctaagagctaggggtagga

SEQ ID NO: 285880 - DNA, 20 bp, human
ggcgcccgggaactcggtgg

SEQ ID NO: 285881 - DNA, 20 bp, human
gggcgctaagagctaggggt

SEQ ID NO: 285882 - DNA, 20 bp, human
gtcgtggcgcaaagagctcg

SEQ ID NO: 285883 - DNA, 20 bp, human
gagggtgggacggggcttgt

SEQ ID NO: 285884 - DNA, 20 bp, human
gggcgtggcgctaagagcta

SEQ ID NO: 285885 - DNA, 20 bp, human
ggcggcctccgtggagtccg

SEQ ID NO: 285886 - DNA, 20 bp, human
gacagctgaagagtgtgcgg

SEQ ID NO: 285887 - DNA, 20 bp, human
ggaccctcagctgtcctctc

SEQ ID NO: 285888 - DNA, 20 bp, human
gccctgagtgagagcaacga

SEQ ID NO: 285889 - DNA, 20 bp, human
gaggggactaggggtccggg

SEQ ID NO: 285890 - DNA, 20 bp, human
gcactcttcagctgtcgcag

SEQ ID NO: 285891 - DNA, 20 bp, human
gggggaggggactaggggtc

SEQ ID NO: 285892 - DNA, 20 bp, human
gctgaagagtgtgcggggga

SEQ ID NO: 285893 - DNA, 20 bp, human
gctgtcgcagggggcctgag

SEQ ID NO: 285894 - DNA, 20 bp, human
ggtgcgggggaggggactag

SEQ ID NO: 285895 - DNA, 20 bp, human
gcaccgaagaggagaaaatg

SEQ ID NO: 285896 - DNA, 20 bp, human
ggtaagggcaatccatgact

SEQ ID NO: 285897 - DNA, 20 bp, human
gcacacatgctgacaatgaa

SEQ ID NO: 285898 - DNA, 20 bp, human
gatgactgggcagcttgtgc

SEQ ID NO: 285899 - DNA, 20 bp, human
gcagacgcaatcacttaatt

SEQ ID NO: 285900 - DNA, 20 bp, human
gggctgtgtgctaaatgcac

SEQ ID NO: 285901 - DNA, 20 bp, human
gacaatgaacggctatttat

SEQ ID NO: 285902 - DNA, 20 bp, human
gagagagtgggaatcgaaaa

SEQ ID NO: 285903 - DNA, 20 bp, human
ggcattccgtgctatgattc

SEQ ID NO: 285904 - DNA, 20 bp, human
gaggctagagtgcaacggta

SEQ ID NO: 285905 - DNA, 20 bp, human
gatggtatttgaaaaatatc

SEQ ID NO: 285906 - DNA, 20 bp, human
gccagcaggcgcttaataaa

SEQ ID NO: 285907 - DNA, 20 bp, human
ggagggctgcccagggacac

SEQ ID NO: 285908 - DNA, 20 bp, human
gcctgtgccggcccctcgga

SEQ ID NO: 285909 - DNA, 20 bp, human
ggagcacagcgtggtgattg

SEQ ID NO: 285910 - DNA, 20 bp, human
gtccctgggcagccctccga

SEQ ID NO: 285911 - DNA, 20 bp, human
gctggcaaatgctgtcaaga

SEQ ID NO: 285912 - DNA, 20 bp, human
ggccacggtcccagtgtccc

SEQ ID NO: 285913 - DNA, 20 bp, human
gggggagccttgcgggtgtg

SEQ ID NO: 285914 - DNA, 20 bp, human
gaatggccaagtcattgttt

SEQ ID NO: 285915 - DNA, 20 bp, human
gggactggaaactcttccgt

SEQ ID NO: 285916 - DNA, 20 bp, human
gccctctcggcctgcgtgtc

SEQ ID NO: 285917 - DNA, 20 bp, human
ggtgatcagcctggaatgtc

SEQ ID NO: 285918 - DNA, 20 bp, human
ggcctcctcaccactgcaca

SEQ ID NO: 285919 - DNA, 20 bp, human
ggcccgacacgcaggccgag

SEQ ID NO: 285920 - DNA, 20 bp, human
gtgcgtgtcgggctgtcagc

SEQ ID NO: 285921 - DNA, 20 bp, human
ggtccgagtggcaaggagac

SEQ ID NO: 285922 - DNA, 20 bp, human
gacagtcctcaggagccccc

SEQ ID NO: 285923 - DNA, 20 bp, human
ggtcagcagggccggcgcac

SEQ ID NO: 285924 - DNA, 20 bp, human
gaggagcccccaggctgacg

SEQ ID NO: 285925 - DNA, 20 bp, human
ggcctctccatggcccagag

SEQ ID NO: 285926 - DNA, 20 bp, human
gttagtgccccgctcgggga

SEQ ID NO: 285927 - DNA, 20 bp, human
gtccctccgcggattctccg

SEQ ID NO: 285928 - DNA, 20 bp, human
gcggagaggccggctgaact

SEQ ID NO: 285929 - DNA, 20 bp, human
gagcccagctgttccctccg

SEQ ID NO: 285930 - DNA, 20 bp, human
gaggccttagtgccccgctc

SEQ ID NO: 285931 - DNA, 20 bp, human
ggccccggagaatccgcgga

SEQ ID NO: 285932 - DNA, 20 bp, human
gctgtcacaggaatattcgg

SEQ ID NO: 285933 - DNA, 20 bp, human
gaccagccccggagaatccg

SEQ ID NO: 285934 - DNA, 20 bp, human
gggccggctgaacttggacg

SEQ ID NO: 285935 - DNA, 20 bp, human
gggaggtgatgaaccagccc

SEQ ID NO: 285936 - DNA, 20 bp, human
gtccccgggtccattaacga

SEQ ID NO: 285937 - DNA, 20 bp, human
ggcaaacgcaggcggagttc

SEQ ID NO: 285938 - DNA, 20 bp, human
gggagaaagggtcggagtct

SEQ ID NO: 285939 - DNA, 20 bp, human
gtggctcttggaggtaagat

SEQ ID NO: 285940 - DNA, 20 bp, human
gcattaacgaaggtggggaa

SEQ ID NO: 285941 - DNA, 20 bp, human
ggaaagggtcggagtctggg

SEQ ID NO: 285942 - DNA, 20 bp, human
gggtgcggctccctcgggtc

SEQ ID NO: 285943 - DNA, 20 bp, human
gcctgcgtttgcagaagcga

SEQ ID NO: 285944 - DNA, 20 bp, human
gagccagactgtcagcgccc

SEQ ID NO: 285945 - DNA, 20 bp, human
gacgaccaggccagacccga

SEQ ID NO: 285946 - DNA, 20 bp, human
gagccccggcgactcccgcc

SEQ ID NO: 285947 - DNA, 20 bp, human
gtgagagccggcgtttccgt

SEQ ID NO: 285948 - DNA, 20 bp, human
gccggctcctacggaaacgc

SEQ ID NO: 285949 - DNA, 20 bp, human
gagccgggcgggagtcgccg

SEQ ID NO: 285950 - DNA, 20 bp, human
gtcacgtgacggatgctggg

SEQ ID NO: 285951 - DNA, 20 bp, human
gggaaacgccggctctcacg

SEQ ID NO: 285952 - DNA, 20 bp, human
gactacaataaagaacgcta

SEQ ID NO: 285953 - DNA, 20 bp, human
gagcggctcgcgaaagctca

SEQ ID NO: 285954 - DNA, 20 bp, human
gtcacgtggaggtcacgtga

SEQ ID NO: 285955 - DNA, 20 bp, human
gataaagaacgctaaggtcc

SEQ ID NO: 285956 - DNA, 20 bp, human
gagcaggggcgggaatcgta

SEQ ID NO: 285957 - DNA, 20 bp, human
gtgagaaggggataagagtc

SEQ ID NO: 285958 - DNA, 20 bp, human
ggggcggcgcccgcacgaag

SEQ ID NO: 285959 - DNA, 20 bp, human
gagtgggaggggcctgtaaa

SEQ ID NO: 285960 - DNA, 20 bp, human
ggcggggcacacgttagaag

SEQ ID NO: 285961 - DNA, 20 bp, human
gaaggggcgtcccagcttgg

SEQ ID NO: 285962 - DNA, 20 bp, human
gtgggcggggtcagacctgg

SEQ ID NO: 285963 - DNA, 20 bp, human
ggggcgtcccagcttggagg

SEQ ID NO: 285964 - DNA, 20 bp, human
ggcaaccacggcacgaagtt

SEQ ID NO: 285965 - DNA, 20 bp, human
gctgggacgccccttcgtgc

SEQ ID NO: 285966 - DNA, 20 bp, human
gcggactgcgagtctctttg

SEQ ID NO: 285967 - DNA, 20 bp, human
gagactaagccggccggaga

SEQ ID NO: 285968 - DNA, 20 bp, human
gagcacaccctgcgcgggta

SEQ ID NO: 285969 - DNA, 20 bp, human
ggcgctagcacaccctgcgc

SEQ ID NO: 285970 - DNA, 20 bp, human
gcaccctgcgcgggtaggga

SEQ ID NO: 285971 - DNA, 20 bp, human
gaggggcggggctcgcgcgc

SEQ ID NO: 285972 - DNA, 20 bp, human
gaggggacacgggctcattg

SEQ ID NO: 285973 - DNA, 20 bp, human
gccggcttagtctagttccc

SEQ ID NO: 285974 - DNA, 20 bp, human
gcgcagggtgtgcagattgc

SEQ ID NO: 285975 - DNA, 20 bp, human
gtgacgcgaagactcggagg

SEQ ID NO: 285976 - DNA, 20 bp, human
gtgacgcgaagactcggagg

SEQ ID NO: 285977 - DNA, 20 bp, human
gcgctgacgcgaagactcgg

SEQ ID NO: 285978 - DNA, 20 bp, human
gagactaagccggccggaga

SEQ ID NO: 285979 - DNA, 20 bp, human
ggggcccttggggcgaatcg

SEQ ID NO: 285980 - DNA, 20 bp, human
ggcaccgcgattcgccccaa

SEQ ID NO: 285981 - DNA, 20 bp, human
gctcggaggcggaagaaaaa

SEQ ID NO: 285982 - DNA, 20 bp, human
gcgtcctgcgcagggccctt

SEQ ID NO: 285983 - DNA, 20 bp, human
gggacgctgacgcgaagact

SEQ ID NO: 285984 - DNA, 20 bp, human
ggggctagcggcgaccgctg

SEQ ID NO: 285985 - DNA, 20 bp, human
gaggggtagttctttcacct

SEQ ID NO: 285986 - DNA, 20 bp, human
gtgacgcgaagactcggagg

SEQ ID NO: 285987 - DNA, 20 bp, human
gcgctgacgcgaagactcgg

SEQ ID NO: 285988 - DNA, 20 bp, human
gagactaagccggccggaga

SEQ ID NO: 285989 - DNA, 20 bp, human
ggggcccttggggcgaatcg

SEQ ID NO: 285990 - DNA, 20 bp, human
ggcaccgcgattcgccccaa

SEQ ID NO: 285991 - DNA, 20 bp, human
gctcggaggcggaagaaaaa

SEQ ID NO: 285992 - DNA, 20 bp, human
gcgtcctgcgcagggccctt

SEQ ID NO: 285993 - DNA, 20 bp, human
gggacgctgacgcgaagact

SEQ ID NO: 285994 - DNA, 20 bp, human
ggggctagcggcgaccgctg

SEQ ID NO: 285995 - DNA, 20 bp, human
gaggggtagttctttcacct

SEQ ID NO: 285996 - DNA, 20 bp, human
ggccgcggcccgcgcggagg

SEQ ID NO: 285997 - DNA, 20 bp, human
gcgggcccgggcatgggatg

SEQ ID NO: 285998 - DNA, 20 bp, human
ggggcctggcgctccgggga

SEQ ID NO: 285999 - DNA, 20 bp, human
ggcccagacaaaggcctagt

SEQ ID NO: 286000 - DNA, 20 bp, human
gccgtcccatcccatactcc

SEQ ID NO: 286001 - DNA, 20 bp, human
ggcctagtaggctgcgcggc

SEQ ID NO: 286002 - DNA, 20 bp, human
gctccccgccaaacccggcc

SEQ ID NO: 286003 - DNA, 20 bp, human
gggggcccgggcccgggcat

SEQ ID NO: 286004 - DNA, 20 bp, human
gccatactccaggccgggtt

SEQ ID NO: 286005 - DNA, 20 bp, human
gcggcccgggggcggtccgt

SEQ ID NO: 286006 - DNA, 20 bp, human
gtgagccaatggcacgggag

SEQ ID NO: 286007 - DNA, 20 bp, human
gcaacggcggccgttctccg

SEQ ID NO: 286008 - DNA, 20 bp, human
ggcggccgttctccggggac

SEQ ID NO: 286009 - DNA, 20 bp, human
gagcggaagtggcacgtgga

SEQ ID NO: 286010 - DNA, 20 bp, human
gtggctagggcgggagtggg

SEQ ID NO: 286011 - DNA, 20 bp, human
gcggggaccggctgcccatt

SEQ ID NO: 286012 - DNA, 20 bp, human
gtggaaagattctacccaat

SEQ ID NO: 286013 - DNA, 20 bp, human
gaaaacgcctgtggctaggg

SEQ ID NO: 286014 - DNA, 20 bp, human
gtccagaaggctcgagaaga

SEQ ID NO: 286015 - DNA, 20 bp, human
gagggccgctcccgtgccat

SEQ ID NO: 286016 - DNA, 20 bp, human
ggctccgcgcacgtgctctc

SEQ ID NO: 286017 - DNA, 20 bp, human
ggaccccgagagcacgtgcg

SEQ ID NO: 286018 - DNA, 20 bp, human
gaccctcacaggcgcgggga

SEQ ID NO: 286019 - DNA, 20 bp, human
gaacccccccggtccgacca

SEQ ID NO: 286020 - DNA, 20 bp, human
gccaaacttaggaagggtcg

SEQ ID NO: 286021 - DNA, 20 bp, human
gcggtccgaccagggaaggt

SEQ ID NO: 286022 - DNA, 20 bp, human
gggaaggggcccgagctgga

SEQ ID NO: 286023 - DNA, 20 bp, human
gggacctggagacgaactcc

SEQ ID NO: 286024 - DNA, 20 bp, human
gagctcgggccccttccgat

SEQ ID NO: 286025 - DNA, 20 bp, human
gcctgagccagcagacccat

SEQ ID NO: 286026 - DNA, 20 bp, human
gcgtcgacgcccaccggggt

SEQ ID NO: 286027 - DNA, 20 bp, human
gggatcccgcggcgcctcaa

SEQ ID NO: 286028 - DNA, 20 bp, human
gcgtcgacgcgcagcagcag

SEQ ID NO: 286029 - DNA, 20 bp, human
gccccaaacccgaccccggt

SEQ ID NO: 286030 - DNA, 20 bp, human
ggctgcgcgtcgacgcccac

SEQ ID NO: 286031 - DNA, 20 bp, human
ggggtccccggcggatcggc

SEQ ID NO: 286032 - DNA, 20 bp, human
gttgagctccgcggggtccc

SEQ ID NO: 286033 - DNA, 20 bp, human
gcgcccaccggggtcgggtt

SEQ ID NO: 286034 - DNA, 20 bp, human
gggaaacggaaggaaggcgt

SEQ ID NO: 286035 - DNA, 20 bp, human
gaaaagacgcggttcctgag

SEQ ID NO: 286036 - DNA, 20 bp, human
gggagatcatatgattgaga

SEQ ID NO: 286037 - DNA, 20 bp, human
ggatctattgtaaaatcacc

SEQ ID NO: 286038 - DNA, 20 bp, human
gtacatcagccatatagaaa

SEQ ID NO: 286039 - DNA, 20 bp, human
gacactcaaagtcaatgtaa

SEQ ID NO: 286040 - DNA, 20 bp, human
gtttctaaatagcatcaatt

SEQ ID NO: 286041 - DNA, 20 bp, human
ggtgtaaaattttgataaca

SEQ ID NO: 286042 - DNA, 20 bp, human
gactgggattagcatgtgat

SEQ ID NO: 286043 - DNA, 20 bp, human
gccgttgtctgactcactca

SEQ ID NO: 286044 - DNA, 20 bp, human
gtcagggctagactaacact

SEQ ID NO: 286045 - DNA, 20 bp, human
gagacaacggaaaagcacgc

SEQ ID NO: 286046 - DNA, 20 bp, human
gtgagatcatatgatcgaga

SEQ ID NO: 286047 - DNA, 20 bp, human
gtgtaaaatttttcataaca

SEQ ID NO: 286048 - DNA, 20 bp, human
gattctaagtcaatgtaagc

SEQ ID NO: 286049 - DNA, 20 bp, human
ggatctattgcagaatcacc

SEQ ID NO: 286050 - DNA, 20 bp, human
gggagatttcaaaaaacaaa

SEQ ID NO: 286051 - DNA, 20 bp, human
gattgtgaagacaaggcaac

SEQ ID NO: 286052 - DNA, 20 bp, human
gactgggattagcatgtgat

SEQ ID NO: 286053 - DNA, 20 bp, human
gccgttgtctgactcactca

SEQ ID NO: 286054 - DNA, 20 bp, human
gtcagggctagactaacact

SEQ ID NO: 286055 - DNA, 20 bp, human
gagacaacggaaaagcacgc

SEQ ID NO: 286056 - DNA, 20 bp, human
gtagtcgatggggtccgtga

SEQ ID NO: 286057 - DNA, 20 bp, human
gagggcgatgaacaggtcgc

SEQ ID NO: 286058 - DNA, 20 bp, human
gcatgggcgggatagagatg

SEQ ID NO: 286059 - DNA, 20 bp, human
gtgcgccagcccagcatggg

SEQ ID NO: 286060 - DNA, 20 bp, human
ggaacaggtcgcaggttacc

SEQ ID NO: 286061 - DNA, 20 bp, human
gggtgcagcacagcacgtcg

SEQ ID NO: 286062 - DNA, 20 bp, human
gagggagcgctccaaggcga

SEQ ID NO: 286063 - DNA, 20 bp, human
gctcttgttcacgtagtcga

SEQ ID NO: 286064 - DNA, 20 bp, human
ggggtgcgccagcccagcat

SEQ ID NO: 286065 - DNA, 20 bp, human
gcccatggccgcgctgtatc

SEQ ID NO: 286066 - DNA, 20 bp, human
gtctaagacccggtgtggag

SEQ ID NO: 286067 - DNA, 20 bp, human
gcacaccgggtcttagacct

SEQ ID NO: 286068 - DNA, 20 bp, human
gcgctctggaagtgcagggg

SEQ ID NO: 286069 - DNA, 20 bp, human
gaaactagaggtcatgggtg

SEQ ID NO: 286070 - DNA, 20 bp, human
gaggcgctctggaagtgcag

SEQ ID NO: 286071 - DNA, 20 bp, human
ggcaacccaggtctaagacc

SEQ ID NO: 286072 - DNA, 20 bp, human
gggaacaaccacagacgcgg

SEQ ID NO: 286073 - DNA, 20 bp, human
gggtgggaatgcaagatctc

SEQ ID NO: 286074 - DNA, 20 bp, human
ggggaggcgcccgcctgcct

SEQ ID NO: 286075 - DNA, 20 bp, human
gctagacgcctccagggagc

SEQ ID NO: 286076 - DNA, 20 bp, human
gcaggaccctgagacatctt

SEQ ID NO: 286077 - DNA, 20 bp, human
gggaatcccaagatgtctca

SEQ ID NO: 286078 - DNA, 20 bp, human
ggccaaaggcaagaatccca

SEQ ID NO: 286079 - DNA, 20 bp, human
ggatgcgtcaagatgaacct

SEQ ID NO: 286080 - DNA, 20 bp, human
gaaattcagcatgtgtcccc

SEQ ID NO: 286081 - DNA, 20 bp, human
gtcccagggcattgcccacc

SEQ ID NO: 286082 - DNA, 20 bp, human
gagcagctcgcggttttccc

SEQ ID NO: 286083 - DNA, 20 bp, human
gcagcagatggtcatgccca

SEQ ID NO: 286084 - DNA, 20 bp, human
gcgcgagctgctgtgctgac

SEQ ID NO: 286085 - DNA, 20 bp, human
gcaggggatcacacccaggt

SEQ ID NO: 286086 - DNA, 20 bp, human
gcctcccgggacaccgtgaa

SEQ ID NO: 286087 - DNA, 20 bp, human
gacaccgtgaacggagaggg

SEQ ID NO: 286088 - DNA, 20 bp, human
ggggacaccgtgaacggaga

SEQ ID NO: 286089 - DNA, 20 bp, human
gaacggcgggagcagttgac

SEQ ID NO: 286090 - DNA, 20 bp, human
gtaaaccgggccagcggggt

SEQ ID NO: 286091 - DNA, 20 bp, human
gcccggttgcagacactaga

SEQ ID NO: 286092 - DNA, 20 bp, human
ggggaaaatagatacaacaa

SEQ ID NO: 286093 - DNA, 20 bp, human
gtggagctgatggcgcctta

SEQ ID NO: 286094 - DNA, 20 bp, human
ggggatgaaaagatgagccc

SEQ ID NO: 286095 - DNA, 20 bp, human
gtctgcaaccgggagcccta

SEQ ID NO: 286096 - DNA, 20 bp, human
gaaaatgaggttcagattga

SEQ ID NO: 286097 - DNA, 20 bp, human
ggaaatgttttggaagttac

SEQ ID NO: 286098 - DNA, 20 bp, human
gatctctgccattatagaat

SEQ ID NO: 286099 - DNA, 20 bp, human
gtttgtcatgcttcaagcct

SEQ ID NO: 286100 - DNA, 20 bp, human
gagaaaaaccaattctataa

SEQ ID NO: 286101 - DNA, 20 bp, human
gggcccgatctcaataacgc

SEQ ID NO: 286102 - DNA, 20 bp, human
gaggcctgcgttattgagat

SEQ ID NO: 286103 - DNA, 20 bp, human
gcccaccaagagttttgctt

SEQ ID NO: 286104 - DNA, 20 bp, human
gttaatctatagaatattct

SEQ ID NO: 286105 - DNA, 20 bp, human
gaaaacatttcttaaaatat

SEQ ID NO: 286106 - DNA, 20 bp, human
gtcgcacaaaagaactgcat

SEQ ID NO: 286107 - DNA, 20 bp, human
ggaagagctgtctgcaccaa

SEQ ID NO: 286108 - DNA, 20 bp, human
gtcccattaaggtaggtaag

SEQ ID NO: 286109 - DNA, 20 bp, human
gatgacatacacatagaggg

SEQ ID NO: 286110 - DNA, 20 bp, human
ggccacttacctaccttaat

SEQ ID NO: 286111 - DNA, 20 bp, human
ggggtggctaggcacgtctg

SEQ ID NO: 286112 - DNA, 20 bp, human
gtgcagattcccattaaggt

SEQ ID NO: 286113 - DNA, 20 bp, human
gtggccacataggctcaggg

SEQ ID NO: 286114 - DNA, 20 bp, human
gtagccaccctgagcctatg

SEQ ID NO: 286115 - DNA, 20 bp, human
gcaaggtagcaacagccagg

SEQ ID NO: 286116 - DNA, 20 bp, human
gtaaaaatataacttgaata

SEQ ID NO: 286117 - DNA, 20 bp, human
gagcatgttgaaccagttca

SEQ ID NO: 286118 - DNA, 20 bp, human
gggttcaacatgcttaacag

SEQ ID NO: 286119 - DNA, 20 bp, human
gcaaatgtgaaaaacagctc

SEQ ID NO: 286120 - DNA, 20 bp, human
gtatagctgcaagcatgcca

SEQ ID NO: 286121 - DNA, 20 bp, human
gagctctctttaatatttgg

SEQ ID NO: 286122 - DNA, 20 bp, human
gagctgcaagcatgccaagg

SEQ ID NO: 286123 - DNA, 20 bp, human
gtaatggtgttccacagcaa

SEQ ID NO: 286124 - DNA, 20 bp, human
gtttcaaccgcctgtgctgg

SEQ ID NO: 286125 - DNA, 20 bp, human
ggaacaccattaatttgctc

SEQ ID NO: 286126 - DNA, 20 bp, human
ggaccccatggtggagatgg

SEQ ID NO: 286127 - DNA, 20 bp, human
gccaaaagcgggatgagggg

SEQ ID NO: 286128 - DNA, 20 bp, human
gcagggggcgcgagacccca

SEQ ID NO: 286129 - DNA, 20 bp, human
gtgggccaaaagcgggatga

SEQ ID NO: 286130 - DNA, 20 bp, human
gcccccgggcctgtttggac

SEQ ID NO: 286131 - DNA, 20 bp, human
gggggcgcgagaccccatgg

SEQ ID NO: 286132 - DNA, 20 bp, human
ggggaagtgggccttataac

SEQ ID NO: 286133 - DNA, 20 bp, human
gccgctccaaaggcagtatc

SEQ ID NO: 286134 - DNA, 20 bp, human
gtctcgcgccccctgccagc

SEQ ID NO: 286135 - DNA, 20 bp, human
gggcaccggatagagagaga

SEQ ID NO: 286136 - DNA, 20 bp, human
gccaagccccctggctgaat

SEQ ID NO: 286137 - DNA, 20 bp, human
gctagctgatgtcatgctgt

SEQ ID NO: 286138 - DNA, 20 bp, human
gctccctgggccaccaaggt

SEQ ID NO: 286139 - DNA, 20 bp, human
gtttccccaaggagtaactt

SEQ ID NO: 286140 - DNA, 20 bp, human
gcagtccacccattcagcca

SEQ ID NO: 286141 - DNA, 20 bp, human
gagccccctggctgaatggg

SEQ ID NO: 286142 - DNA, 20 bp, human
ggggcaggatagggtgagtc

SEQ ID NO: 286143 - DNA, 20 bp, human
gcccacctaagttactcctt

SEQ ID NO: 286144 - DNA, 20 bp, human
gtgtttcaggcgggaggaaa

SEQ ID NO: 286145 - DNA, 20 bp, human
gagcatgacatcagctaggg

SEQ ID NO: 286146 - DNA, 20 bp, human
gaaccctgatgcagaccctt

SEQ ID NO: 286147 - DNA, 20 bp, human
gtggcccagtccacctccta

SEQ ID NO: 286148 - DNA, 20 bp, human
gatgttgtgtgcagatgctg

SEQ ID NO: 286149 - DNA, 20 bp, human
gtggggagcaacaaggaagc

SEQ ID NO: 286150 - DNA, 20 bp, human
ggcccacggggcctaagcga

SEQ ID NO: 286151 - DNA, 20 bp, human
gagctgggctgtctcattac

SEQ ID NO: 286152 - DNA, 20 bp, human
ggggtgcgaggatcctcttg

SEQ ID NO: 286153 - DNA, 20 bp, human
gagcccaagggtctgcatca

SEQ ID NO: 286154 - DNA, 20 bp, human
gagatgctgaggtttgacct

SEQ ID NO: 286155 - DNA, 20 bp, human
ggcacaatttctaagcccaa

SEQ ID NO: 286156 - DNA, 20 bp, human
gcaacgcgggagttaagttt

SEQ ID NO: 286157 - DNA, 20 bp, human
ggaggagaaaagtacaaatt

SEQ ID NO: 286158 - DNA, 20 bp, human
gtcaacgccatctccaaggt

SEQ ID NO: 286159 - DNA, 20 bp, human
gtaaatcaacgccatctcca

SEQ ID NO: 286160 - DNA, 20 bp, human
gggaagtgacaaatttgtga

SEQ ID NO: 286161 - DNA, 20 bp, human
gaattcacagccagctggtg

SEQ ID NO: 286162 - DNA, 20 bp, human
ggtgactggtgttgaggcca

SEQ ID NO: 286163 - DNA, 20 bp, human
gtacaatgaggtttctccat

SEQ ID NO: 286164 - DNA, 20 bp, human
gtgctaggagaggatgatac

SEQ ID NO: 286165 - DNA, 20 bp, human
gagaaatgagcaccagcaat

SEQ ID NO: 286166 - DNA, 20 bp, human
gaggggaaaagcattctatt

SEQ ID NO: 286167 - DNA, 20 bp, human
ggagcccggaaggtgcatct

SEQ ID NO: 286168 - DNA, 20 bp, human
gtgccttaatgagagaatgt

SEQ ID NO: 286169 - DNA, 20 bp, human
gctgggacctctctggtcac

SEQ ID NO: 286170 - DNA, 20 bp, human
gcagaccacaccctggttgc

SEQ ID NO: 286171 - DNA, 20 bp, human
gggaaattgggcggacacta

SEQ ID NO: 286172 - DNA, 20 bp, human
gccagccaagtgtcctgcat

SEQ ID NO: 286173 - DNA, 20 bp, human
gcacttggctgggacctctc

SEQ ID NO: 286174 - DNA, 20 bp, human
gctgcccagatgcaccttcc

SEQ ID NO: 286175 - DNA, 20 bp, human
gtgagctcctttaagctcca

SEQ ID NO: 286176 - DNA, 20 bp, human
gcactgtaaagtggcggtcg

SEQ ID NO: 286177 - DNA, 20 bp, human
gggttgcagtgagattgtta

SEQ ID NO: 286178 - DNA, 20 bp, human
ggaaggacactggcagaagg

SEQ ID NO: 286179 - DNA, 20 bp, human
gttgcatggggacaaaacaa

SEQ ID NO: 286180 - DNA, 20 bp, human
gatggcaggacactgtaaag

SEQ ID NO: 286181 - DNA, 20 bp, human
ggtaagcaagagaaggacac

SEQ ID NO: 286182 - DNA, 20 bp, human
gggacaaaacaatggcactg

SEQ ID NO: 286183 - DNA, 20 bp, human
gcacccacatggctccaggt

SEQ ID NO: 286184 - DNA, 20 bp, human
gttgagtttgcatacacatc

SEQ ID NO: 286185 - DNA, 20 bp, human
gacatcacccacatggctcc

SEQ ID NO: 286186 - DNA, 20 bp, human
ggtacagtgcctcaccgaga

SEQ ID NO: 286187 - DNA, 20 bp, human
gtcaggcccagttaaagcac

SEQ ID NO: 286188 - DNA, 20 bp, human
ggggctcaaggtgtgatctg

SEQ ID NO: 286189 - DNA, 20 bp, human
gagcaaaaatatgtggtccc

SEQ ID NO: 286190 - DNA, 20 bp, human
gccaaggggtcttgttagag

SEQ ID NO: 286191 - DNA, 20 bp, human
gctagcctccaaaagtaata

SEQ ID NO: 286192 - DNA, 20 bp, human
ggtaatatggcaaatcagtt

SEQ ID NO: 286193 - DNA, 20 bp, human
gcatccatgccttctcggtg

SEQ ID NO: 286194 - DNA, 20 bp, human
gacttttggaggctagattc

SEQ ID NO: 286195 - DNA, 20 bp, human
ggtgcctcaccgagaaggca

SEQ ID NO: 286196 - DNA, 20 bp, human
ggggccccaaggcagggcgt

SEQ ID NO: 286197 - DNA, 20 bp, human
gttggggcccctctcatata

SEQ ID NO: 286198 - DNA, 20 bp, human
ggaccccacgccctgccttg

SEQ ID NO: 286199 - DNA, 20 bp, human
gtacctgataggggattggg

SEQ ID NO: 286200 - DNA, 20 bp, human
gctgtgctccctatatgaga

SEQ ID NO: 286201 - DNA, 20 bp, human
gcatcgaatgtgtgagatga

SEQ ID NO: 286202 - DNA, 20 bp, human
ggggaggggatcaccgagag

SEQ ID NO: 286203 - DNA, 20 bp, human
gtatctacctgataggggat

SEQ ID NO: 286204 - DNA, 20 bp, human
gatcctcccaatcccctatc

SEQ ID NO: 286205 - DNA, 20 bp, human
gcatcctcccgggcctcgga

SEQ ID NO: 286206 - DNA, 20 bp, human
gggcgagcccaggtgatccg

SEQ ID NO: 286207 - DNA, 20 bp, human
ggcagggcgcacaggggagt

SEQ ID NO: 286208 - DNA, 20 bp, human
gagggcagcggggaccaccg

SEQ ID NO: 286209 - DNA, 20 bp, human
gctgttgagcccgtggagtc

SEQ ID NO: 286210 - DNA, 20 bp, human
gtgtccctggcgcccagtgg

SEQ ID NO: 286211 - DNA, 20 bp, human
gtggggagaaggacgatgcg

SEQ ID NO: 286212 - DNA, 20 bp, human
ggagcccgtggagtccggct

SEQ ID NO: 286213 - DNA, 20 bp, human
gcgtgctggccagcccggaa

SEQ ID NO: 286214 - DNA, 20 bp, human
gccccagccccggatcacct

SEQ ID NO: 286215 - DNA, 20 bp, human
gctggagcccgcacccgagg

SEQ ID NO: 286216 - DNA, 20 bp, human
gccgctggcagctaggtcgg

SEQ ID NO: 286217 - DNA, 20 bp, human
gcgcccctgctctcggtctt

SEQ ID NO: 286218 - DNA, 20 bp, human
gaaggtgcgtacacggagga

SEQ ID NO: 286219 - DNA, 20 bp, human
ggcggtggaaggtgcgtaca

SEQ ID NO: 286220 - DNA, 20 bp, human
ggcgcgtgatggaccagtag

SEQ ID NO: 286221 - DNA, 20 bp, human
ggcggagcgtgtattccatg

SEQ ID NO: 286222 - DNA, 20 bp, human
ggccaccaggacatccgaga

SEQ ID NO: 286223 - DNA, 20 bp, human
gaggacatccgagacggcca

SEQ ID NO: 286224 - DNA, 20 bp, human
gcagtagcggtccagggcta

SEQ ID NO: 286225 - DNA, 20 bp, human
ggtggaaggtgcgtacacgg

SEQ ID NO: 286226 - DNA, 20 bp, human
gcggacagcaccacatgtgg

SEQ ID NO: 286227 - DNA, 20 bp, human
gaaccctcctgctcccgggc

SEQ ID NO: 286228 - DNA, 20 bp, human
ggccccgcccgggagcagga

SEQ ID NO: 286229 - DNA, 20 bp, human
gctgcgctccccgcgcctgg

SEQ ID NO: 286230 - DNA, 20 bp, human
gccgcggacagcaccacatg

SEQ ID NO: 286231 - DNA, 20 bp, human
gggggagcgcagcagcaccg

SEQ ID NO: 286232 - DNA, 20 bp, human
gcctcctggctcagagcgcg

SEQ ID NO: 286233 - DNA, 20 bp, human
gacatgtggtggcgcacact

SEQ ID NO: 286234 - DNA, 20 bp, human
gtggctaggggaacgttttg

SEQ ID NO: 286235 - DNA, 20 bp, human
gggctcagagcgcgcggctt

SEQ ID NO: 286236 - DNA, 20 bp, human
ggctggggcgctctgatctt

SEQ ID NO: 286237 - DNA, 20 bp, human
gccgccgccacgtgtgggtt

SEQ ID NO: 286238 - DNA, 20 bp, human
gaggtgacccctcgcagctg

SEQ ID NO: 286239 - DNA, 20 bp, human
gggttgggaggggcatctga

SEQ ID NO: 286240 - DNA, 20 bp, human
gggtgcctgcccactcacaa

SEQ ID NO: 286241 - DNA, 20 bp, human
gaggcggggcgcacgctccg

SEQ ID NO: 286242 - DNA, 20 bp, human
ggaggggcatctgagggtgt

SEQ ID NO: 286243 - DNA, 20 bp, human
ggctgcgaggggtcacctcc

SEQ ID NO: 286244 - DNA, 20 bp, human
gctgcgccgccgccacgtgt

SEQ ID NO: 286245 - DNA, 20 bp, human
gcgtgcgccccgcctcgcgg

SEQ ID NO: 286246 - DNA, 20 bp, human
ggaggctggggtcggctgga

SEQ ID NO: 286247 - DNA, 20 bp, human
gccgccccctcacagtaggg

SEQ ID NO: 286248 - DNA, 20 bp, human
gaggacagcttcccgggcga

SEQ ID NO: 286249 - DNA, 20 bp, human
gctcctgggacgggataccc

SEQ ID NO: 286250 - DNA, 20 bp, human
gagcccgggtatcccgtccc

SEQ ID NO: 286251 - DNA, 20 bp, human
gcccgctccctcgcgctcct

SEQ ID NO: 286252 - DNA, 20 bp, human
ggatcccgggtcccctcgcc

SEQ ID NO: 286253 - DNA, 20 bp, human
ggcggcaaggacagcttccc

SEQ ID NO: 286254 - DNA, 20 bp, human
ggcgccgccccctcacagta

SEQ ID NO: 286255 - DNA, 20 bp, human
gctccctcgcgctcctggga

SEQ ID NO: 286256 - DNA, 20 bp, human
ggaccgggaccgcccgcgga

SEQ ID NO: 286257 - DNA, 20 bp, human
ggggcacggcgcccgggatg

SEQ ID NO: 286258 - DNA, 20 bp, human
gcacaggccggccctctcgc

SEQ ID NO: 286259 - DNA, 20 bp, human
ggacgagccgccttggggac

SEQ ID NO: 286260 - DNA, 20 bp, human
gtgcggaaagcgaatatgtg

SEQ ID NO: 286261 - DNA, 20 bp, human
gcagcccattggcctcgcag

SEQ ID NO: 286262 - DNA, 20 bp, human
gatgggggctggccggatgg

SEQ ID NO: 286263 - DNA, 20 bp, human
gtggccggatggcgggaggg

SEQ ID NO: 286264 - DNA, 20 bp, human
gccccctccgcgggcggtcc

SEQ ID NO: 286265 - DNA, 20 bp, human
gaatatgtggggcgcgcaga

SEQ ID NO: 286266 - DNA, 20 bp, human
gccgggaccaggattccggg

SEQ ID NO: 286267 - DNA, 20 bp, human
gcccggccgcaggggctctt

SEQ ID NO: 286268 - DNA, 20 bp, human
gccgtctcacaactcgcgtc

SEQ ID NO: 286269 - DNA, 20 bp, human
gtcccggcgtgcacttctga

SEQ ID NO: 286270 - DNA, 20 bp, human
gtcccggcattcgtggggca

SEQ ID NO: 286271 - DNA, 20 bp, human
gagaagtgcacgccgggacc

SEQ ID NO: 286272 - DNA, 20 bp, human
ggtgccgcctctgagtaggg

SEQ ID NO: 286273 - DNA, 20 bp, human
ggtcctgaggcgcgccggaa

SEQ ID NO: 286274 - DNA, 20 bp, human
gccggcgcgcctcaggactt

SEQ ID NO: 286275 - DNA, 20 bp, human
gctactcagaggcggcaccc

SEQ ID NO: 286276 - DNA, 20 bp, human
gcaggccttgggactctggt

SEQ ID NO: 286277 - DNA, 20 bp, human
ggacacgcaggggtcctttc

SEQ ID NO: 286278 - DNA, 20 bp, human
ggtcccaaggcctgccgggt

SEQ ID NO: 286279 - DNA, 20 bp, human
gaggccaggcggggccctgt

SEQ ID NO: 286280 - DNA, 20 bp, human
ggcctggtcgagaaaacccg

SEQ ID NO: 286281 - DNA, 20 bp, human
ggggccgccccttccagcga

SEQ ID NO: 286282 - DNA, 20 bp, human
ggcgccgggcgcctacggat

SEQ ID NO: 286283 - DNA, 20 bp, human
gccgccgcccgcggaccgtc

SEQ ID NO: 286284 - DNA, 20 bp, human
gcctatcccagaaacgttgg

SEQ ID NO: 286285 - DNA, 20 bp, human
gccggcaggccttgggactc

SEQ ID NO: 286286 - DNA, 20 bp, human
gcgggtggtaggggatgtac

SEQ ID NO: 286287 - DNA, 20 bp, human
gccgacgggggcgggtggta

SEQ ID NO: 286288 - DNA, 20 bp, human
gtacgggtgtgtatatgcag

SEQ ID NO: 286289 - DNA, 20 bp, human
gtggtcagaaggtcagtatt

SEQ ID NO: 286290 - DNA, 20 bp, human
gtcacccacccatggtcaga

SEQ ID NO: 286291 - DNA, 20 bp, human
gtaggttcctgctccgggta

SEQ ID NO: 286292 - DNA, 20 bp, human
gtccctaaaaccgacaatga

SEQ ID NO: 286293 - DNA, 20 bp, human
gtgaccttctgaccatgggt

SEQ ID NO: 286294 - DNA, 20 bp, human
ggggggagaacctggctccg

SEQ ID NO: 286295 - DNA, 20 bp, human
gtgcactcgctgtaagctct

SEQ ID NO: 286296 - DNA, 20 bp, human
ggggcgggactgcatggtaa

SEQ ID NO: 286297 - DNA, 20 bp, human
ggcgcggggctcaacggaga

SEQ ID NO: 286298 - DNA, 20 bp, human
gtggcagagtccgcaggcta

SEQ ID NO: 286299 - DNA, 20 bp, human
gcgggactgcatggtaaggg

SEQ ID NO: 286300 - DNA, 20 bp, human
ggcgaaggcgcggggctcaa

SEQ ID NO: 286301 - DNA, 20 bp, human
gcaggggcgggctggttccc

SEQ ID NO: 286302 - DNA, 20 bp, human
gggcgtggtgagactgtaat

SEQ ID NO: 286303 - DNA, 20 bp, human
gactctgccaatggctggcc

SEQ ID NO: 286304 - DNA, 20 bp, human
gccacccgggcgaaggcgcg

SEQ ID NO: 286305 - DNA, 20 bp, human
gtcagcggccttgctgtgtg

SEQ ID NO: 286306 - DNA, 20 bp, human
gctcccgggccgcccaggtc

SEQ ID NO: 286307 - DNA, 20 bp, human
gggaggcggcccgacctggg

SEQ ID NO: 286308 - DNA, 20 bp, human
gggggaaggaggggctacta

SEQ ID NO: 286309 - DNA, 20 bp, human
gcagacagggagaacctgcg

SEQ ID NO: 286310 - DNA, 20 bp, human
gcgcctcttgcccggattct

SEQ ID NO: 286311 - DNA, 20 bp, human
gaaaacccaagcccagaatc

SEQ ID NO: 286312 - DNA, 20 bp, human
ggccctcccctctccagcga

SEQ ID NO: 286313 - DNA, 20 bp, human
gtccggctgcgcctcttgcc

SEQ ID NO: 286314 - DNA, 20 bp, human
gcaacccgactcacagtcca

SEQ ID NO: 286315 - DNA, 20 bp, human
gtccctgtctggcgctcagg

SEQ ID NO: 286316 - DNA, 20 bp, human
ggaggtggggtcacgggtca

SEQ ID NO: 286317 - DNA, 20 bp, human
gcgtgaccccacctcctcta

SEQ ID NO: 286318 - DNA, 20 bp, human
gatcacaggtcacgccccgg

SEQ ID NO: 286319 - DNA, 20 bp, human
ggggctacgcgactcttacc

SEQ ID NO: 286320 - DNA, 20 bp, human
gcggaggcatacccggagac

SEQ ID NO: 286321 - DNA, 20 bp, human
gttatctccgggccacgccc

SEQ ID NO: 286322 - DNA, 20 bp, human
ggtcacgccctagaggaggt

SEQ ID NO: 286323 - DNA, 20 bp, human
gcctccgcgctgccgggtaa

SEQ ID NO: 286324 - DNA, 20 bp, human
gaacaacctccccgaatctg

SEQ ID NO: 286325 - DNA, 20 bp, human
gaacacggcagcgcgaacag

SEQ ID NO: 286326 - DNA, 20 bp, human
gtaggcctggagccacggaa

SEQ ID NO: 286327 - DNA, 20 bp, human
gaacggaagcattttgtgag

SEQ ID NO: 286328 - DNA, 20 bp, human
gggaaggtgagaacgggcgt

SEQ ID NO: 286329 - DNA, 20 bp, human
gcggttgcgggttctgttgt

SEQ ID NO: 286330 - DNA, 20 bp, human
gggaccccagcggaccggaa

SEQ ID NO: 286331 - DNA, 20 bp, human
ggggttcccggttgcggttg

SEQ ID NO: 286332 - DNA, 20 bp, human
ggcagcgccacggaccccag

SEQ ID NO: 286333 - DNA, 20 bp, human
ggcactcgggttcccggttg

SEQ ID NO: 286334 - DNA, 20 bp, human
gttgtgggttccgcagccct

SEQ ID NO: 286335 - DNA, 20 bp, human
gaggcaggcactcgggttcc

SEQ ID NO: 286336 - DNA, 20 bp, human
gtgaagtcgggtcccttgca

SEQ ID NO: 286337 - DNA, 20 bp, human
gctccctccgcggtgaagtc

SEQ ID NO: 286338 - DNA, 20 bp, human
ggggcggagccaacctacca

SEQ ID NO: 286339 - DNA, 20 bp, human
gaacctaacgaagcagtgag

SEQ ID NO: 286340 - DNA, 20 bp, human
ggggtcggaaacctcgtggt

SEQ ID NO: 286341 - DNA, 20 bp, human
gaggcgcgggcggcatcctg

SEQ ID NO: 286342 - DNA, 20 bp, human
gtgcgggagccggccgtggt

SEQ ID NO: 286343 - DNA, 20 bp, human
gatcccgcgagaacctctac

SEQ ID NO: 286344 - DNA, 20 bp, human
gtggtaggcgagatccctgc

SEQ ID NO: 286345 - DNA, 20 bp, human
gatgactgggagtttttcgg

SEQ ID NO: 286346 - DNA, 20 bp, human
gagccccgactcaaccggaa

SEQ ID NO: 286347 - DNA, 20 bp, human
ggggactaagacccgggccg

SEQ ID NO: 286348 - DNA, 20 bp, human
ggagggaggtagggacgaac

SEQ ID NO: 286349 - DNA, 20 bp, human
gctgccccgggccagcctaa

SEQ ID NO: 286350 - DNA, 20 bp, human
gtgggacaaatggtctctgg

SEQ ID NO: 286351 - DNA, 20 bp, human
ggaacgggtggactgaccac

SEQ ID NO: 286352 - DNA, 20 bp, human
ggacaaggggactaagaccc

SEQ ID NO: 286353 - DNA, 20 bp, human
gcctgcggggccgtacgagt

SEQ ID NO: 286354 - DNA, 20 bp, human
gcccacagccccgactcaac

SEQ ID NO: 286355 - DNA, 20 bp, human
gaggggtggcccggagacgg

SEQ ID NO: 286356 - DNA, 20 bp, human
gctagtgctgacagcgtggg

SEQ ID NO: 286357 - DNA, 20 bp, human
gtggcaaagggatcttggtt

SEQ ID NO: 286358 - DNA, 20 bp, human
ggccctagtgctgacagcgt

SEQ ID NO: 286359 - DNA, 20 bp, human
gaaggggcgggccttggatt

SEQ ID NO: 286360 - DNA, 20 bp, human
ggggcgggccttggattagg

SEQ ID NO: 286361 - DNA, 20 bp, human
gcagaggtagccctgatgcc

SEQ ID NO: 286362 - DNA, 20 bp, human
gacctcctccagcctaggta

SEQ ID NO: 286363 - DNA, 20 bp, human
gtggctgcatctgacattga

SEQ ID NO: 286364 - DNA, 20 bp, human
gggcctggcctcctaatcca

SEQ ID NO: 286365 - DNA, 20 bp, human
ggggctttgtggccttacct

SEQ ID NO: 286366 - DNA, 20 bp, human
gctggctgaagtgacgtgct

SEQ ID NO: 286367 - DNA, 20 bp, human
gaaggaggaggggcctgtat

SEQ ID NO: 286368 - DNA, 20 bp, human
gggaagaagccaaatcgagg

SEQ ID NO: 286369 - DNA, 20 bp, human
gcctggaagaagccaaatcg

SEQ ID NO: 286370 - DNA, 20 bp, human
gcttaggtcccgcctcgatt

SEQ ID NO: 286371 - DNA, 20 bp, human
gggacctaagctgtgacgca

SEQ ID NO: 286372 - DNA, 20 bp, human
ggaaacggtccgatcaggtg

SEQ ID NO: 286373 - DNA, 20 bp, human
gtccccacccggccccatac

SEQ ID NO: 286374 - DNA, 20 bp, human
ggctctgacaagtctagctt

SEQ ID NO: 286375 - DNA, 20 bp, human
gtctccttgcgtcacagctt

SEQ ID NO: 286376 - DNA, 20 bp, human
gtccctctgcagaggacctg

SEQ ID NO: 286377 - DNA, 20 bp, human
ggggcattagggtcctaaat

SEQ ID NO: 286378 - DNA, 20 bp, human
gagccccaggtcctctgcag

SEQ ID NO: 286379 - DNA, 20 bp, human
gcgagcccgaaacgaggcac

SEQ ID NO: 286380 - DNA, 20 bp, human
gcccgggcccacctccgcac

SEQ ID NO: 286381 - DNA, 20 bp, human
ggggacgtggccgcccattt

SEQ ID NO: 286382 - DNA, 20 bp, human
gaggactgaaccaccggcct

SEQ ID NO: 286383 - DNA, 20 bp, human
ggagactcccatagaaagcc

SEQ ID NO: 286384 - DNA, 20 bp, human
gcgggattggacttgcggac

SEQ ID NO: 286385 - DNA, 20 bp, human
gggtgccggtgcctcgtttc

SEQ ID NO: 286386 - DNA, 20 bp, human
gatcctactcgggaagggtg

SEQ ID NO: 286387 - DNA, 20 bp, human
ggccagatcctactcgggaa

SEQ ID NO: 286388 - DNA, 20 bp, human
gtccctccagaatgccctgc

SEQ ID NO: 286389 - DNA, 20 bp, human
gaaagggccaggaacaggcg

SEQ ID NO: 286390 - DNA, 20 bp, human
ggccagcagggcattctgga

SEQ ID NO: 286391 - DNA, 20 bp, human
gacaggaaggctatgggctc

SEQ ID NO: 286392 - DNA, 20 bp, human
gaggatgggccccaatccta

SEQ ID NO: 286393 - DNA, 20 bp, human
gtgggccccaatcctaggga

SEQ ID NO: 286394 - DNA, 20 bp, human
gatgggaggcgggagcggat

SEQ ID NO: 286395 - DNA, 20 bp, human
gtgaagaggttccctagtgt

SEQ ID NO: 286396 - DNA, 20 bp, human
gctggctgaagtgacgtgct

SEQ ID NO: 286397 - DNA, 20 bp, human
gaaggaggaggggcctgtat

SEQ ID NO: 286398 - DNA, 20 bp, human
gggaagaagccaaatcgagg

SEQ ID NO: 286399 - DNA, 20 bp, human
gcctggaagaagccaaatcg

SEQ ID NO: 286400 - DNA, 20 bp, human
gcttaggtcccgcctcgatt

SEQ ID NO: 286401 - DNA, 20 bp, human
gggacctaagctgtgacgca

SEQ ID NO: 286402 - DNA, 20 bp, human
ggtgacgcgcaaaccagggg

SEQ ID NO: 286403 - DNA, 20 bp, human
ggaaacggtccgatcaggtg

SEQ ID NO: 286404 - DNA, 20 bp, human
gtccccacccggccccatac

SEQ ID NO: 286405 - DNA, 20 bp, human
gaccaggggcgggttctaag

SEQ ID NO: 286406 - DNA, 20 bp, human
gcccaggaagtgtaagagat

SEQ ID NO: 286407 - DNA, 20 bp, human
gaggaagtgtaagagattgg

SEQ ID NO: 286408 - DNA, 20 bp, human
gggaaaagcactattttggt

SEQ ID NO: 286409 - DNA, 20 bp, human
gcgggaatcaccttgtctac

SEQ ID NO: 286410 - DNA, 20 bp, human
gacaaggtgattcccgtgcc

SEQ ID NO: 286411 - DNA, 20 bp, human
gctactggttgctaagtcct

SEQ ID NO: 286412 - DNA, 20 bp, human
ggtgattcccgtgcctggct

SEQ ID NO: 286413 - DNA, 20 bp, human
gagtgggtgcagtccaagga

SEQ ID NO: 286414 - DNA, 20 bp, human
gcaaaatagtgcttttccca

SEQ ID NO: 286415 - DNA, 20 bp, human
gattcccgtgcctggctcgg

SEQ ID NO: 286416 - DNA, 20 bp, human
gaaaactttgactctttagc

SEQ ID NO: 286417 - DNA, 20 bp, human
gttcgttatctaggctagag

SEQ ID NO: 286418 - DNA, 20 bp, human
gagcctccagtttaacttgg

SEQ ID NO: 286419 - DNA, 20 bp, human
gtaaattcactaacttaaga

SEQ ID NO: 286420 - DNA, 20 bp, human
gtaagttagtgaatttaaac

SEQ ID NO: 286421 - DNA, 20 bp, human
ggcaagcctccagtttaact

SEQ ID NO: 286422 - DNA, 20 bp, human
ggggtattttcagaaagcaa

SEQ ID NO: 286423 - DNA, 20 bp, human
gtccagaataaagagaaaaa

SEQ ID NO: 286424 - DNA, 20 bp, human
gcccttttttctctttattc

SEQ ID NO: 286425 - DNA, 20 bp, human
gcttttaagagaactgactt

SEQ ID NO: 286426 - DNA, 20 bp, human
ggaagtgtggctttggggag

SEQ ID NO: 286427 - DNA, 20 bp, human
gtgctaggtgcaaaagaatt

SEQ ID NO: 286428 - DNA, 20 bp, human
gctggcgaagtgtggctttg

SEQ ID NO: 286429 - DNA, 20 bp, human
gcaagccgcgcgatgattgg

SEQ ID NO: 286430 - DNA, 20 bp, human
gagaaggaagatggggttaa

SEQ ID NO: 286431 - DNA, 20 bp, human
ggtggtgtccgaagaatcct

SEQ ID NO: 286432 - DNA, 20 bp, human
gaactaggcctggcgaagtg

SEQ ID NO: 286433 - DNA, 20 bp, human
gtccgtggttaccgtggcaa

SEQ ID NO: 286434 - DNA, 20 bp, human
gtagcaagccgcgcgatgat

SEQ ID NO: 286435 - DNA, 20 bp, human
ggcctcctccaatcatcgcg

SEQ ID NO: 286436 - DNA, 20 bp, human
ggtagggaggccgagctcca

SEQ ID NO: 286437 - DNA, 20 bp, human
gcaggacccgcgcctggaga

SEQ ID NO: 286438 - DNA, 20 bp, human
gttagcgagagagggatcac

SEQ ID NO: 286439 - DNA, 20 bp, human
gagagagggatcacggggag

SEQ ID NO: 286440 - DNA, 20 bp, human
gagggcccggttgcaatgat

SEQ ID NO: 286441 - DNA, 20 bp, human
gaggctagtggtgtgataac

SEQ ID NO: 286442 - DNA, 20 bp, human
ggagagagctggctgcccga

SEQ ID NO: 286443 - DNA, 20 bp, human
gctctctcttgcttcgcgtc

SEQ ID NO: 286444 - DNA, 20 bp, human
gcggcctccctaccttctcc

SEQ ID NO: 286445 - DNA, 20 bp, human
ggctctcaggccctggagct

SEQ ID NO: 286446 - DNA, 20 bp, human
ggcaacccggagagccaatc

SEQ ID NO: 286447 - DNA, 20 bp, human
gtttcccggccccgcctagg

SEQ ID NO: 286448 - DNA, 20 bp, human
gttgccgccccaccccgagt

SEQ ID NO: 286449 - DNA, 20 bp, human
gcaatcaggaataaggagtc

SEQ ID NO: 286450 - DNA, 20 bp, human
gaagcctgcccactcggggt

SEQ ID NO: 286451 - DNA, 20 bp, human
gaggacccttacagttcctg

SEQ ID NO: 286452 - DNA, 20 bp, human
gaggagtccggttcatgaaa

SEQ ID NO: 286453 - DNA, 20 bp, human
ggaggagccaatcagaagtc

SEQ ID NO: 286454 - DNA, 20 bp, human
ggccgaaagcctgcccactc

SEQ ID NO: 286455 - DNA, 20 bp, human
gaaggtagccggattctgac

SEQ ID NO: 286456 - DNA, 20 bp, human
gctccctcttattggtcctg

SEQ ID NO: 286457 - DNA, 20 bp, human
gggtccgccctccctcttat

SEQ ID NO: 286458 - DNA, 20 bp, human
gcggaccgggccaagggtgc

SEQ ID NO: 286459 - DNA, 20 bp, human
gtaccctcaggaccaataag

SEQ ID NO: 286460 - DNA, 20 bp, human
gatgctcccgccggcggaga

SEQ ID NO: 286461 - DNA, 20 bp, human
gtccaagtctgtatcctgat

SEQ ID NO: 286462 - DNA, 20 bp, human
gggaccaataagagggaggg

SEQ ID NO: 286463 - DNA, 20 bp, human
gggagggcggaccgggccaa

SEQ ID NO: 286464 - DNA, 20 bp, human
gttgtctgggccttctccgc

SEQ ID NO: 286465 - DNA, 20 bp, human
gatcccgggcatgctcccgc

SEQ ID NO: 286466 - DNA, 20 bp, human
gacaaggctggcaaagggag

SEQ ID NO: 286467 - DNA, 20 bp, human
gaagcagccggcgtcggcct

SEQ ID NO: 286468 - DNA, 20 bp, human
gccccggcgcgcgtactcat

SEQ ID NO: 286469 - DNA, 20 bp, human
gaggggaccagccaccggtt

SEQ ID NO: 286470 - DNA, 20 bp, human
gactcattggaccacgtccc

SEQ ID NO: 286471 - DNA, 20 bp, human
ggctgcttctgcccaaccgg

SEQ ID NO: 286472 - DNA, 20 bp, human
gtgggattggaccacgtcac

SEQ ID NO: 286473 - DNA, 20 bp, human
gcctccgccgccccattaca

SEQ ID NO: 286474 - DNA, 20 bp, human
gcagccttgtaatggggcgg

SEQ ID NO: 286475 - DNA, 20 bp, human
gccggctgcttctgcccaac

SEQ ID NO: 286476 - DNA, 20 bp, human
gaggtggttaaggatatcgg

SEQ ID NO: 286477 - DNA, 20 bp, human
gcggaagtcggcgtgaggtg

SEQ ID NO: 286478 - DNA, 20 bp, human
gcggaagctgtgtcagttgc

SEQ ID NO: 286479 - DNA, 20 bp, human
gacacagcttccgcccgggg

SEQ ID NO: 286480 - DNA, 20 bp, human
gaactgacacagcttccgcc

SEQ ID NO: 286481 - DNA, 20 bp, human
gtgaacggagttccctgagg

SEQ ID NO: 286482 - DNA, 20 bp, human
gaacactgtacaaacccgaa

SEQ ID NO: 286483 - DNA, 20 bp, human
ggctggagcggtgtcgggtt

SEQ ID NO: 286484 - DNA, 20 bp, human
gtcgggttaggtctgagaga

SEQ ID NO: 286485 - DNA, 20 bp, human
gttaaggatatcggtggggt

SEQ ID NO: 286486 - DNA, 20 bp, human
gcgcccgcggagcgcggggt

SEQ ID NO: 286487 - DNA, 20 bp, human
gcgggctccggactccctgg

SEQ ID NO: 286488 - DNA, 20 bp, human
gcgcccagcgtcactctgga

SEQ ID NO: 286489 - DNA, 20 bp, human
gcatcccacgacctcttcca

SEQ ID NO: 286490 - DNA, 20 bp, human
gtggactcgaacagcagcag

SEQ ID NO: 286491 - DNA, 20 bp, human
gggcacccacgcagtcactt

SEQ ID NO: 286492 - DNA, 20 bp, human
gccgccccagggagcggggt

SEQ ID NO: 286493 - DNA, 20 bp, human
gaggagagggtaaccagcag

SEQ ID NO: 286494 - DNA, 20 bp, human
gtacccgtgggaatcacgtg

SEQ ID NO: 286495 - DNA, 20 bp, human
ggcgcggggtgggcttagaa

SEQ ID NO: 286496 - DNA, 20 bp, human
gacaggcagcagaagcggat

SEQ ID NO: 286497 - DNA, 20 bp, human
gtaaacccaagtgacctcaa

SEQ ID NO: 286498 - DNA, 20 bp, human
gtagatagaaagtacctcac

SEQ ID NO: 286499 - DNA, 20 bp, human
gtcagccattgaggtcactt

SEQ ID NO: 286500 - DNA, 20 bp, human
gcactcatgtcttacaaaga

SEQ ID NO: 286501 - DNA, 20 bp, human
gcagagctgagaaaggtgtg

SEQ ID NO: 286502 - DNA, 20 bp, human
gggatggaaattaatgacag

SEQ ID NO: 286503 - DNA, 20 bp, human
ggaggtactttctatctata

SEQ ID NO: 286504 - DNA, 20 bp, human
gagggaaaggtgtataaaaa

SEQ ID NO: 286505 - DNA, 20 bp, human
ggaagacctactctgtggta

SEQ ID NO: 286506 - DNA, 20 bp, human
gggctcggatggtgcgacag

SEQ ID NO: 286507 - DNA, 20 bp, human
gtgggccgtcacctacccgg

SEQ ID NO: 286508 - DNA, 20 bp, human
gtcgcaccatccgagccagt

SEQ ID NO: 286509 - DNA, 20 bp, human
gcggacatgattgcgcccac

SEQ ID NO: 286510 - DNA, 20 bp, human
gaaaatgcgggatccagtga

SEQ ID NO: 286511 - DNA, 20 bp, human
gcatgtccggcgcgaccaat

SEQ ID NO: 286512 - DNA, 20 bp, human
gaggcgccgattggtcgcgc

SEQ ID NO: 286513 - DNA, 20 bp, human
ggaaaacgaaccagcgctga

SEQ ID NO: 286514 - DNA, 20 bp, human
gggaaggggcgccgaggtcg

SEQ ID NO: 286515 - DNA, 20 bp, human
gcaacaagccaggcgccgat

SEQ ID NO: 286516 - DNA, 20 bp, human
gggcgggctcagattcacgg

SEQ ID NO: 286517 - DNA, 20 bp, human
gccccccggcggctgcaggg

SEQ ID NO: 286518 - DNA, 20 bp, human
gtgcagggaggacccggagg

SEQ ID NO: 286519 - DNA, 20 bp, human
ggccttcccggagtccgcgg

SEQ ID NO: 286520 - DNA, 20 bp, human
ggggtcctccctgcagccgc

SEQ ID NO: 286521 - DNA, 20 bp, human
ggggggcgggctcagattca

SEQ ID NO: 286522 - DNA, 20 bp, human
gaccgccttcccggagtccg

SEQ ID NO: 286523 - DNA, 20 bp, human
gggagggagcggcgggtagt

SEQ ID NO: 286524 - DNA, 20 bp, human
gtaagagggcgcacgcgctc

SEQ ID NO: 286525 - DNA, 20 bp, human
ggggctcagattcacggggg

SEQ ID NO: 286526 - DNA, 20 bp, human
ggcgcagagtgcgtgcgtga

SEQ ID NO: 286527 - DNA, 20 bp, human
gctgaggggcggagcagcgc

SEQ ID NO: 286528 - DNA, 20 bp, human
gactctcagtcggcctcaac

SEQ ID NO: 286529 - DNA, 20 bp, human
gcgcaggctccaccctcggt

SEQ ID NO: 286530 - DNA, 20 bp, human
gcggaacgtgcgtgcctgag

SEQ ID NO: 286531 - DNA, 20 bp, human
ggggcctcccgagctggaag

SEQ ID NO: 286532 - DNA, 20 bp, human
gagggcccaaggaagcggga

SEQ ID NO: 286533 - DNA, 20 bp, human
gggcggagcagcgccggttg

SEQ ID NO: 286534 - DNA, 20 bp, human
gagcctgcgtgctgacggat

SEQ ID NO: 286535 - DNA, 20 bp, human
ggggcggagcatcgtgcgcg

SEQ ID NO: 286536 - DNA, 20 bp, human
gacagtgattggctgttgga

SEQ ID NO: 286537 - DNA, 20 bp, human
gccaaggtgatgtcagaacg

SEQ ID NO: 286538 - DNA, 20 bp, human
gccaatcactgtcacgacca

SEQ ID NO: 286539 - DNA, 20 bp, human
gtagatgaagatgaatagtt

SEQ ID NO: 286540 - DNA, 20 bp, human
gagccaagaggtttgcattg

SEQ ID NO: 286541 - DNA, 20 bp, human
gacgtgattctagagccaag

SEQ ID NO: 286542 - DNA, 20 bp, human
gcaatgaagtatatttcagg

SEQ ID NO: 286543 - DNA, 20 bp, human
gtttcactatgtcgaaagaa

SEQ ID NO: 286544 - DNA, 20 bp, human
gcattgtggaatttaattga

SEQ ID NO: 286545 - DNA, 20 bp, human
gaatatgtataataatatac

SEQ ID NO: 286546 - DNA, 20 bp, human
ggggccgctgactcaggcca

SEQ ID NO: 286547 - DNA, 20 bp, human
ggggaactctaggccaacaa

SEQ ID NO: 286548 - DNA, 20 bp, human
gctgccacgcgaaaccttct

SEQ ID NO: 286549 - DNA, 20 bp, human
ggcgaggtcaagttcctttg

SEQ ID NO: 286550 - DNA, 20 bp, human
ggccttggggccgctgactc

SEQ ID NO: 286551 - DNA, 20 bp, human
gtctgccatggccttttccc

SEQ ID NO: 286552 - DNA, 20 bp, human
gcgggcggttcccagtaata

SEQ ID NO: 286553 - DNA, 20 bp, human
gtctaggccaacaacggtga

SEQ ID NO: 286554 - DNA, 20 bp, human
gtaggtagctggagactcgc

SEQ ID NO: 286555 - DNA, 20 bp, human
gtggctggtgcctgcccaga

SEQ ID NO: 286556 - DNA, 20 bp, human
gagagtggaaaaatggagta

SEQ ID NO: 286557 - DNA, 20 bp, human
gactggaacactaagcttac

SEQ ID NO: 286558 - DNA, 20 bp, human
gtccagagtacaaccaatgt

SEQ ID NO: 286559 - DNA, 20 bp, human
gtaggtaccataaatatgaa

SEQ ID NO: 286560 - DNA, 20 bp, human
gtgtaaaaatacagcataga

SEQ ID NO: 286561 - DNA, 20 bp, human
gtaaatatccataattgcaa

SEQ ID NO: 286562 - DNA, 20 bp, human
gacccacattggttgtactc

SEQ ID NO: 286563 - DNA, 20 bp, human
gttaactttaaacatgagag

SEQ ID NO: 286564 - DNA, 20 bp, human
gcaattatggatatttaaaa

SEQ ID NO: 286565 - DNA, 20 bp, human
gtaagcgtattcatagcttg

SEQ ID NO: 286566 - DNA, 20 bp, human
gaaccctggggtgtacgctg

SEQ ID NO: 286567 - DNA, 20 bp, human
gggggcggggtcactctggg

SEQ ID NO: 286568 - DNA, 20 bp, human
gtcagccgaaggcgagggaa

SEQ ID NO: 286569 - DNA, 20 bp, human
gagccacagcgtacacccca

SEQ ID NO: 286570 - DNA, 20 bp, human
gctgctggagggtagaagcg

SEQ ID NO: 286571 - DNA, 20 bp, human
gacccctcccagggtgaccg

SEQ ID NO: 286572 - DNA, 20 bp, human
gaacacctgccggagagcag

SEQ ID NO: 286573 - DNA, 20 bp, human
gtctgggcggcggatccgag

SEQ ID NO: 286574 - DNA, 20 bp, human
gcaggaaccggcccttcctg

SEQ ID NO: 286575 - DNA, 20 bp, human
gcaggcggcggtaggtagcc

SEQ ID NO: 286576 - DNA, 20 bp, human
gaggtgtcaggctcccgctg

SEQ ID NO: 286577 - DNA, 20 bp, human
gagattcatcataaacatta

SEQ ID NO: 286578 - DNA, 20 bp, human
gcactggtgcggaggggcac

SEQ ID NO: 286579 - DNA, 20 bp, human
ggccgcctgagggggaatag

SEQ ID NO: 286580 - DNA, 20 bp, human
ggcctgagggggaatagggg

SEQ ID NO: 286581 - DNA, 20 bp, human
ggggtcaggccggcgcccga

SEQ ID NO: 286582 - DNA, 20 bp, human
ggggcctgaccgccgcctga

SEQ ID NO: 286583 - DNA, 20 bp, human
ggggaataggggcggacagg

SEQ ID NO: 286584 - DNA, 20 bp, human
gtcaggccggcgcccgaggg

SEQ ID NO: 286585 - DNA, 20 bp, human
gcccgccaccggcccgactc

SEQ ID NO: 286586 - DNA, 20 bp, human
gctgaagcggccagcgaggg

SEQ ID NO: 286587 - DNA, 20 bp, human
ggagctgaagcggccagcga

SEQ ID NO: 286588 - DNA, 20 bp, human
gcccgggcaccctgtcagtc

SEQ ID NO: 286589 - DNA, 20 bp, human
gggcagggcgatgaccccgg

SEQ ID NO: 286590 - DNA, 20 bp, human
gaggatgaccctctcggccc

SEQ ID NO: 286591 - DNA, 20 bp, human
gcgagggaggatgaccctct

SEQ ID NO: 286592 - DNA, 20 bp, human
gtaaagcaatcgggcggcgg

SEQ ID NO: 286593 - DNA, 20 bp, human
gcaatcgggcggcggtggca

SEQ ID NO: 286594 - DNA, 20 bp, human
gaggccgggagcagcccccg

SEQ ID NO: 286595 - DNA, 20 bp, human
gaacctcgcgccttcccctc

SEQ ID NO: 286596 - DNA, 20 bp, human
ggtcacttctggtggggagt

SEQ ID NO: 286597 - DNA, 20 bp, human
ggaagcacgtcacttctggt

SEQ ID NO: 286598 - DNA, 20 bp, human
ggctagtttagggtgggaac

SEQ ID NO: 286599 - DNA, 20 bp, human
gaatgaggctagtttagggt

SEQ ID NO: 286600 - DNA, 20 bp, human
gacaggaagcacgtcacttc

SEQ ID NO: 286601 - DNA, 20 bp, human
gtgacgtgcttcctgtgccc

SEQ ID NO: 286602 - DNA, 20 bp, human
ggtggtcccggttactctgc

SEQ ID NO: 286603 - DNA, 20 bp, human
ggctaaatgaggctagttta

SEQ ID NO: 286604 - DNA, 20 bp, human
gactgaataagccgtgaact

SEQ ID NO: 286605 - DNA, 20 bp, human
ggtcacagctgcccagttca

SEQ ID NO: 286606 - DNA, 20 bp, human
gcactgctgagtctccccca

SEQ ID NO: 286607 - DNA, 20 bp, human
gggaccagcccattccctgg

SEQ ID NO: 286608 - DNA, 20 bp, human
gtgagtctcccccagggaat

SEQ ID NO: 286609 - DNA, 20 bp, human
ggcggggcctcccactgcga

SEQ ID NO: 286610 - DNA, 20 bp, human
gcactgcgacggaagcacag

SEQ ID NO: 286611 - DNA, 20 bp, human
gtggctgaacttaggtgggt

SEQ ID NO: 286612 - DNA, 20 bp, human
gtctcccccagggaatgggc

SEQ ID NO: 286613 - DNA, 20 bp, human
ggggggccagcagtgcaact

SEQ ID NO: 286614 - DNA, 20 bp, human
gactttgcagagccccgtct

SEQ ID NO: 286615 - DNA, 20 bp, human
gggcccccatttgaattcac

SEQ ID NO: 286616 - DNA, 20 bp, human
gcccgggagtactgcaaaaa

SEQ ID NO: 286617 - DNA, 20 bp, human
gaaggggaggccccaacaga

SEQ ID NO: 286618 - DNA, 20 bp, human
gagggccggctctagagata

SEQ ID NO: 286619 - DNA, 20 bp, human
ggccggctctagagataagg

SEQ ID NO: 286620 - DNA, 20 bp, human
ggggaggaagtgggaggatc

SEQ ID NO: 286621 - DNA, 20 bp, human
gtcccccaagaaaacattgt

SEQ ID NO: 286622 - DNA, 20 bp, human
gaggctgtggctgcttagaa

SEQ ID NO: 286623 - DNA, 20 bp, human
gactcccgggccctctgttg

SEQ ID NO: 286624 - DNA, 20 bp, human
gcctctccagggtggagtcg

SEQ ID NO: 286625 - DNA, 20 bp, human
gaggtcaagaataagattcc

SEQ ID NO: 286626 - DNA, 20 bp, human
gacccctggggtctacgtgg

SEQ ID NO: 286627 - DNA, 20 bp, human
gccggccgcgactctgggat

SEQ ID NO: 286628 - DNA, 20 bp, human
gtggggaaaggacagttcta

SEQ ID NO: 286629 - DNA, 20 bp, human
gggcctccacgtagacccca

SEQ ID NO: 286630 - DNA, 20 bp, human
gaggccctgggccatcatgc

SEQ ID NO: 286631 - DNA, 20 bp, human
gggtgggaggagctaaatgt

SEQ ID NO: 286632 - DNA, 20 bp, human
gtgccagctcgccttcacca

SEQ ID NO: 286633 - DNA, 20 bp, human
gccgcggggtcaaaaggaga

SEQ ID NO: 286634 - DNA, 20 bp, human
ggcgacccctggggtctacg

SEQ ID NO: 286635 - DNA, 20 bp, human
gcatccccggccgcgactct

SEQ ID NO: 286636 - DNA, 20 bp, human
gcgcagcggaagaagcagac

SEQ ID NO: 286637 - DNA, 20 bp, human
ggcgcacactacaggcgcgt

SEQ ID NO: 286638 - DNA, 20 bp, human
ggggacttggaacagaaggt

SEQ ID NO: 286639 - DNA, 20 bp, human
gtgcgcgcggcgcacactac

SEQ ID NO: 286640 - DNA, 20 bp, human
gaaggtggggcctgaagggg

SEQ ID NO: 286641 - DNA, 20 bp, human
ggacccagaggggtttgcgt

SEQ ID NO: 286642 - DNA, 20 bp, human
ggcctgaaggggaggaccct

SEQ ID NO: 286643 - DNA, 20 bp, human
gcgcactttccgtgagttct

SEQ ID NO: 286644 - DNA, 20 bp, human
gagacctcgctgcgccgaaa

SEQ ID NO: 286645 - DNA, 20 bp, human
gcgccgaaacgggacccaga

SEQ ID NO: 286646 - DNA, 20 bp, human
gacgcagtgcagggacgcgc

SEQ ID NO: 286647 - DNA, 20 bp, human
gcactgcgtcctgttcgccc

SEQ ID NO: 286648 - DNA, 20 bp, human
gggcccagagctgcgcctgg

SEQ ID NO: 286649 - DNA, 20 bp, human
gcgcgcgagccagggcgaac

SEQ ID NO: 286650 - DNA, 20 bp, human
gacgaccggccgctttccct

SEQ ID NO: 286651 - DNA, 20 bp, human
ggccagcgaggggagctgca

SEQ ID NO: 286652 - DNA, 20 bp, human
gatcgccttgcggtcagcgg

SEQ ID NO: 286653 - DNA, 20 bp, human
ggcgaacaggacgcagtgca

SEQ ID NO: 286654 - DNA, 20 bp, human
gcctgccggaggctggaaaa

SEQ ID NO: 286655 - DNA, 20 bp, human
gttgcggtcagcgggggtta

SEQ ID NO: 286656 - DNA, 20 bp, human
gccccgcccggcacagagtc

SEQ ID NO: 286657 - DNA, 20 bp, human
gccgcccctcggggacatcc

SEQ ID NO: 286658 - DNA, 20 bp, human
ggggcgctcccgccaaattc

SEQ ID NO: 286659 - DNA, 20 bp, human
gagagcccggatgtccccga

SEQ ID NO: 286660 - DNA, 20 bp, human
ggtagcccggagaaacgcgc

SEQ ID NO: 286661 - DNA, 20 bp, human
gggcccgccctgttgctgtc

SEQ ID NO: 286662 - DNA, 20 bp, human
gcttcccgggccggcatcgg

SEQ ID NO: 286663 - DNA, 20 bp, human
gactaagtttggacagacgc

SEQ ID NO: 286664 - DNA, 20 bp, human
gcgcagccggcgcgtttctc

SEQ ID NO: 286665 - DNA, 20 bp, human
gcctgttgctgtccggaatt

SEQ ID NO: 286666 - DNA, 20 bp, human
gatgccaatggctatatgaa

SEQ ID NO: 286667 - DNA, 20 bp, human
gaaacacccccttgatttga

SEQ ID NO: 286668 - DNA, 20 bp, human
gcacgcttaccatcaaatca

SEQ ID NO: 286669 - DNA, 20 bp, human
ggcttaccatcaaatcaagg

SEQ ID NO: 286670 - DNA, 20 bp, human
gacatgagttaaacaatgca

SEQ ID NO: 286671 - DNA, 20 bp, human
gtcatcatgtgagtattttt

SEQ ID NO: 286672 - DNA, 20 bp, human
gaatagttatgggggttaac

SEQ ID NO: 286673 - DNA, 20 bp, human
gatgcctttcatatagccat

SEQ ID NO: 286674 - DNA, 20 bp, human
gtctgaatcaatagttatgg

SEQ ID NO: 286675 - DNA, 20 bp, human
gactattgattcagagaagt

SEQ ID NO: 286676 - DNA, 20 bp, human
gaggcgggacagaggcaggt

SEQ ID NO: 286677 - DNA, 20 bp, human
gtgcccaggcgtgtgcccgt

SEQ ID NO: 286678 - DNA, 20 bp, human
gcaggcgtgtgcccgtcggc

SEQ ID NO: 286679 - DNA, 20 bp, human
ggctctgagcgcccagcgcg

SEQ ID NO: 286680 - DNA, 20 bp, human
gtcggccggaggcgggacag

SEQ ID NO: 286681 - DNA, 20 bp, human
gtgggcgggctctaccctct

SEQ ID NO: 286682 - DNA, 20 bp, human
gtcctgtcccggggcggtct

SEQ ID NO: 286683 - DNA, 20 bp, human
ggtgccggcgcagcgaggga

SEQ ID NO: 286684 - DNA, 20 bp, human
gagggcaccgtgggaggcaa

SEQ ID NO: 286685 - DNA, 20 bp, human
gcggcctgtccgcctggacg

SEQ ID NO: 286686 - DNA, 20 bp, human
gcgcctccgggaggcctggt

SEQ ID NO: 286687 - DNA, 20 bp, human
ggaggggaggcggcaaactg

SEQ ID NO: 286688 - DNA, 20 bp, human
ggcggccggccagaaagcat

SEQ ID NO: 286689 - DNA, 20 bp, human
gcggaaccaaagctcgaggg

SEQ ID NO: 286690 - DNA, 20 bp, human
gtccgggaggcctggttggc

SEQ ID NO: 286691 - DNA, 20 bp, human
ggggtcccgccgatgctttc

SEQ ID NO: 286692 - DNA, 20 bp, human
ggagagaagtggtgtttctg

SEQ ID NO: 286693 - DNA, 20 bp, human
ggaagagtgccccgatcttg

SEQ ID NO: 286694 - DNA, 20 bp, human
gggagggcacggactctgaa

SEQ ID NO: 286695 - DNA, 20 bp, human
gtctgggggccacaagatcg

SEQ ID NO: 286696 - DNA, 20 bp, human
gaacagcaagggtgggtcgg

SEQ ID NO: 286697 - DNA, 20 bp, human
gaggctggacctaggagcgc

SEQ ID NO: 286698 - DNA, 20 bp, human
gcaggcactagacgagcagg

SEQ ID NO: 286699 - DNA, 20 bp, human
gctagtgcctgctcgcagtg

SEQ ID NO: 286700 - DNA, 20 bp, human
gtgggtcggtggcagggcac

SEQ ID NO: 286701 - DNA, 20 bp, human
ggggcgtgacccgcgctcct

SEQ ID NO: 286702 - DNA, 20 bp, human
gccgggtttcagaacagcaa

SEQ ID NO: 286703 - DNA, 20 bp, human
gcagtgtggaaagacgaccc

SEQ ID NO: 286704 - DNA, 20 bp, human
gcaagggtgggtcggtggca

SEQ ID NO: 286705 - DNA, 20 bp, human
ggtttcagaacagcaagggt

SEQ ID NO: 286706 - DNA, 20 bp, human
gagcgggcgcttccattggt

SEQ ID NO: 286707 - DNA, 20 bp, human
gcggggattggctgcgaacg

SEQ ID NO: 286708 - DNA, 20 bp, human
ggtacagtacagtaagtgcg

SEQ ID NO: 286709 - DNA, 20 bp, human
gttcgcagccaatccccgcg

SEQ ID NO: 286710 - DNA, 20 bp, human
gccgcgcccgcgcccaccaa

SEQ ID NO: 286711 - DNA, 20 bp, human
gcgtccccattggcggaagg

SEQ ID NO: 286712 - DNA, 20 bp, human
gttccgccaatggggacgaa

SEQ ID NO: 286713 - DNA, 20 bp, human
gagtacagtaagtgcggggc

SEQ ID NO: 286714 - DNA, 20 bp, human
ggtgccaccttccgccaatg

SEQ ID NO: 286715 - DNA, 20 bp, human
gggcggggcgcgagcccagc

SEQ ID NO: 286716 - DNA, 20 bp, human
gagccccggagcagactctc

SEQ ID NO: 286717 - DNA, 20 bp, human
gcccgcgagtgatccctgac

SEQ ID NO: 286718 - DNA, 20 bp, human
gggatcactcgcggggtcac

SEQ ID NO: 286719 - DNA, 20 bp, human
gcccccggcgcatcacgcgg

SEQ ID NO: 286720 - DNA, 20 bp, human
ggccaattcatcacctgtca

SEQ ID NO: 286721 - DNA, 20 bp, human
gcctgcacatctggcgcaat

SEQ ID NO: 286722 - DNA, 20 bp, human
gcgcgcgctgagtgacggcg

SEQ ID NO: 286723 - DNA, 20 bp, human
ggggcgcgcgcgctgagtga

SEQ ID NO: 286724 - DNA, 20 bp, human
gacaggtgatgaattggcgg

SEQ ID NO: 286725 - DNA, 20 bp, human
gcatcacgcgggggtggcaa

SEQ ID NO: 286726 - DNA, 20 bp, human
gggtctgacgccgaagaccg

SEQ ID NO: 286727 - DNA, 20 bp, human
ggccgcggattcaaagaatg

SEQ ID NO: 286728 - DNA, 20 bp, human
gaatgaggaagcgctgatac

SEQ ID NO: 286729 - DNA, 20 bp, human
ggccgaagaccgcggagccg

SEQ ID NO: 286730 - DNA, 20 bp, human
gtcggcgtcagaccagccgg

SEQ ID NO: 286731 - DNA, 20 bp, human
gaagcgctgataccggggag

SEQ ID NO: 286732 - DNA, 20 bp, human
gcaaacaggcttcctccggc

SEQ ID NO: 286733 - DNA, 20 bp, human
ggcccgcttaaattgcaaac

SEQ ID NO: 286734 - DNA, 20 bp, human
gcgaaccagtgttgggctaa

SEQ ID NO: 286735 - DNA, 20 bp, human
gcagggaagctcaaagatct

SEQ ID NO: 286736 - DNA, 20 bp, human
ggggagtccggctacccgag

SEQ ID NO: 286737 - DNA, 20 bp, human
gagtccggctacccgagtgg

SEQ ID NO: 286738 - DNA, 20 bp, human
gacgctcgggccaatgggaa

SEQ ID NO: 286739 - DNA, 20 bp, human
ggctacccgagtggaggagt

SEQ ID NO: 286740 - DNA, 20 bp, human
gacctcggggaatgacgctc

SEQ ID NO: 286741 - DNA, 20 bp, human
gcaggctgatgtgtgcccaa

SEQ ID NO: 286742 - DNA, 20 bp, human
gccgtcaacgctgtgggtcg

SEQ ID NO: 286743 - DNA, 20 bp, human
gacccgagtggaggagtggg

SEQ ID NO: 286744 - DNA, 20 bp, human
gcccgcccactcctccactc

SEQ ID NO: 286745 - DNA, 20 bp, human
gagcccgctgggcgcgcggg

SEQ ID NO: 286746 - DNA, 20 bp, human
gccaccggccgcacttgtga

SEQ ID NO: 286747 - DNA, 20 bp, human
gtgaagaccgcggacagccg

SEQ ID NO: 286748 - DNA, 20 bp, human
gtctcccgggagctgcggag

SEQ ID NO: 286749 - DNA, 20 bp, human
gcctgagcaggcggactgga

SEQ ID NO: 286750 - DNA, 20 bp, human
ggcgaggacggtgaagaccg

SEQ ID NO: 286751 - DNA, 20 bp, human
gcaggcggactggagggaca

SEQ ID NO: 286752 - DNA, 20 bp, human
gtccccgcctgggaaagtct

SEQ ID NO: 286753 - DNA, 20 bp, human
gtggagacaaggctcgagtg

SEQ ID NO: 286754 - DNA, 20 bp, human
gcctgggaaagtctgggtgc

SEQ ID NO: 286755 - DNA, 20 bp, human
gtggggccaggacgcaggcg

SEQ ID NO: 286756 - DNA, 20 bp, human
ggccacacgccaattcccgt

SEQ ID NO: 286757 - DNA, 20 bp, human
gccgcccatcccacgggaat

SEQ ID NO: 286758 - DNA, 20 bp, human
gtgggcggagtcagcgagag

SEQ ID NO: 286759 - DNA, 20 bp, human
gaggccacacggggcgagag

SEQ ID NO: 286760 - DNA, 20 bp, human
gttcccggtgatcccggtgg

SEQ ID NO: 286761 - DNA, 20 bp, human
ggattctccatctttgactg

SEQ ID NO: 286762 - DNA, 20 bp, human
ggcgtggccacagtcaaaga

SEQ ID NO: 286763 - DNA, 20 bp, human
gcatcccggcaggtaacctc

SEQ ID NO: 286764 - DNA, 20 bp, human
gacgccaattcccgtgggat

SEQ ID NO: 286765 - DNA, 20 bp, human
gcgtctgcaggcaactcagg

SEQ ID NO: 286766 - DNA, 20 bp, human
ggggacgctggaggcgtcgg

SEQ ID NO: 286767 - DNA, 20 bp, human
gccggcaaggcccaatgggg

SEQ ID NO: 286768 - DNA, 20 bp, human
gggacccgcgagcgggatca

SEQ ID NO: 286769 - DNA, 20 bp, human
gcccgctcgcgggtcccggt

SEQ ID NO: 286770 - DNA, 20 bp, human
gggcccggctggtgcttctc

SEQ ID NO: 286771 - DNA, 20 bp, human
gctccccggcaaggcccaat

SEQ ID NO: 286772 - DNA, 20 bp, human
gcccggctcccgcgggacgc

SEQ ID NO: 286773 - DNA, 20 bp, human
gcgcgcgggcaccaccgggg

SEQ ID NO: 286774 - DNA, 20 bp, human
gcgcgggacgctggaggcgt

SEQ ID NO: 286775 - DNA, 20 bp, human
gggccgcgcgggcaccaccg

SEQ ID NO: 286776 - DNA, 20 bp, human
ggagcccggcgattcgccag

SEQ ID NO: 286777 - DNA, 20 bp, human
ggggctcgtctctctgtgac

SEQ ID NO: 286778 - DNA, 20 bp, human
gcgagcgcgaagcaatcctg

SEQ ID NO: 286779 - DNA, 20 bp, human
gccgcccctggacattccgc

SEQ ID NO: 286780 - DNA, 20 bp, human
gttcgccagcggaatgtcca

SEQ ID NO: 286781 - DNA, 20 bp, human
gaggcgaacccggaaactga

SEQ ID NO: 286782 - DNA, 20 bp, human
gactgaggggccggcatctc

SEQ ID NO: 286783 - DNA, 20 bp, human
gatgccggcccctcagtttc

SEQ ID NO: 286784 - DNA, 20 bp, human
gaatcctgaggcggtctagg

SEQ ID NO: 286785 - DNA, 20 bp, human
gcattccgctggcgaatcgc

SEQ ID NO: 286786 - DNA, 20 bp, human
gctgcggggcgggaagggtc

SEQ ID NO: 286787 - DNA, 20 bp, human
gcccgcagctcgcctggagg

SEQ ID NO: 286788 - DNA, 20 bp, human
gccagccgcggggctgccga

SEQ ID NO: 286789 - DNA, 20 bp, human
ggggctccgactcccatcag

SEQ ID NO: 286790 - DNA, 20 bp, human
gctgcagcgcgcccgggtcc

SEQ ID NO: 286791 - DNA, 20 bp, human
ggggaagggtccggccaccg

SEQ ID NO: 286792 - DNA, 20 bp, human
ggcggcgcggcggccaccat

SEQ ID NO: 286793 - DNA, 20 bp, human
ggcctcctccaggcgagctg

SEQ ID NO: 286794 - DNA, 20 bp, human
gagccagcgccccgtgcccg

SEQ ID NO: 286795 - DNA, 20 bp, human
ggcgcccgggtcccggcagg

SEQ ID NO: 286796 - DNA, 20 bp, human
gaggcgtgagcaagcagtgc

SEQ ID NO: 286797 - DNA, 20 bp, human
gctccccaccggcaaggaaa

SEQ ID NO: 286798 - DNA, 20 bp, human
gtctccttttccttgccggt

SEQ ID NO: 286799 - DNA, 20 bp, human
gcaggccggaagtcggggta

SEQ ID NO: 286800 - DNA, 20 bp, human
gggccccgtaccccgacttc

SEQ ID NO: 286801 - DNA, 20 bp, human
gtcagtacaggccggaagtc

SEQ ID NO: 286802 - DNA, 20 bp, human
gaataccaggaactcagtac

SEQ ID NO: 286803 - DNA, 20 bp, human
gccggcctgtactgagttcc

SEQ ID NO: 286804 - DNA, 20 bp, human
ggtgacgcctgaagctggcg

SEQ ID NO: 286805 - DNA, 20 bp, human
ggggcactctcggagactgg

SEQ ID NO: 286806 - DNA, 20 bp, human
gaggaagagcgacgcgtaag

SEQ ID NO: 286807 - DNA, 20 bp, human
gccgctgccgccatgttgag

SEQ ID NO: 286808 - DNA, 20 bp, human
ggcgcaccgaacggctgggc

SEQ ID NO: 286809 - DNA, 20 bp, human
gcagccgttcggtgcgcgat

SEQ ID NO: 286810 - DNA, 20 bp, human
ggccggcattgtgacgtctc

SEQ ID NO: 286811 - DNA, 20 bp, human
gagcgacgcgtaagtggcag

SEQ ID NO: 286812 - DNA, 20 bp, human
gtgctctaggcgccggaagg

SEQ ID NO: 286813 - DNA, 20 bp, human
gtgaacacgaggggcaaacg

SEQ ID NO: 286814 - DNA, 20 bp, human
ggtctctggcagcactgacg

SEQ ID NO: 286815 - DNA, 20 bp, human
gcagccaatcgcgcaccgaa

SEQ ID NO: 286816 - DNA, 20 bp, human
gggctctggcgcctttaagg

SEQ ID NO: 286817 - DNA, 20 bp, human
gtcgcgggacgctgcctctg

SEQ ID NO: 286818 - DNA, 20 bp, human
ggaacctgagccgtgaccgc

SEQ ID NO: 286819 - DNA, 20 bp, human
ggcaggatcgaaagcgtgat

SEQ ID NO: 286820 - DNA, 20 bp, human
gtcccagcggcggaactcgg

SEQ ID NO: 286821 - DNA, 20 bp, human
gcctctgcggaactgggggt

SEQ ID NO: 286822 - DNA, 20 bp, human
gctgccgttgtcacaggcca

SEQ ID NO: 286823 - DNA, 20 bp, human
ggcgcgtctgccgttgtcac

SEQ ID NO: 286824 - DNA, 20 bp, human
ggagcccgaggcgctgcgaa

SEQ ID NO: 286825 - DNA, 20 bp, human
gcctcgagacgtctgacgtt

SEQ ID NO: 286826 - DNA, 20 bp, human
gctattatccctcaattgag

SEQ ID NO: 286827 - DNA, 20 bp, human
gctttctccctctcaattga

SEQ ID NO: 286828 - DNA, 20 bp, human
ggtagaaaataacttaccct

SEQ ID NO: 286829 - DNA, 20 bp, human
gtaagttattttctactcta

SEQ ID NO: 286830 - DNA, 20 bp, human
gtgtagaaagatatcagcta

SEQ ID NO: 286831 - DNA, 20 bp, human
gggagagatagagagagacc

SEQ ID NO: 286832 - DNA, 20 bp, human
gtacatccccagggtataaa

SEQ ID NO: 286833 - DNA, 20 bp, human
gcttttagtttttaaaccta

SEQ ID NO: 286834 - DNA, 20 bp, human
gatatctttctacatcccca

SEQ ID NO: 286835 - DNA, 20 bp, human
gttaacaagaaaacacaccc

SEQ ID NO: 286836 - DNA, 20 bp, human
gcgggcgcgcgcttcacttc

SEQ ID NO: 286837 - DNA, 20 bp, human
gctggcactcgcgtctccct

SEQ ID NO: 286838 - DNA, 20 bp, human
gaaaacggggagggcgcaga

SEQ ID NO: 286839 - DNA, 20 bp, human
ggcagtagaacgacaggtgg

SEQ ID NO: 286840 - DNA, 20 bp, human
gcactcgcgtctccctgggc

SEQ ID NO: 286841 - DNA, 20 bp, human
gctctggaaccaagaggggc

SEQ ID NO: 286842 - DNA, 20 bp, human
ggccggggcagtagaacgac

SEQ ID NO: 286843 - DNA, 20 bp, human
gctacccggcgctcgagggg

SEQ ID NO: 286844 - DNA, 20 bp, human
ggagacgcgagtgccaggcc

SEQ ID NO: 286845 - DNA, 20 bp, human
ggaaaaggggcgcgggaaaa

SEQ ID NO: 286846 - DNA, 20 bp, human
gagtgaccacagtttatcac

SEQ ID NO: 286847 - DNA, 20 bp, human
gtagtcaatggctctgaagt

SEQ ID NO: 286848 - DNA, 20 bp, human
gatactcaactattagtcaa

SEQ ID NO: 286849 - DNA, 20 bp, human
gacagaactatgaaaacagg

SEQ ID NO: 286850 - DNA, 20 bp, human
gataacacaggttgtgtttc

SEQ ID NO: 286851 - DNA, 20 bp, human
gctgcccctgtgataaactg

SEQ ID NO: 286852 - DNA, 20 bp, human
ggcctttctggcttcctata

SEQ ID NO: 286853 - DNA, 20 bp, human
gtaatagttgagtataacac

SEQ ID NO: 286854 - DNA, 20 bp, human
gtagttctgtgttttccttc

SEQ ID NO: 286855 - DNA, 20 bp, human
gagaactgtggaagcctaaa

SEQ ID NO: 286856 - DNA, 20 bp, human
gaggagattgtattgtgtag

SEQ ID NO: 286857 - DNA, 20 bp, human
gaaagtaaaagattgaaccc

SEQ ID NO: 286858 - DNA, 20 bp, human
ggaaaactactgaactatat

SEQ ID NO: 286859 - DNA, 20 bp, human
gtgggtatcaattcccatat

SEQ ID NO: 286860 - DNA, 20 bp, human
gacactttttggacagtaag

SEQ ID NO: 286861 - DNA, 20 bp, human
gttactttgtcatagctgtg

SEQ ID NO: 286862 - DNA, 20 bp, human
gaactttgctatcacagtat

SEQ ID NO: 286863 - DNA, 20 bp, human
ggttcttttacaagggaact

SEQ ID NO: 286864 - DNA, 20 bp, human
gaaaaagtcatgcatgagtt

SEQ ID NO: 286865 - DNA, 20 bp, human
gctaatatatagaatcttct

SEQ ID NO: 286866 - DNA, 20 bp, human
gtgggtctgcgaagcttgca

SEQ ID NO: 286867 - DNA, 20 bp, human
gcatcctgcagcaataggcg

SEQ ID NO: 286868 - DNA, 20 bp, human
gcctaggtgtagaactgcta

SEQ ID NO: 286869 - DNA, 20 bp, human
gcagcggcccgcaggcccct

SEQ ID NO: 286870 - DNA, 20 bp, human
gcctccggggcgggttctag

SEQ ID NO: 286871 - DNA, 20 bp, human
gataggcgtggccgagagac

SEQ ID NO: 286872 - DNA, 20 bp, human
gcggccacgcctattgctgc

SEQ ID NO: 286873 - DNA, 20 bp, human
gtggaaggagaatggcattg

SEQ ID NO: 286874 - DNA, 20 bp, human
gccgctctgcgcctgtctct

SEQ ID NO: 286875 - DNA, 20 bp, human
gaggagaatggcattgaggc

SEQ ID NO: 286876 - DNA, 20 bp, human
ggggcgatggccgggtggga

SEQ ID NO: 286877 - DNA, 20 bp, human
gctgaggcccgcaaggaagc

SEQ ID NO: 286878 - DNA, 20 bp, human
gccgcggcggcggtcacatg

SEQ ID NO: 286879 - DNA, 20 bp, human
gtggagccccgcttccttgc

SEQ ID NO: 286880 - DNA, 20 bp, human
gcggggcggggccttggtga

SEQ ID NO: 286881 - DNA, 20 bp, human
gtgagcgctttccgagtcat

SEQ ID NO: 286882 - DNA, 20 bp, human
ggaggggttgggtggcctcg

SEQ ID NO: 286883 - DNA, 20 bp, human
gttggtgagggggcgatggc

SEQ ID NO: 286884 - DNA, 20 bp, human
gtccgacccggaggcggaac

SEQ ID NO: 286885 - DNA, 20 bp, human
gctgaagccaagtgtaagga

SEQ ID NO: 286886 - DNA, 20 bp, human
gaaccaagatggctgaggag

SEQ ID NO: 286887 - DNA, 20 bp, human
gtccgcacgtcgggcctccg

SEQ ID NO: 286888 - DNA, 20 bp, human
gggagaaagagaagcctcgg

SEQ ID NO: 286889 - DNA, 20 bp, human
gggtggcggcgcgttctcct

SEQ ID NO: 286890 - DNA, 20 bp, human
ggcacgagagggctaagggg

SEQ ID NO: 286891 - DNA, 20 bp, human
gcctacggtgcggcacgaga

SEQ ID NO: 286892 - DNA, 20 bp, human
gggggcgggggcatgtgcac

SEQ ID NO: 286893 - DNA, 20 bp, human
gggaaccagcccgcgaaccc

SEQ ID NO: 286894 - DNA, 20 bp, human
gatcgagagccggaccgcca

SEQ ID NO: 286895 - DNA, 20 bp, human
ggcctcggaggcccgacgtg

SEQ ID NO: 286896 - DNA, 20 bp, human
gacactcacaacgtgcagtt

SEQ ID NO: 286897 - DNA, 20 bp, human
gtgcgggaggaggagttaga

SEQ ID NO: 286898 - DNA, 20 bp, human
gacgattaaacaaagggagt

SEQ ID NO: 286899 - DNA, 20 bp, human
gtagccacaggatccctcac

SEQ ID NO: 286900 - DNA, 20 bp, human
gaaggacccgcccaattttc

SEQ ID NO: 286901 - DNA, 20 bp, human
gaacgtgcagttgggcgcct

SEQ ID NO: 286902 - DNA, 20 bp, human
gtgtgagtcgtgagtggggg

SEQ ID NO: 286903 - DNA, 20 bp, human
gaattccgacgattaaacaa

SEQ ID NO: 286904 - DNA, 20 bp, human
gaccgctccccagctgcggg

SEQ ID NO: 286905 - DNA, 20 bp, human
gaggggctcactttagccac

SEQ ID NO: 286906 - DNA, 20 bp, human
ggggcccaaaacgaactctc

SEQ ID NO: 286907 - DNA, 20 bp, human
ggggaagccccgcctccatc

SEQ ID NO: 286908 - DNA, 20 bp, human
ggacttgcagtcttcagcga

SEQ ID NO: 286909 - DNA, 20 bp, human
gtgcaatcaatgctctgatg

SEQ ID NO: 286910 - DNA, 20 bp, human
gagcattgattgcacatcac

SEQ ID NO: 286911 - DNA, 20 bp, human
gtcctgccgcttgtctagac

SEQ ID NO: 286912 - DNA, 20 bp, human
gtgcagtcttcagcgagggg

SEQ ID NO: 286913 - DNA, 20 bp, human
gcatcaccggtctagacaag

SEQ ID NO: 286914 - DNA, 20 bp, human
gcacacttggaactggaaca

SEQ ID NO: 286915 - DNA, 20 bp, human
gttcccggagagttcgtttt

SEQ ID NO: 286916 - DNA, 20 bp, human
gcccgtggggagtgaatgtt

SEQ ID NO: 286917 - DNA, 20 bp, human
ggccaatcggagcccgagga

SEQ ID NO: 286918 - DNA, 20 bp, human
gaggctcttaaagggggcga

SEQ ID NO: 286919 - DNA, 20 bp, human
gccgcggagcaggctcttaa

SEQ ID NO: 286920 - DNA, 20 bp, human
gcggagcaggctcttaaagg

SEQ ID NO: 286921 - DNA, 20 bp, human
gggggagtgaatgttcggga

SEQ ID NO: 286922 - DNA, 20 bp, human
ggcgccggccagccccggaa

SEQ ID NO: 286923 - DNA, 20 bp, human
gcgttcgaacgttagtcccg

SEQ ID NO: 286924 - DNA, 20 bp, human
gagggccgccaaccgttccg

SEQ ID NO: 286925 - DNA, 20 bp, human
gggccgcagaccaggcccgt

SEQ ID NO: 286926 - DNA, 20 bp, human
gtggaggcccggggtccgtt

SEQ ID NO: 286927 - DNA, 20 bp, human
gctgcagactgcggccccgg

SEQ ID NO: 286928 - DNA, 20 bp, human
ggcagccgcgggcttcaacg

SEQ ID NO: 286929 - DNA, 20 bp, human
gcagccgagtagccccgggg

SEQ ID NO: 286930 - DNA, 20 bp, human
gagccccaggagaacattcg

SEQ ID NO: 286931 - DNA, 20 bp, human
ggaggcagcagcggcgttgg

SEQ ID NO: 286932 - DNA, 20 bp, human
ggcacccggctaaatagctg

SEQ ID NO: 286933 - DNA, 20 bp, human
gagcccgccccggggctact

SEQ ID NO: 286934 - DNA, 20 bp, human
gcacctgagtgctgcggcga

SEQ ID NO: 286935 - DNA, 20 bp, human
gctgcctcgaatgttctcct

SEQ ID NO: 286936 - DNA, 20 bp, human
gccgaggggaagccaatgac

SEQ ID NO: 286937 - DNA, 20 bp, human
gcggtggctcccctcatcac

SEQ ID NO: 286938 - DNA, 20 bp, human
gacaggctccaattggaggc

SEQ ID NO: 286939 - DNA, 20 bp, human
gcaatcaggcggctcggcag

SEQ ID NO: 286940 - DNA, 20 bp, human
gtcagacccggaaaggtcca

SEQ ID NO: 286941 - DNA, 20 bp, human
gcccggaaaggtccagggtc

SEQ ID NO: 286942 - DNA, 20 bp, human
gagaacccatggggtactgg

SEQ ID NO: 286943 - DNA, 20 bp, human
gacagagccgaccaatcagg

SEQ ID NO: 286944 - DNA, 20 bp, human
gaggacctccagtaccccat

SEQ ID NO: 286945 - DNA, 20 bp, human
gctcggcctcagacccggaa

SEQ ID NO: 286946 - DNA, 20 bp, human
gtcccccggctttccagatc

SEQ ID NO: 286947 - DNA, 20 bp, human
gctggaaagccgggggagaa

SEQ ID NO: 286948 - DNA, 20 bp, human
gcccagcgggcccaaactga

SEQ ID NO: 286949 - DNA, 20 bp, human
gctcacggggctagactggg

SEQ ID NO: 286950 - DNA, 20 bp, human
gtccagatctggaaagccgg

SEQ ID NO: 286951 - DNA, 20 bp, human
gaaagctttaggacgcaagg

SEQ ID NO: 286952 - DNA, 20 bp, human
ggtaaggagcagcatcagga

SEQ ID NO: 286953 - DNA, 20 bp, human
gcctgaatcacatccagatc

SEQ ID NO: 286954 - DNA, 20 bp, human
gcccgctgggctcttgagca

SEQ ID NO: 286955 - DNA, 20 bp, human
ggcagcttagaaactgggac

SEQ ID NO: 286956 - DNA, 20 bp, human
ggagccgagggtctgtgggt

SEQ ID NO: 286957 - DNA, 20 bp, human
gagaaagcgggagaacccgg

SEQ ID NO: 286958 - DNA, 20 bp, human
gccggcgctgcgggcctcgt

SEQ ID NO: 286959 - DNA, 20 bp, human
ggctcggggaacgccgcaga

SEQ ID NO: 286960 - DNA, 20 bp, human
gcctcggctccgcccacctc

SEQ ID NO: 286961 - DNA, 20 bp, human
gagcgggagaacccggaggt

SEQ ID NO: 286962 - DNA, 20 bp, human
gctgggcggagtctatgctg

SEQ ID NO: 286963 - DNA, 20 bp, human
gcagagaatcggcacccggc

SEQ ID NO: 286964 - DNA, 20 bp, human
gagagggcgtggccccgccg

SEQ ID NO: 286965 - DNA, 20 bp, human
gccctctcggcaggcgacgt

SEQ ID NO: 286966 - DNA, 20 bp, human
gagggctggagcatgtggtg

SEQ ID NO: 286967 - DNA, 20 bp, human
ggaaagctaaaaacactggt

SEQ ID NO: 286968 - DNA, 20 bp, human
gtggcaagggctggagcatg

SEQ ID NO: 286969 - DNA, 20 bp, human
gtctggggcaatagcagaat

SEQ ID NO: 286970 - DNA, 20 bp, human
gatgaacagtttcctggcaa

SEQ ID NO: 286971 - DNA, 20 bp, human
gactcacatgtaagtctgct

SEQ ID NO: 286972 - DNA, 20 bp, human
gttagttagctgactagtgc

SEQ ID NO: 286973 - DNA, 20 bp, human
gtaactaagtgactcaacca

SEQ ID NO: 286974 - DNA, 20 bp, human
ggctattgccccagagaaaa

SEQ ID NO: 286975 - DNA, 20 bp, human
gtcctactccattttctctg

SEQ ID NO: 286976 - DNA, 20 bp, human
gaggggcagtgcttcagtcg

SEQ ID NO: 286977 - DNA, 20 bp, human
gaagcactgccccttgacac

SEQ ID NO: 286978 - DNA, 20 bp, human
ggcctgggatcacacccttt

SEQ ID NO: 286979 - DNA, 20 bp, human
gcggggtggagctgcttaaa

SEQ ID NO: 286980 - DNA, 20 bp, human
gacagcccacccaaggtccg

SEQ ID NO: 286981 - DNA, 20 bp, human
gggagctctgaggacgggat

SEQ ID NO: 286982 - DNA, 20 bp, human
gaggtccggggccacgggaa

SEQ ID NO: 286983 - DNA, 20 bp, human
gtggagagataagggagtcc

SEQ ID NO: 286984 - DNA, 20 bp, human
gcaggccttgaaaggatcct

SEQ ID NO: 286985 - DNA, 20 bp, human
gagcttggatgtgttcccaa

SEQ ID NO: 286986 - DNA, 20 bp, human
gagcaactgcagttccgggg

SEQ ID NO: 286987 - DNA, 20 bp, human
gcgcacgagtacgtgcgtgg

SEQ ID NO: 286988 - DNA, 20 bp, human
ggggctgaggccaggaaccc

SEQ ID NO: 286989 - DNA, 20 bp, human
gtgcagctgaggtacagcgg

SEQ ID NO: 286990 - DNA, 20 bp, human
gcacgtactcgtgcgcgctg

SEQ ID NO: 286991 - DNA, 20 bp, human
ggcgactgacggagctgcgg

SEQ ID NO: 286992 - DNA, 20 bp, human
gctgcggtggcgtctccaca

SEQ ID NO: 286993 - DNA, 20 bp, human
ggtactcgtgcgcgctgggg

SEQ ID NO: 286994 - DNA, 20 bp, human
gcgacccgcgataggaaccc

SEQ ID NO: 286995 - DNA, 20 bp, human
gtctggacccgggaacccac

SEQ ID NO: 286996 - DNA, 20 bp, human
ggcgagccggggagtcgcga

SEQ ID NO: 286997 - DNA, 20 bp, human
gcggggcctgcgtctctcta

SEQ ID NO: 286998 - DNA, 20 bp, human
ggctcccgggcgagcggggt

SEQ ID NO: 286999 - DNA, 20 bp, human
gaagcggggctcacttgcta

SEQ ID NO: 287000 - DNA, 20 bp, human
gctcgcctgtcccggcttga

SEQ ID NO: 287001 - DNA, 20 bp, human
gaagccgggacaggcgagcc

SEQ ID NO: 287002 - DNA, 20 bp, human
ggggagtcgcgaaggctccc

SEQ ID NO: 287003 - DNA, 20 bp, human
gtaggcgcgtccctactgga

SEQ ID NO: 287004 - DNA, 20 bp, human
gcgtccctactggatggagg

SEQ ID NO: 287005 - DNA, 20 bp, human
ggcgaaggctcccgggcgag

SEQ ID NO: 287006 - DNA, 20 bp, human
gacccgaggggcgtgggcat

SEQ ID NO: 287007 - DNA, 20 bp, human
ggccgcccctagaaggtcta

SEQ ID NO: 287008 - DNA, 20 bp, human
gcgctggcccgggacccgag

SEQ ID NO: 287009 - DNA, 20 bp, human
gcgcacccctagaccttcta

SEQ ID NO: 287010 - DNA, 20 bp, human
gctggcgcaagactaccttt

SEQ ID NO: 287011 - DNA, 20 bp, human
ggaggggcgtgggcatcggg

SEQ ID NO: 287012 - DNA, 20 bp, human
gggcccaatggcctcgtgac

SEQ ID NO: 287013 - DNA, 20 bp, human
gccccagtcacgaggccatt

SEQ ID NO: 287014 - DNA, 20 bp, human
gaaaggtgtggcgactgcag

SEQ ID NO: 287015 - DNA, 20 bp, human
gtgggcctgtgacctaacag

SEQ ID NO: 287016 - DNA, 20 bp, human
gaaggctcctcccaggggtg

SEQ ID NO: 287017 - DNA, 20 bp, human
gggtggggaagcctcggcag

SEQ ID NO: 287018 - DNA, 20 bp, human
gcaaagcagggtctaccaat

SEQ ID NO: 287019 - DNA, 20 bp, human
gccaagaaggctcctcccag

SEQ ID NO: 287020 - DNA, 20 bp, human
gaagtcgacttcactcagcc

SEQ ID NO: 287021 - DNA, 20 bp, human
gcacatgccgccccctgccg

SEQ ID NO: 287022 - DNA, 20 bp, human
ggggcttgtcggagattgct

SEQ ID NO: 287023 - DNA, 20 bp, human
gtgtcggagattgctgggaa

SEQ ID NO: 287024 - DNA, 20 bp, human
ggggggccagtttgcagttg

SEQ ID NO: 287025 - DNA, 20 bp, human
ggcggcatgtgagcgccaga

SEQ ID NO: 287026 - DNA, 20 bp, human
gtgccaacttctctcaacaa

SEQ ID NO: 287027 - DNA, 20 bp, human
gatcaaggaattgaagtcag

SEQ ID NO: 287028 - DNA, 20 bp, human
gagttggcatgctgtcaagt

SEQ ID NO: 287029 - DNA, 20 bp, human
ggcatgctgtcaagtgggct

SEQ ID NO: 287030 - DNA, 20 bp, human
ggcttcaaagactcagagaa

SEQ ID NO: 287031 - DNA, 20 bp, human
gctgagtctttgaagcttca

SEQ ID NO: 287032 - DNA, 20 bp, human
gtttgagatacatattctag

SEQ ID NO: 287033 - DNA, 20 bp, human
gagcaatgtgaagttagaga

SEQ ID NO: 287034 - DNA, 20 bp, human
gtcataaattcgtgtcctat

SEQ ID NO: 287035 - DNA, 20 bp, human
gctcctttgttgagagaagt

SEQ ID NO: 287036 - DNA, 20 bp, human
gggtccccttgtatgtatgt

SEQ ID NO: 287037 - DNA, 20 bp, human
gactgtacgcagttgttctg

SEQ ID NO: 287038 - DNA, 20 bp, human
gaataaatgtaggacaaacg

SEQ ID NO: 287039 - DNA, 20 bp, human
gcccttgtatgtatgtaggc

SEQ ID NO: 287040 - DNA, 20 bp, human
gaagccaagcctgtctgcac

SEQ ID NO: 287041 - DNA, 20 bp, human
gtgtttgttccagtgcagac

SEQ ID NO: 287042 - DNA, 20 bp, human
gtggaatttagagttgtacg

SEQ ID NO: 287043 - DNA, 20 bp, human
ggctgatagaatcgtggagc

SEQ ID NO: 287044 - DNA, 20 bp, human
ggttccagtgcagacaggct

SEQ ID NO: 287045 - DNA, 20 bp, human
gagcacataaaaactatcac

SEQ ID NO: 287046 - DNA, 20 bp, human
ggctgcctagggtgagacgt

SEQ ID NO: 287047 - DNA, 20 bp, human
gactaagcccagtatggccg

SEQ ID NO: 287048 - DNA, 20 bp, human
gtctcccagctccgcccagc

SEQ ID NO: 287049 - DNA, 20 bp, human
gtctgcagagtgcaggagct

SEQ ID NO: 287050 - DNA, 20 bp, human
ggcacacaaatgttcccgct

SEQ ID NO: 287051 - DNA, 20 bp, human
gtgagagccacggccatact

SEQ ID NO: 287052 - DNA, 20 bp, human
gcacaaatgttcccgctggg

SEQ ID NO: 287053 - DNA, 20 bp, human
gcgacagggattggctgcct

SEQ ID NO: 287054 - DNA, 20 bp, human
gtagaaactccgacagggat

SEQ ID NO: 287055 - DNA, 20 bp, human
ggttcccgctgggcggagct

SEQ ID NO: 287056 - DNA, 20 bp, human
gggaacccaggatccctctc

SEQ ID NO: 287057 - DNA, 20 bp, human
gaatccgcacacccaccggt

SEQ ID NO: 287058 - DNA, 20 bp, human
ggattcccgaggctcctgag

SEQ ID NO: 287059 - DNA, 20 bp, human
ggacctgcgaacgggcgaga

SEQ ID NO: 287060 - DNA, 20 bp, human
ggcgagagggagatggtccc

SEQ ID NO: 287061 - DNA, 20 bp, human
gtgggtgtgcggattctgtg

SEQ ID NO: 287062 - DNA, 20 bp, human
gcgcgcgcggcgccaccatg

SEQ ID NO: 287063 - DNA, 20 bp, human
gagtaaaaagcagcgaggtg

SEQ ID NO: 287064 - DNA, 20 bp, human
gtgtccctgccccaaccggt

SEQ ID NO: 287065 - DNA, 20 bp, human
gcgaacgggcgagagggaga

SEQ ID NO: 287066 - DNA, 20 bp, human
gggtcggggcgggtgaagag

SEQ ID NO: 287067 - DNA, 20 bp, human
gacaccgcgggaaacagaaa

SEQ ID NO: 287068 - DNA, 20 bp, human
ggcggggagggagtttcctc

SEQ ID NO: 287069 - DNA, 20 bp, human
gccgcggtgtccttaaccaa

SEQ ID NO: 287070 - DNA, 20 bp, human
ggagacgccaccttttggtc

SEQ ID NO: 287071 - DNA, 20 bp, human
gtaaacgtaatctgcctggc

SEQ ID NO: 287072 - DNA, 20 bp, human
ggagaggaggcctttggtta

SEQ ID NO: 287073 - DNA, 20 bp, human
ggccaccttttggtcggggc

SEQ ID NO: 287074 - DNA, 20 bp, human
gttcacccgccccgaccaaa

SEQ ID NO: 287075 - DNA, 20 bp, human
ggagggtggtgagactgcga

SEQ ID NO: 287076 - DNA, 20 bp, human
gaaacctagggaaaccgaaa

SEQ ID NO: 287077 - DNA, 20 bp, human
gaattcctgctgacgggggg

SEQ ID NO: 287078 - DNA, 20 bp, human
gcctgctgacgggggggggt

SEQ ID NO: 287079 - DNA, 20 bp, human
gcggaattcctgctgacggg

SEQ ID NO: 287080 - DNA, 20 bp, human
gcagccaatggtgtaagctg

SEQ ID NO: 287081 - DNA, 20 bp, human
gctagcggaattcctgctga

SEQ ID NO: 287082 - DNA, 20 bp, human
gcttgcaagttggaaaccta

SEQ ID NO: 287083 - DNA, 20 bp, human
gaaagtgaaactaaagctag

SEQ ID NO: 287084 - DNA, 20 bp, human
gtgggtgtgtccttgcaagt

SEQ ID NO: 287085 - DNA, 20 bp, human
ggctgcagaaacccaatgac

SEQ ID NO: 287086 - DNA, 20 bp, human
ggtccctggaaccacctggc

SEQ ID NO: 287087 - DNA, 20 bp, human
gatgtggtgtaggagataga

SEQ ID NO: 287088 - DNA, 20 bp, human
ggtaggagatagagggtaac

SEQ ID NO: 287089 - DNA, 20 bp, human
gtcccttgctggagtcaatg

SEQ ID NO: 287090 - DNA, 20 bp, human
ggatgcctagtgaattggca

SEQ ID NO: 287091 - DNA, 20 bp, human
ggctggagtcaatgtggtgt

SEQ ID NO: 287092 - DNA, 20 bp, human
gtatcccgccaggtggttcc

SEQ ID NO: 287093 - DNA, 20 bp, human
gagtgttgtggaaaaaccag

SEQ ID NO: 287094 - DNA, 20 bp, human
gctgagttttggcagctaag

SEQ ID NO: 287095 - DNA, 20 bp, human
ggatacgcaaattcccttgc

SEQ ID NO: 287096 - DNA, 20 bp, human
gtctgatcacaactcagctc

SEQ ID NO: 287097 - DNA, 20 bp, human
ggatcacaactcagctccgg

SEQ ID NO: 287098 - DNA, 20 bp, human
gagaggccacttgtatatat

SEQ ID NO: 287099 - DNA, 20 bp, human
gttcagctgacgttacaaaa

SEQ ID NO: 287100 - DNA, 20 bp, human
gactagaaagtgaaattggc

SEQ ID NO: 287101 - DNA, 20 bp, human
gtctaactcactacgcagct

SEQ ID NO: 287102 - DNA, 20 bp, human
gtcgaatatgaaataagaga

SEQ ID NO: 287103 - DNA, 20 bp, human
gtctttgtggaatgtactga

SEQ ID NO: 287104 - DNA, 20 bp, human
gttgtgcaaatctgagatga

SEQ ID NO: 287105 - DNA, 20 bp, human
gcttactcaagagcattttg

SEQ ID NO: 287106 - DNA, 20 bp, human
gaacctgaaaactgatgtga

SEQ ID NO: 287107 - DNA, 20 bp, human
gaaactaatttaaaatcgtt

SEQ ID NO: 287108 - DNA, 20 bp, human
gaagcaggggtccagtcaca

SEQ ID NO: 287109 - DNA, 20 bp, human
gtaattttttggtttacatt

SEQ ID NO: 287110 - DNA, 20 bp, human
gatttaaaatcgttgggagg

SEQ ID NO: 287111 - DNA, 20 bp, human
gttgcaggtctcaagccgtt

SEQ ID NO: 287112 - DNA, 20 bp, human
gtactcaccaaccatgtgac

SEQ ID NO: 287113 - DNA, 20 bp, human
gtttgagtaattgcttttag

SEQ ID NO: 287114 - DNA, 20 bp, human
gctaatttaaaatcgttggg

SEQ ID NO: 287115 - DNA, 20 bp, human
gagttttgaataacgtactc

SEQ ID NO: 287116 - DNA, 20 bp, human
gcatcccttgagatcacgac

SEQ ID NO: 287117 - DNA, 20 bp, human
ggccgcgcggccgagtccag

SEQ ID NO: 287118 - DNA, 20 bp, human
gcacccagtcgtgatctcaa

SEQ ID NO: 287119 - DNA, 20 bp, human
ggaactcagcgtactcaggg

SEQ ID NO: 287120 - DNA, 20 bp, human
gcccgcggtccccggtgctg

SEQ ID NO: 287121 - DNA, 20 bp, human
gcacgcgcacgcccaccgcg

SEQ ID NO: 287122 - DNA, 20 bp, human
ggcccctggactcggccgcg

SEQ ID NO: 287123 - DNA, 20 bp, human
gcctggactccgcaaacgtc

SEQ ID NO: 287124 - DNA, 20 bp, human
gctccgcaaacgtctggccg

SEQ ID NO: 287125 - DNA, 20 bp, human
gcccaccgcgcggcttcccg

SEQ ID NO: 287126 - DNA, 20 bp, human
ggaggaaaggctgaaggcta

SEQ ID NO: 287127 - DNA, 20 bp, human
gaattagccagggaccaatg

SEQ ID NO: 287128 - DNA, 20 bp, human
gggccctggggattttaccc

SEQ ID NO: 287129 - DNA, 20 bp, human
gaagttaaaccacacctcat

SEQ ID NO: 287130 - DNA, 20 bp, human
ggatcaaattactttatggc

SEQ ID NO: 287131 - DNA, 20 bp, human
gcctaagtgttgggtttagg

SEQ ID NO: 287132 - DNA, 20 bp, human
gcctgcgacaagtgaggtga

SEQ ID NO: 287133 - DNA, 20 bp, human
ggagaggcctgcgacaagtg

SEQ ID NO: 287134 - DNA, 20 bp, human
ggtcctggcgcctggagtgt

SEQ ID NO: 287135 - DNA, 20 bp, human
gggtgtggtttaacttcttg

SEQ ID NO: 287136 - DNA, 20 bp, human
gactgtgcccgggtcagccc

SEQ ID NO: 287137 - DNA, 20 bp, human
gggggcctgtcggagaacca

SEQ ID NO: 287138 - DNA, 20 bp, human
gcacaggccgtgggtggatg

SEQ ID NO: 287139 - DNA, 20 bp, human
gtcagacggggcctgatccc

SEQ ID NO: 287140 - DNA, 20 bp, human
gggaggggtcatgaagcatg

SEQ ID NO: 287141 - DNA, 20 bp, human
gggtgcccaaggagacgagg

SEQ ID NO: 287142 - DNA, 20 bp, human
ggccttgtgctgtgggttcc

SEQ ID NO: 287143 - DNA, 20 bp, human
gtgacccctcctgctcgtta

SEQ ID NO: 287144 - DNA, 20 bp, human
ggcccaaggagacgaggagg

SEQ ID NO: 287145 - DNA, 20 bp, human
gtaagatcagccttgtgctg

SEQ ID NO: 287146 - DNA, 20 bp, human
ggggagttgcaaggtcccgc

SEQ ID NO: 287147 - DNA, 20 bp, human
gcccgctgccgccgtgagtc

SEQ ID NO: 287148 - DNA, 20 bp, human
ggtggcgcggacaccctggt

SEQ ID NO: 287149 - DNA, 20 bp, human
gaggaagacgcagtgggtcc

SEQ ID NO: 287150 - DNA, 20 bp, human
gtccgcctcctcctgccagg

SEQ ID NO: 287151 - DNA, 20 bp, human
ggggaccttgcaactcccca

SEQ ID NO: 287152 - DNA, 20 bp, human
ggcgcggacaccctggtcgg

SEQ ID NO: 287153 - DNA, 20 bp, human
ggtggggaggaagacgcagt

SEQ ID NO: 287154 - DNA, 20 bp, human
ggggctccgcgagagggatg

SEQ ID NO: 287155 - DNA, 20 bp, human
gcgctggggtggagcgccat

SEQ ID NO: 287156 - DNA, 20 bp, human
gaatttgttctgcccttatc

SEQ ID NO: 287157 - DNA, 20 bp, human
gatgagacttgtgctccttt

SEQ ID NO: 287158 - DNA, 20 bp, human
ggaggaaactgttgagaaaa

SEQ ID NO: 287159 - DNA, 20 bp, human
gtcaaatgcagagctggcca

SEQ ID NO: 287160 - DNA, 20 bp, human
gagctggccagggccagata

SEQ ID NO: 287161 - DNA, 20 bp, human
gtctgcatttgacaaatgcc

SEQ ID NO: 287162 - DNA, 20 bp, human
gttctgcccttatctggccc

SEQ ID NO: 287163 - DNA, 20 bp, human
ggttgagaaaacggaactac

SEQ ID NO: 287164 - DNA, 20 bp, human
gggtgagggctttggggaaa

SEQ ID NO: 287165 - DNA, 20 bp, human
gaggggctgagggctaagag

SEQ ID NO: 287166 - DNA, 20 bp, human
ggagccctgaaccgggacag

SEQ ID NO: 287167 - DNA, 20 bp, human
ggatgagccttgtgctccct

SEQ ID NO: 287168 - DNA, 20 bp, human
gtcaaatcgggatttggccg

SEQ ID NO: 287169 - DNA, 20 bp, human
gatttggccggggccagatg

SEQ ID NO: 287170 - DNA, 20 bp, human
gtccctttccccagtagttt

SEQ ID NO: 287171 - DNA, 20 bp, human
gcatttgtcaaatcgggatt

SEQ ID NO: 287172 - DNA, 20 bp, human
ggtgagggttatgggagacg

SEQ ID NO: 287173 - DNA, 20 bp, human
gggccggggccagatgaggg

SEQ ID NO: 287174 - DNA, 20 bp, human
ggcagaggtgagggctttgg

SEQ ID NO: 287175 - DNA, 20 bp, human
gtcctggcatttgtcaaatc

SEQ ID NO: 287176 - DNA, 20 bp, human
gccaaggcagcctcggacag

SEQ ID NO: 287177 - DNA, 20 bp, human
gaagcggggggctcccagat

SEQ ID NO: 287178 - DNA, 20 bp, human
gtgggagccccccgcttgga

SEQ ID NO: 287179 - DNA, 20 bp, human
gcggccgtagccttccaagc

SEQ ID NO: 287180 - DNA, 20 bp, human
ggaaggctacggccgggcag

SEQ ID NO: 287181 - DNA, 20 bp, human
gccccccgcttggaaggcta

SEQ ID NO: 287182 - DNA, 20 bp, human
gagcgcaggcatccctgcaa

SEQ ID NO: 287183 - DNA, 20 bp, human
gagatgggatgtctgtcagg

SEQ ID NO: 287184 - DNA, 20 bp, human
gtcttcttggcctggacgga

SEQ ID NO: 287185 - DNA, 20 bp, human
gaaggggcgggccgcaccct

SEQ ID NO: 287186 - DNA, 20 bp, human
gttccccagtatgtacatac

SEQ ID NO: 287187 - DNA, 20 bp, human
gaaggccagtatgtacatac

SEQ ID NO: 287188 - DNA, 20 bp, human
ggcaacaactgtagtcataa

SEQ ID NO: 287189 - DNA, 20 bp, human
gaactggaacttggttacta

SEQ ID NO: 287190 - DNA, 20 bp, human
gtagttctaagaggcagtgt

SEQ ID NO: 287191 - DNA, 20 bp, human
gttttggtggcaaagtctag

SEQ ID NO: 287192 - DNA, 20 bp, human
gtcatactgctggcataact

SEQ ID NO: 287193 - DNA, 20 bp, human
ggagaagaatttaggtgttc

SEQ ID NO: 287194 - DNA, 20 bp, human
ggacaaatactttgagcaca

SEQ ID NO: 287195 - DNA, 20 bp, human
gattacctcatagttctaag

SEQ ID NO: 287196 - DNA, 20 bp, human
gtcatgtaaagagtgcatga

SEQ ID NO: 287197 - DNA, 20 bp, human
gccactttcttaatgcttct

SEQ ID NO: 287198 - DNA, 20 bp, human
gctgatataaattgtactgt

SEQ ID NO: 287199 - DNA, 20 bp, human
gtaatctttgtattcaatgc

SEQ ID NO: 287200 - DNA, 20 bp, human
gtactgtaggcctggcgagg

SEQ ID NO: 287201 - DNA, 20 bp, human
gacaaaacatttgagaaaca

SEQ ID NO: 287202 - DNA, 20 bp, human
gataaattgtactgtaggcc

SEQ ID NO: 287203 - DNA, 20 bp, human
gttgtactgtaggcctggcg

SEQ ID NO: 287204 - DNA, 20 bp, human
gttagcttaaatttttcatt

SEQ ID NO: 287205 - DNA, 20 bp, human
gttataactaaatttgctta

SEQ ID NO: 287206 - DNA, 20 bp, human
gtcatgtaaagagttcaaga

SEQ ID NO: 287207 - DNA, 20 bp, human
gtataactaaatttgcttgt

SEQ ID NO: 287208 - DNA, 20 bp, human
gacaataatgaaaaacaaaa

SEQ ID NO: 287209 - DNA, 20 bp, human
gaaagtctctgggaacaaga

SEQ ID NO: 287210 - DNA, 20 bp, human
gtttcacggtgggttcaatt

SEQ ID NO: 287211 - DNA, 20 bp, human
gaaaaaatctaaaaagtctc

SEQ ID NO: 287212 - DNA, 20 bp, human
gacaaaatggttgagaaaca

SEQ ID NO: 287213 - DNA, 20 bp, human
gtccactttcttaatgcttc

SEQ ID NO: 287214 - DNA, 20 bp, human
gtgttattaaattttcacgg

SEQ ID NO: 287215 - DNA, 20 bp, human
gttatcttaaaattttcatt

SEQ ID NO: 287216 - DNA, 20 bp, human
gctaaaaagcccatggggca

SEQ ID NO: 287217 - DNA, 20 bp, human
ggctctacacccatgtagac

SEQ ID NO: 287218 - DNA, 20 bp, human
ggtgttaagaatgaccaaat

SEQ ID NO: 287219 - DNA, 20 bp, human
gccatgtagacaggacataa

SEQ ID NO: 287220 - DNA, 20 bp, human
gcatgaagacgttcagaaaa

SEQ ID NO: 287221 - DNA, 20 bp, human
gaatttctaaaaagcccatg

SEQ ID NO: 287222 - DNA, 20 bp, human
ggtaatactgaaaataaaag

SEQ ID NO: 287223 - DNA, 20 bp, human
gccaccgggcccagcccatt

SEQ ID NO: 287224 - DNA, 20 bp, human
gaagaatgaccaaatgggct

SEQ ID NO: 287225 - DNA, 20 bp, human
gctgtacatatctatttata

SEQ ID NO: 287226 - DNA, 20 bp, human
gaaagtaacacaggggcatt

SEQ ID NO: 287227 - DNA, 20 bp, human
gatagaatagagatatacat

SEQ ID NO: 287228 - DNA, 20 bp, human
gtaagaggcgtctgtgttta

SEQ ID NO: 287229 - DNA, 20 bp, human
gtctttatgcactctttaca

SEQ ID NO: 287230 - DNA, 20 bp, human
gaaaggctctggggtaaaag

SEQ ID NO: 287231 - DNA, 20 bp, human
ggaagtagaaagtaacacag

SEQ ID NO: 287232 - DNA, 20 bp, human
gagtttctaaaaaggctctg

SEQ ID NO: 287233 - DNA, 20 bp, human
gcagaaaaaagtttctaaaa

SEQ ID NO: 287234 - DNA, 20 bp, human
gtatgtgattaaaatataat

SEQ ID NO: 287235 - DNA, 20 bp, human
gataatcacagcagggtgaa

SEQ ID NO: 287236 - DNA, 20 bp, human
gacacagatatactatgtgt

SEQ ID NO: 287237 - DNA, 20 bp, human
gtctttctacatagatgtac

SEQ ID NO: 287238 - DNA, 20 bp, human
gaatattctctctcgataat

SEQ ID NO: 287239 - DNA, 20 bp, human
gtatgtggcagaggaagatg

SEQ ID NO: 287240 - DNA, 20 bp, human
gacacaaggcattcagaaaa

SEQ ID NO: 287241 - DNA, 20 bp, human
gcatttgctcattcttaatc

SEQ ID NO: 287242 - DNA, 20 bp, human
gaatagaatttattcagtcc

SEQ ID NO: 287243 - DNA, 20 bp, human
gtaattaaatttacaattta

SEQ ID NO: 287244 - DNA, 20 bp, human
gtgagcaaatgaaaattcta

SEQ ID NO: 287245 - DNA, 20 bp, human
gtaaaaagcatatgtggcag

SEQ ID NO: 287246 - DNA, 20 bp, human
gacatgcataagtttcttaa

SEQ ID NO: 287247 - DNA, 20 bp, human
gtggcgaatagatggcttac

SEQ ID NO: 287248 - DNA, 20 bp, human
gcgaatagatggcttactgg

SEQ ID NO: 287249 - DNA, 20 bp, human
gtaagcaacatctggaagaa

SEQ ID NO: 287250 - DNA, 20 bp, human
gaatcagtgttataaatcta

SEQ ID NO: 287251 - DNA, 20 bp, human
gtgcttatgtttgagcttca

SEQ ID NO: 287252 - DNA, 20 bp, human
gaggcaatcacagcaaatga

SEQ ID NO: 287253 - DNA, 20 bp, human
ggaataaaatgctgacactc

SEQ ID NO: 287254 - DNA, 20 bp, human
gtacacaagaaaattcaata

SEQ ID NO: 287255 - DNA, 20 bp, human
gctcaaacataagcaacatc

SEQ ID NO: 287256 - DNA, 20 bp, human
ggtactctctacatgggctt

SEQ ID NO: 287257 - DNA, 20 bp, human
gttatcaaacaggactctgg

SEQ ID NO: 287258 - DNA, 20 bp, human
gccatgtagagagtacataa

SEQ ID NO: 287259 - DNA, 20 bp, human
gtgcagtagcattcagaaaa

SEQ ID NO: 287260 - DNA, 20 bp, human
gttgtacaccgccttatata

SEQ ID NO: 287261 - DNA, 20 bp, human
gtctgtgttattaaattatc

SEQ ID NO: 287262 - DNA, 20 bp, human
gaaattatcaaacaggactc

SEQ ID NO: 287263 - DNA, 20 bp, human
gtgttattaaattatcagga

SEQ ID NO: 287264 - DNA, 20 bp, human
gcaaatatgttccctatata

SEQ ID NO: 287265 - DNA, 20 bp, human
gtgttttctaaagcatggat

SEQ ID NO: 287266 - DNA, 20 bp, human
gtggagaaggggtgctagct

SEQ ID NO: 287267 - DNA, 20 bp, human
gaggaaaggcgcgtgcgtgg

SEQ ID NO: 287268 - DNA, 20 bp, human
ggggtgctagctaggaggaa

SEQ ID NO: 287269 - DNA, 20 bp, human
ggggcagcgcgtgtgcagag

SEQ ID NO: 287270 - DNA, 20 bp, human
gagaaggggtgctagctagg

SEQ ID NO: 287271 - DNA, 20 bp, human
ggcacaggggtgctgcaatt

SEQ ID NO: 287272 - DNA, 20 bp, human
ggaacggcgcgtgcgcggag

SEQ ID NO: 287273 - DNA, 20 bp, human
ggaggcggcgcgtgcgtaga

SEQ ID NO: 287274 - DNA, 20 bp, human
gaggcgcgtgcgtggaggaa

SEQ ID NO: 287275 - DNA, 20 bp, human
gggggtgctgcaattaggat

SEQ ID NO: 287276 - DNA, 20 bp, human
gggagccaggggcgggtcct

SEQ ID NO: 287277 - DNA, 20 bp, human
gggcgaaggcgggattggtt

SEQ ID NO: 287278 - DNA, 20 bp, human
gttctcggcgaaggcgggat

SEQ ID NO: 287279 - DNA, 20 bp, human
gaggagcgatacggaagcgc

SEQ ID NO: 287280 - DNA, 20 bp, human
gttcgccgagaaagctccat

SEQ ID NO: 287281 - DNA, 20 bp, human
gcttccgtatcgctcctcgt

SEQ ID NO: 287282 - DNA, 20 bp, human
gaagaggggagaatctacaa

SEQ ID NO: 287283 - DNA, 20 bp, human
ggagctttctcggcgaaggc

SEQ ID NO: 287284 - DNA, 20 bp, human
gcgccgagccccggcctacg

SEQ ID NO: 287285 - DNA, 20 bp, human
ggcagacgattgtaaatgac

SEQ ID NO: 287286 - DNA, 20 bp, human
gaattcctctgaatagagag

SEQ ID NO: 287287 - DNA, 20 bp, human
gctacagtcagtagaatcca

SEQ ID NO: 287288 - DNA, 20 bp, human
gttgaggttcttgaattctc

SEQ ID NO: 287289 - DNA, 20 bp, human
gactaaaatgtaaatgacat

SEQ ID NO: 287290 - DNA, 20 bp, human
gaaaagatttacaaactgtg

SEQ ID NO: 287291 - DNA, 20 bp, human
gaaacactaaaagatacagt

SEQ ID NO: 287292 - DNA, 20 bp, human
gattatatatatcataagat

SEQ ID NO: 287293 - DNA, 20 bp, human
gaagacttgggagaaagcaa

SEQ ID NO: 287294 - DNA, 20 bp, human
gtccacggatacagaaccta

SEQ ID NO: 287295 - DNA, 20 bp, human
gtgaaagggagaagtgaaag

SEQ ID NO: 287296 - DNA, 20 bp, human
gcagagctatcactattcta

SEQ ID NO: 287297 - DNA, 20 bp, human
gatatgtgaagagagattgg

SEQ ID NO: 287298 - DNA, 20 bp, human
gtcaagaggaacttagaata

SEQ ID NO: 287299 - DNA, 20 bp, human
gaacctataggttcaacgac

SEQ ID NO: 287300 - DNA, 20 bp, human
gcacctgtcgttgaacctat

SEQ ID NO: 287301 - DNA, 20 bp, human
ggattggaaaggtatattgg

SEQ ID NO: 287302 - DNA, 20 bp, human
gcaagtgctagctgtattaa

SEQ ID NO: 287303 - DNA, 20 bp, human
gagaaaggttcttgaggtaa

SEQ ID NO: 287304 - DNA, 20 bp, human
gttgcacagaaaggttcttg

SEQ ID NO: 287305 - DNA, 20 bp, human
gactatatttagagcaacag

SEQ ID NO: 287306 - DNA, 20 bp, human
gtggcacaggtgggcataat

SEQ ID NO: 287307 - DNA, 20 bp, human
ggggtctgtctcatcgtcaa

SEQ ID NO: 287308 - DNA, 20 bp, human
gaagagtcaacattttacca

SEQ ID NO: 287309 - DNA, 20 bp, human
gccacctgtgccattctggt

SEQ ID NO: 287310 - DNA, 20 bp, human
gatgcccacctgtgccattc

SEQ ID NO: 287311 - DNA, 20 bp, human
gtcaaagaatcccaccagaa

SEQ ID NO: 287312 - DNA, 20 bp, human
ggtgaaaatacgtaatcctc

SEQ ID NO: 287313 - DNA, 20 bp, human
gcacattgatcatttgcttg

SEQ ID NO: 287314 - DNA, 20 bp, human
ggtacctccccacttcgccc

SEQ ID NO: 287315 - DNA, 20 bp, human
ggagatggtgacagataggc

SEQ ID NO: 287316 - DNA, 20 bp, human
gcgtgggcggggtcaagtcc

SEQ ID NO: 287317 - DNA, 20 bp, human
gcgcctgagtccgcctcctg

SEQ ID NO: 287318 - DNA, 20 bp, human
gcagtgagcacggcgtcgtg

SEQ ID NO: 287319 - DNA, 20 bp, human
gcgacgccgtgctcactgct

SEQ ID NO: 287320 - DNA, 20 bp, human
gtccgggaagccgcaggagg

SEQ ID NO: 287321 - DNA, 20 bp, human
gccggcacagaccccggtga

SEQ ID NO: 287322 - DNA, 20 bp, human
ggacctggacttctgggtgt

SEQ ID NO: 287323 - DNA, 20 bp, human
gcggtcgggacctggacttc

SEQ ID NO: 287324 - DNA, 20 bp, human
ggcgtcgtgcggtcgggacc

SEQ ID NO: 287325 - DNA, 20 bp, human
gagcacggcgtcgtgcggtc

SEQ ID NO: 287326 - DNA, 20 bp, human
gtccgggaaccgcggccctg

SEQ ID NO: 287327 - DNA, 20 bp, human
gcagccggcctcccagagcg

SEQ ID NO: 287328 - DNA, 20 bp, human
gggaaagtcccgcgcggggg

SEQ ID NO: 287329 - DNA, 20 bp, human
ggagcgggaaagtcccgcgc

SEQ ID NO: 287330 - DNA, 20 bp, human
gtcaaaatggggttgactgg

SEQ ID NO: 287331 - DNA, 20 bp, human
gtctgggaggccggctgcgt

SEQ ID NO: 287332 - DNA, 20 bp, human
gcctctgcggctgcagcgcg

SEQ ID NO: 287333 - DNA, 20 bp, human
gctcgcggggcccttccgga

SEQ ID NO: 287334 - DNA, 20 bp, human
ggcgggacgcccaccttcgg

SEQ ID NO: 287335 - DNA, 20 bp, human
gccagtctccaggacgttcc

SEQ ID NO: 287336 - DNA, 20 bp, human
gcctcctgctgaagatattc

SEQ ID NO: 287337 - DNA, 20 bp, human
gtgtggcttgagatccttat

SEQ ID NO: 287338 - DNA, 20 bp, human
gattgctggcaccctatccc

SEQ ID NO: 287339 - DNA, 20 bp, human
gttgccaggtgactcttctc

SEQ ID NO: 287340 - DNA, 20 bp, human
gtaagttacagtccagggat

SEQ ID NO: 287341 - DNA, 20 bp, human
gagcaatgaatatacccata

SEQ ID NO: 287342 - DNA, 20 bp, human
gttcagtaagttacagtcca

SEQ ID NO: 287343 - DNA, 20 bp, human
gtcacagttaaccaaggttg

SEQ ID NO: 287344 - DNA, 20 bp, human
gaggaaaggggccgcaacct

SEQ ID NO: 287345 - DNA, 20 bp, human
gtcacctgagaagagtcacc

SEQ ID NO: 287346 - DNA, 20 bp, human
gagggataaggctacctgag

SEQ ID NO: 287347 - DNA, 20 bp, human
gccgtctgggagcctgatga

SEQ ID NO: 287348 - DNA, 20 bp, human
gctgatgagggaacaggtgt

SEQ ID NO: 287349 - DNA, 20 bp, human
gctcagggagtccctgacgg

SEQ ID NO: 287350 - DNA, 20 bp, human
gttgacttaagaggcatgag

SEQ ID NO: 287351 - DNA, 20 bp, human
gctgacggaggctgagatta

SEQ ID NO: 287352 - DNA, 20 bp, human
ggggagcctgatgagggaac

SEQ ID NO: 287353 - DNA, 20 bp, human
ggctgggagctgcatcaaga

SEQ ID NO: 287354 - DNA, 20 bp, human
gttaagaggcatgagtgggc

SEQ ID NO: 287355 - DNA, 20 bp, human
ggaaatccttagaactccct

SEQ ID NO: 287356 - DNA, 20 bp, human
gatatatatgccaggagggg

SEQ ID NO: 287357 - DNA, 20 bp, human
gatgccaggaggggtggctc

SEQ ID NO: 287358 - DNA, 20 bp, human
gtctcagcactttaataggc

SEQ ID NO: 287359 - DNA, 20 bp, human
gtatatatatatgccaggag

SEQ ID NO: 287360 - DNA, 20 bp, human
gagagcaggtggaatcctcc

SEQ ID NO: 287361 - DNA, 20 bp, human
ggtggccggtgtcttacctg

SEQ ID NO: 287362 - DNA, 20 bp, human
ggggcagtcccagctgatgt

SEQ ID NO: 287363 - DNA, 20 bp, human
ggaaactgatggagactcag

SEQ ID NO: 287364 - DNA, 20 bp, human
gcagcctggggctcccctgg

SEQ ID NO: 287365 - DNA, 20 bp, human
ggctgggaaagcccagagca

SEQ ID NO: 287366 - DNA, 20 bp, human
gctctgtcactgcagtgcaa

SEQ ID NO: 287367 - DNA, 20 bp, human
gaggaaggtatgttcccaag

SEQ ID NO: 287368 - DNA, 20 bp, human
gagagcaggtggaatcctct

SEQ ID NO: 287369 - DNA, 20 bp, human
gggtctgtttgggtcttgtc

SEQ ID NO: 287370 - DNA, 20 bp, human
ggggcagtcccagctgatgt

SEQ ID NO: 287371 - DNA, 20 bp, human
gcagtctgagatccagaaga

SEQ ID NO: 287372 - DNA, 20 bp, human
ggtggccggtgtcttacctg

SEQ ID NO: 287373 - DNA, 20 bp, human
gtgggactgcccttctgtca

SEQ ID NO: 287374 - DNA, 20 bp, human
gtgtcacccagggtctgttt

SEQ ID NO: 287375 - DNA, 20 bp, human
ggaaactgatggagactcag

SEQ ID NO: 287376 - DNA, 20 bp, human
gcctcccaggggacagtgga

SEQ ID NO: 287377 - DNA, 20 bp, human
ggcgtccagccccccgcctt

SEQ ID NO: 287378 - DNA, 20 bp, human
gggatcctaacccaaggcgg

SEQ ID NO: 287379 - DNA, 20 bp, human
gcggctctggacgcctccca

SEQ ID NO: 287380 - DNA, 20 bp, human
gcagagggtgcactgcagac

SEQ ID NO: 287381 - DNA, 20 bp, human
gatgcgcagggctgagaatg

SEQ ID NO: 287382 - DNA, 20 bp, human
gtgccctggacgggaaagcc

SEQ ID NO: 287383 - DNA, 20 bp, human
ggaaacagacagtagaaaca

SEQ ID NO: 287384 - DNA, 20 bp, human
gctaacccaaggcggggggc

SEQ ID NO: 287385 - DNA, 20 bp, human
gtcccagggaaggcaatgct

SEQ ID NO: 287386 - DNA, 20 bp, human
ggcagatgaagcagaggtac

SEQ ID NO: 287387 - DNA, 20 bp, human
gcgcgggcaggtgacgcagt

SEQ ID NO: 287388 - DNA, 20 bp, human
gaaagggaatcgcgtgtgta

SEQ ID NO: 287389 - DNA, 20 bp, human
gtacgggcgagtttcgagcg

SEQ ID NO: 287390 - DNA, 20 bp, human
ggatccccgggggcattaaa

SEQ ID NO: 287391 - DNA, 20 bp, human
gtgcgtcacctgcccgcggt

SEQ ID NO: 287392 - DNA, 20 bp, human
ggatccgccgggatccccgg

SEQ ID NO: 287393 - DNA, 20 bp, human
ggaccttctcagtgaatcct

SEQ ID NO: 287394 - DNA, 20 bp, human
gggagagttcaaggccggtt

SEQ ID NO: 287395 - DNA, 20 bp, human
gccgtcctggagcactggac

SEQ ID NO: 287396 - DNA, 20 bp, human
ggacctcagtaagcaaatga

SEQ ID NO: 287397 - DNA, 20 bp, human
ggcaaacaaaactgcgtttt

SEQ ID NO: 287398 - DNA, 20 bp, human
gcatgtggttacgcttcact

SEQ ID NO: 287399 - DNA, 20 bp, human
gacattcatgcaggtccatg

SEQ ID NO: 287400 - DNA, 20 bp, human
gtatattaatcttcaccttg

SEQ ID NO: 287401 - DNA, 20 bp, human
gagtgtggtggcatgatcag

SEQ ID NO: 287402 - DNA, 20 bp, human
gaactcctggcctgaagctg

SEQ ID NO: 287403 - DNA, 20 bp, human
gaacagcaaaatgctgttct

SEQ ID NO: 287404 - DNA, 20 bp, human
gtgcatgaatgttttctaga

SEQ ID NO: 287405 - DNA, 20 bp, human
ggctgttttattcacaacag

SEQ ID NO: 287406 - DNA, 20 bp, human
gcccagggagcctgtcttcg

SEQ ID NO: 287407 - DNA, 20 bp, human
gccgacggaggcgtccagtg

SEQ ID NO: 287408 - DNA, 20 bp, human
ggacggaagactggccgcat

SEQ ID NO: 287409 - DNA, 20 bp, human
gtcagtgaggccacgaagac

SEQ ID NO: 287410 - DNA, 20 bp, human
gtccgcgccccgcccgacgg

SEQ ID NO: 287411 - DNA, 20 bp, human
gtggacgcctccgtcgggcg

SEQ ID NO: 287412 - DNA, 20 bp, human
gcctacctacaaatcccatg

SEQ ID NO: 287413 - DNA, 20 bp, human
gcaggctccctgggcgcgga

SEQ ID NO: 287414 - DNA, 20 bp, human
ggggaaacgtagtaaggctg

SEQ ID NO: 287415 - DNA, 20 bp, human
gacggaggcgtccagtgggg

SEQ ID NO: 287416 - DNA, 20 bp, human
gcctgcccccggggtagggt

SEQ ID NO: 287417 - DNA, 20 bp, human
gctgagtcatcctgcccccg

SEQ ID NO: 287418 - DNA, 20 bp, human
gccctggaatgcttgctcgg

SEQ ID NO: 287419 - DNA, 20 bp, human
gaggccctggaatgcttgct

SEQ ID NO: 287420 - DNA, 20 bp, human
gaccccaggaggccctacca

SEQ ID NO: 287421 - DNA, 20 bp, human
ggtcatcctgcccccggggt

SEQ ID NO: 287422 - DNA, 20 bp, human
gtggatcagtgggcgagaga

SEQ ID NO: 287423 - DNA, 20 bp, human
ggagaaggtcagctgtaaat

SEQ ID NO: 287424 - DNA, 20 bp, human
gcacctcaagaactgggatc

SEQ ID NO: 287425 - DNA, 20 bp, human
ggagagatgggagaataaat

SEQ ID NO: 287426 - DNA, 20 bp, human
ggctgcgcgtagagcaccat

SEQ ID NO: 287427 - DNA, 20 bp, human
ggggaatggtagtccacgcc

SEQ ID NO: 287428 - DNA, 20 bp, human
gagttcagccagcgcgtcgt

SEQ ID NO: 287429 - DNA, 20 bp, human
ggatgtgggcctgaatcgga

SEQ ID NO: 287430 - DNA, 20 bp, human
gccaccagccgacgacgcgc

SEQ ID NO: 287431 - DNA, 20 bp, human
gtgttcccgacgcggggctg

SEQ ID NO: 287432 - DNA, 20 bp, human
ggtcgggaacaagtgcacgg

SEQ ID NO: 287433 - DNA, 20 bp, human
gggcctgagcgcgcaggcga

SEQ ID NO: 287434 - DNA, 20 bp, human
ggggcgcgcgcagggcattg

SEQ ID NO: 287435 - DNA, 20 bp, human
ggggcgcctcgcgaagatgg

SEQ ID NO: 287436 - DNA, 20 bp, human
gcgcggtaagctgagtgcga

SEQ ID NO: 287437 - DNA, 20 bp, human
ggtaacgcaggtagccaaag

SEQ ID NO: 287438 - DNA, 20 bp, human
gcgagcgcgcatgtccgaaa

SEQ ID NO: 287439 - DNA, 20 bp, human
gccctggcaacgtacatgcg

SEQ ID NO: 287440 - DNA, 20 bp, human
gagagcgcgagcgattggtc

SEQ ID NO: 287441 - DNA, 20 bp, human
gcaaccagagcgcgagcgat

SEQ ID NO: 287442 - DNA, 20 bp, human
gcccagcgccgcaacgccca

SEQ ID NO: 287443 - DNA, 20 bp, human
gacgttgccaggggtaacgc

SEQ ID NO: 287444 - DNA, 20 bp, human
gtggttgcgctggcgcctta

SEQ ID NO: 287445 - DNA, 20 bp, human
gtggctacctgcgttacccc

SEQ ID NO: 287446 - DNA, 20 bp, human
gaggatgccgcggttgatcg

SEQ ID NO: 287447 - DNA, 20 bp, human
gtccgaggcccgagcgtcgg

SEQ ID NO: 287448 - DNA, 20 bp, human
ggctccgcctcgggatgcac

SEQ ID NO: 287449 - DNA, 20 bp, human
gaacctggcccccgacgctc

SEQ ID NO: 287450 - DNA, 20 bp, human
gagcgcgccctccacacaaa

SEQ ID NO: 287451 - DNA, 20 bp, human
gagctccgaggcccgagcgt

SEQ ID NO: 287452 - DNA, 20 bp, human
gagaccgccgcgtgctggaa

SEQ ID NO: 287453 - DNA, 20 bp, human
gggaaagagccgaaggcgat

SEQ ID NO: 287454 - DNA, 20 bp, human
ggaagggaacacgcccagga

SEQ ID NO: 287455 - DNA, 20 bp, human
gtgctggaaaggctccgcct

SEQ ID NO: 287456 - DNA, 20 bp, human
gcggcgggccggcttcgcta

SEQ ID NO: 287457 - DNA, 20 bp, human
gccggtggggacctcacgga

SEQ ID NO: 287458 - DNA, 20 bp, human
gcggggcggggcgacgaacg

SEQ ID NO: 287459 - DNA, 20 bp, human
ggggcccgaagaaacattgg

SEQ ID NO: 287460 - DNA, 20 bp, human
ggaactgctgctgagggcgg

SEQ ID NO: 287461 - DNA, 20 bp, human
gactgtgcgtctctttggat

SEQ ID NO: 287462 - DNA, 20 bp, human
gagcacgggccctggcctat

SEQ ID NO: 287463 - DNA, 20 bp, human
gccgcccagcgctagccaat

SEQ ID NO: 287464 - DNA, 20 bp, human
gtacgagcccggtgggcgtc

SEQ ID NO: 287465 - DNA, 20 bp, human
gcgggcccgtctccccaaaa

SEQ ID NO: 287466 - DNA, 20 bp, human
gctagggcgggcccttgaga

SEQ ID NO: 287467 - DNA, 20 bp, human
gcgctatgacgtaggacctg

SEQ ID NO: 287468 - DNA, 20 bp, human
gagcgcggtgagatctaggg

SEQ ID NO: 287469 - DNA, 20 bp, human
gcgcaagcgcggtgagatct

SEQ ID NO: 287470 - DNA, 20 bp, human
gggctgaaggcttgtgggcg

SEQ ID NO: 287471 - DNA, 20 bp, human
gagagtgcactcagaaagtc

SEQ ID NO: 287472 - DNA, 20 bp, human
ggcggcgacgggattggtca

SEQ ID NO: 287473 - DNA, 20 bp, human
gagacggaccgctatgacgt

SEQ ID NO: 287474 - DNA, 20 bp, human
gaaggcttgtgggcggggct

SEQ ID NO: 287475 - DNA, 20 bp, human
gttgcatgcggcgacgggat

SEQ ID NO: 287476 - DNA, 20 bp, human
gtctccgcgaagaccctcgg

SEQ ID NO: 287477 - DNA, 20 bp, human
gtggaggcggaatcccccga

SEQ ID NO: 287478 - DNA, 20 bp, human
gctctctccgcgaagaccct

SEQ ID NO: 287479 - DNA, 20 bp, human
gaatcccccgagggtcttcg

SEQ ID NO: 287480 - DNA, 20 bp, human
gcatgcatagcgctctatcc

SEQ ID NO: 287481 - DNA, 20 bp, human
gtagcgctctatccgggaaa

SEQ ID NO: 287482 - DNA, 20 bp, human
ggagagagcagagctacttc

SEQ ID NO: 287483 - DNA, 20 bp, human
ggacccagaagccttagcgc

SEQ ID NO: 287484 - DNA, 20 bp, human
gatccgggaaagggtggagg

SEQ ID NO: 287485 - DNA, 20 bp, human
gggctgggcagcactccggg

SEQ ID NO: 287486 - DNA, 20 bp, human
gcgggggcgggatataaagc

SEQ ID NO: 287487 - DNA, 20 bp, human
gccaatgggagtagagagct

SEQ ID NO: 287488 - DNA, 20 bp, human
ggggcaggttgggctctagg

SEQ ID NO: 287489 - DNA, 20 bp, human
gctctcaggcgcagcggggg

SEQ ID NO: 287490 - DNA, 20 bp, human
gtctagaaggacagcgggag

SEQ ID NO: 287491 - DNA, 20 bp, human
ggggactctcaggcgcagcg

SEQ ID NO: 287492 - DNA, 20 bp, human
gcacgtcaagcagtcagaag

SEQ ID NO: 287493 - DNA, 20 bp, human
gggtctcacaaaaatccaat

SEQ ID NO: 287494 - DNA, 20 bp, human
gggttcgcctacaatggggc

SEQ ID NO: 287495 - DNA, 20 bp, human
ggtggaggcttctttatctc

SEQ ID NO: 287496 - DNA, 20 bp, human
ggggacgcgtctgggccagt

SEQ ID NO: 287497 - DNA, 20 bp, human
ggaggggcggggctgttagc

SEQ ID NO: 287498 - DNA, 20 bp, human
gcctccaccccaatttttaa

SEQ ID NO: 287499 - DNA, 20 bp, human
gtaccctttaaaaattgggg

SEQ ID NO: 287500 - DNA, 20 bp, human
gtctgggccagtcggtttcc

SEQ ID NO: 287501 - DNA, 20 bp, human
gtaagaaagattcggtagtt

SEQ ID NO: 287502 - DNA, 20 bp, human
ggaaagattcggtagtttgg

SEQ ID NO: 287503 - DNA, 20 bp, human
ggattcggtagtttggagga

SEQ ID NO: 287504 - DNA, 20 bp, human
gcgtctcgcaggagcagcgt

SEQ ID NO: 287505 - DNA, 20 bp, human
ggggcattaacaaccttgtg

SEQ ID NO: 287506 - DNA, 20 bp, human
gcccctaggacaacaatctc

SEQ ID NO: 287507 - DNA, 20 bp, human
gcaagtcgcctgtttgtcta

SEQ ID NO: 287508 - DNA, 20 bp, human
gttgcggcatctagcggcta

SEQ ID NO: 287509 - DNA, 20 bp, human
gcgtctgttgcggcatctag

SEQ ID NO: 287510 - DNA, 20 bp, human
ggcgacttggccgcccagag

SEQ ID NO: 287511 - DNA, 20 bp, human
gcggctgataaatttcgggc

SEQ ID NO: 287512 - DNA, 20 bp, human
gaacgcggctgataaatttc

SEQ ID NO: 287513 - DNA, 20 bp, human
gtcagtaaatacgtctgttg

SEQ ID NO: 287514 - DNA, 20 bp, human
gcccagagattgttgtccta

SEQ ID NO: 287515 - DNA, 20 bp, human
gccacgcaggaagaagatca

SEQ ID NO: 287516 - DNA, 20 bp, human
ggtacagccccacatcagtc

SEQ ID NO: 287517 - DNA, 20 bp, human
gtctccgtcgcaggcgtcag

SEQ ID NO: 287518 - DNA, 20 bp, human
gtaggcagcctgactgatgt

SEQ ID NO: 287519 - DNA, 20 bp, human
gggagctagcgctgcgtcct

SEQ ID NO: 287520 - DNA, 20 bp, human
ggtgatgacgacagcacgga

SEQ ID NO: 287521 - DNA, 20 bp, human
gacagggaggagaatagtga

SEQ ID NO: 287522 - DNA, 20 bp, human
ggatgtggggctgtaccatt

SEQ ID NO: 287523 - DNA, 20 bp, human
ggaaggcgcctctccgtcgc

SEQ ID NO: 287524 - DNA, 20 bp, human
gaggggcaaatccaaacata

SEQ ID NO: 287525 - DNA, 20 bp, human
gtgaaggcttccagcgcggg

SEQ ID NO: 287526 - DNA, 20 bp, human
gcctctgtggaaatggtggt

SEQ ID NO: 287527 - DNA, 20 bp, human
gagaagacgcagccggcagt

SEQ ID NO: 287528 - DNA, 20 bp, human
gcgaacgccacgcctccatg

SEQ ID NO: 287529 - DNA, 20 bp, human
gccacgcctccatgaggggc

SEQ ID NO: 287530 - DNA, 20 bp, human
gcccttcagactttcagcga

SEQ ID NO: 287531 - DNA, 20 bp, human
ggcagccccgcccctcatgg

SEQ ID NO: 287532 - DNA, 20 bp, human
gtcctgaatgacgtcacctg

SEQ ID NO: 287533 - DNA, 20 bp, human
gggaaagccgccctgattgg

SEQ ID NO: 287534 - DNA, 20 bp, human
ggccacaggtgacgtcattc

SEQ ID NO: 287535 - DNA, 20 bp, human
gacagaggcagggcaagaag

SEQ ID NO: 287536 - DNA, 20 bp, human
ggagctccgtgtgtaaccaa

SEQ ID NO: 287537 - DNA, 20 bp, human
ggtgtaaccaagggctgagg

SEQ ID NO: 287538 - DNA, 20 bp, human
gcgtgtgtaaccaagggctg

SEQ ID NO: 287539 - DNA, 20 bp, human
gaacgggggcgggatagcgg

SEQ ID NO: 287540 - DNA, 20 bp, human
gggagctctcgcgagaattg

SEQ ID NO: 287541 - DNA, 20 bp, human
ggcggcgtatcccggcaacg

SEQ ID NO: 287542 - DNA, 20 bp, human
ggcggcgcacggcagttagt

SEQ ID NO: 287543 - DNA, 20 bp, human
gtccctaggtaacctcacgt

SEQ ID NO: 287544 - DNA, 20 bp, human
gaagggctgaggcggaggat

SEQ ID NO: 287545 - DNA, 20 bp, human
gtccaaaaagcactgaagcg

SEQ ID NO: 287546 - DNA, 20 bp, human
ggctctccgagtcgcccctg

SEQ ID NO: 287547 - DNA, 20 bp, human
ggccacgagctggacgtacg

SEQ ID NO: 287548 - DNA, 20 bp, human
ggagcggcgcaaccaggtac

SEQ ID NO: 287549 - DNA, 20 bp, human
gcccgagagccggtacggaa

SEQ ID NO: 287550 - DNA, 20 bp, human
gggggcgactcggagagcgc

SEQ ID NO: 287551 - DNA, 20 bp, human
ggggaaggggcgcgccgagc

SEQ ID NO: 287552 - DNA, 20 bp, human
ggtgcgagaccagtccgcag

SEQ ID NO: 287553 - DNA, 20 bp, human
gaccggaagagcccgagagc

SEQ ID NO: 287554 - DNA, 20 bp, human
gcccagccgcccttccgtac

SEQ ID NO: 287555 - DNA, 20 bp, human
gaagagcccgagagccggta

SEQ ID NO: 287556 - DNA, 20 bp, human
gcgcaggagcgacaataaga

SEQ ID NO: 287557 - DNA, 20 bp, human
gagcccgccctcttctgaag

SEQ ID NO: 287558 - DNA, 20 bp, human
gcgcatgcgcgaactcctgg

SEQ ID NO: 287559 - DNA, 20 bp, human
gcgagggattcttttctctg

SEQ ID NO: 287560 - DNA, 20 bp, human
gagcccgagcggcgaagtcc

SEQ ID NO: 287561 - DNA, 20 bp, human
ggtagggttccgctcacagt

SEQ ID NO: 287562 - DNA, 20 bp, human
gctaccgcgtaggtcccgcc

SEQ ID NO: 287563 - DNA, 20 bp, human
ggtgccgcgtagaagtatcg

SEQ ID NO: 287564 - DNA, 20 bp, human
gacgcggcacgtcatccgag

SEQ ID NO: 287565 - DNA, 20 bp, human
gactcctggcgggacctacg

SEQ ID NO: 287566 - DNA, 20 bp, human
gcgcgcgcgcacgagctggg

SEQ ID NO: 287567 - DNA, 20 bp, human
gcggaagtgacgtaactcta

SEQ ID NO: 287568 - DNA, 20 bp, human
gtaacagtcccaaatgccct

SEQ ID NO: 287569 - DNA, 20 bp, human
gagagcccgggcgcctcctg

SEQ ID NO: 287570 - DNA, 20 bp, human
gagccactgcagacagccga

SEQ ID NO: 287571 - DNA, 20 bp, human
ggcgcgcgcgcgcacgagct

SEQ ID NO: 287572 - DNA, 20 bp, human
ggagtcgagctccttggcaa

SEQ ID NO: 287573 - DNA, 20 bp, human
gcccgctttgcaagtaagcc

SEQ ID NO: 287574 - DNA, 20 bp, human
ggcgcgcacgagctgggggg

SEQ ID NO: 287575 - DNA, 20 bp, human
gctcccagagtcgagctcct

SEQ ID NO: 287576 - DNA, 20 bp, human
gccccctcagtggaagggag

SEQ ID NO: 287577 - DNA, 20 bp, human
ggcctcccgtggaacggaac

SEQ ID NO: 287578 - DNA, 20 bp, human
ggatgcgggtagaacggtgg

SEQ ID NO: 287579 - DNA, 20 bp, human
gccggtccccctcagtggaa

SEQ ID NO: 287580 - DNA, 20 bp, human
gcccccgcgcggaggactgt

SEQ ID NO: 287581 - DNA, 20 bp, human
gcccgtggaacggaaccggg

SEQ ID NO: 287582 - DNA, 20 bp, human
ggcggccagtagatgcagga

SEQ ID NO: 287583 - DNA, 20 bp, human
gggtagaacggtggaggaga

SEQ ID NO: 287584 - DNA, 20 bp, human
gggcgatgcgggtagaacgg

SEQ ID NO: 287585 - DNA, 20 bp, human
gcctcagtggaagggagtgg

SEQ ID NO: 287586 - DNA, 20 bp, human
gtgccagggccggctaacag

SEQ ID NO: 287587 - DNA, 20 bp, human
gtaggcgtgtgtggggtgaa

SEQ ID NO: 287588 - DNA, 20 bp, human
gaggcgagcgcggacaaaac

SEQ ID NO: 287589 - DNA, 20 bp, human
ggcctggtaaaatgagtcta

SEQ ID NO: 287590 - DNA, 20 bp, human
ggcagcccgttacaagtcgt

SEQ ID NO: 287591 - DNA, 20 bp, human
gacccggagctccatctggt

SEQ ID NO: 287592 - DNA, 20 bp, human
ggagcccccctcagcaagat

SEQ ID NO: 287593 - DNA, 20 bp, human
gaccggaagaagcacctcat

SEQ ID NO: 287594 - DNA, 20 bp, human
gagccgctgttagccggccc

SEQ ID NO: 287595 - DNA, 20 bp, human
gcgggtcgtaggcgtgtgtg

SEQ ID NO: 287596 - DNA, 20 bp, human
ggtctggggaacaaaagagc

SEQ ID NO: 287597 - DNA, 20 bp, human
gttaagcggccggacattcc

SEQ ID NO: 287598 - DNA, 20 bp, human
gtctccccggaggcccggtc

SEQ ID NO: 287599 - DNA, 20 bp, human
gccgcgcagccgggaatgtc

SEQ ID NO: 287600 - DNA, 20 bp, human
gagggcgcagcagaaagagt

SEQ ID NO: 287601 - DNA, 20 bp, human
gctgaggaagtggacaccag

SEQ ID NO: 287602 - DNA, 20 bp, human
gccacagttcaaagcgcagg

SEQ ID NO: 287603 - DNA, 20 bp, human
ggccgcgagcggtgcgagtg

SEQ ID NO: 287604 - DNA, 20 bp, human
ggagtcctggcgctccgctg

SEQ ID NO: 287605 - DNA, 20 bp, human
gagccggcgagcgctttaag

SEQ ID NO: 287606 - DNA, 20 bp, human
gggcccgcggcgacccggag

SEQ ID NO: 287607 - DNA, 20 bp, human
gagggggcgcccggcgagtg

SEQ ID NO: 287608 - DNA, 20 bp, human
gcgcccaagatggcgatgga

SEQ ID NO: 287609 - DNA, 20 bp, human
gacggccctgcgcctcgcgg

SEQ ID NO: 287610 - DNA, 20 bp, human
gcaagatggcgatggagggg

SEQ ID NO: 287611 - DNA, 20 bp, human
gtcccctgagcctggaacgg

SEQ ID NO: 287612 - DNA, 20 bp, human
gctcaggggaggcagattca

SEQ ID NO: 287613 - DNA, 20 bp, human
gagaagaaatagagacgctg

SEQ ID NO: 287614 - DNA, 20 bp, human
gaccctgcgcccgcgcgcca

SEQ ID NO: 287615 - DNA, 20 bp, human
gccagggtggccacactcgc

SEQ ID NO: 287616 - DNA, 20 bp, human
ggtagacaggaaacagctgg

SEQ ID NO: 287617 - DNA, 20 bp, human
gtgactggggtaaagtagat

SEQ ID NO: 287618 - DNA, 20 bp, human
gctggcaaagttattgagta

SEQ ID NO: 287619 - DNA, 20 bp, human
gccccatattcctttaatac

SEQ ID NO: 287620 - DNA, 20 bp, human
gcacttggcaactgggacaa

SEQ ID NO: 287621 - DNA, 20 bp, human
gactgtagacaggaaacagc

SEQ ID NO: 287622 - DNA, 20 bp, human
gagaatgtgtgttagtgaca

SEQ ID NO: 287623 - DNA, 20 bp, human
gcaataactttgccagaaga

SEQ ID NO: 287624 - DNA, 20 bp, human
gttaaaggaatatgggggat

SEQ ID NO: 287625 - DNA, 20 bp, human
gactaacacacattctttta

SEQ ID NO: 287626 - DNA, 20 bp, human
gaggcggtggggcgggagat

SEQ ID NO: 287627 - DNA, 20 bp, human
ggctccgctccgcacgtctt

SEQ ID NO: 287628 - DNA, 20 bp, human
gcccggttccccaagacgtg

SEQ ID NO: 287629 - DNA, 20 bp, human
gcgtggggcgcgagactgcg

SEQ ID NO: 287630 - DNA, 20 bp, human
gttccccaagacgtgcggag

SEQ ID NO: 287631 - DNA, 20 bp, human
gcctcggcgcgccgctgctg

SEQ ID NO: 287632 - DNA, 20 bp, human
ggcccgctcgcacactcgag

SEQ ID NO: 287633 - DNA, 20 bp, human
ggccggcgcgcgcaaaaaac

SEQ ID NO: 287634 - DNA, 20 bp, human
gcgcgcaaaaaaccggagcc

SEQ ID NO: 287635 - DNA, 20 bp, human
ggtggccggcgcagtgcggt

SEQ ID NO: 287636 - DNA, 20 bp, human
gccctccgggtgcgcggacg

SEQ ID NO: 287637 - DNA, 20 bp, human
gaacccgaggcgcgccgggg

SEQ ID NO: 287638 - DNA, 20 bp, human
gcgccggcagcagcggccca

SEQ ID NO: 287639 - DNA, 20 bp, human
ggctccccctccaaaaacaa

SEQ ID NO: 287640 - DNA, 20 bp, human
gggcgggctgtcggcgtcgt

SEQ ID NO: 287641 - DNA, 20 bp, human
ggcgcgccggggcgggctgt

SEQ ID NO: 287642 - DNA, 20 bp, human
ggccccgaagtccgggtcac

SEQ ID NO: 287643 - DNA, 20 bp, human
ggaaggaaacaatactccga

SEQ ID NO: 287644 - DNA, 20 bp, human
gcctccaaaaacaagggcga

SEQ ID NO: 287645 - DNA, 20 bp, human
ggacgcccgagcttccgccg

SEQ ID NO: 287646 - DNA, 20 bp, human
gcaccccagaaacccgggat

SEQ ID NO: 287647 - DNA, 20 bp, human
gcccgccccgctcttggctc

SEQ ID NO: 287648 - DNA, 20 bp, human
ggcggcggtcgcaggggctg

SEQ ID NO: 287649 - DNA, 20 bp, human
ggcctcgcgcccgcgccaat

SEQ ID NO: 287650 - DNA, 20 bp, human
gacccgagccaagagcgggg

SEQ ID NO: 287651 - DNA, 20 bp, human
gcgaccgccgcccccccccc

SEQ ID NO: 287652 - DNA, 20 bp, human
ggaccccagctcacgagcac

SEQ ID NO: 287653 - DNA, 20 bp, human
gctcttggctcgggttgcgg

SEQ ID NO: 287654 - DNA, 20 bp, human
ggcaacccgagccaagagcg

SEQ ID NO: 287655 - DNA, 20 bp, human
ggccccatcccgggtttctg

SEQ ID NO: 287656 - DNA, 20 bp, human
gcgaggggccctgtggcgtc

SEQ ID NO: 287657 - DNA, 20 bp, human
gggtttggccggagggccga

SEQ ID NO: 287658 - DNA, 20 bp, human
gaaggggcctgtagagcttc

SEQ ID NO: 287659 - DNA, 20 bp, human
gggccaggttcttgcaaagg

SEQ ID NO: 287660 - DNA, 20 bp, human
gtcacccccggggtaaactg

SEQ ID NO: 287661 - DNA, 20 bp, human
gccgccccagtttaccccgg

SEQ ID NO: 287662 - DNA, 20 bp, human
gggggaactcaactcacccc

SEQ ID NO: 287663 - DNA, 20 bp, human
gtgcaagaacctggccccta

SEQ ID NO: 287664 - DNA, 20 bp, human
gtcgggggtctttccctgca

SEQ ID NO: 287665 - DNA, 20 bp, human
ggctagcagttaaccgggga

SEQ ID NO: 287666 - DNA, 20 bp, human
gctcccgccaccgccttgag

SEQ ID NO: 287667 - DNA, 20 bp, human
gtctctccctctcaaggcgg

SEQ ID NO: 287668 - DNA, 20 bp, human
gtcggcgcggctgcctcctc

SEQ ID NO: 287669 - DNA, 20 bp, human
gtccctctcaaggcggtggc

SEQ ID NO: 287670 - DNA, 20 bp, human
gggcgtgtgcgcagccgaga

SEQ ID NO: 287671 - DNA, 20 bp, human
gcgcccaccgcgctcggcag

SEQ ID NO: 287672 - DNA, 20 bp, human
gcggaggaggaggagagacg

SEQ ID NO: 287673 - DNA, 20 bp, human
gtctcacacagacacacgcg

SEQ ID NO: 287674 - DNA, 20 bp, human
ggcgctcgctcgctccctct

SEQ ID NO: 287675 - DNA, 20 bp, human
gcgctcggcagtggctgctc

SEQ ID NO: 287676 - DNA, 20 bp, human
gtcagcgccccgcttggtgc

SEQ ID NO: 287677 - DNA, 20 bp, human
gcctcaattagagtgggttt

SEQ ID NO: 287678 - DNA, 20 bp, human
gtccccataaaaaacccaga

SEQ ID NO: 287679 - DNA, 20 bp, human
gggccgaagccaaaggggtt

SEQ ID NO: 287680 - DNA, 20 bp, human
gcacccttctgggtttttta

SEQ ID NO: 287681 - DNA, 20 bp, human
gtccgctggccgaagccaaa

SEQ ID NO: 287682 - DNA, 20 bp, human
gccagagcctcaattagagt

SEQ ID NO: 287683 - DNA, 20 bp, human
gctcctgccagtcacccttc

SEQ ID NO: 287684 - DNA, 20 bp, human
ggaaaatatcacactacgtg

SEQ ID NO: 287685 - DNA, 20 bp, human
gaaagcgagcgagaggaaga

SEQ ID NO: 287686 - DNA, 20 bp, human
gtcacgtgagcgcagcgcgc

SEQ ID NO: 287687 - DNA, 20 bp, human
gccagcccgccgagaggctc

SEQ ID NO: 287688 - DNA, 20 bp, human
gcggggcctgagcctctcgg

SEQ ID NO: 287689 - DNA, 20 bp, human
ggcgggacaggaagcggcgc

SEQ ID NO: 287690 - DNA, 20 bp, human
gccgcgcccagcccgccgag

SEQ ID NO: 287691 - DNA, 20 bp, human
gcacccgccacgatccagca

SEQ ID NO: 287692 - DNA, 20 bp, human
gaacaagggagtcacgtgag

SEQ ID NO: 287693 - DNA, 20 bp, human
gttcccctactggtcgatcg

SEQ ID NO: 287694 - DNA, 20 bp, human
gccagcagggcgcggtggga

SEQ ID NO: 287695 - DNA, 20 bp, human
gaggctccaggtgcctcccg

SEQ ID NO: 287696 - DNA, 20 bp, human
ggggtgagggagcttcagtc

SEQ ID NO: 287697 - DNA, 20 bp, human
gagcccccagggccgcatta

SEQ ID NO: 287698 - DNA, 20 bp, human
gccctcccaggctgctgcaa

SEQ ID NO: 287699 - DNA, 20 bp, human
gctgcagggggcccgggcac

SEQ ID NO: 287700 - DNA, 20 bp, human
ggcactggccgtcagccccc

SEQ ID NO: 287701 - DNA, 20 bp, human
gacaggacctggtaaaaccc

SEQ ID NO: 287702 - DNA, 20 bp, human
gttaaccccctcgtgccggg

SEQ ID NO: 287703 - DNA, 20 bp, human
ggcccgaggtagccgtaatg

SEQ ID NO: 287704 - DNA, 20 bp, human
gagccgtaatgcggccctgg

SEQ ID NO: 287705 - DNA, 20 bp, human
gctgtagggaacccccggga

SEQ ID NO: 287706 - DNA, 20 bp, human
gtacgcaaaccgctggtggg

SEQ ID NO: 287707 - DNA, 20 bp, human
gggcctgaaccccctaacaa

SEQ ID NO: 287708 - DNA, 20 bp, human
gagaactggactttaactga

SEQ ID NO: 287709 - DNA, 20 bp, human
gccctacgcaaaccgctggt

SEQ ID NO: 287710 - DNA, 20 bp, human
gagccctagcaggttatctg

SEQ ID NO: 287711 - DNA, 20 bp, human
ggcaccaggaggttaatgat

SEQ ID NO: 287712 - DNA, 20 bp, human
gaggccgcgccacttgcacc

SEQ ID NO: 287713 - DNA, 20 bp, human
gaaggccctacgcaaaccgc

SEQ ID NO: 287714 - DNA, 20 bp, human
gtcccgttgttagggggttc

SEQ ID NO: 287715 - DNA, 20 bp, human
gattggcagcgccgcacgct

SEQ ID NO: 287716 - DNA, 20 bp, human
gagggagtgtcgggggggaa

SEQ ID NO: 287717 - DNA, 20 bp, human
gtgccggcgcgagggagtgt

SEQ ID NO: 287718 - DNA, 20 bp, human
gcactcacttgccggcgcga

SEQ ID NO: 287719 - DNA, 20 bp, human
gaacgcggaggtgggcgagc

SEQ ID NO: 287720 - DNA, 20 bp, human
gcccgcagccaacgcggagg

SEQ ID NO: 287721 - DNA, 20 bp, human
ggcgcgagggagtgtcgggg

SEQ ID NO: 287722 - DNA, 20 bp, human
ggagcccgcagccaacgcgg

SEQ ID NO: 287723 - DNA, 20 bp, human
ggaagggagtggtctccaaa

SEQ ID NO: 287724 - DNA, 20 bp, human
gccagagcccgcagccaacg

SEQ ID NO: 287725 - DNA, 20 bp, human
gcccacctccgcgttggctg

SEQ ID NO: 287726 - DNA, 20 bp, human
ggcggggtcaaggagatcgg

SEQ ID NO: 287727 - DNA, 20 bp, human
gagcagccggggccgagctc

SEQ ID NO: 287728 - DNA, 20 bp, human
ggcttcgccctgagcagccg

SEQ ID NO: 287729 - DNA, 20 bp, human
ggggcgggtcggcgcaggca

SEQ ID NO: 287730 - DNA, 20 bp, human
ggcggcggggtcaaggagat

SEQ ID NO: 287731 - DNA, 20 bp, human
gtgcagctcgagactcgccc

SEQ ID NO: 287732 - DNA, 20 bp, human
ggctgctcagggcgaagcac

SEQ ID NO: 287733 - DNA, 20 bp, human
gacgcccccgagctcggccc

SEQ ID NO: 287734 - DNA, 20 bp, human
ggcgcccaggagtgggggtt

SEQ ID NO: 287735 - DNA, 20 bp, human
ggggcgtgcgcacgaggagc

SEQ ID NO: 287736 - DNA, 20 bp, human
gagggagaggcggccgttag

SEQ ID NO: 287737 - DNA, 20 bp, human
gtctgaaccggagccccgga

SEQ ID NO: 287738 - DNA, 20 bp, human
gcaccggggtgcggtggaaa

SEQ ID NO: 287739 - DNA, 20 bp, human
ggcgggacgagactcctccg

SEQ ID NO: 287740 - DNA, 20 bp, human
gtgcctcccctccggggctc

SEQ ID NO: 287741 - DNA, 20 bp, human
gcacagctaggggcacagaa

SEQ ID NO: 287742 - DNA, 20 bp, human
ggggccccctttcccgacct

SEQ ID NO: 287743 - DNA, 20 bp, human
gtggaagcaccggggtgcgg

SEQ ID NO: 287744 - DNA, 20 bp, human
gccccctttcccgacctcgg

SEQ ID NO: 287745 - DNA, 20 bp, human
gactcctccgaggtcgggaa

SEQ ID NO: 287746 - DNA, 20 bp, human
gaggccttctagacacaagg

SEQ ID NO: 287747 - DNA, 20 bp, human
gggaggagggcgctgttcag

SEQ ID NO: 287748 - DNA, 20 bp, human
ggcgctgttcagggagcgaa

SEQ ID NO: 287749 - DNA, 20 bp, human
gtccccccggaatgtaagaa

SEQ ID NO: 287750 - DNA, 20 bp, human
gtacaaactcacacggggtg

SEQ ID NO: 287751 - DNA, 20 bp, human
gggggaggagggcgctgttc

SEQ ID NO: 287752 - DNA, 20 bp, human
ggctggggctaccgagaatg

SEQ ID NO: 287753 - DNA, 20 bp, human
ggagaggccttctagacaca

SEQ ID NO: 287754 - DNA, 20 bp, human
gttacattccggggggagga

SEQ ID NO: 287755 - DNA, 20 bp, human
ggcccctttcttacattccg

SEQ ID NO: 287756 - DNA, 20 bp, human
gtggggaggagcggaagaag

SEQ ID NO: 287757 - DNA, 20 bp, human
ggggcatgcagggacccggt

SEQ ID NO: 287758 - DNA, 20 bp, human
gagtggggaggacccaggtt

SEQ ID NO: 287759 - DNA, 20 bp, human
ggtggggagtgagaagacgg

SEQ ID NO: 287760 - DNA, 20 bp, human
gttgggaagtaaacagaaac

SEQ ID NO: 287761 - DNA, 20 bp, human
gtgtatgtgtaggacgacga

SEQ ID NO: 287762 - DNA, 20 bp, human
gccggtggggagtgagaaga

SEQ ID NO: 287763 - DNA, 20 bp, human
gcaggggcattccctaaact

SEQ ID NO: 287764 - DNA, 20 bp, human
gcctacacatacacactaag

SEQ ID NO: 287765 - DNA, 20 bp, human
ggagaagacgggggctgaaa

SEQ ID NO: 287766 - DNA, 20 bp, human
gcgctcctgctggcgtcggg

SEQ ID NO: 287767 - DNA, 20 bp, human
gagaccgagcgcccatgggc

SEQ ID NO: 287768 - DNA, 20 bp, human
gagcgggcacccggcgtgac

SEQ ID NO: 287769 - DNA, 20 bp, human
ggccccgcccggcctgtccg

SEQ ID NO: 287770 - DNA, 20 bp, human
gcgcgcgctcctgctggcgt

SEQ ID NO: 287771 - DNA, 20 bp, human
gactgcggtgcgatccctga

SEQ ID NO: 287772 - DNA, 20 bp, human
gcccggggcggtgagagcac

SEQ ID NO: 287773 - DNA, 20 bp, human
ggaaacggggagaaaccaga

SEQ ID NO: 287774 - DNA, 20 bp, human
gcggggtgagctctgcgaag

SEQ ID NO: 287775 - DNA, 20 bp, human
gtccgcgggaaccacacccc

SEQ ID NO: 287776 - DNA, 20 bp, human
gaggtcggagagctgctctc

SEQ ID NO: 287777 - DNA, 20 bp, human
gaacttgcccgaggtcgcta

SEQ ID NO: 287778 - DNA, 20 bp, human
gaggtcgctatggcagagtc

SEQ ID NO: 287779 - DNA, 20 bp, human
ggggaaccgagacccagtcg

SEQ ID NO: 287780 - DNA, 20 bp, human
gtgtcgccccgactgggtct

SEQ ID NO: 287781 - DNA, 20 bp, human
gcagctctccgacctccgat

SEQ ID NO: 287782 - DNA, 20 bp, human
gcctccgattggactcttga

SEQ ID NO: 287783 - DNA, 20 bp, human
gtcggggcgaccctccagct

SEQ ID NO: 287784 - DNA, 20 bp, human
gcggggcgacaacttgcccg

SEQ ID NO: 287785 - DNA, 20 bp, human
gcgcagcgcggcaccgtctg

SEQ ID NO: 287786 - DNA, 20 bp, human
gtcagtgtgggggacgattg

SEQ ID NO: 287787 - DNA, 20 bp, human
gaggaaagtcatagctcagt

SEQ ID NO: 287788 - DNA, 20 bp, human
gagtcctctggaaaatagga

SEQ ID NO: 287789 - DNA, 20 bp, human
gtctctgcaggacttgcagg

SEQ ID NO: 287790 - DNA, 20 bp, human
gccagctccactagaaatat

SEQ ID NO: 287791 - DNA, 20 bp, human
gctgtctctgcaggacttgc

SEQ ID NO: 287792 - DNA, 20 bp, human
gctggaaaataggaaggttc

SEQ ID NO: 287793 - DNA, 20 bp, human
ggcaggacttgcaggagggc

SEQ ID NO: 287794 - DNA, 20 bp, human
ggtcggagagtgttaatgcc

SEQ ID NO: 287795 - DNA, 20 bp, human
gctgggtccttgggcaggag

SEQ ID NO: 287796 - DNA, 20 bp, human
ggggaggtgcccagaagcac

SEQ ID NO: 287797 - DNA, 20 bp, human
gagcactggcctcttggaaa

SEQ ID NO: 287798 - DNA, 20 bp, human
gtttactctgagatttcgag

SEQ ID NO: 287799 - DNA, 20 bp, human
gccaagaggccagtgcttct

SEQ ID NO: 287800 - DNA, 20 bp, human
gaacttatccacatttaggg

SEQ ID NO: 287801 - DNA, 20 bp, human
gtgagaaggtagcagtcact

SEQ ID NO: 287802 - DNA, 20 bp, human
gctggagccggactgagatg

SEQ ID NO: 287803 - DNA, 20 bp, human
gggtagcagtcacttggaac

SEQ ID NO: 287804 - DNA, 20 bp, human
gctgggcacctccctaaatg

SEQ ID NO: 287805 - DNA, 20 bp, human
gctcagataagtgagagcca

SEQ ID NO: 287806 - DNA, 20 bp, human
gaggagactgggtggcgtaa

SEQ ID NO: 287807 - DNA, 20 bp, human
gttaacagacaaccccattt

SEQ ID NO: 287808 - DNA, 20 bp, human
ggaaactaatgaatgtgctt

SEQ ID NO: 287809 - DNA, 20 bp, human
gtagaagcctaacttggagt

SEQ ID NO: 287810 - DNA, 20 bp, human
gtatggagacagcctaaatg

SEQ ID NO: 287811 - DNA, 20 bp, human
gacattcattagtttcttta

SEQ ID NO: 287812 - DNA, 20 bp, human
gtgaggtctgcaatagtata

SEQ ID NO: 287813 - DNA, 20 bp, human
gtgagtcagtctgcaacatt

SEQ ID NO: 287814 - DNA, 20 bp, human
gagggtgaatgagtgtaggt

SEQ ID NO: 287815 - DNA, 20 bp, human
gggtaagtttactgattgga

SEQ ID NO: 287816 - DNA, 20 bp, human
ggggctgcaaaactgtgcca

SEQ ID NO: 287817 - DNA, 20 bp, human
gaacttaccgccatttaggg

SEQ ID NO: 287818 - DNA, 20 bp, human
gggatctgaagggtctgagg

SEQ ID NO: 287819 - DNA, 20 bp, human
gcttctggacctgttccaag

SEQ ID NO: 287820 - DNA, 20 bp, human
gaaagcttagataggttcct

SEQ ID NO: 287821 - DNA, 20 bp, human
gaaaataggcggtggtagga

SEQ ID NO: 287822 - DNA, 20 bp, human
gtgaggaggcagcaaccact

SEQ ID NO: 287823 - DNA, 20 bp, human
gcgcccaagggaaaaccact

SEQ ID NO: 287824 - DNA, 20 bp, human
gtttaccctgaggatctgaa

SEQ ID NO: 287825 - DNA, 20 bp, human
gcagacccttcagatcctca

SEQ ID NO: 287826 - DNA, 20 bp, human
gcacccccgaggttccatac

SEQ ID NO: 287827 - DNA, 20 bp, human
gagacaggggcggtagaaga

SEQ ID NO: 287828 - DNA, 20 bp, human
gggccagtatggaacctcgg

SEQ ID NO: 287829 - DNA, 20 bp, human
gcggccatgccagtgatcag

SEQ ID NO: 287830 - DNA, 20 bp, human
gtgtccctgttgggggtgaa

SEQ ID NO: 287831 - DNA, 20 bp, human
gcaggaacatctgtccctgt

SEQ ID NO: 287832 - DNA, 20 bp, human
gcccacacatgtgacgaaaa

SEQ ID NO: 287833 - DNA, 20 bp, human
gttatggagcccgggagcct

SEQ ID NO: 287834 - DNA, 20 bp, human
ggaaaaggggaaacaagact

SEQ ID NO: 287835 - DNA, 20 bp, human
gacgcagctttattaagaca

SEQ ID NO: 287836 - DNA, 20 bp, human
ggactggcaaggatgaacag

SEQ ID NO: 287837 - DNA, 20 bp, human
gggggcgcgaccaagttccc

SEQ ID NO: 287838 - DNA, 20 bp, human
gagagtgaggcatgaaggtt

SEQ ID NO: 287839 - DNA, 20 bp, human
ggatgaacagcgggatggaa

SEQ ID NO: 287840 - DNA, 20 bp, human
ggcaaggatgaacagcggga

SEQ ID NO: 287841 - DNA, 20 bp, human
gagaaaaaaagccgggcggt

SEQ ID NO: 287842 - DNA, 20 bp, human
ggtcgcgcccccatgcgtac

SEQ ID NO: 287843 - DNA, 20 bp, human
gacccggcacggagcctcgg

SEQ ID NO: 287844 - DNA, 20 bp, human
gaaaacggcacgaagaccgg

SEQ ID NO: 287845 - DNA, 20 bp, human
ggcgtacaggctacacacgg

SEQ ID NO: 287846 - DNA, 20 bp, human
gtgcaaagcgaggagttgga

SEQ ID NO: 287847 - DNA, 20 bp, human
gaaaaagggtcgtataaatg

SEQ ID NO: 287848 - DNA, 20 bp, human
ggagctagaatgttagccct

SEQ ID NO: 287849 - DNA, 20 bp, human
gggccttgccctgccaagcc

SEQ ID NO: 287850 - DNA, 20 bp, human
gggctaacattctagctcag

SEQ ID NO: 287851 - DNA, 20 bp, human
gccaccgagagtgaccagga

SEQ ID NO: 287852 - DNA, 20 bp, human
gagctgaaaagttaagggtt

SEQ ID NO: 287853 - DNA, 20 bp, human
gcgtataaatgaggcttcat

SEQ ID NO: 287854 - DNA, 20 bp, human
gtaacattctagctcagagg

SEQ ID NO: 287855 - DNA, 20 bp, human
gttggatggactgatgtcac

SEQ ID NO: 287856 - DNA, 20 bp, human
gcgccctaaggtgaccgtca

SEQ ID NO: 287857 - DNA, 20 bp, human
gttccctgacggtcacctta

SEQ ID NO: 287858 - DNA, 20 bp, human
gccgcagcctcggccggaaa

SEQ ID NO: 287859 - DNA, 20 bp, human
gtccgggccccgaaggtctc

SEQ ID NO: 287860 - DNA, 20 bp, human
gcaggtgagacctgggatat

SEQ ID NO: 287861 - DNA, 20 bp, human
gcggcgcagaagcgggacgt

SEQ ID NO: 287862 - DNA, 20 bp, human
gtatgtgcctgggtccgacc

SEQ ID NO: 287863 - DNA, 20 bp, human
ggcggacgccagccgcccta

SEQ ID NO: 287864 - DNA, 20 bp, human
gaaggcaccaggtcggaccc

SEQ ID NO: 287865 - DNA, 20 bp, human
gaaccgcgtgcgtaacgcac

SEQ ID NO: 287866 - DNA, 20 bp, human
gcccctgccttgaaccagga

SEQ ID NO: 287867 - DNA, 20 bp, human
ggggaatccagttgatatat

SEQ ID NO: 287868 - DNA, 20 bp, human
gtcagggcatctctagacat

SEQ ID NO: 287869 - DNA, 20 bp, human
gtaccctgctagaaattgtc

SEQ ID NO: 287870 - DNA, 20 bp, human
gctgacccctgccttgaacc

SEQ ID NO: 287871 - DNA, 20 bp, human
gtgggaaacaagatgtcact

SEQ ID NO: 287872 - DNA, 20 bp, human
gacatcagtttggtgacgtt

SEQ ID NO: 287873 - DNA, 20 bp, human
gatttgccttacaactttgc

SEQ ID NO: 287874 - DNA, 20 bp, human
gttaactatgctttacatgg

SEQ ID NO: 287875 - DNA, 20 bp, human
ggtgcctgacaatttctagc

SEQ ID NO: 287876 - DNA, 20 bp, human
gttaaggtgtgtgatctata

SEQ ID NO: 287877 - DNA, 20 bp, human
ggcaaaaaaagtcagggtta

SEQ ID NO: 287878 - DNA, 20 bp, human
gtgaagtttaaatgctgaac

SEQ ID NO: 287879 - DNA, 20 bp, human
gctggtagcttggttaatta

SEQ ID NO: 287880 - DNA, 20 bp, human
gtgcctagaataataaatga

SEQ ID NO: 287881 - DNA, 20 bp, human
ggaaattattattagtcttc

SEQ ID NO: 287882 - DNA, 20 bp, human
ggatacacttgggaccttaa

SEQ ID NO: 287883 - DNA, 20 bp, human
gaaatgattgtatcaaatta

SEQ ID NO: 287884 - DNA, 20 bp, human
gattaacataagatacactt

SEQ ID NO: 287885 - DNA, 20 bp, human
ggactaatatgaatatatct

SEQ ID NO: 287886 - DNA, 20 bp, human
gctgctgtggtcaggatcca

SEQ ID NO: 287887 - DNA, 20 bp, human
ggggccctgggtgctttgtt

SEQ ID NO: 287888 - DNA, 20 bp, human
gccaagctgacaggtgtggg

SEQ ID NO: 287889 - DNA, 20 bp, human
ggatggggccacatggactg

SEQ ID NO: 287890 - DNA, 20 bp, human
gggggcaaggccaagctgac

SEQ ID NO: 287891 - DNA, 20 bp, human
ggggaccagaggatgaggat

SEQ ID NO: 287892 - DNA, 20 bp, human
gtctgccaactgccctgctg

SEQ ID NO: 287893 - DNA, 20 bp, human
gtccatgaccgttacccctg

SEQ ID NO: 287894 - DNA, 20 bp, human
gagggcgcaggtgcctccaa

SEQ ID NO: 287895 - DNA, 20 bp, human
gaccccaggggtaacggtca

SEQ ID NO: 287896 - DNA, 20 bp, human
gtggggaagacaagtgggtc

SEQ ID NO: 287897 - DNA, 20 bp, human
gggcttgagctcagggggtt

SEQ ID NO: 287898 - DNA, 20 bp, human
gtcctgctgggcagctctct

SEQ ID NO: 287899 - DNA, 20 bp, human
gggcagctctctaggcccta

SEQ ID NO: 287900 - DNA, 20 bp, human
gagggctggtcccaactggc

SEQ ID NO: 287901 - DNA, 20 bp, human
gggaccagccctttcttggc

SEQ ID NO: 287902 - DNA, 20 bp, human
gggggccaggcagccggctg

SEQ ID NO: 287903 - DNA, 20 bp, human
gtggctgggttggttaagcc

SEQ ID NO: 287904 - DNA, 20 bp, human
gggtgtgcaccacccagggg

SEQ ID NO: 287905 - DNA, 20 bp, human
gggccacaggatagccagcc

SEQ ID NO: 287906 - DNA, 20 bp, human
gactccgtgttctgcggatg

SEQ ID NO: 287907 - DNA, 20 bp, human
ggaaagacgtggggacgcct

SEQ ID NO: 287908 - DNA, 20 bp, human
gtcccagactccgtgttctg

SEQ ID NO: 287909 - DNA, 20 bp, human
ggctgctgcagacccgggga

SEQ ID NO: 287910 - DNA, 20 bp, human
gtcaagggggggttgcttgt

SEQ ID NO: 287911 - DNA, 20 bp, human
gggggaggcggggtcaaggg

SEQ ID NO: 287912 - DNA, 20 bp, human
ggctgcagacccggggaggg

SEQ ID NO: 287913 - DNA, 20 bp, human
gagtctcctaggtccatggg

SEQ ID NO: 287914 - DNA, 20 bp, human
gggactggggctagtctcct

SEQ ID NO: 287915 - DNA, 20 bp, human
gccccgggccggtgcagcgc

SEQ ID NO: 287916 - DNA, 20 bp, human
gtgccaggcagagttggtgt

SEQ ID NO: 287917 - DNA, 20 bp, human
gtagaaatccccgtcgtcag

SEQ ID NO: 287918 - DNA, 20 bp, human
gaggcagagttggtgtaggt

SEQ ID NO: 287919 - DNA, 20 bp, human
gcagggagtccggagagagg

SEQ ID NO: 287920 - DNA, 20 bp, human
gggctccagcaacctctgca

SEQ ID NO: 287921 - DNA, 20 bp, human
gaactctgagagacaggcga

SEQ ID NO: 287922 - DNA, 20 bp, human
ggggggcaggggcctgaatt

SEQ ID NO: 287923 - DNA, 20 bp, human
ggggcccaggggcacacagt

SEQ ID NO: 287924 - DNA, 20 bp, human
gactgggtcactgtattgtg

SEQ ID NO: 287925 - DNA, 20 bp, human
gctgcagggagtccggagag

SEQ ID NO: 287926 - DNA, 20 bp, human
gtaacccaaaaggcagatta

SEQ ID NO: 287927 - DNA, 20 bp, human
gcgaccaaaacacacaatcc

SEQ ID NO: 287928 - DNA, 20 bp, human
ggtaaagcaggagatgtttt

SEQ ID NO: 287929 - DNA, 20 bp, human
gttggtcgtagtgtggtgag

SEQ ID NO: 287930 - DNA, 20 bp, human
gtggctataatagtcattgg

SEQ ID NO: 287931 - DNA, 20 bp, human
ggtgtggtgagcggtagtca

SEQ ID NO: 287932 - DNA, 20 bp, human
gtaatggctataatagtcat

SEQ ID NO: 287933 - DNA, 20 bp, human
ggattccttaatctgccttt

SEQ ID NO: 287934 - DNA, 20 bp, human
ggtgtgttttggtcgtagtg

SEQ ID NO: 287935 - DNA, 20 bp, human
ggctccaacatccataccca

SEQ ID NO: 287936 - DNA, 20 bp, human
gacgcctggcggcccacccg

SEQ ID NO: 287937 - DNA, 20 bp, human
gtcgccccgcttggtctcca

SEQ ID NO: 287938 - DNA, 20 bp, human
gttgccctggagaccaagcg

SEQ ID NO: 287939 - DNA, 20 bp, human
ggggcggcgcggtgcacagg

SEQ ID NO: 287940 - DNA, 20 bp, human
gcggcgcggtgcacaggtgg

SEQ ID NO: 287941 - DNA, 20 bp, human
ggagtagcggggcgtgagtt

SEQ ID NO: 287942 - DNA, 20 bp, human
gtagcggggcgtgagttggg

SEQ ID NO: 287943 - DNA, 20 bp, human
gaagggaggggccctaactc

SEQ ID NO: 287944 - DNA, 20 bp, human
gcgcgctctgctccgcgggt

SEQ ID NO: 287945 - DNA, 20 bp, human
gagctggtggaggcgtgcgg

SEQ ID NO: 287946 - DNA, 20 bp, human
ggtaatcccggggataggag

SEQ ID NO: 287947 - DNA, 20 bp, human
ggataggaggggctaggtaa

SEQ ID NO: 287948 - DNA, 20 bp, human
ggagggcgatggtaatcccg

SEQ ID NO: 287949 - DNA, 20 bp, human
ggtcccccctcactcaaaac

SEQ ID NO: 287950 - DNA, 20 bp, human
gaggcagcctccctcccgag

SEQ ID NO: 287951 - DNA, 20 bp, human
gtgttgggtcacctgggtaa

SEQ ID NO: 287952 - DNA, 20 bp, human
gaggaggggctaggtaaagg

SEQ ID NO: 287953 - DNA, 20 bp, human
gcgatggagcatagcttcca

SEQ ID NO: 287954 - DNA, 20 bp, human
gagccagttttgagtgaggg

SEQ ID NO: 287955 - DNA, 20 bp, human
gtggagcatagcttccaggg

SEQ ID NO: 287956 - DNA, 20 bp, human
ggctgagggtggcagtccag

SEQ ID NO: 287957 - DNA, 20 bp, human
ggcacactgcttggttgtgg

SEQ ID NO: 287958 - DNA, 20 bp, human
gggaacaaaaaaagtacccc

SEQ ID NO: 287959 - DNA, 20 bp, human
gtgcagctgtctcagctaga

SEQ ID NO: 287960 - DNA, 20 bp, human
gggacacggtgaactgggga

SEQ ID NO: 287961 - DNA, 20 bp, human
gactaaggaatcgcccccag

SEQ ID NO: 287962 - DNA, 20 bp, human
gactgggacacggtgaactg

SEQ ID NO: 287963 - DNA, 20 bp, human
ggggggaaacactgaaggcc

SEQ ID NO: 287964 - DNA, 20 bp, human
gcaggcacacactcaggtac

SEQ ID NO: 287965 - DNA, 20 bp, human
ggccaaaacctgtaccacaa

SEQ ID NO: 287966 - DNA, 20 bp, human
ggccgtggacacaaggtgct

SEQ ID NO: 287967 - DNA, 20 bp, human
gagacagggccgtggacaca

SEQ ID NO: 287968 - DNA, 20 bp, human
gggccaaaggtcaacctggt

SEQ ID NO: 287969 - DNA, 20 bp, human
ggtagtaggcgctcaacgaa

SEQ ID NO: 287970 - DNA, 20 bp, human
gccacggccctgtctgactc

SEQ ID NO: 287971 - DNA, 20 bp, human
ggtaggaggtgacggggctt

SEQ ID NO: 287972 - DNA, 20 bp, human
gcaaaggtcaacctggtagg

SEQ ID NO: 287973 - DNA, 20 bp, human
gtagtgcctggtcacgtagt

SEQ ID NO: 287974 - DNA, 20 bp, human
gaacctggtaggaggtgacg

SEQ ID NO: 287975 - DNA, 20 bp, human
gggtgtctaggatgtcctgg

SEQ ID NO: 287976 - DNA, 20 bp, human
ggccgggactcgcgtctcca

SEQ ID NO: 287977 - DNA, 20 bp, human
gcagccctgcccaggtcctc

SEQ ID NO: 287978 - DNA, 20 bp, human
ggagacgcgagtcccggccc

SEQ ID NO: 287979 - DNA, 20 bp, human
gtgagggtggcccggggcac

SEQ ID NO: 287980 - DNA, 20 bp, human
gcctggcgggggcatgaggg

SEQ ID NO: 287981 - DNA, 20 bp, human
gggactcgcgtctccagggg

SEQ ID NO: 287982 - DNA, 20 bp, human
ggcaccggaggacctgggca

SEQ ID NO: 287983 - DNA, 20 bp, human
gcagcccggcaagttaatca

SEQ ID NO: 287984 - DNA, 20 bp, human
gggggccgggcctctcttcg

SEQ ID NO: 287985 - DNA, 20 bp, human
ggcggcctcgaagagaggcc

SEQ ID NO: 287986 - DNA, 20 bp, human
ggctggaggactggtggata

SEQ ID NO: 287987 - DNA, 20 bp, human
gaagccacacttactcctaa

SEQ ID NO: 287988 - DNA, 20 bp, human
gggagtaagtgtggcttcca

SEQ ID NO: 287989 - DNA, 20 bp, human
gtcctagcacttgagggtgg

SEQ ID NO: 287990 - DNA, 20 bp, human
gtaatggctgtctcatccag

SEQ ID NO: 287991 - DNA, 20 bp, human
gccccccaccctcaagtgct

SEQ ID NO: 287992 - DNA, 20 bp, human
gatccagaggacgcaccctc

SEQ ID NO: 287993 - DNA, 20 bp, human
gatctcctagcacttgaggg

SEQ ID NO: 287994 - DNA, 20 bp, human
gcagtatggtgctgaacatc

SEQ ID NO: 287995 - DNA, 20 bp, human
gggagatgaacacaggaacg

SEQ ID NO: 287996 - DNA, 20 bp, human
gagagaggaacctcttatga

SEQ ID NO: 287997 - DNA, 20 bp, human
gcataggtgttagatgtttc

SEQ ID NO: 287998 - DNA, 20 bp, human
gatgacaactgtaaaatcca

SEQ ID NO: 287999 - DNA, 20 bp, human
gctgtctagggtacctgctc

SEQ ID NO: 288000 - DNA, 20 bp, human
gacagttcagtcactgtcta

SEQ ID NO: 288001 - DNA, 20 bp, human
gaactttttgaaattgtgca

SEQ ID NO: 288002 - DNA, 20 bp, human
gattatggttccttcataag

SEQ ID NO: 288003 - DNA, 20 bp, human
gcttccccccttttttgaca

SEQ ID NO: 288004 - DNA, 20 bp, human
gcctgctctgggtgccactc

SEQ ID NO: 288005 - DNA, 20 bp, human
gctctgggccagtaactgct

SEQ ID NO: 288006 - DNA, 20 bp, human
ggaggcccggggcggatcca

SEQ ID NO: 288007 - DNA, 20 bp, human
ggggactcgatgcgactcaa

SEQ ID NO: 288008 - DNA, 20 bp, human
gcctagacggggcggtggaa

SEQ ID NO: 288009 - DNA, 20 bp, human
gagggccaaggctgggtccg

SEQ ID NO: 288010 - DNA, 20 bp, human
gactcaaaggtgagtttcga

SEQ ID NO: 288011 - DNA, 20 bp, human
gcaaaggccggagtctggcg

SEQ ID NO: 288012 - DNA, 20 bp, human
ggggcggggcgggcctagac

SEQ ID NO: 288013 - DNA, 20 bp, human
gaagcggggcagcgaggcgt

SEQ ID NO: 288014 - DNA, 20 bp, human
gggggcgggcctagacgggg

SEQ ID NO: 288015 - DNA, 20 bp, human
gcggagcaaaggccggagtc

SEQ ID NO: 288016 - DNA, 20 bp, human
ggaagagctcggctgcacgt

SEQ ID NO: 288017 - DNA, 20 bp, human
gctcggctgcacgtgggctc

SEQ ID NO: 288018 - DNA, 20 bp, human
ggctgtgcagaggtccacga

SEQ ID NO: 288019 - DNA, 20 bp, human
gaacgggcgcgccacagagg

SEQ ID NO: 288020 - DNA, 20 bp, human
ggaggcgctcggggcatccg

SEQ ID NO: 288021 - DNA, 20 bp, human
gggcgggcgggacccctgag

SEQ ID NO: 288022 - DNA, 20 bp, human
gtctgtggcgcgcccgttcg

SEQ ID NO: 288023 - DNA, 20 bp, human
gcaactcccaggccgctcag

SEQ ID NO: 288024 - DNA, 20 bp, human
gcgcctcgccgtgcctctgg

SEQ ID NO: 288025 - DNA, 20 bp, human
gggacctgggtggatcccct

SEQ ID NO: 288026 - DNA, 20 bp, human
gaggaggcgagcccatttca

SEQ ID NO: 288027 - DNA, 20 bp, human
gtccgcccgtcgcggcgcga

SEQ ID NO: 288028 - DNA, 20 bp, human
ggagccgagcggagcctagg

SEQ ID NO: 288029 - DNA, 20 bp, human
ggcccgtcgcggcgcgaagg

SEQ ID NO: 288030 - DNA, 20 bp, human
gtgtgagccgagagagaagc

SEQ ID NO: 288031 - DNA, 20 bp, human
gggcaatgcgcatgattctg

SEQ ID NO: 288032 - DNA, 20 bp, human
gggcgccgcccgcaagccgg

SEQ ID NO: 288033 - DNA, 20 bp, human
gcggacccccggcttgcggg

SEQ ID NO: 288034 - DNA, 20 bp, human
gccgcccgggcgagtagtgc

SEQ ID NO: 288035 - DNA, 20 bp, human
gcgggcggcgcccaataggc

SEQ ID NO: 288036 - DNA, 20 bp, human
gggaggcgcgagcgggacga

SEQ ID NO: 288037 - DNA, 20 bp, human
ggggcgcgtccaggcgggga

SEQ ID NO: 288038 - DNA, 20 bp, human
gccgccaggcgcaaacctcc

SEQ ID NO: 288039 - DNA, 20 bp, human
gcagcctcctccccctcggg

SEQ ID NO: 288040 - DNA, 20 bp, human
gaggaggcagggacatgggt

SEQ ID NO: 288041 - DNA, 20 bp, human
gccgccctggcctcgcctac

SEQ ID NO: 288042 - DNA, 20 bp, human
gtggggcaccaggttatgag

SEQ ID NO: 288043 - DNA, 20 bp, human
gccgcaggggacaccgtagg

SEQ ID NO: 288044 - DNA, 20 bp, human
gacgagggctggctagtgcc

SEQ ID NO: 288045 - DNA, 20 bp, human
gtcgctgtcgagcgcacagg

SEQ ID NO: 288046 - DNA, 20 bp, human
gcataggctgcatgaggcag

SEQ ID NO: 288047 - DNA, 20 bp, human
gaccctaaagcctagcccat

SEQ ID NO: 288048 - DNA, 20 bp, human
ggggcgagcgctgacataag

SEQ ID NO: 288049 - DNA, 20 bp, human
ggctccggtctgaccaaccg

SEQ ID NO: 288050 - DNA, 20 bp, human
gtgcgctcggggttggtcgg

SEQ ID NO: 288051 - DNA, 20 bp, human
ggcaggggcggggtaaagct

SEQ ID NO: 288052 - DNA, 20 bp, human
gtggcctgaagacctggaat

SEQ ID NO: 288053 - DNA, 20 bp, human
ggcagcaagtcgaggagtcg

SEQ ID NO: 288054 - DNA, 20 bp, human
gtgcgaacgcaaagcagtgt

SEQ ID NO: 288055 - DNA, 20 bp, human
gggtccgcggttggtcagac

SEQ ID NO: 288056 - DNA, 20 bp, human
gaatctggagaaatggtcag

SEQ ID NO: 288057 - DNA, 20 bp, human
ggcccctggcatctgatcag

SEQ ID NO: 288058 - DNA, 20 bp, human
gtccctctgatcagatgcca

SEQ ID NO: 288059 - DNA, 20 bp, human
gaggtgctgacatgagaatc

SEQ ID NO: 288060 - DNA, 20 bp, human
gagggcattaagagctggag

SEQ ID NO: 288061 - DNA, 20 bp, human
gtcttgtgtctggcattttg

SEQ ID NO: 288062 - DNA, 20 bp, human
gaaatggtcagggggagtga

SEQ ID NO: 288063 - DNA, 20 bp, human
ggttcagtggaaattaactg

SEQ ID NO: 288064 - DNA, 20 bp, human
gaagtatgtatcctagcccc

SEQ ID NO: 288065 - DNA, 20 bp, human
ggaaaatggagatcactagc

SEQ ID NO: 288066 - DNA, 20 bp, human
gccgccgcgcactcctgcca

SEQ ID NO: 288067 - DNA, 20 bp, human
gtcgccgcccacctctccta

SEQ ID NO: 288068 - DNA, 20 bp, human
ggggtcgcgcgcgccacgtc

SEQ ID NO: 288069 - DNA, 20 bp, human
gcgacgggacccgaggagga

SEQ ID NO: 288070 - DNA, 20 bp, human
gcgcaggccgacgggacccg

SEQ ID NO: 288071 - DNA, 20 bp, human
gtcgcagtggaaggcgctgt

SEQ ID NO: 288072 - DNA, 20 bp, human
gcgggcgcgcgcaggccgac

SEQ ID NO: 288073 - DNA, 20 bp, human
gtggccgccccttggggctt

SEQ ID NO: 288074 - DNA, 20 bp, human
gaacgaggatgccggggaga

SEQ ID NO: 288075 - DNA, 20 bp, human
gtggaaggcgctgtgggttg

SEQ ID NO: 288076 - DNA, 20 bp, human
gcggactgggcgtgctcttc

SEQ ID NO: 288077 - DNA, 20 bp, human
gtgtaggcctggcaccgtag

SEQ ID NO: 288078 - DNA, 20 bp, human
gcctccgcgcagcccggact

SEQ ID NO: 288079 - DNA, 20 bp, human
ggagtgacgtcaccaggcgg

SEQ ID NO: 288080 - DNA, 20 bp, human
gagggcgcctccatccttgg

SEQ ID NO: 288081 - DNA, 20 bp, human
ggaagcgctggggtcccgga

SEQ ID NO: 288082 - DNA, 20 bp, human
gcgggagtgacgtcaccagg

SEQ ID NO: 288083 - DNA, 20 bp, human
gggtgccaggcctacaaaga

SEQ ID NO: 288084 - DNA, 20 bp, human
ggcgcgggagtgacgtcacc

SEQ ID NO: 288085 - DNA, 20 bp, human
gctgcgcggaggaagcgctg

SEQ ID NO: 288086 - DNA, 20 bp, human
gtcgcccggtcgagggtccc

SEQ ID NO: 288087 - DNA, 20 bp, human
gtgtcccgggaccctcgacc

SEQ ID NO: 288088 - DNA, 20 bp, human
gtcgaccgggcgactccccc

SEQ ID NO: 288089 - DNA, 20 bp, human
gccgccccgggggagtcgcc

SEQ ID NO: 288090 - DNA, 20 bp, human
gcccccgctgggatgattta

SEQ ID NO: 288091 - DNA, 20 bp, human
gcgggcgctcccctgtctgg

SEQ ID NO: 288092 - DNA, 20 bp, human
gtgaagaaatccccataccc

SEQ ID NO: 288093 - DNA, 20 bp, human
ggtggtctctagacaactga

SEQ ID NO: 288094 - DNA, 20 bp, human
gacaggggagcgcccgcagt

SEQ ID NO: 288095 - DNA, 20 bp, human
gtcagagcaggaagtgtttg

SEQ ID NO: 288096 - DNA, 20 bp, human
gagagcgagagacggaaatc

SEQ ID NO: 288097 - DNA, 20 bp, human
gggtcctattgcctaccctt

SEQ ID NO: 288098 - DNA, 20 bp, human
gggatgctctgagttcccaa

SEQ ID NO: 288099 - DNA, 20 bp, human
ggctctgagttcccaagggt

SEQ ID NO: 288100 - DNA, 20 bp, human
gccttggggttcctgggtgt

SEQ ID NO: 288101 - DNA, 20 bp, human
gccaacttctaggactggat

SEQ ID NO: 288102 - DNA, 20 bp, human
gtaaagagacagaggcaact

SEQ ID NO: 288103 - DNA, 20 bp, human
gcactggagcagggaagttc

SEQ ID NO: 288104 - DNA, 20 bp, human
gcccttctggtaatcttgat

SEQ ID NO: 288105 - DNA, 20 bp, human
gttctctgtggctcacactc

SEQ ID NO: 288106 - DNA, 20 bp, human
ggtagggccgcatcccgctc

SEQ ID NO: 288107 - DNA, 20 bp, human
gaacaggcgagggttcccgg

SEQ ID NO: 288108 - DNA, 20 bp, human
ggccgccgtccgagagacga

SEQ ID NO: 288109 - DNA, 20 bp, human
gttgacccgcgaacaggcga

SEQ ID NO: 288110 - DNA, 20 bp, human
ggaagccggcgagaagtgtg

SEQ ID NO: 288111 - DNA, 20 bp, human
gagacgagggggcgtgtagg

SEQ ID NO: 288112 - DNA, 20 bp, human
gagaagtgtgaggccgcggt

SEQ ID NO: 288113 - DNA, 20 bp, human
ggcggactcagacttctctc

SEQ ID NO: 288114 - DNA, 20 bp, human
gcccctcgtctctcggacgg

SEQ ID NO: 288115 - DNA, 20 bp, human
gagcacgccggccactttgc

SEQ ID NO: 288116 - DNA, 20 bp, human
gcgcggagggggccaggtac

SEQ ID NO: 288117 - DNA, 20 bp, human
gtgcgcgcggggcagccggt

SEQ ID NO: 288118 - DNA, 20 bp, human
gcccccagccggctcagacc

SEQ ID NO: 288119 - DNA, 20 bp, human
ggcagctggtggcaacgcaa

SEQ ID NO: 288120 - DNA, 20 bp, human
gcgcccgcgggccccgtacc

SEQ ID NO: 288121 - DNA, 20 bp, human
gaaagctgggaagagctccg

SEQ ID NO: 288122 - DNA, 20 bp, human
ggatgcgagtgcccacccga

SEQ ID NO: 288123 - DNA, 20 bp, human
gggacccgcgcgtaacccgt

SEQ ID NO: 288124 - DNA, 20 bp, human
ggcgaaagcctggtctgagc

SEQ ID NO: 288125 - DNA, 20 bp, human
gccggccgccgcatcccgtg

SEQ ID NO: 288126 - DNA, 20 bp, human
gccccctcgtcccttaggga

SEQ ID NO: 288127 - DNA, 20 bp, human
gcctactagaccatccctaa

SEQ ID NO: 288128 - DNA, 20 bp, human
gcctaagggacgagggggag

SEQ ID NO: 288129 - DNA, 20 bp, human
gctagtaggaaaagtcactc

SEQ ID NO: 288130 - DNA, 20 bp, human
ggaccatccctaagggacga

SEQ ID NO: 288131 - DNA, 20 bp, human
gagaacccagctaggaaccc

SEQ ID NO: 288132 - DNA, 20 bp, human
gccaagaagaaagattgggt

SEQ ID NO: 288133 - DNA, 20 bp, human
gaatggcaccacgtactttc

SEQ ID NO: 288134 - DNA, 20 bp, human
gtggtcgattcttaaggaac

SEQ ID NO: 288135 - DNA, 20 bp, human
gagtcaggcagaacccagct

SEQ ID NO: 288136 - DNA, 20 bp, human
gcggcgggggagatgtgctc

SEQ ID NO: 288137 - DNA, 20 bp, human
gacgcccgcgggcggagggc

SEQ ID NO: 288138 - DNA, 20 bp, human
gtgctcgggctccaccggat

SEQ ID NO: 288139 - DNA, 20 bp, human
gaggacaagtgctgccccgg

SEQ ID NO: 288140 - DNA, 20 bp, human
gcacacacgcacaggcgctc

SEQ ID NO: 288141 - DNA, 20 bp, human
gggctcgcgcagacgcccgc

SEQ ID NO: 288142 - DNA, 20 bp, human
ggcgctcggcaatcgattac

SEQ ID NO: 288143 - DNA, 20 bp, human
gccaccggatcggtttctcg

SEQ ID NO: 288144 - DNA, 20 bp, human
gcgagggagtgcgcgcgtcg

SEQ ID NO: 288145 - DNA, 20 bp, human
ggattgccgagcgcgccgag

SEQ ID NO: 288146 - DNA, 20 bp, human
gcgtcggcgcagactgaaaa

SEQ ID NO: 288147 - DNA, 20 bp, human
gccggtgcgcggggttacag

SEQ ID NO: 288148 - DNA, 20 bp, human
ggcaggagccggcgacctgc

SEQ ID NO: 288149 - DNA, 20 bp, human
gcggaacccgcggcactccg

SEQ ID NO: 288150 - DNA, 20 bp, human
gtggctggcggcggctttaa

SEQ ID NO: 288151 - DNA, 20 bp, human
gttacagcggcgctggctgg

SEQ ID NO: 288152 - DNA, 20 bp, human
gaaaagtgacatcacacgga

SEQ ID NO: 288153 - DNA, 20 bp, human
gcgggatccggcagccgcgt

SEQ ID NO: 288154 - DNA, 20 bp, human
ggggttacagcggcgctggc

SEQ ID NO: 288155 - DNA, 20 bp, human
gccaaggaaccccgacagga

SEQ ID NO: 288156 - DNA, 20 bp, human
ggagactgctgggggaaaat

SEQ ID NO: 288157 - DNA, 20 bp, human
ggggaccggaagttgttagg

SEQ ID NO: 288158 - DNA, 20 bp, human
gaaaatgggagaggagctag

SEQ ID NO: 288159 - DNA, 20 bp, human
gccgcctgtcgcctggtagt

SEQ ID NO: 288160 - DNA, 20 bp, human
gcttggggacgctcggtgtt

SEQ ID NO: 288161 - DNA, 20 bp, human
gcaccgagcgtccccaagcc

SEQ ID NO: 288162 - DNA, 20 bp, human
gtgtgcttagattgcaaact

SEQ ID NO: 288163 - DNA, 20 bp, human
gcaaactgggtgcagattaa

SEQ ID NO: 288164 - DNA, 20 bp, human
gggagggggacggctgtgat

SEQ ID NO: 288165 - DNA, 20 bp, human
gggtcccactaccaggcgac

SEQ ID NO: 288166 - DNA, 20 bp, human
ggctgcctgcgaaatgacgg

SEQ ID NO: 288167 - DNA, 20 bp, human
ggcagcggcacggtgagcag

SEQ ID NO: 288168 - DNA, 20 bp, human
gggaaccgccgtcatttcgc

SEQ ID NO: 288169 - DNA, 20 bp, human
gcttggatgtgcttggggag

SEQ ID NO: 288170 - DNA, 20 bp, human
gactcaacacacatacaccc

SEQ ID NO: 288171 - DNA, 20 bp, human
gtccaggaagcgtggattcc

SEQ ID NO: 288172 - DNA, 20 bp, human
ggctgctgcctgcgaaatga

SEQ ID NO: 288173 - DNA, 20 bp, human
gactcaccttccaggaagcg

SEQ ID NO: 288174 - DNA, 20 bp, human
gctcttgctggctgcagccg

SEQ ID NO: 288175 - DNA, 20 bp, human
gagcacgcttggatgtgctt

SEQ ID NO: 288176 - DNA, 20 bp, human
gagtgggcggggccttgctc

SEQ ID NO: 288177 - DNA, 20 bp, human
gctcgcgtgagcaggatgga

SEQ ID NO: 288178 - DNA, 20 bp, human
ggcagggggcagggattaag

SEQ ID NO: 288179 - DNA, 20 bp, human
gggcctgcggcgaggatgga

SEQ ID NO: 288180 - DNA, 20 bp, human
gcttgctcgggtaactccca

SEQ ID NO: 288181 - DNA, 20 bp, human
gactgtgacggtgacgaaga

SEQ ID NO: 288182 - DNA, 20 bp, human
gcgagacttgagcaaggcag

SEQ ID NO: 288183 - DNA, 20 bp, human
gaaccccaagagagacaaac

SEQ ID NO: 288184 - DNA, 20 bp, human
gacggtgacgaagacggcgg

SEQ ID NO: 288185 - DNA, 20 bp, human
gatggcggcggcgactgtga

SEQ ID NO: 288186 - DNA, 20 bp, human
ggaatgagaacccacagctg

SEQ ID NO: 288187 - DNA, 20 bp, human
ggcccattccagaatacaat

SEQ ID NO: 288188 - DNA, 20 bp, human
gaattgggtccccccaacct

SEQ ID NO: 288189 - DNA, 20 bp, human
gcagaacagctgttctcccc

SEQ ID NO: 288190 - DNA, 20 bp, human
gtgccgggaaaccttgattg

SEQ ID NO: 288191 - DNA, 20 bp, human
gttagagaggttagagaagg

SEQ ID NO: 288192 - DNA, 20 bp, human
gtgagcttacaatataaaag

SEQ ID NO: 288193 - DNA, 20 bp, human
ggcagaaaaaatcctgtgcc

SEQ ID NO: 288194 - DNA, 20 bp, human
gttcctaggtcacagtgacg

SEQ ID NO: 288195 - DNA, 20 bp, human
gtgggtattcatcccaggtt

SEQ ID NO: 288196 - DNA, 20 bp, human
gggagtgtgcagcatgatta

SEQ ID NO: 288197 - DNA, 20 bp, human
ggactttaaggtgagagcag

SEQ ID NO: 288198 - DNA, 20 bp, human
ggtgcagcatgattaaggga

SEQ ID NO: 288199 - DNA, 20 bp, human
gtaaggtgagagcaggggcg

SEQ ID NO: 288200 - DNA, 20 bp, human
gctggacaacttgttgttaa

SEQ ID NO: 288201 - DNA, 20 bp, human
gggccccgaagggttgacat

SEQ ID NO: 288202 - DNA, 20 bp, human
ggggggctcaaggccccgaa

SEQ ID NO: 288203 - DNA, 20 bp, human
gttaaaggagtccttgctgg

SEQ ID NO: 288204 - DNA, 20 bp, human
gcaaaaggagaatgaacttg

SEQ ID NO: 288205 - DNA, 20 bp, human
ggagctacattcggctttaa

SEQ ID NO: 288206 - DNA, 20 bp, human
gtccccgtccgcggcctcgg

SEQ ID NO: 288207 - DNA, 20 bp, human
gtcccacagggctaccgcct

SEQ ID NO: 288208 - DNA, 20 bp, human
gtaccgcctggggcaacccg

SEQ ID NO: 288209 - DNA, 20 bp, human
gtagcgccccaggacagcct

SEQ ID NO: 288210 - DNA, 20 bp, human
gggcaacccgaggctgtcct

SEQ ID NO: 288211 - DNA, 20 bp, human
ggctccgccagcgccccgca

SEQ ID NO: 288212 - DNA, 20 bp, human
gcccgcagggctgacgtcag

SEQ ID NO: 288213 - DNA, 20 bp, human
ggctgtcctggggcgctagc

SEQ ID NO: 288214 - DNA, 20 bp, human
gcccgctgacgtcagccctg

SEQ ID NO: 288215 - DNA, 20 bp, human
gctggggcgctagcgggctc

SEQ ID NO: 288216 - DNA, 20 bp, human
ggcgcctcgcgggtggaccc

SEQ ID NO: 288217 - DNA, 20 bp, human
gcagcccgggtccacccgcg

SEQ ID NO: 288218 - DNA, 20 bp, human
gtccgggaaccagcggagat

SEQ ID NO: 288219 - DNA, 20 bp, human
gggcttggcagatgcacacg

SEQ ID NO: 288220 - DNA, 20 bp, human
ggcagatgcacacgaggaag

SEQ ID NO: 288221 - DNA, 20 bp, human
ggatcctcgcaagctttgaa

SEQ ID NO: 288222 - DNA, 20 bp, human
ggtgctccggacaaaacctg

SEQ ID NO: 288223 - DNA, 20 bp, human
ggggtgggagcccggtcgcc

SEQ ID NO: 288224 - DNA, 20 bp, human
gctgcatgctggaatgacgg

SEQ ID NO: 288225 - DNA, 20 bp, human
ggagagcggacttcaagaga

SEQ ID NO: 288226 - DNA, 20 bp, human
gtgtctgctccggcccgtgg

SEQ ID NO: 288227 - DNA, 20 bp, human
gcgggccggagcagacactc

SEQ ID NO: 288228 - DNA, 20 bp, human
ggctcggaggagggcacgga

SEQ ID NO: 288229 - DNA, 20 bp, human
gtgagcctgagtgtctgctc

SEQ ID NO: 288230 - DNA, 20 bp, human
gacggagcggctgccttgca

SEQ ID NO: 288231 - DNA, 20 bp, human
ggaggggctggtgaggtcat

SEQ ID NO: 288232 - DNA, 20 bp, human
gcgcctggggggttatatag

SEQ ID NO: 288233 - DNA, 20 bp, human
gtccggcccgtggaggtgga

SEQ ID NO: 288234 - DNA, 20 bp, human
gagggagtgtggacgcctgg

SEQ ID NO: 288235 - DNA, 20 bp, human
ggctcccccggcagcggaca

SEQ ID NO: 288236 - DNA, 20 bp, human
gccgcccaggcgccaatgga

SEQ ID NO: 288237 - DNA, 20 bp, human
gggcagttggagtctccaat

SEQ ID NO: 288238 - DNA, 20 bp, human
ggtcccgtcccggactgaag

SEQ ID NO: 288239 - DNA, 20 bp, human
ggaagtgtccggcggaggtg

SEQ ID NO: 288240 - DNA, 20 bp, human
gagcctcttcagtccgggac

SEQ ID NO: 288241 - DNA, 20 bp, human
gccaagcagcctcttcagtc

SEQ ID NO: 288242 - DNA, 20 bp, human
ggacacttcctgtcccgtcc

SEQ ID NO: 288243 - DNA, 20 bp, human
ggacaggaagtgtccggcgg

SEQ ID NO: 288244 - DNA, 20 bp, human
gccagggtggataggccttc

SEQ ID NO: 288245 - DNA, 20 bp, human
gaggagaggagtgaaatagg

SEQ ID NO: 288246 - DNA, 20 bp, human
gaagaggcctcccccaagtc

SEQ ID NO: 288247 - DNA, 20 bp, human
gacagccaaggccagcaaga

SEQ ID NO: 288248 - DNA, 20 bp, human
gggaaggaggggatggctct

SEQ ID NO: 288249 - DNA, 20 bp, human
gtggcttcctttccagactt

SEQ ID NO: 288250 - DNA, 20 bp, human
gcagagctccagggcttaga

SEQ ID NO: 288251 - DNA, 20 bp, human
gggggcccaaagaatggagg

SEQ ID NO: 288252 - DNA, 20 bp, human
gcttcccttcccagggcctt

SEQ ID NO: 288253 - DNA, 20 bp, human
gagggcatctctcactgaca

SEQ ID NO: 288254 - DNA, 20 bp, human
ggagggggcctggctagggg

SEQ ID NO: 288255 - DNA, 20 bp, human
ggctggggcccaaagaatgg

SEQ ID NO: 288256 - DNA, 20 bp, human
ggcaggacatgcaaagtggg

SEQ ID NO: 288257 - DNA, 20 bp, human
gcccctgccgacgtagagag

SEQ ID NO: 288258 - DNA, 20 bp, human
ggcgctgcacagctgcgggg

SEQ ID NO: 288259 - DNA, 20 bp, human
gggcactcctctctctacgt

SEQ ID NO: 288260 - DNA, 20 bp, human
ggggcggggtagcttagaca

SEQ ID NO: 288261 - DNA, 20 bp, human
gtacgcaggacatgcaaagt

SEQ ID NO: 288262 - DNA, 20 bp, human
gagggggcgctgcacagctg

SEQ ID NO: 288263 - DNA, 20 bp, human
gctccagcctagtactggaa

SEQ ID NO: 288264 - DNA, 20 bp, human
gacgacctccagcctagtac

SEQ ID NO: 288265 - DNA, 20 bp, human
gtaggctggaggtcgtggtt

SEQ ID NO: 288266 - DNA, 20 bp, human
gtgtgtatcaataacgagga

SEQ ID NO: 288267 - DNA, 20 bp, human
ggggaggctgagttcatgtc

SEQ ID NO: 288268 - DNA, 20 bp, human
gtgtgtgtgtatcaataacg

SEQ ID NO: 288269 - DNA, 20 bp, human
gcaaggggcggtcagacggg

SEQ ID NO: 288270 - DNA, 20 bp, human
gccctgggttccacagatcg

SEQ ID NO: 288271 - DNA, 20 bp, human
gtcccaggtaatgaactaag

SEQ ID NO: 288272 - DNA, 20 bp, human
gggttcttcccaagtcagag

SEQ ID NO: 288273 - DNA, 20 bp, human
gcagcactaggcagattccc

SEQ ID NO: 288274 - DNA, 20 bp, human
gaggaaatgacttttgggtg

SEQ ID NO: 288275 - DNA, 20 bp, human
gtcctcttagttcattacct

SEQ ID NO: 288276 - DNA, 20 bp, human
gaccacggagctgacttcct

SEQ ID NO: 288277 - DNA, 20 bp, human
gggagcaagtcagggttcta

SEQ ID NO: 288278 - DNA, 20 bp, human
ggaagtcagctccgtggtgg

SEQ ID NO: 288279 - DNA, 20 bp, human
gggaaccacaggtggcccat

SEQ ID NO: 288280 - DNA, 20 bp, human
ggcatctgggtgttcagttc

SEQ ID NO: 288281 - DNA, 20 bp, human
gtgggcccatgggccacctg

SEQ ID NO: 288282 - DNA, 20 bp, human
gtgggtgttcagttcaggtc

SEQ ID NO: 288283 - DNA, 20 bp, human
gggtggcccatgggcccatg

SEQ ID NO: 288284 - DNA, 20 bp, human
ggtgtcacagcccatcccta

SEQ ID NO: 288285 - DNA, 20 bp, human
gtttgacttgccttagggat

SEQ ID NO: 288286 - DNA, 20 bp, human
gggtcgaagcgggctcgggt

SEQ ID NO: 288287 - DNA, 20 bp, human
gagtgaggatcgggccgggg

SEQ ID NO: 288288 - DNA, 20 bp, human
gcccgcttcgacccgcgggg

SEQ ID NO: 288289 - DNA, 20 bp, human
gctggcggcgagtgaggatc

SEQ ID NO: 288290 - DNA, 20 bp, human
gacccgcggggtggaaacca

SEQ ID NO: 288291 - DNA, 20 bp, human
gccgagcccgcttcgacccg

SEQ ID NO: 288292 - DNA, 20 bp, human
gaccgggaacgcccgagcgc

SEQ ID NO: 288293 - DNA, 20 bp, human
ggcctctgcgccaccaactc

SEQ ID NO: 288294 - DNA, 20 bp, human
ggcgagtgaggatcgggccg

SEQ ID NO: 288295 - DNA, 20 bp, human
gaccaactccggggtgggcg

SEQ ID NO: 288296 - DNA, 20 bp, human
gaggacaggagctcagagtt

SEQ ID NO: 288297 - DNA, 20 bp, human
ggtgtcaggcgtcaccactt

SEQ ID NO: 288298 - DNA, 20 bp, human
gtgggtgggtttaattccag

SEQ ID NO: 288299 - DNA, 20 bp, human
gcacttctggtgacccaaaa

SEQ ID NO: 288300 - DNA, 20 bp, human
gtcagctgtccaggtactca

SEQ ID NO: 288301 - DNA, 20 bp, human
gttgtcacaggcaaaactgc

SEQ ID NO: 288302 - DNA, 20 bp, human
gcaaatgccacgccgctctc

SEQ ID NO: 288303 - DNA, 20 bp, human
gggcagagtttccaagatct

SEQ ID NO: 288304 - DNA, 20 bp, human
gctcatggacttattgagaa

SEQ ID NO: 288305 - DNA, 20 bp, human
gtcccatagctggtagactg

SEQ ID NO: 288306 - DNA, 20 bp, human
ggcggccgggccctcctccg

SEQ ID NO: 288307 - DNA, 20 bp, human
gcctccggcggtggccggtc

SEQ ID NO: 288308 - DNA, 20 bp, human
gcgccggtgcgcaccggcga

SEQ ID NO: 288309 - DNA, 20 bp, human
gaagctgcggaggctggcga

SEQ ID NO: 288310 - DNA, 20 bp, human
gatggcccgcggagataggg

SEQ ID NO: 288311 - DNA, 20 bp, human
ggcgatggcccgcggagata

SEQ ID NO: 288312 - DNA, 20 bp, human
gcgcgcagatcccgcttatc

SEQ ID NO: 288313 - DNA, 20 bp, human
ggggagatgggcccgataag

SEQ ID NO: 288314 - DNA, 20 bp, human
gcaagggccggctggacacc

SEQ ID NO: 288315 - DNA, 20 bp, human
gggggggtggccttatgtaa

SEQ ID NO: 288316 - DNA, 20 bp, human
ggcggctctggcggctccta

SEQ ID NO: 288317 - DNA, 20 bp, human
gcccaggcagcgcccggagt

SEQ ID NO: 288318 - DNA, 20 bp, human
ggggccggcgcagacgggaa

SEQ ID NO: 288319 - DNA, 20 bp, human
gtaacctgagccggcgagag

SEQ ID NO: 288320 - DNA, 20 bp, human
gctcctccggccgctctcgc

SEQ ID NO: 288321 - DNA, 20 bp, human
ggcggctcctacggctccca

SEQ ID NO: 288322 - DNA, 20 bp, human
gggacgcgggagctgcgggt

SEQ ID NO: 288323 - DNA, 20 bp, human
ggtccagccttgggagccgt

SEQ ID NO: 288324 - DNA, 20 bp, human
gcacacttgcggggcctcgg

SEQ ID NO: 288325 - DNA, 20 bp, human
gcccggagtgggcggcgacg

SEQ ID NO: 288326 - DNA, 20 bp, human
gtatgtgttgctaggggaga

SEQ ID NO: 288327 - DNA, 20 bp, human
gctcacgagagtgttcttac

SEQ ID NO: 288328 - DNA, 20 bp, human
gctaggggagacggttgcta

SEQ ID NO: 288329 - DNA, 20 bp, human
gctaacggtcttccggatga

SEQ ID NO: 288330 - DNA, 20 bp, human
gtgttcttactggttcacaa

SEQ ID NO: 288331 - DNA, 20 bp, human
gaacactctcgtgagtctaa

SEQ ID NO: 288332 - DNA, 20 bp, human
gcgtgagtctaacggtcttc

SEQ ID NO: 288333 - DNA, 20 bp, human
gctctctgaggcttcggttt

SEQ ID NO: 288334 - DNA, 20 bp, human
gtttgaaagttatttcggcc

SEQ ID NO: 288335 - DNA, 20 bp, human
ggtgttttatgtgttgctag

SEQ ID NO: 288336 - DNA, 20 bp, human
gctgtgggacccagcagaat

SEQ ID NO: 288337 - DNA, 20 bp, human
gaatcctgagtcatgcctgt

SEQ ID NO: 288338 - DNA, 20 bp, human
gttaaacactggggttccag

SEQ ID NO: 288339 - DNA, 20 bp, human
gtgctgtgtaatcttgggtg

SEQ ID NO: 288340 - DNA, 20 bp, human
gacatggtgttgattcagct

SEQ ID NO: 288341 - DNA, 20 bp, human
gaaaggaagatttaaacact

SEQ ID NO: 288342 - DNA, 20 bp, human
ggaacacactggttactact

SEQ ID NO: 288343 - DNA, 20 bp, human
gttaaggactaagggcaatc

SEQ ID NO: 288344 - DNA, 20 bp, human
gtgtaagtactaggtagatt

SEQ ID NO: 288345 - DNA, 20 bp, human
gttagtgggcagccattggc

SEQ ID NO: 288346 - DNA, 20 bp, human
gccccggcagggacggaaac

SEQ ID NO: 288347 - DNA, 20 bp, human
gcgggaagcagtgacacctg

SEQ ID NO: 288348 - DNA, 20 bp, human
gaacacctcccgcggagact

SEQ ID NO: 288349 - DNA, 20 bp, human
ggccccacccccagtctccg

SEQ ID NO: 288350 - DNA, 20 bp, human
gcgaagacaaacacctcccg

SEQ ID NO: 288351 - DNA, 20 bp, human
gggcaagcgcaaggacatcg

SEQ ID NO: 288352 - DNA, 20 bp, human
gtcccgcggagactgggggt

SEQ ID NO: 288353 - DNA, 20 bp, human
ggtgcccgtcgcttgggatg

SEQ ID NO: 288354 - DNA, 20 bp, human
ggagaaagagccgggagcat

SEQ ID NO: 288355 - DNA, 20 bp, human
ggggtctccaggttcagctg

SEQ ID NO: 288356 - DNA, 20 bp, human
gcccatgcgtcccggggaca

SEQ ID NO: 288357 - DNA, 20 bp, human
ggggcacggcccatgcgtcc

SEQ ID NO: 288358 - DNA, 20 bp, human
gggctcggagaggtgcaaag

SEQ ID NO: 288359 - DNA, 20 bp, human
gtggctgtgcggtgccgcgg

SEQ ID NO: 288360 - DNA, 20 bp, human
ggggtggctgtgcggtgccg

SEQ ID NO: 288361 - DNA, 20 bp, human
gcacctctccgagccctcgg

SEQ ID NO: 288362 - DNA, 20 bp, human
gagagagtgggcaaagtcat

SEQ ID NO: 288363 - DNA, 20 bp, human
ggaggctcccgggcttgcgt

SEQ ID NO: 288364 - DNA, 20 bp, human
gcttgcgtgggtaaggtcct

SEQ ID NO: 288365 - DNA, 20 bp, human
ggggacctccagtgtgcact

SEQ ID NO: 288366 - DNA, 20 bp, human
ggaagggccagtgatcttaa

SEQ ID NO: 288367 - DNA, 20 bp, human
ggacgggtggccactggaca

SEQ ID NO: 288368 - DNA, 20 bp, human
gggggctcagttaacccaag

SEQ ID NO: 288369 - DNA, 20 bp, human
ggagtgggtgttaaccgctt

SEQ ID NO: 288370 - DNA, 20 bp, human
gcacgggcaccaagaacccg

SEQ ID NO: 288371 - DNA, 20 bp, human
gcactccactcccagtgtca

SEQ ID NO: 288372 - DNA, 20 bp, human
gcccgtgaagcaggacagat

SEQ ID NO: 288373 - DNA, 20 bp, human
ggggttaactgagccccatt

SEQ ID NO: 288374 - DNA, 20 bp, human
gctggcccttggctgacggg

SEQ ID NO: 288375 - DNA, 20 bp, human
gcctctagggactcatgaag

SEQ ID NO: 288376 - DNA, 20 bp, human
ggggctggccggcaacaccc

SEQ ID NO: 288377 - DNA, 20 bp, human
gctggccggcaacacccagg

SEQ ID NO: 288378 - DNA, 20 bp, human
gaaaggtagcagacatgact

SEQ ID NO: 288379 - DNA, 20 bp, human
gttcacgtggagcagtcaga

SEQ ID NO: 288380 - DNA, 20 bp, human
gaagctcctagcagcgtgcc

SEQ ID NO: 288381 - DNA, 20 bp, human
gcagtcagatggctcagatc

SEQ ID NO: 288382 - DNA, 20 bp, human
gaaagaaggcaggggcaact

SEQ ID NO: 288383 - DNA, 20 bp, human
gaggcttgatccaaaaaggg

SEQ ID NO: 288384 - DNA, 20 bp, human
gtgccggccagcccagcaga

SEQ ID NO: 288385 - DNA, 20 bp, human
gaacaaggtccaccatctgc

SEQ ID NO: 288386 - DNA, 20 bp, human
gaaaagaggacatggtcttt

SEQ ID NO: 288387 - DNA, 20 bp, human
ggcgtgtcgcagtgggttca

SEQ ID NO: 288388 - DNA, 20 bp, human
gagcagagctgctatgctat

SEQ ID NO: 288389 - DNA, 20 bp, human
gttctgaaggaaaatgggaa

SEQ ID NO: 288390 - DNA, 20 bp, human
ggaagaatctctccttctga

SEQ ID NO: 288391 - DNA, 20 bp, human
ggattcttctatgacctcat

SEQ ID NO: 288392 - DNA, 20 bp, human
gtcttctatgacctcattgg

SEQ ID NO: 288393 - DNA, 20 bp, human
gtaagaatgaaaagaggaca

SEQ ID NO: 288394 - DNA, 20 bp, human
gcctggccaaggaatctgtg

SEQ ID NO: 288395 - DNA, 20 bp, human
gttcaggggtgacaccattt

SEQ ID NO: 288396 - DNA, 20 bp, human
gcccaggggctgttgaccga

SEQ ID NO: 288397 - DNA, 20 bp, human
gagccgagctgaggtgccca

SEQ ID NO: 288398 - DNA, 20 bp, human
gcacacagggcattgtccct

SEQ ID NO: 288399 - DNA, 20 bp, human
gggacaatgccctgtgtgtc

SEQ ID NO: 288400 - DNA, 20 bp, human
gtccctcggtcaacagcccc

SEQ ID NO: 288401 - DNA, 20 bp, human
gagcctagcgcagtggcagg

SEQ ID NO: 288402 - DNA, 20 bp, human
gggcacctcagctcggctcc

SEQ ID NO: 288403 - DNA, 20 bp, human
ggccggccgcaggccacagg

SEQ ID NO: 288404 - DNA, 20 bp, human
gtgctctcctgaccaaccaa

SEQ ID NO: 288405 - DNA, 20 bp, human
gggagggatgggccgttggt

SEQ ID NO: 288406 - DNA, 20 bp, human
gtgggcggagtctctctcgg

SEQ ID NO: 288407 - DNA, 20 bp, human
gtgtaggtgctcaggttggg

SEQ ID NO: 288408 - DNA, 20 bp, human
gtcctgatgcacagcaggcg

SEQ ID NO: 288409 - DNA, 20 bp, human
ggcaccctgtgtaggtgctc

SEQ ID NO: 288410 - DNA, 20 bp, human
gtaacaggacagcgcctccc

SEQ ID NO: 288411 - DNA, 20 bp, human
gcccccgcctgctgtgcatc

SEQ ID NO: 288412 - DNA, 20 bp, human
gacaaggcagcaccctgtgt

SEQ ID NO: 288413 - DNA, 20 bp, human
ggagtctctctcgggggagg

SEQ ID NO: 288414 - DNA, 20 bp, human
gctgtgtaggtgctcaggtt

SEQ ID NO: 288415 - DNA, 20 bp, human
gctcgggggaggggggtaac

SEQ ID NO: 288416 - DNA, 20 bp, human
gtgacgaggcgcaggggcaa

SEQ ID NO: 288417 - DNA, 20 bp, human
gccagcccgcgcagggtccg

SEQ ID NO: 288418 - DNA, 20 bp, human
gaccctgcgcgggctggctg

SEQ ID NO: 288419 - DNA, 20 bp, human
ggggcaagggtgggtctgcg

SEQ ID NO: 288420 - DNA, 20 bp, human
gcaagggtgggtctgcgagg

SEQ ID NO: 288421 - DNA, 20 bp, human
gcctgctccgccgccagcga

SEQ ID NO: 288422 - DNA, 20 bp, human
ggggtgggtctgcgaggcgg

SEQ ID NO: 288423 - DNA, 20 bp, human
gggcggatgacgaggcgcag

SEQ ID NO: 288424 - DNA, 20 bp, human
gaatctgaaagcgctttcgg

SEQ ID NO: 288425 - DNA, 20 bp, human
gggggcttctcgcggaaaag

SEQ ID NO: 288426 - DNA, 20 bp, human
ggcagctgatggcaaacaac

SEQ ID NO: 288427 - DNA, 20 bp, human
gcatgaaattcacacccact

SEQ ID NO: 288428 - DNA, 20 bp, human
gagccctggtatagaccagt

SEQ ID NO: 288429 - DNA, 20 bp, human
gaatggctagctagccttta

SEQ ID NO: 288430 - DNA, 20 bp, human
gatcagtgttgccaatggga

SEQ ID NO: 288431 - DNA, 20 bp, human
gttcatgaccataccggccc

SEQ ID NO: 288432 - DNA, 20 bp, human
gttgctctagagtggagcgg

SEQ ID NO: 288433 - DNA, 20 bp, human
gagaccaactggtctatacc

SEQ ID NO: 288434 - DNA, 20 bp, human
gaagcaatcagtgttgccaa

SEQ ID NO: 288435 - DNA, 20 bp, human
gggcaacactgattgcttac

SEQ ID NO: 288436 - DNA, 20 bp, human
gtcccgaaggggaacaaaag

SEQ ID NO: 288437 - DNA, 20 bp, human
gaagggggaccctaaagaaa

SEQ ID NO: 288438 - DNA, 20 bp, human
gggcaatgggggtggaagta

SEQ ID NO: 288439 - DNA, 20 bp, human
ggctctgatttgtgggcaat

SEQ ID NO: 288440 - DNA, 20 bp, human
gtggtccgtgacaagggtgt

SEQ ID NO: 288441 - DNA, 20 bp, human
gacgattcatattgcgtgac

SEQ ID NO: 288442 - DNA, 20 bp, human
gtaagcaggtcaatcgaaac

SEQ ID NO: 288443 - DNA, 20 bp, human
gctgcattcgtcagtaactc

SEQ ID NO: 288444 - DNA, 20 bp, human
gcaagggtgttggcaatttg

SEQ ID NO: 288445 - DNA, 20 bp, human
gttgacaacaatttctaact

SEQ ID NO: 288446 - DNA, 20 bp, human
gacgccggaaggactgggta

SEQ ID NO: 288447 - DNA, 20 bp, human
ggcccggaggactgagcgta

SEQ ID NO: 288448 - DNA, 20 bp, human
gggggcgcaaggaggaacgg

SEQ ID NO: 288449 - DNA, 20 bp, human
ggccctacgctcagtcctcc

SEQ ID NO: 288450 - DNA, 20 bp, human
gtgagcgtagggccgagagg

SEQ ID NO: 288451 - DNA, 20 bp, human
gaggactgggtagggacgcc

SEQ ID NO: 288452 - DNA, 20 bp, human
gtccttccggcgtccctccc

SEQ ID NO: 288453 - DNA, 20 bp, human
ggccggggagggacgccgga

SEQ ID NO: 288454 - DNA, 20 bp, human
gaggggtttagggtgagaca

SEQ ID NO: 288455 - DNA, 20 bp, human
gactgggtagggacgcccgg

SEQ ID NO: 288456 - DNA, 20 bp, human
gtgctggggctcggagggat

SEQ ID NO: 288457 - DNA, 20 bp, human
ggcagcgccctcgcctgctg

SEQ ID NO: 288458 - DNA, 20 bp, human
gtcgcctgctggggctcgga

SEQ ID NO: 288459 - DNA, 20 bp, human
gggcccgccctctgttcggg

SEQ ID NO: 288460 - DNA, 20 bp, human
ggggtcggcgctgcgagagg

SEQ ID NO: 288461 - DNA, 20 bp, human
gctccgccagcgctcggaca

SEQ ID NO: 288462 - DNA, 20 bp, human
gccgccacccgaacagaggg

SEQ ID NO: 288463 - DNA, 20 bp, human
gggaggcgcgcgaagcccga

SEQ ID NO: 288464 - DNA, 20 bp, human
gagcgggcccgccctctgtt

SEQ ID NO: 288465 - DNA, 20 bp, human
gcgctctctgcgtccggaat

SEQ ID NO: 288466 - DNA, 20 bp, human
gccagccaggtgtcagcaga

SEQ ID NO: 288467 - DNA, 20 bp, human
gagccagcagccttggacta

SEQ ID NO: 288468 - DNA, 20 bp, human
gcacccccggagccctaagg

SEQ ID NO: 288469 - DNA, 20 bp, human
gcattcgctgtcttcttcag

SEQ ID NO: 288470 - DNA, 20 bp, human
gaatgcatcacggctgagta

SEQ ID NO: 288471 - DNA, 20 bp, human
gcagcagccttggactaggg

SEQ ID NO: 288472 - DNA, 20 bp, human
gtagtaaggggagacttagt

SEQ ID NO: 288473 - DNA, 20 bp, human
ggaagacagcgaatgcatca

SEQ ID NO: 288474 - DNA, 20 bp, human
gactcacccccggagcccta

SEQ ID NO: 288475 - DNA, 20 bp, human
ggaccgagtgtgcctagtaa

SEQ ID NO: 288476 - DNA, 20 bp, human
gagtctcagtgggggcttgg

SEQ ID NO: 288477 - DNA, 20 bp, human
ggggccacaactggagggcc

SEQ ID NO: 288478 - DNA, 20 bp, human
ggcggctgccagagtctcag

SEQ ID NO: 288479 - DNA, 20 bp, human
gcagcctggccctccagttg

SEQ ID NO: 288480 - DNA, 20 bp, human
gcagcgaaggggaccgcact

SEQ ID NO: 288481 - DNA, 20 bp, human
gggccagcacacgaggactg

SEQ ID NO: 288482 - DNA, 20 bp, human
ggcacacgaggactgagggt

SEQ ID NO: 288483 - DNA, 20 bp, human
ggcttggggggcgtgaccag

SEQ ID NO: 288484 - DNA, 20 bp, human
ggtccccttcgctgccgccg

SEQ ID NO: 288485 - DNA, 20 bp, human
gccgctggccagccccgagt

SEQ ID NO: 288486 - DNA, 20 bp, human
gggggtgaagcgcatgtcta

SEQ ID NO: 288487 - DNA, 20 bp, human
ggggaagccagggtacatat

SEQ ID NO: 288488 - DNA, 20 bp, human
gtccagagtgtgctgatggg

SEQ ID NO: 288489 - DNA, 20 bp, human
ggctgtgggtgagaagtaac

SEQ ID NO: 288490 - DNA, 20 bp, human
gagtaggaggggctaagaaa

SEQ ID NO: 288491 - DNA, 20 bp, human
gcggctaattctctaagtga

SEQ ID NO: 288492 - DNA, 20 bp, human
gaggggctagcatcaggttg

SEQ ID NO: 288493 - DNA, 20 bp, human
gagccccttgtctttcaggt

SEQ ID NO: 288494 - DNA, 20 bp, human
ggccccccacctgaaagaca

SEQ ID NO: 288495 - DNA, 20 bp, human
gagttccagagtgtgctgat

SEQ ID NO: 288496 - DNA, 20 bp, human
gcggcggcagcctatcccgc

SEQ ID NO: 288497 - DNA, 20 bp, human
gaaccccattagggtgtcct

SEQ ID NO: 288498 - DNA, 20 bp, human
gtccccctcccggcaaaaca

SEQ ID NO: 288499 - DNA, 20 bp, human
gcctgtggggaaccccatta

SEQ ID NO: 288500 - DNA, 20 bp, human
gggtccgaggacaccctaat

SEQ ID NO: 288501 - DNA, 20 bp, human
gaggcggtggaaagtctccc

SEQ ID NO: 288502 - DNA, 20 bp, human
ggagccctgttttgccggga

SEQ ID NO: 288503 - DNA, 20 bp, human
gcctccctcaggcatgcatg

SEQ ID NO: 288504 - DNA, 20 bp, human
ggccggcgtgcacctccctc

SEQ ID NO: 288505 - DNA, 20 bp, human
gtgcaccagtggccgccctg

SEQ ID NO: 288506 - DNA, 20 bp, human
gagtcgaaataaagtggcag

SEQ ID NO: 288507 - DNA, 20 bp, human
gaatggaagtcgaaataaag

SEQ ID NO: 288508 - DNA, 20 bp, human
gaagaggtacaggttttgga

SEQ ID NO: 288509 - DNA, 20 bp, human
gactgctgtcggcactcctt

SEQ ID NO: 288510 - DNA, 20 bp, human
gaagctcaatatggtgtcaa

SEQ ID NO: 288511 - DNA, 20 bp, human
gcagaaagaggtacaggttt

SEQ ID NO: 288512 - DNA, 20 bp, human
gcggaataatcagtcctatt

SEQ ID NO: 288513 - DNA, 20 bp, human
gagatgcttctaatggacta

SEQ ID NO: 288514 - DNA, 20 bp, human
gacaccatattgagcttggg

SEQ ID NO: 288515 - DNA, 20 bp, human
gtgcttctaatggactaagg

SEQ ID NO: 288516 - DNA, 20 bp, human
gactggctcaacactggctc

SEQ ID NO: 288517 - DNA, 20 bp, human
ggcacttcccggggaagagg

SEQ ID NO: 288518 - DNA, 20 bp, human
ggtagtcccagactcctacc

SEQ ID NO: 288519 - DNA, 20 bp, human
gacaaatggcgctggggctg

SEQ ID NO: 288520 - DNA, 20 bp, human
ggatgggacaaatggcgctg

SEQ ID NO: 288521 - DNA, 20 bp, human
ggaagggcaggcacttcccg

SEQ ID NO: 288522 - DNA, 20 bp, human
ggggagatgtagccgacctt

SEQ ID NO: 288523 - DNA, 20 bp, human
gcaaccctaacaggagggaa

SEQ ID NO: 288524 - DNA, 20 bp, human
gtcacggccaacccaggaac

SEQ ID NO: 288525 - DNA, 20 bp, human
gagagccaaccctaacagga

SEQ ID NO: 288526 - DNA, 20 bp, human
gcggccgcccggctcttcag

SEQ ID NO: 288527 - DNA, 20 bp, human
gaggccgcggttcacagcag

SEQ ID NO: 288528 - DNA, 20 bp, human
gacagcagaggatgccagga

SEQ ID NO: 288529 - DNA, 20 bp, human
ggggatgccgaaggtgagag

SEQ ID NO: 288530 - DNA, 20 bp, human
ggacctgcggggccggaagg

SEQ ID NO: 288531 - DNA, 20 bp, human
gccgctcgcaagcaccctgc

SEQ ID NO: 288532 - DNA, 20 bp, human
gcatcctctgctgtgaaccg

SEQ ID NO: 288533 - DNA, 20 bp, human
gaaggatgggagttcactat

SEQ ID NO: 288534 - DNA, 20 bp, human
gaagagccgggcggccgctg

SEQ ID NO: 288535 - DNA, 20 bp, human
gggccagcggtcctccctcc

SEQ ID NO: 288536 - DNA, 20 bp, human
gctccctaacaccatgtagg

SEQ ID NO: 288537 - DNA, 20 bp, human
gagaaagtcactcatgaaga

SEQ ID NO: 288538 - DNA, 20 bp, human
gaacctccctaacaccatgt

SEQ ID NO: 288539 - DNA, 20 bp, human
ggtaactatctatagagata

SEQ ID NO: 288540 - DNA, 20 bp, human
ggagtgacctgccacctaca

SEQ ID NO: 288541 - DNA, 20 bp, human
gaactaccaactcgcgttaa

SEQ ID NO: 288542 - DNA, 20 bp, human
gtgttaacagtgtgatcatc

SEQ ID NO: 288543 - DNA, 20 bp, human
gcattaaagatctttcaaat

SEQ ID NO: 288544 - DNA, 20 bp, human
gctttcaaatagggagaatg

SEQ ID NO: 288545 - DNA, 20 bp, human
ggttcagcttatcagtaacc

SEQ ID NO: 288546 - DNA, 20 bp, human
gtcaagctcccaatatccct

SEQ ID NO: 288547 - DNA, 20 bp, human
gcatagagcctagggatatt

SEQ ID NO: 288548 - DNA, 20 bp, human
gcacacaggaagctttgaaa

SEQ ID NO: 288549 - DNA, 20 bp, human
gacacactgcatagagccta

SEQ ID NO: 288550 - DNA, 20 bp, human
ggtaagttataggcaagtga

SEQ ID NO: 288551 - DNA, 20 bp, human
gggcaagtgaaggccggttt

SEQ ID NO: 288552 - DNA, 20 bp, human
gagatctgggctgtgtccaa

SEQ ID NO: 288553 - DNA, 20 bp, human
gcctccagagaatcagatct

SEQ ID NO: 288554 - DNA, 20 bp, human
gaacaaagtgcatctcacac

SEQ ID NO: 288555 - DNA, 20 bp, human
gtgagatgcactttgttcac

SEQ ID NO: 288556 - DNA, 20 bp, human
gagaaagttaatcacaaaat

SEQ ID NO: 288557 - DNA, 20 bp, human
gtgagataaagtttgtggtt

SEQ ID NO: 288558 - DNA, 20 bp, human
ggttgaaagagtgagtaagc

SEQ ID NO: 288559 - DNA, 20 bp, human
gcttgatgagataaagtttg

SEQ ID NO: 288560 - DNA, 20 bp, human
ggtaagctggtttcctttac

SEQ ID NO: 288561 - DNA, 20 bp, human
gaactcaatttctcaactgt

SEQ ID NO: 288562 - DNA, 20 bp, human
gtatctagacttcaccaaga

SEQ ID NO: 288563 - DNA, 20 bp, human
gaatactagactcttgacgg

SEQ ID NO: 288564 - DNA, 20 bp, human
gtagaatactagactcttga

SEQ ID NO: 288565 - DNA, 20 bp, human
gaaactcattacaactattg

SEQ ID NO: 288566 - DNA, 20 bp, human
gggaaaaaacaatctcccca

SEQ ID NO: 288567 - DNA, 20 bp, human
gggcacctgcagagcctcat

SEQ ID NO: 288568 - DNA, 20 bp, human
gtgagagtgcttttgtgagt

SEQ ID NO: 288569 - DNA, 20 bp, human
ggttaccaagtgtaccctgc

SEQ ID NO: 288570 - DNA, 20 bp, human
ggctgggtggatccaccttg

SEQ ID NO: 288571 - DNA, 20 bp, human
gtcatagctgcctaaggcat

SEQ ID NO: 288572 - DNA, 20 bp, human
gaaagcagttagctagcacc

SEQ ID NO: 288573 - DNA, 20 bp, human
ggcctaaggcattggagaac

SEQ ID NO: 288574 - DNA, 20 bp, human
gtccagttctccaatgcctt

SEQ ID NO: 288575 - DNA, 20 bp, human
gaagttcaacaaaatgatgc

SEQ ID NO: 288576 - DNA, 20 bp, human
gtacaagtgcgtcgtcaaaa

SEQ ID NO: 288577 - DNA, 20 bp, human
gaggcgaagaagactgactc

SEQ ID NO: 288578 - DNA, 20 bp, human
gtacttaagacaattacaaa

SEQ ID NO: 288579 - DNA, 20 bp, human
gttaagctgccagccagaga

SEQ ID NO: 288580 - DNA, 20 bp, human
gttaagtaggcgtggctacg

SEQ ID NO: 288581 - DNA, 20 bp, human
gaaatgactccctctctggc

SEQ ID NO: 288582 - DNA, 20 bp, human
gcaaggggctagatttggag

SEQ ID NO: 288583 - DNA, 20 bp, human
gtctggcaatacattaggtt

SEQ ID NO: 288584 - DNA, 20 bp, human
gagctcctggcaacttttga

SEQ ID NO: 288585 - DNA, 20 bp, human
gaacttatcaagtttctagg

SEQ ID NO: 288586 - DNA, 20 bp, human
gggtggaagcttcttagggg

SEQ ID NO: 288587 - DNA, 20 bp, human
gattggtggaagcttcttag

SEQ ID NO: 288588 - DNA, 20 bp, human
gggaaaggggaaaagagtat

SEQ ID NO: 288589 - DNA, 20 bp, human
gataaactgagataattctc

SEQ ID NO: 288590 - DNA, 20 bp, human
gcaactgcacaacgattgtc

SEQ ID NO: 288591 - DNA, 20 bp, human
gtttcaaaagcagaagtagg

SEQ ID NO: 288592 - DNA, 20 bp, human
ggagataattctctggttca

SEQ ID NO: 288593 - DNA, 20 bp, human
gaccctcaatacagacaggg

SEQ ID NO: 288594 - DNA, 20 bp, human
ggccctccctgtctgtattg

SEQ ID NO: 288595 - DNA, 20 bp, human
gcaatcaagttaaaggaaag

SEQ ID NO: 288596 - DNA, 20 bp, human
gccttggcagaaataaggta

SEQ ID NO: 288597 - DNA, 20 bp, human
ggaccccagcactgtttatc

SEQ ID NO: 288598 - DNA, 20 bp, human
gtaaagccttggcagaaata

SEQ ID NO: 288599 - DNA, 20 bp, human
ggggcatttcacaatgtctt

SEQ ID NO: 288600 - DNA, 20 bp, human
gcagccagataaacagtgct

SEQ ID NO: 288601 - DNA, 20 bp, human
gcatcctaggcttgaagagg

SEQ ID NO: 288602 - DNA, 20 bp, human
gtgctggggtcagacatctt

SEQ ID NO: 288603 - DNA, 20 bp, human
gctgacccacctgtaccaga

SEQ ID NO: 288604 - DNA, 20 bp, human
ggacagtcagtacagagcag

SEQ ID NO: 288605 - DNA, 20 bp, human
gtataccgtctggtacaggt

SEQ ID NO: 288606 - DNA, 20 bp, human
gctcggctgggccagtccgc

SEQ ID NO: 288607 - DNA, 20 bp, human
gggcggggaacgggcggaga

SEQ ID NO: 288608 - DNA, 20 bp, human
gggaacgggcggagacggct

SEQ ID NO: 288609 - DNA, 20 bp, human
gccagctcgctcgcagcccg

SEQ ID NO: 288610 - DNA, 20 bp, human
gggcagggcggtgtccgcag

SEQ ID NO: 288611 - DNA, 20 bp, human
gtctagccccgccgctgcgg

SEQ ID NO: 288612 - DNA, 20 bp, human
gctgccccgggtagcccgca

SEQ ID NO: 288613 - DNA, 20 bp, human
ggacccctgcgggctacccg

SEQ ID NO: 288614 - DNA, 20 bp, human
gtcgctcgcagcccgcggac

SEQ ID NO: 288615 - DNA, 20 bp, human
gtgcgggggcggggaacggg

SEQ ID NO: 288616 - DNA, 20 bp, human
gagtacatgatcacccagat

SEQ ID NO: 288617 - DNA, 20 bp, human
gacccccaggctgcagtgct

SEQ ID NO: 288618 - DNA, 20 bp, human
ggtcacccgctcacactggg

SEQ ID NO: 288619 - DNA, 20 bp, human
gtggtgtcacccgctcacac

SEQ ID NO: 288620 - DNA, 20 bp, human
gaaaaatagggaaacttatg

SEQ ID NO: 288621 - DNA, 20 bp, human
gcctgggggtgctccccgtg

SEQ ID NO: 288622 - DNA, 20 bp, human
ggtgagcgggtgacaccacc

SEQ ID NO: 288623 - DNA, 20 bp, human
gtagcgagtcacagaaaaat

SEQ ID NO: 288624 - DNA, 20 bp, human
gcagggatttataccctctt

SEQ ID NO: 288625 - DNA, 20 bp, human
gcacaccttttcctcctcac

SEQ ID NO: 288626 - DNA, 20 bp, human
gtccctagcaaggtggtctc

SEQ ID NO: 288627 - DNA, 20 bp, human
ggaggccacatgtagggcat

SEQ ID NO: 288628 - DNA, 20 bp, human
ggctagggaggccacatgta

SEQ ID NO: 288629 - DNA, 20 bp, human
gccctgagaccaccttgcta

SEQ ID NO: 288630 - DNA, 20 bp, human
gccccttggaaaccaggtgg

SEQ ID NO: 288631 - DNA, 20 bp, human
gcgtggtggctgactttcca

SEQ ID NO: 288632 - DNA, 20 bp, human
gagttggactgtcttcgtgg

SEQ ID NO: 288633 - DNA, 20 bp, human
ggcctccacctggtttccaa

SEQ ID NO: 288634 - DNA, 20 bp, human
ggcaccccttggaaaccagg

SEQ ID NO: 288635 - DNA, 20 bp, human
gggcagaagcaagcacccct

SEQ ID NO: 288636 - DNA, 20 bp, human
gaggctgcgctcggcccctt

SEQ ID NO: 288637 - DNA, 20 bp, human
gctcaagcccgcacaggcgg

SEQ ID NO: 288638 - DNA, 20 bp, human
gcgcggggcggcgtcctgga

SEQ ID NO: 288639 - DNA, 20 bp, human
ggccttggctcgcgatccac

SEQ ID NO: 288640 - DNA, 20 bp, human
ggccaatcgcgccgctccgg

SEQ ID NO: 288641 - DNA, 20 bp, human
gtcctggaagcccagagcgc

SEQ ID NO: 288642 - DNA, 20 bp, human
gggatcgcgagccaaggcgg

SEQ ID NO: 288643 - DNA, 20 bp, human
gggtcccgcccgccgccagg

SEQ ID NO: 288644 - DNA, 20 bp, human
gcagccttgcatccgtccgc

SEQ ID NO: 288645 - DNA, 20 bp, human
gccgcctgcggacggatgca

SEQ ID NO: 288646 - DNA, 20 bp, human
gtcaaaaaagagtcgggggg

SEQ ID NO: 288647 - DNA, 20 bp, human
ggcaaagcggtggctgtctg

SEQ ID NO: 288648 - DNA, 20 bp, human
gttccctgggatattttgag

SEQ ID NO: 288649 - DNA, 20 bp, human
gtcaggattagcatcattca

SEQ ID NO: 288650 - DNA, 20 bp, human
gatccactcaaaatatccca

SEQ ID NO: 288651 - DNA, 20 bp, human
gttgcttgtggttttcgctc

SEQ ID NO: 288652 - DNA, 20 bp, human
gtccagtgtttctacaagat

SEQ ID NO: 288653 - DNA, 20 bp, human
gggatattttgagtggattg

SEQ ID NO: 288654 - DNA, 20 bp, human
gttttcaaaaaagagtcggg

SEQ ID NO: 288655 - DNA, 20 bp, human
gtttgctgcaagtcataaag

SEQ ID NO: 288656 - DNA, 20 bp, human
gaggggaggcagattgagaa

SEQ ID NO: 288657 - DNA, 20 bp, human
gtaggccggcgtacaggatt

SEQ ID NO: 288658 - DNA, 20 bp, human
gcccgcgctcccaaatctaa

SEQ ID NO: 288659 - DNA, 20 bp, human
ggggacacgctttccttctc

SEQ ID NO: 288660 - DNA, 20 bp, human
gcctgtacgccggcctactc

SEQ ID NO: 288661 - DNA, 20 bp, human
gacgccggcctactctggta

SEQ ID NO: 288662 - DNA, 20 bp, human
gcgagcgctcaactgagtgc

SEQ ID NO: 288663 - DNA, 20 bp, human
gatctaaaggggtgtggaag

SEQ ID NO: 288664 - DNA, 20 bp, human
gctgactgattgcaccgggg

SEQ ID NO: 288665 - DNA, 20 bp, human
gtccacacccctttagattt

SEQ ID NO: 288666 - DNA, 20 bp, human
gaagttgattctaaaatagg

SEQ ID NO: 288667 - DNA, 20 bp, human
gtgaaagtgtcccaatatcg

SEQ ID NO: 288668 - DNA, 20 bp, human
gctactgggacttaaatcca

SEQ ID NO: 288669 - DNA, 20 bp, human
gctggcggagctttcctgag

SEQ ID NO: 288670 - DNA, 20 bp, human
gtggccacaaatcaaatttc

SEQ ID NO: 288671 - DNA, 20 bp, human
gcttgacatcggggacctgg

SEQ ID NO: 288672 - DNA, 20 bp, human
gaatcaaatttcaggatggg

SEQ ID NO: 288673 - DNA, 20 bp, human
gattgcctgtaccccgatat

SEQ ID NO: 288674 - DNA, 20 bp, human
gttcaattatttcctctcaa

SEQ ID NO: 288675 - DNA, 20 bp, human
gcgaagtaagcagcactttc

SEQ ID NO: 288676 - DNA, 20 bp, human
gctccctaacaccatgtagg

SEQ ID NO: 288677 - DNA, 20 bp, human
gagaaagtcactcatgaaga

SEQ ID NO: 288678 - DNA, 20 bp, human
gaacctccctaacaccatgt

SEQ ID NO: 288679 - DNA, 20 bp, human
gtgttaacagtgtgatcatc

SEQ ID NO: 288680 - DNA, 20 bp, human
ggtaactatctatagagata

SEQ ID NO: 288681 - DNA, 20 bp, human
ggagtgacctgccacctaca

SEQ ID NO: 288682 - DNA, 20 bp, human
gaactaccaactcgcgttaa

SEQ ID NO: 288683 - DNA, 20 bp, human
gctttcaaatagggagaatg

SEQ ID NO: 288684 - DNA, 20 bp, human
ggttcagcttatcagtaacc

SEQ ID NO: 288685 - DNA, 20 bp, human
gcattaaagatctttcaaat

SEQ ID NO: 288686 - DNA, 20 bp, human
gccatcccaaatggcttcta

SEQ ID NO: 288687 - DNA, 20 bp, human
gtccccagtggagcgtagga

SEQ ID NO: 288688 - DNA, 20 bp, human
gaagttaatgagcacgactc

SEQ ID NO: 288689 - DNA, 20 bp, human
ggcatggaagtggcatgaca

SEQ ID NO: 288690 - DNA, 20 bp, human
gtccttcctacgctccactg

SEQ ID NO: 288691 - DNA, 20 bp, human
gtaactgctcaaataggatt

SEQ ID NO: 288692 - DNA, 20 bp, human
ggctcaaataggatttggaa

SEQ ID NO: 288693 - DNA, 20 bp, human
gactctggggtgtctcctga

SEQ ID NO: 288694 - DNA, 20 bp, human
gaggaatgtgacatcacact

SEQ ID NO: 288695 - DNA, 20 bp, human
gtctgccccgcccacggtgg

SEQ ID NO: 288696 - DNA, 20 bp, human
gaccccactaagtgtcgcaa

SEQ ID NO: 288697 - DNA, 20 bp, human
gctccattgcgacacttagt

SEQ ID NO: 288698 - DNA, 20 bp, human
gggtacctgtcaggaacagt

SEQ ID NO: 288699 - DNA, 20 bp, human
gtcaggaacagtagggagtt

SEQ ID NO: 288700 - DNA, 20 bp, human
gttcccaggaactcaatgaa

SEQ ID NO: 288701 - DNA, 20 bp, human
gtccccttcattgagttcct

SEQ ID NO: 288702 - DNA, 20 bp, human
gccgcttctcgcagtggggc

SEQ ID NO: 288703 - DNA, 20 bp, human
ggggtggcagacgcctagct

SEQ ID NO: 288704 - DNA, 20 bp, human
gccattgtgctcttcttccc

SEQ ID NO: 288705 - DNA, 20 bp, human
gtgagactgtcccatgtgca

SEQ ID NO: 288706 - DNA, 20 bp, human
gttggccagcatgaggagat

SEQ ID NO: 288707 - DNA, 20 bp, human
gagtcaccctcctggaaact

SEQ ID NO: 288708 - DNA, 20 bp, human
gctgaggtgctctggaagga

SEQ ID NO: 288709 - DNA, 20 bp, human
gccacacactcacagagggt

SEQ ID NO: 288710 - DNA, 20 bp, human
gctggcggcagtcggggttg

SEQ ID NO: 288711 - DNA, 20 bp, human
gcatgagctggcggcagtcg

SEQ ID NO: 288712 - DNA, 20 bp, human
gacgcagataagaaccagtt

SEQ ID NO: 288713 - DNA, 20 bp, human
gtagcacccgggcagtacct

SEQ ID NO: 288714 - DNA, 20 bp, human
ggagcacctcagagagtaca

SEQ ID NO: 288715 - DNA, 20 bp, human
gctgggagggactgtggccc

SEQ ID NO: 288716 - DNA, 20 bp, human
gtgggctaatgtaacaaaga

SEQ ID NO: 288717 - DNA, 20 bp, human
gagagctatcacctaagtgt

SEQ ID NO: 288718 - DNA, 20 bp, human
gtccaaagagtcatcagaag

SEQ ID NO: 288719 - DNA, 20 bp, human
gagactgactgaatggatgt

SEQ ID NO: 288720 - DNA, 20 bp, human
gaactcctgccacaatgtac

SEQ ID NO: 288721 - DNA, 20 bp, human
gccacccccttaaagaaagg

SEQ ID NO: 288722 - DNA, 20 bp, human
gtccccacccccttaaagaa

SEQ ID NO: 288723 - DNA, 20 bp, human
gagtgattaaagagagtgat

SEQ ID NO: 288724 - DNA, 20 bp, human
gttctggaaaaatattatgg

SEQ ID NO: 288725 - DNA, 20 bp, human
gccattcagtcagtctttgg

SEQ ID NO: 288726 - DNA, 20 bp, human
gtgggtctgaggggaccaga

SEQ ID NO: 288727 - DNA, 20 bp, human
gtccccctaggtgttttcga

SEQ ID NO: 288728 - DNA, 20 bp, human
gccagaagggtgagctacgt

SEQ ID NO: 288729 - DNA, 20 bp, human
ggtagtcaggcactcctggg

SEQ ID NO: 288730 - DNA, 20 bp, human
gctacgttggctttctggaa

SEQ ID NO: 288731 - DNA, 20 bp, human
gtggtcccctcagacccaca

SEQ ID NO: 288732 - DNA, 20 bp, human
gctaacggcggagccaggat

SEQ ID NO: 288733 - DNA, 20 bp, human
gactgtagtcaggcactcct

SEQ ID NO: 288734 - DNA, 20 bp, human
gcgttagtgcccagcaggta

SEQ ID NO: 288735 - DNA, 20 bp, human
gagtcccagacacgagtgtt

SEQ ID NO: 288736 - DNA, 20 bp, human
gcagctggatggcagcgcga

SEQ ID NO: 288737 - DNA, 20 bp, human
gactgacagccgagtggctg

SEQ ID NO: 288738 - DNA, 20 bp, human
gtctgggcatgaaccccgag

SEQ ID NO: 288739 - DNA, 20 bp, human
gcgctcgcccttggtttctg

SEQ ID NO: 288740 - DNA, 20 bp, human
gcatccagctgggtagccgg

SEQ ID NO: 288741 - DNA, 20 bp, human
gcggccgcgcttggccccag

SEQ ID NO: 288742 - DNA, 20 bp, human
gtccgcgagtcgctcgccct

SEQ ID NO: 288743 - DNA, 20 bp, human
gtagccgggggagcgcgcgt

SEQ ID NO: 288744 - DNA, 20 bp, human
ggcgtggcacgcagagcccc

SEQ ID NO: 288745 - DNA, 20 bp, human
gtgagagtttccacctctcg

SEQ ID NO: 288746 - DNA, 20 bp, human
gaccacaggctctgtcctaa

SEQ ID NO: 288747 - DNA, 20 bp, human
gtggtccgggtattgctcat

SEQ ID NO: 288748 - DNA, 20 bp, human
gtgctcattggcttttaggg

SEQ ID NO: 288749 - DNA, 20 bp, human
ggggaggtgcagagtccttt

SEQ ID NO: 288750 - DNA, 20 bp, human
gcaggaagctcagaaagggc

SEQ ID NO: 288751 - DNA, 20 bp, human
gaacaagattggttaccttg

SEQ ID NO: 288752 - DNA, 20 bp, human
gtaaaagccaatgagcaggc

SEQ ID NO: 288753 - DNA, 20 bp, human
gccctgctgatgcaacatct

SEQ ID NO: 288754 - DNA, 20 bp, human
ggataatcctgcctgctcat

SEQ ID NO: 288755 - DNA, 20 bp, human
gtcctttaggacagagcctg

SEQ ID NO: 288756 - DNA, 20 bp, human
gtgtgcatgtgctaatgtgt

SEQ ID NO: 288757 - DNA, 20 bp, human
gagaacaggtaagatgccag

SEQ ID NO: 288758 - DNA, 20 bp, human
gcacacgtatacctagccag

SEQ ID NO: 288759 - DNA, 20 bp, human
gacaggtaagatgccagggg

SEQ ID NO: 288760 - DNA, 20 bp, human
ggggctttacctctccctga

SEQ ID NO: 288761 - DNA, 20 bp, human
ggtgtgggggcagggattga

SEQ ID NO: 288762 - DNA, 20 bp, human
gcttgattcatgctgaaaat

SEQ ID NO: 288763 - DNA, 20 bp, human
gtttccaggctgcaatggga

SEQ ID NO: 288764 - DNA, 20 bp, human
gtacttttatgatggaatac

SEQ ID NO: 288765 - DNA, 20 bp, human
gggaggagaggctacctttt

SEQ ID NO: 288766 - DNA, 20 bp, human
gatgtcacaggtccctaaga

SEQ ID NO: 288767 - DNA, 20 bp, human
gcctgtggggatgatgtcac

SEQ ID NO: 288768 - DNA, 20 bp, human
ggggtgacacttccctctta

SEQ ID NO: 288769 - DNA, 20 bp, human
gaggcacccactgtcaccaa

SEQ ID NO: 288770 - DNA, 20 bp, human
ggagggaagtgtcaccccga

SEQ ID NO: 288771 - DNA, 20 bp, human
gaagacatttggggccatcg

SEQ ID NO: 288772 - DNA, 20 bp, human
gcagccgcatgtgcagagtg

SEQ ID NO: 288773 - DNA, 20 bp, human
gcacctgcaagtaagacatt

SEQ ID NO: 288774 - DNA, 20 bp, human
gcctccccactctgcacatg

SEQ ID NO: 288775 - DNA, 20 bp, human
gctctcagtcataacccatg

SEQ ID NO: 288776 - DNA, 20 bp, human
ggatagaggtggtgttttgt

SEQ ID NO: 288777 - DNA, 20 bp, human
ggctctaatagtgacgtttt

SEQ ID NO: 288778 - DNA, 20 bp, human
gagaacgacctaaccaccac

SEQ ID NO: 288779 - DNA, 20 bp, human
ggtgggctcctgtggtggtt

SEQ ID NO: 288780 - DNA, 20 bp, human
gaaacacttgcatctcaagg

SEQ ID NO: 288781 - DNA, 20 bp, human
ggttttgtgggctcctgtgg

SEQ ID NO: 288782 - DNA, 20 bp, human
ggtcactattagagcccgga

SEQ ID NO: 288783 - DNA, 20 bp, human
ggggaaacacttgcatctca

SEQ ID NO: 288784 - DNA, 20 bp, human
gggtgttttgtgggctcctg

SEQ ID NO: 288785 - DNA, 20 bp, human
gcttgcatctcaaggtggaa

SEQ ID NO: 288786 - DNA, 20 bp, human
gacccccaacggcctctcta

SEQ ID NO: 288787 - DNA, 20 bp, human
gcatcccaagtggtttatca

SEQ ID NO: 288788 - DNA, 20 bp, human
gaggttctgggcgggatcta

SEQ ID NO: 288789 - DNA, 20 bp, human
gtggaattccaggttctggg

SEQ ID NO: 288790 - DNA, 20 bp, human
gagaaaacagcaatagtaac

SEQ ID NO: 288791 - DNA, 20 bp, human
gcccctagagaggccgttgg

SEQ ID NO: 288792 - DNA, 20 bp, human
gaggtccccacgcttggggt

SEQ ID NO: 288793 - DNA, 20 bp, human
ggctccttgataaaccactt

SEQ ID NO: 288794 - DNA, 20 bp, human
gggtttatcaaggagctgag

SEQ ID NO: 288795 - DNA, 20 bp, human
ggggtgggacctgtgccggt

SEQ ID NO: 288796 - DNA, 20 bp, human
gaaggtaaaacactgaggat

SEQ ID NO: 288797 - DNA, 20 bp, human
ggcagccaagtcctagtcct

SEQ ID NO: 288798 - DNA, 20 bp, human
gctggggccagattccctta

SEQ ID NO: 288799 - DNA, 20 bp, human
ggctgccaaggactaggact

SEQ ID NO: 288800 - DNA, 20 bp, human
gacaactagtggggccttaa

SEQ ID NO: 288801 - DNA, 20 bp, human
gacaatcactcccgggttta

SEQ ID NO: 288802 - DNA, 20 bp, human
gtggtcctgagctggttaaa

SEQ ID NO: 288803 - DNA, 20 bp, human
gaaccagctcaggaccaaag

SEQ ID NO: 288804 - DNA, 20 bp, human
ggattgtgcaagtggcaagc

SEQ ID NO: 288805 - DNA, 20 bp, human
gcagtggttcaaagcaagag

SEQ ID NO: 288806 - DNA, 20 bp, human
gccaggggaaatgagtagtg

SEQ ID NO: 288807 - DNA, 20 bp, human
gttgctgtggctagaggcct

SEQ ID NO: 288808 - DNA, 20 bp, human
gcacagagggggatgatgca

SEQ ID NO: 288809 - DNA, 20 bp, human
gtatagaaggggcggggatg

SEQ ID NO: 288810 - DNA, 20 bp, human
ggtatgcagcctcagttcca

SEQ ID NO: 288811 - DNA, 20 bp, human
gaatagctatagaaggggcg

SEQ ID NO: 288812 - DNA, 20 bp, human
gatgagtagtgtggttgctg

SEQ ID NO: 288813 - DNA, 20 bp, human
gagagggggatgatgcaggg

SEQ ID NO: 288814 - DNA, 20 bp, human
gtaaaagactcagagacaaa

SEQ ID NO: 288815 - DNA, 20 bp, human
gagtcacctgctggtataaa

SEQ ID NO: 288816 - DNA, 20 bp, human
ggagtctgcaatgtaggtca

SEQ ID NO: 288817 - DNA, 20 bp, human
gagagccagtcatttcgaat

SEQ ID NO: 288818 - DNA, 20 bp, human
gtggctctcgtgtcactatt

SEQ ID NO: 288819 - DNA, 20 bp, human
gtaaaatggtctcatccaag

SEQ ID NO: 288820 - DNA, 20 bp, human
gacattgcagactcttgaag

SEQ ID NO: 288821 - DNA, 20 bp, human
gctgtccaattcgaaatgac

SEQ ID NO: 288822 - DNA, 20 bp, human
gtgaaagtgaactgttttgt

SEQ ID NO: 288823 - DNA, 20 bp, human
ggtataagtgttctgcctct

SEQ ID NO: 288824 - DNA, 20 bp, human
gcagttcactttcagtaatc

SEQ ID NO: 288825 - DNA, 20 bp, human
gaaactaagcgtcatatttt

SEQ ID NO: 288826 - DNA, 20 bp, human
gcctgaggtgagatgagacc

SEQ ID NO: 288827 - DNA, 20 bp, human
gaccactggctgtgtgggca

SEQ ID NO: 288828 - DNA, 20 bp, human
gtgagttcaggctctaccac

SEQ ID NO: 288829 - DNA, 20 bp, human
ggatttgggcatatatatgg

SEQ ID NO: 288830 - DNA, 20 bp, human
gcaatcagaggcatagctgt

SEQ ID NO: 288831 - DNA, 20 bp, human
gtatgcctctgattggtgaa

SEQ ID NO: 288832 - DNA, 20 bp, human
gcaaggctttgtggagattt

SEQ ID NO: 288833 - DNA, 20 bp, human
gcagctacccatggtcccta

SEQ ID NO: 288834 - DNA, 20 bp, human
ggggcaagtgtaataaacag

SEQ ID NO: 288835 - DNA, 20 bp, human
gtacacttgcccttgggggg

SEQ ID NO: 288836 - DNA, 20 bp, human
gggagtcaaaggatgtctaa

SEQ ID NO: 288837 - DNA, 20 bp, human
gggaaaggaaataatcacga

SEQ ID NO: 288838 - DNA, 20 bp, human
gaaaccagaccctggatggg

SEQ ID NO: 288839 - DNA, 20 bp, human
ggtgaaaccagaccctggat

SEQ ID NO: 288840 - DNA, 20 bp, human
gggagaagtcatagctgatg

SEQ ID NO: 288841 - DNA, 20 bp, human
gggaaacgaggcctcttgaa

SEQ ID NO: 288842 - DNA, 20 bp, human
gggggggcagtgactggcga

SEQ ID NO: 288843 - DNA, 20 bp, human
gagcagggatcatggaaacg

SEQ ID NO: 288844 - DNA, 20 bp, human
gtatatgcctggtagctgat

SEQ ID NO: 288845 - DNA, 20 bp, human
gcgagggcaagggggagtta

SEQ ID NO: 288846 - DNA, 20 bp, human
gggaagctgggtgaaggatg

SEQ ID NO: 288847 - DNA, 20 bp, human
ggaacgcaatcttaccagta

SEQ ID NO: 288848 - DNA, 20 bp, human
gaaaaacaggatgatttcca

SEQ ID NO: 288849 - DNA, 20 bp, human
gtaatgcaagctgctgtgat

SEQ ID NO: 288850 - DNA, 20 bp, human
gtcacagcacctcattggac

SEQ ID NO: 288851 - DNA, 20 bp, human
gaaggcatgccaataaaaac

SEQ ID NO: 288852 - DNA, 20 bp, human
gattggactggtggctttga

SEQ ID NO: 288853 - DNA, 20 bp, human
gcagcacctcattggactgg

SEQ ID NO: 288854 - DNA, 20 bp, human
gtttaaataatgtcagttga

SEQ ID NO: 288855 - DNA, 20 bp, human
gtttgagggctacattaagt

SEQ ID NO: 288856 - DNA, 20 bp, human
gtgggatcaaccagtgaata

SEQ ID NO: 288857 - DNA, 20 bp, human
gtggaaggacagtagaccct

SEQ ID NO: 288858 - DNA, 20 bp, human
ggcccacccgaggggattcg

SEQ ID NO: 288859 - DNA, 20 bp, human
gtgaggacagggctggacgt

SEQ ID NO: 288860 - DNA, 20 bp, human
gtagcagtgagtctggagct

SEQ ID NO: 288861 - DNA, 20 bp, human
gggggggtgacgggaagctg

SEQ ID NO: 288862 - DNA, 20 bp, human
gtgacgggaagctggggttt

SEQ ID NO: 288863 - DNA, 20 bp, human
ggcagagccgagaatcagga

SEQ ID NO: 288864 - DNA, 20 bp, human
gaaggggattgcccacccga

SEQ ID NO: 288865 - DNA, 20 bp, human
ggggacattgaggacagggc

SEQ ID NO: 288866 - DNA, 20 bp, human
gacgcggtaccacccctcgg

SEQ ID NO: 288867 - DNA, 20 bp, human
gggcggggaccctgagcgaa

SEQ ID NO: 288868 - DNA, 20 bp, human
gccccgcgacggaaagtccc

SEQ ID NO: 288869 - DNA, 20 bp, human
ggacggaaagtccccggctg

SEQ ID NO: 288870 - DNA, 20 bp, human
gcccggctggggctgcttga

SEQ ID NO: 288871 - DNA, 20 bp, human
gtgcccagagctctcctagg

SEQ ID NO: 288872 - DNA, 20 bp, human
gggtacgcggtaccacccct

SEQ ID NO: 288873 - DNA, 20 bp, human
gggcccccctaggagagctc

SEQ ID NO: 288874 - DNA, 20 bp, human
ggggcgtaggacaggtttcg

SEQ ID NO: 288875 - DNA, 20 bp, human
ggggctgcttgagggggagt

SEQ ID NO: 288876 - DNA, 20 bp, human
gtgggctggggttgatgaga

SEQ ID NO: 288877 - DNA, 20 bp, human
gtatgggcgtagctgaagaa

SEQ ID NO: 288878 - DNA, 20 bp, human
gtcccctgccgttgaaggta

SEQ ID NO: 288879 - DNA, 20 bp, human
ggctacgcccataaaaggag

SEQ ID NO: 288880 - DNA, 20 bp, human
gaatctccctctccttttat

SEQ ID NO: 288881 - DNA, 20 bp, human
gaggacgttacagccctgag

SEQ ID NO: 288882 - DNA, 20 bp, human
gacgttacagccctgagggg

SEQ ID NO: 288883 - DNA, 20 bp, human
gtggtcccggctgactcctg

SEQ ID NO: 288884 - DNA, 20 bp, human
gaccctaccttcaacggcag

SEQ ID NO: 288885 - DNA, 20 bp, human
gagcaagcacttcttggcag

SEQ ID NO: 288886 - DNA, 20 bp, human
ggtgccgcccccagcgtagg

SEQ ID NO: 288887 - DNA, 20 bp, human
gtgtgtgccgcccccagcgt

SEQ ID NO: 288888 - DNA, 20 bp, human
gtggaggcgtcagaggtgtt

SEQ ID NO: 288889 - DNA, 20 bp, human
gagcctgtgtgagttggcgt

SEQ ID NO: 288890 - DNA, 20 bp, human
ggaaactcctcaagcaccca

SEQ ID NO: 288891 - DNA, 20 bp, human
gtaggaggcagatctttatc

SEQ ID NO: 288892 - DNA, 20 bp, human
gcacacaagcaggtccctct

SEQ ID NO: 288893 - DNA, 20 bp, human
ggatctgcctcctacgctgg

SEQ ID NO: 288894 - DNA, 20 bp, human
ggggaggagggtgagacgct

SEQ ID NO: 288895 - DNA, 20 bp, human
gttcctgtgcagaggataga

SEQ ID NO: 288896 - DNA, 20 bp, human
gattaggtgctgctgtaagg

SEQ ID NO: 288897 - DNA, 20 bp, human
gacagaggaaacgtgtgggt

SEQ ID NO: 288898 - DNA, 20 bp, human
gtaaaccagggctttacaga

SEQ ID NO: 288899 - DNA, 20 bp, human
gtatgacagaggaaacgtgt

SEQ ID NO: 288900 - DNA, 20 bp, human
gcagctaagggtgggtattc

SEQ ID NO: 288901 - DNA, 20 bp, human
gcatagaacggtgatgtcgg

SEQ ID NO: 288902 - DNA, 20 bp, human
gtccttcccaggatctaggt

SEQ ID NO: 288903 - DNA, 20 bp, human
ggcagcacctaatctcctag

SEQ ID NO: 288904 - DNA, 20 bp, human
gtggttgagaatggtgctag

SEQ ID NO: 288905 - DNA, 20 bp, human
gctaagtcctctaggagatt

SEQ ID NO: 288906 - DNA, 20 bp, human
ggtagcagagatgacactgg

SEQ ID NO: 288907 - DNA, 20 bp, human
gctggtatcaggaagagtat

SEQ ID NO: 288908 - DNA, 20 bp, human
gcccctctggatccccttaa

SEQ ID NO: 288909 - DNA, 20 bp, human
ggaatctaatgcctcccctc

SEQ ID NO: 288910 - DNA, 20 bp, human
gatcaggaagagtatgggta

SEQ ID NO: 288911 - DNA, 20 bp, human
gatgacactggtgggtgttc

SEQ ID NO: 288912 - DNA, 20 bp, human
gctcctcaaggaacaatcag

SEQ ID NO: 288913 - DNA, 20 bp, human
gtacttgtctatctggtatc

SEQ ID NO: 288914 - DNA, 20 bp, human
ggtgggtgtctatgagagaa

SEQ ID NO: 288915 - DNA, 20 bp, human
gagccattaaggggatccag

SEQ ID NO: 288916 - DNA, 20 bp, human
gtgtcaaggaggatgagaga

SEQ ID NO: 288917 - DNA, 20 bp, human
gccgccttgcccggggttgt

SEQ ID NO: 288918 - DNA, 20 bp, human
gaagcatggcagcaggtgag

SEQ ID NO: 288919 - DNA, 20 bp, human
ggccagggtagtccaggtga

SEQ ID NO: 288920 - DNA, 20 bp, human
ggtgtggggcaggcgtcgga

SEQ ID NO: 288921 - DNA, 20 bp, human
gggatgaataattacgtctg

SEQ ID NO: 288922 - DNA, 20 bp, human
gggtggtgtggggcaggcgt

SEQ ID NO: 288923 - DNA, 20 bp, human
gtgctgctgcacatataagg

SEQ ID NO: 288924 - DNA, 20 bp, human
gggcctcagtgagctgagtc

SEQ ID NO: 288925 - DNA, 20 bp, human
gagatgggaagcatggcagc

SEQ ID NO: 288926 - DNA, 20 bp, human
gtggccacggctgagtgaaa

SEQ ID NO: 288927 - DNA, 20 bp, human
gctgaggttaccctccaggt

SEQ ID NO: 288928 - DNA, 20 bp, human
gaggctccttccaagaagaa

SEQ ID NO: 288929 - DNA, 20 bp, human
gcagccctttcactcagccg

SEQ ID NO: 288930 - DNA, 20 bp, human
gaggcatctgcccacctgga

SEQ ID NO: 288931 - DNA, 20 bp, human
gagtcaggcatctgcccacc

SEQ ID NO: 288932 - DNA, 20 bp, human
gaatgctgaggttaccctcc

SEQ ID NO: 288933 - DNA, 20 bp, human
ggctgagtgaaagggctgaa

SEQ ID NO: 288934 - DNA, 20 bp, human
ggaagtcacccgctccttgg

SEQ ID NO: 288935 - DNA, 20 bp, human
gcgtccctgcacaccggcgt

SEQ ID NO: 288936 - DNA, 20 bp, human
gacccacttatgctgggaaa

SEQ ID NO: 288937 - DNA, 20 bp, human
gggtagctgactccaaaaag

SEQ ID NO: 288938 - DNA, 20 bp, human
gggcacttacccacttatgc

SEQ ID NO: 288939 - DNA, 20 bp, human
ggtaagtgccactttgactt

SEQ ID NO: 288940 - DNA, 20 bp, human
gcaggaagtccttacaaatg

SEQ ID NO: 288941 - DNA, 20 bp, human
gaaaatactcctgatgttat

SEQ ID NO: 288942 - DNA, 20 bp, human
gagctattaccacatttgta

SEQ ID NO: 288943 - DNA, 20 bp, human
gatccatttcccagcataag

SEQ ID NO: 288944 - DNA, 20 bp, human
gtaatgatgattattactag

SEQ ID NO: 288945 - DNA, 20 bp, human
gcacttcttttagttgtttc

SEQ ID NO: 288946 - DNA, 20 bp, human
gaggaatgagggtccgtccc

SEQ ID NO: 288947 - DNA, 20 bp, human
ggggtccctgggaggaatga

SEQ ID NO: 288948 - DNA, 20 bp, human
gcctaagaggggcgccgtga

SEQ ID NO: 288949 - DNA, 20 bp, human
ggaactgccggacctaagag

SEQ ID NO: 288950 - DNA, 20 bp, human
gaccccagctcagagggagc

SEQ ID NO: 288951 - DNA, 20 bp, human
gtccccactctcaggctggt

SEQ ID NO: 288952 - DNA, 20 bp, human
gacttacccgagagagacag

SEQ ID NO: 288953 - DNA, 20 bp, human
gaaggtgacgtcagccaagt

SEQ ID NO: 288954 - DNA, 20 bp, human
gaccccaccagcctgagagt

SEQ ID NO: 288955 - DNA, 20 bp, human
gcccgagagagacagaggtc

SEQ ID NO: 288956 - DNA, 20 bp, human
gtgccttagaagggagatct

SEQ ID NO: 288957 - DNA, 20 bp, human
gacaattctgtcaacatcta

SEQ ID NO: 288958 - DNA, 20 bp, human
gagccaaaacataaagttta

SEQ ID NO: 288959 - DNA, 20 bp, human
ggcccctaaactttatgttt

SEQ ID NO: 288960 - DNA, 20 bp, human
gcgcccagatctcccttcta

SEQ ID NO: 288961 - DNA, 20 bp, human
gctcccttctaaggcaattt

SEQ ID NO: 288962 - DNA, 20 bp, human
ggacccaaattgccttagaa

SEQ ID NO: 288963 - DNA, 20 bp, human
ggacagaattgtaactctgt

SEQ ID NO: 288964 - DNA, 20 bp, human
ggaaagcccgtcagatatgt

SEQ ID NO: 288965 - DNA, 20 bp, human
gttgggtctctgccaaactt

SEQ ID NO: 288966 - DNA, 20 bp, human
ggagccgtgtccagctgcca

SEQ ID NO: 288967 - DNA, 20 bp, human
gataactcactcatgggcca

SEQ ID NO: 288968 - DNA, 20 bp, human
gcggtgtgcgctgtggctga

SEQ ID NO: 288969 - DNA, 20 bp, human
ggtgggtgcggtgtgcgctg

SEQ ID NO: 288970 - DNA, 20 bp, human
ggtcatcataactcactcat

SEQ ID NO: 288971 - DNA, 20 bp, human
gctgaacaaaagcaggacca

SEQ ID NO: 288972 - DNA, 20 bp, human
gtcacgtgagaaatgacttc

SEQ ID NO: 288973 - DNA, 20 bp, human
gctggggcctgaacaaaagc

SEQ ID NO: 288974 - DNA, 20 bp, human
gtgacaccagctggcagcct

SEQ ID NO: 288975 - DNA, 20 bp, human
ggggccgggtggtcctgtgc

SEQ ID NO: 288976 - DNA, 20 bp, human
gaggggactgctctgactga

SEQ ID NO: 288977 - DNA, 20 bp, human
gagtcagagcagtcccctgg

SEQ ID NO: 288978 - DNA, 20 bp, human
gcaacccagaggacccgcca

SEQ ID NO: 288979 - DNA, 20 bp, human
gggccactgcagctctgctc

SEQ ID NO: 288980 - DNA, 20 bp, human
ggtcccctggcgggtcctct

SEQ ID NO: 288981 - DNA, 20 bp, human
ggcagcttggactgttctaa

SEQ ID NO: 288982 - DNA, 20 bp, human
gccttggactgtgaagtagg

SEQ ID NO: 288983 - DNA, 20 bp, human
gctgccttggactgtgaagt

SEQ ID NO: 288984 - DNA, 20 bp, human
gagaacagtccaagctgcct

SEQ ID NO: 288985 - DNA, 20 bp, human
ggagggagtcttcaacccag

SEQ ID NO: 288986 - DNA, 20 bp, human
gggagccctcagtaagtgca

SEQ ID NO: 288987 - DNA, 20 bp, human
gcaagcaacctgaaacatga

SEQ ID NO: 288988 - DNA, 20 bp, human
ggtaagtgcaaggtagactg

SEQ ID NO: 288989 - DNA, 20 bp, human
gaggcctgggcaggattcat

SEQ ID NO: 288990 - DNA, 20 bp, human
gactgagggctcccactctt

SEQ ID NO: 288991 - DNA, 20 bp, human
ggcacctatgaatcctgccc

SEQ ID NO: 288992 - DNA, 20 bp, human
gagcactctagccacctcaa

SEQ ID NO: 288993 - DNA, 20 bp, human
gtccctaccattatgaacaa

SEQ ID NO: 288994 - DNA, 20 bp, human
gtgcacttgggttttctgac

SEQ ID NO: 288995 - DNA, 20 bp, human
gcagagatgagtcattgacc

SEQ ID NO: 288996 - DNA, 20 bp, human
ggagcagcaagtattcccgg

SEQ ID NO: 288997 - DNA, 20 bp, human
gtagaattctagggacatag

SEQ ID NO: 288998 - DNA, 20 bp, human
ggtctcatggaacacattgt

SEQ ID NO: 288999 - DNA, 20 bp, human
gcacaccaccctaagccgcc

SEQ ID NO: 289000 - DNA, 20 bp, human
gtattcccggcggcttaggg

SEQ ID NO: 289001 - DNA, 20 bp, human
gctgctcattatctctctat

SEQ ID NO: 289002 - DNA, 20 bp, human
ggtgaggataagtcaccaca

SEQ ID NO: 289003 - DNA, 20 bp, human
gtctgcttacattctcatat

SEQ ID NO: 289004 - DNA, 20 bp, human
ggtgagaatggcaataaccc

SEQ ID NO: 289005 - DNA, 20 bp, human
gcaagtattcccggcggctt

SEQ ID NO: 289006 - DNA, 20 bp, human
gcctaccagaagatcctgtg

SEQ ID NO: 289007 - DNA, 20 bp, human
gaagatcctgtgaggctcgg

SEQ ID NO: 289008 - DNA, 20 bp, human
ggcacaagtatcacctgtcc

SEQ ID NO: 289009 - DNA, 20 bp, human
gggaccttgcctgagacgtg

SEQ ID NO: 289010 - DNA, 20 bp, human
gaaggaggctccagcttcct

SEQ ID NO: 289011 - DNA, 20 bp, human
gctcataaaggggaaactaa

SEQ ID NO: 289012 - DNA, 20 bp, human
gagctctagaatgacatgac

SEQ ID NO: 289013 - DNA, 20 bp, human
ggccaggcactctcatgtca

SEQ ID NO: 289014 - DNA, 20 bp, human
gccctctgcagtcaggctaa

SEQ ID NO: 289015 - DNA, 20 bp, human
ggacaggagagctgaactct

SEQ ID NO: 289016 - DNA, 20 bp, human
ggctgctcattatctgtcgt

SEQ ID NO: 289017 - DNA, 20 bp, human
ggccatgggcactgactctt

SEQ ID NO: 289018 - DNA, 20 bp, human
gagtgcccatggcagctcaa

SEQ ID NO: 289019 - DNA, 20 bp, human
gctaggcttttgcatctcag

SEQ ID NO: 289020 - DNA, 20 bp, human
ggcttcccttgagctgccat

SEQ ID NO: 289021 - DNA, 20 bp, human
gaatgagcagcaagtgcttc

SEQ ID NO: 289022 - DNA, 20 bp, human
gtacaggagatgttagaggt

SEQ ID NO: 289023 - DNA, 20 bp, human
ggaggaaatagtgttgtcat

SEQ ID NO: 289024 - DNA, 20 bp, human
gtctcctgtaggcctggcaa

SEQ ID NO: 289025 - DNA, 20 bp, human
gcaagtgcttctggcgactt

SEQ ID NO: 289026 - DNA, 20 bp, human
gctttgaaggcgtgatagac

SEQ ID NO: 289027 - DNA, 20 bp, human
ggtgttagcactgtgactca

SEQ ID NO: 289028 - DNA, 20 bp, human
gacatgcagcaaggtgtcct

SEQ ID NO: 289029 - DNA, 20 bp, human
gagtcacagtgctaacacac

SEQ ID NO: 289030 - DNA, 20 bp, human
gcaaccagaaaggcaccaag

SEQ ID NO: 289031 - DNA, 20 bp, human
gggtgagaagatgccataac

SEQ ID NO: 289032 - DNA, 20 bp, human
gtaaaaaaacagtcagggac

SEQ ID NO: 289033 - DNA, 20 bp, human
gtagacaggagagcatggtc

SEQ ID NO: 289034 - DNA, 20 bp, human
ggggtgcaatagcatttttg

SEQ ID NO: 289035 - DNA, 20 bp, human
gtatggcatcttctcacccc

SEQ ID NO: 289036 - DNA, 20 bp, human
gagtgccagcgccagcttta

SEQ ID NO: 289037 - DNA, 20 bp, human
gtcagggcgctgaggctcta

SEQ ID NO: 289038 - DNA, 20 bp, human
gagcgagaacaccacttaag

SEQ ID NO: 289039 - DNA, 20 bp, human
ggctggcagttgttttctat

SEQ ID NO: 289040 - DNA, 20 bp, human
gagtgccctaaagctggcgc

SEQ ID NO: 289041 - DNA, 20 bp, human
gctgatgctgctgacgtttg

SEQ ID NO: 289042 - DNA, 20 bp, human
gcaggacaggcccgacagag

SEQ ID NO: 289043 - DNA, 20 bp, human
gcgccctgagtttctgaggc

SEQ ID NO: 289044 - DNA, 20 bp, human
ggcactagtaactttctgta

SEQ ID NO: 289045 - DNA, 20 bp, human
ggaaggtgtgagtggtctta

SEQ ID NO: 289046 - DNA, 20 bp, human
gttacgaagctgctgacccc

SEQ ID NO: 289047 - DNA, 20 bp, human
gccccaggatcccagcccgt

SEQ ID NO: 289048 - DNA, 20 bp, human
gcccttctctcccacgggct

SEQ ID NO: 289049 - DNA, 20 bp, human
ggggaaacagcacccagaca

SEQ ID NO: 289050 - DNA, 20 bp, human
gcccactgccagatccttat

SEQ ID NO: 289051 - DNA, 20 bp, human
ggagacccccttctctccca

SEQ ID NO: 289052 - DNA, 20 bp, human
ggggtctgagtttcaggggt

SEQ ID NO: 289053 - DNA, 20 bp, human
ggcgtgaacgctggtgtcca

SEQ ID NO: 289054 - DNA, 20 bp, human
gtgctgtttcccacgagaca

SEQ ID NO: 289055 - DNA, 20 bp, human
gtggctatacaggcagggtt

SEQ ID NO: 289056 - DNA, 20 bp, human
ggaaaaaatgcctcacaaac

SEQ ID NO: 289057 - DNA, 20 bp, human
gctggaagagaggtgctgat

SEQ ID NO: 289058 - DNA, 20 bp, human
gccccaagtgactgacaatc

SEQ ID NO: 289059 - DNA, 20 bp, human
gtgcatagaggcagaataac

SEQ ID NO: 289060 - DNA, 20 bp, human
gcaacaaattcggacacctg

SEQ ID NO: 289061 - DNA, 20 bp, human
gattttttctcctggaagag

SEQ ID NO: 289062 - DNA, 20 bp, human
gagattaatcttatcagctt

SEQ ID NO: 289063 - DNA, 20 bp, human
gcctattggtctgatttcac

SEQ ID NO: 289064 - DNA, 20 bp, human
gaactacaaagtttcagcat

SEQ ID NO: 289065 - DNA, 20 bp, human
gttaaaattgctgaaaccga

SEQ ID NO: 289066 - DNA, 20 bp, human
ggtccccgtgggaatcaagg

SEQ ID NO: 289067 - DNA, 20 bp, human
ggattcccacggggacagag

SEQ ID NO: 289068 - DNA, 20 bp, human
gaacaacggggaatcccctt

SEQ ID NO: 289069 - DNA, 20 bp, human
ggccccagatagttctgggg

SEQ ID NO: 289070 - DNA, 20 bp, human
gtggccgagggaaatgaaac

SEQ ID NO: 289071 - DNA, 20 bp, human
ggtagcccctctgtccccgt

SEQ ID NO: 289072 - DNA, 20 bp, human
gtggcctggtgatcagggac

SEQ ID NO: 289073 - DNA, 20 bp, human
gcaggtaaccgtgccaacaa

SEQ ID NO: 289074 - DNA, 20 bp, human
gaggccagaaatagatgctc

SEQ ID NO: 289075 - DNA, 20 bp, human
gtcaactagactctgagcat

SEQ ID NO: 289076 - DNA, 20 bp, human
gaggtgctggggtcgccccc

SEQ ID NO: 289077 - DNA, 20 bp, human
gcgcccccaggagaggacgg

SEQ ID NO: 289078 - DNA, 20 bp, human
gtgacctcgggctacggcgt

SEQ ID NO: 289079 - DNA, 20 bp, human
ggagccgccgtcctctcctg

SEQ ID NO: 289080 - DNA, 20 bp, human
gacaggggcgcgaggtggcc

SEQ ID NO: 289081 - DNA, 20 bp, human
gccactgcagagttctccgc

SEQ ID NO: 289082 - DNA, 20 bp, human
gagcccgaggtcacgcccag

SEQ ID NO: 289083 - DNA, 20 bp, human
gcagcgacaggggcgcgagg

SEQ ID NO: 289084 - DNA, 20 bp, human
gaagacacccagcgaggtgc

SEQ ID NO: 289085 - DNA, 20 bp, human
ggcggcgcatgcaaatctgc

SEQ ID NO: 289086 - DNA, 20 bp, human
gggtcgagttctgttcactg

SEQ ID NO: 289087 - DNA, 20 bp, human
ggttcactggggtcttgatt

SEQ ID NO: 289088 - DNA, 20 bp, human
gttctattacgaagaatctt

SEQ ID NO: 289089 - DNA, 20 bp, human
ggatagagaatgcctaataa

SEQ ID NO: 289090 - DNA, 20 bp, human
gacagaactcgaccctgcca

SEQ ID NO: 289091 - DNA, 20 bp, human
gttagtcactggcaacagaa

SEQ ID NO: 289092 - DNA, 20 bp, human
gctatgttctactatgactg

SEQ ID NO: 289093 - DNA, 20 bp, human
gactcgaccctgccaaggct

SEQ ID NO: 289094 - DNA, 20 bp, human
ggacagacaataaattgact

SEQ ID NO: 289095 - DNA, 20 bp, human
gtttgcacacatcttttaag

SEQ ID NO: 289096 - DNA, 20 bp, human
gcggttgcggggtcgcattg

SEQ ID NO: 289097 - DNA, 20 bp, human
ggccgccctgcggatcacgt

SEQ ID NO: 289098 - DNA, 20 bp, human
gccgccggtggggagagcgg

SEQ ID NO: 289099 - DNA, 20 bp, human
gcggggtcgcattgtggcta

SEQ ID NO: 289100 - DNA, 20 bp, human
gccggcgtgccccaggagag

SEQ ID NO: 289101 - DNA, 20 bp, human
gcggggaaagcagctggtgt

SEQ ID NO: 289102 - DNA, 20 bp, human
gcgtccacgccgctctcctg

SEQ ID NO: 289103 - DNA, 20 bp, human
gccgcctccgctctccccac

SEQ ID NO: 289104 - DNA, 20 bp, human
ggaggcccacgtgatccgca

SEQ ID NO: 289105 - DNA, 20 bp, human
ggcccacgtgatccgcaggg

SEQ ID NO: 289106 - DNA, 20 bp, human
gaggcagcttccttcatgat

SEQ ID NO: 289107 - DNA, 20 bp, human
gttgtacagagcaactgtgc

SEQ ID NO: 289108 - DNA, 20 bp, human
gagctaaggcggttctctaa

SEQ ID NO: 289109 - DNA, 20 bp, human
gaactgtgcaggagctgaac

SEQ ID NO: 289110 - DNA, 20 bp, human
gttatcagataatggctatc

SEQ ID NO: 289111 - DNA, 20 bp, human
gtttctctaagcaaatatgg

SEQ ID NO: 289112 - DNA, 20 bp, human
gttgacagcagtttggttgt

SEQ ID NO: 289113 - DNA, 20 bp, human
gctgctattgcctagtgagt

SEQ ID NO: 289114 - DNA, 20 bp, human
gtaactactgtagccaaaca

SEQ ID NO: 289115 - DNA, 20 bp, human
gcaagacagttatcagataa

SEQ ID NO: 289116 - DNA, 20 bp, human
gagcatggcaagacacaact

SEQ ID NO: 289117 - DNA, 20 bp, human
ggcagcttaggtcgtcattg

SEQ ID NO: 289118 - DNA, 20 bp, human
gcagagcgggtggggctgat

SEQ ID NO: 289119 - DNA, 20 bp, human
gctcaacccccaataaatat

SEQ ID NO: 289120 - DNA, 20 bp, human
gttgtgtcttgccatgctaa

SEQ ID NO: 289121 - DNA, 20 bp, human
gttgataaatctttgttgga

SEQ ID NO: 289122 - DNA, 20 bp, human
gttaccttcttcataatccc

SEQ ID NO: 289123 - DNA, 20 bp, human
gctctaatattgagactcat

SEQ ID NO: 289124 - DNA, 20 bp, human
gggggctgcgatggagtcag

SEQ ID NO: 289125 - DNA, 20 bp, human
gtcataatcccaggcttggg

SEQ ID NO: 289126 - DNA, 20 bp, human
gcacctgagcggggagaaca

SEQ ID NO: 289127 - DNA, 20 bp, human
gagggtgcggttacgaaagc

SEQ ID NO: 289128 - DNA, 20 bp, human
gccgcgcaccggccgaccga

SEQ ID NO: 289129 - DNA, 20 bp, human
gaggaagccaccccctcggt

SEQ ID NO: 289130 - DNA, 20 bp, human
gtggcaggaagccaccccct

SEQ ID NO: 289131 - DNA, 20 bp, human
gtctgggccgtcccagggtg

SEQ ID NO: 289132 - DNA, 20 bp, human
ggctgttgcgccatccgctc

SEQ ID NO: 289133 - DNA, 20 bp, human
ggcgtctctgggccgtccca

SEQ ID NO: 289134 - DNA, 20 bp, human
gactcgcgctggagcgtctc

SEQ ID NO: 289135 - DNA, 20 bp, human
gccacagcgccgcacctgag

SEQ ID NO: 289136 - DNA, 20 bp, human
gtgggcgcaaagggtctctc

SEQ ID NO: 289137 - DNA, 20 bp, human
gtggccgcctgtcgacgagg

SEQ ID NO: 289138 - DNA, 20 bp, human
gcgcccaggcattggtccag

SEQ ID NO: 289139 - DNA, 20 bp, human
gccgccccctaccgggacct

SEQ ID NO: 289140 - DNA, 20 bp, human
ggaccaatgcctgggcgcaa

SEQ ID NO: 289141 - DNA, 20 bp, human
gtacgggaatcgctacccct

SEQ ID NO: 289142 - DNA, 20 bp, human
gccgccccctcgtcgacagg

SEQ ID NO: 289143 - DNA, 20 bp, human
ggtcccgccccctcgtcgac

SEQ ID NO: 289144 - DNA, 20 bp, human
ggctgcgccccgccccctac

SEQ ID NO: 289145 - DNA, 20 bp, human
gggccactggaccaatgcct

SEQ ID NO: 289146 - DNA, 20 bp, human
gcaggtgcatgtacagcaga

SEQ ID NO: 289147 - DNA, 20 bp, human
gagagaggttggagtggtag

SEQ ID NO: 289148 - DNA, 20 bp, human
gagaaagagactgattagag

SEQ ID NO: 289149 - DNA, 20 bp, human
gcagtcgccaagcgttgcca

SEQ ID NO: 289150 - DNA, 20 bp, human
gaggacgcaagctgggttat

SEQ ID NO: 289151 - DNA, 20 bp, human
gagagactgattagagaggt

SEQ ID NO: 289152 - DNA, 20 bp, human
gcctgtgggtccacctaatc

SEQ ID NO: 289153 - DNA, 20 bp, human
gtgtgccgccccccttggga

SEQ ID NO: 289154 - DNA, 20 bp, human
ggcatcgtccaccacatccg

SEQ ID NO: 289155 - DNA, 20 bp, human
gagtgtgtgccgcccccctt

SEQ ID NO: 289156 - DNA, 20 bp, human
gctgctgtaagcagaggtca

SEQ ID NO: 289157 - DNA, 20 bp, human
gtgtaagcacagtaagtgtg

SEQ ID NO: 289158 - DNA, 20 bp, human
ggctgcagggaatatccagg

SEQ ID NO: 289159 - DNA, 20 bp, human
gtcaagctatcttaggctag

SEQ ID NO: 289160 - DNA, 20 bp, human
gaggcagtagattcacacct

SEQ ID NO: 289161 - DNA, 20 bp, human
gctgtgcttacatcagagta

SEQ ID NO: 289162 - DNA, 20 bp, human
gtttatacttcccttgtctg

SEQ ID NO: 289163 - DNA, 20 bp, human
gacttatctaaccacagaca

SEQ ID NO: 289164 - DNA, 20 bp, human
gacagagaagcttagatcta

SEQ ID NO: 289165 - DNA, 20 bp, human
gggaggaacaataatttcag

SEQ ID NO: 289166 - DNA, 20 bp, human
gggtgcataagttctctagt

SEQ ID NO: 289167 - DNA, 20 bp, human
ggacagatatagtactagag

SEQ ID NO: 289168 - DNA, 20 bp, human
gtgactcaggtttgccctga

SEQ ID NO: 289169 - DNA, 20 bp, human
gggccatcagttgcaaatcg

SEQ ID NO: 289170 - DNA, 20 bp, human
gaggtgttagaacaagatca

SEQ ID NO: 289171 - DNA, 20 bp, human
gggaactgttactgctctta

SEQ ID NO: 289172 - DNA, 20 bp, human
gtcatactccgtatttgata

SEQ ID NO: 289173 - DNA, 20 bp, human
gttccacgatttgcaactga

SEQ ID NO: 289174 - DNA, 20 bp, human
gaggtttgccctgaggggat

SEQ ID NO: 289175 - DNA, 20 bp, human
gccagccaatcattttattg

SEQ ID NO: 289176 - DNA, 20 bp, human
gtcactgtgaggtaagatgg

SEQ ID NO: 289177 - DNA, 20 bp, human
ggatcctggctagcagacta

SEQ ID NO: 289178 - DNA, 20 bp, human
gaacaaggacttgtggatcc

SEQ ID NO: 289179 - DNA, 20 bp, human
gcaaccctagtctgctagcc

SEQ ID NO: 289180 - DNA, 20 bp, human
gattgtgtgggtctgttgta

SEQ ID NO: 289181 - DNA, 20 bp, human
gaacacttcatgtattgtgt

SEQ ID NO: 289182 - DNA, 20 bp, human
gacatcactgtgaggtaaga

SEQ ID NO: 289183 - DNA, 20 bp, human
gaattcctgaaattaaagtt

SEQ ID NO: 289184 - DNA, 20 bp, human
gtggcatcttcactgattct

SEQ ID NO: 289185 - DNA, 20 bp, human
gcggatattctcttggccct

SEQ ID NO: 289186 - DNA, 20 bp, human
gtggggagacagagcgggtt

SEQ ID NO: 289187 - DNA, 20 bp, human
gttgaaaatcatcttttctg

SEQ ID NO: 289188 - DNA, 20 bp, human
gaggtggcaaacttcatcct

SEQ ID NO: 289189 - DNA, 20 bp, human
gccaacttacagagaaaaag

SEQ ID NO: 289190 - DNA, 20 bp, human
gcatgggtgttctaacgaag

SEQ ID NO: 289191 - DNA, 20 bp, human
gtctgaggaatgatatttcc

SEQ ID NO: 289192 - DNA, 20 bp, human
gtaaagctccctctcaaaca

SEQ ID NO: 289193 - DNA, 20 bp, human
gtctaacgaaggggggcctg

SEQ ID NO: 289194 - DNA, 20 bp, human
gcagagaaaaagtgggctct

SEQ ID NO: 289195 - DNA, 20 bp, human
gctgaggttgcaattactaa

SEQ ID NO: 289196 - DNA, 20 bp, human
gaatctcagtggtgtttctt

SEQ ID NO: 289197 - DNA, 20 bp, human
gcgcttgtggtttcagatgt

SEQ ID NO: 289198 - DNA, 20 bp, human
gccctgacttagaagattag

SEQ ID NO: 289199 - DNA, 20 bp, human
gcagctctgtaatgcgcttg

SEQ ID NO: 289200 - DNA, 20 bp, human
gttgcacgacaggttcacac

SEQ ID NO: 289201 - DNA, 20 bp, human
gggcagttctcaatgtcatg

SEQ ID NO: 289202 - DNA, 20 bp, human
gaccactaatcttctaagtc

SEQ ID NO: 289203 - DNA, 20 bp, human
gaatcactgaagtccatgtc

SEQ ID NO: 289204 - DNA, 20 bp, human
gaaagtgtagaaggggacaa

SEQ ID NO: 289205 - DNA, 20 bp, human
gaggaggcaagaacctgtgc

SEQ ID NO: 289206 - DNA, 20 bp, human
gcaggaggcggcagcaggta

SEQ ID NO: 289207 - DNA, 20 bp, human
ggagggggatacatttgcag

SEQ ID NO: 289208 - DNA, 20 bp, human
gaaggtggccgcagtccccc

SEQ ID NO: 289209 - DNA, 20 bp, human
gttctccgtcagcggggtgg

SEQ ID NO: 289210 - DNA, 20 bp, human
gagaacttctggaggaaagt

SEQ ID NO: 289211 - DNA, 20 bp, human
gggggcggagcaggaaacgg

SEQ ID NO: 289212 - DNA, 20 bp, human
gggacggtgtttcagcgagc

SEQ ID NO: 289213 - DNA, 20 bp, human
gtgtttcagcgagcaggagg

SEQ ID NO: 289214 - DNA, 20 bp, human
ggtggggagcgccgcaggtg

SEQ ID NO: 289215 - DNA, 20 bp, human
ggggaatcttctccgtcagc

SEQ ID NO: 289216 - DNA, 20 bp, human
ggagcggggagcgaccatcg

SEQ ID NO: 289217 - DNA, 20 bp, human
gacgcccgcgctcgggaacc

SEQ ID NO: 289218 - DNA, 20 bp, human
gtggcaggcagcgagaggcg

SEQ ID NO: 289219 - DNA, 20 bp, human
gctggctggggactcgagca

SEQ ID NO: 289220 - DNA, 20 bp, human
ggccgagctcccccgcgcgg

SEQ ID NO: 289221 - DNA, 20 bp, human
ggccccgtgccgcgctgcct

SEQ ID NO: 289222 - DNA, 20 bp, human
gaccatcgcggcttctccca

SEQ ID NO: 289223 - DNA, 20 bp, human
gggaacccgggcgagaacgc

SEQ ID NO: 289224 - DNA, 20 bp, human
gtcccgagcgcgggcgtccc

SEQ ID NO: 289225 - DNA, 20 bp, human
gtggagtgattgaggccacg

SEQ ID NO: 289226 - DNA, 20 bp, human
gaaaaaacgcctactgtgtc

SEQ ID NO: 289227 - DNA, 20 bp, human
gaggcataagcgatggggta

SEQ ID NO: 289228 - DNA, 20 bp, human
gcacagtaggcgttttttat

SEQ ID NO: 289229 - DNA, 20 bp, human
ggagtagcagacaactgaag

SEQ ID NO: 289230 - DNA, 20 bp, human
gggaactagccaataagaac

SEQ ID NO: 289231 - DNA, 20 bp, human
gccaataggcataagcgatg

SEQ ID NO: 289232 - DNA, 20 bp, human
gataagcgatggggtaaggc

SEQ ID NO: 289233 - DNA, 20 bp, human
gaactgaagaggcgtcttgc

SEQ ID NO: 289234 - DNA, 20 bp, human
gaggcgggagccaatcgcac

SEQ ID NO: 289235 - DNA, 20 bp, human
gctatagaaccagttcttat

SEQ ID NO: 289236 - DNA, 20 bp, human
gaggggcgaaaagagataag

SEQ ID NO: 289237 - DNA, 20 bp, human
gaggtgcgggaacacgtgac

SEQ ID NO: 289238 - DNA, 20 bp, human
gaggcccaacccaaatggga

SEQ ID NO: 289239 - DNA, 20 bp, human
ggacgcaggcccaacccaaa

SEQ ID NO: 289240 - DNA, 20 bp, human
gaggactcccagtacggcaa

SEQ ID NO: 289241 - DNA, 20 bp, human
gggcgaaaagagataagggg

SEQ ID NO: 289242 - DNA, 20 bp, human
gcgcaacgcggcgtcaaagg

SEQ ID NO: 289243 - DNA, 20 bp, human
gcctccctcccatttgggtt

SEQ ID NO: 289244 - DNA, 20 bp, human
gaggcgcaacgcggcgtcaa

SEQ ID NO: 289245 - DNA, 20 bp, human
ggatgcaaggcaagcgtcag

SEQ ID NO: 289246 - DNA, 20 bp, human
gcgcgcctggctaaactcga

SEQ ID NO: 289247 - DNA, 20 bp, human
gaaccaaagcgtgacagcca

SEQ ID NO: 289248 - DNA, 20 bp, human
gacccctggctgtcacgctt

SEQ ID NO: 289249 - DNA, 20 bp, human
gtagccaggcgcggctagaa

SEQ ID NO: 289250 - DNA, 20 bp, human
gagacctgccagaaccgacc

SEQ ID NO: 289251 - DNA, 20 bp, human
gcagccaggggttgctagag

SEQ ID NO: 289252 - DNA, 20 bp, human
gccaaggcccgcggctactg

SEQ ID NO: 289253 - DNA, 20 bp, human
gcgcggctagaagggcaggg

SEQ ID NO: 289254 - DNA, 20 bp, human
gtcgaacatgagggtcggga

SEQ ID NO: 289255 - DNA, 20 bp, human
ggctgtcacgctttggtttc

SEQ ID NO: 289256 - DNA, 20 bp, human
gcgcgcgcagccctctgggg

SEQ ID NO: 289257 - DNA, 20 bp, human
gaaacaccgcggggcccaga

SEQ ID NO: 289258 - DNA, 20 bp, human
ggtggcccggccgccccaga

SEQ ID NO: 289259 - DNA, 20 bp, human
gggcccggggttcgccaagg

SEQ ID NO: 289260 - DNA, 20 bp, human
gaggggcccggggttcgcca

SEQ ID NO: 289261 - DNA, 20 bp, human
gcgtccgcccggctcgcagt

SEQ ID NO: 289262 - DNA, 20 bp, human
gagcccgcgcgcagccctct

SEQ ID NO: 289263 - DNA, 20 bp, human
gcgcgccccgactgcgagcc

SEQ ID NO: 289264 - DNA, 20 bp, human
gagtcccggacgccaccaat

SEQ ID NO: 289265 - DNA, 20 bp, human
gcgggcggacggcgccgtct

SEQ ID NO: 289266 - DNA, 20 bp, human
ggaggcggggtctatgaggg

SEQ ID NO: 289267 - DNA, 20 bp, human
gggctcctgaagccgctgag

SEQ ID NO: 289268 - DNA, 20 bp, human
gggggaggcggggtctatga

SEQ ID NO: 289269 - DNA, 20 bp, human
ggaggcggccagtagaggca

SEQ ID NO: 289270 - DNA, 20 bp, human
gcgactgtgcgcatgcgcat

SEQ ID NO: 289271 - DNA, 20 bp, human
gggtgggcccccaaaggtct

SEQ ID NO: 289272 - DNA, 20 bp, human
gagtagaggcaaggctcttt

SEQ ID NO: 289273 - DNA, 20 bp, human
ggcggaaggtgggcccccaa

SEQ ID NO: 289274 - DNA, 20 bp, human
gcacgcccctcagcggcttc

SEQ ID NO: 289275 - DNA, 20 bp, human
ggcctccccttgcctttcat

SEQ ID NO: 289276 - DNA, 20 bp, human
gcctccagtgttaacccaat

SEQ ID NO: 289277 - DNA, 20 bp, human
gactggaggctctaagatgg

SEQ ID NO: 289278 - DNA, 20 bp, human
gctcgcggcaacactaccgc

SEQ ID NO: 289279 - DNA, 20 bp, human
gggaggcgggagtttggcac

SEQ ID NO: 289280 - DNA, 20 bp, human
gggctctaggacccctcctc

SEQ ID NO: 289281 - DNA, 20 bp, human
gcgacctaagagctggtcta

SEQ ID NO: 289282 - DNA, 20 bp, human
gggacccctcctctggaaac

SEQ ID NO: 289283 - DNA, 20 bp, human
gactgcagacccagtactcg

SEQ ID NO: 289284 - DNA, 20 bp, human
ggttacgagagccgcggttg

SEQ ID NO: 289285 - DNA, 20 bp, human
ggttcctattgggttaacac

SEQ ID NO: 289286 - DNA, 20 bp, human
gtcgggctcaaaatgcggcg

SEQ ID NO: 289287 - DNA, 20 bp, human
gaatgcggcgtggatctgaa

SEQ ID NO: 289288 - DNA, 20 bp, human
gctgcgcggggacttccccc

SEQ ID NO: 289289 - DNA, 20 bp, human
gccggcggaaaactggtctc

SEQ ID NO: 289290 - DNA, 20 bp, human
gccagcgcgcgacggggcag

SEQ ID NO: 289291 - DNA, 20 bp, human
ggggccggggccgactccca

SEQ ID NO: 289292 - DNA, 20 bp, human
gtccgcccccggcggaaaac

SEQ ID NO: 289293 - DNA, 20 bp, human
gcggcgggtggggggctgtg

SEQ ID NO: 289294 - DNA, 20 bp, human
gggagcttgccgccggcgga

SEQ ID NO: 289295 - DNA, 20 bp, human
gagaccccgccctccgccgg

SEQ ID NO: 289296 - DNA, 20 bp, human
gggcgcgaaggaggcgaaaa

SEQ ID NO: 289297 - DNA, 20 bp, human
gcccgggcgcgacccggaaa

SEQ ID NO: 289298 - DNA, 20 bp, human
gtccgcggctcttagagggt

SEQ ID NO: 289299 - DNA, 20 bp, human
ggagtcggggacggtagaag

SEQ ID NO: 289300 - DNA, 20 bp, human
gcgactccgcggctcttaga

SEQ ID NO: 289301 - DNA, 20 bp, human
gtctaccgtccccgactccg

SEQ ID NO: 289302 - DNA, 20 bp, human
gcggcgcaccggaagcacag

SEQ ID NO: 289303 - DNA, 20 bp, human
gcaggcgattggcgcgaagg

SEQ ID NO: 289304 - DNA, 20 bp, human
gctgcggaaacgccaactcc

SEQ ID NO: 289305 - DNA, 20 bp, human
gcgggctgcaggtccttatc

SEQ ID NO: 289306 - DNA, 20 bp, human
gcagaggcgtggtcccaccc

SEQ ID NO: 289307 - DNA, 20 bp, human
gtggtcccaccctggccaat

SEQ ID NO: 289308 - DNA, 20 bp, human
gggggtagaagcaccggagg

SEQ ID NO: 289309 - DNA, 20 bp, human
gacgcgagatcccagtgcag

SEQ ID NO: 289310 - DNA, 20 bp, human
gtgggaccacgcctctgcac

SEQ ID NO: 289311 - DNA, 20 bp, human
gacttcccattggccagggt

SEQ ID NO: 289312 - DNA, 20 bp, human
ggagggggtagaagcaccgg

SEQ ID NO: 289313 - DNA, 20 bp, human
gaaaccgcgcggaaccgcct

SEQ ID NO: 289314 - DNA, 20 bp, human
gttcgcgtttgcgagggagg

SEQ ID NO: 289315 - DNA, 20 bp, human
ggcctcttcagctcttgcgg

SEQ ID NO: 289316 - DNA, 20 bp, human
gccggcagggcgttctcctt

SEQ ID NO: 289317 - DNA, 20 bp, human
gcagtctatcggttatccca

SEQ ID NO: 289318 - DNA, 20 bp, human
gggagaacgccctgccggaa

SEQ ID NO: 289319 - DNA, 20 bp, human
gttaagatggcgaatagggc

SEQ ID NO: 289320 - DNA, 20 bp, human
gggaccatcttggttgaggg

SEQ ID NO: 289321 - DNA, 20 bp, human
gtcaaggcgattggccattc

SEQ ID NO: 289322 - DNA, 20 bp, human
ggacgaggatggagaagcct

SEQ ID NO: 289323 - DNA, 20 bp, human
gggcgtggggatccccagat

SEQ ID NO: 289324 - DNA, 20 bp, human
gatagggcggggacatctca

SEQ ID NO: 289325 - DNA, 20 bp, human
gctgtcctgccaaactgcgg

SEQ ID NO: 289326 - DNA, 20 bp, human
ggaacccggagggtgcggtg

SEQ ID NO: 289327 - DNA, 20 bp, human
gagcgcccgctgaacccgga

SEQ ID NO: 289328 - DNA, 20 bp, human
gcgccctgcgagcctctgcc

SEQ ID NO: 289329 - DNA, 20 bp, human
gccgctgaacccggagggtg

SEQ ID NO: 289330 - DNA, 20 bp, human
gtccagcgcgggtcaggacc

SEQ ID NO: 289331 - DNA, 20 bp, human
gaaagcaaccacgccccctc

SEQ ID NO: 289332 - DNA, 20 bp, human
gccatgctccagcgcgggtc

SEQ ID NO: 289333 - DNA, 20 bp, human
gcctccggaagagacgagtg

SEQ ID NO: 289334 - DNA, 20 bp, human
gggaaaccgtgaatgaatgg

SEQ ID NO: 289335 - DNA, 20 bp, human
gcggcctggcagaggctcgc

SEQ ID NO: 289336 - DNA, 20 bp, human
ggcggggccgggagcgtcaa

SEQ ID NO: 289337 - DNA, 20 bp, human
ggcggggccgagctctgcga

SEQ ID NO: 289338 - DNA, 20 bp, human
gggccgggagcgtcaagggg

SEQ ID NO: 289339 - DNA, 20 bp, human
gagcagcaacgggtgcgggg

SEQ ID NO: 289340 - DNA, 20 bp, human
gcggggctggaggtaaagcg

SEQ ID NO: 289341 - DNA, 20 bp, human
gaggagcagcaacgggtgcg

SEQ ID NO: 289342 - DNA, 20 bp, human
gcccggctgcgccccgtacc

SEQ ID NO: 289343 - DNA, 20 bp, human
gtacggggcgcagccgggag

SEQ ID NO: 289344 - DNA, 20 bp, human
gatgctgcaccacaggggcg

SEQ ID NO: 289345 - DNA, 20 bp, human
gagggtggggagcggaaagc

SEQ ID NO: 289346 - DNA, 20 bp, human
gaaccccaccccaaacccgg

SEQ ID NO: 289347 - DNA, 20 bp, human
ggcgggccgaagggtgtaaa

SEQ ID NO: 289348 - DNA, 20 bp, human
gtggcccccgggtttggggt

SEQ ID NO: 289349 - DNA, 20 bp, human
gggctcctggcccccgggtt

SEQ ID NO: 289350 - DNA, 20 bp, human
gttggggtggggttctcggt

SEQ ID NO: 289351 - DNA, 20 bp, human
ggccctacgggagacagtga

SEQ ID NO: 289352 - DNA, 20 bp, human
gacccggaagcagatgccgg

SEQ ID NO: 289353 - DNA, 20 bp, human
ggcgcggcgtggcagggttg

SEQ ID NO: 289354 - DNA, 20 bp, human
gctctggctgcaactcgcga

SEQ ID NO: 289355 - DNA, 20 bp, human
gttgcagccagaggccctca

SEQ ID NO: 289356 - DNA, 20 bp, human
gcccgccccgccccaagggg

SEQ ID NO: 289357 - DNA, 20 bp, human
gggcgagcagcaatccgcac

SEQ ID NO: 289358 - DNA, 20 bp, human
gcgaggtgaaaggggagcgt

SEQ ID NO: 289359 - DNA, 20 bp, human
ggggagcgtgggtgtgtatc

SEQ ID NO: 289360 - DNA, 20 bp, human
gagagctgggcacctcccct

SEQ ID NO: 289361 - DNA, 20 bp, human
gtgggcacctccccttgggg

SEQ ID NO: 289362 - DNA, 20 bp, human
gtacggccgcgaggtgaaag

SEQ ID NO: 289363 - DNA, 20 bp, human
gtgagctgccttccttggtc

SEQ ID NO: 289364 - DNA, 20 bp, human
gcaggcgcgcggggcggcgt

SEQ ID NO: 289365 - DNA, 20 bp, human
gttcccacccagaccaagga

SEQ ID NO: 289366 - DNA, 20 bp, human
gtccgcccgcgccgcacaaa

SEQ ID NO: 289367 - DNA, 20 bp, human
gccgcaagcccggaccgggt

SEQ ID NO: 289368 - DNA, 20 bp, human
gcaagcccggaccgggtagg

SEQ ID NO: 289369 - DNA, 20 bp, human
gtgagccctttgtgcggcgc

SEQ ID NO: 289370 - DNA, 20 bp, human
gccggaccgggtaggaggtg

SEQ ID NO: 289371 - DNA, 20 bp, human
gttccgcgggaggggcgaga

SEQ ID NO: 289372 - DNA, 20 bp, human
ggaccccgcaagcccggacc

SEQ ID NO: 289373 - DNA, 20 bp, human
ggggctgcgggggagagtac

SEQ ID NO: 289374 - DNA, 20 bp, human
gcgggggagagtaccgggtc

SEQ ID NO: 289375 - DNA, 20 bp, human
gggcggcggtttccgcggga

SEQ ID NO: 289376 - DNA, 20 bp, human
gagacactggaaggtccgga

SEQ ID NO: 289377 - DNA, 20 bp, human
gttcagcgagggtacatcgg

SEQ ID NO: 289378 - DNA, 20 bp, human
gcatctgcgtagcagcgccg

SEQ ID NO: 289379 - DNA, 20 bp, human
gagggtacatcgggggatga

SEQ ID NO: 289380 - DNA, 20 bp, human
gctgggctccccgctctccc

SEQ ID NO: 289381 - DNA, 20 bp, human
gcccatcccagattcagcga

SEQ ID NO: 289382 - DNA, 20 bp, human
gaccctcgctgaatctggga

SEQ ID NO: 289383 - DNA, 20 bp, human
ggggaatccgggagtcgact

SEQ ID NO: 289384 - DNA, 20 bp, human
ggggagaggtgtccctacac

SEQ ID NO: 289385 - DNA, 20 bp, human
gatgtaccctcgctgaatct

SEQ ID NO: 289386 - DNA, 20 bp, human
ggaacctacccgcctcgctg

SEQ ID NO: 289387 - DNA, 20 bp, human
ggaggtcctgcggggagtgt

SEQ ID NO: 289388 - DNA, 20 bp, human
ggcgcgcgacgctgacgtca

SEQ ID NO: 289389 - DNA, 20 bp, human
gtacccgcctcgctgcggcg

SEQ ID NO: 289390 - DNA, 20 bp, human
gcgcagcgcagtgacgaaat

SEQ ID NO: 289391 - DNA, 20 bp, human
gcgcccccgccgcagcgagg

SEQ ID NO: 289392 - DNA, 20 bp, human
ggaactggccgaggtcctgc

SEQ ID NO: 289393 - DNA, 20 bp, human
gcatagtggccttgtcactg

SEQ ID NO: 289394 - DNA, 20 bp, human
ggcgcagtgacgaaatcggc

SEQ ID NO: 289395 - DNA, 20 bp, human
ggtcagggcgtagtgcgcgc

SEQ ID NO: 289396 - DNA, 20 bp, human
gagaataaggctgacagtta

SEQ ID NO: 289397 - DNA, 20 bp, human
gttctgccaaacagagaata

SEQ ID NO: 289398 - DNA, 20 bp, human
gctctctgtgtcactgtaac

SEQ ID NO: 289399 - DNA, 20 bp, human
gtaagcagagattacacctg

SEQ ID NO: 289400 - DNA, 20 bp, human
gcatctgtcagcctagctcc

SEQ ID NO: 289401 - DNA, 20 bp, human
gcagaaggttaatgagataa

SEQ ID NO: 289402 - DNA, 20 bp, human
ggagacagtttcgctatctg

SEQ ID NO: 289403 - DNA, 20 bp, human
gtacagtgacacagagagcc

SEQ ID NO: 289404 - DNA, 20 bp, human
gtgtggagactaatacatat

SEQ ID NO: 289405 - DNA, 20 bp, human
gtgacagatgctcctccaga

SEQ ID NO: 289406 - DNA, 20 bp, human
gttagtggactgcttgttaa

SEQ ID NO: 289407 - DNA, 20 bp, human
gtgaaacacattattcttag

SEQ ID NO: 289408 - DNA, 20 bp, human
gggactgcttgttaaaggca

SEQ ID NO: 289409 - DNA, 20 bp, human
gttctgaatctgttagttct

SEQ ID NO: 289410 - DNA, 20 bp, human
gagctctgtattattgaaat

SEQ ID NO: 289411 - DNA, 20 bp, human
gtcatggtagagctaatgtg

SEQ ID NO: 289412 - DNA, 20 bp, human
gataagctaattagagcaga

SEQ ID NO: 289413 - DNA, 20 bp, human
gtaggtagatatagtcagtc

SEQ ID NO: 289414 - DNA, 20 bp, human
gtccttccttacgtataaaa

SEQ ID NO: 289415 - DNA, 20 bp, human
gctcatgtagataaacacac

SEQ ID NO: 289416 - DNA, 20 bp, human
ggacctggggcgccgggaca

SEQ ID NO: 289417 - DNA, 20 bp, human
ggcttcggaagtgactcgag

SEQ ID NO: 289418 - DNA, 20 bp, human
gaaggggggcatccaggagt

SEQ ID NO: 289419 - DNA, 20 bp, human
ggctgcgcgcgcgacgacct

SEQ ID NO: 289420 - DNA, 20 bp, human
ggggagaagcgctgcggaaa

SEQ ID NO: 289421 - DNA, 20 bp, human
gtcggaagtgactcgagcgg

SEQ ID NO: 289422 - DNA, 20 bp, human
gccgaagcagtcgattcttg

SEQ ID NO: 289423 - DNA, 20 bp, human
gctcctgctcagagtctggc

SEQ ID NO: 289424 - DNA, 20 bp, human
gatcccggcaccatgagctt

SEQ ID NO: 289425 - DNA, 20 bp, human
ggtcgtcgcgcgcgcagctg

SEQ ID NO: 289426 - DNA, 20 bp, human
ggggaggcgggctccaagga

SEQ ID NO: 289427 - DNA, 20 bp, human
ggggacagccgccactgacg

SEQ ID NO: 289428 - DNA, 20 bp, human
gcagccgccactgacgggga

SEQ ID NO: 289429 - DNA, 20 bp, human
gggcaaccgtcctccctcct

SEQ ID NO: 289430 - DNA, 20 bp, human
gcacctgcacgtaaacagcc

SEQ ID NO: 289431 - DNA, 20 bp, human
ggagggagatccggacagac

SEQ ID NO: 289432 - DNA, 20 bp, human
gccccgggcggggagagtcg

SEQ ID NO: 289433 - DNA, 20 bp, human
gcctgggaaaagtgggctgt

SEQ ID NO: 289434 - DNA, 20 bp, human
ggccctggctgtttacgtgc

SEQ ID NO: 289435 - DNA, 20 bp, human
gagatccggacagaccggtg

SEQ ID NO: 289436 - DNA, 20 bp, human
gaagaacagggaaacgtcgg

SEQ ID NO: 289437 - DNA, 20 bp, human
gcagacgccgcaacccagga

SEQ ID NO: 289438 - DNA, 20 bp, human
ggcccagcgagcgggaacgt

SEQ ID NO: 289439 - DNA, 20 bp, human
gccgagctgcggacgcagaa

SEQ ID NO: 289440 - DNA, 20 bp, human
gggtacgcgcggtcccggga

SEQ ID NO: 289441 - DNA, 20 bp, human
gcaggcgtctgcaaccctcc

SEQ ID NO: 289442 - DNA, 20 bp, human
gcgggcagcgcgagctgggg

SEQ ID NO: 289443 - DNA, 20 bp, human
gcccctggacgcgcctccaa

SEQ ID NO: 289444 - DNA, 20 bp, human
gttcccgtcgccgccgttgg

SEQ ID NO: 289445 - DNA, 20 bp, human
ggccgttggaggcgcgtcca

SEQ ID NO: 289446 - DNA, 20 bp, human
gcagcacccggaagctgagg

SEQ ID NO: 289447 - DNA, 20 bp, human
ggggactaagaggcggggaa

SEQ ID NO: 289448 - DNA, 20 bp, human
gaatctgcgggactaagagg

SEQ ID NO: 289449 - DNA, 20 bp, human
gagcaatctgcgggactaag

SEQ ID NO: 289450 - DNA, 20 bp, human
ggtcccggcgagcactgcga

SEQ ID NO: 289451 - DNA, 20 bp, human
gtagtcccgcagattgctag

SEQ ID NO: 289452 - DNA, 20 bp, human
ggacctggaactacgagtcc

SEQ ID NO: 289453 - DNA, 20 bp, human
ggtggatatggccaatagga

SEQ ID NO: 289454 - DNA, 20 bp, human
gccgcagcacccggaagctg

SEQ ID NO: 289455 - DNA, 20 bp, human
gaggaagtagatccccgcct

SEQ ID NO: 289456 - DNA, 20 bp, human
ggggcggccaggttattcac

SEQ ID NO: 289457 - DNA, 20 bp, human
ggggacggggcggacagtgg

SEQ ID NO: 289458 - DNA, 20 bp, human
gcggaggataggggtgtagg

SEQ ID NO: 289459 - DNA, 20 bp, human
gccactgtggccggtccctg

SEQ ID NO: 289460 - DNA, 20 bp, human
ggtgccgccccgcccgtcag

SEQ ID NO: 289461 - DNA, 20 bp, human
gtacacccctatcctccggt

SEQ ID NO: 289462 - DNA, 20 bp, human
ggtccctgagggcgctttaa

SEQ ID NO: 289463 - DNA, 20 bp, human
gggaccggccacagtgggcg

SEQ ID NO: 289464 - DNA, 20 bp, human
gcgcccgtcagcggccacgt

SEQ ID NO: 289465 - DNA, 20 bp, human
gaccccttaaagcgccctca

SEQ ID NO: 289466 - DNA, 20 bp, human
ggctccaggccggccctcgc

SEQ ID NO: 289467 - DNA, 20 bp, human
gccagggcctgggacggtga

SEQ ID NO: 289468 - DNA, 20 bp, human
gggcggggacgaagagtcag

SEQ ID NO: 289469 - DNA, 20 bp, human
ggacagcgtcagggccgctg

SEQ ID NO: 289470 - DNA, 20 bp, human
gacggtgaggggcgtgaatg

SEQ ID NO: 289471 - DNA, 20 bp, human
gcgcccgctgggaaacgcag

SEQ ID NO: 289472 - DNA, 20 bp, human
gccacagagcagtataagta

SEQ ID NO: 289473 - DNA, 20 bp, human
gccgctggggtgtggacggc

SEQ ID NO: 289474 - DNA, 20 bp, human
gcaaggccacgcccccgcga

SEQ ID NO: 289475 - DNA, 20 bp, human
gtttccagaggcgagggtcg

SEQ ID NO: 289476 - DNA, 20 bp, human
gtggcctccgccctccaaat

SEQ ID NO: 289477 - DNA, 20 bp, human
gcccgagagccgccgcctat

SEQ ID NO: 289478 - DNA, 20 bp, human
ggccgtgctcttccgccctg

SEQ ID NO: 289479 - DNA, 20 bp, human
ggaatcgccgatttggaggg

SEQ ID NO: 289480 - DNA, 20 bp, human
gcggcgattcccataggcgg

SEQ ID NO: 289481 - DNA, 20 bp, human
gtgaacgtcttcgggtcgct

SEQ ID NO: 289482 - DNA, 20 bp, human
gagcgagaagaaccaatcca

SEQ ID NO: 289483 - DNA, 20 bp, human
ggagaaccaaccacaccgca

SEQ ID NO: 289484 - DNA, 20 bp, human
gtgggaatcgccgatttgga

SEQ ID NO: 289485 - DNA, 20 bp, human
gttccgccctgcggtgtggt

SEQ ID NO: 289486 - DNA, 20 bp, human
ggcagtggggatcccctcgg

SEQ ID NO: 289487 - DNA, 20 bp, human
ggtagcatctggggactccg

SEQ ID NO: 289488 - DNA, 20 bp, human
gcaggggcggggcgaaaccg

SEQ ID NO: 289489 - DNA, 20 bp, human
gtagcgggaggctctccgtg

SEQ ID NO: 289490 - DNA, 20 bp, human
gcgggagaatgcgaaccctc

SEQ ID NO: 289491 - DNA, 20 bp, human
gacggcactcgtagcatctg

SEQ ID NO: 289492 - DNA, 20 bp, human
gacggagggtgactggggac

SEQ ID NO: 289493 - DNA, 20 bp, human
gaaccctccggtaggcggta

SEQ ID NO: 289494 - DNA, 20 bp, human
ggaggggatccccactgctc

SEQ ID NO: 289495 - DNA, 20 bp, human
gagaatgcgaaccctccggt

SEQ ID NO: 289496 - DNA, 20 bp, human
gagcgcgccaaccctcgctg

SEQ ID NO: 289497 - DNA, 20 bp, human
ggttcgcccccgtgcctctg

SEQ ID NO: 289498 - DNA, 20 bp, human
ggggccggcagcccacaacg

SEQ ID NO: 289499 - DNA, 20 bp, human
ggcccggagctgctattggt

SEQ ID NO: 289500 - DNA, 20 bp, human
ggcgccaaccctcgctgagg

SEQ ID NO: 289501 - DNA, 20 bp, human
ggctagcggaggcgccatat

SEQ ID NO: 289502 - DNA, 20 bp, human
gagcagcacccgctcgactc

SEQ ID NO: 289503 - DNA, 20 bp, human
ggcgagggttggcgcgctgg

SEQ ID NO: 289504 - DNA, 20 bp, human
gcgtgcgtcaggggggtcga

SEQ ID NO: 289505 - DNA, 20 bp, human
gagcggaggcgccatattgg

SEQ ID NO: 289506 - DNA, 20 bp, human
gacgaccgcccacagtgagg

SEQ ID NO: 289507 - DNA, 20 bp, human
ggaaaagtttcagtgtcggg

SEQ ID NO: 289508 - DNA, 20 bp, human
gaccggcggtaatatagtaa

SEQ ID NO: 289509 - DNA, 20 bp, human
gggcggtaatatagtaaggg

SEQ ID NO: 289510 - DNA, 20 bp, human
ggagacaggtatgacgtcac

SEQ ID NO: 289511 - DNA, 20 bp, human
ggcgtcctggggtgtctgta

SEQ ID NO: 289512 - DNA, 20 bp, human
ggtcgtggctaccatgcaaa

SEQ ID NO: 289513 - DNA, 20 bp, human
ggctacagccgcctcactgt

SEQ ID NO: 289514 - DNA, 20 bp, human
gacagccgcctcactgtggg

SEQ ID NO: 289515 - DNA, 20 bp, human
gtgtctgtaagggcggaagc

SEQ ID NO: 289516 - DNA, 20 bp, human
gccgcccgccggaagctgaa

SEQ ID NO: 289517 - DNA, 20 bp, human
gcgggcggaggttgtggcag

SEQ ID NO: 289518 - DNA, 20 bp, human
gacccagggccgcagcggat

SEQ ID NO: 289519 - DNA, 20 bp, human
ggggtcgctgacaggtgcgg

SEQ ID NO: 289520 - DNA, 20 bp, human
gcagggccgcagcggatcgg

SEQ ID NO: 289521 - DNA, 20 bp, human
gcaggggtcgctgacaggtg

SEQ ID NO: 289522 - DNA, 20 bp, human
ggcaggacccagggccgcag

SEQ ID NO: 289523 - DNA, 20 bp, human
gcgggcagcgagcaggaccc

SEQ ID NO: 289524 - DNA, 20 bp, human
gccgggagcaggggtcgcgt

SEQ ID NO: 289525 - DNA, 20 bp, human
gaggacgggcgtgaggtccc

SEQ ID NO: 289526 - DNA, 20 bp, human
gctggcgggagtgggagata

SEQ ID NO: 289527 - DNA, 20 bp, human
gaggggcaactcggactgtg

SEQ ID NO: 289528 - DNA, 20 bp, human
gtctctgacgcagatgtctg

SEQ ID NO: 289529 - DNA, 20 bp, human
ggagtgggagataaggctca

SEQ ID NO: 289530 - DNA, 20 bp, human
gtggggcgtggaaaggactg

SEQ ID NO: 289531 - DNA, 20 bp, human
gcatctgcgtcagagatagg

SEQ ID NO: 289532 - DNA, 20 bp, human
gataggaggtctcaatgcca

SEQ ID NO: 289533 - DNA, 20 bp, human
gccactcccgccagggatgt

SEQ ID NO: 289534 - DNA, 20 bp, human
gcggactgtggggcgtggaa

SEQ ID NO: 289535 - DNA, 20 bp, human
gggtctcaatgccacgggca

SEQ ID NO: 289536 - DNA, 20 bp, human
gctggcttctgagacactac

SEQ ID NO: 289537 - DNA, 20 bp, human
gggaatcagcatgacatcag

SEQ ID NO: 289538 - DNA, 20 bp, human
ggagggctggggctttgttt

SEQ ID NO: 289539 - DNA, 20 bp, human
ggtaccactgaaacagagga

SEQ ID NO: 289540 - DNA, 20 bp, human
gcacacgtctcgttatattc

SEQ ID NO: 289541 - DNA, 20 bp, human
gctggggctttgtttgggat

SEQ ID NO: 289542 - DNA, 20 bp, human
ggtaagttggttggggtcgg

SEQ ID NO: 289543 - DNA, 20 bp, human
gtcctagccagaggtttcac

SEQ ID NO: 289544 - DNA, 20 bp, human
gagtgtaagttggttggggt

SEQ ID NO: 289545 - DNA, 20 bp, human
gttcataattcattatctaa

SEQ ID NO: 289546 - DNA, 20 bp, human
gttcccgcgcggcagggaag

SEQ ID NO: 289547 - DNA, 20 bp, human
ggcgccccgagacgcccgtg

SEQ ID NO: 289548 - DNA, 20 bp, human
gagggctgccgccggctcgc

SEQ ID NO: 289549 - DNA, 20 bp, human
gccgggcggggcggaggtcg

SEQ ID NO: 289550 - DNA, 20 bp, human
gccgccgggagggctgccgc

SEQ ID NO: 289551 - DNA, 20 bp, human
gccctccccctgcgagccgg

SEQ ID NO: 289552 - DNA, 20 bp, human
ggagaaggctgcagatgccg

SEQ ID NO: 289553 - DNA, 20 bp, human
gcccccgacgcggaaaggat

SEQ ID NO: 289554 - DNA, 20 bp, human
gtgccgcgcgggaacccccg

SEQ ID NO: 289555 - DNA, 20 bp, human
ggagccggcggcagccctcc

SEQ ID NO: 289556 - DNA, 20 bp, human
gtcagtgaaagtacagagtg

SEQ ID NO: 289557 - DNA, 20 bp, human
gggagactctcaaacaagaa

SEQ ID NO: 289558 - DNA, 20 bp, human
ggtctcccaacattggccca

SEQ ID NO: 289559 - DNA, 20 bp, human
gcacgtccctgggccaatgt

SEQ ID NO: 289560 - DNA, 20 bp, human
gggagaggttggtttgttta

SEQ ID NO: 289561 - DNA, 20 bp, human
gaactcctaaggtggggaaa

SEQ ID NO: 289562 - DNA, 20 bp, human
gcagcaagggtagagatctg

SEQ ID NO: 289563 - DNA, 20 bp, human
gttagggaaagacacgtccc

SEQ ID NO: 289564 - DNA, 20 bp, human
gctctcagagggaactccta

SEQ ID NO: 289565 - DNA, 20 bp, human
gggcatggctccttgttgca

SEQ ID NO: 289566 - DNA, 20 bp, human
ggggcctgaagtaggggtat

SEQ ID NO: 289567 - DNA, 20 bp, human
ggacctaccctctgagtccc

SEQ ID NO: 289568 - DNA, 20 bp, human
gtcctcctccccatcagctc

SEQ ID NO: 289569 - DNA, 20 bp, human
gggtgactgggcctgaagta

SEQ ID NO: 289570 - DNA, 20 bp, human
gtggtgaaacctgagctgat

SEQ ID NO: 289571 - DNA, 20 bp, human
gacccccatacccctacttc

SEQ ID NO: 289572 - DNA, 20 bp, human
gggggctaggacagggatga

SEQ ID NO: 289573 - DNA, 20 bp, human
gctgcccatcaggcccctgc

SEQ ID NO: 289574 - DNA, 20 bp, human
gactcagagggtaggtcggc

SEQ ID NO: 289575 - DNA, 20 bp, human
gagaaagactagaggtatga

SEQ ID NO: 289576 - DNA, 20 bp, human
gctaaagtgcgaatcacgac

SEQ ID NO: 289577 - DNA, 20 bp, human
gacgacgggcggtggccgtt

SEQ ID NO: 289578 - DNA, 20 bp, human
ggatgcaaacggtacttttg

SEQ ID NO: 289579 - DNA, 20 bp, human
gtcggctgggcctcggagga

SEQ ID NO: 289580 - DNA, 20 bp, human
gtgacagtcgaagaggctca

SEQ ID NO: 289581 - DNA, 20 bp, human
ggggcgggacggagaacacc

SEQ ID NO: 289582 - DNA, 20 bp, human
ggcctcccgccgggacccaa

SEQ ID NO: 289583 - DNA, 20 bp, human
gggcggtggccgttgggtcc

SEQ ID NO: 289584 - DNA, 20 bp, human
gcaaagagtgacagtcgaag

SEQ ID NO: 289585 - DNA, 20 bp, human
gtgcgaatcacgacgggcgg

SEQ ID NO: 289586 - DNA, 20 bp, human
gcccagagctatgacagctg

SEQ ID NO: 289587 - DNA, 20 bp, human
gctgtcatagctctggggtt

SEQ ID NO: 289588 - DNA, 20 bp, human
gaggagccatgggatgaggc

SEQ ID NO: 289589 - DNA, 20 bp, human
ggccccagctgtcatagctc

SEQ ID NO: 289590 - DNA, 20 bp, human
gcctggccctgctgcctcta

SEQ ID NO: 289591 - DNA, 20 bp, human
gaaggaaaggcatacttggg

SEQ ID NO: 289592 - DNA, 20 bp, human
gaccaccaggcgacaagatg

SEQ ID NO: 289593 - DNA, 20 bp, human
gcacgcaggtggggaaacat

SEQ ID NO: 289594 - DNA, 20 bp, human
ggacatgggttggtccctag

SEQ ID NO: 289595 - DNA, 20 bp, human
gagccacactgacacacctg

SEQ ID NO: 289596 - DNA, 20 bp, human
gggcgaagattgccgaaagg

SEQ ID NO: 289597 - DNA, 20 bp, human
gcgtgcgaaccggggttcga

SEQ ID NO: 289598 - DNA, 20 bp, human
ggaagattgccgaaaggcgg

SEQ ID NO: 289599 - DNA, 20 bp, human
gggcgacgagcagtgagtgt

SEQ ID NO: 289600 - DNA, 20 bp, human
gaaaagtaaccttgcatcgg

SEQ ID NO: 289601 - DNA, 20 bp, human
gagggtctcccctcgaaccc

SEQ ID NO: 289602 - DNA, 20 bp, human
gatctctttaggggaaggag

SEQ ID NO: 289603 - DNA, 20 bp, human
gactggcgaagattgccgaa

SEQ ID NO: 289604 - DNA, 20 bp, human
gacacggggagccatggcgg

SEQ ID NO: 289605 - DNA, 20 bp, human
gactcagatggcatggatca

SEQ ID NO: 289606 - DNA, 20 bp, human
gtgggctgtcccgacctcag

SEQ ID NO: 289607 - DNA, 20 bp, human
gaggtcgggacagcccaaat

SEQ ID NO: 289608 - DNA, 20 bp, human
gagcgtgccccgcacaagga

SEQ ID NO: 289609 - DNA, 20 bp, human
ggcgaagcgtgccccgcaca

SEQ ID NO: 289610 - DNA, 20 bp, human
ggagggaccggaacgttcgt

SEQ ID NO: 289611 - DNA, 20 bp, human
gcggcgtgggagcacctctg

SEQ ID NO: 289612 - DNA, 20 bp, human
gagcacctctggggctatgg

SEQ ID NO: 289613 - DNA, 20 bp, human
ggaccggaacgttcgttgga

SEQ ID NO: 289614 - DNA, 20 bp, human
gttccggtccctctgaggtc

SEQ ID NO: 289615 - DNA, 20 bp, human
gtctgaaagctagcgtgggg

SEQ ID NO: 289616 - DNA, 20 bp, human
gcgggacgggaagatgtcag

SEQ ID NO: 289617 - DNA, 20 bp, human
gtagcctgtgccgtcgggac

SEQ ID NO: 289618 - DNA, 20 bp, human
gcgctctgggcgtgggcctt

SEQ ID NO: 289619 - DNA, 20 bp, human
gtctctcggtgcaatctaaa

SEQ ID NO: 289620 - DNA, 20 bp, human
gcccagagcgcccgagtggc

SEQ ID NO: 289621 - DNA, 20 bp, human
gtggaaatccccattgatag

SEQ ID NO: 289622 - DNA, 20 bp, human
gcggagtagcctgtgccgtc

SEQ ID NO: 289623 - DNA, 20 bp, human
gactcgggcgctctgggcgt

SEQ ID NO: 289624 - DNA, 20 bp, human
gtctgggcgtgggccttggg

SEQ ID NO: 289625 - DNA, 20 bp, human
gcaggcacgtgccccaccca

SEQ ID NO: 289626 - DNA, 20 bp, human
ggctctgcctccaagatggt

SEQ ID NO: 289627 - DNA, 20 bp, human
gggaaagttgtcgtttcgga

SEQ ID NO: 289628 - DNA, 20 bp, human
gggtaggaaagttgtcgttt

SEQ ID NO: 289629 - DNA, 20 bp, human
gcctcctacagcaccactac

SEQ ID NO: 289630 - DNA, 20 bp, human
ggccggggctgtacaagaag

SEQ ID NO: 289631 - DNA, 20 bp, human
ggtcctcgcagtgcctgtag

SEQ ID NO: 289632 - DNA, 20 bp, human
gagagcaaaggggggccagg

SEQ ID NO: 289633 - DNA, 20 bp, human
gcaccactacaggcactgcg

SEQ ID NO: 289634 - DNA, 20 bp, human
gcatcttggaggcagagcaa

SEQ ID NO: 289635 - DNA, 20 bp, human
gtggctggagagtatattca

SEQ ID NO: 289636 - DNA, 20 bp, human
gctcaggggcgtcaccgcac

SEQ ID NO: 289637 - DNA, 20 bp, human
ggcacgggccgacctcccgg

SEQ ID NO: 289638 - DNA, 20 bp, human
gcggtgacgcccctgagcgc

SEQ ID NO: 289639 - DNA, 20 bp, human
gtcccgggggacactgggac

SEQ ID NO: 289640 - DNA, 20 bp, human
gggatggcgtagcagcgacg

SEQ ID NO: 289641 - DNA, 20 bp, human
gtacgccatccccagcgcag

SEQ ID NO: 289642 - DNA, 20 bp, human
gcgcggtgacgccacaaaaa

SEQ ID NO: 289643 - DNA, 20 bp, human
gctgcggcaacgtggggcga

SEQ ID NO: 289644 - DNA, 20 bp, human
gcacagccttgcagcgtctc

SEQ ID NO: 289645 - DNA, 20 bp, human
gccggcgtaccccgcgctca

SEQ ID NO: 289646 - DNA, 20 bp, human
gtggacaggaagcgcatcaa

SEQ ID NO: 289647 - DNA, 20 bp, human
gtgagagtacagatgaatgg

SEQ ID NO: 289648 - DNA, 20 bp, human
ggtggagcgcgatgattcag

SEQ ID NO: 289649 - DNA, 20 bp, human
ggactgcgggtttgacagat

SEQ ID NO: 289650 - DNA, 20 bp, human
gaggaagcgcatcaagggtg

SEQ ID NO: 289651 - DNA, 20 bp, human
gttaaaagtgaattcgtggg

SEQ ID NO: 289652 - DNA, 20 bp, human
gtactctcataggggactgc

SEQ ID NO: 289653 - DNA, 20 bp, human
ggcgcgatgattcagaggga

SEQ ID NO: 289654 - DNA, 20 bp, human
gcgggcgcgaggttaggcga

SEQ ID NO: 289655 - DNA, 20 bp, human
ggccccgcttggctcggcac

SEQ ID NO: 289656 - DNA, 20 bp, human
gagggcctcagatgcctcag

SEQ ID NO: 289657 - DNA, 20 bp, human
gcagagggcggacccagctc

SEQ ID NO: 289658 - DNA, 20 bp, human
ggatgcctcagtggatgaca

SEQ ID NO: 289659 - DNA, 20 bp, human
gcccagctcgggctggtagt

SEQ ID NO: 289660 - DNA, 20 bp, human
gggaacctagcagtaggaat

SEQ ID NO: 289661 - DNA, 20 bp, human
gaccggccctactgtctcag

SEQ ID NO: 289662 - DNA, 20 bp, human
gaagcagtcacaggataggg

SEQ ID NO: 289663 - DNA, 20 bp, human
ggcgcgagcagctcggtcac

SEQ ID NO: 289664 - DNA, 20 bp, human
gggatagggtgggatcttgt

SEQ ID NO: 289665 - DNA, 20 bp, human
gcgcccggcgtctagagcgg

SEQ ID NO: 289666 - DNA, 20 bp, human
ggaactgcaaatgtggtcag

SEQ ID NO: 289667 - DNA, 20 bp, human
gagttcatgcaagtctttac

SEQ ID NO: 289668 - DNA, 20 bp, human
ggagtgtgacttaaagccca

SEQ ID NO: 289669 - DNA, 20 bp, human
gtggctaattaaagtcactg

SEQ ID NO: 289670 - DNA, 20 bp, human
gggaagtaccttacagaaat

SEQ ID NO: 289671 - DNA, 20 bp, human
gagggtctgtaatatgagcc

SEQ ID NO: 289672 - DNA, 20 bp, human
gtggtgttccttattgacat

SEQ ID NO: 289673 - DNA, 20 bp, human
gaaatatggtatggtggcga

SEQ ID NO: 289674 - DNA, 20 bp, human
gatgcgtgactatgcacaca

SEQ ID NO: 289675 - DNA, 20 bp, human
gaatccaacccatgtcaata

SEQ ID NO: 289676 - DNA, 20 bp, human
ggtacccggggctgagaacc

SEQ ID NO: 289677 - DNA, 20 bp, human
gggagcgcggccgaagccag

SEQ ID NO: 289678 - DNA, 20 bp, human
ggcgctggtgacaacttctc

SEQ ID NO: 289679 - DNA, 20 bp, human
gcgcgcggggctggtaggcg

SEQ ID NO: 289680 - DNA, 20 bp, human
gaccgaagcctcagtacccg

SEQ ID NO: 289681 - DNA, 20 bp, human
gttctcagccccgggtactg

SEQ ID NO: 289682 - DNA, 20 bp, human
gtgggtcgcccacccagact

SEQ ID NO: 289683 - DNA, 20 bp, human
ggcaggttacagctcctcct

SEQ ID NO: 289684 - DNA, 20 bp, human
gggcagaggggccgcagaaa

SEQ ID NO: 289685 - DNA, 20 bp, human
gagaaaggggtcggggtacg

SEQ ID NO: 289686 - DNA, 20 bp, human
ggaggtgcggagcctgagtt

SEQ ID NO: 289687 - DNA, 20 bp, human
gggggcggagccttgaggtg

SEQ ID NO: 289688 - DNA, 20 bp, human
ggcggagcctgactcggggt

SEQ ID NO: 289689 - DNA, 20 bp, human
gcggggcggagcctgactcg

SEQ ID NO: 289690 - DNA, 20 bp, human
gggcctagatctgaacagag

SEQ ID NO: 289691 - DNA, 20 bp, human
gatctgaacagagtggggcg

SEQ ID NO: 289692 - DNA, 20 bp, human
gtgccctcagcctgagtcgg

SEQ ID NO: 289693 - DNA, 20 bp, human
gccccactctgttcagatct

SEQ ID NO: 289694 - DNA, 20 bp, human
gtcagatctaggcccaactc

SEQ ID NO: 289695 - DNA, 20 bp, human
gtggggcggagccttgctgg

SEQ ID NO: 289696 - DNA, 20 bp, human
gcatgcccgagtcaatcgtg

SEQ ID NO: 289697 - DNA, 20 bp, human
gcccgagtcaatcgtggggt

SEQ ID NO: 289698 - DNA, 20 bp, human
gccccagccctctaggtcat

SEQ ID NO: 289699 - DNA, 20 bp, human
gcctaaggggttaacacgga

SEQ ID NO: 289700 - DNA, 20 bp, human
gagggcctaaggggttaaca

SEQ ID NO: 289701 - DNA, 20 bp, human
gggaagcccagtgtacccca

SEQ ID NO: 289702 - DNA, 20 bp, human
gtctggccccatgacctaga

SEQ ID NO: 289703 - DNA, 20 bp, human
gcagcccctgcgccacatgg

SEQ ID NO: 289704 - DNA, 20 bp, human
ggtgtaccccagggcctaag

SEQ ID NO: 289705 - DNA, 20 bp, human
gatgtggcgcaggggctgtt

SEQ ID NO: 289706 - DNA, 20 bp, human
gcgtcccggaagaaacggtg

SEQ ID NO: 289707 - DNA, 20 bp, human
gggtacgcgacaattggcgg

SEQ ID NO: 289708 - DNA, 20 bp, human
gaaacggtggggattggagg

SEQ ID NO: 289709 - DNA, 20 bp, human
gcggaggcaggtatccgtcc

SEQ ID NO: 289710 - DNA, 20 bp, human
ggctccgccccaaaacagaa

SEQ ID NO: 289711 - DNA, 20 bp, human
gcggaagaaacggtggggat

SEQ ID NO: 289712 - DNA, 20 bp, human
gggccagggtacgcgacaat

SEQ ID NO: 289713 - DNA, 20 bp, human
ggtatccgtcccggaagaaa

SEQ ID NO: 289714 - DNA, 20 bp, human
gcagggtacgcgacaattgg

SEQ ID NO: 289715 - DNA, 20 bp, human
ggtaccctggccaggtaact

SEQ ID NO: 289716 - DNA, 20 bp, human
ggccggtcattccacccagg

SEQ ID NO: 289717 - DNA, 20 bp, human
gcgtcccctacaccctgcca

SEQ ID NO: 289718 - DNA, 20 bp, human
gagagccggtcattccaccc

SEQ ID NO: 289719 - DNA, 20 bp, human
ggccgtgctgacacccacgt

SEQ ID NO: 289720 - DNA, 20 bp, human
ggggagagcagaaggctcgg

SEQ ID NO: 289721 - DNA, 20 bp, human
gaagagagccgcggcagccg

SEQ ID NO: 289722 - DNA, 20 bp, human
gccgctgggagtctctaaag

SEQ ID NO: 289723 - DNA, 20 bp, human
gcaggacagagcaaacttga

SEQ ID NO: 289724 - DNA, 20 bp, human
gcatgggtgggccagagaag

SEQ ID NO: 289725 - DNA, 20 bp, human
gaggctcgggggcctgtcta

SEQ ID NO: 289726 - DNA, 20 bp, human
gcgaggcaggtgcaggtccc

SEQ ID NO: 289727 - DNA, 20 bp, human
gaccgcacccaggtcctctc

SEQ ID NO: 289728 - DNA, 20 bp, human
gcaggtgcaggtccccggag

SEQ ID NO: 289729 - DNA, 20 bp, human
gcggcaggtcccagcgaggc

SEQ ID NO: 289730 - DNA, 20 bp, human
gcggggctgccgggttggga

SEQ ID NO: 289731 - DNA, 20 bp, human
gccggtgcggcgcagtcctc

SEQ ID NO: 289732 - DNA, 20 bp, human
ggcgccgcaccggacccgga

SEQ ID NO: 289733 - DNA, 20 bp, human
ggacctgcacctgcctcgct

SEQ ID NO: 289734 - DNA, 20 bp, human
gactgcggggctgccgggtt

SEQ ID NO: 289735 - DNA, 20 bp, human
gcacaggtgaaggtgcttga

SEQ ID NO: 289736 - DNA, 20 bp, human
gggcgggcggaaggacgaga

SEQ ID NO: 289737 - DNA, 20 bp, human
gagggaggaggaaagacccg

SEQ ID NO: 289738 - DNA, 20 bp, human
gggaggagacacccgggaga

SEQ ID NO: 289739 - DNA, 20 bp, human
ggcctgggcaagagcgggag

SEQ ID NO: 289740 - DNA, 20 bp, human
gcccggggcacccgaccggt

SEQ ID NO: 289741 - DNA, 20 bp, human
gacgccccggggcacccgac

SEQ ID NO: 289742 - DNA, 20 bp, human
ggcgggagggagctgaaagg

SEQ ID NO: 289743 - DNA, 20 bp, human
gggagaacgcgccccggcag

SEQ ID NO: 289744 - DNA, 20 bp, human
gtgccaccggtgaccacgac

SEQ ID NO: 289745 - DNA, 20 bp, human
ggaaccgcgccgagaagcag

SEQ ID NO: 289746 - DNA, 20 bp, human
gcctggaagaggccgaagca

SEQ ID NO: 289747 - DNA, 20 bp, human
gctggaacagccatggagtg

SEQ ID NO: 289748 - DNA, 20 bp, human
gggaagaggccgaagcaagg

SEQ ID NO: 289749 - DNA, 20 bp, human
gaattctcagcaggttgaaa

SEQ ID NO: 289750 - DNA, 20 bp, human
gtgcccctccctggagcaaa

SEQ ID NO: 289751 - DNA, 20 bp, human
gaacacacctgccttaaggt

SEQ ID NO: 289752 - DNA, 20 bp, human
ggtcccaactggcagcagga

SEQ ID NO: 289753 - DNA, 20 bp, human
gggacctgggccaggcagat

SEQ ID NO: 289754 - DNA, 20 bp, human
ggccggggcaagctctgagc

SEQ ID NO: 289755 - DNA, 20 bp, human
ggcctggcccaggtcccaac

SEQ ID NO: 289756 - DNA, 20 bp, human
ggacgtaagaggggcgtgtc

SEQ ID NO: 289757 - DNA, 20 bp, human
ggggttcgcggacgtaagag

SEQ ID NO: 289758 - DNA, 20 bp, human
ggcacacctcgcgtcgtctg

SEQ ID NO: 289759 - DNA, 20 bp, human
gacgagcgcaaagctgcgag

SEQ ID NO: 289760 - DNA, 20 bp, human
ggggtggtgcggttcgcaga

SEQ ID NO: 289761 - DNA, 20 bp, human
gccctcggatccctcacgag

SEQ ID NO: 289762 - DNA, 20 bp, human
ggctcccaggggtcaaacga

SEQ ID NO: 289763 - DNA, 20 bp, human
gcggggcacgctgggagctg

SEQ ID NO: 289764 - DNA, 20 bp, human
gcgcgccaggggccgtcttc

SEQ ID NO: 289765 - DNA, 20 bp, human
ggcgcaccccgggatctggg

SEQ ID NO: 289766 - DNA, 20 bp, human
ggcggcgcggggttgagcgt

SEQ ID NO: 289767 - DNA, 20 bp, human
ggccgagcgcggtacgagct

SEQ ID NO: 289768 - DNA, 20 bp, human
gctggaaaatggggatcctg

SEQ ID NO: 289769 - DNA, 20 bp, human
gccggagccgctggcccact

SEQ ID NO: 289770 - DNA, 20 bp, human
gtggcgagggccggctctgg

SEQ ID NO: 289771 - DNA, 20 bp, human
gaatggggatcctgtggcga

SEQ ID NO: 289772 - DNA, 20 bp, human
gcgcggatggccatcttaag

SEQ ID NO: 289773 - DNA, 20 bp, human
ggacgcggcagccgcaaagg

SEQ ID NO: 289774 - DNA, 20 bp, human
gcctccagccgagggcggaa

SEQ ID NO: 289775 - DNA, 20 bp, human
gagcccgcgctcccgaacgg

SEQ ID NO: 289776 - DNA, 20 bp, human
gcggcaggggttgagaggta

SEQ ID NO: 289777 - DNA, 20 bp, human
gctctgcagcagggaggacg

SEQ ID NO: 289778 - DNA, 20 bp, human
gcccgctggtcctgaggaag

SEQ ID NO: 289779 - DNA, 20 bp, human
gtgtccctgctcacagctgg

SEQ ID NO: 289780 - DNA, 20 bp, human
gtgggctcgtgaagcatgtg

SEQ ID NO: 289781 - DNA, 20 bp, human
gctgtgagcagggacaggtc

SEQ ID NO: 289782 - DNA, 20 bp, human
gagacccagcaccagggaaa

SEQ ID NO: 289783 - DNA, 20 bp, human
gtaatgacccgctggtcctg

SEQ ID NO: 289784 - DNA, 20 bp, human
ggaagaggtgctgacgacca

SEQ ID NO: 289785 - DNA, 20 bp, human
gcagggacaggtctggccac

SEQ ID NO: 289786 - DNA, 20 bp, human
gcccgctggtcctgaggaag

SEQ ID NO: 289787 - DNA, 20 bp, human
gcggcaggggttgagaggta

SEQ ID NO: 289788 - DNA, 20 bp, human
gtgtccctgctcacagctgg

SEQ ID NO: 289789 - DNA, 20 bp, human
gctgtgagcagggacaggtc

SEQ ID NO: 289790 - DNA, 20 bp, human
gagacccagcaccagggaaa

SEQ ID NO: 289791 - DNA, 20 bp, human
gtaatgacccgctggtcctg

SEQ ID NO: 289792 - DNA, 20 bp, human
ggaagaggtgctgacgacca

SEQ ID NO: 289793 - DNA, 20 bp, human
gcagggacaggtctggccac

SEQ ID NO: 289794 - DNA, 20 bp, human
gcccccaccccaggccctaa

SEQ ID NO: 289795 - DNA, 20 bp, human
gggtctggccaccgggcccc

SEQ ID NO: 289796 - DNA, 20 bp, human
gctgatgtggtcatggggaa

SEQ ID NO: 289797 - DNA, 20 bp, human
gggtgaccctagctaccctg

SEQ ID NO: 289798 - DNA, 20 bp, human
gtgggcagacgagaacctag

SEQ ID NO: 289799 - DNA, 20 bp, human
gtcgaggcccaagctggcag

SEQ ID NO: 289800 - DNA, 20 bp, human
gctggaggcggggctagctg

SEQ ID NO: 289801 - DNA, 20 bp, human
ggggctgcctgggcctactg

SEQ ID NO: 289802 - DNA, 20 bp, human
gctagccccgcctccagagt

SEQ ID NO: 289803 - DNA, 20 bp, human
gggcccccactctggaggcg

SEQ ID NO: 289804 - DNA, 20 bp, human
gacctgctgctcacccagaa

SEQ ID NO: 289805 - DNA, 20 bp, human
gggggggctgatgtggtcat

SEQ ID NO: 289806 - DNA, 20 bp, human
ggctgtggaaggtccttggg

SEQ ID NO: 289807 - DNA, 20 bp, human
gctgcaggagcgctggaatg

SEQ ID NO: 289808 - DNA, 20 bp, human
ggggagcccggtctctaatt

SEQ ID NO: 289809 - DNA, 20 bp, human
gggcaccagggtgatcgccc

SEQ ID NO: 289810 - DNA, 20 bp, human
gctgacgcgggaccaaggct

SEQ ID NO: 289811 - DNA, 20 bp, human
gaggctatttcggtgcccct

SEQ ID NO: 289812 - DNA, 20 bp, human
gggctcccgggcgatcaccc

SEQ ID NO: 289813 - DNA, 20 bp, human
gcgggactacgaggctattt

SEQ ID NO: 289814 - DNA, 20 bp, human
gagccgcgaagccgtccagg

SEQ ID NO: 289815 - DNA, 20 bp, human
ggtcaggcctaattagagac

SEQ ID NO: 289816 - DNA, 20 bp, human
gagcccgtccgcacgcggtc

SEQ ID NO: 289817 - DNA, 20 bp, human
ggcaaccaatgggaggccgg

SEQ ID NO: 289818 - DNA, 20 bp, human
gcgcactcgggcgggagcct

SEQ ID NO: 289819 - DNA, 20 bp, human
gcgcacgcggtctggtgagg

SEQ ID NO: 289820 - DNA, 20 bp, human
gcaggcgctgcggccgtccc

SEQ ID NO: 289821 - DNA, 20 bp, human
gcgcccgccggctctccgaa

SEQ ID NO: 289822 - DNA, 20 bp, human
gtacgcggccggctgggata

SEQ ID NO: 289823 - DNA, 20 bp, human
gccgccggctctccgaacgg

SEQ ID NO: 289824 - DNA, 20 bp, human
gccgcgagcccgtccgcacg

SEQ ID NO: 289825 - DNA, 20 bp, human
gggcgtgtgcgcacgtcata

SEQ ID NO: 289826 - DNA, 20 bp, human
ggaaactggaggctagcggt

SEQ ID NO: 289827 - DNA, 20 bp, human
gcaaaagggcttccggtctg

SEQ ID NO: 289828 - DNA, 20 bp, human
gaccggaagcccttttgccc

SEQ ID NO: 289829 - DNA, 20 bp, human
gaggccgcgcgcaggcgatc

SEQ ID NO: 289830 - DNA, 20 bp, human
gcctgcgagccggggcaaaa

SEQ ID NO: 289831 - DNA, 20 bp, human
gcaaccgccagtcacctcga

SEQ ID NO: 289832 - DNA, 20 bp, human
gccggtctgcgggaaactgg

SEQ ID NO: 289833 - DNA, 20 bp, human
ggggcatccgtcattaccta

SEQ ID NO: 289834 - DNA, 20 bp, human
ggccggggcaaaagggcttc

SEQ ID NO: 289835 - DNA, 20 bp, human
gtcctgctgtcaataagacg

SEQ ID NO: 289836 - DNA, 20 bp, human
gcgcccaggaaaaaggtcaa

SEQ ID NO: 289837 - DNA, 20 bp, human
gcaggaaaaaggtcaagggt

SEQ ID NO: 289838 - DNA, 20 bp, human
ggttgcccagtgctccctct

SEQ ID NO: 289839 - DNA, 20 bp, human
gtctgggagaagtacatcca

SEQ ID NO: 289840 - DNA, 20 bp, human
gttctcccagagggagcact

SEQ ID NO: 289841 - DNA, 20 bp, human
gtcaggaccgcccaggaaaa

SEQ ID NO: 289842 - DNA, 20 bp, human
gggcccaggcgcctataaag

SEQ ID NO: 289843 - DNA, 20 bp, human
gcccccagctgggacggccc

SEQ ID NO: 289844 - DNA, 20 bp, human
gaccccctttataggcgcct

SEQ ID NO: 289845 - DNA, 20 bp, human
ggcgcctgggccgtcccagc

SEQ ID NO: 289846 - DNA, 20 bp, human
ggagggagaaagttccttgt

SEQ ID NO: 289847 - DNA, 20 bp, human
gagcacattgggagcaaaga

SEQ ID NO: 289848 - DNA, 20 bp, human
gggagaaagttccttgtagg

SEQ ID NO: 289849 - DNA, 20 bp, human
ggcaaagtgcagcagcacat

SEQ ID NO: 289850 - DNA, 20 bp, human
gaagagggatatgagagtgt

SEQ ID NO: 289851 - DNA, 20 bp, human
gcctttcccacccacctaca

SEQ ID NO: 289852 - DNA, 20 bp, human
gtactcagcttttgcgtcaa

SEQ ID NO: 289853 - DNA, 20 bp, human
gaactgacctgtaagctcat

SEQ ID NO: 289854 - DNA, 20 bp, human
gaaagttccttgtaggtggg

SEQ ID NO: 289855 - DNA, 20 bp, human
gataaaaatagtattacagg

SEQ ID NO: 289856 - DNA, 20 bp, human
gataaaaacagatgccctct

SEQ ID NO: 289857 - DNA, 20 bp, human
gtgagagtgaaactcattct

SEQ ID NO: 289858 - DNA, 20 bp, human
ggccctcttggaaggcatta

SEQ ID NO: 289859 - DNA, 20 bp, human
ggagttgaggcaaagcctgg

SEQ ID NO: 289860 - DNA, 20 bp, human
gtgtcactcagtaagtagca

SEQ ID NO: 289861 - DNA, 20 bp, human
gagatgcgttgatggtatta

SEQ ID NO: 289862 - DNA, 20 bp, human
gtccataatgccttccaaga

SEQ ID NO: 289863 - DNA, 20 bp, human
gctacttactgagtgacata

SEQ ID NO: 289864 - DNA, 20 bp, human
gaggcattatggaaaactca

SEQ ID NO: 289865 - DNA, 20 bp, human
gaaacagatgccctcttgga

SEQ ID NO: 289866 - DNA, 20 bp, human
gggcgtcgccagaacttcaa

SEQ ID NO: 289867 - DNA, 20 bp, human
gggtcgaaggtagcaggccc

SEQ ID NO: 289868 - DNA, 20 bp, human
ggcggcgcgcacaaacactg

SEQ ID NO: 289869 - DNA, 20 bp, human
gccacctgagacccctgagc

SEQ ID NO: 289870 - DNA, 20 bp, human
gttcaagggaaggcgcgcgc

SEQ ID NO: 289871 - DNA, 20 bp, human
gtcaccaagcgtgagaacat

SEQ ID NO: 289872 - DNA, 20 bp, human
ggccagatcccggggtacga

SEQ ID NO: 289873 - DNA, 20 bp, human
gaaaaatgaatcaaactagg

SEQ ID NO: 289874 - DNA, 20 bp, human
ggggggtggcggggtagtga

SEQ ID NO: 289875 - DNA, 20 bp, human
gcggaattccgagcgcgtgg

SEQ ID NO: 289876 - DNA, 20 bp, human
gcccgcgcggggattacccg

SEQ ID NO: 289877 - DNA, 20 bp, human
gggcgatggggcggccaaaa

SEQ ID NO: 289878 - DNA, 20 bp, human
ggggggtcgcccggtaggtg

SEQ ID NO: 289879 - DNA, 20 bp, human
gagaagcagcagaccgtgaa

SEQ ID NO: 289880 - DNA, 20 bp, human
gcgccgggcggggcgaccag

SEQ ID NO: 289881 - DNA, 20 bp, human
gcgtgtgcctggaccgggcg

SEQ ID NO: 289882 - DNA, 20 bp, human
ggtgcggcagatgtacctga

SEQ ID NO: 289883 - DNA, 20 bp, human
ggggcgcggagccgccaaat

SEQ ID NO: 289884 - DNA, 20 bp, human
gtggggaggcgcacgtgcct

SEQ ID NO: 289885 - DNA, 20 bp, human
gccggccccgcctcccttca

SEQ ID NO: 289886 - DNA, 20 bp, human
gtcactggagtagacgaatc

SEQ ID NO: 289887 - DNA, 20 bp, human
gttctcccgtgccgattcac

SEQ ID NO: 289888 - DNA, 20 bp, human
gtccgcggagcgtcccactg

SEQ ID NO: 289889 - DNA, 20 bp, human
ggagtagacgaatctggcgg

SEQ ID NO: 289890 - DNA, 20 bp, human
gcgggctggcccggccaatc

SEQ ID NO: 289891 - DNA, 20 bp, human
gggttcgcggcgctgtgagg

SEQ ID NO: 289892 - DNA, 20 bp, human
gtagacgaatctggcggcgg

SEQ ID NO: 289893 - DNA, 20 bp, human
gcggacccagccggccacag

SEQ ID NO: 289894 - DNA, 20 bp, human
gctggagtagacgaatctgg

SEQ ID NO: 289895 - DNA, 20 bp, human
ggcccgctcccactcctgat

SEQ ID NO: 289896 - DNA, 20 bp, human
gtggggcgcgccctcggtcc

SEQ ID NO: 289897 - DNA, 20 bp, human
gggaaaaggcggcgcggatc

SEQ ID NO: 289898 - DNA, 20 bp, human
gagggagggaaagcttgcag

SEQ ID NO: 289899 - DNA, 20 bp, human
gtgaaactggaggagactcg

SEQ ID NO: 289900 - DNA, 20 bp, human
ggggactctgcgcccgggag

SEQ ID NO: 289901 - DNA, 20 bp, human
gaggaagggactctgcgccc

SEQ ID NO: 289902 - DNA, 20 bp, human
gtgcgggccgcgggaaaagg

SEQ ID NO: 289903 - DNA, 20 bp, human
ggcctccgggggtctgaaac

SEQ ID NO: 289904 - DNA, 20 bp, human
gcgcacggggcccagctgac

SEQ ID NO: 289905 - DNA, 20 bp, human
ggcgcggatctggcctagga

SEQ ID NO: 289906 - DNA, 20 bp, human
gaggggaggacaggtctgtt

SEQ ID NO: 289907 - DNA, 20 bp, human
gaggggtggagagaacggaa

SEQ ID NO: 289908 - DNA, 20 bp, human
gtggggctgcaccgccggag

SEQ ID NO: 289909 - DNA, 20 bp, human
gcaaaatacggggggagggt

SEQ ID NO: 289910 - DNA, 20 bp, human
gttggaagaagcctgtggtg

SEQ ID NO: 289911 - DNA, 20 bp, human
ggaaataaggccaaaatacg

SEQ ID NO: 289912 - DNA, 20 bp, human
ggcagccgcagcgggatttg

SEQ ID NO: 289913 - DNA, 20 bp, human
ggccccccgcctaaacagat

SEQ ID NO: 289914 - DNA, 20 bp, human
gaaggccaaaatacgggggg

SEQ ID NO: 289915 - DNA, 20 bp, human
gaaccctttgtccccaccac

SEQ ID NO: 289916 - DNA, 20 bp, human
ggccgccgacccacctggac

SEQ ID NO: 289917 - DNA, 20 bp, human
gggcgctgcaggcatcaggc

SEQ ID NO: 289918 - DNA, 20 bp, human
ggcgccgcgcgcatgtggtc

SEQ ID NO: 289919 - DNA, 20 bp, human
gcgcgcatgtggtccggtcc

SEQ ID NO: 289920 - DNA, 20 bp, human
gctgcagcgccccatggcgg

SEQ ID NO: 289921 - DNA, 20 bp, human
gggcctctcgcgcctccttc

SEQ ID NO: 289922 - DNA, 20 bp, human
gaaacagtgcggcgggaagc

SEQ ID NO: 289923 - DNA, 20 bp, human
gccggaagtcgggtcctcga

SEQ ID NO: 289924 - DNA, 20 bp, human
gggccggcgccgcgcgcatg

SEQ ID NO: 289925 - DNA, 20 bp, human
gcccgcgccgccgacccacc

SEQ ID NO: 289926 - DNA, 20 bp, human
gggcgtccccccggcgtgga

SEQ ID NO: 289927 - DNA, 20 bp, human
gggaagcggttcaactgctc

SEQ ID NO: 289928 - DNA, 20 bp, human
ggggcggtaacgaggagcca

SEQ ID NO: 289929 - DNA, 20 bp, human
ggaggctggcagagtggatc

SEQ ID NO: 289930 - DNA, 20 bp, human
ggaagtcagggagcatgcgc

SEQ ID NO: 289931 - DNA, 20 bp, human
gcggtccctgggcgtccccc

SEQ ID NO: 289932 - DNA, 20 bp, human
gaggggaccgggcggtaacg

SEQ ID NO: 289933 - DNA, 20 bp, human
gatgctccctgacttcacca

SEQ ID NO: 289934 - DNA, 20 bp, human
gccaggtcacctcgaaaatg

SEQ ID NO: 289935 - DNA, 20 bp, human
ggcgtgaccttggtgaagtc

SEQ ID NO: 289936 - DNA, 20 bp, human
gtggccgcgcctctgcgacc

SEQ ID NO: 289937 - DNA, 20 bp, human
gccggccgtcattcataatc

SEQ ID NO: 289938 - DNA, 20 bp, human
gcctctgcgaccaggtaaag

SEQ ID NO: 289939 - DNA, 20 bp, human
gtccgccggattatgaatga

SEQ ID NO: 289940 - DNA, 20 bp, human
gccagggcgggagaaaaatc

SEQ ID NO: 289941 - DNA, 20 bp, human
ggccgtcattcataatccgg

SEQ ID NO: 289942 - DNA, 20 bp, human
gggagggtgcgtgagcgtgt

SEQ ID NO: 289943 - DNA, 20 bp, human
gtgtggaggcgagtggtctg

SEQ ID NO: 289944 - DNA, 20 bp, human
gaatccggcggaccggaaaa

SEQ ID NO: 289945 - DNA, 20 bp, human
gtaggggcgggggaaacgtt

SEQ ID NO: 289946 - DNA, 20 bp, human
gtagggcagggcaaataaag

SEQ ID NO: 289947 - DNA, 20 bp, human
gggaaggagctggtaggctc

SEQ ID NO: 289948 - DNA, 20 bp, human
ggcttgcttgtctaaaagga

SEQ ID NO: 289949 - DNA, 20 bp, human
gagtggcttgcttgtctaaa

SEQ ID NO: 289950 - DNA, 20 bp, human
gcccgtgcattgcctctcta

SEQ ID NO: 289951 - DNA, 20 bp, human
gcggggattcaggaattctc

SEQ ID NO: 289952 - DNA, 20 bp, human
gagtgctcggcacttcttct

SEQ ID NO: 289953 - DNA, 20 bp, human
ggattgccatggcattcaaa

SEQ ID NO: 289954 - DNA, 20 bp, human
gtttggcgaacaagtagggc

SEQ ID NO: 289955 - DNA, 20 bp, human
gctagaatcccaggatttgt

SEQ ID NO: 289956 - DNA, 20 bp, human
gaggggtaggaagacctcgg

SEQ ID NO: 289957 - DNA, 20 bp, human
gccaaggggtaggaagacct

SEQ ID NO: 289958 - DNA, 20 bp, human
ggtggcgctgagtctccaag

SEQ ID NO: 289959 - DNA, 20 bp, human
gccaccgcggaagcagctat

SEQ ID NO: 289960 - DNA, 20 bp, human
gcgtctgccaatggtgttga

SEQ ID NO: 289961 - DNA, 20 bp, human
gccaccccgagagcaaagga

SEQ ID NO: 289962 - DNA, 20 bp, human
gcggaagcagctattggcgg

SEQ ID NO: 289963 - DNA, 20 bp, human
ggctagttgtccatcagacc

SEQ ID NO: 289964 - DNA, 20 bp, human
gagaaaaggccagtccgccg

SEQ ID NO: 289965 - DNA, 20 bp, human
ggccgcttctgtgtggtgtg

SEQ ID NO: 289966 - DNA, 20 bp, human
gcgactgcctcgccactgta

SEQ ID NO: 289967 - DNA, 20 bp, human
gaaagggtgggcaacccaat

SEQ ID NO: 289968 - DNA, 20 bp, human
gaggcggggcctctggcggg

SEQ ID NO: 289969 - DNA, 20 bp, human
ggcagtcgagcaacaggaag

SEQ ID NO: 289970 - DNA, 20 bp, human
gaaaacttgcgtaggcgcgg

SEQ ID NO: 289971 - DNA, 20 bp, human
gggcgaggcagtcgagcaac

SEQ ID NO: 289972 - DNA, 20 bp, human
gggaggaagtacaggttaaa

SEQ ID NO: 289973 - DNA, 20 bp, human
gacccaatgggagctttggg

SEQ ID NO: 289974 - DNA, 20 bp, human
ggaaataagagcttcgcttg

SEQ ID NO: 289975 - DNA, 20 bp, human
gggcaacccaatgggagctt

SEQ ID NO: 289976 - DNA, 20 bp, human
gagtcccagagcataatccc

SEQ ID NO: 289977 - DNA, 20 bp, human
gatgctctgggactccgaca

SEQ ID NO: 289978 - DNA, 20 bp, human
gggtgcggaactaatgtaag

SEQ ID NO: 289979 - DNA, 20 bp, human
gatcccgggacgatgatagc

SEQ ID NO: 289980 - DNA, 20 bp, human
gttcctgctatcatcgtccc

SEQ ID NO: 289981 - DNA, 20 bp, human
gtcgtcccgggattatgctc

SEQ ID NO: 289982 - DNA, 20 bp, human
gggttgcatatagggcgaat

SEQ ID NO: 289983 - DNA, 20 bp, human
gaataaagtggttgcatata

SEQ ID NO: 289984 - DNA, 20 bp, human
gctgggactccgacagggtg

SEQ ID NO: 289985 - DNA, 20 bp, human
ggcctagtctgtatgtcaat

SEQ ID NO: 289986 - DNA, 20 bp, human
gttaaacagctcaggggcgg

SEQ ID NO: 289987 - DNA, 20 bp, human
ggcgggggaagcttgtaggc

SEQ ID NO: 289988 - DNA, 20 bp, human
gtggctcggggacgtgtcag

SEQ ID NO: 289989 - DNA, 20 bp, human
gagctggcgaagaggggagt

SEQ ID NO: 289990 - DNA, 20 bp, human
ggaagcttgtaggccggctc

SEQ ID NO: 289991 - DNA, 20 bp, human
gagcgcttcagtagcgagag

SEQ ID NO: 289992 - DNA, 20 bp, human
gcccctgcccgagttaaaac

SEQ ID NO: 289993 - DNA, 20 bp, human
gaggggcgggggaagcttgt

SEQ ID NO: 289994 - DNA, 20 bp, human
ggacaccgccggggtgcgga

SEQ ID NO: 289995 - DNA, 20 bp, human
gcgtgctcaataactgtccc

SEQ ID NO: 289996 - DNA, 20 bp, human
gagagagcgtgacgtcagtt

SEQ ID NO: 289997 - DNA, 20 bp, human
gcctctgctaccccctgcgc

SEQ ID NO: 289998 - DNA, 20 bp, human
gaggaggcggggatccgaag

SEQ ID NO: 289999 - DNA, 20 bp, human
gacaaaccgcggggtgacca

SEQ ID NO: 290000 - DNA, 20 bp, human
gtgacgtcacgctctctgat

SEQ ID NO: 290001 - DNA, 20 bp, human
gcttggactccaggttcccg

SEQ ID NO: 290002 - DNA, 20 bp, human
ggaggcgcggacaaaccgcg

SEQ ID NO: 290003 - DNA, 20 bp, human
gtggcttccgagcgacgtcc

SEQ ID NO: 290004 - DNA, 20 bp, human
ggaggcgcccggacgtcgct

SEQ ID NO: 290005 - DNA, 20 bp, human
gctcccgccactgtaagccc

SEQ ID NO: 290006 - DNA, 20 bp, human
ggggaggaggcgtggttcga

SEQ ID NO: 290007 - DNA, 20 bp, human
gccgcatgaagccgggtcgc

SEQ ID NO: 290008 - DNA, 20 bp, human
gcatgcggcgccgtctccta

SEQ ID NO: 290009 - DNA, 20 bp, human
gagacggcgccgcatgaagc

SEQ ID NO: 290010 - DNA, 20 bp, human
gtctcgctggagaactgtca

SEQ ID NO: 290011 - DNA, 20 bp, human
gtggtccgaaggcgcggcgg

SEQ ID NO: 290012 - DNA, 20 bp, human
gtcctatggcaaccgggagg

SEQ ID NO: 290013 - DNA, 20 bp, human
gtcccggttgccataggaga

SEQ ID NO: 290014 - DNA, 20 bp, human
gatgaagccgggtcgcgggt

SEQ ID NO: 290015 - DNA, 20 bp, human
gaggacggcgggagcatctg

SEQ ID NO: 290016 - DNA, 20 bp, human
ggagagggaggatgcattgg

SEQ ID NO: 290017 - DNA, 20 bp, human
ggaggcgttcggagaggaaa

SEQ ID NO: 290018 - DNA, 20 bp, human
gctggggcccatggtgttct

SEQ ID NO: 290019 - DNA, 20 bp, human
gcggaaggaggcgttcggag

SEQ ID NO: 290020 - DNA, 20 bp, human
ggtggagagggaggatgcat

SEQ ID NO: 290021 - DNA, 20 bp, human
gaatttgagctgacggaagg

SEQ ID NO: 290022 - DNA, 20 bp, human
gacgcccggcggcagcaggt

SEQ ID NO: 290023 - DNA, 20 bp, human
gccaggcatcatgggaactg

SEQ ID NO: 290024 - DNA, 20 bp, human
gatgaatttgagctgacgga

SEQ ID NO: 290025 - DNA, 20 bp, human
gttccctcctcccaaaggga

SEQ ID NO: 290026 - DNA, 20 bp, human
gagaacagaaagcagccaat

SEQ ID NO: 290027 - DNA, 20 bp, human
gaagcttcccagaagaaaca

SEQ ID NO: 290028 - DNA, 20 bp, human
gctgccaccaattgcagcta

SEQ ID NO: 290029 - DNA, 20 bp, human
gtccaggagggcttctcagt

SEQ ID NO: 290030 - DNA, 20 bp, human
ggcgttccggagagcgtaag

SEQ ID NO: 290031 - DNA, 20 bp, human
gggagggcttctcagttgga

SEQ ID NO: 290032 - DNA, 20 bp, human
ggctctaaggaattgcgttc

SEQ ID NO: 290033 - DNA, 20 bp, human
ggtggcaggtcgcgttgcca

SEQ ID NO: 290034 - DNA, 20 bp, human
gaaaacaggcggagatgcac

SEQ ID NO: 290035 - DNA, 20 bp, human
gggtcgcgttgccagggaga

SEQ ID NO: 290036 - DNA, 20 bp, human
ggagtggaggaaactctcaa

SEQ ID NO: 290037 - DNA, 20 bp, human
gctagcgctgcaaacaaggg

SEQ ID NO: 290038 - DNA, 20 bp, human
ggaagacccgaaaacgagtg

SEQ ID NO: 290039 - DNA, 20 bp, human
gccgaaaacgagtggggaag

SEQ ID NO: 290040 - DNA, 20 bp, human
ggcggcctcgctgtcctgga

SEQ ID NO: 290041 - DNA, 20 bp, human
gctcgctgtcctggaaggga

SEQ ID NO: 290042 - DNA, 20 bp, human
gaacgagtggggaagaggca

SEQ ID NO: 290043 - DNA, 20 bp, human
ggcttctagcgctgcaaaca

SEQ ID NO: 290044 - DNA, 20 bp, human
ggcctggacgcgggtgtccc

SEQ ID NO: 290045 - DNA, 20 bp, human
ggtagttcctacactggggg

SEQ ID NO: 290046 - DNA, 20 bp, human
gcgcagaggactcagtggac

SEQ ID NO: 290047 - DNA, 20 bp, human
ggccgagagcccaatgggaa

SEQ ID NO: 290048 - DNA, 20 bp, human
gccggggccgagagcccaat

SEQ ID NO: 290049 - DNA, 20 bp, human
gacggacgacgtgcggggtg

SEQ ID NO: 290050 - DNA, 20 bp, human
gtcccgaagtgcaccgaggt

SEQ ID NO: 290051 - DNA, 20 bp, human
gtctgcgcgcggggtcctgt

SEQ ID NO: 290052 - DNA, 20 bp, human
gccgcgcgcagaggactcag

SEQ ID NO: 290053 - DNA, 20 bp, human
ggtcctgtgggatagaaggg

SEQ ID NO: 290054 - DNA, 20 bp, human
gctagatgacggacgacgtg

SEQ ID NO: 290055 - DNA, 20 bp, human
ggtgttcgccgctggagccc

SEQ ID NO: 290056 - DNA, 20 bp, human
ggtggggcacgtgactgtga

SEQ ID NO: 290057 - DNA, 20 bp, human
gggcctctgccgaaagcgtg

SEQ ID NO: 290058 - DNA, 20 bp, human
gcacgtgactgtgacggcat

SEQ ID NO: 290059 - DNA, 20 bp, human
gtgccccacgctttcggcag

SEQ ID NO: 290060 - DNA, 20 bp, human
ggccgggcgtcatagtaacc

SEQ ID NO: 290061 - DNA, 20 bp, human
ggtcacgtgccccacgcttt

SEQ ID NO: 290062 - DNA, 20 bp, human
gactccgccgccagccactc

SEQ ID NO: 290063 - DNA, 20 bp, human
gtttcggcagaggccctgag

SEQ ID NO: 290064 - DNA, 20 bp, human
gggcgcatgcgcttcgttcc

SEQ ID NO: 290065 - DNA, 20 bp, human
gcacacacagggaatctcag

SEQ ID NO: 290066 - DNA, 20 bp, human
ggggccggaggtctgacggg

SEQ ID NO: 290067 - DNA, 20 bp, human
ggcggactggacagcctgaa

SEQ ID NO: 290068 - DNA, 20 bp, human
gaggacgagccaatagtgag

SEQ ID NO: 290069 - DNA, 20 bp, human
gtccggaaaaggcggtgact

SEQ ID NO: 290070 - DNA, 20 bp, human
gcaaccgcccgtcagacctc

SEQ ID NO: 290071 - DNA, 20 bp, human
gaggagctgcgcacgcggac

SEQ ID NO: 290072 - DNA, 20 bp, human
gtcccggtgcccctcactat

SEQ ID NO: 290073 - DNA, 20 bp, human
gctgcagcagcttccggaaa

SEQ ID NO: 290074 - DNA, 20 bp, human
gctgaaaggcgctgttgcta

SEQ ID NO: 290075 - DNA, 20 bp, human
ggacaatgctccgccctctc

SEQ ID NO: 290076 - DNA, 20 bp, human
gcaggtcctgacatctacgt

SEQ ID NO: 290077 - DNA, 20 bp, human
gtgtcaggggattacagctg

SEQ ID NO: 290078 - DNA, 20 bp, human
gtcaacagtcagttagactg

SEQ ID NO: 290079 - DNA, 20 bp, human
gaaaaaataaccagggcctt

SEQ ID NO: 290080 - DNA, 20 bp, human
ggtcaggacctgggcaccaa

SEQ ID NO: 290081 - DNA, 20 bp, human
gtgcagcttaccccatactg

SEQ ID NO: 290082 - DNA, 20 bp, human
gaaaggggtgagtctcgggt

SEQ ID NO: 290083 - DNA, 20 bp, human
gtcatgctctcccttctgct

SEQ ID NO: 290084 - DNA, 20 bp, human
gcagtgaggttcttgcagag

SEQ ID NO: 290085 - DNA, 20 bp, human
gggcatgtccagctgtcagc

SEQ ID NO: 290086 - DNA, 20 bp, human
gaacggggagctactagctg

SEQ ID NO: 290087 - DNA, 20 bp, human
ggtgagagcggcttgtgggt

SEQ ID NO: 290088 - DNA, 20 bp, human
gactaaagtagtagtgagag

SEQ ID NO: 290089 - DNA, 20 bp, human
gtagtagtgagagcggcttg

SEQ ID NO: 290090 - DNA, 20 bp, human
gcatagtcctgctaccacgt

SEQ ID NO: 290091 - DNA, 20 bp, human
gtatgatagcacagtgttca

SEQ ID NO: 290092 - DNA, 20 bp, human
gtctaaccctacgtggtagc

SEQ ID NO: 290093 - DNA, 20 bp, human
gggtggcagtgtttatgagc

SEQ ID NO: 290094 - DNA, 20 bp, human
gctccaggcagagcttaacg

SEQ ID NO: 290095 - DNA, 20 bp, human
gagagctagtacagaatagt

SEQ ID NO: 290096 - DNA, 20 bp, human
gcgcccgccccgctgacttg

SEQ ID NO: 290097 - DNA, 20 bp, human
ggggccggaatcccgttgga

SEQ ID NO: 290098 - DNA, 20 bp, human
ggacgcgcgcgcggcagctg

SEQ ID NO: 290099 - DNA, 20 bp, human
gtgcccagaggccgtccaac

SEQ ID NO: 290100 - DNA, 20 bp, human
gtggcgacggcgacagggat

SEQ ID NO: 290101 - DNA, 20 bp, human
gtggggggccggaatcccgt

SEQ ID NO: 290102 - DNA, 20 bp, human
ggcgcggcagctgaggggac

SEQ ID NO: 290103 - DNA, 20 bp, human
gccggccccccaagtcagcg

SEQ ID NO: 290104 - DNA, 20 bp, human
gaggccgtccaacgggattc

SEQ ID NO: 290105 - DNA, 20 bp, human
gcctggggccctgacggcga

SEQ ID NO: 290106 - DNA, 20 bp, human
ggtgacagatccggctagtc

SEQ ID NO: 290107 - DNA, 20 bp, human
gctagccggatctgtcacca

SEQ ID NO: 290108 - DNA, 20 bp, human
gagagaaggcgataggcgaa

SEQ ID NO: 290109 - DNA, 20 bp, human
gagaccagcgcgcatgcgac

SEQ ID NO: 290110 - DNA, 20 bp, human
ggaaggcgataggcgaacgg

SEQ ID NO: 290111 - DNA, 20 bp, human
gcgcgcgaaaactacgtcac

SEQ ID NO: 290112 - DNA, 20 bp, human
gggaaacaattgagctccct

SEQ ID NO: 290113 - DNA, 20 bp, human
gctgccggtcgcatgcgcgc

SEQ ID NO: 290114 - DNA, 20 bp, human
ggtcggagaaaccagaccta

SEQ ID NO: 290115 - DNA, 20 bp, human
gttgcgcagtataaagagcc

SEQ ID NO: 290116 - DNA, 20 bp, human
gggaaggcggcgccctgcgg

SEQ ID NO: 290117 - DNA, 20 bp, human
gcgctccaccgcctgctcag

SEQ ID NO: 290118 - DNA, 20 bp, human
ggcgagctggcgcgaggaca

SEQ ID NO: 290119 - DNA, 20 bp, human
ggggccgtgccggcctgtac

SEQ ID NO: 290120 - DNA, 20 bp, human
ggtaggacgacgtgactcga

SEQ ID NO: 290121 - DNA, 20 bp, human
ggctcggcacggcccggtac

SEQ ID NO: 290122 - DNA, 20 bp, human
gccaggccgcggccgagtct

SEQ ID NO: 290123 - DNA, 20 bp, human
ggccccgcgccggtctgacc

SEQ ID NO: 290124 - DNA, 20 bp, human
gacggcccagcggaactgcg

SEQ ID NO: 290125 - DNA, 20 bp, human
gccccgccgctgttcaccct

SEQ ID NO: 290126 - DNA, 20 bp, human
gcgcttcccacaaagaggtc

SEQ ID NO: 290127 - DNA, 20 bp, human
gcggctcctccacttccgtt

SEQ ID NO: 290128 - DNA, 20 bp, human
gaatcgcggaaacccgactc

SEQ ID NO: 290129 - DNA, 20 bp, human
gaggagccggacctctttgt

SEQ ID NO: 290130 - DNA, 20 bp, human
ggggagttcccaagctgggt

SEQ ID NO: 290131 - DNA, 20 bp, human
gaacctacattgccagagtc

SEQ ID NO: 290132 - DNA, 20 bp, human
ggagttctccaacccagctt

SEQ ID NO: 290133 - DNA, 20 bp, human
gttctgacacccacttccgg

SEQ ID NO: 290134 - DNA, 20 bp, human
gtggggaaggaatgcccaaa

SEQ ID NO: 290135 - DNA, 20 bp, human
gacgccgggagttcccaagc

SEQ ID NO: 290136 - DNA, 20 bp, human
gtgattggccacgcaccctg

SEQ ID NO: 290137 - DNA, 20 bp, human
ggccagtgaggcgccggcgc

SEQ ID NO: 290138 - DNA, 20 bp, human
ggcccccgaggaggcgtcct

SEQ ID NO: 290139 - DNA, 20 bp, human
gcggggaccggcaccagcgg

SEQ ID NO: 290140 - DNA, 20 bp, human
gccggcgcctcactggcctt

SEQ ID NO: 290141 - DNA, 20 bp, human
gggtgcgtggccaatcagcg

SEQ ID NO: 290142 - DNA, 20 bp, human
gcaccctgcggtgccgtcag

SEQ ID NO: 290143 - DNA, 20 bp, human
gcgcgggaagggcggggcaa

SEQ ID NO: 290144 - DNA, 20 bp, human
gggcttgcggggggccgcgc

SEQ ID NO: 290145 - DNA, 20 bp, human
gggggccgccggctgtacgc

SEQ ID NO: 290146 - DNA, 20 bp, human
ggggctgcggactgtgtttg

SEQ ID NO: 290147 - DNA, 20 bp, human
gcgcgcccacaggaagtcgc

SEQ ID NO: 290148 - DNA, 20 bp, human
gtctgtaggaacgacagctc

SEQ ID NO: 290149 - DNA, 20 bp, human
gaacagaaagacttgtctgt

SEQ ID NO: 290150 - DNA, 20 bp, human
ggtggaggcgggagatgctc

SEQ ID NO: 290151 - DNA, 20 bp, human
ggaggcgaagaggttctatc

SEQ ID NO: 290152 - DNA, 20 bp, human
ggctccgcaggcgcgcccac

SEQ ID NO: 290153 - DNA, 20 bp, human
gtgctccggcgacttcctgt

SEQ ID NO: 290154 - DNA, 20 bp, human
gtggtgcaatcgattgctaa

SEQ ID NO: 290155 - DNA, 20 bp, human
gatctcccaaagtgctccgc

SEQ ID NO: 290156 - DNA, 20 bp, human
gaacccgcgctcccgaactc

SEQ ID NO: 290157 - DNA, 20 bp, human
gtatgaccgcctcccgtcgg

SEQ ID NO: 290158 - DNA, 20 bp, human
gcggccgccatgctgctgta

SEQ ID NO: 290159 - DNA, 20 bp, human
gtgcctgagttcgggagcgc

SEQ ID NO: 290160 - DNA, 20 bp, human
ggggagcgcgggttcctttc

SEQ ID NO: 290161 - DNA, 20 bp, human
gcggccgctatgcttccgta

SEQ ID NO: 290162 - DNA, 20 bp, human
ggctgtacggaaaacggcct

SEQ ID NO: 290163 - DNA, 20 bp, human
gcggtcatagcatcacgccc

SEQ ID NO: 290164 - DNA, 20 bp, human
gacggcctaggcttctttcc

SEQ ID NO: 290165 - DNA, 20 bp, human
gcagcatggcggccgccgac

SEQ ID NO: 290166 - DNA, 20 bp, human
gcaggaggcgctgtctctgg

SEQ ID NO: 290167 - DNA, 20 bp, human
gcagcaggaggcgctgtctc

SEQ ID NO: 290168 - DNA, 20 bp, human
ggggacccgccaccgaatga

SEQ ID NO: 290169 - DNA, 20 bp, human
gcgcgcctgcgcaccagagg

SEQ ID NO: 290170 - DNA, 20 bp, human
gcctgcgcaccagaggcggg

SEQ ID NO: 290171 - DNA, 20 bp, human
gcgcgggggccgtcattcgg

SEQ ID NO: 290172 - DNA, 20 bp, human
gaaaggtgcagttctcgttc

SEQ ID NO: 290173 - DNA, 20 bp, human
gaggagagaggaggcgggat

SEQ ID NO: 290174 - DNA, 20 bp, human
ggaaagccccttaacctgtc

SEQ ID NO: 290175 - DNA, 20 bp, human
gctttctctgcaaggatctc

SEQ ID NO: 290176 - DNA, 20 bp, human
gcacgcgcagtgaaaaccca

SEQ ID NO: 290177 - DNA, 20 bp, human
gagccctgggccccatcagt

SEQ ID NO: 290178 - DNA, 20 bp, human
gaactggaggcgaagccggg

SEQ ID NO: 290179 - DNA, 20 bp, human
gcctctcagtgcccactgat

SEQ ID NO: 290180 - DNA, 20 bp, human
gcggcttcgcctccagttct

SEQ ID NO: 290181 - DNA, 20 bp, human
gtgcccactgatggggccca

SEQ ID NO: 290182 - DNA, 20 bp, human
ggtgacgaggcgggagtgac

SEQ ID NO: 290183 - DNA, 20 bp, human
ggggacttcggacgcttcgc

SEQ ID NO: 290184 - DNA, 20 bp, human
gcggacgcttcgcgggccct

SEQ ID NO: 290185 - DNA, 20 bp, human
gagtgcaagcggaatggaaa

SEQ ID NO: 290186 - DNA, 20 bp, human
gaggccggaagcttctcttc

SEQ ID NO: 290187 - DNA, 20 bp, human
gcccccggcgcctgccatga

SEQ ID NO: 290188 - DNA, 20 bp, human
gcaccgtcgcgatcggtgtg

SEQ ID NO: 290189 - DNA, 20 bp, human
gggctcccaagaccgcgttc

SEQ ID NO: 290190 - DNA, 20 bp, human
ggcgcctgccatgacggagt

SEQ ID NO: 290191 - DNA, 20 bp, human
gaccgatcgcgacggtggat

SEQ ID NO: 290192 - DNA, 20 bp, human
gtcggcgccggatgtgtagc

SEQ ID NO: 290193 - DNA, 20 bp, human
ggcgccggatgtgtagctgg

SEQ ID NO: 290194 - DNA, 20 bp, human
gtgtagctggcggaaggagc

SEQ ID NO: 290195 - DNA, 20 bp, human
ggggactgccggtcactacc

SEQ ID NO: 290196 - DNA, 20 bp, human
gcaggcggaaggcaatgcgc

SEQ ID NO: 290197 - DNA, 20 bp, human
ggtggcgcaggcgcggaatg

SEQ ID NO: 290198 - DNA, 20 bp, human
ggcgcaggcgcggaatgcgg

SEQ ID NO: 290199 - DNA, 20 bp, human
gaggcctcccgcggtggcgc

SEQ ID NO: 290200 - DNA, 20 bp, human
gtccgcgcctgcgccaccgc

SEQ ID NO: 290201 - DNA, 20 bp, human
gcgcgacgcggccctagcaa

SEQ ID NO: 290202 - DNA, 20 bp, human
ggaccacaggctaagtgctg

SEQ ID NO: 290203 - DNA, 20 bp, human
gaggcgcggaatgcgggggg

SEQ ID NO: 290204 - DNA, 20 bp, human
gagtccgagcgctccgtcgc

SEQ ID NO: 290205 - DNA, 20 bp, human
gagacggcctggaggaccac

SEQ ID NO: 290206 - DNA, 20 bp, human
gcgagcgcggggtggagtct

SEQ ID NO: 290207 - DNA, 20 bp, human
gaacgtgagacgctccggtg

SEQ ID NO: 290208 - DNA, 20 bp, human
ggggcggtgcgcgtcgagcg

SEQ ID NO: 290209 - DNA, 20 bp, human
gtcgacgcgcaccgccccac

SEQ ID NO: 290210 - DNA, 20 bp, human
gtaggagcctcggagtcaag

SEQ ID NO: 290211 - DNA, 20 bp, human
ggctccgccccttgactccg

SEQ ID NO: 290212 - DNA, 20 bp, human
ggagcctcggagtcaagggg

SEQ ID NO: 290213 - DNA, 20 bp, human
gtgcgtcgcgacgcgggaag

SEQ ID NO: 290214 - DNA, 20 bp, human
gaacccgctcgcgacggtct

SEQ ID NO: 290215 - DNA, 20 bp, human
gaggaccatccggggataga

SEQ ID NO: 290216 - DNA, 20 bp, human
gcgcctgcgaagtacgtcat

SEQ ID NO: 290217 - DNA, 20 bp, human
ggcggtacctccataaccga

SEQ ID NO: 290218 - DNA, 20 bp, human
gggcaacctcctaccgtcca

SEQ ID NO: 290219 - DNA, 20 bp, human
ggcccctcccacagccgcaa

SEQ ID NO: 290220 - DNA, 20 bp, human
ggccccttgcggctgtggga

SEQ ID NO: 290221 - DNA, 20 bp, human
ggtagaggcgtcctggcgac

SEQ ID NO: 290222 - DNA, 20 bp, human
gaggacgcctctaccctgga

SEQ ID NO: 290223 - DNA, 20 bp, human
gcgccaggacgcctctaccc

SEQ ID NO: 290224 - DNA, 20 bp, human
ggaggtaccgcctgcgggat

SEQ ID NO: 290225 - DNA, 20 bp, human
gcccacgcccgcgcatgctc

SEQ ID NO: 290226 - DNA, 20 bp, human
ggggttggactcaacgagta

SEQ ID NO: 290227 - DNA, 20 bp, human
gcgagtaaggcggggaacaa

SEQ ID NO: 290228 - DNA, 20 bp, human
ggggaacaagggaggagtaa

SEQ ID NO: 290229 - DNA, 20 bp, human
gttggactcaacgagtaagg

SEQ ID NO: 290230 - DNA, 20 bp, human
gctgcccgcctccttaagaa

SEQ ID NO: 290231 - DNA, 20 bp, human
gcgggcagggagtaccgcat

SEQ ID NO: 290232 - DNA, 20 bp, human
ggggttgagaggacggtagg

SEQ ID NO: 290233 - DNA, 20 bp, human
gaaagacttgggactccctc

SEQ ID NO: 290234 - DNA, 20 bp, human
gggtcagacttcaggaggtg

SEQ ID NO: 290235 - DNA, 20 bp, human
ggcagggagtaccgcatcgg

SEQ ID NO: 290236 - DNA, 20 bp, human
gagttcccggggcggagcgc

SEQ ID NO: 290237 - DNA, 20 bp, human
gagcgctcccggagttcccg

SEQ ID NO: 290238 - DNA, 20 bp, human
gcacgcgcatggtcgcccca

SEQ ID NO: 290239 - DNA, 20 bp, human
ggctccgccccgggaactcc

SEQ ID NO: 290240 - DNA, 20 bp, human
gacccggctgggtaggtcgg

SEQ ID NO: 290241 - DNA, 20 bp, human
ggctcccggagttcccgggg

SEQ ID NO: 290242 - DNA, 20 bp, human
ggggcgccggccggccgacc

SEQ ID NO: 290243 - DNA, 20 bp, human
gggaactccgggagcgctcc

SEQ ID NO: 290244 - DNA, 20 bp, human
gtgcgcgtgcgcagagtccg

SEQ ID NO: 290245 - DNA, 20 bp, human
gggaacgcaggtcgcttacc

SEQ ID NO: 290246 - DNA, 20 bp, human
gatactggcccattgctgta

SEQ ID NO: 290247 - DNA, 20 bp, human
gagcaatgggccagtatttc

SEQ ID NO: 290248 - DNA, 20 bp, human
gacaagtgagccccctccaa

SEQ ID NO: 290249 - DNA, 20 bp, human
ggcatcttgcctttgaagtc

SEQ ID NO: 290250 - DNA, 20 bp, human
gctgtgactcaggcaccaga

SEQ ID NO: 290251 - DNA, 20 bp, human
gtcagggctttggccatttc

SEQ ID NO: 290252 - DNA, 20 bp, human
gtcacttgttaggagccatc

SEQ ID NO: 290253 - DNA, 20 bp, human
gatttctggcagaaaagaat

SEQ ID NO: 290254 - DNA, 20 bp, human
gtttataaaccttacagcaa

SEQ ID NO: 290255 - DNA, 20 bp, human
gggcaagatgccagaaatac

SEQ ID NO: 290256 - DNA, 20 bp, human
gtgaaacctggcccttttta

SEQ ID NO: 290257 - DNA, 20 bp, human
ggaagaggctttattccccc

SEQ ID NO: 290258 - DNA, 20 bp, human
gtgacagagacacatctctg

SEQ ID NO: 290259 - DNA, 20 bp, human
gggggaacttgtactgtagc

SEQ ID NO: 290260 - DNA, 20 bp, human
gtgtcagaaacaaactccag

SEQ ID NO: 290261 - DNA, 20 bp, human
gaaaagggccaggtttcaca

SEQ ID NO: 290262 - DNA, 20 bp, human
gaagtcggccaatgctcccg

SEQ ID NO: 290263 - DNA, 20 bp, human
gagagttgaaagccctaaaa

SEQ ID NO: 290264 - DNA, 20 bp, human
ggcattatgacatagggatt

SEQ ID NO: 290265 - DNA, 20 bp, human
gaaggggtccatgtgaaacc

SEQ ID NO: 290266 - DNA, 20 bp, human
gtatgactctggcatcagaa

SEQ ID NO: 290267 - DNA, 20 bp, human
ggagtgtgatgatgtcataa

SEQ ID NO: 290268 - DNA, 20 bp, human
gctggctaattagcacaaag

SEQ ID NO: 290269 - DNA, 20 bp, human
gagcaagccactggaaatac

SEQ ID NO: 290270 - DNA, 20 bp, human
ggaaacaattgagccatata

SEQ ID NO: 290271 - DNA, 20 bp, human
gaagagttccacatattcgc

SEQ ID NO: 290272 - DNA, 20 bp, human
gctggaaaagactcagctgt

SEQ ID NO: 290273 - DNA, 20 bp, human
gtgcttttgtagtcaaattg

SEQ ID NO: 290274 - DNA, 20 bp, human
gtcctggcagggattcagaa

SEQ ID NO: 290275 - DNA, 20 bp, human
gcattctcttagggtgtcta

SEQ ID NO: 290276 - DNA, 20 bp, human
gaaccatgaaaaaagttaac

SEQ ID NO: 290277 - DNA, 20 bp, human
gtgcctgttaacttttttca

SEQ ID NO: 290278 - DNA, 20 bp, human
gacaaaggcaactatgacca

SEQ ID NO: 290279 - DNA, 20 bp, human
gcagaattgtaaaggggcaa

SEQ ID NO: 290280 - DNA, 20 bp, human
gctctcctgttgacttcctt

SEQ ID NO: 290281 - DNA, 20 bp, human
gcttgggcaactctctgttg

SEQ ID NO: 290282 - DNA, 20 bp, human
ggatggccgtgatgtcacaa

SEQ ID NO: 290283 - DNA, 20 bp, human
gacaaaagcagaattgtaaa

SEQ ID NO: 290284 - DNA, 20 bp, human
gtatccatcaactttgagcc

SEQ ID NO: 290285 - DNA, 20 bp, human
ggttgcccaaggaagtcaac

SEQ ID NO: 290286 - DNA, 20 bp, human
gagggtgtaaaggaactgaa

SEQ ID NO: 290287 - DNA, 20 bp, human
gttggaataccagggtgtaa

SEQ ID NO: 290288 - DNA, 20 bp, human
gaatgctgctcattaaaatc

SEQ ID NO: 290289 - DNA, 20 bp, human
ggtcctggtgcctgcatcac

SEQ ID NO: 290290 - DNA, 20 bp, human
gtcagtacttggggtcttct

SEQ ID NO: 290291 - DNA, 20 bp, human
gaggcccccaggactagcct

SEQ ID NO: 290292 - DNA, 20 bp, human
gagcatatgagcctcttcta

SEQ ID NO: 290293 - DNA, 20 bp, human
gtgtcaatgggtcagtactt

SEQ ID NO: 290294 - DNA, 20 bp, human
gtgaggacggtggaattgga

SEQ ID NO: 290295 - DNA, 20 bp, human
gtccaaataactattagaat

SEQ ID NO: 290296 - DNA, 20 bp, human
ggggcggagtccaatgatgg

SEQ ID NO: 290297 - DNA, 20 bp, human
gagtgggcggagtccaatga

SEQ ID NO: 290298 - DNA, 20 bp, human
gagggtggggctaaagacaa

SEQ ID NO: 290299 - DNA, 20 bp, human
ggaggtgtgactaacagttg

SEQ ID NO: 290300 - DNA, 20 bp, human
ggtgcagacgggacctgatg

SEQ ID NO: 290301 - DNA, 20 bp, human
ggtgactaacagttgagggt

SEQ ID NO: 290302 - DNA, 20 bp, human
ggaaggcaagagataatggt

SEQ ID NO: 290303 - DNA, 20 bp, human
gtagagtcttgtgtgcaagt

SEQ ID NO: 290304 - DNA, 20 bp, human
gccaaattggctatgagtag

SEQ ID NO: 290305 - DNA, 20 bp, human
gcacaagactctacctcatc

SEQ ID NO: 290306 - DNA, 20 bp, human
gtaccaagatgaaaggactt

SEQ ID NO: 290307 - DNA, 20 bp, human
gccaagatggcggtaagaga

SEQ ID NO: 290308 - DNA, 20 bp, human
ggtaagagtgctattgaatg

SEQ ID NO: 290309 - DNA, 20 bp, human
gaagatgcctaaattgaggg

SEQ ID NO: 290310 - DNA, 20 bp, human
gtggcggtaagagaaggacg

SEQ ID NO: 290311 - DNA, 20 bp, human
gaacccgggcagccgttctc

SEQ ID NO: 290312 - DNA, 20 bp, human
gtcgactccgccctcaattt

SEQ ID NO: 290313 - DNA, 20 bp, human
ggccccgccgcgtggccttg

SEQ ID NO: 290314 - DNA, 20 bp, human
gttcctaagtcctttcatct

SEQ ID NO: 290315 - DNA, 20 bp, human
gaaaaacaatcctcggaaat

SEQ ID NO: 290316 - DNA, 20 bp, human
ggccgctgggggtagacgga

SEQ ID NO: 290317 - DNA, 20 bp, human
gtacccccagcggcgagggg

SEQ ID NO: 290318 - DNA, 20 bp, human
gtctgcggcgaacttctagc

SEQ ID NO: 290319 - DNA, 20 bp, human
gcgtctacccccagcggcga

SEQ ID NO: 290320 - DNA, 20 bp, human
gacgctcggcccgaagatgg

SEQ ID NO: 290321 - DNA, 20 bp, human
gttcgcgccacgagacgcga

SEQ ID NO: 290322 - DNA, 20 bp, human
gagttcgccgcagaagatga

SEQ ID NO: 290323 - DNA, 20 bp, human
ggcgtctcgtggcgcgaagc

SEQ ID NO: 290324 - DNA, 20 bp, human
ggggccgagcgtcgttacca

SEQ ID NO: 290325 - DNA, 20 bp, human
gcggaaaggcgctttccgat

SEQ ID NO: 290326 - DNA, 20 bp, human
gctcgcgagccggttccgtc

SEQ ID NO: 290327 - DNA, 20 bp, human
gagcggctgcctgacggaac

SEQ ID NO: 290328 - DNA, 20 bp, human
gtggtccaacgtgagtagat

SEQ ID NO: 290329 - DNA, 20 bp, human
gcacggccgccggcgcgagg

SEQ ID NO: 290330 - DNA, 20 bp, human
gaggccggagagggcgttct

SEQ ID NO: 290331 - DNA, 20 bp, human
gcggctcgcgagcgcagcta

SEQ ID NO: 290332 - DNA, 20 bp, human
gggagcggaagggggtctag

SEQ ID NO: 290333 - DNA, 20 bp, human
gtggtctcctgagaagacgg

SEQ ID NO: 290334 - DNA, 20 bp, human
gcagctggtgactaacgcac

SEQ ID NO: 290335 - DNA, 20 bp, human
gattccgagaacgccctctc

SEQ ID NO: 290336 - DNA, 20 bp, human
gttctcatctagctgtctgt

SEQ ID NO: 290337 - DNA, 20 bp, human
gtagagtgagctcaactcaa

SEQ ID NO: 290338 - DNA, 20 bp, human
gcatcagaaagcctcaaaga

SEQ ID NO: 290339 - DNA, 20 bp, human
gttacctgcctgtttctgca

SEQ ID NO: 290340 - DNA, 20 bp, human
gtgtgaggcgagtgtgaggc

SEQ ID NO: 290341 - DNA, 20 bp, human
gactgaatcaaaaaattaag

SEQ ID NO: 290342 - DNA, 20 bp, human
gtaaaggtatctagggaagc

SEQ ID NO: 290343 - DNA, 20 bp, human
gatttggagacgtatagtga

SEQ ID NO: 290344 - DNA, 20 bp, human
gatgcgcaacaaatagctga

SEQ ID NO: 290345 - DNA, 20 bp, human
gggtatctagggaagctggc

SEQ ID NO: 290346 - DNA, 20 bp, human
gaagctgatcttagcttaaa

SEQ ID NO: 290347 - DNA, 20 bp, human
gtcatggcactgtatcgata

SEQ ID NO: 290348 - DNA, 20 bp, human
gtgatcttagcttaaagggg

SEQ ID NO: 290349 - DNA, 20 bp, human
ggacatcattgggtgtcatg

SEQ ID NO: 290350 - DNA, 20 bp, human
gtccctggagaagctgctgt

SEQ ID NO: 290351 - DNA, 20 bp, human
gtggtgaatatagtgaagaa

SEQ ID NO: 290352 - DNA, 20 bp, human
gttactatctctgaaacgat

SEQ ID NO: 290353 - DNA, 20 bp, human
gctacttatattaaatagca

SEQ ID NO: 290354 - DNA, 20 bp, human
gtgctaaatacttcactaga

SEQ ID NO: 290355 - DNA, 20 bp, human
gctttagagatgacatcatt

SEQ ID NO: 290356 - DNA, 20 bp, human
gaagaagccggaacccgaga

SEQ ID NO: 290357 - DNA, 20 bp, human
gcgggcgcacaccgactgga

SEQ ID NO: 290358 - DNA, 20 bp, human
gcgcccaccggtgagtgcca

SEQ ID NO: 290359 - DNA, 20 bp, human
ggcgccctggcactcaccgg

SEQ ID NO: 290360 - DNA, 20 bp, human
gagtgcgcggcggggaagat

SEQ ID NO: 290361 - DNA, 20 bp, human
gactggaggggtcggattca

SEQ ID NO: 290362 - DNA, 20 bp, human
ggtcgccggcccaccctctc

SEQ ID NO: 290363 - DNA, 20 bp, human
ggggtcggattcagggatgt

SEQ ID NO: 290364 - DNA, 20 bp, human
gcgactcgaagtggacttcc

SEQ ID NO: 290365 - DNA, 20 bp, human
gcaccagaggaagtgcgcgg

SEQ ID NO: 290366 - DNA, 20 bp, human
ggccctgagcggccggaaag

SEQ ID NO: 290367 - DNA, 20 bp, human
ggctcagggcggtgtcgctg

SEQ ID NO: 290368 - DNA, 20 bp, human
gcgtgagcccgattggagga

SEQ ID NO: 290369 - DNA, 20 bp, human
gcagggcggtgtcgctgggg

SEQ ID NO: 290370 - DNA, 20 bp, human
gtcagcgtgagcccgattgg

SEQ ID NO: 290371 - DNA, 20 bp, human
gctgccgggaatgcccgccc

SEQ ID NO: 290372 - DNA, 20 bp, human
gtgagcggccggaaagaggc

SEQ ID NO: 290373 - DNA, 20 bp, human
gggggcggggctataaacct

SEQ ID NO: 290374 - DNA, 20 bp, human
ggggctgagggggcggagtt

SEQ ID NO: 290375 - DNA, 20 bp, human
gcccgccctgcatcccgcta

SEQ ID NO: 290376 - DNA, 20 bp, human
ggcgaccggccagggagcga

SEQ ID NO: 290377 - DNA, 20 bp, human
gaaggggccgagagggacgc

SEQ ID NO: 290378 - DNA, 20 bp, human
ggtgaataacggggcctggc

SEQ ID NO: 290379 - DNA, 20 bp, human
ggagaaggggcgggtccacg

SEQ ID NO: 290380 - DNA, 20 bp, human
gcccaccgcggtgaataacg

SEQ ID NO: 290381 - DNA, 20 bp, human
gtcggcgcgcgctcccaccg

SEQ ID NO: 290382 - DNA, 20 bp, human
ggcaacaccccggacacgaa

SEQ ID NO: 290383 - DNA, 20 bp, human
gctgcgcccgacacgcggta

SEQ ID NO: 290384 - DNA, 20 bp, human
gggccgggaccccctgcagc

SEQ ID NO: 290385 - DNA, 20 bp, human
ggggtggaagtgaaccaacg

SEQ ID NO: 290386 - DNA, 20 bp, human
gaaggggagcggtactgccc

SEQ ID NO: 290387 - DNA, 20 bp, human
gagacgaggaactgctgtaa

SEQ ID NO: 290388 - DNA, 20 bp, human
gggaactgctgtaaggggag

SEQ ID NO: 290389 - DNA, 20 bp, human
gaagcagagtaggggttaat

SEQ ID NO: 290390 - DNA, 20 bp, human
gcgaatgcagagatgtatga

SEQ ID NO: 290391 - DNA, 20 bp, human
ggcggtactgccccggcctg

SEQ ID NO: 290392 - DNA, 20 bp, human
gggccaccgcccctcaccgt

SEQ ID NO: 290393 - DNA, 20 bp, human
gcgggaagtgtcctgtctgg

SEQ ID NO: 290394 - DNA, 20 bp, human
gaccgtcggcaccgccagac

SEQ ID NO: 290395 - DNA, 20 bp, human
gctggcggtgccgacggtga

SEQ ID NO: 290396 - DNA, 20 bp, human
gagactgcacggagcgtgtg

SEQ ID NO: 290397 - DNA, 20 bp, human
ggccccctgtgcttcttccg

SEQ ID NO: 290398 - DNA, 20 bp, human
gcgcggggtgcagagcgcaa

SEQ ID NO: 290399 - DNA, 20 bp, human
ggccgcggaagaagcacagg

SEQ ID NO: 290400 - DNA, 20 bp, human
gcaggggcggggctacgcgc

SEQ ID NO: 290401 - DNA, 20 bp, human
gggcgccgcggaagaagcac

SEQ ID NO: 290402 - DNA, 20 bp, human
gaatgtggccctgaagtggg

SEQ ID NO: 290403 - DNA, 20 bp, human
gcacagggggcggggggtca

SEQ ID NO: 290404 - DNA, 20 bp, human
gggggtgcagagcgcaaggg

SEQ ID NO: 290405 - DNA, 20 bp, human
ggcgtggccacacggcgccg

SEQ ID NO: 290406 - DNA, 20 bp, human
gaactcctcctccgaggaag

SEQ ID NO: 290407 - DNA, 20 bp, human
gcagccctcctggaggagta

SEQ ID NO: 290408 - DNA, 20 bp, human
gcaaacttgatggggtgcgt

SEQ ID NO: 290409 - DNA, 20 bp, human
gtctagcagaggtgcactga

SEQ ID NO: 290410 - DNA, 20 bp, human
gccagcccttccctagaagg

SEQ ID NO: 290411 - DNA, 20 bp, human
gtggcctggccccgccttct

SEQ ID NO: 290412 - DNA, 20 bp, human
gttcttggttcctccttcta

SEQ ID NO: 290413 - DNA, 20 bp, human
gaaggaggaaccaagaaggc

SEQ ID NO: 290414 - DNA, 20 bp, human
ggccagcgatacaaacttga

SEQ ID NO: 290415 - DNA, 20 bp, human
gctgcgggccagattgcaac

SEQ ID NO: 290416 - DNA, 20 bp, human
gggaatggagagatctcttg

SEQ ID NO: 290417 - DNA, 20 bp, human
gtaagtgaggacccagggac

SEQ ID NO: 290418 - DNA, 20 bp, human
ggccgggcgccggtgccttg

SEQ ID NO: 290419 - DNA, 20 bp, human
ggacccagggacgggtggaa

SEQ ID NO: 290420 - DNA, 20 bp, human
gatctcttgcgggctgtcat

SEQ ID NO: 290421 - DNA, 20 bp, human
gggacgggcggactctggga

SEQ ID NO: 290422 - DNA, 20 bp, human
gggccgggcgagccgggtgg

SEQ ID NO: 290423 - DNA, 20 bp, human
gggcagctgcagacagtcaa

SEQ ID NO: 290424 - DNA, 20 bp, human
gtgggaaggagggcttcttt

SEQ ID NO: 290425 - DNA, 20 bp, human
ggtgaggacccagggacggg

SEQ ID NO: 290426 - DNA, 20 bp, human
ggccaagaggcagcgaggtg

SEQ ID NO: 290427 - DNA, 20 bp, human
gctgacgccaagaggcagcg

SEQ ID NO: 290428 - DNA, 20 bp, human
gagggaggcgagccgaccgc

SEQ ID NO: 290429 - DNA, 20 bp, human
gctggaggacaggaaggcgt

SEQ ID NO: 290430 - DNA, 20 bp, human
gaggtggggaggcgaggagt

SEQ ID NO: 290431 - DNA, 20 bp, human
gggaagcagcgatactggga

SEQ ID NO: 290432 - DNA, 20 bp, human
gtgcctcttggcgtcagcga

SEQ ID NO: 290433 - DNA, 20 bp, human
ggaaggggaagcagcgatac

SEQ ID NO: 290434 - DNA, 20 bp, human
gtggggaggtctggaggtag

SEQ ID NO: 290435 - DNA, 20 bp, human
gaaggtgcggtgggacctgt

SEQ ID NO: 290436 - DNA, 20 bp, human
gcggccccgcccccagtctt

SEQ ID NO: 290437 - DNA, 20 bp, human
gcggaggggcggtgtcggga

SEQ ID NO: 290438 - DNA, 20 bp, human
ggaggagcgcggcagggtag

SEQ ID NO: 290439 - DNA, 20 bp, human
gaggaacgcgatagggaaaa

SEQ ID NO: 290440 - DNA, 20 bp, human
ggggaaggaggagcgcggca

SEQ ID NO: 290441 - DNA, 20 bp, human
ggagccagaggcgaagagac

SEQ ID NO: 290442 - DNA, 20 bp, human
gaggagcgcggcaggaaata

SEQ ID NO: 290443 - DNA, 20 bp, human
gggaggagtcagaggcgagc

SEQ ID NO: 290444 - DNA, 20 bp, human
ggcaaaggaggaacgcgata

SEQ ID NO: 290445 - DNA, 20 bp, human
gacaggaagagggacgcgtc

SEQ ID NO: 290446 - DNA, 20 bp, human
gcggggctctggaggacgaa

SEQ ID NO: 290447 - DNA, 20 bp, human
ggccgcgcgctgggtcacac

SEQ ID NO: 290448 - DNA, 20 bp, human
gggctctggaggacgaacgg

SEQ ID NO: 290449 - DNA, 20 bp, human
gcgccgctcgcggaacccgc

SEQ ID NO: 290450 - DNA, 20 bp, human
ggtgacccagcgcgcggccg

SEQ ID NO: 290451 - DNA, 20 bp, human
gcctcccgggctcgcccggg

SEQ ID NO: 290452 - DNA, 20 bp, human
ggagcggcgatcggcctccc

SEQ ID NO: 290453 - DNA, 20 bp, human
ggcacgaggccggctcgaag

SEQ ID NO: 290454 - DNA, 20 bp, human
ggggttccgcgagcggcgat

SEQ ID NO: 290455 - DNA, 20 bp, human
gtcccggcgttggggacaga

SEQ ID NO: 290456 - DNA, 20 bp, human
ggcctggctggtctccaagt

SEQ ID NO: 290457 - DNA, 20 bp, human
gcaacatagcaagataggca

SEQ ID NO: 290458 - DNA, 20 bp, human
ggacactgtgccacagctct

SEQ ID NO: 290459 - DNA, 20 bp, human
gacagagctgacttcctggt

SEQ ID NO: 290460 - DNA, 20 bp, human
ggaagtcagctctgtcaaac

SEQ ID NO: 290461 - DNA, 20 bp, human
ggggagagccccatggagct

SEQ ID NO: 290462 - DNA, 20 bp, human
gagtggtgctctgggcccta

SEQ ID NO: 290463 - DNA, 20 bp, human
gtctgtcaaaccgggtccca

SEQ ID NO: 290464 - DNA, 20 bp, human
gaggcaggaagtagcctgag

SEQ ID NO: 290465 - DNA, 20 bp, human
gaaatctctagaagctactc

SEQ ID NO: 290466 - DNA, 20 bp, human
ggcgcaaagtatgccgggat

SEQ ID NO: 290467 - DNA, 20 bp, human
ggcgcccgccagaagttccg

SEQ ID NO: 290468 - DNA, 20 bp, human
gaaggggccaatgcgcacca

SEQ ID NO: 290469 - DNA, 20 bp, human
ggcacggcgcaaagtatgcc

SEQ ID NO: 290470 - DNA, 20 bp, human
gaggccgcggaacttctggc

SEQ ID NO: 290471 - DNA, 20 bp, human
gtgaggtgcagaggcgcggt

SEQ ID NO: 290472 - DNA, 20 bp, human
gaggaaggagaagagtagcg

SEQ ID NO: 290473 - DNA, 20 bp, human
ggcggcctccacacccatcc

SEQ ID NO: 290474 - DNA, 20 bp, human
gagatgcggcaagatcaaca

SEQ ID NO: 290475 - DNA, 20 bp, human
ggtggaggccgcggaacttc

SEQ ID NO: 290476 - DNA, 20 bp, human
gccagcgccggccagagaat

SEQ ID NO: 290477 - DNA, 20 bp, human
gcagagaatcggaactgcga

SEQ ID NO: 290478 - DNA, 20 bp, human
ggaccggcggggaagtgggc

SEQ ID NO: 290479 - DNA, 20 bp, human
ggtgtagtgccgatggaagt

SEQ ID NO: 290480 - DNA, 20 bp, human
gctagccaggggcggaccgg

SEQ ID NO: 290481 - DNA, 20 bp, human
gggcggcacgacggccccgc

SEQ ID NO: 290482 - DNA, 20 bp, human
gatgcatggtgtagtgccga

SEQ ID NO: 290483 - DNA, 20 bp, human
gctgcggcagaattcccgtg

SEQ ID NO: 290484 - DNA, 20 bp, human
gtctctagccaggggcggac

SEQ ID NO: 290485 - DNA, 20 bp, human
gttgatgagcgcatgatgca

SEQ ID NO: 290486 - DNA, 20 bp, human
gcccaccgcagaggtgtgaa

SEQ ID NO: 290487 - DNA, 20 bp, human
gcctggccaggcggacgcag

SEQ ID NO: 290488 - DNA, 20 bp, human
ggcgccccttcacacctctg

SEQ ID NO: 290489 - DNA, 20 bp, human
gggggcgcaaagccagcgaa

SEQ ID NO: 290490 - DNA, 20 bp, human
gcacggagcctccacctatt

SEQ ID NO: 290491 - DNA, 20 bp, human
ggtggggcacggtgggctcc

SEQ ID NO: 290492 - DNA, 20 bp, human
gcgaagggagaacccgggtc

SEQ ID NO: 290493 - DNA, 20 bp, human
gggagaacggcgtgttccta

SEQ ID NO: 290494 - DNA, 20 bp, human
gaggagaccgcctagccgtg

SEQ ID NO: 290495 - DNA, 20 bp, human
ggcggtgcccacgtgacgca

SEQ ID NO: 290496 - DNA, 20 bp, human
ggacaggggcgtaattaaag

SEQ ID NO: 290497 - DNA, 20 bp, human
gtcggaggctgaaacactta

SEQ ID NO: 290498 - DNA, 20 bp, human
ggtagggcgcgtctttacgt

SEQ ID NO: 290499 - DNA, 20 bp, human
gaaactccacgtattgcgta

SEQ ID NO: 290500 - DNA, 20 bp, human
gaatgccttccactgaaccg

SEQ ID NO: 290501 - DNA, 20 bp, human
ggaagcccatcggggaagtg

SEQ ID NO: 290502 - DNA, 20 bp, human
gttaattacgcccctgtcgg

SEQ ID NO: 290503 - DNA, 20 bp, human
gcccgtctacctcggttcag

SEQ ID NO: 290504 - DNA, 20 bp, human
gtccccgatgggcttcatct

SEQ ID NO: 290505 - DNA, 20 bp, human
gaactcgaccccgtctacct

SEQ ID NO: 290506 - DNA, 20 bp, human
gctaactcccgcgagatcgt

SEQ ID NO: 290507 - DNA, 20 bp, human
gctcgcgagaacagcggcga

SEQ ID NO: 290508 - DNA, 20 bp, human
gcccccgctcgcgagaacag

SEQ ID NO: 290509 - DNA, 20 bp, human
gaagacaggcggactggcaa

SEQ ID NO: 290510 - DNA, 20 bp, human
gtcccgcgagatcgtcggac

SEQ ID NO: 290511 - DNA, 20 bp, human
gggcgcgagaaatcgctttc

SEQ ID NO: 290512 - DNA, 20 bp, human
gtcccgcgagcgcagacccg

SEQ ID NO: 290513 - DNA, 20 bp, human
ggaggctccagtgggggcgt

SEQ ID NO: 290514 - DNA, 20 bp, human
gaaggtgtctgttggagtca

SEQ ID NO: 290515 - DNA, 20 bp, human
ggccccgggtctgcgctcgc

SEQ ID NO: 290516 - DNA, 20 bp, human
gttgtagagctagcggcgaa

SEQ ID NO: 290517 - DNA, 20 bp, human
ggcgaaggggaagtacaggg

SEQ ID NO: 290518 - DNA, 20 bp, human
ggcggcgaaggggaagtaca

SEQ ID NO: 290519 - DNA, 20 bp, human
gcgcccgcgcggctgtccgg

SEQ ID NO: 290520 - DNA, 20 bp, human
gcaggctgttgtagagctag

SEQ ID NO: 290521 - DNA, 20 bp, human
gcagccgcgcgggcgcccat

SEQ ID NO: 290522 - DNA, 20 bp, human
gcgcccggccggagagggtg

SEQ ID NO: 290523 - DNA, 20 bp, human
ggcccgcggtggccccgggg

SEQ ID NO: 290524 - DNA, 20 bp, human
ggggaatcccgctaagtgtt

SEQ ID NO: 290525 - DNA, 20 bp, human
ggtcccgggcagccctcctc

SEQ ID NO: 290526 - DNA, 20 bp, human
ggagtccgcggctcgcaccc

SEQ ID NO: 290527 - DNA, 20 bp, human
gggcgaacttccgcacctcc

SEQ ID NO: 290528 - DNA, 20 bp, human
gttgtgcaaccgggaggtgg

SEQ ID NO: 290529 - DNA, 20 bp, human
gcggcgggagcaacaagcag

SEQ ID NO: 290530 - DNA, 20 bp, human
gtcaagcttgtgcaaccggg

SEQ ID NO: 290531 - DNA, 20 bp, human
gaagcttgaaacaaacactg

SEQ ID NO: 290532 - DNA, 20 bp, human
gcgccgcagcagctcattgg

SEQ ID NO: 290533 - DNA, 20 bp, human
gagcttgtgcaaccgggagg

SEQ ID NO: 290534 - DNA, 20 bp, human
ggcgcaggcccgcggcggta

SEQ ID NO: 290535 - DNA, 20 bp, human
gaggaaactgcgaagagccg

SEQ ID NO: 290536 - DNA, 20 bp, human
ggggaaacgtagtcccgccg

SEQ ID NO: 290537 - DNA, 20 bp, human
ggggaacggcgggcagacgc

SEQ ID NO: 290538 - DNA, 20 bp, human
ggggaagctggcaactaggt

SEQ ID NO: 290539 - DNA, 20 bp, human
gaactccggccccacggaga

SEQ ID NO: 290540 - DNA, 20 bp, human
gggccggctcttaaagggaa

SEQ ID NO: 290541 - DNA, 20 bp, human
gaaggttgtaaggtttgcgc

SEQ ID NO: 290542 - DNA, 20 bp, human
gggctcttaaagggaacggc

SEQ ID NO: 290543 - DNA, 20 bp, human
gtccctgcgaagcggcctct

SEQ ID NO: 290544 - DNA, 20 bp, human
gaccttacaaccttctccgt

SEQ ID NO: 290545 - DNA, 20 bp, human
gggcgggcagacgcgggctg

SEQ ID NO: 290546 - DNA, 20 bp, human
gcatgcggggcaggtcacac

SEQ ID NO: 290547 - DNA, 20 bp, human
gtccgaggagcccgcgacgc

SEQ ID NO: 290548 - DNA, 20 bp, human
gaccgccgcggccatgtccg

SEQ ID NO: 290549 - DNA, 20 bp, human
gggctcctcggacatggccg

SEQ ID NO: 290550 - DNA, 20 bp, human
gcagccgcggcagacgggtt

SEQ ID NO: 290551 - DNA, 20 bp, human
gcacgactgccgccgggacg

SEQ ID NO: 290552 - DNA, 20 bp, human
gtcctcggacatggccgcgg

SEQ ID NO: 290553 - DNA, 20 bp, human
ggtcgcgggctcctcggaca

SEQ ID NO: 290554 - DNA, 20 bp, human
ggcggcggcaaagcccgcga

SEQ ID NO: 290555 - DNA, 20 bp, human
gagggcgcgcgtggtgccgg

SEQ ID NO: 290556 - DNA, 20 bp, human
gcagaggaagggtggttctt

SEQ ID NO: 290557 - DNA, 20 bp, human
ggggccaacgggtctaaagc

SEQ ID NO: 290558 - DNA, 20 bp, human
gaggcggaaccagtgcttgg

SEQ ID NO: 290559 - DNA, 20 bp, human
gtgactgcaggcaggttgtt

SEQ ID NO: 290560 - DNA, 20 bp, human
gtgtgaagtgagggggtcta

SEQ ID NO: 290561 - DNA, 20 bp, human
ggttccgcctcaggcagatc

SEQ ID NO: 290562 - DNA, 20 bp, human
ggcgtgtcgcgcacggtctt

SEQ ID NO: 290563 - DNA, 20 bp, human
gaggagccggccctgactgc

SEQ ID NO: 290564 - DNA, 20 bp, human
gccacttcctgatctgcctg

SEQ ID NO: 290565 - DNA, 20 bp, human
gtgcaccagcacggccactc

SEQ ID NO: 290566 - DNA, 20 bp, human
ggggccggctgggaggaatc

SEQ ID NO: 290567 - DNA, 20 bp, human
gtgtacacacacggcgaggg

SEQ ID NO: 290568 - DNA, 20 bp, human
gcaacaagtgggctccacag

SEQ ID NO: 290569 - DNA, 20 bp, human
gtggagcccacttgttgctc

SEQ ID NO: 290570 - DNA, 20 bp, human
gcgtgtgtgtacaacagctg

SEQ ID NO: 290571 - DNA, 20 bp, human
gaggcccggcgagctaatgc

SEQ ID NO: 290572 - DNA, 20 bp, human
gccttgcctgagcaacaagt

SEQ ID NO: 290573 - DNA, 20 bp, human
ggccgcgcgggatgccgccc

SEQ ID NO: 290574 - DNA, 20 bp, human
gcgcccagattcctcccagc

SEQ ID NO: 290575 - DNA, 20 bp, human
gctcaggcaaggcgcatgcg

SEQ ID NO: 290576 - DNA, 20 bp, human
gggactggggtgcccaccac

SEQ ID NO: 290577 - DNA, 20 bp, human
ggctgggccggttatcgacc

SEQ ID NO: 290578 - DNA, 20 bp, human
gaccgcaagttgagtggagg

SEQ ID NO: 290579 - DNA, 20 bp, human
gtcagcggggtgttgacgag

SEQ ID NO: 290580 - DNA, 20 bp, human
gcggcccagcgtagaaaggg

SEQ ID NO: 290581 - DNA, 20 bp, human
gaaccggcccagcgtagaaa

SEQ ID NO: 290582 - DNA, 20 bp, human
ggaggagaccgcaagttgag

SEQ ID NO: 290583 - DNA, 20 bp, human
ggagaccgcaagttgagtgg

SEQ ID NO: 290584 - DNA, 20 bp, human
ggcctcctccactcaacttg

SEQ ID NO: 290585 - DNA, 20 bp, human
gactgggccgggtcgataac

SEQ ID NO: 290586 - DNA, 20 bp, human
ggcgcgcggagggtcgccaa

SEQ ID NO: 290587 - DNA, 20 bp, human
gccgcttcggggactgtcac

SEQ ID NO: 290588 - DNA, 20 bp, human
gcggctggaggtgcgctctc

SEQ ID NO: 290589 - DNA, 20 bp, human
gcagcccccagccttcacgc

SEQ ID NO: 290590 - DNA, 20 bp, human
gggagggtcgccaagggcgc

SEQ ID NO: 290591 - DNA, 20 bp, human
gccctcggcaaggccatcac

SEQ ID NO: 290592 - DNA, 20 bp, human
ggggccggcgtgaaggctgg

SEQ ID NO: 290593 - DNA, 20 bp, human
gtggggccgtttcccgcgaa

SEQ ID NO: 290594 - DNA, 20 bp, human
gagcgtgtaacggaagacgg

SEQ ID NO: 290595 - DNA, 20 bp, human
ggccgggcgggcgagcctca

SEQ ID NO: 290596 - DNA, 20 bp, human
gctggcgcaggggatcgggg

SEQ ID NO: 290597 - DNA, 20 bp, human
gtcactggcgcaggggatcg

SEQ ID NO: 290598 - DNA, 20 bp, human
ggggcggggtgcccggagtg

SEQ ID NO: 290599 - DNA, 20 bp, human
ggcggtgcctcgtggctgaa

SEQ ID NO: 290600 - DNA, 20 bp, human
ggcctcgtggtcactggcgc

SEQ ID NO: 290601 - DNA, 20 bp, human
gcgcggggcatgaacctgga

SEQ ID NO: 290602 - DNA, 20 bp, human
gggcccggacgaccctgaca

SEQ ID NO: 290603 - DNA, 20 bp, human
gagagcgggcggaggacccc

SEQ ID NO: 290604 - DNA, 20 bp, human
gggcacgcggggcatgaacc

SEQ ID NO: 290605 - DNA, 20 bp, human
gcgaggccccggagtctttg

SEQ ID NO: 290606 - DNA, 20 bp, human
ggggcccggagtggattcgc

SEQ ID NO: 290607 - DNA, 20 bp, human
gagagccagtggccagtcta

SEQ ID NO: 290608 - DNA, 20 bp, human
gcctccagggagatgccaga

SEQ ID NO: 290609 - DNA, 20 bp, human
gccgccccgcgaatccactc

SEQ ID NO: 290610 - DNA, 20 bp, human
gcggggctgcacacaaatga

SEQ ID NO: 290611 - DNA, 20 bp, human
ggcgccgtctggcatctccc

SEQ ID NO: 290612 - DNA, 20 bp, human
gtccgggccccgcactgacc

SEQ ID NO: 290613 - DNA, 20 bp, human
gagccccggaggaccagagt

SEQ ID NO: 290614 - DNA, 20 bp, human
ggacctggcaactgcagatc

SEQ ID NO: 290615 - DNA, 20 bp, human
gcagttgccaggtcagtgcg

SEQ ID NO: 290616 - DNA, 20 bp, human
gaggttggaaatttggtctg

SEQ ID NO: 290617 - DNA, 20 bp, human
gccctggcctcagaacacgc

SEQ ID NO: 290618 - DNA, 20 bp, human
ggaaacgaaagtggctagac

SEQ ID NO: 290619 - DNA, 20 bp, human
ggggtgggaggttggaaatt

SEQ ID NO: 290620 - DNA, 20 bp, human
gctgagggagggagccgagt

SEQ ID NO: 290621 - DNA, 20 bp, human
gagcctccacccggccccag

SEQ ID NO: 290622 - DNA, 20 bp, human
gactgagcccgcgtgttctg

SEQ ID NO: 290623 - DNA, 20 bp, human
gttggtctgggggacccact

SEQ ID NO: 290624 - DNA, 20 bp, human
ggaggggtgccagtcaccag

SEQ ID NO: 290625 - DNA, 20 bp, human
gtcagaaaccagactcactg

SEQ ID NO: 290626 - DNA, 20 bp, human
ggccccccggcgttcgggat

SEQ ID NO: 290627 - DNA, 20 bp, human
gtcttagccggagttagaag

SEQ ID NO: 290628 - DNA, 20 bp, human
gcgggcggatgcgaaggctg

SEQ ID NO: 290629 - DNA, 20 bp, human
gcggccacgcctcccaggtg

SEQ ID NO: 290630 - DNA, 20 bp, human
gaggcctagccttacggctc

SEQ ID NO: 290631 - DNA, 20 bp, human
ggaggagtagggtgggacgc

SEQ ID NO: 290632 - DNA, 20 bp, human
gtagccggagttagaagcgg

SEQ ID NO: 290633 - DNA, 20 bp, human
gagtagggtgggacgctgga

SEQ ID NO: 290634 - DNA, 20 bp, human
gagttagaagcggaggagta

SEQ ID NO: 290635 - DNA, 20 bp, human
gtggacggacgccgctgggc

SEQ ID NO: 290636 - DNA, 20 bp, human
gcggccagcgcggagtaggg

SEQ ID NO: 290637 - DNA, 20 bp, human
gagggaggagtggagggcgt

SEQ ID NO: 290638 - DNA, 20 bp, human
gctcccggcctgcaccgcgt

SEQ ID NO: 290639 - DNA, 20 bp, human
ggagcctgagagatgagggt

SEQ ID NO: 290640 - DNA, 20 bp, human
gctctggcacccaggtactg

SEQ ID NO: 290641 - DNA, 20 bp, human
gggccggggcggggttccgc

SEQ ID NO: 290642 - DNA, 20 bp, human
gagggccggcgcttttatgg

SEQ ID NO: 290643 - DNA, 20 bp, human
gaggcggaggcggggttccg

SEQ ID NO: 290644 - DNA, 20 bp, human
gtcgtctcgcggggaagcgg

SEQ ID NO: 290645 - DNA, 20 bp, human
ggggggagcctgagagatga

SEQ ID NO: 290646 - DNA, 20 bp, human
gcggccagcggctccagaag

SEQ ID NO: 290647 - DNA, 20 bp, human
gccccggcagccacggcagt

SEQ ID NO: 290648 - DNA, 20 bp, human
ggggagccgccgcactcccg

SEQ ID NO: 290649 - DNA, 20 bp, human
gtcctcacacctggggtcca

SEQ ID NO: 290650 - DNA, 20 bp, human
gaggagcggggctcggccag

SEQ ID NO: 290651 - DNA, 20 bp, human
gcggccttaaaaagggtcgt

SEQ ID NO: 290652 - DNA, 20 bp, human
ggagccccgctcctcacacc

SEQ ID NO: 290653 - DNA, 20 bp, human
ggtggggtccgggcctcttc

SEQ ID NO: 290654 - DNA, 20 bp, human
gcggggctgtccgcccgagc

SEQ ID NO: 290655 - DNA, 20 bp, human
gccgcccgagccggcctgga

SEQ ID NO: 290656 - DNA, 20 bp, human
gggaactggcggccactaga

SEQ ID NO: 290657 - DNA, 20 bp, human
gggcccccctgctgcgacag

SEQ ID NO: 290658 - DNA, 20 bp, human
gtctgggaaaaggccctccc

SEQ ID NO: 290659 - DNA, 20 bp, human
ggggaaaaggccctccctgg

SEQ ID NO: 290660 - DNA, 20 bp, human
gggtctgagttgcagggaac

SEQ ID NO: 290661 - DNA, 20 bp, human
gtgacaccgtggcttcccca

SEQ ID NO: 290662 - DNA, 20 bp, human
gaggtcccaggcctgactcc

SEQ ID NO: 290663 - DNA, 20 bp, human
gtgggggaatgcagatgcac

SEQ ID NO: 290664 - DNA, 20 bp, human
gtagggtggggactgtagaa

SEQ ID NO: 290665 - DNA, 20 bp, human
gaggatgccactgtcgcagc

SEQ ID NO: 290666 - DNA, 20 bp, human
gagttaaagtgagtctagtc

SEQ ID NO: 290667 - DNA, 20 bp, human
gtgatcatatgattactcac

SEQ ID NO: 290668 - DNA, 20 bp, human
ggaaacatgactgggtgcat

SEQ ID NO: 290669 - DNA, 20 bp, human
ggaattgtttaactcttacg

SEQ ID NO: 290670 - DNA, 20 bp, human
gggaagtaagcatggatgta

SEQ ID NO: 290671 - DNA, 20 bp, human
gtaagctatgtaggcacaaa

SEQ ID NO: 290672 - DNA, 20 bp, human
gcaaaaattggaaacatgac

SEQ ID NO: 290673 - DNA, 20 bp, human
ggtattgacataagctatgt

SEQ ID NO: 290674 - DNA, 20 bp, human
gtagtcacactcttttaact

SEQ ID NO: 290675 - DNA, 20 bp, human
gatgaattttgtttgtgtgc

SEQ ID NO: 290676 - DNA, 20 bp, human
ggggaagcacagagagttgt

SEQ ID NO: 290677 - DNA, 20 bp, human
gggacacagcattgcgtgat

SEQ ID NO: 290678 - DNA, 20 bp, human
gctcaactgagaagataaac

SEQ ID NO: 290679 - DNA, 20 bp, human
gcacagcattgcgtgatggg

SEQ ID NO: 290680 - DNA, 20 bp, human
gaaactaaatctgagcaact

SEQ ID NO: 290681 - DNA, 20 bp, human
gtatcttctcagttgagttg

SEQ ID NO: 290682 - DNA, 20 bp, human
ggagacttgtgggtattaaa

SEQ ID NO: 290683 - DNA, 20 bp, human
gaatctctatcacacagacg

SEQ ID NO: 290684 - DNA, 20 bp, human
ggtgtgatagagatttctgc

SEQ ID NO: 290685 - DNA, 20 bp, human
gtgtcgagttacacctatag

SEQ ID NO: 290686 - DNA, 20 bp, human
gtggagggcccagtgtgagt

SEQ ID NO: 290687 - DNA, 20 bp, human
gagtcttcaggggaactgga

SEQ ID NO: 290688 - DNA, 20 bp, human
gaatgcgacagtgatgtcag

SEQ ID NO: 290689 - DNA, 20 bp, human
gacagtgatgtcagggggtg

SEQ ID NO: 290690 - DNA, 20 bp, human
ggaggattttgaacaggtct

SEQ ID NO: 290691 - DNA, 20 bp, human
gctgctgcttgctatgataa

SEQ ID NO: 290692 - DNA, 20 bp, human
gggtcaccacccactcacac

SEQ ID NO: 290693 - DNA, 20 bp, human
ggaactgacagtcccctggg

SEQ ID NO: 290694 - DNA, 20 bp, human
gatagcaagcagcagcttat

SEQ ID NO: 290695 - DNA, 20 bp, human
gcaactttcacacttctctg

SEQ ID NO: 290696 - DNA, 20 bp, human
gtggcaggggactctggcaa

SEQ ID NO: 290697 - DNA, 20 bp, human
ggggtctgccaccacaaccc

SEQ ID NO: 290698 - DNA, 20 bp, human
gtccatcaggtagttctcca

SEQ ID NO: 290699 - DNA, 20 bp, human
ggaaataggaggcacatctt

SEQ ID NO: 290700 - DNA, 20 bp, human
gtcactatggcaggggactc

SEQ ID NO: 290701 - DNA, 20 bp, human
gtttcgaagggcactgatga

SEQ ID NO: 290702 - DNA, 20 bp, human
gcttcgaaacacaggacatg

SEQ ID NO: 290703 - DNA, 20 bp, human
gaaccggtatgacttcatca

SEQ ID NO: 290704 - DNA, 20 bp, human
gtcagtgcccttcgaaacac

SEQ ID NO: 290705 - DNA, 20 bp, human
gacaccagttaacatcacta

SEQ ID NO: 290706 - DNA, 20 bp, human
gttccaagacacaccccctt

SEQ ID NO: 290707 - DNA, 20 bp, human
gtctgcgcaggcgcggcgaa

SEQ ID NO: 290708 - DNA, 20 bp, human
gccctgaggccgccaaagag

SEQ ID NO: 290709 - DNA, 20 bp, human
gtgggagagggagtgacgtc

SEQ ID NO: 290710 - DNA, 20 bp, human
gaagaggggcgtgcacactt

SEQ ID NO: 290711 - DNA, 20 bp, human
gcacttcggccgttctgcgc

SEQ ID NO: 290712 - DNA, 20 bp, human
ggacacacccccttgggaga

SEQ ID NO: 290713 - DNA, 20 bp, human
gtgtgcacgcccctctttgg

SEQ ID NO: 290714 - DNA, 20 bp, human
gaagccttttgcgcatgcgt

SEQ ID NO: 290715 - DNA, 20 bp, human
gctacccacgcatgcgcaaa

SEQ ID NO: 290716 - DNA, 20 bp, human
ggggagtctgggaaaacggg

SEQ ID NO: 290717 - DNA, 20 bp, human
gccccggttggcgcgcgtgt

SEQ ID NO: 290718 - DNA, 20 bp, human
gcccgccgcggggattcctg

SEQ ID NO: 290719 - DNA, 20 bp, human
ggccgctgcagcacggctgg

SEQ ID NO: 290720 - DNA, 20 bp, human
gcgggaagacgcaggagtga

SEQ ID NO: 290721 - DNA, 20 bp, human
gcggcccgcaggaatccccg

SEQ ID NO: 290722 - DNA, 20 bp, human
gctaggacagcgcccctgcg

SEQ ID NO: 290723 - DNA, 20 bp, human
gggttggcgcgcgtgtaggg

SEQ ID NO: 290724 - DNA, 20 bp, human
gcgaaagcacgaggggagtc

SEQ ID NO: 290725 - DNA, 20 bp, human
gggcgcaggcgggggtgttt

SEQ ID NO: 290726 - DNA, 20 bp, human
gccgccccgctgcctcgcat

SEQ ID NO: 290727 - DNA, 20 bp, human
gccccggcctcattaatcag

SEQ ID NO: 290728 - DNA, 20 bp, human
gaacgcggcccggggagaaa

SEQ ID NO: 290729 - DNA, 20 bp, human
gggccgagcgcgccgtccgt

SEQ ID NO: 290730 - DNA, 20 bp, human
gggggcgcggcgccaatgcg

SEQ ID NO: 290731 - DNA, 20 bp, human
gcggcgccaatgcgaggcag

SEQ ID NO: 290732 - DNA, 20 bp, human
gcggggcgggggatcgggat

SEQ ID NO: 290733 - DNA, 20 bp, human
ggaaaaggggcgcggaagag

SEQ ID NO: 290734 - DNA, 20 bp, human
gccgcgagcgccgcgccgat

SEQ ID NO: 290735 - DNA, 20 bp, human
gtacgcaggcacacacagcg

SEQ ID NO: 290736 - DNA, 20 bp, human
gcaccagtagaggtgagcaa

SEQ ID NO: 290737 - DNA, 20 bp, human
gcgcgagcggccaccagtag

SEQ ID NO: 290738 - DNA, 20 bp, human
gggctggggcgggcagacga

SEQ ID NO: 290739 - DNA, 20 bp, human
gagaaagcggccggctatca

SEQ ID NO: 290740 - DNA, 20 bp, human
gcgtgcgctcagagtggagt

SEQ ID NO: 290741 - DNA, 20 bp, human
gcgcgggccaaggcaggagg

SEQ ID NO: 290742 - DNA, 20 bp, human
gcactctgagcgcacgacag

SEQ ID NO: 290743 - DNA, 20 bp, human
ggagtccaggaaggcatgag

SEQ ID NO: 290744 - DNA, 20 bp, human
gcggccgccgcgtgaggctg

SEQ ID NO: 290745 - DNA, 20 bp, human
ggggagagggcgccacagtc

SEQ ID NO: 290746 - DNA, 20 bp, human
ggtgggcgcgcgcgtcgggg

SEQ ID NO: 290747 - DNA, 20 bp, human
gtggacgctggtgacagcga

SEQ ID NO: 290748 - DNA, 20 bp, human
gcggccagctactctcgcgg

SEQ ID NO: 290749 - DNA, 20 bp, human
gagcacgtggtgccccgtgc

SEQ ID NO: 290750 - DNA, 20 bp, human
gtagctggccgggccggcac

SEQ ID NO: 290751 - DNA, 20 bp, human
gcgcccaccgcgagagtagc

SEQ ID NO: 290752 - DNA, 20 bp, human
ggcccggccagctactctcg

SEQ ID NO: 290753 - DNA, 20 bp, human
gcggggcaccacgtgctcgc

SEQ ID NO: 290754 - DNA, 20 bp, human
ggtggtgccccgtgccggcc

SEQ ID NO: 290755 - DNA, 20 bp, human
gtctgacaacctgtcgacac

SEQ ID NO: 290756 - DNA, 20 bp, human
gggctgcagcgggcggagca

SEQ ID NO: 290757 - DNA, 20 bp, human
gggggccggagctgctagag

SEQ ID NO: 290758 - DNA, 20 bp, human
gcgctcatctgcatattcgg

SEQ ID NO: 290759 - DNA, 20 bp, human
gagggaccggcaggcttttg

SEQ ID NO: 290760 - DNA, 20 bp, human
gcaggggcgaagacggtggc

SEQ ID NO: 290761 - DNA, 20 bp, human
ggacgtggctccgagtggat

SEQ ID NO: 290762 - DNA, 20 bp, human
gacgcgctcatctgcatatt

SEQ ID NO: 290763 - DNA, 20 bp, human
ggcctctgcctagtccgtga

SEQ ID NO: 290764 - DNA, 20 bp, human
ggcctcctcggggtgcacag

SEQ ID NO: 290765 - DNA, 20 bp, human
gcgcgccggggcacgcagcg

SEQ ID NO: 290766 - DNA, 20 bp, human
gcccgcgcgcgggatccgcg

SEQ ID NO: 290767 - DNA, 20 bp, human
ggcgactcggggaagagacg

SEQ ID NO: 290768 - DNA, 20 bp, human
ggcgcgggatccgcgggggt

SEQ ID NO: 290769 - DNA, 20 bp, human
gcggggaaaagtcgaataag

SEQ ID NO: 290770 - DNA, 20 bp, human
gtttggggaaaggcgaggga

SEQ ID NO: 290771 - DNA, 20 bp, human
gcgtaaggcgcccaggcgat

SEQ ID NO: 290772 - DNA, 20 bp, human
gcccgagtcgccaatcgcct

SEQ ID NO: 290773 - DNA, 20 bp, human
ggtgggcggcctcgcccgta

SEQ ID NO: 290774 - DNA, 20 bp, human
gcggggactgggtgagtgca

SEQ ID NO: 290775 - DNA, 20 bp, human
gacgtcagacccgagatttg

SEQ ID NO: 290776 - DNA, 20 bp, human
ggcgccgcgcgcagaccgga

SEQ ID NO: 290777 - DNA, 20 bp, human
ggggagccggcgacaactaa

SEQ ID NO: 290778 - DNA, 20 bp, human
gggacctcacctacctgcgg

SEQ ID NO: 290779 - DNA, 20 bp, human
gagcctccgcctcctcggaa

SEQ ID NO: 290780 - DNA, 20 bp, human
gcgcgcgccgagcttccgcg

SEQ ID NO: 290781 - DNA, 20 bp, human
gcttccgcgcggagccctcg

SEQ ID NO: 290782 - DNA, 20 bp, human
gagggctccgcgcggaagct

SEQ ID NO: 290783 - DNA, 20 bp, human
gcgcgcgcagaccggacgga

SEQ ID NO: 290784 - DNA, 20 bp, human
gcgggctcggctgacgaccg

SEQ ID NO: 290785 - DNA, 20 bp, human
ggggtctcggaaccccgggg

SEQ ID NO: 290786 - DNA, 20 bp, human
gactggcaggagcttctggg

SEQ ID NO: 290787 - DNA, 20 bp, human
gcgagaggagcgccagcgag

SEQ ID NO: 290788 - DNA, 20 bp, human
ggggaggcgggcgctaggga

SEQ ID NO: 290789 - DNA, 20 bp, human
gagagagccgaggaggaaga

SEQ ID NO: 290790 - DNA, 20 bp, human
gttcccggggtgtagtcggt

SEQ ID NO: 290791 - DNA, 20 bp, human
gtgggcggccgcagccaacc

SEQ ID NO: 290792 - DNA, 20 bp, human
gcctcccaccgactacaccc

SEQ ID NO: 290793 - DNA, 20 bp, human
gggaagagatcggcgctcct

SEQ ID NO: 290794 - DNA, 20 bp, human
gctccttcccggggtgtagt

SEQ ID NO: 290795 - DNA, 20 bp, human
ggtgtagtcggtgggaggac

SEQ ID NO: 290796 - DNA, 20 bp, human
gtctagcccgagtcctgggg

SEQ ID NO: 290797 - DNA, 20 bp, human
gcagctccgggcagcgtcgg

SEQ ID NO: 290798 - DNA, 20 bp, human
ggagcagctccgggcagcgt

SEQ ID NO: 290799 - DNA, 20 bp, human
gaggccagggcttggagagc

SEQ ID NO: 290800 - DNA, 20 bp, human
ggacctggcgagtttcccga

SEQ ID NO: 290801 - DNA, 20 bp, human
gccacaggcccggctctcgt

SEQ ID NO: 290802 - DNA, 20 bp, human
gggaatctagcccgagtcct

SEQ ID NO: 290803 - DNA, 20 bp, human
gcagccagggagcctgaaga

SEQ ID NO: 290804 - DNA, 20 bp, human
gccccctcgaggccgaggtt

SEQ ID NO: 290805 - DNA, 20 bp, human
gcccgaggacaaagatgggc

SEQ ID NO: 290806 - DNA, 20 bp, human
ggtcacgccgactccgtcct

SEQ ID NO: 290807 - DNA, 20 bp, human
gtcaccgccgaggacggagt

SEQ ID NO: 290808 - DNA, 20 bp, human
gtcggcgtgacgtcggggag

SEQ ID NO: 290809 - DNA, 20 bp, human
gacgccgactccgtcctcgg

SEQ ID NO: 290810 - DNA, 20 bp, human
ggggcggggcaagccgctcg

SEQ ID NO: 290811 - DNA, 20 bp, human
gctgggttgcgcacggtctc

SEQ ID NO: 290812 - DNA, 20 bp, human
ggacggagtcggcgtgacgt

SEQ ID NO: 290813 - DNA, 20 bp, human
gacgctgcaccttgccccgg

SEQ ID NO: 290814 - DNA, 20 bp, human
ggggttttgccgctcaacgc

SEQ ID NO: 290815 - DNA, 20 bp, human
gctagcagctgggttgcgca

SEQ ID NO: 290816 - DNA, 20 bp, human
gtcctcccgcactacccaat

SEQ ID NO: 290817 - DNA, 20 bp, human
gagccggagaggtgctctaa

SEQ ID NO: 290818 - DNA, 20 bp, human
gcccccccaacatgcctatt

SEQ ID NO: 290819 - DNA, 20 bp, human
gtaaagggaaggaacggggc

SEQ ID NO: 290820 - DNA, 20 bp, human
ggagaggtgctctaaaggga

SEQ ID NO: 290821 - DNA, 20 bp, human
gagcacctctccggcttcct

SEQ ID NO: 290822 - DNA, 20 bp, human
gtctgaggggatggcatggg

SEQ ID NO: 290823 - DNA, 20 bp, human
gtacccaataggcatgttgg

SEQ ID NO: 290824 - DNA, 20 bp, human
gtgctctaaagggaaggaac

SEQ ID NO: 290825 - DNA, 20 bp, human
gggaggcggagagaacgaac

SEQ ID NO: 290826 - DNA, 20 bp, human
gaaggtctgaagtcgctgga

SEQ ID NO: 290827 - DNA, 20 bp, human
gcgggaaggtctgaagtcgc

SEQ ID NO: 290828 - DNA, 20 bp, human
gcccccgagaggcgtggtca

SEQ ID NO: 290829 - DNA, 20 bp, human
ggagaggcgtggtcaaggcg

SEQ ID NO: 290830 - DNA, 20 bp, human
ggcggggcgcgtctgcgagt

SEQ ID NO: 290831 - DNA, 20 bp, human
ggcacggagcggtaaagcgc

SEQ ID NO: 290832 - DNA, 20 bp, human
gagccggtaccattcgtcta

SEQ ID NO: 290833 - DNA, 20 bp, human
gggcggacgcgtgcacggag

SEQ ID NO: 290834 - DNA, 20 bp, human
gcagaaggcggacgcgtgca

SEQ ID NO: 290835 - DNA, 20 bp, human
gcctcggcgtcgctctggac

SEQ ID NO: 290836 - DNA, 20 bp, human
gtggggcatgcctcgggaaa

SEQ ID NO: 290837 - DNA, 20 bp, human
ggccaccagcgcaggctcgg

SEQ ID NO: 290838 - DNA, 20 bp, human
gagcctgaggcacacacgtc

SEQ ID NO: 290839 - DNA, 20 bp, human
gctgaggcacacacgtcagg

SEQ ID NO: 290840 - DNA, 20 bp, human
gcagggaaaagcaaaagtgg

SEQ ID NO: 290841 - DNA, 20 bp, human
gtgtgcctcaggcttataat

SEQ ID NO: 290842 - DNA, 20 bp, human
ggcaaaagtggcggggactc

SEQ ID NO: 290843 - DNA, 20 bp, human
gggggactccggacagcgga

SEQ ID NO: 290844 - DNA, 20 bp, human
gtaggtgtttccagggtgtt

SEQ ID NO: 290845 - DNA, 20 bp, human
gcggccctattataagcctg

SEQ ID NO: 290846 - DNA, 20 bp, human
gagctccgtcagccctgact

SEQ ID NO: 290847 - DNA, 20 bp, human
gctgccggtagcccaggaga

SEQ ID NO: 290848 - DNA, 20 bp, human
gaaggccgggcacgtgggct

SEQ ID NO: 290849 - DNA, 20 bp, human
ggaagtcaggggcggaaggc

SEQ ID NO: 290850 - DNA, 20 bp, human
gacgtcaaatgcgtcatctg

SEQ ID NO: 290851 - DNA, 20 bp, human
gcaaatgcgtcatctgagga

SEQ ID NO: 290852 - DNA, 20 bp, human
gcgggccgagtcagggctga

SEQ ID NO: 290853 - DNA, 20 bp, human
gagctggcaggctccatgtc

SEQ ID NO: 290854 - DNA, 20 bp, human
gcctgggctaccggcaggtg

SEQ ID NO: 290855 - DNA, 20 bp, human
gtagaaactgaaacagggtc

SEQ ID NO: 290856 - DNA, 20 bp, human
gacaacgcgaaggtgtggga

SEQ ID NO: 290857 - DNA, 20 bp, human
ggcagcccgccggacacctc

SEQ ID NO: 290858 - DNA, 20 bp, human
gtcagcgtcagagacacgta

SEQ ID NO: 290859 - DNA, 20 bp, human
gtcactacctggggtcgggg

SEQ ID NO: 290860 - DNA, 20 bp, human
gaagtgaagccggaggtgtc

SEQ ID NO: 290861 - DNA, 20 bp, human
gttcacttccgtaagaggag

SEQ ID NO: 290862 - DNA, 20 bp, human
gtgaagccggaggtgtccgg

SEQ ID NO: 290863 - DNA, 20 bp, human
gctgccttcccgggcttcgt

SEQ ID NO: 290864 - DNA, 20 bp, human
gggcgccccccagacgtcac

SEQ ID NO: 290865 - DNA, 20 bp, human
gggagaggagtgtacggcaa

SEQ ID NO: 290866 - DNA, 20 bp, human
gtggctcgccgagcggtcag

SEQ ID NO: 290867 - DNA, 20 bp, human
ggctcccgaggcaacttgct

SEQ ID NO: 290868 - DNA, 20 bp, human
gaatggcgatggagctgagt

SEQ ID NO: 290869 - DNA, 20 bp, human
gaggcgagcgccgcgcccat

SEQ ID NO: 290870 - DNA, 20 bp, human
ggagccagcgggagaggatt

SEQ ID NO: 290871 - DNA, 20 bp, human
gtggtctgacgcagcgcgcg

SEQ ID NO: 290872 - DNA, 20 bp, human
ggggatgtgcaccacggcgt

SEQ ID NO: 290873 - DNA, 20 bp, human
gtgcgtcagaccaatggcga

SEQ ID NO: 290874 - DNA, 20 bp, human
gagcccggcagcccgagctt

SEQ ID NO: 290875 - DNA, 20 bp, human
gagcggtcagtggcgctcag

SEQ ID NO: 290876 - DNA, 20 bp, human
ggaagtcggggtacaggaag

SEQ ID NO: 290877 - DNA, 20 bp, human
ggaggttaatacttcggaga

SEQ ID NO: 290878 - DNA, 20 bp, human
gaaaggaagtaagggaagtc

SEQ ID NO: 290879 - DNA, 20 bp, human
ggacacagagagtataatct

SEQ ID NO: 290880 - DNA, 20 bp, human
gttgggggaggttaatactt

SEQ ID NO: 290881 - DNA, 20 bp, human
gtgagatcttccatttcata

SEQ ID NO: 290882 - DNA, 20 bp, human
ggtaagggaagtcggggtac

SEQ ID NO: 290883 - DNA, 20 bp, human
ggagggagtgaaaggaagta

SEQ ID NO: 290884 - DNA, 20 bp, human
gctcacattgagtaggcgga

SEQ ID NO: 290885 - DNA, 20 bp, human
gtagggtgaagacttgactt

SEQ ID NO: 290886 - DNA, 20 bp, human
gcatgagagaggatccttgt

SEQ ID NO: 290887 - DNA, 20 bp, human
gaacggccgcggagccagct

SEQ ID NO: 290888 - DNA, 20 bp, human
ggaagtgggccaaccctgat

SEQ ID NO: 290889 - DNA, 20 bp, human
gattggcccggagtgaacaa

SEQ ID NO: 290890 - DNA, 20 bp, human
gagaactgccggggatgcgg

SEQ ID NO: 290891 - DNA, 20 bp, human
gagcttccccagaactgccg

SEQ ID NO: 290892 - DNA, 20 bp, human
gctgatgggcggggtgggtt

SEQ ID NO: 290893 - DNA, 20 bp, human
gcaggcccggggcatgagag

SEQ ID NO: 290894 - DNA, 20 bp, human
gtggggatccaggggctgat

SEQ ID NO: 290895 - DNA, 20 bp, human
ggttcactccgggccaatca

SEQ ID NO: 290896 - DNA, 20 bp, human
ggggccaggaggattttagc

SEQ ID NO: 290897 - DNA, 20 bp, human
ggcggtcatggccggaggag

SEQ ID NO: 290898 - DNA, 20 bp, human
gtgtctgctgcggtcatggc

SEQ ID NO: 290899 - DNA, 20 bp, human
gccaaggcaaagcataccta

SEQ ID NO: 290900 - DNA, 20 bp, human
gaaggacccaagaaatgatg

SEQ ID NO: 290901 - DNA, 20 bp, human
ggtggtgtgcactgcacaag

SEQ ID NO: 290902 - DNA, 20 bp, human
ggacaccagaaacttgaggg

SEQ ID NO: 290903 - DNA, 20 bp, human
gaggacctctcagctgactt

SEQ ID NO: 290904 - DNA, 20 bp, human
gtgcacaaggggcctcgtct

SEQ ID NO: 290905 - DNA, 20 bp, human
ggggaggcctgttggacata

SEQ ID NO: 290906 - DNA, 20 bp, human
gcgtagcgacggcaggagta

SEQ ID NO: 290907 - DNA, 20 bp, human
gcctccccatgggtcggcgg

SEQ ID NO: 290908 - DNA, 20 bp, human
ggaagccggctgttgtgtga

SEQ ID NO: 290909 - DNA, 20 bp, human
gcacccggcccggggttccg

SEQ ID NO: 290910 - DNA, 20 bp, human
gggtcccgctcgaagtctgt

SEQ ID NO: 290911 - DNA, 20 bp, human
gcgccctccccatgggtcgg

SEQ ID NO: 290912 - DNA, 20 bp, human
ggggaggaggcggctagcag

SEQ ID NO: 290913 - DNA, 20 bp, human
gggccatgggggtctctcga

SEQ ID NO: 290914 - DNA, 20 bp, human
gtcgctacgggcggcccagc

SEQ ID NO: 290915 - DNA, 20 bp, human
gtccccccccgccgacccat

SEQ ID NO: 290916 - DNA, 20 bp, human
gggagcgcggagagtagtgg

SEQ ID NO: 290917 - DNA, 20 bp, human
gtggctcggggcggcgaggg

SEQ ID NO: 290918 - DNA, 20 bp, human
ggagtggctcggggcggcga

SEQ ID NO: 290919 - DNA, 20 bp, human
gagtaggagggcttcagctg

SEQ ID NO: 290920 - DNA, 20 bp, human
gcgcactcggagtcccgggg

SEQ ID NO: 290921 - DNA, 20 bp, human
ggcgcggagagtagtggagg

SEQ ID NO: 290922 - DNA, 20 bp, human
ggccccgcactcggagtccc

SEQ ID NO: 290923 - DNA, 20 bp, human
gcaagcgtggaggtaactcc

SEQ ID NO: 290924 - DNA, 20 bp, human
gtgtgcccggggcccccatc

SEQ ID NO: 290925 - DNA, 20 bp, human
gagtagtggaggtggcttgc

SEQ ID NO: 290926 - DNA, 20 bp, human
gtggccccggctcctcgcgt

SEQ ID NO: 290927 - DNA, 20 bp, human
gccgcccacagggtcaagac

SEQ ID NO: 290928 - DNA, 20 bp, human
gcacagggtcaagacgggtc

SEQ ID NO: 290929 - DNA, 20 bp, human
gggcgcccacgcgaggagcc

SEQ ID NO: 290930 - DNA, 20 bp, human
gtcaaagagagccgcccaca

SEQ ID NO: 290931 - DNA, 20 bp, human
gtgggcggctctctttgatc

SEQ ID NO: 290932 - DNA, 20 bp, human
gcggggcgcgactgggttcg

SEQ ID NO: 290933 - DNA, 20 bp, human
gagcggcggggactgagggc

SEQ ID NO: 290934 - DNA, 20 bp, human
gctgtgcgggcgcccacgcg

SEQ ID NO: 290935 - DNA, 20 bp, human
ggcgaacaggaattcgctgg

SEQ ID NO: 290936 - DNA, 20 bp, human
gtaagagagcgcgcgagcag

SEQ ID NO: 290937 - DNA, 20 bp, human
gcgggccgcggcgtaagggt

SEQ ID NO: 290938 - DNA, 20 bp, human
gggcgagcgcaggcgctccc

SEQ ID NO: 290939 - DNA, 20 bp, human
gccagctcgcggaggcgaag

SEQ ID NO: 290940 - DNA, 20 bp, human
gcgcgcgagcagcggtcgtc

SEQ ID NO: 290941 - DNA, 20 bp, human
ggccgcggcgtaagggtggg

SEQ ID NO: 290942 - DNA, 20 bp, human
gacgcagcggcccgggaagc

SEQ ID NO: 290943 - DNA, 20 bp, human
gggcagcccaggcgggtctt

SEQ ID NO: 290944 - DNA, 20 bp, human
ggagggcgggccgcggcgta

SEQ ID NO: 290945 - DNA, 20 bp, human
gccgcccagtcgcacccagc

SEQ ID NO: 290946 - DNA, 20 bp, human
gagcagctgcatatgcggat

SEQ ID NO: 290947 - DNA, 20 bp, human
gcatatgcggattggttgag

SEQ ID NO: 290948 - DNA, 20 bp, human
gggcagtggcacatgcggat

SEQ ID NO: 290949 - DNA, 20 bp, human
gagctcgcaaaggcgccgtg

SEQ ID NO: 290950 - DNA, 20 bp, human
ggagcatgatgagtgtcgat

SEQ ID NO: 290951 - DNA, 20 bp, human
ggccctctacggctctccat

SEQ ID NO: 290952 - DNA, 20 bp, human
gcaagtgggcggaaaacgga

SEQ ID NO: 290953 - DNA, 20 bp, human
gtgccaatggagagccgtag

SEQ ID NO: 290954 - DNA, 20 bp, human
ggtcgcgcggtggtctccga

SEQ ID NO: 290955 - DNA, 20 bp, human
gagttggtgagcgccgattg

SEQ ID NO: 290956 - DNA, 20 bp, human
ggacggtgggtcaggcccga

SEQ ID NO: 290957 - DNA, 20 bp, human
gtggcagccgccattttctg

SEQ ID NO: 290958 - DNA, 20 bp, human
gccggagccacgtgtggatg

SEQ ID NO: 290959 - DNA, 20 bp, human
ggggtgggcagagggacggt

SEQ ID NO: 290960 - DNA, 20 bp, human
gggactgatagtaactgggg

SEQ ID NO: 290961 - DNA, 20 bp, human
ggggctgatggtgaccaggg

SEQ ID NO: 290962 - DNA, 20 bp, human
ggggtggatggtaaccgggg

SEQ ID NO: 290963 - DNA, 20 bp, human
ggaacacagggaccaggaga

SEQ ID NO: 290964 - DNA, 20 bp, human
ggaccagggcggatggtgac

SEQ ID NO: 290965 - DNA, 20 bp, human
gaaccgggactgatagtaac

SEQ ID NO: 290966 - DNA, 20 bp, human
gaaagatcgcagatactcaa

SEQ ID NO: 290967 - DNA, 20 bp, human
gcctccctgctttaaaattt

SEQ ID NO: 290968 - DNA, 20 bp, human
gtcaagggccatgagtatgc

SEQ ID NO: 290969 - DNA, 20 bp, human
gctcccgcaggcgctgggac

SEQ ID NO: 290970 - DNA, 20 bp, human
gagtcacaggatgggacgta

SEQ ID NO: 290971 - DNA, 20 bp, human
gtcttccgaaattttaaagc

SEQ ID NO: 290972 - DNA, 20 bp, human
gtgagtatgcaggagaggtc

SEQ ID NO: 290973 - DNA, 20 bp, human
gtccacttgcggcgacagct

SEQ ID NO: 290974 - DNA, 20 bp, human
gttaaaatttcggaagagat

SEQ ID NO: 290975 - DNA, 20 bp, human
gaatggaattcagataatcg

SEQ ID NO: 290976 - DNA, 20 bp, human
gccgactccaaaggaaaccg

SEQ ID NO: 290977 - DNA, 20 bp, human
gggggcacggcagacgttgg

SEQ ID NO: 290978 - DNA, 20 bp, human
ggggacccacgcgctgactc

SEQ ID NO: 290979 - DNA, 20 bp, human
gccggccgcgccgactccaa

SEQ ID NO: 290980 - DNA, 20 bp, human
gcgccgcgggaagtagtccc

SEQ ID NO: 290981 - DNA, 20 bp, human
gaaggagggcgtggctatat

SEQ ID NO: 290982 - DNA, 20 bp, human
gtccaaaggaaaccgaggga

SEQ ID NO: 290983 - DNA, 20 bp, human
gccccagcagctgactcagt

SEQ ID NO: 290984 - DNA, 20 bp, human
ggtctgccgtgcccccgccg

SEQ ID NO: 290985 - DNA, 20 bp, human
ggtgccccgagtcagcgcgt

SEQ ID NO: 290986 - DNA, 20 bp, human
gggaggcagtggggatctga

SEQ ID NO: 290987 - DNA, 20 bp, human
gtattggaggccccagggag

SEQ ID NO: 290988 - DNA, 20 bp, human
gagagcctgtggtcatgtgt

SEQ ID NO: 290989 - DNA, 20 bp, human
gctgcatccccagccttaag

SEQ ID NO: 290990 - DNA, 20 bp, human
gaaactctccacgcccctta

SEQ ID NO: 290991 - DNA, 20 bp, human
gacaggtattggaggcccca

SEQ ID NO: 290992 - DNA, 20 bp, human
gtctgaaggacaggtattgg

SEQ ID NO: 290993 - DNA, 20 bp, human
gacatgaccacaggctctcc

SEQ ID NO: 290994 - DNA, 20 bp, human
gggatctgaaggacaggtat

SEQ ID NO: 290995 - DNA, 20 bp, human
gctccacgccccttaaggct

SEQ ID NO: 290996 - DNA, 20 bp, human
gacagggaccggaactgaat

SEQ ID NO: 290997 - DNA, 20 bp, human
gaaagggaccggaagtgaaa

SEQ ID NO: 290998 - DNA, 20 bp, human
gcggaactgaatgggagtac

SEQ ID NO: 290999 - DNA, 20 bp, human
gagggaggaccggaagtgaa

SEQ ID NO: 291000 - DNA, 20 bp, human
gccgacgctcgcaggaactg

SEQ ID NO: 291001 - DNA, 20 bp, human
ggggaccggaagtgaaaggg

SEQ ID NO: 291002 - DNA, 20 bp, human
gtgaaagggagatccggccg

SEQ ID NO: 291003 - DNA, 20 bp, human
gggacgaagccgacgctcgc

SEQ ID NO: 291004 - DNA, 20 bp, human
gcggaagtgaaagggagatc

SEQ ID NO: 291005 - DNA, 20 bp, human
ggggagatccggccggggat

SEQ ID NO: 291006 - DNA, 20 bp, human
gacagggaccggaactgaat

SEQ ID NO: 291007 - DNA, 20 bp, human
gaaagggaccggaagtgaaa

SEQ ID NO: 291008 - DNA, 20 bp, human
gcggaactgaatgggagtac

SEQ ID NO: 291009 - DNA, 20 bp, human
gagggaggaccggaagtgaa

SEQ ID NO: 291010 - DNA, 20 bp, human
gccgacgctcgcaggaactg

SEQ ID NO: 291011 - DNA, 20 bp, human
ggggaccggaagtgaaaggg

SEQ ID NO: 291012 - DNA, 20 bp, human
gtgaaagggagatccggccg

SEQ ID NO: 291013 - DNA, 20 bp, human
gggacgaagccgacgctcgc

SEQ ID NO: 291014 - DNA, 20 bp, human
gcggaagtgaaagggagatc

SEQ ID NO: 291015 - DNA, 20 bp, human
ggggagatccggccggggat

SEQ ID NO: 291016 - DNA, 20 bp, human
ggggccgcagcgcttttctc

SEQ ID NO: 291017 - DNA, 20 bp, human
ggagggaggggcccaacgtc

SEQ ID NO: 291018 - DNA, 20 bp, human
gtggccatcgggtccccgcc

SEQ ID NO: 291019 - DNA, 20 bp, human
gagcccagccacaagccagg

SEQ ID NO: 291020 - DNA, 20 bp, human
gggaagctgggcctccgggg

SEQ ID NO: 291021 - DNA, 20 bp, human
ggaaccgggtctccagacgt

SEQ ID NO: 291022 - DNA, 20 bp, human
gggttgtcgggcctcgaacc

SEQ ID NO: 291023 - DNA, 20 bp, human
gtgtcccccgagatggatgg

SEQ ID NO: 291024 - DNA, 20 bp, human
gtggccacttccgccaggcg

SEQ ID NO: 291025 - DNA, 20 bp, human
gacgcctggccacttccgcc

SEQ ID NO: 291026 - DNA, 20 bp, human
gcaggtgagatgggcgcgag

SEQ ID NO: 291027 - DNA, 20 bp, human
gcagccagctcttcaagcca

SEQ ID NO: 291028 - DNA, 20 bp, human
gagctcttcaagccaggggc

SEQ ID NO: 291029 - DNA, 20 bp, human
gagtccttataggctctggt

SEQ ID NO: 291030 - DNA, 20 bp, human
gccgcccaccagagcctata

SEQ ID NO: 291031 - DNA, 20 bp, human
gcttgaagagctggctgcgg

SEQ ID NO: 291032 - DNA, 20 bp, human
gcttcaagccaggggcgggc

SEQ ID NO: 291033 - DNA, 20 bp, human
gaggcgcctgagcgcggaag

SEQ ID NO: 291034 - DNA, 20 bp, human
gcgctctagtagctgtggtc

SEQ ID NO: 291035 - DNA, 20 bp, human
ggccttgcgcgccagccgtc

SEQ ID NO: 291036 - DNA, 20 bp, human
gtaaaaaagcagtggagcta

SEQ ID NO: 291037 - DNA, 20 bp, human
gcctcccgacagtgtcgtgc

SEQ ID NO: 291038 - DNA, 20 bp, human
gctgccggaagtgagcgtga

SEQ ID NO: 291039 - DNA, 20 bp, human
gcgcccccgccatcgcgctc

SEQ ID NO: 291040 - DNA, 20 bp, human
gccggaagtgagcgtgaggg

SEQ ID NO: 291041 - DNA, 20 bp, human
gccccccgcacgacactgtc

SEQ ID NO: 291042 - DNA, 20 bp, human
ggtcggaagggcagccctag

SEQ ID NO: 291043 - DNA, 20 bp, human
ggacgcgtaagagccgctgc

SEQ ID NO: 291044 - DNA, 20 bp, human
gactcacggcagaagtgagc

SEQ ID NO: 291045 - DNA, 20 bp, human
ggggctgcgcgccactctct

SEQ ID NO: 291046 - DNA, 20 bp, human
ggagaaaaggagtggcccgt

SEQ ID NO: 291047 - DNA, 20 bp, human
gggtaaaccaaccctgacgg

SEQ ID NO: 291048 - DNA, 20 bp, human
gggccactccttttctccac

SEQ ID NO: 291049 - DNA, 20 bp, human
ggaacagatcgacccccgtc

SEQ ID NO: 291050 - DNA, 20 bp, human
ggtaaggttaaaggaggaag

SEQ ID NO: 291051 - DNA, 20 bp, human
ggtcagggttggtttaccca

SEQ ID NO: 291052 - DNA, 20 bp, human
gtgtcactcacatcagagtt

SEQ ID NO: 291053 - DNA, 20 bp, human
gaggcagagattggaggttc

SEQ ID NO: 291054 - DNA, 20 bp, human
gtcctctgtaaggttaaagg

SEQ ID NO: 291055 - DNA, 20 bp, human
gttggcaacagggctcccaa

SEQ ID NO: 291056 - DNA, 20 bp, human
ggggcgaggacgcagatcgg

SEQ ID NO: 291057 - DNA, 20 bp, human
ggggggacgggaacgaagag

SEQ ID NO: 291058 - DNA, 20 bp, human
ggctcggcaacggggatctt

SEQ ID NO: 291059 - DNA, 20 bp, human
gtggggagagcacccggaag

SEQ ID NO: 291060 - DNA, 20 bp, human
gaggacaaggtcgggagagg

SEQ ID NO: 291061 - DNA, 20 bp, human
ggggagcgaggacgcagaga

SEQ ID NO: 291062 - DNA, 20 bp, human
gcaaccgaagcatggcggtg

SEQ ID NO: 291063 - DNA, 20 bp, human
gggagaggagcgaggacgga

SEQ ID NO: 291064 - DNA, 20 bp, human
gggcgggggcggaaatgcgc

SEQ ID NO: 291065 - DNA, 20 bp, human
gccgccccaccgccatgctt

SEQ ID NO: 291066 - DNA, 20 bp, human
gcaaatgcccagcgtgttct

SEQ ID NO: 291067 - DNA, 20 bp, human
gtcaccaccaagaacacgct

SEQ ID NO: 291068 - DNA, 20 bp, human
ggctgcttgctgtaaacaac

SEQ ID NO: 291069 - DNA, 20 bp, human
gtctgcctcattggctgttg

SEQ ID NO: 291070 - DNA, 20 bp, human
gatgcccagcgtgttcttgg

SEQ ID NO: 291071 - DNA, 20 bp, human
gttgagggcgaacagctgat

SEQ ID NO: 291072 - DNA, 20 bp, human
ggttctggaaaaatggttat

SEQ ID NO: 291073 - DNA, 20 bp, human
ggccttggaattcaggagaa

SEQ ID NO: 291074 - DNA, 20 bp, human
gtcgccctcaacttattttt

SEQ ID NO: 291075 - DNA, 20 bp, human
ggaaatctgccttggaattc

SEQ ID NO: 291076 - DNA, 20 bp, human
gcccgggccgggagaagtaa

SEQ ID NO: 291077 - DNA, 20 bp, human
ggaaagctgcctcccgttaa

SEQ ID NO: 291078 - DNA, 20 bp, human
gcctgggcgcccttaacggg

SEQ ID NO: 291079 - DNA, 20 bp, human
gccctctgcgcaatggaccc

SEQ ID NO: 291080 - DNA, 20 bp, human
gcgggtaagggctggacctt

SEQ ID NO: 291081 - DNA, 20 bp, human
gggagaagtaaggggtgtga

SEQ ID NO: 291082 - DNA, 20 bp, human
gaagggctggaccttcggga

SEQ ID NO: 291083 - DNA, 20 bp, human
gacttctcccggcccgggca

SEQ ID NO: 291084 - DNA, 20 bp, human
gagggcgctttgacagtgcc

SEQ ID NO: 291085 - DNA, 20 bp, human
ggtgtccgcaggggatggaa

SEQ ID NO: 291086 - DNA, 20 bp, human
gagtgatggtggggaactgt

SEQ ID NO: 291087 - DNA, 20 bp, human
ggaatgggaggagtgatggt

SEQ ID NO: 291088 - DNA, 20 bp, human
gttctctggatatagagatg

SEQ ID NO: 291089 - DNA, 20 bp, human
gggcaaaaaaatatgttctc

SEQ ID NO: 291090 - DNA, 20 bp, human
gccatcctgccccctcccaa

SEQ ID NO: 291091 - DNA, 20 bp, human
ggatcgctcagtgttttcct

SEQ ID NO: 291092 - DNA, 20 bp, human
gtaaagttggaaggaatggg

SEQ ID NO: 291093 - DNA, 20 bp, human
gctttcctcaaatttggaac

SEQ ID NO: 291094 - DNA, 20 bp, human
gcactcctgttccaaatttg

SEQ ID NO: 291095 - DNA, 20 bp, human
gctcagtgttttccttggtc

SEQ ID NO: 291096 - DNA, 20 bp, human
gcggagaaggagcgctgcac

SEQ ID NO: 291097 - DNA, 20 bp, human
gaggcggtgcggtgctacac

SEQ ID NO: 291098 - DNA, 20 bp, human
gcggtgctacactggtgagg

SEQ ID NO: 291099 - DNA, 20 bp, human
gagggctcgagcggagggga

SEQ ID NO: 291100 - DNA, 20 bp, human
gccaaccccacgtcagcctc

SEQ ID NO: 291101 - DNA, 20 bp, human
gcccgagccggagtggtgtc

SEQ ID NO: 291102 - DNA, 20 bp, human
gacagctgcggctcattcag

SEQ ID NO: 291103 - DNA, 20 bp, human
gtcgggctctgggccagtct

SEQ ID NO: 291104 - DNA, 20 bp, human
gactggcccagagcccgagc

SEQ ID NO: 291105 - DNA, 20 bp, human
ggtggcagagcggccgagac

SEQ ID NO: 291106 - DNA, 20 bp, human
gggccccgcgggctgcacct

SEQ ID NO: 291107 - DNA, 20 bp, human
gcccgcgtgtggacgagccg

SEQ ID NO: 291108 - DNA, 20 bp, human
gtgctggcgacaggctgcgg

SEQ ID NO: 291109 - DNA, 20 bp, human
gggagcagatccggtgtttg

SEQ ID NO: 291110 - DNA, 20 bp, human
ggaggggccacgttctcccg

SEQ ID NO: 291111 - DNA, 20 bp, human
ggacgggtgggcatatccga

SEQ ID NO: 291112 - DNA, 20 bp, human
gggtgtttgcggaatcagga

SEQ ID NO: 291113 - DNA, 20 bp, human
gttgcggaatcaggaggggc

SEQ ID NO: 291114 - DNA, 20 bp, human
gcaccttggctcccgtacag

SEQ ID NO: 291115 - DNA, 20 bp, human
gtgcccacccgtcccgtcca

SEQ ID NO: 291116 - DNA, 20 bp, human
ggtacagccagatgggggaa

SEQ ID NO: 291117 - DNA, 20 bp, human
gcacggtggtagtagagatg

SEQ ID NO: 291118 - DNA, 20 bp, human
ggctagaattgccaggaagt

SEQ ID NO: 291119 - DNA, 20 bp, human
gggtgaggccacccagaggg

SEQ ID NO: 291120 - DNA, 20 bp, human
ggccatgagcatccaccctc

SEQ ID NO: 291121 - DNA, 20 bp, human
gaagcctcaggttttatcgg

SEQ ID NO: 291122 - DNA, 20 bp, human
gctgcccccgataaaacctg

SEQ ID NO: 291123 - DNA, 20 bp, human
gatagcccctggactcatgg

SEQ ID NO: 291124 - DNA, 20 bp, human
gcgcccaaggtcctagaagg

SEQ ID NO: 291125 - DNA, 20 bp, human
gtgagcaacgggcagagcaa

SEQ ID NO: 291126 - DNA, 20 bp, human
gcggccgcctcctcttaaag

SEQ ID NO: 291127 - DNA, 20 bp, human
gagaccgccagccacctctt

SEQ ID NO: 291128 - DNA, 20 bp, human
gcgggctgcgctttccttcc

SEQ ID NO: 291129 - DNA, 20 bp, human
gacctgtcggcaacccccaa

SEQ ID NO: 291130 - DNA, 20 bp, human
gctgggctcgcaaggtgggg

SEQ ID NO: 291131 - DNA, 20 bp, human
ggaggtgcgggactgggcgt

SEQ ID NO: 291132 - DNA, 20 bp, human
gcgggctgggctcgcaaggt

SEQ ID NO: 291133 - DNA, 20 bp, human
gttctcccccaaacacctgt

SEQ ID NO: 291134 - DNA, 20 bp, human
gtctcggagaagcgaggggc

SEQ ID NO: 291135 - DNA, 20 bp, human
ggcaagatggatgtgacggg

SEQ ID NO: 291136 - DNA, 20 bp, human
gctcccagcccgcagagcgc

SEQ ID NO: 291137 - DNA, 20 bp, human
gtagaagggtgctgagatgt

SEQ ID NO: 291138 - DNA, 20 bp, human
ggagccatcccgcgctctgc

SEQ ID NO: 291139 - DNA, 20 bp, human
gtgcctacgcgcggctgcag

SEQ ID NO: 291140 - DNA, 20 bp, human
gaggactcgcgtcctggccc

SEQ ID NO: 291141 - DNA, 20 bp, human
gtggggaacctcggctgcgc

SEQ ID NO: 291142 - DNA, 20 bp, human
ggggctgggcggtcacagcg

SEQ ID NO: 291143 - DNA, 20 bp, human
gcagcccgcagagcgcggga

SEQ ID NO: 291144 - DNA, 20 bp, human
gccacccagcggcccgtacc

SEQ ID NO: 291145 - DNA, 20 bp, human
gtcggggagtgggactgcgg

SEQ ID NO: 291146 - DNA, 20 bp, human
gctaacccagtccagacaac

SEQ ID NO: 291147 - DNA, 20 bp, human
ggacgcgggctcagagttcc

SEQ ID NO: 291148 - DNA, 20 bp, human
gccccacgccccttaggggt

SEQ ID NO: 291149 - DNA, 20 bp, human
gcggaaaacgagtcggaaaa

SEQ ID NO: 291150 - DNA, 20 bp, human
gcccccccccacgcccctta

SEQ ID NO: 291151 - DNA, 20 bp, human
gagccccctcggcaggcggg

SEQ ID NO: 291152 - DNA, 20 bp, human
gggaagccggttgtctggac

SEQ ID NO: 291153 - DNA, 20 bp, human
gtgtctggactgggttagac

SEQ ID NO: 291154 - DNA, 20 bp, human
gaggcgaatgactcaacgcg

SEQ ID NO: 291155 - DNA, 20 bp, human
gttacgttgtacatctggaa

SEQ ID NO: 291156 - DNA, 20 bp, human
gtgcccggaagccacgacgt

SEQ ID NO: 291157 - DNA, 20 bp, human
gcagctggagacgccagagc

SEQ ID NO: 291158 - DNA, 20 bp, human
gagccacgacgtgggagccc

SEQ ID NO: 291159 - DNA, 20 bp, human
gcagctgcccggtacctgcc

SEQ ID NO: 291160 - DNA, 20 bp, human
gacgccagagccggcgggta

SEQ ID NO: 291161 - DNA, 20 bp, human
gggagagcgcgacccgtccc

SEQ ID NO: 291162 - DNA, 20 bp, human
gagagccggcgggtaaggtg

SEQ ID NO: 291163 - DNA, 20 bp, human
gcacgacgtgggagccccgg

SEQ ID NO: 291164 - DNA, 20 bp, human
gccggcgggtaaggtgcggg

SEQ ID NO: 291165 - DNA, 20 bp, human
gctcccacgtcgtggcttcc

SEQ ID NO: 291166 - DNA, 20 bp, human
ggacccaagcccgtctccaa

SEQ ID NO: 291167 - DNA, 20 bp, human
gccaagcccagcaccgtctc

SEQ ID NO: 291168 - DNA, 20 bp, human
gcggagccggagacggtgct

SEQ ID NO: 291169 - DNA, 20 bp, human
gtccccttggagacgggctt

SEQ ID NO: 291170 - DNA, 20 bp, human
ggggcctgagtggcgtcccc

SEQ ID NO: 291171 - DNA, 20 bp, human
gtctcccggggacgccactc

SEQ ID NO: 291172 - DNA, 20 bp, human
ggcggcgccttggaatgcgg

SEQ ID NO: 291173 - DNA, 20 bp, human
gccacctgccgcgggagcga

SEQ ID NO: 291174 - DNA, 20 bp, human
gcgtctccaaggggatgccc

SEQ ID NO: 291175 - DNA, 20 bp, human
gagtacagatagaaagagag

SEQ ID NO: 291176 - DNA, 20 bp, human
gggaagctgctgagttgtta

SEQ ID NO: 291177 - DNA, 20 bp, human
gctgctgagttgttaggggt

SEQ ID NO: 291178 - DNA, 20 bp, human
ggccccctttctttgagcac

SEQ ID NO: 291179 - DNA, 20 bp, human
gtagacaaggcttcacatac

SEQ ID NO: 291180 - DNA, 20 bp, human
gtgggaggtcacttaccaaa

SEQ ID NO: 291181 - DNA, 20 bp, human
gttaacacttgagaaggact

SEQ ID NO: 291182 - DNA, 20 bp, human
ggacacagagtgagtagaca

SEQ ID NO: 291183 - DNA, 20 bp, human
gtggctgggccaaacagggc

SEQ ID NO: 291184 - DNA, 20 bp, human
gacacttgagaaggactggg

SEQ ID NO: 291185 - DNA, 20 bp, human
gctgactggctgggccaaac

SEQ ID NO: 291186 - DNA, 20 bp, human
gagagccagggactcccggg

SEQ ID NO: 291187 - DNA, 20 bp, human
gcctgcccgcggccggagga

SEQ ID NO: 291188 - DNA, 20 bp, human
gggagcgctgggtgcctctt

SEQ ID NO: 291189 - DNA, 20 bp, human
gaggaggtggggtggactta

SEQ ID NO: 291190 - DNA, 20 bp, human
gaaatccgggcagcccgaag

SEQ ID NO: 291191 - DNA, 20 bp, human
ggggactgcaatagaaatcc

SEQ ID NO: 291192 - DNA, 20 bp, human
gggtccctgcccgcggccgg

SEQ ID NO: 291193 - DNA, 20 bp, human
gtctagagccagggactccc

SEQ ID NO: 291194 - DNA, 20 bp, human
ggcagggaccagctctctcg

SEQ ID NO: 291195 - DNA, 20 bp, human
gaactgattgtccttgagat

SEQ ID NO: 291196 - DNA, 20 bp, human
ggcgccccggcgggtcccag

SEQ ID NO: 291197 - DNA, 20 bp, human
gaacccgagcgccccgtgcg

SEQ ID NO: 291198 - DNA, 20 bp, human
gcctgcgcgcacttcccggg

SEQ ID NO: 291199 - DNA, 20 bp, human
ggaagtgcgcgcagggctca

SEQ ID NO: 291200 - DNA, 20 bp, human
gagagcctgtagtgacggag

SEQ ID NO: 291201 - DNA, 20 bp, human
gcggcggcggctggacggcg

SEQ ID NO: 291202 - DNA, 20 bp, human
gccggcagagcctgtagtga

SEQ ID NO: 291203 - DNA, 20 bp, human
gtcagcccctgggacccgcc

SEQ ID NO: 291204 - DNA, 20 bp, human
gcgggcgggagtcagcccct

SEQ ID NO: 291205 - DNA, 20 bp, human
ggggttgctctggatcttac

SEQ ID NO: 291206 - DNA, 20 bp, human
ggggacctcagagagctacg

SEQ ID NO: 291207 - DNA, 20 bp, human
gaggggccaacaacaccctg

SEQ ID NO: 291208 - DNA, 20 bp, human
ggggctccctgggtaccaac

SEQ ID NO: 291209 - DNA, 20 bp, human
gtgggggagggtggtcttct

SEQ ID NO: 291210 - DNA, 20 bp, human
gacagtgggtaggaggggcg

SEQ ID NO: 291211 - DNA, 20 bp, human
gggaggggcgtggttaatta

SEQ ID NO: 291212 - DNA, 20 bp, human
gaaggtgctcaccctcccag

SEQ ID NO: 291213 - DNA, 20 bp, human
gagaatgagggtttttcccc

SEQ ID NO: 291214 - DNA, 20 bp, human
ggaggggcacagtgggtagg

SEQ ID NO: 291215 - DNA, 20 bp, human
gagagagctacggggctccc

SEQ ID NO: 291216 - DNA, 20 bp, human
gaaagtgtgggtcaaagtgt

SEQ ID NO: 291217 - DNA, 20 bp, human
ggacaggggaccgactcaaa

SEQ ID NO: 291218 - DNA, 20 bp, human
gtgtcctcagcagatgctgg

SEQ ID NO: 291219 - DNA, 20 bp, human
gaaagtgtgggtggtagagt

SEQ ID NO: 291220 - DNA, 20 bp, human
ggaagctgggctgagatgtc

SEQ ID NO: 291221 - DNA, 20 bp, human
ggggagctgaggtttggcca

SEQ ID NO: 291222 - DNA, 20 bp, human
gggctgagatgtctggtggt

SEQ ID NO: 291223 - DNA, 20 bp, human
gacacctagaactgtggccc

SEQ ID NO: 291224 - DNA, 20 bp, human
gcggctggttgtgtacgagc

SEQ ID NO: 291225 - DNA, 20 bp, human
gagggtccagcccacaactg

SEQ ID NO: 291226 - DNA, 20 bp, human
gaggagttgtgaaaccgcag

SEQ ID NO: 291227 - DNA, 20 bp, human
ggtgaaaccgcaggggttca

SEQ ID NO: 291228 - DNA, 20 bp, human
gaaaagctgacagcatgtca

SEQ ID NO: 291229 - DNA, 20 bp, human
gacaggctggtgacactggc

SEQ ID NO: 291230 - DNA, 20 bp, human
gcttcctccctgaacccctg

SEQ ID NO: 291231 - DNA, 20 bp, human
gggcaacaggctggtgacac

SEQ ID NO: 291232 - DNA, 20 bp, human
gggactggtctaataaacag

SEQ ID NO: 291233 - DNA, 20 bp, human
gtcactaacatcccaactaa

SEQ ID NO: 291234 - DNA, 20 bp, human
gaccactgtaagaggccaaa

SEQ ID NO: 291235 - DNA, 20 bp, human
gagttcatgtacatctttca

SEQ ID NO: 291236 - DNA, 20 bp, human
gcagtcctgggcggaagacc

SEQ ID NO: 291237 - DNA, 20 bp, human
gaagtctatcagagattcaa

SEQ ID NO: 291238 - DNA, 20 bp, human
gattcaaaggaagagggcgg

SEQ ID NO: 291239 - DNA, 20 bp, human
gtcagcttgttcatatgctt

SEQ ID NO: 291240 - DNA, 20 bp, human
ggccaacccaagaaacaagt

SEQ ID NO: 291241 - DNA, 20 bp, human
ggactttgaaagtttgggtc

SEQ ID NO: 291242 - DNA, 20 bp, human
gtcagcctgtccagtagcag

SEQ ID NO: 291243 - DNA, 20 bp, human
gggcaggctgtgggcagtcc

SEQ ID NO: 291244 - DNA, 20 bp, human
ggtagcccctgctactggac

SEQ ID NO: 291245 - DNA, 20 bp, human
gttgtcacccacttgtttct

SEQ ID NO: 291246 - DNA, 20 bp, human
ggagaggcgcccttctacag

SEQ ID NO: 291247 - DNA, 20 bp, human
gggcccctgcacagacgccc

SEQ ID NO: 291248 - DNA, 20 bp, human
ggacgcccaggtctcgggac

SEQ ID NO: 291249 - DNA, 20 bp, human
gtgagctctcccctgtagaa

SEQ ID NO: 291250 - DNA, 20 bp, human
gcggcgggacaagggaacgt

SEQ ID NO: 291251 - DNA, 20 bp, human
gcaggcggcgactgcactca

SEQ ID NO: 291252 - DNA, 20 bp, human
gtgcacagacgcccaggtct

SEQ ID NO: 291253 - DNA, 20 bp, human
gtctcctcccagtgccgccg

SEQ ID NO: 291254 - DNA, 20 bp, human
gggagcgctgccgctgaccc

SEQ ID NO: 291255 - DNA, 20 bp, human
ggctcctggacgaaggcctc

SEQ ID NO: 291256 - DNA, 20 bp, human
gcatctgatgagagtgactc

SEQ ID NO: 291257 - DNA, 20 bp, human
ggatgagagtgactccggtt

SEQ ID NO: 291258 - DNA, 20 bp, human
gtgtcagcatgagtcagagg

SEQ ID NO: 291259 - DNA, 20 bp, human
ggggaggccgagcctgtcct

SEQ ID NO: 291260 - DNA, 20 bp, human
gggtgccttctggcagtcaa

SEQ ID NO: 291261 - DNA, 20 bp, human
ggggcagatgccaacccctc

SEQ ID NO: 291262 - DNA, 20 bp, human
ggagagtgactccggttggg

SEQ ID NO: 291263 - DNA, 20 bp, human
gacgcaactgatccgaggac

SEQ ID NO: 291264 - DNA, 20 bp, human
gaggtactgaggaagcaagt

SEQ ID NO: 291265 - DNA, 20 bp, human
gggcagtcaagggtgagcct

SEQ ID NO: 291266 - DNA, 20 bp, human
gagaggaatgcgtttccgga

SEQ ID NO: 291267 - DNA, 20 bp, human
gagcgggatcagacgcgcag

SEQ ID NO: 291268 - DNA, 20 bp, human
ggggatcagacgcgcagagg

SEQ ID NO: 291269 - DNA, 20 bp, human
gccgggccgggctgacgcgg

SEQ ID NO: 291270 - DNA, 20 bp, human
gcagacgcgcagaggaggcg

SEQ ID NO: 291271 - DNA, 20 bp, human
ggctcgaaacgggacatcag

SEQ ID NO: 291272 - DNA, 20 bp, human
ggccgcgcccgacacccggg

SEQ ID NO: 291273 - DNA, 20 bp, human
gcccggcaggaaaccagccg

SEQ ID NO: 291274 - DNA, 20 bp, human
gtggggcaggaagtgcgacc

SEQ ID NO: 291275 - DNA, 20 bp, human
gaggaacgcgcggggctcta

SEQ ID NO: 291276 - DNA, 20 bp, human
gtcccccgaccggaagtcga

SEQ ID NO: 291277 - DNA, 20 bp, human
ggggaggagtctagtgccgc

SEQ ID NO: 291278 - DNA, 20 bp, human
gttccaagaccccaagtggt

SEQ ID NO: 291279 - DNA, 20 bp, human
ggccgcgggctccggagtga

SEQ ID NO: 291280 - DNA, 20 bp, human
ggcgagcggcgtcccccgac

SEQ ID NO: 291281 - DNA, 20 bp, human
gcctcccctcgacttccggt

SEQ ID NO: 291282 - DNA, 20 bp, human
gtcggccccaagcgggacga

SEQ ID NO: 291283 - DNA, 20 bp, human
ggaaccgggggtaggacgtc

SEQ ID NO: 291284 - DNA, 20 bp, human
gcgaggcttcccaccacttg

SEQ ID NO: 291285 - DNA, 20 bp, human
gagtctagtgccgcgggctc

SEQ ID NO: 291286 - DNA, 20 bp, human
gcccccgagctctttcctat

SEQ ID NO: 291287 - DNA, 20 bp, human
gggcgtacacctcctaacat

SEQ ID NO: 291288 - DNA, 20 bp, human
gcgggggcattttagctctg

SEQ ID NO: 291289 - DNA, 20 bp, human
gcagccaataggaaagagct

SEQ ID NO: 291290 - DNA, 20 bp, human
gttcccttgcccatgttagg

SEQ ID NO: 291291 - DNA, 20 bp, human
gggctcaggaaaaaaggatc

SEQ ID NO: 291292 - DNA, 20 bp, human
gacacctcctaacatgggca

SEQ ID NO: 291293 - DNA, 20 bp, human
gaagttcccttgcccatgtt

SEQ ID NO: 291294 - DNA, 20 bp, human
ggcagctgctgctgtgtcca

SEQ ID NO: 291295 - DNA, 20 bp, human
gaggtgcatcaaatggctgg

SEQ ID NO: 291296 - DNA, 20 bp, human
gagctgctgtagagcggaga

SEQ ID NO: 291297 - DNA, 20 bp, human
gcatgtcccacctgtctcaa

SEQ ID NO: 291298 - DNA, 20 bp, human
gcgacccgcgcctccagctg

SEQ ID NO: 291299 - DNA, 20 bp, human
ggaagcaggtccttctcgcc

SEQ ID NO: 291300 - DNA, 20 bp, human
gcaggggtgaagggccacgg

SEQ ID NO: 291301 - DNA, 20 bp, human
ggcggccccttgagacaggt

SEQ ID NO: 291302 - DNA, 20 bp, human
gtgtagagcggagaggggca

SEQ ID NO: 291303 - DNA, 20 bp, human
gtcaatgcgtgcacgcaccc

SEQ ID NO: 291304 - DNA, 20 bp, human
gcagcgaggaggagacactc

SEQ ID NO: 291305 - DNA, 20 bp, human
ggaaacctcagctggaggcg

SEQ ID NO: 291306 - DNA, 20 bp, human
gctggcaggcgggtcctcgt

SEQ ID NO: 291307 - DNA, 20 bp, human
gagggtctagagaagcgcga

SEQ ID NO: 291308 - DNA, 20 bp, human
ggggtgggacgcaacggggc

SEQ ID NO: 291309 - DNA, 20 bp, human
gcgaggggatctagagaagc

SEQ ID NO: 291310 - DNA, 20 bp, human
ggggatctagagaagccgga

SEQ ID NO: 291311 - DNA, 20 bp, human
gccaggaggcgggactggaa

SEQ ID NO: 291312 - DNA, 20 bp, human
gctagaccctgcgcctgaga

SEQ ID NO: 291313 - DNA, 20 bp, human
gccaggatgcgctgacgacc

SEQ ID NO: 291314 - DNA, 20 bp, human
ggcgcctgagagggagcggt

SEQ ID NO: 291315 - DNA, 20 bp, human
ggtcctcgtgggcgaggcga

SEQ ID NO: 291316 - DNA, 20 bp, human
gtccccgcgacgaaggatcc

SEQ ID NO: 291317 - DNA, 20 bp, human
gagcggggagttctaggccc

SEQ ID NO: 291318 - DNA, 20 bp, human
gagcccttctccaaacgatc

SEQ ID NO: 291319 - DNA, 20 bp, human
gggagcgagcggggagttct

SEQ ID NO: 291320 - DNA, 20 bp, human
gcacccggatccttcgtcgc

SEQ ID NO: 291321 - DNA, 20 bp, human
gtggccagagtagtgagaga

SEQ ID NO: 291322 - DNA, 20 bp, human
gtgccatggtgattagagaa

SEQ ID NO: 291323 - DNA, 20 bp, human
gtccgggtgtgcgcgagcaa

SEQ ID NO: 291324 - DNA, 20 bp, human
gtgctcctctatcgcggggg

SEQ ID NO: 291325 - DNA, 20 bp, human
gtgttacaccagcaggaaat

SEQ ID NO: 291326 - DNA, 20 bp, human
gggagccgcagccctttccg

SEQ ID NO: 291327 - DNA, 20 bp, human
gaggcgctggtgagtcagac

SEQ ID NO: 291328 - DNA, 20 bp, human
gcgggtccgccccccggaaa

SEQ ID NO: 291329 - DNA, 20 bp, human
gcgcccagggccggaccgga

SEQ ID NO: 291330 - DNA, 20 bp, human
gacaggtgcgcgccgcgcga

SEQ ID NO: 291331 - DNA, 20 bp, human
ggcgcggcgcgcacctgtcg

SEQ ID NO: 291332 - DNA, 20 bp, human
gcacctgtcggggcaggagc

SEQ ID NO: 291333 - DNA, 20 bp, human
gcgccccgatcggctagcgg

SEQ ID NO: 291334 - DNA, 20 bp, human
gcccccgccgctagccgatc

SEQ ID NO: 291335 - DNA, 20 bp, human
ggcgagcagggactgtccga

SEQ ID NO: 291336 - DNA, 20 bp, human
ggggagcgggctctactcag

SEQ ID NO: 291337 - DNA, 20 bp, human
gacacggtcagcttacggtg

SEQ ID NO: 291338 - DNA, 20 bp, human
gccgccacacggtcagctta

SEQ ID NO: 291339 - DNA, 20 bp, human
gcgctcggcggccgcgactt

SEQ ID NO: 291340 - DNA, 20 bp, human
gccggcgcgcgggggagtct

SEQ ID NO: 291341 - DNA, 20 bp, human
gagagtgtgccggcgcgcgg

SEQ ID NO: 291342 - DNA, 20 bp, human
gggtcagcttacggtgaggc

SEQ ID NO: 291343 - DNA, 20 bp, human
gaggggctggctccgctcgg

SEQ ID NO: 291344 - DNA, 20 bp, human
gagagggagagcaggtacgg

SEQ ID NO: 291345 - DNA, 20 bp, human
gggcgtctacgtcccatctc

SEQ ID NO: 291346 - DNA, 20 bp, human
gaggtgtacaatcaccaaga

SEQ ID NO: 291347 - DNA, 20 bp, human
gtacacctgccttccttata

SEQ ID NO: 291348 - DNA, 20 bp, human
gttctccttataaggaaggc

SEQ ID NO: 291349 - DNA, 20 bp, human
gaaagatattaactttctct

SEQ ID NO: 291350 - DNA, 20 bp, human
gagcatataggctatatatg

SEQ ID NO: 291351 - DNA, 20 bp, human
gcttgttctccttataagga

SEQ ID NO: 291352 - DNA, 20 bp, human
ggtaaatgagaaggaaggct

SEQ ID NO: 291353 - DNA, 20 bp, human
gcatctaatttgaaaaaata

SEQ ID NO: 291354 - DNA, 20 bp, human
gtgtacaatcaccaagaagg

SEQ ID NO: 291355 - DNA, 20 bp, human
gttacagtaaatgagaagga

SEQ ID NO: 291356 - DNA, 20 bp, human
gctagaaggtggtgcagata

SEQ ID NO: 291357 - DNA, 20 bp, human
gaaggtggtgcagatagggg

SEQ ID NO: 291358 - DNA, 20 bp, human
gtgacaggggttcaataaat

SEQ ID NO: 291359 - DNA, 20 bp, human
gccagggtggggaagatttg

SEQ ID NO: 291360 - DNA, 20 bp, human
gttacgttcaacacatgaca

SEQ ID NO: 291361 - DNA, 20 bp, human
gcaacaatctcataagatag

SEQ ID NO: 291362 - DNA, 20 bp, human
gtgggggtgactgatctaga

SEQ ID NO: 291363 - DNA, 20 bp, human
gcatctgtaaaattggggct

SEQ ID NO: 291364 - DNA, 20 bp, human
gagtggacaatacagagatc

SEQ ID NO: 291365 - DNA, 20 bp, human
gggggaagatttggggttgg

SEQ ID NO: 291366 - DNA, 20 bp, human
gttggggtgcaaggattcgg

SEQ ID NO: 291367 - DNA, 20 bp, human
gcgtgggcgggacattggtg

SEQ ID NO: 291368 - DNA, 20 bp, human
gccaccacccccgcgagcgt

SEQ ID NO: 291369 - DNA, 20 bp, human
gcgtagccgcgcaacaggaa

SEQ ID NO: 291370 - DNA, 20 bp, human
gtaacagctcggagcagcgt

SEQ ID NO: 291371 - DNA, 20 bp, human
ggggtagccgggtgcactca

SEQ ID NO: 291372 - DNA, 20 bp, human
gtgcaccccaacgctcgcgg

SEQ ID NO: 291373 - DNA, 20 bp, human
ggcgcgggggtgagagattg

SEQ ID NO: 291374 - DNA, 20 bp, human
gaggagcagcagtaacagct

SEQ ID NO: 291375 - DNA, 20 bp, human
gagtgcacccggctacccgc

SEQ ID NO: 291376 - DNA, 20 bp, human
ggacagtagtgggaacactt

SEQ ID NO: 291377 - DNA, 20 bp, human
gctggtgccaaacccctcag

SEQ ID NO: 291378 - DNA, 20 bp, human
gtgaggccagtgacagtagt

SEQ ID NO: 291379 - DNA, 20 bp, human
gtagtgggaacacttgggta

SEQ ID NO: 291380 - DNA, 20 bp, human
ggtacttgaaatctgtgaac

SEQ ID NO: 291381 - DNA, 20 bp, human
gctcttgtcaaatatttctg

SEQ ID NO: 291382 - DNA, 20 bp, human
gatccctgagttgtggagaa

SEQ ID NO: 291383 - DNA, 20 bp, human
gacccctcagtggagagtct

SEQ ID NO: 291384 - DNA, 20 bp, human
gcactctttggagtttgggt

SEQ ID NO: 291385 - DNA, 20 bp, human
gctgcctagactctccactg

SEQ ID NO: 291386 - DNA, 20 bp, human
gagagctgggaacccccctg

SEQ ID NO: 291387 - DNA, 20 bp, human
gggtggttaaactactgatg

SEQ ID NO: 291388 - DNA, 20 bp, human
gaactgtgaggatccccgga

SEQ ID NO: 291389 - DNA, 20 bp, human
ggaagctttttgcctcaggg

SEQ ID NO: 291390 - DNA, 20 bp, human
gccagtgacacggtgacatg

SEQ ID NO: 291391 - DNA, 20 bp, human
gggatcctcacagttcacat

SEQ ID NO: 291392 - DNA, 20 bp, human
gtaagcgcagttctacacag

SEQ ID NO: 291393 - DNA, 20 bp, human
gttagcctatgtgaactgtg

SEQ ID NO: 291394 - DNA, 20 bp, human
gggatgagatgagccatccg

SEQ ID NO: 291395 - DNA, 20 bp, human
gtaaacattagacaaggtgc

SEQ ID NO: 291396 - DNA, 20 bp, human
gcaaacttgagctgtgtggg

SEQ ID NO: 291397 - DNA, 20 bp, human
gtactgtgaggacaagtcag

SEQ ID NO: 291398 - DNA, 20 bp, human
ggctcaaacttgagctgtgt

SEQ ID NO: 291399 - DNA, 20 bp, human
ggggtggatcgaacacccag

SEQ ID NO: 291400 - DNA, 20 bp, human
gttgctgtttgaataacctc

SEQ ID NO: 291401 - DNA, 20 bp, human
ggtggctgtgcaggatacta

SEQ ID NO: 291402 - DNA, 20 bp, human
gtgcacttggtcctttagaa

SEQ ID NO: 291403 - DNA, 20 bp, human
ggcccctatcagccgggctc

SEQ ID NO: 291404 - DNA, 20 bp, human
gcctgctgcccctatcagcc

SEQ ID NO: 291405 - DNA, 20 bp, human
gacagtcatcaaagagatag

SEQ ID NO: 291406 - DNA, 20 bp, human
gccgagtcccccggtctctc

SEQ ID NO: 291407 - DNA, 20 bp, human
gagaggctgtcccagtggta

SEQ ID NO: 291408 - DNA, 20 bp, human
gagaccgggggactcggaag

SEQ ID NO: 291409 - DNA, 20 bp, human
ggggtcttgccaacagcgtt

SEQ ID NO: 291410 - DNA, 20 bp, human
gtgggcatgggtggaatgac

SEQ ID NO: 291411 - DNA, 20 bp, human
gggactcggaagaggcccgc

SEQ ID NO: 291412 - DNA, 20 bp, human
gaatgaagccccaacgctgt

SEQ ID NO: 291413 - DNA, 20 bp, human
gtcccagtggtagggataag

SEQ ID NO: 291414 - DNA, 20 bp, human
gcttcagacagacacatcga

SEQ ID NO: 291415 - DNA, 20 bp, human
gggtcagtgacctgcagcgg

SEQ ID NO: 291416 - DNA, 20 bp, human
gtgttggaatgaaagcaaga

SEQ ID NO: 291417 - DNA, 20 bp, human
gggacgtgcagctacattga

SEQ ID NO: 291418 - DNA, 20 bp, human
gtccaactccccttttaata

SEQ ID NO: 291419 - DNA, 20 bp, human
gtatgagggcagatctttct

SEQ ID NO: 291420 - DNA, 20 bp, human
gggcagatgataaagtgatg

SEQ ID NO: 291421 - DNA, 20 bp, human
gggaagacatgtgcagacac

SEQ ID NO: 291422 - DNA, 20 bp, human
gtctgcacatgtcttccctc

SEQ ID NO: 291423 - DNA, 20 bp, human
gaaaataaggtcatgagtat

SEQ ID NO: 291424 - DNA, 20 bp, human
gagtgtaggtatgtctgtta

SEQ ID NO: 291425 - DNA, 20 bp, human
ggccattacctgcctagaga

SEQ ID NO: 291426 - DNA, 20 bp, human
gtgcccccagccaaggtcca

SEQ ID NO: 291427 - DNA, 20 bp, human
ggggatggtggggaagacta

SEQ ID NO: 291428 - DNA, 20 bp, human
gtctccccgggctggactta

SEQ ID NO: 291429 - DNA, 20 bp, human
gcattccaccaagctccaca

SEQ ID NO: 291430 - DNA, 20 bp, human
gctgaggtcactgtggtttt

SEQ ID NO: 291431 - DNA, 20 bp, human
gagaaacagcgggggatggt

SEQ ID NO: 291432 - DNA, 20 bp, human
ggcccggggagaaacagcgg

SEQ ID NO: 291433 - DNA, 20 bp, human
gtaggctcagtttggagtgg

SEQ ID NO: 291434 - DNA, 20 bp, human
gatcccccgctgtttctccc

SEQ ID NO: 291435 - DNA, 20 bp, human
ggcggcttcccggaagaagg

SEQ ID NO: 291436 - DNA, 20 bp, human
ggaggtgggagcaggactaa

SEQ ID NO: 291437 - DNA, 20 bp, human
gctgcccccaggatcatcga

SEQ ID NO: 291438 - DNA, 20 bp, human
ggtggggagggtctagacaa

SEQ ID NO: 291439 - DNA, 20 bp, human
gggggcagcttcagtgggga

SEQ ID NO: 291440 - DNA, 20 bp, human
gggggtaaggctggtagagg

SEQ ID NO: 291441 - DNA, 20 bp, human
ggtggggggcagcttcagtg

SEQ ID NO: 291442 - DNA, 20 bp, human
gccagggatcatcaaggaga

SEQ ID NO: 291443 - DNA, 20 bp, human
gacaaaggccaccttgcctt

SEQ ID NO: 291444 - DNA, 20 bp, human
gagggccaccgggagaaaca

SEQ ID NO: 291445 - DNA, 20 bp, human
ggcacagtacagcgcagcag

SEQ ID NO: 291446 - DNA, 20 bp, human
gagtccaggaggggaccgca

SEQ ID NO: 291447 - DNA, 20 bp, human
gccccgagagcgtcccgcag

SEQ ID NO: 291448 - DNA, 20 bp, human
gccaggaggggacgcagggt

SEQ ID NO: 291449 - DNA, 20 bp, human
ggcgtggagaaacggagctt

SEQ ID NO: 291450 - DNA, 20 bp, human
gcccaccccgcgtcccagcc

SEQ ID NO: 291451 - DNA, 20 bp, human
gggagtccagaaggggaccg

SEQ ID NO: 291452 - DNA, 20 bp, human
ggtccagggaggcagggtgt

SEQ ID NO: 291453 - DNA, 20 bp, human
gccaccccgcggtccccttc

SEQ ID NO: 291454 - DNA, 20 bp, human
ggccactgcgggacgctctc

SEQ ID NO: 291455 - DNA, 20 bp, human
ggggagagttggagtccaga

SEQ ID NO: 291456 - DNA, 20 bp, human
gagggagggaccatcctgaa

SEQ ID NO: 291457 - DNA, 20 bp, human
gcatcttacagctggatgag

SEQ ID NO: 291458 - DNA, 20 bp, human
gccatcctgaagggtgggga

SEQ ID NO: 291459 - DNA, 20 bp, human
gcacaggagcccagtaactg

SEQ ID NO: 291460 - DNA, 20 bp, human
gcagggaagaccagtattgg

SEQ ID NO: 291461 - DNA, 20 bp, human
gcccagctcttggacaatcc

SEQ ID NO: 291462 - DNA, 20 bp, human
ggtccctccctctcaagaga

SEQ ID NO: 291463 - DNA, 20 bp, human
gggctcctgtggatgtttat

SEQ ID NO: 291464 - DNA, 20 bp, human
gagagccttccccacccttc

SEQ ID NO: 291465 - DNA, 20 bp, human
gctggcatcttgcctggaga

SEQ ID NO: 291466 - DNA, 20 bp, human
gcaaaattcacaaaacgagg

SEQ ID NO: 291467 - DNA, 20 bp, human
gcatttcaagccattagcaa

SEQ ID NO: 291468 - DNA, 20 bp, human
gaaggagtaaggacaatgtg

SEQ ID NO: 291469 - DNA, 20 bp, human
gacaaaacgtcaggacagaa

SEQ ID NO: 291470 - DNA, 20 bp, human
ggatagaaagataacgttga

SEQ ID NO: 291471 - DNA, 20 bp, human
gggcaaagaatgcaatgtgg

SEQ ID NO: 291472 - DNA, 20 bp, human
gtgtgaattttgaaaggatg

SEQ ID NO: 291473 - DNA, 20 bp, human
gtcatgtagcacaaggagta

SEQ ID NO: 291474 - DNA, 20 bp, human
gtgctacatgatttaactgc

SEQ ID NO: 291475 - DNA, 20 bp, human
gtttcaaaattcacaaaacg

SEQ ID NO: 291476 - DNA, 20 bp, human
gacgctagcaggtgattctt

SEQ ID NO: 291477 - DNA, 20 bp, human
ggaggcttctggttatctcg

SEQ ID NO: 291478 - DNA, 20 bp, human
gcacctgctagcgttgttcc

SEQ ID NO: 291479 - DNA, 20 bp, human
gagcgttgttcctggatctg

SEQ ID NO: 291480 - DNA, 20 bp, human
gtgcactgggcattgtgcca

SEQ ID NO: 291481 - DNA, 20 bp, human
gtctacttcctacttgacac

SEQ ID NO: 291482 - DNA, 20 bp, human
ggcttctggttatctcgggg

SEQ ID NO: 291483 - DNA, 20 bp, human
gagcccagtggggccaacca

SEQ ID NO: 291484 - DNA, 20 bp, human
gccatgaaacccccagatcc

SEQ ID NO: 291485 - DNA, 20 bp, human
gatccaggaacaacgctagc

SEQ ID NO: 291486 - DNA, 20 bp, human
gtgggagagggagaacgcag

SEQ ID NO: 291487 - DNA, 20 bp, human
ggtacctgagcctgggaccg

SEQ ID NO: 291488 - DNA, 20 bp, human
gtcagagggaagggcttcag

SEQ ID NO: 291489 - DNA, 20 bp, human
gtgactgtcgccatctgagg

SEQ ID NO: 291490 - DNA, 20 bp, human
gaggacgtgcgactggctgg

SEQ ID NO: 291491 - DNA, 20 bp, human
gtcaggtaccctcagaggga

SEQ ID NO: 291492 - DNA, 20 bp, human
gaggctcaggtaccctcaga

SEQ ID NO: 291493 - DNA, 20 bp, human
gtagcagcctaggctgctca

SEQ ID NO: 291494 - DNA, 20 bp, human
gttctcatttccacggtccc

SEQ ID NO: 291495 - DNA, 20 bp, human
gatgagaaaggacgtgcgac

SEQ ID NO: 291496 - DNA, 20 bp, human
gacagggtggcactgtcgag

SEQ ID NO: 291497 - DNA, 20 bp, human
ggcaagcttgtgaacaggag

SEQ ID NO: 291498 - DNA, 20 bp, human
gcctgctgtagaatcagatg

SEQ ID NO: 291499 - DNA, 20 bp, human
gtctgattctacagcaggat

SEQ ID NO: 291500 - DNA, 20 bp, human
gctcctgcaagcttgtgaac

SEQ ID NO: 291501 - DNA, 20 bp, human
gtccacgaaagatgggaagg

SEQ ID NO: 291502 - DNA, 20 bp, human
gtgtggcgtgtgctgatttc

SEQ ID NO: 291503 - DNA, 20 bp, human
gcaggagactggctccacgg

SEQ ID NO: 291504 - DNA, 20 bp, human
gtttgctctgagctgcacag

SEQ ID NO: 291505 - DNA, 20 bp, human
gtccccaaacatggaaagat

SEQ ID NO: 291506 - DNA, 20 bp, human
gggcgcggatttgccactgg

SEQ ID NO: 291507 - DNA, 20 bp, human
gcctgagttgggggtttgcg

SEQ ID NO: 291508 - DNA, 20 bp, human
ggcccaagtgcctgagttgg

SEQ ID NO: 291509 - DNA, 20 bp, human
gtcatagtcaggggctattg

SEQ ID NO: 291510 - DNA, 20 bp, human
gtatgcctgaggtgcaggtg

SEQ ID NO: 291511 - DNA, 20 bp, human
ggggaagtggagtccgtggc

SEQ ID NO: 291512 - DNA, 20 bp, human
ggcccagggaggtgcctaaa

SEQ ID NO: 291513 - DNA, 20 bp, human
gccaggccctgcggggagtc

SEQ ID NO: 291514 - DNA, 20 bp, human
gagcgagagggggcccaaaa

SEQ ID NO: 291515 - DNA, 20 bp, human
gcaaactggggggagaccgt

SEQ ID NO: 291516 - DNA, 20 bp, human
gggacacccatccctctccg

SEQ ID NO: 291517 - DNA, 20 bp, human
gggcctggaggtaacctggt

SEQ ID NO: 291518 - DNA, 20 bp, human
ggcggtggggacagggtaca

SEQ ID NO: 291519 - DNA, 20 bp, human
gtaggctcgcggtggggaca

SEQ ID NO: 291520 - DNA, 20 bp, human
gacagggtacagggaagcgg

SEQ ID NO: 291521 - DNA, 20 bp, human
gggcgcgcctcggagaggga

SEQ ID NO: 291522 - DNA, 20 bp, human
gtccgaggcgcgccgggatc

SEQ ID NO: 291523 - DNA, 20 bp, human
gagagggatgggtgtccctc

SEQ ID NO: 291524 - DNA, 20 bp, human
gagactgctcgcacatcccc

SEQ ID NO: 291525 - DNA, 20 bp, human
gactcggcctggaggtaacc

SEQ ID NO: 291526 - DNA, 20 bp, human
gagaacggatccgagcgtga

SEQ ID NO: 291527 - DNA, 20 bp, human
gcgccgctccgcacctgggg

SEQ ID NO: 291528 - DNA, 20 bp, human
ggcccggcaggggtcactgc

SEQ ID NO: 291529 - DNA, 20 bp, human
gtggaagaagacagatggtt

SEQ ID NO: 291530 - DNA, 20 bp, human
gacccgccccaggtgcggag

SEQ ID NO: 291531 - DNA, 20 bp, human
gcggagcggcgcgcccggca

SEQ ID NO: 291532 - DNA, 20 bp, human
gggaccctggcgagagtgga

SEQ ID NO: 291533 - DNA, 20 bp, human
gccgccccgtccccgcggga

SEQ ID NO: 291534 - DNA, 20 bp, human
gtgtgcgagcgagcggcaga

SEQ ID NO: 291535 - DNA, 20 bp, human
gagtggagggaagaccccca

SEQ ID NO: 291536 - DNA, 20 bp, human
gtcccttaggcaggaggggt

SEQ ID NO: 291537 - DNA, 20 bp, human
gcggaccccaaggcgcgtat

SEQ ID NO: 291538 - DNA, 20 bp, human
ggtcccggggaaagccgacc

SEQ ID NO: 291539 - DNA, 20 bp, human
gaaacggtggccacggagaa

SEQ ID NO: 291540 - DNA, 20 bp, human
gcgcaaacctccagggtcac

SEQ ID NO: 291541 - DNA, 20 bp, human
gggctggtggcggaagtgaa

SEQ ID NO: 291542 - DNA, 20 bp, human
gacccacccctcctgcctaa

SEQ ID NO: 291543 - DNA, 20 bp, human
gcagagaagagcgaaagcag

SEQ ID NO: 291544 - DNA, 20 bp, human
gggatcatagctggcgggta

SEQ ID NO: 291545 - DNA, 20 bp, human
gctgcaatggggtctccgaa

SEQ ID NO: 291546 - DNA, 20 bp, human
ggccgcccgccgcctcttaa

SEQ ID NO: 291547 - DNA, 20 bp, human
ggcgcccaggggttacggcc

SEQ ID NO: 291548 - DNA, 20 bp, human
ggcccggctgggaacatcag

SEQ ID NO: 291549 - DNA, 20 bp, human
gtggcccggcggtcttactt

SEQ ID NO: 291550 - DNA, 20 bp, human
gggaacacacgcccacaccg

SEQ ID NO: 291551 - DNA, 20 bp, human
gccagggtccgcttcctcga

SEQ ID NO: 291552 - DNA, 20 bp, human
gtgtttgtgtccccgggtgt

SEQ ID NO: 291553 - DNA, 20 bp, human
ggccgcgggctcaagcgggg

SEQ ID NO: 291554 - DNA, 20 bp, human
gtccgcttcctcgagggaag

SEQ ID NO: 291555 - DNA, 20 bp, human
gcaagcgcgcccaggggtta

SEQ ID NO: 291556 - DNA, 20 bp, human
ggaacccgaggaacggggta

SEQ ID NO: 291557 - DNA, 20 bp, human
gtctcggtgactcctcgggg

SEQ ID NO: 291558 - DNA, 20 bp, human
ggagccttctctccctcgca

SEQ ID NO: 291559 - DNA, 20 bp, human
gagaaagcgcgggcctccca

SEQ ID NO: 291560 - DNA, 20 bp, human
ggggaagtggggaacttgcg

SEQ ID NO: 291561 - DNA, 20 bp, human
ggcggggcgcgggcgtgcag

SEQ ID NO: 291562 - DNA, 20 bp, human
gccagccgcgaagcccggga

SEQ ID NO: 291563 - DNA, 20 bp, human
gaggctctcggtgactcctc

SEQ ID NO: 291564 - DNA, 20 bp, human
gggcaggcggagcgaagcct

SEQ ID NO: 291565 - DNA, 20 bp, human
gtcccggcgggcagagaaca

SEQ ID NO: 291566 - DNA, 20 bp, human
ggggagaaaggcggaggctt

SEQ ID NO: 291567 - DNA, 20 bp, human
ggaagttgtgagcctgtctg

SEQ ID NO: 291568 - DNA, 20 bp, human
ggcaagcctcgattgagggg

SEQ ID NO: 291569 - DNA, 20 bp, human
ggctgagttcaaccccagac

SEQ ID NO: 291570 - DNA, 20 bp, human
gtgcttggcaagacgaggga

SEQ ID NO: 291571 - DNA, 20 bp, human
gcatcagcaagcctcgattg

SEQ ID NO: 291572 - DNA, 20 bp, human
gctattgcttggcaagacga

SEQ ID NO: 291573 - DNA, 20 bp, human
gaacaaacactgaagtagcc

SEQ ID NO: 291574 - DNA, 20 bp, human
gattttccacccctcaatcg

SEQ ID NO: 291575 - DNA, 20 bp, human
gttaaaacctgcaactctgc

SEQ ID NO: 291576 - DNA, 20 bp, human
gcccaccggacgtgacggaa

SEQ ID NO: 291577 - DNA, 20 bp, human
gcccgccccaccggacgtga

SEQ ID NO: 291578 - DNA, 20 bp, human
ggtgacggaacggaacgaga

SEQ ID NO: 291579 - DNA, 20 bp, human
gtgggaggcggagtcggaca

SEQ ID NO: 291580 - DNA, 20 bp, human
ggcggccaggtatgcatcta

SEQ ID NO: 291581 - DNA, 20 bp, human
gtaaccgatactcccctcaa

SEQ ID NO: 291582 - DNA, 20 bp, human
gtaacccttgcgcggcgggg

SEQ ID NO: 291583 - DNA, 20 bp, human
gagcccgccccgccgcgcaa

SEQ ID NO: 291584 - DNA, 20 bp, human
gcggggctttcccctttgag

SEQ ID NO: 291585 - DNA, 20 bp, human
gccgcgcttcggatgctcag

SEQ ID NO: 291586 - DNA, 20 bp, human
gcgggcgcccaggggattct

SEQ ID NO: 291587 - DNA, 20 bp, human
gtagacgcgtgcggggacag

SEQ ID NO: 291588 - DNA, 20 bp, human
gtccttggctggggtcggta

SEQ ID NO: 291589 - DNA, 20 bp, human
gttaaagtgcagtaaccatg

SEQ ID NO: 291590 - DNA, 20 bp, human
gtccccgcacgcgtctattt

SEQ ID NO: 291591 - DNA, 20 bp, human
gggcgtcctgcgaggctttc

SEQ ID NO: 291592 - DNA, 20 bp, human
gggctccgggtggcttatat

SEQ ID NO: 291593 - DNA, 20 bp, human
gggccctaaatagacgcgtg

SEQ ID NO: 291594 - DNA, 20 bp, human
gggaggagaggcgtccccaa

SEQ ID NO: 291595 - DNA, 20 bp, human
gggcaatgtagtccaagtag

SEQ ID NO: 291596 - DNA, 20 bp, human
ggactgtcgcgccccaggtc

SEQ ID NO: 291597 - DNA, 20 bp, human
ggggtggcccggcctcccga

SEQ ID NO: 291598 - DNA, 20 bp, human
gtgcccattgggcgaggagg

SEQ ID NO: 291599 - DNA, 20 bp, human
gccggccgctgctccctgat

SEQ ID NO: 291600 - DNA, 20 bp, human
gtgccggtgcccattgggcg

SEQ ID NO: 291601 - DNA, 20 bp, human
ggtgggggggcggccaatca

SEQ ID NO: 291602 - DNA, 20 bp, human
gcgcgcggggacgcgacgct

SEQ ID NO: 291603 - DNA, 20 bp, human
ggggcgaccctcgggaggcc

SEQ ID NO: 291604 - DNA, 20 bp, human
gccctggagaggccggacct

SEQ ID NO: 291605 - DNA, 20 bp, human
gagccccctcggtcccctca

SEQ ID NO: 291606 - DNA, 20 bp, human
gggcccgggtgcagatagtc

SEQ ID NO: 291607 - DNA, 20 bp, human
ggatagtccgggaaccccga

SEQ ID NO: 291608 - DNA, 20 bp, human
gacgcctctggagatcagga

SEQ ID NO: 291609 - DNA, 20 bp, human
gagtccgggaaccccgaggg

SEQ ID NO: 291610 - DNA, 20 bp, human
ggcaaggcaccgggtctagg

SEQ ID NO: 291611 - DNA, 20 bp, human
gggtgcacatgggtgccggc

SEQ ID NO: 291612 - DNA, 20 bp, human
gagtgcaggcgcccgcggaa

SEQ ID NO: 291613 - DNA, 20 bp, human
gtctccggcgggcgtcaccc

SEQ ID NO: 291614 - DNA, 20 bp, human
ggctccggggtgacgcccgc

SEQ ID NO: 291615 - DNA, 20 bp, human
ggggaggcccaggcgtagtg

SEQ ID NO: 291616 - DNA, 20 bp, human
gcggccccggaagctcctta

SEQ ID NO: 291617 - DNA, 20 bp, human
gaaactggagcgagtggaca

SEQ ID NO: 291618 - DNA, 20 bp, human
gaggaccgtgtgggtttcgg

SEQ ID NO: 291619 - DNA, 20 bp, human
gtccttaaggaggaccgtgt

SEQ ID NO: 291620 - DNA, 20 bp, human
gcctccttaaggagcttccg

SEQ ID NO: 291621 - DNA, 20 bp, human
ggttgggcccaggatccgcc

SEQ ID NO: 291622 - DNA, 20 bp, human
gccgtgccggggaagtttct

SEQ ID NO: 291623 - DNA, 20 bp, human
gagtcggggagagttttctg

SEQ ID NO: 291624 - DNA, 20 bp, human
gcgggtgttttgttcttata

SEQ ID NO: 291625 - DNA, 20 bp, human
gttccccggcacggcagaac

SEQ ID NO: 291626 - DNA, 20 bp, human
gtccgcaccgaggcccccgt

SEQ ID NO: 291627 - DNA, 20 bp, human
gccgagcagcggagagtgtg

SEQ ID NO: 291628 - DNA, 20 bp, human
gcggacagagacccggtgtg

SEQ ID NO: 291629 - DNA, 20 bp, human
gcctgcacgctgggccacgg

SEQ ID NO: 291630 - DNA, 20 bp, human
gtctcccagcaaacccacgg

SEQ ID NO: 291631 - DNA, 20 bp, human
gcctccctggggtggcaaat

SEQ ID NO: 291632 - DNA, 20 bp, human
gtccgctgctcggcctccct

SEQ ID NO: 291633 - DNA, 20 bp, human
gaggcccccgtgggtttgct

SEQ ID NO: 291634 - DNA, 20 bp, human
gttactaggattcgggtgta

SEQ ID NO: 291635 - DNA, 20 bp, human
gggccagcccgaagtgagaa

SEQ ID NO: 291636 - DNA, 20 bp, human
gccaattctgccttcgggga

SEQ ID NO: 291637 - DNA, 20 bp, human
gttaaggcggaggcccggga

SEQ ID NO: 291638 - DNA, 20 bp, human
ggaaggccctgattccgggg

SEQ ID NO: 291639 - DNA, 20 bp, human
gaagctaccgccccggaatc

SEQ ID NO: 291640 - DNA, 20 bp, human
gggggcggtagcttcgtcca

SEQ ID NO: 291641 - DNA, 20 bp, human
gacccccaccgcacaagctg

SEQ ID NO: 291642 - DNA, 20 bp, human
ggccccgcgtcgctttaagg

SEQ ID NO: 291643 - DNA, 20 bp, human
gccttcccaattctgccttc

SEQ ID NO: 291644 - DNA, 20 bp, human
gttgggaaggccctgattcc

SEQ ID NO: 291645 - DNA, 20 bp, human
gtggagctggcgagccgggt

SEQ ID NO: 291646 - DNA, 20 bp, human
gtatgggcggagatggatgg

SEQ ID NO: 291647 - DNA, 20 bp, human
gaggagataggcgggagcga

SEQ ID NO: 291648 - DNA, 20 bp, human
gccaccgtgcgaacccaaag

SEQ ID NO: 291649 - DNA, 20 bp, human
gggcggagatggatggtgga

SEQ ID NO: 291650 - DNA, 20 bp, human
gggtttccccacccacttat

SEQ ID NO: 291651 - DNA, 20 bp, human
gggtgggcggggccagtggt

SEQ ID NO: 291652 - DNA, 20 bp, human
gtctccgcccataagtgggt

SEQ ID NO: 291653 - DNA, 20 bp, human
gacttatgggcggagatgga

SEQ ID NO: 291654 - DNA, 20 bp, human
gtacgcctacatggggagga

SEQ ID NO: 291655 - DNA, 20 bp, human
gttccccacccacttatggg

SEQ ID NO: 291656 - DNA, 20 bp, human
gagggcagagaggagcgctt

SEQ ID NO: 291657 - DNA, 20 bp, human
ggcctccgcaggaagccggg

SEQ ID NO: 291658 - DNA, 20 bp, human
gcggccgccatgttgttgtg

SEQ ID NO: 291659 - DNA, 20 bp, human
ggcttcggacccgaccgact

SEQ ID NO: 291660 - DNA, 20 bp, human
gcaatgccccggaactcctg

SEQ ID NO: 291661 - DNA, 20 bp, human
gccggagcccgaaactgccc

SEQ ID NO: 291662 - DNA, 20 bp, human
gccggggcattgaaccctga

SEQ ID NO: 291663 - DNA, 20 bp, human
ggccacgcccgggcagtttc

SEQ ID NO: 291664 - DNA, 20 bp, human
ggctgccaggtctggggctt

SEQ ID NO: 291665 - DNA, 20 bp, human
gcccaccacggggttctccc

SEQ ID NO: 291666 - DNA, 20 bp, human
gggaagctggcaggcgatca

SEQ ID NO: 291667 - DNA, 20 bp, human
gcggcctgcggccgttgcac

SEQ ID NO: 291668 - DNA, 20 bp, human
ggcaacggccgcaggccgag

SEQ ID NO: 291669 - DNA, 20 bp, human
gccgcccaccaaaccggcta

SEQ ID NO: 291670 - DNA, 20 bp, human
gtggctcgggtgcggtccaa

SEQ ID NO: 291671 - DNA, 20 bp, human
gaccctaggcggcccgccga

SEQ ID NO: 291672 - DNA, 20 bp, human
ggatcacggttgattggctc

SEQ ID NO: 291673 - DNA, 20 bp, human
gcaccaaaccggctaggggg

SEQ ID NO: 291674 - DNA, 20 bp, human
gccaagggcagcaacgcctt

SEQ ID NO: 291675 - DNA, 20 bp, human
ggcttcgccgcccaccaaac

SEQ ID NO: 291676 - DNA, 20 bp, human
gtaggtcagaaaagcatcac

SEQ ID NO: 291677 - DNA, 20 bp, human
gttaagcagcaaacccttta

SEQ ID NO: 291678 - DNA, 20 bp, human
gaagatgcctgtggtgagtc

SEQ ID NO: 291679 - DNA, 20 bp, human
ggcctgtggtgagtcaggaa

SEQ ID NO: 291680 - DNA, 20 bp, human
gcagagcagaagtttgacta

SEQ ID NO: 291681 - DNA, 20 bp, human
gctaccagaatcctctggcc

SEQ ID NO: 291682 - DNA, 20 bp, human
gttgagctaccagaatcctc

SEQ ID NO: 291683 - DNA, 20 bp, human
gctgggaaatggggccctaa

SEQ ID NO: 291684 - DNA, 20 bp, human
gactaaggtcacaaaacagt

SEQ ID NO: 291685 - DNA, 20 bp, human
gctgcctggccagaggattc

SEQ ID NO: 291686 - DNA, 20 bp, human
gtcagcgcaaggtgatcctg

SEQ ID NO: 291687 - DNA, 20 bp, human
gcggcgaaagtgagggtgcg

SEQ ID NO: 291688 - DNA, 20 bp, human
gaaggaaccccagtagacca

SEQ ID NO: 291689 - DNA, 20 bp, human
gggtgcggggcaaggaacgg

SEQ ID NO: 291690 - DNA, 20 bp, human
ggtggggcggggcttagagt

SEQ ID NO: 291691 - DNA, 20 bp, human
gtagaccagggaggaaggcg

SEQ ID NO: 291692 - DNA, 20 bp, human
gggcgcgataagaggaacga

SEQ ID NO: 291693 - DNA, 20 bp, human
ggggacaaaggcgcgataag

SEQ ID NO: 291694 - DNA, 20 bp, human
gccgggacaggcaacgcaca

SEQ ID NO: 291695 - DNA, 20 bp, human
gcacagggcggcgaaagtga

SEQ ID NO: 291696 - DNA, 20 bp, human
gacgccaggcacggccggaa

SEQ ID NO: 291697 - DNA, 20 bp, human
ggtctgcccacgaccctcaa

SEQ ID NO: 291698 - DNA, 20 bp, human
gggcgccgcaacccgtcaac

SEQ ID NO: 291699 - DNA, 20 bp, human
gactcctgggaaaattgagc

SEQ ID NO: 291700 - DNA, 20 bp, human
gcaatgacgccaggcacggc

SEQ ID NO: 291701 - DNA, 20 bp, human
gtgctgttgcgtcttctcat

SEQ ID NO: 291702 - DNA, 20 bp, human
gtcagaccaggatccacccg

SEQ ID NO: 291703 - DNA, 20 bp, human
gggaaaattgagctggaact

SEQ ID NO: 291704 - DNA, 20 bp, human
ggcgcgctgcattcctttga

SEQ ID NO: 291705 - DNA, 20 bp, human
gaccaggatccacccgagga

SEQ ID NO: 291706 - DNA, 20 bp, human
ggagaatgccgggagataga

SEQ ID NO: 291707 - DNA, 20 bp, human
ggtctggagtctgacgtcac

SEQ ID NO: 291708 - DNA, 20 bp, human
ggatcacagtcacatgtgtg

SEQ ID NO: 291709 - DNA, 20 bp, human
ggtgtggggtgttgtggctt

SEQ ID NO: 291710 - DNA, 20 bp, human
gagtcaggaaatacatggtc

SEQ ID NO: 291711 - DNA, 20 bp, human
gtcttccagcagatctgagt

SEQ ID NO: 291712 - DNA, 20 bp, human
ggcgtgcacacttcccacac

SEQ ID NO: 291713 - DNA, 20 bp, human
gctgcactttgttccttccc

SEQ ID NO: 291714 - DNA, 20 bp, human
ggcagatctgagttggtgtg

SEQ ID NO: 291715 - DNA, 20 bp, human
gctctgtgaggactttgcaa

SEQ ID NO: 291716 - DNA, 20 bp, human
gcccacgcggaggtcccagt

SEQ ID NO: 291717 - DNA, 20 bp, human
gggaagcctcctgactactc

SEQ ID NO: 291718 - DNA, 20 bp, human
gacagagttgagtttctggg

SEQ ID NO: 291719 - DNA, 20 bp, human
gtgagtccggtccttgactc

SEQ ID NO: 291720 - DNA, 20 bp, human
gaaactcaactctgtctgat

SEQ ID NO: 291721 - DNA, 20 bp, human
gccaccgcggtccttggaaa

SEQ ID NO: 291722 - DNA, 20 bp, human
gggaagccagagtagtcagg

SEQ ID NO: 291723 - DNA, 20 bp, human
gctgtgacgtcatggagcga

SEQ ID NO: 291724 - DNA, 20 bp, human
gtgggcagaagaggcggagg

SEQ ID NO: 291725 - DNA, 20 bp, human
gtctggaagccagagtagtc

SEQ ID NO: 291726 - DNA, 20 bp, human
gtaacaccgtgatgctccct

SEQ ID NO: 291727 - DNA, 20 bp, human
gcgcgccctcgcctgggagg

SEQ ID NO: 291728 - DNA, 20 bp, human
gaggcgagggcgcggtcagg

SEQ ID NO: 291729 - DNA, 20 bp, human
gcccaggcgagggcgcggtc

SEQ ID NO: 291730 - DNA, 20 bp, human
gaaaggccccgccatgcctc

SEQ ID NO: 291731 - DNA, 20 bp, human
gaattagtaagttccaagag

SEQ ID NO: 291732 - DNA, 20 bp, human
gtccaagaggggttgagcag

SEQ ID NO: 291733 - DNA, 20 bp, human
gggcgcggtcaggaggccca

SEQ ID NO: 291734 - DNA, 20 bp, human
ggcctctgctcaacccctct

SEQ ID NO: 291735 - DNA, 20 bp, human
gagagttgagactccatctc

SEQ ID NO: 291736 - DNA, 20 bp, human
gatctctgaaggtcaggagg

SEQ ID NO: 291737 - DNA, 20 bp, human
ggaggatgcaagtcagggag

SEQ ID NO: 291738 - DNA, 20 bp, human
gttgagttaagcaatctctc

SEQ ID NO: 291739 - DNA, 20 bp, human
gcacaagcagagttctgtgc

SEQ ID NO: 291740 - DNA, 20 bp, human
gtcaacaatactgccccagt

SEQ ID NO: 291741 - DNA, 20 bp, human
ggcaatctctcaggttctat

SEQ ID NO: 291742 - DNA, 20 bp, human
gggggtttaagagtctcatg

SEQ ID NO: 291743 - DNA, 20 bp, human
ggcgggtctcggtccctact

SEQ ID NO: 291744 - DNA, 20 bp, human
gaactctgcttctacattag

SEQ ID NO: 291745 - DNA, 20 bp, human
gtgttctacactcagaactc

SEQ ID NO: 291746 - DNA, 20 bp, human
gagccggcgccgtcagtagt

SEQ ID NO: 291747 - DNA, 20 bp, human
gctgaggggcgggtcgtggg

SEQ ID NO: 291748 - DNA, 20 bp, human
gcagtggcggagtcttctga

SEQ ID NO: 291749 - DNA, 20 bp, human
gagtagtcggctgaggacgg

SEQ ID NO: 291750 - DNA, 20 bp, human
ggggcaccggccattggcac

SEQ ID NO: 291751 - DNA, 20 bp, human
ggtcagtagtcggctgagga

SEQ ID NO: 291752 - DNA, 20 bp, human
ggtggcgcgagcagcgtcgt

SEQ ID NO: 291753 - DNA, 20 bp, human
gcttctgaggggcgggtcgt

SEQ ID NO: 291754 - DNA, 20 bp, human
ggggcggggcctgcgctggt

SEQ ID NO: 291755 - DNA, 20 bp, human
gggcggagtcttctgagggg

SEQ ID NO: 291756 - DNA, 20 bp, human
gccctccccagcaacgtgaa

SEQ ID NO: 291757 - DNA, 20 bp, human
gcccagcaacgtgaagggga

SEQ ID NO: 291758 - DNA, 20 bp, human
gccgaagctcccgagggcgg

SEQ ID NO: 291759 - DNA, 20 bp, human
ggcgaggaggaacttggaag

SEQ ID NO: 291760 - DNA, 20 bp, human
gcacggcccggggcgcccga

SEQ ID NO: 291761 - DNA, 20 bp, human
ggcgccctgcccggcgtgct

SEQ ID NO: 291762 - DNA, 20 bp, human
gccggccgctgctgccagac

SEQ ID NO: 291763 - DNA, 20 bp, human
gccctcgggagcttcgggcc

SEQ ID NO: 291764 - DNA, 20 bp, human
ggggggcagcgggatgctca

SEQ ID NO: 291765 - DNA, 20 bp, human
gctacccagcacgccgggca

SEQ ID NO: 291766 - DNA, 20 bp, human
gcaggtgcgcgggtgacgaa

SEQ ID NO: 291767 - DNA, 20 bp, human
ggcgccccaggctttaaagg

SEQ ID NO: 291768 - DNA, 20 bp, human
ggagaaggggagattctcgg

SEQ ID NO: 291769 - DNA, 20 bp, human
ggcggtggcgcactgatggg

SEQ ID NO: 291770 - DNA, 20 bp, human
ggcggcccgcgctgaccccg

SEQ ID NO: 291771 - DNA, 20 bp, human
gggtgtgagcggggcccccg

SEQ ID NO: 291772 - DNA, 20 bp, human
gccgcctcctactctgatca

SEQ ID NO: 291773 - DNA, 20 bp, human
ggggccgcgccaccccgcgt

SEQ ID NO: 291774 - DNA, 20 bp, human
gcatgcatatgcaggtgcgc

SEQ ID NO: 291775 - DNA, 20 bp, human
ggcgccccgaggttgccgtg

SEQ ID NO: 291776 - DNA, 20 bp, human
gctctgggcgccagcaaaag

SEQ ID NO: 291777 - DNA, 20 bp, human
ggggccggaagttctcttca

SEQ ID NO: 291778 - DNA, 20 bp, human
gcgggggcgagagggaacga

SEQ ID NO: 291779 - DNA, 20 bp, human
gaatccccagcctcttttgc

SEQ ID NO: 291780 - DNA, 20 bp, human
ggcgccagcaaaagaggctg

SEQ ID NO: 291781 - DNA, 20 bp, human
gttcctgcgcgctccacaag

SEQ ID NO: 291782 - DNA, 20 bp, human
ggctccgtgaagagaacttc

SEQ ID NO: 291783 - DNA, 20 bp, human
gtgcgcgctccacaagaggc

SEQ ID NO: 291784 - DNA, 20 bp, human
gagaggagtgaccatagagt

SEQ ID NO: 291785 - DNA, 20 bp, human
gtggtcactcctctccgcgc

SEQ ID NO: 291786 - DNA, 20 bp, human
gcgcgagcgaagccggatgg

SEQ ID NO: 291787 - DNA, 20 bp, human
ggaccccgccccgctttccg

SEQ ID NO: 291788 - DNA, 20 bp, human
ggccgctggtgacgtcgcga

SEQ ID NO: 291789 - DNA, 20 bp, human
gcccctcgcgacgtcaccag

SEQ ID NO: 291790 - DNA, 20 bp, human
ggcggtgaacagagacgagt

SEQ ID NO: 291791 - DNA, 20 bp, human
ggcagcttcgcgagcgaagc

SEQ ID NO: 291792 - DNA, 20 bp, human
ggagcgaagccggatggggg

SEQ ID NO: 291793 - DNA, 20 bp, human
gcagccccggaaagcggggc

SEQ ID NO: 291794 - DNA, 20 bp, human
gcagcggcagccccggaaag

SEQ ID NO: 291795 - DNA, 20 bp, human
ggctgggaggggtcaatcta

SEQ ID NO: 291796 - DNA, 20 bp, human
gagactgcaggccaaccggg

SEQ ID NO: 291797 - DNA, 20 bp, human
gcacgcccaggggccgtccc

SEQ ID NO: 291798 - DNA, 20 bp, human
ggggcccggccctcactaga

SEQ ID NO: 291799 - DNA, 20 bp, human
ggggtggagacaactgtgac

SEQ ID NO: 291800 - DNA, 20 bp, human
gtcaacgccgcgggcgacac

SEQ ID NO: 291801 - DNA, 20 bp, human
gtccccgaatggcaggagac

SEQ ID NO: 291802 - DNA, 20 bp, human
ggaccgggccggatagaggc

SEQ ID NO: 291803 - DNA, 20 bp, human
gcgctcgccggcttcccgag

SEQ ID NO: 291804 - DNA, 20 bp, human
gaggagaccgggccggatag

SEQ ID NO: 291805 - DNA, 20 bp, human
gtgagaagacggtgtggccc

SEQ ID NO: 291806 - DNA, 20 bp, human
ggcagcctgtctgaacgggg

SEQ ID NO: 291807 - DNA, 20 bp, human
gaacggggcggctgatgcag

SEQ ID NO: 291808 - DNA, 20 bp, human
gaaggaggggcagaaagttc

SEQ ID NO: 291809 - DNA, 20 bp, human
gtcagccgccccgttcagac

SEQ ID NO: 291810 - DNA, 20 bp, human
gagggtctgggtcacaccag

SEQ ID NO: 291811 - DNA, 20 bp, human
gtaacaagtgggtctagagt

SEQ ID NO: 291812 - DNA, 20 bp, human
gatagcacagagaagggtct

SEQ ID NO: 291813 - DNA, 20 bp, human
gctccagcagcctgtctgaa

SEQ ID NO: 291814 - DNA, 20 bp, human
gtagacccacttgttaagtg

SEQ ID NO: 291815 - DNA, 20 bp, human
gctggagacccctaagccaa

SEQ ID NO: 291816 - DNA, 20 bp, human
gcccgccccgggcagatgcc

SEQ ID NO: 291817 - DNA, 20 bp, human
gctctcctgccgccgtggga

SEQ ID NO: 291818 - DNA, 20 bp, human
ggagctcccggcatctgccc

SEQ ID NO: 291819 - DNA, 20 bp, human
ggaagacagaccaatcggag

SEQ ID NO: 291820 - DNA, 20 bp, human
gcccggggagcccctccgat

SEQ ID NO: 291821 - DNA, 20 bp, human
gtggcccagtgcgcacgctc

SEQ ID NO: 291822 - DNA, 20 bp, human
gtcccggcatctgcccgggg

SEQ ID NO: 291823 - DNA, 20 bp, human
gccagcgggcggccggggca

SEQ ID NO: 291824 - DNA, 20 bp, human
gtccaggctcgagcccccga

SEQ ID NO: 291825 - DNA, 20 bp, human
gacggcggcaggagagctcc

SEQ ID NO: 291826 - DNA, 20 bp, human
ggataagcgaccaagctcag

SEQ ID NO: 291827 - DNA, 20 bp, human
gatgggcgaagcaagctgca

SEQ ID NO: 291828 - DNA, 20 bp, human
gcgaccaagctcagggggag

SEQ ID NO: 291829 - DNA, 20 bp, human
gcgaagcaagctgcagggtc

SEQ ID NO: 291830 - DNA, 20 bp, human
gcccacccctgctgcggtag

SEQ ID NO: 291831 - DNA, 20 bp, human
ggcctctaccgcagcagggg

SEQ ID NO: 291832 - DNA, 20 bp, human
gctcaccccatcctccgaga

SEQ ID NO: 291833 - DNA, 20 bp, human
gcggcagctgctggttgcca

SEQ ID NO: 291834 - DNA, 20 bp, human
gaagacctggagttcagggt

SEQ ID NO: 291835 - DNA, 20 bp, human
gtcggaggatggggtgagct

SEQ ID NO: 291836 - DNA, 20 bp, human
gagcactgcaatgaggtggg

SEQ ID NO: 291837 - DNA, 20 bp, human
gcctcagcactgcaatgagg

SEQ ID NO: 291838 - DNA, 20 bp, human
gtccctggcctgcgtcgtcc

SEQ ID NO: 291839 - DNA, 20 bp, human
gggcgggcagatgggctctg

SEQ ID NO: 291840 - DNA, 20 bp, human
gtctgggggcaccatatggc

SEQ ID NO: 291841 - DNA, 20 bp, human
gagctcaggggcttgtgtgc

SEQ ID NO: 291842 - DNA, 20 bp, human
ggggatgtcctcttagatgt

SEQ ID NO: 291843 - DNA, 20 bp, human
gcagtgctgaggatgctacc

SEQ ID NO: 291844 - DNA, 20 bp, human
gcatcctcagcactgcaatg

SEQ ID NO: 291845 - DNA, 20 bp, human
gcgcggtgagcagctccctc

SEQ ID NO: 291846 - DNA, 20 bp, human
gaggagggacggctctagat

SEQ ID NO: 291847 - DNA, 20 bp, human
gaaaggagttggggcaaaac

SEQ ID NO: 291848 - DNA, 20 bp, human
gggtcctccagcccagggat

SEQ ID NO: 291849 - DNA, 20 bp, human
gacccggcggacgcctcgtc

SEQ ID NO: 291850 - DNA, 20 bp, human
ggcccaacgggcgaagctga

SEQ ID NO: 291851 - DNA, 20 bp, human
gagaacagacccccatccct

SEQ ID NO: 291852 - DNA, 20 bp, human
gccccctcgctaggacccgg

SEQ ID NO: 291853 - DNA, 20 bp, human
gacggggatgtatgcgggta

SEQ ID NO: 291854 - DNA, 20 bp, human
gcccggggcgccttctcagc

SEQ ID NO: 291855 - DNA, 20 bp, human
gctgccccctcgctaggacc

SEQ ID NO: 291856 - DNA, 20 bp, human
ggtaactggggcgggtcgca

SEQ ID NO: 291857 - DNA, 20 bp, human
gcgacccgccccagttacca

SEQ ID NO: 291858 - DNA, 20 bp, human
gcccagccgagccggcacca

SEQ ID NO: 291859 - DNA, 20 bp, human
gtcctctgtcaccatggtgc

SEQ ID NO: 291860 - DNA, 20 bp, human
gatgctctggaccggcacat

SEQ ID NO: 291861 - DNA, 20 bp, human
ggccggcaccatggtgacag

SEQ ID NO: 291862 - DNA, 20 bp, human
gggggcgggtcgcagggtcc

SEQ ID NO: 291863 - DNA, 20 bp, human
gtacggatgcagcgatgctc

SEQ ID NO: 291864 - DNA, 20 bp, human
gcgggtcgcagggtcctggc

SEQ ID NO: 291865 - DNA, 20 bp, human
gtgaaagagaacccatgtgc

SEQ ID NO: 291866 - DNA, 20 bp, human
gcccggcggggaattatccg

SEQ ID NO: 291867 - DNA, 20 bp, human
gggcggcagcaccacagcga

SEQ ID NO: 291868 - DNA, 20 bp, human
gtcctcggataattccccgc

SEQ ID NO: 291869 - DNA, 20 bp, human
gccacgcctgggctcggcgt

SEQ ID NO: 291870 - DNA, 20 bp, human
gcggtcggcaccaggctaag

SEQ ID NO: 291871 - DNA, 20 bp, human
gccaggcgtggaattgagag

SEQ ID NO: 291872 - DNA, 20 bp, human
gcgtgccatgcattgagcta

SEQ ID NO: 291873 - DNA, 20 bp, human
ggcgtgggagcgacgcccga

SEQ ID NO: 291874 - DNA, 20 bp, human
gcggctgcaggtagacgcga

SEQ ID NO: 291875 - DNA, 20 bp, human
gactcggcgagccctcgctg

SEQ ID NO: 291876 - DNA, 20 bp, human
gggcctgggtccgcgcgctg

SEQ ID NO: 291877 - DNA, 20 bp, human
gggtccgcgcgctgaggttg

SEQ ID NO: 291878 - DNA, 20 bp, human
gcctagcgagataaagttgg

SEQ ID NO: 291879 - DNA, 20 bp, human
gtccctcctcccagctgcgg

SEQ ID NO: 291880 - DNA, 20 bp, human
gggggaaggccgccgcagct

SEQ ID NO: 291881 - DNA, 20 bp, human
ggcgcgcggctacagctgtg

SEQ ID NO: 291882 - DNA, 20 bp, human
gatggcaagccgtaaagggc

SEQ ID NO: 291883 - DNA, 20 bp, human
gaggcctagcgagataaagt

SEQ ID NO: 291884 - DNA, 20 bp, human
gacggatggcaagccgtaaa

SEQ ID NO: 291885 - DNA, 20 bp, human
gtccctgcgaggagaactca

SEQ ID NO: 291886 - DNA, 20 bp, human
gaacccgggacgcccccgcg

SEQ ID NO: 291887 - DNA, 20 bp, human
gtgccagctccagacgtcag

SEQ ID NO: 291888 - DNA, 20 bp, human
gcaggagcgctcgagaaagc

SEQ ID NO: 291889 - DNA, 20 bp, human
gaggggccgctatatagccg

SEQ ID NO: 291890 - DNA, 20 bp, human
gggagggcgcccaaggcggc

SEQ ID NO: 291891 - DNA, 20 bp, human
gcaccgtggggtggcggagc

SEQ ID NO: 291892 - DNA, 20 bp, human
gcccctctgacgtctggagc

SEQ ID NO: 291893 - DNA, 20 bp, human
gcgctcgagaaagcaggacg

SEQ ID NO: 291894 - DNA, 20 bp, human
gtccagacgtcagaggggga

SEQ ID NO: 291895 - DNA, 20 bp, human
gtcgagcgctcctgcaccgt

SEQ ID NO: 291896 - DNA, 20 bp, human
ggacgcgcgaggcccagact

SEQ ID NO: 291897 - DNA, 20 bp, human
ggccggaagcagccgagtct

SEQ ID NO: 291898 - DNA, 20 bp, human
gtgcgtctcgcgcacgtctc

SEQ ID NO: 291899 - DNA, 20 bp, human
gtccccgctcctctccgcga

SEQ ID NO: 291900 - DNA, 20 bp, human
ggaggcgcgcgcgacgcgcg

SEQ ID NO: 291901 - DNA, 20 bp, human
ggcttccggcgctcggcgcg

SEQ ID NO: 291902 - DNA, 20 bp, human
ggggcggagggagctgttga

SEQ ID NO: 291903 - DNA, 20 bp, human
gcctctccgcgacggccggg

SEQ ID NO: 291904 - DNA, 20 bp, human
gctgttgaagggcacgcagg

SEQ ID NO: 291905 - DNA, 20 bp, human
gccaccgcgcgtgtcctcac

SEQ ID NO: 291906 - DNA, 20 bp, human
gagcctaaacccggaagcga

SEQ ID NO: 291907 - DNA, 20 bp, human
ggggtctcggagcctaaacc

SEQ ID NO: 291908 - DNA, 20 bp, human
gcctcacccactgactccgc

SEQ ID NO: 291909 - DNA, 20 bp, human
gagaccccgccccccggacg

SEQ ID NO: 291910 - DNA, 20 bp, human
gctaaccagccacgtccggg

SEQ ID NO: 291911 - DNA, 20 bp, human
gtcgctgtggcccggatgtt

SEQ ID NO: 291912 - DNA, 20 bp, human
gtctccatggtctgcgtcgg

SEQ ID NO: 291913 - DNA, 20 bp, human
ggctccgcctcccggtaacc

SEQ ID NO: 291914 - DNA, 20 bp, human
gcgagggcgggcggggtcaa

SEQ ID NO: 291915 - DNA, 20 bp, human
gacgctaaccagccacgtcc

SEQ ID NO: 291916 - DNA, 20 bp, human
gagaacgagtacttggctta

SEQ ID NO: 291917 - DNA, 20 bp, human
ggtaactaatcccccgtcac

SEQ ID NO: 291918 - DNA, 20 bp, human
gttagggcacactgagagaa

SEQ ID NO: 291919 - DNA, 20 bp, human
gttactagtgattactcatt

SEQ ID NO: 291920 - DNA, 20 bp, human
gaattatgagccagtctcta

SEQ ID NO: 291921 - DNA, 20 bp, human
gccaagtactcgttctcatt

SEQ ID NO: 291922 - DNA, 20 bp, human
gcccccgtcacaggtgctga

SEQ ID NO: 291923 - DNA, 20 bp, human
gctagtaatgtgactcgtgc

SEQ ID NO: 291924 - DNA, 20 bp, human
ggtgattactcatttggctg

SEQ ID NO: 291925 - DNA, 20 bp, human
gatgtgactatctctcaagt

SEQ ID NO: 291926 - DNA, 20 bp, human
gcgctggcggggcagaaacg

SEQ ID NO: 291927 - DNA, 20 bp, human
ggagccgcgcgcatgcgtgc

SEQ ID NO: 291928 - DNA, 20 bp, human
ggtcggctctgggactcgtc

SEQ ID NO: 291929 - DNA, 20 bp, human
gaccccccggggatgcggga

SEQ ID NO: 291930 - DNA, 20 bp, human
gcccggggatgcgggaagga

SEQ ID NO: 291931 - DNA, 20 bp, human
ggagccgagggcggacgcta

SEQ ID NO: 291932 - DNA, 20 bp, human
ggcctgcgcagtgaagaccg

SEQ ID NO: 291933 - DNA, 20 bp, human
gctcaggtgagcgacggtgt

SEQ ID NO: 291934 - DNA, 20 bp, human
gagcgcgcggactgagccga

SEQ ID NO: 291935 - DNA, 20 bp, human
ggccgcggtcttcactgcgc

SEQ ID NO: 291936 - DNA, 20 bp, human
gcaacccgaggctcgggagg

SEQ ID NO: 291937 - DNA, 20 bp, human
ggtcggggcggggaagacgg

SEQ ID NO: 291938 - DNA, 20 bp, human
gcggccgcttgcccaacccg

SEQ ID NO: 291939 - DNA, 20 bp, human
ggcccaacccgaggctcggg

SEQ ID NO: 291940 - DNA, 20 bp, human
gtggcgcgaccggaagtgat

SEQ ID NO: 291941 - DNA, 20 bp, human
gcacccctccccggcctggg

SEQ ID NO: 291942 - DNA, 20 bp, human
gaaaaccgcgagaggcgtcg

SEQ ID NO: 291943 - DNA, 20 bp, human
gcatgttgggaaggtcacgt

SEQ ID NO: 291944 - DNA, 20 bp, human
gggctggggagtgaattttc

SEQ ID NO: 291945 - DNA, 20 bp, human
gaccgcgagaggcgtcgggg

SEQ ID NO: 291946 - DNA, 20 bp, human
gagggcggggcgagggtctg

SEQ ID NO: 291947 - DNA, 20 bp, human
ggcggggcgtcggggaaagg

SEQ ID NO: 291948 - DNA, 20 bp, human
gctgcccctggacacacacc

SEQ ID NO: 291949 - DNA, 20 bp, human
gagggcggggcgagtgcttg

SEQ ID NO: 291950 - DNA, 20 bp, human
gcccactggccggcatccca

SEQ ID NO: 291951 - DNA, 20 bp, human
ggccagtcgctccaccgctt

SEQ ID NO: 291952 - DNA, 20 bp, human
gcgactggcagcgcccgctt

SEQ ID NO: 291953 - DNA, 20 bp, human
gagtcgctccaccgcttcgg

SEQ ID NO: 291954 - DNA, 20 bp, human
gtggcctgcggcggggactc

SEQ ID NO: 291955 - DNA, 20 bp, human
ggggtgcctctggaagggcg

SEQ ID NO: 291956 - DNA, 20 bp, human
ggtcccagaacagcagccaa

SEQ ID NO: 291957 - DNA, 20 bp, human
gaggctggcgagtgccacag

SEQ ID NO: 291958 - DNA, 20 bp, human
ggccccctcacgacaggcag

SEQ ID NO: 291959 - DNA, 20 bp, human
gtggagcttaggtggagcag

SEQ ID NO: 291960 - DNA, 20 bp, human
ggccacctgtccaggaaatg

SEQ ID NO: 291961 - DNA, 20 bp, human
gactcccctgcctgtcgtga

SEQ ID NO: 291962 - DNA, 20 bp, human
gcgagtgccacagaggtatc

SEQ ID NO: 291963 - DNA, 20 bp, human
ggtatcaggagctctagtat

SEQ ID NO: 291964 - DNA, 20 bp, human
gcaggtggctggttcaggag

SEQ ID NO: 291965 - DNA, 20 bp, human
gcggcgggtaggagggactt

SEQ ID NO: 291966 - DNA, 20 bp, human
gagggcggggcgagggtctg

SEQ ID NO: 291967 - DNA, 20 bp, human
ggcggggcgtcggggaaagg

SEQ ID NO: 291968 - DNA, 20 bp, human
gctgcccctggacacacacc

SEQ ID NO: 291969 - DNA, 20 bp, human
gagggcggggcgagtgcttg

SEQ ID NO: 291970 - DNA, 20 bp, human
gcccactggccggcatccca

SEQ ID NO: 291971 - DNA, 20 bp, human
ggccagtcgctccaccgctt

SEQ ID NO: 291972 - DNA, 20 bp, human
gcgactggcagcgcccgctt

SEQ ID NO: 291973 - DNA, 20 bp, human
gagtcgctccaccgcttcgg

SEQ ID NO: 291974 - DNA, 20 bp, human
gtggcctgcggcggggactc

SEQ ID NO: 291975 - DNA, 20 bp, human
ggggtgcctctggaagggcg

SEQ ID NO: 291976 - DNA, 20 bp, human
ggtcccagaacagcagccaa

SEQ ID NO: 291977 - DNA, 20 bp, human
gaggctggcgagtgccacag

SEQ ID NO: 291978 - DNA, 20 bp, human
ggccccctcacgacaggcag

SEQ ID NO: 291979 - DNA, 20 bp, human
gtggagcttaggtggagcag

SEQ ID NO: 291980 - DNA, 20 bp, human
ggccacctgtccaggaaatg

SEQ ID NO: 291981 - DNA, 20 bp, human
gactcccctgcctgtcgtga

SEQ ID NO: 291982 - DNA, 20 bp, human
gcgagtgccacagaggtatc

SEQ ID NO: 291983 - DNA, 20 bp, human
ggtatcaggagctctagtat

SEQ ID NO: 291984 - DNA, 20 bp, human
gcaggtggctggttcaggag

SEQ ID NO: 291985 - DNA, 20 bp, human
gcggcgggtaggagggactt

SEQ ID NO: 291986 - DNA, 20 bp, human
gggcgcccatagtcgctctc

SEQ ID NO: 291987 - DNA, 20 bp, human
gccaaaggaggtcacttccg

SEQ ID NO: 291988 - DNA, 20 bp, human
gccgccccgagagcgactat

SEQ ID NO: 291989 - DNA, 20 bp, human
gcaacggccgggaaccggga

SEQ ID NO: 291990 - DNA, 20 bp, human
gcggaagaggcctctacggg

SEQ ID NO: 291991 - DNA, 20 bp, human
ggccccggaagaggcctcta

SEQ ID NO: 291992 - DNA, 20 bp, human
gcgggaaccgggacggaccc

SEQ ID NO: 291993 - DNA, 20 bp, human
gttgtcgccatggtaaccgg

SEQ ID NO: 291994 - DNA, 20 bp, human
gcggatgggcccaaggttcc

SEQ ID NO: 291995 - DNA, 20 bp, human
ggggcccatccgccagccat

SEQ ID NO: 291996 - DNA, 20 bp, human
gtggaggctgcgcggaagga

SEQ ID NO: 291997 - DNA, 20 bp, human
ggaactggaggctgcgcgga

SEQ ID NO: 291998 - DNA, 20 bp, human
gtccagccccggggaactgg

SEQ ID NO: 291999 - DNA, 20 bp, human
ggccgctcgcgggctggctc

SEQ ID NO: 292000 - DNA, 20 bp, human
ggacgtcggcggctccacga

SEQ ID NO: 292001 - DNA, 20 bp, human
gaaaagaggaactaaggcgg

SEQ ID NO: 292002 - DNA, 20 bp, human
gtggctcaggggacgccgag

SEQ ID NO: 292003 - DNA, 20 bp, human
gccggctgtcggctggttgc

SEQ ID NO: 292004 - DNA, 20 bp, human
gagcgcggccgctcgcgggc

SEQ ID NO: 292005 - DNA, 20 bp, human
gccgcacgctggtgacgcgg

SEQ ID NO: 292006 - DNA, 20 bp, human
gcacctgagcccgacgtcag

SEQ ID NO: 292007 - DNA, 20 bp, human
gcctgggagccgcagacgcc

SEQ ID NO: 292008 - DNA, 20 bp, human
gcccgcccgcacggcccagt

SEQ ID NO: 292009 - DNA, 20 bp, human
ggacgtaagtctgacgtcat

SEQ ID NO: 292010 - DNA, 20 bp, human
ggggcgcagttcaacggttg

SEQ ID NO: 292011 - DNA, 20 bp, human
ggcagacgccgggcgtgtag

SEQ ID NO: 292012 - DNA, 20 bp, human
gtggcggccggctgcggtga

SEQ ID NO: 292013 - DNA, 20 bp, human
gagtctgacgtcatcggcac

SEQ ID NO: 292014 - DNA, 20 bp, human
gacgtcatcggcaccggcct

SEQ ID NO: 292015 - DNA, 20 bp, human
gcaggcgtgacgccacggct

SEQ ID NO: 292016 - DNA, 20 bp, human
gccgcactacaacttccgtc

SEQ ID NO: 292017 - DNA, 20 bp, human
gtggccctgaagtcggccgt

SEQ ID NO: 292018 - DNA, 20 bp, human
ggcctctgaggcgcacttcc

SEQ ID NO: 292019 - DNA, 20 bp, human
gcgcggccgtatgcgaaaga

SEQ ID NO: 292020 - DNA, 20 bp, human
gtgacgtcacacaagggaaa

SEQ ID NO: 292021 - DNA, 20 bp, human
gcgggctccgcggcaggtcc

SEQ ID NO: 292022 - DNA, 20 bp, human
ggactcccgtggggccccgc

SEQ ID NO: 292023 - DNA, 20 bp, human
gccggcgcgcggggatcacc

SEQ ID NO: 292024 - DNA, 20 bp, human
ggagtcccgcggggccccac

SEQ ID NO: 292025 - DNA, 20 bp, human
gtcccggaagtgcgcctcag

SEQ ID NO: 292026 - DNA, 20 bp, human
gaaggcgcggctgcctgtgt

SEQ ID NO: 292027 - DNA, 20 bp, human
ggggagggcgagtgtacccg

SEQ ID NO: 292028 - DNA, 20 bp, human
gcagtgggatgccggtggga

SEQ ID NO: 292029 - DNA, 20 bp, human
gtgttcgcgcagtgggatgc

SEQ ID NO: 292030 - DNA, 20 bp, human
gggtgcccggctcacgtggg

SEQ ID NO: 292031 - DNA, 20 bp, human
gcagccgcgccttcatctcc

SEQ ID NO: 292032 - DNA, 20 bp, human
gggtacactcgccctcccac

SEQ ID NO: 292033 - DNA, 20 bp, human
ggggcggtgcccggctcacg

SEQ ID NO: 292034 - DNA, 20 bp, human
gcacacgtggccgcactcac

SEQ ID NO: 292035 - DNA, 20 bp, human
ggggctccggcgcccgcgag

SEQ ID NO: 292036 - DNA, 20 bp, human
ggaggctgagaactgagtgc

SEQ ID NO: 292037 - DNA, 20 bp, human
gggagggcaccggggaatcg

SEQ ID NO: 292038 - DNA, 20 bp, human
ggcgcccgtgccgcagaccc

SEQ ID NO: 292039 - DNA, 20 bp, human
gtccctgcgcgcagacccag

SEQ ID NO: 292040 - DNA, 20 bp, human
ggtaaccccaggtcccctta

SEQ ID NO: 292041 - DNA, 20 bp, human
ggggcatgtgagtggtgatg

SEQ ID NO: 292042 - DNA, 20 bp, human
ggggagctctcattcccggg

SEQ ID NO: 292043 - DNA, 20 bp, human
gactgcccgggtctgcggca

SEQ ID NO: 292044 - DNA, 20 bp, human
ggacagccccgcacacccac

SEQ ID NO: 292045 - DNA, 20 bp, human
gaaaagacaccaggttccct

SEQ ID NO: 292046 - DNA, 20 bp, human
gagcgcggcggtcccaagag

SEQ ID NO: 292047 - DNA, 20 bp, human
gggggccccggggaagccca

SEQ ID NO: 292048 - DNA, 20 bp, human
gcccccgccggactggaaac

SEQ ID NO: 292049 - DNA, 20 bp, human
gggcgcggcccagcaggcta

SEQ ID NO: 292050 - DNA, 20 bp, human
gtcaccgcccagctcccggg

SEQ ID NO: 292051 - DNA, 20 bp, human
gtaaatcccactcccggagg

SEQ ID NO: 292052 - DNA, 20 bp, human
ggctgggccgcgcccctctt

SEQ ID NO: 292053 - DNA, 20 bp, human
gggcccagcaggctagggcg

SEQ ID NO: 292054 - DNA, 20 bp, human
gtggacccaagctgcccgga

SEQ ID NO: 292055 - DNA, 20 bp, human
ggggaaggcgcgcagcactc

SEQ ID NO: 292056 - DNA, 20 bp, human
gaacccttcggtgagggagg

SEQ ID NO: 292057 - DNA, 20 bp, human
gcccatactggggctcggga

SEQ ID NO: 292058 - DNA, 20 bp, human
ggagacccatactggggctc

SEQ ID NO: 292059 - DNA, 20 bp, human
gctcgggagggatggcaagg

SEQ ID NO: 292060 - DNA, 20 bp, human
gggaggggagacccatactg

SEQ ID NO: 292061 - DNA, 20 bp, human
gggcgggggaggagagatgc

SEQ ID NO: 292062 - DNA, 20 bp, human
ggagggagaaagctctgcag

SEQ ID NO: 292063 - DNA, 20 bp, human
ggcaggggtgagcactaagg

SEQ ID NO: 292064 - DNA, 20 bp, human
gtggcatgcgggctgggagt

SEQ ID NO: 292065 - DNA, 20 bp, human
ggggtgggtagagaaggata

SEQ ID NO: 292066 - DNA, 20 bp, human
ggtgtctgggagccagacgc

SEQ ID NO: 292067 - DNA, 20 bp, human
gtggaggactcagcactcgg

SEQ ID NO: 292068 - DNA, 20 bp, human
gtcaaagagctgggtggccg

SEQ ID NO: 292069 - DNA, 20 bp, human
ggcaccgggaagaccgtcct

SEQ ID NO: 292070 - DNA, 20 bp, human
ggcgtcccggaagtagctgg

SEQ ID NO: 292071 - DNA, 20 bp, human
gtcagcactcggtggtgtct

SEQ ID NO: 292072 - DNA, 20 bp, human
gaaggcgacgaggcgcggac

SEQ ID NO: 292073 - DNA, 20 bp, human
gcgggacgctctagacaggc

SEQ ID NO: 292074 - DNA, 20 bp, human
gagagctgggtggccgcgga

SEQ ID NO: 292075 - DNA, 20 bp, human
gtagctgggggaaggcgacg

SEQ ID NO: 292076 - DNA, 20 bp, human
gactcacaggactactacgt

SEQ ID NO: 292077 - DNA, 20 bp, human
gtgcctgagcacagggttaa

SEQ ID NO: 292078 - DNA, 20 bp, human
gtgtgtgaggagtggcacag

SEQ ID NO: 292079 - DNA, 20 bp, human
ggagcagcaggccgagtgca

SEQ ID NO: 292080 - DNA, 20 bp, human
ggccgggtccccagagcagc

SEQ ID NO: 292081 - DNA, 20 bp, human
gatggcagcagccggctgca

SEQ ID NO: 292082 - DNA, 20 bp, human
gcccggccagctctaggctc

SEQ ID NO: 292083 - DNA, 20 bp, human
gccactgggccgggtgtgtg

SEQ ID NO: 292084 - DNA, 20 bp, human
gccgacttgtgcaacgccag

SEQ ID NO: 292085 - DNA, 20 bp, human
ggccagctctaggctctggg

SEQ ID NO: 292086 - DNA, 20 bp, human
gagcgcgagcgagtcccagc

SEQ ID NO: 292087 - DNA, 20 bp, human
gccccccttccggggaccaa

SEQ ID NO: 292088 - DNA, 20 bp, human
gtgtcctgagctggttgccg

SEQ ID NO: 292089 - DNA, 20 bp, human
gggaagtcccgcctctgggt

SEQ ID NO: 292090 - DNA, 20 bp, human
ggatgctcctcccccccttc

SEQ ID NO: 292091 - DNA, 20 bp, human
gctgccccggcaaccagctc

SEQ ID NO: 292092 - DNA, 20 bp, human
gggcgggagggatcatcttc

SEQ ID NO: 292093 - DNA, 20 bp, human
gtgagagcgcgagggcggtg

SEQ ID NO: 292094 - DNA, 20 bp, human
ggaggtggaggcgctttgaa

SEQ ID NO: 292095 - DNA, 20 bp, human
gacttcccttggtccccgga

SEQ ID NO: 292096 - DNA, 20 bp, human
ggcagtggcgagtgctgagt

SEQ ID NO: 292097 - DNA, 20 bp, human
gctgccctgctgcaatggca

SEQ ID NO: 292098 - DNA, 20 bp, human
gatgccctgccctgctgcaa

SEQ ID NO: 292099 - DNA, 20 bp, human
gaacaggtggccagagaccg

SEQ ID NO: 292100 - DNA, 20 bp, human
gtgcaggcgctacgtctccc

SEQ ID NO: 292101 - DNA, 20 bp, human
gggccaatcagcatgcccgc

SEQ ID NO: 292102 - DNA, 20 bp, human
gcctgctgcaatggcaggga

SEQ ID NO: 292103 - DNA, 20 bp, human
gtggagtgaggtcacagccg

SEQ ID NO: 292104 - DNA, 20 bp, human
gcagcatgcccgctggagtg

SEQ ID NO: 292105 - DNA, 20 bp, human
ggtggccagagaccgcgggt

SEQ ID NO: 292106 - DNA, 20 bp, human
gaagctgtgttggaggtcaa

SEQ ID NO: 292107 - DNA, 20 bp, human
gaacaaacacgcgccagcca

SEQ ID NO: 292108 - DNA, 20 bp, human
gatcggtggcgatgaagggg

SEQ ID NO: 292109 - DNA, 20 bp, human
gagagagcaaagtcctgaga

SEQ ID NO: 292110 - DNA, 20 bp, human
gaggcgaggcgccaccgacg

SEQ ID NO: 292111 - DNA, 20 bp, human
ggatcatcggtggcgatgaa

SEQ ID NO: 292112 - DNA, 20 bp, human
gcggcaaatggcggttgcag

SEQ ID NO: 292113 - DNA, 20 bp, human
gagcttctccactggatcat

SEQ ID NO: 292114 - DNA, 20 bp, human
ggcgcgtgtttgttcattct

SEQ ID NO: 292115 - DNA, 20 bp, human
gccccgttgcattgtggtct

SEQ ID NO: 292116 - DNA, 20 bp, human
ggggaaaaacggcccgggga

SEQ ID NO: 292117 - DNA, 20 bp, human
gcccagagaagaatcttcta

SEQ ID NO: 292118 - DNA, 20 bp, human
gggctcgcgtcgctctcagg

SEQ ID NO: 292119 - DNA, 20 bp, human
ggaagggcccgactgtagga

SEQ ID NO: 292120 - DNA, 20 bp, human
gtgggcccgcggaggctcac

SEQ ID NO: 292121 - DNA, 20 bp, human
ggaaagaagggcccgactgt

SEQ ID NO: 292122 - DNA, 20 bp, human
ggagccaatgggaaggcctt

SEQ ID NO: 292123 - DNA, 20 bp, human
gcgcggaggctcacgggatg

SEQ ID NO: 292124 - DNA, 20 bp, human
gcaccccaaggccttcccat

SEQ ID NO: 292125 - DNA, 20 bp, human
ggggccgggaaaaacggccc

SEQ ID NO: 292126 - DNA, 20 bp, human
gtcggggtacgcatggaagg

SEQ ID NO: 292127 - DNA, 20 bp, human
gtaaacagcggccacgggcc

SEQ ID NO: 292128 - DNA, 20 bp, human
gcctcctcgagcgtggggaa

SEQ ID NO: 292129 - DNA, 20 bp, human
gggcggctcgcgtcactgtc

SEQ ID NO: 292130 - DNA, 20 bp, human
gcaatcggagcgcacttccg

SEQ ID NO: 292131 - DNA, 20 bp, human
gtgagtgaggggtttcaggg

SEQ ID NO: 292132 - DNA, 20 bp, human
ggtacgcagcaagtggggtg

SEQ ID NO: 292133 - DNA, 20 bp, human
ggggcccaggcacatgagtg

SEQ ID NO: 292134 - DNA, 20 bp, human
gacctcggggtacgcatgga

SEQ ID NO: 292135 - DNA, 20 bp, human
gaggggctcaaaggacctcg

SEQ ID NO: 292136 - DNA, 20 bp, human
gccgagccgaggctataaga

SEQ ID NO: 292137 - DNA, 20 bp, human
gcaacagcgcgctgccttgt

SEQ ID NO: 292138 - DNA, 20 bp, human
gaggagccgccgccagtgga

SEQ ID NO: 292139 - DNA, 20 bp, human
gccttgtgggttgacgtcat

SEQ ID NO: 292140 - DNA, 20 bp, human
ggtacacagcggtcccgggg

SEQ ID NO: 292141 - DNA, 20 bp, human
gcccacgcgcggacacgggg

SEQ ID NO: 292142 - DNA, 20 bp, human
gctccgccaaggcacgtccc

SEQ ID NO: 292143 - DNA, 20 bp, human
gagagggcgcacaagtggcg

SEQ ID NO: 292144 - DNA, 20 bp, human
gcgccaaggcacgtcccggg

SEQ ID NO: 292145 - DNA, 20 bp, human
gcccgttcgccattgggtgc

SEQ ID NO: 292146 - DNA, 20 bp, human
gtcgcctgactgtcccgtgg

SEQ ID NO: 292147 - DNA, 20 bp, human
gtgactgtcccgtggagggg

SEQ ID NO: 292148 - DNA, 20 bp, human
ggcaagcggataaacagagg

SEQ ID NO: 292149 - DNA, 20 bp, human
gggcggccgtggaagaggac

SEQ ID NO: 292150 - DNA, 20 bp, human
gggactgccagtcggctcta

SEQ ID NO: 292151 - DNA, 20 bp, human
gagccgactggcagtccccg

SEQ ID NO: 292152 - DNA, 20 bp, human
gtgagctcgcaccagagggt

SEQ ID NO: 292153 - DNA, 20 bp, human
gacagaggcggccgtggaag

SEQ ID NO: 292154 - DNA, 20 bp, human
gagggtgggcgtctccccca

SEQ ID NO: 292155 - DNA, 20 bp, human
gccccggggccaatggcaag

SEQ ID NO: 292156 - DNA, 20 bp, human
gaaaactctcgttgcagttg

SEQ ID NO: 292157 - DNA, 20 bp, human
gccacacctcagtggttgag

SEQ ID NO: 292158 - DNA, 20 bp, human
gcacagcccctcaaccactg

SEQ ID NO: 292159 - DNA, 20 bp, human
gcacctaaatgggtgggcgg

SEQ ID NO: 292160 - DNA, 20 bp, human
gttaggtgccctatagtgtg

SEQ ID NO: 292161 - DNA, 20 bp, human
ggggcacctaaatgggtggg

SEQ ID NO: 292162 - DNA, 20 bp, human
gcagagcgggggcaattacg

SEQ ID NO: 292163 - DNA, 20 bp, human
gttgaggggctgtgacttct

SEQ ID NO: 292164 - DNA, 20 bp, human
gtagaggttgacactgtgac

SEQ ID NO: 292165 - DNA, 20 bp, human
gcactgaggtgtgggggggt

SEQ ID NO: 292166 - DNA, 20 bp, human
gggctcgcagctgacgagac

SEQ ID NO: 292167 - DNA, 20 bp, human
ggggcccctcgagacctgcg

SEQ ID NO: 292168 - DNA, 20 bp, human
gggacaggaggccgcaccat

SEQ ID NO: 292169 - DNA, 20 bp, human
gaaggcgtgtgagtgacagg

SEQ ID NO: 292170 - DNA, 20 bp, human
gccagctcgccctcgagggg

SEQ ID NO: 292171 - DNA, 20 bp, human
gtgcgagcccgggcgctccg

SEQ ID NO: 292172 - DNA, 20 bp, human
gcctcccagctcgccctcga

SEQ ID NO: 292173 - DNA, 20 bp, human
gggagggaggtcggcgagga

SEQ ID NO: 292174 - DNA, 20 bp, human
gacgccgcgcaggtctcgag

SEQ ID NO: 292175 - DNA, 20 bp, human
ggctgacgagaccggcccat

SEQ ID NO: 292176 - DNA, 20 bp, human
gggctcctccaatagaatat

SEQ ID NO: 292177 - DNA, 20 bp, human
gaggtcggagatgcgtggga

SEQ ID NO: 292178 - DNA, 20 bp, human
ggcctctggtgtgggaggta

SEQ ID NO: 292179 - DNA, 20 bp, human
gcaccagtcctcccacacag

SEQ ID NO: 292180 - DNA, 20 bp, human
ggcatctccgacctcccctt

SEQ ID NO: 292181 - DNA, 20 bp, human
gtaagacatggacttgactg

SEQ ID NO: 292182 - DNA, 20 bp, human
gagccactggcctctggtgt

SEQ ID NO: 292183 - DNA, 20 bp, human
gccgagcctgcctggaccca

SEQ ID NO: 292184 - DNA, 20 bp, human
gctcccacaccagaggccag

SEQ ID NO: 292185 - DNA, 20 bp, human
gctccaatagaatatgggat

SEQ ID NO: 292186 - DNA, 20 bp, human
gccgcggtgggcgacagctg

SEQ ID NO: 292187 - DNA, 20 bp, human
ggggcctggtggagttgcag

SEQ ID NO: 292188 - DNA, 20 bp, human
ggtcgcccaccgcgggtgag

SEQ ID NO: 292189 - DNA, 20 bp, human
gcgcgtgagaagaacggcgc

SEQ ID NO: 292190 - DNA, 20 bp, human
gaggacgcccggctccccgc

SEQ ID NO: 292191 - DNA, 20 bp, human
gggggagccgggcgtcctct

SEQ ID NO: 292192 - DNA, 20 bp, human
ggagcggcgcgtgagaagaa

SEQ ID NO: 292193 - DNA, 20 bp, human
ggcgcgggccggcgaagccc

SEQ ID NO: 292194 - DNA, 20 bp, human
gctgtggctgcgccccggag

SEQ ID NO: 292195 - DNA, 20 bp, human
gcaagcctctcacccgcggt

SEQ ID NO: 292196 - DNA, 20 bp, human
gaccctgcctcggggactta

SEQ ID NO: 292197 - DNA, 20 bp, human
ggggcggaacggctcggcgg

SEQ ID NO: 292198 - DNA, 20 bp, human
ggaacggctcggcggcggga

SEQ ID NO: 292199 - DNA, 20 bp, human
gagagacgctggttggagac

SEQ ID NO: 292200 - DNA, 20 bp, human
ggggcgggaccagccggagg

SEQ ID NO: 292201 - DNA, 20 bp, human
gcgggcggagccacctccga

SEQ ID NO: 292202 - DNA, 20 bp, human
ggggcgcccgggcggctgga

SEQ ID NO: 292203 - DNA, 20 bp, human
ggggatggagagacgctggt

SEQ ID NO: 292204 - DNA, 20 bp, human
gctgcctcggggacttaggg

SEQ ID NO: 292205 - DNA, 20 bp, human
gggggggcggaacggctcgg

SEQ ID NO: 292206 - DNA, 20 bp, human
gaggcggggcctggaatgta

SEQ ID NO: 292207 - DNA, 20 bp, human
gaatgtaggggtggtgactg

SEQ ID NO: 292208 - DNA, 20 bp, human
gctcggcgaccgtcactcca

SEQ ID NO: 292209 - DNA, 20 bp, human
gaagccgcccagtgggacgg

SEQ ID NO: 292210 - DNA, 20 bp, human
gagtgacggtcgccgagcgc

SEQ ID NO: 292211 - DNA, 20 bp, human
ggctctccaagccgcccagt

SEQ ID NO: 292212 - DNA, 20 bp, human
gtccaagccgcccagtggga

SEQ ID NO: 292213 - DNA, 20 bp, human
gaccccaccgtcccactggg

SEQ ID NO: 292214 - DNA, 20 bp, human
gtgggcggcttggagagcct

SEQ ID NO: 292215 - DNA, 20 bp, human
gagtagaagagtaacccggt

SEQ ID NO: 292216 - DNA, 20 bp, human
gcgagtccccgccttcgcta

SEQ ID NO: 292217 - DNA, 20 bp, human
gaggtcctcgccagcggatg

SEQ ID NO: 292218 - DNA, 20 bp, human
gctcactggcccacatccgc

SEQ ID NO: 292219 - DNA, 20 bp, human
gaagctgggtgcagtaagtt

SEQ ID NO: 292220 - DNA, 20 bp, human
ggaggctaagaccctcccct

SEQ ID NO: 292221 - DNA, 20 bp, human
gaacgcatacgaaagcactt

SEQ ID NO: 292222 - DNA, 20 bp, human
ggggccagggccgagaccgt

SEQ ID NO: 292223 - DNA, 20 bp, human
ggcggtgggtgtgcccgcag

SEQ ID NO: 292224 - DNA, 20 bp, human
gggcgcaccctggtcgtccg

SEQ ID NO: 292225 - DNA, 20 bp, human
ggcagaattgcgaaaccgag

SEQ ID NO: 292226 - DNA, 20 bp, human
gccaccccggcgcgccgcca

SEQ ID NO: 292227 - DNA, 20 bp, human
ggcgaagggccgctccaccc

SEQ ID NO: 292228 - DNA, 20 bp, human
gccgccgcggcgagacgagt

SEQ ID NO: 292229 - DNA, 20 bp, human
ggatggaggtacaaaaacat

SEQ ID NO: 292230 - DNA, 20 bp, human
gtgccgtcgccgcacgtccg

SEQ ID NO: 292231 - DNA, 20 bp, human
gtgccccggacgtgcggcga

SEQ ID NO: 292232 - DNA, 20 bp, human
gggagccatgactgaggcgg

SEQ ID NO: 292233 - DNA, 20 bp, human
gggtacaaaaacatcggcca

SEQ ID NO: 292234 - DNA, 20 bp, human
ggcgcctcctggcggcccgc

SEQ ID NO: 292235 - DNA, 20 bp, human
gccgccggccccagcacgga

SEQ ID NO: 292236 - DNA, 20 bp, human
gtgcacggaacccgtcccga

SEQ ID NO: 292237 - DNA, 20 bp, human
ggaagcggctcggagtgttc

SEQ ID NO: 292238 - DNA, 20 bp, human
gagcacgactcccttaactc

SEQ ID NO: 292239 - DNA, 20 bp, human
gcggcgctagccaatggcaa

SEQ ID NO: 292240 - DNA, 20 bp, human
gggcggggaaaccccggcag

SEQ ID NO: 292241 - DNA, 20 bp, human
gcagcgccatgcaaatgaag

SEQ ID NO: 292242 - DNA, 20 bp, human
gaaaccctgcaccagagtta

SEQ ID NO: 292243 - DNA, 20 bp, human
gtagccaatggcaacggggg

SEQ ID NO: 292244 - DNA, 20 bp, human
ggccatgcaaatgaagcggg

SEQ ID NO: 292245 - DNA, 20 bp, human
gggggcctgcagaagcggct

SEQ ID NO: 292246 - DNA, 20 bp, human
gaggagagtgagccggggaa

SEQ ID NO: 292247 - DNA, 20 bp, human
gcgctgagaaaatgcgaggt

SEQ ID NO: 292248 - DNA, 20 bp, human
gccgccctcccagacacgat

SEQ ID NO: 292249 - DNA, 20 bp, human
gaccaactacctatcgtgtc

SEQ ID NO: 292250 - DNA, 20 bp, human
gagtagccaggagtccggaa

SEQ ID NO: 292251 - DNA, 20 bp, human
gggagcgctgagaaaatgcg

SEQ ID NO: 292252 - DNA, 20 bp, human
gcggactcctggctactcat

SEQ ID NO: 292253 - DNA, 20 bp, human
gcgcccggaggagagtgagc

SEQ ID NO: 292254 - DNA, 20 bp, human
gccgctggcgccactagaga

SEQ ID NO: 292255 - DNA, 20 bp, human
gtatgacaggatgtcgccat

SEQ ID NO: 292256 - DNA, 20 bp, human
gaagctccggcgcctctgtc

SEQ ID NO: 292257 - DNA, 20 bp, human
gcggaagcgggttacggcct

SEQ ID NO: 292258 - DNA, 20 bp, human
gtgagcggcaaagcccggaa

SEQ ID NO: 292259 - DNA, 20 bp, human
gcccggaacggatgaagctc

SEQ ID NO: 292260 - DNA, 20 bp, human
gaaaacgcggaagcgggtta

SEQ ID NO: 292261 - DNA, 20 bp, human
gtcagtagggaaagcgaggg

SEQ ID NO: 292262 - DNA, 20 bp, human
gcggcgcctctgtccggaag

SEQ ID NO: 292263 - DNA, 20 bp, human
gcacaaaggaccaacacggt

SEQ ID NO: 292264 - DNA, 20 bp, human
ggctctcctcttccggacag

SEQ ID NO: 292265 - DNA, 20 bp, human
gcctccacgccccggcgctg

SEQ ID NO: 292266 - DNA, 20 bp, human
gttcgcggcagaggcgtctg

SEQ ID NO: 292267 - DNA, 20 bp, human
gggcccagtgctgcgcttcg

SEQ ID NO: 292268 - DNA, 20 bp, human
gaaaactagaccaagaagct

SEQ ID NO: 292269 - DNA, 20 bp, human
ggggcactctcgatgcgccg

SEQ ID NO: 292270 - DNA, 20 bp, human
gacgaacagagtcgaggaat

SEQ ID NO: 292271 - DNA, 20 bp, human
ggcctcgcggatatctgcgc

SEQ ID NO: 292272 - DNA, 20 bp, human
gcgaagccccacctcttccg

SEQ ID NO: 292273 - DNA, 20 bp, human
gtgtgccaggcgctcgcgag

SEQ ID NO: 292274 - DNA, 20 bp, human
gtcctcgactctgttcgtga

SEQ ID NO: 292275 - DNA, 20 bp, human
ggggctgggccgcacgtaga

SEQ ID NO: 292276 - DNA, 20 bp, human
gctgtcaggggccaagagac

SEQ ID NO: 292277 - DNA, 20 bp, human
ggagtccgggagagtcacga

SEQ ID NO: 292278 - DNA, 20 bp, human
gttgctgcgcggcgcatgac

SEQ ID NO: 292279 - DNA, 20 bp, human
gacagccatcgtgactctcc

SEQ ID NO: 292280 - DNA, 20 bp, human
gtccggagccgcgtggggca

SEQ ID NO: 292281 - DNA, 20 bp, human
gcttggggacaaggagtctt

SEQ ID NO: 292282 - DNA, 20 bp, human
gcaatgtggggccttcactc

SEQ ID NO: 292283 - DNA, 20 bp, human
gtcacgatggctgtcctctt

SEQ ID NO: 292284 - DNA, 20 bp, human
gagtgaagaggggtcaatgt

SEQ ID NO: 292285 - DNA, 20 bp, human
gcaggcctcacttggctgtc

SEQ ID NO: 292286 - DNA, 20 bp, human
ggggcccggccagagcgagc

SEQ ID NO: 292287 - DNA, 20 bp, human
ggggccccgcgcgctgatgg

SEQ ID NO: 292288 - DNA, 20 bp, human
gaatccctgggtgtgggtga

SEQ ID NO: 292289 - DNA, 20 bp, human
gtcccgggcaggagaaccaa

SEQ ID NO: 292290 - DNA, 20 bp, human
ggtgtcgaagcactggggtg

SEQ ID NO: 292291 - DNA, 20 bp, human
gagcgctggcagacaccgtg

SEQ ID NO: 292292 - DNA, 20 bp, human
gccccgcgcgctgatggtgg

SEQ ID NO: 292293 - DNA, 20 bp, human
gcgcccggctcgctctggcc

SEQ ID NO: 292294 - DNA, 20 bp, human
ggaggccaatccctgggtgt

SEQ ID NO: 292295 - DNA, 20 bp, human
gtggctgcggacatgttcct

SEQ ID NO: 292296 - DNA, 20 bp, human
gtggtcacgtgtatgcggag

SEQ ID NO: 292297 - DNA, 20 bp, human
gactggctgtgcacgttatg

SEQ ID NO: 292298 - DNA, 20 bp, human
gcccacagggcgctcggtcc

SEQ ID NO: 292299 - DNA, 20 bp, human
gcctcacgaagcccctgtag

SEQ ID NO: 292300 - DNA, 20 bp, human
ggaagctggtcacgtgtatg

SEQ ID NO: 292301 - DNA, 20 bp, human
ggaccagcttcgcacccggt

SEQ ID NO: 292302 - DNA, 20 bp, human
gcaccgcgacccagctgcga

SEQ ID NO: 292303 - DNA, 20 bp, human
gaagcctcaggccgagccct

SEQ ID NO: 292304 - DNA, 20 bp, human
gggactcagtagaccgccac

SEQ ID NO: 292305 - DNA, 20 bp, human
gcgcccaccgggtgcgaagc

SEQ ID NO: 292306 - DNA, 20 bp, human
ggggaggaggaggacttggt

SEQ ID NO: 292307 - DNA, 20 bp, human
gccggccggcggggtcacgt

SEQ ID NO: 292308 - DNA, 20 bp, human
gcggggcagcagggaagagc

SEQ ID NO: 292309 - DNA, 20 bp, human
gcccgccctccggcctttcc

SEQ ID NO: 292310 - DNA, 20 bp, human
gggggaggggagcgtcgcga

SEQ ID NO: 292311 - DNA, 20 bp, human
gcacgtggggccggtacaaa

SEQ ID NO: 292312 - DNA, 20 bp, human
gtaaacgcgtgagacgggag

SEQ ID NO: 292313 - DNA, 20 bp, human
ggaggcccggcagcgcgggt

SEQ ID NO: 292314 - DNA, 20 bp, human
gagagccgggaaaggccgga

SEQ ID NO: 292315 - DNA, 20 bp, human
ggctgtgcaggcaaatgagt

SEQ ID NO: 292316 - DNA, 20 bp, human
gctgcagagtggttagtgag

SEQ ID NO: 292317 - DNA, 20 bp, human
ggggggggatgatgggtcga

SEQ ID NO: 292318 - DNA, 20 bp, human
gccctccggcaccaccccgg

SEQ ID NO: 292319 - DNA, 20 bp, human
gtggaagcgagatgaccggc

SEQ ID NO: 292320 - DNA, 20 bp, human
gggcagtggaccctcccccg

SEQ ID NO: 292321 - DNA, 20 bp, human
gtatgtggaagcgagatgac

SEQ ID NO: 292322 - DNA, 20 bp, human
gcggcaggaacctgccccaa

SEQ ID NO: 292323 - DNA, 20 bp, human
gcccgccgctgctccattgg

SEQ ID NO: 292324 - DNA, 20 bp, human
ggggtgacagacagacccgt

SEQ ID NO: 292325 - DNA, 20 bp, human
gtcccccggggtggtgccgg

SEQ ID NO: 292326 - DNA, 20 bp, human
ggagacccagccggaagtga

SEQ ID NO: 292327 - DNA, 20 bp, human
gtgactccagtggtggaacc

SEQ ID NO: 292328 - DNA, 20 bp, human
gtggctctgtttgtgggcgt

SEQ ID NO: 292329 - DNA, 20 bp, human
gcagaaagtgactccagtgg

SEQ ID NO: 292330 - DNA, 20 bp, human
gaggtgacgcgagacccagc

SEQ ID NO: 292331 - DNA, 20 bp, human
gtgacgttacgggccagaga

SEQ ID NO: 292332 - DNA, 20 bp, human
gctcgcgtcacctgacgtta

SEQ ID NO: 292333 - DNA, 20 bp, human
gtgggcgccattttgaagtt

SEQ ID NO: 292334 - DNA, 20 bp, human
gtacgggccagagagggtgc

SEQ ID NO: 292335 - DNA, 20 bp, human
gggtctcgaaggggtgggaa

SEQ ID NO: 292336 - DNA, 20 bp, human
gtggctgcagcctatgggtg

SEQ ID NO: 292337 - DNA, 20 bp, human
gtccccgcggccccgcgagt

SEQ ID NO: 292338 - DNA, 20 bp, human
ggcagcctatgggtgaggag

SEQ ID NO: 292339 - DNA, 20 bp, human
ggacctgtggctgcagccta

SEQ ID NO: 292340 - DNA, 20 bp, human
ggagttggatgttgagtgtg

SEQ ID NO: 292341 - DNA, 20 bp, human
ggcggggtctgtgatgtagc

SEQ ID NO: 292342 - DNA, 20 bp, human
ggacggccacagaagccaat

SEQ ID NO: 292343 - DNA, 20 bp, human
gtgatgtagcaggagccgat

SEQ ID NO: 292344 - DNA, 20 bp, human
gactcaacatccaactcgcg

SEQ ID NO: 292345 - DNA, 20 bp, human
ggcttctgtggccgtccccg

SEQ ID NO: 292346 - DNA, 20 bp, human
gtcacactggaaggagtctt

SEQ ID NO: 292347 - DNA, 20 bp, human
gggtcagcctctgacgaaca

SEQ ID NO: 292348 - DNA, 20 bp, human
gggcgcctcgccaggccaga

SEQ ID NO: 292349 - DNA, 20 bp, human
gcctctgacgaacagggaac

SEQ ID NO: 292350 - DNA, 20 bp, human
ggcaccagcccacgcgaagt

SEQ ID NO: 292351 - DNA, 20 bp, human
gaaggcacccagctcgtatt

SEQ ID NO: 292352 - DNA, 20 bp, human
gcgaggcgcccacttcgcgt

SEQ ID NO: 292353 - DNA, 20 bp, human
gagaaggatttcacactgga

SEQ ID NO: 292354 - DNA, 20 bp, human
gccgctggaaccagctgggt

SEQ ID NO: 292355 - DNA, 20 bp, human
ggggcttcatccagctccac

SEQ ID NO: 292356 - DNA, 20 bp, human
ggggcgggagcggcggaaga

SEQ ID NO: 292357 - DNA, 20 bp, human
ggcggacgcagcggagacca

SEQ ID NO: 292358 - DNA, 20 bp, human
ggccccgggagcgaggtcgc

SEQ ID NO: 292359 - DNA, 20 bp, human
gtggtgaaaatcaagtggga

SEQ ID NO: 292360 - DNA, 20 bp, human
gcgggagcgaggtcgctggg

SEQ ID NO: 292361 - DNA, 20 bp, human
gccagggatagtatagacct

SEQ ID NO: 292362 - DNA, 20 bp, human
gttcttgcaccgcctcctcc

SEQ ID NO: 292363 - DNA, 20 bp, human
ggtgagcaagcacctgaaca

SEQ ID NO: 292364 - DNA, 20 bp, human
gaatgcgcacgcgcggcccc

SEQ ID NO: 292365 - DNA, 20 bp, human
ggtgcaagaatgcgcacgcg

SEQ ID NO: 292366 - DNA, 20 bp, human
ggggctgtgagtccgctctg

SEQ ID NO: 292367 - DNA, 20 bp, human
gaggtgcagcggcgcggggt

SEQ ID NO: 292368 - DNA, 20 bp, human
gactcccgcccaggttgccg

SEQ ID NO: 292369 - DNA, 20 bp, human
gctccccccggcaacctggg

SEQ ID NO: 292370 - DNA, 20 bp, human
ggacgtgcgtgaaaaggcgg

SEQ ID NO: 292371 - DNA, 20 bp, human
gctacagggcgggaagcccg

SEQ ID NO: 292372 - DNA, 20 bp, human
gcgaaggtgccctgccacgg

SEQ ID NO: 292373 - DNA, 20 bp, human
gcgcgagctaacggactcgg

SEQ ID NO: 292374 - DNA, 20 bp, human
gctgtgagtccgctctgggg

SEQ ID NO: 292375 - DNA, 20 bp, human
gaatccgagagaaaggggcg

SEQ ID NO: 292376 - DNA, 20 bp, human
ggcggccgcggcgtcttaag

SEQ ID NO: 292377 - DNA, 20 bp, human
ggtggtggcggcagcgtcgt

SEQ ID NO: 292378 - DNA, 20 bp, human
ggccgggcccgtcacgtgaa

SEQ ID NO: 292379 - DNA, 20 bp, human
ggtgacgggcccggctgtag

SEQ ID NO: 292380 - DNA, 20 bp, human
gcccgcgccgttcacgtgac

SEQ ID NO: 292381 - DNA, 20 bp, human
gacgggcccggctgtagcgg

SEQ ID NO: 292382 - DNA, 20 bp, human
ggcccgcgggtggtataaaa

SEQ ID NO: 292383 - DNA, 20 bp, human
gtgggcagggggcaccgcta

SEQ ID NO: 292384 - DNA, 20 bp, human
gcggggcttcggcgcgtcgg

SEQ ID NO: 292385 - DNA, 20 bp, human
gcggccccagaggcacgagc

SEQ ID NO: 292386 - DNA, 20 bp, human
gcagaagcgcctgcttccat

SEQ ID NO: 292387 - DNA, 20 bp, human
gggaggcgggactaaggaaa

SEQ ID NO: 292388 - DNA, 20 bp, human
ggaaaagagggcgggtactg

SEQ ID NO: 292389 - DNA, 20 bp, human
gggaaaacttgagacggagg

SEQ ID NO: 292390 - DNA, 20 bp, human
gaatgggaaaggaacttcgg

SEQ ID NO: 292391 - DNA, 20 bp, human
gaggaaacggcagcttgcat

SEQ ID NO: 292392 - DNA, 20 bp, human
gtggcgcagccgccattgga

SEQ ID NO: 292393 - DNA, 20 bp, human
gcgcagccgccattggaggg

SEQ ID NO: 292394 - DNA, 20 bp, human
gaagggaaaacttgagacgg

SEQ ID NO: 292395 - DNA, 20 bp, human
ggagagccgccctccaatgg

SEQ ID NO: 292396 - DNA, 20 bp, human
ggggtcgctaagggccggag

SEQ ID NO: 292397 - DNA, 20 bp, human
gcggaggggaaaaggacctg

SEQ ID NO: 292398 - DNA, 20 bp, human
ggggcggagccaacgttggg

SEQ ID NO: 292399 - DNA, 20 bp, human
ggaggggcggagccaacgtt

SEQ ID NO: 292400 - DNA, 20 bp, human
gcccctctgggggtcgctaa

SEQ ID NO: 292401 - DNA, 20 bp, human
gcgcgggctccgcccaacgt

SEQ ID NO: 292402 - DNA, 20 bp, human
gtcgcacggtagccttgcta

SEQ ID NO: 292403 - DNA, 20 bp, human
ggttggctccgcccctctgg

SEQ ID NO: 292404 - DNA, 20 bp, human
ggatactgcgataggaactg

SEQ ID NO: 292405 - DNA, 20 bp, human
gtgcgaagctctagccacca

SEQ ID NO: 292406 - DNA, 20 bp, human
ggagccgtaaccagacaccg

SEQ ID NO: 292407 - DNA, 20 bp, human
gaagtcgaggggcggagaga

SEQ ID NO: 292408 - DNA, 20 bp, human
ggacggcagccgggtcttgt

SEQ ID NO: 292409 - DNA, 20 bp, human
gaggctccgcccacaagacc

SEQ ID NO: 292410 - DNA, 20 bp, human
gaggaccggaggcggggagt

SEQ ID NO: 292411 - DNA, 20 bp, human
gagggactgtaaaatcagat

SEQ ID NO: 292412 - DNA, 20 bp, human
gggcctgcccgacccgggtt

SEQ ID NO: 292413 - DNA, 20 bp, human
gggtgcgcgaagtcgagggg

SEQ ID NO: 292414 - DNA, 20 bp, human
gtctccctgcggccgctggt

SEQ ID NO: 292415 - DNA, 20 bp, human
gctcgcggggggatgggcga

SEQ ID NO: 292416 - DNA, 20 bp, human
ggggctgccccaccgctcaa

SEQ ID NO: 292417 - DNA, 20 bp, human
ggagccggggtggatctcca

SEQ ID NO: 292418 - DNA, 20 bp, human
ggacccctgcccctcgccag

SEQ ID NO: 292419 - DNA, 20 bp, human
ggcggcggacggcagtcggg

SEQ ID NO: 292420 - DNA, 20 bp, human
gacttcggagacacaccccc

SEQ ID NO: 292421 - DNA, 20 bp, human
gggggtggatctccatggaa

SEQ ID NO: 292422 - DNA, 20 bp, human
ggggtcgcctggaccgaggc

SEQ ID NO: 292423 - DNA, 20 bp, human
gcgagccggcggcgaatggt

SEQ ID NO: 292424 - DNA, 20 bp, human
gaaggtggcgcccctggcga

SEQ ID NO: 292425 - DNA, 20 bp, human
ggggagggggtctcggtcgg

SEQ ID NO: 292426 - DNA, 20 bp, human
gcccctggctgggtctgcgg

SEQ ID NO: 292427 - DNA, 20 bp, human
gaggggctgtgggttccccg

SEQ ID NO: 292428 - DNA, 20 bp, human
gcgggctcgagtggcgacgt

SEQ ID NO: 292429 - DNA, 20 bp, human
gagggggagaagcgcccggc

SEQ ID NO: 292430 - DNA, 20 bp, human
gacgtgggccgcggtcctgg

SEQ ID NO: 292431 - DNA, 20 bp, human
ggggtctgcggaggggctgt

SEQ ID NO: 292432 - DNA, 20 bp, human
ggccgcttcccggcacctgt

SEQ ID NO: 292433 - DNA, 20 bp, human
gtgggagcagctggaactct

SEQ ID NO: 292434 - DNA, 20 bp, human
gacccgcagcggggcgtggg

SEQ ID NO: 292435 - DNA, 20 bp, human
gagcccgcgcccacgcgcgg

SEQ ID NO: 292436 - DNA, 20 bp, human
gagaccctgtgcagcgacac

SEQ ID NO: 292437 - DNA, 20 bp, human
ggggacgctcagtagggtac

SEQ ID NO: 292438 - DNA, 20 bp, human
ggcagcggcggcgtggtctc

SEQ ID NO: 292439 - DNA, 20 bp, human
ggcagcacctgtcccctcgg

SEQ ID NO: 292440 - DNA, 20 bp, human
gcaggcgcacagcgttccgc

SEQ ID NO: 292441 - DNA, 20 bp, human
gtgcgcaggcgcacagtggc

SEQ ID NO: 292442 - DNA, 20 bp, human
gcggggctgtagtcgccgtc

SEQ ID NO: 292443 - DNA, 20 bp, human
gctggaaccagcgcgggaat

SEQ ID NO: 292444 - DNA, 20 bp, human
gagcgcgggaataggtgcgc

SEQ ID NO: 292445 - DNA, 20 bp, human
ggatggggacaagtgtttaa

SEQ ID NO: 292446 - DNA, 20 bp, human
gtggtggcccgcaggctgta

SEQ ID NO: 292447 - DNA, 20 bp, human
gtgcaggcccggagggcatc

SEQ ID NO: 292448 - DNA, 20 bp, human
gtccctggctaaagatagta

SEQ ID NO: 292449 - DNA, 20 bp, human
ggtatggctgcaggcccgga

SEQ ID NO: 292450 - DNA, 20 bp, human
gcctgcagccatacagcctg

SEQ ID NO: 292451 - DNA, 20 bp, human
gtatggctcatgtgatgtgg

SEQ ID NO: 292452 - DNA, 20 bp, human
gatgtgatgtggtggcccgc

SEQ ID NO: 292453 - DNA, 20 bp, human
gtagaagaaatggtaataat

SEQ ID NO: 292454 - DNA, 20 bp, human
gagccatactatctttagcc

SEQ ID NO: 292455 - DNA, 20 bp, human
gggctataaatatctctccc

SEQ ID NO: 292456 - DNA, 20 bp, human
gcgggagggcggcgtggcga

SEQ ID NO: 292457 - DNA, 20 bp, human
ggcgccgccttgtcagtccg

SEQ ID NO: 292458 - DNA, 20 bp, human
gcccgggaacgcgcgcgcaa

SEQ ID NO: 292459 - DNA, 20 bp, human
gcggccccggactgacaagg

SEQ ID NO: 292460 - DNA, 20 bp, human
gggggcagctagagtaaggg

SEQ ID NO: 292461 - DNA, 20 bp, human
ggaaactgcaaaactgccgc

SEQ ID NO: 292462 - DNA, 20 bp, human
gcgcgcgcgcaatggaccgc

SEQ ID NO: 292463 - DNA, 20 bp, human
gggcgggggcagctagagta

SEQ ID NO: 292464 - DNA, 20 bp, human
gggcatccggcagaggaaaa

SEQ ID NO: 292465 - DNA, 20 bp, human
gtcgcggccccggactgaca

SEQ ID NO: 292466 - DNA, 20 bp, human
gaggcttcggaggcgagcga

SEQ ID NO: 292467 - DNA, 20 bp, human
gcaagtaggcgaggcttcgg

SEQ ID NO: 292468 - DNA, 20 bp, human
gtctcggagaaagcagctgg

SEQ ID NO: 292469 - DNA, 20 bp, human
gagtcgggggcgggctggga

SEQ ID NO: 292470 - DNA, 20 bp, human
gcgagcgaagggcgggacca

SEQ ID NO: 292471 - DNA, 20 bp, human
gtgtgagtggcgtaactgtc

SEQ ID NO: 292472 - DNA, 20 bp, human
gtcccggcgtccgtgcgcag

SEQ ID NO: 292473 - DNA, 20 bp, human
gcgtcaagtaggcgaggctt

SEQ ID NO: 292474 - DNA, 20 bp, human
ggaggaggtggctgagtcgg

SEQ ID NO: 292475 - DNA, 20 bp, human
ggggccagtctgcgtagcga

SEQ ID NO: 292476 - DNA, 20 bp, human
gaaactgccttcaggtgatg

SEQ ID NO: 292477 - DNA, 20 bp, human
gtggcagccgtatagagctc

SEQ ID NO: 292478 - DNA, 20 bp, human
gtggcccgcacagtgcaagt

SEQ ID NO: 292479 - DNA, 20 bp, human
gcactgtgccaagacccacc

SEQ ID NO: 292480 - DNA, 20 bp, human
gatatctgtgagtaagcggt

SEQ ID NO: 292481 - DNA, 20 bp, human
ggcccagctgcagaatacag

SEQ ID NO: 292482 - DNA, 20 bp, human
gatcatctcgggtaagttta

SEQ ID NO: 292483 - DNA, 20 bp, human
gagtgatcctgagctctata

SEQ ID NO: 292484 - DNA, 20 bp, human
gtctcgggtaagtttaggga

SEQ ID NO: 292485 - DNA, 20 bp, human
ggagttgcaggaaatttatg

SEQ ID NO: 292486 - DNA, 20 bp, human
gactcccgggccgagaccga

SEQ ID NO: 292487 - DNA, 20 bp, human
ggttgcctttcgcgccccga

SEQ ID NO: 292488 - DNA, 20 bp, human
gtgggagcggtagttctcct

SEQ ID NO: 292489 - DNA, 20 bp, human
ggaagccgctactgcagcgt

SEQ ID NO: 292490 - DNA, 20 bp, human
ggtcgcccacgctgcagtag

SEQ ID NO: 292491 - DNA, 20 bp, human
gataacgggaggcggttctg

SEQ ID NO: 292492 - DNA, 20 bp, human
gcagcgtgggcgacaatgct

SEQ ID NO: 292493 - DNA, 20 bp, human
gcaaagcggattctttccct

SEQ ID NO: 292494 - DNA, 20 bp, human
gctgtgaaggcgagcagacg

SEQ ID NO: 292495 - DNA, 20 bp, human
gcgagggctgctgggactct

SEQ ID NO: 292496 - DNA, 20 bp, human
gtgggagcagtagttctccc

SEQ ID NO: 292497 - DNA, 20 bp, human
gccgcgctggcgatcccgct

SEQ ID NO: 292498 - DNA, 20 bp, human
gatcgccagcgcggcagtgg

SEQ ID NO: 292499 - DNA, 20 bp, human
gagagccccagcaggcctcg

SEQ ID NO: 292500 - DNA, 20 bp, human
gctggggctctcggacggcc

SEQ ID NO: 292501 - DNA, 20 bp, human
gggtgaagagactgttgccc

SEQ ID NO: 292502 - DNA, 20 bp, human
gtgttagagcagtcaactaa

SEQ ID NO: 292503 - DNA, 20 bp, human
gcccctgccagtatttcata

SEQ ID NO: 292504 - DNA, 20 bp, human
ggcgatcccgctaggcgccc

SEQ ID NO: 292505 - DNA, 20 bp, human
gtctcttcaccatcaaatcc

SEQ ID NO: 292506 - DNA, 20 bp, human
gctcccgcgtggtccgggtc

SEQ ID NO: 292507 - DNA, 20 bp, human
ggggagaggtagtcttctgg

SEQ ID NO: 292508 - DNA, 20 bp, human
ggacgcgagcacatgcgtgt

SEQ ID NO: 292509 - DNA, 20 bp, human
gccaagccgggaattcctat

SEQ ID NO: 292510 - DNA, 20 bp, human
gccggaccacgcgggagccg

SEQ ID NO: 292511 - DNA, 20 bp, human
gcgcccgacccggaccacgc

SEQ ID NO: 292512 - DNA, 20 bp, human
gtggctgattcggatggagg

SEQ ID NO: 292513 - DNA, 20 bp, human
gtattggctgattcggatgg

SEQ ID NO: 292514 - DNA, 20 bp, human
gccaatcagcgccaggaatt

SEQ ID NO: 292515 - DNA, 20 bp, human
gccaggaattcggaggctag

SEQ ID NO: 292516 - DNA, 20 bp, human
gccgcggccggcggtcgcga

SEQ ID NO: 292517 - DNA, 20 bp, human
gggaggtgggtgcttctcgg

SEQ ID NO: 292518 - DNA, 20 bp, human
gcggcaggcccgagagtgac

SEQ ID NO: 292519 - DNA, 20 bp, human
ggggcacgggcgcccgatcg

SEQ ID NO: 292520 - DNA, 20 bp, human
gcgtgactccggtcactctc

SEQ ID NO: 292521 - DNA, 20 bp, human
gcccgccccaggcggggcta

SEQ ID NO: 292522 - DNA, 20 bp, human
ggacgggggcgacgcggcga

SEQ ID NO: 292523 - DNA, 20 bp, human
gccgcccctagccccgcctg

SEQ ID NO: 292524 - DNA, 20 bp, human
gggtccgcggcctctcagtg

SEQ ID NO: 292525 - DNA, 20 bp, human
gctagccagcaggccgcgat

SEQ ID NO: 292526 - DNA, 20 bp, human
ggggaagtagagttagcggt

SEQ ID NO: 292527 - DNA, 20 bp, human
gacaggggaagtagagttag

SEQ ID NO: 292528 - DNA, 20 bp, human
ggccgctaggggccgttcgt

SEQ ID NO: 292529 - DNA, 20 bp, human
gggaaggtcgcgagccgcta

SEQ ID NO: 292530 - DNA, 20 bp, human
ggctaggggccgttcgtggg

SEQ ID NO: 292531 - DNA, 20 bp, human
gccgccgccccgcccacgaa

SEQ ID NO: 292532 - DNA, 20 bp, human
ggatggaaaatatgaggggg

SEQ ID NO: 292533 - DNA, 20 bp, human
gtgcacaaaagcaaacccgt

SEQ ID NO: 292534 - DNA, 20 bp, human
gaaaatatgagggggtggtt

SEQ ID NO: 292535 - DNA, 20 bp, human
ggattggcccacccgggcgt

SEQ ID NO: 292536 - DNA, 20 bp, human
gtggaccaagtggtgaaggg

SEQ ID NO: 292537 - DNA, 20 bp, human
gttctggaccaagtggtgaa

SEQ ID NO: 292538 - DNA, 20 bp, human
gcaccacttggtccagaagc

SEQ ID NO: 292539 - DNA, 20 bp, human
gaggcattacgaatgagatt

SEQ ID NO: 292540 - DNA, 20 bp, human
gacccaatggggattcttta

SEQ ID NO: 292541 - DNA, 20 bp, human
gcccctgcttctggaccaag

SEQ ID NO: 292542 - DNA, 20 bp, human
ggaaaaacaagacgctgggt

SEQ ID NO: 292543 - DNA, 20 bp, human
gaaaaggatgtgtgagggac

SEQ ID NO: 292544 - DNA, 20 bp, human
gataacacgtatggaatgct

SEQ ID NO: 292545 - DNA, 20 bp, human
gtccctaaagaatccccatt

SEQ ID NO: 292546 - DNA, 20 bp, human
ggaggtgacgagctcggtgg

SEQ ID NO: 292547 - DNA, 20 bp, human
gggggagggcagaagttgag

SEQ ID NO: 292548 - DNA, 20 bp, human
gccgcgaggaaaacattctt

SEQ ID NO: 292549 - DNA, 20 bp, human
gaccgagctcgtcacctcgt

SEQ ID NO: 292550 - DNA, 20 bp, human
ggtgacgagctcggtggcgg

SEQ ID NO: 292551 - DNA, 20 bp, human
gcccaacgaggtgacgagct

SEQ ID NO: 292552 - DNA, 20 bp, human
gccacagcgggatccagccc

SEQ ID NO: 292553 - DNA, 20 bp, human
gagcgccgcacctggctcga

SEQ ID NO: 292554 - DNA, 20 bp, human
gggcagaagttgaggggcac

SEQ ID NO: 292555 - DNA, 20 bp, human
gaggttctggttagtaagtc

SEQ ID NO: 292556 - DNA, 20 bp, human
gctccggccgggattccgtt

SEQ ID NO: 292557 - DNA, 20 bp, human
gaggaagccggcttccggac

SEQ ID NO: 292558 - DNA, 20 bp, human
gggcttggcagcagcgagag

SEQ ID NO: 292559 - DNA, 20 bp, human
gggtctggtcctctgcgcgg

SEQ ID NO: 292560 - DNA, 20 bp, human
gtccagccgagggaccgccg

SEQ ID NO: 292561 - DNA, 20 bp, human
gagtgcgccgaacggaatcc

SEQ ID NO: 292562 - DNA, 20 bp, human
gggccggagcccggggcgat

SEQ ID NO: 292563 - DNA, 20 bp, human
ggggcaggagggggttaagg

SEQ ID NO: 292564 - DNA, 20 bp, human
gccgaccgcgcgggcaggag

SEQ ID NO: 292565 - DNA, 20 bp, human
gcggtccctcggctggacgc

SEQ ID NO: 292566 - DNA, 20 bp, human
gcggtgggcgggaatcctaa

SEQ ID NO: 292567 - DNA, 20 bp, human
gggcgcgcgtcccgctctcg

SEQ ID NO: 292568 - DNA, 20 bp, human
ggcaagaaatgcaggcccgg

SEQ ID NO: 292569 - DNA, 20 bp, human
gcccgcctccgcgtcccctt

SEQ ID NO: 292570 - DNA, 20 bp, human
gcggcggctgcccccgagag

SEQ ID NO: 292571 - DNA, 20 bp, human
gtgacaccgaggggccttga

SEQ ID NO: 292572 - DNA, 20 bp, human
ggaatcctaaggggacgcgg

SEQ ID NO: 292573 - DNA, 20 bp, human
gctccccgggctgtacctag

SEQ ID NO: 292574 - DNA, 20 bp, human
ggcgccgaggtacaacatga

SEQ ID NO: 292575 - DNA, 20 bp, human
gaatgcccacccagcagagc

SEQ ID NO: 292576 - DNA, 20 bp, human
gggggccagggccgaaccga

SEQ ID NO: 292577 - DNA, 20 bp, human
ggtcgcgaacgccacaccct

SEQ ID NO: 292578 - DNA, 20 bp, human
gggaatcgatcccagatcct

SEQ ID NO: 292579 - DNA, 20 bp, human
gaacgcgctctgggcggggg

SEQ ID NO: 292580 - DNA, 20 bp, human
ggaacgccacaccctcggtt

SEQ ID NO: 292581 - DNA, 20 bp, human
gcagcgcgggagtccccaga

SEQ ID NO: 292582 - DNA, 20 bp, human
gcccgcccagagcgcgttcg

SEQ ID NO: 292583 - DNA, 20 bp, human
gcccagatcctgggagtcgg

SEQ ID NO: 292584 - DNA, 20 bp, human
ggccggaataggggtttcga

SEQ ID NO: 292585 - DNA, 20 bp, human
gggggtgcacagagtcctcg

SEQ ID NO: 292586 - DNA, 20 bp, human
gtccccggagggcgcagctg

SEQ ID NO: 292587 - DNA, 20 bp, human
gaagggtgcagcccagcgga

SEQ ID NO: 292588 - DNA, 20 bp, human
gcggcttccagcgggttccc

SEQ ID NO: 292589 - DNA, 20 bp, human
ggctgccacgagacccggga

SEQ ID NO: 292590 - DNA, 20 bp, human
ggcagctggggcccctagca

SEQ ID NO: 292591 - DNA, 20 bp, human
ggtggcagcgggtgtctccc

SEQ ID NO: 292592 - DNA, 20 bp, human
gcacccgctgccacgagacc

SEQ ID NO: 292593 - DNA, 20 bp, human
ggcagcgggtgtctccccgg

SEQ ID NO: 292594 - DNA, 20 bp, human
ggaaggttgcatctgctgga

SEQ ID NO: 292595 - DNA, 20 bp, human
gagtccactcggcttccagc

SEQ ID NO: 292596 - DNA, 20 bp, human
gtgggcgaggggtgtgatgt

SEQ ID NO: 292597 - DNA, 20 bp, human
gagagcgcgggaaagcttac

SEQ ID NO: 292598 - DNA, 20 bp, human
gtggagggggtgtggtatta

SEQ ID NO: 292599 - DNA, 20 bp, human
gcccgccccaccacacaata

SEQ ID NO: 292600 - DNA, 20 bp, human
ggggtgccggcgcttgtgga

SEQ ID NO: 292601 - DNA, 20 bp, human
gcaggggctgccgcgagcca

SEQ ID NO: 292602 - DNA, 20 bp, human
ggcgggaaagcttactggtg

SEQ ID NO: 292603 - DNA, 20 bp, human
gcacacccctcgcccagcca

SEQ ID NO: 292604 - DNA, 20 bp, human
gtccatggcgccctggctcg

SEQ ID NO: 292605 - DNA, 20 bp, human
gcacagtgctccgtattgtg

SEQ ID NO: 292606 - DNA, 20 bp, human
gacgcaggacaggatcccgg

SEQ ID NO: 292607 - DNA, 20 bp, human
gagaaaggggaccccgggac

SEQ ID NO: 292608 - DNA, 20 bp, human
ggcagaaggacggagagaaa

SEQ ID NO: 292609 - DNA, 20 bp, human
ggccgccccagcccggtgtc

SEQ ID NO: 292610 - DNA, 20 bp, human
ggacgggaaaggcgcagagc

SEQ ID NO: 292611 - DNA, 20 bp, human
gacaccggacaccggacacc

SEQ ID NO: 292612 - DNA, 20 bp, human
gcagggcggctagggcgcga

SEQ ID NO: 292613 - DNA, 20 bp, human
ggacaccggacaccgggctg

SEQ ID NO: 292614 - DNA, 20 bp, human
ggggcactgtgaccccggcg

SEQ ID NO: 292615 - DNA, 20 bp, human
gcggaaacttggagagacgc

SEQ ID NO: 292616 - DNA, 20 bp, human
ggggcagtaggacatccctg

SEQ ID NO: 292617 - DNA, 20 bp, human
ggtaccacccagtaaggtcc

SEQ ID NO: 292618 - DNA, 20 bp, human
ggtctgcactgtggcatctc

SEQ ID NO: 292619 - DNA, 20 bp, human
gttcctggggatgccgtcag

SEQ ID NO: 292620 - DNA, 20 bp, human
gtctgacaaggctaataaca

SEQ ID NO: 292621 - DNA, 20 bp, human
gcaatccagcaccactcagg

SEQ ID NO: 292622 - DNA, 20 bp, human
gcgcggaccggctccgcgaa

SEQ ID NO: 292623 - DNA, 20 bp, human
gcacgtgaatactctgtgac

SEQ ID NO: 292624 - DNA, 20 bp, human
ggatcagtgggcagtgtatg

SEQ ID NO: 292625 - DNA, 20 bp, human
ggatgccgtcagaggagtcc

SEQ ID NO: 292626 - DNA, 20 bp, human
gccagggccccgtggggtgt

SEQ ID NO: 292627 - DNA, 20 bp, human
gcaggaaggtcggagatgtc

SEQ ID NO: 292628 - DNA, 20 bp, human
gggccgctgctcatccagga

SEQ ID NO: 292629 - DNA, 20 bp, human
ggatgagcagcggccagatg

SEQ ID NO: 292630 - DNA, 20 bp, human
gcctagcgcgtgacccaggt

SEQ ID NO: 292631 - DNA, 20 bp, human
ggctgctcatccaggaaggt

SEQ ID NO: 292632 - DNA, 20 bp, human
gtactctggaggggccgctt

SEQ ID NO: 292633 - DNA, 20 bp, human
ggctcctgggccgacaggga

SEQ ID NO: 292634 - DNA, 20 bp, human
ggcgcgtgacccaggtggga

SEQ ID NO: 292635 - DNA, 20 bp, human
ggccagcagtgtgccgggat

SEQ ID NO: 292636 - DNA, 20 bp, human
gggcccgccgccgcaccgat

SEQ ID NO: 292637 - DNA, 20 bp, human
gaaagcgcagccctcgactt

SEQ ID NO: 292638 - DNA, 20 bp, human
gcaatcagagcccaagtcga

SEQ ID NO: 292639 - DNA, 20 bp, human
gcggacatgcaaatcaggat

SEQ ID NO: 292640 - DNA, 20 bp, human
gtcacattaccattggttga

SEQ ID NO: 292641 - DNA, 20 bp, human
gtggccccgggcgtcccacg

SEQ ID NO: 292642 - DNA, 20 bp, human
ggagcgccagccaatcggtg

SEQ ID NO: 292643 - DNA, 20 bp, human
gcgccagccaatcggtgcgg

SEQ ID NO: 292644 - DNA, 20 bp, human
ggtcgtcggacatgcaaatc

SEQ ID NO: 292645 - DNA, 20 bp, human
gcagccaatcggtgcggcgg

SEQ ID NO: 292646 - DNA, 20 bp, human
gaaccgctgcgggacccgct

SEQ ID NO: 292647 - DNA, 20 bp, human
gagcccagcgggtcccgcag

SEQ ID NO: 292648 - DNA, 20 bp, human
gcggggcttatgcagatgag

SEQ ID NO: 292649 - DNA, 20 bp, human
gtgcagatgagcggcaggtt

SEQ ID NO: 292650 - DNA, 20 bp, human
gcataagccccgcctgctga

SEQ ID NO: 292651 - DNA, 20 bp, human
gtcccagcgtactttcggca

SEQ ID NO: 292652 - DNA, 20 bp, human
ggctgggctcccagccgcgt

SEQ ID NO: 292653 - DNA, 20 bp, human
ggctgggcccgctgccgacg

SEQ ID NO: 292654 - DNA, 20 bp, human
ggatgaggtaaaggtctcgg

SEQ ID NO: 292655 - DNA, 20 bp, human
gtctcggaggataaggaccc

SEQ ID NO: 292656 - DNA, 20 bp, human
gcgtctccttggcccgatcc

SEQ ID NO: 292657 - DNA, 20 bp, human
gatcgcgaggccagctgtgc

SEQ ID NO: 292658 - DNA, 20 bp, human
gcgggccaaggagacgcgcg

SEQ ID NO: 292659 - DNA, 20 bp, human
gctcgcttccgacccgcagg

SEQ ID NO: 292660 - DNA, 20 bp, human
gtgcgggtcggaagcgagcg

SEQ ID NO: 292661 - DNA, 20 bp, human
gttgacgggacgaaggaagg

SEQ ID NO: 292662 - DNA, 20 bp, human
gttcaacacacgttgttgac

SEQ ID NO: 292663 - DNA, 20 bp, human
gaggtggcgccgtcctgcct

SEQ ID NO: 292664 - DNA, 20 bp, human
gcggtgcagggcacggtgac

SEQ ID NO: 292665 - DNA, 20 bp, human
ggaaggaaggcgggatcgcg

SEQ ID NO: 292666 - DNA, 20 bp, human
gtagtccagtgcagccgggt

SEQ ID NO: 292667 - DNA, 20 bp, human
ggctgcagagcgaagcaggt

SEQ ID NO: 292668 - DNA, 20 bp, human
gtagagggacgcagcccccg

SEQ ID NO: 292669 - DNA, 20 bp, human
gggcaccgcccacacctcgg

SEQ ID NO: 292670 - DNA, 20 bp, human
ggaactggggcgaagacaga

SEQ ID NO: 292671 - DNA, 20 bp, human
ggtccccggcggtgcgctgc

SEQ ID NO: 292672 - DNA, 20 bp, human
gccgccgcgacgcgctccgg

SEQ ID NO: 292673 - DNA, 20 bp, human
gagctcccacccggctgcac

SEQ ID NO: 292674 - DNA, 20 bp, human
gccctctagtccagtgcagc

SEQ ID NO: 292675 - DNA, 20 bp, human
gcccgcgctccgcgcacccg

SEQ ID NO: 292676 - DNA, 20 bp, human
gaacgccactccaggggcgg

SEQ ID NO: 292677 - DNA, 20 bp, human
gcccccagcgccgaggttga

SEQ ID NO: 292678 - DNA, 20 bp, human
gccagcgccgaggttgaggg

SEQ ID NO: 292679 - DNA, 20 bp, human
gctcggggaacgccactcca

SEQ ID NO: 292680 - DNA, 20 bp, human
gagggaggccgggctcggtg

SEQ ID NO: 292681 - DNA, 20 bp, human
gggaggggggcgcggaatca

SEQ ID NO: 292682 - DNA, 20 bp, human
gcggctcctgctgctcccgg

SEQ ID NO: 292683 - DNA, 20 bp, human
gttccccgagggcggaccgt

SEQ ID NO: 292684 - DNA, 20 bp, human
gcagccgcactcgcccccgg

SEQ ID NO: 292685 - DNA, 20 bp, human
ggggaacgccactccagggg

SEQ ID NO: 292686 - DNA, 20 bp, human
ggggccgcgccatgcctaag

SEQ ID NO: 292687 - DNA, 20 bp, human
ggcggcccagcgacacccat

SEQ ID NO: 292688 - DNA, 20 bp, human
gggggcgccgcgatgggcca

SEQ ID NO: 292689 - DNA, 20 bp, human
gaatgtgcgcgggatcccag

SEQ ID NO: 292690 - DNA, 20 bp, human
gcctaagggggcgccgcgat

SEQ ID NO: 292691 - DNA, 20 bp, human
gagcgcatcgtgatcaacgt

SEQ ID NO: 292692 - DNA, 20 bp, human
gggagttggcgccggggagg

SEQ ID NO: 292693 - DNA, 20 bp, human
gcgctcccatgggtgtcgct

SEQ ID NO: 292694 - DNA, 20 bp, human
gaggcttggctcgctcgttg

SEQ ID NO: 292695 - DNA, 20 bp, human
gcgcggcgcccccttaggca

SEQ ID NO: 292696 - DNA, 20 bp, human
ggtggggcatagcgaggggt

SEQ ID NO: 292697 - DNA, 20 bp, human
gcaggcagaagctccagaga

SEQ ID NO: 292698 - DNA, 20 bp, human
gcaggaaagagtgggtgggt

SEQ ID NO: 292699 - DNA, 20 bp, human
ggaggggtggggcatagcga

SEQ ID NO: 292700 - DNA, 20 bp, human
gggctcaggaaagagtgggt

SEQ ID NO: 292701 - DNA, 20 bp, human
gacagggctcaggaaagagt

SEQ ID NO: 292702 - DNA, 20 bp, human
gggagagtggggtgtaaata

SEQ ID NO: 292703 - DNA, 20 bp, human
gcggcactgcccgacccctc

SEQ ID NO: 292704 - DNA, 20 bp, human
gtgcccgctcccggaggggt

SEQ ID NO: 292705 - DNA, 20 bp, human
gccagcagtggctgatttgg

SEQ ID NO: 292706 - DNA, 20 bp, human
ggacccagctggacgagtcg

SEQ ID NO: 292707 - DNA, 20 bp, human
gggagaggaaccaaactgat

SEQ ID NO: 292708 - DNA, 20 bp, human
ggtagcgggggcgtggctta

SEQ ID NO: 292709 - DNA, 20 bp, human
gcggggcggggcgtcaaggg

SEQ ID NO: 292710 - DNA, 20 bp, human
ggaaccaaactgattggcct

SEQ ID NO: 292711 - DNA, 20 bp, human
gcactctaacgcgacccagc

SEQ ID NO: 292712 - DNA, 20 bp, human
ggagagaggccgtcctgatt

SEQ ID NO: 292713 - DNA, 20 bp, human
ggagaccgacgggattgggt

SEQ ID NO: 292714 - DNA, 20 bp, human
gggccccgactcgtccagct

SEQ ID NO: 292715 - DNA, 20 bp, human
gacgcaggggcggggacacg

SEQ ID NO: 292716 - DNA, 20 bp, human
gagtacaaggcccatcacaa

SEQ ID NO: 292717 - DNA, 20 bp, human
ggggtgcgccgtggagaaaa

SEQ ID NO: 292718 - DNA, 20 bp, human
gcacggagttgaggaagaga

SEQ ID NO: 292719 - DNA, 20 bp, human
gcgaaaggcagcgtaggcga

SEQ ID NO: 292720 - DNA, 20 bp, human
gctacgctgcctttcgtcaa

SEQ ID NO: 292721 - DNA, 20 bp, human
ggccaggagcctttgacgaa

SEQ ID NO: 292722 - DNA, 20 bp, human
gccacggcgcacccttgtga

SEQ ID NO: 292723 - DNA, 20 bp, human
gggaaggcgcgagaccgcgc

SEQ ID NO: 292724 - DNA, 20 bp, human
gcgcgcaggcgcagtaccgc

SEQ ID NO: 292725 - DNA, 20 bp, human
gcgccctcgcggagcggacc

SEQ ID NO: 292726 - DNA, 20 bp, human
gcgagcgcagtcttcctccc

SEQ ID NO: 292727 - DNA, 20 bp, human
ggaggtgacgcgcttggttg

SEQ ID NO: 292728 - DNA, 20 bp, human
ggggcgggaggggttgccgg

SEQ ID NO: 292729 - DNA, 20 bp, human
ggacgcgcttggttggggct

SEQ ID NO: 292730 - DNA, 20 bp, human
gagactgcgctcggtcgcca

SEQ ID NO: 292731 - DNA, 20 bp, human
gggcctgcagtgagtcggat

SEQ ID NO: 292732 - DNA, 20 bp, human
gggccgatccgactcactgc

SEQ ID NO: 292733 - DNA, 20 bp, human
gcgggcggaggttagaggtc

SEQ ID NO: 292734 - DNA, 20 bp, human
gggtgtcagcgggctgcggt

SEQ ID NO: 292735 - DNA, 20 bp, human
gcccagacgcgcccttcgcg

SEQ ID NO: 292736 - DNA, 20 bp, human
ggaggcccaaccagctttgt

SEQ ID NO: 292737 - DNA, 20 bp, human
gactccgcctcctacaaagc

SEQ ID NO: 292738 - DNA, 20 bp, human
gcccttgaggggcgcagcat

SEQ ID NO: 292739 - DNA, 20 bp, human
ggcccaaccagctttgtagg

SEQ ID NO: 292740 - DNA, 20 bp, human
ggagtcgggggtaattgctg

SEQ ID NO: 292741 - DNA, 20 bp, human
ggggcctcagtcgcgtcatc

SEQ ID NO: 292742 - DNA, 20 bp, human
gcaggcaggccccactccga

SEQ ID NO: 292743 - DNA, 20 bp, human
gtctcccggcaagctcagag

SEQ ID NO: 292744 - DNA, 20 bp, human
gcccctaggacagccagaga

SEQ ID NO: 292745 - DNA, 20 bp, human
gtccctgtggcactccgctc

SEQ ID NO: 292746 - DNA, 20 bp, human
gtcaccgagggagagcatcc

SEQ ID NO: 292747 - DNA, 20 bp, human
gttcacgtgctgggctgcgg

SEQ ID NO: 292748 - DNA, 20 bp, human
gcgagcctcggatgaacaaa

SEQ ID NO: 292749 - DNA, 20 bp, human
gcccacgctcgccttgaacc

SEQ ID NO: 292750 - DNA, 20 bp, human
gggcgagcgtgggaaaatgg

SEQ ID NO: 292751 - DNA, 20 bp, human
gcggcgcaaaatgtcaccga

SEQ ID NO: 292752 - DNA, 20 bp, human
gccgagggagagcatccagg

SEQ ID NO: 292753 - DNA, 20 bp, human
gccgccacgcaggttaggaa

SEQ ID NO: 292754 - DNA, 20 bp, human
gaagggaagcttcacgtgct

SEQ ID NO: 292755 - DNA, 20 bp, human
ggtgctgggctgcggtggtt

SEQ ID NO: 292756 - DNA, 20 bp, human
ggggcccgcggggatcggag

SEQ ID NO: 292757 - DNA, 20 bp, human
gcgaaccgaccgagcgaggg

SEQ ID NO: 292758 - DNA, 20 bp, human
ggctccgctcgcgggctcgc

SEQ ID NO: 292759 - DNA, 20 bp, human
gcacctccccccctcgggaa

SEQ ID NO: 292760 - DNA, 20 bp, human
ggggaggagaggagagtccg

SEQ ID NO: 292761 - DNA, 20 bp, human
ggcacccgccgagggaagac

SEQ ID NO: 292762 - DNA, 20 bp, human
gaggacccggagtctcgccg

SEQ ID NO: 292763 - DNA, 20 bp, human
gaggcagcccgtggccggcc

SEQ ID NO: 292764 - DNA, 20 bp, human
ggcagcgagcgagactgcgc

SEQ ID NO: 292765 - DNA, 20 bp, human
ggggatcggaggggagccga

SEQ ID NO: 292766 - DNA, 20 bp, human
ggtcgggtcatcttgttctc

SEQ ID NO: 292767 - DNA, 20 bp, human
gcagctcatgtggcatgacc

SEQ ID NO: 292768 - DNA, 20 bp, human
gtcatgtggcatgaccaggc

SEQ ID NO: 292769 - DNA, 20 bp, human
gggcatggagagtgattttc

SEQ ID NO: 292770 - DNA, 20 bp, human
gtcttggtatccatggggtt

SEQ ID NO: 292771 - DNA, 20 bp, human
ggtgtggcaacactggttta

SEQ ID NO: 292772 - DNA, 20 bp, human
gaaaacgtcagagtactttc

SEQ ID NO: 292773 - DNA, 20 bp, human
gcagtaatttctaatattca

SEQ ID NO: 292774 - DNA, 20 bp, human
gcatatcagccaatcataga

SEQ ID NO: 292775 - DNA, 20 bp, human
gttaaatcaccatctatgat

SEQ ID NO: 292776 - DNA, 20 bp, human
gggcgaggctgggagacggg

SEQ ID NO: 292777 - DNA, 20 bp, human
gtggctgtctcgctgctcca

SEQ ID NO: 292778 - DNA, 20 bp, human
gttggggcgctcaagggaga

SEQ ID NO: 292779 - DNA, 20 bp, human
gaataaggaggccccgccgt

SEQ ID NO: 292780 - DNA, 20 bp, human
ggggcgggagtgagggaata

SEQ ID NO: 292781 - DNA, 20 bp, human
ggaaaggggacagctggtgg

SEQ ID NO: 292782 - DNA, 20 bp, human
gtcccctcgcccagggggaa

SEQ ID NO: 292783 - DNA, 20 bp, human
ggtgcagctcgagcaacagg

SEQ ID NO: 292784 - DNA, 20 bp, human
gggcgagcgcgcagtggctg

SEQ ID NO: 292785 - DNA, 20 bp, human
ggaactgcagcgagagccag

SEQ ID NO: 292786 - DNA, 20 bp, human
gcagcccttcccacgtattc

SEQ ID NO: 292787 - DNA, 20 bp, human
gtgatggggtgtgtgcctca

SEQ ID NO: 292788 - DNA, 20 bp, human
gcccccaagcctaccctaag

SEQ ID NO: 292789 - DNA, 20 bp, human
ggtgtgtgcctcagggactc

SEQ ID NO: 292790 - DNA, 20 bp, human
gctgccagaatacgtgggaa

SEQ ID NO: 292791 - DNA, 20 bp, human
gctaagaggaagacttcttc

SEQ ID NO: 292792 - DNA, 20 bp, human
gtggcagttggaattcacct

SEQ ID NO: 292793 - DNA, 20 bp, human
ggtggcacaagttcctgctc

SEQ ID NO: 292794 - DNA, 20 bp, human
gtgtgggttcataaaagcat

SEQ ID NO: 292795 - DNA, 20 bp, human
gactctggctttgggcagag

SEQ ID NO: 292796 - DNA, 20 bp, human
gactgtaagtctggaggtag

SEQ ID NO: 292797 - DNA, 20 bp, human
gggtaggggacagcaatcag

SEQ ID NO: 292798 - DNA, 20 bp, human
ggaagacactgtaagtctgg

SEQ ID NO: 292799 - DNA, 20 bp, human
gagtgaagacactgtaagtc

SEQ ID NO: 292800 - DNA, 20 bp, human
gttcctgcagcagctgggtc

SEQ ID NO: 292801 - DNA, 20 bp, human
gttcctttaactgcaaccct

SEQ ID NO: 292802 - DNA, 20 bp, human
gctaaggtaacccttaggaa

SEQ ID NO: 292803 - DNA, 20 bp, human
gtttaactgcaaccctaggc

SEQ ID NO: 292804 - DNA, 20 bp, human
gtccccttcctgcagcagct

SEQ ID NO: 292805 - DNA, 20 bp, human
gaggactgttgcataatcct

SEQ ID NO: 292806 - DNA, 20 bp, human
gggtcggagcccacagccgg

SEQ ID NO: 292807 - DNA, 20 bp, human
gggccagcccggggagaagt

SEQ ID NO: 292808 - DNA, 20 bp, human
gccaggaagcaggcgctgca

SEQ ID NO: 292809 - DNA, 20 bp, human
gcctcagcaagcccagcatg

SEQ ID NO: 292810 - DNA, 20 bp, human
gcttggcctcccccggctgt

SEQ ID NO: 292811 - DNA, 20 bp, human
ggaggccgatctccaggagt

SEQ ID NO: 292812 - DNA, 20 bp, human
gcacccacttctccccgggc

SEQ ID NO: 292813 - DNA, 20 bp, human
gaaaaccgactcctggagat

SEQ ID NO: 292814 - DNA, 20 bp, human
gtggagatcggcctcatgct

SEQ ID NO: 292815 - DNA, 20 bp, human
gcagcggagcgagaggcttt

SEQ ID NO: 292816 - DNA, 20 bp, human
gttacaacagagattgatcg

SEQ ID NO: 292817 - DNA, 20 bp, human
gctacctgaaaaccctggcc

SEQ ID NO: 292818 - DNA, 20 bp, human
ggcacccggccagggttttc

SEQ ID NO: 292819 - DNA, 20 bp, human
gttcacagctgcaaagttca

SEQ ID NO: 292820 - DNA, 20 bp, human
gaaaacctgtagcccaataa

SEQ ID NO: 292821 - DNA, 20 bp, human
gagcgcggactttggggtaa

SEQ ID NO: 292822 - DNA, 20 bp, human
gggtgacgatgagtgaaaag

SEQ ID NO: 292823 - DNA, 20 bp, human
gtcagtgagcgcggactttg

SEQ ID NO: 292824 - DNA, 20 bp, human
gcaccgctacctgaaaaccc

SEQ ID NO: 292825 - DNA, 20 bp, human
gctggggaataaccattatt

SEQ ID NO: 292826 - DNA, 20 bp, human
ggggcgcagcgggtcaccga

SEQ ID NO: 292827 - DNA, 20 bp, human
gtcaccgaggggttgcgacc

SEQ ID NO: 292828 - DNA, 20 bp, human
ggctgtgcccgtctgcccaa

SEQ ID NO: 292829 - DNA, 20 bp, human
ggacccgctgcgcccgagga

SEQ ID NO: 292830 - DNA, 20 bp, human
gaggggacggattaaccctt

SEQ ID NO: 292831 - DNA, 20 bp, human
gggcacgcgcggcagctgca

SEQ ID NO: 292832 - DNA, 20 bp, human
gcggcggtgcgcggtggtgg

SEQ ID NO: 292833 - DNA, 20 bp, human
gggcccctcctcgggcgcag

SEQ ID NO: 292834 - DNA, 20 bp, human
gcgggtctaaggccggagga

SEQ ID NO: 292835 - DNA, 20 bp, human
gaaaagccggcgcgggtcta

SEQ ID NO: 292836 - DNA, 20 bp, human
gcccccggatccaaggtgcg

SEQ ID NO: 292837 - DNA, 20 bp, human
gaaggtgcggggtcccgatt

SEQ ID NO: 292838 - DNA, 20 bp, human
ggcagcggcgccaccgtcac

SEQ ID NO: 292839 - DNA, 20 bp, human
gccaccgtcacggggcgtcc

SEQ ID NO: 292840 - DNA, 20 bp, human
gaccccgcaccttggatccg

SEQ ID NO: 292841 - DNA, 20 bp, human
ggcgcctggacgccccgtga

SEQ ID NO: 292842 - DNA, 20 bp, human
gcggacgcgggctcaggaac

SEQ ID NO: 292843 - DNA, 20 bp, human
gaggccaggcgctgcgcttt

SEQ ID NO: 292844 - DNA, 20 bp, human
gagggaggggactgagcgcg

SEQ ID NO: 292845 - DNA, 20 bp, human
ggccagggcccccggatcca

SEQ ID NO: 292846 - DNA, 20 bp, human
ggaccgcgttagggtcgcga

SEQ ID NO: 292847 - DNA, 20 bp, human
gtccgcccgcggggatccag

SEQ ID NO: 292848 - DNA, 20 bp, human
gcggaccaggtgcagaggtc

SEQ ID NO: 292849 - DNA, 20 bp, human
gcagggccggaccggaccga

SEQ ID NO: 292850 - DNA, 20 bp, human
gtctccgagctcacctccga

SEQ ID NO: 292851 - DNA, 20 bp, human
gggagcccctcggtccggtc

SEQ ID NO: 292852 - DNA, 20 bp, human
gagccctcgcgaccctaacg

SEQ ID NO: 292853 - DNA, 20 bp, human
gaggacgccgtgatgtctgg

SEQ ID NO: 292854 - DNA, 20 bp, human
gcctgcccggctcctgcaaa

SEQ ID NO: 292855 - DNA, 20 bp, human
ggtcgggcctgcggaggagt

SEQ ID NO: 292856 - DNA, 20 bp, human
ggcggggagcccgaggtcca

SEQ ID NO: 292857 - DNA, 20 bp, human
gaatcccagcccgagcaagc

SEQ ID NO: 292858 - DNA, 20 bp, human
ggcacctccccggcttgctc

SEQ ID NO: 292859 - DNA, 20 bp, human
gggcgcgggcgggaagcgga

SEQ ID NO: 292860 - DNA, 20 bp, human
gtgctcgggctgggattccc

SEQ ID NO: 292861 - DNA, 20 bp, human
gggaggacggcgtcacgagg

SEQ ID NO: 292862 - DNA, 20 bp, human
gcctccccgccactacgggc

SEQ ID NO: 292863 - DNA, 20 bp, human
gggacccctccccgccacta

SEQ ID NO: 292864 - DNA, 20 bp, human
gcatcccgatggcccagggc

SEQ ID NO: 292865 - DNA, 20 bp, human
gtgggccatcgggatgaatt

SEQ ID NO: 292866 - DNA, 20 bp, human
gtggaggagcacaactcggg

SEQ ID NO: 292867 - DNA, 20 bp, human
ggaggagcagagggcaactt

SEQ ID NO: 292868 - DNA, 20 bp, human
gactctgccaaccgcctagg

SEQ ID NO: 292869 - DNA, 20 bp, human
gccaaccgcctaggaggcaa

SEQ ID NO: 292870 - DNA, 20 bp, human
gcccacggggacagccagtg

SEQ ID NO: 292871 - DNA, 20 bp, human
ggcatggaggagcacaactc

SEQ ID NO: 292872 - DNA, 20 bp, human
gcataccccgagagactctg

SEQ ID NO: 292873 - DNA, 20 bp, human
ggctccccttgcctcctagg

SEQ ID NO: 292874 - DNA, 20 bp, human
gcctccctcctctggcatgg

SEQ ID NO: 292875 - DNA, 20 bp, human
ggccactctgccaaccgcct

SEQ ID NO: 292876 - DNA, 20 bp, human
gggcctgcgggagaccaagc

SEQ ID NO: 292877 - DNA, 20 bp, human
ggtggggcacgagcccggta

SEQ ID NO: 292878 - DNA, 20 bp, human
gccgtcccagccttggtcca

SEQ ID NO: 292879 - DNA, 20 bp, human
ggccggcggcgccccctacc

SEQ ID NO: 292880 - DNA, 20 bp, human
gggcgggcggccgtggacca

SEQ ID NO: 292881 - DNA, 20 bp, human
gtcccgcagaggcagggaag

SEQ ID NO: 292882 - DNA, 20 bp, human
gcgggctcgtgccccaccgc

SEQ ID NO: 292883 - DNA, 20 bp, human
gtctcccgcaggccggcggt

SEQ ID NO: 292884 - DNA, 20 bp, human
gctgcgggagaccaagctgg

SEQ ID NO: 292885 - DNA, 20 bp, human
ggctagcggcagccgcctcc

SEQ ID NO: 292886 - DNA, 20 bp, human
gactcgcgcgcccagaagag

SEQ ID NO: 292887 - DNA, 20 bp, human
ggggctccttggcagagcga

SEQ ID NO: 292888 - DNA, 20 bp, human
gagcgaggggctggcgttgg

SEQ ID NO: 292889 - DNA, 20 bp, human
ggcgcgcccgaccttcccat

SEQ ID NO: 292890 - DNA, 20 bp, human
gaaggtcgggcgcgcgcggt

SEQ ID NO: 292891 - DNA, 20 bp, human
gggaagggacccttaggcag

SEQ ID NO: 292892 - DNA, 20 bp, human
gaagacgagcccggagtcaa

SEQ ID NO: 292893 - DNA, 20 bp, human
gtctgggcgcgcgagtccca

SEQ ID NO: 292894 - DNA, 20 bp, human
gttaggcaggggaaaccgtg

SEQ ID NO: 292895 - DNA, 20 bp, human
ggccatggccggcttgtagg

SEQ ID NO: 292896 - DNA, 20 bp, human
gcggctgggcgggggtgtca

SEQ ID NO: 292897 - DNA, 20 bp, human
ggagcctagtgtggcggggt

SEQ ID NO: 292898 - DNA, 20 bp, human
gaggcccggctgctggcgga

SEQ ID NO: 292899 - DNA, 20 bp, human
gtgcgcctgtatgtgtcggc

SEQ ID NO: 292900 - DNA, 20 bp, human
gtggagagactgctagtgac

SEQ ID NO: 292901 - DNA, 20 bp, human
ggagactgctagtgactggc

SEQ ID NO: 292902 - DNA, 20 bp, human
gcacgcctgccgacacatac

SEQ ID NO: 292903 - DNA, 20 bp, human
gcatgtgcgcctgtatgtgt

SEQ ID NO: 292904 - DNA, 20 bp, human
ggcctgtcaccgcagattaa

SEQ ID NO: 292905 - DNA, 20 bp, human
ggccgctggctgggcaccgg

SEQ ID NO: 292906 - DNA, 20 bp, human
gcccccgccgaggtcccgaa

SEQ ID NO: 292907 - DNA, 20 bp, human
gggcccgcggggtgggatca

SEQ ID NO: 292908 - DNA, 20 bp, human
gcctcccttcgggacctcgg

SEQ ID NO: 292909 - DNA, 20 bp, human
ggggacaggcctcccgcgga

SEQ ID NO: 292910 - DNA, 20 bp, human
gccagggccgcctccttaaa

SEQ ID NO: 292911 - DNA, 20 bp, human
gtaaggaggcggccctggct

SEQ ID NO: 292912 - DNA, 20 bp, human
gtaaagggacaggcctcccg

SEQ ID NO: 292913 - DNA, 20 bp, human
gaagggaggggagccctccg

SEQ ID NO: 292914 - DNA, 20 bp, human
gccggggtaaccatggagac

SEQ ID NO: 292915 - DNA, 20 bp, human
gtgggtgtgccccgtctcca

SEQ ID NO: 292916 - DNA, 20 bp, human
gcggcccacgcgtgtctctc

SEQ ID NO: 292917 - DNA, 20 bp, human
gccgcgcgggaaaacccgcg

SEQ ID NO: 292918 - DNA, 20 bp, human
gcccgcgcggcgtccacgct

SEQ ID NO: 292919 - DNA, 20 bp, human
gaggggaggcctgaaatgat

SEQ ID NO: 292920 - DNA, 20 bp, human
gcggggcacgcccaccggga

SEQ ID NO: 292921 - DNA, 20 bp, human
gccttgtggctccacctcgc

SEQ ID NO: 292922 - DNA, 20 bp, human
ggcagccagggaaccacgtg

SEQ ID NO: 292923 - DNA, 20 bp, human
ggccagggaaccacgtgtgg

SEQ ID NO: 292924 - DNA, 20 bp, human
gctccccgagagacacgcgt

SEQ ID NO: 292925 - DNA, 20 bp, human
gctggccacgcctccacacg

SEQ ID NO: 292926 - DNA, 20 bp, human
gccctcgcgcagcgagctcc

SEQ ID NO: 292927 - DNA, 20 bp, human
gagacgaaggcgcggggaag

SEQ ID NO: 292928 - DNA, 20 bp, human
ggggaactgcaggctccgcg

SEQ ID NO: 292929 - DNA, 20 bp, human
gagctcgctgcgcgaggggg

SEQ ID NO: 292930 - DNA, 20 bp, human
ggctgctgaggctgctaccg

SEQ ID NO: 292931 - DNA, 20 bp, human
gaccgcggcggccggcgcct

SEQ ID NO: 292932 - DNA, 20 bp, human
gccctgctggggagcgcaag

SEQ ID NO: 292933 - DNA, 20 bp, human
ggggggtggacgaggagacc

SEQ ID NO: 292934 - DNA, 20 bp, human
gcccgctgtcgctgtcccgc

SEQ ID NO: 292935 - DNA, 20 bp, human
gcccgcttgcgctccccagc

SEQ ID NO: 292936 - DNA, 20 bp, human
ggcgcgggccagggaggcga

SEQ ID NO: 292937 - DNA, 20 bp, human
gccgggccggcgcagaggag

SEQ ID NO: 292938 - DNA, 20 bp, human
ggaaagaagccgcgcgccgg

SEQ ID NO: 292939 - DNA, 20 bp, human
gcggggccttgcatcctacg

SEQ ID NO: 292940 - DNA, 20 bp, human
ggaacacctgccctattcca

SEQ ID NO: 292941 - DNA, 20 bp, human
ggcggcttctttcagcacca

SEQ ID NO: 292942 - DNA, 20 bp, human
ggccttgcatcctacggggc

SEQ ID NO: 292943 - DNA, 20 bp, human
gcaaggcgtggacagctccc

SEQ ID NO: 292944 - DNA, 20 bp, human
gccccgccccgtaggatgca

SEQ ID NO: 292945 - DNA, 20 bp, human
gtactgggagggaatcggag

SEQ ID NO: 292946 - DNA, 20 bp, human
gaggttaagcccatttgcac

SEQ ID NO: 292947 - DNA, 20 bp, human
gtgcccagagcagtaaggaa

SEQ ID NO: 292948 - DNA, 20 bp, human
gagcagtaaggaatggctga

SEQ ID NO: 292949 - DNA, 20 bp, human
ggaaagagggagggagctgt

SEQ ID NO: 292950 - DNA, 20 bp, human
ggcaaatgggcttaacctgg

SEQ ID NO: 292951 - DNA, 20 bp, human
ggcggttgcccagagcagta

SEQ ID NO: 292952 - DNA, 20 bp, human
gtgggaaattggcgctgttt

SEQ ID NO: 292953 - DNA, 20 bp, human
gacaaacagctactctggga

SEQ ID NO: 292954 - DNA, 20 bp, human
gtgagtaatccgagctgtgg

SEQ ID NO: 292955 - DNA, 20 bp, human
gtctacggccaccggccaca

SEQ ID NO: 292956 - DNA, 20 bp, human
ggccctgaccgacgtctctg

SEQ ID NO: 292957 - DNA, 20 bp, human
gaccccagagacgtcggtca

SEQ ID NO: 292958 - DNA, 20 bp, human
ggctcccttggacaccactg

SEQ ID NO: 292959 - DNA, 20 bp, human
gtgccctgcccctgtcgcgt

SEQ ID NO: 292960 - DNA, 20 bp, human
gtccgggcgggcgacgtggg

SEQ ID NO: 292961 - DNA, 20 bp, human
gtgagcctcccggtctccac

SEQ ID NO: 292962 - DNA, 20 bp, human
gttgcccgcggagggacggt

SEQ ID NO: 292963 - DNA, 20 bp, human
gacaggtcggggcaggtatc

SEQ ID NO: 292964 - DNA, 20 bp, human
gcccgggagtgggacggaga

SEQ ID NO: 292965 - DNA, 20 bp, human
gggaggagacaggtcggggc

SEQ ID NO: 292966 - DNA, 20 bp, human
gggggctcccgcacataccc

SEQ ID NO: 292967 - DNA, 20 bp, human
gcgggcgggcaactacggag

SEQ ID NO: 292968 - DNA, 20 bp, human
gtgaacctcacccatcagcc

SEQ ID NO: 292969 - DNA, 20 bp, human
gctcggggcgagagtcggag

SEQ ID NO: 292970 - DNA, 20 bp, human
gacccagcccgagcgcaggg

SEQ ID NO: 292971 - DNA, 20 bp, human
gcctgcgcaccctcatctgc

SEQ ID NO: 292972 - DNA, 20 bp, human
gcgctcgggctgggtctcgg

SEQ ID NO: 292973 - DNA, 20 bp, human
gcatctgccggggtatgtgc

SEQ ID NO: 292974 - DNA, 20 bp, human
ggcgcaggggtgagggcgca

SEQ ID NO: 292975 - DNA, 20 bp, human
gaccctaagagacagacccg

SEQ ID NO: 292976 - DNA, 20 bp, human
ggaactgcaaagtgcgggga

SEQ ID NO: 292977 - DNA, 20 bp, human
gtgcctcccccgggctgcaa

SEQ ID NO: 292978 - DNA, 20 bp, human
gaatcccggcagcgccaaag

SEQ ID NO: 292979 - DNA, 20 bp, human
ggggggaggcacccggtgaa

SEQ ID NO: 292980 - DNA, 20 bp, human
gcagaagtcacggggcttgg

SEQ ID NO: 292981 - DNA, 20 bp, human
gcccctaaagcagaagtcac

SEQ ID NO: 292982 - DNA, 20 bp, human
gaagcagaagtcacggggct

SEQ ID NO: 292983 - DNA, 20 bp, human
ggggtgaactgcaaagtgcg

SEQ ID NO: 292984 - DNA, 20 bp, human
ggaagagccccactgagagg

SEQ ID NO: 292985 - DNA, 20 bp, human
gacggggtgcctgagaattg

SEQ ID NO: 292986 - DNA, 20 bp, human
gcggctgcgctctcccgggg

SEQ ID NO: 292987 - DNA, 20 bp, human
ggaaatgcgccggggagtga

SEQ ID NO: 292988 - DNA, 20 bp, human
gacgcgccagactccgtcct

SEQ ID NO: 292989 - DNA, 20 bp, human
gcggcccccatcctgcgcgt

SEQ ID NO: 292990 - DNA, 20 bp, human
gcccctggaggccgcgcggt

SEQ ID NO: 292991 - DNA, 20 bp, human
ggcgcggcggccactccggg

SEQ ID NO: 292992 - DNA, 20 bp, human
gtctcccacgcgcaggatgg

SEQ ID NO: 292993 - DNA, 20 bp, human
gactccgggaggcgtccctg

SEQ ID NO: 292994 - DNA, 20 bp, human
gccgctggcccgcgcggagt

SEQ ID NO: 292995 - DNA, 20 bp, human
gctggaggccgcgcggtcgg

SEQ ID NO: 292996 - DNA, 20 bp, human
gacagccacgcatgaagtcg

SEQ ID NO: 292997 - DNA, 20 bp, human
ggatggagaggctgagaaaa

SEQ ID NO: 292998 - DNA, 20 bp, human
gtgcgccgcgacttcatgcg

SEQ ID NO: 292999 - DNA, 20 bp, human
gagtagcagccggataaagt

SEQ ID NO: 293000 - DNA, 20 bp, human
gtcgcggcgcagatcacccg

SEQ ID NO: 293001 - DNA, 20 bp, human
gaaggctactgctggagaaa

SEQ ID NO: 293002 - DNA, 20 bp, human
gctgtgcaagagtgataatg

SEQ ID NO: 293003 - DNA, 20 bp, human
gccaacaaagccactggtgg

SEQ ID NO: 293004 - DNA, 20 bp, human
gaggagatggctctgcgccc

SEQ ID NO: 293005 - DNA, 20 bp, human
gacgttcctggtgacctcct

SEQ ID NO: 293006 - DNA, 20 bp, human
gtaagtgagtgagataccaa

SEQ ID NO: 293007 - DNA, 20 bp, human
gcatgaggctggatgttaca

SEQ ID NO: 293008 - DNA, 20 bp, human
gctgccacgcctactcttgt

SEQ ID NO: 293009 - DNA, 20 bp, human
gaggctggatgttacagggc

SEQ ID NO: 293010 - DNA, 20 bp, human
gcaaaggtgttgagctacca

SEQ ID NO: 293011 - DNA, 20 bp, human
gtctgtgggccagctcagac

SEQ ID NO: 293012 - DNA, 20 bp, human
gagggaagtaggggtcccca

SEQ ID NO: 293013 - DNA, 20 bp, human
ggatccaacaagagtaggcg

SEQ ID NO: 293014 - DNA, 20 bp, human
gaaccggatccaacaagagt

SEQ ID NO: 293015 - DNA, 20 bp, human
ggttacagggcagggaagta

SEQ ID NO: 293016 - DNA, 20 bp, human
ggggctccgaacagaccaat

SEQ ID NO: 293017 - DNA, 20 bp, human
gcaagaccctccaatctcgg

SEQ ID NO: 293018 - DNA, 20 bp, human
gtggcgctccactctcccat

SEQ ID NO: 293019 - DNA, 20 bp, human
gtcgagccgccgagattgga

SEQ ID NO: 293020 - DNA, 20 bp, human
gaggctcgagccgccgagat

SEQ ID NO: 293021 - DNA, 20 bp, human
ggcccaagaccctccaatct

SEQ ID NO: 293022 - DNA, 20 bp, human
gattggagggtcttgggcag

SEQ ID NO: 293023 - DNA, 20 bp, human
gcggcgcctggaagtgagat

SEQ ID NO: 293024 - DNA, 20 bp, human
gagacgatatgcgaaacgat

SEQ ID NO: 293025 - DNA, 20 bp, human
gcagataagggcttgtccgg

SEQ ID NO: 293026 - DNA, 20 bp, human
gcacgctctacgaaagtggg

SEQ ID NO: 293027 - DNA, 20 bp, human
gcggcggccccagactggga

SEQ ID NO: 293028 - DNA, 20 bp, human
gggaacctgcaaacctggcg

SEQ ID NO: 293029 - DNA, 20 bp, human
gtgcccacgctctacgaaag

SEQ ID NO: 293030 - DNA, 20 bp, human
gaggcggcgccaccaatccc

SEQ ID NO: 293031 - DNA, 20 bp, human
gcgtgggcaggaggaacctc

SEQ ID NO: 293032 - DNA, 20 bp, human
gaaggccgggttgtgagtcc

SEQ ID NO: 293033 - DNA, 20 bp, human
gtctcagcgcctcctttccc

SEQ ID NO: 293034 - DNA, 20 bp, human
gacggggccggggaccgcca

SEQ ID NO: 293035 - DNA, 20 bp, human
gcgggttgtgagtcccggga

SEQ ID NO: 293036 - DNA, 20 bp, human
gacggggagcgaggaatgga

SEQ ID NO: 293037 - DNA, 20 bp, human
gtgtgtgcgcgcatgtcccc

SEQ ID NO: 293038 - DNA, 20 bp, human
gcaccagcctaccacggctc

SEQ ID NO: 293039 - DNA, 20 bp, human
gccagtgcgcaagtggctgg

SEQ ID NO: 293040 - DNA, 20 bp, human
gcgtgcgcgcgtgtccccgg

SEQ ID NO: 293041 - DNA, 20 bp, human
ggggacacgcgcgcacgcac

SEQ ID NO: 293042 - DNA, 20 bp, human
ggtcccagtgcgcaagtggc

SEQ ID NO: 293043 - DNA, 20 bp, human
gccgctgcaccagcctacca

SEQ ID NO: 293044 - DNA, 20 bp, human
gccgagcccctcctagtccc

SEQ ID NO: 293045 - DNA, 20 bp, human
gcatgcaggcacgtccgccg

SEQ ID NO: 293046 - DNA, 20 bp, human
gccaattagctctgatcatg

SEQ ID NO: 293047 - DNA, 20 bp, human
gaaagcctccagaactgact

SEQ ID NO: 293048 - DNA, 20 bp, human
ggctttctccagagttgtta

SEQ ID NO: 293049 - DNA, 20 bp, human
gagctaattggcccccctgc

SEQ ID NO: 293050 - DNA, 20 bp, human
gagttgttaaggtttgtgtt

SEQ ID NO: 293051 - DNA, 20 bp, human
gaaagaccggtcctgattag

SEQ ID NO: 293052 - DNA, 20 bp, human
gtgggggctggtttcagctg

SEQ ID NO: 293053 - DNA, 20 bp, human
gttctccaagtcagttctgg

SEQ ID NO: 293054 - DNA, 20 bp, human
gatcatgtggaaaagaatgc

SEQ ID NO: 293055 - DNA, 20 bp, human
gcagctgaggttgatgtgat

SEQ ID NO: 293056 - DNA, 20 bp, human
gagcccccagcggagggcat

SEQ ID NO: 293057 - DNA, 20 bp, human
gcactccccacctactggtg

SEQ ID NO: 293058 - DNA, 20 bp, human
gcagcccccaccagtaggtg

SEQ ID NO: 293059 - DNA, 20 bp, human
ggctgggggctcctcggcta

SEQ ID NO: 293060 - DNA, 20 bp, human
ggagtccacagatggatcag

SEQ ID NO: 293061 - DNA, 20 bp, human
ggagtggtggggaacacccc

SEQ ID NO: 293062 - DNA, 20 bp, human
gaggagcgagacagcgacta

SEQ ID NO: 293063 - DNA, 20 bp, human
gggtcccaggggccgtgtga

SEQ ID NO: 293064 - DNA, 20 bp, human
gcgacgcagcagagcaggag

SEQ ID NO: 293065 - DNA, 20 bp, human
gaaagtcactgtctaatctg

SEQ ID NO: 293066 - DNA, 20 bp, human
ggagagaaggaatctgagaa

SEQ ID NO: 293067 - DNA, 20 bp, human
gccagactatgcaagaatgc

SEQ ID NO: 293068 - DNA, 20 bp, human
ggcccactagaatcctgtgc

SEQ ID NO: 293069 - DNA, 20 bp, human
gtttcccaaggcaacctgtc

SEQ ID NO: 293070 - DNA, 20 bp, human
gtctagtgggcatccagtcc

SEQ ID NO: 293071 - DNA, 20 bp, human
gtgggcttcgggatacatgt

SEQ ID NO: 293072 - DNA, 20 bp, human
gaccagcacaggattctagt

SEQ ID NO: 293073 - DNA, 20 bp, human
gagtccagacaggttgcctt

SEQ ID NO: 293074 - DNA, 20 bp, human
gaggttgccttgggaaagat

SEQ ID NO: 293075 - DNA, 20 bp, human
gcacaggtgtttggagagcc

SEQ ID NO: 293076 - DNA, 20 bp, human
gcctccctgggaatctacat

SEQ ID NO: 293077 - DNA, 20 bp, human
gtgccacagctgactggcta

SEQ ID NO: 293078 - DNA, 20 bp, human
gacctcctccagaggtacag

SEQ ID NO: 293079 - DNA, 20 bp, human
gaatctacataggtagcccc

SEQ ID NO: 293080 - DNA, 20 bp, human
gcacactgtacctcctccag

SEQ ID NO: 293081 - DNA, 20 bp, human
ggtcaccacctctgtacctc

SEQ ID NO: 293082 - DNA, 20 bp, human
ggctacctatgtagattccc

SEQ ID NO: 293083 - DNA, 20 bp, human
gtacttgatcagggatacaa

SEQ ID NO: 293084 - DNA, 20 bp, human
gttgcttgataagacgccag

SEQ ID NO: 293085 - DNA, 20 bp, human
gaatcactgccacagctgac

SEQ ID NO: 293086 - DNA, 20 bp, human
gacggggagcgaggaatgga

SEQ ID NO: 293087 - DNA, 20 bp, human
gtgtgtgcgcgcatgtcccc

SEQ ID NO: 293088 - DNA, 20 bp, human
gcaccagcctaccacggctc

SEQ ID NO: 293089 - DNA, 20 bp, human
gccagtgcgcaagtggctgg

SEQ ID NO: 293090 - DNA, 20 bp, human
gcgtgcgcgcgtgtccccgg

SEQ ID NO: 293091 - DNA, 20 bp, human
ggggacacgcgcgcacgcac

SEQ ID NO: 293092 - DNA, 20 bp, human
ggtcccagtgcgcaagtggc

SEQ ID NO: 293093 - DNA, 20 bp, human
gccgctgcaccagcctacca

SEQ ID NO: 293094 - DNA, 20 bp, human
gccgagcccctcctagtccc

SEQ ID NO: 293095 - DNA, 20 bp, human
gcatgcaggcacgtccgccg

SEQ ID NO: 293096 - DNA, 20 bp, human
gggccccgggaaccgcggcg

SEQ ID NO: 293097 - DNA, 20 bp, human
ggcaagcggcccaagagcgg

SEQ ID NO: 293098 - DNA, 20 bp, human
ggaggcggtccgtgcgacac

SEQ ID NO: 293099 - DNA, 20 bp, human
gtgccctgcgtgctcctcga

SEQ ID NO: 293100 - DNA, 20 bp, human
gcaggcgcgctgcgattggc

SEQ ID NO: 293101 - DNA, 20 bp, human
gagggcaagcggcccaagag

SEQ ID NO: 293102 - DNA, 20 bp, human
gaggaagttgcggcccagct

SEQ ID NO: 293103 - DNA, 20 bp, human
gcaggagagccggtgtcgca

SEQ ID NO: 293104 - DNA, 20 bp, human
gtggagccccacacacttcc

SEQ ID NO: 293105 - DNA, 20 bp, human
gggggaaccgggaagtgtgt

SEQ ID NO: 293106 - DNA, 20 bp, human
gagaaggagaggcgtctgca

SEQ ID NO: 293107 - DNA, 20 bp, human
ggaggcgctgacaaggagtg

SEQ ID NO: 293108 - DNA, 20 bp, human
ggggagtcaagaggtgaccc

SEQ ID NO: 293109 - DNA, 20 bp, human
ggagcccctccaatgagaag

SEQ ID NO: 293110 - DNA, 20 bp, human
gggacagcgcggtgccctca

SEQ ID NO: 293111 - DNA, 20 bp, human
gggccaccgaggcgctgaca

SEQ ID NO: 293112 - DNA, 20 bp, human
gaagcgagcgctcctgggtg

SEQ ID NO: 293113 - DNA, 20 bp, human
gagcccggagggcgtgggta

SEQ ID NO: 293114 - DNA, 20 bp, human
gaggtgacccgggatgccgg

SEQ ID NO: 293115 - DNA, 20 bp, human
gctcccgcactcaagccagg

SEQ ID NO: 293116 - DNA, 20 bp, human
ggggccgcacggagagtggg

SEQ ID NO: 293117 - DNA, 20 bp, human
ggggcggcgtgccgcgagtt

SEQ ID NO: 293118 - DNA, 20 bp, human
ggacccgcgccccactgcgg

SEQ ID NO: 293119 - DNA, 20 bp, human
gggccggggtccgagacaga

SEQ ID NO: 293120 - DNA, 20 bp, human
gaaagtctcgcaaagcgggg

SEQ ID NO: 293121 - DNA, 20 bp, human
gagggggccgcacggagagt

SEQ ID NO: 293122 - DNA, 20 bp, human
gcgcgggtcacgtgtgagga

SEQ ID NO: 293123 - DNA, 20 bp, human
gtctctgtccgtctccctcg

SEQ ID NO: 293124 - DNA, 20 bp, human
gccccctcccactctccgtg

SEQ ID NO: 293125 - DNA, 20 bp, human
gagacggacagagacgcgca

SEQ ID NO: 293126 - DNA, 20 bp, human
gggcgctcacacacaggcat

SEQ ID NO: 293127 - DNA, 20 bp, human
gcgactgagcagccccgccg

SEQ ID NO: 293128 - DNA, 20 bp, human
gggccccctgcgccctcccc

SEQ ID NO: 293129 - DNA, 20 bp, human
ggggctgctcagtcgctccg

SEQ ID NO: 293130 - DNA, 20 bp, human
gggtagtaacgcgactggaa

SEQ ID NO: 293131 - DNA, 20 bp, human
gacacgcggcgctcacacac

SEQ ID NO: 293132 - DNA, 20 bp, human
gaatcagagccgtcgggcgg

SEQ ID NO: 293133 - DNA, 20 bp, human
gcccctgctgcggggtgcca

SEQ ID NO: 293134 - DNA, 20 bp, human
gcgcagcaggggtgcagccg

SEQ ID NO: 293135 - DNA, 20 bp, human
gtgagcgccgcgtatttagt

SEQ ID NO: 293136 - DNA, 20 bp, human
gtgtcagcgcgtcgaggacc

SEQ ID NO: 293137 - DNA, 20 bp, human
gacacgctagctggcatggg

SEQ ID NO: 293138 - DNA, 20 bp, human
gggaaaaagccgcacagcgc

SEQ ID NO: 293139 - DNA, 20 bp, human
gcggcgcggtccgggaggaa

SEQ ID NO: 293140 - DNA, 20 bp, human
ggcacagcgccggcgcggtc

SEQ ID NO: 293141 - DNA, 20 bp, human
gcggcggggtgggcgtctct

SEQ ID NO: 293142 - DNA, 20 bp, human
gagcctgcaccgcccagagg

SEQ ID NO: 293143 - DNA, 20 bp, human
gagtgcagcgccgcgtgctg

SEQ ID NO: 293144 - DNA, 20 bp, human
ggacgcgctgacacgctagc

SEQ ID NO: 293145 - DNA, 20 bp, human
gctgacacgctagctggcat

SEQ ID NO: 293146 - DNA, 20 bp, human
gccctactccgcgacaacgt

SEQ ID NO: 293147 - DNA, 20 bp, human
gcgtcaaagccctaactggg

SEQ ID NO: 293148 - DNA, 20 bp, human
gcgcaagtccccgggaggta

SEQ ID NO: 293149 - DNA, 20 bp, human
ggcgagcgcaagtccccggg

SEQ ID NO: 293150 - DNA, 20 bp, human
ggtgcgtcaaagccctaact

SEQ ID NO: 293151 - DNA, 20 bp, human
gcacttcagtggaaggagga

SEQ ID NO: 293152 - DNA, 20 bp, human
gcaaatcagcctcccagtta

SEQ ID NO: 293153 - DNA, 20 bp, human
gagagggagggacgacccgg

SEQ ID NO: 293154 - DNA, 20 bp, human
gtaaacgcagggagggctag

SEQ ID NO: 293155 - DNA, 20 bp, human
gggggcgagcgcaagtcccc

SEQ ID NO: 293156 - DNA, 20 bp, human
gcagtcctgggtaccactag

SEQ ID NO: 293157 - DNA, 20 bp, human
gtaaaaatagctatggcgtg

SEQ ID NO: 293158 - DNA, 20 bp, human
gtcaacccctagtggtaccc

SEQ ID NO: 293159 - DNA, 20 bp, human
ggccaagctctgagttgtcc

SEQ ID NO: 293160 - DNA, 20 bp, human
gtgtgtcatccctacttccc

SEQ ID NO: 293161 - DNA, 20 bp, human
gtctgagttgtccaggagga

SEQ ID NO: 293162 - DNA, 20 bp, human
gggtttggatcaacccctag

SEQ ID NO: 293163 - DNA, 20 bp, human
gcaggtgctgctctcaggtc

SEQ ID NO: 293164 - DNA, 20 bp, human
gagggcttgtattttccccc

SEQ ID NO: 293165 - DNA, 20 bp, human
gccagaaggcggtagctaga

SEQ ID NO: 293166 - DNA, 20 bp, human
ggcccgagagagccaatcgc

SEQ ID NO: 293167 - DNA, 20 bp, human
gagagccaatcgcaggaaga

SEQ ID NO: 293168 - DNA, 20 bp, human
gcaggtaacccgagagtcag

SEQ ID NO: 293169 - DNA, 20 bp, human
gacggcgctgcccggaggag

SEQ ID NO: 293170 - DNA, 20 bp, human
ggcaggaagacggcgctgcc

SEQ ID NO: 293171 - DNA, 20 bp, human
gctctggagtgcgcagaagg

SEQ ID NO: 293172 - DNA, 20 bp, human
gataaaaagcccagatgatg

SEQ ID NO: 293173 - DNA, 20 bp, human
gctgacgtggttgccggctc

SEQ ID NO: 293174 - DNA, 20 bp, human
gactctcgggttacctgagc

SEQ ID NO: 293175 - DNA, 20 bp, human
gagcgccgtcttcctgcgat

SEQ ID NO: 293176 - DNA, 20 bp, human
ggggaagtggggggcgtcgc

SEQ ID NO: 293177 - DNA, 20 bp, human
ggcgccacccctacatccaa

SEQ ID NO: 293178 - DNA, 20 bp, human
gcggccgagccagtaagtag

SEQ ID NO: 293179 - DNA, 20 bp, human
gaagccattggatgtagggg

SEQ ID NO: 293180 - DNA, 20 bp, human
ggtgagaagaggtgacccgg

SEQ ID NO: 293181 - DNA, 20 bp, human
gcccgctccccgaaagccat

SEQ ID NO: 293182 - DNA, 20 bp, human
gtgccggggcgcggcgtctg

SEQ ID NO: 293183 - DNA, 20 bp, human
gtgggcgcgccgctacttac

SEQ ID NO: 293184 - DNA, 20 bp, human
gacacgccccaccccggccg

SEQ ID NO: 293185 - DNA, 20 bp, human
ggagcccccggcacccggct

SEQ ID NO: 293186 - DNA, 20 bp, human
ggcaagacgaggttccccgg

SEQ ID NO: 293187 - DNA, 20 bp, human
gctgctgcgacgcctcccgg

SEQ ID NO: 293188 - DNA, 20 bp, human
gggctctggcggcaccaatg

SEQ ID NO: 293189 - DNA, 20 bp, human
gggagcaagacgaggttccc

SEQ ID NO: 293190 - DNA, 20 bp, human
gtggtagcccgcaccgcagt

SEQ ID NO: 293191 - DNA, 20 bp, human
gcgcagtcggacacctgctc

SEQ ID NO: 293192 - DNA, 20 bp, human
gtcaccgcggcatgagataa

SEQ ID NO: 293193 - DNA, 20 bp, human
gcgcagggaggagcaagacg

SEQ ID NO: 293194 - DNA, 20 bp, human
gcctccctgcgcttcgcctc

SEQ ID NO: 293195 - DNA, 20 bp, human
gctgctccggtgccccgcat

SEQ ID NO: 293196 - DNA, 20 bp, human
gtccctgtccggctcagata

SEQ ID NO: 293197 - DNA, 20 bp, human
gtccggctcagataggggag

SEQ ID NO: 293198 - DNA, 20 bp, human
gtgagccggacagggagccg

SEQ ID NO: 293199 - DNA, 20 bp, human
gcccctatctgagccggaca

SEQ ID NO: 293200 - DNA, 20 bp, human
ggcctcccgagtctccgaat

SEQ ID NO: 293201 - DNA, 20 bp, human
gtccccaggtagatcgacga

SEQ ID NO: 293202 - DNA, 20 bp, human
gagaactccgaggagagcag

SEQ ID NO: 293203 - DNA, 20 bp, human
gcccgcgaccgtctctttgc

SEQ ID NO: 293204 - DNA, 20 bp, human
gggcgggcgcacggagagag

SEQ ID NO: 293205 - DNA, 20 bp, human
ggctgaaggtcccggggaac

SEQ ID NO: 293206 - DNA, 20 bp, human
ggaaccccgggcaggcgagt

SEQ ID NO: 293207 - DNA, 20 bp, human
gtgggaggcggacaggggag

SEQ ID NO: 293208 - DNA, 20 bp, human
ggacaggggagcggttcttc

SEQ ID NO: 293209 - DNA, 20 bp, human
gccccgggcaggcgagtggg

SEQ ID NO: 293210 - DNA, 20 bp, human
ggcgagtgggaggcggacag

SEQ ID NO: 293211 - DNA, 20 bp, human
ggcgtggggccggggttgga

SEQ ID NO: 293212 - DNA, 20 bp, human
ggggttgtgacgggcgaggc

SEQ ID NO: 293213 - DNA, 20 bp, human
gtggaggctgggatcgccac

SEQ ID NO: 293214 - DNA, 20 bp, human
gcggtccgggcacacggagc

SEQ ID NO: 293215 - DNA, 20 bp, human
gggctgggatcgccacgggt

SEQ ID NO: 293216 - DNA, 20 bp, human
gcggccgagagagcccactg

SEQ ID NO: 293217 - DNA, 20 bp, human
gcctgatggtaagagtatca

SEQ ID NO: 293218 - DNA, 20 bp, human
gtaaactgcgtgacaaatca

SEQ ID NO: 293219 - DNA, 20 bp, human
ggatcctgggatggtaagag

SEQ ID NO: 293220 - DNA, 20 bp, human
gactctgtccaggccccagt

SEQ ID NO: 293221 - DNA, 20 bp, human
gggggtcttacagccttcaa

SEQ ID NO: 293222 - DNA, 20 bp, human
gccagcgtcttcacccttga

SEQ ID NO: 293223 - DNA, 20 bp, human
gctgaaggtaacccactaga

SEQ ID NO: 293224 - DNA, 20 bp, human
gcagggcaaagtaaatagac

SEQ ID NO: 293225 - DNA, 20 bp, human
gagaccccagcttaggagct

SEQ ID NO: 293226 - DNA, 20 bp, human
ggggtgaccgcaggcgctga

SEQ ID NO: 293227 - DNA, 20 bp, human
gcccccgagtccaagaactt

SEQ ID NO: 293228 - DNA, 20 bp, human
gagtccaagaacttaggcag

SEQ ID NO: 293229 - DNA, 20 bp, human
ggggcccctgcctaagttct

SEQ ID NO: 293230 - DNA, 20 bp, human
ggccccgcctcaaatgtgtg

SEQ ID NO: 293231 - DNA, 20 bp, human
ggaacaatgggagggacttc

SEQ ID NO: 293232 - DNA, 20 bp, human
gtggcctaggcctagcaggt

SEQ ID NO: 293233 - DNA, 20 bp, human
ggacaagtggcaatcagctg

SEQ ID NO: 293234 - DNA, 20 bp, human
gaaaagaggctctgaactgt

SEQ ID NO: 293235 - DNA, 20 bp, human
gtggacaagcctcttggtta

SEQ ID NO: 293236 - DNA, 20 bp, human
gtaagccccgccaggaagat

SEQ ID NO: 293237 - DNA, 20 bp, human
ggcaatctggggtgctaggg

SEQ ID NO: 293238 - DNA, 20 bp, human
ggccaggctccagtgctaag

SEQ ID NO: 293239 - DNA, 20 bp, human
gaagatggggtaggagtgcc

SEQ ID NO: 293240 - DNA, 20 bp, human
gcagcggatcaatagcaatc

SEQ ID NO: 293241 - DNA, 20 bp, human
gggagcatctaagccccgcc

SEQ ID NO: 293242 - DNA, 20 bp, human
ggggcgccatctgagtagtt

SEQ ID NO: 293243 - DNA, 20 bp, human
gcgcaccatccacttagcac

SEQ ID NO: 293244 - DNA, 20 bp, human
gtggagcctggctgttctcc

SEQ ID NO: 293245 - DNA, 20 bp, human
ggagtgcccggagaacagcc

SEQ ID NO: 293246 - DNA, 20 bp, human
gggcgacgcaggcaagggta

SEQ ID NO: 293247 - DNA, 20 bp, human
gaggcagcaggtgagccaag

SEQ ID NO: 293248 - DNA, 20 bp, human
gccctcctgtctcaccgcca

SEQ ID NO: 293249 - DNA, 20 bp, human
ggcaggggcgacgcaggcaa

SEQ ID NO: 293250 - DNA, 20 bp, human
gtagaagggagcatcttgca

SEQ ID NO: 293251 - DNA, 20 bp, human
gaagaggagggagttccgaa

SEQ ID NO: 293252 - DNA, 20 bp, human
gcgagagtgaggattttgcg

SEQ ID NO: 293253 - DNA, 20 bp, human
gcgcaggcaagggtagggct

SEQ ID NO: 293254 - DNA, 20 bp, human
gtggccccccagacctgtac

SEQ ID NO: 293255 - DNA, 20 bp, human
gtcctgggggcacaacccct

SEQ ID NO: 293256 - DNA, 20 bp, human
gtggggagacgcgccgagga

SEQ ID NO: 293257 - DNA, 20 bp, human
gcgtctccccagtccttatt

SEQ ID NO: 293258 - DNA, 20 bp, human
gaaaggcagtgtaggactga

SEQ ID NO: 293259 - DNA, 20 bp, human
ggcccagccaaataaggact

SEQ ID NO: 293260 - DNA, 20 bp, human
gtcctgcccgggctctctcg

SEQ ID NO: 293261 - DNA, 20 bp, human
gggcggtgggtggtgctgaa

SEQ ID NO: 293262 - DNA, 20 bp, human
gggactggggagacgcgccg

SEQ ID NO: 293263 - DNA, 20 bp, human
ggaagggggctgtgtgacag

SEQ ID NO: 293264 - DNA, 20 bp, human
gagcgaaacgctgataacta

SEQ ID NO: 293265 - DNA, 20 bp, human
gtccccagtccttatttggc

SEQ ID NO: 293266 - DNA, 20 bp, human
gcaccctggagggatagccg

SEQ ID NO: 293267 - DNA, 20 bp, human
gtagccggggagcaggtaga

SEQ ID NO: 293268 - DNA, 20 bp, human
gccttccggggctgatttct

SEQ ID NO: 293269 - DNA, 20 bp, human
ggggtctttggagaggtcac

SEQ ID NO: 293270 - DNA, 20 bp, human
gagggccaaaacctggagtg

SEQ ID NO: 293271 - DNA, 20 bp, human
gtgggtcccaacctccacgt

SEQ ID NO: 293272 - DNA, 20 bp, human
gtgttcaggcagtgggagag

SEQ ID NO: 293273 - DNA, 20 bp, human
ggggtgggggaaacccggtg

SEQ ID NO: 293274 - DNA, 20 bp, human
gggtgcctgtccggagagac

SEQ ID NO: 293275 - DNA, 20 bp, human
gactggtagggaacctgaac

SEQ ID NO: 293276 - DNA, 20 bp, human
gctcccagggtcagccgcca

SEQ ID NO: 293277 - DNA, 20 bp, human
gtcccctggcggctgaccct

SEQ ID NO: 293278 - DNA, 20 bp, human
ggggctgcttgtgcggggaa

SEQ ID NO: 293279 - DNA, 20 bp, human
gcaagcagcccggcgagcgc

SEQ ID NO: 293280 - DNA, 20 bp, human
ggtgagcgctagaagaggct

SEQ ID NO: 293281 - DNA, 20 bp, human
gcacgccctgcggtgcccga

SEQ ID NO: 293282 - DNA, 20 bp, human
gcggtcggagcccggagcaa

SEQ ID NO: 293283 - DNA, 20 bp, human
ggcgaggtgagcgctagaag

SEQ ID NO: 293284 - DNA, 20 bp, human
ggagcgcaggagtgagcgcg

SEQ ID NO: 293285 - DNA, 20 bp, human
ggcgctctgcccccttgctc

SEQ ID NO: 293286 - DNA, 20 bp, human
gcaaccgccaggtgttcgtt

SEQ ID NO: 293287 - DNA, 20 bp, human
gccgttggtctgctgggtct

SEQ ID NO: 293288 - DNA, 20 bp, human
gacccagcagaccaacggga

SEQ ID NO: 293289 - DNA, 20 bp, human
gccaggtgttcgttcggaga

SEQ ID NO: 293290 - DNA, 20 bp, human
ggggccacccagggctcgcg

SEQ ID NO: 293291 - DNA, 20 bp, human
gacgtcagcggggccaccca

SEQ ID NO: 293292 - DNA, 20 bp, human
gccccgcctccgggaaactg

SEQ ID NO: 293293 - DNA, 20 bp, human
gtccaccctttccatcccgt

SEQ ID NO: 293294 - DNA, 20 bp, human
gcctccgcatggcacccacc

SEQ ID NO: 293295 - DNA, 20 bp, human
gagcctcggagtgggaacag

SEQ ID NO: 293296 - DNA, 20 bp, human
ggggtggctggggtgtgaac

SEQ ID NO: 293297 - DNA, 20 bp, human
gcatcccagctgctgtgaaa

SEQ ID NO: 293298 - DNA, 20 bp, human
gaggacctcacacttattca

SEQ ID NO: 293299 - DNA, 20 bp, human
gaggaaggcggctgcggtga

SEQ ID NO: 293300 - DNA, 20 bp, human
gaggaccttgaataagtgtg

SEQ ID NO: 293301 - DNA, 20 bp, human
gaaggaaacaccctgggtga

SEQ ID NO: 293302 - DNA, 20 bp, human
gtaagtgtgaggtcctctct

SEQ ID NO: 293303 - DNA, 20 bp, human
gcactgggaaagctctgcta

SEQ ID NO: 293304 - DNA, 20 bp, human
ggggcaaatgtcttgcctcc

SEQ ID NO: 293305 - DNA, 20 bp, human
gtgcccatttcacagcagct

SEQ ID NO: 293306 - DNA, 20 bp, human
ggggtctggcgcagggtgtc

SEQ ID NO: 293307 - DNA, 20 bp, human
gcgagaaggcggacaggcac

SEQ ID NO: 293308 - DNA, 20 bp, human
gaggcccgcgcggtacccag

SEQ ID NO: 293309 - DNA, 20 bp, human
gcccgccagccgcctcgcgg

SEQ ID NO: 293310 - DNA, 20 bp, human
ggccgcctccaagttgtaag

SEQ ID NO: 293311 - DNA, 20 bp, human
ggccccgctgggtaccgcgc

SEQ ID NO: 293312 - DNA, 20 bp, human
ggggctgcttcggccgggtc

SEQ ID NO: 293313 - DNA, 20 bp, human
gagcgccggggccaggcgtc

SEQ ID NO: 293314 - DNA, 20 bp, human
gtacaacttggaggcggcgg

SEQ ID NO: 293315 - DNA, 20 bp, human
ggcggggcccggtacccctg

SEQ ID NO: 293316 - DNA, 20 bp, human
gcacacccgtggcgcacggc

SEQ ID NO: 293317 - DNA, 20 bp, human
gccggctccgcgcgcggtcc

SEQ ID NO: 293318 - DNA, 20 bp, human
gcgggggcggcgcagacccc

SEQ ID NO: 293319 - DNA, 20 bp, human
ggcgcggtcccgggtgtcct

SEQ ID NO: 293320 - DNA, 20 bp, human
ggcgtggcgacaggactagg

SEQ ID NO: 293321 - DNA, 20 bp, human
gcggctcgctgtatatatct

SEQ ID NO: 293322 - DNA, 20 bp, human
gccgagcgccgagagccagg

SEQ ID NO: 293323 - DNA, 20 bp, human
ggcgctgtgcgcgacctggc

SEQ ID NO: 293324 - DNA, 20 bp, human
gtcggggccagcgcagcccg

SEQ ID NO: 293325 - DNA, 20 bp, human
ggcaggggcgcccgggcgga

SEQ ID NO: 293326 - DNA, 20 bp, human
ggtaacagctgccttcctca

SEQ ID NO: 293327 - DNA, 20 bp, human
gaggaagggtggagttgggc

SEQ ID NO: 293328 - DNA, 20 bp, human
gagacacagactcggagagc

SEQ ID NO: 293329 - DNA, 20 bp, human
ggagcaggtacccagccctg

SEQ ID NO: 293330 - DNA, 20 bp, human
gcatgaggaagggtggagtt

SEQ ID NO: 293331 - DNA, 20 bp, human
gctccagcgtggatatgcca

SEQ ID NO: 293332 - DNA, 20 bp, human
ggagttgggctggaggggtt

SEQ ID NO: 293333 - DNA, 20 bp, human
gctcagacttgaccatgttt

SEQ ID NO: 293334 - DNA, 20 bp, human
gcatcttcccagagtctcgt

SEQ ID NO: 293335 - DNA, 20 bp, human
gaagcctccatgcccaaaca

SEQ ID NO: 293336 - DNA, 20 bp, human
gcagtaaaatagaggagcgt

SEQ ID NO: 293337 - DNA, 20 bp, human
ggcctagtgcaactaactaa

SEQ ID NO: 293338 - DNA, 20 bp, human
ggagagcagtcaaccatgca

SEQ ID NO: 293339 - DNA, 20 bp, human
gcccagcagcatttatacca

SEQ ID NO: 293340 - DNA, 20 bp, human
gtttcacggatcatagttcc

SEQ ID NO: 293341 - DNA, 20 bp, human
gtctgcatggctacaataca

SEQ ID NO: 293342 - DNA, 20 bp, human
gactcagctctgtgcttcag

SEQ ID NO: 293343 - DNA, 20 bp, human
ggtgtagtaacaagatcagt

SEQ ID NO: 293344 - DNA, 20 bp, human
gtcacattgtgtgccaggaa

SEQ ID NO: 293345 - DNA, 20 bp, human
gaaatttatggctcaatttc

SEQ ID NO: 293346 - DNA, 20 bp, human
gatccagtgcagggcgatgt

SEQ ID NO: 293347 - DNA, 20 bp, human
ggggcgatgtcggtctggga

SEQ ID NO: 293348 - DNA, 20 bp, human
gtgcagggcgatgtcggtct

SEQ ID NO: 293349 - DNA, 20 bp, human
gaagagcaggaatcccttac

SEQ ID NO: 293350 - DNA, 20 bp, human
ggaaacagcatgcctatcat

SEQ ID NO: 293351 - DNA, 20 bp, human
gtgggagtgagaaaattgtt

SEQ ID NO: 293352 - DNA, 20 bp, human
gtggaaatctgatccagtgc

SEQ ID NO: 293353 - DNA, 20 bp, human
ggctctctctcctatagtta

SEQ ID NO: 293354 - DNA, 20 bp, human
gagcagtggggaagtgatgt

SEQ ID NO: 293355 - DNA, 20 bp, human
gtctatatggaaagcgaact

SEQ ID NO: 293356 - DNA, 20 bp, human
ggtgactcaggttggagagc

SEQ ID NO: 293357 - DNA, 20 bp, human
gctatgccctaaaggacatg

SEQ ID NO: 293358 - DNA, 20 bp, human
gtgcttgtctctaactgttg

SEQ ID NO: 293359 - DNA, 20 bp, human
gacagttagagacaagcata

SEQ ID NO: 293360 - DNA, 20 bp, human
ggacacagtgaaggattgtg

SEQ ID NO: 293361 - DNA, 20 bp, human
ggggagccacacagagaatg

SEQ ID NO: 293362 - DNA, 20 bp, human
gggagaggcagcggtgactc

SEQ ID NO: 293363 - DNA, 20 bp, human
gcacacagagaatgtgggag

SEQ ID NO: 293364 - DNA, 20 bp, human
gcaacagttggatggctcaa

SEQ ID NO: 293365 - DNA, 20 bp, human
ggatggctcaaggggagttc

SEQ ID NO: 293366 - DNA, 20 bp, human
gtgacgggcacaagcgacag

SEQ ID NO: 293367 - DNA, 20 bp, human
ggggcgtctcctttgggcga

SEQ ID NO: 293368 - DNA, 20 bp, human
gcaaaggagacgcccccggg

SEQ ID NO: 293369 - DNA, 20 bp, human
ggcccaaaggagacgccccc

SEQ ID NO: 293370 - DNA, 20 bp, human
gcccgggtctgctgcggacg

SEQ ID NO: 293371 - DNA, 20 bp, human
ggacagcggcgacttgcaat

SEQ ID NO: 293372 - DNA, 20 bp, human
gccaccccgcctcctctcgt

SEQ ID NO: 293373 - DNA, 20 bp, human
gcgggcacgggtggcggtgt

SEQ ID NO: 293374 - DNA, 20 bp, human
gacacccgacgagaggaggc

SEQ ID NO: 293375 - DNA, 20 bp, human
gcatctcggacgtccctcta

SEQ ID NO: 293376 - DNA, 20 bp, human
ggccccggctgtggccgcga

SEQ ID NO: 293377 - DNA, 20 bp, human
gaaggcgtctcctctaaagc

SEQ ID NO: 293378 - DNA, 20 bp, human
gtagaggagacgccttgcgg

SEQ ID NO: 293379 - DNA, 20 bp, human
ggagggggcgcggaccccgc

SEQ ID NO: 293380 - DNA, 20 bp, human
gggaaggtcccagctaggaa

SEQ ID NO: 293381 - DNA, 20 bp, human
gcgcggaccccgcaggccga

SEQ ID NO: 293382 - DNA, 20 bp, human
gcgagggaggcagtccgtcg

SEQ ID NO: 293383 - DNA, 20 bp, human
gggcagctggcgacgttgac

SEQ ID NO: 293384 - DNA, 20 bp, human
gctttggcgagagacctgga

SEQ ID NO: 293385 - DNA, 20 bp, human
ggagcggccccccagagtga

SEQ ID NO: 293386 - DNA, 20 bp, human
gcggcttagggaagcgtgtg

SEQ ID NO: 293387 - DNA, 20 bp, human
gtctggactgcaccccccta

SEQ ID NO: 293388 - DNA, 20 bp, human
gcagcccagctgcactgcgt

SEQ ID NO: 293389 - DNA, 20 bp, human
gcgcgccgcaaactcagtct

SEQ ID NO: 293390 - DNA, 20 bp, human
gtgcaggacaaaccctaggg

SEQ ID NO: 293391 - DNA, 20 bp, human
gttgcggcgcgcgcggctta

SEQ ID NO: 293392 - DNA, 20 bp, human
gagcccccacgcagtgcagc

SEQ ID NO: 293393 - DNA, 20 bp, human
gctgctgctggtgcgaggaa

SEQ ID NO: 293394 - DNA, 20 bp, human
ggatggggaggggaatctgc

SEQ ID NO: 293395 - DNA, 20 bp, human
gcgtccggcactagtcaagg

SEQ ID NO: 293396 - DNA, 20 bp, human
gtggcggcgcagcgaggact

SEQ ID NO: 293397 - DNA, 20 bp, human
gagaccagctgctaataagt

SEQ ID NO: 293398 - DNA, 20 bp, human
gctagctccgccccccgcat

SEQ ID NO: 293399 - DNA, 20 bp, human
ggctgcgccgccactggggc

SEQ ID NO: 293400 - DNA, 20 bp, human
gctctggggaggagcctatg

SEQ ID NO: 293401 - DNA, 20 bp, human
gcctcgctgcgccgccactg

SEQ ID NO: 293402 - DNA, 20 bp, human
gtggggaggagcctatgcgg

SEQ ID NO: 293403 - DNA, 20 bp, human
gtattagcagctggtctcat

SEQ ID NO: 293404 - DNA, 20 bp, human
gggcggagctaggaggaggt

SEQ ID NO: 293405 - DNA, 20 bp, human
ggaggagcctatgcgggggg

SEQ ID NO: 293406 - DNA, 20 bp, human
gtgagaataaggaggggcta

SEQ ID NO: 293407 - DNA, 20 bp, human
ggaggggctagggtgtgtct

SEQ ID NO: 293408 - DNA, 20 bp, human
gcccctccttattctcaaaa

SEQ ID NO: 293409 - DNA, 20 bp, human
gtgggctttgtcacacacaa

SEQ ID NO: 293410 - DNA, 20 bp, human
gcccccttttgagaataagg

SEQ ID NO: 293411 - DNA, 20 bp, human
ggacggagactaacacacca

SEQ ID NO: 293412 - DNA, 20 bp, human
gcaccacacccagacaccga

SEQ ID NO: 293413 - DNA, 20 bp, human
ggtccttcggtgtctgggtg

SEQ ID NO: 293414 - DNA, 20 bp, human
ggctcccccttttgagaata

SEQ ID NO: 293415 - DNA, 20 bp, human
ggtgtgttagtctccgtctt

SEQ ID NO: 293416 - DNA, 20 bp, human
gccgccctctccccacggac

SEQ ID NO: 293417 - DNA, 20 bp, human
gggaacggggccaaacaggt

SEQ ID NO: 293418 - DNA, 20 bp, human
gagggccaggccggtccgtg

SEQ ID NO: 293419 - DNA, 20 bp, human
gagagggcgggccaagccgg

SEQ ID NO: 293420 - DNA, 20 bp, human
ggcggggcacgccgtcccat

SEQ ID NO: 293421 - DNA, 20 bp, human
ggggatagatgacacgagcg

SEQ ID NO: 293422 - DNA, 20 bp, human
gtggccgagggccggtccca

SEQ ID NO: 293423 - DNA, 20 bp, human
gagggacgccctgtgcgcgc

SEQ ID NO: 293424 - DNA, 20 bp, human
ggcacgccgtcccatgggac

SEQ ID NO: 293425 - DNA, 20 bp, human
gcaaacaggtgggcgaggag

SEQ ID NO: 293426 - DNA, 20 bp, human
gcccccgcgacgccagtcga

SEQ ID NO: 293427 - DNA, 20 bp, human
gcgctcctggggtcccagag

SEQ ID NO: 293428 - DNA, 20 bp, human
ggcgacgccagtcgaaggag

SEQ ID NO: 293429 - DNA, 20 bp, human
gcccaagcccggcaggagtg

SEQ ID NO: 293430 - DNA, 20 bp, human
ggggagccgcatggccgagg

SEQ ID NO: 293431 - DNA, 20 bp, human
gcggccatgcggctcccggc

SEQ ID NO: 293432 - DNA, 20 bp, human
gtggtggccccagcgctcct

SEQ ID NO: 293433 - DNA, 20 bp, human
ggcccgcgggaccagagctc

SEQ ID NO: 293434 - DNA, 20 bp, human
ggcgtcgcgggggttaacgc

SEQ ID NO: 293435 - DNA, 20 bp, human
ggccaccaggcaggtccact

SEQ ID NO: 293436 - DNA, 20 bp, human
ggcgacggggcgggacaatg

SEQ ID NO: 293437 - DNA, 20 bp, human
ggcctcccgccgcgacgggg

SEQ ID NO: 293438 - DNA, 20 bp, human
gaggctggaacgggcgggga

SEQ ID NO: 293439 - DNA, 20 bp, human
gtggggacccaggatcgcct

SEQ ID NO: 293440 - DNA, 20 bp, human
gttggggcttcccctggatg

SEQ ID NO: 293441 - DNA, 20 bp, human
gccccaccgctgattgtctg

SEQ ID NO: 293442 - DNA, 20 bp, human
gcggtagcccaggcgatcct

SEQ ID NO: 293443 - DNA, 20 bp, human
gcgcgaacgcacctgctctg

SEQ ID NO: 293444 - DNA, 20 bp, human
ggacaggctgaggctggaac

SEQ ID NO: 293445 - DNA, 20 bp, human
ggcactgcctggttgcaacg

SEQ ID NO: 293446 - DNA, 20 bp, human
ggccgccttcccaaatcggg

SEQ ID NO: 293447 - DNA, 20 bp, human
gccgaaggccagcccggggt

SEQ ID NO: 293448 - DNA, 20 bp, human
gcgagcgagcaagcgaggcg

SEQ ID NO: 293449 - DNA, 20 bp, human
gtggccccgaaggccagccc

SEQ ID NO: 293450 - DNA, 20 bp, human
gctgcccccgccacgcggtt

SEQ ID NO: 293451 - DNA, 20 bp, human
gacacgaggcgtcccacccc

SEQ ID NO: 293452 - DNA, 20 bp, human
gttcggcccaggcaccaact

SEQ ID NO: 293453 - DNA, 20 bp, human
gcgcggccgccttcccaaat

SEQ ID NO: 293454 - DNA, 20 bp, human
gccgccacgcggttcggccc

SEQ ID NO: 293455 - DNA, 20 bp, human
gtcagtgaggtgtgagttat

SEQ ID NO: 293456 - DNA, 20 bp, human
gtgcccccggggatagagtg

SEQ ID NO: 293457 - DNA, 20 bp, human
gtcccgccccgaagcccggg

SEQ ID NO: 293458 - DNA, 20 bp, human
gggagcgcaaggtaacgctc

SEQ ID NO: 293459 - DNA, 20 bp, human
gaaccgcccgggcttcgggg

SEQ ID NO: 293460 - DNA, 20 bp, human
gagccagagacctctgagcc

SEQ ID NO: 293461 - DNA, 20 bp, human
gcagcgacgtagcagcggga

SEQ ID NO: 293462 - DNA, 20 bp, human
gttggggcgtcactttgaga

SEQ ID NO: 293463 - DNA, 20 bp, human
gaggaagccggcggccgacg

SEQ ID NO: 293464 - DNA, 20 bp, human
gtggctggcgggcgccccgt

SEQ ID NO: 293465 - DNA, 20 bp, human
gcgaactcgcgcctcggaga

SEQ ID NO: 293466 - DNA, 20 bp, human
gggtcactttgaatgtggga

SEQ ID NO: 293467 - DNA, 20 bp, human
gagaatgagtagtcaggaac

SEQ ID NO: 293468 - DNA, 20 bp, human
gtggtagacaggtatgggga

SEQ ID NO: 293469 - DNA, 20 bp, human
gttccctcacttcaaactag

SEQ ID NO: 293470 - DNA, 20 bp, human
ggagggaagaatgagtagtc

SEQ ID NO: 293471 - DNA, 20 bp, human
ggaactggtcactttgaatg

SEQ ID NO: 293472 - DNA, 20 bp, human
gagggaagatattcacgaca

SEQ ID NO: 293473 - DNA, 20 bp, human
gttgtatactgcaagttccc

SEQ ID NO: 293474 - DNA, 20 bp, human
gagcctctagtttgaagtga

SEQ ID NO: 293475 - DNA, 20 bp, human
gctgcgtggtagacaggtat

SEQ ID NO: 293476 - DNA, 20 bp, human
ggggcatcctccggagttac

SEQ ID NO: 293477 - DNA, 20 bp, human
gtcccggcccgtaactccgg

SEQ ID NO: 293478 - DNA, 20 bp, human
gccttcccggcccgtaactc

SEQ ID NO: 293479 - DNA, 20 bp, human
gcgggaaggaggggtcattt

SEQ ID NO: 293480 - DNA, 20 bp, human
gctgctgaaatccctctcta

SEQ ID NO: 293481 - DNA, 20 bp, human
gtgaggattccccgtagaga

SEQ ID NO: 293482 - DNA, 20 bp, human
gaccaccccccagccgagtc

SEQ ID NO: 293483 - DNA, 20 bp, human
ggttacgggccgggaaggag

SEQ ID NO: 293484 - DNA, 20 bp, human
ggtggtggtgtctggagact

SEQ ID NO: 293485 - DNA, 20 bp, human
gggagactgggcctacctgc

SEQ ID NO: 293486 - DNA, 20 bp, human
gccggctcacggggcgaatg

SEQ ID NO: 293487 - DNA, 20 bp, human
ggagcagagcgggtgtgacg

SEQ ID NO: 293488 - DNA, 20 bp, human
gtcgccccgtgagccggggc

SEQ ID NO: 293489 - DNA, 20 bp, human
gtcacggggcgaatgcggcg

SEQ ID NO: 293490 - DNA, 20 bp, human
ggctcccgccccggctcacg

SEQ ID NO: 293491 - DNA, 20 bp, human
ggggcgcgcggatccggaga

SEQ ID NO: 293492 - DNA, 20 bp, human
gggcgtacccggcccgagac

SEQ ID NO: 293493 - DNA, 20 bp, human
ggacgggaggagacgctcgg

SEQ ID NO: 293494 - DNA, 20 bp, human
ggggcggcggccgaggcacg

SEQ ID NO: 293495 - DNA, 20 bp, human
ggagcgtctcctcccgtctc

SEQ ID NO: 293496 - DNA, 20 bp, human
ggggcagcatctaggtctat

SEQ ID NO: 293497 - DNA, 20 bp, human
gggtctgtccgcctgtctgg

SEQ ID NO: 293498 - DNA, 20 bp, human
ggctgcgggcccgaagcgag

SEQ ID NO: 293499 - DNA, 20 bp, human
gggagctgcgaccaatgggg

SEQ ID NO: 293500 - DNA, 20 bp, human
gtccgccagcccctcgcttc

SEQ ID NO: 293501 - DNA, 20 bp, human
gggcggagctgcgaccaatg

SEQ ID NO: 293502 - DNA, 20 bp, human
ggcgctgtccgggtgggacc

SEQ ID NO: 293503 - DNA, 20 bp, human
gcccgggagcctcgctctag

SEQ ID NO: 293504 - DNA, 20 bp, human
ggctccgaccgccagacagg

SEQ ID NO: 293505 - DNA, 20 bp, human
gcggcaggcgctgtccgggt

SEQ ID NO: 293506 - DNA, 20 bp, human
gccaggacgccccatggaga

SEQ ID NO: 293507 - DNA, 20 bp, human
gggtgcttgaaccttctcca

SEQ ID NO: 293508 - DNA, 20 bp, human
gacgccgccgcgcagtggaa

SEQ ID NO: 293509 - DNA, 20 bp, human
gccatggggcgtcctggcgg

SEQ ID NO: 293510 - DNA, 20 bp, human
gcggccgttccactgcgcgg

SEQ ID NO: 293511 - DNA, 20 bp, human
ggccctgccaagcgggactc

SEQ ID NO: 293512 - DNA, 20 bp, human
gagaaggttcaagcacccgg

SEQ ID NO: 293513 - DNA, 20 bp, human
ggggtgtagtaccctggcca

SEQ ID NO: 293514 - DNA, 20 bp, human
gaatgacagtcgcgcacggg

SEQ ID NO: 293515 - DNA, 20 bp, human
gcatcccggagtgcccccat

SEQ ID NO: 293516 - DNA, 20 bp, human
gctctggggctggaccctga

SEQ ID NO: 293517 - DNA, 20 bp, human
gtgcgcgcctgtccctgagc

SEQ ID NO: 293518 - DNA, 20 bp, human
gcctccatcctggctcttgg

SEQ ID NO: 293519 - DNA, 20 bp, human
gacccccgtctcagaccctc

SEQ ID NO: 293520 - DNA, 20 bp, human
gtggcggggcttcagagcag

SEQ ID NO: 293521 - DNA, 20 bp, human
gtcatggccagctcagggac

SEQ ID NO: 293522 - DNA, 20 bp, human
ggctccctccaaagcggccc

SEQ ID NO: 293523 - DNA, 20 bp, human
gaagaccctggggacgggga

SEQ ID NO: 293524 - DNA, 20 bp, human
ggccccggggccgctttgga

SEQ ID NO: 293525 - DNA, 20 bp, human
gtggcggcacatgcgggcgg

SEQ ID NO: 293526 - DNA, 20 bp, human
gcctctggtccccaggacta

SEQ ID NO: 293527 - DNA, 20 bp, human
gctgccaaggaaccgccccc

SEQ ID NO: 293528 - DNA, 20 bp, human
ggcgcggtgcctagaaagag

SEQ ID NO: 293529 - DNA, 20 bp, human
gcgcccgagggaacagtagc

SEQ ID NO: 293530 - DNA, 20 bp, human
gccgcctccccctagtcctg

SEQ ID NO: 293531 - DNA, 20 bp, human
ggtgcctagaaagaggggag

SEQ ID NO: 293532 - DNA, 20 bp, human
ggccttggggacaaccaatg

SEQ ID NO: 293533 - DNA, 20 bp, human
gagctggcgggaatcggggg

SEQ ID NO: 293534 - DNA, 20 bp, human
gagggggagtctcattggct

SEQ ID NO: 293535 - DNA, 20 bp, human
gcgagggaacagtagccggg

SEQ ID NO: 293536 - DNA, 20 bp, human
gtcccccggtgccagctcat

SEQ ID NO: 293537 - DNA, 20 bp, human
gacaacccatgagctggcac

SEQ ID NO: 293538 - DNA, 20 bp, human
gaggatgccacgtgcttagt

SEQ ID NO: 293539 - DNA, 20 bp, human
gtggttatcacgcctaatgt

SEQ ID NO: 293540 - DNA, 20 bp, human
gcaagggtctgccaatcccc

SEQ ID NO: 293541 - DNA, 20 bp, human
gattggcagacccttgttcc

SEQ ID NO: 293542 - DNA, 20 bp, human
ggattcctggaattgttacc

SEQ ID NO: 293543 - DNA, 20 bp, human
gtgttcctggaacttctcac

SEQ ID NO: 293544 - DNA, 20 bp, human
gaaaaatcataattctagat

SEQ ID NO: 293545 - DNA, 20 bp, human
gatgaatacacaactggaga

SEQ ID NO: 293546 - DNA, 20 bp, human
gcaggggccaggagcccgga

SEQ ID NO: 293547 - DNA, 20 bp, human
gggggagtggcaggatctaa

SEQ ID NO: 293548 - DNA, 20 bp, human
ggagtggcaggatctaaggg

SEQ ID NO: 293549 - DNA, 20 bp, human
gaccagcagaggggagtggc

SEQ ID NO: 293550 - DNA, 20 bp, human
gtgcttccagcaccagcaga

SEQ ID NO: 293551 - DNA, 20 bp, human
gtggctctcagagctagagc

SEQ ID NO: 293552 - DNA, 20 bp, human
gaggcaaggcagcaggcgct

SEQ ID NO: 293553 - DNA, 20 bp, human
gctctcagagctagagcggg

SEQ ID NO: 293554 - DNA, 20 bp, human
gttacaaaagcacagatccg

SEQ ID NO: 293555 - DNA, 20 bp, human
gtgctggtgctggaagcact

SEQ ID NO: 293556 - DNA, 20 bp, human
gctaatggtgagtttaccta

SEQ ID NO: 293557 - DNA, 20 bp, human
ggtgagtttacctagggcag

SEQ ID NO: 293558 - DNA, 20 bp, human
gtgagcgcttcctaagagcg

SEQ ID NO: 293559 - DNA, 20 bp, human
gtcacagggtcaagggagtg

SEQ ID NO: 293560 - DNA, 20 bp, human
gggtaaactcaccattagca

SEQ ID NO: 293561 - DNA, 20 bp, human
gtatgtggtcttaaatctct

SEQ ID NO: 293562 - DNA, 20 bp, human
gaatcatcctctacctcaca

SEQ ID NO: 293563 - DNA, 20 bp, human
gggggaggaaatgggctaag

SEQ ID NO: 293564 - DNA, 20 bp, human
ggaggtagaggatgattatg

SEQ ID NO: 293565 - DNA, 20 bp, human
gggacctgaacagtgcccca

SEQ ID NO: 293566 - DNA, 20 bp, human
gacaaggcctacacccccgt

SEQ ID NO: 293567 - DNA, 20 bp, human
gctcgcaggaagcccaacgg

SEQ ID NO: 293568 - DNA, 20 bp, human
gcccacccaggctttgttca

SEQ ID NO: 293569 - DNA, 20 bp, human
gtctcctcctggatcttaag

SEQ ID NO: 293570 - DNA, 20 bp, human
gtcccgagaggggtggactt

SEQ ID NO: 293571 - DNA, 20 bp, human
gtggatcttaagcggagaca

SEQ ID NO: 293572 - DNA, 20 bp, human
gaacccaagtccacccctct

SEQ ID NO: 293573 - DNA, 20 bp, human
ggaaaggcgcgcgcggtggg

SEQ ID NO: 293574 - DNA, 20 bp, human
gggaagcccaacgggggtgt

SEQ ID NO: 293575 - DNA, 20 bp, human
gtctggggtcaggaccggcc

SEQ ID NO: 293576 - DNA, 20 bp, human
gactctaggggtcatccctg

SEQ ID NO: 293577 - DNA, 20 bp, human
gtgaccccatgtctcatgat

SEQ ID NO: 293578 - DNA, 20 bp, human
gactcagtgtcacactctag

SEQ ID NO: 293579 - DNA, 20 bp, human
gctccccaatcatgagacat

SEQ ID NO: 293580 - DNA, 20 bp, human
gcactggaggccggcaaggt

SEQ ID NO: 293581 - DNA, 20 bp, human
gctccagtgggtttggtccg

SEQ ID NO: 293582 - DNA, 20 bp, human
gccctggtagagccacaggt

SEQ ID NO: 293583 - DNA, 20 bp, human
gtgccggcctccagtgggtt

SEQ ID NO: 293584 - DNA, 20 bp, human
gccctccctggtagagccac

SEQ ID NO: 293585 - DNA, 20 bp, human
gaggccggcaaggtgggctc

SEQ ID NO: 293586 - DNA, 20 bp, human
ggcggcgcgcaggggatgga

SEQ ID NO: 293587 - DNA, 20 bp, human
gcccgagcgcagctccggag

SEQ ID NO: 293588 - DNA, 20 bp, human
ggggaatgacaattggagcg

SEQ ID NO: 293589 - DNA, 20 bp, human
ggaggggcagcggcgcgcag

SEQ ID NO: 293590 - DNA, 20 bp, human
gaagttagaccggagagata

SEQ ID NO: 293591 - DNA, 20 bp, human
ggagatagggtaaaggacgg

SEQ ID NO: 293592 - DNA, 20 bp, human
gagctaccgggaggcaaagc

SEQ ID NO: 293593 - DNA, 20 bp, human
gtgcgctcgggaatgacaat

SEQ ID NO: 293594 - DNA, 20 bp, human
ggaccggagagatagggtaa

SEQ ID NO: 293595 - DNA, 20 bp, human
gggcaaagccgggctcttaa

SEQ ID NO: 293596 - DNA, 20 bp, human
gcaagatggcggtagtgcgt

SEQ ID NO: 293597 - DNA, 20 bp, human
gcccctaggcgcacaacgga

SEQ ID NO: 293598 - DNA, 20 bp, human
gcctctgcggggcggaagtg

SEQ ID NO: 293599 - DNA, 20 bp, human
gcagaggggaggcaaggtgt

SEQ ID NO: 293600 - DNA, 20 bp, human
ggcagctgaaatagcggagg

SEQ ID NO: 293601 - DNA, 20 bp, human
gctccccagccgagaaaagc

SEQ ID NO: 293602 - DNA, 20 bp, human
ggaaaagctggaacccactc

SEQ ID NO: 293603 - DNA, 20 bp, human
gacagcggaagttatcgctc

SEQ ID NO: 293604 - DNA, 20 bp, human
gctggcccctaggcgcacaa

SEQ ID NO: 293605 - DNA, 20 bp, human
gggaaagaaaactggcccct

SEQ ID NO: 293606 - DNA, 20 bp, human
gtcggacgcgagagactggg

SEQ ID NO: 293607 - DNA, 20 bp, human
gcccttaggccacttcctgg

SEQ ID NO: 293608 - DNA, 20 bp, human
gagagactgggcggactggc

SEQ ID NO: 293609 - DNA, 20 bp, human
gtgactcaggcacgtcgccc

SEQ ID NO: 293610 - DNA, 20 bp, human
gggcggggctgtctcttaaa

SEQ ID NO: 293611 - DNA, 20 bp, human
gaggcacgtcgccccggatg

SEQ ID NO: 293612 - DNA, 20 bp, human
gcgggccgcgcgagcctcgc

SEQ ID NO: 293613 - DNA, 20 bp, human
gagtctcggacgcgagagac

SEQ ID NO: 293614 - DNA, 20 bp, human
ggcggtcgtggccacatccg

SEQ ID NO: 293615 - DNA, 20 bp, human
gtcccccggggaattcccga

SEQ ID NO: 293616 - DNA, 20 bp, human
ggcccccagcgctcgcgagc

SEQ ID NO: 293617 - DNA, 20 bp, human
gtaccgggcgaggggaggtg

SEQ ID NO: 293618 - DNA, 20 bp, human
ggaagccgccaagtctcggg

SEQ ID NO: 293619 - DNA, 20 bp, human
ggtctcgggcgggtcctctt

SEQ ID NO: 293620 - DNA, 20 bp, human
gttgggcgggaccacggggc

SEQ ID NO: 293621 - DNA, 20 bp, human
gggacccgcccgagacttgg

SEQ ID NO: 293622 - DNA, 20 bp, human
gcgcacccaaggactctgga

SEQ ID NO: 293623 - DNA, 20 bp, human
gcaccccggctcgcgagcgc

SEQ ID NO: 293624 - DNA, 20 bp, human
gtggagccagcagccccgcg

SEQ ID NO: 293625 - DNA, 20 bp, human
gtaaacgcggacgccacgcg

SEQ ID NO: 293626 - DNA, 20 bp, human
gcggccccgcccctgaatgg

SEQ ID NO: 293627 - DNA, 20 bp, human
ggccacacgccaaacctcta

SEQ ID NO: 293628 - DNA, 20 bp, human
ggggggatcccgtagaggtt

SEQ ID NO: 293629 - DNA, 20 bp, human
gtcgctgggggatcccgtag

SEQ ID NO: 293630 - DNA, 20 bp, human
ggtcgacgtgcgctcctctc

SEQ ID NO: 293631 - DNA, 20 bp, human
ggggtggtgcgagcgagatg

SEQ ID NO: 293632 - DNA, 20 bp, human
ggggggcggggctgcgagta

SEQ ID NO: 293633 - DNA, 20 bp, human
ggcgcggccccgcccctgaa

SEQ ID NO: 293634 - DNA, 20 bp, human
gtggtgactcgagaccagag

SEQ ID NO: 293635 - DNA, 20 bp, human
gcagccccgcccccattcag

SEQ ID NO: 293636 - DNA, 20 bp, human
gagttgttaggccctgagaa

SEQ ID NO: 293637 - DNA, 20 bp, human
gcgtggcttgcagtgagact

SEQ ID NO: 293638 - DNA, 20 bp, human
gtggctgcccgcccctaggt

SEQ ID NO: 293639 - DNA, 20 bp, human
gcaaaaggtcagtccttaag

SEQ ID NO: 293640 - DNA, 20 bp, human
gcgaggctcaaggcgggacg

SEQ ID NO: 293641 - DNA, 20 bp, human
gcccctaggtgggaacaccg

SEQ ID NO: 293642 - DNA, 20 bp, human
gaaatggagcagacccctta

SEQ ID NO: 293643 - DNA, 20 bp, human
gtggacagtctgtctatttg

SEQ ID NO: 293644 - DNA, 20 bp, human
gaggaagaggcaagttgccg

SEQ ID NO: 293645 - DNA, 20 bp, human
gcagccaggggcacttccgc

SEQ ID NO: 293646 - DNA, 20 bp, human
ggaggcggcggccgcgaaga

SEQ ID NO: 293647 - DNA, 20 bp, human
gggcccagcccggacgtaaa

SEQ ID NO: 293648 - DNA, 20 bp, human
ggaggggccgcgtgaagcgg

SEQ ID NO: 293649 - DNA, 20 bp, human
gcgcggcgaggcgctggcta

SEQ ID NO: 293650 - DNA, 20 bp, human
gaggccgccggagagagagg

SEQ ID NO: 293651 - DNA, 20 bp, human
ggggaggccgccggagagag

SEQ ID NO: 293652 - DNA, 20 bp, human
gcgaggcgctggctaggggc

SEQ ID NO: 293653 - DNA, 20 bp, human
ggccggagagcggcgcgagg

SEQ ID NO: 293654 - DNA, 20 bp, human
gtcgcctcctcccctcttcg

SEQ ID NO: 293655 - DNA, 20 bp, human
gcgttcgcgctgggtaattt

SEQ ID NO: 293656 - DNA, 20 bp, human
gtcacgtcctcctcggtgac

SEQ ID NO: 293657 - DNA, 20 bp, human
gcggcgtccccgtgcagtcc

SEQ ID NO: 293658 - DNA, 20 bp, human
ggcaatcgcgtgcccaccgc

SEQ ID NO: 293659 - DNA, 20 bp, human
gtcctggcaacctgtcaccg

SEQ ID NO: 293660 - DNA, 20 bp, human
gcaccgaggaggacgtgact

SEQ ID NO: 293661 - DNA, 20 bp, human
gtggcaacctgtcaccgagg

SEQ ID NO: 293662 - DNA, 20 bp, human
ggcacggggacgccgcgctc

SEQ ID NO: 293663 - DNA, 20 bp, human
gccagactccaggacaggac

SEQ ID NO: 293664 - DNA, 20 bp, human
gcgtgcccaccgccggagcg

SEQ ID NO: 293665 - DNA, 20 bp, human
gagggggcagggatttgctg

SEQ ID NO: 293666 - DNA, 20 bp, human
gcctgcggggaagggcgaag

SEQ ID NO: 293667 - DNA, 20 bp, human
gtccccgcaggcccgcagtc

SEQ ID NO: 293668 - DNA, 20 bp, human
ggggtggtgaagatgccctc

SEQ ID NO: 293669 - DNA, 20 bp, human
gcggggcgggaccctacccg

SEQ ID NO: 293670 - DNA, 20 bp, human
ggcaggcccgcagtctgggg

SEQ ID NO: 293671 - DNA, 20 bp, human
gaccctacccgcggcccacg

SEQ ID NO: 293672 - DNA, 20 bp, human
gagctgtagtccgcgcctcc

SEQ ID NO: 293673 - DNA, 20 bp, human
gcatgcgggtcaatgctatg

SEQ ID NO: 293674 - DNA, 20 bp, human
gtcccggcctgccccgcgtg

SEQ ID NO: 293675 - DNA, 20 bp, human
gtcttcaccaccccagactg

SEQ ID NO: 293676 - DNA, 20 bp, human
gcactggggcgagacgaatc

SEQ ID NO: 293677 - DNA, 20 bp, human
gtggggcgagacgaatctgg

SEQ ID NO: 293678 - DNA, 20 bp, human
ggggccgcctcggagtcggg

SEQ ID NO: 293679 - DNA, 20 bp, human
ggacccacccgactccgagg

SEQ ID NO: 293680 - DNA, 20 bp, human
ggactccgaggcggcccact

SEQ ID NO: 293681 - DNA, 20 bp, human
gcggaggtaagggaaacaca

SEQ ID NO: 293682 - DNA, 20 bp, human
ggaagacccacccgactccg

SEQ ID NO: 293683 - DNA, 20 bp, human
gcacacggtagagaaggcca

SEQ ID NO: 293684 - DNA, 20 bp, human
gagggctgaaccccaaggga

SEQ ID NO: 293685 - DNA, 20 bp, human
gggtgggtcttccatcccgg

SEQ ID NO: 293686 - DNA, 20 bp, human
ggggtagggtctggccggga

SEQ ID NO: 293687 - DNA, 20 bp, human
ggggtgtggactgggaacgt

SEQ ID NO: 293688 - DNA, 20 bp, human
gggcggggatggcggagcaa

SEQ ID NO: 293689 - DNA, 20 bp, human
gcagccgggtagggtctggc

SEQ ID NO: 293690 - DNA, 20 bp, human
ggaaggcattcgccgcctgg

SEQ ID NO: 293691 - DNA, 20 bp, human
ggaacctgagatagaggcga

SEQ ID NO: 293692 - DNA, 20 bp, human
gaatgggagctggacgagga

SEQ ID NO: 293693 - DNA, 20 bp, human
ggtgcgccgggtggtctcgc

SEQ ID NO: 293694 - DNA, 20 bp, human
gagaccacccggcgcacgcc

SEQ ID NO: 293695 - DNA, 20 bp, human
gcgcctgggggcgctgacgc

SEQ ID NO: 293696 - DNA, 20 bp, human
gaaccagccctcatctctat

SEQ ID NO: 293697 - DNA, 20 bp, human
gtccggaagtatcttcccgg

SEQ ID NO: 293698 - DNA, 20 bp, human
gaggcgctgtgcccgccccc

SEQ ID NO: 293699 - DNA, 20 bp, human
gagccgggccggcccatcgg

SEQ ID NO: 293700 - DNA, 20 bp, human
gggttccggaagtatcttcc

SEQ ID NO: 293701 - DNA, 20 bp, human
gacttgctgcggaggaccgt

SEQ ID NO: 293702 - DNA, 20 bp, human
gggtccccgggcgctggttg

SEQ ID NO: 293703 - DNA, 20 bp, human
ggcacagcgcctcccccgcg

SEQ ID NO: 293704 - DNA, 20 bp, human
gaggagcggcagctacacaa

SEQ ID NO: 293705 - DNA, 20 bp, human
gcgcccccaaccagcgcccg

SEQ ID NO: 293706 - DNA, 20 bp, human
gtacggtgcggccccggacg

SEQ ID NO: 293707 - DNA, 20 bp, human
gtgtctggggaccccgtccg

SEQ ID NO: 293708 - DNA, 20 bp, human
gtccggggccgcaccgtaaa

SEQ ID NO: 293709 - DNA, 20 bp, human
gtccccagacacggccttcc

SEQ ID NO: 293710 - DNA, 20 bp, human
gaagtgcgcccgctgaggtt

SEQ ID NO: 293711 - DNA, 20 bp, human
gccggcgtgccacgcgcgga

SEQ ID NO: 293712 - DNA, 20 bp, human
ggaaaggcgacacccattta

SEQ ID NO: 293713 - DNA, 20 bp, human
gcgccgggaaggccgtgtct

SEQ ID NO: 293714 - DNA, 20 bp, human
gcagaaaagtgcgcccgctg

SEQ ID NO: 293715 - DNA, 20 bp, human
ggcacagccggtcccggctg

SEQ ID NO: 293716 - DNA, 20 bp, human
ggggactggtagttctctct

SEQ ID NO: 293717 - DNA, 20 bp, human
gccagccggccggacaccgg

SEQ ID NO: 293718 - DNA, 20 bp, human
ggggctgcgggatgaagcat

SEQ ID NO: 293719 - DNA, 20 bp, human
ggggcgaggtgcgtgaaatg

SEQ ID NO: 293720 - DNA, 20 bp, human
gacaccggcggggacgaggc

SEQ ID NO: 293721 - DNA, 20 bp, human
gaggccagccggccggacac

SEQ ID NO: 293722 - DNA, 20 bp, human
gaaaggggacgcggtcagag

SEQ ID NO: 293723 - DNA, 20 bp, human
gggtcagagtggcagctcgc

SEQ ID NO: 293724 - DNA, 20 bp, human
ggcgaactccatctcccagg

SEQ ID NO: 293725 - DNA, 20 bp, human
gcgaggtgcgtgaaatgggg

SEQ ID NO: 293726 - DNA, 20 bp, human
gaaaggggctgggatcgcgt

SEQ ID NO: 293727 - DNA, 20 bp, human
gctggcgcgtagggaggcta

SEQ ID NO: 293728 - DNA, 20 bp, human
gaggagcttcccaacgccgc

SEQ ID NO: 293729 - DNA, 20 bp, human
ggccgcggggctggcgcgta

SEQ ID NO: 293730 - DNA, 20 bp, human
gaagctgattcgcagattga

SEQ ID NO: 293731 - DNA, 20 bp, human
ggggctgggatcgcgtgggg

SEQ ID NO: 293732 - DNA, 20 bp, human
ggcggggctggcgcgtaggg

SEQ ID NO: 293733 - DNA, 20 bp, human
gctgggatcgcgtggggagg

SEQ ID NO: 293734 - DNA, 20 bp, human
ggtggggaggaggaacgaaa

SEQ ID NO: 293735 - DNA, 20 bp, human
gggaatcccgcgtgggcagg

SEQ ID NO: 293736 - DNA, 20 bp, human
gggaagggatttgttgtgaa

SEQ ID NO: 293737 - DNA, 20 bp, human
gggagctttctggagtaaga

SEQ ID NO: 293738 - DNA, 20 bp, human
gagaaagctcctgcatacat

SEQ ID NO: 293739 - DNA, 20 bp, human
ggtaactcttattacttcaa

SEQ ID NO: 293740 - DNA, 20 bp, human
gtttgcatttaactgtatca

SEQ ID NO: 293741 - DNA, 20 bp, human
gcatttaactgtatcaggga

SEQ ID NO: 293742 - DNA, 20 bp, human
ggtcagctcggttttgcagt

SEQ ID NO: 293743 - DNA, 20 bp, human
gagctcggttttgcagtagg

SEQ ID NO: 293744 - DNA, 20 bp, human
ggtgcagtgtcacaagtagc

SEQ ID NO: 293745 - DNA, 20 bp, human
gcgtatcagcctatgtatgc

SEQ ID NO: 293746 - DNA, 20 bp, human
gtccggcgggagcggagcac

SEQ ID NO: 293747 - DNA, 20 bp, human
gcgccccggcgtcacgcggt

SEQ ID NO: 293748 - DNA, 20 bp, human
gaggctgggcccgcttccgg

SEQ ID NO: 293749 - DNA, 20 bp, human
gagcggagcacggggtgatc

SEQ ID NO: 293750 - DNA, 20 bp, human
gcaccgctcgtgggaggtcg

SEQ ID NO: 293751 - DNA, 20 bp, human
gcggggcgggcgctctacca

SEQ ID NO: 293752 - DNA, 20 bp, human
ggcccagcctcctgcttttc

SEQ ID NO: 293753 - DNA, 20 bp, human
gacgcggtaggcggaagttc

SEQ ID NO: 293754 - DNA, 20 bp, human
gaggaggctgggcccgcttc

SEQ ID NO: 293755 - DNA, 20 bp, human
gctcgtgcaccgctcgtggg

SEQ ID NO: 293756 - DNA, 20 bp, human
gccagcccgcgctgccgtta

SEQ ID NO: 293757 - DNA, 20 bp, human
ggagcgcgggcgccccctaa

SEQ ID NO: 293758 - DNA, 20 bp, human
gcccactgcgtcctcagggg

SEQ ID NO: 293759 - DNA, 20 bp, human
gcgccccctaacggcagcgc

SEQ ID NO: 293760 - DNA, 20 bp, human
ggggcggaggcgggacgtag

SEQ ID NO: 293761 - DNA, 20 bp, human
gtgcgctggctgagttcctc

SEQ ID NO: 293762 - DNA, 20 bp, human
ggggccccccactatatctc

SEQ ID NO: 293763 - DNA, 20 bp, human
gagccccagtcccgcccctt

SEQ ID NO: 293764 - DNA, 20 bp, human
gaggcctgagatatagtggg

SEQ ID NO: 293765 - DNA, 20 bp, human
gcgcgcggctccgactgcgc

SEQ ID NO: 293766 - DNA, 20 bp, human
gaagtgcgagtggatccaaa

SEQ ID NO: 293767 - DNA, 20 bp, human
gcggcctccggggtaaaggt

SEQ ID NO: 293768 - DNA, 20 bp, human
gcaaagggtcgagcggagtg

SEQ ID NO: 293769 - DNA, 20 bp, human
gggaaacgccggtttctccg

SEQ ID NO: 293770 - DNA, 20 bp, human
gtggggagccccggagaaac

SEQ ID NO: 293771 - DNA, 20 bp, human
gcgtccagagtcaaaggccc

SEQ ID NO: 293772 - DNA, 20 bp, human
gtggaagagggcggcctccg

SEQ ID NO: 293773 - DNA, 20 bp, human
gtggctccgcggcgactcct

SEQ ID NO: 293774 - DNA, 20 bp, human
gagggcggcctccggggtaa

SEQ ID NO: 293775 - DNA, 20 bp, human
gcgtaacgtgcgttcgctgg

SEQ ID NO: 293776 - DNA, 20 bp, human
gctcccgggctccgacgcta

SEQ ID NO: 293777 - DNA, 20 bp, human
gctgacgtcaagccccggac

SEQ ID NO: 293778 - DNA, 20 bp, human
gaggcactgacgtcaagccc

SEQ ID NO: 293779 - DNA, 20 bp, human
gtaactactcctggcagcac

SEQ ID NO: 293780 - DNA, 20 bp, human
ggggctccgacgctaggggg

SEQ ID NO: 293781 - DNA, 20 bp, human
gtgcaagcgtgccgcgaggc

SEQ ID NO: 293782 - DNA, 20 bp, human
gcggtggcgctaactactcc

SEQ ID NO: 293783 - DNA, 20 bp, human
gctccccgacccgcggggac

SEQ ID NO: 293784 - DNA, 20 bp, human
gctgctgctcggctctccgt

SEQ ID NO: 293785 - DNA, 20 bp, human
gtgaggctcgggtcccagtc

SEQ ID NO: 293786 - DNA, 20 bp, human
gaaggctagtagacgggaag

SEQ ID NO: 293787 - DNA, 20 bp, human
ggggagggaagagacgctga

SEQ ID NO: 293788 - DNA, 20 bp, human
ggacgctgaaggctagtaga

SEQ ID NO: 293789 - DNA, 20 bp, human
ggggcatcagccaatcagag

SEQ ID NO: 293790 - DNA, 20 bp, human
gctccaggagcctctctgat

SEQ ID NO: 293791 - DNA, 20 bp, human
gctaacctagccgggacgga

SEQ ID NO: 293792 - DNA, 20 bp, human
gccagagcccgcccgatact

SEQ ID NO: 293793 - DNA, 20 bp, human
ggggctctggctaacctagc

SEQ ID NO: 293794 - DNA, 20 bp, human
gccaatcagcacccagtatc

SEQ ID NO: 293795 - DNA, 20 bp, human
gtcagcacccagtatcgggc

SEQ ID NO: 293796 - DNA, 20 bp, human
ggcggggtggacacgcgtcc

SEQ ID NO: 293797 - DNA, 20 bp, human
ggggatatgtagttcgcgac

SEQ ID NO: 293798 - DNA, 20 bp, human
ggtgcccggcgacaggtcgt

SEQ ID NO: 293799 - DNA, 20 bp, human
gaggttccagccaaggtgta

SEQ ID NO: 293800 - DNA, 20 bp, human
gtgagcctggcccgacgcac

SEQ ID NO: 293801 - DNA, 20 bp, human
gtagttcgcgacaggacgag

SEQ ID NO: 293802 - DNA, 20 bp, human
gcagccaaggtgtagggcga

SEQ ID NO: 293803 - DNA, 20 bp, human
ggcccatcaaaggggcgcac

SEQ ID NO: 293804 - DNA, 20 bp, human
ggacgagcggaaatactgcc

SEQ ID NO: 293805 - DNA, 20 bp, human
gaggggattggcccgtgcgt

SEQ ID NO: 293806 - DNA, 20 bp, human
gccctgtaggggtcgacgat

SEQ ID NO: 293807 - DNA, 20 bp, human
ggaggcccgcccagagaccg

SEQ ID NO: 293808 - DNA, 20 bp, human
gcataggccccgtggaggaa

SEQ ID NO: 293809 - DNA, 20 bp, human
gcagtgggtgattgcggcac

SEQ ID NO: 293810 - DNA, 20 bp, human
gcgggacagcgggcgggaaa

SEQ ID NO: 293811 - DNA, 20 bp, human
gacccctacagggcgcgcag

SEQ ID NO: 293812 - DNA, 20 bp, human
gacccactgcgcgccctgta

SEQ ID NO: 293813 - DNA, 20 bp, human
gggctcgcgttcccgcccga

SEQ ID NO: 293814 - DNA, 20 bp, human
gccgcctcgtctccctcggg

SEQ ID NO: 293815 - DNA, 20 bp, human
gcactcgcagcctcggtctc

SEQ ID NO: 293816 - DNA, 20 bp, human
ggaccctcccaagttcctat

SEQ ID NO: 293817 - DNA, 20 bp, human
gaggagaggctccgcccccg

SEQ ID NO: 293818 - DNA, 20 bp, human
gaagcaggaggtgggcgata

SEQ ID NO: 293819 - DNA, 20 bp, human
gaggaacttgggagggtcgc

SEQ ID NO: 293820 - DNA, 20 bp, human
gtacatccctgcaagggctg

SEQ ID NO: 293821 - DNA, 20 bp, human
gagctgccccataggaactt

SEQ ID NO: 293822 - DNA, 20 bp, human
ggccgccacggcaaagcagg

SEQ ID NO: 293823 - DNA, 20 bp, human
gcccacctcctgctttgccg

SEQ ID NO: 293824 - DNA, 20 bp, human
gccggagcggagcgcaccta

SEQ ID NO: 293825 - DNA, 20 bp, human
ggaggctccgcccccgaggg

SEQ ID NO: 293826 - DNA, 20 bp, human
gagtccggggtcttcttgca

SEQ ID NO: 293827 - DNA, 20 bp, human
gaaacccggcagggaaaatt

SEQ ID NO: 293828 - DNA, 20 bp, human
gctcccttgcaagaagaccc

SEQ ID NO: 293829 - DNA, 20 bp, human
ggaaaatttggcagagtccg

SEQ ID NO: 293830 - DNA, 20 bp, human
gcgcgcgcgcggggcaccct

SEQ ID NO: 293831 - DNA, 20 bp, human
gctggggcgcgcccccttta

SEQ ID NO: 293832 - DNA, 20 bp, human
gcgcgcgcgcgccggcagtt

SEQ ID NO: 293833 - DNA, 20 bp, human
ggccaggccccgccccttaa

SEQ ID NO: 293834 - DNA, 20 bp, human
gcacgtccctggccacgtcg

SEQ ID NO: 293835 - DNA, 20 bp, human
gaggaaagaaaagatcccca

SEQ ID NO: 293836 - DNA, 20 bp, human
gtcgccgggccgcccagtcc

SEQ ID NO: 293837 - DNA, 20 bp, human
gagccgggcgctgggatggg

SEQ ID NO: 293838 - DNA, 20 bp, human
ggggcggcccggcgacgcgg

SEQ ID NO: 293839 - DNA, 20 bp, human
ggggcgggaggcgggatctc

SEQ ID NO: 293840 - DNA, 20 bp, human
gcgggagccgggcgctggga

SEQ ID NO: 293841 - DNA, 20 bp, human
gggaaggcagagggcacttg

SEQ ID NO: 293842 - DNA, 20 bp, human
gactgggcggcccggcgacg

SEQ ID NO: 293843 - DNA, 20 bp, human
ggggcgacatgggtcgtggc

SEQ ID NO: 293844 - DNA, 20 bp, human
gagaagcccccccgcgtcgc

SEQ ID NO: 293845 - DNA, 20 bp, human
gcgcccggccaagagtgcgt

SEQ ID NO: 293846 - DNA, 20 bp, human
gccgcgagaacgccgctcta

SEQ ID NO: 293847 - DNA, 20 bp, human
gaacgccggggagacgctct

SEQ ID NO: 293848 - DNA, 20 bp, human
gaggaaatggtcaccttcgg

SEQ ID NO: 293849 - DNA, 20 bp, human
gtctccccggcgtttggagt

SEQ ID NO: 293850 - DNA, 20 bp, human
ggcgccgggacaaaaagggt

SEQ ID NO: 293851 - DNA, 20 bp, human
gcaaacccgaaagtccctgg

SEQ ID NO: 293852 - DNA, 20 bp, human
gggtcccactccaaacgccg

SEQ ID NO: 293853 - DNA, 20 bp, human
ggaacgccgctctatggctg

SEQ ID NO: 293854 - DNA, 20 bp, human
gggccagactaaacctccga

SEQ ID NO: 293855 - DNA, 20 bp, human
gcgccgcgccgggacaaaaa

SEQ ID NO: 293856 - DNA, 20 bp, human
gaggctcactcgggcgcgga

SEQ ID NO: 293857 - DNA, 20 bp, human
gaagcgaggtaggctcactc

SEQ ID NO: 293858 - DNA, 20 bp, human
ggcggggcgcggagaagtgg

SEQ ID NO: 293859 - DNA, 20 bp, human
gtcacggcgtgacccggggt

SEQ ID NO: 293860 - DNA, 20 bp, human
gagcgctgcggctaaagcga

SEQ ID NO: 293861 - DNA, 20 bp, human
ggtgcaacgaggtacggggc

SEQ ID NO: 293862 - DNA, 20 bp, human
gccccggcgcttggggaagt

SEQ ID NO: 293863 - DNA, 20 bp, human
gcggggcgggagtggagacg

SEQ ID NO: 293864 - DNA, 20 bp, human
gtccgccgctgcgcaaaccc

SEQ ID NO: 293865 - DNA, 20 bp, human
gcggcaaccagctgtaagcg

SEQ ID NO: 293866 - DNA, 20 bp, human
gcgcgcacgcgcggatgcgt

SEQ ID NO: 293867 - DNA, 20 bp, human
gccccgtcggcgttcttcca

SEQ ID NO: 293868 - DNA, 20 bp, human
gggcgggcggcctgacgcga

SEQ ID NO: 293869 - DNA, 20 bp, human
ggcggggcgcgggcgattcg

SEQ ID NO: 293870 - DNA, 20 bp, human
ggcggtgtgtccgcgttaga

SEQ ID NO: 293871 - DNA, 20 bp, human
ggagagcggtaagaagcgca

SEQ ID NO: 293872 - DNA, 20 bp, human
gagggcgcgcggaggaggat

SEQ ID NO: 293873 - DNA, 20 bp, human
ggcgtcactcccctctaacg

SEQ ID NO: 293874 - DNA, 20 bp, human
gtcacgcgcgcccgggagag

SEQ ID NO: 293875 - DNA, 20 bp, human
gcagggaggcctgaaggggg

SEQ ID NO: 293876 - DNA, 20 bp, human
gacacaggtaatgttggggg

SEQ ID NO: 293877 - DNA, 20 bp, human
ggcaatgagggcaggaacgg

SEQ ID NO: 293878 - DNA, 20 bp, human
ggggcgcatcccggagatgg

SEQ ID NO: 293879 - DNA, 20 bp, human
gggcccgaggaggtatgggg

SEQ ID NO: 293880 - DNA, 20 bp, human
ggccacacaggtaatgttgg

SEQ ID NO: 293881 - DNA, 20 bp, human
ggagggcaggaacggaggtg

SEQ ID NO: 293882 - DNA, 20 bp, human
gctccctgccccgccatctc

SEQ ID NO: 293883 - DNA, 20 bp, human
gcggcggcccgaggaggtat

SEQ ID NO: 293884 - DNA, 20 bp, human
gtctgcacacaactcccggg

SEQ ID NO: 293885 - DNA, 20 bp, human
gtgcagagctgacttttgga

SEQ ID NO: 293886 - DNA, 20 bp, human
gcagcccgcacaggagcgaa

SEQ ID NO: 293887 - DNA, 20 bp, human
gcctgtaggggcttcatcaa

SEQ ID NO: 293888 - DNA, 20 bp, human
gcaacccaggaccagtgctg

SEQ ID NO: 293889 - DNA, 20 bp, human
gggtcagctgcggactgcaa

SEQ ID NO: 293890 - DNA, 20 bp, human
ggtgcatggtgctctgggat

SEQ ID NO: 293891 - DNA, 20 bp, human
gaacgtcttccggtcagctg

SEQ ID NO: 293892 - DNA, 20 bp, human
gaatgaaaggcaacgtcttc

SEQ ID NO: 293893 - DNA, 20 bp, human
gttacccttcgctcctgtgc

SEQ ID NO: 293894 - DNA, 20 bp, human
gggggagcagatagatgctc

SEQ ID NO: 293895 - DNA, 20 bp, human
gagggctggtcgcctagtaa

SEQ ID NO: 293896 - DNA, 20 bp, human
gtcgcccgggagtcggaagg

SEQ ID NO: 293897 - DNA, 20 bp, human
gtggccccccgggcgagggc

SEQ ID NO: 293898 - DNA, 20 bp, human
gagccaatgagcggcggaag

SEQ ID NO: 293899 - DNA, 20 bp, human
gtcggctaggcggctggaaa

SEQ ID NO: 293900 - DNA, 20 bp, human
ggctaggcggctggaaacgg

SEQ ID NO: 293901 - DNA, 20 bp, human
ggggcccgggtgtgtggcgg

SEQ ID NO: 293902 - DNA, 20 bp, human
gcggctgccgccggtgactc

SEQ ID NO: 293903 - DNA, 20 bp, human
gagccgcttccgccgctcat

SEQ ID NO: 293904 - DNA, 20 bp, human
gcgcctccctgagtcaccgg

SEQ ID NO: 293905 - DNA, 20 bp, human
ggctccgaggggggcgggtc

SEQ ID NO: 293906 - DNA, 20 bp, human
ggcaggccccggggagattg

SEQ ID NO: 293907 - DNA, 20 bp, human
ggccccccgcgctctggagc

SEQ ID NO: 293908 - DNA, 20 bp, human
gccggccggggtagggaagt

SEQ ID NO: 293909 - DNA, 20 bp, human
gcgctccgccccaatctccc

SEQ ID NO: 293910 - DNA, 20 bp, human
ggctccgctcccggccacgg

SEQ ID NO: 293911 - DNA, 20 bp, human
gtcgccccgctccagagcgc

SEQ ID NO: 293912 - DNA, 20 bp, human
gttggggcggagcgctgcga

SEQ ID NO: 293913 - DNA, 20 bp, human
gccccgctccagagcgcggg

SEQ ID NO: 293914 - DNA, 20 bp, human
gcggccgcgggtggtgcgga

SEQ ID NO: 293915 - DNA, 20 bp, human
ggagaccagggatgatgcca

SEQ ID NO: 293916 - DNA, 20 bp, human
gaggaaacgctgtaccacta

SEQ ID NO: 293917 - DNA, 20 bp, human
gcggtccggtagatgggtaa

SEQ ID NO: 293918 - DNA, 20 bp, human
gagcccgagccggcgctcat

SEQ ID NO: 293919 - DNA, 20 bp, human
gcactggccgcggtccctag

SEQ ID NO: 293920 - DNA, 20 bp, human
gtcccggcaacagcccgagc

SEQ ID NO: 293921 - DNA, 20 bp, human
ggaagctggccaatcatagg

SEQ ID NO: 293922 - DNA, 20 bp, human
gggctgcggcgcgtgctcat

SEQ ID NO: 293923 - DNA, 20 bp, human
ggtgctcattggctggtgta

SEQ ID NO: 293924 - DNA, 20 bp, human
gcagcctatgagcgccggct

SEQ ID NO: 293925 - DNA, 20 bp, human
gcgccggctcgggctgttgc

SEQ ID NO: 293926 - DNA, 20 bp, human
gcccaccgcgcgccgcgatt

SEQ ID NO: 293927 - DNA, 20 bp, human
gattgggcggggacaaacgc

SEQ ID NO: 293928 - DNA, 20 bp, human
gcgggccgtgcggtgttgat

SEQ ID NO: 293929 - DNA, 20 bp, human
ggctgccgcgaccaacccga

SEQ ID NO: 293930 - DNA, 20 bp, human
gccaaggcccagctgccgtc

SEQ ID NO: 293931 - DNA, 20 bp, human
gggtcagcgggcacgtgggt

SEQ ID NO: 293932 - DNA, 20 bp, human
gggcgccggcgtgtccccgc

SEQ ID NO: 293933 - DNA, 20 bp, human
ggccggcctcgcctcttcat

SEQ ID NO: 293934 - DNA, 20 bp, human
gcggcagccaatggcagtcg

SEQ ID NO: 293935 - DNA, 20 bp, human
gcgccggtctgccaatgaag

SEQ ID NO: 293936 - DNA, 20 bp, human
gcgcacttggtgagtcacgt

SEQ ID NO: 293937 - DNA, 20 bp, human
ggaccgctggggcccgcact

SEQ ID NO: 293938 - DNA, 20 bp, human
gtccgcgctgtggttaactt

SEQ ID NO: 293939 - DNA, 20 bp, human
gcaccaagtgcgggccccag

SEQ ID NO: 293940 - DNA, 20 bp, human
ggccggctctccctgcgcga

SEQ ID NO: 293941 - DNA, 20 bp, human
ggcgaaggcgcgcgcaccgc

SEQ ID NO: 293942 - DNA, 20 bp, human
ggggcttacaaacagcttaa

SEQ ID NO: 293943 - DNA, 20 bp, human
ggcgcggcgcagtgatcggg

SEQ ID NO: 293944 - DNA, 20 bp, human
gggaccccagccagcgcttc

SEQ ID NO: 293945 - DNA, 20 bp, human
gcgcctcaccctcccgtcga

SEQ ID NO: 293946 - DNA, 20 bp, human
gcagacgccattaccactct

SEQ ID NO: 293947 - DNA, 20 bp, human
gggtcgtaggcgctagctct

SEQ ID NO: 293948 - DNA, 20 bp, human
ggcgctagctctgggcgcag

SEQ ID NO: 293949 - DNA, 20 bp, human
gcaaaatccaagcgcttcgg

SEQ ID NO: 293950 - DNA, 20 bp, human
gcagttggggtcggagtcgg

SEQ ID NO: 293951 - DNA, 20 bp, human
gcagtggccgaagtggaagt

SEQ ID NO: 293952 - DNA, 20 bp, human
gggacctcggccagtgtgag

SEQ ID NO: 293953 - DNA, 20 bp, human
gtcggcgtaacggcactaag

SEQ ID NO: 293954 - DNA, 20 bp, human
gaagcaaaatccaagcgctt

SEQ ID NO: 293955 - DNA, 20 bp, human
ggtaacggcactaaggggcg

SEQ ID NO: 293956 - DNA, 20 bp, human
gaggatatgtaaacattgtc

SEQ ID NO: 293957 - DNA, 20 bp, human
gcttcctagaagagaccccc

SEQ ID NO: 293958 - DNA, 20 bp, human
gtaaaacatatgctaacatc

SEQ ID NO: 293959 - DNA, 20 bp, human
gggagttaagagcaatgttt

SEQ ID NO: 293960 - DNA, 20 bp, human
gcaggttttgggataggtgg

SEQ ID NO: 293961 - DNA, 20 bp, human
gtaaagaaacttcgtaaggg

SEQ ID NO: 293962 - DNA, 20 bp, human
gttataaagaaacttcgtaa

SEQ ID NO: 293963 - DNA, 20 bp, human
ggtacctgggggtctcttct

SEQ ID NO: 293964 - DNA, 20 bp, human
ggttaagagcaatgttttgg

SEQ ID NO: 293965 - DNA, 20 bp, human
gagtacattctcgagggtgg

SEQ ID NO: 293966 - DNA, 20 bp, human
ggggcgaggcgcaacgaggc

SEQ ID NO: 293967 - DNA, 20 bp, human
ggcgagctgcgtggagtcgt

SEQ ID NO: 293968 - DNA, 20 bp, human
ggcgacgtgacgctttcttc

SEQ ID NO: 293969 - DNA, 20 bp, human
gactccacgcagctcgccct

SEQ ID NO: 293970 - DNA, 20 bp, human
ggcagctcgcccttggtaag

SEQ ID NO: 293971 - DNA, 20 bp, human
gagaagaggcgggtataaag

SEQ ID NO: 293972 - DNA, 20 bp, human
gctccccgaccccttaccaa

SEQ ID NO: 293973 - DNA, 20 bp, human
gcacaggcgtcgtgcagctg

SEQ ID NO: 293974 - DNA, 20 bp, human
gctcgcccttggtaaggggt

SEQ ID NO: 293975 - DNA, 20 bp, human
ggaagccgacggggcgaggc

SEQ ID NO: 293976 - DNA, 20 bp, human
ggcggccccgcccgattcgg

SEQ ID NO: 293977 - DNA, 20 bp, human
ggcggagggtgggtcgatgg

SEQ ID NO: 293978 - DNA, 20 bp, human
gggagccgcgcgcggagggt

SEQ ID NO: 293979 - DNA, 20 bp, human
ggccccgcccgattcggggg

SEQ ID NO: 293980 - DNA, 20 bp, human
gagggtgggtcgatgggggt

SEQ ID NO: 293981 - DNA, 20 bp, human
gcgcgcggagggtgggtcga

SEQ ID NO: 293982 - DNA, 20 bp, human
gggggccgcgccttccgctg

SEQ ID NO: 293983 - DNA, 20 bp, human
gaactctgatacatagtaaa

SEQ ID NO: 293984 - DNA, 20 bp, human
ggccccgcccccgaatcggg

SEQ ID NO: 293985 - DNA, 20 bp, human
gggcgcggccccgcccgatt

SEQ ID NO: 293986 - DNA, 20 bp, human
gacctggttgaggtctgcgg

SEQ ID NO: 293987 - DNA, 20 bp, human
gaagaggagctggtgtccgt

SEQ ID NO: 293988 - DNA, 20 bp, human
ggcgacctggttgaggtctg

SEQ ID NO: 293989 - DNA, 20 bp, human
gagtggagaccgagctaaat

SEQ ID NO: 293990 - DNA, 20 bp, human
gagctggtgtccgtgggtgg

SEQ ID NO: 293991 - DNA, 20 bp, human
gctagacactgacacctctg

SEQ ID NO: 293992 - DNA, 20 bp, human
gtcccccgcagacctcaacc

SEQ ID NO: 293993 - DNA, 20 bp, human
ggtgggtggtggagtcaaac

SEQ ID NO: 293994 - DNA, 20 bp, human
ggacaccccgcggaaggatc

SEQ ID NO: 293995 - DNA, 20 bp, human
gaccggcggtgcacgtttaa

SEQ ID NO: 293996 - DNA, 20 bp, human
gtgcagggaaggaccgtaaa

SEQ ID NO: 293997 - DNA, 20 bp, human
gctgtggtgctgatcaacga

SEQ ID NO: 293998 - DNA, 20 bp, human
gtctacggacatttccgcaa

SEQ ID NO: 293999 - DNA, 20 bp, human
ggcacctgagataaacgctg

SEQ ID NO: 294000 - DNA, 20 bp, human
ggcaagagcgattttaccag

SEQ ID NO: 294001 - DNA, 20 bp, human
ggcaggcgtaacttgcgcag

SEQ ID NO: 294002 - DNA, 20 bp, human
gtcacatgaacggatatcgc

SEQ ID NO: 294003 - DNA, 20 bp, human
gtttaatatgagtccagcga

SEQ ID NO: 294004 - DNA, 20 bp, human
ggcggaaggtctcacaggtt

SEQ ID NO: 294005 - DNA, 20 bp, human
gcatgaacggatatcgccgg

SEQ ID NO: 294006 - DNA, 20 bp, human
gcgtcccgctcccatctcgg

SEQ ID NO: 294007 - DNA, 20 bp, human
ggggcagctagcaagttaag

SEQ ID NO: 294008 - DNA, 20 bp, human
ggcgcccagcagccaaccac

SEQ ID NO: 294009 - DNA, 20 bp, human
gagcaagttaagtggagcca

SEQ ID NO: 294010 - DNA, 20 bp, human
gccgaggccgccaccgagat

SEQ ID NO: 294011 - DNA, 20 bp, human
ggccaattctagccggtggt

SEQ ID NO: 294012 - DNA, 20 bp, human
gggctgacgtgagtcaacaa

SEQ ID NO: 294013 - DNA, 20 bp, human
ggacgcaggccaattctagc

SEQ ID NO: 294014 - DNA, 20 bp, human
gggcgcgtctgtcgggggaa

SEQ ID NO: 294015 - DNA, 20 bp, human
gtgctgggcgcgtctgtcgg

SEQ ID NO: 294016 - DNA, 20 bp, human
gggtggtaggagcattgctc

SEQ ID NO: 294017 - DNA, 20 bp, human
ggcagcaacactggtctccg

SEQ ID NO: 294018 - DNA, 20 bp, human
gcattgtgagtgacaactga

SEQ ID NO: 294019 - DNA, 20 bp, human
gatgggtggagcttgtcttg

SEQ ID NO: 294020 - DNA, 20 bp, human
gggggcgtggagccgaaccc

SEQ ID NO: 294021 - DNA, 20 bp, human
ggctggtggtggtgccgggg

SEQ ID NO: 294022 - DNA, 20 bp, human
gaacactggtctccggggcg

SEQ ID NO: 294023 - DNA, 20 bp, human
ggcgtaaggcacgcaggcgg

SEQ ID NO: 294024 - DNA, 20 bp, human
gcgtgccttacgccccttcc

SEQ ID NO: 294025 - DNA, 20 bp, human
gggggcgtaaggcacgcagg

SEQ ID NO: 294026 - DNA, 20 bp, human
gcctagctgcagagattaaa

SEQ ID NO: 294027 - DNA, 20 bp, human
gaaggcttggctgtatcctc

SEQ ID NO: 294028 - DNA, 20 bp, human
gtgcgtcgtgatcagacgag

SEQ ID NO: 294029 - DNA, 20 bp, human
gtggggtctgagtaggaaac

SEQ ID NO: 294030 - DNA, 20 bp, human
gccactgctgtttaaaaggc

SEQ ID NO: 294031 - DNA, 20 bp, human
gaaaagcggtatcactagcg

SEQ ID NO: 294032 - DNA, 20 bp, human
gctgctgtttaaaaggccgg

SEQ ID NO: 294033 - DNA, 20 bp, human
ggcggtatcactagcgtgga

SEQ ID NO: 294034 - DNA, 20 bp, human
gcagataacaacttcgtaca

SEQ ID NO: 294035 - DNA, 20 bp, human
gcttttaaacagcagtgggg

SEQ ID NO: 294036 - DNA, 20 bp, human
ggggagctggagatcgccgc

SEQ ID NO: 294037 - DNA, 20 bp, human
gcagcgcagtccagttgtgt

SEQ ID NO: 294038 - DNA, 20 bp, human
gccgccgggtacccgggtga

SEQ ID NO: 294039 - DNA, 20 bp, human
gcgcccctcacccgggtacc

SEQ ID NO: 294040 - DNA, 20 bp, human
gttctctcctgggcgacttg

SEQ ID NO: 294041 - DNA, 20 bp, human
gccatcgcgcgcgtctgaag

SEQ ID NO: 294042 - DNA, 20 bp, human
ggctctgggatgttctctcc

SEQ ID NO: 294043 - DNA, 20 bp, human
gcagcagtttggagccacaa

SEQ ID NO: 294044 - DNA, 20 bp, human
gaccaggcgcgtcaaagtgc

SEQ ID NO: 294045 - DNA, 20 bp, human
gagaaacaaagttgttgctc

SEQ ID NO: 294046 - DNA, 20 bp, human
gaggccccggagcatcggaa

SEQ ID NO: 294047 - DNA, 20 bp, human
ggggcctccgagcaacccag

SEQ ID NO: 294048 - DNA, 20 bp, human
gtgcccgctgggttgctcgg

SEQ ID NO: 294049 - DNA, 20 bp, human
gcgtgacgagcgctcctccc

SEQ ID NO: 294050 - DNA, 20 bp, human
gcggctggaggctcccggag

SEQ ID NO: 294051 - DNA, 20 bp, human
gcgcgcgcgccacccaggcg

SEQ ID NO: 294052 - DNA, 20 bp, human
ggctgcgaagactcgctctt

SEQ ID NO: 294053 - DNA, 20 bp, human
gcgccctttccgatgctccg

SEQ ID NO: 294054 - DNA, 20 bp, human
gcgctcttcgggagctcgaa

SEQ ID NO: 294055 - DNA, 20 bp, human
gactgccagaatcgcctctc

SEQ ID NO: 294056 - DNA, 20 bp, human
gccggcggccgcaggatcta

SEQ ID NO: 294057 - DNA, 20 bp, human
gagacatccagcaacgaaat

SEQ ID NO: 294058 - DNA, 20 bp, human
gaacgaaatcgggagatgga

SEQ ID NO: 294059 - DNA, 20 bp, human
gcctcccccacgcgcagcga

SEQ ID NO: 294060 - DNA, 20 bp, human
gggcgctgtgcgttgttaaa

SEQ ID NO: 294061 - DNA, 20 bp, human
gcgcccgtcggcgaggagtg

SEQ ID NO: 294062 - DNA, 20 bp, human
gcgacagcaggcgtgggcgg

SEQ ID NO: 294063 - DNA, 20 bp, human
gaggagtggggcatcgggcg

SEQ ID NO: 294064 - DNA, 20 bp, human
gcgcctccatcgctgcgcgt

SEQ ID NO: 294065 - DNA, 20 bp, human
ggccctggcctcaggcggta

SEQ ID NO: 294066 - DNA, 20 bp, human
gaccaagggcaagattgctt

SEQ ID NO: 294067 - DNA, 20 bp, human
gggtggagcctgcttatcag

SEQ ID NO: 294068 - DNA, 20 bp, human
ggagcctgcttatcagtggg

SEQ ID NO: 294069 - DNA, 20 bp, human
ggggagcaccagaccgacaa

SEQ ID NO: 294070 - DNA, 20 bp, human
gccccaagcaatcttgccct

SEQ ID NO: 294071 - DNA, 20 bp, human
gctgagaagctgagataaag

SEQ ID NO: 294072 - DNA, 20 bp, human
ggacacacaggactggcctc

SEQ ID NO: 294073 - DNA, 20 bp, human
ggaagctgagataaaggggg

SEQ ID NO: 294074 - DNA, 20 bp, human
gtagaaataaaggaacttca

SEQ ID NO: 294075 - DNA, 20 bp, human
gttagttggctgcttatcat

SEQ ID NO: 294076 - DNA, 20 bp, human
gacacgcccagacaagtcac

SEQ ID NO: 294077 - DNA, 20 bp, human
gcctgacaggcaggcatcca

SEQ ID NO: 294078 - DNA, 20 bp, human
ggacagagctaagtcaccca

SEQ ID NO: 294079 - DNA, 20 bp, human
gcaaacaggcaagccctgac

SEQ ID NO: 294080 - DNA, 20 bp, human
gggtgctggctggggttgat

SEQ ID NO: 294081 - DNA, 20 bp, human
gcacgctgacaaacaccaat

SEQ ID NO: 294082 - DNA, 20 bp, human
gttggacaatcagttttccc

SEQ ID NO: 294083 - DNA, 20 bp, human
gggaccatttgaccccaaac

SEQ ID NO: 294084 - DNA, 20 bp, human
gtgtccaacaaagacttagg

SEQ ID NO: 294085 - DNA, 20 bp, human
ggctgtgtagtgatgccatt

SEQ ID NO: 294086 - DNA, 20 bp, human
gttaacccctccaacaacca

SEQ ID NO: 294087 - DNA, 20 bp, human
gtgtaggcactaagattccg

SEQ ID NO: 294088 - DNA, 20 bp, human
gactaagattccgtggttgt

SEQ ID NO: 294089 - DNA, 20 bp, human
gttgttggaggggttaaatt

SEQ ID NO: 294090 - DNA, 20 bp, human
gaaacacgacagtggagcct

SEQ ID NO: 294091 - DNA, 20 bp, human
ggattccgtggttgttggag

SEQ ID NO: 294092 - DNA, 20 bp, human
gaagcagtgaccaatagaaa

SEQ ID NO: 294093 - DNA, 20 bp, human
gcatggtaatggattgaccc

SEQ ID NO: 294094 - DNA, 20 bp, human
gagctgcctattggtaaata

SEQ ID NO: 294095 - DNA, 20 bp, human
gactgccttcagctgcctat

SEQ ID NO: 294096 - DNA, 20 bp, human
ggagtccaggaagcaagggt

SEQ ID NO: 294097 - DNA, 20 bp, human
gaggcgcgctcgagcggaag

SEQ ID NO: 294098 - DNA, 20 bp, human
gccgggacccctggaagggt

SEQ ID NO: 294099 - DNA, 20 bp, human
gcgccggcagtgggctccgc

SEQ ID NO: 294100 - DNA, 20 bp, human
gcccagcagctcttgagtcc

SEQ ID NO: 294101 - DNA, 20 bp, human
gcgaccccgccggaagcgcg

SEQ ID NO: 294102 - DNA, 20 bp, human
ggggtctgggtcattgccac

SEQ ID NO: 294103 - DNA, 20 bp, human
gagcctgcggagcccactgc

SEQ ID NO: 294104 - DNA, 20 bp, human
gcagccgcgcgcttccggcg

SEQ ID NO: 294105 - DNA, 20 bp, human
gcggggtgaactgaaggcat

SEQ ID NO: 294106 - DNA, 20 bp, human
gagggtggatgtccaatccc

SEQ ID NO: 294107 - DNA, 20 bp, human
ggtggatgtccaatccccgg

SEQ ID NO: 294108 - DNA, 20 bp, human
gaagggagagcaaacaatag

SEQ ID NO: 294109 - DNA, 20 bp, human
gacactgtgtggtcactggg

SEQ ID NO: 294110 - DNA, 20 bp, human
ggttgagggtatggaggtgc

SEQ ID NO: 294111 - DNA, 20 bp, human
gcaaagaattttggagcagg

SEQ ID NO: 294112 - DNA, 20 bp, human
gaaaagggttgtccttaata

SEQ ID NO: 294113 - DNA, 20 bp, human
gcaaataaaccaagtcgtgt

SEQ ID NO: 294114 - DNA, 20 bp, human
ggcttggctttctgatgtcc

SEQ ID NO: 294115 - DNA, 20 bp, human
ggtcatagggagcccattgt

SEQ ID NO: 294116 - DNA, 20 bp, human
gaccgggtgcgctgggaaaa

SEQ ID NO: 294117 - DNA, 20 bp, human
gcccaagtgcaccggttcct

SEQ ID NO: 294118 - DNA, 20 bp, human
ggcacccggtaggaggaacc

SEQ ID NO: 294119 - DNA, 20 bp, human
ggagcccggttcctcctacc

SEQ ID NO: 294120 - DNA, 20 bp, human
ggcctgggacccaataagaa

SEQ ID NO: 294121 - DNA, 20 bp, human
gggaggaaacgtagtggcca

SEQ ID NO: 294122 - DNA, 20 bp, human
gcgaggccgcccaagtgcac

SEQ ID NO: 294123 - DNA, 20 bp, human
gtcccagcgcacccggtagg

SEQ ID NO: 294124 - DNA, 20 bp, human
ggacactctaagagcagccc

SEQ ID NO: 294125 - DNA, 20 bp, human
gaagaagggcgcggctagag

SEQ ID NO: 294126 - DNA, 20 bp, human
gcgcatgcgcgggaggcagt

SEQ ID NO: 294127 - DNA, 20 bp, human
gccccctccacgccagaaag

SEQ ID NO: 294128 - DNA, 20 bp, human
gagggaaagccagagtcggg

SEQ ID NO: 294129 - DNA, 20 bp, human
gagaagtcgcctcccgactc

SEQ ID NO: 294130 - DNA, 20 bp, human
gaacccaagggcggtgccgg

SEQ ID NO: 294131 - DNA, 20 bp, human
gccgcccttgggtttctccg

SEQ ID NO: 294132 - DNA, 20 bp, human
ggcgcatgcgcatcaagctc

SEQ ID NO: 294133 - DNA, 20 bp, human
ggccgagagggtcacggaaa

SEQ ID NO: 294134 - DNA, 20 bp, human
gacgtggaaaacgaaacgaa

SEQ ID NO: 294135 - DNA, 20 bp, human
gcgcgtgcgcagccagccac

SEQ ID NO: 294136 - DNA, 20 bp, human
gaaggccgcgggctctcatt

SEQ ID NO: 294137 - DNA, 20 bp, human
gttgggcggtagcgcaagtc

SEQ ID NO: 294138 - DNA, 20 bp, human
ggcaagtcgggtggcctgac

SEQ ID NO: 294139 - DNA, 20 bp, human
ggggtggcctgactggcagg

SEQ ID NO: 294140 - DNA, 20 bp, human
ggggccacgcagcccgacgg

SEQ ID NO: 294141 - DNA, 20 bp, human
gctgcgcgagcgagggacga

SEQ ID NO: 294142 - DNA, 20 bp, human
gcgagcgagggacgacggaa

SEQ ID NO: 294143 - DNA, 20 bp, human
gtgggcatgcctaatagcca

SEQ ID NO: 294144 - DNA, 20 bp, human
gtaaggccgctggtgtgagc

SEQ ID NO: 294145 - DNA, 20 bp, human
gcggggctctgcgcgagcga

SEQ ID NO: 294146 - DNA, 20 bp, human
gtaaccgggcgtttgcgaga

SEQ ID NO: 294147 - DNA, 20 bp, human
gagtcccggcggactcgcag

SEQ ID NO: 294148 - DNA, 20 bp, human
ggcaaacgcccggttagtcc

SEQ ID NO: 294149 - DNA, 20 bp, human
gggccctcagggccaaaggt

SEQ ID NO: 294150 - DNA, 20 bp, human
gtcacccagcgagtgatcct

SEQ ID NO: 294151 - DNA, 20 bp, human
gtgggcgccggacacgcggg

SEQ ID NO: 294152 - DNA, 20 bp, human
gaacgcccggttagtcccgg

SEQ ID NO: 294153 - DNA, 20 bp, human
gcgagagggggtgcgtccaa

SEQ ID NO: 294154 - DNA, 20 bp, human
gcgagtccgccgggactaac

SEQ ID NO: 294155 - DNA, 20 bp, human
ggcggactcgcagtggagag

SEQ ID NO: 294156 - DNA, 20 bp, human
gcgaaacgggcgtgacacgg

SEQ ID NO: 294157 - DNA, 20 bp, human
gttcccgccacgtgaggctg

SEQ ID NO: 294158 - DNA, 20 bp, human
gcggaacccggggtcctctc

SEQ ID NO: 294159 - DNA, 20 bp, human
gaggctgcggcccacccggc

SEQ ID NO: 294160 - DNA, 20 bp, human
ggacacgggggagacgtcgc

SEQ ID NO: 294161 - DNA, 20 bp, human
gggccgcagcctcacgtggc

SEQ ID NO: 294162 - DNA, 20 bp, human
gttcgccggcgtccgccagg

SEQ ID NO: 294163 - DNA, 20 bp, human
ggcggaggagcaggacccgc

SEQ ID NO: 294164 - DNA, 20 bp, human
gcgaccgcgggcttcaggca

SEQ ID NO: 294165 - DNA, 20 bp, human
gggcggctcggggttggctc

SEQ ID NO: 294166 - DNA, 20 bp, human
gctcggcctagtcccctcgg

SEQ ID NO: 294167 - DNA, 20 bp, human
gagagcccctcagccatgtt

SEQ ID NO: 294168 - DNA, 20 bp, human
gcgcgcccagaggccccgac

SEQ ID NO: 294169 - DNA, 20 bp, human
gggccgggagacagacggga

SEQ ID NO: 294170 - DNA, 20 bp, human
gggctggtgagaagcgcaag

SEQ ID NO: 294171 - DNA, 20 bp, human
gaggccgagcgggcccgtcg

SEQ ID NO: 294172 - DNA, 20 bp, human
gccgctcggcctagtcccct

SEQ ID NO: 294173 - DNA, 20 bp, human
gaggccccgacgggcccgct

SEQ ID NO: 294174 - DNA, 20 bp, human
gcccccagcccaggggacaa

SEQ ID NO: 294175 - DNA, 20 bp, human
gcgagccctggagccgccga

SEQ ID NO: 294176 - DNA, 20 bp, human
ggccaatcggagtgcaatga

SEQ ID NO: 294177 - DNA, 20 bp, human
ggccgctgggaggacgacga

SEQ ID NO: 294178 - DNA, 20 bp, human
gcaatcgcgagctctgtagg

SEQ ID NO: 294179 - DNA, 20 bp, human
ggctgcgagctgcccgtgct

SEQ ID NO: 294180 - DNA, 20 bp, human
gcaccaatcgcgagctctgt

SEQ ID NO: 294181 - DNA, 20 bp, human
gcccctcattgcactccgat

SEQ ID NO: 294182 - DNA, 20 bp, human
gagagctcgcgattggtgtc

SEQ ID NO: 294183 - DNA, 20 bp, human
ggtgctgggcgggcaaatga

SEQ ID NO: 294184 - DNA, 20 bp, human
gcctcccgccgccgacgtga

SEQ ID NO: 294185 - DNA, 20 bp, human
ggagtcgtccgtcacgtcgg

SEQ ID NO: 294186 - DNA, 20 bp, human
ggagagggagagctcttgcg

SEQ ID NO: 294187 - DNA, 20 bp, human
gagaggaggcataacagcag

SEQ ID NO: 294188 - DNA, 20 bp, human
ggcccgacggattcttgcaa

SEQ ID NO: 294189 - DNA, 20 bp, human
ggcaagaatccgtcgggcgg

SEQ ID NO: 294190 - DNA, 20 bp, human
gagctcttgcgaggcagaac

SEQ ID NO: 294191 - DNA, 20 bp, human
gggcccttgcaagaatccgt

SEQ ID NO: 294192 - DNA, 20 bp, human
ggaggacgcgacaacggcca

SEQ ID NO: 294193 - DNA, 20 bp, human
gggctggcgcggttaataag

SEQ ID NO: 294194 - DNA, 20 bp, human
gcggatcagggactaagagg

SEQ ID NO: 294195 - DNA, 20 bp, human
gaaaaaaagcggcccggggg

SEQ ID NO: 294196 - DNA, 20 bp, human
gttcacttccacaatagtac

SEQ ID NO: 294197 - DNA, 20 bp, human
gtacttgtccattctatatc

SEQ ID NO: 294198 - DNA, 20 bp, human
gaaagccaggaacaaacaat

SEQ ID NO: 294199 - DNA, 20 bp, human
gggccagtgtttgatatctc

SEQ ID NO: 294200 - DNA, 20 bp, human
gcagtgtttgatatctctgg

SEQ ID NO: 294201 - DNA, 20 bp, human
gctaagaacaacacacaccc

SEQ ID NO: 294202 - DNA, 20 bp, human
gtgtaacctgggaagactag

SEQ ID NO: 294203 - DNA, 20 bp, human
gtttttagccagtactattg

SEQ ID NO: 294204 - DNA, 20 bp, human
ggcagcctattgtttgttcc

SEQ ID NO: 294205 - DNA, 20 bp, human
gtcagtgattgcaaaattgc

SEQ ID NO: 294206 - DNA, 20 bp, human
ggggagggagggcgcgtctg

SEQ ID NO: 294207 - DNA, 20 bp, human
gggagtggggagccaccggc

SEQ ID NO: 294208 - DNA, 20 bp, human
gggccagaggcacccgaggt

SEQ ID NO: 294209 - DNA, 20 bp, human
gccgacgcctggcatagttg

SEQ ID NO: 294210 - DNA, 20 bp, human
gtacctgccgctgccgccga

SEQ ID NO: 294211 - DNA, 20 bp, human
ggagccaccggcgggaagac

SEQ ID NO: 294212 - DNA, 20 bp, human
gcatgcggcaggttgggtga

SEQ ID NO: 294213 - DNA, 20 bp, human
gagggggcaaggacacgtaa

SEQ ID NO: 294214 - DNA, 20 bp, human
ggcgtctgtgagagacaccg

SEQ ID NO: 294215 - DNA, 20 bp, human
gaccggcgggaagacgggga

SEQ ID NO: 294216 - DNA, 20 bp, human
ggtcggccctgcagcgtcgt

SEQ ID NO: 294217 - DNA, 20 bp, human
gcagcgtcgtaggacagggc

SEQ ID NO: 294218 - DNA, 20 bp, human
gcctcgcgcacgcagcccgt

SEQ ID NO: 294219 - DNA, 20 bp, human
ggactggggtgggaggccgt

SEQ ID NO: 294220 - DNA, 20 bp, human
gcgaggagcgggcgtggttc

SEQ ID NO: 294221 - DNA, 20 bp, human
gacgccccgggcgcacacca

SEQ ID NO: 294222 - DNA, 20 bp, human
gaagagctgaaacacgcccc

SEQ ID NO: 294223 - DNA, 20 bp, human
ggagcgggcgtggttccggg

SEQ ID NO: 294224 - DNA, 20 bp, human
gcctgtcctacgacgctgca

SEQ ID NO: 294225 - DNA, 20 bp, human
ggagtccgggcccactacct

SEQ ID NO: 294226 - DNA, 20 bp, human
gcccagtggtgacagcggcg

SEQ ID NO: 294227 - DNA, 20 bp, human
gtcctggtaccgcccacctg

SEQ ID NO: 294228 - DNA, 20 bp, human
gggaacggcgcggaaccaat

SEQ ID NO: 294229 - DNA, 20 bp, human
gcatcaacacgcaaaggcct

SEQ ID NO: 294230 - DNA, 20 bp, human
ggggcattggcaattggttc

SEQ ID NO: 294231 - DNA, 20 bp, human
gtccaggggtacccgactag

SEQ ID NO: 294232 - DNA, 20 bp, human
ggccccaggtgggcggtacc

SEQ ID NO: 294233 - DNA, 20 bp, human
ggcggtaccaggactctcca

SEQ ID NO: 294234 - DNA, 20 bp, human
ggcaaaggcctaggattcgt

SEQ ID NO: 294235 - DNA, 20 bp, human
gcccactagtcgggtacccc

SEQ ID NO: 294236 - DNA, 20 bp, human
ggggcggtgacgtgcggcaa

SEQ ID NO: 294237 - DNA, 20 bp, human
gtgggcccaggcttccgtgg

SEQ ID NO: 294238 - DNA, 20 bp, human
gcacctgcggtcccctgcct

SEQ ID NO: 294239 - DNA, 20 bp, human
gacgccaaggacatccccca

SEQ ID NO: 294240 - DNA, 20 bp, human
gtgacgtgcggcaagggcat

SEQ ID NO: 294241 - DNA, 20 bp, human
gcggcaagggcatggggatg

SEQ ID NO: 294242 - DNA, 20 bp, human
gcggtcccctgcctcggctt

SEQ ID NO: 294243 - DNA, 20 bp, human
gggggccccgacaaggtaag

SEQ ID NO: 294244 - DNA, 20 bp, human
ggaagcgagccacccggaag

SEQ ID NO: 294245 - DNA, 20 bp, human
gcgaaggtcccgcttccggg

SEQ ID NO: 294246 - DNA, 20 bp, human
ggggaattctggcttcttat

SEQ ID NO: 294247 - DNA, 20 bp, human
ggtagctgcaaccgcccctc

SEQ ID NO: 294248 - DNA, 20 bp, human
gaggtgccgagtgatgcggc

SEQ ID NO: 294249 - DNA, 20 bp, human
gctgggagcctggcggaatt

SEQ ID NO: 294250 - DNA, 20 bp, human
gaattaggtgccgagtgatg

SEQ ID NO: 294251 - DNA, 20 bp, human
gttcaggccaccgattggtc

SEQ ID NO: 294252 - DNA, 20 bp, human
gctctcccggccgcatcact

SEQ ID NO: 294253 - DNA, 20 bp, human
gggccagagagctaaagttc

SEQ ID NO: 294254 - DNA, 20 bp, human
gaggcggggagctctgcaaa

SEQ ID NO: 294255 - DNA, 20 bp, human
gttgagaatagggggaattc

SEQ ID NO: 294256 - DNA, 20 bp, human
gcagccctggaagggcggga

SEQ ID NO: 294257 - DNA, 20 bp, human
gccacagtggggttagctga

SEQ ID NO: 294258 - DNA, 20 bp, human
gcacgctgcagattcaggga

SEQ ID NO: 294259 - DNA, 20 bp, human
gctgcagcgtgactagaaat

SEQ ID NO: 294260 - DNA, 20 bp, human
ggctgcagattcagggaggg

SEQ ID NO: 294261 - DNA, 20 bp, human
gcctctgtctgtccatatcc

SEQ ID NO: 294262 - DNA, 20 bp, human
ggtggcctcctctgaagaac

SEQ ID NO: 294263 - DNA, 20 bp, human
ggatactggcagttgtcttc

SEQ ID NO: 294264 - DNA, 20 bp, human
gtagtcacgctgcagattca

SEQ ID NO: 294265 - DNA, 20 bp, human
gaacgcgctgccagatatcc

SEQ ID NO: 294266 - DNA, 20 bp, human
gtgaccgcctggggagtcag

SEQ ID NO: 294267 - DNA, 20 bp, human
gggtctaggcaggggaaatt

SEQ ID NO: 294268 - DNA, 20 bp, human
ggcccgctctcacttttcag

SEQ ID NO: 294269 - DNA, 20 bp, human
gtttcagcggcaggcgaagg

SEQ ID NO: 294270 - DNA, 20 bp, human
gtccccgtggagtgtccctg

SEQ ID NO: 294271 - DNA, 20 bp, human
gaaaggaggtgggtctaggc

SEQ ID NO: 294272 - DNA, 20 bp, human
gggcggtcacatgaccgaag

SEQ ID NO: 294273 - DNA, 20 bp, human
ggagtcaggggcggaagtcg

SEQ ID NO: 294274 - DNA, 20 bp, human
ggagagatggcgtctcggac

SEQ ID NO: 294275 - DNA, 20 bp, human
gtgtgaccactcgccggcga

SEQ ID NO: 294276 - DNA, 20 bp, human
gcggtctgcgagcgcggcct

SEQ ID NO: 294277 - DNA, 20 bp, human
gaccgcgcccctccaacggc

SEQ ID NO: 294278 - DNA, 20 bp, human
gcggcctgcgggagcggcct

SEQ ID NO: 294279 - DNA, 20 bp, human
ggcagaccgcgcccctccaa

SEQ ID NO: 294280 - DNA, 20 bp, human
gccccagcgtgtaatgtcac

SEQ ID NO: 294281 - DNA, 20 bp, human
ggcccccggcgagcactccg

SEQ ID NO: 294282 - DNA, 20 bp, human
gggagcggcctgccgttgga

SEQ ID NO: 294283 - DNA, 20 bp, human
gtgcgggagcggcctgccgt

SEQ ID NO: 294284 - DNA, 20 bp, human
gagtccccggagccggaagt

SEQ ID NO: 294285 - DNA, 20 bp, human
gggggcgcggtctgcgagcg

SEQ ID NO: 294286 - DNA, 20 bp, human
gcgtgcgcgctccctcggtg

SEQ ID NO: 294287 - DNA, 20 bp, human
gcggacaaggccggagtcgc

SEQ ID NO: 294288 - DNA, 20 bp, human
gtggagaccgaggacggcgc

SEQ ID NO: 294289 - DNA, 20 bp, human
gacgcagcccgccgcaccga

SEQ ID NO: 294290 - DNA, 20 bp, human
gcggggccaccgacactcgc

SEQ ID NO: 294291 - DNA, 20 bp, human
ggcgggctgcgtgcgcgagt

SEQ ID NO: 294292 - DNA, 20 bp, human
gcgcgggtggagaccgagga

SEQ ID NO: 294293 - DNA, 20 bp, human
ggcgcgctccctcggtgcgg

SEQ ID NO: 294294 - DNA, 20 bp, human
gcagccgcgggtggagaccg

SEQ ID NO: 294295 - DNA, 20 bp, human
gggctgcgtgcgcgagtggg

SEQ ID NO: 294296 - DNA, 20 bp, human
ggagatgcgcgctcctacac

SEQ ID NO: 294297 - DNA, 20 bp, human
gccccccgcctcccacacgg

SEQ ID NO: 294298 - DNA, 20 bp, human
ggctctctagaagctcctca

SEQ ID NO: 294299 - DNA, 20 bp, human
gtaggcagggcgggatttct

SEQ ID NO: 294300 - DNA, 20 bp, human
gggcccgggcgccgcggcac

SEQ ID NO: 294301 - DNA, 20 bp, human
ggaccggcagaggcgcgcat

SEQ ID NO: 294302 - DNA, 20 bp, human
gggcgccgcggcaccggtgt

SEQ ID NO: 294303 - DNA, 20 bp, human
gagacgcaacgacgctttca

SEQ ID NO: 294304 - DNA, 20 bp, human
gggagggaggagagctaccg

SEQ ID NO: 294305 - DNA, 20 bp, human
ggaggagagctaccgaggag

SEQ ID NO: 294306 - DNA, 20 bp, human
ggcacccgggcggaaggata

SEQ ID NO: 294307 - DNA, 20 bp, human
gtcagcgccccgccaaccag

SEQ ID NO: 294308 - DNA, 20 bp, human
gggagcgcgcccctggttgg

SEQ ID NO: 294309 - DNA, 20 bp, human
ggaggccagttgccgggtaa

SEQ ID NO: 294310 - DNA, 20 bp, human
gccgcagcccagccggaggg

SEQ ID NO: 294311 - DNA, 20 bp, human
gcagttgccgggtaacggag

SEQ ID NO: 294312 - DNA, 20 bp, human
ggccgggattacatcagcgc

SEQ ID NO: 294313 - DNA, 20 bp, human
gaagccgctgggaggtgaga

SEQ ID NO: 294314 - DNA, 20 bp, human
gcctccgcggagtggcgctg

SEQ ID NO: 294315 - DNA, 20 bp, human
gcggccccagcgccactccg

SEQ ID NO: 294316 - DNA, 20 bp, human
gggccgggccaggtacccaa

SEQ ID NO: 294317 - DNA, 20 bp, human
gagaagcgacgcggttgggg

SEQ ID NO: 294318 - DNA, 20 bp, human
ggggagaagcgacgcggttg

SEQ ID NO: 294319 - DNA, 20 bp, human
gccggcggcgcgtgcgtgca

SEQ ID NO: 294320 - DNA, 20 bp, human
gacccaagggagaagcgacg

SEQ ID NO: 294321 - DNA, 20 bp, human
ggggccaggcgcgcacgcaa

SEQ ID NO: 294322 - DNA, 20 bp, human
gcgtgcagggcctcccggcg

SEQ ID NO: 294323 - DNA, 20 bp, human
gctcccttgggtacctggcc

SEQ ID NO: 294324 - DNA, 20 bp, human
gggcgcgcacgcaacggcgc

SEQ ID NO: 294325 - DNA, 20 bp, human
gaccgcgtcgcttctccctt

SEQ ID NO: 294326 - DNA, 20 bp, human
gcacgcgcacacacgccctc

SEQ ID NO: 294327 - DNA, 20 bp, human
gggtacttagagcgcaaccg

SEQ ID NO: 294328 - DNA, 20 bp, human
gccgcgccccacatccctga

SEQ ID NO: 294329 - DNA, 20 bp, human
gcacacgccctcagggatgt

SEQ ID NO: 294330 - DNA, 20 bp, human
ggggtgggagtgtgtcgccc

SEQ ID NO: 294331 - DNA, 20 bp, human
gcgtggccctaaacagtctg

SEQ ID NO: 294332 - DNA, 20 bp, human
gtagggtatgaaggccgctc

SEQ ID NO: 294333 - DNA, 20 bp, human
gcggaaaggcgctgaatcac

SEQ ID NO: 294334 - DNA, 20 bp, human
gcgcgtcgccgtggtaaccg

SEQ ID NO: 294335 - DNA, 20 bp, human
ggacccaggcagtgcaccca

SEQ ID NO: 294336 - DNA, 20 bp, human
gctctggccaatggcaagtc

SEQ ID NO: 294337 - DNA, 20 bp, human
gtaaaactacgcacaagcga

SEQ ID NO: 294338 - DNA, 20 bp, human
ggctggggctcgagcgaagg

SEQ ID NO: 294339 - DNA, 20 bp, human
ggattcgtcaagagcggtgc

SEQ ID NO: 294340 - DNA, 20 bp, human
gtccgcggctgcttcactcc

SEQ ID NO: 294341 - DNA, 20 bp, human
ggcaggggagggcccgaagg

SEQ ID NO: 294342 - DNA, 20 bp, human
ggctgcttcactccgggctc

SEQ ID NO: 294343 - DNA, 20 bp, human
ggctcccggagcatcgcgct

SEQ ID NO: 294344 - DNA, 20 bp, human
gaccgctcttgacgaatccg

SEQ ID NO: 294345 - DNA, 20 bp, human
ggcccggagtgaagcagccg

SEQ ID NO: 294346 - DNA, 20 bp, human
gcggggcggaggttgaggac

SEQ ID NO: 294347 - DNA, 20 bp, human
gcgccccggccgtcccgctt

SEQ ID NO: 294348 - DNA, 20 bp, human
gcgagaggagagtccgctct

SEQ ID NO: 294349 - DNA, 20 bp, human
gcctgggcccccaagcggga

SEQ ID NO: 294350 - DNA, 20 bp, human
gggcggacgcggggaggttg

SEQ ID NO: 294351 - DNA, 20 bp, human
gcccgggggccaagccatgg

SEQ ID NO: 294352 - DNA, 20 bp, human
gggcccccaagcgggacggc

SEQ ID NO: 294353 - DNA, 20 bp, human
gccctcccctctaatgcgag

SEQ ID NO: 294354 - DNA, 20 bp, human
gggaccggagacgtaacttc

SEQ ID NO: 294355 - DNA, 20 bp, human
gaagccatggtgggggatct

SEQ ID NO: 294356 - DNA, 20 bp, human
ggtgctcccaaaacggctag

SEQ ID NO: 294357 - DNA, 20 bp, human
gtccgggactgagtcagcgc

SEQ ID NO: 294358 - DNA, 20 bp, human
ggcccccgacagcccagttc

SEQ ID NO: 294359 - DNA, 20 bp, human
gccggggccgagaagttcgg

SEQ ID NO: 294360 - DNA, 20 bp, human
ggcggcgcaggggctcgtcc

SEQ ID NO: 294361 - DNA, 20 bp, human
gccacctccacaccagaact

SEQ ID NO: 294362 - DNA, 20 bp, human
gaccagaactgggctgtcgg

SEQ ID NO: 294363 - DNA, 20 bp, human
ggcgccgagcgcagcgtccg

SEQ ID NO: 294364 - DNA, 20 bp, human
gaaaacggctagcgggagca

SEQ ID NO: 294365 - DNA, 20 bp, human
ggggaaacacgcctgtccaa

SEQ ID NO: 294366 - DNA, 20 bp, human
gggctggcgcggtgcatcgt

SEQ ID NO: 294367 - DNA, 20 bp, human
ggcccggcggcgaggaaaaa

SEQ ID NO: 294368 - DNA, 20 bp, human
gcaggcggaacgcctaagtc

SEQ ID NO: 294369 - DNA, 20 bp, human
gccgacggacgagactgacc

SEQ ID NO: 294370 - DNA, 20 bp, human
gtcagtctcgtccgtcggtc

SEQ ID NO: 294371 - DNA, 20 bp, human
gctcgtccgtcggtcggggc

SEQ ID NO: 294372 - DNA, 20 bp, human
ggaagcatttagtggcaaaa

SEQ ID NO: 294373 - DNA, 20 bp, human
ggaagtgtctactacattca

SEQ ID NO: 294374 - DNA, 20 bp, human
ggcaccgccaggccccgtaa

SEQ ID NO: 294375 - DNA, 20 bp, human
gcaaccaccatcttgatcga

SEQ ID NO: 294376 - DNA, 20 bp, human
ggagctctggttggaagagg

SEQ ID NO: 294377 - DNA, 20 bp, human
gtcaaacttgccaaaagagc

SEQ ID NO: 294378 - DNA, 20 bp, human
gacatttttagcttttataa

SEQ ID NO: 294379 - DNA, 20 bp, human
gtaacatcatacaatgacaa

SEQ ID NO: 294380 - DNA, 20 bp, human
gttagagcagctcatgctct

SEQ ID NO: 294381 - DNA, 20 bp, human
ggacgtcagttacttggagg

SEQ ID NO: 294382 - DNA, 20 bp, human
gggtaaacaactccaggtcc

SEQ ID NO: 294383 - DNA, 20 bp, human
gtactgtgacgtcagttact

SEQ ID NO: 294384 - DNA, 20 bp, human
gaaagttacagagctctggt

SEQ ID NO: 294385 - DNA, 20 bp, human
gttggcaagtttgaaaatac

SEQ ID NO: 294386 - DNA, 20 bp, human
gcatgctgggaaccccgggg

SEQ ID NO: 294387 - DNA, 20 bp, human
ggggcatgctgggaaccccg

SEQ ID NO: 294388 - DNA, 20 bp, human
ggccgcgtcctgtccgcgcg

SEQ ID NO: 294389 - DNA, 20 bp, human
ggccccgcgcggacaggacg

SEQ ID NO: 294390 - DNA, 20 bp, human
ggtgcggaagcggaagtgaa

SEQ ID NO: 294391 - DNA, 20 bp, human
gtgaagggtgcgcttggcgg

SEQ ID NO: 294392 - DNA, 20 bp, human
gcgacaggggcggtgcggtg

SEQ ID NO: 294393 - DNA, 20 bp, human
gcgggaaagtccctatttag

SEQ ID NO: 294394 - DNA, 20 bp, human
gggaaggcctccttaaactg

SEQ ID NO: 294395 - DNA, 20 bp, human
gtccctatttaggggtttat

SEQ ID NO: 294396 - DNA, 20 bp, human
ggaggcctgcccacgctcgg

SEQ ID NO: 294397 - DNA, 20 bp, human
gcgcctcccgccccccgcga

SEQ ID NO: 294398 - DNA, 20 bp, human
gagacggccctcccctcgcg

SEQ ID NO: 294399 - DNA, 20 bp, human
ggagcgctcccaccgagcgt

SEQ ID NO: 294400 - DNA, 20 bp, human
ggctcggtgggagcgctctc

SEQ ID NO: 294401 - DNA, 20 bp, human
ggtcacgtgacaccaagcgc

SEQ ID NO: 294402 - DNA, 20 bp, human
ggcgcgagctgtcagtcaac

SEQ ID NO: 294403 - DNA, 20 bp, human
gccttgctggctctgcttag

SEQ ID NO: 294404 - DNA, 20 bp, human
ggctcccaccgagcgtgggc

SEQ ID NO: 294405 - DNA, 20 bp, human
gttaaaggtagggaaaccga

SEQ ID NO: 294406 - DNA, 20 bp, human
gggtcagacccagggttcgg

SEQ ID NO: 294407 - DNA, 20 bp, human
ggccccggatcgttgtgcgc

SEQ ID NO: 294408 - DNA, 20 bp, human
gcgcctgcgcacaacgatcc

SEQ ID NO: 294409 - DNA, 20 bp, human
gcggggccccggaccaatga

SEQ ID NO: 294410 - DNA, 20 bp, human
gccggggagtgacgtcatgc

SEQ ID NO: 294411 - DNA, 20 bp, human
gcagacccagggttcggagg

SEQ ID NO: 294412 - DNA, 20 bp, human
ggtgggtcagacccagggtt

SEQ ID NO: 294413 - DNA, 20 bp, human
gcacaacgatccggggcccg

SEQ ID NO: 294414 - DNA, 20 bp, human
ggaactcctcctccgaaccc

SEQ ID NO: 294415 - DNA, 20 bp, human
gaggaggagttccagcgcgc

SEQ ID NO: 294416 - DNA, 20 bp, human
gcatgcgtgttgtgtctcaa

SEQ ID NO: 294417 - DNA, 20 bp, human
gccgagacccgcaccgtcgt

SEQ ID NO: 294418 - DNA, 20 bp, human
gactgtagagcggtcttgtg

SEQ ID NO: 294419 - DNA, 20 bp, human
gggaagtgggtgttgacctg

SEQ ID NO: 294420 - DNA, 20 bp, human
gagtttgtttccacccggag

SEQ ID NO: 294421 - DNA, 20 bp, human
gccacgtccctaacggtctt

SEQ ID NO: 294422 - DNA, 20 bp, human
gcaaactccggacataacag

SEQ ID NO: 294423 - DNA, 20 bp, human
gaagcagtgtcaacagtccc

SEQ ID NO: 294424 - DNA, 20 bp, human
gtctcaagggcgggtttgaa

SEQ ID NO: 294425 - DNA, 20 bp, human
ggcgtgttgtgtctcaaggg

SEQ ID NO: 294426 - DNA, 20 bp, human
gcggggctgggactagatta

SEQ ID NO: 294427 - DNA, 20 bp, human
gccagcgccgctaaagacta

SEQ ID NO: 294428 - DNA, 20 bp, human
gaacaggcgcagggcggctt

SEQ ID NO: 294429 - DNA, 20 bp, human
gcctacgcgggacccaaccg

SEQ ID NO: 294430 - DNA, 20 bp, human
ggatggattgtggtcgtcag

SEQ ID NO: 294431 - DNA, 20 bp, human
ggccccgacctcatggacac

SEQ ID NO: 294432 - DNA, 20 bp, human
gcgccctgcgcctgttgcta

SEQ ID NO: 294433 - DNA, 20 bp, human
gtactggaggagtgcacgtc

SEQ ID NO: 294434 - DNA, 20 bp, human
ggctagcgcagaaagatctg

SEQ ID NO: 294435 - DNA, 20 bp, human
gtagcggcgctggcttccgc

SEQ ID NO: 294436 - DNA, 20 bp, human
gactccgagagtggagggag

SEQ ID NO: 294437 - DNA, 20 bp, human
ggagcgactccgagagtgga

SEQ ID NO: 294438 - DNA, 20 bp, human
gcgacgcggagagcacagga

SEQ ID NO: 294439 - DNA, 20 bp, human
gaggctgaggcgccgaagga

SEQ ID NO: 294440 - DNA, 20 bp, human
gcgcgcgacgcggagagcac

SEQ ID NO: 294441 - DNA, 20 bp, human
gtcggagtcgctcctctccc

SEQ ID NO: 294442 - DNA, 20 bp, human
gagaggagcgactccgagag

SEQ ID NO: 294443 - DNA, 20 bp, human
gccgaaggaggggcttctgc

SEQ ID NO: 294444 - DNA, 20 bp, human
ggaagtgctcggctggcggg

SEQ ID NO: 294445 - DNA, 20 bp, human
gacccgggacgccagccgtt

SEQ ID NO: 294446 - DNA, 20 bp, human
gcgggaggcagaaacttcgg

SEQ ID NO: 294447 - DNA, 20 bp, human
gtcaactgcttcacgaatcc

SEQ ID NO: 294448 - DNA, 20 bp, human
gaatggtactatcgcttccg

SEQ ID NO: 294449 - DNA, 20 bp, human
gcttccttcggtggcagcgg

SEQ ID NO: 294450 - DNA, 20 bp, human
gaccaccctggcgacggctc

SEQ ID NO: 294451 - DNA, 20 bp, human
gccagacaccgggaaggtaa

SEQ ID NO: 294452 - DNA, 20 bp, human
ggcttcacgaatccgggctc

SEQ ID NO: 294453 - DNA, 20 bp, human
gaggctaggaaggaagcggc

SEQ ID NO: 294454 - DNA, 20 bp, human
gacgctccggagccgtcgcc

SEQ ID NO: 294455 - DNA, 20 bp, human
gtgtggggatgtttcttcgc

SEQ ID NO: 294456 - DNA, 20 bp, human
ggggggcgctcgtgcgacga

SEQ ID NO: 294457 - DNA, 20 bp, human
ggcgggcggcgagagagagt

SEQ ID NO: 294458 - DNA, 20 bp, human
gtgcgacgaaggcccgcggg

SEQ ID NO: 294459 - DNA, 20 bp, human
ggtcgcacgagcgcccccag

SEQ ID NO: 294460 - DNA, 20 bp, human
gccagtgcctccggggcttg

SEQ ID NO: 294461 - DNA, 20 bp, human
gctcgtgcgacgaaggcccg

SEQ ID NO: 294462 - DNA, 20 bp, human
ggcacagccacaagccccgg

SEQ ID NO: 294463 - DNA, 20 bp, human
gagcgcccccagcggcgcgc

SEQ ID NO: 294464 - DNA, 20 bp, human
gctcccggcgtgcacagcgc

SEQ ID NO: 294465 - DNA, 20 bp, human
gtgctaggaaactgcccccg

SEQ ID NO: 294466 - DNA, 20 bp, human
gcggggccggtgactcagtg

SEQ ID NO: 294467 - DNA, 20 bp, human
gggcagccgcactgagtcac

SEQ ID NO: 294468 - DNA, 20 bp, human
gactcagtgcggctgccgcc

SEQ ID NO: 294469 - DNA, 20 bp, human
ggcagctggaatgccctgca

SEQ ID NO: 294470 - DNA, 20 bp, human
gggagttcacgcagcccgca

SEQ ID NO: 294471 - DNA, 20 bp, human
gtaacgaagaagttcatacc

SEQ ID NO: 294472 - DNA, 20 bp, human
gaatgtgcgttgtcacattc

SEQ ID NO: 294473 - DNA, 20 bp, human
gatcctactgcctttcccgg

SEQ ID NO: 294474 - DNA, 20 bp, human
gaacccatatgcaatctcaa

SEQ ID NO: 294475 - DNA, 20 bp, human
gcgttagttagctgaacaat

SEQ ID NO: 294476 - DNA, 20 bp, human
ggcgagttgctgggcttcag

SEQ ID NO: 294477 - DNA, 20 bp, human
gggaacgcagtctgcacaga

SEQ ID NO: 294478 - DNA, 20 bp, human
gtcgctcccagtggcctcgg

SEQ ID NO: 294479 - DNA, 20 bp, human
gcaggggctccaggcggcca

SEQ ID NO: 294480 - DNA, 20 bp, human
gggcctgggcgcggagacgt

SEQ ID NO: 294481 - DNA, 20 bp, human
ggggcggtgttcgtggtcct

SEQ ID NO: 294482 - DNA, 20 bp, human
gactcgctgtggccttggga

SEQ ID NO: 294483 - DNA, 20 bp, human
ggaagcccagcaactcgctg

SEQ ID NO: 294484 - DNA, 20 bp, human
gagactcttgctcacggcct

SEQ ID NO: 294485 - DNA, 20 bp, human
gggaataaaagtgcccacga

SEQ ID NO: 294486 - DNA, 20 bp, human
gaggctgtgcgtaagaacgt

SEQ ID NO: 294487 - DNA, 20 bp, human
gtcggccccacgaccggaag

SEQ ID NO: 294488 - DNA, 20 bp, human
gcaggtagggtgtgatcttc

SEQ ID NO: 294489 - DNA, 20 bp, human
gtggactctcgatgatttaa

SEQ ID NO: 294490 - DNA, 20 bp, human
gggcgtttctgaggcaggta

SEQ ID NO: 294491 - DNA, 20 bp, human
ggggcggaagtgacgagagg

SEQ ID NO: 294492 - DNA, 20 bp, human
gaaggcatctggcgtttctg

SEQ ID NO: 294493 - DNA, 20 bp, human
gaaccgctcggccccacgac

SEQ ID NO: 294494 - DNA, 20 bp, human
gctgtgcgtaagaacgttgg

SEQ ID NO: 294495 - DNA, 20 bp, human
gtgaaaatgtcgattccgat

SEQ ID NO: 294496 - DNA, 20 bp, human
gcacacgcgctcagagcaag

SEQ ID NO: 294497 - DNA, 20 bp, human
gtgtgcgccgcagataggga

SEQ ID NO: 294498 - DNA, 20 bp, human
gagggagggacggaacgcgg

SEQ ID NO: 294499 - DNA, 20 bp, human
gcgcgtgtgcgccgcagata

SEQ ID NO: 294500 - DNA, 20 bp, human
ggatagggagggacggaacg

SEQ ID NO: 294501 - DNA, 20 bp, human
gccctgctgtcgcccgggag

SEQ ID NO: 294502 - DNA, 20 bp, human
gagcgcggcgagcaacggag

SEQ ID NO: 294503 - DNA, 20 bp, human
gggggcacggagggacggta

SEQ ID NO: 294504 - DNA, 20 bp, human
gcgcgagcagcagcatggcg

SEQ ID NO: 294505 - DNA, 20 bp, human
gcatgtgctccgcgccgggg

SEQ ID NO: 294506 - DNA, 20 bp, human
gggaggcgggaccccgcgag

SEQ ID NO: 294507 - DNA, 20 bp, human
ggggcggggcaagggaggtc

SEQ ID NO: 294508 - DNA, 20 bp, human
ggaacggcccggacccaccc

SEQ ID NO: 294509 - DNA, 20 bp, human
gggtccgggccgttcagagg

SEQ ID NO: 294510 - DNA, 20 bp, human
gcccgcgagcggtttgaggg

SEQ ID NO: 294511 - DNA, 20 bp, human
gttggaagtgggcggggcaa

SEQ ID NO: 294512 - DNA, 20 bp, human
gaggggagaggtgccctgaa

SEQ ID NO: 294513 - DNA, 20 bp, human
gagactggccgtttggaagt

SEQ ID NO: 294514 - DNA, 20 bp, human
gggaccccgcgagcggtttg

SEQ ID NO: 294515 - DNA, 20 bp, human
ggtggggcgtttaggacctt

SEQ ID NO: 294516 - DNA, 20 bp, human
ggctgcaagcgggaaccgca

SEQ ID NO: 294517 - DNA, 20 bp, human
gccccccagccaagccttcc

SEQ ID NO: 294518 - DNA, 20 bp, human
gctggctgcggcagtcccag

SEQ ID NO: 294519 - DNA, 20 bp, human
gagcgggaacccgacttaaa

SEQ ID NO: 294520 - DNA, 20 bp, human
gacgaagctgcgcagacgtg

SEQ ID NO: 294521 - DNA, 20 bp, human
ggctgcgcagacgtggggca

SEQ ID NO: 294522 - DNA, 20 bp, human
ggaggagccaggaacgccac

SEQ ID NO: 294523 - DNA, 20 bp, human
ggaagccgggaaggcttggc

SEQ ID NO: 294524 - DNA, 20 bp, human
gggcgggtgctgtctccctg

SEQ ID NO: 294525 - DNA, 20 bp, human
gcactggctggctggtgtct

SEQ ID NO: 294526 - DNA, 20 bp, human
ggatttacagctagagggat

SEQ ID NO: 294527 - DNA, 20 bp, human
gatcgacccttaacagtggt

SEQ ID NO: 294528 - DNA, 20 bp, human
ggagctgtgctatgcggcgg

SEQ ID NO: 294529 - DNA, 20 bp, human
ggaggagctgtgctatgcgg

SEQ ID NO: 294530 - DNA, 20 bp, human
ggcctgagcaacaccgggag

SEQ ID NO: 294531 - DNA, 20 bp, human
ggcgctgcctgagcaacacc

SEQ ID NO: 294532 - DNA, 20 bp, human
gggagaggagctgtgctatg

SEQ ID NO: 294533 - DNA, 20 bp, human
gaaggatcgacccttaacag

SEQ ID NO: 294534 - DNA, 20 bp, human
gcgtctggagcttacgtcac

SEQ ID NO: 294535 - DNA, 20 bp, human
gtcctctcccggtgttgctc

SEQ ID NO: 294536 - DNA, 20 bp, human
gtactggagaagcgagacgg

SEQ ID NO: 294537 - DNA, 20 bp, human
gaaggcgggaggcgacgatg

SEQ ID NO: 294538 - DNA, 20 bp, human
ggctgagaaagacactctag

SEQ ID NO: 294539 - DNA, 20 bp, human
ggcgaaggtcggaataacca

SEQ ID NO: 294540 - DNA, 20 bp, human
gcgctcgaatgacaagtgtg

SEQ ID NO: 294541 - DNA, 20 bp, human
gtggagggcgcggtggttgt

SEQ ID NO: 294542 - DNA, 20 bp, human
gacagcggcaaaccggttac

SEQ ID NO: 294543 - DNA, 20 bp, human
ggccgctgtccccttttcta

SEQ ID NO: 294544 - DNA, 20 bp, human
gaaaggggacagcggcaaac

SEQ ID NO: 294545 - DNA, 20 bp, human
gtgacccgggctggtcacgt

SEQ ID NO: 294546 - DNA, 20 bp, human
ggaccgagacacaaagaccg

SEQ ID NO: 294547 - DNA, 20 bp, human
gtgagaccgccaggggttga

SEQ ID NO: 294548 - DNA, 20 bp, human
ggggcgctcggactcctctg

SEQ ID NO: 294549 - DNA, 20 bp, human
gagggtgaggccgcgtcccg

SEQ ID NO: 294550 - DNA, 20 bp, human
gaccgaggctgagaccgcca

SEQ ID NO: 294551 - DNA, 20 bp, human
ggtcggcgtcgccacgtcat

SEQ ID NO: 294552 - DNA, 20 bp, human
gccagcgcgccgcggctgaa

SEQ ID NO: 294553 - DNA, 20 bp, human
gaggctgcggcggaggaaag

SEQ ID NO: 294554 - DNA, 20 bp, human
gcgctcggactcctctgggg

SEQ ID NO: 294555 - DNA, 20 bp, human
ggcgtcatgcgagactgtcc

SEQ ID NO: 294556 - DNA, 20 bp, human
gagtatagccccatctgttt

SEQ ID NO: 294557 - DNA, 20 bp, human
gaacccgcaatgcggagcac

SEQ ID NO: 294558 - DNA, 20 bp, human
ggtgcttgaccgaaacagat

SEQ ID NO: 294559 - DNA, 20 bp, human
gtcacacacatgtacatgga

SEQ ID NO: 294560 - DNA, 20 bp, human
gttaggttgcacaagagttg

SEQ ID NO: 294561 - DNA, 20 bp, human
ggggtcaaggtggtagactg

SEQ ID NO: 294562 - DNA, 20 bp, human
ggaaactattgtttgaataa

SEQ ID NO: 294563 - DNA, 20 bp, human
gtgtgttacaacccgcaatg

SEQ ID NO: 294564 - DNA, 20 bp, human
gatcctgagtatcacatgtg

SEQ ID NO: 294565 - DNA, 20 bp, human
gtttcctgtgctccgcattg

SEQ ID NO: 294566 - DNA, 20 bp, human
gcctccgccgtggccgaagg

SEQ ID NO: 294567 - DNA, 20 bp, human
gcggccgccttcggccacgg

SEQ ID NO: 294568 - DNA, 20 bp, human
ggtcgcaggggcaacgagcc

SEQ ID NO: 294569 - DNA, 20 bp, human
gagtcctccgccgtggccga

SEQ ID NO: 294570 - DNA, 20 bp, human
ggccccgcctccgctcgcga

SEQ ID NO: 294571 - DNA, 20 bp, human
gatggcgccggcagtgccag

SEQ ID NO: 294572 - DNA, 20 bp, human
gcggccctcgcgagcggagg

SEQ ID NO: 294573 - DNA, 20 bp, human
gtggcggccgccttcggcca

SEQ ID NO: 294574 - DNA, 20 bp, human
ggaaagcgagtcctccgccg

SEQ ID NO: 294575 - DNA, 20 bp, human
gcggaggactcgctttccca

SEQ ID NO: 294576 - DNA, 20 bp, human
gggcccagggcacctcgcgc

SEQ ID NO: 294577 - DNA, 20 bp, human
gggccagtggggtactgcaa

SEQ ID NO: 294578 - DNA, 20 bp, human
ggtgccctgggccggccggt

SEQ ID NO: 294579 - DNA, 20 bp, human
gcacccgcgcgaggtgccct

SEQ ID NO: 294580 - DNA, 20 bp, human
gcctggaggcgcaagaggac

SEQ ID NO: 294581 - DNA, 20 bp, human
ggaggcgcaagaggactggg

SEQ ID NO: 294582 - DNA, 20 bp, human
gcacacccacccgccccggg

SEQ ID NO: 294583 - DNA, 20 bp, human
gccagccgaggattatgtga

SEQ ID NO: 294584 - DNA, 20 bp, human
gtggggcgccgtgggaatgc

SEQ ID NO: 294585 - DNA, 20 bp, human
ggcggggcgcgcccaccggc

SEQ ID NO: 294586 - DNA, 20 bp, human
gactggttgctatgacaatg

SEQ ID NO: 294587 - DNA, 20 bp, human
gggagtaagtagattctgaa

SEQ ID NO: 294588 - DNA, 20 bp, human
gtggaaggtgttcatatcaa

SEQ ID NO: 294589 - DNA, 20 bp, human
ggacatcattgatctagctt

SEQ ID NO: 294590 - DNA, 20 bp, human
gggctctgcgtgataagctg

SEQ ID NO: 294591 - DNA, 20 bp, human
gtttagatttttaagatcgt

SEQ ID NO: 294592 - DNA, 20 bp, human
gtacaaggtcaaatgctcta

SEQ ID NO: 294593 - DNA, 20 bp, human
gcaagcaacaaatcagcagc

SEQ ID NO: 294594 - DNA, 20 bp, human
ggataagctgtggatcttcc

SEQ ID NO: 294595 - DNA, 20 bp, human
gggttttacgtgcaagatcc

SEQ ID NO: 294596 - DNA, 20 bp, human
gaaacagggcgggacgccgc

SEQ ID NO: 294597 - DNA, 20 bp, human
ggccctgcccaggaatccgg

SEQ ID NO: 294598 - DNA, 20 bp, human
ggggacgccgccggattcct

SEQ ID NO: 294599 - DNA, 20 bp, human
ggtgccgcccggcctcggtt

SEQ ID NO: 294600 - DNA, 20 bp, human
gccgcccccttgggtgtcgg

SEQ ID NO: 294601 - DNA, 20 bp, human
gcgtcacacgccagcgtcgc

SEQ ID NO: 294602 - DNA, 20 bp, human
gcagccaccgacacccaagg

SEQ ID NO: 294603 - DNA, 20 bp, human
gcgccgccggattcctgggc

SEQ ID NO: 294604 - DNA, 20 bp, human
gaggggtcccaaccgaggcc

SEQ ID NO: 294605 - DNA, 20 bp, human
gcccgggcggcggggctaaa

SEQ ID NO: 294606 - DNA, 20 bp, human
gcgtaggccgggcaacatgg

SEQ ID NO: 294607 - DNA, 20 bp, human
gcggtgcagtcgggaggtgg

SEQ ID NO: 294608 - DNA, 20 bp, human
gcaacatggcggcctccatg

SEQ ID NO: 294609 - DNA, 20 bp, human
gcagtcgcgcgcggtgcagt

SEQ ID NO: 294610 - DNA, 20 bp, human
gggccacgcccccgatgcgt

SEQ ID NO: 294611 - DNA, 20 bp, human
gtgcccggcctacgcatcgg

SEQ ID NO: 294612 - DNA, 20 bp, human
gcgcgcgcggtgcagtcggg

SEQ ID NO: 294613 - DNA, 20 bp, human
gcaccggctgcattgttttc

SEQ ID NO: 294614 - DNA, 20 bp, human
ggcgcggtgcagtcgggagg

SEQ ID NO: 294615 - DNA, 20 bp, human
gtgcggccatcttgagcggg

SEQ ID NO: 294616 - DNA, 20 bp, human
gcacacgggcgcctccgaat

SEQ ID NO: 294617 - DNA, 20 bp, human
ggaaccgcgagcctattcgg

SEQ ID NO: 294618 - DNA, 20 bp, human
ggctccgcggacgcctgctc

SEQ ID NO: 294619 - DNA, 20 bp, human
ggttcccgaagccggctccg

SEQ ID NO: 294620 - DNA, 20 bp, human
ggacgcaaggatgaacgttc

SEQ ID NO: 294621 - DNA, 20 bp, human
ggggcagcgccagacccggc

SEQ ID NO: 294622 - DNA, 20 bp, human
gacgcctgctctggctccgt

SEQ ID NO: 294623 - DNA, 20 bp, human
gcgtgtgcacgtccgtgtgt

SEQ ID NO: 294624 - DNA, 20 bp, human
gtggcgcggccaggcgaggg

SEQ ID NO: 294625 - DNA, 20 bp, human
gcgtgggaaaggcgcctccg

SEQ ID NO: 294626 - DNA, 20 bp, human
gaggaggggtcgaacgtcaa

SEQ ID NO: 294627 - DNA, 20 bp, human
ggggcagagcacagagcggt

SEQ ID NO: 294628 - DNA, 20 bp, human
ggcacagagcggtgggagga

SEQ ID NO: 294629 - DNA, 20 bp, human
ggggtcgaacgtcaagggca

SEQ ID NO: 294630 - DNA, 20 bp, human
gctgaggcccgagacgagac

SEQ ID NO: 294631 - DNA, 20 bp, human
gagagcggtgggaggaaggt

SEQ ID NO: 294632 - DNA, 20 bp, human
gatccgcctgataacctggg

SEQ ID NO: 294633 - DNA, 20 bp, human
ggcgtggccgaggaacccca

SEQ ID NO: 294634 - DNA, 20 bp, human
gcccctcctcccaggttatc

SEQ ID NO: 294635 - DNA, 20 bp, human
gcgggcccgccggcgggagt

SEQ ID NO: 294636 - DNA, 20 bp, human
gacaagctaagggaagacgg

SEQ ID NO: 294637 - DNA, 20 bp, human
ggctgggcggcgaagggcat

SEQ ID NO: 294638 - DNA, 20 bp, human
gtgcggctccacaactcgct

SEQ ID NO: 294639 - DNA, 20 bp, human
gcaactcgctgggcggcgaa

SEQ ID NO: 294640 - DNA, 20 bp, human
gacacgcgctgaggaagtgg

SEQ ID NO: 294641 - DNA, 20 bp, human
gaggcacagcacacgcgctg

SEQ ID NO: 294642 - DNA, 20 bp, human
gagagcggcggcgatttcga

SEQ ID NO: 294643 - DNA, 20 bp, human
gtgggtccgtgacaagctaa

SEQ ID NO: 294644 - DNA, 20 bp, human
gggagccgcagctccgagtg

SEQ ID NO: 294645 - DNA, 20 bp, human
gccggagtccggcactaaaa

SEQ ID NO: 294646 - DNA, 20 bp, human
gtggagggaagtttcatcgg

SEQ ID NO: 294647 - DNA, 20 bp, human
gccgccttgcccaagtgggg

SEQ ID NO: 294648 - DNA, 20 bp, human
gccttgcccaagtggggcgg

SEQ ID NO: 294649 - DNA, 20 bp, human
gctgtgcccgggccggaccg

SEQ ID NO: 294650 - DNA, 20 bp, human
ggcccgcagcagccaggtga

SEQ ID NO: 294651 - DNA, 20 bp, human
gcccccgccttgcccaagtg

SEQ ID NO: 294652 - DNA, 20 bp, human
gcggccgctccaccgagtcc

SEQ ID NO: 294653 - DNA, 20 bp, human
gcagggcccccgccccactt

SEQ ID NO: 294654 - DNA, 20 bp, human
gaccgcggagagcaagtccc

SEQ ID NO: 294655 - DNA, 20 bp, human
gggcgggactctgcgcaccc

SEQ ID NO: 294656 - DNA, 20 bp, human
ggggcggcgaggaatgaccc

SEQ ID NO: 294657 - DNA, 20 bp, human
gcacctgcgcgagctctccc

SEQ ID NO: 294658 - DNA, 20 bp, human
gcccaaccagcggggtgcac

SEQ ID NO: 294659 - DNA, 20 bp, human
gggggacagcgagacacctc

SEQ ID NO: 294660 - DNA, 20 bp, human
ggggcaccgcccccaaccag

SEQ ID NO: 294661 - DNA, 20 bp, human
gcgaggaatgacccgggggt

SEQ ID NO: 294662 - DNA, 20 bp, human
gctgccgagtcccagaagct

SEQ ID NO: 294663 - DNA, 20 bp, human
ggggctcctaaccgcccaaa

SEQ ID NO: 294664 - DNA, 20 bp, human
gctctcgccgcaaaaacggg

SEQ ID NO: 294665 - DNA, 20 bp, human
ggtgctctcgccgcaaaaac

SEQ ID NO: 294666 - DNA, 20 bp, human
ggaggcagagcacgagccaa

SEQ ID NO: 294667 - DNA, 20 bp, human
gccagcgcgatccatgcaca

SEQ ID NO: 294668 - DNA, 20 bp, human
ggggctggcgccgacattcc

SEQ ID NO: 294669 - DNA, 20 bp, human
gggtgaatcgtctgtccccc

SEQ ID NO: 294670 - DNA, 20 bp, human
gagggcttggtcgctcattc

SEQ ID NO: 294671 - DNA, 20 bp, human
gaagaggttccaagtggcca

SEQ ID NO: 294672 - DNA, 20 bp, human
ggcgcgatccatgcacaggg

SEQ ID NO: 294673 - DNA, 20 bp, human
gagacgattcaccatgcctt

SEQ ID NO: 294674 - DNA, 20 bp, human
ggcatggatcgcgctggggc

SEQ ID NO: 294675 - DNA, 20 bp, human
gaacaagaagaggttccaag

SEQ ID NO: 294676 - DNA, 20 bp, human
gtgtaactgcagggtcggga

SEQ ID NO: 294677 - DNA, 20 bp, human
gtggaaggtgattacaagtg

SEQ ID NO: 294678 - DNA, 20 bp, human
ggtgtctgtaactgcagggt

SEQ ID NO: 294679 - DNA, 20 bp, human
gtatcttcacgtggggcctt

SEQ ID NO: 294680 - DNA, 20 bp, human
gacagccttaggtacccttc

SEQ ID NO: 294681 - DNA, 20 bp, human
gcttcacgtggggccttagg

SEQ ID NO: 294682 - DNA, 20 bp, human
gacgtggggccttaggtgga

SEQ ID NO: 294683 - DNA, 20 bp, human
gactgtcagggcagaatcct

SEQ ID NO: 294684 - DNA, 20 bp, human
gacagcctgaagggtaccta

SEQ ID NO: 294685 - DNA, 20 bp, human
ggaatctttgtcagatgtga

SEQ ID NO: 294686 - DNA, 20 bp, human
gtggggccgagacctcgggg

SEQ ID NO: 294687 - DNA, 20 bp, human
ggccgcgcgcacctcccccg

SEQ ID NO: 294688 - DNA, 20 bp, human
gcagctggcccggcggagtg

SEQ ID NO: 294689 - DNA, 20 bp, human
ggagtggggccgagacctcg

SEQ ID NO: 294690 - DNA, 20 bp, human
gggtgcggggagggcaatcg

SEQ ID NO: 294691 - DNA, 20 bp, human
gggtctcggccccactccgc

SEQ ID NO: 294692 - DNA, 20 bp, human
ggcctccgcagctggcccgg

SEQ ID NO: 294693 - DNA, 20 bp, human
ggcctcccgcggggcgtcca

SEQ ID NO: 294694 - DNA, 20 bp, human
ggggaggcgggagggcgatc

SEQ ID NO: 294695 - DNA, 20 bp, human
gaggtggtggcaagtcagtc

SEQ ID NO: 294696 - DNA, 20 bp, human
gtccccggagagcgcgcctg

SEQ ID NO: 294697 - DNA, 20 bp, human
gaaccaggcaggcccagttg

SEQ ID NO: 294698 - DNA, 20 bp, human
ggcctctcctacccacaact

SEQ ID NO: 294699 - DNA, 20 bp, human
gcggacggacggacagacct

SEQ ID NO: 294700 - DNA, 20 bp, human
gcaccgaggctctgcagccg

SEQ ID NO: 294701 - DNA, 20 bp, human
gtgccagggcagggcgatgc

SEQ ID NO: 294702 - DNA, 20 bp, human
ggcccagttgtgggtaggag

SEQ ID NO: 294703 - DNA, 20 bp, human
gggacagacctagggacgga

SEQ ID NO: 294704 - DNA, 20 bp, human
gcggagagcgcgcctgagga

SEQ ID NO: 294705 - DNA, 20 bp, human
ggatccaagaggccccgcgc

SEQ ID NO: 294706 - DNA, 20 bp, human
gcctcttcatagatgttaat

SEQ ID NO: 294707 - DNA, 20 bp, human
gaaccaggcaggcccagttg

SEQ ID NO: 294708 - DNA, 20 bp, human
gttccggcactaacttttta

SEQ ID NO: 294709 - DNA, 20 bp, human
gcaccgaggctctgcagccg

SEQ ID NO: 294710 - DNA, 20 bp, human
ggcctctcctacccacaact

SEQ ID NO: 294711 - DNA, 20 bp, human
gtgccagggcagggcgatgc

SEQ ID NO: 294712 - DNA, 20 bp, human
gtaaggccgagagccttcgc

SEQ ID NO: 294713 - DNA, 20 bp, human
gtccccggagagcgcgcctg

SEQ ID NO: 294714 - DNA, 20 bp, human
gggctcccagcgaaggctct

SEQ ID NO: 294715 - DNA, 20 bp, human
gtctgagattaaagagatga

SEQ ID NO: 294716 - DNA, 20 bp, human
gtccgcgggtagttcctccg

SEQ ID NO: 294717 - DNA, 20 bp, human
ggtcaggcgagcagaacagc

SEQ ID NO: 294718 - DNA, 20 bp, human
gccggtgagtgcgccttgat

SEQ ID NO: 294719 - DNA, 20 bp, human
ggcggcgaggagcacgtgaa

SEQ ID NO: 294720 - DNA, 20 bp, human
ggaaaggcccctaggaacct

SEQ ID NO: 294721 - DNA, 20 bp, human
ggcgcggggctccagcaacc

SEQ ID NO: 294722 - DNA, 20 bp, human
gggaaccttggaggcctcgg

SEQ ID NO: 294723 - DNA, 20 bp, human
gggtgcgcacccggccgcgc

SEQ ID NO: 294724 - DNA, 20 bp, human
gcgccttgatgggagcagaa

SEQ ID NO: 294725 - DNA, 20 bp, human
gaggcccctaggaaccttgg

SEQ ID NO: 294726 - DNA, 20 bp, human
gggagcgcacctgacccagg

SEQ ID NO: 294727 - DNA, 20 bp, human
gtcaggtgcgctccgctcgg

SEQ ID NO: 294728 - DNA, 20 bp, human
gagcggagcgcacctgaccc

SEQ ID NO: 294729 - DNA, 20 bp, human
ggcacctgacccaggcgggc

SEQ ID NO: 294730 - DNA, 20 bp, human
ggtggcccgcggcatggagc

SEQ ID NO: 294731 - DNA, 20 bp, human
gcgcggccaccgtcggctca

SEQ ID NO: 294732 - DNA, 20 bp, human
ggcctcggcggtcaggtcag

SEQ ID NO: 294733 - DNA, 20 bp, human
ggggagcgcctggtccgcgg

SEQ ID NO: 294734 - DNA, 20 bp, human
ggcagcagagggcttctcat

SEQ ID NO: 294735 - DNA, 20 bp, human
ggccgctgacctgaccgccg

SEQ ID NO: 294736 - DNA, 20 bp, human
gaaactgcgcgcagtggctg

SEQ ID NO: 294737 - DNA, 20 bp, human
gcccgtacgatgggaggtag

SEQ ID NO: 294738 - DNA, 20 bp, human
gcggttgctaggagacgcga

SEQ ID NO: 294739 - DNA, 20 bp, human
gcaaggaccaggcttatagt

SEQ ID NO: 294740 - DNA, 20 bp, human
gcatcgtacgggcaaggacc

SEQ ID NO: 294741 - DNA, 20 bp, human
gaccgccaaacgtagctgag

SEQ ID NO: 294742 - DNA, 20 bp, human
gtccttgcccgtacgatggg

SEQ ID NO: 294743 - DNA, 20 bp, human
gtaggagacgcgagggcgtg

SEQ ID NO: 294744 - DNA, 20 bp, human
gacctcccatcgtacgggca

SEQ ID NO: 294745 - DNA, 20 bp, human
gctgcgcgcagtttgtcaaa

SEQ ID NO: 294746 - DNA, 20 bp, human
gacgctcggcaatgaccaat

SEQ ID NO: 294747 - DNA, 20 bp, human
gcgttgcggccgctgtggaa

SEQ ID NO: 294748 - DNA, 20 bp, human
gaactcaccgctgcaggggg

SEQ ID NO: 294749 - DNA, 20 bp, human
gcggagaaccgcaatacgct

SEQ ID NO: 294750 - DNA, 20 bp, human
gcgtattgcggttctccggg

SEQ ID NO: 294751 - DNA, 20 bp, human
ggattgctgcgtcttcccat

SEQ ID NO: 294752 - DNA, 20 bp, human
gttctccgggagggttatat

SEQ ID NO: 294753 - DNA, 20 bp, human
gataaactcaccgctgcagg

SEQ ID NO: 294754 - DNA, 20 bp, human
gcgacacgttgcggccgctg

SEQ ID NO: 294755 - DNA, 20 bp, human
ggtgtcgcaaagcagaagga

SEQ ID NO: 294756 - DNA, 20 bp, human
gtcaaggcgacgtgggtagg

SEQ ID NO: 294757 - DNA, 20 bp, human
gttgtcaaggcgacgtgggt

SEQ ID NO: 294758 - DNA, 20 bp, human
gcacccgcgcggagccagag

SEQ ID NO: 294759 - DNA, 20 bp, human
ggcgacgtgggtaggaggag

SEQ ID NO: 294760 - DNA, 20 bp, human
gagagaggaggcggttgtca

SEQ ID NO: 294761 - DNA, 20 bp, human
ggagggaggtacacaggcgg

SEQ ID NO: 294762 - DNA, 20 bp, human
gccgcgcggagccagagagg

SEQ ID NO: 294763 - DNA, 20 bp, human
gggcagaaggcggaaaaaaa

SEQ ID NO: 294764 - DNA, 20 bp, human
gacgccgcgcgcaccagcgg

SEQ ID NO: 294765 - DNA, 20 bp, human
gaaaggggagggaggtacac

SEQ ID NO: 294766 - DNA, 20 bp, human
ggagcgccgcgcagcccctg

SEQ ID NO: 294767 - DNA, 20 bp, human
gcagcccctggggacccgcc

SEQ ID NO: 294768 - DNA, 20 bp, human
gtcgcgctagagggcgagag

SEQ ID NO: 294769 - DNA, 20 bp, human
gcgggagcgcccctcccagt

SEQ ID NO: 294770 - DNA, 20 bp, human
ggtccccgtggcccactggg

SEQ ID NO: 294771 - DNA, 20 bp, human
gggcgctcgcctcgcgctag

SEQ ID NO: 294772 - DNA, 20 bp, human
gcgcccctcccagtgggcca

SEQ ID NO: 294773 - DNA, 20 bp, human
gagcctgtctcaggtccccg

SEQ ID NO: 294774 - DNA, 20 bp, human
gccgtggagtagcctgtctc

SEQ ID NO: 294775 - DNA, 20 bp, human
ggatgctcccgtcacgccgg

SEQ ID NO: 294776 - DNA, 20 bp, human
gcctgcggggcgagagggtg

SEQ ID NO: 294777 - DNA, 20 bp, human
gaagctacgtcccggaggtg

SEQ ID NO: 294778 - DNA, 20 bp, human
gaggggaagctacgtcccgg

SEQ ID NO: 294779 - DNA, 20 bp, human
ggaggaggaggcatcgtccc

SEQ ID NO: 294780 - DNA, 20 bp, human
gaagcgcggcgcagtgatga

SEQ ID NO: 294781 - DNA, 20 bp, human
gcagcagctccgtggggcgc

SEQ ID NO: 294782 - DNA, 20 bp, human
gcgtcccggaggtgcggtgt

SEQ ID NO: 294783 - DNA, 20 bp, human
gtcccgccgcgcgcgaatcg

SEQ ID NO: 294784 - DNA, 20 bp, human
gctgctgtcagaccaacccc

SEQ ID NO: 294785 - DNA, 20 bp, human
gcgagagggtgggggcgaag

SEQ ID NO: 294786 - DNA, 20 bp, human
ggacccgggttgttgcgcga

SEQ ID NO: 294787 - DNA, 20 bp, human
ggcaacaacccgggtcccta

SEQ ID NO: 294788 - DNA, 20 bp, human
gggcaacccaagcatcccta

SEQ ID NO: 294789 - DNA, 20 bp, human
gaggagctacaggtcggggc

SEQ ID NO: 294790 - DNA, 20 bp, human
gcgggtccctagggatgctt

SEQ ID NO: 294791 - DNA, 20 bp, human
gcacccctcgcgcaacaacc

SEQ ID NO: 294792 - DNA, 20 bp, human
gcccctccagcttcgagcgg

SEQ ID NO: 294793 - DNA, 20 bp, human
gctgggaggagctacaggtc

SEQ ID NO: 294794 - DNA, 20 bp, human
ggccacccgccgctcgaagc

SEQ ID NO: 294795 - DNA, 20 bp, human
ggaggcagcggcgacctcgc

SEQ ID NO: 294796 - DNA, 20 bp, human
gggcctgcgcagagcctcgt

SEQ ID NO: 294797 - DNA, 20 bp, human
ggtaactgagccaacgcgag

SEQ ID NO: 294798 - DNA, 20 bp, human
gttgatgacggcaagagcga

SEQ ID NO: 294799 - DNA, 20 bp, human
gctgcgcaggccgctcgcgt

SEQ ID NO: 294800 - DNA, 20 bp, human
ggggacctctgccgttgcta

SEQ ID NO: 294801 - DNA, 20 bp, human
gctcccacgaggctctgcgc

SEQ ID NO: 294802 - DNA, 20 bp, human
gcgtgggagtggtggttcga

SEQ ID NO: 294803 - DNA, 20 bp, human
gtcaaggctcgcttgaatgt

SEQ ID NO: 294804 - DNA, 20 bp, human
gttcaagcgagccttgatga

SEQ ID NO: 294805 - DNA, 20 bp, human
gcagagcctcgtgggagtgg

SEQ ID NO: 294806 - DNA, 20 bp, human
gggtggcgaagtgcggagac

SEQ ID NO: 294807 - DNA, 20 bp, human
gcaacaagatgcgttgggat

SEQ ID NO: 294808 - DNA, 20 bp, human
gccctccgccgcgctggaaa

SEQ ID NO: 294809 - DNA, 20 bp, human
gcccctagaacgcagagggg

SEQ ID NO: 294810 - DNA, 20 bp, human
ggcgccccctagaacgcaga

SEQ ID NO: 294811 - DNA, 20 bp, human
ggtaacgcggaggaacgaca

SEQ ID NO: 294812 - DNA, 20 bp, human
gaagtgagatggggactacg

SEQ ID NO: 294813 - DNA, 20 bp, human
gaacgcagagggggggcaga

SEQ ID NO: 294814 - DNA, 20 bp, human
gaaggcggggccggcaactc

SEQ ID NO: 294815 - DNA, 20 bp, human
gtccgggcaacaagatgcgt

SEQ ID NO: 294816 - DNA, 20 bp, human
gcctcgtgcggccctcgcgg

SEQ ID NO: 294817 - DNA, 20 bp, human
gagcagcagtaacgcctcta

SEQ ID NO: 294818 - DNA, 20 bp, human
gcggcgggcgtcacagagcg

SEQ ID NO: 294819 - DNA, 20 bp, human
gggcgccatggcaaccacgc

SEQ ID NO: 294820 - DNA, 20 bp, human
gccagcccgcgtggttgcca

SEQ ID NO: 294821 - DNA, 20 bp, human
ggctggaccgccttcttccg

SEQ ID NO: 294822 - DNA, 20 bp, human
gtctgtgacgcccgccgcga

SEQ ID NO: 294823 - DNA, 20 bp, human
ggaggcggagagagcggaaa

SEQ ID NO: 294824 - DNA, 20 bp, human
gagtgtgcgcgtccctggcc

SEQ ID NO: 294825 - DNA, 20 bp, human
ggcgcacgccgggcctcgtg

SEQ ID NO: 294826 - DNA, 20 bp, human
gcccgcgcggcctgaggaag

SEQ ID NO: 294827 - DNA, 20 bp, human
gaaaaccctggagactgcta

SEQ ID NO: 294828 - DNA, 20 bp, human
gtcaccacgccgcgccgcgt

SEQ ID NO: 294829 - DNA, 20 bp, human
gaaacagctagggagaccgc

SEQ ID NO: 294830 - DNA, 20 bp, human
ggggccagcgcgcagaagtg

SEQ ID NO: 294831 - DNA, 20 bp, human
gggcaagtggggcgagtcta

SEQ ID NO: 294832 - DNA, 20 bp, human
gacgccgcgccgcgtgggtc

SEQ ID NO: 294833 - DNA, 20 bp, human
gaagtgcggacgcaacccgg

SEQ ID NO: 294834 - DNA, 20 bp, human
ggggagctggagtcacgtga

SEQ ID NO: 294835 - DNA, 20 bp, human
ggggccggtggaacacgccc

SEQ ID NO: 294836 - DNA, 20 bp, human
gcgagagaggcaggcaacaa

SEQ ID NO: 294837 - DNA, 20 bp, human
gcggggacggggtgaccttc

SEQ ID NO: 294838 - DNA, 20 bp, human
gcgaacgtgcccgggaagtg

SEQ ID NO: 294839 - DNA, 20 bp, human
gggcgtggcccttcctgcgt

SEQ ID NO: 294840 - DNA, 20 bp, human
ggcaacaagggcacggctgg

SEQ ID NO: 294841 - DNA, 20 bp, human
gggaagggccacgccgagag

SEQ ID NO: 294842 - DNA, 20 bp, human
gcccggcgggagcacctggt

SEQ ID NO: 294843 - DNA, 20 bp, human
ggcggggaggcgacagtccc

SEQ ID NO: 294844 - DNA, 20 bp, human
gcgcatcagcgcagtacctt

SEQ ID NO: 294845 - DNA, 20 bp, human
ggccgcgggcggtctcccga

SEQ ID NO: 294846 - DNA, 20 bp, human
ggctgcctcctctgcgctga

SEQ ID NO: 294847 - DNA, 20 bp, human
ggcctcctctgcgctgaggg

SEQ ID NO: 294848 - DNA, 20 bp, human
gcaaaagcctaggaagctcg

SEQ ID NO: 294849 - DNA, 20 bp, human
gtgcgctgagggcggtatcc

SEQ ID NO: 294850 - DNA, 20 bp, human
gaccgccctcagcgcagagg

SEQ ID NO: 294851 - DNA, 20 bp, human
gaggcggaccccaaaagcct

SEQ ID NO: 294852 - DNA, 20 bp, human
gtctgcgcgacccacgcagg

SEQ ID NO: 294853 - DNA, 20 bp, human
gccttctgcgcgacccacgc

SEQ ID NO: 294854 - DNA, 20 bp, human
gtgtctttggacatttccac

SEQ ID NO: 294855 - DNA, 20 bp, human
ggggcggacggcggttctcc

SEQ ID NO: 294856 - DNA, 20 bp, human
ggtgacctgcataggtaggg

SEQ ID NO: 294857 - DNA, 20 bp, human
ggaggtgacctgcataggta

SEQ ID NO: 294858 - DNA, 20 bp, human
ggtggtgaggtgacctgcat

SEQ ID NO: 294859 - DNA, 20 bp, human
gtcgaaggagatatttaagg

SEQ ID NO: 294860 - DNA, 20 bp, human
ggaagtgtagttccgagcgg

SEQ ID NO: 294861 - DNA, 20 bp, human
gaaaggtgggacccgcttgc

SEQ ID NO: 294862 - DNA, 20 bp, human
gtctcccaccctacctatgc

SEQ ID NO: 294863 - DNA, 20 bp, human
ggcctgcggagcgtgtactc

SEQ ID NO: 294864 - DNA, 20 bp, human
gcagctctgtccccagcaag

SEQ ID NO: 294865 - DNA, 20 bp, human
gcatcttgggcaagtccctt

SEQ ID NO: 294866 - DNA, 20 bp, human
gaaggcgtggagcggactga

SEQ ID NO: 294867 - DNA, 20 bp, human
gggaatgggcggagctgaag

SEQ ID NO: 294868 - DNA, 20 bp, human
gccaatcatggaggagtcgt

SEQ ID NO: 294869 - DNA, 20 bp, human
gcggggctagatcggggaga

SEQ ID NO: 294870 - DNA, 20 bp, human
ggccagatagcaaagattga

SEQ ID NO: 294871 - DNA, 20 bp, human
ggctggggcggggctagatc

SEQ ID NO: 294872 - DNA, 20 bp, human
ggcagcggccgggcaggtat

SEQ ID NO: 294873 - DNA, 20 bp, human
ggcggccgggcaggtattgg

SEQ ID NO: 294874 - DNA, 20 bp, human
ggggggcgttccggaattga

SEQ ID NO: 294875 - DNA, 20 bp, human
gaggaagacgcctgcagagc

SEQ ID NO: 294876 - DNA, 20 bp, human
gggcctggcgcgcatcccgt

SEQ ID NO: 294877 - DNA, 20 bp, human
gcgggggcgtggtcgagctg

SEQ ID NO: 294878 - DNA, 20 bp, human
gaccacgcccccgagctctg

SEQ ID NO: 294879 - DNA, 20 bp, human
gtccgcccctcccgggacct

SEQ ID NO: 294880 - DNA, 20 bp, human
ggcccagcctagggcgcaca

SEQ ID NO: 294881 - DNA, 20 bp, human
gcccagaggctaccgctctg

SEQ ID NO: 294882 - DNA, 20 bp, human
ggcacgtgacagtcacgggg

SEQ ID NO: 294883 - DNA, 20 bp, human
gctgaggagtgcaatggagc

SEQ ID NO: 294884 - DNA, 20 bp, human
gagccgacgggatgcgcgcc

SEQ ID NO: 294885 - DNA, 20 bp, human
gccgcccccggcctggccat

SEQ ID NO: 294886 - DNA, 20 bp, human
ggaagagggtggtatggggt

SEQ ID NO: 294887 - DNA, 20 bp, human
ggcaccgcgggagatctgtt

SEQ ID NO: 294888 - DNA, 20 bp, human
gaggtccagtcccgagagga

SEQ ID NO: 294889 - DNA, 20 bp, human
gcctcccccggtcccggcgg

SEQ ID NO: 294890 - DNA, 20 bp, human
gggcgaggtccagtcccgag

SEQ ID NO: 294891 - DNA, 20 bp, human
gcgggagatctgttcggaag

SEQ ID NO: 294892 - DNA, 20 bp, human
gtcgtggggccgcccgggag

SEQ ID NO: 294893 - DNA, 20 bp, human
gtgttcggaagagggtggta

SEQ ID NO: 294894 - DNA, 20 bp, human
ggcccgagagggcgggtcgt

SEQ ID NO: 294895 - DNA, 20 bp, human
gccagcggggggcacgaccc

SEQ ID NO: 294896 - DNA, 20 bp, human
gcaccctaggggaccgttct

SEQ ID NO: 294897 - DNA, 20 bp, human
gcggcctctcagacgagggt

SEQ ID NO: 294898 - DNA, 20 bp, human
gcggaagcttctgagagcga

SEQ ID NO: 294899 - DNA, 20 bp, human
gaggggtcgaggtgatttgt

SEQ ID NO: 294900 - DNA, 20 bp, human
gctcgggagaggaatcggtt

SEQ ID NO: 294901 - DNA, 20 bp, human
ggacgagggtgggttagcgg

SEQ ID NO: 294902 - DNA, 20 bp, human
gcaccgagaacggtccccta

SEQ ID NO: 294903 - DNA, 20 bp, human
gaagtccctaggcaccctag

SEQ ID NO: 294904 - DNA, 20 bp, human
gtaacccaccctcgtctgag

SEQ ID NO: 294905 - DNA, 20 bp, human
gagaggaatcggttaggaga

SEQ ID NO: 294906 - DNA, 20 bp, human
gcccgcgcgttgccgggcag

SEQ ID NO: 294907 - DNA, 20 bp, human
ggggctcggcgcggcagagg

SEQ ID NO: 294908 - DNA, 20 bp, human
gggctccgaggctccgaagg

SEQ ID NO: 294909 - DNA, 20 bp, human
ggggccggaaccgaggacag

SEQ ID NO: 294910 - DNA, 20 bp, human
gcccgggcccgcgcgttgcc

SEQ ID NO: 294911 - DNA, 20 bp, human
gggcgcggcagaggcggcaa

SEQ ID NO: 294912 - DNA, 20 bp, human
gcggctggcgcccctgtcct

SEQ ID NO: 294913 - DNA, 20 bp, human
gaggcaggcaggcgtccggc

SEQ ID NO: 294914 - DNA, 20 bp, human
ggcgtccggccggccgggag

SEQ ID NO: 294915 - DNA, 20 bp, human
ggcggcagaggcggcaaggg

SEQ ID NO: 294916 - DNA, 20 bp, human
gatgggactgtggacaacga

SEQ ID NO: 294917 - DNA, 20 bp, human
gtccaaccggggcctaaagg

SEQ ID NO: 294918 - DNA, 20 bp, human
gcactgaaggatgtccctga

SEQ ID NO: 294919 - DNA, 20 bp, human
ggtcttggacgcaggggttc

SEQ ID NO: 294920 - DNA, 20 bp, human
gaccgagtccctggtccaac

SEQ ID NO: 294921 - DNA, 20 bp, human
gaagaagcagccgatgtgtc

SEQ ID NO: 294922 - DNA, 20 bp, human
gtggtccaaccggggcctaa

SEQ ID NO: 294923 - DNA, 20 bp, human
ggaatccttggaaggttcga

SEQ ID NO: 294924 - DNA, 20 bp, human
ggcctccctcgaaccttcca

SEQ ID NO: 294925 - DNA, 20 bp, human
gactcggtagaatccttgga

SEQ ID NO: 294926 - DNA, 20 bp, human
gcggcccgcagataacaccc

SEQ ID NO: 294927 - DNA, 20 bp, human
gcaagcccgggtgttatctg

SEQ ID NO: 294928 - DNA, 20 bp, human
gtatctgcgggccgggtccg

SEQ ID NO: 294929 - DNA, 20 bp, human
gcccgaggcggtggctgcga

SEQ ID NO: 294930 - DNA, 20 bp, human
gtgctgcggatgcacgctga

SEQ ID NO: 294931 - DNA, 20 bp, human
gacgctccgcctcacgcccg

SEQ ID NO: 294932 - DNA, 20 bp, human
gctccgcctcacgcccgagg

SEQ ID NO: 294933 - DNA, 20 bp, human
gggtggcactaggaccgcgg

SEQ ID NO: 294934 - DNA, 20 bp, human
ggtagctgttcctggatcct

SEQ ID NO: 294935 - DNA, 20 bp, human
gagtgccaccagagaagccg

SEQ ID NO: 294936 - DNA, 20 bp, human
gccagcatcctctgcggcgc

SEQ ID NO: 294937 - DNA, 20 bp, human
gggagatagcggaccagtga

SEQ ID NO: 294938 - DNA, 20 bp, human
gagaggctccggggagatag

SEQ ID NO: 294939 - DNA, 20 bp, human
gcccgcgcgtgggtgaagaa

SEQ ID NO: 294940 - DNA, 20 bp, human
gtggcctcccagctcacgca

SEQ ID NO: 294941 - DNA, 20 bp, human
ggaaaaccgcttcaaaagag

SEQ ID NO: 294942 - DNA, 20 bp, human
gaaagaggggcagccctcac

SEQ ID NO: 294943 - DNA, 20 bp, human
gacccgcccctgcgtgagct

SEQ ID NO: 294944 - DNA, 20 bp, human
gcgcccctgcgtgagctggg

SEQ ID NO: 294945 - DNA, 20 bp, human
gttccttccccgcgccgcag

SEQ ID NO: 294946 - DNA, 20 bp, human
gtcagggggtggaggaacga

SEQ ID NO: 294947 - DNA, 20 bp, human
gggcccagcagtcccgttca

SEQ ID NO: 294948 - DNA, 20 bp, human
gctgccgcgccggcagccac

SEQ ID NO: 294949 - DNA, 20 bp, human
gtccccacgcacctactcgg

SEQ ID NO: 294950 - DNA, 20 bp, human
ggcaggacgcgctggtggga

SEQ ID NO: 294951 - DNA, 20 bp, human
ggccgccgagtaggtgcgtg

SEQ ID NO: 294952 - DNA, 20 bp, human
gcagccgctatgccagcctg

SEQ ID NO: 294953 - DNA, 20 bp, human
gaactcgcgtccctgagtcc

SEQ ID NO: 294954 - DNA, 20 bp, human
gcgggagcggatccaacttc

SEQ ID NO: 294955 - DNA, 20 bp, human
gggcttgcggctccactacc

SEQ ID NO: 294956 - DNA, 20 bp, human
ggctcctccagcccctcccg

SEQ ID NO: 294957 - DNA, 20 bp, human
gcccagggagcgagtgtccc

SEQ ID NO: 294958 - DNA, 20 bp, human
gtccccggccgtcagaggcg

SEQ ID NO: 294959 - DNA, 20 bp, human
gaaggcgagccctgggtgta

SEQ ID NO: 294960 - DNA, 20 bp, human
gggcgcgggatggaagtcca

SEQ ID NO: 294961 - DNA, 20 bp, human
gaaggggccaccgccctgcg

SEQ ID NO: 294962 - DNA, 20 bp, human
gcccgagcttggggacgacg

SEQ ID NO: 294963 - DNA, 20 bp, human
gaaagcgggcgcaagagcgg

SEQ ID NO: 294964 - DNA, 20 bp, human
gcccgcgcctctgacggccg

SEQ ID NO: 294965 - DNA, 20 bp, human
gacactcgctccctgggccg

SEQ ID NO: 294966 - DNA, 20 bp, human
gagggcggggagtggggcta

SEQ ID NO: 294967 - DNA, 20 bp, human
gcacaaggctgtaagaccag

SEQ ID NO: 294968 - DNA, 20 bp, human
gctggagtgcgtggggactg

SEQ ID NO: 294969 - DNA, 20 bp, human
gccagaggctggagtgcgtg

SEQ ID NO: 294970 - DNA, 20 bp, human
gtctagctgtgggatctcac

SEQ ID NO: 294971 - DNA, 20 bp, human
gcctaggcccaggcgggagc

SEQ ID NO: 294972 - DNA, 20 bp, human
gaggtgccacacaccctctg

SEQ ID NO: 294973 - DNA, 20 bp, human
gtggcggccctaggcccagg

SEQ ID NO: 294974 - DNA, 20 bp, human
gcacagaggccagcctgcgc

SEQ ID NO: 294975 - DNA, 20 bp, human
gtccccacaccagcccgggg

SEQ ID NO: 294976 - DNA, 20 bp, human
gtatggttgtggattcatgg

SEQ ID NO: 294977 - DNA, 20 bp, human
gggctgtcgtatggaatctg

SEQ ID NO: 294978 - DNA, 20 bp, human
gttggaaaacagtcagtgtc

SEQ ID NO: 294979 - DNA, 20 bp, human
gtctctgagctctggacgag

SEQ ID NO: 294980 - DNA, 20 bp, human
gtcagcagagggctgtcgta

SEQ ID NO: 294981 - DNA, 20 bp, human
gaagttcgttccagctccaa

SEQ ID NO: 294982 - DNA, 20 bp, human
gtggccacgcgggtcgaggt

SEQ ID NO: 294983 - DNA, 20 bp, human
gacccgcgtggccatggtta

SEQ ID NO: 294984 - DNA, 20 bp, human
gtggaacgaacttcagggat

SEQ ID NO: 294985 - DNA, 20 bp, human
ggccgggtgaggtcagcaga

SEQ ID NO: 294986 - DNA, 20 bp, human
gggtgactggggaacatcca

SEQ ID NO: 294987 - DNA, 20 bp, human
gcggccggcggcagttccca

SEQ ID NO: 294988 - DNA, 20 bp, human
ggggcgggagcgcttccggc

SEQ ID NO: 294989 - DNA, 20 bp, human
ggacgcgcccccgtcaccat

SEQ ID NO: 294990 - DNA, 20 bp, human
ggacccgccggagaggtccc

SEQ ID NO: 294991 - DNA, 20 bp, human
ggacctctccggcgggtcag

SEQ ID NO: 294992 - DNA, 20 bp, human
gcgagtccgcagtggcgcct

SEQ ID NO: 294993 - DNA, 20 bp, human
ggcaggacccgagtccgcag

SEQ ID NO: 294994 - DNA, 20 bp, human
gctcgcttggacacccctgc

SEQ ID NO: 294995 - DNA, 20 bp, human
ggagcggggtcgggcctcga

SEQ ID NO: 294996 - DNA, 20 bp, human
gtagcaaccaccatgacctt

SEQ ID NO: 294997 - DNA, 20 bp, human
gcaccccctaagagctgcca

SEQ ID NO: 294998 - DNA, 20 bp, human
gagcgctataaggggaagtc

SEQ ID NO: 294999 - DNA, 20 bp, human
gctgtcctggatcacctcct

SEQ ID NO: 295000 - DNA, 20 bp, human
gagggggtggggattctaga

SEQ ID NO: 295001 - DNA, 20 bp, human
gtgcctctaggtacatggag

SEQ ID NO: 295002 - DNA, 20 bp, human
ggtgctcagaaaatgcccgt

SEQ ID NO: 295003 - DNA, 20 bp, human
gcatcctgttccccaacctc

SEQ ID NO: 295004 - DNA, 20 bp, human
ggatgggaagggaccaaaaa

SEQ ID NO: 295005 - DNA, 20 bp, human
gactcaggatgagccggtgt

SEQ ID NO: 295006 - DNA, 20 bp, human
gccagggtacggtcacgtga

SEQ ID NO: 295007 - DNA, 20 bp, human
gccctgggcgggtagttgtt

SEQ ID NO: 295008 - DNA, 20 bp, human
gctggagcgcggggtttcat

SEQ ID NO: 295009 - DNA, 20 bp, human
ggacaccgagcagcctaagc

SEQ ID NO: 295010 - DNA, 20 bp, human
gggcgggtagttgttggggc

SEQ ID NO: 295011 - DNA, 20 bp, human
gcaactacccgcccagggta

SEQ ID NO: 295012 - DNA, 20 bp, human
ggagatgggtgcatctggaa

SEQ ID NO: 295013 - DNA, 20 bp, human
gacacaagatcctaacctcc

SEQ ID NO: 295014 - DNA, 20 bp, human
ggccgcgcgagcgaagagtg

SEQ ID NO: 295015 - DNA, 20 bp, human
gcgcggcgccaattggcgag

SEQ ID NO: 295016 - DNA, 20 bp, human
ggggacagggcctattcccg

SEQ ID NO: 295017 - DNA, 20 bp, human
gtgggcccctaggcaggctg

SEQ ID NO: 295018 - DNA, 20 bp, human
ggccctgtcccgccttcctc

SEQ ID NO: 295019 - DNA, 20 bp, human
gtcccggcggcccccgagga

SEQ ID NO: 295020 - DNA, 20 bp, human
gaatggccggaccaaaccgc

SEQ ID NO: 295021 - DNA, 20 bp, human
gcggaccaaaccgcgggaat

SEQ ID NO: 295022 - DNA, 20 bp, human
ggacaggtgtgacaaataat

SEQ ID NO: 295023 - DNA, 20 bp, human
gccaccgagcgcggcccata

SEQ ID NO: 295024 - DNA, 20 bp, human
gtggcgggcggtttgaatga

SEQ ID NO: 295025 - DNA, 20 bp, human
gtcggcgatggctctcccgc

SEQ ID NO: 295026 - DNA, 20 bp, human
ggtgccgggtcatccgagtc

SEQ ID NO: 295027 - DNA, 20 bp, human
gtggctggcgaaagccgtcg

SEQ ID NO: 295028 - DNA, 20 bp, human
ggggaaagggcgcatttcca

SEQ ID NO: 295029 - DNA, 20 bp, human
gtgacccgactcggatgacc

SEQ ID NO: 295030 - DNA, 20 bp, human
gaaagccgtcgcggaggcgt

SEQ ID NO: 295031 - DNA, 20 bp, human
ggaacagcgtgcggtctcca

SEQ ID NO: 295032 - DNA, 20 bp, human
gccagccacgtgacccgact

SEQ ID NO: 295033 - DNA, 20 bp, human
gcctccccacgcctccgcga

SEQ ID NO: 295034 - DNA, 20 bp, human
gcttctaggagaacagcgtg

SEQ ID NO: 295035 - DNA, 20 bp, human
gccgcgccggcctggtcttc

SEQ ID NO: 295036 - DNA, 20 bp, human
gactccctgggaagtgtagg

SEQ ID NO: 295037 - DNA, 20 bp, human
gcgcgcgggctgggcacaaa

SEQ ID NO: 295038 - DNA, 20 bp, human
gtccgggccgggtgcgccgt

SEQ ID NO: 295039 - DNA, 20 bp, human
ggggtcgggccaccagacgg

SEQ ID NO: 295040 - DNA, 20 bp, human
gccgtgggaagagcgaggag

SEQ ID NO: 295041 - DNA, 20 bp, human
gagcggggaggaaaacttgg

SEQ ID NO: 295042 - DNA, 20 bp, human
gctctgcgggtctgtacaat

SEQ ID NO: 295043 - DNA, 20 bp, human
ggggcggactcgggttcctc

SEQ ID NO: 295044 - DNA, 20 bp, human
gaaacttggcggggcggact

SEQ ID NO: 295045 - DNA, 20 bp, human
gcaaagggctcaggcacaaa

SEQ ID NO: 295046 - DNA, 20 bp, human
gcgcccgggacgggtcaagg

SEQ ID NO: 295047 - DNA, 20 bp, human
ggtgcggaatggagccggag

SEQ ID NO: 295048 - DNA, 20 bp, human
gcgggacgggtcaaggaggg

SEQ ID NO: 295049 - DNA, 20 bp, human
gctaggaaggcggtcccata

SEQ ID NO: 295050 - DNA, 20 bp, human
gcgggatggtgcagttggtg

SEQ ID NO: 295051 - DNA, 20 bp, human
ggggcccggcccaaggtggt

SEQ ID NO: 295052 - DNA, 20 bp, human
gcagtctgcgcccgccctat

SEQ ID NO: 295053 - DNA, 20 bp, human
ggggcggaatgaacctggag

SEQ ID NO: 295054 - DNA, 20 bp, human
gggcggccctggcgcggcta

SEQ ID NO: 295055 - DNA, 20 bp, human
gccctggcgcggctagggtg

SEQ ID NO: 295056 - DNA, 20 bp, human
ggcgctgcggacggggttgc

SEQ ID NO: 295057 - DNA, 20 bp, human
gggtaacagaggcgctgcga

SEQ ID NO: 295058 - DNA, 20 bp, human
ggggcgggagggcaccggag

SEQ ID NO: 295059 - DNA, 20 bp, human
ggagactagcgccgaggggt

SEQ ID NO: 295060 - DNA, 20 bp, human
gcaccgcggggcgggaagtg

SEQ ID NO: 295061 - DNA, 20 bp, human
ggtgtgaggcgctgcggacg

SEQ ID NO: 295062 - DNA, 20 bp, human
ggggcggtgccgaccactgc

SEQ ID NO: 295063 - DNA, 20 bp, human
gggcagccgcggccctgtgg

SEQ ID NO: 295064 - DNA, 20 bp, human
ggggctcgggtgcccaccgc

SEQ ID NO: 295065 - DNA, 20 bp, human
ggaggtgagcgagacgccga

SEQ ID NO: 295066 - DNA, 20 bp, human
ggggcgggagggcaccggag

SEQ ID NO: 295067 - DNA, 20 bp, human
gtcctctggcatacactccc

SEQ ID NO: 295068 - DNA, 20 bp, human
ggcgctgcggacggggttgc

SEQ ID NO: 295069 - DNA, 20 bp, human
ggagactagcgccgaggggt

SEQ ID NO: 295070 - DNA, 20 bp, human
gaagagacaagacgctggga

SEQ ID NO: 295071 - DNA, 20 bp, human
ggcaggggctcggcgctcat

SEQ ID NO: 295072 - DNA, 20 bp, human
gcgggccagcgccgcagcgg

SEQ ID NO: 295073 - DNA, 20 bp, human
ggctgcactgcgacaagcct

SEQ ID NO: 295074 - DNA, 20 bp, human
gaaccctgagtccagaagaa

SEQ ID NO: 295075 - DNA, 20 bp, human
gagacaagacgctgggaggg

SEQ ID NO: 295076 - DNA, 20 bp, human
gcacacaagacgtatactat

SEQ ID NO: 295077 - DNA, 20 bp, human
ggtgtggaatggaaagagca

SEQ ID NO: 295078 - DNA, 20 bp, human
gtccccaattttacaagatg

SEQ ID NO: 295079 - DNA, 20 bp, human
ggctatactatgtttatttt

SEQ ID NO: 295080 - DNA, 20 bp, human
gcttctgtttgtgaggtgtg

SEQ ID NO: 295081 - DNA, 20 bp, human
gagatcacagcgctaagaag

SEQ ID NO: 295082 - DNA, 20 bp, human
ggaacctcatcttgtaaaat

SEQ ID NO: 295083 - DNA, 20 bp, human
ggtatacgtcttgtgtggaa

SEQ ID NO: 295084 - DNA, 20 bp, human
gattatctgctaccatgtaa

SEQ ID NO: 295085 - DNA, 20 bp, human
gctaaatctcttcacaaaaa

SEQ ID NO: 295086 - DNA, 20 bp, human
gcggtctcctggggagcgaa

SEQ ID NO: 295087 - DNA, 20 bp, human
ggagctacgtccggtctcct

SEQ ID NO: 295088 - DNA, 20 bp, human
ggggtcacgtggcggaaatg

SEQ ID NO: 295089 - DNA, 20 bp, human
gccggcttgaggcacgatag

SEQ ID NO: 295090 - DNA, 20 bp, human
gtaggctagagagctacgtc

SEQ ID NO: 295091 - DNA, 20 bp, human
gacactgtagcgcctcgcgc

SEQ ID NO: 295092 - DNA, 20 bp, human
ggccggctccccggtctcct

SEQ ID NO: 295093 - DNA, 20 bp, human
gaagttgcagcctgggacca

SEQ ID NO: 295094 - DNA, 20 bp, human
ggcggacgtgcgccccatgg

SEQ ID NO: 295095 - DNA, 20 bp, human
gctcaagccggaagttgata

SEQ ID NO: 295096 - DNA, 20 bp, human
gtgtgtaacgacacctccta

SEQ ID NO: 295097 - DNA, 20 bp, human
ggggcccaggacgtgtagta

SEQ ID NO: 295098 - DNA, 20 bp, human
gaccggaaacgcgccgtggt

SEQ ID NO: 295099 - DNA, 20 bp, human
gcgagctcggtgcgtgccgt

SEQ ID NO: 295100 - DNA, 20 bp, human
ggctcgatctacacctcctc

SEQ ID NO: 295101 - DNA, 20 bp, human
ggctcggtgcgtgccgtagg

SEQ ID NO: 295102 - DNA, 20 bp, human
ggcagcaacgactgcgagct

SEQ ID NO: 295103 - DNA, 20 bp, human
gacggggcagcggtgactat

SEQ ID NO: 295104 - DNA, 20 bp, human
gcgcagtcgttgctgccccg

SEQ ID NO: 295105 - DNA, 20 bp, human
gcacggcgcgtttccggtgc

SEQ ID NO: 295106 - DNA, 20 bp, human
gccactggggcaagactcac

SEQ ID NO: 295107 - DNA, 20 bp, human
gcagcccgacgccagcaagg

SEQ ID NO: 295108 - DNA, 20 bp, human
gggggcaagactcacgggag

SEQ ID NO: 295109 - DNA, 20 bp, human
ggggcggggcggagtccact

SEQ ID NO: 295110 - DNA, 20 bp, human
gcggcggcgcgggcagaagc

SEQ ID NO: 295111 - DNA, 20 bp, human
ggggacttgcgggtcccctg

SEQ ID NO: 295112 - DNA, 20 bp, human
gagccagcccgacgccagca

SEQ ID NO: 295113 - DNA, 20 bp, human
gtggggagggctcacgggag

SEQ ID NO: 295114 - DNA, 20 bp, human
ggcaccacctgggtcgggaa

SEQ ID NO: 295115 - DNA, 20 bp, human
gaagctggagagcatgcagc

SEQ ID NO: 295116 - DNA, 20 bp, human
ggagcaggccggagagaagg

SEQ ID NO: 295117 - DNA, 20 bp, human
gggaccactcgttcccaggc

SEQ ID NO: 295118 - DNA, 20 bp, human
gccagtggagttaagtgcag

SEQ ID NO: 295119 - DNA, 20 bp, human
gggcgggaccactcgttccc

SEQ ID NO: 295120 - DNA, 20 bp, human
gaaggggcccaacacgtgtt

SEQ ID NO: 295121 - DNA, 20 bp, human
gacgacagatggaaaacggg

SEQ ID NO: 295122 - DNA, 20 bp, human
ggcgggacaaaagctgccgg

SEQ ID NO: 295123 - DNA, 20 bp, human
gggacaaaagctgccggggg

SEQ ID NO: 295124 - DNA, 20 bp, human
gggacttcactcttccggcc

SEQ ID NO: 295125 - DNA, 20 bp, human
ggaccgccggcgtcgtttga

SEQ ID NO: 295126 - DNA, 20 bp, human
ggggcggaggtgtgcaagtt

SEQ ID NO: 295127 - DNA, 20 bp, human
gtcgggcggcccaatgagga

SEQ ID NO: 295128 - DNA, 20 bp, human
ggggatcgggcggcccaatg

SEQ ID NO: 295129 - DNA, 20 bp, human
gaacgcggcgcgcccagggt

SEQ ID NO: 295130 - DNA, 20 bp, human
gaacccgccaatcaggctgc

SEQ ID NO: 295131 - DNA, 20 bp, human
gcggcattctgtcttcttat

SEQ ID NO: 295132 - DNA, 20 bp, human
ggccccccggccctcctcat

SEQ ID NO: 295133 - DNA, 20 bp, human
gggaaaccaaggagtgaacg

SEQ ID NO: 295134 - DNA, 20 bp, human
ggccctctagcgtagtgcaa

SEQ ID NO: 295135 - DNA, 20 bp, human
gcactacgctagagggcggg

SEQ ID NO: 295136 - DNA, 20 bp, human
gtctgggcacctttctgaat

SEQ ID NO: 295137 - DNA, 20 bp, human
ggacagctccgggagaagag

SEQ ID NO: 295138 - DNA, 20 bp, human
gatggcaggggcaacagcga

SEQ ID NO: 295139 - DNA, 20 bp, human
gaatgggcagagacagctcc

SEQ ID NO: 295140 - DNA, 20 bp, human
gagcagaggcggccccactc

SEQ ID NO: 295141 - DNA, 20 bp, human
gtcagaaaggtgcccagagt

SEQ ID NO: 295142 - DNA, 20 bp, human
gtggggaagaagggtagagg

SEQ ID NO: 295143 - DNA, 20 bp, human
gtgggggggcacataaggaa

SEQ ID NO: 295144 - DNA, 20 bp, human
gaggaggggggacgaggcag

SEQ ID NO: 295145 - DNA, 20 bp, human
ggcaggggaagaacctggga

SEQ ID NO: 295146 - DNA, 20 bp, human
gaagccccgctgggcggtga

SEQ ID NO: 295147 - DNA, 20 bp, human
gaatcgaacatgttgatgga

SEQ ID NO: 295148 - DNA, 20 bp, human
gtggtccgcgcaaccctagc

SEQ ID NO: 295149 - DNA, 20 bp, human
ggggcacgatggtggcgggg

SEQ ID NO: 295150 - DNA, 20 bp, human
gcgcaccggggatggcgaca

SEQ ID NO: 295151 - DNA, 20 bp, human
gggcggggcacgatggtggc

SEQ ID NO: 295152 - DNA, 20 bp, human
gtacgcatgcgcaccgggga

SEQ ID NO: 295153 - DNA, 20 bp, human
gggccaatcgaacatgttga

SEQ ID NO: 295154 - DNA, 20 bp, human
gccccgccccgctacgcaaa

SEQ ID NO: 295155 - DNA, 20 bp, human
gcgcaaccctagcaggcttc

SEQ ID NO: 295156 - DNA, 20 bp, human
ggcggggcgtagagcaggcg

SEQ ID NO: 295157 - DNA, 20 bp, human
gcccctgggcgtggagggga

SEQ ID NO: 295158 - DNA, 20 bp, human
ggcaaggcctaggaatgtgg

SEQ ID NO: 295159 - DNA, 20 bp, human
gttgccacgccccctgggcg

SEQ ID NO: 295160 - DNA, 20 bp, human
gcacccaggacaagcgcccc

SEQ ID NO: 295161 - DNA, 20 bp, human
gccgggttgccacgccccct

SEQ ID NO: 295162 - DNA, 20 bp, human
gcacgccccctgggcgtgga

SEQ ID NO: 295163 - DNA, 20 bp, human
ggatcacgtgccctgggtag

SEQ ID NO: 295164 - DNA, 20 bp, human
gaggacaagcgccccaggca

SEQ ID NO: 295165 - DNA, 20 bp, human
ggcagcaaggcctaggaatg

SEQ ID NO: 295166 - DNA, 20 bp, human
gctacgggaacgtaaagagg

SEQ ID NO: 295167 - DNA, 20 bp, human
gggcctacgggaacgtaaag

SEQ ID NO: 295168 - DNA, 20 bp, human
gctggcgcgcaaggcaccat

SEQ ID NO: 295169 - DNA, 20 bp, human
gcccccggagcgtggcctac

SEQ ID NO: 295170 - DNA, 20 bp, human
gcgggggcggggctccagtg

SEQ ID NO: 295171 - DNA, 20 bp, human
gtgggatgcagtatcctcac

SEQ ID NO: 295172 - DNA, 20 bp, human
gtcccgtaggccacgctccg

SEQ ID NO: 295173 - DNA, 20 bp, human
ggtggtctgtctgcttgctc

SEQ ID NO: 295174 - DNA, 20 bp, human
ggagacgctagaattgagtg

SEQ ID NO: 295175 - DNA, 20 bp, human
gaattctagcgtctcggctc

SEQ ID NO: 295176 - DNA, 20 bp, human
gcagctggagtctttccgga

SEQ ID NO: 295177 - DNA, 20 bp, human
gtgggcagctggagtctttc

SEQ ID NO: 295178 - DNA, 20 bp, human
gctccagaaccccctagcta

SEQ ID NO: 295179 - DNA, 20 bp, human
ggctaggggtcccctagctt

SEQ ID NO: 295180 - DNA, 20 bp, human
ggctaggggacccctagcta

SEQ ID NO: 295181 - DNA, 20 bp, human
gccggtctgggtggtcccac

SEQ ID NO: 295182 - DNA, 20 bp, human
gcctcacaagaggaacccgt

SEQ ID NO: 295183 - DNA, 20 bp, human
ggagactttctccaccgcag

SEQ ID NO: 295184 - DNA, 20 bp, human
gaaagtctctcccaagctag

SEQ ID NO: 295185 - DNA, 20 bp, human
gtggggatacctaagcagat

SEQ ID NO: 295186 - DNA, 20 bp, human
ggcagcgcggcgcttagggg

SEQ ID NO: 295187 - DNA, 20 bp, human
gccccggcgggtgacgggcg

SEQ ID NO: 295188 - DNA, 20 bp, human
gtggcctgggaggtcccctg

SEQ ID NO: 295189 - DNA, 20 bp, human
gccgagccccggcgggtgac

SEQ ID NO: 295190 - DNA, 20 bp, human
gtgacgggcgcggaacatgg

SEQ ID NO: 295191 - DNA, 20 bp, human
ggggtgacgggcgcggaaca

SEQ ID NO: 295192 - DNA, 20 bp, human
ggctcgggagaggccggaca

SEQ ID NO: 295193 - DNA, 20 bp, human
gtaggggaggctggagtccg

SEQ ID NO: 295194 - DNA, 20 bp, human
gtccggcctctcccgagccc

SEQ ID NO: 295195 - DNA, 20 bp, human
gcggcgctgcggtctcggct

SEQ ID NO: 295196 - DNA, 20 bp, human
gagttccccagggtcgtcgt

SEQ ID NO: 295197 - DNA, 20 bp, human
gcccgcccacgacgaccctg

SEQ ID NO: 295198 - DNA, 20 bp, human
gggcgctccccgctgtatgg

SEQ ID NO: 295199 - DNA, 20 bp, human
gggcgggggcgggaatgctc

SEQ ID NO: 295200 - DNA, 20 bp, human
gcgggacttgtagttcccca

SEQ ID NO: 295201 - DNA, 20 bp, human
ggcggggccgcagcgaaggc

SEQ ID NO: 295202 - DNA, 20 bp, human
gaaggcttacttctcaatac

SEQ ID NO: 295203 - DNA, 20 bp, human
gtccccagggtcgtcgtggg

SEQ ID NO: 295204 - DNA, 20 bp, human
gcaagtcccgccatacagcg

SEQ ID NO: 295205 - DNA, 20 bp, human
gaagaggtatcagctcttga

SEQ ID NO: 295206 - DNA, 20 bp, human
gaggggagggagcgttgcct

SEQ ID NO: 295207 - DNA, 20 bp, human
ggcagaacccgaggagggga

SEQ ID NO: 295208 - DNA, 20 bp, human
gcaaccaccggcacttccgg

SEQ ID NO: 295209 - DNA, 20 bp, human
gagcgttgcctgggagatga

SEQ ID NO: 295210 - DNA, 20 bp, human
gctttagcagaacccgagga

SEQ ID NO: 295211 - DNA, 20 bp, human
gcgagtccagcattcagaga

SEQ ID NO: 295212 - DNA, 20 bp, human
gcgccccccggaagtgccgg

SEQ ID NO: 295213 - DNA, 20 bp, human
gcacgctttagcagaacccg

SEQ ID NO: 295214 - DNA, 20 bp, human
ggctaccggagcccaaccac

SEQ ID NO: 295215 - DNA, 20 bp, human
gtggctgctgggcgtcgcgt

SEQ ID NO: 295216 - DNA, 20 bp, human
gcgtaggccgggcaacatgg

SEQ ID NO: 295217 - DNA, 20 bp, human
gtgcccggcctacgcatcgg

SEQ ID NO: 295218 - DNA, 20 bp, human
gcagaagacaggttccgcga

SEQ ID NO: 295219 - DNA, 20 bp, human
gggccacgcccccgatgcgt

SEQ ID NO: 295220 - DNA, 20 bp, human
ggaaccaggtatcgtacgtg

SEQ ID NO: 295221 - DNA, 20 bp, human
gtatcgtcgcgaatccgtcg

SEQ ID NO: 295222 - DNA, 20 bp, human
gggacccaccgtagagacta

SEQ ID NO: 295223 - DNA, 20 bp, human
gcaacatggcggcctccatg

SEQ ID NO: 295224 - DNA, 20 bp, human
gaccatgagcaagcggaacc

SEQ ID NO: 295225 - DNA, 20 bp, human
gacctggttccgcttgctca

SEQ ID NO: 295226 - DNA, 20 bp, human
gagcatgcccagaacggctc

SEQ ID NO: 295227 - DNA, 20 bp, human
gccactgagcatgcccagaa

SEQ ID NO: 295228 - DNA, 20 bp, human
gaggctgcttccaggccccg

SEQ ID NO: 295229 - DNA, 20 bp, human
gccagacttgcagatcccgg

SEQ ID NO: 295230 - DNA, 20 bp, human
gccgcgtgatccatgcgcca

SEQ ID NO: 295231 - DNA, 20 bp, human
gacccggagcggatggtttc

SEQ ID NO: 295232 - DNA, 20 bp, human
gtgatccatgcgccacggtt

SEQ ID NO: 295233 - DNA, 20 bp, human
gggcggccgggcggtgcaga

SEQ ID NO: 295234 - DNA, 20 bp, human
ggaccttggcgcagaggtta

SEQ ID NO: 295235 - DNA, 20 bp, human
ggaagccaggttcttgttaa

SEQ ID NO: 295236 - DNA, 20 bp, human
gggactgtgcggattcgaga

SEQ ID NO: 295237 - DNA, 20 bp, human
gagaaggcagcggacgcgaa

SEQ ID NO: 295238 - DNA, 20 bp, human
gcgtggctgcggggatcact

SEQ ID NO: 295239 - DNA, 20 bp, human
gtgcggattcgagaaggcag

SEQ ID NO: 295240 - DNA, 20 bp, human
gagtacggggacgtggataa

SEQ ID NO: 295241 - DNA, 20 bp, human
ggccaggcggggcgttcccg

SEQ ID NO: 295242 - DNA, 20 bp, human
ggccacgcgcggccgcttgc

SEQ ID NO: 295243 - DNA, 20 bp, human
gcgcgaaaggagcccagcca

SEQ ID NO: 295244 - DNA, 20 bp, human
ggcccgtggcgtcacaagag

SEQ ID NO: 295245 - DNA, 20 bp, human
ggccagggacctaggaaaag

SEQ ID NO: 295246 - DNA, 20 bp, human
gcgggccgggcctcagaaac

SEQ ID NO: 295247 - DNA, 20 bp, human
gcggcccgagcggggacgtg

SEQ ID NO: 295248 - DNA, 20 bp, human
ggacgcccagctcccctccg

SEQ ID NO: 295249 - DNA, 20 bp, human
ggctccgggctcgggttctg

SEQ ID NO: 295250 - DNA, 20 bp, human
ggccaggcggggcgttcccg

SEQ ID NO: 295251 - DNA, 20 bp, human
gcagcccgggccaaggggcg

SEQ ID NO: 295252 - DNA, 20 bp, human
gcgtggctgcggggatcact

SEQ ID NO: 295253 - DNA, 20 bp, human
ggcccgtggcgtcacaagag

SEQ ID NO: 295254 - DNA, 20 bp, human
gttctgaggcccggcccgag

SEQ ID NO: 295255 - DNA, 20 bp, human
gggcgtcgcaggacccgagc

SEQ ID NO: 295256 - DNA, 20 bp, human
gcctgcacccgccggtctac

SEQ ID NO: 295257 - DNA, 20 bp, human
gggcccggtcccagagttaa

SEQ ID NO: 295258 - DNA, 20 bp, human
ggaggcctggtgatctcaag

SEQ ID NO: 295259 - DNA, 20 bp, human
gtggccaccgcctccggaaa

SEQ ID NO: 295260 - DNA, 20 bp, human
ggcacccgccggtctacagg

SEQ ID NO: 295261 - DNA, 20 bp, human
gcgcgcgcggccgtttccgg

SEQ ID NO: 295262 - DNA, 20 bp, human
gcggacgctgtcacggctcg

SEQ ID NO: 295263 - DNA, 20 bp, human
gtcgcgtgatgtcatcacgt

SEQ ID NO: 295264 - DNA, 20 bp, human
gacacccttaactctgggac

SEQ ID NO: 295265 - DNA, 20 bp, human
gccactttggccaccgcctc

SEQ ID NO: 295266 - DNA, 20 bp, human
gtttcccaggcggtgtctcc

SEQ ID NO: 295267 - DNA, 20 bp, human
gcagaagccaacgcagggtt

SEQ ID NO: 295268 - DNA, 20 bp, human
gtgagcaagcccactgtgaa

SEQ ID NO: 295269 - DNA, 20 bp, human
gcaaccccggagacaccgcc

SEQ ID NO: 295270 - DNA, 20 bp, human
gtgcgagagccgttcacagt

SEQ ID NO: 295271 - DNA, 20 bp, human
gaactgcagccgacaggaag

SEQ ID NO: 295272 - DNA, 20 bp, human
gaaacagccaatcagcgata

SEQ ID NO: 295273 - DNA, 20 bp, human
ggatacggacgctgaccaat

SEQ ID NO: 295274 - DNA, 20 bp, human
gggaaagagacgctggacag

SEQ ID NO: 295275 - DNA, 20 bp, human
ggttgggcacacgagagtag

SEQ ID NO: 295276 - DNA, 20 bp, human
gccgcgctgagggtgagagt

SEQ ID NO: 295277 - DNA, 20 bp, human
gtcaggctcgggggcctcct

SEQ ID NO: 295278 - DNA, 20 bp, human
gtgctggggcgctccctaaa

SEQ ID NO: 295279 - DNA, 20 bp, human
gcatcgtcgcgcagcggttc

SEQ ID NO: 295280 - DNA, 20 bp, human
gtcgcgcagcggttcaggct

SEQ ID NO: 295281 - DNA, 20 bp, human
gcgcagcggttcaggctcgg

SEQ ID NO: 295282 - DNA, 20 bp, human
gtaaggacgccgacccgagg

SEQ ID NO: 295283 - DNA, 20 bp, human
gctgcgcgacgatgtgtgcc

SEQ ID NO: 295284 - DNA, 20 bp, human
gtctcaccctcagcgcgggg

SEQ ID NO: 295285 - DNA, 20 bp, human
ggccgcagggccgcacagcc

SEQ ID NO: 295286 - DNA, 20 bp, human
ggggcccgccgcggtgtcag

SEQ ID NO: 295287 - DNA, 20 bp, human
gacgcggccgccgcggggat

SEQ ID NO: 295288 - DNA, 20 bp, human
gccaaccagcgcctcgggag

SEQ ID NO: 295289 - DNA, 20 bp, human
gtgcccctgagacctcgcgg

SEQ ID NO: 295290 - DNA, 20 bp, human
gcgcagccaaccagcgcctc

SEQ ID NO: 295291 - DNA, 20 bp, human
gaggtctcaggggcacgccg

SEQ ID NO: 295292 - DNA, 20 bp, human
gtgcacgcggggcttcggga

SEQ ID NO: 295293 - DNA, 20 bp, human
gagggtgggggaccgacacc

SEQ ID NO: 295294 - DNA, 20 bp, human
gtgacgtcacagcccggccc

SEQ ID NO: 295295 - DNA, 20 bp, human
gggtttgtcgcgcggggaga

SEQ ID NO: 295296 - DNA, 20 bp, human
gggggcggccagccaatcgt

SEQ ID NO: 295297 - DNA, 20 bp, human
gccccggctcaccctacgat

SEQ ID NO: 295298 - DNA, 20 bp, human
gccggcgcccgcgacggaca

SEQ ID NO: 295299 - DNA, 20 bp, human
gccggctcaaccaggggtgc

SEQ ID NO: 295300 - DNA, 20 bp, human
gggagcccggagttccctcc

SEQ ID NO: 295301 - DNA, 20 bp, human
gaaactccgcccgcagtcgc

SEQ ID NO: 295302 - DNA, 20 bp, human
ggatacgaggtgacgcgcag

SEQ ID NO: 295303 - DNA, 20 bp, human
ggggcgccggggcggatacg

SEQ ID NO: 295304 - DNA, 20 bp, human
gcgtcacctcgtatccgccc

SEQ ID NO: 295305 - DNA, 20 bp, human
gcctcgggccggctcaacca

SEQ ID NO: 295306 - DNA, 20 bp, human
gaagaacagggaaacgtcgg

SEQ ID NO: 295307 - DNA, 20 bp, human
ggcccagcgagcgggaacgt

SEQ ID NO: 295308 - DNA, 20 bp, human
gggtacgcgcggtcccggga

SEQ ID NO: 295309 - DNA, 20 bp, human
gcccctggacgcgcctccaa

SEQ ID NO: 295310 - DNA, 20 bp, human
gcgggcagcgcgagctgggg

SEQ ID NO: 295311 - DNA, 20 bp, human
gccgagctgcggacgcagaa

SEQ ID NO: 295312 - DNA, 20 bp, human
gcagacgccgcaacccagga

SEQ ID NO: 295313 - DNA, 20 bp, human
gttcccgtcgccgccgttgg

SEQ ID NO: 295314 - DNA, 20 bp, human
ggccgttggaggcgcgtcca

SEQ ID NO: 295315 - DNA, 20 bp, human
gcaggcgtctgcaaccctcc

SEQ ID NO: 295316 - DNA, 20 bp, human
gtaacaaagctgcacctcgt

SEQ ID NO: 295317 - DNA, 20 bp, human
gtgacctctgagttctaatg

SEQ ID NO: 295318 - DNA, 20 bp, human
gaacgactggaattccagtc

SEQ ID NO: 295319 - DNA, 20 bp, human
gtcgttcggccaatcagata

SEQ ID NO: 295320 - DNA, 20 bp, human
gaccaatccgcgtaaggaaa

SEQ ID NO: 295321 - DNA, 20 bp, human
gagtgcgaatccacgacagt

SEQ ID NO: 295322 - DNA, 20 bp, human
ggacccacattagaactcag

SEQ ID NO: 295323 - DNA, 20 bp, human
ggcaggcttccctatctgat

SEQ ID NO: 295324 - DNA, 20 bp, human
gtccgcgtaaggaaaggggg

SEQ ID NO: 295325 - DNA, 20 bp, human
gcccgccccctttccttacg

SEQ ID NO: 295326 - DNA, 20 bp, human
gaatgggcggaagcaggcgt

SEQ ID NO: 295327 - DNA, 20 bp, human
gagccggctacgctccctgg

SEQ ID NO: 295328 - DNA, 20 bp, human
ggcagccaatgggcggaagc

SEQ ID NO: 295329 - DNA, 20 bp, human
gtgaacgctgggagtaggtg

SEQ ID NO: 295330 - DNA, 20 bp, human
gcgccctggtgctgacggtc

SEQ ID NO: 295331 - DNA, 20 bp, human
gggggcgggtcttgaaacgc

SEQ ID NO: 295332 - DNA, 20 bp, human
gaaagcccggctagcagagc

SEQ ID NO: 295333 - DNA, 20 bp, human
gaagaagctctccaatatgg

SEQ ID NO: 295334 - DNA, 20 bp, human
gcgcactgaacgctgggagt

SEQ ID NO: 295335 - DNA, 20 bp, human
gagggcaccgcactgaacgc

SEQ ID NO: 295336 - DNA, 20 bp, human
gcctcccagcggccaggctg

SEQ ID NO: 295337 - DNA, 20 bp, human
ggggacaaagcgcgcttgaa

SEQ ID NO: 295338 - DNA, 20 bp, human
gcgcctgtggagaagccaac

SEQ ID NO: 295339 - DNA, 20 bp, human
ggcgccctgccccctccggt

SEQ ID NO: 295340 - DNA, 20 bp, human
gtgaacggcgagcgcgcctg

SEQ ID NO: 295341 - DNA, 20 bp, human
gcactcacccggccgccctg

SEQ ID NO: 295342 - DNA, 20 bp, human
gccaggcagtgtcccgacga

SEQ ID NO: 295343 - DNA, 20 bp, human
gcggcggctgacgcagtgcg

SEQ ID NO: 295344 - DNA, 20 bp, human
ggaggccgctggcggcctgt

SEQ ID NO: 295345 - DNA, 20 bp, human
ggccggctgccctcgcccga

SEQ ID NO: 295346 - DNA, 20 bp, human
gagccaagaggtccctttaa

SEQ ID NO: 295347 - DNA, 20 bp, human
gcgggactcgcgcctttaaa

SEQ ID NO: 295348 - DNA, 20 bp, human
gcctacccccagccaccccg

SEQ ID NO: 295349 - DNA, 20 bp, human
gggcgggctcggggccggat

SEQ ID NO: 295350 - DNA, 20 bp, human
gttggctcgcggccacgggg

SEQ ID NO: 295351 - DNA, 20 bp, human
ggcagcgcgaacaaaggggg

SEQ ID NO: 295352 - DNA, 20 bp, human
ggctcattagggctttcgat

SEQ ID NO: 295353 - DNA, 20 bp, human
gggtagggggcgggattgaa

SEQ ID NO: 295354 - DNA, 20 bp, human
gcattagggctttcgattgg

SEQ ID NO: 295355 - DNA, 20 bp, human
gcgcctttaaagggacctct

SEQ ID NO: 295356 - DNA, 20 bp, human
gcctccgggtccccaagaaa

SEQ ID NO: 295357 - DNA, 20 bp, human
gcgcgcatgcgtcctgacca

SEQ ID NO: 295358 - DNA, 20 bp, human
ggggcaccggggaattcgaa

SEQ ID NO: 295359 - DNA, 20 bp, human
ggaggcgagcgctggaaggc

SEQ ID NO: 295360 - DNA, 20 bp, human
gccgcgcagccgttgatgtc

SEQ ID NO: 295361 - DNA, 20 bp, human
gtacgcagggatgttggcga

SEQ ID NO: 295362 - DNA, 20 bp, human
gcacacgcagcagcttccgg

SEQ ID NO: 295363 - DNA, 20 bp, human
gccaggggaaccttttcttg

SEQ ID NO: 295364 - DNA, 20 bp, human
gggcgcgtagtcttgattgg

SEQ ID NO: 295365 - DNA, 20 bp, human
ggcgctggaaggcgggatag

SEQ ID NO: 295366 - DNA, 20 bp, human
gccacagcaactccatgaga

SEQ ID NO: 295367 - DNA, 20 bp, human
gtatgcaactagtgaaagag

SEQ ID NO: 295368 - DNA, 20 bp, human
ggcaggaggtagctggtgct

SEQ ID NO: 295369 - DNA, 20 bp, human
gtggacacacttgacaagag

SEQ ID NO: 295370 - DNA, 20 bp, human
gtgacctgagggcgggattt

SEQ ID NO: 295371 - DNA, 20 bp, human
gaccctctacaagcttaaga

SEQ ID NO: 295372 - DNA, 20 bp, human
gtccaggggtaagcaagttg

SEQ ID NO: 295373 - DNA, 20 bp, human
gagggtgctaatattaccac

SEQ ID NO: 295374 - DNA, 20 bp, human
ggccttggggttaaacgaac

SEQ ID NO: 295375 - DNA, 20 bp, human
gtctagtggtgttcgattct

SEQ ID NO: 295376 - DNA, 20 bp, human
gagcgcccgtccgcagggag

SEQ ID NO: 295377 - DNA, 20 bp, human
gtccgcggccctttcagcgt

SEQ ID NO: 295378 - DNA, 20 bp, human
gaggagacaagcgccacttc

SEQ ID NO: 295379 - DNA, 20 bp, human
gaccgacgctgaaagggccg

SEQ ID NO: 295380 - DNA, 20 bp, human
gggccgcggagtcgcgtgtc

SEQ ID NO: 295381 - DNA, 20 bp, human
gtaggcgaccgacgctgaaa

SEQ ID NO: 295382 - DNA, 20 bp, human
gccaatcagcgcccgtccgc

SEQ ID NO: 295383 - DNA, 20 bp, human
ggtgccctgctccaagtctc

SEQ ID NO: 295384 - DNA, 20 bp, human
gcggagtcgcgtgtcagggc

SEQ ID NO: 295385 - DNA, 20 bp, human
gagcgaagtcacttccgcgg

SEQ ID NO: 295386 - DNA, 20 bp, human
gggaacgattggctgaaggt

SEQ ID NO: 295387 - DNA, 20 bp, human
gttccctcaagcggaacgat

SEQ ID NO: 295388 - DNA, 20 bp, human
gcctctggaagaccaatcag

SEQ ID NO: 295389 - DNA, 20 bp, human
gtgggcccatcaatagaatt

SEQ ID NO: 295390 - DNA, 20 bp, human
gagaggtctgaagaaaccgt

SEQ ID NO: 295391 - DNA, 20 bp, human
gacagcgcgggcgttcgaac

SEQ ID NO: 295392 - DNA, 20 bp, human
gagccaatcgttccgcttga

SEQ ID NO: 295393 - DNA, 20 bp, human
gaagcggaacgattggctga

SEQ ID NO: 295394 - DNA, 20 bp, human
gaaattgagagttacgccca

SEQ ID NO: 295395 - DNA, 20 bp, human
gtccttggatgcccattggt

SEQ ID NO: 295396 - DNA, 20 bp, human
ggtagagctaatttagttat

SEQ ID NO: 295397 - DNA, 20 bp, human
gtggagcacggtgagagaac

SEQ ID NO: 295398 - DNA, 20 bp, human
gagggagggaagagcgggag

SEQ ID NO: 295399 - DNA, 20 bp, human
gtggttggttgcacttggtc

SEQ ID NO: 295400 - DNA, 20 bp, human
ggaacttgaattgatatcat

SEQ ID NO: 295401 - DNA, 20 bp, human
gctgaaaaggaaacctcatg

SEQ ID NO: 295402 - DNA, 20 bp, human
gaaattagctctactttaga

SEQ ID NO: 295403 - DNA, 20 bp, human
gcctgtcgttcaggaaactg

SEQ ID NO: 295404 - DNA, 20 bp, human
gaagtcaaaacctgtcgttc

SEQ ID NO: 295405 - DNA, 20 bp, human
gtgaattgatatcatgggac

SEQ ID NO: 295406 - DNA, 20 bp, human
gcaagggcggggcactctct

SEQ ID NO: 295407 - DNA, 20 bp, human
ggggctgcgcgtctcccagg

SEQ ID NO: 295408 - DNA, 20 bp, human
ggggcgcgctcgggaggcga

SEQ ID NO: 295409 - DNA, 20 bp, human
ggggcagggactcacctaac

SEQ ID NO: 295410 - DNA, 20 bp, human
gccaaggaccccaacctgtt

SEQ ID NO: 295411 - DNA, 20 bp, human
ggggactcacctaacaggtt

SEQ ID NO: 295412 - DNA, 20 bp, human
ggccgcccagcactgggcaa

SEQ ID NO: 295413 - DNA, 20 bp, human
gtctacaggcgggaaaactg

SEQ ID NO: 295414 - DNA, 20 bp, human
gccaaggcccacggcgaggt

SEQ ID NO: 295415 - DNA, 20 bp, human
gttcccgcctgtagagggag

SEQ ID NO: 295416 - DNA, 20 bp, human
ggtggcccgggagcggtcgg

SEQ ID NO: 295417 - DNA, 20 bp, human
gtcgcctgacagttgcgcga

SEQ ID NO: 295418 - DNA, 20 bp, human
gatcccggccggcgcggcga

SEQ ID NO: 295419 - DNA, 20 bp, human
ggaaacgggccggcggatat

SEQ ID NO: 295420 - DNA, 20 bp, human
gacagcgcgcgtgtgcgccc

SEQ ID NO: 295421 - DNA, 20 bp, human
gttgcgcgagggccgggaga

SEQ ID NO: 295422 - DNA, 20 bp, human
gggccgggatccattttatg

SEQ ID NO: 295423 - DNA, 20 bp, human
gcggccctcgcgcaactgtc

SEQ ID NO: 295424 - DNA, 20 bp, human
gtaaagatccagactcgggg

SEQ ID NO: 295425 - DNA, 20 bp, human
gacattgcgaggcctggagc

SEQ ID NO: 295426 - DNA, 20 bp, human
ggtccccaggaagtccgcaa

SEQ ID NO: 295427 - DNA, 20 bp, human
gtggaggcgtggccaggatg

SEQ ID NO: 295428 - DNA, 20 bp, human
gggccctttgcggacttcct

SEQ ID NO: 295429 - DNA, 20 bp, human
ggactcctgcgcggcgggct

SEQ ID NO: 295430 - DNA, 20 bp, human
gaggacgcggcatccaggag

SEQ ID NO: 295431 - DNA, 20 bp, human
gcagaccggtcccagcgcgt

SEQ ID NO: 295432 - DNA, 20 bp, human
ggcgctgggaccggtctgtg

SEQ ID NO: 295433 - DNA, 20 bp, human
ggcgctcaggcctcacagac

SEQ ID NO: 295434 - DNA, 20 bp, human
gacgcaggactcctgcgcgg

SEQ ID NO: 295435 - DNA, 20 bp, human
gggacacaactcggatttgc

SEQ ID NO: 295436 - DNA, 20 bp, human
gcgcgcggcctagaagacgc

SEQ ID NO: 295437 - DNA, 20 bp, human
ggatcccgtactgtcaacgg

SEQ ID NO: 295438 - DNA, 20 bp, human
gagacggcgcggggtagagt

SEQ ID NO: 295439 - DNA, 20 bp, human
gggcgcggggtagagtggga

SEQ ID NO: 295440 - DNA, 20 bp, human
ggacgcgcacgccgggtagt

SEQ ID NO: 295441 - DNA, 20 bp, human
gtagggccggggccgtgaga

SEQ ID NO: 295442 - DNA, 20 bp, human
gcctgcgcagagcgcgcctc

SEQ ID NO: 295443 - DNA, 20 bp, human
gcgagcgctcaacgctccag

SEQ ID NO: 295444 - DNA, 20 bp, human
gcgccccgcctccccagcgt

SEQ ID NO: 295445 - DNA, 20 bp, human
gtctaccccgcgccgtctca

SEQ ID NO: 295446 - DNA, 20 bp, human
ggaatggtacgggagcacaa

SEQ ID NO: 295447 - DNA, 20 bp, human
gaaggcctccttttatgctt

SEQ ID NO: 295448 - DNA, 20 bp, human
gcataaaaggaggccttggc

SEQ ID NO: 295449 - DNA, 20 bp, human
ggcggcagaacctagggctt

SEQ ID NO: 295450 - DNA, 20 bp, human
gggggccactacgtcacaaa

SEQ ID NO: 295451 - DNA, 20 bp, human
ggaggatgtggcgtgctctc

SEQ ID NO: 295452 - DNA, 20 bp, human
ggatgaggcggcagaaccta

SEQ ID NO: 295453 - DNA, 20 bp, human
gggcttaggagtgaatggta

SEQ ID NO: 295454 - DNA, 20 bp, human
ggtcacaaagggatgagatg

SEQ ID NO: 295455 - DNA, 20 bp, human
gtaactctccagtgatcagt

SEQ ID NO: 295456 - DNA, 20 bp, human
ggtctcccccaaggctccgc

SEQ ID NO: 295457 - DNA, 20 bp, human
gggtctggggctcccatttc

SEQ ID NO: 295458 - DNA, 20 bp, human
gtagcggcgaagttcccaga

SEQ ID NO: 295459 - DNA, 20 bp, human
ggcgccctgcggagccttgg

SEQ ID NO: 295460 - DNA, 20 bp, human
gggggtgtggccagacgcat

SEQ ID NO: 295461 - DNA, 20 bp, human
gcagaaggcacagcgctcgg

SEQ ID NO: 295462 - DNA, 20 bp, human
gcaagcgtaggaagatggtt

SEQ ID NO: 295463 - DNA, 20 bp, human
ggcagggcgccgctgactgg

SEQ ID NO: 295464 - DNA, 20 bp, human
gagccccagaccccacgtag

SEQ ID NO: 295465 - DNA, 20 bp, human
gcgccgctacgtggggtctg

SEQ ID NO: 295466 - DNA, 20 bp, human
gccgcgcaggcgtaattcaa

SEQ ID NO: 295467 - DNA, 20 bp, human
gcgcacgcgcggcctcagtc

SEQ ID NO: 295468 - DNA, 20 bp, human
ggtggcacgcactgaggcgg

SEQ ID NO: 295469 - DNA, 20 bp, human
gtaacctggcagcccggggt

SEQ ID NO: 295470 - DNA, 20 bp, human
gagaaatgtggcacgcactg

SEQ ID NO: 295471 - DNA, 20 bp, human
gctcctaggacgccagactg

SEQ ID NO: 295472 - DNA, 20 bp, human
ggcgtcctaggagatggact

SEQ ID NO: 295473 - DNA, 20 bp, human
ggggaggaggagctgctctt

SEQ ID NO: 295474 - DNA, 20 bp, human
gaatgtggcacgcactgagg

SEQ ID NO: 295475 - DNA, 20 bp, human
gggcctcagtctggcgtcct

SEQ ID NO: 295476 - DNA, 20 bp, human
gtctcctcacccacctaagc

SEQ ID NO: 295477 - DNA, 20 bp, human
gccactctccccgcttaggt

SEQ ID NO: 295478 - DNA, 20 bp, human
gacagggaaagccggctgga

SEQ ID NO: 295479 - DNA, 20 bp, human
gtcgccgagccaggttgcta

SEQ ID NO: 295480 - DNA, 20 bp, human
gaagccggctggaggggtct

SEQ ID NO: 295481 - DNA, 20 bp, human
ggggagagtggcgcacaacg

SEQ ID NO: 295482 - DNA, 20 bp, human
gcggtgctggtgtttagcgg

SEQ ID NO: 295483 - DNA, 20 bp, human
gtggcacacgagcagaggac

SEQ ID NO: 295484 - DNA, 20 bp, human
ggcggggctcaggtcggtgc

SEQ ID NO: 295485 - DNA, 20 bp, human
gctccccgcttaggtgggtg

SEQ ID NO: 295486 - DNA, 20 bp, human
gagggaggcgcctcccggac

SEQ ID NO: 295487 - DNA, 20 bp, human
gaaggggtggcatgcggatg

SEQ ID NO: 295488 - DNA, 20 bp, human
gtggctgcgctgcacccgac

SEQ ID NO: 295489 - DNA, 20 bp, human
gcacccccgccgaccgctcc

SEQ ID NO: 295490 - DNA, 20 bp, human
gggtggcatgcggatgaggg

SEQ ID NO: 295491 - DNA, 20 bp, human
gaggcctggcgacaccctga

SEQ ID NO: 295492 - DNA, 20 bp, human
gaagcctcccgactggggtg

SEQ ID NO: 295493 - DNA, 20 bp, human
gggggggtgtccgaggatgg

SEQ ID NO: 295494 - DNA, 20 bp, human
gtcactcaaggggtggcatg

SEQ ID NO: 295495 - DNA, 20 bp, human
ggcccggagcggcccgggtg

SEQ ID NO: 295496 - DNA, 20 bp, human
gaggtggtgcggcgtttatg

SEQ ID NO: 295497 - DNA, 20 bp, human
ggggtcagctcgttgcaccc

SEQ ID NO: 295498 - DNA, 20 bp, human
ggctccgcagggtcgaaaag

SEQ ID NO: 295499 - DNA, 20 bp, human
gtcagtctgggaaccggaag

SEQ ID NO: 295500 - DNA, 20 bp, human
gtgtggactgcccactggtg

SEQ ID NO: 295501 - DNA, 20 bp, human
gcggaagcggatgctccgca

SEQ ID NO: 295502 - DNA, 20 bp, human
gtcgaaaagaggccgggcca

SEQ ID NO: 295503 - DNA, 20 bp, human
gtgtcagtgagcggagtctg

SEQ ID NO: 295504 - DNA, 20 bp, human
ggtcgctgtggactgcccac

SEQ ID NO: 295505 - DNA, 20 bp, human
gggctggtcaggtgaaggaa

SEQ ID NO: 295506 - DNA, 20 bp, human
gtgcagtgcaggcggcccga

SEQ ID NO: 295507 - DNA, 20 bp, human
ggggccgcctgcactgcaat

SEQ ID NO: 295508 - DNA, 20 bp, human
gccgcgcgcgcaggccagca

SEQ ID NO: 295509 - DNA, 20 bp, human
gcaaccaattgcagtgcagg

SEQ ID NO: 295510 - DNA, 20 bp, human
gcaccaaccaattgcagtgc

SEQ ID NO: 295511 - DNA, 20 bp, human
ggcaattggttggtgtctct

SEQ ID NO: 295512 - DNA, 20 bp, human
gctgatgaacaagatcaaag

SEQ ID NO: 295513 - DNA, 20 bp, human
gatctcatacatattctgtt

SEQ ID NO: 295514 - DNA, 20 bp, human
ggagtatagtataaacttaa

SEQ ID NO: 295515 - DNA, 20 bp, human
gcaggacatttttctgttgt

SEQ ID NO: 295516 - DNA, 20 bp, human
ggacgtcgacccccgaaggg

SEQ ID NO: 295517 - DNA, 20 bp, human
gacaaacaggtcgggggtat

SEQ ID NO: 295518 - DNA, 20 bp, human
gggtgaggttccacccttcg

SEQ ID NO: 295519 - DNA, 20 bp, human
gggagggacaaacaggtcgg

SEQ ID NO: 295520 - DNA, 20 bp, human
gagccagcgtccccagtgga

SEQ ID NO: 295521 - DNA, 20 bp, human
ggctcgacgtcgacccccga

SEQ ID NO: 295522 - DNA, 20 bp, human
gtccccttatcccttccagg

SEQ ID NO: 295523 - DNA, 20 bp, human
gcggggccgcgatggaggag

SEQ ID NO: 295524 - DNA, 20 bp, human
gaggtcgggggtataggggt

SEQ ID NO: 295525 - DNA, 20 bp, human
gcaccccctggaagggataa

SEQ ID NO: 295526 - DNA, 20 bp, human
gcgctcgcaccctgccgcgg

SEQ ID NO: 295527 - DNA, 20 bp, human
ggctctggggaattcttcgg

SEQ ID NO: 295528 - DNA, 20 bp, human
ggcaccggggagagcgtccg

SEQ ID NO: 295529 - DNA, 20 bp, human
gaggcggcccggcgaccaat

SEQ ID NO: 295530 - DNA, 20 bp, human
gccgccctgtcgcccaacgg

SEQ ID NO: 295531 - DNA, 20 bp, human
gcggcggcctcaggagtgat

SEQ ID NO: 295532 - DNA, 20 bp, human
gcactcctgaggccgccgtt

SEQ ID NO: 295533 - DNA, 20 bp, human
gtgcgggaggaggactgcgc

SEQ ID NO: 295534 - DNA, 20 bp, human
gtgcgagcgcgcgcaccgat

SEQ ID NO: 295535 - DNA, 20 bp, human
ggaatctgcgaccccgggcc

SEQ ID NO: 295536 - DNA, 20 bp, human
gtacctgccgggggaaggac

SEQ ID NO: 295537 - DNA, 20 bp, human
ggatgcgcagcgctcggagt

SEQ ID NO: 295538 - DNA, 20 bp, human
gtgcccaagccggaaccgga

SEQ ID NO: 295539 - DNA, 20 bp, human
gtccgagcgctgcgcatccc

SEQ ID NO: 295540 - DNA, 20 bp, human
gggggccgggcggacctcta

SEQ ID NO: 295541 - DNA, 20 bp, human
gcgctggtgctgatgcagga

SEQ ID NO: 295542 - DNA, 20 bp, human
gcggacttgcaggctcttgg

SEQ ID NO: 295543 - DNA, 20 bp, human
gtcgcccggctcagacctcc

SEQ ID NO: 295544 - DNA, 20 bp, human
gagcccgggaggtctgagcc

SEQ ID NO: 295545 - DNA, 20 bp, human
ggtagtcactctacctgccg

SEQ ID NO: 295546 - DNA, 20 bp, human
gaggaggccactacggggcg

SEQ ID NO: 295547 - DNA, 20 bp, human
gtgcgcatgagcgagtgtct

SEQ ID NO: 295548 - DNA, 20 bp, human
gaccggaaggaggccactac

SEQ ID NO: 295549 - DNA, 20 bp, human
gcccgcctcctccctctaat

SEQ ID NO: 295550 - DNA, 20 bp, human
gctggaccgtgtggttaaag

SEQ ID NO: 295551 - DNA, 20 bp, human
gtgggctctgggtttagcgc

SEQ ID NO: 295552 - DNA, 20 bp, human
gccctagccccgccccgtag

SEQ ID NO: 295553 - DNA, 20 bp, human
gccggtcgcgaccaattaga

SEQ ID NO: 295554 - DNA, 20 bp, human
gctgggtttagcgccggacc

SEQ ID NO: 295555 - DNA, 20 bp, human
gtaaccacacggtccaggcc

SEQ ID NO: 295556 - DNA, 20 bp, human
gagtcggcccgcagacaggg

SEQ ID NO: 295557 - DNA, 20 bp, human
ggggcccgtgctcaagggct

SEQ ID NO: 295558 - DNA, 20 bp, human
ggccccgcccgccctgtctg

SEQ ID NO: 295559 - DNA, 20 bp, human
gaggcccagcccttgagcac

SEQ ID NO: 295560 - DNA, 20 bp, human
gaccggggatgaaggtgact

SEQ ID NO: 295561 - DNA, 20 bp, human
gcgggcggggcccgtgctca

SEQ ID NO: 295562 - DNA, 20 bp, human
gccggtcggcgtcgcggagt

SEQ ID NO: 295563 - DNA, 20 bp, human
gcggagtcggcccgcagaca

SEQ ID NO: 295564 - DNA, 20 bp, human
gggcggaggcgcgagccggt

SEQ ID NO: 295565 - DNA, 20 bp, human
ggggcaggagaggtgatctg

SEQ ID NO: 295566 - DNA, 20 bp, human
gtgctgctccgcgctccgag

SEQ ID NO: 295567 - DNA, 20 bp, human
ggaggcctgcgcagttgcag

SEQ ID NO: 295568 - DNA, 20 bp, human
ggcaactgcgcaggcctcgc

SEQ ID NO: 295569 - DNA, 20 bp, human
gcgcggagcagcaatcggac

SEQ ID NO: 295570 - DNA, 20 bp, human
gccggccgctgcaactgcgc

SEQ ID NO: 295571 - DNA, 20 bp, human
ggccggctagacactaacca

SEQ ID NO: 295572 - DNA, 20 bp, human
gccagtccgcggtaccttga

SEQ ID NO: 295573 - DNA, 20 bp, human
ggaatcgggaagacgagaga

SEQ ID NO: 295574 - DNA, 20 bp, human
gcggagcgcggagcagcaat

SEQ ID NO: 295575 - DNA, 20 bp, human
gcgaggagattcaactacgg

SEQ ID NO: 295576 - DNA, 20 bp, human
gtatgcgcaggctcagtctg

SEQ ID NO: 295577 - DNA, 20 bp, human
gtcaccgcccccttgaggat

SEQ ID NO: 295578 - DNA, 20 bp, human
ggagccgagcagggaagttt

SEQ ID NO: 295579 - DNA, 20 bp, human
gctcaagggggcggtgacta

SEQ ID NO: 295580 - DNA, 20 bp, human
gcgtcgtgacggcccggctt

SEQ ID NO: 295581 - DNA, 20 bp, human
gcccggtgcgtcaaactctg

SEQ ID NO: 295582 - DNA, 20 bp, human
gagcgtccgtgtataaggag

SEQ ID NO: 295583 - DNA, 20 bp, human
gacgcaccggggagccgagc

SEQ ID NO: 295584 - DNA, 20 bp, human
gcgcatgcgtcgtgacggcc

SEQ ID NO: 295585 - DNA, 20 bp, human
ggcaagcgcatgcgtcgtga

SEQ ID NO: 295586 - DNA, 20 bp, human
ggtcgggcggggtgtggctt

SEQ ID NO: 295587 - DNA, 20 bp, human
gggagcctcaatcacgtcga

SEQ ID NO: 295588 - DNA, 20 bp, human
gaaaagacaaggcgcctgtc

SEQ ID NO: 295589 - DNA, 20 bp, human
gtcgcaggcgcaggagaggt

SEQ ID NO: 295590 - DNA, 20 bp, human
gtcgctgtcgccacagccga

SEQ ID NO: 295591 - DNA, 20 bp, human
gggcggggtgtggcttcggg

SEQ ID NO: 295592 - DNA, 20 bp, human
gctgacgtagcgagcgacgg

SEQ ID NO: 295593 - DNA, 20 bp, human
gtgcagagcgcggtgagagt

SEQ ID NO: 295594 - DNA, 20 bp, human
gcctcctggtgactgcagta

SEQ ID NO: 295595 - DNA, 20 bp, human
ggaggggtgagaagcataag

SEQ ID NO: 295596 - DNA, 20 bp, human
ggggtctgggcgagactgag

SEQ ID NO: 295597 - DNA, 20 bp, human
gggcgaggctgcaaggaacg

SEQ ID NO: 295598 - DNA, 20 bp, human
ggagaaccccggcgtgttga

SEQ ID NO: 295599 - DNA, 20 bp, human
gcctgggcgaggatgcgatg

SEQ ID NO: 295600 - DNA, 20 bp, human
ggagactgagagggaccgag

SEQ ID NO: 295601 - DNA, 20 bp, human
ggctgcaaggaacggggttt

SEQ ID NO: 295602 - DNA, 20 bp, human
gtgagatgggcggggctgta

SEQ ID NO: 295603 - DNA, 20 bp, human
ggcaaggaacggggtttggg

SEQ ID NO: 295604 - DNA, 20 bp, human
ggagagcggcgggtctgaga

SEQ ID NO: 295605 - DNA, 20 bp, human
ggggagataaggtttaggcg

SEQ ID NO: 295606 - DNA, 20 bp, human
gacacccccgggtgcggaag

SEQ ID NO: 295607 - DNA, 20 bp, human
gagtgccggcgggagacctg

SEQ ID NO: 295608 - DNA, 20 bp, human
gcgcccgcactcacgcgcac

SEQ ID NO: 295609 - DNA, 20 bp, human
gtgggagtgggagtgccggc

SEQ ID NO: 295610 - DNA, 20 bp, human
gggaggccccgcgaaggagt

SEQ ID NO: 295611 - DNA, 20 bp, human
gcaaccggctccgaccccgg

SEQ ID NO: 295612 - DNA, 20 bp, human
gcccgcgaaggagtgggagt

SEQ ID NO: 295613 - DNA, 20 bp, human
gcgcgtgcaaggacacggta

SEQ ID NO: 295614 - DNA, 20 bp, human
gtctcctcttccgcacccgg

SEQ ID NO: 295615 - DNA, 20 bp, human
gacagagtacccgccctcct

SEQ ID NO: 295616 - DNA, 20 bp, human
gacacccgcgcgagagaaca

SEQ ID NO: 295617 - DNA, 20 bp, human
ggccctgctgaaggtcggtc

SEQ ID NO: 295618 - DNA, 20 bp, human
gactgaagaagagagcaagg

SEQ ID NO: 295619 - DNA, 20 bp, human
gctgagaggcggaaggaggt

SEQ ID NO: 295620 - DNA, 20 bp, human
gccagctgagaggcggaagg

SEQ ID NO: 295621 - DNA, 20 bp, human
gctctcgcgcgggtgtcgct

SEQ ID NO: 295622 - DNA, 20 bp, human
gaagatcggcaggaccgcaa

SEQ ID NO: 295623 - DNA, 20 bp, human
gtttcttcgcgctacggcga

SEQ ID NO: 295624 - DNA, 20 bp, human
gagccagccggaaacggaac

SEQ ID NO: 295625 - DNA, 20 bp, human
gcggaggcgccgggtagcgg

SEQ ID NO: 295626 - DNA, 20 bp, human
gggtcgtagtgaaggacgca

SEQ ID NO: 295627 - DNA, 20 bp, human
gcaatcatctcgtgtatgag

SEQ ID NO: 295628 - DNA, 20 bp, human
gaatgtgcaaaatgtctaac

SEQ ID NO: 295629 - DNA, 20 bp, human
ggtttctactactaaaccag

SEQ ID NO: 295630 - DNA, 20 bp, human
gcatctcgtgtatgagaggt

SEQ ID NO: 295631 - DNA, 20 bp, human
gttgagtctggtcgtagtga

SEQ ID NO: 295632 - DNA, 20 bp, human
gctgagacgtcttttgagtc

SEQ ID NO: 295633 - DNA, 20 bp, human
gtcaagcaggaaaattagaa

SEQ ID NO: 295634 - DNA, 20 bp, human
gtagtagtagaaactcaagc

SEQ ID NO: 295635 - DNA, 20 bp, human
gcaagctattctgatgcctc

SEQ ID NO: 295636 - DNA, 20 bp, human
gcaagtggtgaatcagtcaa

SEQ ID NO: 295637 - DNA, 20 bp, human
ggtggtgaatcagtcaaggg

SEQ ID NO: 295638 - DNA, 20 bp, human
ggactcacttacccctgcac

SEQ ID NO: 295639 - DNA, 20 bp, human
ggtgcagaggatgtggtgag

SEQ ID NO: 295640 - DNA, 20 bp, human
gcacatcatgcgcaacggcc

SEQ ID NO: 295641 - DNA, 20 bp, human
gcaacatgtgaaggggacat

SEQ ID NO: 295642 - DNA, 20 bp, human
ggcttcttctacgtcatatg

SEQ ID NO: 295643 - DNA, 20 bp, human
gacgtcatatgaggttcaag

SEQ ID NO: 295644 - DNA, 20 bp, human
gttgaccacaacatgtgaag

SEQ ID NO: 295645 - DNA, 20 bp, human
gcacttcacatcatgcgcaa

SEQ ID NO: 295646 - DNA, 20 bp, human
gaaaagttgtgacttgggtg

SEQ ID NO: 295647 - DNA, 20 bp, human
gatgaggcccagtggctgtt

SEQ ID NO: 295648 - DNA, 20 bp, human
gctgctagaaatgctggggc

SEQ ID NO: 295649 - DNA, 20 bp, human
gatgggaggatgacgtatgc

SEQ ID NO: 295650 - DNA, 20 bp, human
gcatctcctgtatgagagat

SEQ ID NO: 295651 - DNA, 20 bp, human
gcagatccaatctctcatac

SEQ ID NO: 295652 - DNA, 20 bp, human
ggttctaaaagttgtgactt

SEQ ID NO: 295653 - DNA, 20 bp, human
gcaggagatgactgaatgct

SEQ ID NO: 295654 - DNA, 20 bp, human
ggaagtcaaagaacagcctg

SEQ ID NO: 295655 - DNA, 20 bp, human
gctcttgaccaaacagccac

SEQ ID NO: 295656 - DNA, 20 bp, human
gcatagtgaaggatgcaagg

SEQ ID NO: 295657 - DNA, 20 bp, human
gatccaacctctcacacatg

SEQ ID NO: 295658 - DNA, 20 bp, human
gttagtactagaaactcatc

SEQ ID NO: 295659 - DNA, 20 bp, human
ggtttctagtactaaacctg

SEQ ID NO: 295660 - DNA, 20 bp, human
gtgtagtcacaacaatttcc

SEQ ID NO: 295661 - DNA, 20 bp, human
gaatgtgcaaaatatctaag

SEQ ID NO: 295662 - DNA, 20 bp, human
gcaatcacctcatgtgtgag

SEQ ID NO: 295663 - DNA, 20 bp, human
gggtcatagtgaaggatgca

SEQ ID NO: 295664 - DNA, 20 bp, human
gcacctcatgtgtgagaggt

SEQ ID NO: 295665 - DNA, 20 bp, human
gctgagacgtcttttgagtc

SEQ ID NO: 295666 - DNA, 20 bp, human
ggcacacaggatgttgtgag

SEQ ID NO: 295667 - DNA, 20 bp, human
gatgaggcccagtggctgtt

SEQ ID NO: 295668 - DNA, 20 bp, human
gaaaagttgtgacttgggtg

SEQ ID NO: 295669 - DNA, 20 bp, human
gatgggaggatgacgtatgc

SEQ ID NO: 295670 - DNA, 20 bp, human
gctgctagaaatgctggggc

SEQ ID NO: 295671 - DNA, 20 bp, human
gcatctcctgtatgagagat

SEQ ID NO: 295672 - DNA, 20 bp, human
gcagatccaatctctcatac

SEQ ID NO: 295673 - DNA, 20 bp, human
ggttctaaaagttgtgactt

SEQ ID NO: 295674 - DNA, 20 bp, human
gcaggagatgactgaatgct

SEQ ID NO: 295675 - DNA, 20 bp, human
gctcttgaccaaacagccac

SEQ ID NO: 295676 - DNA, 20 bp, human
gcaggaggagaaaaaggtct

SEQ ID NO: 295677 - DNA, 20 bp, human
gtagacgtcaggcggaggga

SEQ ID NO: 295678 - DNA, 20 bp, human
gcggagggagagtagacgtc

SEQ ID NO: 295679 - DNA, 20 bp, human
gtgtgtgcgcgcgttgtggg

SEQ ID NO: 295680 - DNA, 20 bp, human
ggggctatggaactaagcag

SEQ ID NO: 295681 - DNA, 20 bp, human
gtggagggaggcgccgtcgg

SEQ ID NO: 295682 - DNA, 20 bp, human
gcagggggagggctcgtgga

SEQ ID NO: 295683 - DNA, 20 bp, human
gagagataaagagaatcgga

SEQ ID NO: 295684 - DNA, 20 bp, human
gataaagagaatcggagggc

SEQ ID NO: 295685 - DNA, 20 bp, human
ggtgaccgtcgtgggttctg

SEQ ID NO: 295686 - DNA, 20 bp, human
gctgagacgcggatgaatgg

SEQ ID NO: 295687 - DNA, 20 bp, human
gaactcccgcggctgagacg

SEQ ID NO: 295688 - DNA, 20 bp, human
gggcgcccccagctcaattg

SEQ ID NO: 295689 - DNA, 20 bp, human
gcggctgagacgcggatgaa

SEQ ID NO: 295690 - DNA, 20 bp, human
ggcagggcgggatcccccgg

SEQ ID NO: 295691 - DNA, 20 bp, human
gtcctcgaacccaggtgttc

SEQ ID NO: 295692 - DNA, 20 bp, human
ggaagagggcggagctcccg

SEQ ID NO: 295693 - DNA, 20 bp, human
gggggttgaggggcaggcaa

SEQ ID NO: 295694 - DNA, 20 bp, human
gcgcaggtgtccaacccagc

SEQ ID NO: 295695 - DNA, 20 bp, human
gcggatgaatgggggacgca

SEQ ID NO: 295696 - DNA, 20 bp, human
gtgtgtatggggaggtgcgg

SEQ ID NO: 295697 - DNA, 20 bp, human
ggtgtggccaggaggatcag

SEQ ID NO: 295698 - DNA, 20 bp, human
gtacactcccggcttctgtg

SEQ ID NO: 295699 - DNA, 20 bp, human
gacacatacacacaggactt

SEQ ID NO: 295700 - DNA, 20 bp, human
gagggaggaactcaagtcat

SEQ ID NO: 295701 - DNA, 20 bp, human
gcttaagtcttaagagtcgg

SEQ ID NO: 295702 - DNA, 20 bp, human
gtgagaccccagggtctgag

SEQ ID NO: 295703 - DNA, 20 bp, human
gctgagaggggagggatctg

SEQ ID NO: 295704 - DNA, 20 bp, human
gatcctcctgggcctgtgtg

SEQ ID NO: 295705 - DNA, 20 bp, human
gtcccgagtccttggagaga

SEQ ID NO: 295706 - DNA, 20 bp, human
gagacaggtcataattaaag

SEQ ID NO: 295707 - DNA, 20 bp, human
gttcactgaagctgaggcga

SEQ ID NO: 295708 - DNA, 20 bp, human
gactcctttcactgaagctg

SEQ ID NO: 295709 - DNA, 20 bp, human
gtctatgcaaaacggacagt

SEQ ID NO: 295710 - DNA, 20 bp, human
gccaagctcaagatgccttt

SEQ ID NO: 295711 - DNA, 20 bp, human
gggctgaaagggaactagga

SEQ ID NO: 295712 - DNA, 20 bp, human
gtgtgggaggagcccgcctg

SEQ ID NO: 295713 - DNA, 20 bp, human
gaaaggagatctatgcaaaa

SEQ ID NO: 295714 - DNA, 20 bp, human
gtgaaagggaactaggaagg

SEQ ID NO: 295715 - DNA, 20 bp, human
gacttggccaatgtgtgcag

SEQ ID NO: 295716 - DNA, 20 bp, human
ggaaatgggctatctgagga

SEQ ID NO: 295717 - DNA, 20 bp, human
gccacccgagccctccgagg

SEQ ID NO: 295718 - DNA, 20 bp, human
gctgaagagcatggcacctt

SEQ ID NO: 295719 - DNA, 20 bp, human
gaggaagcgctcagtgaccg

SEQ ID NO: 295720 - DNA, 20 bp, human
gtgtctgtggctcttcggag

SEQ ID NO: 295721 - DNA, 20 bp, human
gggtgccatgctcttcagga

SEQ ID NO: 295722 - DNA, 20 bp, human
gcgtggaaatgggctatctg

SEQ ID NO: 295723 - DNA, 20 bp, human
ggagaaagtcccgcctcgga

SEQ ID NO: 295724 - DNA, 20 bp, human
gcccccaaacaacgtggaaa

SEQ ID NO: 295725 - DNA, 20 bp, human
gtcaccccgggctttataaa

SEQ ID NO: 295726 - DNA, 20 bp, human
gggttaaggtcggtccttcc

SEQ ID NO: 295727 - DNA, 20 bp, human
gtctactcgctggttaaggt

SEQ ID NO: 295728 - DNA, 20 bp, human
gtcggagtgagagcgcggga

SEQ ID NO: 295729 - DNA, 20 bp, human
gcctcctcccggtgcaaggt

SEQ ID NO: 295730 - DNA, 20 bp, human
ggggtgaatagagggcgcgt

SEQ ID NO: 295731 - DNA, 20 bp, human
gcaccgggaggagggaatag

SEQ ID NO: 295732 - DNA, 20 bp, human
ggcgccctctattcacccag

SEQ ID NO: 295733 - DNA, 20 bp, human
ggagagccatggaaagttca

SEQ ID NO: 295734 - DNA, 20 bp, human
gaggcctgtgaatatgggaa

SEQ ID NO: 295735 - DNA, 20 bp, human
gaatagagggcgcgtgggca

SEQ ID NO: 295736 - DNA, 20 bp, human
gggaagaagcgagacccggg

SEQ ID NO: 295737 - DNA, 20 bp, human
ggagacccgggcgggcgcga

SEQ ID NO: 295738 - DNA, 20 bp, human
gccgggaagaagcgagaccc

SEQ ID NO: 295739 - DNA, 20 bp, human
gtcgccgctcgcggctctgg

SEQ ID NO: 295740 - DNA, 20 bp, human
gcgagcgggcagcacctcct

SEQ ID NO: 295741 - DNA, 20 bp, human
gttaacacgtcgaaagagca

SEQ ID NO: 295742 - DNA, 20 bp, human
gggtgccaggagctcctaac

SEQ ID NO: 295743 - DNA, 20 bp, human
gggctccggagtcaagagcg

SEQ ID NO: 295744 - DNA, 20 bp, human
gagcaggggccagacgccgc

SEQ ID NO: 295745 - DNA, 20 bp, human
ggccgtccacatcccagggg

SEQ ID NO: 295746 - DNA, 20 bp, human
ggcccccaggcgagcggaca

SEQ ID NO: 295747 - DNA, 20 bp, human
gtaccctcccggatccgctg

SEQ ID NO: 295748 - DNA, 20 bp, human
gagccccagcggatccggga

SEQ ID NO: 295749 - DNA, 20 bp, human
gcactggcgggagaccgcga

SEQ ID NO: 295750 - DNA, 20 bp, human
gaagcaggcaagggcgcgga

SEQ ID NO: 295751 - DNA, 20 bp, human
ggcggagggaagaatcggga

SEQ ID NO: 295752 - DNA, 20 bp, human
gtccggggcccccaggcgag

SEQ ID NO: 295753 - DNA, 20 bp, human
gtctcccgccagtgcaggtc

SEQ ID NO: 295754 - DNA, 20 bp, human
gcctaccccgggctccggaa

SEQ ID NO: 295755 - DNA, 20 bp, human
gcccggggtaggcgagaagc

SEQ ID NO: 295756 - DNA, 20 bp, human
gactgcctccgccctggcac

SEQ ID NO: 295757 - DNA, 20 bp, human
gccccgacgaagccgctcca

SEQ ID NO: 295758 - DNA, 20 bp, human
gcggcttcgtcggggagaaa

SEQ ID NO: 295759 - DNA, 20 bp, human
ggcaggggcgccgagggcga

SEQ ID NO: 295760 - DNA, 20 bp, human
ggcggggcgcgggcataaag

SEQ ID NO: 295761 - DNA, 20 bp, human
gtgccaggtgggacagccga

SEQ ID NO: 295762 - DNA, 20 bp, human
gcgctccgctagggcccggc

SEQ ID NO: 295763 - DNA, 20 bp, human
ggcacggcgaagttccccct

SEQ ID NO: 295764 - DNA, 20 bp, human
ggctggagccaattagggac

SEQ ID NO: 295765 - DNA, 20 bp, human
ggcagcgggcaaggtgcggc

SEQ ID NO: 295766 - DNA, 20 bp, human
gagagagcaacgtaatttga

SEQ ID NO: 295767 - DNA, 20 bp, human
ggagagagaaggagacgcgt

SEQ ID NO: 295768 - DNA, 20 bp, human
gacgcgttggtgactgcaat

SEQ ID NO: 295769 - DNA, 20 bp, human
ggagcaacgtaatttgaggg

SEQ ID NO: 295770 - DNA, 20 bp, human
gtcaatgattagcttgaact

SEQ ID NO: 295771 - DNA, 20 bp, human
gaaattagatgaaaatgcat

SEQ ID NO: 295772 - DNA, 20 bp, human
gagatttgggtcaatatgaa

SEQ ID NO: 295773 - DNA, 20 bp, human
gtagatgcgttataattttg

SEQ ID NO: 295774 - DNA, 20 bp, human
gaaatatagcactttgtgga

SEQ ID NO: 295775 - DNA, 20 bp, human
gttctttactattggtatgt

SEQ ID NO: 295776 - DNA, 20 bp, human
gagggcgcggctcgcggggt

SEQ ID NO: 295777 - DNA, 20 bp, human
ggggcctcccggttgtaacg

SEQ ID NO: 295778 - DNA, 20 bp, human
ggcaagcgctcggcgagctg

SEQ ID NO: 295779 - DNA, 20 bp, human
gcgctcggcgagctggggac

SEQ ID NO: 295780 - DNA, 20 bp, human
gaggggcgatgacgtcatgc

SEQ ID NO: 295781 - DNA, 20 bp, human
gaggggcgagaaagttgttt

SEQ ID NO: 295782 - DNA, 20 bp, human
gtatcaggtgggcggtcaca

SEQ ID NO: 295783 - DNA, 20 bp, human
gttacaaccgggaggcccgc

SEQ ID NO: 295784 - DNA, 20 bp, human
gcaggtgggcggtcacaggg

SEQ ID NO: 295785 - DNA, 20 bp, human
ggggaggagggtgacggtgc

SEQ ID NO: 295786 - DNA, 20 bp, human
gcggccgagggcacccctcg

SEQ ID NO: 295787 - DNA, 20 bp, human
gcgggccggctccagcggga

SEQ ID NO: 295788 - DNA, 20 bp, human
gcgcccggggcgcagttccc

SEQ ID NO: 295789 - DNA, 20 bp, human
gaggacgtcgggagaaactg

SEQ ID NO: 295790 - DNA, 20 bp, human
gcggggcggggccatcgagg

SEQ ID NO: 295791 - DNA, 20 bp, human
gggcccgttcgctgccttaa

SEQ ID NO: 295792 - DNA, 20 bp, human
ggctacctcggtggcgtcgg

SEQ ID NO: 295793 - DNA, 20 bp, human
gcccggcccgcgctccttta

SEQ ID NO: 295794 - DNA, 20 bp, human
ggccctgggaactgcgcccc

SEQ ID NO: 295795 - DNA, 20 bp, human
gcagggcccgccagccccga

SEQ ID NO: 295796 - DNA, 20 bp, human
gctccaggacacctcgaatc

SEQ ID NO: 295797 - DNA, 20 bp, human
gacctcgggcggctcctccg

SEQ ID NO: 295798 - DNA, 20 bp, human
gctacaatcaccctgattcg

SEQ ID NO: 295799 - DNA, 20 bp, human
ggtggccggctcacctgcgg

SEQ ID NO: 295800 - DNA, 20 bp, human
gccgaggctgaacttcccac

SEQ ID NO: 295801 - DNA, 20 bp, human
gaccctgattcgaggtgtcc

SEQ ID NO: 295802 - DNA, 20 bp, human
gaatggcagaacttcgcacg

SEQ ID NO: 295803 - DNA, 20 bp, human
gaagttctgccattcccgcg

SEQ ID NO: 295804 - DNA, 20 bp, human
gagaacttcgcacgcggaac

SEQ ID NO: 295805 - DNA, 20 bp, human
gaggctgaacttcccacggg

SEQ ID NO: 295806 - DNA, 20 bp, human
ggctctcacggcgttcaggt

SEQ ID NO: 295807 - DNA, 20 bp, human
gcacggcgttcaggtaggaa

SEQ ID NO: 295808 - DNA, 20 bp, human
gggcggggaagaatcgcgaa

SEQ ID NO: 295809 - DNA, 20 bp, human
gaaggaggcgggcagaaaac

SEQ ID NO: 295810 - DNA, 20 bp, human
gcgctccgcaataacgtaaa

SEQ ID NO: 295811 - DNA, 20 bp, human
ggccgtgagagccaatccgc

SEQ ID NO: 295812 - DNA, 20 bp, human
ggtagtgcgagaataagaga

SEQ ID NO: 295813 - DNA, 20 bp, human
gtccgcaataacgtaaaagg

SEQ ID NO: 295814 - DNA, 20 bp, human
ggcggcggggaacagactcg

SEQ ID NO: 295815 - DNA, 20 bp, human
gaggaggtgtgtatccagct

SEQ ID NO: 295816 - DNA, 20 bp, human
ggggctgtggagcctcaatc

SEQ ID NO: 295817 - DNA, 20 bp, human
gcgggggggcactgtttctg

SEQ ID NO: 295818 - DNA, 20 bp, human
gacagagaggagccctcgaa

SEQ ID NO: 295819 - DNA, 20 bp, human
gtgtcctccggtgaagggga

SEQ ID NO: 295820 - DNA, 20 bp, human
ggcaaagcaaggcaaggcgg

SEQ ID NO: 295821 - DNA, 20 bp, human
gtggggcacaaacttcacgt

SEQ ID NO: 295822 - DNA, 20 bp, human
gttccaggaaagttaactga

SEQ ID NO: 295823 - DNA, 20 bp, human
gccccctgtccccctgattg

SEQ ID NO: 295824 - DNA, 20 bp, human
gtagcagcctccaacgtctg

SEQ ID NO: 295825 - DNA, 20 bp, human
gtcccagccctccccttcac

SEQ ID NO: 295826 - DNA, 20 bp, human
gggagcgtgtacacaatccc

SEQ ID NO: 295827 - DNA, 20 bp, human
gctgccccggggaactccag

SEQ ID NO: 295828 - DNA, 20 bp, human
ggcaccgcctctctaggcag

SEQ ID NO: 295829 - DNA, 20 bp, human
ggccggccaatcaacggcaa

SEQ ID NO: 295830 - DNA, 20 bp, human
gtcaacggcaaaggtgtgtg

SEQ ID NO: 295831 - DNA, 20 bp, human
gaggggcaaggagtgggcga

SEQ ID NO: 295832 - DNA, 20 bp, human
gcagagggaacacgctgccg

SEQ ID NO: 295833 - DNA, 20 bp, human
gcctgaggccggccaatcaa

SEQ ID NO: 295834 - DNA, 20 bp, human
gtcgcggggccacgcgtgat

SEQ ID NO: 295835 - DNA, 20 bp, human
ggacaccagcttcacgctgc

SEQ ID NO: 295836 - DNA, 20 bp, human
gaggctcacgggtgagtcac

SEQ ID NO: 295837 - DNA, 20 bp, human
gggccgccctaacctcaatg

SEQ ID NO: 295838 - DNA, 20 bp, human
gcctagctggcggagaccga

SEQ ID NO: 295839 - DNA, 20 bp, human
gctaacctcaatgaggctca

SEQ ID NO: 295840 - DNA, 20 bp, human
gcggcggcccgagcccggat

SEQ ID NO: 295841 - DNA, 20 bp, human
gtggcggagaccgacggatg

SEQ ID NO: 295842 - DNA, 20 bp, human
gtcacccgtgagcctcattg

SEQ ID NO: 295843 - DNA, 20 bp, human
gcggcgggggagatcctagc

SEQ ID NO: 295844 - DNA, 20 bp, human
gagcctcattgaggttaggg

SEQ ID NO: 295845 - DNA, 20 bp, human
ggtgaacaaagcgtgatcag

SEQ ID NO: 295846 - DNA, 20 bp, human
gtggccggccgggcacgaat

SEQ ID NO: 295847 - DNA, 20 bp, human
ggccctggaaagtaagggaa

SEQ ID NO: 295848 - DNA, 20 bp, human
gcccccgcccaacggccgtc

SEQ ID NO: 295849 - DNA, 20 bp, human
gcggccaatgagcgccgcgg

SEQ ID NO: 295850 - DNA, 20 bp, human
gccgtcgggcgggttaagag

SEQ ID NO: 295851 - DNA, 20 bp, human
gagcctggccgcggcgtgat

SEQ ID NO: 295852 - DNA, 20 bp, human
ggccctgcccgatcacgccg

SEQ ID NO: 295853 - DNA, 20 bp, human
ggggccgcgtgatcggagcc

SEQ ID NO: 295854 - DNA, 20 bp, human
gtgggggcgggcaaggtcta

SEQ ID NO: 295855 - DNA, 20 bp, human
gccgtccggctcacaggacc

SEQ ID NO: 295856 - DNA, 20 bp, human
gccgcctcctaatcctcggg

SEQ ID NO: 295857 - DNA, 20 bp, human
ggatggttgaaatcccctgt

SEQ ID NO: 295858 - DNA, 20 bp, human
gagcccgcctcctaatcctc

SEQ ID NO: 295859 - DNA, 20 bp, human
gcaaagtggtgcaggtgaaa

SEQ ID NO: 295860 - DNA, 20 bp, human
ggaggggttagtttcccaca

SEQ ID NO: 295861 - DNA, 20 bp, human
gtgggagctcggggagtcgt

SEQ ID NO: 295862 - DNA, 20 bp, human
gcggcgtcctgcaaccccct

SEQ ID NO: 295863 - DNA, 20 bp, human
gagcggcggggctttgtttc

SEQ ID NO: 295864 - DNA, 20 bp, human
gcccagcgagttgctctcca

SEQ ID NO: 295865 - DNA, 20 bp, human
gccagcccggcggtccgggc

SEQ ID NO: 295866 - DNA, 20 bp, human
gaccgggcacgcccctctaa

SEQ ID NO: 295867 - DNA, 20 bp, human
gggcaagggggcgtgaccga

SEQ ID NO: 295868 - DNA, 20 bp, human
ggggaccccagagcgcgcac

SEQ ID NO: 295869 - DNA, 20 bp, human
gaccccagagcgcgcaccgg

SEQ ID NO: 295870 - DNA, 20 bp, human
gtggcggcgcaggttacagg

SEQ ID NO: 295871 - DNA, 20 bp, human
gtccgccggtgcgcgctctg

SEQ ID NO: 295872 - DNA, 20 bp, human
gcgtgcccgcgcctgggcaa

SEQ ID NO: 295873 - DNA, 20 bp, human
ggggccctgcgcgcgccagt

SEQ ID NO: 295874 - DNA, 20 bp, human
gcggcgcaggttacaggcgg

SEQ ID NO: 295875 - DNA, 20 bp, human
gtggcctggccgtgcactca

SEQ ID NO: 295876 - DNA, 20 bp, human
gggcccgcaggacaccccct

SEQ ID NO: 295877 - DNA, 20 bp, human
gtcgccagctgggtgtcccg

SEQ ID NO: 295878 - DNA, 20 bp, human
gactccgcgggacacccagc

SEQ ID NO: 295879 - DNA, 20 bp, human
gggagacaagataatttctg

SEQ ID NO: 295880 - DNA, 20 bp, human
ggcaacccagaagttccgac

SEQ ID NO: 295881 - DNA, 20 bp, human
gtgacgcgcccctgacgcac

SEQ ID NO: 295882 - DNA, 20 bp, human
gccagctggcgacggaccag

SEQ ID NO: 295883 - DNA, 20 bp, human
ggacaccccctcggaacgcg

SEQ ID NO: 295884 - DNA, 20 bp, human
gactccccagtcggaacttc

SEQ ID NO: 295885 - DNA, 20 bp, human
gttccgagggggtgtcctgc

SEQ ID NO: 295886 - DNA, 20 bp, human
gcgtgcgcgtctggcagctc

SEQ ID NO: 295887 - DNA, 20 bp, human
ggcccgctgcgtcacgtgag

SEQ ID NO: 295888 - DNA, 20 bp, human
gagcatccgccgctcaagtc

SEQ ID NO: 295889 - DNA, 20 bp, human
gccaatggggcgcgcgcccg

SEQ ID NO: 295890 - DNA, 20 bp, human
ggaccaggcagcgtgttggg

SEQ ID NO: 295891 - DNA, 20 bp, human
gcgaaggctcgcaggaggct

SEQ ID NO: 295892 - DNA, 20 bp, human
gagggccggcttctaaagct

SEQ ID NO: 295893 - DNA, 20 bp, human
gcgagacagcggcgagaggt

SEQ ID NO: 295894 - DNA, 20 bp, human
gggcggatgctcggggatcc

SEQ ID NO: 295895 - DNA, 20 bp, human
gtcgcggcgtccacgagggc

SEQ ID NO: 295896 - DNA, 20 bp, human
ggcggctcggagagtggtgg

SEQ ID NO: 295897 - DNA, 20 bp, human
ggctccgggcctaagacgct

SEQ ID NO: 295898 - DNA, 20 bp, human
gcggccgcgcgccccggcgt

SEQ ID NO: 295899 - DNA, 20 bp, human
gctgacgcgtcctgacgcac

SEQ ID NO: 295900 - DNA, 20 bp, human
gcgccagcgcctagcgtctt

SEQ ID NO: 295901 - DNA, 20 bp, human
gccccgagggggcgtcctcc

SEQ ID NO: 295902 - DNA, 20 bp, human
ggcctcccgccccggcttga

SEQ ID NO: 295903 - DNA, 20 bp, human
gagagtggtggagggcgcgc

SEQ ID NO: 295904 - DNA, 20 bp, human
gccccccggcgcgcccactc

SEQ ID NO: 295905 - DNA, 20 bp, human
gggcctaagacgctaggcgc

SEQ ID NO: 295906 - DNA, 20 bp, human
ggcgcagggcgggacgggtg

SEQ ID NO: 295907 - DNA, 20 bp, human
gccttggcgcagctgtaaat

SEQ ID NO: 295908 - DNA, 20 bp, human
gtcagactgaggggtggaat

SEQ ID NO: 295909 - DNA, 20 bp, human
gcctcaccatgccccaacca

SEQ ID NO: 295910 - DNA, 20 bp, human
gaggggtggaatgggtcggt

SEQ ID NO: 295911 - DNA, 20 bp, human
gcccgcctgcgacgccgtgg

SEQ ID NO: 295912 - DNA, 20 bp, human
gtggaatgggtcggttgggt

SEQ ID NO: 295913 - DNA, 20 bp, human
gcaactgtttcacccaagtg

SEQ ID NO: 295914 - DNA, 20 bp, human
ggaaacagttgctcagactg

SEQ ID NO: 295915 - DNA, 20 bp, human
gagaggcaaggttgggtgta

SEQ ID NO: 295916 - DNA, 20 bp, human
gcggaaacgcgtcccggatg

SEQ ID NO: 295917 - DNA, 20 bp, human
gcccgccggcttatataccg

SEQ ID NO: 295918 - DNA, 20 bp, human
ggcagcggccgtggccactg

SEQ ID NO: 295919 - DNA, 20 bp, human
ggggcccgcccaagccttat

SEQ ID NO: 295920 - DNA, 20 bp, human
gcgggcggggacggctctgt

SEQ ID NO: 295921 - DNA, 20 bp, human
gcgcagcctaaatttagccg

SEQ ID NO: 295922 - DNA, 20 bp, human
gacaacgtcgccggggagac

SEQ ID NO: 295923 - DNA, 20 bp, human
ggggccgggctgtcagcgca

SEQ ID NO: 295924 - DNA, 20 bp, human
gcggcggcggaaacgcgtcc

SEQ ID NO: 295925 - DNA, 20 bp, human
gttagccgcggtatataagc

SEQ ID NO: 295926 - DNA, 20 bp, human
gcggcccaacctgtcccacg

SEQ ID NO: 295927 - DNA, 20 bp, human
gcgcgcctcgtgggacaggt

SEQ ID NO: 295928 - DNA, 20 bp, human
gggaataatgagtgtctgtc

SEQ ID NO: 295929 - DNA, 20 bp, human
gactcggccgacccctccgg

SEQ ID NO: 295930 - DNA, 20 bp, human
gccgcccagtcacccgggga

SEQ ID NO: 295931 - DNA, 20 bp, human
gggcgggtccccacccactt

SEQ ID NO: 295932 - DNA, 20 bp, human
gccgccccgcccagtcaccc

SEQ ID NO: 295933 - DNA, 20 bp, human
gcggccgcgccgcgcctcgt

SEQ ID NO: 295934 - DNA, 20 bp, human
gaggccgtccccgggtgact

SEQ ID NO: 295935 - DNA, 20 bp, human
ggtgactcggccgacccctc

SEQ ID NO: 295936 - DNA, 20 bp, human
gctcccttccatcgttgcta

SEQ ID NO: 295937 - DNA, 20 bp, human
gctgccatagcaacgatgga

SEQ ID NO: 295938 - DNA, 20 bp, human
gaaagggaggggcggggcat

SEQ ID NO: 295939 - DNA, 20 bp, human
gatggaagggagcctcgggg

SEQ ID NO: 295940 - DNA, 20 bp, human
gtgaccccaccagtcttcgc

SEQ ID NO: 295941 - DNA, 20 bp, human
ggaggaaaaggctgtagcga

SEQ ID NO: 295942 - DNA, 20 bp, human
gaacaaactcggcgcacgtg

SEQ ID NO: 295943 - DNA, 20 bp, human
gttagctgccatagcaacga

SEQ ID NO: 295944 - DNA, 20 bp, human
gccggcggcagtggtgtcgg

SEQ ID NO: 295945 - DNA, 20 bp, human
gaactcggcgcacgtggggg

SEQ ID NO: 295946 - DNA, 20 bp, human
gcgacagcgcgcccggggac

SEQ ID NO: 295947 - DNA, 20 bp, human
ggacgtccacgggacctgga

SEQ ID NO: 295948 - DNA, 20 bp, human
gcctaccgacagcgcgcccg

SEQ ID NO: 295949 - DNA, 20 bp, human
gccggggactggtgaagacc

SEQ ID NO: 295950 - DNA, 20 bp, human
gacgcccggtgggttttcgt

SEQ ID NO: 295951 - DNA, 20 bp, human
ggacgcggccacctcccgcc

SEQ ID NO: 295952 - DNA, 20 bp, human
gcgctctcgggccaccgggc

SEQ ID NO: 295953 - DNA, 20 bp, human
gcgctcgctcacacgcaatt

SEQ ID NO: 295954 - DNA, 20 bp, human
gcaggtcccgtggacgtccc

SEQ ID NO: 295955 - DNA, 20 bp, human
gagtgagtttagcgcgtagg

SEQ ID NO: 295956 - DNA, 20 bp, human
gagcggagcgggtggaatct

SEQ ID NO: 295957 - DNA, 20 bp, human
gccctacctagctgccttct

SEQ ID NO: 295958 - DNA, 20 bp, human
ggaagctcgtggcccgagag

SEQ ID NO: 295959 - DNA, 20 bp, human
ggcccgagaggggtgcggtc

SEQ ID NO: 295960 - DNA, 20 bp, human
ggcccgaccgcacccctctc

SEQ ID NO: 295961 - DNA, 20 bp, human
ggccctgcgcgcgaagctcg

SEQ ID NO: 295962 - DNA, 20 bp, human
ggagcggccagcctatgagc

SEQ ID NO: 295963 - DNA, 20 bp, human
gaggggtgcggtcgggccga

SEQ ID NO: 295964 - DNA, 20 bp, human
gaagttgtgtacaaactgcg

SEQ ID NO: 295965 - DNA, 20 bp, human
gcggggcccgatcgcctgat

SEQ ID NO: 295966 - DNA, 20 bp, human
ggcggggcgagtcacgtggg

SEQ ID NO: 295967 - DNA, 20 bp, human
gcgcaggcggcgacacacag

SEQ ID NO: 295968 - DNA, 20 bp, human
gtgaccgagactctccatca

SEQ ID NO: 295969 - DNA, 20 bp, human
ggggcgagtcacgtgggggg

SEQ ID NO: 295970 - DNA, 20 bp, human
ggtcagctccggccaatcgc

SEQ ID NO: 295971 - DNA, 20 bp, human
ggccggagctaagggagccg

SEQ ID NO: 295972 - DNA, 20 bp, human
ggcgccgatgatgtcagctc

SEQ ID NO: 295973 - DNA, 20 bp, human
gtggcagcggagctttgaat

SEQ ID NO: 295974 - DNA, 20 bp, human
gccaatggtgcgggccgtga

SEQ ID NO: 295975 - DNA, 20 bp, human
gcccgcgcccgccccgtgcg

SEQ ID NO: 295976 - DNA, 20 bp, human
gtctgctccgggctccccat

SEQ ID NO: 295977 - DNA, 20 bp, human
gcgagcgcaagggacaggga

SEQ ID NO: 295978 - DNA, 20 bp, human
gtgcgcggagaaccgaacgg

SEQ ID NO: 295979 - DNA, 20 bp, human
gaccatgtaaggtaaacagg

SEQ ID NO: 295980 - DNA, 20 bp, human
gagcgcgagcgcaagggaca

SEQ ID NO: 295981 - DNA, 20 bp, human
gggcgcggattggcacgctg

SEQ ID NO: 295982 - DNA, 20 bp, human
gcagccgtgggatctcgagg

SEQ ID NO: 295983 - DNA, 20 bp, human
gtccctgctgccttacaagg

SEQ ID NO: 295984 - DNA, 20 bp, human
gaggaggaagtgccacacaa

SEQ ID NO: 295985 - DNA, 20 bp, human
gagggagcctaggtagacgt

SEQ ID NO: 295986 - DNA, 20 bp, human
gctagaggagagtgcaaagt

SEQ ID NO: 295987 - DNA, 20 bp, human
ggaggcgaggccagctctgt

SEQ ID NO: 295988 - DNA, 20 bp, human
ggagctggcctcgcctccgg

SEQ ID NO: 295989 - DNA, 20 bp, human
ggaggagagtgcaaagtggg

SEQ ID NO: 295990 - DNA, 20 bp, human
ggaaacgggtactgggattg

SEQ ID NO: 295991 - DNA, 20 bp, human
gcaggggagggtggtgaaac

SEQ ID NO: 295992 - DNA, 20 bp, human
ggggtggtgaaacgggtact

SEQ ID NO: 295993 - DNA, 20 bp, human
gcggccgcctgtccttttta

SEQ ID NO: 295994 - DNA, 20 bp, human
gtgcttgcaagccttaattt

SEQ ID NO: 295995 - DNA, 20 bp, human
ggtgaggactccacctaggg

SEQ ID NO: 295996 - DNA, 20 bp, human
gaggctgtaggggtagcacg

SEQ ID NO: 295997 - DNA, 20 bp, human
gcagtcagaacggccttcgg

SEQ ID NO: 295998 - DNA, 20 bp, human
gggaacgagcgcaactgact

SEQ ID NO: 295999 - DNA, 20 bp, human
ggtagcacgaggcagcgaaa

SEQ ID NO: 296000 - DNA, 20 bp, human
gagaacggccttcggtggag

SEQ ID NO: 296001 - DNA, 20 bp, human
gagaggtgcgtctagaactg

SEQ ID NO: 296002 - DNA, 20 bp, human
gtgccagtcagaacggcctt

SEQ ID NO: 296003 - DNA, 20 bp, human
ggaggcactccgaaagtgtg

SEQ ID NO: 296004 - DNA, 20 bp, human
gtcagtgttcgaggctgtag

SEQ ID NO: 296005 - DNA, 20 bp, human
gttggctcggccaatcacaa

SEQ ID NO: 296006 - DNA, 20 bp, human
gcacgaacggaacgcggcga

SEQ ID NO: 296007 - DNA, 20 bp, human
ggctcctcgcagtgggcaag

SEQ ID NO: 296008 - DNA, 20 bp, human
gaggggcggcgcggctgtgg

SEQ ID NO: 296009 - DNA, 20 bp, human
gacgtcccgcggctctcgct

SEQ ID NO: 296010 - DNA, 20 bp, human
gagggtcgagattggtggga

SEQ ID NO: 296011 - DNA, 20 bp, human
gcgctcgggaagtcgagcca

SEQ ID NO: 296012 - DNA, 20 bp, human
gggcgagggtcgagattggt

SEQ ID NO: 296013 - DNA, 20 bp, human
gacgcggcgagggtcgagat

SEQ ID NO: 296014 - DNA, 20 bp, human
gagtcgagccaggggcggcg

SEQ ID NO: 296015 - DNA, 20 bp, human
gcgcagtgggcaaggggcct

SEQ ID NO: 296016 - DNA, 20 bp, human
ggggctgcggcaatcgttag

SEQ ID NO: 296017 - DNA, 20 bp, human
gcaccaaggcggtaagtcat

SEQ ID NO: 296018 - DNA, 20 bp, human
gcaagaaaacgactgaccat

SEQ ID NO: 296019 - DNA, 20 bp, human
gcgggaggcggagagaaacg

SEQ ID NO: 296020 - DNA, 20 bp, human
gaacgtggtaaccatagcta

SEQ ID NO: 296021 - DNA, 20 bp, human
gcgcctgcggaaagactccc

SEQ ID NO: 296022 - DNA, 20 bp, human
ggcggtaagtcattggtctc

SEQ ID NO: 296023 - DNA, 20 bp, human
gcctggccccgcaggagtcg

SEQ ID NO: 296024 - DNA, 20 bp, human
gacggccagtgcctcagtct

SEQ ID NO: 296025 - DNA, 20 bp, human
gagagcggacgatgagagct

SEQ ID NO: 296026 - DNA, 20 bp, human
gcctgggcaccgcagatcta

SEQ ID NO: 296027 - DNA, 20 bp, human
gctgccgggcgccgcctctg

SEQ ID NO: 296028 - DNA, 20 bp, human
gaggagaggcccccggggat

SEQ ID NO: 296029 - DNA, 20 bp, human
gctgcccgcgcctccgccta

SEQ ID NO: 296030 - DNA, 20 bp, human
gaggcccccggggatcgggc

SEQ ID NO: 296031 - DNA, 20 bp, human
gcgggcggcgtcagcggaac

SEQ ID NO: 296032 - DNA, 20 bp, human
ggggcccagcccgatccccg

SEQ ID NO: 296033 - DNA, 20 bp, human
gcgcggcgtaaacaaggccg

SEQ ID NO: 296034 - DNA, 20 bp, human
gaaacacactggcacactag

SEQ ID NO: 296035 - DNA, 20 bp, human
gccgccgagctccggaagcg

SEQ ID NO: 296036 - DNA, 20 bp, human
gcgtttcctgagggacgaga

SEQ ID NO: 296037 - DNA, 20 bp, human
gtcaatcatggatatggggc

SEQ ID NO: 296038 - DNA, 20 bp, human
gtcgtccctcaggaaacgta

SEQ ID NO: 296039 - DNA, 20 bp, human
gaatgacggaggcggggcaa

SEQ ID NO: 296040 - DNA, 20 bp, human
gagcccgcggcctccacttc

SEQ ID NO: 296041 - DNA, 20 bp, human
gcattacccagtggcctcct

SEQ ID NO: 296042 - DNA, 20 bp, human
gtcgttggggactaaggcgt

SEQ ID NO: 296043 - DNA, 20 bp, human
gccagcgtcaatcatggata

SEQ ID NO: 296044 - DNA, 20 bp, human
gtcctcgccagcgtcaatca

SEQ ID NO: 296045 - DNA, 20 bp, human
gggaggccgcgggctctgag

SEQ ID NO: 296046 - DNA, 20 bp, human
ggagactagtgcccctgtgg

SEQ ID NO: 296047 - DNA, 20 bp, human
gtagtgtgggagggccccca

SEQ ID NO: 296048 - DNA, 20 bp, human
ggcactagtctcagctcagg

SEQ ID NO: 296049 - DNA, 20 bp, human
ggggcccccagggtgacact

SEQ ID NO: 296050 - DNA, 20 bp, human
ggcctccaagtgtcaccctg

SEQ ID NO: 296051 - DNA, 20 bp, human
ggacctcggcagctcccttg

SEQ ID NO: 296052 - DNA, 20 bp, human
gcccccagggtgacacttgg

SEQ ID NO: 296053 - DNA, 20 bp, human
gcccctgtggaggggtagtg

SEQ ID NO: 296054 - DNA, 20 bp, human
gtctgagctggcaatcaggt

SEQ ID NO: 296055 - DNA, 20 bp, human
gtgccccaagggagctgccg

SEQ ID NO: 296056 - DNA, 20 bp, human
ggggccttatgcagagtccg

SEQ ID NO: 296057 - DNA, 20 bp, human
gaaggcctcccaaagctcca

SEQ ID NO: 296058 - DNA, 20 bp, human
gcggaagcggctcgaactcg

SEQ ID NO: 296059 - DNA, 20 bp, human
gggagctcggcgcacagaaa

SEQ ID NO: 296060 - DNA, 20 bp, human
gggagctccgtcttcggcag

SEQ ID NO: 296061 - DNA, 20 bp, human
gcaagaccgaacctcgtaaa

SEQ ID NO: 296062 - DNA, 20 bp, human
ggggcctcggactctgcata

SEQ ID NO: 296063 - DNA, 20 bp, human
gagcggctcgaactcggggc

SEQ ID NO: 296064 - DNA, 20 bp, human
ggcagcgggctcgggggcct

SEQ ID NO: 296065 - DNA, 20 bp, human
gtgcggctgggccctttacg

SEQ ID NO: 296066 - DNA, 20 bp, human
gagcggaggggagggagttc

SEQ ID NO: 296067 - DNA, 20 bp, human
gtcagcagctaggggatgtt

SEQ ID NO: 296068 - DNA, 20 bp, human
gggagaagcatgttccccag

SEQ ID NO: 296069 - DNA, 20 bp, human
gagtgggcatacaaaagagg

SEQ ID NO: 296070 - DNA, 20 bp, human
gctgcagagggtggccgctg

SEQ ID NO: 296071 - DNA, 20 bp, human
ggatgttaggagtatccagt

SEQ ID NO: 296072 - DNA, 20 bp, human
ggccacctaagccagctctg

SEQ ID NO: 296073 - DNA, 20 bp, human
ggttcctgggtcctgctgag

SEQ ID NO: 296074 - DNA, 20 bp, human
gccgatgccaggaaatgcat

SEQ ID NO: 296075 - DNA, 20 bp, human
gctggcatcgggtgactgtt

SEQ ID NO: 296076 - DNA, 20 bp, human
gcccccggagcaagcaaagc

SEQ ID NO: 296077 - DNA, 20 bp, human
gcgggcgaggctcacggctc

SEQ ID NO: 296078 - DNA, 20 bp, human
gtgggccccaggtcagcggc

SEQ ID NO: 296079 - DNA, 20 bp, human
ggaggctcacggctccggga

SEQ ID NO: 296080 - DNA, 20 bp, human
gggagcgcgggcgaggctca

SEQ ID NO: 296081 - DNA, 20 bp, human
gccggcctcgccggcatcgt

SEQ ID NO: 296082 - DNA, 20 bp, human
gccggcccttgggacgagag

SEQ ID NO: 296083 - DNA, 20 bp, human
ggagggcgcgcggctgtggc

SEQ ID NO: 296084 - DNA, 20 bp, human
gccacaggggcctacgatgc

SEQ ID NO: 296085 - DNA, 20 bp, human
gtcgcccactctcgtcccaa

SEQ ID NO: 296086 - DNA, 20 bp, human
ggagaggcgcggagacactg

SEQ ID NO: 296087 - DNA, 20 bp, human
gcacccagtctcagctgcaa

SEQ ID NO: 296088 - DNA, 20 bp, human
gacagccccacccctgagga

SEQ ID NO: 296089 - DNA, 20 bp, human
gataactggcagcgttgcaa

SEQ ID NO: 296090 - DNA, 20 bp, human
gggcctttgcagctgagact

SEQ ID NO: 296091 - DNA, 20 bp, human
gaacgctgccagttatgcaa

SEQ ID NO: 296092 - DNA, 20 bp, human
gcatagaaaggcaaaggtat

SEQ ID NO: 296093 - DNA, 20 bp, human
gcactggggctctgacgagc

SEQ ID NO: 296094 - DNA, 20 bp, human
gcctgaatgcacagaaactt

SEQ ID NO: 296095 - DNA, 20 bp, human
gcgtgacccccctactgaga

SEQ ID NO: 296096 - DNA, 20 bp, human
gagcagggcgtgccgatcta

SEQ ID NO: 296097 - DNA, 20 bp, human
gtccagctgcggcatgtgca

SEQ ID NO: 296098 - DNA, 20 bp, human
gtccctgagtcggaggggga

SEQ ID NO: 296099 - DNA, 20 bp, human
gcccctccccctccgactca

SEQ ID NO: 296100 - DNA, 20 bp, human
ggcaggccagccgaacccga

SEQ ID NO: 296101 - DNA, 20 bp, human
gcacatgccgcagctggagc

SEQ ID NO: 296102 - DNA, 20 bp, human
gtcggacgctaaattctgtc

SEQ ID NO: 296103 - DNA, 20 bp, human
gccgccgggaagcctgtaat

SEQ ID NO: 296104 - DNA, 20 bp, human
gcgacccagcctgggtgcgc

SEQ ID NO: 296105 - DNA, 20 bp, human
gatgcaaacggacagataaa

SEQ ID NO: 296106 - DNA, 20 bp, human
gatcacaggggtttattcta

SEQ ID NO: 296107 - DNA, 20 bp, human
gaagcaaaagtcagagggtg

SEQ ID NO: 296108 - DNA, 20 bp, human
gactcgggctaaccacccca

SEQ ID NO: 296109 - DNA, 20 bp, human
ggttaacctcagaaagtcgg

SEQ ID NO: 296110 - DNA, 20 bp, human
ggtggctatcgggaaccgta

SEQ ID NO: 296111 - DNA, 20 bp, human
gaggagaagcaaaagtcaga

SEQ ID NO: 296112 - DNA, 20 bp, human
gagaaagtcggaggacagtc

SEQ ID NO: 296113 - DNA, 20 bp, human
gggtggtgccaccaaggcta

SEQ ID NO: 296114 - DNA, 20 bp, human
gttcacagcggagatcacag

SEQ ID NO: 296115 - DNA, 20 bp, human
gtagcagaacccagtctctc

SEQ ID NO: 296116 - DNA, 20 bp, human
gagtaatgtagcgaggaagg

SEQ ID NO: 296117 - DNA, 20 bp, human
gggtgacaagacccacgcaa

SEQ ID NO: 296118 - DNA, 20 bp, human
gcacagtaatgtagcgagga

SEQ ID NO: 296119 - DNA, 20 bp, human
ggctacacagtaatgtagcg

SEQ ID NO: 296120 - DNA, 20 bp, human
gtcttattgtccccttgcgt

SEQ ID NO: 296121 - DNA, 20 bp, human
gtctgcgtcacttacagggg

SEQ ID NO: 296122 - DNA, 20 bp, human
ggcgtcacttacaggggagg

SEQ ID NO: 296123 - DNA, 20 bp, human
gatgtgcactggggcctata

SEQ ID NO: 296124 - DNA, 20 bp, human
gcacatctgcgtcacttaca

SEQ ID NO: 296125 - DNA, 20 bp, human
ggtgacgcagatgtgcactg

SEQ ID NO: 296126 - DNA, 20 bp, human
gcagcctaagtggggtggta

SEQ ID NO: 296127 - DNA, 20 bp, human
gaacactcagatggtgctag

SEQ ID NO: 296128 - DNA, 20 bp, human
gcctccttaccaccccactt

SEQ ID NO: 296129 - DNA, 20 bp, human
gaaggtagatgaatgctcca

SEQ ID NO: 296130 - DNA, 20 bp, human
gccctgcagtgagatcacac

SEQ ID NO: 296131 - DNA, 20 bp, human
gagggatagagacctgtatc

SEQ ID NO: 296132 - DNA, 20 bp, human
ggtctagggagccaagtgtt

SEQ ID NO: 296133 - DNA, 20 bp, human
gcacacaggattgtgctctc

SEQ ID NO: 296134 - DNA, 20 bp, human
gcctgttactcacctgatac

SEQ ID NO: 296135 - DNA, 20 bp, human
ggtggtcatggttctgtttt

SEQ ID NO: 296136 - DNA, 20 bp, human
gactgggcgactgttactga

SEQ ID NO: 296137 - DNA, 20 bp, human
gacgccctgggggtaggcct

SEQ ID NO: 296138 - DNA, 20 bp, human
ggggcgaagtcttctggact

SEQ ID NO: 296139 - DNA, 20 bp, human
gtgacggacctcaccaaggc

SEQ ID NO: 296140 - DNA, 20 bp, human
gcaacagccgcatcgttccg

SEQ ID NO: 296141 - DNA, 20 bp, human
ggcaccgacgccctgggggt

SEQ ID NO: 296142 - DNA, 20 bp, human
gtcgccccaggcctaccccc

SEQ ID NO: 296143 - DNA, 20 bp, human
gaggcgaggcggcgcatgtg

SEQ ID NO: 296144 - DNA, 20 bp, human
ggctgttggtacgacacaga

SEQ ID NO: 296145 - DNA, 20 bp, human
ggagagcatgctacccacta

SEQ ID NO: 296146 - DNA, 20 bp, human
gcccgcgctagggtacagac

SEQ ID NO: 296147 - DNA, 20 bp, human
ggtacagaagccccgcgcta

SEQ ID NO: 296148 - DNA, 20 bp, human
gtctgcgtcacgtgaggagg

SEQ ID NO: 296149 - DNA, 20 bp, human
gcgcaggggccagacccgga

SEQ ID NO: 296150 - DNA, 20 bp, human
ggacgcagactctggagcgg

SEQ ID NO: 296151 - DNA, 20 bp, human
gagactctggagcgggggga

SEQ ID NO: 296152 - DNA, 20 bp, human
gccagagtctgcgtcacgtg

SEQ ID NO: 296153 - DNA, 20 bp, human
ggagtctgcgtcacgtgagg

SEQ ID NO: 296154 - DNA, 20 bp, human
gcaaaaaggtcgggtgggca

SEQ ID NO: 296155 - DNA, 20 bp, human
gaattacaaaaaggtcgggt

SEQ ID NO: 296156 - DNA, 20 bp, human
gacggtgtgtggggtccgaa

SEQ ID NO: 296157 - DNA, 20 bp, human
gcggggctaggacggtgtgt

SEQ ID NO: 296158 - DNA, 20 bp, human
ggggtccgaacggaactccc

SEQ ID NO: 296159 - DNA, 20 bp, human
ggctgtagcgaaagcgtgac

SEQ ID NO: 296160 - DNA, 20 bp, human
gcgcgcgggcgggggaaaca

SEQ ID NO: 296161 - DNA, 20 bp, human
gacagcctgggagttccgtt

SEQ ID NO: 296162 - DNA, 20 bp, human
ggcggctgcactgttgtccc

SEQ ID NO: 296163 - DNA, 20 bp, human
gaagctgaatgaccgctaag

SEQ ID NO: 296164 - DNA, 20 bp, human
gggcgggaacccagttgggg

SEQ ID NO: 296165 - DNA, 20 bp, human
gctcccgcgcaggcgccgcc

SEQ ID NO: 296166 - DNA, 20 bp, human
ggcacggcctcaacctgctg

SEQ ID NO: 296167 - DNA, 20 bp, human
gtcgctgtggctggggtcga

SEQ ID NO: 296168 - DNA, 20 bp, human
ggtgcagcaggttgtcgctg

SEQ ID NO: 296169 - DNA, 20 bp, human
gcaacctggcagacaggggt

SEQ ID NO: 296170 - DNA, 20 bp, human
gcggcctcaacctgctgtgg

SEQ ID NO: 296171 - DNA, 20 bp, human
gccgacccctcccccgagag

SEQ ID NO: 296172 - DNA, 20 bp, human
gccagccacccccctctcgg

SEQ ID NO: 296173 - DNA, 20 bp, human
gtgctggccctgggccgtca

SEQ ID NO: 296174 - DNA, 20 bp, human
gtggacatggcgagctgact

SEQ ID NO: 296175 - DNA, 20 bp, human
gcagcacggccttgtggcaa

SEQ ID NO: 296176 - DNA, 20 bp, human
gaagcacggtgatcacacaa

SEQ ID NO: 296177 - DNA, 20 bp, human
gcattgattgaagataactt

SEQ ID NO: 296178 - DNA, 20 bp, human
gatgtcaaaataaggaggga

SEQ ID NO: 296179 - DNA, 20 bp, human
gttgacattgcaaggtctcg

SEQ ID NO: 296180 - DNA, 20 bp, human
gttgcaatgtcaaaataagg

SEQ ID NO: 296181 - DNA, 20 bp, human
gaatttcaaatgtgcttttt

SEQ ID NO: 296182 - DNA, 20 bp, human
gggagtctgtcgctcaggct

SEQ ID NO: 296183 - DNA, 20 bp, human
gttgaagataacttggggag

SEQ ID NO: 296184 - DNA, 20 bp, human
ggctggggtgcagtggatct

SEQ ID NO: 296185 - DNA, 20 bp, human
ggcatggtggggcacgtctg

SEQ ID NO: 296186 - DNA, 20 bp, human
ggggcggcgccgagaaacag

SEQ ID NO: 296187 - DNA, 20 bp, human
ggtctgggggtgcttctcgg

SEQ ID NO: 296188 - DNA, 20 bp, human
gggcttcggggactagacgt

SEQ ID NO: 296189 - DNA, 20 bp, human
gcgccgagaaacagcggctg

SEQ ID NO: 296190 - DNA, 20 bp, human
gccgcctcccgagaggcttc

SEQ ID NO: 296191 - DNA, 20 bp, human
gggagtgagcgacacagagc

SEQ ID NO: 296192 - DNA, 20 bp, human
gagaaacagcggctgcgggc

SEQ ID NO: 296193 - DNA, 20 bp, human
gccaccgccgagcagccctc

SEQ ID NO: 296194 - DNA, 20 bp, human
gggacgcggagactgccgga

SEQ ID NO: 296195 - DNA, 20 bp, human
gaaggaagatggcgaggcct

SEQ ID NO: 296196 - DNA, 20 bp, human
ggaatcgggaagacgagaga

SEQ ID NO: 296197 - DNA, 20 bp, human
gcctggtgaacggtgagcag

SEQ ID NO: 296198 - DNA, 20 bp, human
gcgcggagcagcaatcggac

SEQ ID NO: 296199 - DNA, 20 bp, human
gtgctgctccgcgctccgag

SEQ ID NO: 296200 - DNA, 20 bp, human
ggtggcggaaatgaagtccg

SEQ ID NO: 296201 - DNA, 20 bp, human
ggtgaggtcatggccgaatc

SEQ ID NO: 296202 - DNA, 20 bp, human
gcatgaaccaggaagcggag

SEQ ID NO: 296203 - DNA, 20 bp, human
gccgacacttccggaatccc

SEQ ID NO: 296204 - DNA, 20 bp, human
gaaccaggaagcggagtggc

SEQ ID NO: 296205 - DNA, 20 bp, human
gagcgtcgctgcctggtgaa

SEQ ID NO: 296206 - DNA, 20 bp, human
gcggccgagtacccctccct

SEQ ID NO: 296207 - DNA, 20 bp, human
ggcgccgagggaggggtact

SEQ ID NO: 296208 - DNA, 20 bp, human
ggccgcccacagcgggtctc

SEQ ID NO: 296209 - DNA, 20 bp, human
gctgtgacgggactgcgatg

SEQ ID NO: 296210 - DNA, 20 bp, human
gccggggccgaacccggaag

SEQ ID NO: 296211 - DNA, 20 bp, human
ggggcgctggaaaatgggag

SEQ ID NO: 296212 - DNA, 20 bp, human
gcgccggccggggccgaacc

SEQ ID NO: 296213 - DNA, 20 bp, human
ggacgggggcgctggaaaat

SEQ ID NO: 296214 - DNA, 20 bp, human
ggaggggtactcggccgccg

SEQ ID NO: 296215 - DNA, 20 bp, human
gggcgggcgtgcccagacgc

SEQ ID NO: 296216 - DNA, 20 bp, human
gcgaggataaacaacctctg

SEQ ID NO: 296217 - DNA, 20 bp, human
gccgccaaggggttccggtg

SEQ ID NO: 296218 - DNA, 20 bp, human
gtacctgaatgccccagcaa

SEQ ID NO: 296219 - DNA, 20 bp, human
ggagccgcaccggaacccct

SEQ ID NO: 296220 - DNA, 20 bp, human
gaccccttggcggattatgt

SEQ ID NO: 296221 - DNA, 20 bp, human
gaacccacataatccgccaa

SEQ ID NO: 296222 - DNA, 20 bp, human
gcaaagggcacgactacttc

SEQ ID NO: 296223 - DNA, 20 bp, human
gactacttccggagccgcac

SEQ ID NO: 296224 - DNA, 20 bp, human
gaggttgtttatcctcgtgg

SEQ ID NO: 296225 - DNA, 20 bp, human
gataatccgccaaggggttc

SEQ ID NO: 296226 - DNA, 20 bp, human
ggggagacgcagaagggcgg

SEQ ID NO: 296227 - DNA, 20 bp, human
gtcagcggggagacgcagaa

SEQ ID NO: 296228 - DNA, 20 bp, human
gtccccggcccgggcgtcag

SEQ ID NO: 296229 - DNA, 20 bp, human
gcgtgcgcggggtccgagaa

SEQ ID NO: 296230 - DNA, 20 bp, human
ggggcgccgcggctctcgag

SEQ ID NO: 296231 - DNA, 20 bp, human
gggctcgcctgtcccccgcg

SEQ ID NO: 296232 - DNA, 20 bp, human
gcggcacagaggggttaagg

SEQ ID NO: 296233 - DNA, 20 bp, human
gagtcaccgctgtccgcggc

SEQ ID NO: 296234 - DNA, 20 bp, human
gcggtggcgcccggcacaga

SEQ ID NO: 296235 - DNA, 20 bp, human
gtgacaagtgccaggtccga

SEQ ID NO: 296236 - DNA, 20 bp, human
gtggccgggtagcagcgcgg

SEQ ID NO: 296237 - DNA, 20 bp, human
gaggacagcagcgatcgcca

SEQ ID NO: 296238 - DNA, 20 bp, human
ggggccagacgtaggcccgg

SEQ ID NO: 296239 - DNA, 20 bp, human
ggctccactccggcgctctg

SEQ ID NO: 296240 - DNA, 20 bp, human
gcctggggcggggagacagg

SEQ ID NO: 296241 - DNA, 20 bp, human
ggctgtcctccgcagagcgc

SEQ ID NO: 296242 - DNA, 20 bp, human
gcgccgggcgggccagacgt

SEQ ID NO: 296243 - DNA, 20 bp, human
ggaggcaaggaaagagtcaa

SEQ ID NO: 296244 - DNA, 20 bp, human
gccgcccccgcgctgctacc

SEQ ID NO: 296245 - DNA, 20 bp, human
ggaacccccgggcctacgtc

SEQ ID NO: 296246 - DNA, 20 bp, human
ggtacgagtaacaactccac

SEQ ID NO: 296247 - DNA, 20 bp, human
gcgtaccagcatctctgacg

SEQ ID NO: 296248 - DNA, 20 bp, human
ggacacctcgtcagagatgc

SEQ ID NO: 296249 - DNA, 20 bp, human
gtccatgatgctcctagatc

SEQ ID NO: 296250 - DNA, 20 bp, human
gctcccttgttcctcggcta

SEQ ID NO: 296251 - DNA, 20 bp, human
gactgtggcgccaagcgccg

SEQ ID NO: 296252 - DNA, 20 bp, human
gctccaccggctggcgtccg

SEQ ID NO: 296253 - DNA, 20 bp, human
ggacgggcgaaggaaagtac

SEQ ID NO: 296254 - DNA, 20 bp, human
gaggcgaggatgccgaatga

SEQ ID NO: 296255 - DNA, 20 bp, human
ggatgctggtacggtttgga

SEQ ID NO: 296256 - DNA, 20 bp, human
ggcggcgcgcgctgtctcct

SEQ ID NO: 296257 - DNA, 20 bp, human
ggcgaagcctactgagggag

SEQ ID NO: 296258 - DNA, 20 bp, human
gggctggcgaagcctactga

SEQ ID NO: 296259 - DNA, 20 bp, human
gcagagagcgagccaaggaa

SEQ ID NO: 296260 - DNA, 20 bp, human
gtcgccgcacggcccggcga

SEQ ID NO: 296261 - DNA, 20 bp, human
ggaagcagtcccacctgctg

SEQ ID NO: 296262 - DNA, 20 bp, human
gccgcgcgctctctcacacc

SEQ ID NO: 296263 - DNA, 20 bp, human
gcggggccaaggcgaagtcc

SEQ ID NO: 296264 - DNA, 20 bp, human
gtaagagaagacgctcgacc

SEQ ID NO: 296265 - DNA, 20 bp, human
ggtgctggtgagcacatcag

SEQ ID NO: 296266 - DNA, 20 bp, human
gaaccctggccaatccgggt

SEQ ID NO: 296267 - DNA, 20 bp, human
gtggcctccggggccacctg

SEQ ID NO: 296268 - DNA, 20 bp, human
gaggacgagacccacccaaa

SEQ ID NO: 296269 - DNA, 20 bp, human
gccgccgtggggtgggtgtc

SEQ ID NO: 296270 - DNA, 20 bp, human
gtgggtgtcgggtgcccaag

SEQ ID NO: 296271 - DNA, 20 bp, human
gacctggggctcccgccgtg

SEQ ID NO: 296272 - DNA, 20 bp, human
ggggtgggtctcgtcctctt

SEQ ID NO: 296273 - DNA, 20 bp, human
gctcccagggttccccgggg

SEQ ID NO: 296274 - DNA, 20 bp, human
gcgcccacccggattggcca

SEQ ID NO: 296275 - DNA, 20 bp, human
gggaggacgcccacccggat

SEQ ID NO: 296276 - DNA, 20 bp, human
gggggagggggggggaccgg

SEQ ID NO: 296277 - DNA, 20 bp, human
ggccccccaccccccggtgc

SEQ ID NO: 296278 - DNA, 20 bp, human
gaggccgcgccggcaccggg

SEQ ID NO: 296279 - DNA, 20 bp, human
ggtgcagccgcagaaaagaa

SEQ ID NO: 296280 - DNA, 20 bp, human
gccaccccccggtgccggcg

SEQ ID NO: 296281 - DNA, 20 bp, human
gccccaggccgcgccggcac

SEQ ID NO: 296282 - DNA, 20 bp, human
gtggctgctgctcttcgggc

SEQ ID NO: 296283 - DNA, 20 bp, human
gggagaaactagtttgttgg

SEQ ID NO: 296284 - DNA, 20 bp, human
gcaaccccgccgcccaagtt

SEQ ID NO: 296285 - DNA, 20 bp, human
gagaggcatcgcctctgtga

SEQ ID NO: 296286 - DNA, 20 bp, human
ggaggggcgtggtctacgga

SEQ ID NO: 296287 - DNA, 20 bp, human
gctgaaagggaagcggttct

SEQ ID NO: 296288 - DNA, 20 bp, human
gggggcgggcccggaatcgg

SEQ ID NO: 296289 - DNA, 20 bp, human
gtgagagggcgtattgtctg

SEQ ID NO: 296290 - DNA, 20 bp, human
gggggcgggtctgggataaa

SEQ ID NO: 296291 - DNA, 20 bp, human
gaggcggggcgcaggataaa

SEQ ID NO: 296292 - DNA, 20 bp, human
gtgggctaggggtgccggat

SEQ ID NO: 296293 - DNA, 20 bp, human
gtggggcggggtctgaagaa

SEQ ID NO: 296294 - DNA, 20 bp, human
gaggggcctgctatgcagag

SEQ ID NO: 296295 - DNA, 20 bp, human
ggggcgtattgtctgtggat

SEQ ID NO: 296296 - DNA, 20 bp, human
gcagctacagcggagaaggg

SEQ ID NO: 296297 - DNA, 20 bp, human
ggtggcagctgtggggtcta

SEQ ID NO: 296298 - DNA, 20 bp, human
gggccaaagtctcctggaag

SEQ ID NO: 296299 - DNA, 20 bp, human
ggggttatgtagtccacgtc

SEQ ID NO: 296300 - DNA, 20 bp, human
gctagtctcaacacctgacg

SEQ ID NO: 296301 - DNA, 20 bp, human
gagactaggccaaagtctcc

SEQ ID NO: 296302 - DNA, 20 bp, human
gaccatggaagcaatcggtt

SEQ ID NO: 296303 - DNA, 20 bp, human
gcacttgccgtgatgaatgc

SEQ ID NO: 296304 - DNA, 20 bp, human
gaacgcagctacagcggaga

SEQ ID NO: 296305 - DNA, 20 bp, human
ggggtctagggctcagacgg

SEQ ID NO: 296306 - DNA, 20 bp, human
gcggcagccgggaatccctc

SEQ ID NO: 296307 - DNA, 20 bp, human
gctgccgcgcgccgggtccg

SEQ ID NO: 296308 - DNA, 20 bp, human
gagcactccaacctcggacc

SEQ ID NO: 296309 - DNA, 20 bp, human
ggccccgtgcgcagtttccc

SEQ ID NO: 296310 - DNA, 20 bp, human
gggcgggcggagccaatcac

SEQ ID NO: 296311 - DNA, 20 bp, human
gccccggcccgagggattcc

SEQ ID NO: 296312 - DNA, 20 bp, human
gccactcgggcgcccgtgat

SEQ ID NO: 296313 - DNA, 20 bp, human
gtgctcgcgggtgtgtccgt

SEQ ID NO: 296314 - DNA, 20 bp, human
ggggagctcgcctcagtccc

SEQ ID NO: 296315 - DNA, 20 bp, human
ggccggggaaactgcgcacg

SEQ ID NO: 296316 - DNA, 20 bp, human
ggggctaatcgcctgggctg

SEQ ID NO: 296317 - DNA, 20 bp, human
ggcggcagctccagcgaccc

SEQ ID NO: 296318 - DNA, 20 bp, human
gtggagctgccgccgttcct

SEQ ID NO: 296319 - DNA, 20 bp, human
gagctactacagaatttggg

SEQ ID NO: 296320 - DNA, 20 bp, human
ggtaggggccagtatttctc

SEQ ID NO: 296321 - DNA, 20 bp, human
gatagatggggagaagttaa

SEQ ID NO: 296322 - DNA, 20 bp, human
gggaaaggtggcagtgcacc

SEQ ID NO: 296323 - DNA, 20 bp, human
gtcactagcccgagaaatac

SEQ ID NO: 296324 - DNA, 20 bp, human
ggctctgagtgtctgataga

SEQ ID NO: 296325 - DNA, 20 bp, human
ggtctaggctgcaaagaatc

SEQ ID NO: 296326 - DNA, 20 bp, human
gctaggacagacatcaggaa

SEQ ID NO: 296327 - DNA, 20 bp, human
gggtgaaagctgtcgcggtt

SEQ ID NO: 296328 - DNA, 20 bp, human
gctggtctggtggccacgtg

SEQ ID NO: 296329 - DNA, 20 bp, human
gacagtggagcccgtggtgg

SEQ ID NO: 296330 - DNA, 20 bp, human
gaggggacacggaggcctgc

SEQ ID NO: 296331 - DNA, 20 bp, human
gggacaggtgaaagctgtcg

SEQ ID NO: 296332 - DNA, 20 bp, human
gaaagctgtcgcggttgggc

SEQ ID NO: 296333 - DNA, 20 bp, human
ggagtgagatgccggctcct

SEQ ID NO: 296334 - DNA, 20 bp, human
gtctgagctaacagtcacca

SEQ ID NO: 296335 - DNA, 20 bp, human
gtaggccacaagtccctgga

SEQ ID NO: 296336 - DNA, 20 bp, human
gcgagcctgcgctttggccc

SEQ ID NO: 296337 - DNA, 20 bp, human
gcggctggctggagagttga

SEQ ID NO: 296338 - DNA, 20 bp, human
gtcggcctgccttatccagt

SEQ ID NO: 296339 - DNA, 20 bp, human
gttgaaggccaaagacggag

SEQ ID NO: 296340 - DNA, 20 bp, human
gtgctcccgggccaaagcgc

SEQ ID NO: 296341 - DNA, 20 bp, human
gttatccagtgggacggcaa

SEQ ID NO: 296342 - DNA, 20 bp, human
gccgtcccactggataaggc

SEQ ID NO: 296343 - DNA, 20 bp, human
gtctagtagagtaaggagaa

SEQ ID NO: 296344 - DNA, 20 bp, human
ggcaggccgagcctgcgctt

SEQ ID NO: 296345 - DNA, 20 bp, human
gcaaaagaccgtaggtgacc

SEQ ID NO: 296346 - DNA, 20 bp, human
ggatgtgcgcgggatcgcgg

SEQ ID NO: 296347 - DNA, 20 bp, human
gggcgggttcagacgccaca

SEQ ID NO: 296348 - DNA, 20 bp, human
ggtggcgaaaggatgtgcgc

SEQ ID NO: 296349 - DNA, 20 bp, human
gagggagcgcgcgggctagc

SEQ ID NO: 296350 - DNA, 20 bp, human
gtgcgcgggatcgcggggga

SEQ ID NO: 296351 - DNA, 20 bp, human
gccaggcggtcgcgtcagac

SEQ ID NO: 296352 - DNA, 20 bp, human
gacgcaccttggcacccccg

SEQ ID NO: 296353 - DNA, 20 bp, human
gcgcgcgggctagctggagg

SEQ ID NO: 296354 - DNA, 20 bp, human
gcaccttggcacccccgggg

SEQ ID NO: 296355 - DNA, 20 bp, human
gttgcgcgcggggtggcgaa

SEQ ID NO: 296356 - DNA, 20 bp, human
gtgggcccagctctgacgcc

SEQ ID NO: 296357 - DNA, 20 bp, human
gcagctcagggggataatgt

SEQ ID NO: 296358 - DNA, 20 bp, human
gggaacgctggtgtctcctg

SEQ ID NO: 296359 - DNA, 20 bp, human
gggcgtgcacaaggagtcca

SEQ ID NO: 296360 - DNA, 20 bp, human
ggagtccaaggcagtccctc

SEQ ID NO: 296361 - DNA, 20 bp, human
gacagcctggcgtcagagct

SEQ ID NO: 296362 - DNA, 20 bp, human
gcaaggcagtccctctggac

SEQ ID NO: 296363 - DNA, 20 bp, human
ggtccgagacgctcatgccg

SEQ ID NO: 296364 - DNA, 20 bp, human
ggacagctatagggtgcacg

SEQ ID NO: 296365 - DNA, 20 bp, human
ggtctctcatcccgtccaga

SEQ ID NO: 296366 - DNA, 20 bp, human
gggttcgcggccagcagtca

SEQ ID NO: 296367 - DNA, 20 bp, human
gacaactggtcacggggcag

SEQ ID NO: 296368 - DNA, 20 bp, human
ggtgaagcggcccgggccaa

SEQ ID NO: 296369 - DNA, 20 bp, human
ggaggggcgtccggctgggc

SEQ ID NO: 296370 - DNA, 20 bp, human
ggggagggcgcaggtcagag

SEQ ID NO: 296371 - DNA, 20 bp, human
gcggccagcagtcagggcac

SEQ ID NO: 296372 - DNA, 20 bp, human
gactgctggccgcgaaccga

SEQ ID NO: 296373 - DNA, 20 bp, human
gagcctaggggattagggag

SEQ ID NO: 296374 - DNA, 20 bp, human
gcgcccgtgccctcggttcg

SEQ ID NO: 296375 - DNA, 20 bp, human
gctaccgggtcgaggggctc

SEQ ID NO: 296376 - DNA, 20 bp, human
gcctgcgtgcgctttctcga

SEQ ID NO: 296377 - DNA, 20 bp, human
gggctcgtgcctggcgcctc

SEQ ID NO: 296378 - DNA, 20 bp, human
gaagccacctggctgcgccc

SEQ ID NO: 296379 - DNA, 20 bp, human
gagaggaaataaacggatga

SEQ ID NO: 296380 - DNA, 20 bp, human
gtctcccgggcgcagccagg

SEQ ID NO: 296381 - DNA, 20 bp, human
ggggagagtcgctgaacaaa

SEQ ID NO: 296382 - DNA, 20 bp, human
gcggcgcagcgctaggctgt

SEQ ID NO: 296383 - DNA, 20 bp, human
gggccctgaacgcctaccgg

SEQ ID NO: 296384 - DNA, 20 bp, human
ggtggtgccagtagctcccg

SEQ ID NO: 296385 - DNA, 20 bp, human
ggcgaacaagctgcggaagt

SEQ ID NO: 296386 - DNA, 20 bp, human
ggccctgcgtccgtgacggt

SEQ ID NO: 296387 - DNA, 20 bp, human
gcccggggcgcggacgaggg

SEQ ID NO: 296388 - DNA, 20 bp, human
ggccgtggggtgagctcgca

SEQ ID NO: 296389 - DNA, 20 bp, human
gatccccggggcgcggacga

SEQ ID NO: 296390 - DNA, 20 bp, human
ggtcgtggtggggtggacac

SEQ ID NO: 296391 - DNA, 20 bp, human
gacggagtcgggcgtcgtgg

SEQ ID NO: 296392 - DNA, 20 bp, human
gcgcgcgcggccaatggcgg

SEQ ID NO: 296393 - DNA, 20 bp, human
gggtggacaccggggatccc

SEQ ID NO: 296394 - DNA, 20 bp, human
gcacggacgcagggccacgg

SEQ ID NO: 296395 - DNA, 20 bp, human
ggtggggtgagctcgcaggg

SEQ ID NO: 296396 - DNA, 20 bp, human
gccaaggaggccaactgcga

SEQ ID NO: 296397 - DNA, 20 bp, human
gaacagcaggcgctcctggt

SEQ ID NO: 296398 - DNA, 20 bp, human
gaggagcgcctgctgtttgt

SEQ ID NO: 296399 - DNA, 20 bp, human
ggggcggcgaggtctccgag

SEQ ID NO: 296400 - DNA, 20 bp, human
gtgcgcttggtctgcatgac

SEQ ID NO: 296401 - DNA, 20 bp, human
gaactgcgagggcttcatcg

SEQ ID NO: 296402 - DNA, 20 bp, human
gtgcgagggcttcatcgagg

SEQ ID NO: 296403 - DNA, 20 bp, human
ggaggtctccgagcggtgtc

SEQ ID NO: 296404 - DNA, 20 bp, human
ggtgcagcaggtcgttcttg

SEQ ID NO: 296405 - DNA, 20 bp, human
gttggtctgcatgacgggct

SEQ ID NO: 296406 - DNA, 20 bp, human
gtggtcactggacagaaatg

SEQ ID NO: 296407 - DNA, 20 bp, human
gggtgtggccctctggtcac

SEQ ID NO: 296408 - DNA, 20 bp, human
ggagcctttttccagatcga

SEQ ID NO: 296409 - DNA, 20 bp, human
ggaagcaagataacagtcca

SEQ ID NO: 296410 - DNA, 20 bp, human
gaagtcagaccaggcaccag

SEQ ID NO: 296411 - DNA, 20 bp, human
gctccagaatatcatccttg

SEQ ID NO: 296412 - DNA, 20 bp, human
gttctggaggtgtggccctc

SEQ ID NO: 296413 - DNA, 20 bp, human
gcttctgctggtcaaatcca

SEQ ID NO: 296414 - DNA, 20 bp, human
ggtgtcatccaataaaccag

SEQ ID NO: 296415 - DNA, 20 bp, human
gaaggctcatgaacttctgc

SEQ ID NO: 296416 - DNA, 20 bp, human
gggtgggaacccatgctgac

SEQ ID NO: 296417 - DNA, 20 bp, human
gtaacagctggagagtgttg

SEQ ID NO: 296418 - DNA, 20 bp, human
gtgcagctaacagtgtaggt

SEQ ID NO: 296419 - DNA, 20 bp, human
gcagctggagagtgttgtgg

SEQ ID NO: 296420 - DNA, 20 bp, human
gctcatcatcctgtcagcat

SEQ ID NO: 296421 - DNA, 20 bp, human
gagcctgcaaatctaacagc

SEQ ID NO: 296422 - DNA, 20 bp, human
gcaggggaggcgtgagtaga

SEQ ID NO: 296423 - DNA, 20 bp, human
gctccagctgttagatttgc

SEQ ID NO: 296424 - DNA, 20 bp, human
ggccttctgcttctgctaga

SEQ ID NO: 296425 - DNA, 20 bp, human
gcacagtgtatcataggcag

SEQ ID NO: 296426 - DNA, 20 bp, human
gaggccctcatctttcagaa

SEQ ID NO: 296427 - DNA, 20 bp, human
ggagatgcccctaggggaga

SEQ ID NO: 296428 - DNA, 20 bp, human
gcccaagcaccctgtatcca

SEQ ID NO: 296429 - DNA, 20 bp, human
gcacggagaggtcttgactc

SEQ ID NO: 296430 - DNA, 20 bp, human
gaagggagaccctggaagag

SEQ ID NO: 296431 - DNA, 20 bp, human
gtggtcaggagatgccccta

SEQ ID NO: 296432 - DNA, 20 bp, human
gtgaccctcagtccagagac

SEQ ID NO: 296433 - DNA, 20 bp, human
gaggtggccgggtccctgta

SEQ ID NO: 296434 - DNA, 20 bp, human
gccgggggcttatgggacgg

SEQ ID NO: 296435 - DNA, 20 bp, human
gggagtgagacatattccgg

SEQ ID NO: 296436 - DNA, 20 bp, human
gctggaacttttaatcacta

SEQ ID NO: 296437 - DNA, 20 bp, human
gatagattgaaagtaacaac

SEQ ID NO: 296438 - DNA, 20 bp, human
gactctaacaacgggaattt

SEQ ID NO: 296439 - DNA, 20 bp, human
gctctgaattaatgatgcaa

SEQ ID NO: 296440 - DNA, 20 bp, human
ggaatttaggagagctggct

SEQ ID NO: 296441 - DNA, 20 bp, human
gtagtgggattaaattgcaa

SEQ ID NO: 296442 - DNA, 20 bp, human
gaattgcaaaggcttcaagc

SEQ ID NO: 296443 - DNA, 20 bp, human
gtagataccaactctaacaa

SEQ ID NO: 296444 - DNA, 20 bp, human
gggtatctatatttagctag

SEQ ID NO: 296445 - DNA, 20 bp, human
gattatcatggcaacattaa

SEQ ID NO: 296446 - DNA, 20 bp, human
ggaagtgagaagggcggcgg

SEQ ID NO: 296447 - DNA, 20 bp, human
gctcccgggcggcgccaggc

SEQ ID NO: 296448 - DNA, 20 bp, human
gcccgcgggcggaagtgaga

SEQ ID NO: 296449 - DNA, 20 bp, human
gggcccttttttggcgctga

SEQ ID NO: 296450 - DNA, 20 bp, human
gcgctccgccggcccttttt

SEQ ID NO: 296451 - DNA, 20 bp, human
ggggaggagcggcgaggtga

SEQ ID NO: 296452 - DNA, 20 bp, human
ggcctcgcgggagcgggccc

SEQ ID NO: 296453 - DNA, 20 bp, human
ggcggaagtgagaagggcgg

SEQ ID NO: 296454 - DNA, 20 bp, human
gcggaaccggcgcgcgcgta

SEQ ID NO: 296455 - DNA, 20 bp, human
gcgccgagggatggcggccc

SEQ ID NO: 296456 - DNA, 20 bp, human
gcgggcgcgcgacccggcga

SEQ ID NO: 296457 - DNA, 20 bp, human
ggacggcccgagccggggaa

SEQ ID NO: 296458 - DNA, 20 bp, human
gagagcaaagaaacccccgg

SEQ ID NO: 296459 - DNA, 20 bp, human
ggggggaacgggagcgtctg

SEQ ID NO: 296460 - DNA, 20 bp, human
gaggagggggcgtggcgtag

SEQ ID NO: 296461 - DNA, 20 bp, human
gtggggttaggggaattcct

SEQ ID NO: 296462 - DNA, 20 bp, human
gaaggggacgtcaggctggg

SEQ ID NO: 296463 - DNA, 20 bp, human
gggcggggctctggcgagga

SEQ ID NO: 296464 - DNA, 20 bp, human
gaggaagaggtccctctgca

SEQ ID NO: 296465 - DNA, 20 bp, human
gagtgggggaaggggacgtc

SEQ ID NO: 296466 - DNA, 20 bp, human
gacagctggtgataagtgga

SEQ ID NO: 296467 - DNA, 20 bp, human
gtgctggcatttgtagtaac

SEQ ID NO: 296468 - DNA, 20 bp, human
gcctgctcacggatatgagg

SEQ ID NO: 296469 - DNA, 20 bp, human
gcaagtcgtcagcgagggga

SEQ ID NO: 296470 - DNA, 20 bp, human
gagaatgtcagggataagtg

SEQ ID NO: 296471 - DNA, 20 bp, human
gagtacaaatgtgaagcagg

SEQ ID NO: 296472 - DNA, 20 bp, human
ggtcaggcaggccccattgc

SEQ ID NO: 296473 - DNA, 20 bp, human
gactcacagtggactctgag

SEQ ID NO: 296474 - DNA, 20 bp, human
gcttagaataggtgtgtggg

SEQ ID NO: 296475 - DNA, 20 bp, human
gtaacccaagtcgtcagcga

SEQ ID NO: 296476 - DNA, 20 bp, human
gtcagcgcgggacagcgaca

SEQ ID NO: 296477 - DNA, 20 bp, human
ggcactatgaggagagtcag

SEQ ID NO: 296478 - DNA, 20 bp, human
ggggacagcgacagggaatc

SEQ ID NO: 296479 - DNA, 20 bp, human
gggggcctgacacgtcacag

SEQ ID NO: 296480 - DNA, 20 bp, human
gttgcctcggagctggtccg

SEQ ID NO: 296481 - DNA, 20 bp, human
ggggagcgacgctaccaact

SEQ ID NO: 296482 - DNA, 20 bp, human
gacttcgcgcaaggaggcgg

SEQ ID NO: 296483 - DNA, 20 bp, human
gcgcgccactgtgacgtgtc

SEQ ID NO: 296484 - DNA, 20 bp, human
gcgacctcggaccagctccg

SEQ ID NO: 296485 - DNA, 20 bp, human
gtgcctgcagtctcattgct

SEQ ID NO: 296486 - DNA, 20 bp, human
ggggctgcgcacggcactct

SEQ ID NO: 296487 - DNA, 20 bp, human
ggcccactagggagccgcgg

SEQ ID NO: 296488 - DNA, 20 bp, human
ggagacccggccgcccacta

SEQ ID NO: 296489 - DNA, 20 bp, human
ggcccccgcggctccctagt

SEQ ID NO: 296490 - DNA, 20 bp, human
gcggccgggtctcagggact

SEQ ID NO: 296491 - DNA, 20 bp, human
gcccagaggccgcggctcgc

SEQ ID NO: 296492 - DNA, 20 bp, human
gctgcccagtccctgagacc

SEQ ID NO: 296493 - DNA, 20 bp, human
ggcggaccagggcgtggcgg

SEQ ID NO: 296494 - DNA, 20 bp, human
gcggctccctagtgggcggc

SEQ ID NO: 296495 - DNA, 20 bp, human
gaaggcggaccagggcgtgg

SEQ ID NO: 296496 - DNA, 20 bp, human
ggacctcgtcagtcagcggg

SEQ ID NO: 296497 - DNA, 20 bp, human
gtccagacctcgtcagtcag

SEQ ID NO: 296498 - DNA, 20 bp, human
gaccctcccgctgactgacg

SEQ ID NO: 296499 - DNA, 20 bp, human
ggggggaggaagtacccggg

SEQ ID NO: 296500 - DNA, 20 bp, human
ggaagggggaggaagtaccc

SEQ ID NO: 296501 - DNA, 20 bp, human
gcagctctaagaggccgggc

SEQ ID NO: 296502 - DNA, 20 bp, human
gcaaggcagctctaagaggc

SEQ ID NO: 296503 - DNA, 20 bp, human
gtcccaggataccacggggt

SEQ ID NO: 296504 - DNA, 20 bp, human
gcctagtcccaggataccac

SEQ ID NO: 296505 - DNA, 20 bp, human
gttagagctgccttgtatgt

SEQ ID NO: 296506 - DNA, 20 bp, human
gtacagctctggggatcgga

SEQ ID NO: 296507 - DNA, 20 bp, human
ggctctggggatcggagggg

SEQ ID NO: 296508 - DNA, 20 bp, human
gccagagctgtagacgggga

SEQ ID NO: 296509 - DNA, 20 bp, human
gcccccaggcaacaggggaa

SEQ ID NO: 296510 - DNA, 20 bp, human
ggcccttcccctgttgcctg

SEQ ID NO: 296511 - DNA, 20 bp, human
gtggggctctgaggggataa

SEQ ID NO: 296512 - DNA, 20 bp, human
ggatccagggcctgcagaac

SEQ ID NO: 296513 - DNA, 20 bp, human
gatccccagagctgtagacg

SEQ ID NO: 296514 - DNA, 20 bp, human
gatgcgtccagcgtgatcca

SEQ ID NO: 296515 - DNA, 20 bp, human
gcattcctggggttgaagcc

SEQ ID NO: 296516 - DNA, 20 bp, human
ggggtctgaagggacattgc

SEQ ID NO: 296517 - DNA, 20 bp, human
gggcggtgctgggtcaggaa

SEQ ID NO: 296518 - DNA, 20 bp, human
gcacctgcagaggcggtgct

SEQ ID NO: 296519 - DNA, 20 bp, human
gggctggaggttggggacat

SEQ ID NO: 296520 - DNA, 20 bp, human
ggacagtagagcagcctcca

SEQ ID NO: 296521 - DNA, 20 bp, human
gcattgcgggtagaggacca

SEQ ID NO: 296522 - DNA, 20 bp, human
gcacaatccgggactgaatc

SEQ ID NO: 296523 - DNA, 20 bp, human
gcactgaggaagaatctgga

SEQ ID NO: 296524 - DNA, 20 bp, human
gagtggtggctggacctggt

SEQ ID NO: 296525 - DNA, 20 bp, human
gggatcaaggcgccaagggt

SEQ ID NO: 296526 - DNA, 20 bp, human
ggggacccggagaatcccca

SEQ ID NO: 296527 - DNA, 20 bp, human
gccccccccaacacgcacat

SEQ ID NO: 296528 - DNA, 20 bp, human
gcctcccagagcaggaatct

SEQ ID NO: 296529 - DNA, 20 bp, human
gataaagcaggttgagtagg

SEQ ID NO: 296530 - DNA, 20 bp, human
gtccaaaagggatgaaaagg

SEQ ID NO: 296531 - DNA, 20 bp, human
gagaagccagactgtggaag

SEQ ID NO: 296532 - DNA, 20 bp, human
gagttccaaaagggatgaaa

SEQ ID NO: 296533 - DNA, 20 bp, human
ggccacccctagccttgctg

SEQ ID NO: 296534 - DNA, 20 bp, human
gtgggagaagcctgtattcc

SEQ ID NO: 296535 - DNA, 20 bp, human
gggcttccgtggggattctc

SEQ ID NO: 296536 - DNA, 20 bp, human
gtgtgtgtgagggccctccc

SEQ ID NO: 296537 - DNA, 20 bp, human
gccggaggcctctgaggcac

SEQ ID NO: 296538 - DNA, 20 bp, human
gtgggcgggcccaggatgac

SEQ ID NO: 296539 - DNA, 20 bp, human
ggcctcagaggcctccgggg

SEQ ID NO: 296540 - DNA, 20 bp, human
gaccccgccccggggcatta

SEQ ID NO: 296541 - DNA, 20 bp, human
gaagccctgccttaatgccc

SEQ ID NO: 296542 - DNA, 20 bp, human
ggacacagattcagagactc

SEQ ID NO: 296543 - DNA, 20 bp, human
gcgccccggggcattaaggc

SEQ ID NO: 296544 - DNA, 20 bp, human
gtcagaattactgaatgaca

SEQ ID NO: 296545 - DNA, 20 bp, human
gcttggaggccagtcatcct

SEQ ID NO: 296546 - DNA, 20 bp, human
gacagacctgcttgcagggg

SEQ ID NO: 296547 - DNA, 20 bp, human
gtgggatcaggcttccagga

SEQ ID NO: 296548 - DNA, 20 bp, human
gaaactgagccttgcagggg

SEQ ID NO: 296549 - DNA, 20 bp, human
gactgaagggaaactggagg

SEQ ID NO: 296550 - DNA, 20 bp, human
gtgcactgaagggaaactgg

SEQ ID NO: 296551 - DNA, 20 bp, human
ggtgacagacctgcttgcag

SEQ ID NO: 296552 - DNA, 20 bp, human
ggtctccactgggactcaag

SEQ ID NO: 296553 - DNA, 20 bp, human
gaggttgggatcaggcttcc

SEQ ID NO: 296554 - DNA, 20 bp, human
gtaagggtagtcatagtagt

SEQ ID NO: 296555 - DNA, 20 bp, human
gtctccccaaatgcactgaa

SEQ ID NO: 296556 - DNA, 20 bp, human
gggaccacgaagacaggggt

SEQ ID NO: 296557 - DNA, 20 bp, human
gggaaggggaccacgaagac

SEQ ID NO: 296558 - DNA, 20 bp, human
gtggtccccttcccttaacc

SEQ ID NO: 296559 - DNA, 20 bp, human
gcagtcctggggctgctgac

SEQ ID NO: 296560 - DNA, 20 bp, human
gaccttgagtcatcagtcct

SEQ ID NO: 296561 - DNA, 20 bp, human
gcagctaaacggagtgggga

SEQ ID NO: 296562 - DNA, 20 bp, human
gaggaggaaaggacccaggg

SEQ ID NO: 296563 - DNA, 20 bp, human
gcgccccacccctgtcttcg

SEQ ID NO: 296564 - DNA, 20 bp, human
gggttgagcaacatgacagg

SEQ ID NO: 296565 - DNA, 20 bp, human
gcttaacccggaaactggat

SEQ ID NO: 296566 - DNA, 20 bp, human
gtcaggaggtaagaatgcgc

SEQ ID NO: 296567 - DNA, 20 bp, human
gtgggcccctcactcaggta

SEQ ID NO: 296568 - DNA, 20 bp, human
ggccacatggctccgggatc

SEQ ID NO: 296569 - DNA, 20 bp, human
gggtgcagtggcgaggtggg

SEQ ID NO: 296570 - DNA, 20 bp, human
gaatggaaggcagactctgg

SEQ ID NO: 296571 - DNA, 20 bp, human
gcccccaccaaggatggaat

SEQ ID NO: 296572 - DNA, 20 bp, human
ggctccgggatcgggagggg

SEQ ID NO: 296573 - DNA, 20 bp, human
gcgcggacagataagaactt

SEQ ID NO: 296574 - DNA, 20 bp, human
gctccaattccatccttggt

SEQ ID NO: 296575 - DNA, 20 bp, human
gatggctccgggatcgggag

SEQ ID NO: 296576 - DNA, 20 bp, human
ggttcatgagaacccgccca

SEQ ID NO: 296577 - DNA, 20 bp, human
ggaagatgctataatctaga

SEQ ID NO: 296578 - DNA, 20 bp, human
gtggcaaagccttttatccc

SEQ ID NO: 296579 - DNA, 20 bp, human
ggggttctcatgaacaattg

SEQ ID NO: 296580 - DNA, 20 bp, human
gtttttggccagacagggga

SEQ ID NO: 296581 - DNA, 20 bp, human
gcagaggaaagggcacgaag

SEQ ID NO: 296582 - DNA, 20 bp, human
ggactgagagagggagtcac

SEQ ID NO: 296583 - DNA, 20 bp, human
gggtgggaggatgtggagca

SEQ ID NO: 296584 - DNA, 20 bp, human
gatgtcttgatgaaggaagg

SEQ ID NO: 296585 - DNA, 20 bp, human
gtatagcatcttccctgggc

SEQ ID NO: 296586 - DNA, 20 bp, human
gggatgtcgagatttctaaa

SEQ ID NO: 296587 - DNA, 20 bp, human
gctaaagggtcgggagacct

SEQ ID NO: 296588 - DNA, 20 bp, human
ggggtcttgggaaaaggtaa

SEQ ID NO: 296589 - DNA, 20 bp, human
ggcgcaggttgtgctctccc

SEQ ID NO: 296590 - DNA, 20 bp, human
gtcaaagagtgggcaacccg

SEQ ID NO: 296591 - DNA, 20 bp, human
ggcactctcatgaagctgtg

SEQ ID NO: 296592 - DNA, 20 bp, human
gcgatggcccagagcaacta

SEQ ID NO: 296593 - DNA, 20 bp, human
gacaacctgcgcaagcgcga

SEQ ID NO: 296594 - DNA, 20 bp, human
ggggaagagctcctagattt

SEQ ID NO: 296595 - DNA, 20 bp, human
gctggattcggggacagacc

SEQ ID NO: 296596 - DNA, 20 bp, human
gtcaggatgaacagcaacag

SEQ ID NO: 296597 - DNA, 20 bp, human
gcaatctgacctcacaccgt

SEQ ID NO: 296598 - DNA, 20 bp, human
ggggcagggcctatggatca

SEQ ID NO: 296599 - DNA, 20 bp, human
gtgtgaggtcagattgggca

SEQ ID NO: 296600 - DNA, 20 bp, human
ggaggcattcccacggtgtg

SEQ ID NO: 296601 - DNA, 20 bp, human
gcagtctggaggcattccca

SEQ ID NO: 296602 - DNA, 20 bp, human
gtcagattgggcagggccta

SEQ ID NO: 296603 - DNA, 20 bp, human
gatcatggagatgtgatcta

SEQ ID NO: 296604 - DNA, 20 bp, human
gcagactgatctagtatgtg

SEQ ID NO: 296605 - DNA, 20 bp, human
ggaccccgcccttgccctgt

SEQ ID NO: 296606 - DNA, 20 bp, human
ggggcaggggcggagtcctg

SEQ ID NO: 296607 - DNA, 20 bp, human
ggaagtctccatgagctaca

SEQ ID NO: 296608 - DNA, 20 bp, human
ggcggagtcctggggaatga

SEQ ID NO: 296609 - DNA, 20 bp, human
gaggcagaggagacacgccc

SEQ ID NO: 296610 - DNA, 20 bp, human
gtggagctggattctgggtt

SEQ ID NO: 296611 - DNA, 20 bp, human
gcctgagtgctggtgtctta

SEQ ID NO: 296612 - DNA, 20 bp, human
ggacttcatctaggggacaa

SEQ ID NO: 296613 - DNA, 20 bp, human
gtgaaacagaaacagggggt

SEQ ID NO: 296614 - DNA, 20 bp, human
gcccaggatgaaacagaaac

SEQ ID NO: 296615 - DNA, 20 bp, human
gctccatgagctacagggcc

SEQ ID NO: 296616 - DNA, 20 bp, human
ggatcctgagggcggagtca

SEQ ID NO: 296617 - DNA, 20 bp, human
gcgagcaggggcgtggtcag

SEQ ID NO: 296618 - DNA, 20 bp, human
gggggcgtggtcagaggttc

SEQ ID NO: 296619 - DNA, 20 bp, human
ggagcagtcagggctcctcg

SEQ ID NO: 296620 - DNA, 20 bp, human
gcagtcagggctcctcgggg

SEQ ID NO: 296621 - DNA, 20 bp, human
gggctcctcggggcggagtc

SEQ ID NO: 296622 - DNA, 20 bp, human
gcagggctgggaacgggctc

SEQ ID NO: 296623 - DNA, 20 bp, human
ggcggagtcagggatgggat

SEQ ID NO: 296624 - DNA, 20 bp, human
gggagcagtcaggactcttg

SEQ ID NO: 296625 - DNA, 20 bp, human
ggctcggtaagcccaccccc

SEQ ID NO: 296626 - DNA, 20 bp, human
gatggaaagaggagtatcga

SEQ ID NO: 296627 - DNA, 20 bp, human
ggaggtagggagtgacattc

SEQ ID NO: 296628 - DNA, 20 bp, human
gcctccctggcccggagaat

SEQ ID NO: 296629 - DNA, 20 bp, human
gagggagtgacattccggac

SEQ ID NO: 296630 - DNA, 20 bp, human
ggctccctggggcacattcc

SEQ ID NO: 296631 - DNA, 20 bp, human
gtcccccagccttaaggatc

SEQ ID NO: 296632 - DNA, 20 bp, human
gtgcccgggaatgtgcccca

SEQ ID NO: 296633 - DNA, 20 bp, human
gatcgagggtgaacagacag

SEQ ID NO: 296634 - DNA, 20 bp, human
gcctggcccggagaatgggg

SEQ ID NO: 296635 - DNA, 20 bp, human
gagtgacattccggactggg

SEQ ID NO: 296636 - DNA, 20 bp, human
ggggcagtcagagactgcaa

SEQ ID NO: 296637 - DNA, 20 bp, human
ggggagggcggttacatcaa

SEQ ID NO: 296638 - DNA, 20 bp, human
gtggtccctgagtgcagtga

SEQ ID NO: 296639 - DNA, 20 bp, human
gcccaggcgcgatggggaaa

SEQ ID NO: 296640 - DNA, 20 bp, human
gcccgccggaagagaggttg

SEQ ID NO: 296641 - DNA, 20 bp, human
gcctccagggaagggagcac

SEQ ID NO: 296642 - DNA, 20 bp, human
gcacgctgtagctgtctccc

SEQ ID NO: 296643 - DNA, 20 bp, human
gcaggccctcactgcactca

SEQ ID NO: 296644 - DNA, 20 bp, human
gagcaagagacctcaggggt

SEQ ID NO: 296645 - DNA, 20 bp, human
gatggagcaagagacctcag

SEQ ID NO: 296646 - DNA, 20 bp, human
gggcaccgcccgtccttcgg

SEQ ID NO: 296647 - DNA, 20 bp, human
gagcagccaggagggactgt

SEQ ID NO: 296648 - DNA, 20 bp, human
gcctccctccgaaggacggg

SEQ ID NO: 296649 - DNA, 20 bp, human
gcaccctccctccgaaggac

SEQ ID NO: 296650 - DNA, 20 bp, human
ggagctcagagaataggctc

SEQ ID NO: 296651 - DNA, 20 bp, human
gacacccccgcctgcatttg

SEQ ID NO: 296652 - DNA, 20 bp, human
gtgcgctgggtctgaggggc

SEQ ID NO: 296653 - DNA, 20 bp, human
gccggtgcgctgggtctgag

SEQ ID NO: 296654 - DNA, 20 bp, human
ggggcggggggtgatataag

SEQ ID NO: 296655 - DNA, 20 bp, human
gggggagggacccggtgcgc

SEQ ID NO: 296656 - DNA, 20 bp, human
gctggaatctcagactcctg

SEQ ID NO: 296657 - DNA, 20 bp, human
ggggtcctggaatctggaga

SEQ ID NO: 296658 - DNA, 20 bp, human
gaggcagccgagagtatctg

SEQ ID NO: 296659 - DNA, 20 bp, human
ggaacgtgaaatcttgaggg

SEQ ID NO: 296660 - DNA, 20 bp, human
ggcggggccggtaaacagga

SEQ ID NO: 296661 - DNA, 20 bp, human
ggggctgttctgggcttctc

SEQ ID NO: 296662 - DNA, 20 bp, human
gtactggggcctcctccact

SEQ ID NO: 296663 - DNA, 20 bp, human
ggactcctgaggctagggag

SEQ ID NO: 296664 - DNA, 20 bp, human
gctacgatctgaaacataaa

SEQ ID NO: 296665 - DNA, 20 bp, human
ggctctagtgcaggaggaga

SEQ ID NO: 296666 - DNA, 20 bp, human
gaagccctggggctgtgaca

SEQ ID NO: 296667 - DNA, 20 bp, human
ggggctgtgacaggggcctt

SEQ ID NO: 296668 - DNA, 20 bp, human
ggggagaggaggtaagtgca

SEQ ID NO: 296669 - DNA, 20 bp, human
ggggccagagcttgactgaa

SEQ ID NO: 296670 - DNA, 20 bp, human
gccagagcttgactgaatgg

SEQ ID NO: 296671 - DNA, 20 bp, human
ggcagggggacccccctttt

SEQ ID NO: 296672 - DNA, 20 bp, human
gccgcccctgtgattaatcg

SEQ ID NO: 296673 - DNA, 20 bp, human
gcctctggggtcttcagagt

SEQ ID NO: 296674 - DNA, 20 bp, human
gccccccttttgggatgaac

SEQ ID NO: 296675 - DNA, 20 bp, human
gccgccagttcatcccaaaa

SEQ ID NO: 296676 - DNA, 20 bp, human
gttaacagctgaacacggat

SEQ ID NO: 296677 - DNA, 20 bp, human
ggtccctcctccatgcaaga

SEQ ID NO: 296678 - DNA, 20 bp, human
gtgtcagcaagaataggaat

SEQ ID NO: 296679 - DNA, 20 bp, human
gctggtctggggtgagcatg

SEQ ID NO: 296680 - DNA, 20 bp, human
gcttgaaggtgagatgacac

SEQ ID NO: 296681 - DNA, 20 bp, human
gcacatagaagtgtatagga

SEQ ID NO: 296682 - DNA, 20 bp, human
gtggagtgggcttggtgctt

SEQ ID NO: 296683 - DNA, 20 bp, human
gtaagtatattaactatttc

SEQ ID NO: 296684 - DNA, 20 bp, human
gttggcttcaatattgactt

SEQ ID NO: 296685 - DNA, 20 bp, human
gtgttctaatgtggcactgc

SEQ ID NO: 296686 - DNA, 20 bp, human
gccggcgggcggtgatgtgg

SEQ ID NO: 296687 - DNA, 20 bp, human
ggggcgcctcggaagaccga

SEQ ID NO: 296688 - DNA, 20 bp, human
gtcggaagaccgaggggagg

SEQ ID NO: 296689 - DNA, 20 bp, human
gagccccaggcagctacact

SEQ ID NO: 296690 - DNA, 20 bp, human
ggggggcagagcggtagctc

SEQ ID NO: 296691 - DNA, 20 bp, human
gcgcagagtccccaagccgc

SEQ ID NO: 296692 - DNA, 20 bp, human
gcaggctggcggctgggaac

SEQ ID NO: 296693 - DNA, 20 bp, human
gcgggaccgcgccgggcgag

SEQ ID NO: 296694 - DNA, 20 bp, human
gtcagtagagcctgcggctt

SEQ ID NO: 296695 - DNA, 20 bp, human
gaggcggacgggaccgcgcc

SEQ ID NO: 296696 - DNA, 20 bp, human
gacaacaggccagttaatta

SEQ ID NO: 296697 - DNA, 20 bp, human
gagcctggggttccaattta

SEQ ID NO: 296698 - DNA, 20 bp, human
gctggtcctggccctgagag

SEQ ID NO: 296699 - DNA, 20 bp, human
ggcaaatgaggcatagcctg

SEQ ID NO: 296700 - DNA, 20 bp, human
gtctactttccttaattaac

SEQ ID NO: 296701 - DNA, 20 bp, human
gtgttgtttgagaaaattct

SEQ ID NO: 296702 - DNA, 20 bp, human
gcacatacactttttgttgg

SEQ ID NO: 296703 - DNA, 20 bp, human
gttagctctaaaggcactct

SEQ ID NO: 296704 - DNA, 20 bp, human
gccccttaaattggaacccc

SEQ ID NO: 296705 - DNA, 20 bp, human
gcaaaaagtgtatgtgggtg

SEQ ID NO: 296706 - DNA, 20 bp, human
gggcactcttaacaaggtga

SEQ ID NO: 296707 - DNA, 20 bp, human
gctaaaaggcactcttaaca

SEQ ID NO: 296708 - DNA, 20 bp, human
gtaagagtgccttttagact

SEQ ID NO: 296709 - DNA, 20 bp, human
gtctcatcaacgtgttacta

SEQ ID NO: 296710 - DNA, 20 bp, human
gctccaaaatataggatact

SEQ ID NO: 296711 - DNA, 20 bp, human
gttggtctattaaaagtaca

SEQ ID NO: 296712 - DNA, 20 bp, human
ggaacaggaaattctacaca

SEQ ID NO: 296713 - DNA, 20 bp, human
gtgaaagtgtgtcatttagt

SEQ ID NO: 296714 - DNA, 20 bp, human
gtttagcaacctagtctaaa

SEQ ID NO: 296715 - DNA, 20 bp, human
gacccttgataaaaatatct

SEQ ID NO: 296716 - DNA, 20 bp, human
gtctcccaggaagtctctgt

SEQ ID NO: 296717 - DNA, 20 bp, human
ggtcagcaagcatgccccag

SEQ ID NO: 296718 - DNA, 20 bp, human
gaaggactgatctcaagttg

SEQ ID NO: 296719 - DNA, 20 bp, human
ggggtgaaggtcaagattca

SEQ ID NO: 296720 - DNA, 20 bp, human
gaggaagtctctgtgggtga

SEQ ID NO: 296721 - DNA, 20 bp, human
gccacagctgagaagggtga

SEQ ID NO: 296722 - DNA, 20 bp, human
gaactcaggtcacagttgag

SEQ ID NO: 296723 - DNA, 20 bp, human
gatatacatctgtacctctg

SEQ ID NO: 296724 - DNA, 20 bp, human
gggagtttgagtggagattc

SEQ ID NO: 296725 - DNA, 20 bp, human
gtcatctttgtcagcagtac

SEQ ID NO: 296726 - DNA, 20 bp, human
gcttacattcatttattaaa

SEQ ID NO: 296727 - DNA, 20 bp, human
ggttgacatatgcagtctat

SEQ ID NO: 296728 - DNA, 20 bp, human
gaggcaatgtgcatgtgttg

SEQ ID NO: 296729 - DNA, 20 bp, human
gtagtagcagaattttacat

SEQ ID NO: 296730 - DNA, 20 bp, human
gaaaaattggtattaaatta

SEQ ID NO: 296731 - DNA, 20 bp, human
gttgacataatattactagt

SEQ ID NO: 296732 - DNA, 20 bp, human
gaaaaatcacacgatataat

SEQ ID NO: 296733 - DNA, 20 bp, human
gtaggaagttcatgaaaaat

SEQ ID NO: 296734 - DNA, 20 bp, human
ggatttttgtttaaagcttt

SEQ ID NO: 296735 - DNA, 20 bp, human
gtagttttaagagtcattga

SEQ ID NO: 296736 - DNA, 20 bp, human
gtcaatgactcttaaaacta

SEQ ID NO: 296737 - DNA, 20 bp, human
gtttactttgctgttaacct

SEQ ID NO: 296738 - DNA, 20 bp, human
gaatcagttgacaatacctc

SEQ ID NO: 296739 - DNA, 20 bp, human
gcatttattaaaaggacctg

SEQ ID NO: 296740 - DNA, 20 bp, human
ggttacattcatttattaaa

SEQ ID NO: 296741 - DNA, 20 bp, human
gaggcaatgtgcatgtgttg

SEQ ID NO: 296742 - DNA, 20 bp, human
gacagaatacatctaaaaaa

SEQ ID NO: 296743 - DNA, 20 bp, human
gtagtagcagaattttacct

SEQ ID NO: 296744 - DNA, 20 bp, human
gaaaaatcacacgatataat

SEQ ID NO: 296745 - DNA, 20 bp, human
gttgacataatattactagt

SEQ ID NO: 296746 - DNA, 20 bp, human
ggattgagcgctaaagatgg

SEQ ID NO: 296747 - DNA, 20 bp, human
gaaggattgagcgctaaaga

SEQ ID NO: 296748 - DNA, 20 bp, human
gagatggaggaataatttgt

SEQ ID NO: 296749 - DNA, 20 bp, human
gtttgacataatattattaa

SEQ ID NO: 296750 - DNA, 20 bp, human
gatattatgtcaaatataga

SEQ ID NO: 296751 - DNA, 20 bp, human
gcaataggtcactttttaaa

SEQ ID NO: 296752 - DNA, 20 bp, human
gttttacacaggtattctat

SEQ ID NO: 296753 - DNA, 20 bp, human
gcaattttagttttttacac

SEQ ID NO: 296754 - DNA, 20 bp, human
gggcaaactgcatgtgttgg

SEQ ID NO: 296755 - DNA, 20 bp, human
gataggcaaactgcatgtgt

SEQ ID NO: 296756 - DNA, 20 bp, human
ggattgagcgctaaagatgg

SEQ ID NO: 296757 - DNA, 20 bp, human
gaaggattgagcgctaaaga

SEQ ID NO: 296758 - DNA, 20 bp, human
gagatggaggaataatttgt

SEQ ID NO: 296759 - DNA, 20 bp, human
gtttgacataatattattaa

SEQ ID NO: 296760 - DNA, 20 bp, human
gatattatgtcaaatataga

SEQ ID NO: 296761 - DNA, 20 bp, human
gcaataggtcactttttaaa

SEQ ID NO: 296762 - DNA, 20 bp, human
gttttacacaggtattctat

SEQ ID NO: 296763 - DNA, 20 bp, human
gcaattttagttttttacac

SEQ ID NO: 296764 - DNA, 20 bp, human
gggcaaactgcatgtgttgg

SEQ ID NO: 296765 - DNA, 20 bp, human
gataggcaaactgcatgtgt

SEQ ID NO: 296766 - DNA, 20 bp, human
ggactaaagaaggtgagagg

SEQ ID NO: 296767 - DNA, 20 bp, human
gggttcctggaacacttcag

SEQ ID NO: 296768 - DNA, 20 bp, human
ggtgaatgaggcgtccaagt

SEQ ID NO: 296769 - DNA, 20 bp, human
gtgtcgtggccaggataatt

SEQ ID NO: 296770 - DNA, 20 bp, human
gctttggcaaggactaaaga

SEQ ID NO: 296771 - DNA, 20 bp, human
gttaaattgtgttaagtaca

SEQ ID NO: 296772 - DNA, 20 bp, human
ggcccaaggtcacataaatt

SEQ ID NO: 296773 - DNA, 20 bp, human
gtgctaagtaaatttacctt

SEQ ID NO: 296774 - DNA, 20 bp, human
gtttaaggctaacgtgaatg

SEQ ID NO: 296775 - DNA, 20 bp, human
ggtgagaatttcctgtattg

SEQ ID NO: 296776 - DNA, 20 bp, human
gtatgtgttatctatgtcat

SEQ ID NO: 296777 - DNA, 20 bp, human
gccctcatatgtactgtgaa

SEQ ID NO: 296778 - DNA, 20 bp, human
gactgtgaaaggacaatttg

SEQ ID NO: 296779 - DNA, 20 bp, human
gtccattcccttgactttaa

SEQ ID NO: 296780 - DNA, 20 bp, human
gtatgcccctttttgaggtg

SEQ ID NO: 296781 - DNA, 20 bp, human
gtagtactagtctgaatacc

SEQ ID NO: 296782 - DNA, 20 bp, human
gttaacctcacctcaaaaag

SEQ ID NO: 296783 - DNA, 20 bp, human
gttatttgtgaaaacctcag

SEQ ID NO: 296784 - DNA, 20 bp, human
gatatttaggctataacaaa

SEQ ID NO: 296785 - DNA, 20 bp, human
gattaaatatcaatatgtta

SEQ ID NO: 296786 - DNA, 20 bp, human
gctaatacaccgcacacaag

SEQ ID NO: 296787 - DNA, 20 bp, human
gtacaccgcacacaagtggc

SEQ ID NO: 296788 - DNA, 20 bp, human
gaaactgccacacctactga

SEQ ID NO: 296789 - DNA, 20 bp, human
gaaaaccacacaggatgtgt

SEQ ID NO: 296790 - DNA, 20 bp, human
gtctgtgaatttcaaggtaa

SEQ ID NO: 296791 - DNA, 20 bp, human
gggttagatgggacaaaaat

SEQ ID NO: 296792 - DNA, 20 bp, human
gccaaataacgatggttaga

SEQ ID NO: 296793 - DNA, 20 bp, human
ggtccatttgttgaaaacag

SEQ ID NO: 296794 - DNA, 20 bp, human
gaaccttggatatgtctctt

SEQ ID NO: 296795 - DNA, 20 bp, human
gagtagagtccaaataacga

SEQ ID NO: 296796 - DNA, 20 bp, human
ggagcatctacagtgtcatg

SEQ ID NO: 296797 - DNA, 20 bp, human
gagtccagcaatttcagtta

SEQ ID NO: 296798 - DNA, 20 bp, human
gtcaggaaatgattcaaatt

SEQ ID NO: 296799 - DNA, 20 bp, human
gcaacagaattaggtgagat

SEQ ID NO: 296800 - DNA, 20 bp, human
gaaagcagaagtaatttttc

SEQ ID NO: 296801 - DNA, 20 bp, human
gttccttgctcaacagaatt

SEQ ID NO: 296802 - DNA, 20 bp, human
gtgcatatgcctggaatcac

SEQ ID NO: 296803 - DNA, 20 bp, human
ggaagggatatgtatcagtg

SEQ ID NO: 296804 - DNA, 20 bp, human
gcacctaattctgttgagca

SEQ ID NO: 296805 - DNA, 20 bp, human
ggtgataagcaataacgaaa

SEQ ID NO: 296806 - DNA, 20 bp, human
gcggggctgtgtcccgaagg

SEQ ID NO: 296807 - DNA, 20 bp, human
gaccccgctgtgattggctg

SEQ ID NO: 296808 - DNA, 20 bp, human
ggggccaggcgagggttgca

SEQ ID NO: 296809 - DNA, 20 bp, human
ggcggctggaccaatccgga

SEQ ID NO: 296810 - DNA, 20 bp, human
ggctgtgtcccgaagggggt

SEQ ID NO: 296811 - DNA, 20 bp, human
gacagcggggtccttcgggg

SEQ ID NO: 296812 - DNA, 20 bp, human
gccaccctgcaaccctcgcc

SEQ ID NO: 296813 - DNA, 20 bp, human
gggccggggctgtgtcccga

SEQ ID NO: 296814 - DNA, 20 bp, human
ggggcgtggcctgacaactt

SEQ ID NO: 296815 - DNA, 20 bp, human
gaaaagcagaacaccagcgg

SEQ ID NO: 296816 - DNA, 20 bp, human
gctaacatttatccaacaat

SEQ ID NO: 296817 - DNA, 20 bp, human
gcaaaacctgaggtattaac

SEQ ID NO: 296818 - DNA, 20 bp, human
gagttaagaccacccattgt

SEQ ID NO: 296819 - DNA, 20 bp, human
gcaattccagttaatacctc

SEQ ID NO: 296820 - DNA, 20 bp, human
gtaaaggcaaagtggcatgt

SEQ ID NO: 296821 - DNA, 20 bp, human
gtgataaggcggaagtactg

SEQ ID NO: 296822 - DNA, 20 bp, human
gggtaacattgcagataaag

SEQ ID NO: 296823 - DNA, 20 bp, human
gacatttatccaacaatggg

SEQ ID NO: 296824 - DNA, 20 bp, human
ggttaaaaccgtattaataa

SEQ ID NO: 296825 - DNA, 20 bp, human
gtatttttgtagtgataagg

SEQ ID NO: 296826 - DNA, 20 bp, human
gcatctgtggatcatttttg

SEQ ID NO: 296827 - DNA, 20 bp, human
gcagcggcaatgtttagtca

SEQ ID NO: 296828 - DNA, 20 bp, human
gatgagaagggctccattca

SEQ ID NO: 296829 - DNA, 20 bp, human
gtgtactttggccaactaat

SEQ ID NO: 296830 - DNA, 20 bp, human
gtttggacttcagatgagaa

SEQ ID NO: 296831 - DNA, 20 bp, human
gtagagtctaattaccacta

SEQ ID NO: 296832 - DNA, 20 bp, human
gtaatgggttaatactgtca

SEQ ID NO: 296833 - DNA, 20 bp, human
gcatgaatgcactaggcttg

SEQ ID NO: 296834 - DNA, 20 bp, human
ggggaggtataagatgtttt

SEQ ID NO: 296835 - DNA, 20 bp, human
gttcatctaaagggtcctca

SEQ ID NO: 296836 - DNA, 20 bp, human
gagaggcattgctcgggaaa

SEQ ID NO: 296837 - DNA, 20 bp, human
ggcgctgcaactccatcccg

SEQ ID NO: 296838 - DNA, 20 bp, human
gtgcagcgcccaggcgtcag

SEQ ID NO: 296839 - DNA, 20 bp, human
gagccccgcaatctgtatag

SEQ ID NO: 296840 - DNA, 20 bp, human
gggccgctatacagattgcg

SEQ ID NO: 296841 - DNA, 20 bp, human
gagcgcccaggcgtcagagg

SEQ ID NO: 296842 - DNA, 20 bp, human
gggcctccgcctctgacgcc

SEQ ID NO: 296843 - DNA, 20 bp, human
gcggaacccgcgctctgctc

SEQ ID NO: 296844 - DNA, 20 bp, human
ggagaggcgacaacacaggg

SEQ ID NO: 296845 - DNA, 20 bp, human
ggcattgctcgggaaaagga

SEQ ID NO: 296846 - DNA, 20 bp, human
gccgcggactccctctcccg

SEQ ID NO: 296847 - DNA, 20 bp, human
gccgcagaggggcgaaccgc

SEQ ID NO: 296848 - DNA, 20 bp, human
gctccccaggtgcggtccga

SEQ ID NO: 296849 - DNA, 20 bp, human
ggacccggcaacccgctttc

SEQ ID NO: 296850 - DNA, 20 bp, human
ggccgggaaccccgccgtcc

SEQ ID NO: 296851 - DNA, 20 bp, human
gcgccctcggaccgcacctg

SEQ ID NO: 296852 - DNA, 20 bp, human
ggccacgcgcagggcaccac

SEQ ID NO: 296853 - DNA, 20 bp, human
gcgccgccgcgggagaccgg

SEQ ID NO: 296854 - DNA, 20 bp, human
gcctctgcggccgcgacgcg

SEQ ID NO: 296855 - DNA, 20 bp, human
gggccgggccggccacgcgc

SEQ ID NO: 296856 - DNA, 20 bp, human
ggggccgtccccgagaccgc

SEQ ID NO: 296857 - DNA, 20 bp, human
gtgagccctccaccccccgg

SEQ ID NO: 296858 - DNA, 20 bp, human
gcccccggcggtctcgggga

SEQ ID NO: 296859 - DNA, 20 bp, human
gggcactgactgaacttctc

SEQ ID NO: 296860 - DNA, 20 bp, human
gaggggcccggtccaggacc

SEQ ID NO: 296861 - DNA, 20 bp, human
ggcccggctccggggtgctt

SEQ ID NO: 296862 - DNA, 20 bp, human
gtcggggacggcccccagga

SEQ ID NO: 296863 - DNA, 20 bp, human
gccaccccccggcggtctcg

SEQ ID NO: 296864 - DNA, 20 bp, human
gcagctggaaatgcaaggag

SEQ ID NO: 296865 - DNA, 20 bp, human
gagacccctgcccggaaacg

SEQ ID NO: 296866 - DNA, 20 bp, human
ggcccgcggcaggaggagaa

SEQ ID NO: 296867 - DNA, 20 bp, human
gcgtcaggcccgtcaggccc

SEQ ID NO: 296868 - DNA, 20 bp, human
ggccgccgcccgggcctgac

SEQ ID NO: 296869 - DNA, 20 bp, human
gcccgcgcgtcaggcccgtc

SEQ ID NO: 296870 - DNA, 20 bp, human
gcaggcccgtcaggcccggg

SEQ ID NO: 296871 - DNA, 20 bp, human
gggccgcgggcggagacccc

SEQ ID NO: 296872 - DNA, 20 bp, human
ggcctgacgggcctgacgcg

SEQ ID NO: 296873 - DNA, 20 bp, human
gcctcctgccgcgggcggct

SEQ ID NO: 296874 - DNA, 20 bp, human
gcggcgcccagcgccgccac

SEQ ID NO: 296875 - DNA, 20 bp, human
gccacacaccgccgcctcga

SEQ ID NO: 296876 - DNA, 20 bp, human
ggtcccctcaaccaccccag

SEQ ID NO: 296877 - DNA, 20 bp, human
gggaactgagcacccgggac

SEQ ID NO: 296878 - DNA, 20 bp, human
ggctgggaggcataaggccc

SEQ ID NO: 296879 - DNA, 20 bp, human
ggcaacacagccacctgggc

SEQ ID NO: 296880 - DNA, 20 bp, human
ggtggctgctgggaggcata

SEQ ID NO: 296881 - DNA, 20 bp, human
gcaaccaccccaggggcccc

SEQ ID NO: 296882 - DNA, 20 bp, human
gagcatgccctggggcccct

SEQ ID NO: 296883 - DNA, 20 bp, human
gcagcagcaccctggagctt

SEQ ID NO: 296884 - DNA, 20 bp, human
gcataagcacctgtctgtga

SEQ ID NO: 296885 - DNA, 20 bp, human
ggtacagacaaaccaagctc

SEQ ID NO: 296886 - DNA, 20 bp, human
ggcaaactggaggcggtgag

SEQ ID NO: 296887 - DNA, 20 bp, human
gcggcagcccacaagcaaaa

SEQ ID NO: 296888 - DNA, 20 bp, human
gccgctccgcaggggcagag

SEQ ID NO: 296889 - DNA, 20 bp, human
ggcggcggcggcaagtgcac

SEQ ID NO: 296890 - DNA, 20 bp, human
gcgcccgtcccgctccgcag

SEQ ID NO: 296891 - DNA, 20 bp, human
gagcctccgcggagaggcaa

SEQ ID NO: 296892 - DNA, 20 bp, human
gcccacaagcaaaatggcgc

SEQ ID NO: 296893 - DNA, 20 bp, human
gctcgaagatagcaaactgg

SEQ ID NO: 296894 - DNA, 20 bp, human
gaggaagtgtcggtattcgg

SEQ ID NO: 296895 - DNA, 20 bp, human
gcccggcgccattttgcttg

SEQ ID NO: 296896 - DNA, 20 bp, human
gctagcgcggtctcacacat

SEQ ID NO: 296897 - DNA, 20 bp, human
gtgaaccgagccttcaggaa

SEQ ID NO: 296898 - DNA, 20 bp, human
gttggcctaccccttcctga

SEQ ID NO: 296899 - DNA, 20 bp, human
ggacacagggggttctgtga

SEQ ID NO: 296900 - DNA, 20 bp, human
ggaaggggtaggccaagatg

SEQ ID NO: 296901 - DNA, 20 bp, human
gtcacagacgagcacacaaa

SEQ ID NO: 296902 - DNA, 20 bp, human
ggagaggcctcacctatggt

SEQ ID NO: 296903 - DNA, 20 bp, human
gaggagcctggtgagtgttg

SEQ ID NO: 296904 - DNA, 20 bp, human
gctgaaggctcggttcaacc

SEQ ID NO: 296905 - DNA, 20 bp, human
gatcctgcctaccataggtg

SEQ ID NO: 296906 - DNA, 20 bp, human
gcgcccaggaaagctcggac

SEQ ID NO: 296907 - DNA, 20 bp, human
gcggggctgccgcagtcccg

SEQ ID NO: 296908 - DNA, 20 bp, human
ggggacgcggtcagggatac

SEQ ID NO: 296909 - DNA, 20 bp, human
gggaacgtcgctccttcctg

SEQ ID NO: 296910 - DNA, 20 bp, human
gtctccaggggacgcggtca

SEQ ID NO: 296911 - DNA, 20 bp, human
ggctgccgcagtgtctccag

SEQ ID NO: 296912 - DNA, 20 bp, human
ggtggcctctgcagcggcgt

SEQ ID NO: 296913 - DNA, 20 bp, human
gctgcccaacgccgctgcag

SEQ ID NO: 296914 - DNA, 20 bp, human
ggcagtgtctccaggggacg

SEQ ID NO: 296915 - DNA, 20 bp, human
gtacgcgcgccctggctcca

SEQ ID NO: 296916 - DNA, 20 bp, human
gagcagaatctgatgaagga

SEQ ID NO: 296917 - DNA, 20 bp, human
gcagcacagtgcatatttcc

SEQ ID NO: 296918 - DNA, 20 bp, human
gagtctgcttctatgcaggt

SEQ ID NO: 296919 - DNA, 20 bp, human
ggggcgtcctatctgctctc

SEQ ID NO: 296920 - DNA, 20 bp, human
gaaacaagtgcctactaact

SEQ ID NO: 296921 - DNA, 20 bp, human
gatagaggaaaagcatagga

SEQ ID NO: 296922 - DNA, 20 bp, human
gccctgtgcatgagcttctt

SEQ ID NO: 296923 - DNA, 20 bp, human
gggggaataaccgagttagt

SEQ ID NO: 296924 - DNA, 20 bp, human
gggctttgcaaaagtcacag

SEQ ID NO: 296925 - DNA, 20 bp, human
gctagttgccttgttcccaa

SEQ ID NO: 296926 - DNA, 20 bp, human
ggggcttgaggcgcactatg

SEQ ID NO: 296927 - DNA, 20 bp, human
gtgtgggagcagatctgcaa

SEQ ID NO: 296928 - DNA, 20 bp, human
gaagaagccggaacccgaga

SEQ ID NO: 296929 - DNA, 20 bp, human
gaaacctgggctggccgaga

SEQ ID NO: 296930 - DNA, 20 bp, human
ggaggcgcactatgtggctg

SEQ ID NO: 296931 - DNA, 20 bp, human
ggtcgccggcccaccctctc

SEQ ID NO: 296932 - DNA, 20 bp, human
gggagcagatctgcaagggt

SEQ ID NO: 296933 - DNA, 20 bp, human
gtcgcgggacgcgagagaca

SEQ ID NO: 296934 - DNA, 20 bp, human
gtgacctgccacgacgagac

SEQ ID NO: 296935 - DNA, 20 bp, human
gtcgtcgttcacccggacgc

SEQ ID NO: 296936 - DNA, 20 bp, human
gcgggagccgccatactgta

SEQ ID NO: 296937 - DNA, 20 bp, human
gggaaaactctgtccagggg

SEQ ID NO: 296938 - DNA, 20 bp, human
gagccgccatactgtacgga

SEQ ID NO: 296939 - DNA, 20 bp, human
gaaccttccgtacagtatgg

SEQ ID NO: 296940 - DNA, 20 bp, human
gtccggtagctaggcggaag

SEQ ID NO: 296941 - DNA, 20 bp, human
ggtacggaaaactctgtcca

SEQ ID NO: 296942 - DNA, 20 bp, human
gcagacctagcgaaaggtgt

SEQ ID NO: 296943 - DNA, 20 bp, human
gtgttggagcccccaggtct

SEQ ID NO: 296944 - DNA, 20 bp, human
ggaaacttccggtagctagg

SEQ ID NO: 296945 - DNA, 20 bp, human
ggtcgtgccaccggctaagt

SEQ ID NO: 296946 - DNA, 20 bp, human
ggcagtcgggagaacggaat

SEQ ID NO: 296947 - DNA, 20 bp, human
gaatgggcggaactcagggt

SEQ ID NO: 296948 - DNA, 20 bp, human
gggggccaagaatacacccc

SEQ ID NO: 296949 - DNA, 20 bp, human
gcacccccggaatgcgcagt

SEQ ID NO: 296950 - DNA, 20 bp, human
gaaagaccgtgaagagggcg

SEQ ID NO: 296951 - DNA, 20 bp, human
gctcccgactgcgcattccg

SEQ ID NO: 296952 - DNA, 20 bp, human
gattgggtgttctttcatag

SEQ ID NO: 296953 - DNA, 20 bp, human
gaacggaatgggcggaactc

SEQ ID NO: 296954 - DNA, 20 bp, human
gagtgtaaagaccgtgaaga

SEQ ID NO: 296955 - DNA, 20 bp, human
gcattccgggggtgtattct

SEQ ID NO: 296956 - DNA, 20 bp, human
gccagcctgtgaagagtcgg

SEQ ID NO: 296957 - DNA, 20 bp, human
gcctccggcgcttgtcgcag

SEQ ID NO: 296958 - DNA, 20 bp, human
gtcagcgcctcgtgtctaaa

SEQ ID NO: 296959 - DNA, 20 bp, human
gaggctgggcgctaaccatt

SEQ ID NO: 296960 - DNA, 20 bp, human
gggagggggtctcgctaaga

SEQ ID NO: 296961 - DNA, 20 bp, human
ggcaggcgcactgcgaacgc

SEQ ID NO: 296962 - DNA, 20 bp, human
gcctgtgaagagtcgggggt

SEQ ID NO: 296963 - DNA, 20 bp, human
ggggggtctcgctaagaagg

SEQ ID NO: 296964 - DNA, 20 bp, human
ggcagtgcgcctgcgtgcgg

SEQ ID NO: 296965 - DNA, 20 bp, human
gggggcgcgcgtaggcgctc

SEQ ID NO: 296966 - DNA, 20 bp, human
gttgctctgtccacccggac

SEQ ID NO: 296967 - DNA, 20 bp, human
gcccaaagggacatcagaaa

SEQ ID NO: 296968 - DNA, 20 bp, human
ggtccctttgggatatgtct

SEQ ID NO: 296969 - DNA, 20 bp, human
gatgcccagacatatcccaa

SEQ ID NO: 296970 - DNA, 20 bp, human
gatgatagcttaaacaatac

SEQ ID NO: 296971 - DNA, 20 bp, human
gtaagctatcatccctattc

SEQ ID NO: 296972 - DNA, 20 bp, human
gtaaaactgttaaagtaacc

SEQ ID NO: 296973 - DNA, 20 bp, human
gtctcaaaaaagacaggagt

SEQ ID NO: 296974 - DNA, 20 bp, human
gaaaagacaggagtggggga

SEQ ID NO: 296975 - DNA, 20 bp, human
gaccttgtctcaaaaaagac

SEQ ID NO: 296976 - DNA, 20 bp, human
gcgggcggtccctgagcgcc

SEQ ID NO: 296977 - DNA, 20 bp, human
gtgaagcgtgcatggtcctt

SEQ ID NO: 296978 - DNA, 20 bp, human
gggccgttcgtgtttccata

SEQ ID NO: 296979 - DNA, 20 bp, human
ggggagggagtcatagggct

SEQ ID NO: 296980 - DNA, 20 bp, human
gccgccccgccaggcgctca

SEQ ID NO: 296981 - DNA, 20 bp, human
gaatcggaatgcggagtcac

SEQ ID NO: 296982 - DNA, 20 bp, human
gcatagggcttgggggcgag

SEQ ID NO: 296983 - DNA, 20 bp, human
gggatggcatcgcgagatga

SEQ ID NO: 296984 - DNA, 20 bp, human
gaaaaacacgttgggagggg

SEQ ID NO: 296985 - DNA, 20 bp, human
gtaggctcgaaccagccaat

SEQ ID NO: 296986 - DNA, 20 bp, human
ggaggctggcgacacgtgac

SEQ ID NO: 296987 - DNA, 20 bp, human
ggctggcgacacgtgaccgg

SEQ ID NO: 296988 - DNA, 20 bp, human
gcacgtgtcgccagcctccg

SEQ ID NO: 296989 - DNA, 20 bp, human
ggaggcgcgggccgactgcc

SEQ ID NO: 296990 - DNA, 20 bp, human
gcgcgaggtggcagtagcgc

SEQ ID NO: 296991 - DNA, 20 bp, human
ggcgggaacggtgctgagag

SEQ ID NO: 296992 - DNA, 20 bp, human
ggaggtggcagtagcgccgg

SEQ ID NO: 296993 - DNA, 20 bp, human
gcgcgggccgactgccgggc

SEQ ID NO: 296994 - DNA, 20 bp, human
ggaccggcttgggcgttcgc

SEQ ID NO: 296995 - DNA, 20 bp, human
ggggtcatcccgagaaccaa

SEQ ID NO: 296996 - DNA, 20 bp, human
gtgcccccgccgcacccctc

SEQ ID NO: 296997 - DNA, 20 bp, human
gcggaaagagcgaacggaaa

SEQ ID NO: 296998 - DNA, 20 bp, human
gaaggggcgatggagagccg

SEQ ID NO: 296999 - DNA, 20 bp, human
gggaagcgaacgacgctggg

SEQ ID NO: 297000 - DNA, 20 bp, human
gggcccggaggggtgcggcg

SEQ ID NO: 297001 - DNA, 20 bp, human
ggggaggcagcctcgatctg

SEQ ID NO: 297002 - DNA, 20 bp, human
gcgccggggccctcagatcg

SEQ ID NO: 297003 - DNA, 20 bp, human
gaggggaagcgaacgacgct

SEQ ID NO: 297004 - DNA, 20 bp, human
ggggaaggaccacgtgcctt

SEQ ID NO: 297005 - DNA, 20 bp, human
gtgcgttcgaccaatcagaa

SEQ ID NO: 297006 - DNA, 20 bp, human
gccgccgtcccacccaccga

SEQ ID NO: 297007 - DNA, 20 bp, human
ggcacaggctcctccttcgg

SEQ ID NO: 297008 - DNA, 20 bp, human
ggccgccgcgtcgagtgcaa

SEQ ID NO: 297009 - DNA, 20 bp, human
gtggccgcacatcctagcag

SEQ ID NO: 297010 - DNA, 20 bp, human
gcctccttcggtgggtggga

SEQ ID NO: 297011 - DNA, 20 bp, human
gcagggcttgtcgcaggcac

SEQ ID NO: 297012 - DNA, 20 bp, human
gaaaatccagggcttgtcgc

SEQ ID NO: 297013 - DNA, 20 bp, human
gtgcacacacggaggtctac

SEQ ID NO: 297014 - DNA, 20 bp, human
ggcaagcgcaactaaaatcc

SEQ ID NO: 297015 - DNA, 20 bp, human
gcgtccctttgcacacacgg

SEQ ID NO: 297016 - DNA, 20 bp, human
ggaccgcagctactaaaggt

SEQ ID NO: 297017 - DNA, 20 bp, human
gaagagaccgcagctactaa

SEQ ID NO: 297018 - DNA, 20 bp, human
gtgtaggacggcagcccgaa

SEQ ID NO: 297019 - DNA, 20 bp, human
gagctactaaaggtggggag

SEQ ID NO: 297020 - DNA, 20 bp, human
ggaaataggaaaggagtggt

SEQ ID NO: 297021 - DNA, 20 bp, human
gggtgtaatgataggcgatt

SEQ ID NO: 297022 - DNA, 20 bp, human
gttctgggagaaaaagttcc

SEQ ID NO: 297023 - DNA, 20 bp, human
gatatggcggatctgtagga

SEQ ID NO: 297024 - DNA, 20 bp, human
gggacaaaccagttaactcc

SEQ ID NO: 297025 - DNA, 20 bp, human
gtaactggtttgtccctttc

SEQ ID NO: 297026 - DNA, 20 bp, human
gtgagcccaagggttgggga

SEQ ID NO: 297027 - DNA, 20 bp, human
ggggctcacagtggagcaaa

SEQ ID NO: 297028 - DNA, 20 bp, human
gtaaggctctaacccttaaa

SEQ ID NO: 297029 - DNA, 20 bp, human
gctccactgtgagcccttta

SEQ ID NO: 297030 - DNA, 20 bp, human
gctccccgtccccaaccctt

SEQ ID NO: 297031 - DNA, 20 bp, human
gacccttaaagggctcacag

SEQ ID NO: 297032 - DNA, 20 bp, human
gaactctcactcagcttctc

SEQ ID NO: 297033 - DNA, 20 bp, human
gttattatgtcagtatcata

SEQ ID NO: 297034 - DNA, 20 bp, human
gaaaaaaaaagctagcttcc

SEQ ID NO: 297035 - DNA, 20 bp, human
ggactgttgttcttgctgcc

SEQ ID NO: 297036 - DNA, 20 bp, human
ggtggaccggaggcacgact

SEQ ID NO: 297037 - DNA, 20 bp, human
ggagagagcccgccgttgat

SEQ ID NO: 297038 - DNA, 20 bp, human
gagcccgccgttgattgggt

SEQ ID NO: 297039 - DNA, 20 bp, human
ggccacgcggaatccctaac

SEQ ID NO: 297040 - DNA, 20 bp, human
gaactaaggagaggagttcg

SEQ ID NO: 297041 - DNA, 20 bp, human
ggagcgcgcggattggccga

SEQ ID NO: 297042 - DNA, 20 bp, human
ggccagttagggattccgcg

SEQ ID NO: 297043 - DNA, 20 bp, human
gggaccggacctctccgcgg

SEQ ID NO: 297044 - DNA, 20 bp, human
gagggtgcccgggagaacta

SEQ ID NO: 297045 - DNA, 20 bp, human
gaccaagcccacccaatcaa

SEQ ID NO: 297046 - DNA, 20 bp, human
gactctgtaggtgacggcaa

SEQ ID NO: 297047 - DNA, 20 bp, human
gccgaccatcaggtcttcta

SEQ ID NO: 297048 - DNA, 20 bp, human
gccatcaggtcttctaggga

SEQ ID NO: 297049 - DNA, 20 bp, human
gccagcccggttgatgcacc

SEQ ID NO: 297050 - DNA, 20 bp, human
ggaaactgttagggcaatga

SEQ ID NO: 297051 - DNA, 20 bp, human
gagctgctggaatgccagcc

SEQ ID NO: 297052 - DNA, 20 bp, human
gacctgatggtcgggagatg

SEQ ID NO: 297053 - DNA, 20 bp, human
gtaccagagtgacataaaag

SEQ ID NO: 297054 - DNA, 20 bp, human
ggtcttagtgttgaagcctc

SEQ ID NO: 297055 - DNA, 20 bp, human
gatgccaaccagctgtctca

SEQ ID NO: 297056 - DNA, 20 bp, human
gcagtggggcaaagtcgcct

SEQ ID NO: 297057 - DNA, 20 bp, human
gccttggtccagaaatggaa

SEQ ID NO: 297058 - DNA, 20 bp, human
gagagagcgcgggcgcagtg

SEQ ID NO: 297059 - DNA, 20 bp, human
gactccttatggcagcccct

SEQ ID NO: 297060 - DNA, 20 bp, human
gggaccaaggggctgccata

SEQ ID NO: 297061 - DNA, 20 bp, human
gggaaaggagaagagagcgc

SEQ ID NO: 297062 - DNA, 20 bp, human
gtggggcaaagtcgcctggg

SEQ ID NO: 297063 - DNA, 20 bp, human
ggcggccaggtcgcctgctc

SEQ ID NO: 297064 - DNA, 20 bp, human
ggggtgcccggccgttgcgc

SEQ ID NO: 297065 - DNA, 20 bp, human
ggcaacggccgggcacccgg

SEQ ID NO: 297066 - DNA, 20 bp, human
ggggtggctggggcggtcta

SEQ ID NO: 297067 - DNA, 20 bp, human
gtacgagagggagcggctga

SEQ ID NO: 297068 - DNA, 20 bp, human
gtggctggggcggtctaggg

SEQ ID NO: 297069 - DNA, 20 bp, human
gcgcccggccccgaactcat

SEQ ID NO: 297070 - DNA, 20 bp, human
gctgagggcggtgtgggaag

SEQ ID NO: 297071 - DNA, 20 bp, human
gagggactgccggacccacg

SEQ ID NO: 297072 - DNA, 20 bp, human
gaggcgacttcggggactta

SEQ ID NO: 297073 - DNA, 20 bp, human
gtcccgctccgggtcagaat

SEQ ID NO: 297074 - DNA, 20 bp, human
gttcagacgggcgtacgaga

SEQ ID NO: 297075 - DNA, 20 bp, human
ggactgccggacccacgcgg

SEQ ID NO: 297076 - DNA, 20 bp, human
gaaacggcaccacccaccaa

SEQ ID NO: 297077 - DNA, 20 bp, human
ggcgcctcgcatcccttggt

SEQ ID NO: 297078 - DNA, 20 bp, human
gcggccggccggcgcagacg

SEQ ID NO: 297079 - DNA, 20 bp, human
gaacctctacccgcagctgg

SEQ ID NO: 297080 - DNA, 20 bp, human
gcggccgggccgccgaagcc

SEQ ID NO: 297081 - DNA, 20 bp, human
ggctcggggcgggctcaacg

SEQ ID NO: 297082 - DNA, 20 bp, human
gataagcggcgcgtacccgc

SEQ ID NO: 297083 - DNA, 20 bp, human
gcctcgcatcccttggtggg

SEQ ID NO: 297084 - DNA, 20 bp, human
gccggagcccccggcttcgg

SEQ ID NO: 297085 - DNA, 20 bp, human
ggcggcgccggctcggaagc

SEQ ID NO: 297086 - DNA, 20 bp, human
gtgtccgcggtgcctctagg

SEQ ID NO: 297087 - DNA, 20 bp, human
gggagacttggcaacaacgt

SEQ ID NO: 297088 - DNA, 20 bp, human
gcgggcccgagttaagtcac

SEQ ID NO: 297089 - DNA, 20 bp, human
gtaagccagtgacttaactc

SEQ ID NO: 297090 - DNA, 20 bp, human
gccgccccctagaggcaccg

SEQ ID NO: 297091 - DNA, 20 bp, human
gttggcaacaacgtgggaat

SEQ ID NO: 297092 - DNA, 20 bp, human
gcagcgctgcacggtgtccg

SEQ ID NO: 297093 - DNA, 20 bp, human
gggcgctgaccggcttccgg

SEQ ID NO: 297094 - DNA, 20 bp, human
gtcgtcaggatgaagtgaaa

SEQ ID NO: 297095 - DNA, 20 bp, human
ggcttccggctggcgctgac

SEQ ID NO: 297096 - DNA, 20 bp, human
gttcctcacgggaattagga

SEQ ID NO: 297097 - DNA, 20 bp, human
gctaattcccgtgaggaaaa

SEQ ID NO: 297098 - DNA, 20 bp, human
gggtgcctcaactcagaact

SEQ ID NO: 297099 - DNA, 20 bp, human
gttccctcctaattcccgtg

SEQ ID NO: 297100 - DNA, 20 bp, human
gaagggcacgctggcgagat

SEQ ID NO: 297101 - DNA, 20 bp, human
gtcaactcagaactgggctc

SEQ ID NO: 297102 - DNA, 20 bp, human
gagtgcgtcatcacactgac

SEQ ID NO: 297103 - DNA, 20 bp, human
gactctctggatttctctct

SEQ ID NO: 297104 - DNA, 20 bp, human
gggtgaacccatacactctc

SEQ ID NO: 297105 - DNA, 20 bp, human
ggatttctctctaggactcg

SEQ ID NO: 297106 - DNA, 20 bp, human
gcgcacgcgcagtagcacgg

SEQ ID NO: 297107 - DNA, 20 bp, human
gccccctgggaacgcgggat

SEQ ID NO: 297108 - DNA, 20 bp, human
ggccaagatggcggcttcca

SEQ ID NO: 297109 - DNA, 20 bp, human
gacgcgcagtagcacggggg

SEQ ID NO: 297110 - DNA, 20 bp, human
gccaccgccccctgggaacg

SEQ ID NO: 297111 - DNA, 20 bp, human
ggtgggtgcgccaccgccaa

SEQ ID NO: 297112 - DNA, 20 bp, human
gccgcgcacgcgcagtagca

SEQ ID NO: 297113 - DNA, 20 bp, human
gccatcttggccattggcgg

SEQ ID NO: 297114 - DNA, 20 bp, human
gaagccgccatcttggccat

SEQ ID NO: 297115 - DNA, 20 bp, human
gccgccatcttggccattgg

SEQ ID NO: 297116 - DNA, 20 bp, human
gcgggaactgccaggccaag

SEQ ID NO: 297117 - DNA, 20 bp, human
ggccgccgagcaggctggat

SEQ ID NO: 297118 - DNA, 20 bp, human
gcgaagcaagcagcaaggcg

SEQ ID NO: 297119 - DNA, 20 bp, human
gtcccatccagcctgctcgg

SEQ ID NO: 297120 - DNA, 20 bp, human
gcggagacccggcttcctga

SEQ ID NO: 297121 - DNA, 20 bp, human
gggcctggcagttcccggcg

SEQ ID NO: 297122 - DNA, 20 bp, human
ggccactaccggcttatgac

SEQ ID NO: 297123 - DNA, 20 bp, human
ggggaagtcgccgccactac

SEQ ID NO: 297124 - DNA, 20 bp, human
gcaagaggcttcctgggcgc

SEQ ID NO: 297125 - DNA, 20 bp, human
ggtagcgcgtctcgccgcca

SEQ ID NO: 297126 - DNA, 20 bp, human
ggcggggcgtgcgtgcgcag

SEQ ID NO: 297127 - DNA, 20 bp, human
gcccaggtgaggcgagagat

SEQ ID NO: 297128 - DNA, 20 bp, human
gtggggcccgcccggatccg

SEQ ID NO: 297129 - DNA, 20 bp, human
ggtgaggcgagagatgggcg

SEQ ID NO: 297130 - DNA, 20 bp, human
gtcagcccggccaaaccgct

SEQ ID NO: 297131 - DNA, 20 bp, human
gggtaggatcagcaggtgag

SEQ ID NO: 297132 - DNA, 20 bp, human
gcacctgctgatcctaccct

SEQ ID NO: 297133 - DNA, 20 bp, human
ggcctctccgcggatccggg

SEQ ID NO: 297134 - DNA, 20 bp, human
gcggcctccaagtcaccaag

SEQ ID NO: 297135 - DNA, 20 bp, human
gccggggcggggctacactc

SEQ ID NO: 297136 - DNA, 20 bp, human
gccgcctcgcatccctccgt

SEQ ID NO: 297137 - DNA, 20 bp, human
ggcttcccggcctcccatgg

SEQ ID NO: 297138 - DNA, 20 bp, human
gcctcgcccaggtctccaac

SEQ ID NO: 297139 - DNA, 20 bp, human
ggggaagccccgcccagcac

SEQ ID NO: 297140 - DNA, 20 bp, human
gtgagcgcctggcaatgaat

SEQ ID NO: 297141 - DNA, 20 bp, human
gggacccacggagggatgcg

SEQ ID NO: 297142 - DNA, 20 bp, human
gcgggcaggagtcagcccgt

SEQ ID NO: 297143 - DNA, 20 bp, human
gcccggcctcccatgggggg

SEQ ID NO: 297144 - DNA, 20 bp, human
ggggaagcgctggacgcccg

SEQ ID NO: 297145 - DNA, 20 bp, human
gtgaaccggcaccgacctga

SEQ ID NO: 297146 - DNA, 20 bp, human
gcccgcaggggcgtagccgt

SEQ ID NO: 297147 - DNA, 20 bp, human
gtgcccggagcacagggggt

SEQ ID NO: 297148 - DNA, 20 bp, human
gtcaccgcagtcaccgccca

SEQ ID NO: 297149 - DNA, 20 bp, human
gccacccagctcactcaccc

SEQ ID NO: 297150 - DNA, 20 bp, human
ggaaaccgcgagtggagaaa

SEQ ID NO: 297151 - DNA, 20 bp, human
gacaagagagacagcgggga

SEQ ID NO: 297152 - DNA, 20 bp, human
gccaggggcggggttagcag

SEQ ID NO: 297153 - DNA, 20 bp, human
gaactgcagcggcgtgagtg

SEQ ID NO: 297154 - DNA, 20 bp, human
gggcggtgactgcggtgatg

SEQ ID NO: 297155 - DNA, 20 bp, human
ggcacagtggggccaggatc

SEQ ID NO: 297156 - DNA, 20 bp, human
ggctgcgccgcctcactcgg

SEQ ID NO: 297157 - DNA, 20 bp, human
ggcgccgcctcactcggggg

SEQ ID NO: 297158 - DNA, 20 bp, human
gggtgaaagagcttccgggt

SEQ ID NO: 297159 - DNA, 20 bp, human
gggcgactaggagactaggg

SEQ ID NO: 297160 - DNA, 20 bp, human
ggactaggagactagggtgg

SEQ ID NO: 297161 - DNA, 20 bp, human
gcaaggctggaacatgagcc

SEQ ID NO: 297162 - DNA, 20 bp, human
ggaaagagcttccgggtcgg

SEQ ID NO: 297163 - DNA, 20 bp, human
gccccaaaagctcaggtctc

SEQ ID NO: 297164 - DNA, 20 bp, human
ggtgctgaggtgcgaggaga

SEQ ID NO: 297165 - DNA, 20 bp, human
gccagcccctgagagactgc

SEQ ID NO: 297166 - DNA, 20 bp, human
gaaagtctccggctcttcat

SEQ ID NO: 297167 - DNA, 20 bp, human
gcatactgggagaaagtctc

SEQ ID NO: 297168 - DNA, 20 bp, human
gggccacgtaggagaagctg

SEQ ID NO: 297169 - DNA, 20 bp, human
gtcccagtacgcaaactcca

SEQ ID NO: 297170 - DNA, 20 bp, human
gggctcttcattggccacgt

SEQ ID NO: 297171 - DNA, 20 bp, human
gcgcaaactccatggtttca

SEQ ID NO: 297172 - DNA, 20 bp, human
ggtagtttagcaggcggtat

SEQ ID NO: 297173 - DNA, 20 bp, human
gggcttaacgcacgtacgca

SEQ ID NO: 297174 - DNA, 20 bp, human
gacggcctaacctggaccat

SEQ ID NO: 297175 - DNA, 20 bp, human
ggtggtttgtgtaaaagcgc

SEQ ID NO: 297176 - DNA, 20 bp, human
ggagatgcagtgcctgtcaa

SEQ ID NO: 297177 - DNA, 20 bp, human
gacacacctagctcccagga

SEQ ID NO: 297178 - DNA, 20 bp, human
gaaacaccaggtatcagatg

SEQ ID NO: 297179 - DNA, 20 bp, human
gtgtgcttggtagctcacaa

SEQ ID NO: 297180 - DNA, 20 bp, human
gaattttgagagcccatcct

SEQ ID NO: 297181 - DNA, 20 bp, human
gcactacacacctagctccc

SEQ ID NO: 297182 - DNA, 20 bp, human
ggatctcagaaggagctctc

SEQ ID NO: 297183 - DNA, 20 bp, human
gggaccccacatctgatacc

SEQ ID NO: 297184 - DNA, 20 bp, human
gggcaagccaaacccttgac

SEQ ID NO: 297185 - DNA, 20 bp, human
gcatgcaagattggttcatg

SEQ ID NO: 297186 - DNA, 20 bp, human
gtgccctaagaataaacagg

SEQ ID NO: 297187 - DNA, 20 bp, human
gacaccctctcagtatataa

SEQ ID NO: 297188 - DNA, 20 bp, human
gaagcctttatatactgaga

SEQ ID NO: 297189 - DNA, 20 bp, human
gtaagccaaagatgctaagt

SEQ ID NO: 297190 - DNA, 20 bp, human
gttgctcaatgttcttcaac

SEQ ID NO: 297191 - DNA, 20 bp, human
gaagcaaactctaacacatg

SEQ ID NO: 297192 - DNA, 20 bp, human
gtttgccaacttagcatctt

SEQ ID NO: 297193 - DNA, 20 bp, human
gtgttgaaattgaaaatggg

SEQ ID NO: 297194 - DNA, 20 bp, human
gaaattgtacatattaggat

SEQ ID NO: 297195 - DNA, 20 bp, human
gaaatagcataaagtctggc

SEQ ID NO: 297196 - DNA, 20 bp, human
ggtgaagctcatgttaatgg

SEQ ID NO: 297197 - DNA, 20 bp, human
gctacagtcccaactggcct

SEQ ID NO: 297198 - DNA, 20 bp, human
gtgttgcattgcatattctt

SEQ ID NO: 297199 - DNA, 20 bp, human
gcatgagagttaacatacca

SEQ ID NO: 297200 - DNA, 20 bp, human
gtaacataccaaggccagtt

SEQ ID NO: 297201 - DNA, 20 bp, human
gcaccatactcaactgaaca

SEQ ID NO: 297202 - DNA, 20 bp, human
gagacgtaatgtacaagctc

SEQ ID NO: 297203 - DNA, 20 bp, human
gccgtttcagaaacaatccc

SEQ ID NO: 297204 - DNA, 20 bp, human
gatagaactacagtcccaac

SEQ ID NO: 297205 - DNA, 20 bp, human
gctctagagtattaaaaaca

SEQ ID NO: 297206 - DNA, 20 bp, human
ggggaggatccaattttgag

SEQ ID NO: 297207 - DNA, 20 bp, human
gtacaggcaacagactaatt

SEQ ID NO: 297208 - DNA, 20 bp, human
ggatcctccccccaggtttt

SEQ ID NO: 297209 - DNA, 20 bp, human
gctactgtgaacaagacgct

SEQ ID NO: 297210 - DNA, 20 bp, human
gataatgagcgattgctgaa

SEQ ID NO: 297211 - DNA, 20 bp, human
ggtagagtctgcttgtcata

SEQ ID NO: 297212 - DNA, 20 bp, human
ggaaatgcactggtgaaagg

SEQ ID NO: 297213 - DNA, 20 bp, human
ggaaacaaacagaaaagatc

SEQ ID NO: 297214 - DNA, 20 bp, human
gaaaattggatcctcccccc

SEQ ID NO: 297215 - DNA, 20 bp, human
gacaagacgctaggcagtgc

SEQ ID NO: 297216 - DNA, 20 bp, human
gggcaccaagtcagagggtg

SEQ ID NO: 297217 - DNA, 20 bp, human
gcccgttctaatactgggtg

SEQ ID NO: 297218 - DNA, 20 bp, human
gtagttggcaccaagtcaga

SEQ ID NO: 297219 - DNA, 20 bp, human
gccctatggaggtgtataaa

SEQ ID NO: 297220 - DNA, 20 bp, human
gagaagataaccagccccta

SEQ ID NO: 297221 - DNA, 20 bp, human
gaacgggacctgagatgcgg

SEQ ID NO: 297222 - DNA, 20 bp, human
gtatacacctccataggggc

SEQ ID NO: 297223 - DNA, 20 bp, human
gttgtcaaaagggcagtctc

SEQ ID NO: 297224 - DNA, 20 bp, human
gcctgccaggagcttctgcg

SEQ ID NO: 297225 - DNA, 20 bp, human
gtcaggtcccgttctaatac

SEQ ID NO: 297226 - DNA, 20 bp, human
ggggactcccagggtccgat

SEQ ID NO: 297227 - DNA, 20 bp, human
gggtggtcatggtgcagagg

SEQ ID NO: 297228 - DNA, 20 bp, human
gcaggggatggatacccggc

SEQ ID NO: 297229 - DNA, 20 bp, human
gggagagctagcaggtaact

SEQ ID NO: 297230 - DNA, 20 bp, human
ggcagcaggcttcctctacg

SEQ ID NO: 297231 - DNA, 20 bp, human
ggcaggtggtcatggtgcag

SEQ ID NO: 297232 - DNA, 20 bp, human
gtagcaggtaactaggttta

SEQ ID NO: 297233 - DNA, 20 bp, human
ggaggaagcctgctgctgca

SEQ ID NO: 297234 - DNA, 20 bp, human
gacactttcccatcggaccc

SEQ ID NO: 297235 - DNA, 20 bp, human
gcctccttgtctctaataga

SEQ ID NO: 297236 - DNA, 20 bp, human
ggctgcctgcacaccttgag

SEQ ID NO: 297237 - DNA, 20 bp, human
gtcccacaacaccctctgaa

SEQ ID NO: 297238 - DNA, 20 bp, human
gaacacggagctgtcctctt

SEQ ID NO: 297239 - DNA, 20 bp, human
gggaagtgaagtccagctga

SEQ ID NO: 297240 - DNA, 20 bp, human
gacttcacatgacccactca

SEQ ID NO: 297241 - DNA, 20 bp, human
ggactcccaaactaagaaca

SEQ ID NO: 297242 - DNA, 20 bp, human
gcatcacagcacagctacca

SEQ ID NO: 297243 - DNA, 20 bp, human
gcctgagctgctctcagtac

SEQ ID NO: 297244 - DNA, 20 bp, human
gaaggagttggctttgcttt

SEQ ID NO: 297245 - DNA, 20 bp, human
gctgctgctctcttctggca

SEQ ID NO: 297246 - DNA, 20 bp, human
gcctggagacctgggatagg

SEQ ID NO: 297247 - DNA, 20 bp, human
gacctgggataggagggaga

SEQ ID NO: 297248 - DNA, 20 bp, human
gcagcctggagacctgggat

SEQ ID NO: 297249 - DNA, 20 bp, human
ggatgaccagcaggatgtaa

SEQ ID NO: 297250 - DNA, 20 bp, human
ggccccgcagccacattcca

SEQ ID NO: 297251 - DNA, 20 bp, human
gcttgctccaactgagagtc

SEQ ID NO: 297252 - DNA, 20 bp, human
gctacagcagcggggctctg

SEQ ID NO: 297253 - DNA, 20 bp, human
gggtggggcaggtgactgtc

SEQ ID NO: 297254 - DNA, 20 bp, human
gggtctcaggcctgagtgtc

SEQ ID NO: 297255 - DNA, 20 bp, human
gtgacaagggaggctttcat

SEQ ID NO: 297256 - DNA, 20 bp, human
gggccccacacccccaaagc

SEQ ID NO: 297257 - DNA, 20 bp, human
gggtgactcaggctaggcgg

SEQ ID NO: 297258 - DNA, 20 bp, human
gaaggcccgactggccccga

SEQ ID NO: 297259 - DNA, 20 bp, human
gaaacacagaaatgcgagtt

SEQ ID NO: 297260 - DNA, 20 bp, human
ggcgagttcggtggtgactc

SEQ ID NO: 297261 - DNA, 20 bp, human
gcacagaaatgcgagttcgg

SEQ ID NO: 297262 - DNA, 20 bp, human
gagtccagcctggtcactga

SEQ ID NO: 297263 - DNA, 20 bp, human
gggagccctcggggccagtc

SEQ ID NO: 297264 - DNA, 20 bp, human
ggagttcccacccagctttg

SEQ ID NO: 297265 - DNA, 20 bp, human
gacccagctttgggggtgtg

SEQ ID NO: 297266 - DNA, 20 bp, human
ggtgacgggcctgagaccag

SEQ ID NO: 297267 - DNA, 20 bp, human
gtgtgcgtgcctctggtctc

SEQ ID NO: 297268 - DNA, 20 bp, human
gaaaggaagcgggcgaaccc

SEQ ID NO: 297269 - DNA, 20 bp, human
gtggtggcctataaaggaag

SEQ ID NO: 297270 - DNA, 20 bp, human
gccagaggcacgcacacgca

SEQ ID NO: 297271 - DNA, 20 bp, human
gccgtcacctgtgattcagg

SEQ ID NO: 297272 - DNA, 20 bp, human
ggttcgcccgcttcctttat

SEQ ID NO: 297273 - DNA, 20 bp, human
gtgaaagacagcaactttgg

SEQ ID NO: 297274 - DNA, 20 bp, human
ggacagcaactttggcgggg

SEQ ID NO: 297275 - DNA, 20 bp, human
gtcttcagcacccagccccg

SEQ ID NO: 297276 - DNA, 20 bp, human
gtcaccccccagaaacgggg

SEQ ID NO: 297277 - DNA, 20 bp, human
gtggccaccccgtttctggg

SEQ ID NO: 297278 - DNA, 20 bp, human
ggctccgagccgtccacctg

SEQ ID NO: 297279 - DNA, 20 bp, human
ggccctgaaagcagcctcga

SEQ ID NO: 297280 - DNA, 20 bp, human
gccccgccccggagccgctt

SEQ ID NO: 297281 - DNA, 20 bp, human
gggccaaccgggcatggaca

SEQ ID NO: 297282 - DNA, 20 bp, human
gcaggagtcccggggaagaa

SEQ ID NO: 297283 - DNA, 20 bp, human
gtcactctgcgatataactc

SEQ ID NO: 297284 - DNA, 20 bp, human
gcgctcaccccccagaaacg

SEQ ID NO: 297285 - DNA, 20 bp, human
gcaggtgttgttggccctcg

SEQ ID NO: 297286 - DNA, 20 bp, human
gtatgtccctgacgggggaa

SEQ ID NO: 297287 - DNA, 20 bp, human
gggcggatatctgagccctg

SEQ ID NO: 297288 - DNA, 20 bp, human
gaagggaggaatggtgtcag

SEQ ID NO: 297289 - DNA, 20 bp, human
gtatgcccgcggccggtgga

SEQ ID NO: 297290 - DNA, 20 bp, human
gggcaggggcctctggtctc

SEQ ID NO: 297291 - DNA, 20 bp, human
gggggagggaattgaccaat

SEQ ID NO: 297292 - DNA, 20 bp, human
gggctcctgagagcaaatat

SEQ ID NO: 297293 - DNA, 20 bp, human
gctccagaggtgccccgccc

SEQ ID NO: 297294 - DNA, 20 bp, human
gtgagccctgaggaatttgc

SEQ ID NO: 297295 - DNA, 20 bp, human
ggcccgcggccggtggaggg

SEQ ID NO: 297296 - DNA, 20 bp, human
gggtgagcctgcacaagcat

SEQ ID NO: 297297 - DNA, 20 bp, human
gaactaggtgttgtgtacat

SEQ ID NO: 297298 - DNA, 20 bp, human
ggtggtagctgacttccctt

SEQ ID NO: 297299 - DNA, 20 bp, human
gagcttgataatcacgcacc

SEQ ID NO: 297300 - DNA, 20 bp, human
gtacacaacacctagttggc

SEQ ID NO: 297301 - DNA, 20 bp, human
gtctgcctgggagctattcc

SEQ ID NO: 297302 - DNA, 20 bp, human
gagtgcaggggagactgcaa

SEQ ID NO: 297303 - DNA, 20 bp, human
gtgtggatccacttatacgt

SEQ ID NO: 297304 - DNA, 20 bp, human
gtgcaatcaaagcaagttct

SEQ ID NO: 297305 - DNA, 20 bp, human
gctgttctggacctgcccaa

SEQ ID NO: 297306 - DNA, 20 bp, human
gagcggggggcgtggaagta

SEQ ID NO: 297307 - DNA, 20 bp, human
gtattgctatacaaagcggg

SEQ ID NO: 297308 - DNA, 20 bp, human
gttcttggaggcttttatca

SEQ ID NO: 297309 - DNA, 20 bp, human
gaacatattgctatacaaag

SEQ ID NO: 297310 - DNA, 20 bp, human
ggcgtggaagtaaggcaagg

SEQ ID NO: 297311 - DNA, 20 bp, human
ggctgacatgtcactaggat

SEQ ID NO: 297312 - DNA, 20 bp, human
gtgcctctagtggtattttc

SEQ ID NO: 297313 - DNA, 20 bp, human
gtgcctgtggacttcataaa

SEQ ID NO: 297314 - DNA, 20 bp, human
gctccaagaaatgcctctag

SEQ ID NO: 297315 - DNA, 20 bp, human
gcctgccaaggcaggcgcat

SEQ ID NO: 297316 - DNA, 20 bp, human
gtctgctcggtctgcgcgga

SEQ ID NO: 297317 - DNA, 20 bp, human
ggcagtctgctcggtctgcg

SEQ ID NO: 297318 - DNA, 20 bp, human
gtcggtctgcgcggaaggca

SEQ ID NO: 297319 - DNA, 20 bp, human
ggtcgctgcggcagtctgct

SEQ ID NO: 297320 - DNA, 20 bp, human
gaatgtcagattcttcatga

SEQ ID NO: 297321 - DNA, 20 bp, human
gctactataccaataacaat

SEQ ID NO: 297322 - DNA, 20 bp, human
gaaagtgctcaatttttaca

SEQ ID NO: 297323 - DNA, 20 bp, human
gagaaagatgagaatttccg

SEQ ID NO: 297324 - DNA, 20 bp, human
gtgcagagctcctttttcgg

SEQ ID NO: 297325 - DNA, 20 bp, human
gataacataagaaaattgcc

SEQ ID NO: 297326 - DNA, 20 bp, human
gcacacctccgggttaccag

SEQ ID NO: 297327 - DNA, 20 bp, human
gctccgggttaccaggggaa

SEQ ID NO: 297328 - DNA, 20 bp, human
gaatacccgcctgatgtcgt

SEQ ID NO: 297329 - DNA, 20 bp, human
gtgtcgtgggccacacctcc

SEQ ID NO: 297330 - DNA, 20 bp, human
gcgaaggcccaggggcactt

SEQ ID NO: 297331 - DNA, 20 bp, human
gaaggccataaaaccatcca

SEQ ID NO: 297332 - DNA, 20 bp, human
gtagaggtggggcttattgg

SEQ ID NO: 297333 - DNA, 20 bp, human
ggcaaactgtcatattgatg

SEQ ID NO: 297334 - DNA, 20 bp, human
gtcaatcccaaagtgcccct

SEQ ID NO: 297335 - DNA, 20 bp, human
gtcaggcgggtattgggctc

SEQ ID NO: 297336 - DNA, 20 bp, human
gtgatatagtaaatgtccca

SEQ ID NO: 297337 - DNA, 20 bp, human
gcctcgaagtgtgtatataa

SEQ ID NO: 297338 - DNA, 20 bp, human
gtcaatcagcgtgtttttta

SEQ ID NO: 297339 - DNA, 20 bp, human
gatgattggtaacttttctc

SEQ ID NO: 297340 - DNA, 20 bp, human
ggattaccaaaactgtaaca

SEQ ID NO: 297341 - DNA, 20 bp, human
gagttttggtaatccgtaat

SEQ ID NO: 297342 - DNA, 20 bp, human
gtgaacacttctctgaagct

SEQ ID NO: 297343 - DNA, 20 bp, human
gtacagttttaatctttcag

SEQ ID NO: 297344 - DNA, 20 bp, human
gtttcagaggttttgatgat

SEQ ID NO: 297345 - DNA, 20 bp, human
gaaaaaagttacatgattga

SEQ ID NO: 297346 - DNA, 20 bp, human
gtggtggttatctgagaaat

SEQ ID NO: 297347 - DNA, 20 bp, human
ggtctgggtggagcaatgtc

SEQ ID NO: 297348 - DNA, 20 bp, human
ggggaagttaacttccattc

SEQ ID NO: 297349 - DNA, 20 bp, human
gtaggagggcagttgccctc

SEQ ID NO: 297350 - DNA, 20 bp, human
gtgggctcattcctgtagga

SEQ ID NO: 297351 - DNA, 20 bp, human
gagggcagttgccctcaggt

SEQ ID NO: 297352 - DNA, 20 bp, human
gtcagcaagttggcataatt

SEQ ID NO: 297353 - DNA, 20 bp, human
gcagataaccaccaacctga

SEQ ID NO: 297354 - DNA, 20 bp, human
ggttatctgagaaatgggtc

SEQ ID NO: 297355 - DNA, 20 bp, human
gcttgccagtctcagcaagt

SEQ ID NO: 297356 - DNA, 20 bp, human
gaggaagcactcaatgaagt

SEQ ID NO: 297357 - DNA, 20 bp, human
gttaacagcgtccagtctgt

SEQ ID NO: 297358 - DNA, 20 bp, human
ggtccagtctgtaggtggaa

SEQ ID NO: 297359 - DNA, 20 bp, human
gcacctttccacctacagac

SEQ ID NO: 297360 - DNA, 20 bp, human
gtgctgaggctgaggatcac

SEQ ID NO: 297361 - DNA, 20 bp, human
ggattctattaatattccag

SEQ ID NO: 297362 - DNA, 20 bp, human
gtgtgcatctttttggccac

SEQ ID NO: 297363 - DNA, 20 bp, human
gctttgttatatgtggcagg

SEQ ID NO: 297364 - DNA, 20 bp, human
gtatatataaaaatggtgcc

SEQ ID NO: 297365 - DNA, 20 bp, human
gaactaaatcatagcctcaa

SEQ ID NO: 297366 - DNA, 20 bp, human
gtaggtggatagttattgtg

SEQ ID NO: 297367 - DNA, 20 bp, human
gtacagaaatggacacagta

SEQ ID NO: 297368 - DNA, 20 bp, human
gtggggttatttgttatctc

SEQ ID NO: 297369 - DNA, 20 bp, human
gcaggaaggataaggatcaa

SEQ ID NO: 297370 - DNA, 20 bp, human
ggacagggtggagtattatc

SEQ ID NO: 297371 - DNA, 20 bp, human
gtctctggagttggacaggg

SEQ ID NO: 297372 - DNA, 20 bp, human
gtgagctggcaaacatcatt

SEQ ID NO: 297373 - DNA, 20 bp, human
ggaaggaggggaggtcctaa

SEQ ID NO: 297374 - DNA, 20 bp, human
gaaaaccagtacagatgaaa

SEQ ID NO: 297375 - DNA, 20 bp, human
gaactatccacctacagaaa

SEQ ID NO: 297376 - DNA, 20 bp, human
gtgcctagggtctagatgaa

SEQ ID NO: 297377 - DNA, 20 bp, human
gtagcccaaagcaacaccga

SEQ ID NO: 297378 - DNA, 20 bp, human
gttaccatggaggggtataa

SEQ ID NO: 297379 - DNA, 20 bp, human
ggagttctgtgaggtacagt

SEQ ID NO: 297380 - DNA, 20 bp, human
gagggtctcaattaccatgg

SEQ ID NO: 297381 - DNA, 20 bp, human
gacatccctcggtgttgctt

SEQ ID NO: 297382 - DNA, 20 bp, human
gagtagggtctcaattacca

SEQ ID NO: 297383 - DNA, 20 bp, human
gggcatatactgtcattatc

SEQ ID NO: 297384 - DNA, 20 bp, human
gtaatgacagtatatgccta

SEQ ID NO: 297385 - DNA, 20 bp, human
gattatgatagagttctgtg

SEQ ID NO: 297386 - DNA, 20 bp, human
ggtaaaagtgctaaggtggc

SEQ ID NO: 297387 - DNA, 20 bp, human
gcagctaataggcagaggga

SEQ ID NO: 297388 - DNA, 20 bp, human
ggaggccatgcccaaacatg

SEQ ID NO: 297389 - DNA, 20 bp, human
gaaggcaataagtttgttcc

SEQ ID NO: 297390 - DNA, 20 bp, human
gaggcacgctcacctgcatc

SEQ ID NO: 297391 - DNA, 20 bp, human
gctggtgttgccccatgttt

SEQ ID NO: 297392 - DNA, 20 bp, human
gaatggtaaaagtgctaagg

SEQ ID NO: 297393 - DNA, 20 bp, human
gctgtctgacaggacccagg

SEQ ID NO: 297394 - DNA, 20 bp, human
gggagcccactcacagctct

SEQ ID NO: 297395 - DNA, 20 bp, human
gcaaaggccagcgtagagct

SEQ ID NO: 297396 - DNA, 20 bp, human
gttcatgggtggactgtctg

SEQ ID NO: 297397 - DNA, 20 bp, human
gtgacacaaaagaatgtcat

SEQ ID NO: 297398 - DNA, 20 bp, human
gagaactctgatttcatggg

SEQ ID NO: 297399 - DNA, 20 bp, human
gtatcccactgcagagggtg

SEQ ID NO: 297400 - DNA, 20 bp, human
gtcaacacctcaattaatga

SEQ ID NO: 297401 - DNA, 20 bp, human
gctgtggtaggccttcaaag

SEQ ID NO: 297402 - DNA, 20 bp, human
gatgggtggactgtctgcgg

SEQ ID NO: 297403 - DNA, 20 bp, human
gagaaacacggattgatttg

SEQ ID NO: 297404 - DNA, 20 bp, human
gagggaaagacagtccactg

SEQ ID NO: 297405 - DNA, 20 bp, human
gtgagggcagatacttgggc

SEQ ID NO: 297406 - DNA, 20 bp, human
ggggcctgccctagtaatga

SEQ ID NO: 297407 - DNA, 20 bp, human
gtctcatggtgatcaatgac

SEQ ID NO: 297408 - DNA, 20 bp, human
gtaatgagggcccaggcatg

SEQ ID NO: 297409 - DNA, 20 bp, human
ggcctgggccctcattacta

SEQ ID NO: 297410 - DNA, 20 bp, human
gagaggccaaacttatcatt

SEQ ID NO: 297411 - DNA, 20 bp, human
gatcaccatgagagagcttc

SEQ ID NO: 297412 - DNA, 20 bp, human
gctagccctgagaagcctgc

SEQ ID NO: 297413 - DNA, 20 bp, human
gttactagggcaggccctcc

SEQ ID NO: 297414 - DNA, 20 bp, human
gtttggctaaagcaggagtc

SEQ ID NO: 297415 - DNA, 20 bp, human
gtagcagcttcctctggggc

SEQ ID NO: 297416 - DNA, 20 bp, human
gagagcttgccaaagagtta

SEQ ID NO: 297417 - DNA, 20 bp, human
gacctcgtccatggagggtg

SEQ ID NO: 297418 - DNA, 20 bp, human
gaccccactgaagaaggcca

SEQ ID NO: 297419 - DNA, 20 bp, human
ggaaaaaagcccatcatatc

SEQ ID NO: 297420 - DNA, 20 bp, human
gtacgtgtccacaccctcca

SEQ ID NO: 297421 - DNA, 20 bp, human
ggaagaaacacaacaaatgg

SEQ ID NO: 297422 - DNA, 20 bp, human
gtttatacctcgtccatgga

SEQ ID NO: 297423 - DNA, 20 bp, human
gtcatgatgtaagagcttca

SEQ ID NO: 297424 - DNA, 20 bp, human
gttcttcagtggggtgcagc

SEQ ID NO: 297425 - DNA, 20 bp, human
gccaagtaaagtattttatg

SEQ ID NO: 297426 - DNA, 20 bp, human
gcctcacaaaacatgctgat

SEQ ID NO: 297427 - DNA, 20 bp, human
gtggttaagtaagagcttca

SEQ ID NO: 297428 - DNA, 20 bp, human
ggggccctgtccccagagta

SEQ ID NO: 297429 - DNA, 20 bp, human
ggaaactagactatgtgata

SEQ ID NO: 297430 - DNA, 20 bp, human
gttaatgaggtataggactc

SEQ ID NO: 297431 - DNA, 20 bp, human
gctgcagccccataggaaga

SEQ ID NO: 297432 - DNA, 20 bp, human
ggaagtggctaaataacaaa

SEQ ID NO: 297433 - DNA, 20 bp, human
gtgtagcagtgcttatccat

SEQ ID NO: 297434 - DNA, 20 bp, human
gaaaggaggaatacttgaca

SEQ ID NO: 297435 - DNA, 20 bp, human
gactctagctcaatgtccca

SEQ ID NO: 297436 - DNA, 20 bp, human
gaacagtggcggaaactcct

SEQ ID NO: 297437 - DNA, 20 bp, human
gtcaccaaccactagcaccc

SEQ ID NO: 297438 - DNA, 20 bp, human
gctgtctgcattactcagag

SEQ ID NO: 297439 - DNA, 20 bp, human
gtggcggaaactcctgggtg

SEQ ID NO: 297440 - DNA, 20 bp, human
gccaacgaatagtaaggctc

SEQ ID NO: 297441 - DNA, 20 bp, human
ggacatggggtggagttgtt

SEQ ID NO: 297442 - DNA, 20 bp, human
gtggtgtgacataagctgaa

SEQ ID NO: 297443 - DNA, 20 bp, human
ggtaatgcagacagcctttt

SEQ ID NO: 297444 - DNA, 20 bp, human
ggtgggaggaaagagctact

SEQ ID NO: 297445 - DNA, 20 bp, human
gcttcctgggtgctagtggt

SEQ ID NO: 297446 - DNA, 20 bp, human
ggagtcttgacatagtaatg

SEQ ID NO: 297447 - DNA, 20 bp, human
gttggtcttcccagtgatgt

SEQ ID NO: 297448 - DNA, 20 bp, human
gttggagaaagtcaagacag

SEQ ID NO: 297449 - DNA, 20 bp, human
gaggtctgggctcaaatgac

SEQ ID NO: 297450 - DNA, 20 bp, human
gggcccagaaaatatggcta

SEQ ID NO: 297451 - DNA, 20 bp, human
gtcacaggaaactaaataac

SEQ ID NO: 297452 - DNA, 20 bp, human
gccatgcttgcttaatgcgg

SEQ ID NO: 297453 - DNA, 20 bp, human
ggagactggtaaattttcac

SEQ ID NO: 297454 - DNA, 20 bp, human
ggtgctcccagaagatggaa

SEQ ID NO: 297455 - DNA, 20 bp, human
gtctctgccccagtgggcat

SEQ ID NO: 297456 - DNA, 20 bp, human
gaaggcatggggttccggat

SEQ ID NO: 297457 - DNA, 20 bp, human
ggcagtggatggaagtgaca

SEQ ID NO: 297458 - DNA, 20 bp, human
gactcccgatttatgggatc

SEQ ID NO: 297459 - DNA, 20 bp, human
gtggctgcacgaatgacatt

SEQ ID NO: 297460 - DNA, 20 bp, human
gtgctaggaaatgacaacag

SEQ ID NO: 297461 - DNA, 20 bp, human
gtacactcaccattgggtgt

SEQ ID NO: 297462 - DNA, 20 bp, human
ggcagccactcccgatttat

SEQ ID NO: 297463 - DNA, 20 bp, human
ggggacagatgaggatcccc

SEQ ID NO: 297464 - DNA, 20 bp, human
ggtaccatgccaacacccaa

SEQ ID NO: 297465 - DNA, 20 bp, human
gtagctgctcacccctgcct

SEQ ID NO: 297466 - DNA, 20 bp, human
gctgatatggaagagccaag

SEQ ID NO: 297467 - DNA, 20 bp, human
gtccatatcaggttagctgt

SEQ ID NO: 297468 - DNA, 20 bp, human
gcacaggcgaaagatccagt

SEQ ID NO: 297469 - DNA, 20 bp, human
gagtccagagagagcaattg

SEQ ID NO: 297470 - DNA, 20 bp, human
gtatcaggttagctgttggt

SEQ ID NO: 297471 - DNA, 20 bp, human
gctctggactatggtctctg

SEQ ID NO: 297472 - DNA, 20 bp, human
gggctgattcagtcttgcac

SEQ ID NO: 297473 - DNA, 20 bp, human
gactatggtctctgtggatg

SEQ ID NO: 297474 - DNA, 20 bp, human
gggagacacagagaaccaat

SEQ ID NO: 297475 - DNA, 20 bp, human
gaaacaccagcagttgattc

SEQ ID NO: 297476 - DNA, 20 bp, human
gtggctctttgaaatcaggt

SEQ ID NO: 297477 - DNA, 20 bp, human
gaatcaggttggctgttgat

SEQ ID NO: 297478 - DNA, 20 bp, human
gcaggttggctgttgatggg

SEQ ID NO: 297479 - DNA, 20 bp, human
gaggaatgttgacgaatctg

SEQ ID NO: 297480 - DNA, 20 bp, human
gaaccagccttccctatcca

SEQ ID NO: 297481 - DNA, 20 bp, human
gactgggtttggcctcttta

SEQ ID NO: 297482 - DNA, 20 bp, human
gtcaaggtctaagcatctga

SEQ ID NO: 297483 - DNA, 20 bp, human
gaagaggccaaacccagtca

SEQ ID NO: 297484 - DNA, 20 bp, human
gcgagctgagaaacttttca

SEQ ID NO: 297485 - DNA, 20 bp, human
gagtggacacatccataaag

SEQ ID NO: 297486 - DNA, 20 bp, human
gctacgtggtgtcacacagg

SEQ ID NO: 297487 - DNA, 20 bp, human
gcttctacgtggtgtcacac

SEQ ID NO: 297488 - DNA, 20 bp, human
ggtgacaccacgtagaagag

SEQ ID NO: 297489 - DNA, 20 bp, human
gagacaagtagtagttatga

SEQ ID NO: 297490 - DNA, 20 bp, human
gtggcttgagcttttcatcc

SEQ ID NO: 297491 - DNA, 20 bp, human
gccttggaattcagactctg

SEQ ID NO: 297492 - DNA, 20 bp, human
gtggaattcagactctgtgg

SEQ ID NO: 297493 - DNA, 20 bp, human
gctatataagcacttcaaag

SEQ ID NO: 297494 - DNA, 20 bp, human
gatatagcctctcttctacg

SEQ ID NO: 297495 - DNA, 20 bp, human
gactcacacctgcttaataa

SEQ ID NO: 297496 - DNA, 20 bp, human
ggtgacatgctcaacgggtg

SEQ ID NO: 297497 - DNA, 20 bp, human
gcaacgggtgcgggaaggat

SEQ ID NO: 297498 - DNA, 20 bp, human
gcctacagaagtcatctgga

SEQ ID NO: 297499 - DNA, 20 bp, human
gcaggcaggggcttctgatt

SEQ ID NO: 297500 - DNA, 20 bp, human
gatgctcaacgggtgcggga

SEQ ID NO: 297501 - DNA, 20 bp, human
gctcccagagagtagtgtga

SEQ ID NO: 297502 - DNA, 20 bp, human
gtctggagggcacaggttac

SEQ ID NO: 297503 - DNA, 20 bp, human
gaacctgaactggtgcccca

SEQ ID NO: 297504 - DNA, 20 bp, human
gtgtgagcctagcgagatgg

SEQ ID NO: 297505 - DNA, 20 bp, human
gggtgatggggtgtcttttc

SEQ ID NO: 297506 - DNA, 20 bp, human
gcaacatagtggccctactt

SEQ ID NO: 297507 - DNA, 20 bp, human
gctcgagcccatagcaccaa

SEQ ID NO: 297508 - DNA, 20 bp, human
gggcaccagccaagtgatga

SEQ ID NO: 297509 - DNA, 20 bp, human
ggtgctatgggctcgagaat

SEQ ID NO: 297510 - DNA, 20 bp, human
gcaaggggtcacataggttg

SEQ ID NO: 297511 - DNA, 20 bp, human
gcccaagaaccacccaagta

SEQ ID NO: 297512 - DNA, 20 bp, human
gtcaatcccagggaactaca

SEQ ID NO: 297513 - DNA, 20 bp, human
gcaccaacccagtcaatccc

SEQ ID NO: 297514 - DNA, 20 bp, human
gccactatgttgcatctcca

SEQ ID NO: 297515 - DNA, 20 bp, human
gtccctgggattgactgggt

SEQ ID NO: 297516 - DNA, 20 bp, human
gaatggtgtgggtcctgctt

SEQ ID NO: 297517 - DNA, 20 bp, human
gtagagttgtttatttactg

SEQ ID NO: 297518 - DNA, 20 bp, human
gggggggttataaaactctc

SEQ ID NO: 297519 - DNA, 20 bp, human
gttgcacatggaaatggtgt

SEQ ID NO: 297520 - DNA, 20 bp, human
ggagatgtttgtacgaaaac

SEQ ID NO: 297521 - DNA, 20 bp, human
gtctcaggagaggagagttt

SEQ ID NO: 297522 - DNA, 20 bp, human
gtgtaaacacccattttggg

SEQ ID NO: 297523 - DNA, 20 bp, human
gtttgtcttgcacatggaaa

SEQ ID NO: 297524 - DNA, 20 bp, human
gtatttcagaaaatcgtcat

SEQ ID NO: 297525 - DNA, 20 bp, human
gagtctgtaaacacccattt

SEQ ID NO: 297526 - DNA, 20 bp, human
gtgcacgtggatactagctc

SEQ ID NO: 297527 - DNA, 20 bp, human
gtgcaggggaaacacacagc

SEQ ID NO: 297528 - DNA, 20 bp, human
ggcgtgcaaagtgctctggg

SEQ ID NO: 297529 - DNA, 20 bp, human
gttgacatgtgagttcatcc

SEQ ID NO: 297530 - DNA, 20 bp, human
gcatgaggccttaagaaatt

SEQ ID NO: 297531 - DNA, 20 bp, human
gactgcctcatgtggagatg

SEQ ID NO: 297532 - DNA, 20 bp, human
gttctcaagaacatagatgg

SEQ ID NO: 297533 - DNA, 20 bp, human
ggtatccacgtgcagcaact

SEQ ID NO: 297534 - DNA, 20 bp, human
gtcaaccaagttgctgcacg

SEQ ID NO: 297535 - DNA, 20 bp, human
ggggaaacacacagctggct

SEQ ID NO: 297536 - DNA, 20 bp, human
ggcaccccacaccactgtgc

SEQ ID NO: 297537 - DNA, 20 bp, human
gccaatgccccctcagttcc

SEQ ID NO: 297538 - DNA, 20 bp, human
ggagctgtgaatgattaagt

SEQ ID NO: 297539 - DNA, 20 bp, human
gggtgcaaacgctttcttcc

SEQ ID NO: 297540 - DNA, 20 bp, human
gggctgtgagcagcccaaaa

SEQ ID NO: 297541 - DNA, 20 bp, human
gtggtcctgtaagagtcccc

SEQ ID NO: 297542 - DNA, 20 bp, human
gagcatgtaccgtactggga

SEQ ID NO: 297543 - DNA, 20 bp, human
gaactgagggggcattggca

SEQ ID NO: 297544 - DNA, 20 bp, human
gtgatctcttggcagcaagt

SEQ ID NO: 297545 - DNA, 20 bp, human
ggtgggctgggcatgcctgg

SEQ ID NO: 297546 - DNA, 20 bp, human
gtacccgggcttattgtgtt

SEQ ID NO: 297547 - DNA, 20 bp, human
gaggaaggatcccactcaga

SEQ ID NO: 297548 - DNA, 20 bp, human
gcttcagtgaatgtataccc

SEQ ID NO: 297549 - DNA, 20 bp, human
ggcagtggaaaaaacacaac

SEQ ID NO: 297550 - DNA, 20 bp, human
ggttaggatcaagtcaaggc

SEQ ID NO: 297551 - DNA, 20 bp, human
gtgagtgggatccttcctga

SEQ ID NO: 297552 - DNA, 20 bp, human
gatcctaacacaataagccc

SEQ ID NO: 297553 - DNA, 20 bp, human
gcaaatgcccatacgccctc

SEQ ID NO: 297554 - DNA, 20 bp, human
gtgcccatacgccctcagga

SEQ ID NO: 297555 - DNA, 20 bp, human
gtcacacccagtttctagaa

SEQ ID NO: 297556 - DNA, 20 bp, human
gtgagattggtggggtacaa

SEQ ID NO: 297557 - DNA, 20 bp, human
gcaggtccgggaggttccca

SEQ ID NO: 297558 - DNA, 20 bp, human
gcagcaccatgggaacctcc

SEQ ID NO: 297559 - DNA, 20 bp, human
gaagacgggaatcaaatcat

SEQ ID NO: 297560 - DNA, 20 bp, human
ggtttcctggcaggtccggg

SEQ ID NO: 297561 - DNA, 20 bp, human
gtgtctggtatccggtttcc

SEQ ID NO: 297562 - DNA, 20 bp, human
gagaacacctgaatggtccg

SEQ ID NO: 297563 - DNA, 20 bp, human
gtcctctagtgagattggtg

SEQ ID NO: 297564 - DNA, 20 bp, human
gcttgtctctctttcaggtg

SEQ ID NO: 297565 - DNA, 20 bp, human
gacaattcctctagtgagat

SEQ ID NO: 297566 - DNA, 20 bp, human
gagatgatcatcatggaagc

SEQ ID NO: 297567 - DNA, 20 bp, human
ggcaggtgacaggtatatac

SEQ ID NO: 297568 - DNA, 20 bp, human
gtgatctccaacagcaaggc

SEQ ID NO: 297569 - DNA, 20 bp, human
gggctggaagaaagtcagac

SEQ ID NO: 297570 - DNA, 20 bp, human
gcctgtgatctccaacagca

SEQ ID NO: 297571 - DNA, 20 bp, human
gtttaggtgcaattttaaac

SEQ ID NO: 297572 - DNA, 20 bp, human
gttgaagtatgaaagaaatc

SEQ ID NO: 297573 - DNA, 20 bp, human
gggccatgagatgatcatca

SEQ ID NO: 297574 - DNA, 20 bp, human
gtattctcaattcatgaagt

SEQ ID NO: 297575 - DNA, 20 bp, human
gataacttttgtaataatgc

SEQ ID NO: 297576 - DNA, 20 bp, human
gtagaggagcagaacacaat

SEQ ID NO: 297577 - DNA, 20 bp, human
gcaaatagtgagatcacacc

SEQ ID NO: 297578 - DNA, 20 bp, human
gtctctgctggaagaaagtc

SEQ ID NO: 297579 - DNA, 20 bp, human
gcatcatggaaacaggtaat

SEQ ID NO: 297580 - DNA, 20 bp, human
gggccataaggtaatcatca

SEQ ID NO: 297581 - DNA, 20 bp, human
gacaggtaataggtatatac

SEQ ID NO: 297582 - DNA, 20 bp, human
gttaacattgataagggaac

SEQ ID NO: 297583 - DNA, 20 bp, human
gagaaataagactggccata

SEQ ID NO: 297584 - DNA, 20 bp, human
gtgcaatttcaaacatgtag

SEQ ID NO: 297585 - DNA, 20 bp, human
gcattgataagggaaccggg

SEQ ID NO: 297586 - DNA, 20 bp, human
gagtccaagcagggatggtc

SEQ ID NO: 297587 - DNA, 20 bp, human
gaggagctggatcggtgtga

SEQ ID NO: 297588 - DNA, 20 bp, human
gacccagtggcaagagactg

SEQ ID NO: 297589 - DNA, 20 bp, human
gccactgggtctctctgctt

SEQ ID NO: 297590 - DNA, 20 bp, human
gaaacggactcagtgaggga

SEQ ID NO: 297591 - DNA, 20 bp, human
gctggaggatggggacgtct

SEQ ID NO: 297592 - DNA, 20 bp, human
gtctctctgcttgggcctca

SEQ ID NO: 297593 - DNA, 20 bp, human
gcggaggaggatgcttggag

SEQ ID NO: 297594 - DNA, 20 bp, human
ggctgggcttccacaggtag

SEQ ID NO: 297595 - DNA, 20 bp, human
ggaccgcagttccagcccat

SEQ ID NO: 297596 - DNA, 20 bp, human
gagtcaagagcttaattcgt

SEQ ID NO: 297597 - DNA, 20 bp, human
ggggttgttggcttcctcct

SEQ ID NO: 297598 - DNA, 20 bp, human
gtcactcatggggtattagg

SEQ ID NO: 297599 - DNA, 20 bp, human
gggcagctgctctcactcat

SEQ ID NO: 297600 - DNA, 20 bp, human
gtgagagcagctgccctcta

SEQ ID NO: 297601 - DNA, 20 bp, human
gctgtcccatgctagcgaga

SEQ ID NO: 297602 - DNA, 20 bp, human
gagagcttaattcgtgggtt

SEQ ID NO: 297603 - DNA, 20 bp, human
gctaattaacctgctgttat

SEQ ID NO: 297604 - DNA, 20 bp, human
gcagtgccaagcacatataa

SEQ ID NO: 297605 - DNA, 20 bp, human
gctcatggggtattaggagg

SEQ ID NO: 297606 - DNA, 20 bp, human
gaggcctcaagggatctaaa

SEQ ID NO: 297607 - DNA, 20 bp, human
gacaccttttagatcccttg

SEQ ID NO: 297608 - DNA, 20 bp, human
gagctgggccgagaacgcag

SEQ ID NO: 297609 - DNA, 20 bp, human
gaccctctgggtgtgtgtct

SEQ ID NO: 297610 - DNA, 20 bp, human
ggcaggaggaggacaggcta

SEQ ID NO: 297611 - DNA, 20 bp, human
gcaaacagccgctgcgttct

SEQ ID NO: 297612 - DNA, 20 bp, human
ggccccttaaatagcctggc

SEQ ID NO: 297613 - DNA, 20 bp, human
gcctacatgaagaacccaag

SEQ ID NO: 297614 - DNA, 20 bp, human
gaggccagcaggtggagata

SEQ ID NO: 297615 - DNA, 20 bp, human
gtgttgtcgacatacaaatt

SEQ ID NO: 297616 - DNA, 20 bp, human
gctcccctgggagatagttc

SEQ ID NO: 297617 - DNA, 20 bp, human
gatggaggggagttgttggt

SEQ ID NO: 297618 - DNA, 20 bp, human
gaagccagaactatctccca

SEQ ID NO: 297619 - DNA, 20 bp, human
gcccctccatccctaggcag

SEQ ID NO: 297620 - DNA, 20 bp, human
gtccttgggacccctgccta

SEQ ID NO: 297621 - DNA, 20 bp, human
ggcccgtgtccaggaccgaa

SEQ ID NO: 297622 - DNA, 20 bp, human
gcaagatgagagccttctat

SEQ ID NO: 297623 - DNA, 20 bp, human
gtgggacccctgcctaggga

SEQ ID NO: 297624 - DNA, 20 bp, human
gctgcctcgttgcccataga

SEQ ID NO: 297625 - DNA, 20 bp, human
ggctgcggcacacacaatac

SEQ ID NO: 297626 - DNA, 20 bp, human
gagaccactccactctgcaa

SEQ ID NO: 297627 - DNA, 20 bp, human
ggagcccaggacaccggaaa

SEQ ID NO: 297628 - DNA, 20 bp, human
gatatgctgcccttgcagag

SEQ ID NO: 297629 - DNA, 20 bp, human
gagctaggagatctcttcag

SEQ ID NO: 297630 - DNA, 20 bp, human
gtatctgtgctccctaatta

SEQ ID NO: 297631 - DNA, 20 bp, human
gaagctccagggtccgtcct

SEQ ID NO: 297632 - DNA, 20 bp, human
gggcccctggcccatcagca

SEQ ID NO: 297633 - DNA, 20 bp, human
gtgatggttaagcaagaagg

SEQ ID NO: 297634 - DNA, 20 bp, human
gttcccctgctccttgctga

SEQ ID NO: 297635 - DNA, 20 bp, human
gagctggaatttttacctca

SEQ ID NO: 297636 - DNA, 20 bp, human
ggatgccgagtgtgagctca

SEQ ID NO: 297637 - DNA, 20 bp, human
gggtcccaggcctaagaaag

SEQ ID NO: 297638 - DNA, 20 bp, human
gtccctcgggaaatggtgta

SEQ ID NO: 297639 - DNA, 20 bp, human
gagtttgcacgttgtgggga

SEQ ID NO: 297640 - DNA, 20 bp, human
gcggggcactgctagtggag

SEQ ID NO: 297641 - DNA, 20 bp, human
gctcacactcggcatccctc

SEQ ID NO: 297642 - DNA, 20 bp, human
gcccagggaatgccatcaga

SEQ ID NO: 297643 - DNA, 20 bp, human
gcagggttggcggatgccca

SEQ ID NO: 297644 - DNA, 20 bp, human
gaaaatggggtggattccta

SEQ ID NO: 297645 - DNA, 20 bp, human
ggtgccagggaaccagccag

SEQ ID NO: 297646 - DNA, 20 bp, human
gcttgaggacagcacaaaaa

SEQ ID NO: 297647 - DNA, 20 bp, human
gcacctcagagataatcctc

SEQ ID NO: 297648 - DNA, 20 bp, human
ggacccagcccactcagaag

SEQ ID NO: 297649 - DNA, 20 bp, human
ggagtgggagcggaagtgag

SEQ ID NO: 297650 - DNA, 20 bp, human
gcaaagccactctggcccag

SEQ ID NO: 297651 - DNA, 20 bp, human
gtaggcattaagttacttct

SEQ ID NO: 297652 - DNA, 20 bp, human
gcaggcaacctcttctgagt

SEQ ID NO: 297653 - DNA, 20 bp, human
gtgtcaactgaggcaagttt

SEQ ID NO: 297654 - DNA, 20 bp, human
ggggttccctgaaacccttg

SEQ ID NO: 297655 - DNA, 20 bp, human
ggtcagggagctcatggctc

SEQ ID NO: 297656 - DNA, 20 bp, human
ggggagcagaagcagtgtgt

SEQ ID NO: 297657 - DNA, 20 bp, human
gtccacctctgtcccagcta

SEQ ID NO: 297658 - DNA, 20 bp, human
gcagaatgcaagaatctctc

SEQ ID NO: 297659 - DNA, 20 bp, human
gctcgatggtggagtttctt

SEQ ID NO: 297660 - DNA, 20 bp, human
ggatctggggcaaagttaga

SEQ ID NO: 297661 - DNA, 20 bp, human
gaatgataaatgatcgagtt

SEQ ID NO: 297662 - DNA, 20 bp, human
ggggatgtgcctgggagatc

SEQ ID NO: 297663 - DNA, 20 bp, human
ggagacctcaggaccatagc

SEQ ID NO: 297664 - DNA, 20 bp, human
gtctctcaggatctcattgc

SEQ ID NO: 297665 - DNA, 20 bp, human
gtcccctttcaggattgtaa

SEQ ID NO: 297666 - DNA, 20 bp, human
gtgcctggagaataagtgtc

SEQ ID NO: 297667 - DNA, 20 bp, human
gccggcacgtgcagagccaa

SEQ ID NO: 297668 - DNA, 20 bp, human
gcctatttctccaacagcct

SEQ ID NO: 297669 - DNA, 20 bp, human
gaacgctagaaggggttcag

SEQ ID NO: 297670 - DNA, 20 bp, human
gactgggatgtcagtgctga

SEQ ID NO: 297671 - DNA, 20 bp, human
gggccggagcaaagtcactg

SEQ ID NO: 297672 - DNA, 20 bp, human
gcccagcccaggtacgggag

SEQ ID NO: 297673 - DNA, 20 bp, human
gcacgtcagagtaagtcagc

SEQ ID NO: 297674 - DNA, 20 bp, human
gtgcctcaaggagttggaga

SEQ ID NO: 297675 - DNA, 20 bp, human
ggagtgccctggattctcaa

SEQ ID NO: 297676 - DNA, 20 bp, human
gggagagggaggggtcctta

SEQ ID NO: 297677 - DNA, 20 bp, human
gcccccaggctctcctcggt

SEQ ID NO: 297678 - DNA, 20 bp, human
ggccctctccccaagcagga

SEQ ID NO: 297679 - DNA, 20 bp, human
gatcctgccccagacagtct

SEQ ID NO: 297680 - DNA, 20 bp, human
ggcacaggtgataaccggga

SEQ ID NO: 297681 - DNA, 20 bp, human
gtgccaaccgaggagagcct

SEQ ID NO: 297682 - DNA, 20 bp, human
gcagccttggcttacaacag

SEQ ID NO: 297683 - DNA, 20 bp, human
gtggagcacaggtgataacc

SEQ ID NO: 297684 - DNA, 20 bp, human
gagaaggagcattgggcaat

SEQ ID NO: 297685 - DNA, 20 bp, human
gggtgtgtgacacaggtgac

SEQ ID NO: 297686 - DNA, 20 bp, human
ggtcactggaaattcaaaac

SEQ ID NO: 297687 - DNA, 20 bp, human
gtggttggggaggagttagc

SEQ ID NO: 297688 - DNA, 20 bp, human
gtatttgactcaagctccaa

SEQ ID NO: 297689 - DNA, 20 bp, human
ggactcagtaaaacatacag

SEQ ID NO: 297690 - DNA, 20 bp, human
gcacgggaagaagggaagtg

SEQ ID NO: 297691 - DNA, 20 bp, human
gactgtgttgttgaaagtga

SEQ ID NO: 297692 - DNA, 20 bp, human
gaaatctcatcaaaagtggt

SEQ ID NO: 297693 - DNA, 20 bp, human
gattgccatggtcaatttat

SEQ ID NO: 297694 - DNA, 20 bp, human
gaatcagaacacgtagaaaa

SEQ ID NO: 297695 - DNA, 20 bp, human
gaaagactacacgggaagaa

SEQ ID NO: 297696 - DNA, 20 bp, human
ggagagctgccgccacccaa

SEQ ID NO: 297697 - DNA, 20 bp, human
gggaacgggcccttgggtgg

SEQ ID NO: 297698 - DNA, 20 bp, human
gcaagggcccgttccaaccc

SEQ ID NO: 297699 - DNA, 20 bp, human
gccacctccgggcaggactc

SEQ ID NO: 297700 - DNA, 20 bp, human
ggaaaggcctcgtacctgag

SEQ ID NO: 297701 - DNA, 20 bp, human
ggtgggctccagggttggaa

SEQ ID NO: 297702 - DNA, 20 bp, human
gccacctgagtcctgcccgg

SEQ ID NO: 297703 - DNA, 20 bp, human
ggttggaacgggcccttggg

SEQ ID NO: 297704 - DNA, 20 bp, human
gagacaagacccaggagtca

SEQ ID NO: 297705 - DNA, 20 bp, human
ggcctcgtacctgagtggct

SEQ ID NO: 297706 - DNA, 20 bp, human
ggggtggggctagatgaaaa

SEQ ID NO: 297707 - DNA, 20 bp, human
gagagtgaccaggtgcacta

SEQ ID NO: 297708 - DNA, 20 bp, human
gagccaatccagggtgtagg

SEQ ID NO: 297709 - DNA, 20 bp, human
gcggaatggggactattgga

SEQ ID NO: 297710 - DNA, 20 bp, human
gtaaacaagaggccttcctt

SEQ ID NO: 297711 - DNA, 20 bp, human
gtagggggcccagagtgacc

SEQ ID NO: 297712 - DNA, 20 bp, human
gctggcggaatggggactat

SEQ ID NO: 297713 - DNA, 20 bp, human
gacactggctctggcggaat

SEQ ID NO: 297714 - DNA, 20 bp, human
ggggctagatgaaaagggat

SEQ ID NO: 297715 - DNA, 20 bp, human
gcctgctgaggcttcccaag

SEQ ID NO: 297716 - DNA, 20 bp, human
gaaggctggactggccgggt

SEQ ID NO: 297717 - DNA, 20 bp, human
gcaaaaggaaggccattcaa

SEQ ID NO: 297718 - DNA, 20 bp, human
ggggccaaggctggactggc

SEQ ID NO: 297719 - DNA, 20 bp, human
ggacctcactgcatacttga

SEQ ID NO: 297720 - DNA, 20 bp, human
gaatgcagatacctgttggg

SEQ ID NO: 297721 - DNA, 20 bp, human
gtgtaggtctccctcccaac

SEQ ID NO: 297722 - DNA, 20 bp, human
gagcacccacatcatccaac

SEQ ID NO: 297723 - DNA, 20 bp, human
gggtatctgcattgcttagg

SEQ ID NO: 297724 - DNA, 20 bp, human
gaagcaatgcagatacctgt

SEQ ID NO: 297725 - DNA, 20 bp, human
ggggagacctacatgctgct

SEQ ID NO: 297726 - DNA, 20 bp, human
gtggctgccaggtttctgtc

SEQ ID NO: 297727 - DNA, 20 bp, human
ggcaaggaggggtgaaaggc

SEQ ID NO: 297728 - DNA, 20 bp, human
gttcccctggctacatggaa

SEQ ID NO: 297729 - DNA, 20 bp, human
ggcatgggaatgggacacca

SEQ ID NO: 297730 - DNA, 20 bp, human
gctggctacatggaatggat

SEQ ID NO: 297731 - DNA, 20 bp, human
gtgccagctcatcccaggaa

SEQ ID NO: 297732 - DNA, 20 bp, human
gaccagggactgctttcccc

SEQ ID NO: 297733 - DNA, 20 bp, human
ggccaggggaaagcagtccc

SEQ ID NO: 297734 - DNA, 20 bp, human
gtttgtcatcagagggacag

SEQ ID NO: 297735 - DNA, 20 bp, human
gaggcatggtcaaggcaaac

SEQ ID NO: 297736 - DNA, 20 bp, human
ggtagcaaggtggataatta

SEQ ID NO: 297737 - DNA, 20 bp, human
ggcccaccagcactgaccat

SEQ ID NO: 297738 - DNA, 20 bp, human
ggcagagctaagtagcaagg

SEQ ID NO: 297739 - DNA, 20 bp, human
gggccaatggtcagtgctgg

SEQ ID NO: 297740 - DNA, 20 bp, human
gaggggccaatggtcagtgc

SEQ ID NO: 297741 - DNA, 20 bp, human
ggtcctccttccttgattgt

SEQ ID NO: 297742 - DNA, 20 bp, human
gtgggactacgtcatttcat

SEQ ID NO: 297743 - DNA, 20 bp, human
gcccccacaatcaaggaagg

SEQ ID NO: 297744 - DNA, 20 bp, human
gtcaaggaaggaggacaaat

SEQ ID NO: 297745 - DNA, 20 bp, human
gaaactaggtttatgagctt

SEQ ID NO: 297746 - DNA, 20 bp, human
gccacagcagtgccagtggg

SEQ ID NO: 297747 - DNA, 20 bp, human
gtggctgcatcaacaatccc

SEQ ID NO: 297748 - DNA, 20 bp, human
ggcaaggaggaagcttataa

SEQ ID NO: 297749 - DNA, 20 bp, human
gggcagctggtgttaaaaga

SEQ ID NO: 297750 - DNA, 20 bp, human
gggccagccactccacccca

SEQ ID NO: 297751 - DNA, 20 bp, human
ggggaatgggtgcagtgacc

SEQ ID NO: 297752 - DNA, 20 bp, human
gctggcctgtcccaaggagg

SEQ ID NO: 297753 - DNA, 20 bp, human
gagagctaggctatgggccc

SEQ ID NO: 297754 - DNA, 20 bp, human
gcaccccagggcttggccat

SEQ ID NO: 297755 - DNA, 20 bp, human
gcatcaacaatccctggcca

SEQ ID NO: 297756 - DNA, 20 bp, human
gccctcatcccaatgagact

SEQ ID NO: 297757 - DNA, 20 bp, human
gcagacacacctagtctcat

SEQ ID NO: 297758 - DNA, 20 bp, human
ggtccccttaatggcaattg

SEQ ID NO: 297759 - DNA, 20 bp, human
gagttaactcattgtcaagg

SEQ ID NO: 297760 - DNA, 20 bp, human
gagatcaccacacacataaa

SEQ ID NO: 297761 - DNA, 20 bp, human
gtccagcaagaggctcacat

SEQ ID NO: 297762 - DNA, 20 bp, human
gctaccacaattgccattaa

SEQ ID NO: 297763 - DNA, 20 bp, human
gtgtgtggtgatctgaggct

SEQ ID NO: 297764 - DNA, 20 bp, human
gctgagttaactcattgtca

SEQ ID NO: 297765 - DNA, 20 bp, human
ggcaattgtggtagacttat

SEQ ID NO: 297766 - DNA, 20 bp, human
gccccacggactcatcttaa

SEQ ID NO: 297767 - DNA, 20 bp, human
ggcaggagccattgtctcaa

SEQ ID NO: 297768 - DNA, 20 bp, human
gtgaactccacaacagcctg

SEQ ID NO: 297769 - DNA, 20 bp, human
gataacatcttcaagacttc

SEQ ID NO: 297770 - DNA, 20 bp, human
gcacctttaagatgagtccg

SEQ ID NO: 297771 - DNA, 20 bp, human
gagctctccccaccaataaa

SEQ ID NO: 297772 - DNA, 20 bp, human
gcaagcaatgctgcctagat

SEQ ID NO: 297773 - DNA, 20 bp, human
gaacctctcccttgagacaa

SEQ ID NO: 297774 - DNA, 20 bp, human
gtttcaggggccaataggtc

SEQ ID NO: 297775 - DNA, 20 bp, human
gaatgctgcctagatggggt

SEQ ID NO: 297776 - DNA, 20 bp, human
gccagcaattgggccttgga

SEQ ID NO: 297777 - DNA, 20 bp, human
gagaaggcacatggtgggat

SEQ ID NO: 297778 - DNA, 20 bp, human
gaagagccacggggaaatgc

SEQ ID NO: 297779 - DNA, 20 bp, human
ggatcccaaagattctcctg

SEQ ID NO: 297780 - DNA, 20 bp, human
gagagaaggcagggtctccc

SEQ ID NO: 297781 - DNA, 20 bp, human
ggagggctgccctgctaagg

SEQ ID NO: 297782 - DNA, 20 bp, human
ggggtgctgctctaaggagc

SEQ ID NO: 297783 - DNA, 20 bp, human
ggccttggcctccaggtctg

SEQ ID NO: 297784 - DNA, 20 bp, human
gtctgccagcaattgggcct

SEQ ID NO: 297785 - DNA, 20 bp, human
gcttcctcaggagaatcttt

SEQ ID NO: 297786 - DNA, 20 bp, human
gcctccccccacagacccga

SEQ ID NO: 297787 - DNA, 20 bp, human
gctaccggctcccaagtgca

SEQ ID NO: 297788 - DNA, 20 bp, human
ggacacagctggtagctcac

SEQ ID NO: 297789 - DNA, 20 bp, human
gcctccctcgggtctgtggg

SEQ ID NO: 297790 - DNA, 20 bp, human
gcagcctctctccattgtgt

SEQ ID NO: 297791 - DNA, 20 bp, human
gacagacccgagggaggtct

SEQ ID NO: 297792 - DNA, 20 bp, human
gagggaggtctgggatacgg

SEQ ID NO: 297793 - DNA, 20 bp, human
gccgccgctgcggctcaagt

SEQ ID NO: 297794 - DNA, 20 bp, human
gctgcggctcaagtaggacg

SEQ ID NO: 297795 - DNA, 20 bp, human
gcgtcctttggtgactgcct

SEQ ID NO: 297796 - DNA, 20 bp, human
gcctttctagggccctctga

SEQ ID NO: 297797 - DNA, 20 bp, human
gtaccaaggacaaacacatt

SEQ ID NO: 297798 - DNA, 20 bp, human
gcagcatttgaaccatcaga

SEQ ID NO: 297799 - DNA, 20 bp, human
gctttaaaccagcctttcta

SEQ ID NO: 297800 - DNA, 20 bp, human
ggggccaattcctctatttg

SEQ ID NO: 297801 - DNA, 20 bp, human
gcaccaaatgtgtttgtcct

SEQ ID NO: 297802 - DNA, 20 bp, human
gtcgccacaaatagaggaat

SEQ ID NO: 297803 - DNA, 20 bp, human
gaaagtgactctcacccata

SEQ ID NO: 297804 - DNA, 20 bp, human
gccaaaatcacatcacctta

SEQ ID NO: 297805 - DNA, 20 bp, human
gaataagattatatcgagag

SEQ ID NO: 297806 - DNA, 20 bp, human
gttaagaaacatgaggagtt

SEQ ID NO: 297807 - DNA, 20 bp, human
gtttgaaagttgattgtatt

SEQ ID NO: 297808 - DNA, 20 bp, human
ggactgatgcctcaccttta

SEQ ID NO: 297809 - DNA, 20 bp, human
gcagaaagggatgctttctt

SEQ ID NO: 297810 - DNA, 20 bp, human
gcccaatcacccagttgtaa

SEQ ID NO: 297811 - DNA, 20 bp, human
ggtcttgcttcacagtcaaa

SEQ ID NO: 297812 - DNA, 20 bp, human
gaccatggtcaagaagtcat

SEQ ID NO: 297813 - DNA, 20 bp, human
gaggttcaacaaataattca

SEQ ID NO: 297814 - DNA, 20 bp, human
gaaggagccacagttaaaat

SEQ ID NO: 297815 - DNA, 20 bp, human
gcagtgttgacccttacaac

SEQ ID NO: 297816 - DNA, 20 bp, human
gtgccctctgggcgaagtga

SEQ ID NO: 297817 - DNA, 20 bp, human
gagccttcacttcgcccaga

SEQ ID NO: 297818 - DNA, 20 bp, human
gtctgcctaaaggttatcaa

SEQ ID NO: 297819 - DNA, 20 bp, human
ggcgaagtgaaggctcatca

SEQ ID NO: 297820 - DNA, 20 bp, human
gcagggcgacacttggctca

SEQ ID NO: 297821 - DNA, 20 bp, human
ggacatcaagaaaaggtgtt

SEQ ID NO: 297822 - DNA, 20 bp, human
ggggtaaatatgcagctcta

SEQ ID NO: 297823 - DNA, 20 bp, human
gaaagaggcacttcggtgct

SEQ ID NO: 297824 - DNA, 20 bp, human
gttgtcctttgataaccttt

SEQ ID NO: 297825 - DNA, 20 bp, human
gaacgtgccagggcgacact

SEQ ID NO: 297826 - DNA, 20 bp, human
gggaagtactctttgaacat

SEQ ID NO: 297827 - DNA, 20 bp, human
gtactccgtggatctctgat

SEQ ID NO: 297828 - DNA, 20 bp, human
gtaagccaatcagagatcca

SEQ ID NO: 297829 - DNA, 20 bp, human
gagagcaaaggactgatatg

SEQ ID NO: 297830 - DNA, 20 bp, human
ggctctttggaatatgtttg

SEQ ID NO: 297831 - DNA, 20 bp, human
gaacatattccaaagagcaa

SEQ ID NO: 297832 - DNA, 20 bp, human
gtggatatctactgaactga

SEQ ID NO: 297833 - DNA, 20 bp, human
ggctggttcagatatataaa

SEQ ID NO: 297834 - DNA, 20 bp, human
ggtatggatagattgtcacg

SEQ ID NO: 297835 - DNA, 20 bp, human
gtgaactgaaggaatacctt

SEQ ID NO: 297836 - DNA, 20 bp, human
gacaacccggactgcactgg

SEQ ID NO: 297837 - DNA, 20 bp, human
gcacgccaccagtgcagtcc

SEQ ID NO: 297838 - DNA, 20 bp, human
ggctacagcccagacaggac

SEQ ID NO: 297839 - DNA, 20 bp, human
gggctgtagcctgtcccatg

SEQ ID NO: 297840 - DNA, 20 bp, human
ggtggcgtgtgtcatgacta

SEQ ID NO: 297841 - DNA, 20 bp, human
ggacaggctacagcccagac

SEQ ID NO: 297842 - DNA, 20 bp, human
ggcagtccgggttgtaagaa

SEQ ID NO: 297843 - DNA, 20 bp, human
gaccaggaaggggacgctgt

SEQ ID NO: 297844 - DNA, 20 bp, human
gcttacaacccggactgcac

SEQ ID NO: 297845 - DNA, 20 bp, human
gacgcccccacgatcgtgag

SEQ ID NO: 297846 - DNA, 20 bp, human
gtgggcctcccccaggctga

SEQ ID NO: 297847 - DNA, 20 bp, human
gtgggccctcagcctggggg

SEQ ID NO: 297848 - DNA, 20 bp, human
gctccaaacaccaacacgga

SEQ ID NO: 297849 - DNA, 20 bp, human
gcaggctgagggcccacgct

SEQ ID NO: 297850 - DNA, 20 bp, human
gttccatctcctcagaggag

SEQ ID NO: 297851 - DNA, 20 bp, human
ggatgtctgccaagggcagg

SEQ ID NO: 297852 - DNA, 20 bp, human
gtctggacagtcagctcatt

SEQ ID NO: 297853 - DNA, 20 bp, human
gctcccctcctctgaggaga

SEQ ID NO: 297854 - DNA, 20 bp, human
gctgccaagggcaggaggac

SEQ ID NO: 297855 - DNA, 20 bp, human
gctccctgtcctcctgccct

SEQ ID NO: 297856 - DNA, 20 bp, human
gaactggtatgtatgtcgca

SEQ ID NO: 297857 - DNA, 20 bp, human
gcatgtgttgtcccaacagg

SEQ ID NO: 297858 - DNA, 20 bp, human
gtgttgggacaacacatgcc

SEQ ID NO: 297859 - DNA, 20 bp, human
gatacataccagtttaataa

SEQ ID NO: 297860 - DNA, 20 bp, human
gtcttcatcagtttttattt

SEQ ID NO: 297861 - DNA, 20 bp, human
gtgtttttcccttattaaac

SEQ ID NO: 297862 - DNA, 20 bp, human
ggcttgtggagcctcctgtt

SEQ ID NO: 297863 - DNA, 20 bp, human
ggggacaacacatgccaggg

SEQ ID NO: 297864 - DNA, 20 bp, human
gtgttggtgtttacagctgg

SEQ ID NO: 297865 - DNA, 20 bp, human
gccttgttggtgtttacagc

SEQ ID NO: 297866 - DNA, 20 bp, human
gaagcctggggccttgtgct

SEQ ID NO: 297867 - DNA, 20 bp, human
gggagcttatatatctctca

SEQ ID NO: 297868 - DNA, 20 bp, human
gagaactgagcgggaccgtg

SEQ ID NO: 297869 - DNA, 20 bp, human
gcctctgcgtggaccacaga

SEQ ID NO: 297870 - DNA, 20 bp, human
gtccttgttggtgtttgggg

SEQ ID NO: 297871 - DNA, 20 bp, human
gcattggccggctccctcca

SEQ ID NO: 297872 - DNA, 20 bp, human
gaatcacagaggggcggcca

SEQ ID NO: 297873 - DNA, 20 bp, human
gcccaggtgtcagaactgag

SEQ ID NO: 297874 - DNA, 20 bp, human
gagggagccggccaatgggc

SEQ ID NO: 297875 - DNA, 20 bp, human
gaccaacaaggaaagaagcc

SEQ ID NO: 297876 - DNA, 20 bp, human
gcgggcccagagctcacgct

SEQ ID NO: 297877 - DNA, 20 bp, human
gttccctcctggtgttcccg

SEQ ID NO: 297878 - DNA, 20 bp, human
gtgtgcccagcgtgagctct

SEQ ID NO: 297879 - DNA, 20 bp, human
gtgttgggaaaagacgcttg

SEQ ID NO: 297880 - DNA, 20 bp, human
gtgtgagcctgttggctgct

SEQ ID NO: 297881 - DNA, 20 bp, human
gcctgatgtctgccaagagc

SEQ ID NO: 297882 - DNA, 20 bp, human
gccctcctctgagaaggaga

SEQ ID NO: 297883 - DNA, 20 bp, human
gaaaagccccagcagccaac

SEQ ID NO: 297884 - DNA, 20 bp, human
ggacctcccctcctctgaga

SEQ ID NO: 297885 - DNA, 20 bp, human
ggatgtctgccaagagcagg

SEQ ID NO: 297886 - DNA, 20 bp, human
gaggctcctgactggagtta

SEQ ID NO: 297887 - DNA, 20 bp, human
gggaagccctaactccagtc

SEQ ID NO: 297888 - DNA, 20 bp, human
gagccctggggcaggtgtga

SEQ ID NO: 297889 - DNA, 20 bp, human
gtcaacacagaggggtataa

SEQ ID NO: 297890 - DNA, 20 bp, human
gtgtggacaagcccacatta

SEQ ID NO: 297891 - DNA, 20 bp, human
ggttagggcttccctaatgt

SEQ ID NO: 297892 - DNA, 20 bp, human
gtggcagttaggagatattc

SEQ ID NO: 297893 - DNA, 20 bp, human
gggcagcacaatcaacacag

SEQ ID NO: 297894 - DNA, 20 bp, human
gcagccctctgctccatccc

SEQ ID NO: 297895 - DNA, 20 bp, human
gctacacctaaggagggatg

SEQ ID NO: 297896 - DNA, 20 bp, human
gaagagctgaggggcagttc

SEQ ID NO: 297897 - DNA, 20 bp, human
gctggctgtacaccccaaca

SEQ ID NO: 297898 - DNA, 20 bp, human
gtgtacaccccaacaaggaa

SEQ ID NO: 297899 - DNA, 20 bp, human
gagccctcccttccttgttg

SEQ ID NO: 297900 - DNA, 20 bp, human
gggggtgtacagccagctcc

SEQ ID NO: 297901 - DNA, 20 bp, human
gtggacaacatgcaccaagg

SEQ ID NO: 297902 - DNA, 20 bp, human
gctccccaggcgcacgtgga

SEQ ID NO: 297903 - DNA, 20 bp, human
gtagggagagaggtttgttt

SEQ ID NO: 297904 - DNA, 20 bp, human
gaaacacgcacatgcgcccc

SEQ ID NO: 297905 - DNA, 20 bp, human
gccaccctccacgtgcgcct

SEQ ID NO: 297906 - DNA, 20 bp, human
gaacttgtgtgtatgttgca

SEQ ID NO: 297907 - DNA, 20 bp, human
gagagagagggctctgaggg

SEQ ID NO: 297908 - DNA, 20 bp, human
gaccccttgtgcctcgtaag

SEQ ID NO: 297909 - DNA, 20 bp, human
gggcacaaggggttgaagag

SEQ ID NO: 297910 - DNA, 20 bp, human
ggagatgaagacttctctaa

SEQ ID NO: 297911 - DNA, 20 bp, human
gtggaagagctgaagagaca

SEQ ID NO: 297912 - DNA, 20 bp, human
gaacagagagagggctctga

SEQ ID NO: 297913 - DNA, 20 bp, human
gtccccttacgaggcacaag

SEQ ID NO: 297914 - DNA, 20 bp, human
gcatacacacaagtttaatg

SEQ ID NO: 297915 - DNA, 20 bp, human
ggtcaggacaacacacgcca

SEQ ID NO: 297916 - DNA, 20 bp, human
ggcccagggcaggtcaatga

SEQ ID NO: 297917 - DNA, 20 bp, human
ggatccctgggggcaggaat

SEQ ID NO: 297918 - DNA, 20 bp, human
ggacacagcccagatgtgat

SEQ ID NO: 297919 - DNA, 20 bp, human
ggatgggggaaggaccacgc

SEQ ID NO: 297920 - DNA, 20 bp, human
gaggccggcttcctgcagag

SEQ ID NO: 297921 - DNA, 20 bp, human
gcagctctcggcaacacgga

SEQ ID NO: 297922 - DNA, 20 bp, human
ggaacaaacacccctaatcc

SEQ ID NO: 297923 - DNA, 20 bp, human
gccgcccaattcctgccccc

SEQ ID NO: 297924 - DNA, 20 bp, human
gtgtgggcccggggacaaca

SEQ ID NO: 297925 - DNA, 20 bp, human
ggcctcaggaagtgtccttg

SEQ ID NO: 297926 - DNA, 20 bp, human
ggtaggtgagggtgcgtcaa

SEQ ID NO: 297927 - DNA, 20 bp, human
gtctgcaaatagagtgtccc

SEQ ID NO: 297928 - DNA, 20 bp, human
gaaactgaacggcgtctcat

SEQ ID NO: 297929 - DNA, 20 bp, human
ggcccacaggcgctgggatt

SEQ ID NO: 297930 - DNA, 20 bp, human
gcgcctgtgggccatcgcca

SEQ ID NO: 297931 - DNA, 20 bp, human
gacgcaccctcacctacctt

SEQ ID NO: 297932 - DNA, 20 bp, human
gcggaaccaaatatagactc

SEQ ID NO: 297933 - DNA, 20 bp, human
gtcccctggcgatggcccac

SEQ ID NO: 297934 - DNA, 20 bp, human
gaagcagagtcccctggcga

SEQ ID NO: 297935 - DNA, 20 bp, human
gccaggggactctgcttgtc

SEQ ID NO: 297936 - DNA, 20 bp, human
gcaggactgctgcatgtggt

SEQ ID NO: 297937 - DNA, 20 bp, human
ggggcacagacacctgcaag

SEQ ID NO: 297938 - DNA, 20 bp, human
gcgtgtctgctggtggagct

SEQ ID NO: 297939 - DNA, 20 bp, human
gacagcaagtaaactaatta

SEQ ID NO: 297940 - DNA, 20 bp, human
gtctcagccacaacaaggaa

SEQ ID NO: 297941 - DNA, 20 bp, human
ggtcccaggactgctgcatg

SEQ ID NO: 297942 - DNA, 20 bp, human
gcatcactgtgtgtggttgc

SEQ ID NO: 297943 - DNA, 20 bp, human
gggtgatgctgaccacttgc

SEQ ID NO: 297944 - DNA, 20 bp, human
gtggagcagaactctgggac

SEQ ID NO: 297945 - DNA, 20 bp, human
gtcctgtgaggaaaataccc

SEQ ID NO: 297946 - DNA, 20 bp, human
gacggctgtgggcgtctggt

SEQ ID NO: 297947 - DNA, 20 bp, human
ggggccatctttggttgctg

SEQ ID NO: 297948 - DNA, 20 bp, human
gcgtctggtgggtgggatgt

SEQ ID NO: 297949 - DNA, 20 bp, human
gtggaggcaaggacggctgt

SEQ ID NO: 297950 - DNA, 20 bp, human
gaggggaaggaccatactag

SEQ ID NO: 297951 - DNA, 20 bp, human
gagaggaagcccgtgtcctg

SEQ ID NO: 297952 - DNA, 20 bp, human
gtgggttctggaggcaagga

SEQ ID NO: 297953 - DNA, 20 bp, human
gctgtgggcgtctggtgggt

SEQ ID NO: 297954 - DNA, 20 bp, human
ggggtgggcctgatcccagc

SEQ ID NO: 297955 - DNA, 20 bp, human
gcagctgggttctggaggca

SEQ ID NO: 297956 - DNA, 20 bp, human
gtgaatgagggacaacgtgt

SEQ ID NO: 297957 - DNA, 20 bp, human
gggagagagtgtgtgatggt

SEQ ID NO: 297958 - DNA, 20 bp, human
gggtaggatggtggcatctt

SEQ ID NO: 297959 - DNA, 20 bp, human
ggagggacaacgtgtgggct

SEQ ID NO: 297960 - DNA, 20 bp, human
ggctctctccctggtctccg

SEQ ID NO: 297961 - DNA, 20 bp, human
ggtacttagtctgattaaga

SEQ ID NO: 297962 - DNA, 20 bp, human
gtgaggagctccgttaggtg

SEQ ID NO: 297963 - DNA, 20 bp, human
gagagtgtgtgatggtagga

SEQ ID NO: 297964 - DNA, 20 bp, human
gcccaatgaggagctccgtt

SEQ ID NO: 297965 - DNA, 20 bp, human
gtactaaactttctttatga

SEQ ID NO: 297966 - DNA, 20 bp, human
gtcagcgtagaactaacgaa

SEQ ID NO: 297967 - DNA, 20 bp, human
ggcaattagtcacgaaacaa

SEQ ID NO: 297968 - DNA, 20 bp, human
gacgaagggaggcagatatc

SEQ ID NO: 297969 - DNA, 20 bp, human
gagggaggcagatatcaggc

SEQ ID NO: 297970 - DNA, 20 bp, human
gttcaagctcttgttacatt

SEQ ID NO: 297971 - DNA, 20 bp, human
gacgctgaagcagacatgag

SEQ ID NO: 297972 - DNA, 20 bp, human
gggagtgagtgatgcaaagc

SEQ ID NO: 297973 - DNA, 20 bp, human
ggaagcacagtctgcactgc

SEQ ID NO: 297974 - DNA, 20 bp, human
gcaacagaagttgcggttcg

SEQ ID NO: 297975 - DNA, 20 bp, human
ggtagatgatgttttttatc

SEQ ID NO: 297976 - DNA, 20 bp, human
gcataccaagagttcgaaga

SEQ ID NO: 297977 - DNA, 20 bp, human
ggcaattagtcatgaagcta

SEQ ID NO: 297978 - DNA, 20 bp, human
ggccagtaaaacactctggc

SEQ ID NO: 297979 - DNA, 20 bp, human
gtgcaccttcttcgaactct

SEQ ID NO: 297980 - DNA, 20 bp, human
gagaggagtgtaaacttctg

SEQ ID NO: 297981 - DNA, 20 bp, human
gtgtcctgagagcttagagc

SEQ ID NO: 297982 - DNA, 20 bp, human
ggacgtgtctagctgatctg

SEQ ID NO: 297983 - DNA, 20 bp, human
gtgaagccagtaaaacactc

SEQ ID NO: 297984 - DNA, 20 bp, human
gaggctccacagtcaatgtg

SEQ ID NO: 297985 - DNA, 20 bp, human
gggtgtctctgggttttgtt

SEQ ID NO: 297986 - DNA, 20 bp, human
ggacgcgggaaagtacacgc

SEQ ID NO: 297987 - DNA, 20 bp, human
gtacctgggtcctgtcatct

SEQ ID NO: 297988 - DNA, 20 bp, human
gttatggtggagcatgacgc

SEQ ID NO: 297989 - DNA, 20 bp, human
gacaactgttgtcttccttg

SEQ ID NO: 297990 - DNA, 20 bp, human
gacgcgggaaaataagatgt

SEQ ID NO: 297991 - DNA, 20 bp, human
gtcaaggccgaagctattta

SEQ ID NO: 297992 - DNA, 20 bp, human
gaccgtgcacatagcaccac

SEQ ID NO: 297993 - DNA, 20 bp, human
gtacccagatgacaggaccc

SEQ ID NO: 297994 - DNA, 20 bp, human
gttctggtttgacgttatgc

SEQ ID NO: 297995 - DNA, 20 bp, human
gtctggtggtctttatacct

SEQ ID NO: 297996 - DNA, 20 bp, human
gagcaggggtagctggtgaa

SEQ ID NO: 297997 - DNA, 20 bp, human
gcacggtctgctgaatgata

SEQ ID NO: 297998 - DNA, 20 bp, human
gccacgaggaagatgccagg

SEQ ID NO: 297999 - DNA, 20 bp, human
gcacccacgaggaagatgcc

SEQ ID NO: 298000 - DNA, 20 bp, human
ggaaacagagcaggggtagc

SEQ ID NO: 298001 - DNA, 20 bp, human
gcagaaagatcaaccagaca

SEQ ID NO: 298002 - DNA, 20 bp, human
gtaacgagagccaaactact

SEQ ID NO: 298003 - DNA, 20 bp, human
ggggcttgttgccaggatgc

SEQ ID NO: 298004 - DNA, 20 bp, human
gggaggaaaaaccacccacg

SEQ ID NO: 298005 - DNA, 20 bp, human
gcaggaaactctttcagcta

SEQ ID NO: 298006 - DNA, 20 bp, human
gcgtgggtgtggcaccttac

SEQ ID NO: 298007 - DNA, 20 bp, human
gacggctgaacgtatataaa

SEQ ID NO: 298008 - DNA, 20 bp, human
gcttgtaagtccagtctcga

SEQ ID NO: 298009 - DNA, 20 bp, human
gtgtgaaggatgaccctgta

SEQ ID NO: 298010 - DNA, 20 bp, human
gtccataaatataagatgaa

SEQ ID NO: 298011 - DNA, 20 bp, human
ggcagagctgtaaaaacaaa

SEQ ID NO: 298012 - DNA, 20 bp, human
gatgggcagagaaaataaga

SEQ ID NO: 298013 - DNA, 20 bp, human
ggggaaattctttctgtctt

SEQ ID NO: 298014 - DNA, 20 bp, human
gtccctactccattatgtcc

SEQ ID NO: 298015 - DNA, 20 bp, human
gtatacatctgctcctgttt

SEQ ID NO: 298016 - DNA, 20 bp, human
gtcactctggaacacttaga

SEQ ID NO: 298017 - DNA, 20 bp, human
ggatgctcctgataacttaa

SEQ ID NO: 298018 - DNA, 20 bp, human
gaagttatcaggagcatcag

SEQ ID NO: 298019 - DNA, 20 bp, human
ggagctcaggatcagaactg

SEQ ID NO: 298020 - DNA, 20 bp, human
gtcaaaccacagtgaattcc

SEQ ID NO: 298021 - DNA, 20 bp, human
gaggagtgcagcattatgtt

SEQ ID NO: 298022 - DNA, 20 bp, human
gtatatatgctcttagacct

SEQ ID NO: 298023 - DNA, 20 bp, human
gacttgtactttagtcactc

SEQ ID NO: 298024 - DNA, 20 bp, human
gtggagaaatcctccgtttc

SEQ ID NO: 298025 - DNA, 20 bp, human
gtaaaaagtgagcaaggaga

SEQ ID NO: 298026 - DNA, 20 bp, human
gagggagcacaaaaatgtga

SEQ ID NO: 298027 - DNA, 20 bp, human
gagaaaggatggtgacatgt

SEQ ID NO: 298028 - DNA, 20 bp, human
gcacgcataaatacaacatg

SEQ ID NO: 298029 - DNA, 20 bp, human
gcatacttttccctctacac

SEQ ID NO: 298030 - DNA, 20 bp, human
ggaaacagtcatagcatttc

SEQ ID NO: 298031 - DNA, 20 bp, human
ggtctcacatccagtgtaga

SEQ ID NO: 298032 - DNA, 20 bp, human
ggtcttgttattggctgtta

SEQ ID NO: 298033 - DNA, 20 bp, human
gtgtaggtttagttttcagc

SEQ ID NO: 298034 - DNA, 20 bp, human
ggacacatgaaaattatgct

SEQ ID NO: 298035 - DNA, 20 bp, human
gacatgaaaattatgctagg

SEQ ID NO: 298036 - DNA, 20 bp, human
gaagccagatgtgaatacac

SEQ ID NO: 298037 - DNA, 20 bp, human
gaataggtgtggtgcccaac

SEQ ID NO: 298038 - DNA, 20 bp, human
gatgtaaaggatgaccctgt

SEQ ID NO: 298039 - DNA, 20 bp, human
gtgtgaatacacaggaaaag

SEQ ID NO: 298040 - DNA, 20 bp, human
gcacccataaatacaataca

SEQ ID NO: 298041 - DNA, 20 bp, human
ggatataaatgcccttgtcc

SEQ ID NO: 298042 - DNA, 20 bp, human
ggcaatcaatggtgacaaga

SEQ ID NO: 298043 - DNA, 20 bp, human
gaatgtcgcatcctggacaa

SEQ ID NO: 298044 - DNA, 20 bp, human
gttcacaaaggttctcatcc

SEQ ID NO: 298045 - DNA, 20 bp, human
gttccatgtattgtatttat

SEQ ID NO: 298046 - DNA, 20 bp, human
gactgatgcttcaaagggtc

SEQ ID NO: 298047 - DNA, 20 bp, human
gtataagactgatgcttcaa

SEQ ID NO: 298048 - DNA, 20 bp, human
gtaagtgttctcattagaat

SEQ ID NO: 298049 - DNA, 20 bp, human
gagtcttataggtacaatta

SEQ ID NO: 298050 - DNA, 20 bp, human
gcttataggtacaattatgg

SEQ ID NO: 298051 - DNA, 20 bp, human
gtgcttcaaagggtcgggcg

SEQ ID NO: 298052 - DNA, 20 bp, human
gctaatgagaacacttaatt

SEQ ID NO: 298053 - DNA, 20 bp, human
gttcaaagggtcgggcgcgg

SEQ ID NO: 298054 - DNA, 20 bp, human
gtttctcattcatcttgctt

SEQ ID NO: 298055 - DNA, 20 bp, human
gactgacatactctagcaat

SEQ ID NO: 298056 - DNA, 20 bp, human
gtccaacccagggccctgta

SEQ ID NO: 298057 - DNA, 20 bp, human
gccctgtatggaagactaga

SEQ ID NO: 298058 - DNA, 20 bp, human
gaagactacctgtagctctg

SEQ ID NO: 298059 - DNA, 20 bp, human
gtcactggcgtgttctgttt

SEQ ID NO: 298060 - DNA, 20 bp, human
gaggcgagatccaagagaat

SEQ ID NO: 298061 - DNA, 20 bp, human
ggggaaaagaacaactgggc

SEQ ID NO: 298062 - DNA, 20 bp, human
gatcctctgaatccaaccca

SEQ ID NO: 298063 - DNA, 20 bp, human
gacagaacacgccagtgagg

SEQ ID NO: 298064 - DNA, 20 bp, human
gcttccagatcaacaaacgg

SEQ ID NO: 298065 - DNA, 20 bp, human
gtccatacagggccctgggt

SEQ ID NO: 298066 - DNA, 20 bp, human
ggatgcttggccatgatgac

SEQ ID NO: 298067 - DNA, 20 bp, human
gtggataaacagcagttggc

SEQ ID NO: 298068 - DNA, 20 bp, human
gttgccttccacatcttcgc

SEQ ID NO: 298069 - DNA, 20 bp, human
gggggcgtttttatgagttg

SEQ ID NO: 298070 - DNA, 20 bp, human
gattagcccaggttggagat

SEQ ID NO: 298071 - DNA, 20 bp, human
ggggagtgtgccacacgttt

SEQ ID NO: 298072 - DNA, 20 bp, human
gtgcctggctcacatgaacc

SEQ ID NO: 298073 - DNA, 20 bp, human
gtttccaggactagcatcca

SEQ ID NO: 298074 - DNA, 20 bp, human
ggagttgaggtactcaggac

SEQ ID NO: 298075 - DNA, 20 bp, human
ggtccctcatgcctgggtga

SEQ ID NO: 298076 - DNA, 20 bp, human
gtaggtagccaaacaagctc

SEQ ID NO: 298077 - DNA, 20 bp, human
gcttgtttggctacctagtt

SEQ ID NO: 298078 - DNA, 20 bp, human
gaagaattctatttaaggtt

SEQ ID NO: 298079 - DNA, 20 bp, human
gtcttactgagtgttgtcag

SEQ ID NO: 298080 - DNA, 20 bp, human
ggtgactgatgttaagtgac

SEQ ID NO: 298081 - DNA, 20 bp, human
gcatgaattatacttgcctg

SEQ ID NO: 298082 - DNA, 20 bp, human
gttctcatcactagcatttt

SEQ ID NO: 298083 - DNA, 20 bp, human
gtagattaacgagctgcctc

SEQ ID NO: 298084 - DNA, 20 bp, human
gtcactagcatttttggacg

SEQ ID NO: 298085 - DNA, 20 bp, human
gtttatcacatgctctgacc

SEQ ID NO: 298086 - DNA, 20 bp, human
gaagaagtctatttaaggtc

SEQ ID NO: 298087 - DNA, 20 bp, human
gcttaaatagacttcttcgt

SEQ ID NO: 298088 - DNA, 20 bp, human
gcagatgtcaggattgggtc

SEQ ID NO: 298089 - DNA, 20 bp, human
gagtgatgcaatatgttaaa

SEQ ID NO: 298090 - DNA, 20 bp, human
gccaatcctgacatctgaag

SEQ ID NO: 298091 - DNA, 20 bp, human
gtaaaaagggacctcacctg

SEQ ID NO: 298092 - DNA, 20 bp, human
ggagggcctcttcagatgtc

SEQ ID NO: 298093 - DNA, 20 bp, human
gtaacagtaaagaatttcat

SEQ ID NO: 298094 - DNA, 20 bp, human
gttaaatattgcttcatctc

SEQ ID NO: 298095 - DNA, 20 bp, human
gtttgttacgtgatgtgtca

SEQ ID NO: 298096 - DNA, 20 bp, human
gagggcctctccttgtgcca

SEQ ID NO: 298097 - DNA, 20 bp, human
gtgaatggcagcacgtgtag

SEQ ID NO: 298098 - DNA, 20 bp, human
gtcatcacatactcttatca

SEQ ID NO: 298099 - DNA, 20 bp, human
gtcagcactttgggggtcga

SEQ ID NO: 298100 - DNA, 20 bp, human
gttttccctggcacaaggag

SEQ ID NO: 298101 - DNA, 20 bp, human
gcaatagcatctgactttag

SEQ ID NO: 298102 - DNA, 20 bp, human
ggctatgaagaaatctattt

SEQ ID NO: 298103 - DNA, 20 bp, human
gaacaatttaacgattgtga

SEQ ID NO: 298104 - DNA, 20 bp, human
gttcatttttccctggcaca

SEQ ID NO: 298105 - DNA, 20 bp, human
ggcactttgggggtcgaggg

SEQ ID NO: 298106 - DNA, 20 bp, human
gggcaattctgttgagcatt

SEQ ID NO: 298107 - DNA, 20 bp, human
gatgtaatacacctggtaat

SEQ ID NO: 298108 - DNA, 20 bp, human
ggtagatgatgtaatacacc

SEQ ID NO: 298109 - DNA, 20 bp, human
gaacagaattgcctattacc

SEQ ID NO: 298110 - DNA, 20 bp, human
gcttacttaatgtcttattc

SEQ ID NO: 298111 - DNA, 20 bp, human
ggtgcctatatgcacaatac

SEQ ID NO: 298112 - DNA, 20 bp, human
gttggcgattgtacacagca

SEQ ID NO: 298113 - DNA, 20 bp, human
gtttggaagatgacggacaa

SEQ ID NO: 298114 - DNA, 20 bp, human
ggaatatgaagttatcagtt

SEQ ID NO: 298115 - DNA, 20 bp, human
gttatcagtttggaagatga

SEQ ID NO: 298116 - DNA, 20 bp, human
gaagagaagtccttgggttc

SEQ ID NO: 298117 - DNA, 20 bp, human
gaatgaagtaaccaagacga

SEQ ID NO: 298118 - DNA, 20 bp, human
gtatgtaattacagcgttac

SEQ ID NO: 298119 - DNA, 20 bp, human
gtatagccacttcaaaggcc

SEQ ID NO: 298120 - DNA, 20 bp, human
gtgtcatgaacaacaatgac

SEQ ID NO: 298121 - DNA, 20 bp, human
gtaattaaaatggtctaatc

SEQ ID NO: 298122 - DNA, 20 bp, human
gcttctcttcatggtagtca

SEQ ID NO: 298123 - DNA, 20 bp, human
gattttatactctaagtagt

SEQ ID NO: 298124 - DNA, 20 bp, human
gacttcattcccagaaccca

SEQ ID NO: 298125 - DNA, 20 bp, human
gaagtctttaaataatagtt

SEQ ID NO: 298126 - DNA, 20 bp, human
gataactagcttcataaaca

SEQ ID NO: 298127 - DNA, 20 bp, human
gagcagccatggactgtcaa

SEQ ID NO: 298128 - DNA, 20 bp, human
gttcaggtaacacgttctaa

SEQ ID NO: 298129 - DNA, 20 bp, human
gtgggaaccacattttatag

SEQ ID NO: 298130 - DNA, 20 bp, human
gtgttacaaaacaagatagt

SEQ ID NO: 298131 - DNA, 20 bp, human
gagaataaagataacatcct

SEQ ID NO: 298132 - DNA, 20 bp, human
gaaggaaagagtgcaatcag

SEQ ID NO: 298133 - DNA, 20 bp, human
gaacatccttggcttagaaa

SEQ ID NO: 298134 - DNA, 20 bp, human
gtgcaactacattttattag

SEQ ID NO: 298135 - DNA, 20 bp, human
gtctttcctttgacagtcca

SEQ ID NO: 298136 - DNA, 20 bp, human
gaagaattggatactgggaa

SEQ ID NO: 298137 - DNA, 20 bp, human
gagacagcataatcatcctg

SEQ ID NO: 298138 - DNA, 20 bp, human
gtgtgcagtttggattccac

SEQ ID NO: 298139 - DNA, 20 bp, human
gtagtggggtagacttctca

SEQ ID NO: 298140 - DNA, 20 bp, human
gtatgatggtcaaagcaaga

SEQ ID NO: 298141 - DNA, 20 bp, human
gatgctcagagctagagata

SEQ ID NO: 298142 - DNA, 20 bp, human
gaggatgtataaaagtccca

SEQ ID NO: 298143 - DNA, 20 bp, human
gtatagagcattaactatga

SEQ ID NO: 298144 - DNA, 20 bp, human
ggtgcctgggatgcattagt

SEQ ID NO: 298145 - DNA, 20 bp, human
gacatcctcagtgattagtg

SEQ ID NO: 298146 - DNA, 20 bp, human
gggtcacctgcacccggcca

SEQ ID NO: 298147 - DNA, 20 bp, human
gagtatggatgtactcacat

SEQ ID NO: 298148 - DNA, 20 bp, human
gccaagcagactacgtggga

SEQ ID NO: 298149 - DNA, 20 bp, human
ggccaaaaggtaaacgaaaa

SEQ ID NO: 298150 - DNA, 20 bp, human
gaggacttgagtcccctatt

SEQ ID NO: 298151 - DNA, 20 bp, human
ggaaaagggtcacctgcacc

SEQ ID NO: 298152 - DNA, 20 bp, human
gggatcaaatctggacaaaa

SEQ ID NO: 298153 - DNA, 20 bp, human
ggcctatcctgaccccaata

SEQ ID NO: 298154 - DNA, 20 bp, human
gtgagtcccctattggggtc

SEQ ID NO: 298155 - DNA, 20 bp, human
gtcacatgtaggtgcttcca

SEQ ID NO: 298156 - DNA, 20 bp, human
gaatctgctggtgttatttc

SEQ ID NO: 298157 - DNA, 20 bp, human
gaatgggtctacactaaata

SEQ ID NO: 298158 - DNA, 20 bp, human
gaggaaatgaccttgtgtcc

SEQ ID NO: 298159 - DNA, 20 bp, human
gaaatgaccttgtgtcctgg

SEQ ID NO: 298160 - DNA, 20 bp, human
gagacattgtttagatgctc

SEQ ID NO: 298161 - DNA, 20 bp, human
gtcctgggcaaaacaagttg

SEQ ID NO: 298162 - DNA, 20 bp, human
gttgtgctctgcatgctctg

SEQ ID NO: 298163 - DNA, 20 bp, human
gaattggagactttgaagtt

SEQ ID NO: 298164 - DNA, 20 bp, human
gaagttgaggataatactac

SEQ ID NO: 298165 - DNA, 20 bp, human
gacaaaacttactaatctgc

SEQ ID NO: 298166 - DNA, 20 bp, human
gactctggatttaactgctg

SEQ ID NO: 298167 - DNA, 20 bp, human
ggaccaggtattccgttcta

SEQ ID NO: 298168 - DNA, 20 bp, human
gcaggccatgccatgtgaga

SEQ ID NO: 298169 - DNA, 20 bp, human
gcgtgacttaagcatgggac

SEQ ID NO: 298170 - DNA, 20 bp, human
gcacaggctgggtttctgat

SEQ ID NO: 298171 - DNA, 20 bp, human
gtggaatgttcatgagtcac

SEQ ID NO: 298172 - DNA, 20 bp, human
gcccatgcttaagtcacgga

SEQ ID NO: 298173 - DNA, 20 bp, human
gcaagaggaaagtgtgatgg

SEQ ID NO: 298174 - DNA, 20 bp, human
gtgcaccttctcacatggca

SEQ ID NO: 298175 - DNA, 20 bp, human
gaaatgacctcatgtcctgg

SEQ ID NO: 298176 - DNA, 20 bp, human
gaagcccaggtcctagtcag

SEQ ID NO: 298177 - DNA, 20 bp, human
gctgtgaagcagatgactac

SEQ ID NO: 298178 - DNA, 20 bp, human
gaatgcagatccctggccac

SEQ ID NO: 298179 - DNA, 20 bp, human
gcatctgtagagtccgggaa

SEQ ID NO: 298180 - DNA, 20 bp, human
gtctcccctgactaggacct

SEQ ID NO: 298181 - DNA, 20 bp, human
gatgactactggtctgcact

SEQ ID NO: 298182 - DNA, 20 bp, human
gcagggatctgcatttcgtg

SEQ ID NO: 298183 - DNA, 20 bp, human
gtggtcactctcccctgact

SEQ ID NO: 298184 - DNA, 20 bp, human
gaagttgagtttggattgga

SEQ ID NO: 298185 - DNA, 20 bp, human
gtctttaagtgagtcatgga

SEQ ID NO: 298186 - DNA, 20 bp, human
ggggagacagatgtgcctaa

SEQ ID NO: 298187 - DNA, 20 bp, human
gttgaccgctaacaccgcca

SEQ ID NO: 298188 - DNA, 20 bp, human
gagtaggtgtggcaaatcac

SEQ ID NO: 298189 - DNA, 20 bp, human
gtatgagagtgttgccttgg

SEQ ID NO: 298190 - DNA, 20 bp, human
ggttgccttggcggtgttag

SEQ ID NO: 298191 - DNA, 20 bp, human
gaaaaaaggatgttaaaacc

SEQ ID NO: 298192 - DNA, 20 bp, human
gtagtgaagccttcatagct

SEQ ID NO: 298193 - DNA, 20 bp, human
gataaatctcttatttcatt

SEQ ID NO: 298194 - DNA, 20 bp, human
gagtctgtctgcatggcttt

SEQ ID NO: 298195 - DNA, 20 bp, human
gatctgattcaaattggttt

SEQ ID NO: 298196 - DNA, 20 bp, human
ggggtcccacccaccactga

SEQ ID NO: 298197 - DNA, 20 bp, human
gaaggcatttgatcatgaga

SEQ ID NO: 298198 - DNA, 20 bp, human
gctaaacaaagtatgagtaa

SEQ ID NO: 298199 - DNA, 20 bp, human
gcaatcaacaggtcctgtgg

SEQ ID NO: 298200 - DNA, 20 bp, human
gtatatacaccctcagtggt

SEQ ID NO: 298201 - DNA, 20 bp, human
gggtgggtgggacccaccac

SEQ ID NO: 298202 - DNA, 20 bp, human
gatgcaatcaacaggtcctg

SEQ ID NO: 298203 - DNA, 20 bp, human
gtcattgaatgggttgtaaa

SEQ ID NO: 298204 - DNA, 20 bp, human
gatacaccctcagtggtggg

SEQ ID NO: 298205 - DNA, 20 bp, human
gtctaatttaatcattgaat

SEQ ID NO: 298206 - DNA, 20 bp, human
gacaatgtcaggagtgcctg

SEQ ID NO: 298207 - DNA, 20 bp, human
gtggaggtgtgacaaaccac

SEQ ID NO: 298208 - DNA, 20 bp, human
gtcatccaacatagctacaa

SEQ ID NO: 298209 - DNA, 20 bp, human
gtggtctatatgacaatgtc

SEQ ID NO: 298210 - DNA, 20 bp, human
gttagcaaagtgatcggaag

SEQ ID NO: 298211 - DNA, 20 bp, human
gggtcttttatcagtctcag

SEQ ID NO: 298212 - DNA, 20 bp, human
gagtctatcagctgtttggc

SEQ ID NO: 298213 - DNA, 20 bp, human
ggttggatgacatcacgtgg

SEQ ID NO: 298214 - DNA, 20 bp, human
gcttgctgccggagtggcag

SEQ ID NO: 298215 - DNA, 20 bp, human
gtatgttggatgacatcacg

SEQ ID NO: 298216 - DNA, 20 bp, human
gtgggcacatgatttcattg

SEQ ID NO: 298217 - DNA, 20 bp, human
gttaagcaaaatattattga

SEQ ID NO: 298218 - DNA, 20 bp, human
gtttcattgaggcagttctt

SEQ ID NO: 298219 - DNA, 20 bp, human
gatgactcaggaaaggagat

SEQ ID NO: 298220 - DNA, 20 bp, human
gttgcagatagcatacattc

SEQ ID NO: 298221 - DNA, 20 bp, human
gatcactcattccctgactt

SEQ ID NO: 298222 - DNA, 20 bp, human
gggagtgtctccttccctat

SEQ ID NO: 298223 - DNA, 20 bp, human
ggggaggttggacaaggggt

SEQ ID NO: 298224 - DNA, 20 bp, human
ggtggaagtgcagagtgagt

SEQ ID NO: 298225 - DNA, 20 bp, human
gttgagggaggttggacaag

SEQ ID NO: 298226 - DNA, 20 bp, human
gttggtgatgtgttatgtca

SEQ ID NO: 298227 - DNA, 20 bp, human
ggcatgggtcatcctcacat

SEQ ID NO: 298228 - DNA, 20 bp, human
gaggatgacccatgcatccc

SEQ ID NO: 298229 - DNA, 20 bp, human
gtatacttccagggatgcat

SEQ ID NO: 298230 - DNA, 20 bp, human
gaaaagaacaccaaggtatt

SEQ ID NO: 298231 - DNA, 20 bp, human
gaagaagttgaggtagcacg

SEQ ID NO: 298232 - DNA, 20 bp, human
ggagaattatctatttaata

SEQ ID NO: 298233 - DNA, 20 bp, human
gggtttttggacaaagaatt

SEQ ID NO: 298234 - DNA, 20 bp, human
gaaacttttcttcagagaga

SEQ ID NO: 298235 - DNA, 20 bp, human
gcacagaatgagctcatttt

SEQ ID NO: 298236 - DNA, 20 bp, human
gaattcttgtgggaatgaga

SEQ ID NO: 298237 - DNA, 20 bp, human
gtttgtggagtgtacatttg

SEQ ID NO: 298238 - DNA, 20 bp, human
gtaaaatgagaggctttctt

SEQ ID NO: 298239 - DNA, 20 bp, human
gctcctgagtagtacagttg

SEQ ID NO: 298240 - DNA, 20 bp, human
ggagtagtacagttgtggat

SEQ ID NO: 298241 - DNA, 20 bp, human
gcagcctcctagagaaagga

SEQ ID NO: 298242 - DNA, 20 bp, human
gtggggattctcaatgtttt

SEQ ID NO: 298243 - DNA, 20 bp, human
gcagtctatgattaacttgc

SEQ ID NO: 298244 - DNA, 20 bp, human
gaaaaacagaacatgacagt

SEQ ID NO: 298245 - DNA, 20 bp, human
ggtggattggatggtaatac

SEQ ID NO: 298246 - DNA, 20 bp, human
gggtatgtgggacaaatcac

SEQ ID NO: 298247 - DNA, 20 bp, human
ggccttaaatgccacatgaa

SEQ ID NO: 298248 - DNA, 20 bp, human
gagaaacagcaaagttgtct

SEQ ID NO: 298249 - DNA, 20 bp, human
gcaaccaagagtaacccaca

SEQ ID NO: 298250 - DNA, 20 bp, human
ggtcccacataccattcatg

SEQ ID NO: 298251 - DNA, 20 bp, human
gaagccatgtgggttactct

SEQ ID NO: 298252 - DNA, 20 bp, human
gcttggatgtattggttaca

SEQ ID NO: 298253 - DNA, 20 bp, human
gataaacgagtcatcaaaat

SEQ ID NO: 298254 - DNA, 20 bp, human
gacaacaagtggaagccatg

SEQ ID NO: 298255 - DNA, 20 bp, human
gcacgcaccagctattcata

SEQ ID NO: 298256 - DNA, 20 bp, human
gatctcttagccatatgtcc

SEQ ID NO: 298257 - DNA, 20 bp, human
gcaacctgagttatatgtga

SEQ ID NO: 298258 - DNA, 20 bp, human
ggaaggttggctatgcagtg

SEQ ID NO: 298259 - DNA, 20 bp, human
gtatggctaagagattcttg

SEQ ID NO: 298260 - DNA, 20 bp, human
gactgcatttatggaggtag

SEQ ID NO: 298261 - DNA, 20 bp, human
gttaagagaatatctcctta

SEQ ID NO: 298262 - DNA, 20 bp, human
gggctcatgattttacttgt

SEQ ID NO: 298263 - DNA, 20 bp, human
gttaaggactgcatttatgg

SEQ ID NO: 298264 - DNA, 20 bp, human
gctggccactctgtggttta

SEQ ID NO: 298265 - DNA, 20 bp, human
gatgagtccaatgtagattg

SEQ ID NO: 298266 - DNA, 20 bp, human
gtgggcgtgatgcagtatcc

SEQ ID NO: 298267 - DNA, 20 bp, human
gtctctgcagaaataaggtt

SEQ ID NO: 298268 - DNA, 20 bp, human
gaacacattcacaagaatgg

SEQ ID NO: 298269 - DNA, 20 bp, human
gtcactggatcattgggcac

SEQ ID NO: 298270 - DNA, 20 bp, human
gacaagaatgggggggttcc

SEQ ID NO: 298271 - DNA, 20 bp, human
gccaatgggcttctataaac

SEQ ID NO: 298272 - DNA, 20 bp, human
ggtgagggtgtaaacatcac

SEQ ID NO: 298273 - DNA, 20 bp, human
gcaagctcagtaaaaggggt

SEQ ID NO: 298274 - DNA, 20 bp, human
gtttacaccctcacactgct

SEQ ID NO: 298275 - DNA, 20 bp, human
gggtttgctttcagaaacat

SEQ ID NO: 298276 - DNA, 20 bp, human
ggtctacagatgatgagtga

SEQ ID NO: 298277 - DNA, 20 bp, human
gcaacatctcattagtgtgt

SEQ ID NO: 298278 - DNA, 20 bp, human
gtaacagcgtggaaaaatac

SEQ ID NO: 298279 - DNA, 20 bp, human
gacaagagttcatgggtcta

SEQ ID NO: 298280 - DNA, 20 bp, human
gatggtcaaagtggtgatta

SEQ ID NO: 298281 - DNA, 20 bp, human
ggaggcttttgacaatcacc

SEQ ID NO: 298282 - DNA, 20 bp, human
gcctgtgcagggccatatac

SEQ ID NO: 298283 - DNA, 20 bp, human
gtaagagtatagcacatatt

SEQ ID NO: 298284 - DNA, 20 bp, human
ggaggttaacaagagttcat

SEQ ID NO: 298285 - DNA, 20 bp, human
gtcactatttgctgaaggta

SEQ ID NO: 298286 - DNA, 20 bp, human
gtggcctacttgtgtaaact

SEQ ID NO: 298287 - DNA, 20 bp, human
gggtcccagtttacacaagt

SEQ ID NO: 298288 - DNA, 20 bp, human
gaaggtttaccacatgtctc

SEQ ID NO: 298289 - DNA, 20 bp, human
gcaactggatgaatggtagc

SEQ ID NO: 298290 - DNA, 20 bp, human
gtagaagtcaaattcagcgt

SEQ ID NO: 298291 - DNA, 20 bp, human
gtcaaggtgtagaagcaacc

SEQ ID NO: 298292 - DNA, 20 bp, human
gcagccagcatctgctatta

SEQ ID NO: 298293 - DNA, 20 bp, human
gtctgagtatatagctatca

SEQ ID NO: 298294 - DNA, 20 bp, human
gagtcaaattcagcgttggt

SEQ ID NO: 298295 - DNA, 20 bp, human
gatgcacacaactggatgaa

SEQ ID NO: 298296 - DNA, 20 bp, human
gggtggaagcctcacttcct

SEQ ID NO: 298297 - DNA, 20 bp, human
gcgcagaagcaccaccttct

SEQ ID NO: 298298 - DNA, 20 bp, human
gcaaggagcatccagtttta

SEQ ID NO: 298299 - DNA, 20 bp, human
gcttccaccctccataaaac

SEQ ID NO: 298300 - DNA, 20 bp, human
ggatagacgtaatcaatgga

SEQ ID NO: 298301 - DNA, 20 bp, human
gtatagatagacgtaatcaa

SEQ ID NO: 298302 - DNA, 20 bp, human
gtattaaaactcagtcgcat

SEQ ID NO: 298303 - DNA, 20 bp, human
gagacctcttaaagaaagtc

SEQ ID NO: 298304 - DNA, 20 bp, human
gctgagtgaagctgaaacct

SEQ ID NO: 298305 - DNA, 20 bp, human
ggaactctttattatagcca

SEQ ID NO: 298306 - DNA, 20 bp, human
ggactcattcaaggtggggt

SEQ ID NO: 298307 - DNA, 20 bp, human
gtactcagaaacctgggtgt

SEQ ID NO: 298308 - DNA, 20 bp, human
gggagagaacaatatctgag

SEQ ID NO: 298309 - DNA, 20 bp, human
gaatgttagcttggttggac

SEQ ID NO: 298310 - DNA, 20 bp, human
gggacaatgagaaatgcatg

SEQ ID NO: 298311 - DNA, 20 bp, human
gtgagaaatgcatgaggcag

SEQ ID NO: 298312 - DNA, 20 bp, human
gtcttgagaagccaacaccc

SEQ ID NO: 298313 - DNA, 20 bp, human
gttaccaatgtgcagagtca

SEQ ID NO: 298314 - DNA, 20 bp, human
gtccaaagatgactcattca

SEQ ID NO: 298315 - DNA, 20 bp, human
gagatgactcattcaaggtg

SEQ ID NO: 298316 - DNA, 20 bp, human
gcaaagttgaaacatctccc

SEQ ID NO: 298317 - DNA, 20 bp, human
gagacagctcatccaagagc

SEQ ID NO: 298318 - DNA, 20 bp, human
gtataaaagcccctctgtat

SEQ ID NO: 298319 - DNA, 20 bp, human
ggtgccaacacccctagtga

SEQ ID NO: 298320 - DNA, 20 bp, human
gtggggagaggatgtcaaga

SEQ ID NO: 298321 - DNA, 20 bp, human
gaaaaggtgtctgttgagtc

SEQ ID NO: 298322 - DNA, 20 bp, human
gaaagacatccgatacagag

SEQ ID NO: 298323 - DNA, 20 bp, human
gctctccccaaactgggtca

SEQ ID NO: 298324 - DNA, 20 bp, human
gcatctgattagcaggcttc

SEQ ID NO: 298325 - DNA, 20 bp, human
gggaaaggcctgcttcagtg

SEQ ID NO: 298326 - DNA, 20 bp, human
ggggaaaaaccctcagtaat

SEQ ID NO: 298327 - DNA, 20 bp, human
gggcgtcagcctattactga

SEQ ID NO: 298328 - DNA, 20 bp, human
ggcccggtacctttgaagac

SEQ ID NO: 298329 - DNA, 20 bp, human
gagtaataggctgacgccca

SEQ ID NO: 298330 - DNA, 20 bp, human
gaacctaaatctcttttatg

SEQ ID NO: 298331 - DNA, 20 bp, human
gaccgagccattattagtga

SEQ ID NO: 298332 - DNA, 20 bp, human
gaataatggctcggtatgcc

SEQ ID NO: 298333 - DNA, 20 bp, human
gtaactataaactgaaacat

SEQ ID NO: 298334 - DNA, 20 bp, human
gctgttctaccagtgactac

SEQ ID NO: 298335 - DNA, 20 bp, human
gttccagtcttcaaaggtac

SEQ ID NO: 298336 - DNA, 20 bp, human
gtaagagcgggaactcttaa

SEQ ID NO: 298337 - DNA, 20 bp, human
gagggtgccataaacaaaac

SEQ ID NO: 298338 - DNA, 20 bp, human
gagtaactcaaatgatgaac

SEQ ID NO: 298339 - DNA, 20 bp, human
gggaccaatgcccacttggg

SEQ ID NO: 298340 - DNA, 20 bp, human
gtacccataaaagtcatata

SEQ ID NO: 298341 - DNA, 20 bp, human
gagcaagcaaagtggtagaa

SEQ ID NO: 298342 - DNA, 20 bp, human
gttacagctgaattgtcact

SEQ ID NO: 298343 - DNA, 20 bp, human
gcaaagtggtagaatggtac

SEQ ID NO: 298344 - DNA, 20 bp, human
gaagtgggcattggtccaac

SEQ ID NO: 298345 - DNA, 20 bp, human
gaaaccttatatgactttta

SEQ ID NO: 298346 - DNA, 20 bp, human
gtggctggaccaactcccag

SEQ ID NO: 298347 - DNA, 20 bp, human
ggggagttggtccagccaag

SEQ ID NO: 298348 - DNA, 20 bp, human
gtacccttgctatttgtcac

SEQ ID NO: 298349 - DNA, 20 bp, human
gttccagtgacaaatagcaa

SEQ ID NO: 298350 - DNA, 20 bp, human
gtaaagcagcactggagagc

SEQ ID NO: 298351 - DNA, 20 bp, human
gaggaaagaagcctcttggc

SEQ ID NO: 298352 - DNA, 20 bp, human
gaatactttatcagacaaat

SEQ ID NO: 298353 - DNA, 20 bp, human
gtttcaacaccagccctgct

SEQ ID NO: 298354 - DNA, 20 bp, human
gatataataacagaaggctt

SEQ ID NO: 298355 - DNA, 20 bp, human
ggaccaactcccagtggaga

SEQ ID NO: 298356 - DNA, 20 bp, human
gtatcaagttagctaattgt

SEQ ID NO: 298357 - DNA, 20 bp, human
gctgtcacctgacaatcgac

SEQ ID NO: 298358 - DNA, 20 bp, human
gtgtgagacacacagttttc

SEQ ID NO: 298359 - DNA, 20 bp, human
gaaaatatctgtataaaagg

SEQ ID NO: 298360 - DNA, 20 bp, human
gtgtcaggtgacagatcact

SEQ ID NO: 298361 - DNA, 20 bp, human
ggggaaaatatctgtataaa

SEQ ID NO: 298362 - DNA, 20 bp, human
gactcatccagtcgattgtc

SEQ ID NO: 298363 - DNA, 20 bp, human
gagaaacatcatcccatttg

SEQ ID NO: 298364 - DNA, 20 bp, human
gtctcacagcagtcctcaaa

SEQ ID NO: 298365 - DNA, 20 bp, human
gcaaggaaatagcttttatg

SEQ ID NO: 298366 - DNA, 20 bp, human
gacagagtttagaacttctt

SEQ ID NO: 298367 - DNA, 20 bp, human
gggaagcactcatttgggga

SEQ ID NO: 298368 - DNA, 20 bp, human
gcccatgtgtgcatctcgga

SEQ ID NO: 298369 - DNA, 20 bp, human
gtgtgtgcatctcggatggt

SEQ ID NO: 298370 - DNA, 20 bp, human
gcaaggaaataatgatgtgg

SEQ ID NO: 298371 - DNA, 20 bp, human
gtctcggatggtcgggcaga

SEQ ID NO: 298372 - DNA, 20 bp, human
gcttgttattatttacctac

SEQ ID NO: 298373 - DNA, 20 bp, human
gcagacagcaatctgcaggt

SEQ ID NO: 298374 - DNA, 20 bp, human
gcatgattaatttttccagt

SEQ ID NO: 298375 - DNA, 20 bp, human
ggtggtggcaatgggccttc

SEQ ID NO: 298376 - DNA, 20 bp, human
gggatagctcagaatacaac

SEQ ID NO: 298377 - DNA, 20 bp, human
gcagaagacacatcagatga

SEQ ID NO: 298378 - DNA, 20 bp, human
gtattctgagctatccaatt

SEQ ID NO: 298379 - DNA, 20 bp, human
gttagatagttgtccttatc

SEQ ID NO: 298380 - DNA, 20 bp, human
ggaccagccacaaaattcaa

SEQ ID NO: 298381 - DNA, 20 bp, human
ggtgatgaaagattcatctt

SEQ ID NO: 298382 - DNA, 20 bp, human
gaggtaacttgtgtataata

SEQ ID NO: 298383 - DNA, 20 bp, human
gattattcacattgtcatag

SEQ ID NO: 298384 - DNA, 20 bp, human
gatctttggggggtgatagg

SEQ ID NO: 298385 - DNA, 20 bp, human
gtgaaagattcatctttggg

SEQ ID NO: 298386 - DNA, 20 bp, human
ggtaagagagacacaggagg

SEQ ID NO: 298387 - DNA, 20 bp, human
ggagacacaggaggtggttc

SEQ ID NO: 298388 - DNA, 20 bp, human
gagtcaccagaaagagtcaa

SEQ ID NO: 298389 - DNA, 20 bp, human
ggtcacatggctgctctagg

SEQ ID NO: 298390 - DNA, 20 bp, human
ggtcctaacacattagggaa

SEQ ID NO: 298391 - DNA, 20 bp, human
ggcacatagtatgtgcttac

SEQ ID NO: 298392 - DNA, 20 bp, human
ggtgagaacgagaacaccgt

SEQ ID NO: 298393 - DNA, 20 bp, human
gatgacatcaggccttagca

SEQ ID NO: 298394 - DNA, 20 bp, human
gtgggtcacaattcagagtg

SEQ ID NO: 298395 - DNA, 20 bp, human
gaacacatcatgactactct

SEQ ID NO: 298396 - DNA, 20 bp, human
gaactggggcagtatataag

SEQ ID NO: 298397 - DNA, 20 bp, human
gagaatcaaggaaaagtaga

SEQ ID NO: 298398 - DNA, 20 bp, human
gggtctagaagatgccatca

SEQ ID NO: 298399 - DNA, 20 bp, human
gacctgatagccctgtgtag

SEQ ID NO: 298400 - DNA, 20 bp, human
gtcagtgtggcctctggcct

SEQ ID NO: 298401 - DNA, 20 bp, human
gtccttgattctcaccttga

SEQ ID NO: 298402 - DNA, 20 bp, human
gtcattctggtactgggtac

SEQ ID NO: 298403 - DNA, 20 bp, human
gtatagtgacaacaggaaac

SEQ ID NO: 298404 - DNA, 20 bp, human
gtcctctacacagggctatc

SEQ ID NO: 298405 - DNA, 20 bp, human
gaactgactaaatctcattc

SEQ ID NO: 298406 - DNA, 20 bp, human
gtgctcagggctgatgtcat

SEQ ID NO: 298407 - DNA, 20 bp, human
gtgaagaatcctaacacacc

SEQ ID NO: 298408 - DNA, 20 bp, human
gaaaatgaggctgcagcaca

SEQ ID NO: 298409 - DNA, 20 bp, human
gtgcagcacatggtacctgc

SEQ ID NO: 298410 - DNA, 20 bp, human
gaagctgtgctttaatctca

SEQ ID NO: 298411 - DNA, 20 bp, human
ggaaggtttgaatgtgaaac

SEQ ID NO: 298412 - DNA, 20 bp, human
ggatgtcacatggcagctca

SEQ ID NO: 298413 - DNA, 20 bp, human
gagtcaccaaaagaaaatta

SEQ ID NO: 298414 - DNA, 20 bp, human
gtgggtcatgattcattgta

SEQ ID NO: 298415 - DNA, 20 bp, human
gagtagaacatctagaaaat

SEQ ID NO: 298416 - DNA, 20 bp, human
gaggtgtgaatcatgagaga

SEQ ID NO: 298417 - DNA, 20 bp, human
gggtctagaagatgctaccg

SEQ ID NO: 298418 - DNA, 20 bp, human
gcagctgggcagtatataag

SEQ ID NO: 298419 - DNA, 20 bp, human
gcatgaacagccctctgtgg

SEQ ID NO: 298420 - DNA, 20 bp, human
gaaaacccatctgctcagtg

SEQ ID NO: 298421 - DNA, 20 bp, human
ggtagtaccaacaagacagc

SEQ ID NO: 298422 - DNA, 20 bp, human
gctcgctattggtcactaga

SEQ ID NO: 298423 - DNA, 20 bp, human
gtactgcccagctgtcttgt

SEQ ID NO: 298424 - DNA, 20 bp, human
gactagagggaatgcataac

SEQ ID NO: 298425 - DNA, 20 bp, human
gaatgccacactgagcagat

SEQ ID NO: 298426 - DNA, 20 bp, human
ggactcatgtgggaacacca

SEQ ID NO: 298427 - DNA, 20 bp, human
gagaaacagacaagtgacag

SEQ ID NO: 298428 - DNA, 20 bp, human
ggggtatcatgtgacatggg

SEQ ID NO: 298429 - DNA, 20 bp, human
gaacaagaggtgactcatgt

SEQ ID NO: 298430 - DNA, 20 bp, human
gtctgggtatcatgtgacat

SEQ ID NO: 298431 - DNA, 20 bp, human
gattgggctaagatctctag

SEQ ID NO: 298432 - DNA, 20 bp, human
gtctcatcatgatatcgttt

SEQ ID NO: 298433 - DNA, 20 bp, human
gaatgcatgtgtcaatcagc

SEQ ID NO: 298434 - DNA, 20 bp, human
gtcacaaaggctcctcagct

SEQ ID NO: 298435 - DNA, 20 bp, human
gaatcagctggaatgctgac

SEQ ID NO: 298436 - DNA, 20 bp, human
gagtcatcttcattatagat

SEQ ID NO: 298437 - DNA, 20 bp, human
ggaaggactcattcgggaga

SEQ ID NO: 298438 - DNA, 20 bp, human
gcagggtataaaggaggcta

SEQ ID NO: 298439 - DNA, 20 bp, human
gccaagagagtgaagttctt

SEQ ID NO: 298440 - DNA, 20 bp, human
gtagaaggaaggactcattc

SEQ ID NO: 298441 - DNA, 20 bp, human
gcatgattaagttttccacg

SEQ ID NO: 298442 - DNA, 20 bp, human
gttgggtttggaagtcttct

SEQ ID NO: 298443 - DNA, 20 bp, human
ggtgtttccaatagaaacac

SEQ ID NO: 298444 - DNA, 20 bp, human
gttccacgaggtaaataata

SEQ ID NO: 298445 - DNA, 20 bp, human
gtaaggaaataatgacgtgg

SEQ ID NO: 298446 - DNA, 20 bp, human
gccatccgagatgcacacac

SEQ ID NO: 298447 - DNA, 20 bp, human
gaaagagtttagaacttgtt

SEQ ID NO: 298448 - DNA, 20 bp, human
gtgacaacgggccttcaggc

SEQ ID NO: 298449 - DNA, 20 bp, human
gggaaggactcatttgtgga

SEQ ID NO: 298450 - DNA, 20 bp, human
gtcattgtcaaagaacgtcc

SEQ ID NO: 298451 - DNA, 20 bp, human
gataatgacgtggtgacaac

SEQ ID NO: 298452 - DNA, 20 bp, human
ggtgtgcatctcggatggtc

SEQ ID NO: 298453 - DNA, 20 bp, human
gtctcggatggtcgggcaga

SEQ ID NO: 298454 - DNA, 20 bp, human
gacaaaggtgacccccacca

SEQ ID NO: 298455 - DNA, 20 bp, human
gtgctgtctgcaaataatgg

SEQ ID NO: 298456 - DNA, 20 bp, human
gagagagcaatctacaggta

SEQ ID NO: 298457 - DNA, 20 bp, human
gtatgcttcttgaatagttg

SEQ ID NO: 298458 - DNA, 20 bp, human
ggggagatggtcagatctca

SEQ ID NO: 298459 - DNA, 20 bp, human
gtcttgaatagttggggaga

SEQ ID NO: 298460 - DNA, 20 bp, human
gagtcatcttcattatagat

SEQ ID NO: 298461 - DNA, 20 bp, human
ggaaggactcattcgggaga

SEQ ID NO: 298462 - DNA, 20 bp, human
gactattcaagaagcataca

SEQ ID NO: 298463 - DNA, 20 bp, human
ggagcaatctacaggtaggg

SEQ ID NO: 298464 - DNA, 20 bp, human
gtagaaggaaggactcattc

SEQ ID NO: 298465 - DNA, 20 bp, human
gcatgattaagttttccacg

SEQ ID NO: 298466 - DNA, 20 bp, human
ggagcagcccatacaccaag

SEQ ID NO: 298467 - DNA, 20 bp, human
gggagaggctagacccttgg

SEQ ID NO: 298468 - DNA, 20 bp, human
gaatccgccccttggtgtat

SEQ ID NO: 298469 - DNA, 20 bp, human
gcagcctcacacatgaccct

SEQ ID NO: 298470 - DNA, 20 bp, human
gccaaggggcggatttctag

SEQ ID NO: 298471 - DNA, 20 bp, human
gaatctgtgtccagacttaa

SEQ ID NO: 298472 - DNA, 20 bp, human
gtctagaggaaacaagaaaa

SEQ ID NO: 298473 - DNA, 20 bp, human
gctgcccagggtcatgtgtg

SEQ ID NO: 298474 - DNA, 20 bp, human
gctgtgtccagacttaatgg

SEQ ID NO: 298475 - DNA, 20 bp, human
gtgggggcctccattaagtc

SEQ ID NO: 298476 - DNA, 20 bp, human
gataggggccaaaacaaacg

SEQ ID NO: 298477 - DNA, 20 bp, human
gttactgggggagttaacac

SEQ ID NO: 298478 - DNA, 20 bp, human
ggagttgaggttttaattat

SEQ ID NO: 298479 - DNA, 20 bp, human
ggtaaaattaatattactgg

SEQ ID NO: 298480 - DNA, 20 bp, human
gtaaaggaaagaggttagaa

SEQ ID NO: 298481 - DNA, 20 bp, human
gagatttcaaaagttatcca

SEQ ID NO: 298482 - DNA, 20 bp, human
gcagatgtcaggcaggacac

SEQ ID NO: 298483 - DNA, 20 bp, human
gcaagaagtaccagacagcc

SEQ ID NO: 298484 - DNA, 20 bp, human
gataccagtctcagctttct

SEQ ID NO: 298485 - DNA, 20 bp, human
gtacttcttgcaaagctcca

SEQ ID NO: 298486 - DNA, 20 bp, human
gttatctggagggatagaca

SEQ ID NO: 298487 - DNA, 20 bp, human
gacctgtccagaggtcaggg

SEQ ID NO: 298488 - DNA, 20 bp, human
gagaggtcagggaggacgca

SEQ ID NO: 298489 - DNA, 20 bp, human
gcctcagctccaggctggtc

SEQ ID NO: 298490 - DNA, 20 bp, human
gtgtatcctggagatggatt

SEQ ID NO: 298491 - DNA, 20 bp, human
gttatcatgtatcctggaga

SEQ ID NO: 298492 - DNA, 20 bp, human
ggtgtttcctataaagacca

SEQ ID NO: 298493 - DNA, 20 bp, human
gtctttattatcatgtatcc

SEQ ID NO: 298494 - DNA, 20 bp, human
gtatacctgtccagaggtca

SEQ ID NO: 298495 - DNA, 20 bp, human
gaaaattaatattatctgga

SEQ ID NO: 298496 - DNA, 20 bp, human
gggcatgagtataaagatcg

SEQ ID NO: 298497 - DNA, 20 bp, human
gatgccagtctcagctttcc

SEQ ID NO: 298498 - DNA, 20 bp, human
ggtaaaattaatattattga

SEQ ID NO: 298499 - DNA, 20 bp, human
gtaaaggaaagaggttagaa

SEQ ID NO: 298500 - DNA, 20 bp, human
gaagaggttagaatggctca

SEQ ID NO: 298501 - DNA, 20 bp, human
gcaggaagaaccagacagcc

SEQ ID NO: 298502 - DNA, 20 bp, human
gtttgctagtgacttccttc

SEQ ID NO: 298503 - DNA, 20 bp, human
ggatgctcaactgagccaga

SEQ ID NO: 298504 - DNA, 20 bp, human
gttattgagggagtcaacac

SEQ ID NO: 298505 - DNA, 20 bp, human
gagatgtcaggcatgacaca

SEQ ID NO: 298506 - DNA, 20 bp, human
gtggttgcttggccgaaggg

SEQ ID NO: 298507 - DNA, 20 bp, human
gaagggtggaccattgtcct

SEQ ID NO: 298508 - DNA, 20 bp, human
gcctgggacacccactggag

SEQ ID NO: 298509 - DNA, 20 bp, human
gcggtggttgcttggccgaa

SEQ ID NO: 298510 - DNA, 20 bp, human
gccattgtccttggtgctca

SEQ ID NO: 298511 - DNA, 20 bp, human
gtgaaagaaaggctgtctat

SEQ ID NO: 298512 - DNA, 20 bp, human
gtatacttgaagtttttaag

SEQ ID NO: 298513 - DNA, 20 bp, human
gtatatcaaggatggtcatt

SEQ ID NO: 298514 - DNA, 20 bp, human
gttggtgtttatatcaagga

SEQ ID NO: 298515 - DNA, 20 bp, human
ggccaaaccgcaggaggaag

SEQ ID NO: 298516 - DNA, 20 bp, human
gacaaggtccagttccaagg

SEQ ID NO: 298517 - DNA, 20 bp, human
gctggacttcgggttctcat

SEQ ID NO: 298518 - DNA, 20 bp, human
gatcctctgcccatcacatg

SEQ ID NO: 298519 - DNA, 20 bp, human
gtctcagagcaaccctaccc

SEQ ID NO: 298520 - DNA, 20 bp, human
gaggtgatcagttcagtaca

SEQ ID NO: 298521 - DNA, 20 bp, human
gtagggttgctctgagacct

SEQ ID NO: 298522 - DNA, 20 bp, human
gccgccagcctcaggtcgtg

SEQ ID NO: 298523 - DNA, 20 bp, human
gtatttgtttgctggacttc

SEQ ID NO: 298524 - DNA, 20 bp, human
ggcaccccacgacctgaggc

SEQ ID NO: 298525 - DNA, 20 bp, human
gcaggaagtgctgggaatga

SEQ ID NO: 298526 - DNA, 20 bp, human
gcggggccagtgtttactga

SEQ ID NO: 298527 - DNA, 20 bp, human
gggaaagggaaactcaccgc

SEQ ID NO: 298528 - DNA, 20 bp, human
ggtgacaagaaggaagcgat

SEQ ID NO: 298529 - DNA, 20 bp, human
gagaaaagtgcgaggaaaac

SEQ ID NO: 298530 - DNA, 20 bp, human
gcccgcagaggaatcttccc

SEQ ID NO: 298531 - DNA, 20 bp, human
gcacattcgagaaaagtgcg

SEQ ID NO: 298532 - DNA, 20 bp, human
gtctcacctgaccctggaca

SEQ ID NO: 298533 - DNA, 20 bp, human
gagaggccttggtcttgccg

SEQ ID NO: 298534 - DNA, 20 bp, human
gcaggcagtggctcgctcag

SEQ ID NO: 298535 - DNA, 20 bp, human
gaagagaatactgggaccag

SEQ ID NO: 298536 - DNA, 20 bp, human
ggggccttgtcatttttcag

SEQ ID NO: 298537 - DNA, 20 bp, human
gcagcatcacacctgatcct

SEQ ID NO: 298538 - DNA, 20 bp, human
gtccgctttaaggctcccgt

SEQ ID NO: 298539 - DNA, 20 bp, human
gtgtttgtgccatttcctta

SEQ ID NO: 298540 - DNA, 20 bp, human
gataacaaatggcccccaac

SEQ ID NO: 298541 - DNA, 20 bp, human
gggcaccaatgtccgcttta

SEQ ID NO: 298542 - DNA, 20 bp, human
gttgcccttactaacacaga

SEQ ID NO: 298543 - DNA, 20 bp, human
gggagccttaaagcggacat

SEQ ID NO: 298544 - DNA, 20 bp, human
gcattggtgcctcgcggttc

SEQ ID NO: 298545 - DNA, 20 bp, human
gagtaagggcaacgggagca

SEQ ID NO: 298546 - DNA, 20 bp, human
gctgtattgtgcctgacctc

SEQ ID NO: 298547 - DNA, 20 bp, human
gtataaaggaaaggttagaa

SEQ ID NO: 298548 - DNA, 20 bp, human
gagcaatgcaaaactgagaa

SEQ ID NO: 298549 - DNA, 20 bp, human
ggtgaaattaatattcctgg

SEQ ID NO: 298550 - DNA, 20 bp, human
gttcctgtgttgactccccc

SEQ ID NO: 298551 - DNA, 20 bp, human
ggaaaggttagaatggctca

SEQ ID NO: 298552 - DNA, 20 bp, human
gaatgtgaaattaatattcc

SEQ ID NO: 298553 - DNA, 20 bp, human
gtagatttcaaaattatcca

SEQ ID NO: 298554 - DNA, 20 bp, human
ggtaggggccaaaacaaata

SEQ ID NO: 298555 - DNA, 20 bp, human
ggatgagagcacgtgggcaa

SEQ ID NO: 298556 - DNA, 20 bp, human
gcaagccaccaccgtctccc

SEQ ID NO: 298557 - DNA, 20 bp, human
gtggagctgatggcggctca

SEQ ID NO: 298558 - DNA, 20 bp, human
gacggtggtggcttggccag

SEQ ID NO: 298559 - DNA, 20 bp, human
ggaaagaaaaggctgtctat

SEQ ID NO: 298560 - DNA, 20 bp, human
gaggaaaatggtccacccgc

SEQ ID NO: 298561 - DNA, 20 bp, human
ggcattggtgtttatatcaa

SEQ ID NO: 298562 - DNA, 20 bp, human
gccaccgcttaaaaatttcc

SEQ ID NO: 298563 - DNA, 20 bp, human
gttggtgtttatatcaacgg

SEQ ID NO: 298564 - DNA, 20 bp, human
gccattttccttggcgctca

SEQ ID NO: 298565 - DNA, 20 bp, human
gaacacagttttgaagagcg

SEQ ID NO: 298566 - DNA, 20 bp, human
gctagcaacaccagcctccg

SEQ ID NO: 298567 - DNA, 20 bp, human
gtctgcaggagaagaagctg

SEQ ID NO: 298568 - DNA, 20 bp, human
ggcaatacatgaatgatctc

SEQ ID NO: 298569 - DNA, 20 bp, human
gcggaaccctgcatgagcat

SEQ ID NO: 298570 - DNA, 20 bp, human
gtgacccagtcctgccaaga

SEQ ID NO: 298571 - DNA, 20 bp, human
ggtagagagtggcactgctc

SEQ ID NO: 298572 - DNA, 20 bp, human
ggggggaatcagcaggaatc

SEQ ID NO: 298573 - DNA, 20 bp, human
gcccaggaagaataagagtt

SEQ ID NO: 298574 - DNA, 20 bp, human
gaggactgggtcaatgttgt

SEQ ID NO: 298575 - DNA, 20 bp, human
gcctgcatgagcatggggga

SEQ ID NO: 298576 - DNA, 20 bp, human
gcatacacaagtcatgccat

SEQ ID NO: 298577 - DNA, 20 bp, human
gggtccttcaaattagccaa

SEQ ID NO: 298578 - DNA, 20 bp, human
gtataaaaggccctctgcag

SEQ ID NO: 298579 - DNA, 20 bp, human
gtggagaaactcaagctcaa

SEQ ID NO: 298580 - DNA, 20 bp, human
gtcttgccataaaggctggt

SEQ ID NO: 298581 - DNA, 20 bp, human
gataaaggctggttggaaaa

SEQ ID NO: 298582 - DNA, 20 bp, human
gttatatgcctcagtgtggg

SEQ ID NO: 298583 - DNA, 20 bp, human
ggaagctgagtgacactttc

SEQ ID NO: 298584 - DNA, 20 bp, human
gtgcacaaatgtttcagatg

SEQ ID NO: 298585 - DNA, 20 bp, human
ggactcttggttttcaatcg

SEQ ID NO: 298586 - DNA, 20 bp, human
ggctccccttatctgattga

SEQ ID NO: 298587 - DNA, 20 bp, human
ggagccctcaatcagataag

SEQ ID NO: 298588 - DNA, 20 bp, human
gtgctgcagaggtattaagg

SEQ ID NO: 298589 - DNA, 20 bp, human
gagcagaggtagcataccac

SEQ ID NO: 298590 - DNA, 20 bp, human
gtaatgctgcagaggtatta

SEQ ID NO: 298591 - DNA, 20 bp, human
gttgtttggccttgcaattt

SEQ ID NO: 298592 - DNA, 20 bp, human
gtaaggaggcttgttttgtt

SEQ ID NO: 298593 - DNA, 20 bp, human
gttgtaagataatgctgcag

SEQ ID NO: 298594 - DNA, 20 bp, human
gcaaaagagtacaattaatt

SEQ ID NO: 298595 - DNA, 20 bp, human
gaagtccttttatatgcctc

SEQ ID NO: 298596 - DNA, 20 bp, human
gaaatcagagagatacgtaa

SEQ ID NO: 298597 - DNA, 20 bp, human
gataaatggaggagagtagc

SEQ ID NO: 298598 - DNA, 20 bp, human
gtggccattaaaagtctctc

SEQ ID NO: 298599 - DNA, 20 bp, human
ggagcattatagataaatgg

SEQ ID NO: 298600 - DNA, 20 bp, human
gtcagtaagtgcagaggcca

SEQ ID NO: 298601 - DNA, 20 bp, human
gaacttctcagcacaatgaa

SEQ ID NO: 298602 - DNA, 20 bp, human
gtatggacacttctccgcag

SEQ ID NO: 298603 - DNA, 20 bp, human
gcattaagttcagttactgg

SEQ ID NO: 298604 - DNA, 20 bp, human
gttacattaagttcagttac

SEQ ID NO: 298605 - DNA, 20 bp, human
gcaggttacaatgagacaga

SEQ ID NO: 298606 - DNA, 20 bp, human
gaagaacagtagttaaacta

SEQ ID NO: 298607 - DNA, 20 bp, human
ggcgtgtcaagcatggtcac

SEQ ID NO: 298608 - DNA, 20 bp, human
gtcttcccactaatttgcat

SEQ ID NO: 298609 - DNA, 20 bp, human
gtctgtacccattaactagt

SEQ ID NO: 298610 - DNA, 20 bp, human
gcacatgggtgaatttcaag

SEQ ID NO: 298611 - DNA, 20 bp, human
gttcaaaagacctcaatata

SEQ ID NO: 298612 - DNA, 20 bp, human
gagctaaactaaaaaagctt

SEQ ID NO: 298613 - DNA, 20 bp, human
ggacaatgttgcaaaacatt

SEQ ID NO: 298614 - DNA, 20 bp, human
gttagtttagctatgtcagt

SEQ ID NO: 298615 - DNA, 20 bp, human
gtgtataccaactagttaat

SEQ ID NO: 298616 - DNA, 20 bp, human
gctctcgtgtgatgcaatac

SEQ ID NO: 298617 - DNA, 20 bp, human
ggcttatgatgtctttacag

SEQ ID NO: 298618 - DNA, 20 bp, human
gcctgcttacagagttatat

SEQ ID NO: 298619 - DNA, 20 bp, human
gacagagtgctttgaagtcc

SEQ ID NO: 298620 - DNA, 20 bp, human
gtttcaccacccaccagagc

SEQ ID NO: 298621 - DNA, 20 bp, human
gatatgaaagacaagtgcaa

SEQ ID NO: 298622 - DNA, 20 bp, human
gaaaagagaatccttgaagc

SEQ ID NO: 298623 - DNA, 20 bp, human
ggaatttcaactgtgtgttg

SEQ ID NO: 298624 - DNA, 20 bp, human
gtatatatcccagctctggt

SEQ ID NO: 298625 - DNA, 20 bp, human
gtggaaattcagagagcaag

SEQ ID NO: 298626 - DNA, 20 bp, human
gtgtgccaaacccattctca

SEQ ID NO: 298627 - DNA, 20 bp, human
gtccaccctgagaatgggtt

SEQ ID NO: 298628 - DNA, 20 bp, human
gatgctggaccagcaaacag

SEQ ID NO: 298629 - DNA, 20 bp, human
gctgcaccagatcattttat

SEQ ID NO: 298630 - DNA, 20 bp, human
gtggtccagcatatgggtaa

SEQ ID NO: 298631 - DNA, 20 bp, human
gtgaagttatagtgaaggag

SEQ ID NO: 298632 - DNA, 20 bp, human
ggtgtccaccttcacagcta

SEQ ID NO: 298633 - DNA, 20 bp, human
gcaccttcacagctaaggtc

SEQ ID NO: 298634 - DNA, 20 bp, human
ggccaaacccattctcaggg

SEQ ID NO: 298635 - DNA, 20 bp, human
ggttatagtgaaggagagga

SEQ ID NO: 298636 - DNA, 20 bp, human
gtccctgggcaattccctat

SEQ ID NO: 298637 - DNA, 20 bp, human
gttaaggaacacttcgtccc

SEQ ID NO: 298638 - DNA, 20 bp, human
gaaaggtccagatactagaa

SEQ ID NO: 298639 - DNA, 20 bp, human
gttgggaaccagtgtataaa

SEQ ID NO: 298640 - DNA, 20 bp, human
gagaagattcataacactta

SEQ ID NO: 298641 - DNA, 20 bp, human
gatacactggttcccaaatc

SEQ ID NO: 298642 - DNA, 20 bp, human
gaacctatagggaattgccc

SEQ ID NO: 298643 - DNA, 20 bp, human
gatgacccccttctagtatc

SEQ ID NO: 298644 - DNA, 20 bp, human
ggctcattggttccagattt

SEQ ID NO: 298645 - DNA, 20 bp, human
gccaatgagcagaattttcc

SEQ ID NO: 298646 - DNA, 20 bp, human
ggacaatcgcaaagggagta

SEQ ID NO: 298647 - DNA, 20 bp, human
gtgatagttcctggtgatcc

SEQ ID NO: 298648 - DNA, 20 bp, human
gatctgcttcccggatcacc

SEQ ID NO: 298649 - DNA, 20 bp, human
ggagagaactatctgcttcc

SEQ ID NO: 298650 - DNA, 20 bp, human
gcagacttttgtgggtaaat

SEQ ID NO: 298651 - DNA, 20 bp, human
ggggtaaataggcttggtgc

SEQ ID NO: 298652 - DNA, 20 bp, human
ggatgcattgaatccgtgcc

SEQ ID NO: 298653 - DNA, 20 bp, human
gataggcttggtgccgggca

SEQ ID NO: 298654 - DNA, 20 bp, human
gttttgtgggtaaataggct

SEQ ID NO: 298655 - DNA, 20 bp, human
gctacatacagtcaaccatg

SEQ ID NO: 298656 - DNA, 20 bp, human
ggacagttcctgttgatccg

SEQ ID NO: 298657 - DNA, 20 bp, human
gtatgaaccttttaaactaa

SEQ ID NO: 298658 - DNA, 20 bp, human
gctgttgatccggggggctc

SEQ ID NO: 298659 - DNA, 20 bp, human
gcagttctttgaatgtcact

SEQ ID NO: 298660 - DNA, 20 bp, human
gattaaacccttagtttaaa

SEQ ID NO: 298661 - DNA, 20 bp, human
gtgaaagacacagatgatgt

SEQ ID NO: 298662 - DNA, 20 bp, human
gtgaatgtcacttgggaaga

SEQ ID NO: 298663 - DNA, 20 bp, human
gttgttttccacagtccatt

SEQ ID NO: 298664 - DNA, 20 bp, human
gtttggtgggtgaatagtct

SEQ ID NO: 298665 - DNA, 20 bp, human
ggggctcaggaagttctctc

SEQ ID NO: 298666 - DNA, 20 bp, human
gcaaagaactgaaagacagg

SEQ ID NO: 298667 - DNA, 20 bp, human
gttgagaatcacaaacggac

SEQ ID NO: 298668 - DNA, 20 bp, human
gaacaatgtaaacggaaaca

SEQ ID NO: 298669 - DNA, 20 bp, human
gcagttctttgaacatcact

SEQ ID NO: 298670 - DNA, 20 bp, human
gactgggaaaacaatgtaaa

SEQ ID NO: 298671 - DNA, 20 bp, human
gaactgaaagacaggtggtg

SEQ ID NO: 298672 - DNA, 20 bp, human
ggttcaaagaactgaaagac

SEQ ID NO: 298673 - DNA, 20 bp, human
gtgaacatcacttgggaaga

SEQ ID NO: 298674 - DNA, 20 bp, human
gaccagatgatggtcagaac

SEQ ID NO: 298675 - DNA, 20 bp, human
gtttggtgggtgactagtct

SEQ ID NO: 298676 - DNA, 20 bp, human
gtagttcctggtgactgggg

SEQ ID NO: 298677 - DNA, 20 bp, human
gtctgcccagtctcatcctt

SEQ ID NO: 298678 - DNA, 20 bp, human
gtggaagagacaggtaaagt

SEQ ID NO: 298679 - DNA, 20 bp, human
gcaagaggcttttatagaac

SEQ ID NO: 298680 - DNA, 20 bp, human
gccaaagattcataacattt

SEQ ID NO: 298681 - DNA, 20 bp, human
gctatcacatgacgagatgc

SEQ ID NO: 298682 - DNA, 20 bp, human
gtgaacaccctcttcccaag

SEQ ID NO: 298683 - DNA, 20 bp, human
ggtgaattgaatccatgctt

SEQ ID NO: 298684 - DNA, 20 bp, human
gagtctgattcaagactgat

SEQ ID NO: 298685 - DNA, 20 bp, human
gataaaagcctcttgggaag

SEQ ID NO: 298686 - DNA, 20 bp, human
gggtgaacagtcttgaacat

SEQ ID NO: 298687 - DNA, 20 bp, human
gtgatagttcctggtgacca

SEQ ID NO: 298688 - DNA, 20 bp, human
gtagttcctggtgaccaggg

SEQ ID NO: 298689 - DNA, 20 bp, human
gtcattctttggttgtatgt

SEQ ID NO: 298690 - DNA, 20 bp, human
ggagaatcatgattctgata

SEQ ID NO: 298691 - DNA, 20 bp, human
gtcccaagtgactttgatgg

SEQ ID NO: 298692 - DNA, 20 bp, human
gatcaaagtcacttgggaaa

SEQ ID NO: 298693 - DNA, 20 bp, human
gacagtcttgaacataggca

SEQ ID NO: 298694 - DNA, 20 bp, human
ggtgaaagacacaggtggtg

SEQ ID NO: 298695 - DNA, 20 bp, human
gtgatggaggtgaaagacac

SEQ ID NO: 298696 - DNA, 20 bp, human
ggagaatcacaaacggactg

SEQ ID NO: 298697 - DNA, 20 bp, human
gactagatgatggtcagaat

SEQ ID NO: 298698 - DNA, 20 bp, human
gtcaaataacggaaaggcac

SEQ ID NO: 298699 - DNA, 20 bp, human
gtgacgttcaaataacggaa

SEQ ID NO: 298700 - DNA, 20 bp, human
ggaatccatgcctgggccca

SEQ ID NO: 298701 - DNA, 20 bp, human
gaataacggaaaggcacagg

SEQ ID NO: 298702 - DNA, 20 bp, human
gggaggctcaggaagctctc

SEQ ID NO: 298703 - DNA, 20 bp, human
gaaggcacaggtggtgaggg

SEQ ID NO: 298704 - DNA, 20 bp, human
gcggaaaggcacaggtggtg

SEQ ID NO: 298705 - DNA, 20 bp, human
gtgaacgtcacttgggaaga

SEQ ID NO: 298706 - DNA, 20 bp, human
ggacagttcctgttgatccg

SEQ ID NO: 298707 - DNA, 20 bp, human
gtatgaaccttttaaactaa

SEQ ID NO: 298708 - DNA, 20 bp, human
gctgttgatccggggggctc

SEQ ID NO: 298709 - DNA, 20 bp, human
gcagttctttgaatgtcact

SEQ ID NO: 298710 - DNA, 20 bp, human
gattaaacccttagtttaaa

SEQ ID NO: 298711 - DNA, 20 bp, human
gtgaaagacacagatgatgt

SEQ ID NO: 298712 - DNA, 20 bp, human
gtgaatgtcacttgggaaga

SEQ ID NO: 298713 - DNA, 20 bp, human
gttgttttccacagtccatt

SEQ ID NO: 298714 - DNA, 20 bp, human
gtttggtgggtgaatagtct

SEQ ID NO: 298715 - DNA, 20 bp, human
ggggctcaggaagttctctc

SEQ ID NO: 298716 - DNA, 20 bp, human
gggaggaaataatgcgtcga

SEQ ID NO: 298717 - DNA, 20 bp, human
ggcggggcatgatgggtaac

SEQ ID NO: 298718 - DNA, 20 bp, human
gcccgctcccggtggaaccc

SEQ ID NO: 298719 - DNA, 20 bp, human
gatgggtaacaggaccggtg

SEQ ID NO: 298720 - DNA, 20 bp, human
gctcacgggcggggcatgat

SEQ ID NO: 298721 - DNA, 20 bp, human
ggcatcctcggccaccgccc

SEQ ID NO: 298722 - DNA, 20 bp, human
ggcagcgccctcttgcgaca

SEQ ID NO: 298723 - DNA, 20 bp, human
gcggcgcctctggccaagaa

SEQ ID NO: 298724 - DNA, 20 bp, human
ggcatgatgggtaacaggac

SEQ ID NO: 298725 - DNA, 20 bp, human
gccccgcccgtgagtccaac

SEQ ID NO: 298726 - DNA, 20 bp, human
ggggccgggcccaggtacag

SEQ ID NO: 298727 - DNA, 20 bp, human
gccagcgggattgtagaatt

SEQ ID NO: 298728 - DNA, 20 bp, human
gccgctccccctggcgggaa

SEQ ID NO: 298729 - DNA, 20 bp, human
gcggaggcggggcccaggtt

SEQ ID NO: 298730 - DNA, 20 bp, human
gcccaggtgggagggggacc

SEQ ID NO: 298731 - DNA, 20 bp, human
ggcaactgaggcgaatcgaa

SEQ ID NO: 298732 - DNA, 20 bp, human
gtaaacaaagtgcagagggg

SEQ ID NO: 298733 - DNA, 20 bp, human
gcccaggtacagcggccctg

SEQ ID NO: 298734 - DNA, 20 bp, human
ggagggctgcagcacgtcca

SEQ ID NO: 298735 - DNA, 20 bp, human
gcgaatcgaatggcccccca

SEQ ID NO: 298736 - DNA, 20 bp, human
ggggtgggcgacaagatctg

SEQ ID NO: 298737 - DNA, 20 bp, human
ggggtctcttcatgcagatg

SEQ ID NO: 298738 - DNA, 20 bp, human
gccacccccggggctctggg

SEQ ID NO: 298739 - DNA, 20 bp, human
ggagaaatccgaggcaaatg

SEQ ID NO: 298740 - DNA, 20 bp, human
gatcttgtcgcccacccccg

SEQ ID NO: 298741 - DNA, 20 bp, human
ggtggaaggtaacactgcaa

SEQ ID NO: 298742 - DNA, 20 bp, human
ggactgttcctcatttgcct

SEQ ID NO: 298743 - DNA, 20 bp, human
gatctgggggtgagtcagtg

SEQ ID NO: 298744 - DNA, 20 bp, human
gacctgtccctccaagggat

SEQ ID NO: 298745 - DNA, 20 bp, human
gggtaccactgccaatccct

SEQ ID NO: 298746 - DNA, 20 bp, human
ggcgcggtccggggccccga

SEQ ID NO: 298747 - DNA, 20 bp, human
gcacccggggctcccggttg

SEQ ID NO: 298748 - DNA, 20 bp, human
gcccccaggcgccgagagtc

SEQ ID NO: 298749 - DNA, 20 bp, human
ggtgagggccggccccaacc

SEQ ID NO: 298750 - DNA, 20 bp, human
ggcgcggagcagctccaccc

SEQ ID NO: 298751 - DNA, 20 bp, human
gtgggggacggaggcggacg

SEQ ID NO: 298752 - DNA, 20 bp, human
gcgcggcgaggcaggcggtg

SEQ ID NO: 298753 - DNA, 20 bp, human
gggccccaaccgggagcccc

SEQ ID NO: 298754 - DNA, 20 bp, human
gcccccgactctcggcgcct

SEQ ID NO: 298755 - DNA, 20 bp, human
gcacacccgccgggcgtcca

SEQ ID NO: 298756 - DNA, 20 bp, human
gcgcgccagggacccgtcgg

SEQ ID NO: 298757 - DNA, 20 bp, human
gcggcgcgccagggacccgt

SEQ ID NO: 298758 - DNA, 20 bp, human
ggccagggacccgtcggagg

SEQ ID NO: 298759 - DNA, 20 bp, human
ggactcgcgcacctggccgg

SEQ ID NO: 298760 - DNA, 20 bp, human
ggcctcctccgacgggtccc

SEQ ID NO: 298761 - DNA, 20 bp, human
gcgagcaagcgagcgatcgg

SEQ ID NO: 298762 - DNA, 20 bp, human
gccggggggcgggatttcta

SEQ ID NO: 298763 - DNA, 20 bp, human
gagggatggagaccaagcga

SEQ ID NO: 298764 - DNA, 20 bp, human
ggaggcgtcggcgtgaacct

SEQ ID NO: 298765 - DNA, 20 bp, human
ggacaggcaagatgtcggtg

SEQ ID NO: 298766 - DNA, 20 bp, human
gggaagatcacattctcctg

SEQ ID NO: 298767 - DNA, 20 bp, human
gcacgagcggcatcctctca

SEQ ID NO: 298768 - DNA, 20 bp, human
gacgcgtacaacccggaagt

SEQ ID NO: 298769 - DNA, 20 bp, human
gcctctcagggagcgaccat

SEQ ID NO: 298770 - DNA, 20 bp, human
gttctgagaaagctgaacct

SEQ ID NO: 298771 - DNA, 20 bp, human
gttctacgccagctaggccc

SEQ ID NO: 298772 - DNA, 20 bp, human
ggaagagcagtttgcacttc

SEQ ID NO: 298773 - DNA, 20 bp, human
gacagaccctcttgtttcta

SEQ ID NO: 298774 - DNA, 20 bp, human
ggagggtctgtaaaagtcaa

SEQ ID NO: 298775 - DNA, 20 bp, human
gaccgcgctgcgccaacttc

SEQ ID NO: 298776 - DNA, 20 bp, human
gagcgagtaccggagcgcgt

SEQ ID NO: 298777 - DNA, 20 bp, human
ggggccgaaggtggacgctc

SEQ ID NO: 298778 - DNA, 20 bp, human
ggcggggctactgaacgcag

SEQ ID NO: 298779 - DNA, 20 bp, human
gggtactcgctgctcgcggc

SEQ ID NO: 298780 - DNA, 20 bp, human
gtccaccttcggcccagctg

SEQ ID NO: 298781 - DNA, 20 bp, human
gaaagcccggaatcccgagc

SEQ ID NO: 298782 - DNA, 20 bp, human
gccgctctcccctgtcccga

SEQ ID NO: 298783 - DNA, 20 bp, human
ggcccctgagcgtccacctt

SEQ ID NO: 298784 - DNA, 20 bp, human
gctggccggctcgggattcc

SEQ ID NO: 298785 - DNA, 20 bp, human
gcccttaaagggacagccgc

SEQ ID NO: 298786 - DNA, 20 bp, human
gctgacctacaaatctaaac

SEQ ID NO: 298787 - DNA, 20 bp, human
gctaacctgtttagatttgt

SEQ ID NO: 298788 - DNA, 20 bp, human
gaaaacctaaatagggaaga

SEQ ID NO: 298789 - DNA, 20 bp, human
gtatcagcctcatgatgcag

SEQ ID NO: 298790 - DNA, 20 bp, human
gtcatgaggctgatagtcac

SEQ ID NO: 298791 - DNA, 20 bp, human
gactacacgtgaaaataagg

SEQ ID NO: 298792 - DNA, 20 bp, human
ggatgcagtgggatctatca

SEQ ID NO: 298793 - DNA, 20 bp, human
gtaccaaaagtggatatttc

SEQ ID NO: 298794 - DNA, 20 bp, human
gatcctataaaacctaaata

SEQ ID NO: 298795 - DNA, 20 bp, human
gactactacacgtgaaaata

SEQ ID NO: 298796 - DNA, 20 bp, human
gaagcggcccggaagaagga

SEQ ID NO: 298797 - DNA, 20 bp, human
gagacggagcttcagctcgt

SEQ ID NO: 298798 - DNA, 20 bp, human
gttgaaagcggcccggaaga

SEQ ID NO: 298799 - DNA, 20 bp, human
gggaaagggcggggcttaga

SEQ ID NO: 298800 - DNA, 20 bp, human
gtgggcttctggaaatacgc

SEQ ID NO: 298801 - DNA, 20 bp, human
ggtcacgacaggaaagggcg

SEQ ID NO: 298802 - DNA, 20 bp, human
gccgggccgctttcaagcct

SEQ ID NO: 298803 - DNA, 20 bp, human
ggcgtgcgttaagtcacgac

SEQ ID NO: 298804 - DNA, 20 bp, human
gccacgcgcgctcgcaggat

SEQ ID NO: 298805 - DNA, 20 bp, human
ggcgtggcggggacgtaccc

SEQ ID NO: 298806 - DNA, 20 bp, human
gcctcccaggcgggccctaa

SEQ ID NO: 298807 - DNA, 20 bp, human
ggggcgctaccctaatgaag

SEQ ID NO: 298808 - DNA, 20 bp, human
gccctcgccctctcccgtgt

SEQ ID NO: 298809 - DNA, 20 bp, human
gcgggccctaatggcgtgtt

SEQ ID NO: 298810 - DNA, 20 bp, human
ggaaccctccggagaccgtg

SEQ ID NO: 298811 - DNA, 20 bp, human
gcatccccacggtctccgga

SEQ ID NO: 298812 - DNA, 20 bp, human
gcccggggatttcctttcaa

SEQ ID NO: 298813 - DNA, 20 bp, human
gatggccccggtgcaggtca

SEQ ID NO: 298814 - DNA, 20 bp, human
gcgccctgcggctccagcgg

SEQ ID NO: 298815 - DNA, 20 bp, human
gtctccggagggttctcgag

SEQ ID NO: 298816 - DNA, 20 bp, human
gggaaagaagccctcactgg

SEQ ID NO: 298817 - DNA, 20 bp, human
gggagattaccgattggtta

SEQ ID NO: 298818 - DNA, 20 bp, human
gtaccgattggttaggggag

SEQ ID NO: 298819 - DNA, 20 bp, human
ggtggctggagattaccgat

SEQ ID NO: 298820 - DNA, 20 bp, human
gtaaagagcaaagttgcctc

SEQ ID NO: 298821 - DNA, 20 bp, human
gcctcagtgtatttgaagga

SEQ ID NO: 298822 - DNA, 20 bp, human
gagaccaactcatcagttca

SEQ ID NO: 298823 - DNA, 20 bp, human
gaatgccagagcctccagtg

SEQ ID NO: 298824 - DNA, 20 bp, human
gttcctctcccctaaccaat

SEQ ID NO: 298825 - DNA, 20 bp, human
ggacccctgaactgatgagt

SEQ ID NO: 298826 - DNA, 20 bp, human
gtgccagccgagcgcggctt

SEQ ID NO: 298827 - DNA, 20 bp, human
gccctggtgccagccgagcg

SEQ ID NO: 298828 - DNA, 20 bp, human
gaccaggggctagggtgcgg

SEQ ID NO: 298829 - DNA, 20 bp, human
gctcccggagtgggctgccc

SEQ ID NO: 298830 - DNA, 20 bp, human
gcccgccgcaccctagcccc

SEQ ID NO: 298831 - DNA, 20 bp, human
gggggtctggcgggacccgt

SEQ ID NO: 298832 - DNA, 20 bp, human
gtggcgggacccgtcggctg

SEQ ID NO: 298833 - DNA, 20 bp, human
gcccgcagaccgggagtctc

SEQ ID NO: 298834 - DNA, 20 bp, human
gagcgggctcccttgcgctg

SEQ ID NO: 298835 - DNA, 20 bp, human
gcgagcgcggcttgggctgg

SEQ ID NO: 298836 - DNA, 20 bp, human
gggaaggcagctggcaggaa

SEQ ID NO: 298837 - DNA, 20 bp, human
gaggggttgcactcatgagt

SEQ ID NO: 298838 - DNA, 20 bp, human
gatgcacaggggagctgatg

SEQ ID NO: 298839 - DNA, 20 bp, human
gagctgatggggcaacaagt

SEQ ID NO: 298840 - DNA, 20 bp, human
gaatctggaagagatagccc

SEQ ID NO: 298841 - DNA, 20 bp, human
gtgcacatgcagacacatac

SEQ ID NO: 298842 - DNA, 20 bp, human
gggggcaacaagttggtgct

SEQ ID NO: 298843 - DNA, 20 bp, human
gtgctgggaaggcagctggc

SEQ ID NO: 298844 - DNA, 20 bp, human
gtgcatgtgcaggtgtccgt

SEQ ID NO: 298845 - DNA, 20 bp, human
gatgtgcatgccatgcacag

SEQ ID NO: 298846 - DNA, 20 bp, human
ggggaattggactcagtcgg

SEQ ID NO: 298847 - DNA, 20 bp, human
ggctcgttcaagcggaggca

SEQ ID NO: 298848 - DNA, 20 bp, human
gcgttcaagcggaggcacgg

SEQ ID NO: 298849 - DNA, 20 bp, human
ggtggggctcgttcaagcgg

SEQ ID NO: 298850 - DNA, 20 bp, human
gcgcgggtatgtagacagag

SEQ ID NO: 298851 - DNA, 20 bp, human
gagagggaattggactcagt

SEQ ID NO: 298852 - DNA, 20 bp, human
gtagggcggaatgcgatttc

SEQ ID NO: 298853 - DNA, 20 bp, human
gctcagtcggggggcagcaa

SEQ ID NO: 298854 - DNA, 20 bp, human
gagtctggagtcgggtctga

SEQ ID NO: 298855 - DNA, 20 bp, human
gtatgtagacagagggggtt

SEQ ID NO: 298856 - DNA, 20 bp, human
gactgataaggacatagctc

SEQ ID NO: 298857 - DNA, 20 bp, human
gctgatgtttgaggagatga

SEQ ID NO: 298858 - DNA, 20 bp, human
gttaacttctgaagtctagc

SEQ ID NO: 298859 - DNA, 20 bp, human
gaactgctctcttttcatat

SEQ ID NO: 298860 - DNA, 20 bp, human
ggtagatacatcagacattg

SEQ ID NO: 298861 - DNA, 20 bp, human
gtgcattttaaatctaatac

SEQ ID NO: 298862 - DNA, 20 bp, human
gaaaagttcactagcaaaat

SEQ ID NO: 298863 - DNA, 20 bp, human
ggaatgatttttgttcttac

SEQ ID NO: 298864 - DNA, 20 bp, human
gtagttaagaaaactatgct

SEQ ID NO: 298865 - DNA, 20 bp, human
ggcaattatgaataagttta

SEQ ID NO: 298866 - DNA, 20 bp, human
gaataggcgcgcgcgtcgga

SEQ ID NO: 298867 - DNA, 20 bp, human
gtctctactcacagcgtcgg

SEQ ID NO: 298868 - DNA, 20 bp, human
gactcacagcgtcggaggga

SEQ ID NO: 298869 - DNA, 20 bp, human
gcgcgcgcgtcggagggcga

SEQ ID NO: 298870 - DNA, 20 bp, human
gcagcgttggcgacgggcga

SEQ ID NO: 298871 - DNA, 20 bp, human
gccagggtgccgcagacgcg

SEQ ID NO: 298872 - DNA, 20 bp, human
ggcgtcggagggcgaagggc

SEQ ID NO: 298873 - DNA, 20 bp, human
ggccagcgtccccgcgtctg

SEQ ID NO: 298874 - DNA, 20 bp, human
gcgaaggcgcgccacttcat

SEQ ID NO: 298875 - DNA, 20 bp, human
gagccccgcccctcacgcgg

SEQ ID NO: 298876 - DNA, 20 bp, human
gagcctaaacccggaagcga

SEQ ID NO: 298877 - DNA, 20 bp, human
ggggtctcggagcctaaacc

SEQ ID NO: 298878 - DNA, 20 bp, human
ggctccgcctcccggtaacc

SEQ ID NO: 298879 - DNA, 20 bp, human
gtcgctgtggcccggatgtt

SEQ ID NO: 298880 - DNA, 20 bp, human
gcgggccacagcgagctcgg

SEQ ID NO: 298881 - DNA, 20 bp, human
gcgagggcgggcggggtcaa

SEQ ID NO: 298882 - DNA, 20 bp, human
gctaaccagccacgtccggg

SEQ ID NO: 298883 - DNA, 20 bp, human
gggagccgccgagctcgctg

SEQ ID NO: 298884 - DNA, 20 bp, human
gagaccccgccccccggacg

SEQ ID NO: 298885 - DNA, 20 bp, human
ggctgcccccgcatgatcca

SEQ ID NO: 298886 - DNA, 20 bp, human
gagactggggcaccctgagt

SEQ ID NO: 298887 - DNA, 20 bp, human
gtaggccctggggactatgg

SEQ ID NO: 298888 - DNA, 20 bp, human
gaaaccgcagccatggggcg

SEQ ID NO: 298889 - DNA, 20 bp, human
gagtgggcctgtgttagttt

SEQ ID NO: 298890 - DNA, 20 bp, human
gcacgcccccaaactaacac

SEQ ID NO: 298891 - DNA, 20 bp, human
gactgggcctgtgggtgtct

SEQ ID NO: 298892 - DNA, 20 bp, human
ggcttagagtggggtaccgt

SEQ ID NO: 298893 - DNA, 20 bp, human
ggcttggagtgaggcactct

SEQ ID NO: 298894 - DNA, 20 bp, human
gagtggggtaccgtgggact

SEQ ID NO: 298895 - DNA, 20 bp, human
gcacgcccccatagtcccca

SEQ ID NO: 298896 - DNA, 20 bp, human
ggcctcgaaggcaggcaaga

SEQ ID NO: 298897 - DNA, 20 bp, human
gcgcacaaccagggcctcga

SEQ ID NO: 298898 - DNA, 20 bp, human
gcatgaggcgcgcacaacca

SEQ ID NO: 298899 - DNA, 20 bp, human
gcgtgcggcaaacctgtcct

SEQ ID NO: 298900 - DNA, 20 bp, human
gcaaacctgtcctaggttga

SEQ ID NO: 298901 - DNA, 20 bp, human
gtgccccctcaacctaggac

SEQ ID NO: 298902 - DNA, 20 bp, human
gagctagcagagcgcagcgg

SEQ ID NO: 298903 - DNA, 20 bp, human
gcaaccagggcctcgaaggc

SEQ ID NO: 298904 - DNA, 20 bp, human
gttgcctgccttcgaggccc

SEQ ID NO: 298905 - DNA, 20 bp, human
gggcacgtgcgaccggagag

SEQ ID NO: 298906 - DNA, 20 bp, human
ggggaagccgcgggcggtta

SEQ ID NO: 298907 - DNA, 20 bp, human
gacgtggaaaccaggggcgc

SEQ ID NO: 298908 - DNA, 20 bp, human
gcgcggcttccccgcccaca

SEQ ID NO: 298909 - DNA, 20 bp, human
ggcgacggggcaggccaata

SEQ ID NO: 298910 - DNA, 20 bp, human
gtctccgcgagagcactcat

SEQ ID NO: 298911 - DNA, 20 bp, human
ggggagagaatggcgggagc

SEQ ID NO: 298912 - DNA, 20 bp, human
gggccaatcacgctgcagga

SEQ ID NO: 298913 - DNA, 20 bp, human
gtggtcgcctccctgagccg

SEQ ID NO: 298914 - DNA, 20 bp, human
gctgcagcgtgattggcccg

SEQ ID NO: 298915 - DNA, 20 bp, human
gccatagcgacgtggaaacc

SEQ ID NO: 298916 - DNA, 20 bp, human
gaagcagcaataaagccggg

SEQ ID NO: 298917 - DNA, 20 bp, human
gctgccggggaggctcgctc

SEQ ID NO: 298918 - DNA, 20 bp, human
gaggcgcagcagcagtaaca

SEQ ID NO: 298919 - DNA, 20 bp, human
gtgcgcgtagagtcagggct

SEQ ID NO: 298920 - DNA, 20 bp, human
ggaaaagatgcacctgaaac

SEQ ID NO: 298921 - DNA, 20 bp, human
gcgcatgtgcgcgtagagtc

SEQ ID NO: 298922 - DNA, 20 bp, human
ggggagaggggaaactgcgc

SEQ ID NO: 298923 - DNA, 20 bp, human
gcacctgaaacaggatctgc

SEQ ID NO: 298924 - DNA, 20 bp, human
gactaaggcccactctttaa

SEQ ID NO: 298925 - DNA, 20 bp, human
gcattcagccattaaagagt

SEQ ID NO: 298926 - DNA, 20 bp, human
ggggaaagccccgacctcgg

SEQ ID NO: 298927 - DNA, 20 bp, human
ggggtgtggaacactgagcg

SEQ ID NO: 298928 - DNA, 20 bp, human
gtcggggctttcccatggga

SEQ ID NO: 298929 - DNA, 20 bp, human
ggctgggcccgccgaggtcg

SEQ ID NO: 298930 - DNA, 20 bp, human
gcatgggaaagccccgacct

SEQ ID NO: 298931 - DNA, 20 bp, human
ggggcgcgagggtgcacgcg

SEQ ID NO: 298932 - DNA, 20 bp, human
gtcgctgccagggagcaagc

SEQ ID NO: 298933 - DNA, 20 bp, human
gtgcctgccagcttgctccc

SEQ ID NO: 298934 - DNA, 20 bp, human
ggcgagcagcaggaccgaga

SEQ ID NO: 298935 - DNA, 20 bp, human
ggcaggaagtagccaagatt

SEQ ID NO: 298936 - DNA, 20 bp, human
ggatcccaggggaaacctga

SEQ ID NO: 298937 - DNA, 20 bp, human
gtctgggcggtccgcggagt

SEQ ID NO: 298938 - DNA, 20 bp, human
gcccagacccggaactgctg

SEQ ID NO: 298939 - DNA, 20 bp, human
gaggaaccagagccgcgcga

SEQ ID NO: 298940 - DNA, 20 bp, human
gcgcgagagctggggaatcc

SEQ ID NO: 298941 - DNA, 20 bp, human
gccggcggcgttagaggaac

SEQ ID NO: 298942 - DNA, 20 bp, human
gggccccttgaggagggata

SEQ ID NO: 298943 - DNA, 20 bp, human
gagtcggcatcccgcagccc

SEQ ID NO: 298944 - DNA, 20 bp, human
gtccgggtctgggcggtccg

SEQ ID NO: 298945 - DNA, 20 bp, human
gtccggaaagggtcgcgagg

SEQ ID NO: 298946 - DNA, 20 bp, human
gcggaaggacgggagggcac

SEQ ID NO: 298947 - DNA, 20 bp, human
gtggcagcgtccggaaggac

SEQ ID NO: 298948 - DNA, 20 bp, human
ggggcggggtggaacggaac

SEQ ID NO: 298949 - DNA, 20 bp, human
gtgacctccagtagccacat

SEQ ID NO: 298950 - DNA, 20 bp, human
gggagtgcagcccgcccatg

SEQ ID NO: 298951 - DNA, 20 bp, human
gagaaccaagggatcagtta

SEQ ID NO: 298952 - DNA, 20 bp, human
gagcgtccggaaggacggga

SEQ ID NO: 298953 - DNA, 20 bp, human
gagtcccggctggcagcgtc

SEQ ID NO: 298954 - DNA, 20 bp, human
gccgcccatgtggctactgg

SEQ ID NO: 298955 - DNA, 20 bp, human
gtgggagtcgtagtcccggc

SEQ ID NO: 298956 - DNA, 20 bp, human
gcccaggggtgtgaacccag

SEQ ID NO: 298957 - DNA, 20 bp, human
ggcggaagtcacacctctcc

SEQ ID NO: 298958 - DNA, 20 bp, human
gacctgcctgcaaggatccc

SEQ ID NO: 298959 - DNA, 20 bp, human
gtgacagtttggggaagaag

SEQ ID NO: 298960 - DNA, 20 bp, human
gaacaagggctaggttgggc

SEQ ID NO: 298961 - DNA, 20 bp, human
gaagtcaacaagggctaggt

SEQ ID NO: 298962 - DNA, 20 bp, human
ggttgggctggctgatacct

SEQ ID NO: 298963 - DNA, 20 bp, human
gtcacacccctgggctctca

SEQ ID NO: 298964 - DNA, 20 bp, human
gttgcaggcaggtcctggat

SEQ ID NO: 298965 - DNA, 20 bp, human
gtagagaaaggctcctatcc

SEQ ID NO: 298966 - DNA, 20 bp, human
gtaagggcgagaactcccat

SEQ ID NO: 298967 - DNA, 20 bp, human
gaagaagggctcgatgcgat

SEQ ID NO: 298968 - DNA, 20 bp, human
gagtcaggcgtcgactgcta

SEQ ID NO: 298969 - DNA, 20 bp, human
gttgatctgagggtaagcaa

SEQ ID NO: 298970 - DNA, 20 bp, human
gcatgggacgggaactagga

SEQ ID NO: 298971 - DNA, 20 bp, human
gctgaggggcaagatggtaa

SEQ ID NO: 298972 - DNA, 20 bp, human
ggaggtgacgcttgatctga

SEQ ID NO: 298973 - DNA, 20 bp, human
ggcgagaactcccatgggac

SEQ ID NO: 298974 - DNA, 20 bp, human
gtgcacactgaggggcaaga

SEQ ID NO: 298975 - DNA, 20 bp, human
ggatcggcgctcgggtagtc

SEQ ID NO: 298976 - DNA, 20 bp, human
ggggctgcgcgggcagtggt

SEQ ID NO: 298977 - DNA, 20 bp, human
gggatccggcagctaggccg

SEQ ID NO: 298978 - DNA, 20 bp, human
ggggggcggtgcggaactag

SEQ ID NO: 298979 - DNA, 20 bp, human
ggagggaggggattggccag

SEQ ID NO: 298980 - DNA, 20 bp, human
ggatgcctcgcaacccggga

SEQ ID NO: 298981 - DNA, 20 bp, human
gaaggctggcgcgaggcgtg

SEQ ID NO: 298982 - DNA, 20 bp, human
gaggtcacgtgacgccgcgc

SEQ ID NO: 298983 - DNA, 20 bp, human
ggcaccagcccccgtgacag

SEQ ID NO: 298984 - DNA, 20 bp, human
gcctcgcaacccgggaggga

SEQ ID NO: 298985 - DNA, 20 bp, human
gacaggcgagtggatccaag

SEQ ID NO: 298986 - DNA, 20 bp, human
gcccttgggggtcagtcaga

SEQ ID NO: 298987 - DNA, 20 bp, human
ggtacagcaagcaaaggggt

SEQ ID NO: 298988 - DNA, 20 bp, human
gaagagagggaccctaaccc

SEQ ID NO: 298989 - DNA, 20 bp, human
gctaacttgaggcctaggag

SEQ ID NO: 298990 - DNA, 20 bp, human
ggaaagagtcacactgggaa

SEQ ID NO: 298991 - DNA, 20 bp, human
gtccctctgactgaccccca

SEQ ID NO: 298992 - DNA, 20 bp, human
gataaggtacagtccccttg

SEQ ID NO: 298993 - DNA, 20 bp, human
gtctggctaacttgaggcct

SEQ ID NO: 298994 - DNA, 20 bp, human
ggtgatgtctggctaacttg

SEQ ID NO: 298995 - DNA, 20 bp, human
ggtcacactgggaagggcat

SEQ ID NO: 298996 - DNA, 20 bp, human
gtggaccgtcggacggatcg

SEQ ID NO: 298997 - DNA, 20 bp, human
gggtcccgcgatccgtccga

SEQ ID NO: 298998 - DNA, 20 bp, human
gggatcgcgggaccgaacga

SEQ ID NO: 298999 - DNA, 20 bp, human
gcaagcactgggtggaccgt

SEQ ID NO: 299000 - DNA, 20 bp, human
gccttcggggccccttcgca

SEQ ID NO: 299001 - DNA, 20 bp, human
ggcctgggctgcaatcaatg

SEQ ID NO: 299002 - DNA, 20 bp, human
gcgcgcgggggtgagataag

SEQ ID NO: 299003 - DNA, 20 bp, human
gccgacccgggaatggcctc

SEQ ID NO: 299004 - DNA, 20 bp, human
gtggggctggtcggctgccc

SEQ ID NO: 299005 - DNA, 20 bp, human
ggccccgggcgtccgtcgtt

SEQ ID NO: 299006 - DNA, 20 bp, human
gaaggggagcgccaccacag

SEQ ID NO: 299007 - DNA, 20 bp, human
ggggagcgccaccacagagg

SEQ ID NO: 299008 - DNA, 20 bp, human
gaggccgggcacaggggtga

SEQ ID NO: 299009 - DNA, 20 bp, human
ggcagcttagagatgggcaa

SEQ ID NO: 299010 - DNA, 20 bp, human
gcgtaagccctggggtgcgg

SEQ ID NO: 299011 - DNA, 20 bp, human
ggaggaggcagcttagagat

SEQ ID NO: 299012 - DNA, 20 bp, human
gcagactgctccctctccca

SEQ ID NO: 299013 - DNA, 20 bp, human
gaagcgaaaccgtaagccct

SEQ ID NO: 299014 - DNA, 20 bp, human
gcttcgcagtggaaagtctg

SEQ ID NO: 299015 - DNA, 20 bp, human
gttacggtttcgcttcgcag

SEQ ID NO: 299016 - DNA, 20 bp, human
gggtccctggagagcctgac

SEQ ID NO: 299017 - DNA, 20 bp, human
gtctcagaaggcccccggca

SEQ ID NO: 299018 - DNA, 20 bp, human
gcccggcagggccgcttggc

SEQ ID NO: 299019 - DNA, 20 bp, human
ggcgccagtcaggctctcca

SEQ ID NO: 299020 - DNA, 20 bp, human
gctgcgcaggcgcgtgtggg

SEQ ID NO: 299021 - DNA, 20 bp, human
gcaggcgcgctaaggtcaca

SEQ ID NO: 299022 - DNA, 20 bp, human
ggcctcgcggggtgcgcctc

SEQ ID NO: 299023 - DNA, 20 bp, human
gcacaaggcgcgcttagggg

SEQ ID NO: 299024 - DNA, 20 bp, human
gtcccgccaagcggccctgc

SEQ ID NO: 299025 - DNA, 20 bp, human
gccgctgaccgggtctcaga

SEQ ID NO: 299026 - DNA, 20 bp, human
gggacggcgtccaagtcaat

SEQ ID NO: 299027 - DNA, 20 bp, human
gagctgcgaccgttaacttg

SEQ ID NO: 299028 - DNA, 20 bp, human
gaccgttaacttgtggagtt

SEQ ID NO: 299029 - DNA, 20 bp, human
gtgcctctaagcgacattta

SEQ ID NO: 299030 - DNA, 20 bp, human
gtaccctaaatgtcgcttag

SEQ ID NO: 299031 - DNA, 20 bp, human
ggtcgggcaaccaattgact

SEQ ID NO: 299032 - DNA, 20 bp, human
ggacaaggcagaataaaggt

SEQ ID NO: 299033 - DNA, 20 bp, human
ggttaacggtcgcagctctt

SEQ ID NO: 299034 - DNA, 20 bp, human
gggctcccatttgtaataca

SEQ ID NO: 299035 - DNA, 20 bp, human
ggttgctgtggaagccccat

SEQ ID NO: 299036 - DNA, 20 bp, human
ggtcgtgcaaccaactgact

SEQ ID NO: 299037 - DNA, 20 bp, human
gaccgcgcccggcgcactgt

SEQ ID NO: 299038 - DNA, 20 bp, human
gagcggtggtcgttaatgtg

SEQ ID NO: 299039 - DNA, 20 bp, human
gtaaggtcatctgatcatgc

SEQ ID NO: 299040 - DNA, 20 bp, human
ggtcgttaatgtgtggagtt

SEQ ID NO: 299041 - DNA, 20 bp, human
ggcaactgcctcacacaaga

SEQ ID NO: 299042 - DNA, 20 bp, human
gtggaaaccccacgggcagg

SEQ ID NO: 299043 - DNA, 20 bp, human
gccgggggcctcctgcccgt

SEQ ID NO: 299044 - DNA, 20 bp, human
gggatgacatccaagtcagt

SEQ ID NO: 299045 - DNA, 20 bp, human
gacatcttgcccaagagcgg

SEQ ID NO: 299046 - DNA, 20 bp, human
gtggactagatactgggaga

SEQ ID NO: 299047 - DNA, 20 bp, human
gcctgctatggactagatac

SEQ ID NO: 299048 - DNA, 20 bp, human
gcagagaacaatacctgcta

SEQ ID NO: 299049 - DNA, 20 bp, human
gggtaccaagccctacatct

SEQ ID NO: 299050 - DNA, 20 bp, human
gcaaatgggaagcaggatca

SEQ ID NO: 299051 - DNA, 20 bp, human
gggaaaagtagggtgaatta

SEQ ID NO: 299052 - DNA, 20 bp, human
gaagtgccagctctgatcct

SEQ ID NO: 299053 - DNA, 20 bp, human
gagggctaaacaaagccaaa

SEQ ID NO: 299054 - DNA, 20 bp, human
gcatgtctctaggggggaag

SEQ ID NO: 299055 - DNA, 20 bp, human
ggggggcaatataagaagtg

SEQ ID NO: 299056 - DNA, 20 bp, human
gccggctccgggtaggaggt

SEQ ID NO: 299057 - DNA, 20 bp, human
gagcccggcctccccgactt

SEQ ID NO: 299058 - DNA, 20 bp, human
gcgccctcggacacacccct

SEQ ID NO: 299059 - DNA, 20 bp, human
ggaccccaagtcggggaggc

SEQ ID NO: 299060 - DNA, 20 bp, human
ggcacgcggaccccaagtcg

SEQ ID NO: 299061 - DNA, 20 bp, human
gaggagaaactgggctgcgg

SEQ ID NO: 299062 - DNA, 20 bp, human
ggccaagctgggcgcccccg

SEQ ID NO: 299063 - DNA, 20 bp, human
gacttggggtccgcgtgcgc

SEQ ID NO: 299064 - DNA, 20 bp, human
gcggggcggggcgcagccga

SEQ ID NO: 299065 - DNA, 20 bp, human
gggcgcccagcttggcctct

SEQ ID NO: 299066 - DNA, 20 bp, human
gggaaggagcgctctaggaa

SEQ ID NO: 299067 - DNA, 20 bp, human
gaggaatgatccggtctcag

SEQ ID NO: 299068 - DNA, 20 bp, human
ggcccggccaaagccagagg

SEQ ID NO: 299069 - DNA, 20 bp, human
gttaatagagggccgtcctg

SEQ ID NO: 299070 - DNA, 20 bp, human
ggggccgccgcctgagggtg

SEQ ID NO: 299071 - DNA, 20 bp, human
gcagagggaaggagcgctct

SEQ ID NO: 299072 - DNA, 20 bp, human
gtggccgggccgccgcctga

SEQ ID NO: 299073 - DNA, 20 bp, human
gtcctggggccgcgtgccca

SEQ ID NO: 299074 - DNA, 20 bp, human
ggcggcccggccaaagccag

SEQ ID NO: 299075 - DNA, 20 bp, human
gaaggaggatcctttaatag

SEQ ID NO: 299076 - DNA, 20 bp, human
gtggagggttcgaagatccc

SEQ ID NO: 299077 - DNA, 20 bp, human
gccacccaggcggcgggaac

SEQ ID NO: 299078 - DNA, 20 bp, human
gggcgcgctgcaaacttcgc

SEQ ID NO: 299079 - DNA, 20 bp, human
gaggtcacaggtggcttttc

SEQ ID NO: 299080 - DNA, 20 bp, human
gggaggcttgtaaacgaatt

SEQ ID NO: 299081 - DNA, 20 bp, human
gccggcgccgcccatatccc

SEQ ID NO: 299082 - DNA, 20 bp, human
gctagcgcagccggggatat

SEQ ID NO: 299083 - DNA, 20 bp, human
ggcgctgcaaacttcgcggg

SEQ ID NO: 299084 - DNA, 20 bp, human
gagcgggcaccagccggatc

SEQ ID NO: 299085 - DNA, 20 bp, human
gcgggagagacgccgtctgc

SEQ ID NO: 299086 - DNA, 20 bp, human
ggaggggctccaaactgaga

SEQ ID NO: 299087 - DNA, 20 bp, human
gagaggggagggaagaccgc

SEQ ID NO: 299088 - DNA, 20 bp, human
ggggtggaaaagggattcca

SEQ ID NO: 299089 - DNA, 20 bp, human
gggctccaaactgagagggg

SEQ ID NO: 299090 - DNA, 20 bp, human
gtaaatatagataagacatc

SEQ ID NO: 299091 - DNA, 20 bp, human
ggagggaagaccgcagggaa

SEQ ID NO: 299092 - DNA, 20 bp, human
gcaggaaagtgggtggaaaa

SEQ ID NO: 299093 - DNA, 20 bp, human
gaaaggtagatgatctctga

SEQ ID NO: 299094 - DNA, 20 bp, human
gtacataaataagagtggtg

SEQ ID NO: 299095 - DNA, 20 bp, human
gtgaaaagccagcttagagt

SEQ ID NO: 299096 - DNA, 20 bp, human
ggcccggccgcctcccggaa

SEQ ID NO: 299097 - DNA, 20 bp, human
gcggcggcgccgtcgtccca

SEQ ID NO: 299098 - DNA, 20 bp, human
gagccccggggagaggtccg

SEQ ID NO: 299099 - DNA, 20 bp, human
gccgggcggccttaaccctt

SEQ ID NO: 299100 - DNA, 20 bp, human
gcccggggagaggtccgggg

SEQ ID NO: 299101 - DNA, 20 bp, human
gcggccgggccggggtccga

SEQ ID NO: 299102 - DNA, 20 bp, human
ggggacccggagctacgacc

SEQ ID NO: 299103 - DNA, 20 bp, human
ggggccaggccgtgggacga

SEQ ID NO: 299104 - DNA, 20 bp, human
gtgaagccaggcggccggca

SEQ ID NO: 299105 - DNA, 20 bp, human
ggggcggggcctgacgtccg

SEQ ID NO: 299106 - DNA, 20 bp, human
gactctgcgaggaccgggtg

SEQ ID NO: 299107 - DNA, 20 bp, human
gcggcggggccgtccagcga

SEQ ID NO: 299108 - DNA, 20 bp, human
ggccgcaactctgcgaggac

SEQ ID NO: 299109 - DNA, 20 bp, human
ggtcccggtcccaccccccg

SEQ ID NO: 299110 - DNA, 20 bp, human
gaacaaaagaggcgccccgg

SEQ ID NO: 299111 - DNA, 20 bp, human
ggcggacccgccctgggacc

SEQ ID NO: 299112 - DNA, 20 bp, human
gtcccagggcgggtccgccc

SEQ ID NO: 299113 - DNA, 20 bp, human
ggaggggggcggatgcgtgg

SEQ ID NO: 299114 - DNA, 20 bp, human
gcggggtgcgcgtcccagaa

SEQ ID NO: 299115 - DNA, 20 bp, human
gtccgtatgcgcatgagcag

SEQ ID NO: 299116 - DNA, 20 bp, human
gagggccaggggaaggtaag

SEQ ID NO: 299117 - DNA, 20 bp, human
gggcgaaggcagtttccgga

SEQ ID NO: 299118 - DNA, 20 bp, human
gctgggaaggagcgcaacac

SEQ ID NO: 299119 - DNA, 20 bp, human
ggccggagcggattctggga

SEQ ID NO: 299120 - DNA, 20 bp, human
ggggtgaagtggtctgtctc

SEQ ID NO: 299121 - DNA, 20 bp, human
ggaaaggccggagcggattc

SEQ ID NO: 299122 - DNA, 20 bp, human
gagacctgggaactgacaga

SEQ ID NO: 299123 - DNA, 20 bp, human
gggactggacagaatggggc

SEQ ID NO: 299124 - DNA, 20 bp, human
gaggcagtttccggagggaa

SEQ ID NO: 299125 - DNA, 20 bp, human
ggggaccgctggacagacct

SEQ ID NO: 299126 - DNA, 20 bp, human
gcagtcccgtcctgggaggt

SEQ ID NO: 299127 - DNA, 20 bp, human
gaggacgggactgggcaagt

SEQ ID NO: 299128 - DNA, 20 bp, human
ggggtgcagtgacgacagat

SEQ ID NO: 299129 - DNA, 20 bp, human
ggagctcactacaagaactc

SEQ ID NO: 299130 - DNA, 20 bp, human
ggcagagaacacaaagatta

SEQ ID NO: 299131 - DNA, 20 bp, human
gagggcgggtctcaggaatc

SEQ ID NO: 299132 - DNA, 20 bp, human
gcacaggcaggtgggcattg

SEQ ID NO: 299133 - DNA, 20 bp, human
ggtggggctacacccagcca

SEQ ID NO: 299134 - DNA, 20 bp, human
gtgggtgtagccccaccgca

SEQ ID NO: 299135 - DNA, 20 bp, human
gcactacaagaactctggga

SEQ ID NO: 299136 - DNA, 20 bp, human
gggtccgcctgaaagtagat

SEQ ID NO: 299137 - DNA, 20 bp, human
gaggtggaatagtttcagat

SEQ ID NO: 299138 - DNA, 20 bp, human
gcccgaggcacctaaaagta

SEQ ID NO: 299139 - DNA, 20 bp, human
gaaaatgtgcggaattagat

SEQ ID NO: 299140 - DNA, 20 bp, human
gaatgtctgtgcattattcc

SEQ ID NO: 299141 - DNA, 20 bp, human
gggctcaagatcatcttaaa

SEQ ID NO: 299142 - DNA, 20 bp, human
gtagattgggatggagtcag

SEQ ID NO: 299143 - DNA, 20 bp, human
gcaactaaccattgtgggaa

SEQ ID NO: 299144 - DNA, 20 bp, human
gtactttcaggcggaccagg

SEQ ID NO: 299145 - DNA, 20 bp, human
gatcttgagccaggtaggac

SEQ ID NO: 299146 - DNA, 20 bp, human
ggggccggggagttgcccca

SEQ ID NO: 299147 - DNA, 20 bp, human
gggcggacgcgcagtccatg

SEQ ID NO: 299148 - DNA, 20 bp, human
gccgcctcctggagtcgccg

SEQ ID NO: 299149 - DNA, 20 bp, human
gccgccccggcgactccagg

SEQ ID NO: 299150 - DNA, 20 bp, human
gccgcggcgcgcgacccggg

SEQ ID NO: 299151 - DNA, 20 bp, human
gacgcgcagtccatggggcg

SEQ ID NO: 299152 - DNA, 20 bp, human
gcgtccgccccggcgactcc

SEQ ID NO: 299153 - DNA, 20 bp, human
ggcagtccatggggcgcggt

SEQ ID NO: 299154 - DNA, 20 bp, human
gggtgcatgccgggagggaa

SEQ ID NO: 299155 - DNA, 20 bp, human
ggggcccgcggcgcgcgacc

SEQ ID NO: 299156 - DNA, 20 bp, human
gctccccctcgcagcgagga

SEQ ID NO: 299157 - DNA, 20 bp, human
gaatctgccctggaccaccc

SEQ ID NO: 299158 - DNA, 20 bp, human
gcacacctggcccgggccaa

SEQ ID NO: 299159 - DNA, 20 bp, human
gtctctcccggggtggtcca

SEQ ID NO: 299160 - DNA, 20 bp, human
gtgcgccctcctcgctgcga

SEQ ID NO: 299161 - DNA, 20 bp, human
gtgtgactcacctgtgaata

SEQ ID NO: 299162 - DNA, 20 bp, human
ggaagagagcctgtgtttca

SEQ ID NO: 299163 - DNA, 20 bp, human
gcggcccgggagcctttgcc

SEQ ID NO: 299164 - DNA, 20 bp, human
gtacctgactcagtcctgac

SEQ ID NO: 299165 - DNA, 20 bp, human
gaaacacacagagcacaaac

SEQ ID NO: 299166 - DNA, 20 bp, human
gcccacctgctggacgtgcc

SEQ ID NO: 299167 - DNA, 20 bp, human
ggctcgggagtctgccccag

SEQ ID NO: 299168 - DNA, 20 bp, human
gataaagtgtgccctggaca

SEQ ID NO: 299169 - DNA, 20 bp, human
ggtggggtcggtaaagatgc

SEQ ID NO: 299170 - DNA, 20 bp, human
ggccgggcacgtccagcagg

SEQ ID NO: 299171 - DNA, 20 bp, human
ggcccggcagtgcgcggctc

SEQ ID NO: 299172 - DNA, 20 bp, human
gcggtccctggtatttttag

SEQ ID NO: 299173 - DNA, 20 bp, human
gtctgccccagaggcgaccc

SEQ ID NO: 299174 - DNA, 20 bp, human
gggacgtgcccggcagtgcg

SEQ ID NO: 299175 - DNA, 20 bp, human
gccagggaccgcgccgtccc

SEQ ID NO: 299176 - DNA, 20 bp, human
ggccgctgcgggtcacgtgt

SEQ ID NO: 299177 - DNA, 20 bp, human
gggaagctgccgcacctgcg

SEQ ID NO: 299178 - DNA, 20 bp, human
ggccccctcacgcgtgatgc

SEQ ID NO: 299179 - DNA, 20 bp, human
gaggtcctgaaacgggaagt

SEQ ID NO: 299180 - DNA, 20 bp, human
ggtgacccggcctggtccgg

SEQ ID NO: 299181 - DNA, 20 bp, human
gaagcccgcgaggggagaaa

SEQ ID NO: 299182 - DNA, 20 bp, human
gtcggcctgcatcacgcgtg

SEQ ID NO: 299183 - DNA, 20 bp, human
gcgggcgtcacgtgatcccg

SEQ ID NO: 299184 - DNA, 20 bp, human
ggcgctctcgcgagacccgc

SEQ ID NO: 299185 - DNA, 20 bp, human
ggagcgcgcgcgtcgagcgc

SEQ ID NO: 299186 - DNA, 20 bp, human
gtctctcaggagcataggaa

SEQ ID NO: 299187 - DNA, 20 bp, human
ggagaggggtggtgatgtag

SEQ ID NO: 299188 - DNA, 20 bp, human
gccgtccgcgcatatctctc

SEQ ID NO: 299189 - DNA, 20 bp, human
gcgaccacgccctggctttt

SEQ ID NO: 299190 - DNA, 20 bp, human
gcgcttgaaagcggcgagag

SEQ ID NO: 299191 - DNA, 20 bp, human
gagtgcgagtcataagacta

SEQ ID NO: 299192 - DNA, 20 bp, human
gtggtgatgtagcggccggt

SEQ ID NO: 299193 - DNA, 20 bp, human
ggaaaaggctcgctggacct

SEQ ID NO: 299194 - DNA, 20 bp, human
gcgagtcataagactagggg

SEQ ID NO: 299195 - DNA, 20 bp, human
gttgaaagcggcgagagggg

SEQ ID NO: 299196 - DNA, 20 bp, human
gagacccagggtatgagcgg

SEQ ID NO: 299197 - DNA, 20 bp, human
gaggagacccagggtatgag

SEQ ID NO: 299198 - DNA, 20 bp, human
gaccacgcgcgtgcggtaaa

SEQ ID NO: 299199 - DNA, 20 bp, human
gcggccccctcctaccccta

SEQ ID NO: 299200 - DNA, 20 bp, human
gcggccctgggcgggctttt

SEQ ID NO: 299201 - DNA, 20 bp, human
gctgctccgtaggggtagga

SEQ ID NO: 299202 - DNA, 20 bp, human
gtaccgcacgcgcgtggtcc

SEQ ID NO: 299203 - DNA, 20 bp, human
ggtgcggtaaacggtcccag

SEQ ID NO: 299204 - DNA, 20 bp, human
gcggaggaggccggcgctgc

SEQ ID NO: 299205 - DNA, 20 bp, human
gctccctgctccgtaggggt

SEQ ID NO: 299206 - DNA, 20 bp, human
gaccaggtacagttattaag

SEQ ID NO: 299207 - DNA, 20 bp, human
gggagggccaatgagatctg

SEQ ID NO: 299208 - DNA, 20 bp, human
gcgggggaggagggctatgc

SEQ ID NO: 299209 - DNA, 20 bp, human
ggctatgcaggaatagagaa

SEQ ID NO: 299210 - DNA, 20 bp, human
gaggagatttaataaggctg

SEQ ID NO: 299211 - DNA, 20 bp, human
gggtgtagataccttatcac

SEQ ID NO: 299212 - DNA, 20 bp, human
gaccacttaataactgtacc

SEQ ID NO: 299213 - DNA, 20 bp, human
gtagtccccccagatctcat

SEQ ID NO: 299214 - DNA, 20 bp, human
gctgctctcaatgagctcat

SEQ ID NO: 299215 - DNA, 20 bp, human
gggttcccgaaagaaaacgg

SEQ ID NO: 299216 - DNA, 20 bp, human
gacgtgatgcggggaaaggg

SEQ ID NO: 299217 - DNA, 20 bp, human
gtacggttacgccttcccat

SEQ ID NO: 299218 - DNA, 20 bp, human
gtacacgcaagcacgtgatg

SEQ ID NO: 299219 - DNA, 20 bp, human
gagcacgtgatgcggggaaa

SEQ ID NO: 299220 - DNA, 20 bp, human
ggccgcctcagtcaataccc

SEQ ID NO: 299221 - DNA, 20 bp, human
gagcgggcgggaccggaagc

SEQ ID NO: 299222 - DNA, 20 bp, human
ggccaagcggctccgggaca

SEQ ID NO: 299223 - DNA, 20 bp, human
gacccgcggcggcctcccgc

SEQ ID NO: 299224 - DNA, 20 bp, human
gccgccgcgggtcatgtgac

SEQ ID NO: 299225 - DNA, 20 bp, human
gacagggggtacggggggtg

SEQ ID NO: 299226 - DNA, 20 bp, human
gcgaccacgcggttgttggg

SEQ ID NO: 299227 - DNA, 20 bp, human
gcccagagccccccgcggtg

SEQ ID NO: 299228 - DNA, 20 bp, human
gtggcctcgcgaggcaccct

SEQ ID NO: 299229 - DNA, 20 bp, human
gggaaaagaacgggagtgaa

SEQ ID NO: 299230 - DNA, 20 bp, human
gaaccccgccccaccgcggg

SEQ ID NO: 299231 - DNA, 20 bp, human
gcggtggggcggggttgagt

SEQ ID NO: 299232 - DNA, 20 bp, human
gaacaaccgcgtggtcggct

SEQ ID NO: 299233 - DNA, 20 bp, human
gttggggggcggaaaagaac

SEQ ID NO: 299234 - DNA, 20 bp, human
gagcaggccaacgggactac

SEQ ID NO: 299235 - DNA, 20 bp, human
gccgccccccaacaaccgcg

SEQ ID NO: 299236 - DNA, 20 bp, human
gggcccggcggaagctgcga

SEQ ID NO: 299237 - DNA, 20 bp, human
ggcaagacgcggcccgcggt

SEQ ID NO: 299238 - DNA, 20 bp, human
gcgcctgcgccttgtgtcac

SEQ ID NO: 299239 - DNA, 20 bp, human
gccgtatcgtagggcgacgg

SEQ ID NO: 299240 - DNA, 20 bp, human
gggcccgtgacacaaggcgc

SEQ ID NO: 299241 - DNA, 20 bp, human
ggaagctgcgagggcgcgtc

SEQ ID NO: 299242 - DNA, 20 bp, human
gcgccctcgcagcttccgcc

SEQ ID NO: 299243 - DNA, 20 bp, human
gaaggcgcaggcgcaagacg

SEQ ID NO: 299244 - DNA, 20 bp, human
ggatttccggaggggcccgg

SEQ ID NO: 299245 - DNA, 20 bp, human
ggctgcgagggcgcgtccgg

SEQ ID NO: 299246 - DNA, 20 bp, human
gtagccccgcctctagcatg

SEQ ID NO: 299247 - DNA, 20 bp, human
ggaagacgcgggagcgtccg

SEQ ID NO: 299248 - DNA, 20 bp, human
gcgcgggagcgtccgaggag

SEQ ID NO: 299249 - DNA, 20 bp, human
ggggagatgggtgttaaaga

SEQ ID NO: 299250 - DNA, 20 bp, human
gaccaatcaacgtgcgcctc

SEQ ID NO: 299251 - DNA, 20 bp, human
gcccggaggcgcacgttgat

SEQ ID NO: 299252 - DNA, 20 bp, human
gccgcctctagcatgaggat

SEQ ID NO: 299253 - DNA, 20 bp, human
ggcggctgcaagcacgtgac

SEQ ID NO: 299254 - DNA, 20 bp, human
ggaggggcgggagtaggccg

SEQ ID NO: 299255 - DNA, 20 bp, human
gcagtggcgcaagcagaagg

SEQ ID NO: 299256 - DNA, 20 bp, human
ggggagcccaagccttcgtc

SEQ ID NO: 299257 - DNA, 20 bp, human
gcaggtgcaggtcacctcga

SEQ ID NO: 299258 - DNA, 20 bp, human
gagcggggcgtggaccgtaa

SEQ ID NO: 299259 - DNA, 20 bp, human
ggtcgcacagagcctgacga

SEQ ID NO: 299260 - DNA, 20 bp, human
gccccgcgcggtgaccgtcg

SEQ ID NO: 299261 - DNA, 20 bp, human
gtgacctgcacctggctcca

SEQ ID NO: 299262 - DNA, 20 bp, human
gtctgagccggagtggtcgg

SEQ ID NO: 299263 - DNA, 20 bp, human
ggtgccgctgggttctgagc

SEQ ID NO: 299264 - DNA, 20 bp, human
gagccggagtggtcggtggg

SEQ ID NO: 299265 - DNA, 20 bp, human
gagcctgtggggcaagtacg

SEQ ID NO: 299266 - DNA, 20 bp, human
gcgggtctcgggaacggcga

SEQ ID NO: 299267 - DNA, 20 bp, human
ggaacggcgaaggctctgat

SEQ ID NO: 299268 - DNA, 20 bp, human
ggggattaggagtagagttt

SEQ ID NO: 299269 - DNA, 20 bp, human
gttaccgcccagttcctgcc

SEQ ID NO: 299270 - DNA, 20 bp, human
gcctcctggcaggaactggg

SEQ ID NO: 299271 - DNA, 20 bp, human
gacacccagcagtcaattgc

SEQ ID NO: 299272 - DNA, 20 bp, human
gagccccggacagtaacaga

SEQ ID NO: 299273 - DNA, 20 bp, human
gtaacaaactgtaagagaga

SEQ ID NO: 299274 - DNA, 20 bp, human
gcaaactgtaagagagaagg

SEQ ID NO: 299275 - DNA, 20 bp, human
gactgagcttctccagttgg

SEQ ID NO: 299276 - DNA, 20 bp, human
gtctctgcgcgggccctcgg

SEQ ID NO: 299277 - DNA, 20 bp, human
ggcagagagcgtcctctagg

SEQ ID NO: 299278 - DNA, 20 bp, human
gaacactggaggactctttc

SEQ ID NO: 299279 - DNA, 20 bp, human
gcgcgcagagagcgtcctct

SEQ ID NO: 299280 - DNA, 20 bp, human
ggggctgctcgcacatcagg

SEQ ID NO: 299281 - DNA, 20 bp, human
gggcccgcagagcccgtccg

SEQ ID NO: 299282 - DNA, 20 bp, human
ggcggcctcgctcctcctag

SEQ ID NO: 299283 - DNA, 20 bp, human
gtcgccgcggacgggctctg

SEQ ID NO: 299284 - DNA, 20 bp, human
gcgcgggccctcggaggagg

SEQ ID NO: 299285 - DNA, 20 bp, human
gagcgtgcactgcctcgtcg

SEQ ID NO: 299286 - DNA, 20 bp, human
gtcagtgtcccgcacgtcct

SEQ ID NO: 299287 - DNA, 20 bp, human
gcctcggccttctgccagta

SEQ ID NO: 299288 - DNA, 20 bp, human
ggcagaaggccgaggacgtg

SEQ ID NO: 299289 - DNA, 20 bp, human
gggccttctgccagtagggg

SEQ ID NO: 299290 - DNA, 20 bp, human
gagtggcgcgggccccgcgt

SEQ ID NO: 299291 - DNA, 20 bp, human
ggtcctgcgccccccctcag

SEQ ID NO: 299292 - DNA, 20 bp, human
gctcctcccctactggcaga

SEQ ID NO: 299293 - DNA, 20 bp, human
gaagcatcagcatcacccgg

SEQ ID NO: 299294 - DNA, 20 bp, human
gccacactttgagtatacaa

SEQ ID NO: 299295 - DNA, 20 bp, human
ggttaaaaacgcagcatctc

SEQ ID NO: 299296 - DNA, 20 bp, human
ggcgagcggacgtgcgtcta

SEQ ID NO: 299297 - DNA, 20 bp, human
gcgtgcgcgcggactggctc

SEQ ID NO: 299298 - DNA, 20 bp, human
gcggacgtgcgtctaggggg

SEQ ID NO: 299299 - DNA, 20 bp, human
ggcaacgcgaagtagagggg

SEQ ID NO: 299300 - DNA, 20 bp, human
gtagaggggcgggaccgata

SEQ ID NO: 299301 - DNA, 20 bp, human
gtctagggggcgggacggat

SEQ ID NO: 299302 - DNA, 20 bp, human
gcgagcacgtggagagcggt

SEQ ID NO: 299303 - DNA, 20 bp, human
ggaccgctgggatcaaaccg

SEQ ID NO: 299304 - DNA, 20 bp, human
gagacggcgtgcgcgcggac

SEQ ID NO: 299305 - DNA, 20 bp, human
gtgggatcaaaccgcggttg

SEQ ID NO: 299306 - DNA, 20 bp, human
ggccatcctcgcccctgtgg

SEQ ID NO: 299307 - DNA, 20 bp, human
gagaagaactacttagctgc

SEQ ID NO: 299308 - DNA, 20 bp, human
gaacaggcggagactcgctg

SEQ ID NO: 299309 - DNA, 20 bp, human
ggcgagttgcacttctaatt

SEQ ID NO: 299310 - DNA, 20 bp, human
gcaggccaatggggagcgga

SEQ ID NO: 299311 - DNA, 20 bp, human
gactggatgggaagcgtcac

SEQ ID NO: 299312 - DNA, 20 bp, human
ggcctaggatagttggggat

SEQ ID NO: 299313 - DNA, 20 bp, human
gtgagccatcctcgcccctg

SEQ ID NO: 299314 - DNA, 20 bp, human
ggcactgagcgcagcgactt

SEQ ID NO: 299315 - DNA, 20 bp, human
ggatggaccggacttctgat

SEQ ID NO: 299316 - DNA, 20 bp, human
gcgctgatggatttactcac

SEQ ID NO: 299317 - DNA, 20 bp, human
gaggcccggacctccactca

SEQ ID NO: 299318 - DNA, 20 bp, human
gcctccactcagggccgact

SEQ ID NO: 299319 - DNA, 20 bp, human
gtcagggccgactaggggac

SEQ ID NO: 299320 - DNA, 20 bp, human
gcggccctgagtggaggtcc

SEQ ID NO: 299321 - DNA, 20 bp, human
gccgactaggggactggcgg

SEQ ID NO: 299322 - DNA, 20 bp, human
gggagcccgcgatgacgtca

SEQ ID NO: 299323 - DNA, 20 bp, human
ggggccgactaggggactgg

SEQ ID NO: 299324 - DNA, 20 bp, human
ggagtccgtgacgtcatcgc

SEQ ID NO: 299325 - DNA, 20 bp, human
gccgaaggcgaccgctgcag

SEQ ID NO: 299326 - DNA, 20 bp, human
gaaggtcgtcacagctgggg

SEQ ID NO: 299327 - DNA, 20 bp, human
ggggcatgatgaccgtgtta

SEQ ID NO: 299328 - DNA, 20 bp, human
ggacaaggtcgtcacagctg

SEQ ID NO: 299329 - DNA, 20 bp, human
gccaggagggggttccagag

SEQ ID NO: 299330 - DNA, 20 bp, human
gagcaagctgtgtgaaacgg

SEQ ID NO: 299331 - DNA, 20 bp, human
ggtgtgaaacggtggaaccc

SEQ ID NO: 299332 - DNA, 20 bp, human
ggtaagcaagctgtgtgaaa

SEQ ID NO: 299333 - DNA, 20 bp, human
gttgtccctgcctgtctaag

SEQ ID NO: 299334 - DNA, 20 bp, human
gcatgcccttctctgcacca

SEQ ID NO: 299335 - DNA, 20 bp, human
gagggggaatgattcgtgca

SEQ ID NO: 299336 - DNA, 20 bp, human
gaataaaggtaacgtgactg

SEQ ID NO: 299337 - DNA, 20 bp, human
ggaacagagctgcacgtcag

SEQ ID NO: 299338 - DNA, 20 bp, human
gcggttccggggagggggta

SEQ ID NO: 299339 - DNA, 20 bp, human
gcggaaccgggtaaagttaa

SEQ ID NO: 299340 - DNA, 20 bp, human
gtctgatgccattaccgtgt

SEQ ID NO: 299341 - DNA, 20 bp, human
ggccgcagaggtaagacagc

SEQ ID NO: 299342 - DNA, 20 bp, human
gttcttctccgacacggtaa

SEQ ID NO: 299343 - DNA, 20 bp, human
gggaaggaaggacattcggg

SEQ ID NO: 299344 - DNA, 20 bp, human
gagaacgcgctgaaaacaag

SEQ ID NO: 299345 - DNA, 20 bp, human
gactttacccggttccgggg

SEQ ID NO: 299346 - DNA, 20 bp, human
ggggagcacagctaggctag

SEQ ID NO: 299347 - DNA, 20 bp, human
gagccccagcttgttttcca

SEQ ID NO: 299348 - DNA, 20 bp, human
gaggaaggaagcccaggacc

SEQ ID NO: 299349 - DNA, 20 bp, human
gagtccttggaggggtgaag

SEQ ID NO: 299350 - DNA, 20 bp, human
gactcaggtgagtaaacaaa

SEQ ID NO: 299351 - DNA, 20 bp, human
ggaaaacaagctggggctaa

SEQ ID NO: 299352 - DNA, 20 bp, human
gcccgctaaggtaaagaggt

SEQ ID NO: 299353 - DNA, 20 bp, human
gcaaggaaggtcgacagaga

SEQ ID NO: 299354 - DNA, 20 bp, human
gtactaataactctgcccca

SEQ ID NO: 299355 - DNA, 20 bp, human
ggctgccgtcgctctcttaa

SEQ ID NO: 299356 - DNA, 20 bp, human
gagccagccgcgagccacag

SEQ ID NO: 299357 - DNA, 20 bp, human
gcgggtgccgcccggcccga

SEQ ID NO: 299358 - DNA, 20 bp, human
gcgagtgcgagggaggacga

SEQ ID NO: 299359 - DNA, 20 bp, human
gactcggagggcagctgggg

SEQ ID NO: 299360 - DNA, 20 bp, human
ggggacgactcccggctcac

SEQ ID NO: 299361 - DNA, 20 bp, human
ggtcctccctcgcactcgga

SEQ ID NO: 299362 - DNA, 20 bp, human
gtggagacggcgaagagggg

SEQ ID NO: 299363 - DNA, 20 bp, human
gctggggcggggcagaccct

SEQ ID NO: 299364 - DNA, 20 bp, human
ggcccggcgagagaaggacc

SEQ ID NO: 299365 - DNA, 20 bp, human
ggcccctgagcctgcagtcg

SEQ ID NO: 299366 - DNA, 20 bp, human
ggtacatcccacactgctgc

SEQ ID NO: 299367 - DNA, 20 bp, human
gcaaaagttgagcgcgccga

SEQ ID NO: 299368 - DNA, 20 bp, human
gatgtactatcatctgtcgg

SEQ ID NO: 299369 - DNA, 20 bp, human
gacaactgcttccgggtcta

SEQ ID NO: 299370 - DNA, 20 bp, human
gtctagggaaaaattgtttc

SEQ ID NO: 299371 - DNA, 20 bp, human
ggaagcagttgttgtttcaa

SEQ ID NO: 299372 - DNA, 20 bp, human
gagacgccattctgtggcac

SEQ ID NO: 299373 - DNA, 20 bp, human
gaggtgggactgggcgggtc

SEQ ID NO: 299374 - DNA, 20 bp, human
gcaaccctgccgaaaagtgg

SEQ ID NO: 299375 - DNA, 20 bp, human
ggggatgtactatcatctgt

SEQ ID NO: 299376 - DNA, 20 bp, human
ggtgagtaaggtatgcatat

SEQ ID NO: 299377 - DNA, 20 bp, human
ggtggccatcttcaccaaaa

SEQ ID NO: 299378 - DNA, 20 bp, human
ggagggataaacgtgtgtcc

SEQ ID NO: 299379 - DNA, 20 bp, human
gtgagtttccaggcacaaat

SEQ ID NO: 299380 - DNA, 20 bp, human
gatggccacactctaaaact

SEQ ID NO: 299381 - DNA, 20 bp, human
gtttcttcttcacaccattt

SEQ ID NO: 299382 - DNA, 20 bp, human
ggtttccaagttttagagtg

SEQ ID NO: 299383 - DNA, 20 bp, human
gttaaaagacttgagtttcc

SEQ ID NO: 299384 - DNA, 20 bp, human
gtaaaatcctcaagttttcc

SEQ ID NO: 299385 - DNA, 20 bp, human
gtaaacttttttgaattcag

SEQ ID NO: 299386 - DNA, 20 bp, human
gcgggcgctccactagcggt

SEQ ID NO: 299387 - DNA, 20 bp, human
ggcggggcctcggaggtgga

SEQ ID NO: 299388 - DNA, 20 bp, human
gtgcgcgggcgctccactag

SEQ ID NO: 299389 - DNA, 20 bp, human
gaaaagacggagggagtgat

SEQ ID NO: 299390 - DNA, 20 bp, human
gcccctggagctgtggtctc

SEQ ID NO: 299391 - DNA, 20 bp, human
ggggtcgcggggatccttcc

SEQ ID NO: 299392 - DNA, 20 bp, human
gcctgcggcgccgtgaaaga

SEQ ID NO: 299393 - DNA, 20 bp, human
gtgtgctgcgcccatccctg

SEQ ID NO: 299394 - DNA, 20 bp, human
ggcctccgtcggaggagctc

SEQ ID NO: 299395 - DNA, 20 bp, human
gcacagcggcgaaaagacgg

SEQ ID NO: 299396 - DNA, 20 bp, human
gcgcgctccacctacgtcac

SEQ ID NO: 299397 - DNA, 20 bp, human
gtcacaggcgaggtggttcc

SEQ ID NO: 299398 - DNA, 20 bp, human
gcgccaatcaaattcttcct

SEQ ID NO: 299399 - DNA, 20 bp, human
gaccacctcgcctgtgacgt

SEQ ID NO: 299400 - DNA, 20 bp, human
ggggcccgtctttctcaatt

SEQ ID NO: 299401 - DNA, 20 bp, human
gcggagacggaaatgtccga

SEQ ID NO: 299402 - DNA, 20 bp, human
gacctcgcctgtgacgtagg

SEQ ID NO: 299403 - DNA, 20 bp, human
gtccacctacgtcacaggcg

SEQ ID NO: 299404 - DNA, 20 bp, human
gcaggcgaggtggttccagg

SEQ ID NO: 299405 - DNA, 20 bp, human
gaatacagggtcaagtactg

SEQ ID NO: 299406 - DNA, 20 bp, human
gggcccactcagaggggaac

SEQ ID NO: 299407 - DNA, 20 bp, human
gtatcggaagtctacccgat

SEQ ID NO: 299408 - DNA, 20 bp, human
gccgataggcccactcagag

SEQ ID NO: 299409 - DNA, 20 bp, human
gccagagaaaaacgggttat

SEQ ID NO: 299410 - DNA, 20 bp, human
ggctgtagttagtaaggagc

SEQ ID NO: 299411 - DNA, 20 bp, human
ggcctgctgggtgtctgctc

SEQ ID NO: 299412 - DNA, 20 bp, human
gtgccggttcccctctgagt

SEQ ID NO: 299413 - DNA, 20 bp, human
gtgaaaaggttgatggccaa

SEQ ID NO: 299414 - DNA, 20 bp, human
gccgcgagtgcgccctggtt

SEQ ID NO: 299415 - DNA, 20 bp, human
gtggcatccccgagagggag

SEQ ID NO: 299416 - DNA, 20 bp, human
gggcccggggctccgcctct

SEQ ID NO: 299417 - DNA, 20 bp, human
gcagttaaagggcgtgccag

SEQ ID NO: 299418 - DNA, 20 bp, human
gctgctgggagtcgaggact

SEQ ID NO: 299419 - DNA, 20 bp, human
ggcacgccctttaactgctc

SEQ ID NO: 299420 - DNA, 20 bp, human
ggggtctgggctatatccca

SEQ ID NO: 299421 - DNA, 20 bp, human
gagtcgacacagacagacgg

SEQ ID NO: 299422 - DNA, 20 bp, human
gccgacaccagagcagttaa

SEQ ID NO: 299423 - DNA, 20 bp, human
gcggcaaagctctagacgtc

SEQ ID NO: 299424 - DNA, 20 bp, human
gccccgcccggcgggctgct

SEQ ID NO: 299425 - DNA, 20 bp, human
gggcgggctgctgggagtcg

SEQ ID NO: 299426 - DNA, 20 bp, human
gcaatcggaacgtcagaatt

SEQ ID NO: 299427 - DNA, 20 bp, human
gaccccgcatgtcattaggt

SEQ ID NO: 299428 - DNA, 20 bp, human
gcatgctgacgctggaaggc

SEQ ID NO: 299429 - DNA, 20 bp, human
gggaaggcgggcttgcgtat

SEQ ID NO: 299430 - DNA, 20 bp, human
gtccggtctggtacagaagc

SEQ ID NO: 299431 - DNA, 20 bp, human
ggggttaaaaactcaccggc

SEQ ID NO: 299432 - DNA, 20 bp, human
gcgccgacctaatgacatgc

SEQ ID NO: 299433 - DNA, 20 bp, human
gtttaaccccgcatgtcatt

SEQ ID NO: 299434 - DNA, 20 bp, human
gggaaattggcggaacctag

SEQ ID NO: 299435 - DNA, 20 bp, human
gttctgtaccagaccggaag

SEQ ID NO: 299436 - DNA, 20 bp, human
ggcgctctccgggcgacgtg

SEQ ID NO: 299437 - DNA, 20 bp, human
gaacccctcaagcccgtcga

SEQ ID NO: 299438 - DNA, 20 bp, human
gtgactgcgcccggtgccca

SEQ ID NO: 299439 - DNA, 20 bp, human
gtgcgcgggggcgggttcct

SEQ ID NO: 299440 - DNA, 20 bp, human
gcgggccccgccgtcccccc

SEQ ID NO: 299441 - DNA, 20 bp, human
gcgagcaggctgcacatctg

SEQ ID NO: 299442 - DNA, 20 bp, human
gcagcgcgcagggtccaaga

SEQ ID NO: 299443 - DNA, 20 bp, human
ggccgcctccggctggggaa

SEQ ID NO: 299444 - DNA, 20 bp, human
gtctacccggcatgaatctg

SEQ ID NO: 299445 - DNA, 20 bp, human
gggccggaagagagctaaga

SEQ ID NO: 299446 - DNA, 20 bp, human
gcaccccaggcactcaccaa

SEQ ID NO: 299447 - DNA, 20 bp, human
gcccctccccactggcgggt

SEQ ID NO: 299448 - DNA, 20 bp, human
gcctccccgggtcctggata

SEQ ID NO: 299449 - DNA, 20 bp, human
gcccaccccacccgccagtg

SEQ ID NO: 299450 - DNA, 20 bp, human
gcgccgaggaggggcaggta

SEQ ID NO: 299451 - DNA, 20 bp, human
ggaagcaggggcgtgactca

SEQ ID NO: 299452 - DNA, 20 bp, human
gcccggggaggcagcgagca

SEQ ID NO: 299453 - DNA, 20 bp, human
gtggctgtccccgtcttggg

SEQ ID NO: 299454 - DNA, 20 bp, human
gcctccatatccaggacccg

SEQ ID NO: 299455 - DNA, 20 bp, human
gaaatcatcaagctctcagc

SEQ ID NO: 299456 - DNA, 20 bp, human
gcggcagtgcggcggatgta

SEQ ID NO: 299457 - DNA, 20 bp, human
gaagaaagagagataggacc

SEQ ID NO: 299458 - DNA, 20 bp, human
gcagctatgaagagggcggt

SEQ ID NO: 299459 - DNA, 20 bp, human
gggatgtacggatgattcag

SEQ ID NO: 299460 - DNA, 20 bp, human
gagcctgtccggcagtgcgg

SEQ ID NO: 299461 - DNA, 20 bp, human
ggagataggaccgggcgagg

SEQ ID NO: 299462 - DNA, 20 bp, human
gatccgccgcactgccggac

SEQ ID NO: 299463 - DNA, 20 bp, human
ggtacggatgattcagtggc

SEQ ID NO: 299464 - DNA, 20 bp, human
gagatacactccaatagaca

SEQ ID NO: 299465 - DNA, 20 bp, human
gagaagagaaacaaagtgag

SEQ ID NO: 299466 - DNA, 20 bp, human
gcgcccgcgcccgtgggtta

SEQ ID NO: 299467 - DNA, 20 bp, human
ggggcgcgggcgagtcgtat

SEQ ID NO: 299468 - DNA, 20 bp, human
ggggcaggcgggagcgacgt

SEQ ID NO: 299469 - DNA, 20 bp, human
ggcgacgcaacgaagcccgg

SEQ ID NO: 299470 - DNA, 20 bp, human
gcgggcgagtcgtatgggca

SEQ ID NO: 299471 - DNA, 20 bp, human
gtcacgaacgatcagagctg

SEQ ID NO: 299472 - DNA, 20 bp, human
gcgcgcagcctgcggcctcc

SEQ ID NO: 299473 - DNA, 20 bp, human
ggcccccgcgcaagcgacgc

SEQ ID NO: 299474 - DNA, 20 bp, human
gcgggcgacgcaacgaagcc

SEQ ID NO: 299475 - DNA, 20 bp, human
gacgactcgcccgcgcccgt

SEQ ID NO: 299476 - DNA, 20 bp, human
gcggccgtgcttcctgcctc

SEQ ID NO: 299477 - DNA, 20 bp, human
gccccgcccggactggtatg

SEQ ID NO: 299478 - DNA, 20 bp, human
gggcaggtggcggtcgaggc

SEQ ID NO: 299479 - DNA, 20 bp, human
gcggccgagagtgacgcggg

SEQ ID NO: 299480 - DNA, 20 bp, human
gaatacaaatgcagtcgaga

SEQ ID NO: 299481 - DNA, 20 bp, human
gggcctgcggtagctcgcca

SEQ ID NO: 299482 - DNA, 20 bp, human
ggagctaccgcaggccagca

SEQ ID NO: 299483 - DNA, 20 bp, human
gaggtggcggtcgaggccgg

SEQ ID NO: 299484 - DNA, 20 bp, human
gagggcaaatactcaagttt

SEQ ID NO: 299485 - DNA, 20 bp, human
gtctcggccgcataccagtc

SEQ ID NO: 299486 - DNA, 20 bp, human
ggaaacagagagtcagtcac

SEQ ID NO: 299487 - DNA, 20 bp, human
gtggcaaacccaggaacggt

SEQ ID NO: 299488 - DNA, 20 bp, human
gtcttcaacccaccgttcct

SEQ ID NO: 299489 - DNA, 20 bp, human
gtgcttcattagcacattgg

SEQ ID NO: 299490 - DNA, 20 bp, human
gcaagtctaaggagcactgg

SEQ ID NO: 299491 - DNA, 20 bp, human
gcacccactgaatcagaaga

SEQ ID NO: 299492 - DNA, 20 bp, human
ggaccctcttctgattcagt

SEQ ID NO: 299493 - DNA, 20 bp, human
gcaggacccctgctccccca

SEQ ID NO: 299494 - DNA, 20 bp, human
gctgcagagggggcaggctt

SEQ ID NO: 299495 - DNA, 20 bp, human
gtgactctctgtttccattc

SEQ ID NO: 299496 - DNA, 20 bp, human
gtgtctggcgccaacctcgc

SEQ ID NO: 299497 - DNA, 20 bp, human
gtggctaaggtcagcgggag

SEQ ID NO: 299498 - DNA, 20 bp, human
gagagaggggcgagtcgcag

SEQ ID NO: 299499 - DNA, 20 bp, human
gctcccgtgcggtccgtcgg

SEQ ID NO: 299500 - DNA, 20 bp, human
ggcaaacgcgggatctccca

SEQ ID NO: 299501 - DNA, 20 bp, human
gatctcccagggaagctcgg

SEQ ID NO: 299502 - DNA, 20 bp, human
gggcggaggaatacttcagt

SEQ ID NO: 299503 - DNA, 20 bp, human
ggcgccaacctcgctggagg

SEQ ID NO: 299504 - DNA, 20 bp, human
ggtagcgcccgagtgtcggg

SEQ ID NO: 299505 - DNA, 20 bp, human
gtcgctggaggaggctgtcg

SEQ ID NO: 299506 - DNA, 20 bp, human
gccggggccgtggttcgctg

SEQ ID NO: 299507 - DNA, 20 bp, human
gtcagcgctcgcagctccgg

SEQ ID NO: 299508 - DNA, 20 bp, human
ggcgctcggctctgctcccg

SEQ ID NO: 299509 - DNA, 20 bp, human
gcacacgcgctcactcgcac

SEQ ID NO: 299510 - DNA, 20 bp, human
gggctctgctcccggggccg

SEQ ID NO: 299511 - DNA, 20 bp, human
ggcttcagcgctcgcagctc

SEQ ID NO: 299512 - DNA, 20 bp, human
gtcgcagccgcagcgaacca

SEQ ID NO: 299513 - DNA, 20 bp, human
gacgtcaccaaaatcatgaa

SEQ ID NO: 299514 - DNA, 20 bp, human
ggcccccgcccctataaata

SEQ ID NO: 299515 - DNA, 20 bp, human
gagttcggggtgtgcgtgga

SEQ ID NO: 299516 - DNA, 20 bp, human
gtctgtggggagggtggaca

SEQ ID NO: 299517 - DNA, 20 bp, human
gtgatctaggcagtgaaaac

SEQ ID NO: 299518 - DNA, 20 bp, human
gtcacccccagcagacggca

SEQ ID NO: 299519 - DNA, 20 bp, human
gaatatggggtctttctgtg

SEQ ID NO: 299520 - DNA, 20 bp, human
gagggatgatcataggagtc

SEQ ID NO: 299521 - DNA, 20 bp, human
gggtggacagggatgatcat

SEQ ID NO: 299522 - DNA, 20 bp, human
gcttcctcatccactgatct

SEQ ID NO: 299523 - DNA, 20 bp, human
gctgcctagatcagtggatg

SEQ ID NO: 299524 - DNA, 20 bp, human
gtcaaccctgccgtctgctg

SEQ ID NO: 299525 - DNA, 20 bp, human
ggctgggggtgagatctcaa

SEQ ID NO: 299526 - DNA, 20 bp, human
ggagcgggggaaaccgagtc

SEQ ID NO: 299527 - DNA, 20 bp, human
gtgctgcgagggcgcctggg

SEQ ID NO: 299528 - DNA, 20 bp, human
gcgaccaatcgacagcgccg

SEQ ID NO: 299529 - DNA, 20 bp, human
gcgggctccgtgtgctgcga

SEQ ID NO: 299530 - DNA, 20 bp, human
gcggggaggccggtgagcgg

SEQ ID NO: 299531 - DNA, 20 bp, human
ggcgccggggatgattcaaa

SEQ ID NO: 299532 - DNA, 20 bp, human
gactgctgcgagcgctggga

SEQ ID NO: 299533 - DNA, 20 bp, human
gcatccccggcgctgtcgat

SEQ ID NO: 299534 - DNA, 20 bp, human
ggggatgattcaaaaggtcg

SEQ ID NO: 299535 - DNA, 20 bp, human
gccgggcggcctcgccggtg

SEQ ID NO: 299536 - DNA, 20 bp, human
gcgaggttcgggtgcaataa

SEQ ID NO: 299537 - DNA, 20 bp, human
ggagcgcggctcgcagtttg

SEQ ID NO: 299538 - DNA, 20 bp, human
gactgacaggcgcattaggc

SEQ ID NO: 299539 - DNA, 20 bp, human
gcgcggctcgcagtttgggg

SEQ ID NO: 299540 - DNA, 20 bp, human
ggcccgcaggaggtcagagc

SEQ ID NO: 299541 - DNA, 20 bp, human
gcggagagaccgagaccttc

SEQ ID NO: 299542 - DNA, 20 bp, human
gctagctgcaatgaccgcac

SEQ ID NO: 299543 - DNA, 20 bp, human
ggtggcttttcagtcgcccg

SEQ ID NO: 299544 - DNA, 20 bp, human
gctaatgcgcctgtcagtcc

SEQ ID NO: 299545 - DNA, 20 bp, human
gccacccagagtggactttg

SEQ ID NO: 299546 - DNA, 20 bp, human
gtcaaggcgtgagtcaccaa

SEQ ID NO: 299547 - DNA, 20 bp, human
gaccctgaggaccaagtcac

SEQ ID NO: 299548 - DNA, 20 bp, human
gacttggtcctcagggtctc

SEQ ID NO: 299549 - DNA, 20 bp, human
gtcccgtgacttggtcctca

SEQ ID NO: 299550 - DNA, 20 bp, human
gaaggcgctcaggccggatc

SEQ ID NO: 299551 - DNA, 20 bp, human
gagctggggagcagtctgac

SEQ ID NO: 299552 - DNA, 20 bp, human
gtgaggccgagcagcgcgga

SEQ ID NO: 299553 - DNA, 20 bp, human
gccgcccagccccaatggca

SEQ ID NO: 299554 - DNA, 20 bp, human
gagctcggcgtcgaaaaagc

SEQ ID NO: 299555 - DNA, 20 bp, human
gaggagtgacgggatggcgt

SEQ ID NO: 299556 - DNA, 20 bp, human
gtgcgggagaaggtctccat

SEQ ID NO: 299557 - DNA, 20 bp, human
gggacggcgagtgcgggaga

SEQ ID NO: 299558 - DNA, 20 bp, human
ggtagcggagacccccaagt

SEQ ID NO: 299559 - DNA, 20 bp, human
gactctacccgagctcccat

SEQ ID NO: 299560 - DNA, 20 bp, human
gcagaagccaatgggagctc

SEQ ID NO: 299561 - DNA, 20 bp, human
gtccagacggccctttttat

SEQ ID NO: 299562 - DNA, 20 bp, human
gacccccaagtagggaaatt

SEQ ID NO: 299563 - DNA, 20 bp, human
gggctccagggtaacggagg

SEQ ID NO: 299564 - DNA, 20 bp, human
gccgaccgctctagctgtag

SEQ ID NO: 299565 - DNA, 20 bp, human
ggctccgagagggacgcggg

SEQ ID NO: 299566 - DNA, 20 bp, human
ggtggcctcgcgtttgtctt

SEQ ID NO: 299567 - DNA, 20 bp, human
ggggtcccgggcgccgaaca

SEQ ID NO: 299568 - DNA, 20 bp, human
ggggaagcgccggcctgcgg

SEQ ID NO: 299569 - DNA, 20 bp, human
gcccgggcgccgaacaggga

SEQ ID NO: 299570 - DNA, 20 bp, human
ggtaacttgagtcagtaggt

SEQ ID NO: 299571 - DNA, 20 bp, human
gggcgcgcgcatgcgcactc

SEQ ID NO: 299572 - DNA, 20 bp, human
gaggggcgtcttgggcctgg

SEQ ID NO: 299573 - DNA, 20 bp, human
gcaggccggcgcttcccagg

SEQ ID NO: 299574 - DNA, 20 bp, human
gggcgccgaacagggacggc

SEQ ID NO: 299575 - DNA, 20 bp, human
gcgaggccacactgacctcc

SEQ ID NO: 299576 - DNA, 20 bp, human
gccctggcgccaagagaaga

SEQ ID NO: 299577 - DNA, 20 bp, human
gagaaggcggaactgaaccc

SEQ ID NO: 299578 - DNA, 20 bp, human
gggccctagggccagtggga

SEQ ID NO: 299579 - DNA, 20 bp, human
gtggccagagattgccggaa

SEQ ID NO: 299580 - DNA, 20 bp, human
gcggaaaggggcacagcctc

SEQ ID NO: 299581 - DNA, 20 bp, human
gcccactcccacaccagata

SEQ ID NO: 299582 - DNA, 20 bp, human
ggccccggctctgtttcccc

SEQ ID NO: 299583 - DNA, 20 bp, human
gacgaagggaagggtagcca

SEQ ID NO: 299584 - DNA, 20 bp, human
ggcgccaggggaaacagagc

SEQ ID NO: 299585 - DNA, 20 bp, human
gggttgtggccagagattgc

SEQ ID NO: 299586 - DNA, 20 bp, human
gtcctgtgacaaggagtgac

SEQ ID NO: 299587 - DNA, 20 bp, human
gactcccagtggctaagtgg

SEQ ID NO: 299588 - DNA, 20 bp, human
gccttgtcacaggacccatg

SEQ ID NO: 299589 - DNA, 20 bp, human
gccctgagccccgtggagaa

SEQ ID NO: 299590 - DNA, 20 bp, human
gttcaagagcgagaactgag

SEQ ID NO: 299591 - DNA, 20 bp, human
gagaataaggtaccaggtgg

SEQ ID NO: 299592 - DNA, 20 bp, human
gaggcacctctaagagaata

SEQ ID NO: 299593 - DNA, 20 bp, human
gaagagaataaggtaccagg

SEQ ID NO: 299594 - DNA, 20 bp, human
ggaagaaggagaacatttgg

SEQ ID NO: 299595 - DNA, 20 bp, human
ggacagatcctttcattccc

SEQ ID NO: 299596 - DNA, 20 bp, human
gtaacttggtgagacaagta

SEQ ID NO: 299597 - DNA, 20 bp, human
gagaatgaggagtcctgtga

SEQ ID NO: 299598 - DNA, 20 bp, human
ggaccagggacatgagaatg

SEQ ID NO: 299599 - DNA, 20 bp, human
ggctgtgatatcctctacac

SEQ ID NO: 299600 - DNA, 20 bp, human
gctcctcattctcatgtccc

SEQ ID NO: 299601 - DNA, 20 bp, human
ggtttccatctcatcttttc

SEQ ID NO: 299602 - DNA, 20 bp, human
gctgaaaaatgtcagagcac

SEQ ID NO: 299603 - DNA, 20 bp, human
ggggatgcctagatcagggc

SEQ ID NO: 299604 - DNA, 20 bp, human
gaggcaatggggacagacca

SEQ ID NO: 299605 - DNA, 20 bp, human
ggagtcctgtgatggtgact

SEQ ID NO: 299606 - DNA, 20 bp, human
gtctccacggagaacaacac

SEQ ID NO: 299607 - DNA, 20 bp, human
ggacacccacatgggttctg

SEQ ID NO: 299608 - DNA, 20 bp, human
gcccacctcagaacccatgt

SEQ ID NO: 299609 - DNA, 20 bp, human
gacccacatgggttctgagg

SEQ ID NO: 299610 - DNA, 20 bp, human
gctgctcccagcttggacta

SEQ ID NO: 299611 - DNA, 20 bp, human
gctccaagactaaacagatt

SEQ ID NO: 299612 - DNA, 20 bp, human
gacagattaggtattctcca

SEQ ID NO: 299613 - DNA, 20 bp, human
gacaactataagatagttga

SEQ ID NO: 299614 - DNA, 20 bp, human
gagtggccatagtccaagct

SEQ ID NO: 299615 - DNA, 20 bp, human
gtttcctgtgttgttctccg

SEQ ID NO: 299616 - DNA, 20 bp, human
ggaatgaggtaggtgatggt

SEQ ID NO: 299617 - DNA, 20 bp, human
gaaagtgcctacttgaaacg

SEQ ID NO: 299618 - DNA, 20 bp, human
gaagtgaatgaggtaggtga

SEQ ID NO: 299619 - DNA, 20 bp, human
gcacgtgggtgtcagaagga

SEQ ID NO: 299620 - DNA, 20 bp, human
gacctacctcattcacttga

SEQ ID NO: 299621 - DNA, 20 bp, human
gctggaaccccgtttcaagt

SEQ ID NO: 299622 - DNA, 20 bp, human
gctgccccagctgtgagaca

SEQ ID NO: 299623 - DNA, 20 bp, human
gaacatgcatggaaacctca

SEQ ID NO: 299624 - DNA, 20 bp, human
gacgtgggtcttgtgatggt

SEQ ID NO: 299625 - DNA, 20 bp, human
gagtacttcaacttcaaccc

SEQ ID NO: 299626 - DNA, 20 bp, human
gctgctgctagataggagta

SEQ ID NO: 299627 - DNA, 20 bp, human
gagggcacctgctgctagat

SEQ ID NO: 299628 - DNA, 20 bp, human
gagggctgcttagaaacaaa

SEQ ID NO: 299629 - DNA, 20 bp, human
ggacccacgtgggtatcagg

SEQ ID NO: 299630 - DNA, 20 bp, human
ggagaactaaaaagcggtca

SEQ ID NO: 299631 - DNA, 20 bp, human
gtgccccctgatacccacgt

SEQ ID NO: 299632 - DNA, 20 bp, human
ggggtggggacagtttatac

SEQ ID NO: 299633 - DNA, 20 bp, human
gagcccttttatcccagcct

SEQ ID NO: 299634 - DNA, 20 bp, human
ggtcaaggctgggatttacc

SEQ ID NO: 299635 - DNA, 20 bp, human
ggggatttaccaggaagaat

SEQ ID NO: 299636 - DNA, 20 bp, human
gcagacagcaagttagatgg

SEQ ID NO: 299637 - DNA, 20 bp, human
gagagtgataaaaacattag

SEQ ID NO: 299638 - DNA, 20 bp, human
gatctagaaataatgcagaa

SEQ ID NO: 299639 - DNA, 20 bp, human
gggcaagacatctcggtggc

SEQ ID NO: 299640 - DNA, 20 bp, human
gcatgacaacatctcaaata

SEQ ID NO: 299641 - DNA, 20 bp, human
gcattaaaagctcctaagtg

SEQ ID NO: 299642 - DNA, 20 bp, human
ggatgtgatagaatgaatgc

SEQ ID NO: 299643 - DNA, 20 bp, human
gaaagccttatatcaaacat

SEQ ID NO: 299644 - DNA, 20 bp, human
gccaggaaataaattggctc

SEQ ID NO: 299645 - DNA, 20 bp, human
ggagaaaactataaccgcaa

SEQ ID NO: 299646 - DNA, 20 bp, human
gagctcccaagacctccctc

SEQ ID NO: 299647 - DNA, 20 bp, human
gaagctatggcaaggatctc

SEQ ID NO: 299648 - DNA, 20 bp, human
gttggattgtagggacaagg

SEQ ID NO: 299649 - DNA, 20 bp, human
gggtccccgtggagctgcca

SEQ ID NO: 299650 - DNA, 20 bp, human
ggctccacggggaccagcct

SEQ ID NO: 299651 - DNA, 20 bp, human
gcttcccagagggaggtctt

SEQ ID NO: 299652 - DNA, 20 bp, human
gggagcttgtgcctggacaa

SEQ ID NO: 299653 - DNA, 20 bp, human
gtggaatagcatacttccac

SEQ ID NO: 299654 - DNA, 20 bp, human
gagtgcttccttggattgta

SEQ ID NO: 299655 - DNA, 20 bp, human
gtggcctgcagaaccctgct

SEQ ID NO: 299656 - DNA, 20 bp, human
gcaggcttggctctggaaag

SEQ ID NO: 299657 - DNA, 20 bp, human
gtaacctaagttaactcatt

SEQ ID NO: 299658 - DNA, 20 bp, human
gcaggatcttgtccaggcat

SEQ ID NO: 299659 - DNA, 20 bp, human
gacacagaggccaggaggaa

SEQ ID NO: 299660 - DNA, 20 bp, human
gaggaaaagcagaaacacag

SEQ ID NO: 299661 - DNA, 20 bp, human
ggaggaagggctgagagcct

SEQ ID NO: 299662 - DNA, 20 bp, human
gcagaaacacagaggccagg

SEQ ID NO: 299663 - DNA, 20 bp, human
gacacgaatacaaaagatgc

SEQ ID NO: 299664 - DNA, 20 bp, human
gtacaaaagatgcagggaac

SEQ ID NO: 299665 - DNA, 20 bp, human
ggctggccatggtgagttgg

SEQ ID NO: 299666 - DNA, 20 bp, human
ggtccaggtgtgggtccctt

SEQ ID NO: 299667 - DNA, 20 bp, human
ggaatgacccagcgtgtgcc

SEQ ID NO: 299668 - DNA, 20 bp, human
ggcttgccatggtgagtcgg

SEQ ID NO: 299669 - DNA, 20 bp, human
gcagaatcttgtccaggtgt

SEQ ID NO: 299670 - DNA, 20 bp, human
gacatgcattaaaaaaatgc

SEQ ID NO: 299671 - DNA, 20 bp, human
gtacccaagggacccacacc

SEQ ID NO: 299672 - DNA, 20 bp, human
gacacagaggccaggaggaa

SEQ ID NO: 299673 - DNA, 20 bp, human
gaggaaaagcagaaacacag

SEQ ID NO: 299674 - DNA, 20 bp, human
ggcacaaccaggcacacgct

SEQ ID NO: 299675 - DNA, 20 bp, human
ggaggaagggctgagagcct

SEQ ID NO: 299676 - DNA, 20 bp, human
ggtccaggtgtgggtccctt

SEQ ID NO: 299677 - DNA, 20 bp, human
ggaatgacccagcgtgtgcc

SEQ ID NO: 299678 - DNA, 20 bp, human
ggcttgccatggtgagtcgg

SEQ ID NO: 299679 - DNA, 20 bp, human
gcagaatcttgtccaggtgt

SEQ ID NO: 299680 - DNA, 20 bp, human
gacatgcattaaaaaaatgc

SEQ ID NO: 299681 - DNA, 20 bp, human
gtacccaagggacccacacc

SEQ ID NO: 299682 - DNA, 20 bp, human
gacacagaggccaggaggaa

SEQ ID NO: 299683 - DNA, 20 bp, human
gaggaaaagcagaaacacag

SEQ ID NO: 299684 - DNA, 20 bp, human
ggcacaaccaggcacacgct

SEQ ID NO: 299685 - DNA, 20 bp, human
ggaggaagggctgagagcct

SEQ ID NO: 299686 - DNA, 20 bp, human
gagagctgatgtaacctcag

SEQ ID NO: 299687 - DNA, 20 bp, human
gaagctcccgaggcctcttt

SEQ ID NO: 299688 - DNA, 20 bp, human
gctgcacccaaagaggcctc

SEQ ID NO: 299689 - DNA, 20 bp, human
gaggactgtgagcctagtca

SEQ ID NO: 299690 - DNA, 20 bp, human
gaggactcagacttggctct

SEQ ID NO: 299691 - DNA, 20 bp, human
gctgtgagcctagtcaaggg

SEQ ID NO: 299692 - DNA, 20 bp, human
gacaaactgctcaaggtgca

SEQ ID NO: 299693 - DNA, 20 bp, human
gaaggaacagaaccatgtcc

SEQ ID NO: 299694 - DNA, 20 bp, human
gggagtcctagaagctcccg

SEQ ID NO: 299695 - DNA, 20 bp, human
gagaggcctcgggagcttct

SEQ ID NO: 299696 - DNA, 20 bp, human
gggaaggggcagtatcaggc

SEQ ID NO: 299697 - DNA, 20 bp, human
gtgccctccagctaagacct

SEQ ID NO: 299698 - DNA, 20 bp, human
ggcggggcctgtcacacctc

SEQ ID NO: 299699 - DNA, 20 bp, human
ggagctgttcgcatcgggtc

SEQ ID NO: 299700 - DNA, 20 bp, human
gggagggcagactgagttta

SEQ ID NO: 299701 - DNA, 20 bp, human
gctccagggtggcgtctctc

SEQ ID NO: 299702 - DNA, 20 bp, human
gagggggagctgttcgcatc

SEQ ID NO: 299703 - DNA, 20 bp, human
gggctcctgcgcacgccctg

SEQ ID NO: 299704 - DNA, 20 bp, human
gtccagctaagacctgggga

SEQ ID NO: 299705 - DNA, 20 bp, human
gcccttccccaggtcttagc

SEQ ID NO: 299706 - DNA, 20 bp, human
gtcaggaagcaactggtatt

SEQ ID NO: 299707 - DNA, 20 bp, human
ggggcatgtatgcatctccc

SEQ ID NO: 299708 - DNA, 20 bp, human
gactcccatgcaccccaaag

SEQ ID NO: 299709 - DNA, 20 bp, human
ggcaactggtattaggagta

SEQ ID NO: 299710 - DNA, 20 bp, human
gaatgctggtgtcttctaac

SEQ ID NO: 299711 - DNA, 20 bp, human
gttgtgaagacaggaggact

SEQ ID NO: 299712 - DNA, 20 bp, human
gagcaggaagaggacttcag

SEQ ID NO: 299713 - DNA, 20 bp, human
gaactgatctcaagtaaaac

SEQ ID NO: 299714 - DNA, 20 bp, human
gttcctgaagtgcatatctc

SEQ ID NO: 299715 - DNA, 20 bp, human
gaggtcaacgcaaaagctcc

SEQ ID NO: 299716 - DNA, 20 bp, human
gtaggctgtaaggtgctcaa

SEQ ID NO: 299717 - DNA, 20 bp, human
ggctgaggcagcaggcaact

SEQ ID NO: 299718 - DNA, 20 bp, human
gtacactgcacgggataaaa

SEQ ID NO: 299719 - DNA, 20 bp, human
ggtacagggtggaccagagt

SEQ ID NO: 299720 - DNA, 20 bp, human
gtgcctcagcatgtgcctaa

SEQ ID NO: 299721 - DNA, 20 bp, human
ggggaccatcagtgcaatag

SEQ ID NO: 299722 - DNA, 20 bp, human
gcacctttaggcacatgctg

SEQ ID NO: 299723 - DNA, 20 bp, human
gatagaggactgacttacaa

SEQ ID NO: 299724 - DNA, 20 bp, human
ggcttggaatgaacaagcag

SEQ ID NO: 299725 - DNA, 20 bp, human
gtgaaaacagcagcatactc

SEQ ID NO: 299726 - DNA, 20 bp, human
gctcccaggtgagaggtatg

SEQ ID NO: 299727 - DNA, 20 bp, human
ggtccacatacctctcacct

SEQ ID NO: 299728 - DNA, 20 bp, human
gaccaggggaggtgtcaaca

SEQ ID NO: 299729 - DNA, 20 bp, human
gaagctacaaacctagtctt

SEQ ID NO: 299730 - DNA, 20 bp, human
gggacagtgatcctgcttcc

SEQ ID NO: 299731 - DNA, 20 bp, human
gcaaccaatgacattgaacc

SEQ ID NO: 299732 - DNA, 20 bp, human
ggaagcagtggtagcctccc

SEQ ID NO: 299733 - DNA, 20 bp, human
gcagcacgtgagttgaaaca

SEQ ID NO: 299734 - DNA, 20 bp, human
gtgacattgaacctggaagc

SEQ ID NO: 299735 - DNA, 20 bp, human
gtgtcattggttggatatta

SEQ ID NO: 299736 - DNA, 20 bp, human
gcaccaagatgcctgacaag

SEQ ID NO: 299737 - DNA, 20 bp, human
gagaggggcaatgtggaata

SEQ ID NO: 299738 - DNA, 20 bp, human
gaaaacaattgcttcaagga

SEQ ID NO: 299739 - DNA, 20 bp, human
gtgcagggtgtgtgatgcac

SEQ ID NO: 299740 - DNA, 20 bp, human
gatagtctcaagggtgtgcc

SEQ ID NO: 299741 - DNA, 20 bp, human
ggataaaaacaattgcttca

SEQ ID NO: 299742 - DNA, 20 bp, human
gttcctggttccctcttgtc

SEQ ID NO: 299743 - DNA, 20 bp, human
gaggagtgactactaatgag

SEQ ID NO: 299744 - DNA, 20 bp, human
gcctcattcaggcctgctgg

SEQ ID NO: 299745 - DNA, 20 bp, human
gggcatcttggtgagtacac

SEQ ID NO: 299746 - DNA, 20 bp, human
gcacagggataatccttccc

SEQ ID NO: 299747 - DNA, 20 bp, human
gttcctcttcatcaccttgg

SEQ ID NO: 299748 - DNA, 20 bp, human
gtatactctttgtctgaaag

SEQ ID NO: 299749 - DNA, 20 bp, human
gggaccagcaggccaaccat

SEQ ID NO: 299750 - DNA, 20 bp, human
gagcaggccaaccattggta

SEQ ID NO: 299751 - DNA, 20 bp, human
ggacaaagcaggaaccaacc

SEQ ID NO: 299752 - DNA, 20 bp, human
gccttcagagcaatgggctt

SEQ ID NO: 299753 - DNA, 20 bp, human
ggaaggccagaagtagtagt

SEQ ID NO: 299754 - DNA, 20 bp, human
gattatccctgtgatcagac

SEQ ID NO: 299755 - DNA, 20 bp, human
gctcttcatcaccttggggg

SEQ ID NO: 299756 - DNA, 20 bp, human
gtgagcaaagcgtgttcaga

SEQ ID NO: 299757 - DNA, 20 bp, human
ggagaccttagcctgggaaa

SEQ ID NO: 299758 - DNA, 20 bp, human
gggcaccaaaccagcctctc

SEQ ID NO: 299759 - DNA, 20 bp, human
ggcaaagcgtgttcagaggg

SEQ ID NO: 299760 - DNA, 20 bp, human
gagaagagtggctgaccgag

SEQ ID NO: 299761 - DNA, 20 bp, human
gagacccttttcccaggcta

SEQ ID NO: 299762 - DNA, 20 bp, human
gtatgttaggggctaaatgt

SEQ ID NO: 299763 - DNA, 20 bp, human
gaagtccccagtcctaactg

SEQ ID NO: 299764 - DNA, 20 bp, human
gagagcctctggctgaaatt

SEQ ID NO: 299765 - DNA, 20 bp, human
gacagaggggtttaaggcta

SEQ ID NO: 299766 - DNA, 20 bp, human
ggaactgcaggcctctagga

SEQ ID NO: 299767 - DNA, 20 bp, human
gtgggtccctgggatgcgag

SEQ ID NO: 299768 - DNA, 20 bp, human
gcagaggtgtagagccgtat

SEQ ID NO: 299769 - DNA, 20 bp, human
ggtccctgggatgcgagggg

SEQ ID NO: 299770 - DNA, 20 bp, human
ggcttatgcagggaggaact

SEQ ID NO: 299771 - DNA, 20 bp, human
gatctcaagtattaacccac

SEQ ID NO: 299772 - DNA, 20 bp, human
gcacctcctgatgctaggtc

SEQ ID NO: 299773 - DNA, 20 bp, human
ggcccagctcagaaaataga

SEQ ID NO: 299774 - DNA, 20 bp, human
gagctgcctgtgagatagat

SEQ ID NO: 299775 - DNA, 20 bp, human
ggcttctagcgtcccgcaca

SEQ ID NO: 299776 - DNA, 20 bp, human
gtagctgggatgtggttcaa

SEQ ID NO: 299777 - DNA, 20 bp, human
ggctacatgtagctgggatg

SEQ ID NO: 299778 - DNA, 20 bp, human
gctgctgttgaattctatgt

SEQ ID NO: 299779 - DNA, 20 bp, human
gtgtcattggaggagagcca

SEQ ID NO: 299780 - DNA, 20 bp, human
gtcctcagctacatgtagct

SEQ ID NO: 299781 - DNA, 20 bp, human
gaaggtcttcctcagaccct

SEQ ID NO: 299782 - DNA, 20 bp, human
ggctgacagtcatggatgat

SEQ ID NO: 299783 - DNA, 20 bp, human
gtcccagctacatgtagctg

SEQ ID NO: 299784 - DNA, 20 bp, human
ggattggcctacgcagaagt

SEQ ID NO: 299785 - DNA, 20 bp, human
gagtgtacccacttctgcgt

SEQ ID NO: 299786 - DNA, 20 bp, human
gagatgtaggggacccccag

SEQ ID NO: 299787 - DNA, 20 bp, human
gtgtcaccctgggacagtag

SEQ ID NO: 299788 - DNA, 20 bp, human
ggagaggcaggggtctatgg

SEQ ID NO: 299789 - DNA, 20 bp, human
gacctggtctggagatgtag

SEQ ID NO: 299790 - DNA, 20 bp, human
gtggctgcggagccctccgg

SEQ ID NO: 299791 - DNA, 20 bp, human
gagacaggtggtggctacga

SEQ ID NO: 299792 - DNA, 20 bp, human
gggaagcttggcgtgctaga

SEQ ID NO: 299793 - DNA, 20 bp, human
gggcaggggtctatggtggc

SEQ ID NO: 299794 - DNA, 20 bp, human
gtgggctgctggggcccggt

SEQ ID NO: 299795 - DNA, 20 bp, human
gaaacctcccagtgtcaccc

SEQ ID NO: 299796 - DNA, 20 bp, human
gccacagcccgggatacccc

SEQ ID NO: 299797 - DNA, 20 bp, human
gcacggaacggtggggtgta

SEQ ID NO: 299798 - DNA, 20 bp, human
gaaggtacccggggtatccc

SEQ ID NO: 299799 - DNA, 20 bp, human
ggggctgtggagcaagcgcg

SEQ ID NO: 299800 - DNA, 20 bp, human
gagggacccacggaacggtg

SEQ ID NO: 299801 - DNA, 20 bp, human
gtgcaggcgccgtgacgcaa

SEQ ID NO: 299802 - DNA, 20 bp, human
gcaggggcatgcaatctagt

SEQ ID NO: 299803 - DNA, 20 bp, human
gcgtgacgcaacggcgtccc

SEQ ID NO: 299804 - DNA, 20 bp, human
gacggcgtccccggctgcgt

SEQ ID NO: 299805 - DNA, 20 bp, human
gggtgagaaaacaacgaaat

SEQ ID NO: 299806 - DNA, 20 bp, human
gatccaatgagcaacttcgt

SEQ ID NO: 299807 - DNA, 20 bp, human
gaacccggaaatttgacgat

SEQ ID NO: 299808 - DNA, 20 bp, human
gagcctacgaagttgctcat

SEQ ID NO: 299809 - DNA, 20 bp, human
gtggcaccgcccacataacc

SEQ ID NO: 299810 - DNA, 20 bp, human
gaagcgtagtcttaggtgtc

SEQ ID NO: 299811 - DNA, 20 bp, human
gtcaaatttccgggttatgt

SEQ ID NO: 299812 - DNA, 20 bp, human
gaagactacgcttcccagaa

SEQ ID NO: 299813 - DNA, 20 bp, human
gcggaagaggagccaataag

SEQ ID NO: 299814 - DNA, 20 bp, human
ggaaaaagaaactaaacagt

SEQ ID NO: 299815 - DNA, 20 bp, human
gtcaatgagcgactcggaag

SEQ ID NO: 299816 - DNA, 20 bp, human
gccagtgctaagttcgcttg

SEQ ID NO: 299817 - DNA, 20 bp, human
gcggtagcggaccgtattct

SEQ ID NO: 299818 - DNA, 20 bp, human
ggctacaccctcctcaattc

SEQ ID NO: 299819 - DNA, 20 bp, human
gcgccaaccagaattgagga

SEQ ID NO: 299820 - DNA, 20 bp, human
gcaccctcctcaattctggt

SEQ ID NO: 299821 - DNA, 20 bp, human
ggaggtgtgtgctaaccaag

SEQ ID NO: 299822 - DNA, 20 bp, human
ggtgacatgagtgttaggga

SEQ ID NO: 299823 - DNA, 20 bp, human
gcaggaatggcagtctgtca

SEQ ID NO: 299824 - DNA, 20 bp, human
gtggcgagatgcgctcttcc

SEQ ID NO: 299825 - DNA, 20 bp, human
gcccccggagccgtgagcgt

SEQ ID NO: 299826 - DNA, 20 bp, human
gaacctgccattattgttgg

SEQ ID NO: 299827 - DNA, 20 bp, human
ggataacctgccattattgt

SEQ ID NO: 299828 - DNA, 20 bp, human
gcacgtcagcaagtgtggga

SEQ ID NO: 299829 - DNA, 20 bp, human
gcctgtccaagtgatcctct

SEQ ID NO: 299830 - DNA, 20 bp, human
gtgccattattgttggaggc

SEQ ID NO: 299831 - DNA, 20 bp, human
gtataaagggcggctgtggg

SEQ ID NO: 299832 - DNA, 20 bp, human
gggatcacttggacaggacc

SEQ ID NO: 299833 - DNA, 20 bp, human
gtacggctgcacacgtcccc

SEQ ID NO: 299834 - DNA, 20 bp, human
gtgtgcacgtcagcaagtgt

SEQ ID NO: 299835 - DNA, 20 bp, human
gtcagggtcccccagggacc

SEQ ID NO: 299836 - DNA, 20 bp, human
gagccggggcctctgaggta

SEQ ID NO: 299837 - DNA, 20 bp, human
ggggactccggctcacagaa

SEQ ID NO: 299838 - DNA, 20 bp, human
gtgagtggccgggaccgagg

SEQ ID NO: 299839 - DNA, 20 bp, human
ggaccgaggcggcacctggg

SEQ ID NO: 299840 - DNA, 20 bp, human
ggtcccggccactcaagccc

SEQ ID NO: 299841 - DNA, 20 bp, human
gagccctgctccagtggcca

SEQ ID NO: 299842 - DNA, 20 bp, human
gctccgcccaggtgccgcct

SEQ ID NO: 299843 - DNA, 20 bp, human
gcgggaccgaggcggcacct

SEQ ID NO: 299844 - DNA, 20 bp, human
gctctagctgggaacctcgg

SEQ ID NO: 299845 - DNA, 20 bp, human
gaaccctgaaaactgcgcag

SEQ ID NO: 299846 - DNA, 20 bp, human
ggcctctgaacccccagcat

SEQ ID NO: 299847 - DNA, 20 bp, human
gtggcccgagcaggcgagga

SEQ ID NO: 299848 - DNA, 20 bp, human
gcacccacctgcggtctctt

SEQ ID NO: 299849 - DNA, 20 bp, human
gctgccagtcctgaggaggg

SEQ ID NO: 299850 - DNA, 20 bp, human
gtgacctgccgcagccataa

SEQ ID NO: 299851 - DNA, 20 bp, human
gaggctggggcaggctgcgt

SEQ ID NO: 299852 - DNA, 20 bp, human
gtcacagaatgttgcgtccc

SEQ ID NO: 299853 - DNA, 20 bp, human
gccccgatgcagagcttcca

SEQ ID NO: 299854 - DNA, 20 bp, human
ggaacccaagagaccgcagg

SEQ ID NO: 299855 - DNA, 20 bp, human
gcagcaggtgcccctcccaa

SEQ ID NO: 299856 - DNA, 20 bp, human
gctccaggaaatgaccccct

SEQ ID NO: 299857 - DNA, 20 bp, human
ggctctggcctgatgcaccc

SEQ ID NO: 299858 - DNA, 20 bp, human
ggctccagacagccaggctc

SEQ ID NO: 299859 - DNA, 20 bp, human
gcttggggactcagcaccag

SEQ ID NO: 299860 - DNA, 20 bp, human
gtgtgccaaacaatggacaa

SEQ ID NO: 299861 - DNA, 20 bp, human
gcacactggcagagtgtcca

SEQ ID NO: 299862 - DNA, 20 bp, human
gctataaagctggccccctg

SEQ ID NO: 299863 - DNA, 20 bp, human
gcacttcggctctgagactc

SEQ ID NO: 299864 - DNA, 20 bp, human
gcctctgtccacactctgtc

SEQ ID NO: 299865 - DNA, 20 bp, human
gtgaccctaccccccatgtt

SEQ ID NO: 299866 - DNA, 20 bp, human
gtcccggagtgctgcacctc

SEQ ID NO: 299867 - DNA, 20 bp, human
gcaggattgggcaagacaga

SEQ ID NO: 299868 - DNA, 20 bp, human
gaggccaccggcccacatac

SEQ ID NO: 299869 - DNA, 20 bp, human
gagagggacggggagagtga

SEQ ID NO: 299870 - DNA, 20 bp, human
gtcagagatgacagctcttc

SEQ ID NO: 299871 - DNA, 20 bp, human
ggccctatttatgggatcta

SEQ ID NO: 299872 - DNA, 20 bp, human
ggggccggtggcctgtgagc

SEQ ID NO: 299873 - DNA, 20 bp, human
ggccagaggtgcagcactcc

SEQ ID NO: 299874 - DNA, 20 bp, human
ggagtcgttgtccctgccag

SEQ ID NO: 299875 - DNA, 20 bp, human
gcttccggctcacaggccac

SEQ ID NO: 299876 - DNA, 20 bp, human
ggcaggggatcagtatagta

SEQ ID NO: 299877 - DNA, 20 bp, human
gtgtgcagctggtctgatct

SEQ ID NO: 299878 - DNA, 20 bp, human
gcgtgggtccccaggaacgg

SEQ ID NO: 299879 - DNA, 20 bp, human
gagggagagcgtgggtcccc

SEQ ID NO: 299880 - DNA, 20 bp, human
gctcccctgggtaattttgc

SEQ ID NO: 299881 - DNA, 20 bp, human
gtcagaccagctgcacagcc

SEQ ID NO: 299882 - DNA, 20 bp, human
gacaaagcagaatggtgggt

SEQ ID NO: 299883 - DNA, 20 bp, human
ggggtccccaggaacggggg

SEQ ID NO: 299884 - DNA, 20 bp, human
gtgcttcccaggctgggcga

SEQ ID NO: 299885 - DNA, 20 bp, human
ggaaccagggcgagaacaag

SEQ ID NO: 299886 - DNA, 20 bp, human
ggatctctcaggaagtgaat

SEQ ID NO: 299887 - DNA, 20 bp, human
gctggcactgaggatctctc

SEQ ID NO: 299888 - DNA, 20 bp, human
gaggagactcgacagacggg

SEQ ID NO: 299889 - DNA, 20 bp, human
gaggttcgcccgcgactcgg

SEQ ID NO: 299890 - DNA, 20 bp, human
ggcgactcgggggaaagatg

SEQ ID NO: 299891 - DNA, 20 bp, human
gcaacaggagactcgacaga

SEQ ID NO: 299892 - DNA, 20 bp, human
gggaacgctgaatgctgctg

SEQ ID NO: 299893 - DNA, 20 bp, human
gtcagtgccagatctccacc

SEQ ID NO: 299894 - DNA, 20 bp, human
ggggaggttcgcccgcgact

SEQ ID NO: 299895 - DNA, 20 bp, human
gatgctgctgaggacacaac

SEQ ID NO: 299896 - DNA, 20 bp, human
gccctggagcctgatcaccc

SEQ ID NO: 299897 - DNA, 20 bp, human
ggggtggcacaggaaagtgc

SEQ ID NO: 299898 - DNA, 20 bp, human
gtcactgtcactctggtcgc

SEQ ID NO: 299899 - DNA, 20 bp, human
ggggccagaggcacattagc

SEQ ID NO: 299900 - DNA, 20 bp, human
gtctgactgcccactgcgtc

SEQ ID NO: 299901 - DNA, 20 bp, human
ggagggctgtgggcactgat

SEQ ID NO: 299902 - DNA, 20 bp, human
gtgggcagtcagagctccgg

SEQ ID NO: 299903 - DNA, 20 bp, human
gcagtgggcagtcagagctc

SEQ ID NO: 299904 - DNA, 20 bp, human
ggtcgctggcgctgtgcctc

SEQ ID NO: 299905 - DNA, 20 bp, human
gaccaggcatcaccacccgg

SEQ ID NO: 299906 - DNA, 20 bp, human
ggctgctgccctctctacct

SEQ ID NO: 299907 - DNA, 20 bp, human
gatccaggaagctcccacaa

SEQ ID NO: 299908 - DNA, 20 bp, human
gcatgcagccaaaggccccg

SEQ ID NO: 299909 - DNA, 20 bp, human
gaagctcccacaagggagtg

SEQ ID NO: 299910 - DNA, 20 bp, human
gcagggcagcagggtataaa

SEQ ID NO: 299911 - DNA, 20 bp, human
gggccccagacgctgtgctg

SEQ ID NO: 299912 - DNA, 20 bp, human
gcggccgtcggttgagtctg

SEQ ID NO: 299913 - DNA, 20 bp, human
gaaggtgcctgcctccagtg

SEQ ID NO: 299914 - DNA, 20 bp, human
gcgtccccagactcaaccga

SEQ ID NO: 299915 - DNA, 20 bp, human
ggatcaccccactcccttgt

SEQ ID NO: 299916 - DNA, 20 bp, human
ggatcccagcttcagccctg

SEQ ID NO: 299917 - DNA, 20 bp, human
gctctcagcggggctcagtg

SEQ ID NO: 299918 - DNA, 20 bp, human
gccacctccactccagtcga

SEQ ID NO: 299919 - DNA, 20 bp, human
gtgtgaccgaaaggctagga

SEQ ID NO: 299920 - DNA, 20 bp, human
gagagcaagatccatccctg

SEQ ID NO: 299921 - DNA, 20 bp, human
ggaccgaaaggctaggatgg

SEQ ID NO: 299922 - DNA, 20 bp, human
gagcgtgggggtcacctggc

SEQ ID NO: 299923 - DNA, 20 bp, human
gccagtcgatggagcaggtg

SEQ ID NO: 299924 - DNA, 20 bp, human
gccagagcgtgggggtcacc

SEQ ID NO: 299925 - DNA, 20 bp, human
ggctccatcgactggagtgg

SEQ ID NO: 299926 - DNA, 20 bp, human
gtggccccggcgtggcccgg

SEQ ID NO: 299927 - DNA, 20 bp, human
gggccagcgggactgacttc

SEQ ID NO: 299928 - DNA, 20 bp, human
gccgcccccgggccacgccg

SEQ ID NO: 299929 - DNA, 20 bp, human
gcggcagccgcgtagaagga

SEQ ID NO: 299930 - DNA, 20 bp, human
gcgcgtgcacgcagacccgg

SEQ ID NO: 299931 - DNA, 20 bp, human
gcagccgcgtagaaggacgg

SEQ ID NO: 299932 - DNA, 20 bp, human
gtggggaggagcagtttcga

SEQ ID NO: 299933 - DNA, 20 bp, human
gggtctgcgtgcacgcgcgg

SEQ ID NO: 299934 - DNA, 20 bp, human
gatcccgccgtccttctacg

SEQ ID NO: 299935 - DNA, 20 bp, human
gtgtgggaaggcgccgtccc

SEQ ID NO: 299936 - DNA, 20 bp, human
gccactagcacgccggttcc

SEQ ID NO: 299937 - DNA, 20 bp, human
gtccctgagggagcggtggg

SEQ ID NO: 299938 - DNA, 20 bp, human
ggctccggggctcgcgccga

SEQ ID NO: 299939 - DNA, 20 bp, human
gcgcccgcgaaaaccctgag

SEQ ID NO: 299940 - DNA, 20 bp, human
gacggcgccaagttcagctt

SEQ ID NO: 299941 - DNA, 20 bp, human
ggcctgggaagtgaagtctc

SEQ ID NO: 299942 - DNA, 20 bp, human
gaaccggcgtgctagtggag

SEQ ID NO: 299943 - DNA, 20 bp, human
gcccctcccaccgctccctc

SEQ ID NO: 299944 - DNA, 20 bp, human
gagcacgccggttcctggct

SEQ ID NO: 299945 - DNA, 20 bp, human
gtgcatacccaagtgcgggg

SEQ ID NO: 299946 - DNA, 20 bp, human
gaaaaagaggaagtggtagg

SEQ ID NO: 299947 - DNA, 20 bp, human
gtgtcaggtgatttttggtg

SEQ ID NO: 299948 - DNA, 20 bp, human
gtgttctgtcaggtgatttt

SEQ ID NO: 299949 - DNA, 20 bp, human
gctgtctttgagtagtccct

SEQ ID NO: 299950 - DNA, 20 bp, human
gtcaaagaagtcaagttatc

SEQ ID NO: 299951 - DNA, 20 bp, human
ggaatgacaaatcatcagcc

SEQ ID NO: 299952 - DNA, 20 bp, human
gcactgtgacctgttctgtc

SEQ ID NO: 299953 - DNA, 20 bp, human
gaaaaatgcttataaagagg

SEQ ID NO: 299954 - DNA, 20 bp, human
ggaaaggtttaagtagccca

SEQ ID NO: 299955 - DNA, 20 bp, human
ggaacagctttgtcaagcct

SEQ ID NO: 299956 - DNA, 20 bp, human
gcaccccaacccagtaggag

SEQ ID NO: 299957 - DNA, 20 bp, human
gcaaggaagcccagctctgg

SEQ ID NO: 299958 - DNA, 20 bp, human
gtggggaattaccaaccctg

SEQ ID NO: 299959 - DNA, 20 bp, human
gcagtaggagaggcaatgaa

SEQ ID NO: 299960 - DNA, 20 bp, human
ggctacgccagaaaagacat

SEQ ID NO: 299961 - DNA, 20 bp, human
gccagcagaggaagtggtaa

SEQ ID NO: 299962 - DNA, 20 bp, human
gaatcccagtctttgatggt

SEQ ID NO: 299963 - DNA, 20 bp, human
gcaaccgtcaggatagattt

SEQ ID NO: 299964 - DNA, 20 bp, human
gcctactgggttggggtgac

SEQ ID NO: 299965 - DNA, 20 bp, human
ggaatgcagtgtagacatat

SEQ ID NO: 299966 - DNA, 20 bp, human
gtgatcacaaaatcagtaca

SEQ ID NO: 299967 - DNA, 20 bp, human
gcagttgcagttataaagta

SEQ ID NO: 299968 - DNA, 20 bp, human
gaacttgtataggaagtctg

SEQ ID NO: 299969 - DNA, 20 bp, human
gcaagttaagcagaggaacc

SEQ ID NO: 299970 - DNA, 20 bp, human
gtcctctgcttaacttgtat

SEQ ID NO: 299971 - DNA, 20 bp, human
ggttttcttcagacattttc

SEQ ID NO: 299972 - DNA, 20 bp, human
gaagtctgaggtttttgtgt

SEQ ID NO: 299973 - DNA, 20 bp, human
gtaagacttaatatttaact

SEQ ID NO: 299974 - DNA, 20 bp, human
gaaaatgtaaagatcagggc

SEQ ID NO: 299975 - DNA, 20 bp, human
gtcctatacaagttaagcag

SEQ ID NO: 299976 - DNA, 20 bp, human
gaccaggtctcccccctcct

SEQ ID NO: 299977 - DNA, 20 bp, human
ggagcttggcgctgggtggg

SEQ ID NO: 299978 - DNA, 20 bp, human
gggggagcttggcgctgggt

SEQ ID NO: 299979 - DNA, 20 bp, human
gcttgggactcgaaggactg

SEQ ID NO: 299980 - DNA, 20 bp, human
gtcaatcaactccccatcct

SEQ ID NO: 299981 - DNA, 20 bp, human
ggctgggggagcttggcgct

SEQ ID NO: 299982 - DNA, 20 bp, human
gaagcccagaagggtccagg

SEQ ID NO: 299983 - DNA, 20 bp, human
gtccttcgagtcccaagctg

SEQ ID NO: 299984 - DNA, 20 bp, human
gcccccagcttgggactcga

SEQ ID NO: 299985 - DNA, 20 bp, human
ggccaaggaggggggagacc

SEQ ID NO: 299986 - DNA, 20 bp, human
gcgagggagcgcgagcgcga

SEQ ID NO: 299987 - DNA, 20 bp, human
gctcccgggtcactttgaca

SEQ ID NO: 299988 - DNA, 20 bp, human
ggagccgtgtcaaagtgacc

SEQ ID NO: 299989 - DNA, 20 bp, human
gtccccagcccaagccgggc

SEQ ID NO: 299990 - DNA, 20 bp, human
gaataaagcccggccctgcc

SEQ ID NO: 299991 - DNA, 20 bp, human
ggcttgctgcgcgctctccc

SEQ ID NO: 299992 - DNA, 20 bp, human
ggctctcccctcccactagc

SEQ ID NO: 299993 - DNA, 20 bp, human
gtgccgccggatggggagtc

SEQ ID NO: 299994 - DNA, 20 bp, human
gaattgtcctgctagtggga

SEQ ID NO: 299995 - DNA, 20 bp, human
gcgcgctccgggagggaaaa

SEQ ID NO: 299996 - DNA, 20 bp, human
gacaggggacggatcagatt

SEQ ID NO: 299997 - DNA, 20 bp, human
gcccctccctgagaggaaag

SEQ ID NO: 299998 - DNA, 20 bp, human
gccaggagagacctggatgg

SEQ ID NO: 299999 - DNA, 20 bp, human
gacggtgctcaggagtgagc

SEQ ID NO: 300000 - DNA, 20 bp, human
ggattgggccaggagagacc

SEQ ID NO: 300001 - DNA, 20 bp, human
ggcgggctgcatttcgttcc

SEQ ID NO: 300002 - DNA, 20 bp, human
gacaggcctctcctccatcc

SEQ ID NO: 300003 - DNA, 20 bp, human
gacaggggcgagaaagattt

SEQ ID NO: 300004 - DNA, 20 bp, human
gggacggatcagattgggcc

SEQ ID NO: 300005 - DNA, 20 bp, human
ggcaggtgggccaaagccac

SEQ ID NO: 300006 - DNA, 20 bp, human
ggggagggaggttggtatgg

SEQ ID NO: 300007 - DNA, 20 bp, human
gtgtcggagccctctatagc

SEQ ID NO: 300008 - DNA, 20 bp, human
gagagggagggaggttggta

SEQ ID NO: 300009 - DNA, 20 bp, human
ggagccctctatagcaggag

SEQ ID NO: 300010 - DNA, 20 bp, human
gcagtctgacaagaggtcta

SEQ ID NO: 300011 - DNA, 20 bp, human
gtgtgaactagtctacaatg

SEQ ID NO: 300012 - DNA, 20 bp, human
ggctggctgggaactgctgt

SEQ ID NO: 300013 - DNA, 20 bp, human
gttagcaatcaggttgtgaa

SEQ ID NO: 300014 - DNA, 20 bp, human
gcaggctgaacacgctggct

SEQ ID NO: 300015 - DNA, 20 bp, human
gtgacaagaggtctaaggtt

SEQ ID NO: 300016 - DNA, 20 bp, human
gaccccccaggggggaggaa

SEQ ID NO: 300017 - DNA, 20 bp, human
gcgtgtgagtcatggtggac

SEQ ID NO: 300018 - DNA, 20 bp, human
gctaatatagcccctgggga

SEQ ID NO: 300019 - DNA, 20 bp, human
gtccccttcctcccccctgg

SEQ ID NO: 300020 - DNA, 20 bp, human
ggaaggggaactggcctggt

SEQ ID NO: 300021 - DNA, 20 bp, human
gaggatgggtaccactgggc

SEQ ID NO: 300022 - DNA, 20 bp, human
gcagcaaagcccctacccaa

SEQ ID NO: 300023 - DNA, 20 bp, human
gtcatggtggaccggctggg

SEQ ID NO: 300024 - DNA, 20 bp, human
gtgagtcatggtggaccggc

SEQ ID NO: 300025 - DNA, 20 bp, human
gccagcaccccccagggggg

SEQ ID NO: 300026 - DNA, 20 bp, human
gcgcacgtggagcagtctgc

SEQ ID NO: 300027 - DNA, 20 bp, human
ggcgcagccagacaaccgac

SEQ ID NO: 300028 - DNA, 20 bp, human
gagtctgccggtcggttgtc

SEQ ID NO: 300029 - DNA, 20 bp, human
gtgcgctgggagtctaagta

SEQ ID NO: 300030 - DNA, 20 bp, human
gcgtggagcagtctgccggt

SEQ ID NO: 300031 - DNA, 20 bp, human
gcgggaacccacgtgtgagt

SEQ ID NO: 300032 - DNA, 20 bp, human
ggcggggcactggagaggcc

SEQ ID NO: 300033 - DNA, 20 bp, human
gggagccatgagcctgagtc

SEQ ID NO: 300034 - DNA, 20 bp, human
gcccggcttctgtggttgga

SEQ ID NO: 300035 - DNA, 20 bp, human
ggccgagccaggcggggcac

SEQ ID NO: 300036 - DNA, 20 bp, human
ggggctgcggtgtaggtggt

SEQ ID NO: 300037 - DNA, 20 bp, human
ggggcgggctgcggtgtagg

SEQ ID NO: 300038 - DNA, 20 bp, human
gggtgggcgggctgcggtgt

SEQ ID NO: 300039 - DNA, 20 bp, human
gcccgcccccgcgtgcgggt

SEQ ID NO: 300040 - DNA, 20 bp, human
gacttgggctctctggtgga

SEQ ID NO: 300041 - DNA, 20 bp, human
gtctctggtggatgggttct

SEQ ID NO: 300042 - DNA, 20 bp, human
gccgcgcagctgcagtaagg

SEQ ID NO: 300043 - DNA, 20 bp, human
ggcaggcacaacgcagtgca

SEQ ID NO: 300044 - DNA, 20 bp, human
gggtccgcgcagctgcagta

SEQ ID NO: 300045 - DNA, 20 bp, human
gccccagccctgtaggagaa

SEQ ID NO: 300046 - DNA, 20 bp, human
gaagcacgtgtcggagactc

SEQ ID NO: 300047 - DNA, 20 bp, human
gcgtgtcggagactctggca

SEQ ID NO: 300048 - DNA, 20 bp, human
gaaagcaggcgcccaattct

SEQ ID NO: 300049 - DNA, 20 bp, human
ggagccctatccttcctggc

SEQ ID NO: 300050 - DNA, 20 bp, human
gaaccgtgaccctgccagga

SEQ ID NO: 300051 - DNA, 20 bp, human
gacctgccgtagagtgctga

SEQ ID NO: 300052 - DNA, 20 bp, human
ggctggaggcctattttgaa

SEQ ID NO: 300053 - DNA, 20 bp, human
gaccctgggacagtcggctg

SEQ ID NO: 300054 - DNA, 20 bp, human
gagccccagccgactgtccc

SEQ ID NO: 300055 - DNA, 20 bp, human
gatccttcctggcagggtca

SEQ ID NO: 300056 - DNA, 20 bp, human
gggcgccggctctgcaagga

SEQ ID NO: 300057 - DNA, 20 bp, human
gcaatccccttcaaggacaa

SEQ ID NO: 300058 - DNA, 20 bp, human
gggaaggagacctcctcatc

SEQ ID NO: 300059 - DNA, 20 bp, human
gaaggggattgagcgagccg

SEQ ID NO: 300060 - DNA, 20 bp, human
gcacaatggagaaacctaag

SEQ ID NO: 300061 - DNA, 20 bp, human
gctcccccaccctccagatg

SEQ ID NO: 300062 - DNA, 20 bp, human
ggctcgctcaatccccttca

SEQ ID NO: 300063 - DNA, 20 bp, human
ggaaacctaagaggctgcgg

SEQ ID NO: 300064 - DNA, 20 bp, human
ggacctcctcatctggaggg

SEQ ID NO: 300065 - DNA, 20 bp, human
gggagacctcctcatctgga

SEQ ID NO: 300066 - DNA, 20 bp, human
gctgccctggagcgcagtgt

SEQ ID NO: 300067 - DNA, 20 bp, human
gcccgtcttgcacactcttt

SEQ ID NO: 300068 - DNA, 20 bp, human
gcggcccaggcgcgggcatg

SEQ ID NO: 300069 - DNA, 20 bp, human
gccctggagcgcagtgtggg

SEQ ID NO: 300070 - DNA, 20 bp, human
gacgccccatgcccgcgcct

SEQ ID NO: 300071 - DNA, 20 bp, human
ggatgggaagaattctagac

SEQ ID NO: 300072 - DNA, 20 bp, human
gcacggagggcaaccgtcga

SEQ ID NO: 300073 - DNA, 20 bp, human
gagatcaccgaaatgctgat

SEQ ID NO: 300074 - DNA, 20 bp, human
ggcccaaagagtgtgcaaga

SEQ ID NO: 300075 - DNA, 20 bp, human
gcgtgtctcgagtcgcacgg

SEQ ID NO: 300076 - DNA, 20 bp, human
gccagggacgacacttctaa

SEQ ID NO: 300077 - DNA, 20 bp, human
ggacgacacttctaaaggag

SEQ ID NO: 300078 - DNA, 20 bp, human
gatcttgcagacattttcgt

SEQ ID NO: 300079 - DNA, 20 bp, human
gtaaggtggcacgggcttta

SEQ ID NO: 300080 - DNA, 20 bp, human
gcacttctaaaggagaggcg

SEQ ID NO: 300081 - DNA, 20 bp, human
gaaggagaggcgaggttcac

SEQ ID NO: 300082 - DNA, 20 bp, human
gggcctgcttaaggtggcac

SEQ ID NO: 300083 - DNA, 20 bp, human
ggggtggggcctgcttaagg

SEQ ID NO: 300084 - DNA, 20 bp, human
gatgtctgcaagatctgcaa

SEQ ID NO: 300085 - DNA, 20 bp, human
gccacccctggcctagccaa

SEQ ID NO: 300086 - DNA, 20 bp, human
gcaagaggaggagtttcgaa

SEQ ID NO: 300087 - DNA, 20 bp, human
ggccctggcgacactttcga

SEQ ID NO: 300088 - DNA, 20 bp, human
gcgaacggccgatgtgacat

SEQ ID NO: 300089 - DNA, 20 bp, human
ggtgggaatcagagcttcac

SEQ ID NO: 300090 - DNA, 20 bp, human
ggggccccgagtgcaatcgc

SEQ ID NO: 300091 - DNA, 20 bp, human
gtccttcgaaagtgtcgcca

SEQ ID NO: 300092 - DNA, 20 bp, human
gtaaaaagccgatgtcacat

SEQ ID NO: 300093 - DNA, 20 bp, human
gactttcgaaggactggagt

SEQ ID NO: 300094 - DNA, 20 bp, human
ggaaatgctgtaaatgacgt

SEQ ID NO: 300095 - DNA, 20 bp, human
gaactcctcctcttgcagtg

SEQ ID NO: 300096 - DNA, 20 bp, human
gctgacaggggcctgcccac

SEQ ID NO: 300097 - DNA, 20 bp, human
gcttggaaggcagctgacag

SEQ ID NO: 300098 - DNA, 20 bp, human
gcgggccacaccctccctgt

SEQ ID NO: 300099 - DNA, 20 bp, human
ggggaatagcctggccggag

SEQ ID NO: 300100 - DNA, 20 bp, human
gtcagctgccttccaagcag

SEQ ID NO: 300101 - DNA, 20 bp, human
gaagtctcacagtgcatggg

SEQ ID NO: 300102 - DNA, 20 bp, human
gtggccttggtgacaatgca

SEQ ID NO: 300103 - DNA, 20 bp, human
gcggaggagctcaggttcca

SEQ ID NO: 300104 - DNA, 20 bp, human
ggttccctgcattgtcacca

SEQ ID NO: 300105 - DNA, 20 bp, human
ggacagcaacattgcgaggc

SEQ ID NO: 300106 - DNA, 20 bp, human
gagaagccctatggctgaac

SEQ ID NO: 300107 - DNA, 20 bp, human
ggaaccaggaaactcagatc

SEQ ID NO: 300108 - DNA, 20 bp, human
gctaaggggccagctgatct

SEQ ID NO: 300109 - DNA, 20 bp, human
gcagatccggttcagccata

SEQ ID NO: 300110 - DNA, 20 bp, human
ggaaccggatctgagtttcc

SEQ ID NO: 300111 - DNA, 20 bp, human
gaccaaaggagcctctctga

SEQ ID NO: 300112 - DNA, 20 bp, human
gggttcctgtctggcagaag

SEQ ID NO: 300113 - DNA, 20 bp, human
ggagggatctatgagtgcaa

SEQ ID NO: 300114 - DNA, 20 bp, human
gtagcagatctggcttcctg

SEQ ID NO: 300115 - DNA, 20 bp, human
gtctctgcctgctgctctct

SEQ ID NO: 300116 - DNA, 20 bp, human
ggccacccgcatgttaccct

SEQ ID NO: 300117 - DNA, 20 bp, human
ggacacccagggtaacatgc

SEQ ID NO: 300118 - DNA, 20 bp, human
gtcgctgggtgtggaagcaa

SEQ ID NO: 300119 - DNA, 20 bp, human
gtgggtgtcctgactccgag

SEQ ID NO: 300120 - DNA, 20 bp, human
gacccagggtaacatgcggg

SEQ ID NO: 300121 - DNA, 20 bp, human
gcctcgcggccagacctggg

SEQ ID NO: 300122 - DNA, 20 bp, human
gtcggcggcccctcggagtc

SEQ ID NO: 300123 - DNA, 20 bp, human
gaaccctccgccgcgctcgg

SEQ ID NO: 300124 - DNA, 20 bp, human
ggatcctcgcggccagacct

SEQ ID NO: 300125 - DNA, 20 bp, human
gctaagttttgcaagcgcct

SEQ ID NO: 300126 - DNA, 20 bp, human
gtgcaggatgcgggactgag

SEQ ID NO: 300127 - DNA, 20 bp, human
ggacctgaccggggagtttg

SEQ ID NO: 300128 - DNA, 20 bp, human
gggggagtttgcgggaagga

SEQ ID NO: 300129 - DNA, 20 bp, human
gcgcccggagctcccggcat

SEQ ID NO: 300130 - DNA, 20 bp, human
gcccccgcgcgcgttgacgt

SEQ ID NO: 300131 - DNA, 20 bp, human
gctgggaagtcgattgtctg

SEQ ID NO: 300132 - DNA, 20 bp, human
gacggctcgccgaggcctag

SEQ ID NO: 300133 - DNA, 20 bp, human
ggaccgacgtcaacgcgcgc

SEQ ID NO: 300134 - DNA, 20 bp, human
gcgggtgaagcgggcccgag

SEQ ID NO: 300135 - DNA, 20 bp, human
gaggggcgcggagacagttg

SEQ ID NO: 300136 - DNA, 20 bp, human
ggggcgagaccggccgtcgg

SEQ ID NO: 300137 - DNA, 20 bp, human
gtggacctggagcctggaca

SEQ ID NO: 300138 - DNA, 20 bp, human
gaggaaagcgggggcgtcta

SEQ ID NO: 300139 - DNA, 20 bp, human
gaggccctcaggcccctacg

SEQ ID NO: 300140 - DNA, 20 bp, human
ggggcggggcgagagaggac

SEQ ID NO: 300141 - DNA, 20 bp, human
gggaccgggcggggcgagac

SEQ ID NO: 300142 - DNA, 20 bp, human
gccaccccgtaggggcctga

SEQ ID NO: 300143 - DNA, 20 bp, human
ggggcggcctcggaaactct

SEQ ID NO: 300144 - DNA, 20 bp, human
gcctgagggcctgagagcag

SEQ ID NO: 300145 - DNA, 20 bp, human
gtccgccgcggcgtccgacg

SEQ ID NO: 300146 - DNA, 20 bp, human
gaaggcctgggctacggtga

SEQ ID NO: 300147 - DNA, 20 bp, human
ggggcagagcaagtctgcac

SEQ ID NO: 300148 - DNA, 20 bp, human
gacagcctgtgcctgaaaac

SEQ ID NO: 300149 - DNA, 20 bp, human
gagagcaagtctgcactgga

SEQ ID NO: 300150 - DNA, 20 bp, human
ggaggggtgcagtgtcagcc

SEQ ID NO: 300151 - DNA, 20 bp, human
ggttaccctcaccgtagccc

SEQ ID NO: 300152 - DNA, 20 bp, human
gcagggaagcccaaagggga

SEQ ID NO: 300153 - DNA, 20 bp, human
gaactcaaaggcgactttga

SEQ ID NO: 300154 - DNA, 20 bp, human
gtgagagtgagaactttggt

SEQ ID NO: 300155 - DNA, 20 bp, human
gacttcctgttttcaggcac

SEQ ID NO: 300156 - DNA, 20 bp, human
gggaagggtgtagacaaaga

SEQ ID NO: 300157 - DNA, 20 bp, human
gtccgtccgaatggcctcgt

SEQ ID NO: 300158 - DNA, 20 bp, human
gtctctcggcgggcagttaa

SEQ ID NO: 300159 - DNA, 20 bp, human
gggcagttaaaggctgggat

SEQ ID NO: 300160 - DNA, 20 bp, human
gggcgcaccgtccgtccgaa

SEQ ID NO: 300161 - DNA, 20 bp, human
gcgctgggtcgctgaaccac

SEQ ID NO: 300162 - DNA, 20 bp, human
gacccagcgcatccttttcc

SEQ ID NO: 300163 - DNA, 20 bp, human
gcgccggcgcgacgggggag

SEQ ID NO: 300164 - DNA, 20 bp, human
gggacggtgcgccggcgcga

SEQ ID NO: 300165 - DNA, 20 bp, human
gtgaaccaccggcttgtggt

SEQ ID NO: 300166 - DNA, 20 bp, human
gcgggagcggtcggtatcca

SEQ ID NO: 300167 - DNA, 20 bp, human
gtggcagcagcccgagttgg

SEQ ID NO: 300168 - DNA, 20 bp, human
gaaccagcggggccagccta

SEQ ID NO: 300169 - DNA, 20 bp, human
gtcaccgcgcggcctttgtg

SEQ ID NO: 300170 - DNA, 20 bp, human
gccagtcattcctcccaaga

SEQ ID NO: 300171 - DNA, 20 bp, human
gcggggtcgcggcagagggc

SEQ ID NO: 300172 - DNA, 20 bp, human
gccgaccgctcccgcgcgtg

SEQ ID NO: 300173 - DNA, 20 bp, human
ggcggtggcgggcgggcctt

SEQ ID NO: 300174 - DNA, 20 bp, human
ggggaagactgtagttgctg

SEQ ID NO: 300175 - DNA, 20 bp, human
gactttgtgcatcacttccg

SEQ ID NO: 300176 - DNA, 20 bp, human
gtaagcaagtggacgatctg

SEQ ID NO: 300177 - DNA, 20 bp, human
gtgctcaagggccacctttc

SEQ ID NO: 300178 - DNA, 20 bp, human
ggcccttgagcacattcctc

SEQ ID NO: 300179 - DNA, 20 bp, human
ggaaaccattgagggaggtc

SEQ ID NO: 300180 - DNA, 20 bp, human
gtaaatacaacgtgcctgaa

SEQ ID NO: 300181 - DNA, 20 bp, human
gaccggaggaatgtgctcaa

SEQ ID NO: 300182 - DNA, 20 bp, human
gtcaactcttgcattgttac

SEQ ID NO: 300183 - DNA, 20 bp, human
gggacgatctggggaactgt

SEQ ID NO: 300184 - DNA, 20 bp, human
ggtttcacgtggctttcaaa

SEQ ID NO: 300185 - DNA, 20 bp, human
ggttgcctgacctccctcaa

SEQ ID NO: 300186 - DNA, 20 bp, human
gcccacacattcagagtcac

SEQ ID NO: 300187 - DNA, 20 bp, human
gggccccccaaacagcatcc

SEQ ID NO: 300188 - DNA, 20 bp, human
ggattcagcatcccgctctg

SEQ ID NO: 300189 - DNA, 20 bp, human
gtcaccgggatgctgtttgg

SEQ ID NO: 300190 - DNA, 20 bp, human
gtcccgcggcgggagagaga

SEQ ID NO: 300191 - DNA, 20 bp, human
gagaggtgaggcgctggaag

SEQ ID NO: 300192 - DNA, 20 bp, human
gtagacaggatagagtgagg

SEQ ID NO: 300193 - DNA, 20 bp, human
ggagcgggatgctgaatcct

SEQ ID NO: 300194 - DNA, 20 bp, human
gagggggcatccgggagtgc

SEQ ID NO: 300195 - DNA, 20 bp, human
ggcaattagccatgcaccgg

SEQ ID NO: 300196 - DNA, 20 bp, human
gagaatgttcgtgcgaatga

SEQ ID NO: 300197 - DNA, 20 bp, human
ggtgcatatcgacagtcttc

SEQ ID NO: 300198 - DNA, 20 bp, human
gggcttcttcttcagatcaa

SEQ ID NO: 300199 - DNA, 20 bp, human
gatattaacagaaaatgata

SEQ ID NO: 300200 - DNA, 20 bp, human
ggagaattcaaaaacaccta

SEQ ID NO: 300201 - DNA, 20 bp, human
gtcagtatttccaatataat

SEQ ID NO: 300202 - DNA, 20 bp, human
gtataatatagtcattgata

SEQ ID NO: 300203 - DNA, 20 bp, human
gaatatttagtgctgcctgc

SEQ ID NO: 300204 - DNA, 20 bp, human
ggctatttgatttgcaggta

SEQ ID NO: 300205 - DNA, 20 bp, human
gtctgaaatatgtgctatca

SEQ ID NO: 300206 - DNA, 20 bp, human
gaaaccctctggaggaaatc

SEQ ID NO: 300207 - DNA, 20 bp, human
gccgccccctagaccagctc

SEQ ID NO: 300208 - DNA, 20 bp, human
gagtccagagctggtctagg

SEQ ID NO: 300209 - DNA, 20 bp, human
gggagcagggccgcgctgga

SEQ ID NO: 300210 - DNA, 20 bp, human
gagtggagtgtcgggtatca

SEQ ID NO: 300211 - DNA, 20 bp, human
gccgctgcgggcgatagagc

SEQ ID NO: 300212 - DNA, 20 bp, human
gagggtggaaggcgctttat

SEQ ID NO: 300213 - DNA, 20 bp, human
gggtgtcaggacttttctac

SEQ ID NO: 300214 - DNA, 20 bp, human
gagagtaaatagagacacgt

SEQ ID NO: 300215 - DNA, 20 bp, human
ggtcacccttgttccacaac

SEQ ID NO: 300216 - DNA, 20 bp, human
gtggctgcccgctggagggg

SEQ ID NO: 300217 - DNA, 20 bp, human
gcaaggagagctagaggcgg

SEQ ID NO: 300218 - DNA, 20 bp, human
ggaggagaagcgacgcaagt

SEQ ID NO: 300219 - DNA, 20 bp, human
gagggaaggatcaggcaact

SEQ ID NO: 300220 - DNA, 20 bp, human
gtccttggctgcccgctgga

SEQ ID NO: 300221 - DNA, 20 bp, human
gaaaccaagactcgtcctac

SEQ ID NO: 300222 - DNA, 20 bp, human
gggcgagagaaggaaggacc

SEQ ID NO: 300223 - DNA, 20 bp, human
gggcaaagcgtgcctttcgg

SEQ ID NO: 300224 - DNA, 20 bp, human
gacaagaaacattgccgcag

SEQ ID NO: 300225 - DNA, 20 bp, human
gtgggaggcgtcaaggaggt

SEQ ID NO: 300226 - DNA, 20 bp, human
gagatagggcaagtctgtct

SEQ ID NO: 300227 - DNA, 20 bp, human
gcccagctcagggactcgtc

SEQ ID NO: 300228 - DNA, 20 bp, human
ggctacagctgtctatacaa

SEQ ID NO: 300229 - DNA, 20 bp, human
gcaggcctcaacccacatta

SEQ ID NO: 300230 - DNA, 20 bp, human
gggagggggctgtctagata

SEQ ID NO: 300231 - DNA, 20 bp, human
gccaggctataaagctgccc

SEQ ID NO: 300232 - DNA, 20 bp, human
gggtcatgaacccctaatgt

SEQ ID NO: 300233 - DNA, 20 bp, human
ggaacccctaatgtgggttg

SEQ ID NO: 300234 - DNA, 20 bp, human
gagggccaatccagtctgca

SEQ ID NO: 300235 - DNA, 20 bp, human
ggccagacgagtccctgagc

SEQ ID NO: 300236 - DNA, 20 bp, human
gtctagacagaggatgtcat

SEQ ID NO: 300237 - DNA, 20 bp, human
gggggctgtctagaaaggac

SEQ ID NO: 300238 - DNA, 20 bp, human
gtagaaaggacagggctgtc

SEQ ID NO: 300239 - DNA, 20 bp, human
gtctgcaaatcataaaggaa

SEQ ID NO: 300240 - DNA, 20 bp, human
gccacaccaggggtccctca

SEQ ID NO: 300241 - DNA, 20 bp, human
ggacggtgcgacaaccctga

SEQ ID NO: 300242 - DNA, 20 bp, human
gcacggtcaggacacaaatc

SEQ ID NO: 300243 - DNA, 20 bp, human
gaaggccaggaaaattcaac

SEQ ID NO: 300244 - DNA, 20 bp, human
gtgcaaggagtgtaggttgg

SEQ ID NO: 300245 - DNA, 20 bp, human
gggctgtctggatgccaccc

SEQ ID NO: 300246 - DNA, 20 bp, human
gagggagggaaggggatcga

SEQ ID NO: 300247 - DNA, 20 bp, human
gcgggcggaagtgggaaaac

SEQ ID NO: 300248 - DNA, 20 bp, human
gaggctgggctagtcttacg

SEQ ID NO: 300249 - DNA, 20 bp, human
gagagcaaggggtgataggt

SEQ ID NO: 300250 - DNA, 20 bp, human
gcggcgcgtgagaccctggg

SEQ ID NO: 300251 - DNA, 20 bp, human
ggcggaagtgggaaaactgg

SEQ ID NO: 300252 - DNA, 20 bp, human
gtcacgcgccgggcggaagt

SEQ ID NO: 300253 - DNA, 20 bp, human
ggcccggcgcgtgagaccct

SEQ ID NO: 300254 - DNA, 20 bp, human
gtacgcggaatgctgtgaga

SEQ ID NO: 300255 - DNA, 20 bp, human
gtggtggggctcggaaggct

SEQ ID NO: 300256 - DNA, 20 bp, human
gctgaatgttgaggggtcta

SEQ ID NO: 300257 - DNA, 20 bp, human
ggacccctcaacattcaggc

SEQ ID NO: 300258 - DNA, 20 bp, human
gggctctattctggtgttca

SEQ ID NO: 300259 - DNA, 20 bp, human
gatgttgaggggtctaggga

SEQ ID NO: 300260 - DNA, 20 bp, human
gtggggctaacccaattgtg

SEQ ID NO: 300261 - DNA, 20 bp, human
gttaccagcctgaatgttga

SEQ ID NO: 300262 - DNA, 20 bp, human
gcatgatgaatcacccccct

SEQ ID NO: 300263 - DNA, 20 bp, human
gcattcaggctggtaaaatg

SEQ ID NO: 300264 - DNA, 20 bp, human
gtgggaggctcattgttgct

SEQ ID NO: 300265 - DNA, 20 bp, human
gtaaactttgagggtggaag

SEQ ID NO: 300266 - DNA, 20 bp, human
gccagccctgaggacggtgg

SEQ ID NO: 300267 - DNA, 20 bp, human
gaggcccaagtcagggttga

SEQ ID NO: 300268 - DNA, 20 bp, human
gcccacccccaccgtcctca

SEQ ID NO: 300269 - DNA, 20 bp, human
gtcagggttgaaggaatacc

SEQ ID NO: 300270 - DNA, 20 bp, human
gtgcaccaatagcccggcag

SEQ ID NO: 300271 - DNA, 20 bp, human
ggcccgcccaccaccggcca

SEQ ID NO: 300272 - DNA, 20 bp, human
ggacgtgagtaatacatggc

SEQ ID NO: 300273 - DNA, 20 bp, human
ggggggacgtgagtaataca

SEQ ID NO: 300274 - DNA, 20 bp, human
gcccctctgcaccaatagcc

SEQ ID NO: 300275 - DNA, 20 bp, human
ggggagcagaataggggtat

SEQ ID NO: 300276 - DNA, 20 bp, human
gacgtcagaccgcctcatca

SEQ ID NO: 300277 - DNA, 20 bp, human
gggaaggtcggtcgccatgt

SEQ ID NO: 300278 - DNA, 20 bp, human
gcctcatcatggccgaccaa

SEQ ID NO: 300279 - DNA, 20 bp, human
ggccatggtgggaaggtcca

SEQ ID NO: 300280 - DNA, 20 bp, human
gcggggccacgcgccatgat

SEQ ID NO: 300281 - DNA, 20 bp, human
ggtcggtcgccatgttggga

SEQ ID NO: 300282 - DNA, 20 bp, human
gctcttagagccgccatggt

SEQ ID NO: 300283 - DNA, 20 bp, human
ggtggctcttagagccgcca

SEQ ID NO: 300284 - DNA, 20 bp, human
gcggaactgctccctcccgc

SEQ ID NO: 300285 - DNA, 20 bp, human
gagtgcagaccttcccaaca

SEQ ID NO: 300286 - DNA, 20 bp, human
gcgggaggagctcacctgag

SEQ ID NO: 300287 - DNA, 20 bp, human
ggagcagcgcgcggctccca

SEQ ID NO: 300288 - DNA, 20 bp, human
gcggtctagttcagggtcta

SEQ ID NO: 300289 - DNA, 20 bp, human
gctcctcccgcgcctcccat

SEQ ID NO: 300290 - DNA, 20 bp, human
ggggcatctcggccaatggg

SEQ ID NO: 300291 - DNA, 20 bp, human
gcccgggaacggcacttgga

SEQ ID NO: 300292 - DNA, 20 bp, human
gaacggcacttggaagggca

SEQ ID NO: 300293 - DNA, 20 bp, human
gcggtggcaggaacctagga

SEQ ID NO: 300294 - DNA, 20 bp, human
gtggagatgagatagagagc

SEQ ID NO: 300295 - DNA, 20 bp, human
gacgcagcgcggtctagttc

SEQ ID NO: 300296 - DNA, 20 bp, human
gctcccatccctgtctagag

SEQ ID NO: 300297 - DNA, 20 bp, human
gagcccctctagacagggat

SEQ ID NO: 300298 - DNA, 20 bp, human
gtgagtcagcccctctagac

SEQ ID NO: 300299 - DNA, 20 bp, human
gctagcaaagggaaggttct

SEQ ID NO: 300300 - DNA, 20 bp, human
ggtagtcatgaggctgaagg

SEQ ID NO: 300301 - DNA, 20 bp, human
gccagggtctagcaaaggga

SEQ ID NO: 300302 - DNA, 20 bp, human
gggaaaggagctctcactga

SEQ ID NO: 300303 - DNA, 20 bp, human
gagctgtggaggatgaaaga

SEQ ID NO: 300304 - DNA, 20 bp, human
gaagggaaggttctaggcct

SEQ ID NO: 300305 - DNA, 20 bp, human
gagggcagaacaggctggaa

SEQ ID NO: 300306 - DNA, 20 bp, human
ggcctgtagcgacaggtgat

SEQ ID NO: 300307 - DNA, 20 bp, human
ggggcgggccaacttatgat

SEQ ID NO: 300308 - DNA, 20 bp, human
ggacaagaggcggttgctag

SEQ ID NO: 300309 - DNA, 20 bp, human
gacagcgaatgctaggcgtt

SEQ ID NO: 300310 - DNA, 20 bp, human
gtagcattcgctgtgataaa

SEQ ID NO: 300311 - DNA, 20 bp, human
gcacctgtcgctacaggcca

SEQ ID NO: 300312 - DNA, 20 bp, human
gggttcagatctgtgacaag

SEQ ID NO: 300313 - DNA, 20 bp, human
gaccagatgcggccgtcgat

SEQ ID NO: 300314 - DNA, 20 bp, human
gcttccgcaaggagacttgt

SEQ ID NO: 300315 - DNA, 20 bp, human
gcatctggtagcatcagggg

SEQ ID NO: 300316 - DNA, 20 bp, human
gcgtaagtgcgtgggcagga

SEQ ID NO: 300317 - DNA, 20 bp, human
gttaaggcagaccggaagtc

SEQ ID NO: 300318 - DNA, 20 bp, human
ggggtggcacagcggtgtcg

SEQ ID NO: 300319 - DNA, 20 bp, human
gggccccgaggggacaagcg

SEQ ID NO: 300320 - DNA, 20 bp, human
ggcgtcctgacgtcacgcgg

SEQ ID NO: 300321 - DNA, 20 bp, human
gggctggctctggtcttctt

SEQ ID NO: 300322 - DNA, 20 bp, human
gaaggatcctggttggtaag

SEQ ID NO: 300323 - DNA, 20 bp, human
gggtggggacggtggccccg

SEQ ID NO: 300324 - DNA, 20 bp, human
gcgcgagcgtcgacagggtg

SEQ ID NO: 300325 - DNA, 20 bp, human
gcgcagctcgtggcgttcat

SEQ ID NO: 300326 - DNA, 20 bp, human
ggtaatcatcccgaaagggg

SEQ ID NO: 300327 - DNA, 20 bp, human
gcacacgtaatcatcccgaa

SEQ ID NO: 300328 - DNA, 20 bp, human
ggtaaatcacctaaaggtcg

SEQ ID NO: 300329 - DNA, 20 bp, human
gtacgtgtgcctcgaccttt

SEQ ID NO: 300330 - DNA, 20 bp, human
gcacatcaatcaccgggaaa

SEQ ID NO: 300331 - DNA, 20 bp, human
gtatgtaaatcacttgggaa

SEQ ID NO: 300332 - DNA, 20 bp, human
gaaatcacctaaaaggggtg

SEQ ID NO: 300333 - DNA, 20 bp, human
gcgggaaagggatgggacac

SEQ ID NO: 300334 - DNA, 20 bp, human
gcaaaagtatcactgggaaa

SEQ ID NO: 300335 - DNA, 20 bp, human
ggcagcacacatcaatcacc

SEQ ID NO: 300336 - DNA, 20 bp, human
gcaggcgagaacaggttcac

SEQ ID NO: 300337 - DNA, 20 bp, human
ggtaaggaaaggagtgtctt

SEQ ID NO: 300338 - DNA, 20 bp, human
ggggtcctgcgttcggttgc

SEQ ID NO: 300339 - DNA, 20 bp, human
gcgccccctggtaagaatcc

SEQ ID NO: 300340 - DNA, 20 bp, human
gcacacccgcaaccgaacgc

SEQ ID NO: 300341 - DNA, 20 bp, human
ggcgaaaactaggtcacgta

SEQ ID NO: 300342 - DNA, 20 bp, human
gcactgggcgagcgaaaact

SEQ ID NO: 300343 - DNA, 20 bp, human
gttcggttgcgggtgtggat

SEQ ID NO: 300344 - DNA, 20 bp, human
gtgcatacccaggcgagaac

SEQ ID NO: 300345 - DNA, 20 bp, human
gaactaggtcacgtaaggaa

SEQ ID NO: 300346 - DNA, 20 bp, human
ggcacctcgcggggcctcga

SEQ ID NO: 300347 - DNA, 20 bp, human
gcggcacgtcgctaccctga

SEQ ID NO: 300348 - DNA, 20 bp, human
gccgcagtgtgcacctcgcg

SEQ ID NO: 300349 - DNA, 20 bp, human
gacgtcgctaccctgagggg

SEQ ID NO: 300350 - DNA, 20 bp, human
gagggtagcgacgtgccggg

SEQ ID NO: 300351 - DNA, 20 bp, human
ggctcgaagcaccttcccaa

SEQ ID NO: 300352 - DNA, 20 bp, human
ggagccacgcgcgcaccctt

SEQ ID NO: 300353 - DNA, 20 bp, human
ggcgccgaggccctccctcg

SEQ ID NO: 300354 - DNA, 20 bp, human
ggggtacctcccaaaaattt

SEQ ID NO: 300355 - DNA, 20 bp, human
gccgggcggctgctagccct

SEQ ID NO: 300356 - DNA, 20 bp, human
gaggagctctgtactgtcag

SEQ ID NO: 300357 - DNA, 20 bp, human
gtgggggcggggttctgcac

SEQ ID NO: 300358 - DNA, 20 bp, human
ggggctctgagtagcgaggc

SEQ ID NO: 300359 - DNA, 20 bp, human
ggggcggggttgtgagtggt

SEQ ID NO: 300360 - DNA, 20 bp, human
ggggtctgaactatcaggcg

SEQ ID NO: 300361 - DNA, 20 bp, human
gaggccgggtctgaactatc

SEQ ID NO: 300362 - DNA, 20 bp, human
gtaaggtcggagttctgcac

SEQ ID NO: 300363 - DNA, 20 bp, human
gaggagctctgcattgtctg

SEQ ID NO: 300364 - DNA, 20 bp, human
ggcgctgcctccgcgaggta

SEQ ID NO: 300365 - DNA, 20 bp, human
ggcgactcccggtctggctt

SEQ ID NO: 300366 - DNA, 20 bp, human
ggacgcgccgggattcgctg

SEQ ID NO: 300367 - DNA, 20 bp, human
ggggatccgggctgactgaa

SEQ ID NO: 300368 - DNA, 20 bp, human
ggagcaaggcctgagctcgg

SEQ ID NO: 300369 - DNA, 20 bp, human
ggggctccggctgacgcgcc

SEQ ID NO: 300370 - DNA, 20 bp, human
gtcagcccggatccccccac

SEQ ID NO: 300371 - DNA, 20 bp, human
gcaaggcctgagctcggagg

SEQ ID NO: 300372 - DNA, 20 bp, human
gcctgcgcataaaggcgcgt

SEQ ID NO: 300373 - DNA, 20 bp, human
ggagccccgcctccgagctc

SEQ ID NO: 300374 - DNA, 20 bp, human
gaccggccctcagcgaatcc

SEQ ID NO: 300375 - DNA, 20 bp, human
gattcgctgagggccggtgg

SEQ ID NO: 300376 - DNA, 20 bp, human
gtcaagcggcgctagctctc

SEQ ID NO: 300377 - DNA, 20 bp, human
ggctccccgctgcagcggcg

SEQ ID NO: 300378 - DNA, 20 bp, human
gagtcggcgcgcttccccga

SEQ ID NO: 300379 - DNA, 20 bp, human
ggtgtaaagcgcctcgtccc

SEQ ID NO: 300380 - DNA, 20 bp, human
ggtccccggccggcctcaag

SEQ ID NO: 300381 - DNA, 20 bp, human
ggagcgccggcggtcacctg

SEQ ID NO: 300382 - DNA, 20 bp, human
ggggacggttacgctcgaga

SEQ ID NO: 300383 - DNA, 20 bp, human
ggcgcggccgcctactacag

SEQ ID NO: 300384 - DNA, 20 bp, human
gctagctctctggctggcgc

SEQ ID NO: 300385 - DNA, 20 bp, human
ggcggcgctagctctctggc

SEQ ID NO: 300386 - DNA, 20 bp, human
gaggtctgggggtaactact

SEQ ID NO: 300387 - DNA, 20 bp, human
gggggctgagacccgatggt

SEQ ID NO: 300388 - DNA, 20 bp, human
gagtgctgagtggacaaagc

SEQ ID NO: 300389 - DNA, 20 bp, human
gggtctagtgtggaataaga

SEQ ID NO: 300390 - DNA, 20 bp, human
gggggctgaagtcaccgctg

SEQ ID NO: 300391 - DNA, 20 bp, human
gctccaaaggagtgcagggg

SEQ ID NO: 300392 - DNA, 20 bp, human
gggacaaagctggtctagtg

SEQ ID NO: 300393 - DNA, 20 bp, human
gtagttacccccagacctca

SEQ ID NO: 300394 - DNA, 20 bp, human
gtgagacccgatggtgggag

SEQ ID NO: 300395 - DNA, 20 bp, human
gagatggggctgagacccga

SEQ ID NO: 300396 - DNA, 20 bp, human
ggggcacgaggcggcaaggt

SEQ ID NO: 300397 - DNA, 20 bp, human
gaggggagacgtcgtgaccc

SEQ ID NO: 300398 - DNA, 20 bp, human
ggaccccagctgtactccaa

SEQ ID NO: 300399 - DNA, 20 bp, human
gcgacactatcggaccctct

SEQ ID NO: 300400 - DNA, 20 bp, human
ggctgccccgcggacggaag

SEQ ID NO: 300401 - DNA, 20 bp, human
ggccagcggcatcaggtcct

SEQ ID NO: 300402 - DNA, 20 bp, human
gcggaccctctgggaaaaga

SEQ ID NO: 300403 - DNA, 20 bp, human
gggcgcggcgggcatggctc

SEQ ID NO: 300404 - DNA, 20 bp, human
ggaggacttaacgacactat

SEQ ID NO: 300405 - DNA, 20 bp, human
gccgacgcattctctaccta

SEQ ID NO: 300406 - DNA, 20 bp, human
gaggagctctgtactgtcag

SEQ ID NO: 300407 - DNA, 20 bp, human
ggggctctgagtagcgaggc

SEQ ID NO: 300408 - DNA, 20 bp, human
gtgggggcggggttctgcac

SEQ ID NO: 300409 - DNA, 20 bp, human
ggggcggggttgtgagtggt

SEQ ID NO: 300410 - DNA, 20 bp, human
ggggtctgaactatcaggcg

SEQ ID NO: 300411 - DNA, 20 bp, human
gaggccgggtctgaactatc

SEQ ID NO: 300412 - DNA, 20 bp, human
gaggagctctgcattgtctg

SEQ ID NO: 300413 - DNA, 20 bp, human
ggcgctgcctccgcgaggta

SEQ ID NO: 300414 - DNA, 20 bp, human
gtaaggtcggagttctgcac

SEQ ID NO: 300415 - DNA, 20 bp, human
ggggtcgggaccagcaggga

SEQ ID NO: 300416 - DNA, 20 bp, human
ggaccccttcccaacgcacg

SEQ ID NO: 300417 - DNA, 20 bp, human
gctcccgcgtgcgttgggaa

SEQ ID NO: 300418 - DNA, 20 bp, human
gaacgcacgcgggaggttgc

SEQ ID NO: 300419 - DNA, 20 bp, human
gcctgtcagggccggtctgg

SEQ ID NO: 300420 - DNA, 20 bp, human
gccgccgccgccccgactgg

SEQ ID NO: 300421 - DNA, 20 bp, human
gccctgcctctcttctccgc

SEQ ID NO: 300422 - DNA, 20 bp, human
gcgcgagcccgagtcgccgg

SEQ ID NO: 300423 - DNA, 20 bp, human
gtgcgttgggaaggggtcgc

SEQ ID NO: 300424 - DNA, 20 bp, human
ggcgggaggttgcgggatca

SEQ ID NO: 300425 - DNA, 20 bp, human
ggcggcgatctgcacacccg

SEQ ID NO: 300426 - DNA, 20 bp, human
gggagcggcggactaccctg

SEQ ID NO: 300427 - DNA, 20 bp, human
gccggcgtgcaccggagcgg

SEQ ID NO: 300428 - DNA, 20 bp, human
gaggcgcggactaccggtcc

SEQ ID NO: 300429 - DNA, 20 bp, human
gatcccggcgtgcaccggag

SEQ ID NO: 300430 - DNA, 20 bp, human
gcgggacggcctgcacgctg

SEQ ID NO: 300431 - DNA, 20 bp, human
gaccggtagtccgcgcctca

SEQ ID NO: 300432 - DNA, 20 bp, human
ggggtgcggactaccgatcc

SEQ ID NO: 300433 - DNA, 20 bp, human
gcaccgcggactaccggttc

SEQ ID NO: 300434 - DNA, 20 bp, human
gctgcgagccccggcgtcca

SEQ ID NO: 300435 - DNA, 20 bp, human
gagtccgcaccccagcgtgc

SEQ ID NO: 300436 - DNA, 20 bp, human
gaagctctcaagttctgggg

SEQ ID NO: 300437 - DNA, 20 bp, human
gtcctgggctgctaaggtga

SEQ ID NO: 300438 - DNA, 20 bp, human
gaataagctctcaagttctg

SEQ ID NO: 300439 - DNA, 20 bp, human
ggaaacccgtgattgaagac

SEQ ID NO: 300440 - DNA, 20 bp, human
gacgtcaggggcgaggaaag

SEQ ID NO: 300441 - DNA, 20 bp, human
gccccacaaagaagtcactt

SEQ ID NO: 300442 - DNA, 20 bp, human
gaggcggaaccgtagagact

SEQ ID NO: 300443 - DNA, 20 bp, human
gctcaagttctggggagggc

SEQ ID NO: 300444 - DNA, 20 bp, human
gttaaggcgcgttggtgctg

SEQ ID NO: 300445 - DNA, 20 bp, human
gccgggacccccaagctaga

SEQ ID NO: 300446 - DNA, 20 bp, human
ggtggaatcactctcagaga

SEQ ID NO: 300447 - DNA, 20 bp, human
gagtgattccaccatagtga

SEQ ID NO: 300448 - DNA, 20 bp, human
ggatgagtcacggcagaaca

SEQ ID NO: 300449 - DNA, 20 bp, human
gcctacagcctccctcacta

SEQ ID NO: 300450 - DNA, 20 bp, human
gacagcctccctcactatgg

SEQ ID NO: 300451 - DNA, 20 bp, human
gccgctcaggtgatgagtca

SEQ ID NO: 300452 - DNA, 20 bp, human
ggcggcttggcggaaagggc

SEQ ID NO: 300453 - DNA, 20 bp, human
gcctgagcggcttggcggaa

SEQ ID NO: 300454 - DNA, 20 bp, human
gcggtgggaagctgtcagcc

SEQ ID NO: 300455 - DNA, 20 bp, human
gactactttgatccacagtt

SEQ ID NO: 300456 - DNA, 20 bp, human
gaggccctaaggaatcgcgg

SEQ ID NO: 300457 - DNA, 20 bp, human
gaggactcaaagactaagtg

SEQ ID NO: 300458 - DNA, 20 bp, human
ggctggagccaagcaggcta

SEQ ID NO: 300459 - DNA, 20 bp, human
gtccagcacaagccaggaga

SEQ ID NO: 300460 - DNA, 20 bp, human
ggaccctccgcgattcctta

SEQ ID NO: 300461 - DNA, 20 bp, human
gtggacacagcagtacttcc

SEQ ID NO: 300462 - DNA, 20 bp, human
ggcggcgctgggaagccctg

SEQ ID NO: 300463 - DNA, 20 bp, human
gaggaatcgcggagggtcac

SEQ ID NO: 300464 - DNA, 20 bp, human
ggacccgcggcgccctctaa

SEQ ID NO: 300465 - DNA, 20 bp, human
gataagaactcgctccctct

SEQ ID NO: 300466 - DNA, 20 bp, human
ggcagggctctgaggatcac

SEQ ID NO: 300467 - DNA, 20 bp, human
ggcgaggtatggtgaagctc

SEQ ID NO: 300468 - DNA, 20 bp, human
gcacgcaaataaacatagcg

SEQ ID NO: 300469 - DNA, 20 bp, human
gccacacagaagttctgacc

SEQ ID NO: 300470 - DNA, 20 bp, human
ggggaatgttggtctccatg

SEQ ID NO: 300471 - DNA, 20 bp, human
gagacccacaacctccctca

SEQ ID NO: 300472 - DNA, 20 bp, human
gtcagaacttctgtgtggtg

SEQ ID NO: 300473 - DNA, 20 bp, human
gggcctctgaaagtaagggg

SEQ ID NO: 300474 - DNA, 20 bp, human
gctgtccactagcctgatcc

SEQ ID NO: 300475 - DNA, 20 bp, human
gtgtggtgcggcagcactcc

SEQ ID NO: 300476 - DNA, 20 bp, human
gcacgcccgcagacccacgt

SEQ ID NO: 300477 - DNA, 20 bp, human
gcaaggcaggcgcacgggga

SEQ ID NO: 300478 - DNA, 20 bp, human
gcggggccgctgcgccctct

SEQ ID NO: 300479 - DNA, 20 bp, human
gaactgcccagagggcgcag

SEQ ID NO: 300480 - DNA, 20 bp, human
gcggccccacgtgggtctgc

SEQ ID NO: 300481 - DNA, 20 bp, human
gccgccggagcgacgggctt

SEQ ID NO: 300482 - DNA, 20 bp, human
gggggctgggaactgcccag

SEQ ID NO: 300483 - DNA, 20 bp, human
gcccacgtggggccgcggct

SEQ ID NO: 300484 - DNA, 20 bp, human
gcggtgcaaggcaggcgcac

SEQ ID NO: 300485 - DNA, 20 bp, human
gggcccgcaggggctacccg

SEQ ID NO: 300486 - DNA, 20 bp, human
gagcagctcgccactctgat

SEQ ID NO: 300487 - DNA, 20 bp, human
ggtgctgtggcagagattgg

SEQ ID NO: 300488 - DNA, 20 bp, human
ggaagccagttttggagcag

SEQ ID NO: 300489 - DNA, 20 bp, human
gcggtccggtccagttaaaa

SEQ ID NO: 300490 - DNA, 20 bp, human
gccaattgcaagtcaggata

SEQ ID NO: 300491 - DNA, 20 bp, human
ggggcggggctcacccggtc

SEQ ID NO: 300492 - DNA, 20 bp, human
ggggcctgtggttaagtcag

SEQ ID NO: 300493 - DNA, 20 bp, human
gccccaccaaaattgtgctg

SEQ ID NO: 300494 - DNA, 20 bp, human
ggtggagcttggactctggc

SEQ ID NO: 300495 - DNA, 20 bp, human
gccggtccagttaaaagggt

SEQ ID NO: 300496 - DNA, 20 bp, human
gacaaactggggctgtgtca

SEQ ID NO: 300497 - DNA, 20 bp, human
gtgaggaacgggttctggaa

SEQ ID NO: 300498 - DNA, 20 bp, human
ggagccgggcccacatgcca

SEQ ID NO: 300499 - DNA, 20 bp, human
gggaagggcccatggcatgt

SEQ ID NO: 300500 - DNA, 20 bp, human
gtcagggccacatgaggaac

SEQ ID NO: 300501 - DNA, 20 bp, human
gccagaacccgttcctcatg

SEQ ID NO: 300502 - DNA, 20 bp, human
gtcgaaggtgatgcacacct

SEQ ID NO: 300503 - DNA, 20 bp, human
gggcagcttgacggtcaggt

SEQ ID NO: 300504 - DNA, 20 bp, human
gatctggcagcttgacggtc

SEQ ID NO: 300505 - DNA, 20 bp, human
ggtgtgcatcaccttcgacc

SEQ ID NO: 300506 - DNA, 20 bp, human
gcagctccctggacagcctt

SEQ ID NO: 300507 - DNA, 20 bp, human
ggctcctgtggggccaacga

SEQ ID NO: 300508 - DNA, 20 bp, human
gggaggtggtacgtgtgctt

SEQ ID NO: 300509 - DNA, 20 bp, human
gccctcattaggtcagagga

SEQ ID NO: 300510 - DNA, 20 bp, human
gcgagccctcattaggtcag

SEQ ID NO: 300511 - DNA, 20 bp, human
gtaaaaccctttgtggtgaa

SEQ ID NO: 300512 - DNA, 20 bp, human
gacctaatgagggctcgagt

SEQ ID NO: 300513 - DNA, 20 bp, human
ggaagagataaaaccctttg

SEQ ID NO: 300514 - DNA, 20 bp, human
gtggggccaacgagggtttg

SEQ ID NO: 300515 - DNA, 20 bp, human
gtccaactcgagccctcatt

SEQ ID NO: 300516 - DNA, 20 bp, human
gacagacctgcaaatagcta

SEQ ID NO: 300517 - DNA, 20 bp, human
gcacaaccatagctatttgc

SEQ ID NO: 300518 - DNA, 20 bp, human
gaatctggaatgaagcccga

SEQ ID NO: 300519 - DNA, 20 bp, human
gaagcagcctagtgtggaat

SEQ ID NO: 300520 - DNA, 20 bp, human
gtttccttgcagctttagac

SEQ ID NO: 300521 - DNA, 20 bp, human
gttcagccgttgtacaaatt

SEQ ID NO: 300522 - DNA, 20 bp, human
ggaaatacattagccctaga

SEQ ID NO: 300523 - DNA, 20 bp, human
gggtgagagtggcccttacc

SEQ ID NO: 300524 - DNA, 20 bp, human
gagctgcaaggaaatcttgc

SEQ ID NO: 300525 - DNA, 20 bp, human
ggcttggctctgccaggtaa

SEQ ID NO: 300526 - DNA, 20 bp, human
gacagacctgcaaacatcta

SEQ ID NO: 300527 - DNA, 20 bp, human
gtgcagcaggagaaagactc

SEQ ID NO: 300528 - DNA, 20 bp, human
ggcaactcagagatgccctt

SEQ ID NO: 300529 - DNA, 20 bp, human
gcctgaggatcaaggtcaaa

SEQ ID NO: 300530 - DNA, 20 bp, human
gcacaaccatagatgtttgc

SEQ ID NO: 300531 - DNA, 20 bp, human
gaaggggcctagtgtgaggc

SEQ ID NO: 300532 - DNA, 20 bp, human
gatccaaggggcctagtgtg

SEQ ID NO: 300533 - DNA, 20 bp, human
ggttctgggagggcctttaa

SEQ ID NO: 300534 - DNA, 20 bp, human
gaaaaggatctgacccttaa

SEQ ID NO: 300535 - DNA, 20 bp, human
gcatgaacctgcctcacact

SEQ ID NO: 300536 - DNA, 20 bp, human
gtggggaaggtaccagactg

SEQ ID NO: 300537 - DNA, 20 bp, human
gaatctggaatgatgccaga

SEQ ID NO: 300538 - DNA, 20 bp, human
ggctctcccagaacatttaa

SEQ ID NO: 300539 - DNA, 20 bp, human
ggcagaaatgacattgggga

SEQ ID NO: 300540 - DNA, 20 bp, human
gtgcagcatgagaaagggtc

SEQ ID NO: 300541 - DNA, 20 bp, human
ggccagagggcaaagctgaa

SEQ ID NO: 300542 - DNA, 20 bp, human
gttagccattgtacaaaatt

SEQ ID NO: 300543 - DNA, 20 bp, human
gagccaagtggcttagtgtg

SEQ ID NO: 300544 - DNA, 20 bp, human
gctctctgcagatcctcctc

SEQ ID NO: 300545 - DNA, 20 bp, human
gcttacctagcaaagccaag

SEQ ID NO: 300546 - DNA, 20 bp, human
gaagctgggctaagtgaggg

SEQ ID NO: 300547 - DNA, 20 bp, human
gctgtcaagcggctgcattg

SEQ ID NO: 300548 - DNA, 20 bp, human
gggctgggagagctgtcaag

SEQ ID NO: 300549 - DNA, 20 bp, human
gcgctcccagagcccgagag

SEQ ID NO: 300550 - DNA, 20 bp, human
gtgggctaagtgagggaggc

SEQ ID NO: 300551 - DNA, 20 bp, human
gctgcattgcggtttgtgtg

SEQ ID NO: 300552 - DNA, 20 bp, human
gatgcaggcggggagacaca

SEQ ID NO: 300553 - DNA, 20 bp, human
gccgctcaatgcaatctcct

SEQ ID NO: 300554 - DNA, 20 bp, human
ggcttcccctctcgggctct

SEQ ID NO: 300555 - DNA, 20 bp, human
ggtactgggagatgcaggcg

SEQ ID NO: 300556 - DNA, 20 bp, human
ggctcgcccagcctggtccg

SEQ ID NO: 300557 - DNA, 20 bp, human
ggggagagcgcgggcactga

SEQ ID NO: 300558 - DNA, 20 bp, human
ggcgaccaggaagctcccga

SEQ ID NO: 300559 - DNA, 20 bp, human
ggcggctcggggtgtctggc

SEQ ID NO: 300560 - DNA, 20 bp, human
gctcccgacggggagagcgc

SEQ ID NO: 300561 - DNA, 20 bp, human
gtgcccgcgctctccccgtc

SEQ ID NO: 300562 - DNA, 20 bp, human
ggcgccacggaacctaacgg

SEQ ID NO: 300563 - DNA, 20 bp, human
gttcctggtcgcccctgcgg

SEQ ID NO: 300564 - DNA, 20 bp, human
gcctctccccggaccaggct

SEQ ID NO: 300565 - DNA, 20 bp, human
gctggtcgcccctgcggcgg

SEQ ID NO: 300566 - DNA, 20 bp, human
ggaggcccaaggtgggagtc

SEQ ID NO: 300567 - DNA, 20 bp, human
gctgctgctgatactcccca

SEQ ID NO: 300568 - DNA, 20 bp, human
gagacaaaagagaggggccc

SEQ ID NO: 300569 - DNA, 20 bp, human
gcaccaggtgcagactgtct

SEQ ID NO: 300570 - DNA, 20 bp, human
gtatcagcagcagccaatcc

SEQ ID NO: 300571 - DNA, 20 bp, human
ggggctggcgtttggtggac

SEQ ID NO: 300572 - DNA, 20 bp, human
gctggtcaggggctggcgtt

SEQ ID NO: 300573 - DNA, 20 bp, human
gccagccagactcccacctt

SEQ ID NO: 300574 - DNA, 20 bp, human
gctggcgtttggtggacggg

SEQ ID NO: 300575 - DNA, 20 bp, human
gcagtctgcacctggtggtg

SEQ ID NO: 300576 - DNA, 20 bp, human
gtgcaggagggcgtagggga

SEQ ID NO: 300577 - DNA, 20 bp, human
gaggaagtgctcatgaactt

SEQ ID NO: 300578 - DNA, 20 bp, human
gtcaccagggaagctggcaa

SEQ ID NO: 300579 - DNA, 20 bp, human
gtggcaggggagggtccaca

SEQ ID NO: 300580 - DNA, 20 bp, human
ggaggggacccaggtgattt

SEQ ID NO: 300581 - DNA, 20 bp, human
gcctacgccctcctgcaaag

SEQ ID NO: 300582 - DNA, 20 bp, human
gagtctgggcagggttttat

SEQ ID NO: 300583 - DNA, 20 bp, human
gacttctgttggcagaggga

SEQ ID NO: 300584 - DNA, 20 bp, human
gcaggctgcaggaatgaccc

SEQ ID NO: 300585 - DNA, 20 bp, human
gggagactagggtgcgctct

SEQ ID NO: 300586 - DNA, 20 bp, human
gctaggagctgataataaga

SEQ ID NO: 300587 - DNA, 20 bp, human
gaggtcctgggaggccaatc

SEQ ID NO: 300588 - DNA, 20 bp, human
gggggcaagcccggcgaagc

SEQ ID NO: 300589 - DNA, 20 bp, human
gggtgccactcccgcttcgc

SEQ ID NO: 300590 - DNA, 20 bp, human
ggcactagtgactgacaggg

SEQ ID NO: 300591 - DNA, 20 bp, human
gaggagcactagtgactgac

SEQ ID NO: 300592 - DNA, 20 bp, human
gtaagcttctgcctctgtaa

SEQ ID NO: 300593 - DNA, 20 bp, human
gagacatattaggtcctggg

SEQ ID NO: 300594 - DNA, 20 bp, human
gctgggaggccaatctgggt

SEQ ID NO: 300595 - DNA, 20 bp, human
gcacagacatattaggtcct

SEQ ID NO: 300596 - DNA, 20 bp, human
gggggcaagcctggcgaagt

SEQ ID NO: 300597 - DNA, 20 bp, human
gccagacagggggacttcac

SEQ ID NO: 300598 - DNA, 20 bp, human
ggggacttcacagggtcgga

SEQ ID NO: 300599 - DNA, 20 bp, human
gacttcacagggtcggaggg

SEQ ID NO: 300600 - DNA, 20 bp, human
gagggtctagagttcccgct

SEQ ID NO: 300601 - DNA, 20 bp, human
gtcatgggaagtcctcagtc

SEQ ID NO: 300602 - DNA, 20 bp, human
ggtgcagcactgagccaacc

SEQ ID NO: 300603 - DNA, 20 bp, human
gaacgacgatagtgccagac

SEQ ID NO: 300604 - DNA, 20 bp, human
gcctgagaagccaagcccag

SEQ ID NO: 300605 - DNA, 20 bp, human
ggagaacctcctgcctagac

SEQ ID NO: 300606 - DNA, 20 bp, human
gctcgcgcgcctcactgctg

SEQ ID NO: 300607 - DNA, 20 bp, human
ggccccgccttctgtgtctg

SEQ ID NO: 300608 - DNA, 20 bp, human
gtctgtgtctggggcgtccc

SEQ ID NO: 300609 - DNA, 20 bp, human
ggtgtctggggcgtccctgg

SEQ ID NO: 300610 - DNA, 20 bp, human
gccagagccgggaaccctga

SEQ ID NO: 300611 - DNA, 20 bp, human
ggctgggtggcgatcagcgg

SEQ ID NO: 300612 - DNA, 20 bp, human
gttagaggcagggaacgcaa

SEQ ID NO: 300613 - DNA, 20 bp, human
ggcgagccgggaagtgaacg

SEQ ID NO: 300614 - DNA, 20 bp, human
gttcccggctctggcgtccg

SEQ ID NO: 300615 - DNA, 20 bp, human
gcgagctgggtggcgatcag

SEQ ID NO: 300616 - DNA, 20 bp, human
ggagagaaaggtatggtact

SEQ ID NO: 300617 - DNA, 20 bp, human
ggtatggtactgggtggact

SEQ ID NO: 300618 - DNA, 20 bp, human
gctacaaaggacttcctagt

SEQ ID NO: 300619 - DNA, 20 bp, human
gctgaggctcagagtctaag

SEQ ID NO: 300620 - DNA, 20 bp, human
gaatcttcataaagttcagg

SEQ ID NO: 300621 - DNA, 20 bp, human
gtaagtcgttccctctacaa

SEQ ID NO: 300622 - DNA, 20 bp, human
ggagaatcttcataaagttc

SEQ ID NO: 300623 - DNA, 20 bp, human
gcattattttctggactccg

SEQ ID NO: 300624 - DNA, 20 bp, human
gagaaaggtatggtactggg

SEQ ID NO: 300625 - DNA, 20 bp, human
ggaataatataaatttaaac

SEQ ID NO: 300626 - DNA, 20 bp, human
gctgcccagaagtatgtggc

SEQ ID NO: 300627 - DNA, 20 bp, human
ggaagaatagaaatttaaag

SEQ ID NO: 300628 - DNA, 20 bp, human
ggtagggtgttgggtgaact

SEQ ID NO: 300629 - DNA, 20 bp, human
gcctaagcatgcttggccac

SEQ ID NO: 300630 - DNA, 20 bp, human
ggagaatcttcatatagctc

SEQ ID NO: 300631 - DNA, 20 bp, human
gaaaacataattatgtagaa

SEQ ID NO: 300632 - DNA, 20 bp, human
gcattattttctggaaccag

SEQ ID NO: 300633 - DNA, 20 bp, human
ggaggagggaaaggtcactg

SEQ ID NO: 300634 - DNA, 20 bp, human
gtcaggctggggttgagcac

SEQ ID NO: 300635 - DNA, 20 bp, human
ggagagaaaggtagggtgtt

SEQ ID NO: 300636 - DNA, 20 bp, human
ggaagaatagaaatttaaag

SEQ ID NO: 300637 - DNA, 20 bp, human
ggtagggtgttgggtgaact

SEQ ID NO: 300638 - DNA, 20 bp, human
ggagaatcttcatatagctc

SEQ ID NO: 300639 - DNA, 20 bp, human
gcctaagcatgcttggccac

SEQ ID NO: 300640 - DNA, 20 bp, human
gtaagtcattccttctgcaa

SEQ ID NO: 300641 - DNA, 20 bp, human
gaaaacataattatgtagaa

SEQ ID NO: 300642 - DNA, 20 bp, human
gcattattttctggaaccag

SEQ ID NO: 300643 - DNA, 20 bp, human
ggaggagggaaaggtcactg

SEQ ID NO: 300644 - DNA, 20 bp, human
ggacactcatagagggaagt

SEQ ID NO: 300645 - DNA, 20 bp, human
gtcaggcttgggttgagcac

SEQ ID NO: 300646 - DNA, 20 bp, human
gcccctcggccattggacgg

SEQ ID NO: 300647 - DNA, 20 bp, human
gtggccggtgagagccgaca

SEQ ID NO: 300648 - DNA, 20 bp, human
ggggccctgtcggctctcac

SEQ ID NO: 300649 - DNA, 20 bp, human
gcgggagggacgggcctgtc

SEQ ID NO: 300650 - DNA, 20 bp, human
ggccggggctggagaagtga

SEQ ID NO: 300651 - DNA, 20 bp, human
gctgcccctcggccattgga

SEQ ID NO: 300652 - DNA, 20 bp, human
ggcgctggtggggcgatggg

SEQ ID NO: 300653 - DNA, 20 bp, human
ggacgggcctgtccgggtcc

SEQ ID NO: 300654 - DNA, 20 bp, human
gcgatgggaggcgaggtcga

SEQ ID NO: 300655 - DNA, 20 bp, human
gggccattggacggtggcgg

SEQ ID NO: 300656 - DNA, 20 bp, human
gagcacagaccagccttcga

SEQ ID NO: 300657 - DNA, 20 bp, human
gatgggagggatccaactgc

SEQ ID NO: 300658 - DNA, 20 bp, human
gaacagctttctgctttcac

SEQ ID NO: 300659 - DNA, 20 bp, human
gtcactttgccttcgaaggc

SEQ ID NO: 300660 - DNA, 20 bp, human
gctgtgaggtactgtgagat

SEQ ID NO: 300661 - DNA, 20 bp, human
gggagggatccaactgctgg

SEQ ID NO: 300662 - DNA, 20 bp, human
gaaggagagaatgaattacg

SEQ ID NO: 300663 - DNA, 20 bp, human
gattacgtgggggacccagg

SEQ ID NO: 300664 - DNA, 20 bp, human
gtgtcttattagtgagtggg

SEQ ID NO: 300665 - DNA, 20 bp, human
gtgaggtactgtgagatggg

SEQ ID NO: 300666 - DNA, 20 bp, human
ggggcctgactgagcggtgg

SEQ ID NO: 300667 - DNA, 20 bp, human
gcgcccggcccggggcgaga

SEQ ID NO: 300668 - DNA, 20 bp, human
gcctccaggggtataatctg

SEQ ID NO: 300669 - DNA, 20 bp, human
gcccgacgggggtctccgcc

SEQ ID NO: 300670 - DNA, 20 bp, human
gtcggggcctgactgagcgg

SEQ ID NO: 300671 - DNA, 20 bp, human
gcgagagggggtggcgaggt

SEQ ID NO: 300672 - DNA, 20 bp, human
ggatcctccaccgctcagtc

SEQ ID NO: 300673 - DNA, 20 bp, human
ggaaaagttgggtgaccttg

SEQ ID NO: 300674 - DNA, 20 bp, human
gtcgccaccccctctcgccc

SEQ ID NO: 300675 - DNA, 20 bp, human
gctcccatgggaggaacgtg

SEQ ID NO: 300676 - DNA, 20 bp, human
ggggcctgggagtcacggaa

SEQ ID NO: 300677 - DNA, 20 bp, human
gcatgtgcccgtgcagagac

SEQ ID NO: 300678 - DNA, 20 bp, human
gctggggccatccgcgtgtg

SEQ ID NO: 300679 - DNA, 20 bp, human
gatcccctaggcagcatcat

SEQ ID NO: 300680 - DNA, 20 bp, human
gtggaggcgcttcggcgtta

SEQ ID NO: 300681 - DNA, 20 bp, human
gcgcccggtagagcacacag

SEQ ID NO: 300682 - DNA, 20 bp, human
gcagccggggctgaccgcgc

SEQ ID NO: 300683 - DNA, 20 bp, human
gtggccgctgtgtgctctac

SEQ ID NO: 300684 - DNA, 20 bp, human
gacgccgaagcgcctccaca

SEQ ID NO: 300685 - DNA, 20 bp, human
gtcacgcgcagccccacacg

SEQ ID NO: 300686 - DNA, 20 bp, human
gacacccggcagagtaggat

SEQ ID NO: 300687 - DNA, 20 bp, human
gccctcccctggctacagga

SEQ ID NO: 300688 - DNA, 20 bp, human
gccggcacacccggcagagt

SEQ ID NO: 300689 - DNA, 20 bp, human
gcaggaggacgatgtcacca

SEQ ID NO: 300690 - DNA, 20 bp, human
gctccccgaaggtttgggaa

SEQ ID NO: 300691 - DNA, 20 bp, human
gcccccaatagggttgagtg

SEQ ID NO: 300692 - DNA, 20 bp, human
ggagggggaggggccaccaa

SEQ ID NO: 300693 - DNA, 20 bp, human
gggagcagctggacgtgatc

SEQ ID NO: 300694 - DNA, 20 bp, human
ggccatgagaaggtcggcct

SEQ ID NO: 300695 - DNA, 20 bp, human
gggacgatgtcaccagggtg

SEQ ID NO: 300696 - DNA, 20 bp, human
gtgcatgggcaggggcttct

SEQ ID NO: 300697 - DNA, 20 bp, human
gacgaggccggcgagccaaa

SEQ ID NO: 300698 - DNA, 20 bp, human
gaagtgaggtggggaatccg

SEQ ID NO: 300699 - DNA, 20 bp, human
gagcccctgcccatgcacac

SEQ ID NO: 300700 - DNA, 20 bp, human
gtgcgcactgaagtgaggtg

SEQ ID NO: 300701 - DNA, 20 bp, human
gactgtgccgcggtgactgg

SEQ ID NO: 300702 - DNA, 20 bp, human
ggcggtgactggtggagcta

SEQ ID NO: 300703 - DNA, 20 bp, human
ggtagttgcgcactgaagtg

SEQ ID NO: 300704 - DNA, 20 bp, human
gggggaatccgaggtacttg

SEQ ID NO: 300705 - DNA, 20 bp, human
gcctctcctcccattggttt

SEQ ID NO: 300706 - DNA, 20 bp, human
gcagagaggagagccgccat

SEQ ID NO: 300707 - DNA, 20 bp, human
gccagaggggcgtgtttctc

SEQ ID NO: 300708 - DNA, 20 bp, human
gagagccgccattggccaag

SEQ ID NO: 300709 - DNA, 20 bp, human
gcaatggcgctccgggagaa

SEQ ID NO: 300710 - DNA, 20 bp, human
gaatgagctcgagacctccc

SEQ ID NO: 300711 - DNA, 20 bp, human
gccggagcgccattggcccg

SEQ ID NO: 300712 - DNA, 20 bp, human
gttctcgggcgtgagtgaca

SEQ ID NO: 300713 - DNA, 20 bp, human
ggggaacaaaaagacgggtg

SEQ ID NO: 300714 - DNA, 20 bp, human
gtgcataagccagcggccgg

SEQ ID NO: 300715 - DNA, 20 bp, human
gagctcattactatgcagag

SEQ ID NO: 300716 - DNA, 20 bp, human
ggcctcccagcccaggactt

SEQ ID NO: 300717 - DNA, 20 bp, human
gtgggcggcgaggagaagcg

SEQ ID NO: 300718 - DNA, 20 bp, human
gctgctgctcgcggcctgag

SEQ ID NO: 300719 - DNA, 20 bp, human
ggttcctgaccccacggcgt

SEQ ID NO: 300720 - DNA, 20 bp, human
gaggctgcgctgacgtcact

SEQ ID NO: 300721 - DNA, 20 bp, human
gatgctgctccacaccgctc

SEQ ID NO: 300722 - DNA, 20 bp, human
gagacagtgcggcagacgta

SEQ ID NO: 300723 - DNA, 20 bp, human
gccgcccacgccgtggggtc

SEQ ID NO: 300724 - DNA, 20 bp, human
gcctcgccgcccacgccgtg

SEQ ID NO: 300725 - DNA, 20 bp, human
gcgcatgaaggggtaagggt

SEQ ID NO: 300726 - DNA, 20 bp, human
gacctgcatttgtttggata

SEQ ID NO: 300727 - DNA, 20 bp, human
gtctgctaggacaggagaga

SEQ ID NO: 300728 - DNA, 20 bp, human
ggcaggctgggatgacccga

SEQ ID NO: 300729 - DNA, 20 bp, human
gggaactcgtccaccctccc

SEQ ID NO: 300730 - DNA, 20 bp, human
gtggaggcatgaggggcaat

SEQ ID NO: 300731 - DNA, 20 bp, human
ggcagtgtgaaacgtggtgg

SEQ ID NO: 300732 - DNA, 20 bp, human
gaccctatccaaacaaatgc

SEQ ID NO: 300733 - DNA, 20 bp, human
gcctgcagtgtgaaacgtgg

SEQ ID NO: 300734 - DNA, 20 bp, human
gggctgggatgacccgacgg

SEQ ID NO: 300735 - DNA, 20 bp, human
gctggcctgtctgctaggac

SEQ ID NO: 300736 - DNA, 20 bp, human
ggggcaccgcagcaccagtg

SEQ ID NO: 300737 - DNA, 20 bp, human
ggggccagatactgcgtagc

SEQ ID NO: 300738 - DNA, 20 bp, human
gaataactgtgacctgttgt

SEQ ID NO: 300739 - DNA, 20 bp, human
ggtagagtgtatgtaagccc

SEQ ID NO: 300740 - DNA, 20 bp, human
gagatactgcgtagcaggcg

SEQ ID NO: 300741 - DNA, 20 bp, human
gagtgtgctgatggcaaccg

SEQ ID NO: 300742 - DNA, 20 bp, human
gcagcaccagtggggatgac

SEQ ID NO: 300743 - DNA, 20 bp, human
ggtgagaaatacacccaggc

SEQ ID NO: 300744 - DNA, 20 bp, human
gaatccacacagtgtgctga

SEQ ID NO: 300745 - DNA, 20 bp, human
ggctaaaagcttcttagtgg

SEQ ID NO: 300746 - DNA, 20 bp, human
gccctctggaaaagcctcta

SEQ ID NO: 300747 - DNA, 20 bp, human
gttccagcatactgtgcctt

SEQ ID NO: 300748 - DNA, 20 bp, human
gtaacaaaaattctgtatgt

SEQ ID NO: 300749 - DNA, 20 bp, human
gcatctgcagtctttgttgt

SEQ ID NO: 300750 - DNA, 20 bp, human
gtccatagaggcttttccag

SEQ ID NO: 300751 - DNA, 20 bp, human
gtgcccaaggcacagtatgc

SEQ ID NO: 300752 - DNA, 20 bp, human
gtgacccagatttttaccaa

SEQ ID NO: 300753 - DNA, 20 bp, human
gcagatgatgaattccatag

SEQ ID NO: 300754 - DNA, 20 bp, human
gttctgatgtgtcatgccca

SEQ ID NO: 300755 - DNA, 20 bp, human
gttacataacaattgtattc

SEQ ID NO: 300756 - DNA, 20 bp, human
gtgcacctctcgcccccggg

SEQ ID NO: 300757 - DNA, 20 bp, human
gtggacactaatccccccgg

SEQ ID NO: 300758 - DNA, 20 bp, human
gcgggggcgagaggtgcaca

SEQ ID NO: 300759 - DNA, 20 bp, human
gcgagaggtgcacatggcca

SEQ ID NO: 300760 - DNA, 20 bp, human
gataggatgctggggtaacc

SEQ ID NO: 300761 - DNA, 20 bp, human
ggtccctagcactcgacaac

SEQ ID NO: 300762 - DNA, 20 bp, human
gacctggacactaatccccc

SEQ ID NO: 300763 - DNA, 20 bp, human
gaagaccccacaattggcag

SEQ ID NO: 300764 - DNA, 20 bp, human
gctcagtggtctagcgccag

SEQ ID NO: 300765 - DNA, 20 bp, human
gcctgcctctgccaattgtg

SEQ ID NO: 300766 - DNA, 20 bp, human
gggtcactgggcactgtcgc

SEQ ID NO: 300767 - DNA, 20 bp, human
gcaagacaggggaaagtagc

SEQ ID NO: 300768 - DNA, 20 bp, human
gaaggaggttattgggtcac

SEQ ID NO: 300769 - DNA, 20 bp, human
ggggccatttgcagatggta

SEQ ID NO: 300770 - DNA, 20 bp, human
ggtgcgcggtaagaggggga

SEQ ID NO: 300771 - DNA, 20 bp, human
gcagcggggtgcgcggtaag

SEQ ID NO: 300772 - DNA, 20 bp, human
gtgggcactgtcgcaggtca

SEQ ID NO: 300773 - DNA, 20 bp, human
gagatggtaggggacaagac

SEQ ID NO: 300774 - DNA, 20 bp, human
gtgcaaatggccctagctat

SEQ ID NO: 300775 - DNA, 20 bp, human
ggaagggcagccaaggggcg

SEQ ID NO: 300776 - DNA, 20 bp, human
gaacgtccccggtgcgtcct

SEQ ID NO: 300777 - DNA, 20 bp, human
ggacgcaccggggacgttcc

SEQ ID NO: 300778 - DNA, 20 bp, human
gggtccaggcccacccccgg

SEQ ID NO: 300779 - DNA, 20 bp, human
gggtgccccgctgtccgcgc

SEQ ID NO: 300780 - DNA, 20 bp, human
gactccgcgcagacagaccc

SEQ ID NO: 300781 - DNA, 20 bp, human
gggcgctccaggaacgtccc

SEQ ID NO: 300782 - DNA, 20 bp, human
ggaaagctgcccccgggggt

SEQ ID NO: 300783 - DNA, 20 bp, human
gacagacccaggacgcaccg

SEQ ID NO: 300784 - DNA, 20 bp, human
gcgagggggctcggggctag

SEQ ID NO: 300785 - DNA, 20 bp, human
gtgcgtgcctcgcctgccaa

SEQ ID NO: 300786 - DNA, 20 bp, human
ggctgcccaaaagcctgctg

SEQ ID NO: 300787 - DNA, 20 bp, human
gttgtccgctgtgaggttgg

SEQ ID NO: 300788 - DNA, 20 bp, human
ggggcggagtccaacctaat

SEQ ID NO: 300789 - DNA, 20 bp, human
gaggcaatggaaatcagttt

SEQ ID NO: 300790 - DNA, 20 bp, human
gaacccagcctcagacatac

SEQ ID NO: 300791 - DNA, 20 bp, human
gtgcctgtatgtctgaggct

SEQ ID NO: 300792 - DNA, 20 bp, human
gaataactgctactctgctt

SEQ ID NO: 300793 - DNA, 20 bp, human
gccctagataatctctacca

SEQ ID NO: 300794 - DNA, 20 bp, human
ggctttgtccgctgtgaggt

SEQ ID NO: 300795 - DNA, 20 bp, human
gatgggtctgctacctacca

SEQ ID NO: 300796 - DNA, 20 bp, human
gacaggggatccccgagagg

SEQ ID NO: 300797 - DNA, 20 bp, human
gctagcactcggggagaggg

SEQ ID NO: 300798 - DNA, 20 bp, human
gaccaggcccggcctccgga

SEQ ID NO: 300799 - DNA, 20 bp, human
ggcgacaggggatccccgag

SEQ ID NO: 300800 - DNA, 20 bp, human
ggggccgggcgtccggggga

SEQ ID NO: 300801 - DNA, 20 bp, human
gtccgtcccgcgagcgggcc

SEQ ID NO: 300802 - DNA, 20 bp, human
gcgggggcagcgagagaaag

SEQ ID NO: 300803 - DNA, 20 bp, human
ggccgcctccgtcccgcgag

SEQ ID NO: 300804 - DNA, 20 bp, human
gggggagtgtcctgcgggtc

SEQ ID NO: 300805 - DNA, 20 bp, human
gcgggctagcactcggggag

SEQ ID NO: 300806 - DNA, 20 bp, human
gggagcgcggagcacccctc

SEQ ID NO: 300807 - DNA, 20 bp, human
gctcgctcccggaaggaggg

SEQ ID NO: 300808 - DNA, 20 bp, human
gtcacacccaccaggatcct

SEQ ID NO: 300809 - DNA, 20 bp, human
gtgtgccaggcgagccggag

SEQ ID NO: 300810 - DNA, 20 bp, human
gcgcgcaggagacacactca

SEQ ID NO: 300811 - DNA, 20 bp, human
gtaatccaggcccacttctc

SEQ ID NO: 300812 - DNA, 20 bp, human
gcatcctcgctcccggaagg

SEQ ID NO: 300813 - DNA, 20 bp, human
gaagtgggcctggattagga

SEQ ID NO: 300814 - DNA, 20 bp, human
gaggcgggaagcagagcggg

SEQ ID NO: 300815 - DNA, 20 bp, human
ggctcccccgccctccttcc

SEQ ID NO: 300816 - DNA, 20 bp, human
ggcggggcggaaccggggaa

SEQ ID NO: 300817 - DNA, 20 bp, human
gagggagtcccctacatcgg

SEQ ID NO: 300818 - DNA, 20 bp, human
ggaagggtggccacgatacc

SEQ ID NO: 300819 - DNA, 20 bp, human
gtgggggaccccaggtatcg

SEQ ID NO: 300820 - DNA, 20 bp, human
gggttccaggggaggtaatt

SEQ ID NO: 300821 - DNA, 20 bp, human
gtgtgcttgctgccccggct

SEQ ID NO: 300822 - DNA, 20 bp, human
gacctggggtcccccagccg

SEQ ID NO: 300823 - DNA, 20 bp, human
gatcgggggccctactgtgg

SEQ ID NO: 300824 - DNA, 20 bp, human
gcaagcacacctccacagta

SEQ ID NO: 300825 - DNA, 20 bp, human
gtcttccagcctgagctaag

SEQ ID NO: 300826 - DNA, 20 bp, human
gaaccgagatgacaagaatt

SEQ ID NO: 300827 - DNA, 20 bp, human
gctgcagcagaggcggggaa

SEQ ID NO: 300828 - DNA, 20 bp, human
gccactacaggcccccgccg

SEQ ID NO: 300829 - DNA, 20 bp, human
gaaacggcgccctccgcgga

SEQ ID NO: 300830 - DNA, 20 bp, human
gttcccaattcttgtcatct

SEQ ID NO: 300831 - DNA, 20 bp, human
gctcggttcaggaaggtgaa

SEQ ID NO: 300832 - DNA, 20 bp, human
gttccgattccccgcggcgg

SEQ ID NO: 300833 - DNA, 20 bp, human
gcccctcgcccggaaccccg

SEQ ID NO: 300834 - DNA, 20 bp, human
ggccccggggttccgggcga

SEQ ID NO: 300835 - DNA, 20 bp, human
gttgtcatctcggttcagga

SEQ ID NO: 300836 - DNA, 20 bp, human
gcggggcagggcaagaagac

SEQ ID NO: 300837 - DNA, 20 bp, human
gtcaggggcgagtgacgccg

SEQ ID NO: 300838 - DNA, 20 bp, human
ggggtgcaaacccggaactg

SEQ ID NO: 300839 - DNA, 20 bp, human
ggcgtcactcgcccctgaaa

SEQ ID NO: 300840 - DNA, 20 bp, human
ggagtgacgccggggtgccc

SEQ ID NO: 300841 - DNA, 20 bp, human
gggaactgtagtcccgcggg

SEQ ID NO: 300842 - DNA, 20 bp, human
gagtccctaagaaaggtcaa

SEQ ID NO: 300843 - DNA, 20 bp, human
gtcccaaccgacgccggcgc

SEQ ID NO: 300844 - DNA, 20 bp, human
ggccggcgtcggttgggacg

SEQ ID NO: 300845 - DNA, 20 bp, human
gagaagaccgggtgcaaacc

SEQ ID NO: 300846 - DNA, 20 bp, human
ggcggggagaccgcgtttag

SEQ ID NO: 300847 - DNA, 20 bp, human
gtaaaccattctgcatcccc

SEQ ID NO: 300848 - DNA, 20 bp, human
gcgactgtggggttagacgg

SEQ ID NO: 300849 - DNA, 20 bp, human
ggctggggagagacgcaccg

SEQ ID NO: 300850 - DNA, 20 bp, human
ggggcgctgcattaaggcga

SEQ ID NO: 300851 - DNA, 20 bp, human
gccaggagaccagggactga

SEQ ID NO: 300852 - DNA, 20 bp, human
gtgaccaagccgccggagct

SEQ ID NO: 300853 - DNA, 20 bp, human
gaccgagccttgtggaaggt

SEQ ID NO: 300854 - DNA, 20 bp, human
gacgcaccggggcggcgact

SEQ ID NO: 300855 - DNA, 20 bp, human
gagggccgaccgcgggagaa

SEQ ID NO: 300856 - DNA, 20 bp, human
gtcaggcgcggctgtagaaa

SEQ ID NO: 300857 - DNA, 20 bp, human
ggaaggcgggagacccaaga

SEQ ID NO: 300858 - DNA, 20 bp, human
gcgcgcgcctagcccagccc

SEQ ID NO: 300859 - DNA, 20 bp, human
ggccctggcagcgcgtgctc

SEQ ID NO: 300860 - DNA, 20 bp, human
gggctgtagaaaaggcgcgg

SEQ ID NO: 300861 - DNA, 20 bp, human
gcggccaatggcacggcggc

SEQ ID NO: 300862 - DNA, 20 bp, human
gcgcggctgtagaaaaggcg

SEQ ID NO: 300863 - DNA, 20 bp, human
gcgggagacccaagagggag

SEQ ID NO: 300864 - DNA, 20 bp, human
gaaggcgcggaggcttgcgc

SEQ ID NO: 300865 - DNA, 20 bp, human
gcccggagcacgcgctgcca

SEQ ID NO: 300866 - DNA, 20 bp, human
gagaccagcccgggccactg

SEQ ID NO: 300867 - DNA, 20 bp, human
gcgagggcgggcaccggtaa

SEQ ID NO: 300868 - DNA, 20 bp, human
ggggctaaggttcccgggag

SEQ ID NO: 300869 - DNA, 20 bp, human
gaccgcaggtcccggcgcaa

SEQ ID NO: 300870 - DNA, 20 bp, human
gcgtccggggccgcagttcc

SEQ ID NO: 300871 - DNA, 20 bp, human
gccgccctccgctcggccag

SEQ ID NO: 300872 - DNA, 20 bp, human
ggggccgggacgaacgctgg

SEQ ID NO: 300873 - DNA, 20 bp, human
gtcccgaggccaaacctcag

SEQ ID NO: 300874 - DNA, 20 bp, human
ggcggggccgggacgaacgc

SEQ ID NO: 300875 - DNA, 20 bp, human
gccctcgggccgggcacgcg

SEQ ID NO: 300876 - DNA, 20 bp, human
gggagcgggcacggccaccc

SEQ ID NO: 300877 - DNA, 20 bp, human
gcagcagggcctggagctta

SEQ ID NO: 300878 - DNA, 20 bp, human
ggacactgaccctacccttc

SEQ ID NO: 300879 - DNA, 20 bp, human
ggctgcacgccagaagggta

SEQ ID NO: 300880 - DNA, 20 bp, human
ggagggaggcgcgcccgaca

SEQ ID NO: 300881 - DNA, 20 bp, human
gtggggaccggggcgacgag

SEQ ID NO: 300882 - DNA, 20 bp, human
gcgtgatcaactccagccca

SEQ ID NO: 300883 - DNA, 20 bp, human
gcgcgcccgacacggggcag

SEQ ID NO: 300884 - DNA, 20 bp, human
gacccgcttgctgcgaaact

SEQ ID NO: 300885 - DNA, 20 bp, human
gcgaatcccagcgcctcagc

SEQ ID NO: 300886 - DNA, 20 bp, human
ggccggcacgcgaagggtgg

SEQ ID NO: 300887 - DNA, 20 bp, human
gcgccccgagtgaggccggc

SEQ ID NO: 300888 - DNA, 20 bp, human
gcggggttggtgcacatccc

SEQ ID NO: 300889 - DNA, 20 bp, human
ggcgggcagccgaccccgga

SEQ ID NO: 300890 - DNA, 20 bp, human
gcgggcggccggcacgcgaa

SEQ ID NO: 300891 - DNA, 20 bp, human
gggcacatcccccaacccgg

SEQ ID NO: 300892 - DNA, 20 bp, human
gcgggaggccgcggtcaccc

SEQ ID NO: 300893 - DNA, 20 bp, human
gctgcccgccgccgggttgg

SEQ ID NO: 300894 - DNA, 20 bp, human
ggccccgccggcctcactcg

SEQ ID NO: 300895 - DNA, 20 bp, human
gcggctgcccgccgccgggt

SEQ ID NO: 300896 - DNA, 20 bp, human
gccgtcagccccaaactgga

SEQ ID NO: 300897 - DNA, 20 bp, human
gtggctacagcgttgctgtc

SEQ ID NO: 300898 - DNA, 20 bp, human
ggcaacttctgcaagttcca

SEQ ID NO: 300899 - DNA, 20 bp, human
gacgtggcgctgcacgtagg

SEQ ID NO: 300900 - DNA, 20 bp, human
gagggggcccagcggccaat

SEQ ID NO: 300901 - DNA, 20 bp, human
gcgccccgtcagccccaaac

SEQ ID NO: 300902 - DNA, 20 bp, human
gggacagagcaaaaaaaaca

SEQ ID NO: 300903 - DNA, 20 bp, human
gggctggctgggctggagaa

SEQ ID NO: 300904 - DNA, 20 bp, human
gaatgggcgcaccgtggcca

SEQ ID NO: 300905 - DNA, 20 bp, human
gtattagcttgtacctggtt

SEQ ID NO: 300906 - DNA, 20 bp, human
ggaggactaccaagaggggg

SEQ ID NO: 300907 - DNA, 20 bp, human
gccttcttccgaggcagcgg

SEQ ID NO: 300908 - DNA, 20 bp, human
gaggaggaggactaccaaga

SEQ ID NO: 300909 - DNA, 20 bp, human
ggagcaagacacacacgacg

SEQ ID NO: 300910 - DNA, 20 bp, human
ggaagatgggtgccccttga

SEQ ID NO: 300911 - DNA, 20 bp, human
gcggccgccgttgcagctgg

SEQ ID NO: 300912 - DNA, 20 bp, human
gcggggctccagcggcaggg

SEQ ID NO: 300913 - DNA, 20 bp, human
gccccctccagctgcaacgg

SEQ ID NO: 300914 - DNA, 20 bp, human
ggtgtcttgctctcccttgg

SEQ ID NO: 300915 - DNA, 20 bp, human
gcgagcggggctccagcggc

SEQ ID NO: 300916 - DNA, 20 bp, human
ggggccgggccgaaagtggg

SEQ ID NO: 300917 - DNA, 20 bp, human
gcgggggccgggccgaaagt

SEQ ID NO: 300918 - DNA, 20 bp, human
gtgcaagcagtgggcggcgg

SEQ ID NO: 300919 - DNA, 20 bp, human
gggaacggcctcacgttgga

SEQ ID NO: 300920 - DNA, 20 bp, human
gggtacctgcagctgttccg

SEQ ID NO: 300921 - DNA, 20 bp, human
gaacgtgaggccgttccctg

SEQ ID NO: 300922 - DNA, 20 bp, human
gccgcccctcgggccggacc

SEQ ID NO: 300923 - DNA, 20 bp, human
gccctcgggccggacccggg

SEQ ID NO: 300924 - DNA, 20 bp, human
gacgtccgcgcgcgcttggc

SEQ ID NO: 300925 - DNA, 20 bp, human
gtgtcggccccgcccacttt

SEQ ID NO: 300926 - DNA, 20 bp, human
gatagcggagcggggaacac

SEQ ID NO: 300927 - DNA, 20 bp, human
gcggggaacaccgggctaaa

SEQ ID NO: 300928 - DNA, 20 bp, human
gaaagaaagagctttgtgag

SEQ ID NO: 300929 - DNA, 20 bp, human
gcaccgggctaaagggggtg

SEQ ID NO: 300930 - DNA, 20 bp, human
ggacgtgcccgggtgagcgc

SEQ ID NO: 300931 - DNA, 20 bp, human
gggcggggaaccgacgtgcc

SEQ ID NO: 300932 - DNA, 20 bp, human
gacgtcaatcatagcggagc

SEQ ID NO: 300933 - DNA, 20 bp, human
gaacttgttatccccggcgg

SEQ ID NO: 300934 - DNA, 20 bp, human
gttccagacgtcaatcatag

SEQ ID NO: 300935 - DNA, 20 bp, human
gcgggtgagcgccggagacc

SEQ ID NO: 300936 - DNA, 20 bp, human
gacaaacattacaaaggggt

SEQ ID NO: 300937 - DNA, 20 bp, human
gactgctgggaactcttgga

SEQ ID NO: 300938 - DNA, 20 bp, human
ggggttgagaggagtatgac

SEQ ID NO: 300939 - DNA, 20 bp, human
gctgcttgcccatcaccagg

SEQ ID NO: 300940 - DNA, 20 bp, human
gcaggacaaacattacaaag

SEQ ID NO: 300941 - DNA, 20 bp, human
ggggtggggggatagagagc

SEQ ID NO: 300942 - DNA, 20 bp, human
gtgaactcggatcaaatagg

SEQ ID NO: 300943 - DNA, 20 bp, human
ggtcctgcttgcccatcacc

SEQ ID NO: 300944 - DNA, 20 bp, human
gtagagagcggggaggcagg

SEQ ID NO: 300945 - DNA, 20 bp, human
gaaaatccgtggcagctccg

SEQ ID NO: 300946 - DNA, 20 bp, human
gcactcatgacgcaatacgc

SEQ ID NO: 300947 - DNA, 20 bp, human
gcgtacttgtatcgcgtaag

SEQ ID NO: 300948 - DNA, 20 bp, human
gtgagtgcgcgacgcacgta

SEQ ID NO: 300949 - DNA, 20 bp, human
gagccaagctgctccacgat

SEQ ID NO: 300950 - DNA, 20 bp, human
gctaactcccgggaaaggac

SEQ ID NO: 300951 - DNA, 20 bp, human
ggcggcgcggctcccactct

SEQ ID NO: 300952 - DNA, 20 bp, human
gaatctgaaaccatctgctc

SEQ ID NO: 300953 - DNA, 20 bp, human
gaggacaaggttccgagagt

SEQ ID NO: 300954 - DNA, 20 bp, human
gctgggggacaaacaggaca

SEQ ID NO: 300955 - DNA, 20 bp, human
gaggctaaagcagccaatcg

SEQ ID NO: 300956 - DNA, 20 bp, human
gggaagaaagtgagagtgaa

SEQ ID NO: 300957 - DNA, 20 bp, human
gaaggggggggacgagtgag

SEQ ID NO: 300958 - DNA, 20 bp, human
gtagccgggatccccagtcc

SEQ ID NO: 300959 - DNA, 20 bp, human
gcgtctggggcgcccactgc

SEQ ID NO: 300960 - DNA, 20 bp, human
gcccaaacccaggtgagtca

SEQ ID NO: 300961 - DNA, 20 bp, human
gcagtccaggaagttgtttg

SEQ ID NO: 300962 - DNA, 20 bp, human
ggaggaggctacctctgggg

SEQ ID NO: 300963 - DNA, 20 bp, human
gccacagggcgttttgtcga

SEQ ID NO: 300964 - DNA, 20 bp, human
gagacggccctgactcacct

SEQ ID NO: 300965 - DNA, 20 bp, human
gggcccctgtgccccctggt

SEQ ID NO: 300966 - DNA, 20 bp, human
gcgcgggtgctccaaggagt

SEQ ID NO: 300967 - DNA, 20 bp, human
ggggtgctccaaggagtcgg

SEQ ID NO: 300968 - DNA, 20 bp, human
ggacgggccccggacgccga

SEQ ID NO: 300969 - DNA, 20 bp, human
gagagcggcctcaccaccgg

SEQ ID NO: 300970 - DNA, 20 bp, human
gcgcggccggggatcggcgg

SEQ ID NO: 300971 - DNA, 20 bp, human
gccaaggagtcggaggaacg

SEQ ID NO: 300972 - DNA, 20 bp, human
gcctgcacgccgctcggctg

SEQ ID NO: 300973 - DNA, 20 bp, human
gctcaccaccggaggctcgg

SEQ ID NO: 300974 - DNA, 20 bp, human
ggaggaacgcggccgcgcga

SEQ ID NO: 300975 - DNA, 20 bp, human
ggcgcgcccccgccgatccc

SEQ ID NO: 300976 - DNA, 20 bp, human
gagccacacccgctcatcca

SEQ ID NO: 300977 - DNA, 20 bp, human
ggatgagcgggtgtggctga

SEQ ID NO: 300978 - DNA, 20 bp, human
gcggggcatcccgggagcaa

SEQ ID NO: 300979 - DNA, 20 bp, human
gtccctcgccctggatgagc

SEQ ID NO: 300980 - DNA, 20 bp, human
gggtctgaggagtgactggc

SEQ ID NO: 300981 - DNA, 20 bp, human
gacccgctcatccagggcga

SEQ ID NO: 300982 - DNA, 20 bp, human
gccctcccgcagagcacact

SEQ ID NO: 300983 - DNA, 20 bp, human
gcgcccccgcgaggcacggc

SEQ ID NO: 300984 - DNA, 20 bp, human
gcccgcgctttccctcgccc

SEQ ID NO: 300985 - DNA, 20 bp, human
ggggaagggtgcacatcttg

SEQ ID NO: 300986 - DNA, 20 bp, human
gcgacccacgtggcagacgg

SEQ ID NO: 300987 - DNA, 20 bp, human
gcttcccgggccgcgattgc

SEQ ID NO: 300988 - DNA, 20 bp, human
gccgcccccgtctgccacgt

SEQ ID NO: 300989 - DNA, 20 bp, human
gactactcccaaacatcaca

SEQ ID NO: 300990 - DNA, 20 bp, human
gcaggcgctccaaccgtcgt

SEQ ID NO: 300991 - DNA, 20 bp, human
gcaacctgcaatcgcggccc

SEQ ID NO: 300992 - DNA, 20 bp, human
gaatgcaactacgacccacg

SEQ ID NO: 300993 - DNA, 20 bp, human
ggggaccggtcgcgtggccg

SEQ ID NO: 300994 - DNA, 20 bp, human
ggggggacgtggcggctcct

SEQ ID NO: 300995 - DNA, 20 bp, human
gctgcctgccctgtgatgtt

SEQ ID NO: 300996 - DNA, 20 bp, human
gaggctcgcgatgggaggtg

SEQ ID NO: 300997 - DNA, 20 bp, human
gcagccaggctcgcgatggg

SEQ ID NO: 300998 - DNA, 20 bp, human
gggggggccggcagccccgt

SEQ ID NO: 300999 - DNA, 20 bp, human
gggcgcagccaggctcgcga

SEQ ID NO: 301000 - DNA, 20 bp, human
gaccctaaccaggatcctgc

SEQ ID NO: 301001 - DNA, 20 bp, human
gcggcagccccgtggggctg

SEQ ID NO: 301002 - DNA, 20 bp, human
gccgcctccgcagccccacg

SEQ ID NO: 301003 - DNA, 20 bp, human
gtcaccgggctcaagcacgc

SEQ ID NO: 301004 - DNA, 20 bp, human
gcagagcacaaagtgatctt

SEQ ID NO: 301005 - DNA, 20 bp, human
gtgtactcaagaccctaacc

SEQ ID NO: 301006 - DNA, 20 bp, human
ggcccccgctcgggtgtcgc

SEQ ID NO: 301007 - DNA, 20 bp, human
ggccggcgacacccgagcgg

SEQ ID NO: 301008 - DNA, 20 bp, human
gcgggcagggttcccactcc

SEQ ID NO: 301009 - DNA, 20 bp, human
ggacggagaacaggttatgt

SEQ ID NO: 301010 - DNA, 20 bp, human
gcggccgcgggcacgaaacc

SEQ ID NO: 301011 - DNA, 20 bp, human
gcccgcgacggtggcccgga

SEQ ID NO: 301012 - DNA, 20 bp, human
ggggagcggagacggagaac

SEQ ID NO: 301013 - DNA, 20 bp, human
gccggcgccacggtctagcc

SEQ ID NO: 301014 - DNA, 20 bp, human
gggagctccgggctagaccg

SEQ ID NO: 301015 - DNA, 20 bp, human
gtggggccacagctcgcagc

SEQ ID NO: 301016 - DNA, 20 bp, human
gatgtttgttcccagcgggt

SEQ ID NO: 301017 - DNA, 20 bp, human
gtgttcccagcgggtgggag

SEQ ID NO: 301018 - DNA, 20 bp, human
gtccgagtgtccacactggg

SEQ ID NO: 301019 - DNA, 20 bp, human
ggtgtccactcccacccgct

SEQ ID NO: 301020 - DNA, 20 bp, human
ggaagcagaactaccctacc

SEQ ID NO: 301021 - DNA, 20 bp, human
gccgttaccctcatctggaa

SEQ ID NO: 301022 - DNA, 20 bp, human
gggtaagacctgaactgttt

SEQ ID NO: 301023 - DNA, 20 bp, human
gcccacccagtgtggacact

SEQ ID NO: 301024 - DNA, 20 bp, human
gtcagatgtttgttcccagc

SEQ ID NO: 301025 - DNA, 20 bp, human
ggcctccgagtgtccacact

SEQ ID NO: 301026 - DNA, 20 bp, human
gaaaaggggaagtacaggag

SEQ ID NO: 301027 - DNA, 20 bp, human
gagcctcattcccggggtgg

SEQ ID NO: 301028 - DNA, 20 bp, human
gaggacgcaagggacactga

SEQ ID NO: 301029 - DNA, 20 bp, human
ggactcagagcctcattccc

SEQ ID NO: 301030 - DNA, 20 bp, human
ggcaagggacactgaggggg

SEQ ID NO: 301031 - DNA, 20 bp, human
gcctggctgtcataccttta

SEQ ID NO: 301032 - DNA, 20 bp, human
gaacatggacggaggtgccg

SEQ ID NO: 301033 - DNA, 20 bp, human
gaaactctgaacatggacgg

SEQ ID NO: 301034 - DNA, 20 bp, human
ggggaggaatacttcggcct

SEQ ID NO: 301035 - DNA, 20 bp, human
gcatctggaagggcagacgc

SEQ ID NO: 301036 - DNA, 20 bp, human
ggggagggagaccttgaggg

SEQ ID NO: 301037 - DNA, 20 bp, human
gcacctgaaaggggtgactc

SEQ ID NO: 301038 - DNA, 20 bp, human
ggaggtcgccctcacctgaa

SEQ ID NO: 301039 - DNA, 20 bp, human
ggggtgactcaggaaagcat

SEQ ID NO: 301040 - DNA, 20 bp, human
gcctggctgtctttcctgta

SEQ ID NO: 301041 - DNA, 20 bp, human
gtcttagtgagatgaagaca

SEQ ID NO: 301042 - DNA, 20 bp, human
gttcctgagtcacccctttc

SEQ ID NO: 301043 - DNA, 20 bp, human
gtcttcatctcactaagacc

SEQ ID NO: 301044 - DNA, 20 bp, human
gctgtctgaaatgtctatag

SEQ ID NO: 301045 - DNA, 20 bp, human
gtgtctttcctgtagggctg

SEQ ID NO: 301046 - DNA, 20 bp, human
gacaaatggggattcacaag

SEQ ID NO: 301047 - DNA, 20 bp, human
gccctgggaaatgagagcca

SEQ ID NO: 301048 - DNA, 20 bp, human
ggcacagaaaaggaagtcca

SEQ ID NO: 301049 - DNA, 20 bp, human
gcagacagacacatggtgtg

SEQ ID NO: 301050 - DNA, 20 bp, human
gcacaagggggtcgttaaga

SEQ ID NO: 301051 - DNA, 20 bp, human
gggacaacctcgtgatgggg

SEQ ID NO: 301052 - DNA, 20 bp, human
ggatgggacaacctcgtgat

SEQ ID NO: 301053 - DNA, 20 bp, human
gctgggtcctccccatcacg

SEQ ID NO: 301054 - DNA, 20 bp, human
gcatttcccagggcttgtcc

SEQ ID NO: 301055 - DNA, 20 bp, human
gtcagcacaccgacagaaag

SEQ ID NO: 301056 - DNA, 20 bp, human
ggaaacagaaggcacagtgg

SEQ ID NO: 301057 - DNA, 20 bp, human
ggcagacagtggcccgggga

SEQ ID NO: 301058 - DNA, 20 bp, human
ggaggtttgttactggaggt

SEQ ID NO: 301059 - DNA, 20 bp, human
gctgtgccttctgtttcttt

SEQ ID NO: 301060 - DNA, 20 bp, human
gcatgaccctttagtggccc

SEQ ID NO: 301061 - DNA, 20 bp, human
gacactccagggccactaaa

SEQ ID NO: 301062 - DNA, 20 bp, human
gcagagacacatctgacacc

SEQ ID NO: 301063 - DNA, 20 bp, human
gagatgcaggtccatgccac

SEQ ID NO: 301064 - DNA, 20 bp, human
gagagcagttcccctttctg

SEQ ID NO: 301065 - DNA, 20 bp, human
gacatggattgaggtataga

SEQ ID NO: 301066 - DNA, 20 bp, human
ggaactgatggacgagctga

SEQ ID NO: 301067 - DNA, 20 bp, human
gaactgccaccccaggaacc

SEQ ID NO: 301068 - DNA, 20 bp, human
gttcaggcgagggtgaccgt

SEQ ID NO: 301069 - DNA, 20 bp, human
gaaatcagagccaggttcct

SEQ ID NO: 301070 - DNA, 20 bp, human
ggaagaggaactgccacccc

SEQ ID NO: 301071 - DNA, 20 bp, human
gaaggcaccaggtctatttg

SEQ ID NO: 301072 - DNA, 20 bp, human
ggtggcagttcctcttcctg

SEQ ID NO: 301073 - DNA, 20 bp, human
gacacctggctgtgtagtcc

SEQ ID NO: 301074 - DNA, 20 bp, human
ggatttccccagggctgaag

SEQ ID NO: 301075 - DNA, 20 bp, human
gtctttatctcactgaggac

SEQ ID NO: 301076 - DNA, 20 bp, human
gaatccctgttcaacgcttt

SEQ ID NO: 301077 - DNA, 20 bp, human
gggtgctggaacattaggag

SEQ ID NO: 301078 - DNA, 20 bp, human
gttgtgacaacagtcggcaa

SEQ ID NO: 301079 - DNA, 20 bp, human
gacagtggttgtacggtcag

SEQ ID NO: 301080 - DNA, 20 bp, human
gctcagagatttgttcccgg

SEQ ID NO: 301081 - DNA, 20 bp, human
ggaggtgtttgggacataag

SEQ ID NO: 301082 - DNA, 20 bp, human
gagatttgttcccggggggt

SEQ ID NO: 301083 - DNA, 20 bp, human
gcaatcacctacgtagactg

SEQ ID NO: 301084 - DNA, 20 bp, human
gtacaaccactgtcacgagt

SEQ ID NO: 301085 - DNA, 20 bp, human
ggggtaagacctgaggtgtt

SEQ ID NO: 301086 - DNA, 20 bp, human
gggacggctaaggacgcaat

SEQ ID NO: 301087 - DNA, 20 bp, human
gagactcagaggtttcttcc

SEQ ID NO: 301088 - DNA, 20 bp, human
gcagaggtttcttcccgggg

SEQ ID NO: 301089 - DNA, 20 bp, human
gacacgcagctcaacctgga

SEQ ID NO: 301090 - DNA, 20 bp, human
ggcctctggctgtgccgtcc

SEQ ID NO: 301091 - DNA, 20 bp, human
ggcgtccactccctcccccc

SEQ ID NO: 301092 - DNA, 20 bp, human
gcccggctctcggtgagacg

SEQ ID NO: 301093 - DNA, 20 bp, human
ggggtaagacctgaggcttt

SEQ ID NO: 301094 - DNA, 20 bp, human
gcacaaccactgtgacgagt

SEQ ID NO: 301095 - DNA, 20 bp, human
gtcctcgtctcaccgagagc

SEQ ID NO: 301096 - DNA, 20 bp, human
gggtcaccctcgcctcaaag

SEQ ID NO: 301097 - DNA, 20 bp, human
gagtcagcccctttgaggcg

SEQ ID NO: 301098 - DNA, 20 bp, human
gtcctgagtcagcccctttg

SEQ ID NO: 301099 - DNA, 20 bp, human
gaactgccaccccaggaacc

SEQ ID NO: 301100 - DNA, 20 bp, human
ggaagaggaactgccacccc

SEQ ID NO: 301101 - DNA, 20 bp, human
gttgaggcgagggtgaccgt

SEQ ID NO: 301102 - DNA, 20 bp, human
gaaatcagagccaggttcct

SEQ ID NO: 301103 - DNA, 20 bp, human
ggtggcagttcctcttcctg

SEQ ID NO: 301104 - DNA, 20 bp, human
gaaggcaccaggtctatttg

SEQ ID NO: 301105 - DNA, 20 bp, human
gacacctggctgtgtagtcc

SEQ ID NO: 301106 - DNA, 20 bp, human
gtgcctcagccctagctctg

SEQ ID NO: 301107 - DNA, 20 bp, human
gatacatacgggttgatgtt

SEQ ID NO: 301108 - DNA, 20 bp, human
gcaagagaggaattaagacc

SEQ ID NO: 301109 - DNA, 20 bp, human
ggaacaaccccatgacgaga

SEQ ID NO: 301110 - DNA, 20 bp, human
gcagaggcttgaacaggcga

SEQ ID NO: 301111 - DNA, 20 bp, human
gtgcaaacacacgatacata

SEQ ID NO: 301112 - DNA, 20 bp, human
gtgcaaagcgcctgacactg

SEQ ID NO: 301113 - DNA, 20 bp, human
gagcctgcagaggcttgaac

SEQ ID NO: 301114 - DNA, 20 bp, human
gatgatgtacccccagtgtc

SEQ ID NO: 301115 - DNA, 20 bp, human
ggttgatgtttggtcaagag

SEQ ID NO: 301116 - DNA, 20 bp, human
gcaactgctgtgagggttgg

SEQ ID NO: 301117 - DNA, 20 bp, human
ggagagagggtggcaatctc

SEQ ID NO: 301118 - DNA, 20 bp, human
gctgccgcttcctggctgga

SEQ ID NO: 301119 - DNA, 20 bp, human
ggcgtgatgacatcaggaat

SEQ ID NO: 301120 - DNA, 20 bp, human
gctctttccctgcaactctg

SEQ ID NO: 301121 - DNA, 20 bp, human
gtcacgcccaaggtctgaga

SEQ ID NO: 301122 - DNA, 20 bp, human
gagccaagccccagagttgc

SEQ ID NO: 301123 - DNA, 20 bp, human
gcagtgccttctcagacctt

SEQ ID NO: 301124 - DNA, 20 bp, human
gctgtgaaatgggtggagag

SEQ ID NO: 301125 - DNA, 20 bp, human
gttcctggctggaggggtct

SEQ ID NO: 301126 - DNA, 20 bp, human
gggtgagctgagtataggtc

SEQ ID NO: 301127 - DNA, 20 bp, human
gcgacagcggctagggctca

SEQ ID NO: 301128 - DNA, 20 bp, human
ggtcaggccgacagcggcta

SEQ ID NO: 301129 - DNA, 20 bp, human
gcccttggtgagctgagtat

SEQ ID NO: 301130 - DNA, 20 bp, human
gagggacggccaaggacaaa

SEQ ID NO: 301131 - DNA, 20 bp, human
gttcctgtggggcttccgat

SEQ ID NO: 301132 - DNA, 20 bp, human
gtgtcacaagactgtcccat

SEQ ID NO: 301133 - DNA, 20 bp, human
ggtcccatcggaagccccac

SEQ ID NO: 301134 - DNA, 20 bp, human
ggtataggtcaggccgacag

SEQ ID NO: 301135 - DNA, 20 bp, human
gggaggcaggaacgacttag

SEQ ID NO: 301136 - DNA, 20 bp, human
gaggctggcgacaaggtatt

SEQ ID NO: 301137 - DNA, 20 bp, human
gaaggtattgggttccgggg

SEQ ID NO: 301138 - DNA, 20 bp, human
gtgacctctgtgaccctccc

SEQ ID NO: 301139 - DNA, 20 bp, human
ggcgacaaggtattgggttc

SEQ ID NO: 301140 - DNA, 20 bp, human
ggttccggggagggtcacag

SEQ ID NO: 301141 - DNA, 20 bp, human
gacagaggtcagtgagtggg

SEQ ID NO: 301142 - DNA, 20 bp, human
ggtagtgggaccattgtgta

SEQ ID NO: 301143 - DNA, 20 bp, human
gtggggagtcacaggtgtct

SEQ ID NO: 301144 - DNA, 20 bp, human
gctggaagctgctgggtagt

SEQ ID NO: 301145 - DNA, 20 bp, human
gcgctgaagcaggcatccag

SEQ ID NO: 301146 - DNA, 20 bp, human
gatccacccggcagagggag

SEQ ID NO: 301147 - DNA, 20 bp, human
ggaaagcatccacccggcag

SEQ ID NO: 301148 - DNA, 20 bp, human
gaaaacaggatggccttata

SEQ ID NO: 301149 - DNA, 20 bp, human
ggaaactataccattaatta

SEQ ID NO: 301150 - DNA, 20 bp, human
gcatggagaaagcatccacc

SEQ ID NO: 301151 - DNA, 20 bp, human
gaaagatgcaggatagttgc

SEQ ID NO: 301152 - DNA, 20 bp, human
ggaaacaatttgtagaaccc

SEQ ID NO: 301153 - DNA, 20 bp, human
gtgccactatccgtaattaa

SEQ ID NO: 301154 - DNA, 20 bp, human
gattacggatagtggcagca

SEQ ID NO: 301155 - DNA, 20 bp, human
gtaaacttgtagagaagagc

SEQ ID NO: 301156 - DNA, 20 bp, human
ggggcgctggcgacgggaca

SEQ ID NO: 301157 - DNA, 20 bp, human
gccagtcgctctggcggtgc

SEQ ID NO: 301158 - DNA, 20 bp, human
gcagcctcccgtgcggcctc

SEQ ID NO: 301159 - DNA, 20 bp, human
gcgccagacagcctcccgtg

SEQ ID NO: 301160 - DNA, 20 bp, human
gacacgcacttgcacgacgt

SEQ ID NO: 301161 - DNA, 20 bp, human
gcccggggcctagtctacct

SEQ ID NO: 301162 - DNA, 20 bp, human
gctaacacctactgctcctg

SEQ ID NO: 301163 - DNA, 20 bp, human
gtcggcacgcttttctctga

SEQ ID NO: 301164 - DNA, 20 bp, human
gtgcgcgcccccgcggcggt

SEQ ID NO: 301165 - DNA, 20 bp, human
gtgcgataacgttgagtcag

SEQ ID NO: 301166 - DNA, 20 bp, human
gcgctcccgcgggtcactca

SEQ ID NO: 301167 - DNA, 20 bp, human
gggagcggccctcgaaggtg

SEQ ID NO: 301168 - DNA, 20 bp, human
ggcggccctcgaaggtgggg

SEQ ID NO: 301169 - DNA, 20 bp, human
ggagagccgcgcgctgctag

SEQ ID NO: 301170 - DNA, 20 bp, human
ggggagggggagcacagcta

SEQ ID NO: 301171 - DNA, 20 bp, human
ggcgctgctagaggacgccg

SEQ ID NO: 301172 - DNA, 20 bp, human
ggcctccgcgctcgctcccg

SEQ ID NO: 301173 - DNA, 20 bp, human
gcggggcgcagggacgtgcg

SEQ ID NO: 301174 - DNA, 20 bp, human
gggcggggagcgcgctcctg

SEQ ID NO: 301175 - DNA, 20 bp, human
gacgcgccgtgagtgacccg

SEQ ID NO: 301176 - DNA, 20 bp, human
gagcgtgggacggacttgtg

SEQ ID NO: 301177 - DNA, 20 bp, human
ggggtcctccgctcggagac

SEQ ID NO: 301178 - DNA, 20 bp, human
gtgcacccggcagcgtggct

SEQ ID NO: 301179 - DNA, 20 bp, human
gcaggccgcccgtctccgag

SEQ ID NO: 301180 - DNA, 20 bp, human
gctggctggagaacaccgag

SEQ ID NO: 301181 - DNA, 20 bp, human
gagtcccagtgctagagcgt

SEQ ID NO: 301182 - DNA, 20 bp, human
ggaggtcggagcacccaatt

SEQ ID NO: 301183 - DNA, 20 bp, human
gaggcctgcacccggcagcg

SEQ ID NO: 301184 - DNA, 20 bp, human
gctgggcggggtcctccgct

SEQ ID NO: 301185 - DNA, 20 bp, human
gaggacggtgggccagccat

SEQ ID NO: 301186 - DNA, 20 bp, human
gcggtgcagcgataaggcgg

SEQ ID NO: 301187 - DNA, 20 bp, human
gaggggaagacaaagcgcgg

SEQ ID NO: 301188 - DNA, 20 bp, human
gtggggaagcaacggtggca

SEQ ID NO: 301189 - DNA, 20 bp, human
gcccgacggcggcccggcgt

SEQ ID NO: 301190 - DNA, 20 bp, human
gcggggcgggggacagacaa

SEQ ID NO: 301191 - DNA, 20 bp, human
ggggcggtgcagcgataagg

SEQ ID NO: 301192 - DNA, 20 bp, human
ggcgaggggaagacaaagcg

SEQ ID NO: 301193 - DNA, 20 bp, human
gtggcagggacaggatggaa

SEQ ID NO: 301194 - DNA, 20 bp, human
gcgggcgcggcggagccaat

SEQ ID NO: 301195 - DNA, 20 bp, human
gggaagacaaagcgcggagg

SEQ ID NO: 301196 - DNA, 20 bp, human
gttaggctgtcagaacagtg

SEQ ID NO: 301197 - DNA, 20 bp, human
gctgcctgacacccacagat

SEQ ID NO: 301198 - DNA, 20 bp, human
gcacgtcttcgtgtgtggag

SEQ ID NO: 301199 - DNA, 20 bp, human
gcaagagtgccccacgtggt

SEQ ID NO: 301200 - DNA, 20 bp, human
gtgtggaggggttgtgagtt

SEQ ID NO: 301201 - DNA, 20 bp, human
gcaggcggacctggccctgt

SEQ ID NO: 301202 - DNA, 20 bp, human
gaggcgcacacgtttcatct

SEQ ID NO: 301203 - DNA, 20 bp, human
gggactgtggcccaccacgt

SEQ ID NO: 301204 - DNA, 20 bp, human
gacctggccctgtgggtttg

SEQ ID NO: 301205 - DNA, 20 bp, human
gacgaagacgtgagcagagc

SEQ ID NO: 301206 - DNA, 20 bp, human
gaggctgcagggcagtgcga

SEQ ID NO: 301207 - DNA, 20 bp, human
gctgcagggcagtgcgacgg

SEQ ID NO: 301208 - DNA, 20 bp, human
gaaggctggtcggtgccctg

SEQ ID NO: 301209 - DNA, 20 bp, human
gtcacagcccagcgcgggaa

SEQ ID NO: 301210 - DNA, 20 bp, human
gaggtgggtccgcctcagta

SEQ ID NO: 301211 - DNA, 20 bp, human
gccgcctcagtagggactgg

SEQ ID NO: 301212 - DNA, 20 bp, human
gggtccgcctcagtagggac

SEQ ID NO: 301213 - DNA, 20 bp, human
gtcagggcagagttcactcc

SEQ ID NO: 301214 - DNA, 20 bp, human
gctggtgtccgacttgctga

SEQ ID NO: 301215 - DNA, 20 bp, human
gcagggcagtgcgacggcgg

SEQ ID NO: 301216 - DNA, 20 bp, human
gcccccaggccgggccgcag

SEQ ID NO: 301217 - DNA, 20 bp, human
gaatgaatgaagggcggaag

SEQ ID NO: 301218 - DNA, 20 bp, human
gagggccgctagctctgctg

SEQ ID NO: 301219 - DNA, 20 bp, human
gcccagccgaggcctgtcgc

SEQ ID NO: 301220 - DNA, 20 bp, human
ggaggcgtggccttgggcgt

SEQ ID NO: 301221 - DNA, 20 bp, human
gcctctagaggcgtggcctt

SEQ ID NO: 301222 - DNA, 20 bp, human
gtagaggccacgccccgctg

SEQ ID NO: 301223 - DNA, 20 bp, human
gtgggggcggggttttctgg

SEQ ID NO: 301224 - DNA, 20 bp, human
gcccccgtgccgcagctcac

SEQ ID NO: 301225 - DNA, 20 bp, human
gaaccccgcccccacgccca

SEQ ID NO: 301226 - DNA, 20 bp, human
gggtggggagcgagcgatct

SEQ ID NO: 301227 - DNA, 20 bp, human
gggctgcagcgcacaggagg

SEQ ID NO: 301228 - DNA, 20 bp, human
gcgcaccaaagcccaggcaa

SEQ ID NO: 301229 - DNA, 20 bp, human
ggaggaggctgcagccgcgt

SEQ ID NO: 301230 - DNA, 20 bp, human
gcccacccgcaccaaagccc

SEQ ID NO: 301231 - DNA, 20 bp, human
gcgtggctgcagcgcacagg

SEQ ID NO: 301232 - DNA, 20 bp, human
gcagcgtggctgcagcgcac

SEQ ID NO: 301233 - DNA, 20 bp, human
gagtcctgaacacacgctgt

SEQ ID NO: 301234 - DNA, 20 bp, human
gtccctcaggggctcaggat

SEQ ID NO: 301235 - DNA, 20 bp, human
gtccaatcctgagcccctga

SEQ ID NO: 301236 - DNA, 20 bp, human
gggggccggaagtctcaaca

SEQ ID NO: 301237 - DNA, 20 bp, human
gaccggcgggagcacctcga

SEQ ID NO: 301238 - DNA, 20 bp, human
ggggacgccgctcgcactag

SEQ ID NO: 301239 - DNA, 20 bp, human
ggggccgcgtctcgggagcg

SEQ ID NO: 301240 - DNA, 20 bp, human
gggtaaggttgattctgcgg

SEQ ID NO: 301241 - DNA, 20 bp, human
gtctggctcgggctctgcag

SEQ ID NO: 301242 - DNA, 20 bp, human
gtaaatgagggcgactagat

SEQ ID NO: 301243 - DNA, 20 bp, human
gaggcctcgctcccgagacg

SEQ ID NO: 301244 - DNA, 20 bp, human
ggccggtaaggttgattctg

SEQ ID NO: 301245 - DNA, 20 bp, human
gagggaaagttaaggatcag

SEQ ID NO: 301246 - DNA, 20 bp, human
gtagcctggggtgctgaaat

SEQ ID NO: 301247 - DNA, 20 bp, human
gcaaacgcagcgggtggctg

SEQ ID NO: 301248 - DNA, 20 bp, human
gcgaagggcgcggactggag

SEQ ID NO: 301249 - DNA, 20 bp, human
gtggcggggcgggcgccgaa

SEQ ID NO: 301250 - DNA, 20 bp, human
ggggcccgagccacgggttg

SEQ ID NO: 301251 - DNA, 20 bp, human
ggaggctggcgcaaacgcag

SEQ ID NO: 301252 - DNA, 20 bp, human
gtcagcaccccaggctagtc

SEQ ID NO: 301253 - DNA, 20 bp, human
gcgggggggcggggcgttgc

SEQ ID NO: 301254 - DNA, 20 bp, human
ggactggagaggtaggcgcg

SEQ ID NO: 301255 - DNA, 20 bp, human
gctggcgcaaacgcagcggg

SEQ ID NO: 301256 - DNA, 20 bp, human
gaacgcgtgcaggagatggt

SEQ ID NO: 301257 - DNA, 20 bp, human
gaggttgcgggagtataggt

SEQ ID NO: 301258 - DNA, 20 bp, human
gtaaaggtggggctgacggt

SEQ ID NO: 301259 - DNA, 20 bp, human
gtggcagggtggggcccgcg

SEQ ID NO: 301260 - DNA, 20 bp, human
ggtgttggggaggtgacggt

SEQ ID NO: 301261 - DNA, 20 bp, human
gagccgctccgcccgcgaga

SEQ ID NO: 301262 - DNA, 20 bp, human
gttggggaggtgacggtggg

SEQ ID NO: 301263 - DNA, 20 bp, human
gtcagtgcccagatccgcgg

SEQ ID NO: 301264 - DNA, 20 bp, human
ggcggcccagggactgcaga

SEQ ID NO: 301265 - DNA, 20 bp, human
gcgggagtataggtgggggt

SEQ ID NO: 301266 - DNA, 20 bp, human
gtcagggagagcttgtcagg

SEQ ID NO: 301267 - DNA, 20 bp, human
ggtcagggggatgttttaca

SEQ ID NO: 301268 - DNA, 20 bp, human
gggaacagtgggagtgaccc

SEQ ID NO: 301269 - DNA, 20 bp, human
ggggccaggctgacgtgcgt

SEQ ID NO: 301270 - DNA, 20 bp, human
gctgacgtgcgtgggaacag

SEQ ID NO: 301271 - DNA, 20 bp, human
gtggcagtcaggatttactg

SEQ ID NO: 301272 - DNA, 20 bp, human
ggtcagagcggcagtcccag

SEQ ID NO: 301273 - DNA, 20 bp, human
gacactgcaccaggagaccg

SEQ ID NO: 301274 - DNA, 20 bp, human
gagcacagtacacagttaca

SEQ ID NO: 301275 - DNA, 20 bp, human
gagactgtgtcactactttg

SEQ ID NO: 301276 - DNA, 20 bp, human
gtcagggagagcttgtcagg

SEQ ID NO: 301277 - DNA, 20 bp, human
ggtcagggggatgttttaca

SEQ ID NO: 301278 - DNA, 20 bp, human
gggaacagtgggagtgaccc

SEQ ID NO: 301279 - DNA, 20 bp, human
ggggccaggctgacgtgcgt

SEQ ID NO: 301280 - DNA, 20 bp, human
gctgacgtgcgtgggaacag

SEQ ID NO: 301281 - DNA, 20 bp, human
gtggcagtcaggatttactg

SEQ ID NO: 301282 - DNA, 20 bp, human
gtcactctggagggcataag

SEQ ID NO: 301283 - DNA, 20 bp, human
gactgccagctatgcctgat

SEQ ID NO: 301284 - DNA, 20 bp, human
ggtcagagcggcagtcccag

SEQ ID NO: 301285 - DNA, 20 bp, human
gagcacagtacacagttaca

SEQ ID NO: 301286 - DNA, 20 bp, human
gagctggagccggagggaaa

SEQ ID NO: 301287 - DNA, 20 bp, human
gcacacgcacaactggagat

SEQ ID NO: 301288 - DNA, 20 bp, human
gagggcccacggcttttcaa

SEQ ID NO: 301289 - DNA, 20 bp, human
gccggtctctgacacctctg

SEQ ID NO: 301290 - DNA, 20 bp, human
gtgtcagagaccggagttgt

SEQ ID NO: 301291 - DNA, 20 bp, human
ggagggggaggggagctcaa

SEQ ID NO: 301292 - DNA, 20 bp, human
gaaacctcaaggttctgaga

SEQ ID NO: 301293 - DNA, 20 bp, human
gggggtactcaagtcttcta

SEQ ID NO: 301294 - DNA, 20 bp, human
ggaggggagctcaagggctg

SEQ ID NO: 301295 - DNA, 20 bp, human
gttcccccgcacaatagcgg

SEQ ID NO: 301296 - DNA, 20 bp, human
gcccagtattggggtaaaag

SEQ ID NO: 301297 - DNA, 20 bp, human
gcgtggggcaacatggccga

SEQ ID NO: 301298 - DNA, 20 bp, human
ggggacggtctaagaagggt

SEQ ID NO: 301299 - DNA, 20 bp, human
gagccccactgcgtgatggg

SEQ ID NO: 301300 - DNA, 20 bp, human
gtccttaaggggctggcaag

SEQ ID NO: 301301 - DNA, 20 bp, human
gaaccccccatcacgcagtg

SEQ ID NO: 301302 - DNA, 20 bp, human
ggaaagccccactgcgtgat

SEQ ID NO: 301303 - DNA, 20 bp, human
gtaaagttggggtggaatgg

SEQ ID NO: 301304 - DNA, 20 bp, human
ggaggtaatgcccagtattg

SEQ ID NO: 301305 - DNA, 20 bp, human
gttaattgaaagttatgggg

SEQ ID NO: 301306 - DNA, 20 bp, human
gtaccccctagcttcctggg

SEQ ID NO: 301307 - DNA, 20 bp, human
gtacacctcccaggaagcta

SEQ ID NO: 301308 - DNA, 20 bp, human
gggcgcaggcgctgttactc

SEQ ID NO: 301309 - DNA, 20 bp, human
ggggacttgtagtgtgagaa

SEQ ID NO: 301310 - DNA, 20 bp, human
gggtcaggatgcgagattga

SEQ ID NO: 301311 - DNA, 20 bp, human
gtaaagctgggagactacgg

SEQ ID NO: 301312 - DNA, 20 bp, human
gaggcagctctcaattggtc

SEQ ID NO: 301313 - DNA, 20 bp, human
gagctggaactacacctccc

SEQ ID NO: 301314 - DNA, 20 bp, human
ggcgccgcgcggggcacggt

SEQ ID NO: 301315 - DNA, 20 bp, human
gtacggaggcagctctcaat

SEQ ID NO: 301316 - DNA, 20 bp, human
gctacctccgcctacgtcat

SEQ ID NO: 301317 - DNA, 20 bp, human
gcagccaatgacgtaggcgg

SEQ ID NO: 301318 - DNA, 20 bp, human
gccacctcagccaatgacgt

SEQ ID NO: 301319 - DNA, 20 bp, human
gtggaactccgattggccaa

SEQ ID NO: 301320 - DNA, 20 bp, human
gcgactgcaaaattcttgaa

SEQ ID NO: 301321 - DNA, 20 bp, human
gcacctcaacatccgcgtaa

SEQ ID NO: 301322 - DNA, 20 bp, human
gaactccgattggccaaggg

SEQ ID NO: 301323 - DNA, 20 bp, human
ggtagggagtgtccaagtca

SEQ ID NO: 301324 - DNA, 20 bp, human
ggccccttacgcggatgttg

SEQ ID NO: 301325 - DNA, 20 bp, human
gaaggggcgtggctatactt

SEQ ID NO: 301326 - DNA, 20 bp, human
ggagcccggcggaatgacgc

SEQ ID NO: 301327 - DNA, 20 bp, human
gaaggaagccggccgtgggg

SEQ ID NO: 301328 - DNA, 20 bp, human
gggacgaggcgccgcggaag

SEQ ID NO: 301329 - DNA, 20 bp, human
gcgcggaagaggcggagcga

SEQ ID NO: 301330 - DNA, 20 bp, human
gggagggcccagcgtattat

SEQ ID NO: 301331 - DNA, 20 bp, human
gcaagcccgcgtcattccgc

SEQ ID NO: 301332 - DNA, 20 bp, human
gcgcgggcttgggttgccaa

SEQ ID NO: 301333 - DNA, 20 bp, human
gagcgaaggaagccggccgt

SEQ ID NO: 301334 - DNA, 20 bp, human
gactcggcgtcacgtggaac

SEQ ID NO: 301335 - DNA, 20 bp, human
gacaaggaaagctagacgaa

SEQ ID NO: 301336 - DNA, 20 bp, human
ggggcccgtgctccgcccgg

SEQ ID NO: 301337 - DNA, 20 bp, human
gcggagcacgggcccccgca

SEQ ID NO: 301338 - DNA, 20 bp, human
gcgggggcccgtgctccgcc

SEQ ID NO: 301339 - DNA, 20 bp, human
ggaggcttccccggatatgt

SEQ ID NO: 301340 - DNA, 20 bp, human
gaggcgcacacccacatatc

SEQ ID NO: 301341 - DNA, 20 bp, human
ggagacctttcacccccggg

SEQ ID NO: 301342 - DNA, 20 bp, human
gacctgcggggtcccaagtc

SEQ ID NO: 301343 - DNA, 20 bp, human
gcccttgtgcgtttgaaggt

SEQ ID NO: 301344 - DNA, 20 bp, human
gtgctccgcccgggggtgaa

SEQ ID NO: 301345 - DNA, 20 bp, human
gttgaaggttggcggggcgg

SEQ ID NO: 301346 - DNA, 20 bp, human
ggaacagttgcgtctccatc

SEQ ID NO: 301347 - DNA, 20 bp, human
gacacccacccagcgctcct

SEQ ID NO: 301348 - DNA, 20 bp, human
gagacgcaactgttccgcgg

SEQ ID NO: 301349 - DNA, 20 bp, human
gagcgctgggtgggtgtagc

SEQ ID NO: 301350 - DNA, 20 bp, human
gagggaagacggaaaggagg

SEQ ID NO: 301351 - DNA, 20 bp, human
gggcggcagatcttcagttg

SEQ ID NO: 301352 - DNA, 20 bp, human
gtggagacgcaactgttccg

SEQ ID NO: 301353 - DNA, 20 bp, human
gcgactgcatcgccgggctc

SEQ ID NO: 301354 - DNA, 20 bp, human
ggtggagagggaagacggaa

SEQ ID NO: 301355 - DNA, 20 bp, human
gcagatcttcagttgcggtg

SEQ ID NO: 301356 - DNA, 20 bp, human
gggtcggagcagtcgggcga

SEQ ID NO: 301357 - DNA, 20 bp, human
gctggcgcgcggcaggtggt

SEQ ID NO: 301358 - DNA, 20 bp, human
gacccctcccactgcaggtt

SEQ ID NO: 301359 - DNA, 20 bp, human
gggcaggtggtcggagcagt

SEQ ID NO: 301360 - DNA, 20 bp, human
ggacaggggatagacgggtg

SEQ ID NO: 301361 - DNA, 20 bp, human
gagaccgaacctgcagtggg

SEQ ID NO: 301362 - DNA, 20 bp, human
gcagtcgggcgagggagagc

SEQ ID NO: 301363 - DNA, 20 bp, human
gtgaacaagaggtggagctt

SEQ ID NO: 301364 - DNA, 20 bp, human
gccacgggcgccccctgcgg

SEQ ID NO: 301365 - DNA, 20 bp, human
gcccggccagtcggtcctgt

SEQ ID NO: 301366 - DNA, 20 bp, human
ggccgcggccatcagggtaa

SEQ ID NO: 301367 - DNA, 20 bp, human
ggggacctcgtcaccgcgga

SEQ ID NO: 301368 - DNA, 20 bp, human
gaagccggaaaagtgagtac

SEQ ID NO: 301369 - DNA, 20 bp, human
gtatcgcgagatcaggaagg

SEQ ID NO: 301370 - DNA, 20 bp, human
gtgtgtcgccgcggccatca

SEQ ID NO: 301371 - DNA, 20 bp, human
ggtaagggtacctggacttg

SEQ ID NO: 301372 - DNA, 20 bp, human
ggacttgcggctttttaggt

SEQ ID NO: 301373 - DNA, 20 bp, human
gcctggctccgctccttccg

SEQ ID NO: 301374 - DNA, 20 bp, human
ggaggtcccccggcctccta

SEQ ID NO: 301375 - DNA, 20 bp, human
gagctgctaatgggcaaggt

SEQ ID NO: 301376 - DNA, 20 bp, human
gaggcgcggccccccttcgg

SEQ ID NO: 301377 - DNA, 20 bp, human
ggcgaggcgcggcccccctt

SEQ ID NO: 301378 - DNA, 20 bp, human
gccgagccgggcgggaggaa

SEQ ID NO: 301379 - DNA, 20 bp, human
ggggaggaggtgccgccgaa

SEQ ID NO: 301380 - DNA, 20 bp, human
ggtagactaaggtgacagag

SEQ ID NO: 301381 - DNA, 20 bp, human
gccgccgcctccggccgagc

SEQ ID NO: 301382 - DNA, 20 bp, human
ggctcccggcgcatgttccg

SEQ ID NO: 301383 - DNA, 20 bp, human
gccgccgcggctggctgagg

SEQ ID NO: 301384 - DNA, 20 bp, human
gtgcgagggaggttcgaatg

SEQ ID NO: 301385 - DNA, 20 bp, human
ggcggtctcgggaaaagtga

SEQ ID NO: 301386 - DNA, 20 bp, human
gccaccagaagaggtactga

SEQ ID NO: 301387 - DNA, 20 bp, human
ggaagctgcttcccaggtta

SEQ ID NO: 301388 - DNA, 20 bp, human
gtaagaggccccaccagaag

SEQ ID NO: 301389 - DNA, 20 bp, human
ggaactcagacctgcccttt

SEQ ID NO: 301390 - DNA, 20 bp, human
gtgtggctgtagaagaggca

SEQ ID NO: 301391 - DNA, 20 bp, human
gtagggtccccagcttttta

SEQ ID NO: 301392 - DNA, 20 bp, human
gggagcgttaagcagaccaa

SEQ ID NO: 301393 - DNA, 20 bp, human
gaaagctggggaccctaacc

SEQ ID NO: 301394 - DNA, 20 bp, human
gtggtattacaaggggacag

SEQ ID NO: 301395 - DNA, 20 bp, human
gcctaccaggaagtttggga

SEQ ID NO: 301396 - DNA, 20 bp, human
gccgctgccctgcacgctta

SEQ ID NO: 301397 - DNA, 20 bp, human
gcggccgcaaaacctggtga

SEQ ID NO: 301398 - DNA, 20 bp, human
gagggaggagggatcgaggg

SEQ ID NO: 301399 - DNA, 20 bp, human
ggtgtgcgcgcatacaccca

SEQ ID NO: 301400 - DNA, 20 bp, human
gagggcagcgaaacaggcag

SEQ ID NO: 301401 - DNA, 20 bp, human
ggaaacaggcaggggtgcgc

SEQ ID NO: 301402 - DNA, 20 bp, human
gggagggagcgagtgagccg

SEQ ID NO: 301403 - DNA, 20 bp, human
gtgcgcgcatacacccaggg

SEQ ID NO: 301404 - DNA, 20 bp, human
gctccgccccctccgctgaa

SEQ ID NO: 301405 - DNA, 20 bp, human
gactaggagcgagccaggga

SEQ ID NO: 301406 - DNA, 20 bp, human
gggatggcttgataaggcac

SEQ ID NO: 301407 - DNA, 20 bp, human
gttataacttggggtcccca

SEQ ID NO: 301408 - DNA, 20 bp, human
gctactgcattcttaccatg

SEQ ID NO: 301409 - DNA, 20 bp, human
gtgcatttctaaggcgttct

SEQ ID NO: 301410 - DNA, 20 bp, human
gttatgcagaagaaactcta

SEQ ID NO: 301411 - DNA, 20 bp, human
gtttctaaggcgttctggga

SEQ ID NO: 301412 - DNA, 20 bp, human
gaagactttacattattatg

SEQ ID NO: 301413 - DNA, 20 bp, human
gagccaagagaataaggatg

SEQ ID NO: 301414 - DNA, 20 bp, human
gttagtcataatgacatctg

SEQ ID NO: 301415 - DNA, 20 bp, human
gcctctgccctgtttctaga

SEQ ID NO: 301416 - DNA, 20 bp, human
gataacagcaatatatagtc

SEQ ID NO: 301417 - DNA, 20 bp, human
gtgtctgtctgggacttccg

SEQ ID NO: 301418 - DNA, 20 bp, human
gctaagttataagaagtaga

SEQ ID NO: 301419 - DNA, 20 bp, human
gtagtcaggtatttttaaaa

SEQ ID NO: 301420 - DNA, 20 bp, human
ggggaagagccataaaatgt

SEQ ID NO: 301421 - DNA, 20 bp, human
gagggtttagcttttaccac

SEQ ID NO: 301422 - DNA, 20 bp, human
gaatgaaaattatgtctgtc

SEQ ID NO: 301423 - DNA, 20 bp, human
gcatgttattttactgagaa

SEQ ID NO: 301424 - DNA, 20 bp, human
ggataagttaatatgcaata

SEQ ID NO: 301425 - DNA, 20 bp, human
gatatctcatagatttccca

SEQ ID NO: 301426 - DNA, 20 bp, human
gctggggccgcaggtgtgag

SEQ ID NO: 301427 - DNA, 20 bp, human
ggcggggacactgggagcgc

SEQ ID NO: 301428 - DNA, 20 bp, human
gcgcccgggatgcgcacgga

SEQ ID NO: 301429 - DNA, 20 bp, human
ggaagcgcccgggatgcgca

SEQ ID NO: 301430 - DNA, 20 bp, human
gtgagaggccacgtgggcgc

SEQ ID NO: 301431 - DNA, 20 bp, human
gacgtggcctctcacacctg

SEQ ID NO: 301432 - DNA, 20 bp, human
ggcgcaggtgcggggacact

SEQ ID NO: 301433 - DNA, 20 bp, human
gccacgtgggcgcaggtgcg

SEQ ID NO: 301434 - DNA, 20 bp, human
gcccgggcgcttcgtgtccg

SEQ ID NO: 301435 - DNA, 20 bp, human
ggccccagccgccgcgcacg

SEQ ID NO: 301436 - DNA, 20 bp, human
gacaggctggcaagtgacag

SEQ ID NO: 301437 - DNA, 20 bp, human
gctgcagcaagcaccactac

SEQ ID NO: 301438 - DNA, 20 bp, human
gctattgcatgacccctccc

SEQ ID NO: 301439 - DNA, 20 bp, human
gtcccgtggggctcagtttg

SEQ ID NO: 301440 - DNA, 20 bp, human
gaaactgcaggggtcgggtg

SEQ ID NO: 301441 - DNA, 20 bp, human
gagcaagcaccactacaggc

SEQ ID NO: 301442 - DNA, 20 bp, human
ggagtctgcagcaaccctgt

SEQ ID NO: 301443 - DNA, 20 bp, human
gggagggaggctctggtgcc

SEQ ID NO: 301444 - DNA, 20 bp, human
ggtctagagcatctcccgtg

SEQ ID NO: 301445 - DNA, 20 bp, human
gcaaaagacagtcctctgga

SEQ ID NO: 301446 - DNA, 20 bp, human
gggagtagggacgacttggt

SEQ ID NO: 301447 - DNA, 20 bp, human
ggagcctggagccgtaaacc

SEQ ID NO: 301448 - DNA, 20 bp, human
gccaccacggggaagctgta

SEQ ID NO: 301449 - DNA, 20 bp, human
gaagggaggcgtgccgaacg

SEQ ID NO: 301450 - DNA, 20 bp, human
gggagccgtaaaccaggtcc

SEQ ID NO: 301451 - DNA, 20 bp, human
gagcctcggaagccaccacg

SEQ ID NO: 301452 - DNA, 20 bp, human
gcattcgcgacagttaaggg

SEQ ID NO: 301453 - DNA, 20 bp, human
gttccccgtggtggcttccg

SEQ ID NO: 301454 - DNA, 20 bp, human
gggcgctgattggttgttga

SEQ ID NO: 301455 - DNA, 20 bp, human
gaaccaggtccgggatgggt

SEQ ID NO: 301456 - DNA, 20 bp, human
gctctatggggtcaactggg

SEQ ID NO: 301457 - DNA, 20 bp, human
gtctccgaggcacttcccgg

SEQ ID NO: 301458 - DNA, 20 bp, human
gcatgctctatggggtcaac

SEQ ID NO: 301459 - DNA, 20 bp, human
gagcctgcgaggcggaggac

SEQ ID NO: 301460 - DNA, 20 bp, human
gggctggcaagcggcagcgc

SEQ ID NO: 301461 - DNA, 20 bp, human
gcaactggggggctggcaag

SEQ ID NO: 301462 - DNA, 20 bp, human
gagcccgtcctccgcctcgc

SEQ ID NO: 301463 - DNA, 20 bp, human
ggtctggggcggagtctccg

SEQ ID NO: 301464 - DNA, 20 bp, human
ggacctgccagcctgcgagg

SEQ ID NO: 301465 - DNA, 20 bp, human
gaatcagagcagccagccac

SEQ ID NO: 301466 - DNA, 20 bp, human
gaggggctggaggactgctg

SEQ ID NO: 301467 - DNA, 20 bp, human
gcagaggttccagctgtaca

SEQ ID NO: 301468 - DNA, 20 bp, human
gtggggggcaaccagagatg

SEQ ID NO: 301469 - DNA, 20 bp, human
gatccaatgaaaggcaatga

SEQ ID NO: 301470 - DNA, 20 bp, human
gttctgctcctcaggatcag

SEQ ID NO: 301471 - DNA, 20 bp, human
ggttccagctgtacaggggc

SEQ ID NO: 301472 - DNA, 20 bp, human
gcctccagcccctgtacagc

SEQ ID NO: 301473 - DNA, 20 bp, human
gggacctacagcatcctctg

SEQ ID NO: 301474 - DNA, 20 bp, human
gtgagcaagtcacacaatcc

SEQ ID NO: 301475 - DNA, 20 bp, human
ggcagctttcactgatgcag

SEQ ID NO: 301476 - DNA, 20 bp, human
gcccttgcagcgctgtcaca

SEQ ID NO: 301477 - DNA, 20 bp, human
gggaggcttaggcagccacg

SEQ ID NO: 301478 - DNA, 20 bp, human
gagaaatttggaccctctgg

SEQ ID NO: 301479 - DNA, 20 bp, human
gttgcagcgctgtcacaggg

SEQ ID NO: 301480 - DNA, 20 bp, human
gtgagaggttaattattaat

SEQ ID NO: 301481 - DNA, 20 bp, human
gcacgcagagagcccccaga

SEQ ID NO: 301482 - DNA, 20 bp, human
gggggtaggtggcttccacg

SEQ ID NO: 301483 - DNA, 20 bp, human
gcgctgtcacagggaggctt

SEQ ID NO: 301484 - DNA, 20 bp, human
gagccacctaccccgacctt

SEQ ID NO: 301485 - DNA, 20 bp, human
ggagggtccaaatttctgtt

SEQ ID NO: 301486 - DNA, 20 bp, human
gaacaaaaaggcaaccccgg

SEQ ID NO: 301487 - DNA, 20 bp, human
ggggaggcttcccagcacgt

SEQ ID NO: 301488 - DNA, 20 bp, human
gcctccctgggaaggtgagt

SEQ ID NO: 301489 - DNA, 20 bp, human
gccccctaccgcgcattaaa

SEQ ID NO: 301490 - DNA, 20 bp, human
gagccctttaatgcgcggta

SEQ ID NO: 301491 - DNA, 20 bp, human
gctgctggggtgctccccgc

SEQ ID NO: 301492 - DNA, 20 bp, human
gggtggcgaaaagcgtcctt

SEQ ID NO: 301493 - DNA, 20 bp, human
gccttcgggcaggactagtg

SEQ ID NO: 301494 - DNA, 20 bp, human
gcgggccgggccgcgtgcta

SEQ ID NO: 301495 - DNA, 20 bp, human
ggccaacaaaaaggcaaccc

SEQ ID NO: 301496 - DNA, 20 bp, human
ggatgacagaagccagatgc

SEQ ID NO: 301497 - DNA, 20 bp, human
gctctcttacaagaagggag

SEQ ID NO: 301498 - DNA, 20 bp, human
gttaggcctccgtgtcatct

SEQ ID NO: 301499 - DNA, 20 bp, human
gtgaggaaagcgtcattcag

SEQ ID NO: 301500 - DNA, 20 bp, human
gggaacactcatccagcatc

SEQ ID NO: 301501 - DNA, 20 bp, human
gatgacacggaggcctaaat

SEQ ID NO: 301502 - DNA, 20 bp, human
gctctcttgtgtcataaata

SEQ ID NO: 301503 - DNA, 20 bp, human
gaacattttaacggagtggt

SEQ ID NO: 301504 - DNA, 20 bp, human
ggtcatcccagatgacacgg

SEQ ID NO: 301505 - DNA, 20 bp, human
gaagaaacattttaacggag

SEQ ID NO: 301506 - DNA, 20 bp, human
gattggccaaagtagttctg

SEQ ID NO: 301507 - DNA, 20 bp, human
gttaatcctcagaactactt

SEQ ID NO: 301508 - DNA, 20 bp, human
ggtaatgtaatcagtggatg

SEQ ID NO: 301509 - DNA, 20 bp, human
gtgtctttgttaaaagttaa

SEQ ID NO: 301510 - DNA, 20 bp, human
gtagtttggctcagatagag

SEQ ID NO: 301511 - DNA, 20 bp, human
gccaaaaagacttactatct

SEQ ID NO: 301512 - DNA, 20 bp, human
gctgaggattaaaatgattt

SEQ ID NO: 301513 - DNA, 20 bp, human
gtttttggtaatgtaatcag

SEQ ID NO: 301514 - DNA, 20 bp, human
gatcatttgcattatacctt

SEQ ID NO: 301515 - DNA, 20 bp, human
gtagctagaccattatctgt

SEQ ID NO: 301516 - DNA, 20 bp, human
gctgacgccggaaccgagac

SEQ ID NO: 301517 - DNA, 20 bp, human
gggaagcggggccgagcgtg

SEQ ID NO: 301518 - DNA, 20 bp, human
ggggaggcgatccctggaga

SEQ ID NO: 301519 - DNA, 20 bp, human
ggatctgggtgtccggagga

SEQ ID NO: 301520 - DNA, 20 bp, human
ggccacttgggatggcagtg

SEQ ID NO: 301521 - DNA, 20 bp, human
gctcggttccggcgtcagca

SEQ ID NO: 301522 - DNA, 20 bp, human
gccctgggccgggagtccgt

SEQ ID NO: 301523 - DNA, 20 bp, human
gggtcacaccttgctgacgc

SEQ ID NO: 301524 - DNA, 20 bp, human
gctcgctaggcgggaaggga

SEQ ID NO: 301525 - DNA, 20 bp, human
gtgggccgggagtccgtcgg

SEQ ID NO: 301526 - DNA, 20 bp, human
ggacaacaggaagttcccta

SEQ ID NO: 301527 - DNA, 20 bp, human
gtgcctgcagtcagtcccta

SEQ ID NO: 301528 - DNA, 20 bp, human
gttccctagggactgactgc

SEQ ID NO: 301529 - DNA, 20 bp, human
ggggcggtttattagttgtt

SEQ ID NO: 301530 - DNA, 20 bp, human
gcaaagatcctgaaagggtt

SEQ ID NO: 301531 - DNA, 20 bp, human
gcaggccaacagatacaaac

SEQ ID NO: 301532 - DNA, 20 bp, human
gacttgagatcttttcccct

SEQ ID NO: 301533 - DNA, 20 bp, human
gcatacactcattcatcata

SEQ ID NO: 301534 - DNA, 20 bp, human
ggaatagtttcattcttcgt

SEQ ID NO: 301535 - DNA, 20 bp, human
gagctgtagaaattctcggt

SEQ ID NO: 301536 - DNA, 20 bp, human
gggaaggatttttaagtcac

SEQ ID NO: 301537 - DNA, 20 bp, human
gctacacaagttgaatttaa

SEQ ID NO: 301538 - DNA, 20 bp, human
gcaggatttcagaagcggtc

SEQ ID NO: 301539 - DNA, 20 bp, human
gccacaaccacaagctaaag

SEQ ID NO: 301540 - DNA, 20 bp, human
gattcaacttgtgtagctga

SEQ ID NO: 301541 - DNA, 20 bp, human
gttaaaatagcccctgcttt

SEQ ID NO: 301542 - DNA, 20 bp, human
gcctcttggttgaaaaggtg

SEQ ID NO: 301543 - DNA, 20 bp, human
gtttctcccactttagcttg

SEQ ID NO: 301544 - DNA, 20 bp, human
gtcctccctcttggttgaaa

SEQ ID NO: 301545 - DNA, 20 bp, human
gggctttcattattgattta

SEQ ID NO: 301546 - DNA, 20 bp, human
gtaatggactagggagtcac

SEQ ID NO: 301547 - DNA, 20 bp, human
gtccctagtccattaaatga

SEQ ID NO: 301548 - DNA, 20 bp, human
gggaaaaggtcaaggtgatt

SEQ ID NO: 301549 - DNA, 20 bp, human
ggtcactgggtggctatttt

SEQ ID NO: 301550 - DNA, 20 bp, human
gtcacctaggattgcaagat

SEQ ID NO: 301551 - DNA, 20 bp, human
gcttaaaagccacctaaaag

SEQ ID NO: 301552 - DNA, 20 bp, human
ggatgtaacccatggaggtt

SEQ ID NO: 301553 - DNA, 20 bp, human
gcattacgccccaacctcca

SEQ ID NO: 301554 - DNA, 20 bp, human
ggtagtgcagctttctggaa

SEQ ID NO: 301555 - DNA, 20 bp, human
ggagaaattgcaaaccacta

SEQ ID NO: 301556 - DNA, 20 bp, human
gtactggaaacttgattgat

SEQ ID NO: 301557 - DNA, 20 bp, human
ggtataattcagtattctac

SEQ ID NO: 301558 - DNA, 20 bp, human
ggtatctctagttactagat

SEQ ID NO: 301559 - DNA, 20 bp, human
gaattctacgaagtgaaatt

SEQ ID NO: 301560 - DNA, 20 bp, human
gctctagttactagattggt

SEQ ID NO: 301561 - DNA, 20 bp, human
ggtagataactggacaaaag

SEQ ID NO: 301562 - DNA, 20 bp, human
gtgatggtagagttaatcat

SEQ ID NO: 301563 - DNA, 20 bp, human
gatgacgtgtatataaacac

SEQ ID NO: 301564 - DNA, 20 bp, human
gggttggtacttttttctga

SEQ ID NO: 301565 - DNA, 20 bp, human
ggtgtagaaaagaaatataa

SEQ ID NO: 301566 - DNA, 20 bp, human
ggggattacaagttgtgtga

SEQ ID NO: 301567 - DNA, 20 bp, human
ggggaggagtcagatagtat

SEQ ID NO: 301568 - DNA, 20 bp, human
gacctggtgataaagtacag

SEQ ID NO: 301569 - DNA, 20 bp, human
gtaggctggaaacattgcct

SEQ ID NO: 301570 - DNA, 20 bp, human
gagttgtgtgagggaggaat

SEQ ID NO: 301571 - DNA, 20 bp, human
gccaggtaataaggagtgta

SEQ ID NO: 301572 - DNA, 20 bp, human
gactttatcaccaggtaata

SEQ ID NO: 301573 - DNA, 20 bp, human
gattacaagttgtgtgaggg

SEQ ID NO: 301574 - DNA, 20 bp, human
gcctggaagttgaaggatta

SEQ ID NO: 301575 - DNA, 20 bp, human
ggaaagataaaatctaggag

SEQ ID NO: 301576 - DNA, 20 bp, human
gcgtgtccctgacacaccaa

SEQ ID NO: 301577 - DNA, 20 bp, human
gggaactagcagtatggcag

SEQ ID NO: 301578 - DNA, 20 bp, human
gatactcagtggaaacatga

SEQ ID NO: 301579 - DNA, 20 bp, human
ggccaaccatgcagtgcgta

SEQ ID NO: 301580 - DNA, 20 bp, human
gccatgatgcacttgcaggt

SEQ ID NO: 301581 - DNA, 20 bp, human
gtccctacgcactgcatggt

SEQ ID NO: 301582 - DNA, 20 bp, human
gacagcaacccaaatccctt

SEQ ID NO: 301583 - DNA, 20 bp, human
gtgtgtcagggacacgcctt

SEQ ID NO: 301584 - DNA, 20 bp, human
gtaaccactggtgtaaacaa

SEQ ID NO: 301585 - DNA, 20 bp, human
gcacatccctacgcactgca

SEQ ID NO: 301586 - DNA, 20 bp, human
gcgtacccacggcctcgtga

SEQ ID NO: 301587 - DNA, 20 bp, human
gatgctgccccgccccctga

SEQ ID NO: 301588 - DNA, 20 bp, human
gcgcctagtctctccgcctg

SEQ ID NO: 301589 - DNA, 20 bp, human
gtctccgcctgcggagccgt

SEQ ID NO: 301590 - DNA, 20 bp, human
ggcctcgtgagggctcgagc

SEQ ID NO: 301591 - DNA, 20 bp, human
gtggggtcccggcagcccgc

SEQ ID NO: 301592 - DNA, 20 bp, human
gcccgcaggagtgctaagta

SEQ ID NO: 301593 - DNA, 20 bp, human
gaaggcctgccggttgctcg

SEQ ID NO: 301594 - DNA, 20 bp, human
gaacggccagccctgggcga

SEQ ID NO: 301595 - DNA, 20 bp, human
gaacctggttcccgccctga

SEQ ID NO: 301596 - DNA, 20 bp, human
gagcgcggggccagactcat

SEQ ID NO: 301597 - DNA, 20 bp, human
gaggggggatatgtgatccc

SEQ ID NO: 301598 - DNA, 20 bp, human
ggtgcgtgttaaaagctgga

SEQ ID NO: 301599 - DNA, 20 bp, human
gtcccccaggggctcaacac

SEQ ID NO: 301600 - DNA, 20 bp, human
ggccccgcgcttttggtcct

SEQ ID NO: 301601 - DNA, 20 bp, human
ggtatcaagcgcctatggca

SEQ ID NO: 301602 - DNA, 20 bp, human
ggccccgcggacgcaacggt

SEQ ID NO: 301603 - DNA, 20 bp, human
gcggggccccgcggacgcaa

SEQ ID NO: 301604 - DNA, 20 bp, human
gcgtgttaaaagctggaggg

SEQ ID NO: 301605 - DNA, 20 bp, human
ggcccccaggcccacggaga

SEQ ID NO: 301606 - DNA, 20 bp, human
gcaggggcaggataggagag

SEQ ID NO: 301607 - DNA, 20 bp, human
gtgtcgggggcggacgggtg

SEQ ID NO: 301608 - DNA, 20 bp, human
gcctgggggcgatcagagtg

SEQ ID NO: 301609 - DNA, 20 bp, human
gaaccggcggtggtctcgcc

SEQ ID NO: 301610 - DNA, 20 bp, human
gccccaggcgagaccaccgc

SEQ ID NO: 301611 - DNA, 20 bp, human
gggtccgcgccaggcgtctc

SEQ ID NO: 301612 - DNA, 20 bp, human
ggcgtctcgggggtaagcct

SEQ ID NO: 301613 - DNA, 20 bp, human
ggggcgatcagagtgaggcg

SEQ ID NO: 301614 - DNA, 20 bp, human
ggggagggccaggctgtcgg

SEQ ID NO: 301615 - DNA, 20 bp, human
gtggcgagcgagccgggtgt

SEQ ID NO: 301616 - DNA, 20 bp, human
gtccccagctagcctgtagg

SEQ ID NO: 301617 - DNA, 20 bp, human
gcattcagacaaaatctggt

SEQ ID NO: 301618 - DNA, 20 bp, human
gcccacctacaggctagctg

SEQ ID NO: 301619 - DNA, 20 bp, human
ggcaacacaattgaagatgg

SEQ ID NO: 301620 - DNA, 20 bp, human
ggttaaacacacccacctac

SEQ ID NO: 301621 - DNA, 20 bp, human
ggagtgctataaagattatg

SEQ ID NO: 301622 - DNA, 20 bp, human
ggcttccccagctagcctgt

SEQ ID NO: 301623 - DNA, 20 bp, human
gggggcaacacaattgaaga

SEQ ID NO: 301624 - DNA, 20 bp, human
gacagcattcagacaaaatc

SEQ ID NO: 301625 - DNA, 20 bp, human
gggaagctgtcttgtcattc

SEQ ID NO: 301626 - DNA, 20 bp, human
gccaatcaccagtgatgggg

SEQ ID NO: 301627 - DNA, 20 bp, human
gagggctcctgctccgccat

SEQ ID NO: 301628 - DNA, 20 bp, human
ggggcctagatgcaagattg

SEQ ID NO: 301629 - DNA, 20 bp, human
gcataggcaaattattgagg

SEQ ID NO: 301630 - DNA, 20 bp, human
ggcaaattattgaggagggt

SEQ ID NO: 301631 - DNA, 20 bp, human
gcctagatgcaagattgggg

SEQ ID NO: 301632 - DNA, 20 bp, human
gcgccataggcaaattattg

SEQ ID NO: 301633 - DNA, 20 bp, human
gaaagcaggacagaatcttg

SEQ ID NO: 301634 - DNA, 20 bp, human
gcccgcccccacttgactga

SEQ ID NO: 301635 - DNA, 20 bp, human
gcgaaccttcagtcaagtgg

SEQ ID NO: 301636 - DNA, 20 bp, human
ggcacggcgggctcgctcac

SEQ ID NO: 301637 - DNA, 20 bp, human
gggcccagttcaccattgtc

SEQ ID NO: 301638 - DNA, 20 bp, human
gtggggaagcgctttggagg

SEQ ID NO: 301639 - DNA, 20 bp, human
gcggggccgggcctgcacgg

SEQ ID NO: 301640 - DNA, 20 bp, human
ggcgggctcgctcactggtc

SEQ ID NO: 301641 - DNA, 20 bp, human
ggggtgggcgccgggcgcga

SEQ ID NO: 301642 - DNA, 20 bp, human
gggctcgctcactggtcggg

SEQ ID NO: 301643 - DNA, 20 bp, human
ggccgggcctgcacgggggt

SEQ ID NO: 301644 - DNA, 20 bp, human
ggcccctgttggccagacaa

SEQ ID NO: 301645 - DNA, 20 bp, human
gacttgtagtccatgagccg

SEQ ID NO: 301646 - DNA, 20 bp, human
gcccctgcggcgccgagctg

SEQ ID NO: 301647 - DNA, 20 bp, human
ggcttcccggggccgcggat

SEQ ID NO: 301648 - DNA, 20 bp, human
gcggggcggggcctcgcgaa

SEQ ID NO: 301649 - DNA, 20 bp, human
gaacggcctcggggttccgc

SEQ ID NO: 301650 - DNA, 20 bp, human
gctgcgctcctgccaatccg

SEQ ID NO: 301651 - DNA, 20 bp, human
ggggcctcgcgaacggcctc

SEQ ID NO: 301652 - DNA, 20 bp, human
ggcgggcctgcggaaccccg

SEQ ID NO: 301653 - DNA, 20 bp, human
gcctgccaatccgcggcccc

SEQ ID NO: 301654 - DNA, 20 bp, human
ggagggtgcccccgcccctg

SEQ ID NO: 301655 - DNA, 20 bp, human
gaaccccgaggccgttcgcg

SEQ ID NO: 301656 - DNA, 20 bp, human
gggtaactagagtctggctg

SEQ ID NO: 301657 - DNA, 20 bp, human
gggccaaggctgttggtgat

SEQ ID NO: 301658 - DNA, 20 bp, human
ggcaatgattaaccagccga

SEQ ID NO: 301659 - DNA, 20 bp, human
gggagcacagatcagactgg

SEQ ID NO: 301660 - DNA, 20 bp, human
gccctcagggcagggcccaa

SEQ ID NO: 301661 - DNA, 20 bp, human
gccctggtgccaagactaat

SEQ ID NO: 301662 - DNA, 20 bp, human
gtatggagcactcgagttcc

SEQ ID NO: 301663 - DNA, 20 bp, human
gtgattaaccagccgaggga

SEQ ID NO: 301664 - DNA, 20 bp, human
gctctgccgcctgtgggagt

SEQ ID NO: 301665 - DNA, 20 bp, human
gtcccacaggcggcagagag

SEQ ID NO: 301666 - DNA, 20 bp, human
gcaggtgtagaagtcggatt

SEQ ID NO: 301667 - DNA, 20 bp, human
gtccgcgatcacaccaatgg

SEQ ID NO: 301668 - DNA, 20 bp, human
gccgacttctacacctgtat

SEQ ID NO: 301669 - DNA, 20 bp, human
gaggtccgcgatcacaccaa

SEQ ID NO: 301670 - DNA, 20 bp, human
gaacttggtccgtcccatac

SEQ ID NO: 301671 - DNA, 20 bp, human
ggctccctatctgacaagta

SEQ ID NO: 301672 - DNA, 20 bp, human
gtccgccattggtgtgatcg

SEQ ID NO: 301673 - DNA, 20 bp, human
ggcggaagctcgtcagcgcc

SEQ ID NO: 301674 - DNA, 20 bp, human
gggaccctacttgtcagata

SEQ ID NO: 301675 - DNA, 20 bp, human
ggggcggacgcattgcacgc

SEQ ID NO: 301676 - DNA, 20 bp, human
gtctgccgcgcgggaagcga

SEQ ID NO: 301677 - DNA, 20 bp, human
ggggctcaccccttgccctt

SEQ ID NO: 301678 - DNA, 20 bp, human
gtggctgcggatggccaaca

SEQ ID NO: 301679 - DNA, 20 bp, human
gaatacctgggagcaggaat

SEQ ID NO: 301680 - DNA, 20 bp, human
gttcccgcgcggcagagtgc

SEQ ID NO: 301681 - DNA, 20 bp, human
gctggggcggtgcggtcctt

SEQ ID NO: 301682 - DNA, 20 bp, human
ggggggacccccaagggcaa

SEQ ID NO: 301683 - DNA, 20 bp, human
gccaaccttcgcttcccgcg

SEQ ID NO: 301684 - DNA, 20 bp, human
gttccccacccccggagggt

SEQ ID NO: 301685 - DNA, 20 bp, human
gcacccccggagggtgggcg

SEQ ID NO: 301686 - DNA, 20 bp, human
gcacgtcagactggaggtga

SEQ ID NO: 301687 - DNA, 20 bp, human
ggcagagctcaggttgtcgt

SEQ ID NO: 301688 - DNA, 20 bp, human
gtggaggtgagggatgggcg

SEQ ID NO: 301689 - DNA, 20 bp, human
gtgtctatgctggagataga

SEQ ID NO: 301690 - DNA, 20 bp, human
gcccgctgcccacgtcagac

SEQ ID NO: 301691 - DNA, 20 bp, human
gaggaacaggatgtctatgc

SEQ ID NO: 301692 - DNA, 20 bp, human
ggaggcctgtctccctaact

SEQ ID NO: 301693 - DNA, 20 bp, human
gggccagggctgctgaaggg

SEQ ID NO: 301694 - DNA, 20 bp, human
gatgctggagatagagggag

SEQ ID NO: 301695 - DNA, 20 bp, human
gttggatgcggcagagggga

SEQ ID NO: 301696 - DNA, 20 bp, human
gagtcacggaacagcacgtt

SEQ ID NO: 301697 - DNA, 20 bp, human
gacggccctcgcgctcccgc

SEQ ID NO: 301698 - DNA, 20 bp, human
ggccgggcagcctctcatcc

SEQ ID NO: 301699 - DNA, 20 bp, human
gttaggcttgcgagccaatg

SEQ ID NO: 301700 - DNA, 20 bp, human
gccggaaggcggaagttcta

SEQ ID NO: 301701 - DNA, 20 bp, human
gtcgaaagaacccattgctg

SEQ ID NO: 301702 - DNA, 20 bp, human
ggcgagccaatgaggagcag

SEQ ID NO: 301703 - DNA, 20 bp, human
ggaggctccaaggcacacgc

SEQ ID NO: 301704 - DNA, 20 bp, human
gacccggggaggacaagggt

SEQ ID NO: 301705 - DNA, 20 bp, human
gcggccggaggccaatagat

SEQ ID NO: 301706 - DNA, 20 bp, human
gcaaatgcaaataagggggg

SEQ ID NO: 301707 - DNA, 20 bp, human
gtcagggcaaatgcaaataa

SEQ ID NO: 301708 - DNA, 20 bp, human
gtcggctacgccccttttct

SEQ ID NO: 301709 - DNA, 20 bp, human
ggccttgccaacccagaaaa

SEQ ID NO: 301710 - DNA, 20 bp, human
gagcaagcctagtggaactc

SEQ ID NO: 301711 - DNA, 20 bp, human
ggggcaaatgcaaataaggg

SEQ ID NO: 301712 - DNA, 20 bp, human
gcgaaagccaataggacgca

SEQ ID NO: 301713 - DNA, 20 bp, human
gctacgccccttttctgggt

SEQ ID NO: 301714 - DNA, 20 bp, human
gcatctgccctgcgtcctat

SEQ ID NO: 301715 - DNA, 20 bp, human
ggatacagaagccagccaat

SEQ ID NO: 301716 - DNA, 20 bp, human
ggctccgcccacgctctcag

SEQ ID NO: 301717 - DNA, 20 bp, human
ggggacggggaacgcggcga

SEQ ID NO: 301718 - DNA, 20 bp, human
ggggtagcccctgagagcgt

SEQ ID NO: 301719 - DNA, 20 bp, human
gtagcccctgagagcgtggg

SEQ ID NO: 301720 - DNA, 20 bp, human
gcaggcatacgtcagacgaa

SEQ ID NO: 301721 - DNA, 20 bp, human
ggggcggggccttgaggtcg

SEQ ID NO: 301722 - DNA, 20 bp, human
ggacagcgcctccttaactg

SEQ ID NO: 301723 - DNA, 20 bp, human
gcggatggggacggggaacg

SEQ ID NO: 301724 - DNA, 20 bp, human
ggcactgagtaactggggga

SEQ ID NO: 301725 - DNA, 20 bp, human
gcgctgtcctggcgtcggat

SEQ ID NO: 301726 - DNA, 20 bp, human
gttaaagagtggggagcaaa

SEQ ID NO: 301727 - DNA, 20 bp, human
ggatgggcgggttccttcca

SEQ ID NO: 301728 - DNA, 20 bp, human
gtagtgacgacacaagggat

SEQ ID NO: 301729 - DNA, 20 bp, human
gtacgaggaagcgccgctga

SEQ ID NO: 301730 - DNA, 20 bp, human
gtaaaaagatggaccctcag

SEQ ID NO: 301731 - DNA, 20 bp, human
gggacgccccgcccttaaag

SEQ ID NO: 301732 - DNA, 20 bp, human
gcgacccgaccttaaagagt

SEQ ID NO: 301733 - DNA, 20 bp, human
ggaggaaggcgggatctttt

SEQ ID NO: 301734 - DNA, 20 bp, human
gagatctagtgacgacacaa

SEQ ID NO: 301735 - DNA, 20 bp, human
ggagagctgtcgttcatcgc

SEQ ID NO: 301736 - DNA, 20 bp, human
ggggcagcaaggactgctca

SEQ ID NO: 301737 - DNA, 20 bp, human
gcttgcagggaagccagcga

SEQ ID NO: 301738 - DNA, 20 bp, human
gttccctgcaagctgagatg

SEQ ID NO: 301739 - DNA, 20 bp, human
gcaaggactgctcaggggcg

SEQ ID NO: 301740 - DNA, 20 bp, human
ggaggagcaagtggttgcca

SEQ ID NO: 301741 - DNA, 20 bp, human
gatcaccacgctgccctcgc

SEQ ID NO: 301742 - DNA, 20 bp, human
gccaacctgagcgcccgggg

SEQ ID NO: 301743 - DNA, 20 bp, human
ggccgccaggggacgctagt

SEQ ID NO: 301744 - DNA, 20 bp, human
gctagtgggtccagtctcct

SEQ ID NO: 301745 - DNA, 20 bp, human
gccctggcggcgagccgagc

SEQ ID NO: 301746 - DNA, 20 bp, human
gagcccgtcggactacgaag

SEQ ID NO: 301747 - DNA, 20 bp, human
gtgcggccgcgaagcagagc

SEQ ID NO: 301748 - DNA, 20 bp, human
ggaagtaagggcgagcccgt

SEQ ID NO: 301749 - DNA, 20 bp, human
gcttgcgcgcgcagtgggga

SEQ ID NO: 301750 - DNA, 20 bp, human
gactggtcggcccacggggt

SEQ ID NO: 301751 - DNA, 20 bp, human
gggctccgagcgtgctgctc

SEQ ID NO: 301752 - DNA, 20 bp, human
gcgcgccaaagcgggaatct

SEQ ID NO: 301753 - DNA, 20 bp, human
ggcggaagcgggcggcgcta

SEQ ID NO: 301754 - DNA, 20 bp, human
ggtcccgcttcgtagtccga

SEQ ID NO: 301755 - DNA, 20 bp, human
gtaggcggggaggcggaagc

SEQ ID NO: 301756 - DNA, 20 bp, human
gtctgcactgtggcagcgag

SEQ ID NO: 301757 - DNA, 20 bp, human
ggcgccgcccgccccacctt

SEQ ID NO: 301758 - DNA, 20 bp, human
gtgccgctcgagggatagaa

SEQ ID NO: 301759 - DNA, 20 bp, human
gcagggaggtctctgcactg

SEQ ID NO: 301760 - DNA, 20 bp, human
gtggctggcgaggttttaga

SEQ ID NO: 301761 - DNA, 20 bp, human
gcggctcccgcgatccattc

SEQ ID NO: 301762 - DNA, 20 bp, human
gcgcggccatgctgacgtca

SEQ ID NO: 301763 - DNA, 20 bp, human
ggccagccaatcccagcgcg

SEQ ID NO: 301764 - DNA, 20 bp, human
gcgagggatagaagggagct

SEQ ID NO: 301765 - DNA, 20 bp, human
gctcccttctatccctcgag

SEQ ID NO: 301766 - DNA, 20 bp, human
gcccgcgcccggctacccat

SEQ ID NO: 301767 - DNA, 20 bp, human
gcgccccgatcccccggagg

SEQ ID NO: 301768 - DNA, 20 bp, human
ggcgcgccccgatcccccgg

SEQ ID NO: 301769 - DNA, 20 bp, human
gacccgaggtcgccgcgcgg

SEQ ID NO: 301770 - DNA, 20 bp, human
ggcgcccggctacccattgg

SEQ ID NO: 301771 - DNA, 20 bp, human
gggagcgcgccccgatcccc

SEQ ID NO: 301772 - DNA, 20 bp, human
ggctccgcctccgggggatc

SEQ ID NO: 301773 - DNA, 20 bp, human
gtcggggcgcgctccgccaa

SEQ ID NO: 301774 - DNA, 20 bp, human
gcgctccgccaatgggtagc

SEQ ID NO: 301775 - DNA, 20 bp, human
ggccgcggagctttctttat

SEQ ID NO: 301776 - DNA, 20 bp, human
ggccccgctcacagtcccgg

SEQ ID NO: 301777 - DNA, 20 bp, human
ggtgcctccgggactgtgag

SEQ ID NO: 301778 - DNA, 20 bp, human
ggtgggcggggccggctgga

SEQ ID NO: 301779 - DNA, 20 bp, human
gcggccctgcccacggccga

SEQ ID NO: 301780 - DNA, 20 bp, human
gacccgctcccgcgcgtggg

SEQ ID NO: 301781 - DNA, 20 bp, human
gtgccccagtgagctcgggt

SEQ ID NO: 301782 - DNA, 20 bp, human
gtgggtggggccttcggccg

SEQ ID NO: 301783 - DNA, 20 bp, human
gtgcggggagggcgcactcc

SEQ ID NO: 301784 - DNA, 20 bp, human
gccccgcccacgcgcgggag

SEQ ID NO: 301785 - DNA, 20 bp, human
gtcgcccgacccgagctcac

SEQ ID NO: 301786 - DNA, 20 bp, human
gccgcgcagcgggagctcac

SEQ ID NO: 301787 - DNA, 20 bp, human
gcggggcttggggctgccac

SEQ ID NO: 301788 - DNA, 20 bp, human
ggcgccggggttcgcctctc

SEQ ID NO: 301789 - DNA, 20 bp, human
gcaccggaagagtcgcgggg

SEQ ID NO: 301790 - DNA, 20 bp, human
gtcgaagcctccgggagggg

SEQ ID NO: 301791 - DNA, 20 bp, human
gcccgcccaggaaaatgcgt

SEQ ID NO: 301792 - DNA, 20 bp, human
ggggcggggtcgaagcctcc

SEQ ID NO: 301793 - DNA, 20 bp, human
gtggagctgccgcgggcgag

SEQ ID NO: 301794 - DNA, 20 bp, human
gggggtcgaagcctccggga

SEQ ID NO: 301795 - DNA, 20 bp, human
gagggcttttggggccgccg

SEQ ID NO: 301796 - DNA, 20 bp, human
ggcagcagggagtccctatg

SEQ ID NO: 301797 - DNA, 20 bp, human
gagaaggggaggtcttcgtg

SEQ ID NO: 301798 - DNA, 20 bp, human
gaggccagcctcccaccgca

SEQ ID NO: 301799 - DNA, 20 bp, human
gactccctgctgctagagac

SEQ ID NO: 301800 - DNA, 20 bp, human
gccatcgcaccagccagaag

SEQ ID NO: 301801 - DNA, 20 bp, human
gccagcctcccaccgcaagg

SEQ ID NO: 301802 - DNA, 20 bp, human
gcacgcctgaggcgaacatg

SEQ ID NO: 301803 - DNA, 20 bp, human
gcccccaccacgcagggcag

SEQ ID NO: 301804 - DNA, 20 bp, human
gggggcctccttgcggtggg

SEQ ID NO: 301805 - DNA, 20 bp, human
gccgagggaagcagctgtgt

SEQ ID NO: 301806 - DNA, 20 bp, human
ggcgtctcgtggcgcgaagc

SEQ ID NO: 301807 - DNA, 20 bp, human
gttcgcgccacgagacgcga

SEQ ID NO: 301808 - DNA, 20 bp, human
gagttcgccgcagaagatga

SEQ ID NO: 301809 - DNA, 20 bp, human
gtctgcggcgaacttctagc

SEQ ID NO: 301810 - DNA, 20 bp, human
ggccgctgggggtagacgga

SEQ ID NO: 301811 - DNA, 20 bp, human
ggtttggaggcccacgtgag

SEQ ID NO: 301812 - DNA, 20 bp, human
gtacccccagcggcgagggg

SEQ ID NO: 301813 - DNA, 20 bp, human
gtaaacacctggcacctagt

SEQ ID NO: 301814 - DNA, 20 bp, human
gcggaaaggcgctttccgat

SEQ ID NO: 301815 - DNA, 20 bp, human
gcgtctacccccagcggcga

SEQ ID NO: 301816 - DNA, 20 bp, human
gggaagtgggcgcaaagcaa

SEQ ID NO: 301817 - DNA, 20 bp, human
ggcagtcccagatccattgg

SEQ ID NO: 301818 - DNA, 20 bp, human
ggaggagggggaaggaccgt

SEQ ID NO: 301819 - DNA, 20 bp, human
gtgggtgggcaaaagggtcg

SEQ ID NO: 301820 - DNA, 20 bp, human
ggggaaggaccgttggggtg

SEQ ID NO: 301821 - DNA, 20 bp, human
gactgcccctttaagagtag

SEQ ID NO: 301822 - DNA, 20 bp, human
gccggggcaaaggctctaat

SEQ ID NO: 301823 - DNA, 20 bp, human
gaggggccactactcttaaa

SEQ ID NO: 301824 - DNA, 20 bp, human
gcgttggggtgtggcggagt

SEQ ID NO: 301825 - DNA, 20 bp, human
gccccacccccaatggatct

SEQ ID NO: 301826 - DNA, 20 bp, human
ggggaaccgcccagccggga

SEQ ID NO: 301827 - DNA, 20 bp, human
gagcaggcagcgcgcttcgg

SEQ ID NO: 301828 - DNA, 20 bp, human
gggcgccgcactccccaaca

SEQ ID NO: 301829 - DNA, 20 bp, human
ggggagcaggcagcgcgctt

SEQ ID NO: 301830 - DNA, 20 bp, human
ggcctccacgtgactaccat

SEQ ID NO: 301831 - DNA, 20 bp, human
gtagtcacgtggaggcgccg

SEQ ID NO: 301832 - DNA, 20 bp, human
gcggtggcgcagatccgtcc

SEQ ID NO: 301833 - DNA, 20 bp, human
gcgccaccgcccacactcgg

SEQ ID NO: 301834 - DNA, 20 bp, human
gcgcgctgcctgctccccat

SEQ ID NO: 301835 - DNA, 20 bp, human
gtgactaccatgggccaatg

SEQ ID NO: 301836 - DNA, 20 bp, human
gcagccaggaagtctgtctc

SEQ ID NO: 301837 - DNA, 20 bp, human
gtccagctctcgcttcgcag

SEQ ID NO: 301838 - DNA, 20 bp, human
gcgccacgaggaaacagcgt

SEQ ID NO: 301839 - DNA, 20 bp, human
gaactcccagctccgccacg

SEQ ID NO: 301840 - DNA, 20 bp, human
gggacggagacttcaacttc

SEQ ID NO: 301841 - DNA, 20 bp, human
gcgcgccgccggctgcaaga

SEQ ID NO: 301842 - DNA, 20 bp, human
gacccaacgctgtttcctcg

SEQ ID NO: 301843 - DNA, 20 bp, human
gggactggtagtccgaccgc

SEQ ID NO: 301844 - DNA, 20 bp, human
gtccgtagtagagatggtgt

SEQ ID NO: 301845 - DNA, 20 bp, human
ggcctctgcgaagcgagagc

SEQ ID NO: 301846 - DNA, 20 bp, human
gtgtccgcatgccagagtga

SEQ ID NO: 301847 - DNA, 20 bp, human
gtgagctcaagacaagggtg

SEQ ID NO: 301848 - DNA, 20 bp, human
gtgtgtgcgggtaggagtgt

SEQ ID NO: 301849 - DNA, 20 bp, human
gggtgggacgcgtgcgattg

SEQ ID NO: 301850 - DNA, 20 bp, human
ggacgcgtgcgattgcgggt

SEQ ID NO: 301851 - DNA, 20 bp, human
gccccacacagccctcactc

SEQ ID NO: 301852 - DNA, 20 bp, human
gaaaagttcccgtgccctgc

SEQ ID NO: 301853 - DNA, 20 bp, human
ggagttaaataagctaatgg

SEQ ID NO: 301854 - DNA, 20 bp, human
gactgtgtgagctcaagaca

SEQ ID NO: 301855 - DNA, 20 bp, human
gtgggcgtgactctgggtct

SEQ ID NO: 301856 - DNA, 20 bp, human
gccaccctcccgggttaatg

SEQ ID NO: 301857 - DNA, 20 bp, human
gtgctccgatcccagggtcg

SEQ ID NO: 301858 - DNA, 20 bp, human
gctaggacctagaagcctcc

SEQ ID NO: 301859 - DNA, 20 bp, human
gcattgaagaccacgaccct

SEQ ID NO: 301860 - DNA, 20 bp, human
gaatggggagtggagacgca

SEQ ID NO: 301861 - DNA, 20 bp, human
gcaaagacgctcaccgagct

SEQ ID NO: 301862 - DNA, 20 bp, human
gcgtctttgctccgatccca

SEQ ID NO: 301863 - DNA, 20 bp, human
gctcccgggttaatggggag

SEQ ID NO: 301864 - DNA, 20 bp, human
gccgggcagaactggtagga

SEQ ID NO: 301865 - DNA, 20 bp, human
gtctccactccccattaacc

SEQ ID NO: 301866 - DNA, 20 bp, human
gaaatagaccttcccgagag

SEQ ID NO: 301867 - DNA, 20 bp, human
gggaccgtgcgtctctctcc

SEQ ID NO: 301868 - DNA, 20 bp, human
gactgacttggcttcttaaa

SEQ ID NO: 301869 - DNA, 20 bp, human
gtcgccgccgagggcagaga

SEQ ID NO: 301870 - DNA, 20 bp, human
gaagcccggagagagacgca

SEQ ID NO: 301871 - DNA, 20 bp, human
gctctccccgtccccgacac

SEQ ID NO: 301872 - DNA, 20 bp, human
gcttaaaggggccagtgtcg

SEQ ID NO: 301873 - DNA, 20 bp, human
gtgaatcgtgatcaggaaaa

SEQ ID NO: 301874 - DNA, 20 bp, human
gacctcgaacctgggacggg

SEQ ID NO: 301875 - DNA, 20 bp, human
ggacctgggacctcgaacct

SEQ ID NO: 301876 - DNA, 20 bp, human
gaactcctgcgagagagctc

SEQ ID NO: 301877 - DNA, 20 bp, human
gcgagggagccagcgagaga

SEQ ID NO: 301878 - DNA, 20 bp, human
gcaaagcccgatctgtctcg

SEQ ID NO: 301879 - DNA, 20 bp, human
gggctgctttgcactttccg

SEQ ID NO: 301880 - DNA, 20 bp, human
gaagcagccacgagacagat

SEQ ID NO: 301881 - DNA, 20 bp, human
gtggactggtccaggaggta

SEQ ID NO: 301882 - DNA, 20 bp, human
gtgtgagtagcatatgcatg

SEQ ID NO: 301883 - DNA, 20 bp, human
ggaggtaaatagtcttaaat

SEQ ID NO: 301884 - DNA, 20 bp, human
gaggcatttcttaaagggga

SEQ ID NO: 301885 - DNA, 20 bp, human
ggctttgttgctaatttccc

SEQ ID NO: 301886 - DNA, 20 bp, human
gagcagcagttgccagcgag

SEQ ID NO: 301887 - DNA, 20 bp, human
gtaacagatcatacagttgg

SEQ ID NO: 301888 - DNA, 20 bp, human
gcctacggtgacatcattcg

SEQ ID NO: 301889 - DNA, 20 bp, human
ggggatgcacttagagatct

SEQ ID NO: 301890 - DNA, 20 bp, human
gatgatgtcaccgtaggcag

SEQ ID NO: 301891 - DNA, 20 bp, human
ggcaggttggtgttgatatc

SEQ ID NO: 301892 - DNA, 20 bp, human
gtagtactctatttggactg

SEQ ID NO: 301893 - DNA, 20 bp, human
gatgatctgttacccctcgc

SEQ ID NO: 301894 - DNA, 20 bp, human
gttgagaggaaaaggaagat

SEQ ID NO: 301895 - DNA, 20 bp, human
gattcaactaattaaatgat

SEQ ID NO: 301896 - DNA, 20 bp, human
gaggcgcacccaggcgtcgg

SEQ ID NO: 301897 - DNA, 20 bp, human
ggaagggcccgaatcaggtg

SEQ ID NO: 301898 - DNA, 20 bp, human
gtgagggtcgctgacgtcgg

SEQ ID NO: 301899 - DNA, 20 bp, human
gcaatccggggaaggacaaa

SEQ ID NO: 301900 - DNA, 20 bp, human
ggaacaatccggccgcccag

SEQ ID NO: 301901 - DNA, 20 bp, human
gtgactgaaacgagactcgg

SEQ ID NO: 301902 - DNA, 20 bp, human
gggctgagggtcgctgacgt

SEQ ID NO: 301903 - DNA, 20 bp, human
ggcagagccggggagtagtt

SEQ ID NO: 301904 - DNA, 20 bp, human
gcaaaatcccaactactccc

SEQ ID NO: 301905 - DNA, 20 bp, human
gcgctccgggatggcagcgg

SEQ ID NO: 301906 - DNA, 20 bp, human
gagcccggggagccaaggga

SEQ ID NO: 301907 - DNA, 20 bp, human
gggggcgcatcctctcgggg

SEQ ID NO: 301908 - DNA, 20 bp, human
gcctctcggggcggagccgc

SEQ ID NO: 301909 - DNA, 20 bp, human
ggagatgccacagtccgcca

SEQ ID NO: 301910 - DNA, 20 bp, human
gcgcggcccctggcggactg

SEQ ID NO: 301911 - DNA, 20 bp, human
ggggaaggatgcgggcgcgg

SEQ ID NO: 301912 - DNA, 20 bp, human
gcgcgggggcgcatcctctc

SEQ ID NO: 301913 - DNA, 20 bp, human
gcgggccccgggagggcggt

SEQ ID NO: 301914 - DNA, 20 bp, human
gacggaagcggcgactcggc

SEQ ID NO: 301915 - DNA, 20 bp, human
gctgtgcgggaaccccagcg

SEQ ID NO: 301916 - DNA, 20 bp, human
gccgcccccagcttggggat

SEQ ID NO: 301917 - DNA, 20 bp, human
gtaggcccgcccccagcttg

SEQ ID NO: 301918 - DNA, 20 bp, human
ggagaagccaatccccaagc

SEQ ID NO: 301919 - DNA, 20 bp, human
gccccggctggtctaatcag

SEQ ID NO: 301920 - DNA, 20 bp, human
gaagccaatccccaagctgg

SEQ ID NO: 301921 - DNA, 20 bp, human
ggcagcgctccaagattccc

SEQ ID NO: 301922 - DNA, 20 bp, human
gacccgacaactgccaggcc

SEQ ID NO: 301923 - DNA, 20 bp, human
gacagctctgacagcgaggt

SEQ ID NO: 301924 - DNA, 20 bp, human
gtccgggcctggcagttgtc

SEQ ID NO: 301925 - DNA, 20 bp, human
ggcccagggctagtggaccc

SEQ ID NO: 301926 - DNA, 20 bp, human
gcagagaggggtgaaggcat

SEQ ID NO: 301927 - DNA, 20 bp, human
gggaggtctcagaaccagtg

SEQ ID NO: 301928 - DNA, 20 bp, human
gacaaagaatgtcacatcgg

SEQ ID NO: 301929 - DNA, 20 bp, human
gtcacatcggtggtggatgg

SEQ ID NO: 301930 - DNA, 20 bp, human
gactcagctaaatatggccc

SEQ ID NO: 301931 - DNA, 20 bp, human
gatgtcacatcggtggtgga

SEQ ID NO: 301932 - DNA, 20 bp, human
ggtggggattattaacatac

SEQ ID NO: 301933 - DNA, 20 bp, human
gctgagtctgatagctcatg

SEQ ID NO: 301934 - DNA, 20 bp, human
gctgtatcaccactcttaaa

SEQ ID NO: 301935 - DNA, 20 bp, human
gtgtctccacaatactccat

SEQ ID NO: 301936 - DNA, 20 bp, human
gggaatcccctggagtattg

SEQ ID NO: 301937 - DNA, 20 bp, human
ggctggatggggtcaattta

SEQ ID NO: 301938 - DNA, 20 bp, human
gagtgtggaagcaaataaag

SEQ ID NO: 301939 - DNA, 20 bp, human
gcaaacaggacatcttgcaa

SEQ ID NO: 301940 - DNA, 20 bp, human
gtggcaatatgatggcatat

SEQ ID NO: 301941 - DNA, 20 bp, human
gagctgcatgaatttgtgta

SEQ ID NO: 301942 - DNA, 20 bp, human
gtgtagtctctgctagtctc

SEQ ID NO: 301943 - DNA, 20 bp, human
gtacataccccaatactcca

SEQ ID NO: 301944 - DNA, 20 bp, human
ggagactacagaatctctgc

SEQ ID NO: 301945 - DNA, 20 bp, human
gggtctgcctcttccctaca

SEQ ID NO: 301946 - DNA, 20 bp, human
gccggtgcgccccctgcaga

SEQ ID NO: 301947 - DNA, 20 bp, human
gcgccaccgctcactccttc

SEQ ID NO: 301948 - DNA, 20 bp, human
gcgggggcgggatgtcgtga

SEQ ID NO: 301949 - DNA, 20 bp, human
gcgggatgtcgtgatggaca

SEQ ID NO: 301950 - DNA, 20 bp, human
ggcactcctccgtctgcagg

SEQ ID NO: 301951 - DNA, 20 bp, human
gcgtcagtccacaccggccc

SEQ ID NO: 301952 - DNA, 20 bp, human
ggcgctcccgccgccatgat

SEQ ID NO: 301953 - DNA, 20 bp, human
ggccggtgtggactgacgag

SEQ ID NO: 301954 - DNA, 20 bp, human
ggccactcgtcagtccacac

SEQ ID NO: 301955 - DNA, 20 bp, human
gcagtccacaccggcccagg

SEQ ID NO: 301956 - DNA, 20 bp, human
ggagcctgtcacaggaaggg

SEQ ID NO: 301957 - DNA, 20 bp, human
gtggaggggatgcaatcggg

SEQ ID NO: 301958 - DNA, 20 bp, human
gcgctgcccgggtggctgaa

SEQ ID NO: 301959 - DNA, 20 bp, human
gaggacggctgcgctctgcg

SEQ ID NO: 301960 - DNA, 20 bp, human
gagagcgcagccgtcctcat

SEQ ID NO: 301961 - DNA, 20 bp, human
ggcccggccggtgtgcgcca

SEQ ID NO: 301962 - DNA, 20 bp, human
gggagtgtgcactgcccggc

SEQ ID NO: 301963 - DNA, 20 bp, human
ggggtggaggggatgcaatc

SEQ ID NO: 301964 - DNA, 20 bp, human
gtgccctcagggtgtctcat

SEQ ID NO: 301965 - DNA, 20 bp, human
gcgcagccgtcctcatcggg

SEQ ID NO: 301966 - DNA, 20 bp, human
gagagctcccagaggcggag

SEQ ID NO: 301967 - DNA, 20 bp, human
gcaaaggcccagtcggggtg

SEQ ID NO: 301968 - DNA, 20 bp, human
gtgcaggaacgcagctactg

SEQ ID NO: 301969 - DNA, 20 bp, human
gtcgagaaggggcactgtaa

SEQ ID NO: 301970 - DNA, 20 bp, human
gtctccgcaaaggcccagtc

SEQ ID NO: 301971 - DNA, 20 bp, human
gggtgagggccgcaacgggg

SEQ ID NO: 301972 - DNA, 20 bp, human
gtcccaagagcatgattctt

SEQ ID NO: 301973 - DNA, 20 bp, human
gttggggcggagtcggattc

SEQ ID NO: 301974 - DNA, 20 bp, human
ggtaacagttacacgtggag

SEQ ID NO: 301975 - DNA, 20 bp, human
gtgagccctcgggtgatgag

SEQ ID NO: 301976 - DNA, 20 bp, human
gcatcccggcgcagggatac

SEQ ID NO: 301977 - DNA, 20 bp, human
gcgcgcctggccccgagctc

SEQ ID NO: 301978 - DNA, 20 bp, human
ggggacggcactatttgacg

SEQ ID NO: 301979 - DNA, 20 bp, human
gtacctcggccgacagtcgg

SEQ ID NO: 301980 - DNA, 20 bp, human
ggcggccggtatccctgcgc

SEQ ID NO: 301981 - DNA, 20 bp, human
gcggcggcgcatcccggcgc

SEQ ID NO: 301982 - DNA, 20 bp, human
gcgaggccagactgcgcgga

SEQ ID NO: 301983 - DNA, 20 bp, human
gacgatcaaaacttctgcga

SEQ ID NO: 301984 - DNA, 20 bp, human
gaacccccgactgtcggccg

SEQ ID NO: 301985 - DNA, 20 bp, human
gcgagcgaggccagactgcg

SEQ ID NO: 301986 - DNA, 20 bp, human
gggcgctcaagagatccgag

SEQ ID NO: 301987 - DNA, 20 bp, human
gaaaagcagcggcacagcac

SEQ ID NO: 301988 - DNA, 20 bp, human
gagtggcagaagagttgtga

SEQ ID NO: 301989 - DNA, 20 bp, human
ggggacaacaccagctacga

SEQ ID NO: 301990 - DNA, 20 bp, human
gaggaggggcgcgtatacag

SEQ ID NO: 301991 - DNA, 20 bp, human
gagcgtgcgaaggaagaccg

SEQ ID NO: 301992 - DNA, 20 bp, human
gctccctcttcggttgatac

SEQ ID NO: 301993 - DNA, 20 bp, human
gtgcgaaggaagaccgaggg

SEQ ID NO: 301994 - DNA, 20 bp, human
ggaaaagggccagaggtcac

SEQ ID NO: 301995 - DNA, 20 bp, human
ggtctggcccggcatgccct

SEQ ID NO: 301996 - DNA, 20 bp, human
gcccctgctgctccgtggac

SEQ ID NO: 301997 - DNA, 20 bp, human
gaaccgcaggtgttgattta

SEQ ID NO: 301998 - DNA, 20 bp, human
gtgcccagcgcggcctccaa

SEQ ID NO: 301999 - DNA, 20 bp, human
gcaaaccccctgctgctccg

SEQ ID NO: 302000 - DNA, 20 bp, human
ggctccgtggacaggcgagg

SEQ ID NO: 302001 - DNA, 20 bp, human
gcccctacctgaagtggacc

SEQ ID NO: 302002 - DNA, 20 bp, human
gtgggagcgggttcgcgctg

SEQ ID NO: 302003 - DNA, 20 bp, human
gggccccataagccccgagg

SEQ ID NO: 302004 - DNA, 20 bp, human
gaaaacccggaacggcggag

SEQ ID NO: 302005 - DNA, 20 bp, human
gcgctctccccggccgggaa

SEQ ID NO: 302006 - DNA, 20 bp, human
gtgggcagatatggggaaag

SEQ ID NO: 302007 - DNA, 20 bp, human
ggaaacacttggtgttcaaa

SEQ ID NO: 302008 - DNA, 20 bp, human
gcaggtaaatgacaggtggg

SEQ ID NO: 302009 - DNA, 20 bp, human
gtccccatatctgcccacaa

SEQ ID NO: 302010 - DNA, 20 bp, human
gaagcattgctgagacctta

SEQ ID NO: 302011 - DNA, 20 bp, human
gtgacttcagatctgaacac

SEQ ID NO: 302012 - DNA, 20 bp, human
gaaatggatgcggttcgaaa

SEQ ID NO: 302013 - DNA, 20 bp, human
gggcagttacagtgcactgc

SEQ ID NO: 302014 - DNA, 20 bp, human
ggagggcctgggaaacaacc

SEQ ID NO: 302015 - DNA, 20 bp, human
gctggacacgtgctgtgctc

SEQ ID NO: 302016 - DNA, 20 bp, human
gtatccgagagctcgggagg

SEQ ID NO: 302017 - DNA, 20 bp, human
ggggaggtgggcggaccaga

SEQ ID NO: 302018 - DNA, 20 bp, human
gaggtgggcggaccagaggg

SEQ ID NO: 302019 - DNA, 20 bp, human
gctcgggaggcgggccagaa

SEQ ID NO: 302020 - DNA, 20 bp, human
gggacagcccggggcgagtg

SEQ ID NO: 302021 - DNA, 20 bp, human
gggaggtagcacagggcggg

SEQ ID NO: 302022 - DNA, 20 bp, human
gagaagggacccgtcactcc

SEQ ID NO: 302023 - DNA, 20 bp, human
gccgcacccgggccaatcgg

SEQ ID NO: 302024 - DNA, 20 bp, human
ggagtggtctcactctaacc

SEQ ID NO: 302025 - DNA, 20 bp, human
gaacccgcacccgggccaat

SEQ ID NO: 302026 - DNA, 20 bp, human
ggtaagaaggtcggtctccg

SEQ ID NO: 302027 - DNA, 20 bp, human
gtgggtaaagggaaccatcc

SEQ ID NO: 302028 - DNA, 20 bp, human
gccggctctagacggaccag

SEQ ID NO: 302029 - DNA, 20 bp, human
gtggagggtccccacgcagg

SEQ ID NO: 302030 - DNA, 20 bp, human
gctccaggccccctcagctc

SEQ ID NO: 302031 - DNA, 20 bp, human
gctcagggaccctcctgcgt

SEQ ID NO: 302032 - DNA, 20 bp, human
gcctctcagtgccgaattgg

SEQ ID NO: 302033 - DNA, 20 bp, human
gggtcggtctccgaggcctg

SEQ ID NO: 302034 - DNA, 20 bp, human
gtgtgacacagaccaggcac

SEQ ID NO: 302035 - DNA, 20 bp, human
gggcacgtctctcccagtac

SEQ ID NO: 302036 - DNA, 20 bp, human
gggcatgctgttgtattacg

SEQ ID NO: 302037 - DNA, 20 bp, human
gtttatctcattcgatcgat

SEQ ID NO: 302038 - DNA, 20 bp, human
gcatttatcaaaggtcaaca

SEQ ID NO: 302039 - DNA, 20 bp, human
gcagcaactcacctcttcag

SEQ ID NO: 302040 - DNA, 20 bp, human
ggtagtagaaagcacagcca

SEQ ID NO: 302041 - DNA, 20 bp, human
gaaatgttattgctcctgaa

SEQ ID NO: 302042 - DNA, 20 bp, human
ggtcaacagggtgtgtgcaa

SEQ ID NO: 302043 - DNA, 20 bp, human
gtacattcagtcctctgaag

SEQ ID NO: 302044 - DNA, 20 bp, human
gggaggaactgtaaaagtta

SEQ ID NO: 302045 - DNA, 20 bp, human
gtgccaaaatagtaataaat

SEQ ID NO: 302046 - DNA, 20 bp, human
gttagagctcaactgatggt

SEQ ID NO: 302047 - DNA, 20 bp, human
ggagctcaactgatggtagg

SEQ ID NO: 302048 - DNA, 20 bp, human
gaactgatggtaggtggctc

SEQ ID NO: 302049 - DNA, 20 bp, human
ggccgcactgcaccgagcgg

SEQ ID NO: 302050 - DNA, 20 bp, human
gcggcggcagcggcaagctt

SEQ ID NO: 302051 - DNA, 20 bp, human
ggcagtgcggcgcgtagccc

SEQ ID NO: 302052 - DNA, 20 bp, human
gtaaagtggaactatctgca

SEQ ID NO: 302053 - DNA, 20 bp, human
gcgagatgtaacttgccgta

SEQ ID NO: 302054 - DNA, 20 bp, human
gcgcgccgcactgcaccgag

SEQ ID NO: 302055 - DNA, 20 bp, human
ggtagggcacaaaatttgta

SEQ ID NO: 302056 - DNA, 20 bp, human
ggcgagcccagagacggaga

SEQ ID NO: 302057 - DNA, 20 bp, human
gtgagaaggcacttcctgaa

SEQ ID NO: 302058 - DNA, 20 bp, human
gctgctctgaaagggaaggt

SEQ ID NO: 302059 - DNA, 20 bp, human
gtgaatggagagtcgccaag

SEQ ID NO: 302060 - DNA, 20 bp, human
gacacacttctgctctgaaa

SEQ ID NO: 302061 - DNA, 20 bp, human
gaagtggctatttgcacacc

SEQ ID NO: 302062 - DNA, 20 bp, human
ggctatttgcacacccggag

SEQ ID NO: 302063 - DNA, 20 bp, human
gcccttccctctccgtctct

SEQ ID NO: 302064 - DNA, 20 bp, human
gggaccagcttcctttgaga

SEQ ID NO: 302065 - DNA, 20 bp, human
gacttctgctctgaaaggga

SEQ ID NO: 302066 - DNA, 20 bp, human
gcgaagtcccggatgaggac

SEQ ID NO: 302067 - DNA, 20 bp, human
gcggatgaggacgggtggaa

SEQ ID NO: 302068 - DNA, 20 bp, human
gggtggaatggtagcgacca

SEQ ID NO: 302069 - DNA, 20 bp, human
gcatcctcccaaagcgtgat

SEQ ID NO: 302070 - DNA, 20 bp, human
gaaaagagaaacggagtaac

SEQ ID NO: 302071 - DNA, 20 bp, human
gcggaaggtcagcgaagtcc

SEQ ID NO: 302072 - DNA, 20 bp, human
gagtcccggatgaggacggg

SEQ ID NO: 302073 - DNA, 20 bp, human
gggagattcccatcacgctt

SEQ ID NO: 302074 - DNA, 20 bp, human
gcaggtaggtctcacccaat

SEQ ID NO: 302075 - DNA, 20 bp, human
gaggatgtaccggcgtttat

SEQ ID NO: 302076 - DNA, 20 bp, human
gaccctgggcacctgctaac

SEQ ID NO: 302077 - DNA, 20 bp, human
gctgctcagagccagttagc

SEQ ID NO: 302078 - DNA, 20 bp, human
gagccagttagcaggtgccc

SEQ ID NO: 302079 - DNA, 20 bp, human
gacaggtggtagacagaccc

SEQ ID NO: 302080 - DNA, 20 bp, human
gtacagcgggttcatgggga

SEQ ID NO: 302081 - DNA, 20 bp, human
gcctctgtgctacttcacac

SEQ ID NO: 302082 - DNA, 20 bp, human
gaccactacagcgggttcat

SEQ ID NO: 302083 - DNA, 20 bp, human
gccgctgtagtggtctctcc

SEQ ID NO: 302084 - DNA, 20 bp, human
ggggatgtttgatcttgctg

SEQ ID NO: 302085 - DNA, 20 bp, human
gtgtgaaagtggtttgtgaa

SEQ ID NO: 302086 - DNA, 20 bp, human
gaaaccctgaggagtcccat

SEQ ID NO: 302087 - DNA, 20 bp, human
gtacaagacaatggaatact

SEQ ID NO: 302088 - DNA, 20 bp, human
gacaaggcacgtccgagaca

SEQ ID NO: 302089 - DNA, 20 bp, human
gttacccaatatctgtaacc

SEQ ID NO: 302090 - DNA, 20 bp, human
ggtaggtgataacttgctat

SEQ ID NO: 302091 - DNA, 20 bp, human
gcactcctcaccattcccat

SEQ ID NO: 302092 - DNA, 20 bp, human
gattcccatgggactcctca

SEQ ID NO: 302093 - DNA, 20 bp, human
ggttatcacctacaagacaa

SEQ ID NO: 302094 - DNA, 20 bp, human
gggatgcaaaatgcccagca

SEQ ID NO: 302095 - DNA, 20 bp, human
gtcataaatggtagcggtca

SEQ ID NO: 302096 - DNA, 20 bp, human
ggtacgctggggcttcagtg

SEQ ID NO: 302097 - DNA, 20 bp, human
gagggacggcatcagagtaa

SEQ ID NO: 302098 - DNA, 20 bp, human
gcatgcatgaagcacatctg

SEQ ID NO: 302099 - DNA, 20 bp, human
ggcaggcctgccacactgcg

SEQ ID NO: 302100 - DNA, 20 bp, human
ggcctgccactgtgcgaccg

SEQ ID NO: 302101 - DNA, 20 bp, human
gttgcagagccggtacgctg

SEQ ID NO: 302102 - DNA, 20 bp, human
gactgcggggactggccaca

SEQ ID NO: 302103 - DNA, 20 bp, human
gagaatatgagctgtcacct

SEQ ID NO: 302104 - DNA, 20 bp, human
gggcatcagagtaaaggctt

SEQ ID NO: 302105 - DNA, 20 bp, human
ggcctcggtcgcacagtggc

SEQ ID NO: 302106 - DNA, 20 bp, human
gtgtctgcacccataccccg

SEQ ID NO: 302107 - DNA, 20 bp, human
gggcctgacatcagagacag

SEQ ID NO: 302108 - DNA, 20 bp, human
gacgggaccaggggatcagt

SEQ ID NO: 302109 - DNA, 20 bp, human
gtggtcccgtggtcaccacg

SEQ ID NO: 302110 - DNA, 20 bp, human
gtccttgtgccactgtcatc

SEQ ID NO: 302111 - DNA, 20 bp, human
gcataccccgtggtgaccac

SEQ ID NO: 302112 - DNA, 20 bp, human
gacagcgggtcagacatccc

SEQ ID NO: 302113 - DNA, 20 bp, human
gcgtggatgaactgcctgag

SEQ ID NO: 302114 - DNA, 20 bp, human
ggcacgcccctcttgttcag

SEQ ID NO: 302115 - DNA, 20 bp, human
ggtgccactgtcatcaggcc

SEQ ID NO: 302116 - DNA, 20 bp, human
gtgcccggggctggtccgtg

SEQ ID NO: 302117 - DNA, 20 bp, human
gaccagccccgggcacgtaa

SEQ ID NO: 302118 - DNA, 20 bp, human
gaagggttaccgggagtcca

SEQ ID NO: 302119 - DNA, 20 bp, human
gggcccacagccgtccctaa

SEQ ID NO: 302120 - DNA, 20 bp, human
ggggccgcgcctccacggga

SEQ ID NO: 302121 - DNA, 20 bp, human
gagagctcgggcgcagctct

SEQ ID NO: 302122 - DNA, 20 bp, human
ggggcccgaagcgccagaga

SEQ ID NO: 302123 - DNA, 20 bp, human
gcgggcacgtaagggttacc

SEQ ID NO: 302124 - DNA, 20 bp, human
gacgctacccaacggccccc

SEQ ID NO: 302125 - DNA, 20 bp, human
gagagctcccgggggccgtt

SEQ ID NO: 302126 - DNA, 20 bp, human
gctggccagtctgtagaatt

SEQ ID NO: 302127 - DNA, 20 bp, human
gaagtgcttaacgcaggagc

SEQ ID NO: 302128 - DNA, 20 bp, human
gggggattttaccagataag

SEQ ID NO: 302129 - DNA, 20 bp, human
gaacagggtgcttagaatgg

SEQ ID NO: 302130 - DNA, 20 bp, human
gagtgaaacaaattgcggac

SEQ ID NO: 302131 - DNA, 20 bp, human
gaagaacatgtaaggctata

SEQ ID NO: 302132 - DNA, 20 bp, human
gtttgccaaattctacagac

SEQ ID NO: 302133 - DNA, 20 bp, human
gcttaacagggtgcttagaa

SEQ ID NO: 302134 - DNA, 20 bp, human
gtatgtaaagtgcttaacgc

SEQ ID NO: 302135 - DNA, 20 bp, human
gaaaaagcatgccacttatc

SEQ ID NO: 302136 - DNA, 20 bp, human
ggggccctgcgggagttttg

SEQ ID NO: 302137 - DNA, 20 bp, human
gtggcccaggaggattgtgc

SEQ ID NO: 302138 - DNA, 20 bp, human
gggcatggcaagtagaaccc

SEQ ID NO: 302139 - DNA, 20 bp, human
gccaatgccgagcaaggtgg

SEQ ID NO: 302140 - DNA, 20 bp, human
gtctggcatcacagactccc

SEQ ID NO: 302141 - DNA, 20 bp, human
gagaaccctggccctgtgtg

SEQ ID NO: 302142 - DNA, 20 bp, human
gtccccccaaaactcccgca

SEQ ID NO: 302143 - DNA, 20 bp, human
gctcaggaagccaggctcat

SEQ ID NO: 302144 - DNA, 20 bp, human
gaactcccgcagggccctcg

SEQ ID NO: 302145 - DNA, 20 bp, human
ggagcagggctcttaaccag

SEQ ID NO: 302146 - DNA, 20 bp, human
ggtttcccaggaaataaatc

SEQ ID NO: 302147 - DNA, 20 bp, human
gtgtaatccagctacgttag

SEQ ID NO: 302148 - DNA, 20 bp, human
gataaactacagtgacttag

SEQ ID NO: 302149 - DNA, 20 bp, human
gatgaagtcaagagacatca

SEQ ID NO: 302150 - DNA, 20 bp, human
gaatcaactaagcggtaagc

SEQ ID NO: 302151 - DNA, 20 bp, human
gtctctcactcttgtcaact

SEQ ID NO: 302152 - DNA, 20 bp, human
ggaaatattcttaaactggc

SEQ ID NO: 302153 - DNA, 20 bp, human
ggttaagtgggattagctcc

SEQ ID NO: 302154 - DNA, 20 bp, human
gaagtgggattagctcccgg

SEQ ID NO: 302155 - DNA, 20 bp, human
ggttttcagtgaaacaccac

SEQ ID NO: 302156 - DNA, 20 bp, human
gtggggaagggcctcggtag

SEQ ID NO: 302157 - DNA, 20 bp, human
gagagggtggggctcggtgt

SEQ ID NO: 302158 - DNA, 20 bp, human
gggacggggcttcagtgtta

SEQ ID NO: 302159 - DNA, 20 bp, human
gttggcctcggtgtggggaa

SEQ ID NO: 302160 - DNA, 20 bp, human
ggtggggcttccgcagtaaa

SEQ ID NO: 302161 - DNA, 20 bp, human
gaaggggtgggcatggttat

SEQ ID NO: 302162 - DNA, 20 bp, human
gggggcttcagtgttacggt

SEQ ID NO: 302163 - DNA, 20 bp, human
gcgaggccaaccatttactg

SEQ ID NO: 302164 - DNA, 20 bp, human
gggggcctcaatggcgagga

SEQ ID NO: 302165 - DNA, 20 bp, human
gaagggcctcggtagtggag

SEQ ID NO: 302166 - DNA, 20 bp, human
gtctttggagggacaggtta

SEQ ID NO: 302167 - DNA, 20 bp, human
gcaacccagaagtggggaca

SEQ ID NO: 302168 - DNA, 20 bp, human
ggcagcctggacagaatgtg

SEQ ID NO: 302169 - DNA, 20 bp, human
gttgccttgagtctaaactg

SEQ ID NO: 302170 - DNA, 20 bp, human
gctgcattctttggagggac

SEQ ID NO: 302171 - DNA, 20 bp, human
gctctcaggaggtgttgaat

SEQ ID NO: 302172 - DNA, 20 bp, human
gacagcagcaggtagattag

SEQ ID NO: 302173 - DNA, 20 bp, human
gcctccatcttacttggaac

SEQ ID NO: 302174 - DNA, 20 bp, human
gagcactgttcaatggtaat

SEQ ID NO: 302175 - DNA, 20 bp, human
gctgtccaggctgcattctt

SEQ ID NO: 302176 - DNA, 20 bp, human
ggtcccattagtcttaagga

SEQ ID NO: 302177 - DNA, 20 bp, human
gcaatctctgcttccactgt

SEQ ID NO: 302178 - DNA, 20 bp, human
gctgtcaaaagaatttcagt

SEQ ID NO: 302179 - DNA, 20 bp, human
ggaaagcaagctgcaggctc

SEQ ID NO: 302180 - DNA, 20 bp, human
gacaggtcccattagtctta

SEQ ID NO: 302181 - DNA, 20 bp, human
gaatatcctctgtcctgcgg

SEQ ID NO: 302182 - DNA, 20 bp, human
ggataatatatataaggtgg

SEQ ID NO: 302183 - DNA, 20 bp, human
gcatagggaaagcaagctgc

SEQ ID NO: 302184 - DNA, 20 bp, human
gacccttccttaagactaat

SEQ ID NO: 302185 - DNA, 20 bp, human
gaaaagccaaaacgtttcac

SEQ ID NO: 302186 - DNA, 20 bp, human
ggagcggcaaggcacagccg

SEQ ID NO: 302187 - DNA, 20 bp, human
gacagccaagtcaccttcca

SEQ ID NO: 302188 - DNA, 20 bp, human
ggaaacacgcctcaggccac

SEQ ID NO: 302189 - DNA, 20 bp, human
gcgtggcctgggggcggtca

SEQ ID NO: 302190 - DNA, 20 bp, human
gcgaggggccggccagcacc

SEQ ID NO: 302191 - DNA, 20 bp, human
gggaaactgaaacacgcctc

SEQ ID NO: 302192 - DNA, 20 bp, human
ggccaggaggtgaagtaaca

SEQ ID NO: 302193 - DNA, 20 bp, human
ggaaggtaaacgcagagccg

SEQ ID NO: 302194 - DNA, 20 bp, human
gaacaaggaatgcgtggcct

SEQ ID NO: 302195 - DNA, 20 bp, human
ggggacggttgccatccgcc

SEQ ID NO: 302196 - DNA, 20 bp, human
ggctatgccaaaaatgaata

SEQ ID NO: 302197 - DNA, 20 bp, human
gtgacaataactaagagcag

SEQ ID NO: 302198 - DNA, 20 bp, human
gtgttcttacacaggaagag

SEQ ID NO: 302199 - DNA, 20 bp, human
ggttttcatacactatcgta

SEQ ID NO: 302200 - DNA, 20 bp, human
gtaaaatcctgttcttacac

SEQ ID NO: 302201 - DNA, 20 bp, human
gtatggtccatattcatttt

SEQ ID NO: 302202 - DNA, 20 bp, human
ggaatcttcgacaccccatc

SEQ ID NO: 302203 - DNA, 20 bp, human
ggtcatcagaatttccttta

SEQ ID NO: 302204 - DNA, 20 bp, human
ggtgggaaaaaaagggaatc

SEQ ID NO: 302205 - DNA, 20 bp, human
gtcgtttaggaatacatata

SEQ ID NO: 302206 - DNA, 20 bp, human
gaattatggttgattgtatt

SEQ ID NO: 302207 - DNA, 20 bp, human
ggcccttcctaccttaaaaa

SEQ ID NO: 302208 - DNA, 20 bp, human
gtaggaagggccatttcatt

SEQ ID NO: 302209 - DNA, 20 bp, human
gtcttccccatttttaaggt

SEQ ID NO: 302210 - DNA, 20 bp, human
gcccatttttaaggtaggaa

SEQ ID NO: 302211 - DNA, 20 bp, human
gaaataaataccaaatgaaa

SEQ ID NO: 302212 - DNA, 20 bp, human
gagcacagggaccggaaaat

SEQ ID NO: 302213 - DNA, 20 bp, human
ggttttctggacaccatgac

SEQ ID NO: 302214 - DNA, 20 bp, human
gaaatgcttccccgattttc

SEQ ID NO: 302215 - DNA, 20 bp, human
gattatcttccccattttta

SEQ ID NO: 302216 - DNA, 20 bp, human
ggcctcccccgcgccgggat

SEQ ID NO: 302217 - DNA, 20 bp, human
gcggccgaggggagcggtgt

SEQ ID NO: 302218 - DNA, 20 bp, human
gccctcggccgctttaccgg

SEQ ID NO: 302219 - DNA, 20 bp, human
ggattggatgcgagaggacg

SEQ ID NO: 302220 - DNA, 20 bp, human
ggccccagccaccggtaaag

SEQ ID NO: 302221 - DNA, 20 bp, human
ggggagcggtgtggggcgtc

SEQ ID NO: 302222 - DNA, 20 bp, human
gtccgccggagcgggaacct

SEQ ID NO: 302223 - DNA, 20 bp, human
gtccccccgcggcggtcaga

SEQ ID NO: 302224 - DNA, 20 bp, human
gcggggcggccccccctacc

SEQ ID NO: 302225 - DNA, 20 bp, human
gtgaccctctgaccgccgcg

SEQ ID NO: 302226 - DNA, 20 bp, human
gcaagagggaggtgttgtat

SEQ ID NO: 302227 - DNA, 20 bp, human
gggcgctactcacccatggg

SEQ ID NO: 302228 - DNA, 20 bp, human
ggaggtgttgtattggagaa

SEQ ID NO: 302229 - DNA, 20 bp, human
gaacgtcaagtccaacaaca

SEQ ID NO: 302230 - DNA, 20 bp, human
gtggacttgacgttgttccc

SEQ ID NO: 302231 - DNA, 20 bp, human
gtcccaccagcagatctaga

SEQ ID NO: 302232 - DNA, 20 bp, human
gagtggaactgccagtctga

SEQ ID NO: 302233 - DNA, 20 bp, human
gctagaccctctagatctgc

SEQ ID NO: 302234 - DNA, 20 bp, human
gtcttggcgctactcaccca

SEQ ID NO: 302235 - DNA, 20 bp, human
ggtctgagcaaactttgtgc

SEQ ID NO: 302236 - DNA, 20 bp, human
ggtactgtgggcagacgcca

SEQ ID NO: 302237 - DNA, 20 bp, human
gcgcaaacctggcgggtgga

SEQ ID NO: 302238 - DNA, 20 bp, human
gtgagcgaagccggtactgt

SEQ ID NO: 302239 - DNA, 20 bp, human
gccggccaccgcaaacctgg

SEQ ID NO: 302240 - DNA, 20 bp, human
gccaccgcaaacctggcggg

SEQ ID NO: 302241 - DNA, 20 bp, human
ggccccggccaccgcaaacc

SEQ ID NO: 302242 - DNA, 20 bp, human
ggcttcgctcacgggtgtgt

SEQ ID NO: 302243 - DNA, 20 bp, human
gagctctgcggaggagacgc

SEQ ID NO: 302244 - DNA, 20 bp, human
gggaggagcccactgagcct

SEQ ID NO: 302245 - DNA, 20 bp, human
gtcggggcaaccccccgccg

SEQ ID NO: 302246 - DNA, 20 bp, human
ggacacccaccaccggtccc

SEQ ID NO: 302247 - DNA, 20 bp, human
ggagggcgcgtaaagctcat

SEQ ID NO: 302248 - DNA, 20 bp, human
gttgtcctgggaccggtggt

SEQ ID NO: 302249 - DNA, 20 bp, human
ggcgcgtaaagctcataggc

SEQ ID NO: 302250 - DNA, 20 bp, human
gaatggcccctaaacttgga

SEQ ID NO: 302251 - DNA, 20 bp, human
gctaaacttggggagcgcat

SEQ ID NO: 302252 - DNA, 20 bp, human
gctcccgggacacccaccac

SEQ ID NO: 302253 - DNA, 20 bp, human
gctggagcttcttcaccttt

SEQ ID NO: 302254 - DNA, 20 bp, human
gttacgcgccctccaagttt

SEQ ID NO: 302255 - DNA, 20 bp, human
ggcttcttcacctttaggcg

SEQ ID NO: 302256 - DNA, 20 bp, human
gtgggcggacagagacagaa

SEQ ID NO: 302257 - DNA, 20 bp, human
gcctaaggttactacccagt

SEQ ID NO: 302258 - DNA, 20 bp, human
gggcctcaggaagcacctag

SEQ ID NO: 302259 - DNA, 20 bp, human
gctagaggatggccagaagg

SEQ ID NO: 302260 - DNA, 20 bp, human
gacactggatgctgtagatc

SEQ ID NO: 302261 - DNA, 20 bp, human
ggcaaagtgacttcacgctc

SEQ ID NO: 302262 - DNA, 20 bp, human
gctgtctctgtccgcccact

SEQ ID NO: 302263 - DNA, 20 bp, human
gcgtgaagtcactttgccta

SEQ ID NO: 302264 - DNA, 20 bp, human
gaggttctccctctgcaata

SEQ ID NO: 302265 - DNA, 20 bp, human
ggaagggggcagtacaacac

SEQ ID NO: 302266 - DNA, 20 bp, human
gaccttcagcgcaaagctga

SEQ ID NO: 302267 - DNA, 20 bp, human
ggtaccaggccgccggtccg

SEQ ID NO: 302268 - DNA, 20 bp, human
gtgccctaaccccggaccgg

SEQ ID NO: 302269 - DNA, 20 bp, human
ggctcatcctgcgcctggta

SEQ ID NO: 302270 - DNA, 20 bp, human
gcgcctggtagggcgaagtg

SEQ ID NO: 302271 - DNA, 20 bp, human
gaggccgccggtccggggtt

SEQ ID NO: 302272 - DNA, 20 bp, human
ggcgtcaagtgccctaaccc

SEQ ID NO: 302273 - DNA, 20 bp, human
gaaggggtggcctccccctg

SEQ ID NO: 302274 - DNA, 20 bp, human
gtaacagcaaggaccgcagg

SEQ ID NO: 302275 - DNA, 20 bp, human
gggcctggtacggtggcctg

SEQ ID NO: 302276 - DNA, 20 bp, human
gtcaagttccgatttcctgc

SEQ ID NO: 302277 - DNA, 20 bp, human
gttcacagccagcaggaaat

SEQ ID NO: 302278 - DNA, 20 bp, human
gaccaactcgtgtgtgtgtt

SEQ ID NO: 302279 - DNA, 20 bp, human
ggtaaggggaaaggatccca

SEQ ID NO: 302280 - DNA, 20 bp, human
gaacactggataatgggtaa

SEQ ID NO: 302281 - DNA, 20 bp, human
gcaagtatttcacagccagc

SEQ ID NO: 302282 - DNA, 20 bp, human
gtgtgtgtgtgtgtctccca

SEQ ID NO: 302283 - DNA, 20 bp, human
gtcagcagtgctgttccctt

SEQ ID NO: 302284 - DNA, 20 bp, human
gagttcaggctatcagctca

SEQ ID NO: 302285 - DNA, 20 bp, human
ggcaaaatacagtcacaaga

SEQ ID NO: 302286 - DNA, 20 bp, human
gggtagatgaaaccttcagt

SEQ ID NO: 302287 - DNA, 20 bp, human
gacaagtaggatcccactga

SEQ ID NO: 302288 - DNA, 20 bp, human
gaaaggtcggatctacaagt

SEQ ID NO: 302289 - DNA, 20 bp, human
gatctccgcttctttggagg

SEQ ID NO: 302290 - DNA, 20 bp, human
gcagcggtcagcatcatcaa

SEQ ID NO: 302291 - DNA, 20 bp, human
gaaagaagcggagatcatag

SEQ ID NO: 302292 - DNA, 20 bp, human
ggacatcagcacagctgagg

SEQ ID NO: 302293 - DNA, 20 bp, human
gccactgaagattattaaaa

SEQ ID NO: 302294 - DNA, 20 bp, human
gtctaccacctccaaagaag

SEQ ID NO: 302295 - DNA, 20 bp, human
gatgatctccgcttctttgg

SEQ ID NO: 302296 - DNA, 20 bp, human
gtgcccgcctgctgagaagg

SEQ ID NO: 302297 - DNA, 20 bp, human
gcaaggaagcgcgcctgccg

SEQ ID NO: 302298 - DNA, 20 bp, human
gtgctgagaaggcggaaagg

SEQ ID NO: 302299 - DNA, 20 bp, human
gagggcacccccgggcgtca

SEQ ID NO: 302300 - DNA, 20 bp, human
gcgcctgccggggtgtggcg

SEQ ID NO: 302301 - DNA, 20 bp, human
ggcgtgcccgcctgctgaga

SEQ ID NO: 302302 - DNA, 20 bp, human
gaaggaggcggcagcgtctc

SEQ ID NO: 302303 - DNA, 20 bp, human
ggggcgtcagggtgcattgt

SEQ ID NO: 302304 - DNA, 20 bp, human
gcctccgcctcgccacaccc

SEQ ID NO: 302305 - DNA, 20 bp, human
gctgccggggtgtggcgagg

SEQ ID NO: 302306 - DNA, 20 bp, human
gaccctgctgagttacatga

SEQ ID NO: 302307 - DNA, 20 bp, human
gaggcaagcgagggaggcaa

SEQ ID NO: 302308 - DNA, 20 bp, human
gctccctcatgtaactcagc

SEQ ID NO: 302309 - DNA, 20 bp, human
ggagttacatgagggaggcg

SEQ ID NO: 302310 - DNA, 20 bp, human
gcctctctgtcctgtggact

SEQ ID NO: 302311 - DNA, 20 bp, human
ggctgctggctgctcccacg

SEQ ID NO: 302312 - DNA, 20 bp, human
gctgctcccacgtgggaggt

SEQ ID NO: 302313 - DNA, 20 bp, human
gaagacagttgacttgttcc

SEQ ID NO: 302314 - DNA, 20 bp, human
gtgtcctgtggactgggctg

SEQ ID NO: 302315 - DNA, 20 bp, human
ggctctgttgggtgccgatg

SEQ ID NO: 302316 - DNA, 20 bp, human
gtgtgccccaagcacctcaa

SEQ ID NO: 302317 - DNA, 20 bp, human
gaaatcaggggtaggaaata

SEQ ID NO: 302318 - DNA, 20 bp, human
gaagtggccagctgcccttg

SEQ ID NO: 302319 - DNA, 20 bp, human
gcttgctcagggccaaatca

SEQ ID NO: 302320 - DNA, 20 bp, human
gtcatcacccatcagtatga

SEQ ID NO: 302321 - DNA, 20 bp, human
gcagctgcccttgaggtgct

SEQ ID NO: 302322 - DNA, 20 bp, human
gtttgagccctcatactgat

SEQ ID NO: 302323 - DNA, 20 bp, human
gtgtatgagcagaatgcaaa

SEQ ID NO: 302324 - DNA, 20 bp, human
gtttgagaaatgcaggtgtt

SEQ ID NO: 302325 - DNA, 20 bp, human
gctgtttcagaagagacgtt

SEQ ID NO: 302326 - DNA, 20 bp, human
gaaaaagggcccccttcaat

SEQ ID NO: 302327 - DNA, 20 bp, human
gtcagggttcccattgaagg

SEQ ID NO: 302328 - DNA, 20 bp, human
gaatgtgggccccgcatccc

SEQ ID NO: 302329 - DNA, 20 bp, human
gcccgcaaaagaatcaatgt

SEQ ID NO: 302330 - DNA, 20 bp, human
gtcgcctggcctggtgaaga

SEQ ID NO: 302331 - DNA, 20 bp, human
gagtggggttccatagatga

SEQ ID NO: 302332 - DNA, 20 bp, human
gtccctggagaaggggtacc

SEQ ID NO: 302333 - DNA, 20 bp, human
gtgatggtcctgtcatatca

SEQ ID NO: 302334 - DNA, 20 bp, human
gagcaataaaatgtgtgacc

SEQ ID NO: 302335 - DNA, 20 bp, human
gtcccacattgattcttttg

SEQ ID NO: 302336 - DNA, 20 bp, human
gccagcttggcgccagggat

SEQ ID NO: 302337 - DNA, 20 bp, human
gtcgaagtcgaggagatctg

SEQ ID NO: 302338 - DNA, 20 bp, human
ggccacgcccactggaacac

SEQ ID NO: 302339 - DNA, 20 bp, human
gccaatcgcaagtcccttgg

SEQ ID NO: 302340 - DNA, 20 bp, human
gcggggcccagcttggcgcc

SEQ ID NO: 302341 - DNA, 20 bp, human
gctgaggcgcggggctactt

SEQ ID NO: 302342 - DNA, 20 bp, human
gaacccaatcgcaagtccct

SEQ ID NO: 302343 - DNA, 20 bp, human
gaggaaggggttaaggccga

SEQ ID NO: 302344 - DNA, 20 bp, human
gggtccacctgtgttccagt

SEQ ID NO: 302345 - DNA, 20 bp, human
gcaagagagactgaggcgcg

SEQ ID NO: 302346 - DNA, 20 bp, human
gagagccccggtcacatccc

SEQ ID NO: 302347 - DNA, 20 bp, human
gtaaacaaacggagctgcgg

SEQ ID NO: 302348 - DNA, 20 bp, human
ggtgaccggggctctgcttg

SEQ ID NO: 302349 - DNA, 20 bp, human
ggagccaagagcgacactgg

SEQ ID NO: 302350 - DNA, 20 bp, human
gcgggtcccgggatgtgacc

SEQ ID NO: 302351 - DNA, 20 bp, human
gccgtaaacaaacggagctg

SEQ ID NO: 302352 - DNA, 20 bp, human
gaaaaggcggggcttccgct

SEQ ID NO: 302353 - DNA, 20 bp, human
gtgaggctgtcgggtctttg

SEQ ID NO: 302354 - DNA, 20 bp, human
ggcggagccaagagcgacac

SEQ ID NO: 302355 - DNA, 20 bp, human
gcagcagtgaccagagtggt

SEQ ID NO: 302356 - DNA, 20 bp, human
gagcggttgcgccacaaggt

SEQ ID NO: 302357 - DNA, 20 bp, human
gggccgccgtgccctctggg

SEQ ID NO: 302358 - DNA, 20 bp, human
gcgttaacacgtcttcccct

SEQ ID NO: 302359 - DNA, 20 bp, human
gaaggagctgatagacacgg

SEQ ID NO: 302360 - DNA, 20 bp, human
gtaaacccctagcaactagg

SEQ ID NO: 302361 - DNA, 20 bp, human
gggtggggcccgtgtacttt

SEQ ID NO: 302362 - DNA, 20 bp, human
gaaaacggatctccgcccag

SEQ ID NO: 302363 - DNA, 20 bp, human
gcaggagcggttgcgccaca

SEQ ID NO: 302364 - DNA, 20 bp, human
gtggcgcaaccgctcctgca

SEQ ID NO: 302365 - DNA, 20 bp, human
gtaggaggcgggcgtccgag

SEQ ID NO: 302366 - DNA, 20 bp, human
ggtgcagtgtgcattccccg

SEQ ID NO: 302367 - DNA, 20 bp, human
gtccgctcagacaagaagga

SEQ ID NO: 302368 - DNA, 20 bp, human
ggtgtgcattccccggggat

SEQ ID NO: 302369 - DNA, 20 bp, human
gaggtctcgtgtccagttga

SEQ ID NO: 302370 - DNA, 20 bp, human
gggctcacatatcaggagag

SEQ ID NO: 302371 - DNA, 20 bp, human
gtgcctgagcgggagacact

SEQ ID NO: 302372 - DNA, 20 bp, human
gggggtcaaatggacactga

SEQ ID NO: 302373 - DNA, 20 bp, human
ggcaaggcagagacgggtgc

SEQ ID NO: 302374 - DNA, 20 bp, human
gaagtcccttaaactaaccc

SEQ ID NO: 302375 - DNA, 20 bp, human
ggggcaagctatcccctgat

SEQ ID NO: 302376 - DNA, 20 bp, human
gcacctgaaggcactgttta

SEQ ID NO: 302377 - DNA, 20 bp, human
ggcactgtttaaggaggtgt

SEQ ID NO: 302378 - DNA, 20 bp, human
gggggcaagcgtgtaggtta

SEQ ID NO: 302379 - DNA, 20 bp, human
gctgaaggcactgtttaagg

SEQ ID NO: 302380 - DNA, 20 bp, human
gtgaaacccactggaggcgg

SEQ ID NO: 302381 - DNA, 20 bp, human
gagccagggggcaagcgtgt

SEQ ID NO: 302382 - DNA, 20 bp, human
ggagagaatgacaccctggg

SEQ ID NO: 302383 - DNA, 20 bp, human
ggggaactagccctcaaacg

SEQ ID NO: 302384 - DNA, 20 bp, human
ggagctgtgacatcatggca

SEQ ID NO: 302385 - DNA, 20 bp, human
ggctgcatggagacctccca

SEQ ID NO: 302386 - DNA, 20 bp, human
gtaacactgcccagccacgt

SEQ ID NO: 302387 - DNA, 20 bp, human
gtggggaatcaagtacaagg

SEQ ID NO: 302388 - DNA, 20 bp, human
gactggttgtcatggaaatg

SEQ ID NO: 302389 - DNA, 20 bp, human
ggggctgtgtgaaagacagc

SEQ ID NO: 302390 - DNA, 20 bp, human
gactacttgaagtcttgagg

SEQ ID NO: 302391 - DNA, 20 bp, human
gagtcaggcctggtcatgga

SEQ ID NO: 302392 - DNA, 20 bp, human
ggcaaggccaagacgtgagt

SEQ ID NO: 302393 - DNA, 20 bp, human
gtcccaccaaagtagggggt

SEQ ID NO: 302394 - DNA, 20 bp, human
gccttcttcccaccaaagta

SEQ ID NO: 302395 - DNA, 20 bp, human
gcccccttcccctaagggtg

SEQ ID NO: 302396 - DNA, 20 bp, human
gggcccatgggaagcctctt

SEQ ID NO: 302397 - DNA, 20 bp, human
gtccctaagaggcttcccat

SEQ ID NO: 302398 - DNA, 20 bp, human
gactctcagctgaaaaacac

SEQ ID NO: 302399 - DNA, 20 bp, human
gaacactggactagagggat

SEQ ID NO: 302400 - DNA, 20 bp, human
gagtgagtaaaatggagagg

SEQ ID NO: 302401 - DNA, 20 bp, human
gttaacagggccatacaatc

SEQ ID NO: 302402 - DNA, 20 bp, human
gcaaaagacaggagtggttg

SEQ ID NO: 302403 - DNA, 20 bp, human
gcagccagcagtgagtaaaa

SEQ ID NO: 302404 - DNA, 20 bp, human
gactgctggcatctgggtag

SEQ ID NO: 302405 - DNA, 20 bp, human
gctgaaaaacactggactag

SEQ ID NO: 302406 - DNA, 20 bp, human
gagtcagagggaggcggatg

SEQ ID NO: 302407 - DNA, 20 bp, human
ggaggcggatggggccccgg

SEQ ID NO: 302408 - DNA, 20 bp, human
gccgctgggctaggcccgtg

SEQ ID NO: 302409 - DNA, 20 bp, human
gagagcctgcctgagtcaga

SEQ ID NO: 302410 - DNA, 20 bp, human
gaggctctttatttagcctg

SEQ ID NO: 302411 - DNA, 20 bp, human
ggggctgaatctggtcctcc

SEQ ID NO: 302412 - DNA, 20 bp, human
gcttctggatggcacagtag

SEQ ID NO: 302413 - DNA, 20 bp, human
ggctactctggctgtattca

SEQ ID NO: 302414 - DNA, 20 bp, human
gctgtccaggtgctgacgca

SEQ ID NO: 302415 - DNA, 20 bp, human
gtcagggcccctacagctaa

SEQ ID NO: 302416 - DNA, 20 bp, human
gctaacaaggtagcaatcat

SEQ ID NO: 302417 - DNA, 20 bp, human
ggcaacaagtgcttctaaca

SEQ ID NO: 302418 - DNA, 20 bp, human
gaaggctcatggtgagacat

SEQ ID NO: 302419 - DNA, 20 bp, human
gctggaggggctattaccta

SEQ ID NO: 302420 - DNA, 20 bp, human
gggagcagggccgggtagaa

SEQ ID NO: 302421 - DNA, 20 bp, human
gcccagggtagaatccagag

SEQ ID NO: 302422 - DNA, 20 bp, human
gacccggccctgctcctctc

SEQ ID NO: 302423 - DNA, 20 bp, human
gacccaaggctggtatctgg

SEQ ID NO: 302424 - DNA, 20 bp, human
gtagaatccagagaggagca

SEQ ID NO: 302425 - DNA, 20 bp, human
gttagctagtttattcctag

SEQ ID NO: 302426 - DNA, 20 bp, human
gccaaaagaaagagctcagg

SEQ ID NO: 302427 - DNA, 20 bp, human
gatcccaaaagaaagagctc

SEQ ID NO: 302428 - DNA, 20 bp, human
ggccttaagtaagtgatctt

SEQ ID NO: 302429 - DNA, 20 bp, human
gcttggccgggtcagaaatg

SEQ ID NO: 302430 - DNA, 20 bp, human
gggctggggaaccagagtac

SEQ ID NO: 302431 - DNA, 20 bp, human
ggctggggatctagactctt

SEQ ID NO: 302432 - DNA, 20 bp, human
gatcttggggaactagatcc

SEQ ID NO: 302433 - DNA, 20 bp, human
ggtggctcgcggagttatcc

SEQ ID NO: 302434 - DNA, 20 bp, human
gccccaagatcacttactta

SEQ ID NO: 302435 - DNA, 20 bp, human
gccgggtcagaaatggggcg

SEQ ID NO: 302436 - DNA, 20 bp, human
gagcttgcccgctgtccctc

SEQ ID NO: 302437 - DNA, 20 bp, human
gaaactgcaggaggcggagt

SEQ ID NO: 302438 - DNA, 20 bp, human
gagaaggaagccacgtggct

SEQ ID NO: 302439 - DNA, 20 bp, human
gcacgtggctgggtagccag

SEQ ID NO: 302440 - DNA, 20 bp, human
gagtgacaggagtgaatcta

SEQ ID NO: 302441 - DNA, 20 bp, human
gaacacgggtcccagtgtga

SEQ ID NO: 302442 - DNA, 20 bp, human
gagagcatgggaagcaaaaa

SEQ ID NO: 302443 - DNA, 20 bp, human
gagctcctttgtgcctggcg

SEQ ID NO: 302444 - DNA, 20 bp, human
ggctctctctgatccacgcc

SEQ ID NO: 302445 - DNA, 20 bp, human
gggcaggcagatgcttggtt

SEQ ID NO: 302446 - DNA, 20 bp, human
gaaccgctggccagggctac

SEQ ID NO: 302447 - DNA, 20 bp, human
gagtaggatgagactctcta

SEQ ID NO: 302448 - DNA, 20 bp, human
ggcttagaggggagagatca

SEQ ID NO: 302449 - DNA, 20 bp, human
gccagcccttccaacgtgca

SEQ ID NO: 302450 - DNA, 20 bp, human
gccagtgagtcctcaatgag

SEQ ID NO: 302451 - DNA, 20 bp, human
gcctccccgcggtgccgcgt

SEQ ID NO: 302452 - DNA, 20 bp, human
gggtgtgctggggacccacg

SEQ ID NO: 302453 - DNA, 20 bp, human
gccctagagcaggaagcaaa

SEQ ID NO: 302454 - DNA, 20 bp, human
ggcaaggcggcttcccaggg

SEQ ID NO: 302455 - DNA, 20 bp, human
gcagaagttctgtggcaagg

SEQ ID NO: 302456 - DNA, 20 bp, human
ggacaaccccgtggcaggac

SEQ ID NO: 302457 - DNA, 20 bp, human
ggtggcaggactggggtgga

SEQ ID NO: 302458 - DNA, 20 bp, human
gtactaaacgatcggagcaa

SEQ ID NO: 302459 - DNA, 20 bp, human
gctaaggaggcaccaagttc

SEQ ID NO: 302460 - DNA, 20 bp, human
gccccgtggcaggactgggg

SEQ ID NO: 302461 - DNA, 20 bp, human
gtcgcgagaaagcttgctaa

SEQ ID NO: 302462 - DNA, 20 bp, human
gccccagagtactaaacgat

SEQ ID NO: 302463 - DNA, 20 bp, human
gtggggtccaagctgtatta

SEQ ID NO: 302464 - DNA, 20 bp, human
gctccgatcgtttagtactc

SEQ ID NO: 302465 - DNA, 20 bp, human
ggtggtttctgacaaccccg

SEQ ID NO: 302466 - DNA, 20 bp, human
gagtgggcaaagcagtgcca

SEQ ID NO: 302467 - DNA, 20 bp, human
gttagagactcattgatttt

SEQ ID NO: 302468 - DNA, 20 bp, human
gtggaggagtctgtgctgaa

SEQ ID NO: 302469 - DNA, 20 bp, human
gtcacaaagaaccttctcac

SEQ ID NO: 302470 - DNA, 20 bp, human
ggccatgttccaaatgcctc

SEQ ID NO: 302471 - DNA, 20 bp, human
gggggcctgggcttgcccct

SEQ ID NO: 302472 - DNA, 20 bp, human
ggccagaggcatttggaaca

SEQ ID NO: 302473 - DNA, 20 bp, human
ggctggcaatgttgcaatgc

SEQ ID NO: 302474 - DNA, 20 bp, human
gcctgagcacagtgttctgg

SEQ ID NO: 302475 - DNA, 20 bp, human
ggcccctgagcacagtgttc

SEQ ID NO: 302476 - DNA, 20 bp, human
gagggtgcgggagacggact

SEQ ID NO: 302477 - DNA, 20 bp, human
gggaagcccagccgcattag

SEQ ID NO: 302478 - DNA, 20 bp, human
gtgtgtgtggccaagcccgc

SEQ ID NO: 302479 - DNA, 20 bp, human
gaattccggcaggtgcagag

SEQ ID NO: 302480 - DNA, 20 bp, human
gcggcacgcacccgcgaggt

SEQ ID NO: 302481 - DNA, 20 bp, human
gctccctccccggagaattt

SEQ ID NO: 302482 - DNA, 20 bp, human
gcgggtgcgtgccgatgcgg

SEQ ID NO: 302483 - DNA, 20 bp, human
gttagggcccagctccgcgc

SEQ ID NO: 302484 - DNA, 20 bp, human
gcagctccgcgctggtccag

SEQ ID NO: 302485 - DNA, 20 bp, human
gttagaggctcaattccggc

SEQ ID NO: 302486 - DNA, 20 bp, human
ggggacagagcttgcccgag

SEQ ID NO: 302487 - DNA, 20 bp, human
gtgtgcacacctctttctgt

SEQ ID NO: 302488 - DNA, 20 bp, human
gtggtcatgcaccattggca

SEQ ID NO: 302489 - DNA, 20 bp, human
gagggcctggagcacgtgca

SEQ ID NO: 302490 - DNA, 20 bp, human
ggtgcaaggaacagagttcc

SEQ ID NO: 302491 - DNA, 20 bp, human
gaacgtatgtggcctccctg

SEQ ID NO: 302492 - DNA, 20 bp, human
ggggactgagcaaagcctca

SEQ ID NO: 302493 - DNA, 20 bp, human
gatggcgctgagaacgtatg

SEQ ID NO: 302494 - DNA, 20 bp, human
ggtgactggtcatgcaccat

SEQ ID NO: 302495 - DNA, 20 bp, human
gataacctgggcagcccctc

SEQ ID NO: 302496 - DNA, 20 bp, human
gtaaacagggagtcacatct

SEQ ID NO: 302497 - DNA, 20 bp, human
gtaggagcaagcaaagttat

SEQ ID NO: 302498 - DNA, 20 bp, human
ggagagctgactcaccacgt

SEQ ID NO: 302499 - DNA, 20 bp, human
gtcaccacgtgggatggctg

SEQ ID NO: 302500 - DNA, 20 bp, human
ggctgactcaccacgtggga

SEQ ID NO: 302501 - DNA, 20 bp, human
gactttgcttgctcctaaac

SEQ ID NO: 302502 - DNA, 20 bp, human
gtgcccacagccatcccacg

SEQ ID NO: 302503 - DNA, 20 bp, human
ggcaaagttatggggaccca

SEQ ID NO: 302504 - DNA, 20 bp, human
gccggtggcttgtgcaacct

SEQ ID NO: 302505 - DNA, 20 bp, human
gctatcttgaagtcagccag

SEQ ID NO: 302506 - DNA, 20 bp, human
ggaaagaccatgggtgagat

SEQ ID NO: 302507 - DNA, 20 bp, human
gaccatgggtgagataggtt

SEQ ID NO: 302508 - DNA, 20 bp, human
gtggggaggaggtacaaatt

SEQ ID NO: 302509 - DNA, 20 bp, human
gggagttcagaacagggctc

SEQ ID NO: 302510 - DNA, 20 bp, human
ggcagttggagttcagaaca

SEQ ID NO: 302511 - DNA, 20 bp, human
gcagttgatagaaagaccat

SEQ ID NO: 302512 - DNA, 20 bp, human
gacaagtgataatattgagt

SEQ ID NO: 302513 - DNA, 20 bp, human
gagtagagagacctatgaag

SEQ ID NO: 302514 - DNA, 20 bp, human
gtgtgttgagaacaggcatg

SEQ ID NO: 302515 - DNA, 20 bp, human
gttgggagtagttagcatag

SEQ ID NO: 302516 - DNA, 20 bp, human
gaggaggaggaccagagcta

SEQ ID NO: 302517 - DNA, 20 bp, human
ggcagcctctcccctagctc

SEQ ID NO: 302518 - DNA, 20 bp, human
ggactcagcactgagagctg

SEQ ID NO: 302519 - DNA, 20 bp, human
gatggggacaggggccataa

SEQ ID NO: 302520 - DNA, 20 bp, human
ggtggtgctaagagttcagc

SEQ ID NO: 302521 - DNA, 20 bp, human
gggtgtgagagcaggaatca

SEQ ID NO: 302522 - DNA, 20 bp, human
gagagttcagcaggtggtca

SEQ ID NO: 302523 - DNA, 20 bp, human
gaccccgcggtccaacactc

SEQ ID NO: 302524 - DNA, 20 bp, human
gtgttgctgtttgcaaacaa

SEQ ID NO: 302525 - DNA, 20 bp, human
gtcacaccctggcacttcac

SEQ ID NO: 302526 - DNA, 20 bp, human
gaccctgagggtattgtgat

SEQ ID NO: 302527 - DNA, 20 bp, human
gaacctctccagaacacaat

SEQ ID NO: 302528 - DNA, 20 bp, human
gccccaagatagtgatcgaa

SEQ ID NO: 302529 - DNA, 20 bp, human
ggggaaaaacacaaatgcta

SEQ ID NO: 302530 - DNA, 20 bp, human
gggcagtttaagctgtttca

SEQ ID NO: 302531 - DNA, 20 bp, human
gagcctatcacaataccctc

SEQ ID NO: 302532 - DNA, 20 bp, human
gtactgaatatctacatgaa

SEQ ID NO: 302533 - DNA, 20 bp, human
gaaggcaaccgattgtgttc

SEQ ID NO: 302534 - DNA, 20 bp, human
gccccttcgatcactatctt

SEQ ID NO: 302535 - DNA, 20 bp, human
gcctgggcacagtgaaatcc

SEQ ID NO: 302536 - DNA, 20 bp, human
gctctgaatcccctggatta

SEQ ID NO: 302537 - DNA, 20 bp, human
gaatcccctggattatggca

SEQ ID NO: 302538 - DNA, 20 bp, human
gcttaaaagtggtaggtcaa

SEQ ID NO: 302539 - DNA, 20 bp, human
gacctgcagtgaaaatgcat

SEQ ID NO: 302540 - DNA, 20 bp, human
gaatccctgccataatccag

SEQ ID NO: 302541 - DNA, 20 bp, human
gaatctgtttacacagatcg

SEQ ID NO: 302542 - DNA, 20 bp, human
gaaacaactacaggcaaacc

SEQ ID NO: 302543 - DNA, 20 bp, human
gtaatggtctctgaatcccc

SEQ ID NO: 302544 - DNA, 20 bp, human
gtaagtacctctacattgtt

SEQ ID NO: 302545 - DNA, 20 bp, human
gtcttcctcttaaaagtggt

SEQ ID NO: 302546 - DNA, 20 bp, human
gaactcgcatggtgggtcag

SEQ ID NO: 302547 - DNA, 20 bp, human
gtggtgggtcagtgggtcag

SEQ ID NO: 302548 - DNA, 20 bp, human
ggggcccattgtgaccgccc

SEQ ID NO: 302549 - DNA, 20 bp, human
gctgcagggacaggagataa

SEQ ID NO: 302550 - DNA, 20 bp, human
gagaaagaaaactcgcatgg

SEQ ID NO: 302551 - DNA, 20 bp, human
gaatacacacactcacagtg

SEQ ID NO: 302552 - DNA, 20 bp, human
ggaaagaaagaaaactcgca

SEQ ID NO: 302553 - DNA, 20 bp, human
gccaacactttcagatattg

SEQ ID NO: 302554 - DNA, 20 bp, human
ggataaaggtgggaaaagct

SEQ ID NO: 302555 - DNA, 20 bp, human
gatctgttttataactaggc

SEQ ID NO: 302556 - DNA, 20 bp, human
gtcccccggcctccccggat

SEQ ID NO: 302557 - DNA, 20 bp, human
ggaaagagcgcggccctcgt

SEQ ID NO: 302558 - DNA, 20 bp, human
gtgtggggaggacattgcta

SEQ ID NO: 302559 - DNA, 20 bp, human
ggcagccgcggcgcaagcgg

SEQ ID NO: 302560 - DNA, 20 bp, human
gggctgcggggttatctccg

SEQ ID NO: 302561 - DNA, 20 bp, human
gcctccccggatcggcgccc

SEQ ID NO: 302562 - DNA, 20 bp, human
ggaggccgggggaataaaag

SEQ ID NO: 302563 - DNA, 20 bp, human
gactgcctgcctacccacga

SEQ ID NO: 302564 - DNA, 20 bp, human
ggcggaccgtggggccggaa

SEQ ID NO: 302565 - DNA, 20 bp, human
ggcgccgatccggggaggcc

SEQ ID NO: 302566 - DNA, 20 bp, human
gacgccaagcaggagggtca

SEQ ID NO: 302567 - DNA, 20 bp, human
gagaagtgggaaggtaccct

SEQ ID NO: 302568 - DNA, 20 bp, human
gccgcggaaagcttgaggag

SEQ ID NO: 302569 - DNA, 20 bp, human
gcacgtagggccgagacgac

SEQ ID NO: 302570 - DNA, 20 bp, human
ggctcgcggaccggagagga

SEQ ID NO: 302571 - DNA, 20 bp, human
gccaccagacgccaagcagg

SEQ ID NO: 302572 - DNA, 20 bp, human
gaaaaagctggagataccca

SEQ ID NO: 302573 - DNA, 20 bp, human
ggtgtgccggctctgatttc

SEQ ID NO: 302574 - DNA, 20 bp, human
gtccggaaatccggtcgtct

SEQ ID NO: 302575 - DNA, 20 bp, human
gtttgtttgcagaagtggga

SEQ ID NO: 302576 - DNA, 20 bp, human
gggcccgcggaagacagacc

SEQ ID NO: 302577 - DNA, 20 bp, human
gacagaccgggcgaacgggg

SEQ ID NO: 302578 - DNA, 20 bp, human
gtcgcccggtctgtcttccg

SEQ ID NO: 302579 - DNA, 20 bp, human
gaagacagaccgggcgaacg

SEQ ID NO: 302580 - DNA, 20 bp, human
gtgcccgccccgcagggaag

SEQ ID NO: 302581 - DNA, 20 bp, human
gggccccacccccgtatcca

SEQ ID NO: 302582 - DNA, 20 bp, human
gtacccaagctgactccgac

SEQ ID NO: 302583 - DNA, 20 bp, human
gcgggtctccatggatacgg

SEQ ID NO: 302584 - DNA, 20 bp, human
gggggcccgccccgttcgcc

SEQ ID NO: 302585 - DNA, 20 bp, human
ggcgctctgtgtctttgtcc

SEQ ID NO: 302586 - DNA, 20 bp, human
gccgcggcgctgtgtattgt

SEQ ID NO: 302587 - DNA, 20 bp, human
ggcgcggcgggtcgccccgc

SEQ ID NO: 302588 - DNA, 20 bp, human
ggcggggcggccgtgaccag

SEQ ID NO: 302589 - DNA, 20 bp, human
gggcacgctccgccgccatc

SEQ ID NO: 302590 - DNA, 20 bp, human
ggaggcgcgctccctgccgg

SEQ ID NO: 302591 - DNA, 20 bp, human
gacgctccgccgccatcggg

SEQ ID NO: 302592 - DNA, 20 bp, human
gcccggtaggcaggacgccg

SEQ ID NO: 302593 - DNA, 20 bp, human
ggcggcgcccgcgcagggat

SEQ ID NO: 302594 - DNA, 20 bp, human
ggcagggagcgcgcctcggg

SEQ ID NO: 302595 - DNA, 20 bp, human
gaggcggcccaatccctgcg

SEQ ID NO: 302596 - DNA, 20 bp, human
gaactaagttggtagcagag

SEQ ID NO: 302597 - DNA, 20 bp, human
gatgtggtgcaatactacag

SEQ ID NO: 302598 - DNA, 20 bp, human
gtactcatcagtcattcctg

SEQ ID NO: 302599 - DNA, 20 bp, human
gtgctaccaacttagtttgg

SEQ ID NO: 302600 - DNA, 20 bp, human
gtattgctcaagaatggaac

SEQ ID NO: 302601 - DNA, 20 bp, human
ggagtattcggcttatttag

SEQ ID NO: 302602 - DNA, 20 bp, human
gtctgtgtattgctcaagaa

SEQ ID NO: 302603 - DNA, 20 bp, human
gagccgaatactcgaaagac

SEQ ID NO: 302604 - DNA, 20 bp, human
gtgcctgtctttcgagtatt

SEQ ID NO: 302605 - DNA, 20 bp, human
gcatcagtcattcctgaggg

SEQ ID NO: 302606 - DNA, 20 bp, human
gacccgacacaggttgggag

SEQ ID NO: 302607 - DNA, 20 bp, human
ggggacaggtaaggagtagg

SEQ ID NO: 302608 - DNA, 20 bp, human
gaagagaaaccctgcaaaga

SEQ ID NO: 302609 - DNA, 20 bp, human
ggattggggaggcccagcgc

SEQ ID NO: 302610 - DNA, 20 bp, human
ggggcattccccatctttgc

SEQ ID NO: 302611 - DNA, 20 bp, human
gatggggaatgcccagcgct

SEQ ID NO: 302612 - DNA, 20 bp, human
gggaccgcggctacattgat

SEQ ID NO: 302613 - DNA, 20 bp, human
ggcttggcacagaagtagcg

SEQ ID NO: 302614 - DNA, 20 bp, human
gaagccaatcaatgtagccg

SEQ ID NO: 302615 - DNA, 20 bp, human
gtgatgcaaagtgaagagag

SEQ ID NO: 302616 - DNA, 20 bp, human
ggcctcggaaggccggctgg

SEQ ID NO: 302617 - DNA, 20 bp, human
gttggtgcgcggaataccta

SEQ ID NO: 302618 - DNA, 20 bp, human
gccagcatgcgaggcgtctc

SEQ ID NO: 302619 - DNA, 20 bp, human
gaagcggcaccgttggaatg

SEQ ID NO: 302620 - DNA, 20 bp, human
ggtattccgcgcaccaaaga

SEQ ID NO: 302621 - DNA, 20 bp, human
gacctagggcctcggaaggc

SEQ ID NO: 302622 - DNA, 20 bp, human
gggagaatcggcagtcacta

SEQ ID NO: 302623 - DNA, 20 bp, human
gagctaggaagcggcaccgt

SEQ ID NO: 302624 - DNA, 20 bp, human
ggcccccagccggccttccg

SEQ ID NO: 302625 - DNA, 20 bp, human
ggaatacctagggcctcgga

SEQ ID NO: 302626 - DNA, 20 bp, human
ggggcccgcggggatcggag

SEQ ID NO: 302627 - DNA, 20 bp, human
gtgagcgcgtgtgccagcga

SEQ ID NO: 302628 - DNA, 20 bp, human
gggcgagtggaggaatccta

SEQ ID NO: 302629 - DNA, 20 bp, human
gtggctggggacccacggag

SEQ ID NO: 302630 - DNA, 20 bp, human
gcgcgtgtgccagcgagggt

SEQ ID NO: 302631 - DNA, 20 bp, human
gtggcggagtgtaccgacgc

SEQ ID NO: 302632 - DNA, 20 bp, human
gggcgtgagcgtaagttcgg

SEQ ID NO: 302633 - DNA, 20 bp, human
gcacgcgctcacacccgcgt

SEQ ID NO: 302634 - DNA, 20 bp, human
gtcgcccggggagacgcact

SEQ ID NO: 302635 - DNA, 20 bp, human
gtacggcgtgagcgtaagtt

SEQ ID NO: 302636 - DNA, 20 bp, human
gcgcggcggggcgacatctg

SEQ ID NO: 302637 - DNA, 20 bp, human
gcggggcgacatctgcgggg

SEQ ID NO: 302638 - DNA, 20 bp, human
gtcctggcctgaagcctcga

SEQ ID NO: 302639 - DNA, 20 bp, human
gctcgaggggagcgcgtgca

SEQ ID NO: 302640 - DNA, 20 bp, human
gcccctcgaggcttcaggcc

SEQ ID NO: 302641 - DNA, 20 bp, human
gagaccctcaattattcatg

SEQ ID NO: 302642 - DNA, 20 bp, human
ggaggcctcatgaataattg

SEQ ID NO: 302643 - DNA, 20 bp, human
gctggcaggtggaccggggt

SEQ ID NO: 302644 - DNA, 20 bp, human
gcacgctggcaggtggaccg

SEQ ID NO: 302645 - DNA, 20 bp, human
gcccacgcggggaccctgca

SEQ ID NO: 302646 - DNA, 20 bp, human
gtagagaatggaaggatctg

SEQ ID NO: 302647 - DNA, 20 bp, human
gttcacttctttaacaaaag

SEQ ID NO: 302648 - DNA, 20 bp, human
gaaatgagatttagaattat

SEQ ID NO: 302649 - DNA, 20 bp, human
gtttgattttacagaagagt

SEQ ID NO: 302650 - DNA, 20 bp, human
gtcacaaatacttgattgac

SEQ ID NO: 302651 - DNA, 20 bp, human
gcattacaaatctgtttgct

SEQ ID NO: 302652 - DNA, 20 bp, human
gtatcacaagtttttgtaaa

SEQ ID NO: 302653 - DNA, 20 bp, human
gctcccaataggattcaaga

SEQ ID NO: 302654 - DNA, 20 bp, human
gagggaatgaatgaatggag

SEQ ID NO: 302655 - DNA, 20 bp, human
gcatcagcttgtatgttgtt

SEQ ID NO: 302656 - DNA, 20 bp, human
gaagggtgatggcacacggt

SEQ ID NO: 302657 - DNA, 20 bp, human
gcccaacatctggccaagac

SEQ ID NO: 302658 - DNA, 20 bp, human
ggcggggcaggcagtcaaac

SEQ ID NO: 302659 - DNA, 20 bp, human
ggtgatggcacacggtgggt

SEQ ID NO: 302660 - DNA, 20 bp, human
gaggctgctggggacaggtt

SEQ ID NO: 302661 - DNA, 20 bp, human
gcagtgtcatcaggctgctg

SEQ ID NO: 302662 - DNA, 20 bp, human
ggtggaagggtgatggcaca

SEQ ID NO: 302663 - DNA, 20 bp, human
gcctgcacacccagtttctg

SEQ ID NO: 302664 - DNA, 20 bp, human
gacaggcttggtgttcatcc

SEQ ID NO: 302665 - DNA, 20 bp, human
gacaaccagtgtagccgggg

SEQ ID NO: 302666 - DNA, 20 bp, human
gtatagttctgtgccgtcgt

SEQ ID NO: 302667 - DNA, 20 bp, human
gctggtaagtcactaatttc

SEQ ID NO: 302668 - DNA, 20 bp, human
gaagactaatggattgaacc

SEQ ID NO: 302669 - DNA, 20 bp, human
ggagctacaactacaaccag

SEQ ID NO: 302670 - DNA, 20 bp, human
gtggttgtagtttagacctc

SEQ ID NO: 302671 - DNA, 20 bp, human
gtgtgatatgaatggatacc

SEQ ID NO: 302672 - DNA, 20 bp, human
gtagcagcggatatgtggag

SEQ ID NO: 302673 - DNA, 20 bp, human
ggaagctagcagcggatatg

SEQ ID NO: 302674 - DNA, 20 bp, human
gcactgtcaccgttctagac

SEQ ID NO: 302675 - DNA, 20 bp, human
gacagtcagccggtctagaa

SEQ ID NO: 302676 - DNA, 20 bp, human
gggagtggctgtgtgacagg

SEQ ID NO: 302677 - DNA, 20 bp, human
gtggctgtgtgacaggtggt

SEQ ID NO: 302678 - DNA, 20 bp, human
gagaggccatgccaactgat

SEQ ID NO: 302679 - DNA, 20 bp, human
ggggtggccgagtaggggaa

SEQ ID NO: 302680 - DNA, 20 bp, human
gctggctgccgggtcctaat

SEQ ID NO: 302681 - DNA, 20 bp, human
ggccgagagtggtgggatct

SEQ ID NO: 302682 - DNA, 20 bp, human
gcatggagtggctgtgtgac

SEQ ID NO: 302683 - DNA, 20 bp, human
ggatcggtgaagaaggcagt

SEQ ID NO: 302684 - DNA, 20 bp, human
gccggcagccagcttagatg

SEQ ID NO: 302685 - DNA, 20 bp, human
gtggttggcaagcggcttta

SEQ ID NO: 302686 - DNA, 20 bp, human
gcgcccccagcctgttgcag

SEQ ID NO: 302687 - DNA, 20 bp, human
ggggaccccggggcactagt

SEQ ID NO: 302688 - DNA, 20 bp, human
gcccccttgcgccgccagtc

SEQ ID NO: 302689 - DNA, 20 bp, human
ggggaggaaacgcgagccgc

SEQ ID NO: 302690 - DNA, 20 bp, human
ggcgcctcagctgagaggac

SEQ ID NO: 302691 - DNA, 20 bp, human
gaagcggcgcctcagctgag

SEQ ID NO: 302692 - DNA, 20 bp, human
gcggcagtctctgcgcagca

SEQ ID NO: 302693 - DNA, 20 bp, human
gaaccagactggcggcgcaa

SEQ ID NO: 302694 - DNA, 20 bp, human
gccgccggtcctctcagctg

SEQ ID NO: 302695 - DNA, 20 bp, human
ggaaacgcgagccgctggct

SEQ ID NO: 302696 - DNA, 20 bp, human
gctaagtgctcagacggagg

SEQ ID NO: 302697 - DNA, 20 bp, human
ggaggcttctgggaaaacgg

SEQ ID NO: 302698 - DNA, 20 bp, human
gaacctaagtgctcagacgg

SEQ ID NO: 302699 - DNA, 20 bp, human
gccttcctataggggcccag

SEQ ID NO: 302700 - DNA, 20 bp, human
gccgcccagccttcctatag

SEQ ID NO: 302701 - DNA, 20 bp, human
gagcacaggcagtcttgtga

SEQ ID NO: 302702 - DNA, 20 bp, human
gagtgctcagacggaggagg

SEQ ID NO: 302703 - DNA, 20 bp, human
gcgaaacctaagtgctcaga

SEQ ID NO: 302704 - DNA, 20 bp, human
ggggcccctataggaaggct

SEQ ID NO: 302705 - DNA, 20 bp, human
gaagtgttgggcccacccaa

SEQ ID NO: 302706 - DNA, 20 bp, human
ggccactgcgggtggggtcc

SEQ ID NO: 302707 - DNA, 20 bp, human
gagcagagatgagtcacaga

SEQ ID NO: 302708 - DNA, 20 bp, human
gtctcggtggcgtagagaag

SEQ ID NO: 302709 - DNA, 20 bp, human
ggggacgcggcggccactgc

SEQ ID NO: 302710 - DNA, 20 bp, human
ggcgggaggtcgcttctcgg

SEQ ID NO: 302711 - DNA, 20 bp, human
ggcggcggccactgcgggtg

SEQ ID NO: 302712 - DNA, 20 bp, human
gggcggctgcgctcccggtt

SEQ ID NO: 302713 - DNA, 20 bp, human
gtgcgggtgagaggtatacc

SEQ ID NO: 302714 - DNA, 20 bp, human
gacgggatgtgttgtaccag

SEQ ID NO: 302715 - DNA, 20 bp, human
gcgacctcccgcagctagag

SEQ ID NO: 302716 - DNA, 20 bp, human
gtataatagcagtcaagtac

SEQ ID NO: 302717 - DNA, 20 bp, human
ggaaaccccgaaacatagtt

SEQ ID NO: 302718 - DNA, 20 bp, human
gtacaggctgtgaattctgt

SEQ ID NO: 302719 - DNA, 20 bp, human
gaaaaaatttgcctgtgtga

SEQ ID NO: 302720 - DNA, 20 bp, human
gctctccaaactatgtttcg

SEQ ID NO: 302721 - DNA, 20 bp, human
gattttttactttgtaaaaa

SEQ ID NO: 302722 - DNA, 20 bp, human
gttaaaaaaatggtgaggga

SEQ ID NO: 302723 - DNA, 20 bp, human
gttcaggaaaccaatgcaga

SEQ ID NO: 302724 - DNA, 20 bp, human
gaaaatggtgagggatggcc

SEQ ID NO: 302725 - DNA, 20 bp, human
gtctgtctcttgtttgagac

SEQ ID NO: 302726 - DNA, 20 bp, human
ggcaacccggggtacagggc

SEQ ID NO: 302727 - DNA, 20 bp, human
ggtccaggggaaccggtgga

SEQ ID NO: 302728 - DNA, 20 bp, human
ggcgccaggcggaagcgctc

SEQ ID NO: 302729 - DNA, 20 bp, human
gggctagagtccaggggaac

SEQ ID NO: 302730 - DNA, 20 bp, human
gacccttccaccggttcccc

SEQ ID NO: 302731 - DNA, 20 bp, human
gccctgcaacccggggtaca

SEQ ID NO: 302732 - DNA, 20 bp, human
gatcctctcttggaaacctg

SEQ ID NO: 302733 - DNA, 20 bp, human
gctgccagagcgcttccgcc

SEQ ID NO: 302734 - DNA, 20 bp, human
gcttggccggccctgtaccc

SEQ ID NO: 302735 - DNA, 20 bp, human
gctccacaggtttccaagag

SEQ ID NO: 302736 - DNA, 20 bp, human
gactccatccagcagaaact

SEQ ID NO: 302737 - DNA, 20 bp, human
ggcacccagtttctgctgga

SEQ ID NO: 302738 - DNA, 20 bp, human
gcctgcaattataattatag

SEQ ID NO: 302739 - DNA, 20 bp, human
gtaattataattgcaggatg

SEQ ID NO: 302740 - DNA, 20 bp, human
gaattataattatagtggtc

SEQ ID NO: 302741 - DNA, 20 bp, human
gtagagatgggcttttccaa

SEQ ID NO: 302742 - DNA, 20 bp, human
gaaagcccatctctagtgct

SEQ ID NO: 302743 - DNA, 20 bp, human
gtctaccctccttgaggacc

SEQ ID NO: 302744 - DNA, 20 bp, human
gggcttcacatgcaggctct

SEQ ID NO: 302745 - DNA, 20 bp, human
gcactgcacccagtttctgc

SEQ ID NO: 302746 - DNA, 20 bp, human
gaggcaggtgtgggaagatg

SEQ ID NO: 302747 - DNA, 20 bp, human
gatggagcctgaggcaggtg

SEQ ID NO: 302748 - DNA, 20 bp, human
gaggaggcacagtagcctga

SEQ ID NO: 302749 - DNA, 20 bp, human
ggcctgatggagcctgaggc

SEQ ID NO: 302750 - DNA, 20 bp, human
gagtagcctgatggagcctg

SEQ ID NO: 302751 - DNA, 20 bp, human
gggcgccggcctgatttccc

SEQ ID NO: 302752 - DNA, 20 bp, human
ggtcaggaagatcagggcgc

SEQ ID NO: 302753 - DNA, 20 bp, human
gcagccctgcctgggaaatc

SEQ ID NO: 302754 - DNA, 20 bp, human
gcggcctgatttcccaggca

SEQ ID NO: 302755 - DNA, 20 bp, human
gtctgctttcagccctgcct

SEQ ID NO: 302756 - DNA, 20 bp, human
ggaagaagctcaaaccattc

SEQ ID NO: 302757 - DNA, 20 bp, human
gttaagaaactcaatgtgat

SEQ ID NO: 302758 - DNA, 20 bp, human
gaaactcaatgtgattggtc

SEQ ID NO: 302759 - DNA, 20 bp, human
gacatcataaataaccacat

SEQ ID NO: 302760 - DNA, 20 bp, human
gtgttgttgttttgccagaa

SEQ ID NO: 302761 - DNA, 20 bp, human
gacaccttttagttccaatg

SEQ ID NO: 302762 - DNA, 20 bp, human
gagtaccacatcaccaccac

SEQ ID NO: 302763 - DNA, 20 bp, human
gtcatcagtcatagtgactc

SEQ ID NO: 302764 - DNA, 20 bp, human
gaccacaggaatatattata

SEQ ID NO: 302765 - DNA, 20 bp, human
ggtggtgatgtggtactatc

SEQ ID NO: 302766 - DNA, 20 bp, human
gcgcccatagagacagactg

SEQ ID NO: 302767 - DNA, 20 bp, human
ggcagtcagccgtcatggga

SEQ ID NO: 302768 - DNA, 20 bp, human
gcaggcacgcgtgcgcagaa

SEQ ID NO: 302769 - DNA, 20 bp, human
ggagacagactgagggggtc

SEQ ID NO: 302770 - DNA, 20 bp, human
ggcccccgaggacgcaggta

SEQ ID NO: 302771 - DNA, 20 bp, human
gcccctcagtctgtctctat

SEQ ID NO: 302772 - DNA, 20 bp, human
gcgcgcgcagtcagccgtca

SEQ ID NO: 302773 - DNA, 20 bp, human
gcgcagcaccccgggaaggt

SEQ ID NO: 302774 - DNA, 20 bp, human
gggccggtgcgcgaggctgt

SEQ ID NO: 302775 - DNA, 20 bp, human
gggccctcccccctcctagg

SEQ ID NO: 302776 - DNA, 20 bp, human
gcggctcgcgcggtactcga

SEQ ID NO: 302777 - DNA, 20 bp, human
gtggaaaagcaaggagtgtc

SEQ ID NO: 302778 - DNA, 20 bp, human
gagcccgcgaggctgagggg

SEQ ID NO: 302779 - DNA, 20 bp, human
gcggtactcgagggagttcc

SEQ ID NO: 302780 - DNA, 20 bp, human
gccaacgccagcgctggacc

SEQ ID NO: 302781 - DNA, 20 bp, human
ggctgaggggcggttgttgt

SEQ ID NO: 302782 - DNA, 20 bp, human
ggcctcgcgggctttttgaa

SEQ ID NO: 302783 - DNA, 20 bp, human
gcgagggagttccgggtcgg

SEQ ID NO: 302784 - DNA, 20 bp, human
gaaccgcccctcagcctcgc

SEQ ID NO: 302785 - DNA, 20 bp, human
gaagcaaggagtgtcgggaa

SEQ ID NO: 302786 - DNA, 20 bp, human
gagggcgatgccaccttaaa

SEQ ID NO: 302787 - DNA, 20 bp, human
gagacccgctcctgcgactt

SEQ ID NO: 302788 - DNA, 20 bp, human
gctcctcgaagccagaactg

SEQ ID NO: 302789 - DNA, 20 bp, human
gtggcatcgccctaagtcgc

SEQ ID NO: 302790 - DNA, 20 bp, human
gaagccagaactgcggaaga

SEQ ID NO: 302791 - DNA, 20 bp, human
gtcgccctaagtcgcaggag

SEQ ID NO: 302792 - DNA, 20 bp, human
gttaccctcttccgcagttc

SEQ ID NO: 302793 - DNA, 20 bp, human
ggaggtcaagccctttaagg

SEQ ID NO: 302794 - DNA, 20 bp, human
gtaagccctttcctgttgta

SEQ ID NO: 302795 - DNA, 20 bp, human
ggcaccgcccatctgcgtcc

SEQ ID NO: 302796 - DNA, 20 bp, human
gtgggcctacgcggagaaga

SEQ ID NO: 302797 - DNA, 20 bp, human
gtcagggagctgggcctacg

SEQ ID NO: 302798 - DNA, 20 bp, human
gcgcgtgcctcggtacccga

SEQ ID NO: 302799 - DNA, 20 bp, human
gagtgggagaccggaagagg

SEQ ID NO: 302800 - DNA, 20 bp, human
gctacgcggagaagaggggg

SEQ ID NO: 302801 - DNA, 20 bp, human
ggggggcggagttcgagcat

SEQ ID NO: 302802 - DNA, 20 bp, human
ggctcgaaacagccgcttca

SEQ ID NO: 302803 - DNA, 20 bp, human
gtggccgggtgcgcatactc

SEQ ID NO: 302804 - DNA, 20 bp, human
gccttttccggtcacgtgga

SEQ ID NO: 302805 - DNA, 20 bp, human
gtcaacatcagcatcgactt

SEQ ID NO: 302806 - DNA, 20 bp, human
gacgctcaagtcttaccggg

SEQ ID NO: 302807 - DNA, 20 bp, human
gagcgcgtagccggaagcgg

SEQ ID NO: 302808 - DNA, 20 bp, human
gacgcgctacggtccgtccc

SEQ ID NO: 302809 - DNA, 20 bp, human
gtggaggcgggtctgaggtt

SEQ ID NO: 302810 - DNA, 20 bp, human
gaggacgctcaagtcttacc

SEQ ID NO: 302811 - DNA, 20 bp, human
gacggaccgtagcgcgtagc

SEQ ID NO: 302812 - DNA, 20 bp, human
gcgtagcgcgtagccggaag

SEQ ID NO: 302813 - DNA, 20 bp, human
gtactctgtaagtgaggcga

SEQ ID NO: 302814 - DNA, 20 bp, human
gcttgagcgtcctacctatg

SEQ ID NO: 302815 - DNA, 20 bp, human
ggcgcgaagccatggctttt

SEQ ID NO: 302816 - DNA, 20 bp, human
gtaacttagcatccagtatg

SEQ ID NO: 302817 - DNA, 20 bp, human
gaactcacttcagaaagtgt

SEQ ID NO: 302818 - DNA, 20 bp, human
gggtgcagattatagtgaga

SEQ ID NO: 302819 - DNA, 20 bp, human
gctgagggtagtggcagaag

SEQ ID NO: 302820 - DNA, 20 bp, human
ggccatatagctgagggtag

SEQ ID NO: 302821 - DNA, 20 bp, human
ggccactaccctcagctata

SEQ ID NO: 302822 - DNA, 20 bp, human
gacagctgcactggccgttc

SEQ ID NO: 302823 - DNA, 20 bp, human
gttagtagcacaactggtgt

SEQ ID NO: 302824 - DNA, 20 bp, human
gacaagctgccatcacatac

SEQ ID NO: 302825 - DNA, 20 bp, human
gatggcagcttgtgataagg

SEQ ID NO: 302826 - DNA, 20 bp, human
ggcccagcgcttggctcctc

SEQ ID NO: 302827 - DNA, 20 bp, human
gctcccgaggagccaagcgc

SEQ ID NO: 302828 - DNA, 20 bp, human
gcctccgtcggagatctaat

SEQ ID NO: 302829 - DNA, 20 bp, human
gtccgagccccctccgggtg

SEQ ID NO: 302830 - DNA, 20 bp, human
ggtggcgcgcggacacggcg

SEQ ID NO: 302831 - DNA, 20 bp, human
gaggggcggggcccagcgct

SEQ ID NO: 302832 - DNA, 20 bp, human
gtgaagctccggggtccttc

SEQ ID NO: 302833 - DNA, 20 bp, human
gctgcgtcccccacccggag

SEQ ID NO: 302834 - DNA, 20 bp, human
gaagccaattagatctccga

SEQ ID NO: 302835 - DNA, 20 bp, human
gccgacctgcgtcccccacc

SEQ ID NO: 302836 - DNA, 20 bp, human
gtggccgcccccacaacctg

SEQ ID NO: 302837 - DNA, 20 bp, human
gcagtcgcgcaggagccctc

SEQ ID NO: 302838 - DNA, 20 bp, human
gcagggccccggcacctctg

SEQ ID NO: 302839 - DNA, 20 bp, human
gaggagccctcaggcgagtg

SEQ ID NO: 302840 - DNA, 20 bp, human
gtaagcggagccacaggttg

SEQ ID NO: 302841 - DNA, 20 bp, human
ggagcaggtggccttggccg

SEQ ID NO: 302842 - DNA, 20 bp, human
gcctccccgcagaggtgccg

SEQ ID NO: 302843 - DNA, 20 bp, human
gtcagcctccccagtcattt

SEQ ID NO: 302844 - DNA, 20 bp, human
gtccgcttaagcaagaaccc

SEQ ID NO: 302845 - DNA, 20 bp, human
ggcttcccccactcgcctga

SEQ ID NO: 302846 - DNA, 20 bp, human
gaacccaggcggggctccca

SEQ ID NO: 302847 - DNA, 20 bp, human
gactgcaagcggcaccgtgg

SEQ ID NO: 302848 - DNA, 20 bp, human
ggtgccgccacgctgttcat

SEQ ID NO: 302849 - DNA, 20 bp, human
gggaggagacgaggcgtcta

SEQ ID NO: 302850 - DNA, 20 bp, human
gcggccaccgaggtgtggga

SEQ ID NO: 302851 - DNA, 20 bp, human
gcacgctgttcattggccgg

SEQ ID NO: 302852 - DNA, 20 bp, human
gtaagtgccggaaatgtcat

SEQ ID NO: 302853 - DNA, 20 bp, human
ggcaagcggcaccgtggcgg

SEQ ID NO: 302854 - DNA, 20 bp, human
ggtggcggcggaagagacgg

SEQ ID NO: 302855 - DNA, 20 bp, human
gacgagggtagcactgcaag

SEQ ID NO: 302856 - DNA, 20 bp, human
gaaggggccagtcacacacc

SEQ ID NO: 302857 - DNA, 20 bp, human
ggggcagcctggtgtgtgac

SEQ ID NO: 302858 - DNA, 20 bp, human
gtggggtcacccagtcagag

SEQ ID NO: 302859 - DNA, 20 bp, human
gggcctggatcaatgagtca

SEQ ID NO: 302860 - DNA, 20 bp, human
gtgtgcctgcaatcacaggg

SEQ ID NO: 302861 - DNA, 20 bp, human
gtgtggcaggctcatcagtg

SEQ ID NO: 302862 - DNA, 20 bp, human
gcccacctccctgtgattgc

SEQ ID NO: 302863 - DNA, 20 bp, human
gtctgccatccactctgact

SEQ ID NO: 302864 - DNA, 20 bp, human
gtctgatgcaacagtgtggc

SEQ ID NO: 302865 - DNA, 20 bp, human
gcaggatggcccattcatga

SEQ ID NO: 302866 - DNA, 20 bp, human
gtccctgtgcaacgtgtctg

SEQ ID NO: 302867 - DNA, 20 bp, human
gtgaacaaatagctgagggg

SEQ ID NO: 302868 - DNA, 20 bp, human
gccgacttcccgcctctcaa

SEQ ID NO: 302869 - DNA, 20 bp, human
ggcgaaggcagccaggccat

SEQ ID NO: 302870 - DNA, 20 bp, human
gttggcgtcgccccatggcc

SEQ ID NO: 302871 - DNA, 20 bp, human
gcgattggaaacgtgcaagg

SEQ ID NO: 302872 - DNA, 20 bp, human
ggacacactggcttaatctg

SEQ ID NO: 302873 - DNA, 20 bp, human
gaaagcgagagagtgtgcgt

SEQ ID NO: 302874 - DNA, 20 bp, human
gttgcacagggagcgttaag

SEQ ID NO: 302875 - DNA, 20 bp, human
gcacgaagaaaaatgctatt

SEQ ID NO: 302876 - DNA, 20 bp, human
gaggcactgaggttcagctc

SEQ ID NO: 302877 - DNA, 20 bp, human
gcccggggcaggtacagagg

SEQ ID NO: 302878 - DNA, 20 bp, human
ggaggtggctcaccagaggg

SEQ ID NO: 302879 - DNA, 20 bp, human
gggaacagcaccttgggcac

SEQ ID NO: 302880 - DNA, 20 bp, human
ggaggaggtggctcaccaga

SEQ ID NO: 302881 - DNA, 20 bp, human
gccacccaggcctgagctat

SEQ ID NO: 302882 - DNA, 20 bp, human
gcggggaagccaagaaaacg

SEQ ID NO: 302883 - DNA, 20 bp, human
gccaggcctgagctatagga

SEQ ID NO: 302884 - DNA, 20 bp, human
gggtgggaaatggacttcaa

SEQ ID NO: 302885 - DNA, 20 bp, human
ggggcctcatcacttattca

SEQ ID NO: 302886 - DNA, 20 bp, human
ggactcgggcctggtaagtg

SEQ ID NO: 302887 - DNA, 20 bp, human
gtgggagcgtcgggaggctt

SEQ ID NO: 302888 - DNA, 20 bp, human
gaggggacctctggggactc

SEQ ID NO: 302889 - DNA, 20 bp, human
gaatcgagcagggagtagga

SEQ ID NO: 302890 - DNA, 20 bp, human
ggggccatagggccccgcgg

SEQ ID NO: 302891 - DNA, 20 bp, human
gggcctggtaagtggggctc

SEQ ID NO: 302892 - DNA, 20 bp, human
gggcttggctgggaactcca

SEQ ID NO: 302893 - DNA, 20 bp, human
gtgagggagcactgcagctg

SEQ ID NO: 302894 - DNA, 20 bp, human
gtgccagagccccacttacc

SEQ ID NO: 302895 - DNA, 20 bp, human
gccccagcaggcggaccagg

SEQ ID NO: 302896 - DNA, 20 bp, human
ggggccagagggagctccgc

SEQ ID NO: 302897 - DNA, 20 bp, human
gcaggccttggcctcccccg

SEQ ID NO: 302898 - DNA, 20 bp, human
gtcccccgcggagctccctc

SEQ ID NO: 302899 - DNA, 20 bp, human
gggggaggccaaggcctgcg

SEQ ID NO: 302900 - DNA, 20 bp, human
ggacccacccccttccccga

SEQ ID NO: 302901 - DNA, 20 bp, human
ggaggccgggcctgctgcgg

SEQ ID NO: 302902 - DNA, 20 bp, human
gtcgagagcggccactccca

SEQ ID NO: 302903 - DNA, 20 bp, human
ggccctaaggctggtggata

SEQ ID NO: 302904 - DNA, 20 bp, human
gacccgggcgcgaggagcct

SEQ ID NO: 302905 - DNA, 20 bp, human
gcggcggccgccttcgggga

SEQ ID NO: 302906 - DNA, 20 bp, human
ggtggccagctccacgggga

SEQ ID NO: 302907 - DNA, 20 bp, human
gacggggagggaggacccag

SEQ ID NO: 302908 - DNA, 20 bp, human
gtgggagggacgaacggaga

SEQ ID NO: 302909 - DNA, 20 bp, human
ggcaccggagagacccacac

SEQ ID NO: 302910 - DNA, 20 bp, human
gaagccccggaggcccgtgt

SEQ ID NO: 302911 - DNA, 20 bp, human
ggaatgtgggagggctcagg

SEQ ID NO: 302912 - DNA, 20 bp, human
ggccagctccacggggaggg

SEQ ID NO: 302913 - DNA, 20 bp, human
gtggagggaccagggaaaac

SEQ ID NO: 302914 - DNA, 20 bp, human
gcgctggcccgggactcgga

SEQ ID NO: 302915 - DNA, 20 bp, human
gggagggctcagggggatgt

SEQ ID NO: 302916 - DNA, 20 bp, human
ggcgccccccgtcgggacac

SEQ ID NO: 302917 - DNA, 20 bp, human
ggacacaggccaggtggcgg

SEQ ID NO: 302918 - DNA, 20 bp, human
gtccgcgcggcgccccccgt

SEQ ID NO: 302919 - DNA, 20 bp, human
gcacctggcctgtgtcccga

SEQ ID NO: 302920 - DNA, 20 bp, human
gctggcctgtgtcccgacgg

SEQ ID NO: 302921 - DNA, 20 bp, human
ggcctgcggggcctcctccg

SEQ ID NO: 302922 - DNA, 20 bp, human
gggcccgcggctgttttgca

SEQ ID NO: 302923 - DNA, 20 bp, human
gggagcggagctctcgggaa

SEQ ID NO: 302924 - DNA, 20 bp, human
gcctccctgcaaaacagccg

SEQ ID NO: 302925 - DNA, 20 bp, human
ggggcgggaggcggataaaa

SEQ ID NO: 302926 - DNA, 20 bp, human
gaggcagtgctgtacgagga

SEQ ID NO: 302927 - DNA, 20 bp, human
gaggagacataaaggcaatg

SEQ ID NO: 302928 - DNA, 20 bp, human
gtcaggaaagatgaaggtct

SEQ ID NO: 302929 - DNA, 20 bp, human
gcgtaaactaagacctgaaa

SEQ ID NO: 302930 - DNA, 20 bp, human
gtagcgacacaacctcggga

SEQ ID NO: 302931 - DNA, 20 bp, human
ggtgcaatgtcaatagatgc

SEQ ID NO: 302932 - DNA, 20 bp, human
gcaacaggcagtgctgtacg

SEQ ID NO: 302933 - DNA, 20 bp, human
gcacagtttggtataggatg

SEQ ID NO: 302934 - DNA, 20 bp, human
gcttagtttacgagcaagct

SEQ ID NO: 302935 - DNA, 20 bp, human
gaaggtctaggggtgaggga

SEQ ID NO: 302936 - DNA, 20 bp, human
gccggccctgccaccaccgt

SEQ ID NO: 302937 - DNA, 20 bp, human
gcggggagggcggactctgg

SEQ ID NO: 302938 - DNA, 20 bp, human
gcgccaaagccgggcagtag

SEQ ID NO: 302939 - DNA, 20 bp, human
gccgccgcccggccgagcac

SEQ ID NO: 302940 - DNA, 20 bp, human
ggggcgccacaccaggtaag

SEQ ID NO: 302941 - DNA, 20 bp, human
gaaggggtccagcttgggag

SEQ ID NO: 302942 - DNA, 20 bp, human
ggctggggtaagcgcaggag

SEQ ID NO: 302943 - DNA, 20 bp, human
gcgagccaatgaatggagga

SEQ ID NO: 302944 - DNA, 20 bp, human
ggggctgtcgagccaatgaa

SEQ ID NO: 302945 - DNA, 20 bp, human
gggagggggcgcagaggtca

SEQ ID NO: 302946 - DNA, 20 bp, human
ggggtcccgcgccggaaata

SEQ ID NO: 302947 - DNA, 20 bp, human
gaccacctggagctccgccc

SEQ ID NO: 302948 - DNA, 20 bp, human
gggaaataggggcgactgag

SEQ ID NO: 302949 - DNA, 20 bp, human
gaggtgtgcaggtaccgggg

SEQ ID NO: 302950 - DNA, 20 bp, human
ggggacgcagagctccggga

SEQ ID NO: 302951 - DNA, 20 bp, human
gcgactgaggggccgcgagg

SEQ ID NO: 302952 - DNA, 20 bp, human
gtgggagccaagtcggatca

SEQ ID NO: 302953 - DNA, 20 bp, human
gcgcgaggcggggaggaaac

SEQ ID NO: 302954 - DNA, 20 bp, human
gtccacggccgcgtcggggg

SEQ ID NO: 302955 - DNA, 20 bp, human
gccccgcaggctcgaaactg

SEQ ID NO: 302956 - DNA, 20 bp, human
gcaagagcgctgccctcccg

SEQ ID NO: 302957 - DNA, 20 bp, human
ggccgcgagctgcgctcaaa

SEQ ID NO: 302958 - DNA, 20 bp, human
gcccacctggggacgatccc

SEQ ID NO: 302959 - DNA, 20 bp, human
gtggtcggccggccccgaga

SEQ ID NO: 302960 - DNA, 20 bp, human
gcctgcctgggatcgtcccc

SEQ ID NO: 302961 - DNA, 20 bp, human
gcaaccccaaagctacccga

SEQ ID NO: 302962 - DNA, 20 bp, human
ggctcgcggccttgcaggtt

SEQ ID NO: 302963 - DNA, 20 bp, human
ggccctcccgcggctcgcac

SEQ ID NO: 302964 - DNA, 20 bp, human
ggcaccgccaaactttcctt

SEQ ID NO: 302965 - DNA, 20 bp, human
gcgaacgcacccggcggggc

SEQ ID NO: 302966 - DNA, 20 bp, human
gacggccaggggaactcttg

SEQ ID NO: 302967 - DNA, 20 bp, human
gtaagggaacgatggagcac

SEQ ID NO: 302968 - DNA, 20 bp, human
gctggtgactaagggaacga

SEQ ID NO: 302969 - DNA, 20 bp, human
gtggagcacagggaattggg

SEQ ID NO: 302970 - DNA, 20 bp, human
gtcccttagtcaccagtcac

SEQ ID NO: 302971 - DNA, 20 bp, human
ggtccagtgactggtgacta

SEQ ID NO: 302972 - DNA, 20 bp, human
gaagtccgagctggagccga

SEQ ID NO: 302973 - DNA, 20 bp, human
ggagctggagccgacggcca

SEQ ID NO: 302974 - DNA, 20 bp, human
gagacccccaagagttcccc

SEQ ID NO: 302975 - DNA, 20 bp, human
ggcagtcctgcggcaaagac

SEQ ID NO: 302976 - DNA, 20 bp, human
gtgagtgcactgagctggga

SEQ ID NO: 302977 - DNA, 20 bp, human
gggctgagatctgctgaggt

SEQ ID NO: 302978 - DNA, 20 bp, human
ggatgggctgagatctgctg

SEQ ID NO: 302979 - DNA, 20 bp, human
gcagtccgtgaaggcctctg

SEQ ID NO: 302980 - DNA, 20 bp, human
gctctctccttggcccgtgt

SEQ ID NO: 302981 - DNA, 20 bp, human
gagcaggaatatctgaacga

SEQ ID NO: 302982 - DNA, 20 bp, human
ggctgctggggtttcttctc

SEQ ID NO: 302983 - DNA, 20 bp, human
gcacctggcagacctaggaa

SEQ ID NO: 302984 - DNA, 20 bp, human
gggtgggggcagttcctagt

SEQ ID NO: 302985 - DNA, 20 bp, human
gcacccagggggaaccggtg

SEQ ID NO: 302986 - DNA, 20 bp, human
gggaacaatgagaagggcag

SEQ ID NO: 302987 - DNA, 20 bp, human
gggggctgggaacaatgaga

SEQ ID NO: 302988 - DNA, 20 bp, human
ggggcaacacaggaagggta

SEQ ID NO: 302989 - DNA, 20 bp, human
gttgggcaaatgacgttgag

SEQ ID NO: 302990 - DNA, 20 bp, human
gcaacacaggaagggtatgg

SEQ ID NO: 302991 - DNA, 20 bp, human
ggaggctggataccagggca

SEQ ID NO: 302992 - DNA, 20 bp, human
gagctgaagagaaaggacca

SEQ ID NO: 302993 - DNA, 20 bp, human
ggcaaggcatgtggtgtttg

SEQ ID NO: 302994 - DNA, 20 bp, human
gcgtcatttgcccaagaggc

SEQ ID NO: 302995 - DNA, 20 bp, human
ggctattttatgccagaggc

SEQ ID NO: 302996 - DNA, 20 bp, human
gtacctaggaggcttgcaaa

SEQ ID NO: 302997 - DNA, 20 bp, human
gtgctgggaatatacctagg

SEQ ID NO: 302998 - DNA, 20 bp, human
ggaccatttgcaagcctcct

SEQ ID NO: 302999 - DNA, 20 bp, human
gaatctgataatgtgtctgc

SEQ ID NO: 303000 - DNA, 20 bp, human
gaacaatcgaataagagaac

SEQ ID NO: 303001 - DNA, 20 bp, human
gcactggctgttgaactgcg

SEQ ID NO: 303002 - DNA, 20 bp, human
gatttgtaatatgacatcac

SEQ ID NO: 303003 - DNA, 20 bp, human
gataacaagcatttgactct

SEQ ID NO: 303004 - DNA, 20 bp, human
gtatgagtagctcttatcct

SEQ ID NO: 303005 - DNA, 20 bp, human
gcaggggcctttaaccttta

SEQ ID NO: 303006 - DNA, 20 bp, human
gtggaagcctcgcctcccgc

SEQ ID NO: 303007 - DNA, 20 bp, human
ggcggcggaaggggacgacg

SEQ ID NO: 303008 - DNA, 20 bp, human
gccaccaggtagcggaactc

SEQ ID NO: 303009 - DNA, 20 bp, human
ggcgcgggaggtgacgtggg

SEQ ID NO: 303010 - DNA, 20 bp, human
gtggcagcctcgcgggcccg

SEQ ID NO: 303011 - DNA, 20 bp, human
ggagcaggcgggccgagcgg

SEQ ID NO: 303012 - DNA, 20 bp, human
ggcccggggctcggcaccca

SEQ ID NO: 303013 - DNA, 20 bp, human
gtggctgcaggaggcgcccc

SEQ ID NO: 303014 - DNA, 20 bp, human
gactggagcacagggatccc

SEQ ID NO: 303015 - DNA, 20 bp, human
ggcccgcctgctcgcgggga

SEQ ID NO: 303016 - DNA, 20 bp, human
gcccacgggagagccctcca

SEQ ID NO: 303017 - DNA, 20 bp, human
ggggccctgtgtggtggtca

SEQ ID NO: 303018 - DNA, 20 bp, human
ggccccgcggcctccttcgt

SEQ ID NO: 303019 - DNA, 20 bp, human
gagggcgcagtccaggccac

SEQ ID NO: 303020 - DNA, 20 bp, human
gtggcccgtgaccaccacac

SEQ ID NO: 303021 - DNA, 20 bp, human
gaggcacaggggcggtccca

SEQ ID NO: 303022 - DNA, 20 bp, human
ggctgcgctctcacctacga

SEQ ID NO: 303023 - DNA, 20 bp, human
gcaagcagatgtcccagcgg

SEQ ID NO: 303024 - DNA, 20 bp, human
ggccctggagggctctcccg

SEQ ID NO: 303025 - DNA, 20 bp, human
gcctccgcctgtgtcctcgc

SEQ ID NO: 303026 - DNA, 20 bp, human
gtggaatgttagggatcctg

SEQ ID NO: 303027 - DNA, 20 bp, human
gatagtccatcccctcggag

SEQ ID NO: 303028 - DNA, 20 bp, human
ggtggagccagatgcctgag

SEQ ID NO: 303029 - DNA, 20 bp, human
gggatggactatattaccaa

SEQ ID NO: 303030 - DNA, 20 bp, human
ggtaatatagtccatcccct

SEQ ID NO: 303031 - DNA, 20 bp, human
gtgctgccgccctgcccctt

SEQ ID NO: 303032 - DNA, 20 bp, human
ggaaaacattcccctccgag

SEQ ID NO: 303033 - DNA, 20 bp, human
gccagcctagggcgacgctg

SEQ ID NO: 303034 - DNA, 20 bp, human
gtggggcgtgtcacagccga

SEQ ID NO: 303035 - DNA, 20 bp, human
gggggtacccttcagggtct

SEQ ID NO: 303036 - DNA, 20 bp, human
ggggcctagcgcggcaaggt

SEQ ID NO: 303037 - DNA, 20 bp, human
ggcgcggcaaggtaggaaga

SEQ ID NO: 303038 - DNA, 20 bp, human
ggccgagaatgcacacgggg

SEQ ID NO: 303039 - DNA, 20 bp, human
gcgcaggtcggccaataacg

SEQ ID NO: 303040 - DNA, 20 bp, human
gcagagggcggggcctagcg

SEQ ID NO: 303041 - DNA, 20 bp, human
gcgccagctcaccccgttat

SEQ ID NO: 303042 - DNA, 20 bp, human
ggggccccgagccggaattg

SEQ ID NO: 303043 - DNA, 20 bp, human
gcggttcgctgccttcccat

SEQ ID NO: 303044 - DNA, 20 bp, human
gatgcacacggggaggctca

SEQ ID NO: 303045 - DNA, 20 bp, human
gccggctcggggcccgccca

SEQ ID NO: 303046 - DNA, 20 bp, human
gcggaggagcaggggcgcca

SEQ ID NO: 303047 - DNA, 20 bp, human
gtagcacaggcaggacgcgg

SEQ ID NO: 303048 - DNA, 20 bp, human
gaccgggccaaggagcccat

SEQ ID NO: 303049 - DNA, 20 bp, human
gggcgccccacggaccggga

SEQ ID NO: 303050 - DNA, 20 bp, human
gcgctcgggccattgttccg

SEQ ID NO: 303051 - DNA, 20 bp, human
gtcggagtgggagtgggtct

SEQ ID NO: 303052 - DNA, 20 bp, human
gggcgccccgctcttcctat

SEQ ID NO: 303053 - DNA, 20 bp, human
gcgatggcgccccacggacc

SEQ ID NO: 303054 - DNA, 20 bp, human
gcttcagagaggaacgacgg

SEQ ID NO: 303055 - DNA, 20 bp, human
gcagcccgcccgcgttgtca

SEQ ID NO: 303056 - DNA, 20 bp, human
gcgaacgcggccgggccctt

SEQ ID NO: 303057 - DNA, 20 bp, human
gactcgctggcgcaggggta

SEQ ID NO: 303058 - DNA, 20 bp, human
gccagcgagtcggggccctc

SEQ ID NO: 303059 - DNA, 20 bp, human
gcccctgcgccagcgagtcg

SEQ ID NO: 303060 - DNA, 20 bp, human
gactcctggggtgtgaggat

SEQ ID NO: 303061 - DNA, 20 bp, human
gcggccgcgttcgcccggac

SEQ ID NO: 303062 - DNA, 20 bp, human
gggccccgactcgctggcgc

SEQ ID NO: 303063 - DNA, 20 bp, human
gagcgtccaggtagccccga

SEQ ID NO: 303064 - DNA, 20 bp, human
gaggtcctggccgagcgtcc

SEQ ID NO: 303065 - DNA, 20 bp, human
gcggcggcgctttcattaga

SEQ ID NO: 303066 - DNA, 20 bp, human
gttaacccctcgtccaccgc

SEQ ID NO: 303067 - DNA, 20 bp, human
gcacacgtgccgcctccgtc

SEQ ID NO: 303068 - DNA, 20 bp, human
gcagccccctccgacgccgg

SEQ ID NO: 303069 - DNA, 20 bp, human
gagctccgcggccccgacgg

SEQ ID NO: 303070 - DNA, 20 bp, human
gcgtccaccgccggcgtcgg

SEQ ID NO: 303071 - DNA, 20 bp, human
gccccctccgacgccggcgg

SEQ ID NO: 303072 - DNA, 20 bp, human
ggaggaggccccggctgatg

SEQ ID NO: 303073 - DNA, 20 bp, human
gaggcggcacgtgtgcgccc

SEQ ID NO: 303074 - DNA, 20 bp, human
gtcccagccccctccgacgc

SEQ ID NO: 303075 - DNA, 20 bp, human
gcgcagctccgcggccccga

SEQ ID NO: 303076 - DNA, 20 bp, human
gtacaactgtgacatgaaga

SEQ ID NO: 303077 - DNA, 20 bp, human
gtcggagagcgtggataagc

SEQ ID NO: 303078 - DNA, 20 bp, human
gaaatgttgtcattaagaac

SEQ ID NO: 303079 - DNA, 20 bp, human
gaatgttcataaaaatcgga

SEQ ID NO: 303080 - DNA, 20 bp, human
ggacacgagatcggagagcg

SEQ ID NO: 303081 - DNA, 20 bp, human
ggtggccaggtacacaaatt

SEQ ID NO: 303082 - DNA, 20 bp, human
gaaatcctaatgacaaaata

SEQ ID NO: 303083 - DNA, 20 bp, human
gaccaaaaatcttttattag

SEQ ID NO: 303084 - DNA, 20 bp, human
gtcatccaaatttgtgtacc

SEQ ID NO: 303085 - DNA, 20 bp, human
gttgaatgagatcggtgttt

SEQ ID NO: 303086 - DNA, 20 bp, human
gcgcgcgcgcgcacacccgt

SEQ ID NO: 303087 - DNA, 20 bp, human
gcgcgcacacccgtaggaag

SEQ ID NO: 303088 - DNA, 20 bp, human
gggcgagtcacaggcggcgg

SEQ ID NO: 303089 - DNA, 20 bp, human
ggggggcgagtcacaggcgg

SEQ ID NO: 303090 - DNA, 20 bp, human
gaggggagggggcgagtcac

SEQ ID NO: 303091 - DNA, 20 bp, human
gtgcgcgcgcgcgggttgca

SEQ ID NO: 303092 - DNA, 20 bp, human
gcgggagcgatggaataggt

SEQ ID NO: 303093 - DNA, 20 bp, human
ggggctcgcgccagggaaag

SEQ ID NO: 303094 - DNA, 20 bp, human
gggagcgggagcgatggaat

SEQ ID NO: 303095 - DNA, 20 bp, human
ggcggcagcagctgccggag

SEQ ID NO: 303096 - DNA, 20 bp, human
gggcaagcggggcggtgcga

SEQ ID NO: 303097 - DNA, 20 bp, human
gggtggcccggctgctttca

SEQ ID NO: 303098 - DNA, 20 bp, human
gggccctgcccgctcacccc

SEQ ID NO: 303099 - DNA, 20 bp, human
gcccccaggaacgctaagat

SEQ ID NO: 303100 - DNA, 20 bp, human
gacgctaagataggcggcca

SEQ ID NO: 303101 - DNA, 20 bp, human
ggggcggtgcgagggggact

SEQ ID NO: 303102 - DNA, 20 bp, human
gttgaagaaacacacgagtt

SEQ ID NO: 303103 - DNA, 20 bp, human
gccaggaacgctaagatagg

SEQ ID NO: 303104 - DNA, 20 bp, human
gagggggactcgggacgcgc

SEQ ID NO: 303105 - DNA, 20 bp, human
gcaaacacccagcccgccgc

SEQ ID NO: 303106 - DNA, 20 bp, human
gctcacttggccaggggccc

SEQ ID NO: 303107 - DNA, 20 bp, human
ggcggcttccaaggcagcgg

SEQ ID NO: 303108 - DNA, 20 bp, human
ggccgggagcgcgcgtcacg

SEQ ID NO: 303109 - DNA, 20 bp, human
gaccctgcggcaggtcacgt

SEQ ID NO: 303110 - DNA, 20 bp, human
ggcccctggccaagtgaggg

SEQ ID NO: 303111 - DNA, 20 bp, human
gtcgggcggccctcatgaat

SEQ ID NO: 303112 - DNA, 20 bp, human
gcgcccgccagctgccggct

SEQ ID NO: 303113 - DNA, 20 bp, human
gctgccgcagggttgccatg

SEQ ID NO: 303114 - DNA, 20 bp, human
gccgcggcgtcccattcatg

SEQ ID NO: 303115 - DNA, 20 bp, human
ggcctgggccgcagctgagt

SEQ ID NO: 303116 - DNA, 20 bp, human
ggtgggcggggcatgaagtc

SEQ ID NO: 303117 - DNA, 20 bp, human
gcaggggcggggtctttcca

SEQ ID NO: 303118 - DNA, 20 bp, human
gccccgcctccgaggccaaa

SEQ ID NO: 303119 - DNA, 20 bp, human
gtgggcggggatcggagcag

SEQ ID NO: 303120 - DNA, 20 bp, human
gggcggtggcacagggactt

SEQ ID NO: 303121 - DNA, 20 bp, human
gaaaagtgtggatttcggaa

SEQ ID NO: 303122 - DNA, 20 bp, human
gcgccctttggcctcggagg

SEQ ID NO: 303123 - DNA, 20 bp, human
ggccgcactaggatcgtaga

SEQ ID NO: 303124 - DNA, 20 bp, human
gcagtctgggagatacgggt

SEQ ID NO: 303125 - DNA, 20 bp, human
gtccagaaaagtgtggattt

SEQ ID NO: 303126 - DNA, 20 bp, human
gaaccctgccaacgagaaga

SEQ ID NO: 303127 - DNA, 20 bp, human
gccccctcttctcgttggca

SEQ ID NO: 303128 - DNA, 20 bp, human
gtggcagggcagctagaagt

SEQ ID NO: 303129 - DNA, 20 bp, human
gaaaatcataagttgggggg

SEQ ID NO: 303130 - DNA, 20 bp, human
gttatagccaataggtgatg

SEQ ID NO: 303131 - DNA, 20 bp, human
gaaggggttccactctaccc

SEQ ID NO: 303132 - DNA, 20 bp, human
gatggggtgcggggtgagtg

SEQ ID NO: 303133 - DNA, 20 bp, human
gcccccgcaaagtcaatgta

SEQ ID NO: 303134 - DNA, 20 bp, human
gaaagtcaatgtagggatag

SEQ ID NO: 303135 - DNA, 20 bp, human
gctataaaatcataagttgg

SEQ ID NO: 303136 - DNA, 20 bp, human
gacaccaggaaactgcagaa

SEQ ID NO: 303137 - DNA, 20 bp, human
ggatgcaatagcactgactg

SEQ ID NO: 303138 - DNA, 20 bp, human
gaatgtaagggagggatcaa

SEQ ID NO: 303139 - DNA, 20 bp, human
ggagccctaagctttcatag

SEQ ID NO: 303140 - DNA, 20 bp, human
gggcagtgaatatatgaatg

SEQ ID NO: 303141 - DNA, 20 bp, human
ggactccgggcagatacacc

SEQ ID NO: 303142 - DNA, 20 bp, human
gcatgatcctgatctagttc

SEQ ID NO: 303143 - DNA, 20 bp, human
gtagagccatacaatggcag

SEQ ID NO: 303144 - DNA, 20 bp, human
ggtcccttttaagctcctaa

SEQ ID NO: 303145 - DNA, 20 bp, human
gcaacccactatgaaagctt

SEQ ID NO: 303146 - DNA, 20 bp, human
ggtgtcccgtagtggactga

SEQ ID NO: 303147 - DNA, 20 bp, human
gaagagagggaggtgactca

SEQ ID NO: 303148 - DNA, 20 bp, human
gacgggacacagcaaggcgg

SEQ ID NO: 303149 - DNA, 20 bp, human
gggcctgcaagagggagtga

SEQ ID NO: 303150 - DNA, 20 bp, human
gggctcacttgcatggtgat

SEQ ID NO: 303151 - DNA, 20 bp, human
gacccaccaggctgatctat

SEQ ID NO: 303152 - DNA, 20 bp, human
gagccctcactccctcttgc

SEQ ID NO: 303153 - DNA, 20 bp, human
gggactgagggcctgcaaga

SEQ ID NO: 303154 - DNA, 20 bp, human
gaataggacagtgtatggaa

SEQ ID NO: 303155 - DNA, 20 bp, human
gggtggtctcgaagcctgaa

SEQ ID NO: 303156 - DNA, 20 bp, human
gagctgagatatgaacactg

SEQ ID NO: 303157 - DNA, 20 bp, human
gaaagtctctgactgggccg

SEQ ID NO: 303158 - DNA, 20 bp, human
gatctgactaggagtttagg

SEQ ID NO: 303159 - DNA, 20 bp, human
ggaggtatagaagtaaacca

SEQ ID NO: 303160 - DNA, 20 bp, human
ggcttataaagtctctgact

SEQ ID NO: 303161 - DNA, 20 bp, human
gaccagcttcagaaattccc

SEQ ID NO: 303162 - DNA, 20 bp, human
gtcagagactttataagcct

SEQ ID NO: 303163 - DNA, 20 bp, human
ggtgttgcttatgtatctct

SEQ ID NO: 303164 - DNA, 20 bp, human
gaacagcttcatcttaataa

SEQ ID NO: 303165 - DNA, 20 bp, human
gatccaaatgatatcaagga

SEQ ID NO: 303166 - DNA, 20 bp, human
gagcagagagagtgagctcg

SEQ ID NO: 303167 - DNA, 20 bp, human
ggctccgcggggttcccaga

SEQ ID NO: 303168 - DNA, 20 bp, human
gccgctggacgcaatctggc

SEQ ID NO: 303169 - DNA, 20 bp, human
gactgccgctggacgcaatc

SEQ ID NO: 303170 - DNA, 20 bp, human
gcggtctccaaggatgggtg

SEQ ID NO: 303171 - DNA, 20 bp, human
gcagcggcagtcgctccgcg

SEQ ID NO: 303172 - DNA, 20 bp, human
ggcaaaggtgcgccctgcgc

SEQ ID NO: 303173 - DNA, 20 bp, human
gagcaaaaggctggcgcgga

SEQ ID NO: 303174 - DNA, 20 bp, human
gcagaagcggtctccaagga

SEQ ID NO: 303175 - DNA, 20 bp, human
gtgggtggggatcccaccac

SEQ ID NO: 303176 - DNA, 20 bp, human
gggctccgagggtaatagga

SEQ ID NO: 303177 - DNA, 20 bp, human
gcccgcctccaagatcacgg

SEQ ID NO: 303178 - DNA, 20 bp, human
gggggcctccgtgatcttgg

SEQ ID NO: 303179 - DNA, 20 bp, human
gcgccccgcctccaagatca

SEQ ID NO: 303180 - DNA, 20 bp, human
ggcggggctccgagggtaat

SEQ ID NO: 303181 - DNA, 20 bp, human
ggcgtgttagcatcgattgt

SEQ ID NO: 303182 - DNA, 20 bp, human
gaccaagaatggaagtagag

SEQ ID NO: 303183 - DNA, 20 bp, human
gtccgagggtaataggaggg

SEQ ID NO: 303184 - DNA, 20 bp, human
ggcgcagactccgaggtgga

SEQ ID NO: 303185 - DNA, 20 bp, human
ggttagcatcgattgtagga

SEQ ID NO: 303186 - DNA, 20 bp, human
gtgggtgtgtgatgtgtaga

SEQ ID NO: 303187 - DNA, 20 bp, human
ggatggatgaataactcatg

SEQ ID NO: 303188 - DNA, 20 bp, human
ggatggccctgaattcatgg

SEQ ID NO: 303189 - DNA, 20 bp, human
gtggacagacgcctccgcga

SEQ ID NO: 303190 - DNA, 20 bp, human
gtgtggataggtgagtgaga

SEQ ID NO: 303191 - DNA, 20 bp, human
ggtggatggccctgaattca

SEQ ID NO: 303192 - DNA, 20 bp, human
gtccagccctccatgaattc

SEQ ID NO: 303193 - DNA, 20 bp, human
ggcgggttggatctgtggat

SEQ ID NO: 303194 - DNA, 20 bp, human
gtagatggtcgagttacaga

SEQ ID NO: 303195 - DNA, 20 bp, human
gtccccacagctgcccatag

SEQ ID NO: 303196 - DNA, 20 bp, human
gggcccgctcagggaatagc

SEQ ID NO: 303197 - DNA, 20 bp, human
ggcggggaatgtgacatcag

SEQ ID NO: 303198 - DNA, 20 bp, human
gtccccaggaggagactagg

SEQ ID NO: 303199 - DNA, 20 bp, human
gccttggagcgtcgcaaggg

SEQ ID NO: 303200 - DNA, 20 bp, human
gtcctcttcctcccctagtc

SEQ ID NO: 303201 - DNA, 20 bp, human
gaagaggactggcccgctca

SEQ ID NO: 303202 - DNA, 20 bp, human
gcagccttggagcgtcgcaa

SEQ ID NO: 303203 - DNA, 20 bp, human
gcattgcagcaacagcttgg

SEQ ID NO: 303204 - DNA, 20 bp, human
gaacccagctattccctgag

SEQ ID NO: 303205 - DNA, 20 bp, human
gtcgtctctcgccagaaaaa

SEQ ID NO: 303206 - DNA, 20 bp, human
gccccaggctagcccggagg

SEQ ID NO: 303207 - DNA, 20 bp, human
gggcacctgtacccctcaca

SEQ ID NO: 303208 - DNA, 20 bp, human
gccccggcgcggggtcgcga

SEQ ID NO: 303209 - DNA, 20 bp, human
gggcgctgggtcaatccccc

SEQ ID NO: 303210 - DNA, 20 bp, human
gggcgcggggtcgcgaggga

SEQ ID NO: 303211 - DNA, 20 bp, human
ggtctcgtgcaggggcgcag

SEQ ID NO: 303212 - DNA, 20 bp, human
gcccggaggaggcgctgcgt

SEQ ID NO: 303213 - DNA, 20 bp, human
ggctgggtcaaggaattcga

SEQ ID NO: 303214 - DNA, 20 bp, human
gtccgccctgtgaggggtac

SEQ ID NO: 303215 - DNA, 20 bp, human
gaaggcgcaaagtgccgatg

SEQ ID NO: 303216 - DNA, 20 bp, human
ggaaccaaaaaggtttatag

SEQ ID NO: 303217 - DNA, 20 bp, human
gttgcattatggcagtgcat

SEQ ID NO: 303218 - DNA, 20 bp, human
gtatggcagtgcattggcca

SEQ ID NO: 303219 - DNA, 20 bp, human
gatgaatccaagatgaatcc

SEQ ID NO: 303220 - DNA, 20 bp, human
gaaatgtgactgacatagaa

SEQ ID NO: 303221 - DNA, 20 bp, human
gcttaaaagtagggcagaag

SEQ ID NO: 303222 - DNA, 20 bp, human
gagagtggggtacctacact

SEQ ID NO: 303223 - DNA, 20 bp, human
gcagcctctataaacctttt

SEQ ID NO: 303224 - DNA, 20 bp, human
gaaagaaagatgctcagagt

SEQ ID NO: 303225 - DNA, 20 bp, human
ggctcaccaaatcaaaagag

SEQ ID NO: 303226 - DNA, 20 bp, human
gcacgcgtcgcgacctaacc

SEQ ID NO: 303227 - DNA, 20 bp, human
gggttctaactgagtcacga

SEQ ID NO: 303228 - DNA, 20 bp, human
gaaaacggaggcggggttgt

SEQ ID NO: 303229 - DNA, 20 bp, human
gacgcttgagcccggatgta

SEQ ID NO: 303230 - DNA, 20 bp, human
gacactgcctcccgaaaaaa

SEQ ID NO: 303231 - DNA, 20 bp, human
gaacgcccaggctacttctg

SEQ ID NO: 303232 - DNA, 20 bp, human
gaactgagtcacgacgggaa

SEQ ID NO: 303233 - DNA, 20 bp, human
ggcggcggcaaaacggaggc

SEQ ID NO: 303234 - DNA, 20 bp, human
gcaagcgtcgagccaattgc

SEQ ID NO: 303235 - DNA, 20 bp, human
ggcgacgcgtgccgtacatc

SEQ ID NO: 303236 - DNA, 20 bp, human
gctagcggcggggaggacgc

SEQ ID NO: 303237 - DNA, 20 bp, human
ggggccgactcccagctcca

SEQ ID NO: 303238 - DNA, 20 bp, human
ggatcccggtttctttggga

SEQ ID NO: 303239 - DNA, 20 bp, human
gcggggaggacgcgggatcc

SEQ ID NO: 303240 - DNA, 20 bp, human
gcgctggcgcgctgcgctag

SEQ ID NO: 303241 - DNA, 20 bp, human
gtggcgcgctgcgctagcgg

SEQ ID NO: 303242 - DNA, 20 bp, human
gggactctacctccctaaat

SEQ ID NO: 303243 - DNA, 20 bp, human
gcccccctcccaaagaaacc

SEQ ID NO: 303244 - DNA, 20 bp, human
ggcgggatcccggtttcttt

SEQ ID NO: 303245 - DNA, 20 bp, human
gccgaaggccgtcacagacc

SEQ ID NO: 303246 - DNA, 20 bp, human
gacgacgcgcggacagccaa

SEQ ID NO: 303247 - DNA, 20 bp, human
gtgtaggccctcggacggaa

SEQ ID NO: 303248 - DNA, 20 bp, human
gtgcactaggcgcgctgctc

SEQ ID NO: 303249 - DNA, 20 bp, human
ggccgggccgggtacacacc

SEQ ID NO: 303250 - DNA, 20 bp, human
gcccagcccagcactccggc

SEQ ID NO: 303251 - DNA, 20 bp, human
gcccgagccagccggagtgc

SEQ ID NO: 303252 - DNA, 20 bp, human
gcggaagggtctctcctcgc

SEQ ID NO: 303253 - DNA, 20 bp, human
ggcactcggcgctgtcatgg

SEQ ID NO: 303254 - DNA, 20 bp, human
ggtagcaccaggtgtgtacc

SEQ ID NO: 303255 - DNA, 20 bp, human
gactcccggggagcggacta

SEQ ID NO: 303256 - DNA, 20 bp, human
gcggcggcggccggcagaat

SEQ ID NO: 303257 - DNA, 20 bp, human
gcaggcggggcagactgcgt

SEQ ID NO: 303258 - DNA, 20 bp, human
ggcggccggcagaataggcg

SEQ ID NO: 303259 - DNA, 20 bp, human
ggccggcagaataggcgcgg

SEQ ID NO: 303260 - DNA, 20 bp, human
ggcggaggaaggctcaggcg

SEQ ID NO: 303261 - DNA, 20 bp, human
gtaggcgcggaggaaggctc

SEQ ID NO: 303262 - DNA, 20 bp, human
gaagctaaggactgcggcgg

SEQ ID NO: 303263 - DNA, 20 bp, human
ggggctggacgtctgctccg

SEQ ID NO: 303264 - DNA, 20 bp, human
ggcggatcgcggcaaggcgg

SEQ ID NO: 303265 - DNA, 20 bp, human
ggggaagctaaggactgcgg

SEQ ID NO: 303266 - DNA, 20 bp, human
gggggggcgaggtagagagt

SEQ ID NO: 303267 - DNA, 20 bp, human
gaggacgcatgcgcagactg

SEQ ID NO: 303268 - DNA, 20 bp, human
ggtacccaaagcagcagaac

SEQ ID NO: 303269 - DNA, 20 bp, human
ggtgtcgtttcgcaagactt

SEQ ID NO: 303270 - DNA, 20 bp, human
gaacgctggggagtcacttg

SEQ ID NO: 303271 - DNA, 20 bp, human
gaggcgaactataggtcatc

SEQ ID NO: 303272 - DNA, 20 bp, human
gcctgtgccgcgagtgtaag

SEQ ID NO: 303273 - DNA, 20 bp, human
gcatgcgcagactgggggcg

SEQ ID NO: 303274 - DNA, 20 bp, human
ggaaacaaatatatgagcta

SEQ ID NO: 303275 - DNA, 20 bp, human
gacgacaccaggcgaactat

SEQ ID NO: 303276 - DNA, 20 bp, human
gcccctgggaggttagagta

SEQ ID NO: 303277 - DNA, 20 bp, human
gcacatgatgcgcttttcaa

SEQ ID NO: 303278 - DNA, 20 bp, human
ggaaaagcgcatcatgtggg

SEQ ID NO: 303279 - DNA, 20 bp, human
gcgcggccggaccgctgggt

SEQ ID NO: 303280 - DNA, 20 bp, human
gcacgggaaccgtccggggt

SEQ ID NO: 303281 - DNA, 20 bp, human
gcccggacggttcccgtgat

SEQ ID NO: 303282 - DNA, 20 bp, human
ggggcccgagtgttgtcggc

SEQ ID NO: 303283 - DNA, 20 bp, human
gccgctgggtgggcggagaa

SEQ ID NO: 303284 - DNA, 20 bp, human
gctcacggaccgaccccgga

SEQ ID NO: 303285 - DNA, 20 bp, human
gtactctggcacggtagcgt

SEQ ID NO: 303286 - DNA, 20 bp, human
gccggagtctgacgagagaa

SEQ ID NO: 303287 - DNA, 20 bp, human
gaatcagaacccgtcagtgg

SEQ ID NO: 303288 - DNA, 20 bp, human
gggaccggacggaccaatcg

SEQ ID NO: 303289 - DNA, 20 bp, human
gcagaacccgtcagtggggg

SEQ ID NO: 303290 - DNA, 20 bp, human
ggccaatcagaacccgtcag

SEQ ID NO: 303291 - DNA, 20 bp, human
gactccactagcaggaaaac

SEQ ID NO: 303292 - DNA, 20 bp, human
gccccttgaggcaactacgg

SEQ ID NO: 303293 - DNA, 20 bp, human
gccccgagacgcgtcagaag

SEQ ID NO: 303294 - DNA, 20 bp, human
gcgatctgagcattgtgatt

SEQ ID NO: 303295 - DNA, 20 bp, human
gacaccggcactccactagc

SEQ ID NO: 303296 - DNA, 20 bp, human
ggtcggggagagttgcggaa

SEQ ID NO: 303297 - DNA, 20 bp, human
ggggctggggggctcccgga

SEQ ID NO: 303298 - DNA, 20 bp, human
ggggggttggggaatgtcaa

SEQ ID NO: 303299 - DNA, 20 bp, human
ggggaaaccggttccgggac

SEQ ID NO: 303300 - DNA, 20 bp, human
ggcctggaatgtgctcccgt

SEQ ID NO: 303301 - DNA, 20 bp, human
ggccaacgggagcacattcc

SEQ ID NO: 303302 - DNA, 20 bp, human
gtgggaaaacagtaaggcga

SEQ ID NO: 303303 - DNA, 20 bp, human
gtagagaagcctcagacttg

SEQ ID NO: 303304 - DNA, 20 bp, human
gtggggaaaaggaggtgtcg

SEQ ID NO: 303305 - DNA, 20 bp, human
gcgggacaggtctggggaaa

SEQ ID NO: 303306 - DNA, 20 bp, human
gggcacaggtccctccgctt

SEQ ID NO: 303307 - DNA, 20 bp, human
gtccctccgcttagggtggt

SEQ ID NO: 303308 - DNA, 20 bp, human
gcccctgcctgctgatctca

SEQ ID NO: 303309 - DNA, 20 bp, human
gtcagtgtaggcgtctggac

SEQ ID NO: 303310 - DNA, 20 bp, human
gaccgaaggagggaacaaga

SEQ ID NO: 303311 - DNA, 20 bp, human
gacactgagcctctcatgtg

SEQ ID NO: 303312 - DNA, 20 bp, human
gactgtgcccagcgtactgc

SEQ ID NO: 303313 - DNA, 20 bp, human
gtgatggagagtcaggtgtc

SEQ ID NO: 303314 - DNA, 20 bp, human
gccccaccaccctaagcgga

SEQ ID NO: 303315 - DNA, 20 bp, human
gtggagagtcaggtgtccgg

SEQ ID NO: 303316 - DNA, 20 bp, human
gaacccagctgtaggcggta

SEQ ID NO: 303317 - DNA, 20 bp, human
gagctgtaggcggtagggga

SEQ ID NO: 303318 - DNA, 20 bp, human
gggatgtcctgctacgagtc

SEQ ID NO: 303319 - DNA, 20 bp, human
ggggaaggagccggttaccc

SEQ ID NO: 303320 - DNA, 20 bp, human
ggcctacagctgggttccat

SEQ ID NO: 303321 - DNA, 20 bp, human
gggttccataggatggtgag

SEQ ID NO: 303322 - DNA, 20 bp, human
ggagccggttacccaggcgt

SEQ ID NO: 303323 - DNA, 20 bp, human
ggtagcaggacatcccatgg

SEQ ID NO: 303324 - DNA, 20 bp, human
gacagctgggttccatagga

SEQ ID NO: 303325 - DNA, 20 bp, human
ggagccatggtgcagtggga

SEQ ID NO: 303326 - DNA, 20 bp, human
gcacacgctccaatctggga

SEQ ID NO: 303327 - DNA, 20 bp, human
gaatctgggagggagtcggg

SEQ ID NO: 303328 - DNA, 20 bp, human
gtgtgcatgcggggagtacg

SEQ ID NO: 303329 - DNA, 20 bp, human
gccagcggccagaggcgccc

SEQ ID NO: 303330 - DNA, 20 bp, human
ggctccgcggttcgccactg

SEQ ID NO: 303331 - DNA, 20 bp, human
gtggcgaaccgcggagctgc

SEQ ID NO: 303332 - DNA, 20 bp, human
gccagaggcgcccaggaacc

SEQ ID NO: 303333 - DNA, 20 bp, human
gcccgccgagctctccggcg

SEQ ID NO: 303334 - DNA, 20 bp, human
gagcagtggagaaaacccag

SEQ ID NO: 303335 - DNA, 20 bp, human
ggagaaaacccagcggccag

SEQ ID NO: 303336 - DNA, 20 bp, human
gcacccgcgcttaaaggcgt

SEQ ID NO: 303337 - DNA, 20 bp, human
gagcgccagtgcgactccat

SEQ ID NO: 303338 - DNA, 20 bp, human
gacctcccatggagtcgcac

SEQ ID NO: 303339 - DNA, 20 bp, human
gatgggcaggcttagattga

SEQ ID NO: 303340 - DNA, 20 bp, human
gggcagacaaaaagatgggc

SEQ ID NO: 303341 - DNA, 20 bp, human
ggggcgcgtctttgagagaa

SEQ ID NO: 303342 - DNA, 20 bp, human
ggctctaagacgcagcacct

SEQ ID NO: 303343 - DNA, 20 bp, human
gggagtcgcactggcgctgc

SEQ ID NO: 303344 - DNA, 20 bp, human
ggggaggtggtgctgagata

SEQ ID NO: 303345 - DNA, 20 bp, human
ggaatgaagcgctacactca

SEQ ID NO: 303346 - DNA, 20 bp, human
ggccggccgggctcgcaggg

SEQ ID NO: 303347 - DNA, 20 bp, human
gggcgcgcggggatccaccc

SEQ ID NO: 303348 - DNA, 20 bp, human
gccgctgcagcgcccacggg

SEQ ID NO: 303349 - DNA, 20 bp, human
gtcccaatgcgtgcccccgg

SEQ ID NO: 303350 - DNA, 20 bp, human
gcggcggcgacagagcggga

SEQ ID NO: 303351 - DNA, 20 bp, human
gcctccgcctcgggccggat

SEQ ID NO: 303352 - DNA, 20 bp, human
gctgcggggtggggccgaga

SEQ ID NO: 303353 - DNA, 20 bp, human
gggagggtccccaaccggca

SEQ ID NO: 303354 - DNA, 20 bp, human
gccgcggacacgcacgtgga

SEQ ID NO: 303355 - DNA, 20 bp, human
ggtgactgggcgccacccgt

SEQ ID NO: 303356 - DNA, 20 bp, human
gaaccggtccttctcacgat

SEQ ID NO: 303357 - DNA, 20 bp, human
gaaaaaaagcgcaactggac

SEQ ID NO: 303358 - DNA, 20 bp, human
ggtgtgcagagctgcccgaa

SEQ ID NO: 303359 - DNA, 20 bp, human
gaaagggctgaggaagagtc

SEQ ID NO: 303360 - DNA, 20 bp, human
ggaagcagcacggagggaac

SEQ ID NO: 303361 - DNA, 20 bp, human
ggcacacccagcactgcacg

SEQ ID NO: 303362 - DNA, 20 bp, human
gagaagaaggtgtagataca

SEQ ID NO: 303363 - DNA, 20 bp, human
gggaggagggagccgagaaa

SEQ ID NO: 303364 - DNA, 20 bp, human
gcacccagcactgcacgggg

SEQ ID NO: 303365 - DNA, 20 bp, human
ggaattacgtggattcgggt

SEQ ID NO: 303366 - DNA, 20 bp, human
gcccccgtccagttcctgat

SEQ ID NO: 303367 - DNA, 20 bp, human
gctagaagcagggtcaaaaa

SEQ ID NO: 303368 - DNA, 20 bp, human
gggtcaaaaaggggttgaac

SEQ ID NO: 303369 - DNA, 20 bp, human
gggcaggggaaccaaccctg

SEQ ID NO: 303370 - DNA, 20 bp, human
gcccccaacccggagttcaa

SEQ ID NO: 303371 - DNA, 20 bp, human
ggacccttgaactccgggtt

SEQ ID NO: 303372 - DNA, 20 bp, human
gcccagtccaggcaggtata

SEQ ID NO: 303373 - DNA, 20 bp, human
ggcccctatcaggaactgga

SEQ ID NO: 303374 - DNA, 20 bp, human
gcctcccaagccactgtcta

SEQ ID NO: 303375 - DNA, 20 bp, human
gaggtggccttatacctgcc

SEQ ID NO: 303376 - DNA, 20 bp, human
gggaaccgcggaggattctg

SEQ ID NO: 303377 - DNA, 20 bp, human
gtacgcgcggaggagactac

SEQ ID NO: 303378 - DNA, 20 bp, human
gtaagaggggtctcagggta

SEQ ID NO: 303379 - DNA, 20 bp, human
ggcacctgcgatcctatcgt

SEQ ID NO: 303380 - DNA, 20 bp, human
gagaaggcgagtacgcgcgg

SEQ ID NO: 303381 - DNA, 20 bp, human
gtgcagaaggcgagtacgcg

SEQ ID NO: 303382 - DNA, 20 bp, human
gcgtactcgccttctgcagg

SEQ ID NO: 303383 - DNA, 20 bp, human
gcaggccccagaatcctccg

SEQ ID NO: 303384 - DNA, 20 bp, human
ggggaatgaagcggcaacgg

SEQ ID NO: 303385 - DNA, 20 bp, human
gaagctctaagaggggtctc

SEQ ID NO: 303386 - DNA, 20 bp, human
gcaaccggacgtgacgaccc

SEQ ID NO: 303387 - DNA, 20 bp, human
ggagtctggagagttgtcgt

SEQ ID NO: 303388 - DNA, 20 bp, human
ggcactgaccaggctctgtt

SEQ ID NO: 303389 - DNA, 20 bp, human
gccccctgcgcctgctccgg

SEQ ID NO: 303390 - DNA, 20 bp, human
ggctgaagactgcgtcagtc

SEQ ID NO: 303391 - DNA, 20 bp, human
ggctggagcaaagctcggtc

SEQ ID NO: 303392 - DNA, 20 bp, human
gacgccccctgcgcctgctc

SEQ ID NO: 303393 - DNA, 20 bp, human
gtcggcttcagtgggcgggg

SEQ ID NO: 303394 - DNA, 20 bp, human
gctcggtcgggcgtcttccg

SEQ ID NO: 303395 - DNA, 20 bp, human
gtctcagcgtagggctgtga

SEQ ID NO: 303396 - DNA, 20 bp, human
gagcgctccaatggccctcg

SEQ ID NO: 303397 - DNA, 20 bp, human
ggccgcctgctggcccacgt

SEQ ID NO: 303398 - DNA, 20 bp, human
gctccccgcctgctgctcat

SEQ ID NO: 303399 - DNA, 20 bp, human
ggtagccggtgaagcgggag

SEQ ID NO: 303400 - DNA, 20 bp, human
gctccaatggccctcgaggc

SEQ ID NO: 303401 - DNA, 20 bp, human
gtggctgccggagtccaccg

SEQ ID NO: 303402 - DNA, 20 bp, human
gctcccgcccttcacacctt

SEQ ID NO: 303403 - DNA, 20 bp, human
gccggcagccaatgagcagc

SEQ ID NO: 303404 - DNA, 20 bp, human
gcgcccttcacaccttgggt

SEQ ID NO: 303405 - DNA, 20 bp, human
gacgccctctgcgtcaagaa

SEQ ID NO: 303406 - DNA, 20 bp, human
gccctccagcggaagaacag

SEQ ID NO: 303407 - DNA, 20 bp, human
gccggggcggaactcagtga

SEQ ID NO: 303408 - DNA, 20 bp, human
ggcggaactcagtgaggggc

SEQ ID NO: 303409 - DNA, 20 bp, human
gcagcggcggaactccacag

SEQ ID NO: 303410 - DNA, 20 bp, human
gcgggcgcaacctcatctta

SEQ ID NO: 303411 - DNA, 20 bp, human
ggcgcagtagttccttaaga

SEQ ID NO: 303412 - DNA, 20 bp, human
gcaatcggtgccataagatg

SEQ ID NO: 303413 - DNA, 20 bp, human
gtccttaagagggaatggtg

SEQ ID NO: 303414 - DNA, 20 bp, human
gcgcacaggggccagccaat

SEQ ID NO: 303415 - DNA, 20 bp, human
gaggacgttgcgccgtgggg

SEQ ID NO: 303416 - DNA, 20 bp, human
ggggacgcccgcagccgagt

SEQ ID NO: 303417 - DNA, 20 bp, human
gtcggctgcgggcgtccccg

SEQ ID NO: 303418 - DNA, 20 bp, human
ggcctacgcgcgggagaaag

SEQ ID NO: 303419 - DNA, 20 bp, human
ggggacttggcgcagtgccg

SEQ ID NO: 303420 - DNA, 20 bp, human
gtctcccgcgcgtaggcccc

SEQ ID NO: 303421 - DNA, 20 bp, human
gcagccgggggcctacgcgc

SEQ ID NO: 303422 - DNA, 20 bp, human
gcgtaggcccccggctggag

SEQ ID NO: 303423 - DNA, 20 bp, human
gtagcaaggcgggcgggtag

SEQ ID NO: 303424 - DNA, 20 bp, human
ggaggccgacgcgcgcccat

SEQ ID NO: 303425 - DNA, 20 bp, human
gactgcgccaagtccccgcg

SEQ ID NO: 303426 - DNA, 20 bp, human
gcctcaggagggggtgtaag

SEQ ID NO: 303427 - DNA, 20 bp, human
gtggatattgctatggaagg

SEQ ID NO: 303428 - DNA, 20 bp, human
ggggcctgtggatattgcta

SEQ ID NO: 303429 - DNA, 20 bp, human
gtcactcagtcctgagggta

SEQ ID NO: 303430 - DNA, 20 bp, human
gcaagtaggcagctttccag

SEQ ID NO: 303431 - DNA, 20 bp, human
gcttccctggcactccagtg

SEQ ID NO: 303432 - DNA, 20 bp, human
gtccagaggcgagcagccat

SEQ ID NO: 303433 - DNA, 20 bp, human
gtatccgatggcctcaggag

SEQ ID NO: 303434 - DNA, 20 bp, human
gaggagggggtgtaaggggc

SEQ ID NO: 303435 - DNA, 20 bp, human
gagaacccccgcctcagtaa

SEQ ID NO: 303436 - DNA, 20 bp, human
gtctgagcaccactgttcag

SEQ ID NO: 303437 - DNA, 20 bp, human
ggatcaatgtctcttaacta

SEQ ID NO: 303438 - DNA, 20 bp, human
gggccacatcccctgaacag

SEQ ID NO: 303439 - DNA, 20 bp, human
gctgactgaacttgtggtct

SEQ ID NO: 303440 - DNA, 20 bp, human
gtcagtcagaacacacgaag

SEQ ID NO: 303441 - DNA, 20 bp, human
gtatcgccccagcttccgag

SEQ ID NO: 303442 - DNA, 20 bp, human
gcaccactgttcaggggatg

SEQ ID NO: 303443 - DNA, 20 bp, human
gctacaccacccgtggtgtt

SEQ ID NO: 303444 - DNA, 20 bp, human
gtgggaagagaacaaatgat

SEQ ID NO: 303445 - DNA, 20 bp, human
gaagaaatgtagaatctgta

SEQ ID NO: 303446 - DNA, 20 bp, human
gagcaaagtaacacattcta

SEQ ID NO: 303447 - DNA, 20 bp, human
ggtaatctgctgttactaaa

SEQ ID NO: 303448 - DNA, 20 bp, human
gttgctgaaactgtattcaa

SEQ ID NO: 303449 - DNA, 20 bp, human
ggttctgaatgcttaggatt

SEQ ID NO: 303450 - DNA, 20 bp, human
gtatcgatgttgccacatac

SEQ ID NO: 303451 - DNA, 20 bp, human
gattcagaacctggtatgcc

SEQ ID NO: 303452 - DNA, 20 bp, human
gtttgtattccaggcatacc

SEQ ID NO: 303453 - DNA, 20 bp, human
gctattaaatccctttcttc

SEQ ID NO: 303454 - DNA, 20 bp, human
gtttagagatagccagtatg

SEQ ID NO: 303455 - DNA, 20 bp, human
gaaatggctgtttgtattcc

SEQ ID NO: 303456 - DNA, 20 bp, human
gcaacggctggaggatgtgg

SEQ ID NO: 303457 - DNA, 20 bp, human
gagcgactaacagtgagcag

SEQ ID NO: 303458 - DNA, 20 bp, human
gcagtgagcagaggaagtaa

SEQ ID NO: 303459 - DNA, 20 bp, human
ggagcaggtagggtggctca

SEQ ID NO: 303460 - DNA, 20 bp, human
gagccaacggctggaggatg

SEQ ID NO: 303461 - DNA, 20 bp, human
gaaagggggagttgtaagag

SEQ ID NO: 303462 - DNA, 20 bp, human
gcatggctacattagattca

SEQ ID NO: 303463 - DNA, 20 bp, human
ggggggagttgtaagagagg

SEQ ID NO: 303464 - DNA, 20 bp, human
ggaaaccagccaacggctgg

SEQ ID NO: 303465 - DNA, 20 bp, human
gtctgtaaagtgagggtgtc

SEQ ID NO: 303466 - DNA, 20 bp, human
ggcgacgcggacccgcgaca

SEQ ID NO: 303467 - DNA, 20 bp, human
gcccgggcagcgcgtcaaat

SEQ ID NO: 303468 - DNA, 20 bp, human
gtgacgcgctgcccggggga

SEQ ID NO: 303469 - DNA, 20 bp, human
ggcggggaaagaaaaaaggt

SEQ ID NO: 303470 - DNA, 20 bp, human
gtcggcgcatgcgcactcac

SEQ ID NO: 303471 - DNA, 20 bp, human
gagcagaaggggtcgagggt

SEQ ID NO: 303472 - DNA, 20 bp, human
ggaacagcggtgcgagctcc

SEQ ID NO: 303473 - DNA, 20 bp, human
ggtccgcgtcgccctccccc

SEQ ID NO: 303474 - DNA, 20 bp, human
gggactcgctggctagtttg

SEQ ID NO: 303475 - DNA, 20 bp, human
ggggaggggacgggttgagg

SEQ ID NO: 303476 - DNA, 20 bp, human
gccgtctgacaagtccggca

SEQ ID NO: 303477 - DNA, 20 bp, human
gtaaggcgagcaagtgggtg

SEQ ID NO: 303478 - DNA, 20 bp, human
gagggcccgtctgacaagtc

SEQ ID NO: 303479 - DNA, 20 bp, human
gctgacaagtccggcagggc

SEQ ID NO: 303480 - DNA, 20 bp, human
gcccctgccaatcaacgcac

SEQ ID NO: 303481 - DNA, 20 bp, human
gccaggggttggagtagccg

SEQ ID NO: 303482 - DNA, 20 bp, human
gagctgaagctgcaagtcaa

SEQ ID NO: 303483 - DNA, 20 bp, human
ggcccgtgcgttgattggca

SEQ ID NO: 303484 - DNA, 20 bp, human
gggggttaaggcgagcaagt

SEQ ID NO: 303485 - DNA, 20 bp, human
ggtgtggcccgtgcgttgat

SEQ ID NO: 303486 - DNA, 20 bp, human
gcgggagcaaagttgttctg

SEQ ID NO: 303487 - DNA, 20 bp, human
ggctgggagagcaggccccg

SEQ ID NO: 303488 - DNA, 20 bp, human
gccgctgcccagctagggca

SEQ ID NO: 303489 - DNA, 20 bp, human
ggccactgttcgcacacacc

SEQ ID NO: 303490 - DNA, 20 bp, human
ggcgctgggtggcgacgagt

SEQ ID NO: 303491 - DNA, 20 bp, human
ggcccccgcgcgtctcgcgc

SEQ ID NO: 303492 - DNA, 20 bp, human
gccggcgggaaccgcagtag

SEQ ID NO: 303493 - DNA, 20 bp, human
gccgcggcggggtggagcct

SEQ ID NO: 303494 - DNA, 20 bp, human
gaccaggtgtgtgcgaacag

SEQ ID NO: 303495 - DNA, 20 bp, human
gggtggcgacgagtcggcct

SEQ ID NO: 303496 - DNA, 20 bp, human
gtgacagagcgtgcgaacgc

SEQ ID NO: 303497 - DNA, 20 bp, human
gtggcgctgccttgctcctt

SEQ ID NO: 303498 - DNA, 20 bp, human
gtggagcgcggggtgtgtgg

SEQ ID NO: 303499 - DNA, 20 bp, human
gggaaagtccagcggagcgc

SEQ ID NO: 303500 - DNA, 20 bp, human
ggggctctggcccagcgggt

SEQ ID NO: 303501 - DNA, 20 bp, human
ggggtgggataccagctggg

SEQ ID NO: 303502 - DNA, 20 bp, human
gtggaaatcggcccgaaact

SEQ ID NO: 303503 - DNA, 20 bp, human
ggagcacggtcgctgtccga

SEQ ID NO: 303504 - DNA, 20 bp, human
gcgtgcgatcggcaatcccc

SEQ ID NO: 303505 - DNA, 20 bp, human
gctccggcctcgcgccgctc

SEQ ID NO: 303506 - DNA, 20 bp, human
ggtgaactgcggagcattgt

SEQ ID NO: 303507 - DNA, 20 bp, human
gcagccctgtgctcggctga

SEQ ID NO: 303508 - DNA, 20 bp, human
gtgaacgacgaaggggtgtg

SEQ ID NO: 303509 - DNA, 20 bp, human
ggatttgggtctttggagaa

SEQ ID NO: 303510 - DNA, 20 bp, human
gaagaggcatttaacacaac

SEQ ID NO: 303511 - DNA, 20 bp, human
gagaaccctcagccgagcac

SEQ ID NO: 303512 - DNA, 20 bp, human
gtaactcgaagctggttctg

SEQ ID NO: 303513 - DNA, 20 bp, human
gtcggctgagggttctcagc

SEQ ID NO: 303514 - DNA, 20 bp, human
gtgatcttacatcacgcaag

SEQ ID NO: 303515 - DNA, 20 bp, human
ggtgagagatgccagcggat

SEQ ID NO: 303516 - DNA, 20 bp, human
ggactggcgcgggtagaaaa

SEQ ID NO: 303517 - DNA, 20 bp, human
gcgccccggaacaagcatgc

SEQ ID NO: 303518 - DNA, 20 bp, human
gccgcgctgcaaagtgcagg

SEQ ID NO: 303519 - DNA, 20 bp, human
gaacacacgcgtgctcacac

SEQ ID NO: 303520 - DNA, 20 bp, human
gtccccgtgagccgcctcgc

SEQ ID NO: 303521 - DNA, 20 bp, human
gttcccgcatgcttgttccg

SEQ ID NO: 303522 - DNA, 20 bp, human
gaaaccctgcggagaggcga

SEQ ID NO: 303523 - DNA, 20 bp, human
gtccccgcgctgcaaagtgc

SEQ ID NO: 303524 - DNA, 20 bp, human
gcaagcatgcgggaatccag

SEQ ID NO: 303525 - DNA, 20 bp, human
gcggggcggtcgggtctaaa

SEQ ID NO: 303526 - DNA, 20 bp, human
gcacccgcggggccggacag

SEQ ID NO: 303527 - DNA, 20 bp, human
gcggccgggtccgctctccc

SEQ ID NO: 303528 - DNA, 20 bp, human
gcgtgcgcagggtaagtcag

SEQ ID NO: 303529 - DNA, 20 bp, human
gacggcgagcgcgaactcga

SEQ ID NO: 303530 - DNA, 20 bp, human
gcctcccgggagagcggacc

SEQ ID NO: 303531 - DNA, 20 bp, human
gcggccccgcgggtgctgtc

SEQ ID NO: 303532 - DNA, 20 bp, human
ggtaagtcagtgggcgtgag

SEQ ID NO: 303533 - DNA, 20 bp, human
gaaagggcgggcgcactacc

SEQ ID NO: 303534 - DNA, 20 bp, human
ggggctccgcggccgccatg

SEQ ID NO: 303535 - DNA, 20 bp, human
ggagaggccgcagcacgctg

SEQ ID NO: 303536 - DNA, 20 bp, human
gcgctccagcccagtgctcc

SEQ ID NO: 303537 - DNA, 20 bp, human
gtaggggtggcacaaggcta

SEQ ID NO: 303538 - DNA, 20 bp, human
gagcacagccggctccagga

SEQ ID NO: 303539 - DNA, 20 bp, human
gacgccccgcctcggggtgc

SEQ ID NO: 303540 - DNA, 20 bp, human
gtgtccagcaccccgaggcg

SEQ ID NO: 303541 - DNA, 20 bp, human
gggagagagaggacggctta

SEQ ID NO: 303542 - DNA, 20 bp, human
gacggcttagggacctcata

SEQ ID NO: 303543 - DNA, 20 bp, human
gcccacgaattgatccctcc

SEQ ID NO: 303544 - DNA, 20 bp, human
gagagctgtccagcaccccg

SEQ ID NO: 303545 - DNA, 20 bp, human
gggaccggggagcgaggact

SEQ ID NO: 303546 - DNA, 20 bp, human
ggtcccccgaccccacccgc

SEQ ID NO: 303547 - DNA, 20 bp, human
gcaggaggcgccggcgggtg

SEQ ID NO: 303548 - DNA, 20 bp, human
gccggggccgagggcgggaa

SEQ ID NO: 303549 - DNA, 20 bp, human
ggggtggggtcgggggacca

SEQ ID NO: 303550 - DNA, 20 bp, human
gaccagggagccggggccga

SEQ ID NO: 303551 - DNA, 20 bp, human
gagtaatagcgacagggagg

SEQ ID NO: 303552 - DNA, 20 bp, human
gcccgccggcgcctcctgcg

SEQ ID NO: 303553 - DNA, 20 bp, human
gcatagagctggagtgagcg

SEQ ID NO: 303554 - DNA, 20 bp, human
gggccccgcgcaggaggcgc

SEQ ID NO: 303555 - DNA, 20 bp, human
gcccgccaggggaccgggag

SEQ ID NO: 303556 - DNA, 20 bp, human
gccagcggcgcaggtccccg

SEQ ID NO: 303557 - DNA, 20 bp, human
gcgcgggcgccccccggagc

SEQ ID NO: 303558 - DNA, 20 bp, human
gggggcccggcggccgatcg

SEQ ID NO: 303559 - DNA, 20 bp, human
ggcagggcggggttgcccaa

SEQ ID NO: 303560 - DNA, 20 bp, human
ggaacagggagagaagtggc

SEQ ID NO: 303561 - DNA, 20 bp, human
gctggtccgcggcgcccgag

SEQ ID NO: 303562 - DNA, 20 bp, human
ggaggtgcctccgggaggct

SEQ ID NO: 303563 - DNA, 20 bp, human
ggggagagaagtggccggct

SEQ ID NO: 303564 - DNA, 20 bp, human
ggcgcctccgcctcccccct

SEQ ID NO: 303565 - DNA, 20 bp, human
gaattcataactaaggtaga

SEQ ID NO: 303566 - DNA, 20 bp, human
gcctcccggcggcgccccca

SEQ ID NO: 303567 - DNA, 20 bp, human
ggggcggctgcgtcagcggg

SEQ ID NO: 303568 - DNA, 20 bp, human
gggggcccgggggcagatct

SEQ ID NO: 303569 - DNA, 20 bp, human
ggccgccggccggctccctg

SEQ ID NO: 303570 - DNA, 20 bp, human
gcggctgcgtcagcgggggg

SEQ ID NO: 303571 - DNA, 20 bp, human
gacggggcggggctgcccaa

SEQ ID NO: 303572 - DNA, 20 bp, human
ggcgcgggcggctgcgtcag

SEQ ID NO: 303573 - DNA, 20 bp, human
gcccgggccgctggggccgt

SEQ ID NO: 303574 - DNA, 20 bp, human
ggcgggccccacggccccag

SEQ ID NO: 303575 - DNA, 20 bp, human
gagcctggggtcccatggtg

SEQ ID NO: 303576 - DNA, 20 bp, human
gactgcctcctgtacggcca

SEQ ID NO: 303577 - DNA, 20 bp, human
gtcgcggcgaccctaggagg

SEQ ID NO: 303578 - DNA, 20 bp, human
gtagcagaggcgaactggga

SEQ ID NO: 303579 - DNA, 20 bp, human
ggaggcagtaccgggagaag

SEQ ID NO: 303580 - DNA, 20 bp, human
gagaccctgggagaggttct

SEQ ID NO: 303581 - DNA, 20 bp, human
gtggtcgggactactttctg

SEQ ID NO: 303582 - DNA, 20 bp, human
gaggcggcgttgaacaacat

SEQ ID NO: 303583 - DNA, 20 bp, human
gctcacgccctccgcgggga

SEQ ID NO: 303584 - DNA, 20 bp, human
gtgggctagcagaggcgaac

SEQ ID NO: 303585 - DNA, 20 bp, human
gctcctgtacggccagggaa

SEQ ID NO: 303586 - DNA, 20 bp, human
ggcgcccgctgagagaagag

SEQ ID NO: 303587 - DNA, 20 bp, human
gagaagagtggacgaaagac

SEQ ID NO: 303588 - DNA, 20 bp, human
gcgctccacggccctgctct

SEQ ID NO: 303589 - DNA, 20 bp, human
gagagtggacgaaagacagg

SEQ ID NO: 303590 - DNA, 20 bp, human
gggacccctgcacctgtcat

SEQ ID NO: 303591 - DNA, 20 bp, human
ggaggtgacaggcggatcag

SEQ ID NO: 303592 - DNA, 20 bp, human
gtcgtccactcttctctcag

SEQ ID NO: 303593 - DNA, 20 bp, human
gctgggctcgcctgagtgct

SEQ ID NO: 303594 - DNA, 20 bp, human
ggctctgcagacgcagggat

SEQ ID NO: 303595 - DNA, 20 bp, human
gggagcccatgacaggtgca

SEQ ID NO: 303596 - DNA, 20 bp, human
gagtctgcagcctcgggccg

SEQ ID NO: 303597 - DNA, 20 bp, human
ggcaggcgcaagcgtttccc

SEQ ID NO: 303598 - DNA, 20 bp, human
gctctggcaggggatacaac

SEQ ID NO: 303599 - DNA, 20 bp, human
gggccgcggcgtggttgcct

SEQ ID NO: 303600 - DNA, 20 bp, human
gcgcctaggaagccctgcgc

SEQ ID NO: 303601 - DNA, 20 bp, human
gaggcgctggagtccgccgg

SEQ ID NO: 303602 - DNA, 20 bp, human
gcctaggcgctggagtccgc

SEQ ID NO: 303603 - DNA, 20 bp, human
ggcaaccacgccgcggcccg

SEQ ID NO: 303604 - DNA, 20 bp, human
gcaaacgcggcccggttctt

SEQ ID NO: 303605 - DNA, 20 bp, human
gacccaccgcgcggtctcct

SEQ ID NO: 303606 - DNA, 20 bp, human
gcacccctgcactcctctgt

SEQ ID NO: 303607 - DNA, 20 bp, human
gccaaatgtggggggagcga

SEQ ID NO: 303608 - DNA, 20 bp, human
gccgggcgtgccaaatgtgg

SEQ ID NO: 303609 - DNA, 20 bp, human
gtcctcccaggttggcgcag

SEQ ID NO: 303610 - DNA, 20 bp, human
ggggagcgacggattgtttt

SEQ ID NO: 303611 - DNA, 20 bp, human
gtaccaacagaggagtgcag

SEQ ID NO: 303612 - DNA, 20 bp, human
gcaagaggtcaactcctccc

SEQ ID NO: 303613 - DNA, 20 bp, human
gccagatcggagacggaaga

SEQ ID NO: 303614 - DNA, 20 bp, human
gaagatcccaggacgtggga

SEQ ID NO: 303615 - DNA, 20 bp, human
ggcgacggattgttttaggt

SEQ ID NO: 303616 - DNA, 20 bp, human
gtgcgcgaggaccccgatgg

SEQ ID NO: 303617 - DNA, 20 bp, human
gcggccctgctaagggagaa

SEQ ID NO: 303618 - DNA, 20 bp, human
ggggctcgcgcccgggaaac

SEQ ID NO: 303619 - DNA, 20 bp, human
gggaaaccggcagtcggcgg

SEQ ID NO: 303620 - DNA, 20 bp, human
gcgagaacccggccctgcta

SEQ ID NO: 303621 - DNA, 20 bp, human
gctgccagctgcgcgctcgg

SEQ ID NO: 303622 - DNA, 20 bp, human
ggggactgaccacctggatc

SEQ ID NO: 303623 - DNA, 20 bp, human
gaagggaagccgtttcccgc

SEQ ID NO: 303624 - DNA, 20 bp, human
gcgcccgggaaaccggcagt

SEQ ID NO: 303625 - DNA, 20 bp, human
gtctcgccgtggttgcgtac

SEQ ID NO: 303626 - DNA, 20 bp, human
gcaggtcagtcgaccctctc

SEQ ID NO: 303627 - DNA, 20 bp, human
ggctggcggtctgcttactc

SEQ ID NO: 303628 - DNA, 20 bp, human
ggggcggtcctgtgtgaccc

SEQ ID NO: 303629 - DNA, 20 bp, human
gcccgagggatgctccgctc

SEQ ID NO: 303630 - DNA, 20 bp, human
gggcgacctgcatccagaga

SEQ ID NO: 303631 - DNA, 20 bp, human
ggcatcgggccgtttgagga

SEQ ID NO: 303632 - DNA, 20 bp, human
gcttactccggcaaagacgg

SEQ ID NO: 303633 - DNA, 20 bp, human
ggctccgctccgggttttcc

SEQ ID NO: 303634 - DNA, 20 bp, human
ggatgcgcccccgtctttgc

SEQ ID NO: 303635 - DNA, 20 bp, human
gggtcgactgacctgcgggc

SEQ ID NO: 303636 - DNA, 20 bp, human
gttggggcttaggtgattaa

SEQ ID NO: 303637 - DNA, 20 bp, human
ggacagcgcaacagtccggc

SEQ ID NO: 303638 - DNA, 20 bp, human
gggacactcaagttgctatc

SEQ ID NO: 303639 - DNA, 20 bp, human
gcggcgacagcgcaacagtc

SEQ ID NO: 303640 - DNA, 20 bp, human
gataaaggggattggggctt

SEQ ID NO: 303641 - DNA, 20 bp, human
gaggttgataaaggggattg

SEQ ID NO: 303642 - DNA, 20 bp, human
gcagactcactgagcggggc

SEQ ID NO: 303643 - DNA, 20 bp, human
gctaccctcccattataact

SEQ ID NO: 303644 - DNA, 20 bp, human
gtccccaagttataatggga

SEQ ID NO: 303645 - DNA, 20 bp, human
gaatgaaaaaaggttgataa

SEQ ID NO: 303646 - DNA, 20 bp, human
ggccaaggcgccaccctagt

SEQ ID NO: 303647 - DNA, 20 bp, human
ggcacgccgctggacgtgaa

SEQ ID NO: 303648 - DNA, 20 bp, human
ggctccgcggtgggctggat

SEQ ID NO: 303649 - DNA, 20 bp, human
gcggctgccaatgaggcgga

SEQ ID NO: 303650 - DNA, 20 bp, human
gaaggcgaaggaaacgctgg

SEQ ID NO: 303651 - DNA, 20 bp, human
ggccggggcggggaatctct

SEQ ID NO: 303652 - DNA, 20 bp, human
gactagaggctcacaaggag

SEQ ID NO: 303653 - DNA, 20 bp, human
gcccgacgctgtttggtgtg

SEQ ID NO: 303654 - DNA, 20 bp, human
gtcagtgccaggcttggccg

SEQ ID NO: 303655 - DNA, 20 bp, human
gcgtgcggctgccaatgagg

SEQ ID NO: 303656 - DNA, 20 bp, human
ggcccgccgcgcatccgcat

SEQ ID NO: 303657 - DNA, 20 bp, human
gtcccgcgcagccgtcgcgg

SEQ ID NO: 303658 - DNA, 20 bp, human
gtggctgtcggcccccgcga

SEQ ID NO: 303659 - DNA, 20 bp, human
gcgggggccgacagccaatg

SEQ ID NO: 303660 - DNA, 20 bp, human
gggctgcgcgggagattcgc

SEQ ID NO: 303661 - DNA, 20 bp, human
gcctgggcagccagtccgtc

SEQ ID NO: 303662 - DNA, 20 bp, human
gtggacgatcgcaagcgcgg

SEQ ID NO: 303663 - DNA, 20 bp, human
gggcccccgcgacggctgcg

SEQ ID NO: 303664 - DNA, 20 bp, human
gtgtccgaggcccgacggac

SEQ ID NO: 303665 - DNA, 20 bp, human
gggaggcgtcaacgtcatcg

SEQ ID NO: 303666 - DNA, 20 bp, human
gagcatgcgcgaggccgcac

SEQ ID NO: 303667 - DNA, 20 bp, human
gagccgggaacgttgcactc

SEQ ID NO: 303668 - DNA, 20 bp, human
gcatgctccgtcagtaaagg

SEQ ID NO: 303669 - DNA, 20 bp, human
ggcgggcgcgcggatgacgt

SEQ ID NO: 303670 - DNA, 20 bp, human
ggggaatcctggggtagcaa

SEQ ID NO: 303671 - DNA, 20 bp, human
gttcccgagtgcaacgttcc

SEQ ID NO: 303672 - DNA, 20 bp, human
gccggctcgcgccccacaca

SEQ ID NO: 303673 - DNA, 20 bp, human
gcggcttccacctttactga

SEQ ID NO: 303674 - DNA, 20 bp, human
gtgactgcggcccggaacag

SEQ ID NO: 303675 - DNA, 20 bp, human
gccctagcagtggatctcgt

SEQ ID NO: 303676 - DNA, 20 bp, human
gccccgtggcagggccccca

SEQ ID NO: 303677 - DNA, 20 bp, human
ggtgaagggcacacgccttg

SEQ ID NO: 303678 - DNA, 20 bp, human
gctcggggcacgcagccgtt

SEQ ID NO: 303679 - DNA, 20 bp, human
gcacctcccccaccagtcaa

SEQ ID NO: 303680 - DNA, 20 bp, human
gtgactgctattttggtcct

SEQ ID NO: 303681 - DNA, 20 bp, human
gccagccctgccatgggcac

SEQ ID NO: 303682 - DNA, 20 bp, human
gacctgcccgctggcctcac

SEQ ID NO: 303683 - DNA, 20 bp, human
gacgggctgcctttctgtgt

SEQ ID NO: 303684 - DNA, 20 bp, human
gcagctaaagataggcgtga

SEQ ID NO: 303685 - DNA, 20 bp, human
ggggaactggttaccgagtg

SEQ ID NO: 303686 - DNA, 20 bp, human
gacggtggccaatgcagtga

SEQ ID NO: 303687 - DNA, 20 bp, human
gctggcatccctaaatgtaa

SEQ ID NO: 303688 - DNA, 20 bp, human
gacatgcaggcactgcactg

SEQ ID NO: 303689 - DNA, 20 bp, human
ggtcccgggctgacactaca

SEQ ID NO: 303690 - DNA, 20 bp, human
ggtaccctgtagtgtcagcc

SEQ ID NO: 303691 - DNA, 20 bp, human
ggagacaaggaccccgagaa

SEQ ID NO: 303692 - DNA, 20 bp, human
gactacagggtacacatagc

SEQ ID NO: 303693 - DNA, 20 bp, human
ggtaaactcccctctcacgg

SEQ ID NO: 303694 - DNA, 20 bp, human
gccctgggaggggggactgt

SEQ ID NO: 303695 - DNA, 20 bp, human
gcacttagggaggggtttac

SEQ ID NO: 303696 - DNA, 20 bp, human
gcggcctcgcaccggtgcgg

SEQ ID NO: 303697 - DNA, 20 bp, human
gggacccagcgctcgggcac

SEQ ID NO: 303698 - DNA, 20 bp, human
ggcggaggccggctctcgcg

SEQ ID NO: 303699 - DNA, 20 bp, human
gaccgcacagcgtctctcct

SEQ ID NO: 303700 - DNA, 20 bp, human
ggagcccgggagccatctgc

SEQ ID NO: 303701 - DNA, 20 bp, human
gggccggcctcgcaccggtg

SEQ ID NO: 303702 - DNA, 20 bp, human
gctcgcaccggtgcggaggc

SEQ ID NO: 303703 - DNA, 20 bp, human
gggccggctctcgcgaggtg

SEQ ID NO: 303704 - DNA, 20 bp, human
gctcctgccgggctccggct

SEQ ID NO: 303705 - DNA, 20 bp, human
gccggaggccggcctcgcac

SEQ ID NO: 303706 - DNA, 20 bp, human
gacgcgggagccagcgagaa

SEQ ID NO: 303707 - DNA, 20 bp, human
gacgctgccccccgccccga

SEQ ID NO: 303708 - DNA, 20 bp, human
ggcacaccggccagctcacg

SEQ ID NO: 303709 - DNA, 20 bp, human
gtcgcgccgacccttctcgc

SEQ ID NO: 303710 - DNA, 20 bp, human
ggccccgaaggcccggacac

SEQ ID NO: 303711 - DNA, 20 bp, human
gggctcccgcgtgagctggc

SEQ ID NO: 303712 - DNA, 20 bp, human
ggacaccgggcgacgcacac

SEQ ID NO: 303713 - DNA, 20 bp, human
gtccccccgcctcggagcgc

SEQ ID NO: 303714 - DNA, 20 bp, human
ggccccccgccccgaaggcc

SEQ ID NO: 303715 - DNA, 20 bp, human
gcagccgcccctgaccggag

SEQ ID NO: 303716 - DNA, 20 bp, human
gaggcagagctcattggatg

SEQ ID NO: 303717 - DNA, 20 bp, human
ggagtgtcacacagacaaac

SEQ ID NO: 303718 - DNA, 20 bp, human
gaggaaacggaccacttttg

SEQ ID NO: 303719 - DNA, 20 bp, human
gtgtgtgacactccagtgga

SEQ ID NO: 303720 - DNA, 20 bp, human
gcagactgtctccacaaaag

SEQ ID NO: 303721 - DNA, 20 bp, human
ggcctataatagcgatcctg

SEQ ID NO: 303722 - DNA, 20 bp, human
gaccgcagcacacttttcag

SEQ ID NO: 303723 - DNA, 20 bp, human
gtccccaggatcgctattat

SEQ ID NO: 303724 - DNA, 20 bp, human
ggatcgctattataggctct

SEQ ID NO: 303725 - DNA, 20 bp, human
ggaagatttgagatctgcgt

SEQ ID NO: 303726 - DNA, 20 bp, human
gtggccgttgccatagacag

SEQ ID NO: 303727 - DNA, 20 bp, human
gccaactgcaggaatcacag

SEQ ID NO: 303728 - DNA, 20 bp, human
ggaatcagagcccctgtcta

SEQ ID NO: 303729 - DNA, 20 bp, human
gtgcaaagtgagaggacgga

SEQ ID NO: 303730 - DNA, 20 bp, human
gcaagcggatgtggctacac

SEQ ID NO: 303731 - DNA, 20 bp, human
gcaccagcctgcaaagtgag

SEQ ID NO: 303732 - DNA, 20 bp, human
gaatcacagggggtgagccc

SEQ ID NO: 303733 - DNA, 20 bp, human
gggcttgcctgccacgagga

SEQ ID NO: 303734 - DNA, 20 bp, human
ggagaggacggaaggctgaa

SEQ ID NO: 303735 - DNA, 20 bp, human
ggcctggcttgcctgccacg

SEQ ID NO: 303736 - DNA, 20 bp, human
gacctgttcactgggtacaa

SEQ ID NO: 303737 - DNA, 20 bp, human
gtctagtcaatcttttgcta

SEQ ID NO: 303738 - DNA, 20 bp, human
gacctttgtacccagtgaac

SEQ ID NO: 303739 - DNA, 20 bp, human
gttttaaatcacctgttcac

SEQ ID NO: 303740 - DNA, 20 bp, human
gagaaagaaacacaaaggtt

SEQ ID NO: 303741 - DNA, 20 bp, human
gaattaagaaacacaaaggt

SEQ ID NO: 303742 - DNA, 20 bp, human
gagaaacacaaaggtaggct

SEQ ID NO: 303743 - DNA, 20 bp, human
gttttttagtataacaagta

SEQ ID NO: 303744 - DNA, 20 bp, human
ggagtaattaagaaacacaa

SEQ ID NO: 303745 - DNA, 20 bp, human
gaggctcccggcactgcacc

SEQ ID NO: 303746 - DNA, 20 bp, human
gtcacactggagatcccgga

SEQ ID NO: 303747 - DNA, 20 bp, human
ggatcccggagggtgtggaa

SEQ ID NO: 303748 - DNA, 20 bp, human
gtggccggctgcagcgcgca

SEQ ID NO: 303749 - DNA, 20 bp, human
ggcaccctgcgcgctgcagc

SEQ ID NO: 303750 - DNA, 20 bp, human
gacgaagtctgttttgtctc

SEQ ID NO: 303751 - DNA, 20 bp, human
ggcagatagtccctgggccg

SEQ ID NO: 303752 - DNA, 20 bp, human
gaaacagacttcgtagggga

SEQ ID NO: 303753 - DNA, 20 bp, human
gtgggaacccagccagacgc

SEQ ID NO: 303754 - DNA, 20 bp, human
gggccggggctcgcgctggc

SEQ ID NO: 303755 - DNA, 20 bp, human
gcagcgcgagccccggccca

SEQ ID NO: 303756 - DNA, 20 bp, human
ggggacgcgcagtacatccc

SEQ ID NO: 303757 - DNA, 20 bp, human
gacaaagcggttactccctg

SEQ ID NO: 303758 - DNA, 20 bp, human
gagggggcggagatacagag

SEQ ID NO: 303759 - DNA, 20 bp, human
gctagagggagaacgcctga

SEQ ID NO: 303760 - DNA, 20 bp, human
gcccgccgcggcgccggtcc

SEQ ID NO: 303761 - DNA, 20 bp, human
gcgcgggggtggcgcgcgga

SEQ ID NO: 303762 - DNA, 20 bp, human
gccaatcccggcgccaggac

SEQ ID NO: 303763 - DNA, 20 bp, human
gccagattgggttttctcga

SEQ ID NO: 303764 - DNA, 20 bp, human
ggggcacccgaagtcatcat

SEQ ID NO: 303765 - DNA, 20 bp, human
gtaggaccggggctccagat

SEQ ID NO: 303766 - DNA, 20 bp, human
gggctgagaagcgagaagag

SEQ ID NO: 303767 - DNA, 20 bp, human
gcgtcacccaagaccttaaa

SEQ ID NO: 303768 - DNA, 20 bp, human
gaacccggatgaggcgcgga

SEQ ID NO: 303769 - DNA, 20 bp, human
ggaggcgcggaaggggcgtt

SEQ ID NO: 303770 - DNA, 20 bp, human
gaagatgtccggtcccttta

SEQ ID NO: 303771 - DNA, 20 bp, human
gcgtcccgggaacccggatg

SEQ ID NO: 303772 - DNA, 20 bp, human
ggcgcctcatccgggttccc

SEQ ID NO: 303773 - DNA, 20 bp, human
gcaggtagacctttggaagg

SEQ ID NO: 303774 - DNA, 20 bp, human
gccaccaagccaccttccaa

SEQ ID NO: 303775 - DNA, 20 bp, human
gcttcgaagcaaaaagggcg

SEQ ID NO: 303776 - DNA, 20 bp, human
gggcgcgcgccgtggggagc

SEQ ID NO: 303777 - DNA, 20 bp, human
gggcctgcgctcgagacgtc

SEQ ID NO: 303778 - DNA, 20 bp, human
gccggagtcgggtgcgcggg

SEQ ID NO: 303779 - DNA, 20 bp, human
gactccggcgccctccggat

SEQ ID NO: 303780 - DNA, 20 bp, human
gccggacaccccgctcccca

SEQ ID NO: 303781 - DNA, 20 bp, human
ggagcgcaggccaatccgga

SEQ ID NO: 303782 - DNA, 20 bp, human
gcaaggacagcgccgggtgg

SEQ ID NO: 303783 - DNA, 20 bp, human
gcctgccagcgcacgtgcga

SEQ ID NO: 303784 - DNA, 20 bp, human
gggctcgaagggcacggcca

SEQ ID NO: 303785 - DNA, 20 bp, human
ggccaccgccgcagtaggag

SEQ ID NO: 303786 - DNA, 20 bp, human
gggaagaggaactggtgtct

SEQ ID NO: 303787 - DNA, 20 bp, human
ggcctcaaggttctcaccag

SEQ ID NO: 303788 - DNA, 20 bp, human
ggatgaggtggcagtcggtt

SEQ ID NO: 303789 - DNA, 20 bp, human
gtcggttggggtgctaatag

SEQ ID NO: 303790 - DNA, 20 bp, human
gggttctcaccagaggtgga

SEQ ID NO: 303791 - DNA, 20 bp, human
gtcactgggttctagcaaga

SEQ ID NO: 303792 - DNA, 20 bp, human
gtgcaagaactcagtgggag

SEQ ID NO: 303793 - DNA, 20 bp, human
gatagaggacatgaagtcac

SEQ ID NO: 303794 - DNA, 20 bp, human
gaccttgaggccctgcaagg

SEQ ID NO: 303795 - DNA, 20 bp, human
gatcaagaagcgagttgatg

SEQ ID NO: 303796 - DNA, 20 bp, human
gagcctgggtggggtcgaga

SEQ ID NO: 303797 - DNA, 20 bp, human
ggcaccgccagccacctgtc

SEQ ID NO: 303798 - DNA, 20 bp, human
ggggcgcccggtggtggaca

SEQ ID NO: 303799 - DNA, 20 bp, human
gcgcccggtggtggacaagg

SEQ ID NO: 303800 - DNA, 20 bp, human
ggtgtcctgctgctcaggtc

SEQ ID NO: 303801 - DNA, 20 bp, human
gcaagcgtggatccagccgt

SEQ ID NO: 303802 - DNA, 20 bp, human
gctcggcgggcgcccggtgg

SEQ ID NO: 303803 - DNA, 20 bp, human
gccaacgtgcacatgcggag

SEQ ID NO: 303804 - DNA, 20 bp, human
gacgggctccagggacgcac

SEQ ID NO: 303805 - DNA, 20 bp, human
ggtcgagacgggtgaggagc

SEQ ID NO: 303806 - DNA, 20 bp, human
gcgcggcagggggtcgggtg

SEQ ID NO: 303807 - DNA, 20 bp, human
ggggcaagtagagaccgcga

SEQ ID NO: 303808 - DNA, 20 bp, human
ggtctccatggcgaccgcgt

SEQ ID NO: 303809 - DNA, 20 bp, human
gtgtgatgcgcctgcgcgag

SEQ ID NO: 303810 - DNA, 20 bp, human
gcgcctgcgggattccgtac

SEQ ID NO: 303811 - DNA, 20 bp, human
ggaaaaacggatgctaccgt

SEQ ID NO: 303812 - DNA, 20 bp, human
gggaggccacccagccaacg

SEQ ID NO: 303813 - DNA, 20 bp, human
gggtttgtgcctgcgtgcgg

SEQ ID NO: 303814 - DNA, 20 bp, human
ggtgtggtgcgcctgcgctg

SEQ ID NO: 303815 - DNA, 20 bp, human
ggggtgcccctgcgcggcag

SEQ ID NO: 303816 - DNA, 20 bp, human
gtgaaagcgcgagaacacag

SEQ ID NO: 303817 - DNA, 20 bp, human
gaacacaggggattatcgcg

SEQ ID NO: 303818 - DNA, 20 bp, human
gaacccgcgccagagggagc

SEQ ID NO: 303819 - DNA, 20 bp, human
gtgccaagcgatctgtgtat

SEQ ID NO: 303820 - DNA, 20 bp, human
gggaagcaagagtagagccg

SEQ ID NO: 303821 - DNA, 20 bp, human
gccccagctccctctggcgc

SEQ ID NO: 303822 - DNA, 20 bp, human
gatagaggaagtagcgctct

SEQ ID NO: 303823 - DNA, 20 bp, human
ggggcggagcgccgggcgtc

SEQ ID NO: 303824 - DNA, 20 bp, human
gaactggcggttcccgaagt

SEQ ID NO: 303825 - DNA, 20 bp, human
gctactcttgcttccggctc

SEQ ID NO: 303826 - DNA, 20 bp, human
gggaggcggcagggatgcga

SEQ ID NO: 303827 - DNA, 20 bp, human
gccaaagctcaggaccgcga

SEQ ID NO: 303828 - DNA, 20 bp, human
gtcggcagctcatgcacttc

SEQ ID NO: 303829 - DNA, 20 bp, human
gaagccttgcgcagtggggg

SEQ ID NO: 303830 - DNA, 20 bp, human
gtcgctctcccgtgtttccc

SEQ ID NO: 303831 - DNA, 20 bp, human
gcccactgcgcaaggctttc

SEQ ID NO: 303832 - DNA, 20 bp, human
gagtgcatgagctgccgatg

SEQ ID NO: 303833 - DNA, 20 bp, human
gctcaggcctagctctggac

SEQ ID NO: 303834 - DNA, 20 bp, human
ggcgaggcaaatacccagcc

SEQ ID NO: 303835 - DNA, 20 bp, human
gcctccgcccccactgcgca

SEQ ID NO: 303836 - DNA, 20 bp, human
gggaaggggcggggcatgta

SEQ ID NO: 303837 - DNA, 20 bp, human
ggcggggcatgtaaggagac

SEQ ID NO: 303838 - DNA, 20 bp, human
gcatgtaaggagaccggaac

SEQ ID NO: 303839 - DNA, 20 bp, human
gggcttgagggcgggttctg

SEQ ID NO: 303840 - DNA, 20 bp, human
ggggatttgtggttaggcgg

SEQ ID NO: 303841 - DNA, 20 bp, human
gcggggcgaaaggcggagac

SEQ ID NO: 303842 - DNA, 20 bp, human
gcggaacgggatttgtggtt

SEQ ID NO: 303843 - DNA, 20 bp, human
ggagaccggaacgggatttg

SEQ ID NO: 303844 - DNA, 20 bp, human
ggtactaagacccaggtcgc

SEQ ID NO: 303845 - DNA, 20 bp, human
gacccaggtcgcaggggctg

SEQ ID NO: 303846 - DNA, 20 bp, human
gtgactgggtacatgcaaac

SEQ ID NO: 303847 - DNA, 20 bp, human
gccaacagtccgtacttgtg

SEQ ID NO: 303848 - DNA, 20 bp, human
ggtacatgcaaacaggtcac

SEQ ID NO: 303849 - DNA, 20 bp, human
gtacccagtcaataaaactc

SEQ ID NO: 303850 - DNA, 20 bp, human
gctgccttgtggcattcaga

SEQ ID NO: 303851 - DNA, 20 bp, human
gagagcaggccacacaagta

SEQ ID NO: 303852 - DNA, 20 bp, human
gttgggtatcacagttgagc

SEQ ID NO: 303853 - DNA, 20 bp, human
gggactgttggcaggattgc

SEQ ID NO: 303854 - DNA, 20 bp, human
gtgcctgagttttattgact

SEQ ID NO: 303855 - DNA, 20 bp, human
gacaactttacagtgaaact

SEQ ID NO: 303856 - DNA, 20 bp, human
gagaaggcagaggtcgctga

SEQ ID NO: 303857 - DNA, 20 bp, human
ggtggggggcagtcatgtag

SEQ ID NO: 303858 - DNA, 20 bp, human
gaggtggtgcggcagggagt

SEQ ID NO: 303859 - DNA, 20 bp, human
ggtatctcacacaatgaaat

SEQ ID NO: 303860 - DNA, 20 bp, human
gaaagaaaggtggtgcggca

SEQ ID NO: 303861 - DNA, 20 bp, human
gctggggacagctttgcaaa

SEQ ID NO: 303862 - DNA, 20 bp, human
gaaaaggagcttatgtgcaa

SEQ ID NO: 303863 - DNA, 20 bp, human
gaataagaatgatgtaaccc

SEQ ID NO: 303864 - DNA, 20 bp, human
gccaccccactgaaacatgt

SEQ ID NO: 303865 - DNA, 20 bp, human
gggagcttatgtgcaaagga

SEQ ID NO: 303866 - DNA, 20 bp, human
ggggccgcgaactgcacgtg

SEQ ID NO: 303867 - DNA, 20 bp, human
ggcacccaccgctctccaag

SEQ ID NO: 303868 - DNA, 20 bp, human
ggccccgcggggtccggagg

SEQ ID NO: 303869 - DNA, 20 bp, human
gcaaacaggcgaggtgacgg

SEQ ID NO: 303870 - DNA, 20 bp, human
gaccccacggcctcgccaga

SEQ ID NO: 303871 - DNA, 20 bp, human
gccacggcctcgccagaggg

SEQ ID NO: 303872 - DNA, 20 bp, human
gccttcccggccgaggtccc

SEQ ID NO: 303873 - DNA, 20 bp, human
gtgaccccggggtctggcgc

SEQ ID NO: 303874 - DNA, 20 bp, human
gtaaaccgaggcacggggcc

SEQ ID NO: 303875 - DNA, 20 bp, human
gtctgccagtaagtcagctg

SEQ ID NO: 303876 - DNA, 20 bp, human
gcatctggatggtccgaagg

SEQ ID NO: 303877 - DNA, 20 bp, human
gaggagttcccgaggtttga

SEQ ID NO: 303878 - DNA, 20 bp, human
ggaaggaggtgacatctgga

SEQ ID NO: 303879 - DNA, 20 bp, human
gcctggtggccccgcccttt

SEQ ID NO: 303880 - DNA, 20 bp, human
ggcggagcccctcaaacctc

SEQ ID NO: 303881 - DNA, 20 bp, human
gagaatgcttggtgcgttct

SEQ ID NO: 303882 - DNA, 20 bp, human
gagccaggacgccctccctc

SEQ ID NO: 303883 - DNA, 20 bp, human
gaggagcagctggatctaga

SEQ ID NO: 303884 - DNA, 20 bp, human
gttgcagggaggagttcccg

SEQ ID NO: 303885 - DNA, 20 bp, human
gcaccaagcattctgtcctc

SEQ ID NO: 303886 - DNA, 20 bp, human
gccgctgtggccaaggattg

SEQ ID NO: 303887 - DNA, 20 bp, human
gacggagcccgctctggcgg

SEQ ID NO: 303888 - DNA, 20 bp, human
gggcgggcgggcttgtgacc

SEQ ID NO: 303889 - DNA, 20 bp, human
gcgaccccgggaaccgttat

SEQ ID NO: 303890 - DNA, 20 bp, human
gggcgccaaaagcaccaaag

SEQ ID NO: 303891 - DNA, 20 bp, human
ggggctccgtaccatggtcg

SEQ ID NO: 303892 - DNA, 20 bp, human
gtggagccgcgaccatggta

SEQ ID NO: 303893 - DNA, 20 bp, human
gggtacggagcccgctctgg

SEQ ID NO: 303894 - DNA, 20 bp, human
ggctgctggagccgcgacca

SEQ ID NO: 303895 - DNA, 20 bp, human
gaccacttagccccaatcct

SEQ ID NO: 303896 - DNA, 20 bp, human
gccctgggaaagtaattgta

SEQ ID NO: 303897 - DNA, 20 bp, human
gctggagcaggcaggaactc

SEQ ID NO: 303898 - DNA, 20 bp, human
gtgtgaggcagtggtcgcta

SEQ ID NO: 303899 - DNA, 20 bp, human
gattcaaaggcctaatgtta

SEQ ID NO: 303900 - DNA, 20 bp, human
gacagttgtaactacccttc

SEQ ID NO: 303901 - DNA, 20 bp, human
gtccctacaattactttccc

SEQ ID NO: 303902 - DNA, 20 bp, human
gagttacaactgtgaggcag

SEQ ID NO: 303903 - DNA, 20 bp, human
ggactttcagccctaacatt

SEQ ID NO: 303904 - DNA, 20 bp, human
gattataaggaagtccagtc

SEQ ID NO: 303905 - DNA, 20 bp, human
gtgttgtcactggagcaggc

SEQ ID NO: 303906 - DNA, 20 bp, human
gggtgtagccaccataccta

SEQ ID NO: 303907 - DNA, 20 bp, human
gagggtacacggtatggctt

SEQ ID NO: 303908 - DNA, 20 bp, human
gataccgtgtaccctaggta

SEQ ID NO: 303909 - DNA, 20 bp, human
gccgtgtaccctaggtatgg

SEQ ID NO: 303910 - DNA, 20 bp, human
gcgtatacttacacaaacct

SEQ ID NO: 303911 - DNA, 20 bp, human
gtcagtgggaacttaacttg

SEQ ID NO: 303912 - DNA, 20 bp, human
gacttcctctcacatttcac

SEQ ID NO: 303913 - DNA, 20 bp, human
gttaaagcttgaagtctcct

SEQ ID NO: 303914 - DNA, 20 bp, human
gccaagattcacctcattta

SEQ ID NO: 303915 - DNA, 20 bp, human
gatagctccatccctaaatg

SEQ ID NO: 303916 - DNA, 20 bp, human
gcagctcgcgaaatgccccg

SEQ ID NO: 303917 - DNA, 20 bp, human
ggcgaaatgccccgcggcta

SEQ ID NO: 303918 - DNA, 20 bp, human
ggactttttttttctttcgc

SEQ ID NO: 303919 - DNA, 20 bp, human
gagcctacgagcctgggacg

SEQ ID NO: 303920 - DNA, 20 bp, human
gagctgcgcgtctctctcaa

SEQ ID NO: 303921 - DNA, 20 bp, human
gagtcgggggcggagagcct

SEQ ID NO: 303922 - DNA, 20 bp, human
gtttcagcttcagtttccct

SEQ ID NO: 303923 - DNA, 20 bp, human
gtcaacggcgccaccgcgcc

SEQ ID NO: 303924 - DNA, 20 bp, human
gtctccgaaggccttagccg

SEQ ID NO: 303925 - DNA, 20 bp, human
ggggcagcgccagcgaccga

SEQ ID NO: 303926 - DNA, 20 bp, human
ggtgaccgcgctcctgtaga

SEQ ID NO: 303927 - DNA, 20 bp, human
gcctgtagagggaagaaaca

SEQ ID NO: 303928 - DNA, 20 bp, human
gacaggagcgcggtcacgtg

SEQ ID NO: 303929 - DNA, 20 bp, human
ggcctgggctccaacaagag

SEQ ID NO: 303930 - DNA, 20 bp, human
gaagggaaagctgacgggga

SEQ ID NO: 303931 - DNA, 20 bp, human
gttgaaggcgatcttgagtg

SEQ ID NO: 303932 - DNA, 20 bp, human
ggccggcggaagcgagtgga

SEQ ID NO: 303933 - DNA, 20 bp, human
ggaaacaaggtggcggttga

SEQ ID NO: 303934 - DNA, 20 bp, human
gcagcacggcgctccgggtg

SEQ ID NO: 303935 - DNA, 20 bp, human
ggccgggttgggaggcccga

SEQ ID NO: 303936 - DNA, 20 bp, human
gcggcacccgagaacctgca

SEQ ID NO: 303937 - DNA, 20 bp, human
gcccaggagcggtttcccta

SEQ ID NO: 303938 - DNA, 20 bp, human
ggccaaagggagtgggacct

SEQ ID NO: 303939 - DNA, 20 bp, human
gcgccaccctatgtcgccaa

SEQ ID NO: 303940 - DNA, 20 bp, human
gacccaggtcccactccctt

SEQ ID NO: 303941 - DNA, 20 bp, human
gtggggccgcgttttggcga

SEQ ID NO: 303942 - DNA, 20 bp, human
gcactctgactctgctccgg

SEQ ID NO: 303943 - DNA, 20 bp, human
gtccctttggcgacataggg

SEQ ID NO: 303944 - DNA, 20 bp, human
gctgagaggtccagctgctg

SEQ ID NO: 303945 - DNA, 20 bp, human
gctccgggggcaatccctgc

SEQ ID NO: 303946 - DNA, 20 bp, human
gtgtatgtgagtgcgttctg

SEQ ID NO: 303947 - DNA, 20 bp, human
gacatgaggcttctttgcga

SEQ ID NO: 303948 - DNA, 20 bp, human
gcaggtacagcagaagtttg

SEQ ID NO: 303949 - DNA, 20 bp, human
gtagttctaattttagttca

SEQ ID NO: 303950 - DNA, 20 bp, human
gaagtagaaggactttgaat

SEQ ID NO: 303951 - DNA, 20 bp, human
gcacttggttacagctgact

SEQ ID NO: 303952 - DNA, 20 bp, human
gcagacattataaaactatc

SEQ ID NO: 303953 - DNA, 20 bp, human
gactggggattttaatcatt

SEQ ID NO: 303954 - DNA, 20 bp, human
gctcttcagctttcatagat

SEQ ID NO: 303955 - DNA, 20 bp, human
gctgaagagatcaaagtgag

SEQ ID NO: 303956 - DNA, 20 bp, human
gagcccagccagtgcctcgc

SEQ ID NO: 303957 - DNA, 20 bp, human
ggcaagtagagctgtgtaag

SEQ ID NO: 303958 - DNA, 20 bp, human
gagcagcgccggcgaggcac

SEQ ID NO: 303959 - DNA, 20 bp, human
gggtccggaatggagagagg

SEQ ID NO: 303960 - DNA, 20 bp, human
gcggggtccggaatggagag

SEQ ID NO: 303961 - DNA, 20 bp, human
ggcgctgctctctcgcctcg

SEQ ID NO: 303962 - DNA, 20 bp, human
gctctctcgcctcgcggttg

SEQ ID NO: 303963 - DNA, 20 bp, human
ggcctcgcggttgcggggtc

SEQ ID NO: 303964 - DNA, 20 bp, human
ggctccgctattgtgaggga

SEQ ID NO: 303965 - DNA, 20 bp, human
gggaaatcgcctccaaaccc

SEQ ID NO: 303966 - DNA, 20 bp, human
gggtgcctgccgaccaaacc

SEQ ID NO: 303967 - DNA, 20 bp, human
gaattcttaagttttcacct

SEQ ID NO: 303968 - DNA, 20 bp, human
gtaacaggtttttgaaacaa

SEQ ID NO: 303969 - DNA, 20 bp, human
gttaagttttcacctgggtg

SEQ ID NO: 303970 - DNA, 20 bp, human
gttcaaggccttgccaggta

SEQ ID NO: 303971 - DNA, 20 bp, human
gttagccgggtttggtcggc

SEQ ID NO: 303972 - DNA, 20 bp, human
gaaaatggggtgtgtgtggg

SEQ ID NO: 303973 - DNA, 20 bp, human
gataaaaatggggtgtgtgt

SEQ ID NO: 303974 - DNA, 20 bp, human
gaaggccttgccaggtatgg

SEQ ID NO: 303975 - DNA, 20 bp, human
gaaaggaagaaattcttaac

SEQ ID NO: 303976 - DNA, 20 bp, human
gggagtgagcgtcaagtgag

SEQ ID NO: 303977 - DNA, 20 bp, human
gaatgaacgggctgtgtcgt

SEQ ID NO: 303978 - DNA, 20 bp, human
ggacgagcggagcggggcca

SEQ ID NO: 303979 - DNA, 20 bp, human
gcccgctccgctcgtctaga

SEQ ID NO: 303980 - DNA, 20 bp, human
ggcgccccgtcagcagtcag

SEQ ID NO: 303981 - DNA, 20 bp, human
gtgcctcgcggggttaacgc

SEQ ID NO: 303982 - DNA, 20 bp, human
gtccgctcgtctagaggggg

SEQ ID NO: 303983 - DNA, 20 bp, human
gcccgccccctctagacgag

SEQ ID NO: 303984 - DNA, 20 bp, human
gaggccggcaggaaggattg

SEQ ID NO: 303985 - DNA, 20 bp, human
ggtgaggcaaagcgaaggag

SEQ ID NO: 303986 - DNA, 20 bp, human
gccggcaccggcaacggaaa

SEQ ID NO: 303987 - DNA, 20 bp, human
gactgcgccgcagagagtga

SEQ ID NO: 303988 - DNA, 20 bp, human
gagagtgaaggcccagcgcg

SEQ ID NO: 303989 - DNA, 20 bp, human
gcgctggtgctgacgacatc

SEQ ID NO: 303990 - DNA, 20 bp, human
gaaggagcggggcatcccaa

SEQ ID NO: 303991 - DNA, 20 bp, human
ggtcgtcagcaccagcgcct

SEQ ID NO: 303992 - DNA, 20 bp, human
gcgcgcgctcacgaaaggag

SEQ ID NO: 303993 - DNA, 20 bp, human
gcagagcgcgcgctcacgaa

SEQ ID NO: 303994 - DNA, 20 bp, human
gcaggacgctaggccggcac

SEQ ID NO: 303995 - DNA, 20 bp, human
gtgggctcgcggcctcgcgc

SEQ ID NO: 303996 - DNA, 20 bp, human
gcggctccataagcgatatg

SEQ ID NO: 303997 - DNA, 20 bp, human
gaccatggaggccacgtccc

SEQ ID NO: 303998 - DNA, 20 bp, human
ggtccgcgggcgacactctc

SEQ ID NO: 303999 - DNA, 20 bp, human
ggtagcggcggcaacgacca

SEQ ID NO: 304000 - DNA, 20 bp, human
gtcccgggacgtggcctcca

SEQ ID NO: 304001 - DNA, 20 bp, human
gagcccgagagtgtcgcccg

SEQ ID NO: 304002 - DNA, 20 bp, human
gctggcgcgcccggagttgc

SEQ ID NO: 304003 - DNA, 20 bp, human
gaagtgcggcacactcatcg

SEQ ID NO: 304004 - DNA, 20 bp, human
ggcggaccgccatcttgaaa

SEQ ID NO: 304005 - DNA, 20 bp, human
gctcgcgcacctccccaaga

SEQ ID NO: 304006 - DNA, 20 bp, human
gcaggcgacccgagggccga

SEQ ID NO: 304007 - DNA, 20 bp, human
gcccagggcaggcgacccga

SEQ ID NO: 304008 - DNA, 20 bp, human
gtgcgtgctcgcgggagggt

SEQ ID NO: 304009 - DNA, 20 bp, human
gaaggcggggccggacctgg

SEQ ID NO: 304010 - DNA, 20 bp, human
gcgcgtgcgtgctcgcggga

SEQ ID NO: 304011 - DNA, 20 bp, human
ggacccgagggccgagggtt

SEQ ID NO: 304012 - DNA, 20 bp, human
gagagggcggggccgattgt

SEQ ID NO: 304013 - DNA, 20 bp, human
gccggctcccattacttcgc

SEQ ID NO: 304014 - DNA, 20 bp, human
gggcgctaagagctaggggt

SEQ ID NO: 304015 - DNA, 20 bp, human
gcctgcgcgtgcgtgctcgc

SEQ ID NO: 304016 - DNA, 20 bp, human
gggggccaggctgtctgatc

SEQ ID NO: 304017 - DNA, 20 bp, human
gtaagtgcggcagctcccgc

SEQ ID NO: 304018 - DNA, 20 bp, human
gagagaaaacgcaggtggtt

SEQ ID NO: 304019 - DNA, 20 bp, human
gaggctgtctgatccggatg

SEQ ID NO: 304020 - DNA, 20 bp, human
gttgacaggagctaagaaac

SEQ ID NO: 304021 - DNA, 20 bp, human
gagggcagaagagaaaacgc

SEQ ID NO: 304022 - DNA, 20 bp, human
gtccgtggggagtgcttgac

SEQ ID NO: 304023 - DNA, 20 bp, human
gagaccaccctggaacccac

SEQ ID NO: 304024 - DNA, 20 bp, human
gtataggatgactttccgtg

SEQ ID NO: 304025 - DNA, 20 bp, human
gctatggcgcttactgcctg

SEQ ID NO: 304026 - DNA, 20 bp, human
gtggctaggggcatgagggt

SEQ ID NO: 304027 - DNA, 20 bp, human
gcagcgcgctccaggttcat

SEQ ID NO: 304028 - DNA, 20 bp, human
gcgggccgcaagctgagagg

SEQ ID NO: 304029 - DNA, 20 bp, human
gggctgcgggacgtgaggga

SEQ ID NO: 304030 - DNA, 20 bp, human
gagcccggagcatgccctcc

SEQ ID NO: 304031 - DNA, 20 bp, human
ggctccaggttcattggcta

SEQ ID NO: 304032 - DNA, 20 bp, human
gcattggctgagggtcgtga

SEQ ID NO: 304033 - DNA, 20 bp, human
gtgcccctagccaatgaacc

SEQ ID NO: 304034 - DNA, 20 bp, human
ggccccgggagggcatgctc

SEQ ID NO: 304035 - DNA, 20 bp, human
ggctccgggctcattggctg

SEQ ID NO: 304036 - DNA, 20 bp, human
ggacggaagccgagtggaga

SEQ ID NO: 304037 - DNA, 20 bp, human
ggaaagagctaaggattgtg

SEQ ID NO: 304038 - DNA, 20 bp, human
gcggcttccgtccattcttc

SEQ ID NO: 304039 - DNA, 20 bp, human
gacgccgagtggggaggtaa

SEQ ID NO: 304040 - DNA, 20 bp, human
gaagcagtgggcgtacccgc

SEQ ID NO: 304041 - DNA, 20 bp, human
ggtggagacggaaagagcta

SEQ ID NO: 304042 - DNA, 20 bp, human
gtagctggggtcagagatta

SEQ ID NO: 304043 - DNA, 20 bp, human
gccccggggccggaagcagt

SEQ ID NO: 304044 - DNA, 20 bp, human
ggccccaggcgggtaaggag

SEQ ID NO: 304045 - DNA, 20 bp, human
gcctcgcagcatccccgcca

SEQ ID NO: 304046 - DNA, 20 bp, human
gtctccgcgggtaggggtga

SEQ ID NO: 304047 - DNA, 20 bp, human
gcctgcgtagagccggggag

SEQ ID NO: 304048 - DNA, 20 bp, human
ggagaggccactctcctcta

SEQ ID NO: 304049 - DNA, 20 bp, human
gtcctctatggcacgcgcgg

SEQ ID NO: 304050 - DNA, 20 bp, human
ggagcggctcgctctctccg

SEQ ID NO: 304051 - DNA, 20 bp, human
gctcgctctctccgcgggta

SEQ ID NO: 304052 - DNA, 20 bp, human
ggccgccgcgcgtgccatag

SEQ ID NO: 304053 - DNA, 20 bp, human
gcgcgtgccatagaggagag

SEQ ID NO: 304054 - DNA, 20 bp, human
gagccaggtggcttctctat

SEQ ID NO: 304055 - DNA, 20 bp, human
gggcctctcctgcgtagagc

SEQ ID NO: 304056 - DNA, 20 bp, human
gaatgagggcgggagtcggg

SEQ ID NO: 304057 - DNA, 20 bp, human
gacacgatgggcgagttctg

SEQ ID NO: 304058 - DNA, 20 bp, human
gcctgctgtagagatgaatg

SEQ ID NO: 304059 - DNA, 20 bp, human
gtgtagagatgaatgagggc

SEQ ID NO: 304060 - DNA, 20 bp, human
gtcttgctgcgtggtcccgt

SEQ ID NO: 304061 - DNA, 20 bp, human
gatgaatgagggcgggagtc

SEQ ID NO: 304062 - DNA, 20 bp, human
gcccaaggggacaatctatc

SEQ ID NO: 304063 - DNA, 20 bp, human
gtttgggcgtcaggtctccc

SEQ ID NO: 304064 - DNA, 20 bp, human
gcagctgtgagaggactcgg

SEQ ID NO: 304065 - DNA, 20 bp, human
gtgaccctagtggagtttgt

SEQ ID NO: 304066 - DNA, 20 bp, human
gacgcaaatggacggaacag

SEQ ID NO: 304067 - DNA, 20 bp, human
gtctacggctggttggtgta

SEQ ID NO: 304068 - DNA, 20 bp, human
gacggaacagaggtgaatct

SEQ ID NO: 304069 - DNA, 20 bp, human
gcaccccgcagcgtccgatt

SEQ ID NO: 304070 - DNA, 20 bp, human
ggaggagcgagctaggtcac

SEQ ID NO: 304071 - DNA, 20 bp, human
gaataggaggcgggcttcgt

SEQ ID NO: 304072 - DNA, 20 bp, human
gagtcaatcacgcaaatgga

SEQ ID NO: 304073 - DNA, 20 bp, human
gcccgcagcgtccgattggg

SEQ ID NO: 304074 - DNA, 20 bp, human
ggacttgtcaactttcaccc

SEQ ID NO: 304075 - DNA, 20 bp, human
gcccttgccgcgtctctatt

SEQ ID NO: 304076 - DNA, 20 bp, human
ggggaagaggctggccacac

SEQ ID NO: 304077 - DNA, 20 bp, human
gaaaacagagcgggagtatt

SEQ ID NO: 304078 - DNA, 20 bp, human
gctcccgctctgtttttatg

SEQ ID NO: 304079 - DNA, 20 bp, human
gacagagcgggagtattggg

SEQ ID NO: 304080 - DNA, 20 bp, human
gtctggggcccccaatggga

SEQ ID NO: 304081 - DNA, 20 bp, human
ggacccggagtggacaggtg

SEQ ID NO: 304082 - DNA, 20 bp, human
gagccagtggacacaagcag

SEQ ID NO: 304083 - DNA, 20 bp, human
ggctgaggtgggccgtaaag

SEQ ID NO: 304084 - DNA, 20 bp, human
gcaccggaagtggcgatctg

SEQ ID NO: 304085 - DNA, 20 bp, human
gaacctgctcagggttacca

SEQ ID NO: 304086 - DNA, 20 bp, human
ggggaagaaccggagaggat

SEQ ID NO: 304087 - DNA, 20 bp, human
ggaggggggaagaaccggag

SEQ ID NO: 304088 - DNA, 20 bp, human
gctccctctcccatcctctc

SEQ ID NO: 304089 - DNA, 20 bp, human
ggggagcggaatactgatga

SEQ ID NO: 304090 - DNA, 20 bp, human
ggcggaatactgatgatggt

SEQ ID NO: 304091 - DNA, 20 bp, human
gggagaaaaaggggaggagc

SEQ ID NO: 304092 - DNA, 20 bp, human
gaaggtcctggatgaagggg

SEQ ID NO: 304093 - DNA, 20 bp, human
gtagggaaggcctaactttg

SEQ ID NO: 304094 - DNA, 20 bp, human
gaactcctgcaataaggtcc

SEQ ID NO: 304095 - DNA, 20 bp, human
gcaataaggtcctggatgaa

SEQ ID NO: 304096 - DNA, 20 bp, human
gttagtgtgacaaccaaagc

SEQ ID NO: 304097 - DNA, 20 bp, human
gctgtacgaaatacctgctt

SEQ ID NO: 304098 - DNA, 20 bp, human
gcccaggactaggtagattc

SEQ ID NO: 304099 - DNA, 20 bp, human
gtaagccaaaaactcatcaa

SEQ ID NO: 304100 - DNA, 20 bp, human
ggctgccgaatgttgggggt

SEQ ID NO: 304101 - DNA, 20 bp, human
ggtagcaggtcaatcagcag

SEQ ID NO: 304102 - DNA, 20 bp, human
gctgtgtgctgcagatggta

SEQ ID NO: 304103 - DNA, 20 bp, human
gcctggggcccccctgattt

SEQ ID NO: 304104 - DNA, 20 bp, human
gagcacacagcagctcttgg

SEQ ID NO: 304105 - DNA, 20 bp, human
gtcaggggggccccaggact

SEQ ID NO: 304106 - DNA, 20 bp, human
ggattggagcttcagagatg

SEQ ID NO: 304107 - DNA, 20 bp, human
gcctgaacctcccagcgtgg

SEQ ID NO: 304108 - DNA, 20 bp, human
ggcattaacacttgaagtca

SEQ ID NO: 304109 - DNA, 20 bp, human
gcacttgaagtcagggaaga

SEQ ID NO: 304110 - DNA, 20 bp, human
gctaaaagcaacccccacgc

SEQ ID NO: 304111 - DNA, 20 bp, human
gtaagatgatgggaggtaat

SEQ ID NO: 304112 - DNA, 20 bp, human
gcaatcagtgctaagatgat

SEQ ID NO: 304113 - DNA, 20 bp, human
gtcagtgctaagatgatggg

SEQ ID NO: 304114 - DNA, 20 bp, human
gcttttagactcagctgttc

SEQ ID NO: 304115 - DNA, 20 bp, human
ggggaccagtgtgcttgact

SEQ ID NO: 304116 - DNA, 20 bp, human
gtaagccagctggaactccc

SEQ ID NO: 304117 - DNA, 20 bp, human
gtcacaccacccagaaggag

SEQ ID NO: 304118 - DNA, 20 bp, human
gagttggggcctcatgggta

SEQ ID NO: 304119 - DNA, 20 bp, human
gcatgtgtgtgttggagacc

SEQ ID NO: 304120 - DNA, 20 bp, human
gtcagccaggcagtctcctg

SEQ ID NO: 304121 - DNA, 20 bp, human
ggggggagttggggcctcat

SEQ ID NO: 304122 - DNA, 20 bp, human
gactacagctccatggggag

SEQ ID NO: 304123 - DNA, 20 bp, human
gctaatctgcaggccataga

SEQ ID NO: 304124 - DNA, 20 bp, human
ggcaggccatagagggaaca

SEQ ID NO: 304125 - DNA, 20 bp, human
gcatggagctgtagtagatt

SEQ ID NO: 304126 - DNA, 20 bp, human
gctaaaggatgaagccagga

SEQ ID NO: 304127 - DNA, 20 bp, human
ggggctgttaacaaagtcaa

SEQ ID NO: 304128 - DNA, 20 bp, human
gaacaaacacctaccactga

SEQ ID NO: 304129 - DNA, 20 bp, human
gcccggatgagggacagaaa

SEQ ID NO: 304130 - DNA, 20 bp, human
gtagagtgaggcatgctgca

SEQ ID NO: 304131 - DNA, 20 bp, human
ggcgttattccaggcactaa

SEQ ID NO: 304132 - DNA, 20 bp, human
gataaatagcaacccgtcag

SEQ ID NO: 304133 - DNA, 20 bp, human
gatagcaacccgtcagtggt

SEQ ID NO: 304134 - DNA, 20 bp, human
gtgtccctcatccgggtaaa

SEQ ID NO: 304135 - DNA, 20 bp, human
gccacggtgagccatttacc

SEQ ID NO: 304136 - DNA, 20 bp, human
ggggacctcccgtggatctc

SEQ ID NO: 304137 - DNA, 20 bp, human
gacccagttgaggtccccta

SEQ ID NO: 304138 - DNA, 20 bp, human
gaagggaggggacaagaatg

SEQ ID NO: 304139 - DNA, 20 bp, human
gaccctaggggacctcaact

SEQ ID NO: 304140 - DNA, 20 bp, human
gtccggaaggggacctcccg

SEQ ID NO: 304141 - DNA, 20 bp, human
gggggcaagacacccagttg

SEQ ID NO: 304142 - DNA, 20 bp, human
ggccccctaggctccggaag

SEQ ID NO: 304143 - DNA, 20 bp, human
gctggggccagcgtctgtga

SEQ ID NO: 304144 - DNA, 20 bp, human
gtccccttccggagcctagg

SEQ ID NO: 304145 - DNA, 20 bp, human
ggggccagcgtctgtgaagg

SEQ ID NO: 304146 - DNA, 20 bp, human
gagcaacggtcgctagggcg

SEQ ID NO: 304147 - DNA, 20 bp, human
gcccttagcaacggtcgcta

SEQ ID NO: 304148 - DNA, 20 bp, human
gcctgctgcgggcgatccca

SEQ ID NO: 304149 - DNA, 20 bp, human
gcgggggctcgggttccgtg

SEQ ID NO: 304150 - DNA, 20 bp, human
gtgcgggcgatcccagggga

SEQ ID NO: 304151 - DNA, 20 bp, human
gtataagtcgccgggggctc

SEQ ID NO: 304152 - DNA, 20 bp, human
gcccacccaactcgagttgg

SEQ ID NO: 304153 - DNA, 20 bp, human
gtcgctagggcggggccacg

SEQ ID NO: 304154 - DNA, 20 bp, human
gcacgcggggcgggtaaagg

SEQ ID NO: 304155 - DNA, 20 bp, human
ggggaagcgccaggatcgcg

SEQ ID NO: 304156 - DNA, 20 bp, human
ggacgccgggtcccacgggt

SEQ ID NO: 304157 - DNA, 20 bp, human
ggggtcccacgggttggcag

SEQ ID NO: 304158 - DNA, 20 bp, human
gcgtccgcgcctaacggcgc

SEQ ID NO: 304159 - DNA, 20 bp, human
gatggccgctgccaacccgt

SEQ ID NO: 304160 - DNA, 20 bp, human
gggaaggtgcgtccgagcca

SEQ ID NO: 304161 - DNA, 20 bp, human
gacccggcgtccgcgcctaa

SEQ ID NO: 304162 - DNA, 20 bp, human
ggcttcggggatggtcaatc

SEQ ID NO: 304163 - DNA, 20 bp, human
gggatcgcagggcgaacgca

SEQ ID NO: 304164 - DNA, 20 bp, human
gcgaaggcgccaagagtgag

SEQ ID NO: 304165 - DNA, 20 bp, human
gcccgcccgggactaagccg

SEQ ID NO: 304166 - DNA, 20 bp, human
gagtggcaagagcgcagcat

SEQ ID NO: 304167 - DNA, 20 bp, human
ggccccggaacctgaaccga

SEQ ID NO: 304168 - DNA, 20 bp, human
gcggccgccgaaacccggtc

SEQ ID NO: 304169 - DNA, 20 bp, human
gtcacgcgacgcgagtcctg

SEQ ID NO: 304170 - DNA, 20 bp, human
gggctctgcctcacgaggcg

SEQ ID NO: 304171 - DNA, 20 bp, human
ggcgtcgcgtgactcggcca

SEQ ID NO: 304172 - DNA, 20 bp, human
ggactcggccaaggcgcgca

SEQ ID NO: 304173 - DNA, 20 bp, human
gtccggctcagatgacaatt

SEQ ID NO: 304174 - DNA, 20 bp, human
ggggcgggctctgcctcacg

SEQ ID NO: 304175 - DNA, 20 bp, human
gccgactcagccctcggttc

SEQ ID NO: 304176 - DNA, 20 bp, human
gaaccccacccctccggcgg

SEQ ID NO: 304177 - DNA, 20 bp, human
gcgtgtgcgggcacgccccc

SEQ ID NO: 304178 - DNA, 20 bp, human
gggcacgccccctggtgccc

SEQ ID NO: 304179 - DNA, 20 bp, human
gacgtgcagtgcatcaccct

SEQ ID NO: 304180 - DNA, 20 bp, human
gggcccgcgggcattattgc

SEQ ID NO: 304181 - DNA, 20 bp, human
gaggcgaaagggcacggact

SEQ ID NO: 304182 - DNA, 20 bp, human
gggcgtgcccgcacacgctc

SEQ ID NO: 304183 - DNA, 20 bp, human
gagagcggcccgagcgtgtg

SEQ ID NO: 304184 - DNA, 20 bp, human
gcttccgcgaccactgagat

SEQ ID NO: 304185 - DNA, 20 bp, human
gcaccccaatccccctgatt

SEQ ID NO: 304186 - DNA, 20 bp, human
gccagggtggcagagaactc

SEQ ID NO: 304187 - DNA, 20 bp, human
gtgaggcaggaccaacaagg

SEQ ID NO: 304188 - DNA, 20 bp, human
ggcagagaactcagggactc

SEQ ID NO: 304189 - DNA, 20 bp, human
gagggtgaaacaaaatgagc

SEQ ID NO: 304190 - DNA, 20 bp, human
gagatggcgctccctatatg

SEQ ID NO: 304191 - DNA, 20 bp, human
gttcacatacatagtccctc

SEQ ID NO: 304192 - DNA, 20 bp, human
gcctatatgtggaacacaga

SEQ ID NO: 304193 - DNA, 20 bp, human
ggacagaaatacccccttgt

SEQ ID NO: 304194 - DNA, 20 bp, human
gatctgaggcaggaccaaca

SEQ ID NO: 304195 - DNA, 20 bp, human
gaggccacagaaatccgact

SEQ ID NO: 304196 - DNA, 20 bp, human
ggaggacgaagactgggttt

SEQ ID NO: 304197 - DNA, 20 bp, human
gggcaacggggactctacgg

SEQ ID NO: 304198 - DNA, 20 bp, human
gcagaggagaccgcagtgaa

SEQ ID NO: 304199 - DNA, 20 bp, human
gtctggaaggcaagcctgga

SEQ ID NO: 304200 - DNA, 20 bp, human
ggggagagggaagcagtctg

SEQ ID NO: 304201 - DNA, 20 bp, human
gagctccgcggagcaagcag

SEQ ID NO: 304202 - DNA, 20 bp, human
gtgcgacgaggacgaagact

SEQ ID NO: 304203 - DNA, 20 bp, human
gcatggcaacggggactcta

SEQ ID NO: 304204 - DNA, 20 bp, human
ggcaagtcggaagtgcgacg

SEQ ID NO: 304205 - DNA, 20 bp, human
ggggccaaatccagatctgt

SEQ ID NO: 304206 - DNA, 20 bp, human
gtgcctgagtgcgcaggcgt

SEQ ID NO: 304207 - DNA, 20 bp, human
gggtgcggccggaagcgaag

SEQ ID NO: 304208 - DNA, 20 bp, human
gctcaggcaccgcaggtagg

SEQ ID NO: 304209 - DNA, 20 bp, human
gctgcggtgcctgagtgcgc

SEQ ID NO: 304210 - DNA, 20 bp, human
gtgcgcgcgaagacccccgc

SEQ ID NO: 304211 - DNA, 20 bp, human
gcgagtccgggaggaaatct

SEQ ID NO: 304212 - DNA, 20 bp, human
gtgcccacgcctgcgcactc

SEQ ID NO: 304213 - DNA, 20 bp, human
gagcctggcacgcacagcgc

SEQ ID NO: 304214 - DNA, 20 bp, human
gcgaggtccgggtcgcactc

SEQ ID NO: 304215 - DNA, 20 bp, human
gggtcacaggtgccagtctc

SEQ ID NO: 304216 - DNA, 20 bp, human
gcagccccacagtgcgtcgg

SEQ ID NO: 304217 - DNA, 20 bp, human
gtccgcgcgcgctgcaccgt

SEQ ID NO: 304218 - DNA, 20 bp, human
gccttcctccgacgcactgt

SEQ ID NO: 304219 - DNA, 20 bp, human
gcgcctgcgcgtcaagtggc

SEQ ID NO: 304220 - DNA, 20 bp, human
gctgcagccccacagtgcgt

SEQ ID NO: 304221 - DNA, 20 bp, human
gcccgcgcctgcgcgtcaag

SEQ ID NO: 304222 - DNA, 20 bp, human
gagtgcgtcggaggaaggcg

SEQ ID NO: 304223 - DNA, 20 bp, human
gtagcggaccccggttgcta

SEQ ID NO: 304224 - DNA, 20 bp, human
ggagacacaccctagcaacc

SEQ ID NO: 304225 - DNA, 20 bp, human
ggcgcgctgcaccgtgggct

SEQ ID NO: 304226 - DNA, 20 bp, human
gtaatggcctgcaaagaaac

SEQ ID NO: 304227 - DNA, 20 bp, human
gtgttatcaaatacatgttc

SEQ ID NO: 304228 - DNA, 20 bp, human
gttactcatagagttatgga

SEQ ID NO: 304229 - DNA, 20 bp, human
gatagagttatggagggtca

SEQ ID NO: 304230 - DNA, 20 bp, human
gaagtgtgtacaaattacaa

SEQ ID NO: 304231 - DNA, 20 bp, human
gacacacagtggcttttaag

SEQ ID NO: 304232 - DNA, 20 bp, human
ggtattacatcttcatggct

SEQ ID NO: 304233 - DNA, 20 bp, human
gatttatgtaataaactaca

SEQ ID NO: 304234 - DNA, 20 bp, human
gctttttactcatagagtta

SEQ ID NO: 304235 - DNA, 20 bp, human
gggtcacggtttagtgtaac

SEQ ID NO: 304236 - DNA, 20 bp, human
gggtgcgctagtaattccca

SEQ ID NO: 304237 - DNA, 20 bp, human
gcgcaggcataagctatttt

SEQ ID NO: 304238 - DNA, 20 bp, human
gaaagtagatggtccaggtt

SEQ ID NO: 304239 - DNA, 20 bp, human
gtgagatccaccatgttgaa

SEQ ID NO: 304240 - DNA, 20 bp, human
gagctcccactagtctaaga

SEQ ID NO: 304241 - DNA, 20 bp, human
gatgcttccccccttcaaca

SEQ ID NO: 304242 - DNA, 20 bp, human
ggatccaccatgttgaaggg

SEQ ID NO: 304243 - DNA, 20 bp, human
gcctatgtgaaagatacgaa

SEQ ID NO: 304244 - DNA, 20 bp, human
ggaacctctaattacagaat

SEQ ID NO: 304245 - DNA, 20 bp, human
gacaccaattctgtaattag

SEQ ID NO: 304246 - DNA, 20 bp, human
gagtagcattgaactgagac

SEQ ID NO: 304247 - DNA, 20 bp, human
gcctggagatgaccaccaaa

SEQ ID NO: 304248 - DNA, 20 bp, human
gtgccatgccgatgtttccg

SEQ ID NO: 304249 - DNA, 20 bp, human
gggaatggcagaatcgaatt

SEQ ID NO: 304250 - DNA, 20 bp, human
gcggccgatgattttccgtt

SEQ ID NO: 304251 - DNA, 20 bp, human
gccaccaaacggaaaatcat

SEQ ID NO: 304252 - DNA, 20 bp, human
gacatcggcatggcaccaga

SEQ ID NO: 304253 - DNA, 20 bp, human
gtacttcgcagggctgttta

SEQ ID NO: 304254 - DNA, 20 bp, human
gtccaaagctgtgtgatgat

SEQ ID NO: 304255 - DNA, 20 bp, human
gcacctcggaaacatcggca

SEQ ID NO: 304256 - DNA, 20 bp, human
gcagaggttgccatggatac

SEQ ID NO: 304257 - DNA, 20 bp, human
gattgctgaacggaaatctc

SEQ ID NO: 304258 - DNA, 20 bp, human
gtcttagcttcctgtatcca

SEQ ID NO: 304259 - DNA, 20 bp, human
ggaaacaccactcttcacat

SEQ ID NO: 304260 - DNA, 20 bp, human
gaaacaacatagctactgaa

SEQ ID NO: 304261 - DNA, 20 bp, human
gaaggaaccaatgtgaagag

SEQ ID NO: 304262 - DNA, 20 bp, human
ggtggtgtttcctgagcaaa

SEQ ID NO: 304263 - DNA, 20 bp, human
ggagtctgttgattgatatt

SEQ ID NO: 304264 - DNA, 20 bp, human
gttttacacattgactgtaa

SEQ ID NO: 304265 - DNA, 20 bp, human
ggagtactacttaatacgtg

SEQ ID NO: 304266 - DNA, 20 bp, human
ggaggccggccagagatcgc

SEQ ID NO: 304267 - DNA, 20 bp, human
gtggcggagccagaacccga

SEQ ID NO: 304268 - DNA, 20 bp, human
gaggggagagcccacgaggg

SEQ ID NO: 304269 - DNA, 20 bp, human
ggcgaggggagagcccacga

SEQ ID NO: 304270 - DNA, 20 bp, human
gggagctgatgggtcccaga

SEQ ID NO: 304271 - DNA, 20 bp, human
gagagcacgcggggccgaca

SEQ ID NO: 304272 - DNA, 20 bp, human
gtggcccgcccctcgggttc

SEQ ID NO: 304273 - DNA, 20 bp, human
gcgggcgggcccgagggaaa

SEQ ID NO: 304274 - DNA, 20 bp, human
gagctcctgcgatctctggc

SEQ ID NO: 304275 - DNA, 20 bp, human
gagagatcgcaggagctgat

SEQ ID NO: 304276 - DNA, 20 bp, human
gagcgggggtcagctatgtc

SEQ ID NO: 304277 - DNA, 20 bp, human
gggaggtcagagcgcctcaa

SEQ ID NO: 304278 - DNA, 20 bp, human
gatagctgacccccgctctc

SEQ ID NO: 304279 - DNA, 20 bp, human
ggcacaagggtgggtgttgc

SEQ ID NO: 304280 - DNA, 20 bp, human
gggtaacacgcgtgtgtccg

SEQ ID NO: 304281 - DNA, 20 bp, human
ggcgtgtgtccgaggcacaa

SEQ ID NO: 304282 - DNA, 20 bp, human
ggtgtccgaggcacaagggt

SEQ ID NO: 304283 - DNA, 20 bp, human
gaacacccacccttgtgcct

SEQ ID NO: 304284 - DNA, 20 bp, human
gggtggatgccggagagcgg

SEQ ID NO: 304285 - DNA, 20 bp, human
gctcatggtgatgcgtccgg

SEQ ID NO: 304286 - DNA, 20 bp, human
gtggctgaccccactcccaa

SEQ ID NO: 304287 - DNA, 20 bp, human
ggggtagggctgacggggag

SEQ ID NO: 304288 - DNA, 20 bp, human
gaggcgcggcgcggatgaaa

SEQ ID NO: 304289 - DNA, 20 bp, human
ggggtcagccaactggcagg

SEQ ID NO: 304290 - DNA, 20 bp, human
gtgagtgggtagggctgacg

SEQ ID NO: 304291 - DNA, 20 bp, human
ggataggccgctcttccctt

SEQ ID NO: 304292 - DNA, 20 bp, human
ggtgcccaacgccatctcca

SEQ ID NO: 304293 - DNA, 20 bp, human
ggggagtggggtcagccaac

SEQ ID NO: 304294 - DNA, 20 bp, human
gccgctcttcccttgggagt

SEQ ID NO: 304295 - DNA, 20 bp, human
ggaggttcgcgtacactggg

SEQ ID NO: 304296 - DNA, 20 bp, human
gctagcgccctgctgcttcg

SEQ ID NO: 304297 - DNA, 20 bp, human
gaagcagcagggcgctagcg

SEQ ID NO: 304298 - DNA, 20 bp, human
gctagcgcggaggcgagagc

SEQ ID NO: 304299 - DNA, 20 bp, human
ggcaacctacggggtgtact

SEQ ID NO: 304300 - DNA, 20 bp, human
gcgggctcggcccccttaaa

SEQ ID NO: 304301 - DNA, 20 bp, human
ggggtgaagcggcccaggtg

SEQ ID NO: 304302 - DNA, 20 bp, human
ggggactgctgcaacctacg

SEQ ID NO: 304303 - DNA, 20 bp, human
gtccccaaggtcaggtgccg

SEQ ID NO: 304304 - DNA, 20 bp, human
ggtcacttccggggcggagg

SEQ ID NO: 304305 - DNA, 20 bp, human
gtgcttcggggcggaagtag

SEQ ID NO: 304306 - DNA, 20 bp, human
gaaccgctgactaagttcgc

SEQ ID NO: 304307 - DNA, 20 bp, human
gcacccgcgaacttagtcag

SEQ ID NO: 304308 - DNA, 20 bp, human
gtcacaatggagccggtcgg

SEQ ID NO: 304309 - DNA, 20 bp, human
gggaacgcgtcgcgtcacaa

SEQ ID NO: 304310 - DNA, 20 bp, human
ggaagaggctgcagtcgctt

SEQ ID NO: 304311 - DNA, 20 bp, human
gctaagttcgcgggtggagg

SEQ ID NO: 304312 - DNA, 20 bp, human
ggtgacgcgacgcgttccgc

SEQ ID NO: 304313 - DNA, 20 bp, human
gggtgtagtgccgaagtcac

SEQ ID NO: 304314 - DNA, 20 bp, human
gtcccccaggcgcgccacac

SEQ ID NO: 304315 - DNA, 20 bp, human
ggggaagccccggcgctgtc

SEQ ID NO: 304316 - DNA, 20 bp, human
gagcgaggtggtctctgcag

SEQ ID NO: 304317 - DNA, 20 bp, human
gaggtgggcgtctcaggggt

SEQ ID NO: 304318 - DNA, 20 bp, human
gggccggcggcatccctcgc

SEQ ID NO: 304319 - DNA, 20 bp, human
gcccacctggcggactctga

SEQ ID NO: 304320 - DNA, 20 bp, human
gggaactcctccgaaggcca

SEQ ID NO: 304321 - DNA, 20 bp, human
ggcccgccgagtcgactccg

SEQ ID NO: 304322 - DNA, 20 bp, human
gccgcacgcagcccggctag

SEQ ID NO: 304323 - DNA, 20 bp, human
gtggcaccgcggagtcgact

SEQ ID NO: 304324 - DNA, 20 bp, human
gcgcggcctgcgtcacagcg

SEQ ID NO: 304325 - DNA, 20 bp, human
gaggggaggaagttcccggg

SEQ ID NO: 304326 - DNA, 20 bp, human
ggggacccggggttggagac

SEQ ID NO: 304327 - DNA, 20 bp, human
gctgcagcgcctgaccggac

SEQ ID NO: 304328 - DNA, 20 bp, human
ggacggggtctgtgtggcga

SEQ ID NO: 304329 - DNA, 20 bp, human
gtgaccggacggggtctgtg

SEQ ID NO: 304330 - DNA, 20 bp, human
ggggtctgtgtggcgaggga

SEQ ID NO: 304331 - DNA, 20 bp, human
gcggagcaggtgcttgggag

SEQ ID NO: 304332 - DNA, 20 bp, human
gctctcgcaagcgtccacct

SEQ ID NO: 304333 - DNA, 20 bp, human
gagatgcggagcaggtgctt

SEQ ID NO: 304334 - DNA, 20 bp, human
gggcgagcgactgctagatg

SEQ ID NO: 304335 - DNA, 20 bp, human
ggaaagcgctcgcaatcaca

SEQ ID NO: 304336 - DNA, 20 bp, human
ggatctaggtacttgtgggg

SEQ ID NO: 304337 - DNA, 20 bp, human
ggcagcagctgcaaacggaa

SEQ ID NO: 304338 - DNA, 20 bp, human
gggcaccggcggaggaagcg

SEQ ID NO: 304339 - DNA, 20 bp, human
gtcacactgggcaccggcgg

SEQ ID NO: 304340 - DNA, 20 bp, human
ggagctgtagtggatatact

SEQ ID NO: 304341 - DNA, 20 bp, human
gccacaagtacctagatcaa

SEQ ID NO: 304342 - DNA, 20 bp, human
gaaaataattacctcgggga

SEQ ID NO: 304343 - DNA, 20 bp, human
ggactccacgcttcctccgc

SEQ ID NO: 304344 - DNA, 20 bp, human
gggccgatcacactgggcac

SEQ ID NO: 304345 - DNA, 20 bp, human
gaaaagaaggccgatcacac

SEQ ID NO: 304346 - DNA, 20 bp, human
gaggcgccgcgcgatcagca

SEQ ID NO: 304347 - DNA, 20 bp, human
gatcgcgcggcgcctggagt

SEQ ID NO: 304348 - DNA, 20 bp, human
ggcctggagtagggtcgacc

SEQ ID NO: 304349 - DNA, 20 bp, human
ggggccgcgagggtgagtca

SEQ ID NO: 304350 - DNA, 20 bp, human
gagggcaaagcagcctaaga

SEQ ID NO: 304351 - DNA, 20 bp, human
gaggcggggccgagtcgtcc

SEQ ID NO: 304352 - DNA, 20 bp, human
ggccgcgcgatcagcagggt

SEQ ID NO: 304353 - DNA, 20 bp, human
gcccaggtcgaccctactcc

SEQ ID NO: 304354 - DNA, 20 bp, human
ggggggaagacagccgtctt

SEQ ID NO: 304355 - DNA, 20 bp, human
gaactcccaaagccattcta

SEQ ID NO: 304356 - DNA, 20 bp, human
ggaagcccacagttgggacg

SEQ ID NO: 304357 - DNA, 20 bp, human
ggaatcctcgtcccaactgt

SEQ ID NO: 304358 - DNA, 20 bp, human
gtaaagtaaaactgcttccc

SEQ ID NO: 304359 - DNA, 20 bp, human
ggggaactttcccgccttga

SEQ ID NO: 304360 - DNA, 20 bp, human
gttcccggctgtcggttgga

SEQ ID NO: 304361 - DNA, 20 bp, human
ggtaggagctggagaatgaa

SEQ ID NO: 304362 - DNA, 20 bp, human
gttcccgggcgtgtaggagc

SEQ ID NO: 304363 - DNA, 20 bp, human
gcttgacggtgacgcaaaac

SEQ ID NO: 304364 - DNA, 20 bp, human
gccaccctccaaccgacagc

SEQ ID NO: 304365 - DNA, 20 bp, human
gcgggaaagttcccggctgt

SEQ ID NO: 304366 - DNA, 20 bp, human
gccagcgcgggtccctctta

SEQ ID NO: 304367 - DNA, 20 bp, human
gtcaatcagaacattcggag

SEQ ID NO: 304368 - DNA, 20 bp, human
gaacccgagtccatcttggt

SEQ ID NO: 304369 - DNA, 20 bp, human
gctgcaggcgggtggagaac

SEQ ID NO: 304370 - DNA, 20 bp, human
gcacactgggatactcgagg

SEQ ID NO: 304371 - DNA, 20 bp, human
gggtcacactgggatactcg

SEQ ID NO: 304372 - DNA, 20 bp, human
ggaacgggcgtctgagtctt

SEQ ID NO: 304373 - DNA, 20 bp, human
ggagtctttggctttcgtac

SEQ ID NO: 304374 - DNA, 20 bp, human
gcgggcatctaacgagcagc

SEQ ID NO: 304375 - DNA, 20 bp, human
gactgggatactcgaggagg

SEQ ID NO: 304376 - DNA, 20 bp, human
ggggcggtggggcgagtcat

SEQ ID NO: 304377 - DNA, 20 bp, human
ggggcggggcgtagccggga

SEQ ID NO: 304378 - DNA, 20 bp, human
gaaggcgggtcatggggcgg

SEQ ID NO: 304379 - DNA, 20 bp, human
gcccccacgcagttccgcct

SEQ ID NO: 304380 - DNA, 20 bp, human
gggcggggaaggcgggtcat

SEQ ID NO: 304381 - DNA, 20 bp, human
ggtggggcgagtcatggggc

SEQ ID NO: 304382 - DNA, 20 bp, human
ggtggggaaaggggcgtaac

SEQ ID NO: 304383 - DNA, 20 bp, human
gtgggtggggcggagccggt

SEQ ID NO: 304384 - DNA, 20 bp, human
gggggcggggctcgcgttaa

SEQ ID NO: 304385 - DNA, 20 bp, human
ggaagggcgggacaggccgt

SEQ ID NO: 304386 - DNA, 20 bp, human
gccgctgggcaaagtacccg

SEQ ID NO: 304387 - DNA, 20 bp, human
gtccgggcttgcaccccgct

SEQ ID NO: 304388 - DNA, 20 bp, human
gcggccgactgaggaggcga

SEQ ID NO: 304389 - DNA, 20 bp, human
gggggtgcaagcccggaccg

SEQ ID NO: 304390 - DNA, 20 bp, human
gcctgagcggccgactgagg

SEQ ID NO: 304391 - DNA, 20 bp, human
ggtggcgcttgccgcggtcc

SEQ ID NO: 304392 - DNA, 20 bp, human
gtcgcggccacaactgcttc

SEQ ID NO: 304393 - DNA, 20 bp, human
ggctcgccgtgtgacagccc

SEQ ID NO: 304394 - DNA, 20 bp, human
gggtcgacgacccactcacc

SEQ ID NO: 304395 - DNA, 20 bp, human
ggcgaggcgcggctgccggt

SEQ ID NO: 304396 - DNA, 20 bp, human
gggactggatgaggagctta

SEQ ID NO: 304397 - DNA, 20 bp, human
gggagcttacggttttttac

SEQ ID NO: 304398 - DNA, 20 bp, human
ggaaacgaacgcagcatttc

SEQ ID NO: 304399 - DNA, 20 bp, human
gagcacctgtagggaaaaac

SEQ ID NO: 304400 - DNA, 20 bp, human
ggacaccggtttttccctac

SEQ ID NO: 304401 - DNA, 20 bp, human
ggcatttcagggactggatg

SEQ ID NO: 304402 - DNA, 20 bp, human
gatggcaacagccaatcaca

SEQ ID NO: 304403 - DNA, 20 bp, human
gtccctacaggtgctctaga

SEQ ID NO: 304404 - DNA, 20 bp, human
gaatcactgttcaggattaa

SEQ ID NO: 304405 - DNA, 20 bp, human
ggctacacaaagcgtatcca

SEQ ID NO: 304406 - DNA, 20 bp, human
gtactcctggggagcgtcat

SEQ ID NO: 304407 - DNA, 20 bp, human
gtacgtgggcgacgcacgga

SEQ ID NO: 304408 - DNA, 20 bp, human
gtgctgtgcggcgcggtctc

SEQ ID NO: 304409 - DNA, 20 bp, human
ggggcgggtcagaaacaacc

SEQ ID NO: 304410 - DNA, 20 bp, human
gtggggctatggcagctgct

SEQ ID NO: 304411 - DNA, 20 bp, human
gtgcggcgcggtctcaggga

SEQ ID NO: 304412 - DNA, 20 bp, human
gtcgcagcgatacttccgga

SEQ ID NO: 304413 - DNA, 20 bp, human
gcacccagcgaaaattgcgg

SEQ ID NO: 304414 - DNA, 20 bp, human
ggccagccaaggcgctccgg

SEQ ID NO: 304415 - DNA, 20 bp, human
gagggcgcatgcgtgctgtg

SEQ ID NO: 304416 - DNA, 20 bp, human
ggagtctacgtgttagggga

SEQ ID NO: 304417 - DNA, 20 bp, human
gcatgtgagtctacgtgtta

SEQ ID NO: 304418 - DNA, 20 bp, human
gttaaggatagcaagtctgg

SEQ ID NO: 304419 - DNA, 20 bp, human
gggatagcaagtctggtggc

SEQ ID NO: 304420 - DNA, 20 bp, human
gttcttaaggatagcaagtc

SEQ ID NO: 304421 - DNA, 20 bp, human
ggcactaagtttaatcaact

SEQ ID NO: 304422 - DNA, 20 bp, human
gatgacagaacataaaattt

SEQ ID NO: 304423 - DNA, 20 bp, human
gaggcgggtggacctgaggt

SEQ ID NO: 304424 - DNA, 20 bp, human
gtttaattttatttttctta

SEQ ID NO: 304425 - DNA, 20 bp, human
ggccaaggcgggtggacctg

SEQ ID NO: 304426 - DNA, 20 bp, human
gtcgcgaggcgtcccctcgg

SEQ ID NO: 304427 - DNA, 20 bp, human
gaaactgaggcggccgccga

SEQ ID NO: 304428 - DNA, 20 bp, human
gacgcctcgcgacggttcct

SEQ ID NO: 304429 - DNA, 20 bp, human
gcggcaccgggtcctccttc

SEQ ID NO: 304430 - DNA, 20 bp, human
gggaggacccggtgccggaa

SEQ ID NO: 304431 - DNA, 20 bp, human
gcggaccccggcgtctcccg

SEQ ID NO: 304432 - DNA, 20 bp, human
gcgcccgcgttttacggcca

SEQ ID NO: 304433 - DNA, 20 bp, human
gcccgcccgcctcaggattg

SEQ ID NO: 304434 - DNA, 20 bp, human
gcacccggctgcctccacgc

SEQ ID NO: 304435 - DNA, 20 bp, human
ggatgccccgggagacgccg

SEQ ID NO: 304436 - DNA, 20 bp, human
gtccgcccggggtccggtct

SEQ ID NO: 304437 - DNA, 20 bp, human
ggggccgcgcagaactctgg

SEQ ID NO: 304438 - DNA, 20 bp, human
gaagccgagcaggagggctc

SEQ ID NO: 304439 - DNA, 20 bp, human
gaactctggcggcggccgtg

SEQ ID NO: 304440 - DNA, 20 bp, human
gagcaggagggctccggaga

SEQ ID NO: 304441 - DNA, 20 bp, human
gaggccccaaaaacgagctc

SEQ ID NO: 304442 - DNA, 20 bp, human
gcacgcctagaccggacccc

SEQ ID NO: 304443 - DNA, 20 bp, human
ggcgcggcccgtcgcctcgg

SEQ ID NO: 304444 - DNA, 20 bp, human
gcctcggcggagcctctggc

SEQ ID NO: 304445 - DNA, 20 bp, human
ggcccctgagctcgtttttg

SEQ ID NO: 304446 - DNA, 20 bp, human
ggggaggccgcgaagagggt

SEQ ID NO: 304447 - DNA, 20 bp, human
ggaagagggtcgggcgggag

SEQ ID NO: 304448 - DNA, 20 bp, human
gtctttgcggcgtagaactc

SEQ ID NO: 304449 - DNA, 20 bp, human
ggggccccattgtgcctagc

SEQ ID NO: 304450 - DNA, 20 bp, human
gccgtcccctagacaaaaag

SEQ ID NO: 304451 - DNA, 20 bp, human
gttgttgggcggtccacaga

SEQ ID NO: 304452 - DNA, 20 bp, human
gaggccagctaggcacaatg

SEQ ID NO: 304453 - DNA, 20 bp, human
ggcgtagaactcgggctcgg

SEQ ID NO: 304454 - DNA, 20 bp, human
gccccaggccgaactgtgtc

SEQ ID NO: 304455 - DNA, 20 bp, human
ggtcgccgctttttgtctag

SEQ ID NO: 304456 - DNA, 20 bp, human
gacacccgggaggaaggagt

SEQ ID NO: 304457 - DNA, 20 bp, human
ggggaggaggcgaccggagt

SEQ ID NO: 304458 - DNA, 20 bp, human
gtgtgtgtgcgttaggtaga

SEQ ID NO: 304459 - DNA, 20 bp, human
ggcgtggcatgcagactggg

SEQ ID NO: 304460 - DNA, 20 bp, human
gccacccaactccttcctcc

SEQ ID NO: 304461 - DNA, 20 bp, human
gggactggagggggttggcg

SEQ ID NO: 304462 - DNA, 20 bp, human
gacaaggcttggctgagaga

SEQ ID NO: 304463 - DNA, 20 bp, human
gtaacgcacacacacccggg

SEQ ID NO: 304464 - DNA, 20 bp, human
gacctaacgcacacacaccc

SEQ ID NO: 304465 - DNA, 20 bp, human
gagcgcgaagccgggaagag

SEQ ID NO: 304466 - DNA, 20 bp, human
ggcagctgctccagtctggt

SEQ ID NO: 304467 - DNA, 20 bp, human
gagctgcgagtgctacatct

SEQ ID NO: 304468 - DNA, 20 bp, human
ggaagcgattggctcctctc

SEQ ID NO: 304469 - DNA, 20 bp, human
gtcccaacattccctcagaa

SEQ ID NO: 304470 - DNA, 20 bp, human
gcaggcttgcatgttttcct

SEQ ID NO: 304471 - DNA, 20 bp, human
gagaggacacactactgata

SEQ ID NO: 304472 - DNA, 20 bp, human
gttgtttcagccaaccagac

SEQ ID NO: 304473 - DNA, 20 bp, human
gacttcagagacggagttgg

SEQ ID NO: 304474 - DNA, 20 bp, human
gcttggctgtctgaagcgat

SEQ ID NO: 304475 - DNA, 20 bp, human
gcacatatgctaaattaagt

SEQ ID NO: 304476 - DNA, 20 bp, human
gcgagaggtaaagatgggga

SEQ ID NO: 304477 - DNA, 20 bp, human
gggaaaggtagtgttccgag

SEQ ID NO: 304478 - DNA, 20 bp, human
gagtcaggacccatcctccc

SEQ ID NO: 304479 - DNA, 20 bp, human
ggttccgagaggtaaagatg

SEQ ID NO: 304480 - DNA, 20 bp, human
ggggcaggccctagcgggag

SEQ ID NO: 304481 - DNA, 20 bp, human
gaaagatggggagggctagg

SEQ ID NO: 304482 - DNA, 20 bp, human
gagcagcgctgtcacctctt

SEQ ID NO: 304483 - DNA, 20 bp, human
gcccccgctcagtgacagtg

SEQ ID NO: 304484 - DNA, 20 bp, human
ggagtagcggtgagggctag

SEQ ID NO: 304485 - DNA, 20 bp, human
gaatgaaaggagtagcggtg

SEQ ID NO: 304486 - DNA, 20 bp, human
ggggaggggaacatagaagg

SEQ ID NO: 304487 - DNA, 20 bp, human
ggaagtcatacaacgggatg

SEQ ID NO: 304488 - DNA, 20 bp, human
gtggtgattgccaaaaaaga

SEQ ID NO: 304489 - DNA, 20 bp, human
ggccacctggctgatattag

SEQ ID NO: 304490 - DNA, 20 bp, human
gaaggctgaagtcatacaac

SEQ ID NO: 304491 - DNA, 20 bp, human
ggtgactcagtccctctgaa

SEQ ID NO: 304492 - DNA, 20 bp, human
gaggaagggaggggtgtaga

SEQ ID NO: 304493 - DNA, 20 bp, human
gtcatacaacgggatgggga

SEQ ID NO: 304494 - DNA, 20 bp, human
ggggactgagtcacggggcc

SEQ ID NO: 304495 - DNA, 20 bp, human
gccaggagcttagaatccga

SEQ ID NO: 304496 - DNA, 20 bp, human
gccccgagcacctcagacat

SEQ ID NO: 304497 - DNA, 20 bp, human
gacatgggcagattgaaaag

SEQ ID NO: 304498 - DNA, 20 bp, human
ggggcagattgaaaaggggt

SEQ ID NO: 304499 - DNA, 20 bp, human
gatggcttcccaaactaggt

SEQ ID NO: 304500 - DNA, 20 bp, human
gcacgtagacagttttaaag

SEQ ID NO: 304501 - DNA, 20 bp, human
gacgacactcagtgagcagt

SEQ ID NO: 304502 - DNA, 20 bp, human
gttcaatctgcccatgtctg

SEQ ID NO: 304503 - DNA, 20 bp, human
gacaggaaggcaatgatttg

SEQ ID NO: 304504 - DNA, 20 bp, human
ggctctcccccttgcctttt

SEQ ID NO: 304505 - DNA, 20 bp, human
gtagtggttcggtaaaatgt

SEQ ID NO: 304506 - DNA, 20 bp, human
gaccacacagaactgtatat

SEQ ID NO: 304507 - DNA, 20 bp, human
gagaatcggcagtctaacac

SEQ ID NO: 304508 - DNA, 20 bp, human
ggtatataggctgacgtcac

SEQ ID NO: 304509 - DNA, 20 bp, human
gccgagaaacggcacaagaa

SEQ ID NO: 304510 - DNA, 20 bp, human
gctgctgcttcctacactga

SEQ ID NO: 304511 - DNA, 20 bp, human
gcccatctgaacagtgagtt

SEQ ID NO: 304512 - DNA, 20 bp, human
gagcagtgaggttgtaataa

SEQ ID NO: 304513 - DNA, 20 bp, human
gtctcgctttattgtaatca

SEQ ID NO: 304514 - DNA, 20 bp, human
ggatgacgtgtcttttgttt

SEQ ID NO: 304515 - DNA, 20 bp, human
gacagcatcggggtcgttgc

SEQ ID NO: 304516 - DNA, 20 bp, human
gcagtggtgaagaacattat

SEQ ID NO: 304517 - DNA, 20 bp, human
gtatgtaaagctgcccccag

SEQ ID NO: 304518 - DNA, 20 bp, human
ggtgctgcccagagtttttc

SEQ ID NO: 304519 - DNA, 20 bp, human
gagaaaaccggaaaggctat

SEQ ID NO: 304520 - DNA, 20 bp, human
gtgactccaagaggtcaaat

SEQ ID NO: 304521 - DNA, 20 bp, human
ggttaagaaaaattgacgtt

SEQ ID NO: 304522 - DNA, 20 bp, human
gtgttgctagttattgatca

SEQ ID NO: 304523 - DNA, 20 bp, human
gttcttttgggtggctcagt

SEQ ID NO: 304524 - DNA, 20 bp, human
gcacatgtttagcaattaag

SEQ ID NO: 304525 - DNA, 20 bp, human
gttttatcttgcaaatgagc

SEQ ID NO: 304526 - DNA, 20 bp, human
ggaacaagtgagcctgtcag

SEQ ID NO: 304527 - DNA, 20 bp, human
gataactgaaaggaactcct

SEQ ID NO: 304528 - DNA, 20 bp, human
gaatttccctttctgagcaa

SEQ ID NO: 304529 - DNA, 20 bp, human
gaatatttgctataactgaa

SEQ ID NO: 304530 - DNA, 20 bp, human
gtgttttttctgcacgtcac

SEQ ID NO: 304531 - DNA, 20 bp, human
gcagattgcacattaaagac

SEQ ID NO: 304532 - DNA, 20 bp, human
gatggaagaaatcttattca

SEQ ID NO: 304533 - DNA, 20 bp, human
gtacactgagtgccctccgc

SEQ ID NO: 304534 - DNA, 20 bp, human
gaatctgttttctccagcgg

SEQ ID NO: 304535 - DNA, 20 bp, human
ggttttaaactaaccgctta

SEQ ID NO: 304536 - DNA, 20 bp, human
ggcgcggacaagccagatat

SEQ ID NO: 304537 - DNA, 20 bp, human
gatggcgacaagggcgtctc

SEQ ID NO: 304538 - DNA, 20 bp, human
gcgcctgcccacaacaaaca

SEQ ID NO: 304539 - DNA, 20 bp, human
gcgagaggccggaaatcgcg

SEQ ID NO: 304540 - DNA, 20 bp, human
gacaacaaacatggcgacaa

SEQ ID NO: 304541 - DNA, 20 bp, human
gccggattcgggacgaccga

SEQ ID NO: 304542 - DNA, 20 bp, human
ggcaacaccgggaaggtctc

SEQ ID NO: 304543 - DNA, 20 bp, human
gcgacaagggcgtctctgga

SEQ ID NO: 304544 - DNA, 20 bp, human
ggggcggcgcaacaccggga

SEQ ID NO: 304545 - DNA, 20 bp, human
gtgggagcccgcacgcccta

SEQ ID NO: 304546 - DNA, 20 bp, human
gggaaaggcagggatgatcc

SEQ ID NO: 304547 - DNA, 20 bp, human
gcgtctgaatgggaaaggca

SEQ ID NO: 304548 - DNA, 20 bp, human
gctcatcgtctgaatgggaa

SEQ ID NO: 304549 - DNA, 20 bp, human
gcaaaaaggccgaggcactg

SEQ ID NO: 304550 - DNA, 20 bp, human
gaacccaaagaggggtgacc

SEQ ID NO: 304551 - DNA, 20 bp, human
gttaaaatgttggcctcccc

SEQ ID NO: 304552 - DNA, 20 bp, human
ggaaactgatcccagccaga

SEQ ID NO: 304553 - DNA, 20 bp, human
gcgcggctcatcgtctgaat

SEQ ID NO: 304554 - DNA, 20 bp, human
gaaagaggggtgacccggca

SEQ ID NO: 304555 - DNA, 20 bp, human
gttgacaaacattctttacg

SEQ ID NO: 304556 - DNA, 20 bp, human
gaagacaggtgcagccgggg

SEQ ID NO: 304557 - DNA, 20 bp, human
gcggccggccgtggtgcctc

SEQ ID NO: 304558 - DNA, 20 bp, human
gcagcgagccagagtggagc

SEQ ID NO: 304559 - DNA, 20 bp, human
gggtgcatctgtgatgacag

SEQ ID NO: 304560 - DNA, 20 bp, human
gggagcggggagtgacagct

SEQ ID NO: 304561 - DNA, 20 bp, human
gacacacaggcgcacaccag

SEQ ID NO: 304562 - DNA, 20 bp, human
gggtgcagccgggggggtga

SEQ ID NO: 304563 - DNA, 20 bp, human
ggtcactccccgctccactc

SEQ ID NO: 304564 - DNA, 20 bp, human
ggctgccgaccacagggagg

SEQ ID NO: 304565 - DNA, 20 bp, human
gtgagcgctgccctcgcggc

SEQ ID NO: 304566 - DNA, 20 bp, human
ggaccccggcctgtacttga

SEQ ID NO: 304567 - DNA, 20 bp, human
gacaggccggggtccggaag

SEQ ID NO: 304568 - DNA, 20 bp, human
ggggaccttcagtttgtcag

SEQ ID NO: 304569 - DNA, 20 bp, human
gctggcgcgagcccacgaag

SEQ ID NO: 304570 - DNA, 20 bp, human
gccgacagaggccaatcaga

SEQ ID NO: 304571 - DNA, 20 bp, human
gtatcaccgcttccggaccc

SEQ ID NO: 304572 - DNA, 20 bp, human
gtgtcggcggggcccgctta

SEQ ID NO: 304573 - DNA, 20 bp, human
gccgggaaaaggaagtttga

SEQ ID NO: 304574 - DNA, 20 bp, human
gcaaggccgcgggtgacgct

SEQ ID NO: 304575 - DNA, 20 bp, human
gcggggcccgcttaaggacc

SEQ ID NO: 304576 - DNA, 20 bp, human
gcattcccgaaggacttcgg

SEQ ID NO: 304577 - DNA, 20 bp, human
ggcccccagcggtaaggggt

SEQ ID NO: 304578 - DNA, 20 bp, human
ggagctgcccccagcggtaa

SEQ ID NO: 304579 - DNA, 20 bp, human
ggagacccccgaagtccttc

SEQ ID NO: 304580 - DNA, 20 bp, human
gcacgcggacggcgcgatgg

SEQ ID NO: 304581 - DNA, 20 bp, human
gaggacttcgggggtctcgg

SEQ ID NO: 304582 - DNA, 20 bp, human
gagcccggcactggcgtccg

SEQ ID NO: 304583 - DNA, 20 bp, human
gctgacccagtcggccaccc

SEQ ID NO: 304584 - DNA, 20 bp, human
gagtgcgcaggcgcggccgt

SEQ ID NO: 304585 - DNA, 20 bp, human
gccccaagagcgaccggctg

SEQ ID NO: 304586 - DNA, 20 bp, human
gaagcgaggggccacgtcga

SEQ ID NO: 304587 - DNA, 20 bp, human
gaggggccacgtcgagggga

SEQ ID NO: 304588 - DNA, 20 bp, human
gcggaggggatgacgtggag

SEQ ID NO: 304589 - DNA, 20 bp, human
gggccacgtcgaggggaggg

SEQ ID NO: 304590 - DNA, 20 bp, human
gacgtcgaggggagggcgga

SEQ ID NO: 304591 - DNA, 20 bp, human
gggcagttgtgcaaagcgag

SEQ ID NO: 304592 - DNA, 20 bp, human
gcccgccagcctgggaaagt

SEQ ID NO: 304593 - DNA, 20 bp, human
gaaagtgggttacagagcga

SEQ ID NO: 304594 - DNA, 20 bp, human
gggtactgttcaggagagag

SEQ ID NO: 304595 - DNA, 20 bp, human
ggacagctccatctgaggcc

SEQ ID NO: 304596 - DNA, 20 bp, human
gggaggacgcggagactcgg

SEQ ID NO: 304597 - DNA, 20 bp, human
gcggaggaagagtgtttcgg

SEQ ID NO: 304598 - DNA, 20 bp, human
gacgtgctctagtttctcgc

SEQ ID NO: 304599 - DNA, 20 bp, human
gtgacggaagcagcggaagg

SEQ ID NO: 304600 - DNA, 20 bp, human
gagtctccgcgtcctcctga

SEQ ID NO: 304601 - DNA, 20 bp, human
gtcctgacggaagcagcgga

SEQ ID NO: 304602 - DNA, 20 bp, human
gcggagctagtgccgcgaat

SEQ ID NO: 304603 - DNA, 20 bp, human
gccgaggtgtggtctctccg

SEQ ID NO: 304604 - DNA, 20 bp, human
gggtaaaatcgagacgtaaa

SEQ ID NO: 304605 - DNA, 20 bp, human
gcgaccccagctgcgaactg

SEQ ID NO: 304606 - DNA, 20 bp, human
gcccgaaagctgagggacgg

SEQ ID NO: 304607 - DNA, 20 bp, human
gcggggttcggcagcagaag

SEQ ID NO: 304608 - DNA, 20 bp, human
ggacgacgccagccaatccc

SEQ ID NO: 304609 - DNA, 20 bp, human
gcgaatggagagcagcgaag

SEQ ID NO: 304610 - DNA, 20 bp, human
gcggggcagccgtaccgttg

SEQ ID NO: 304611 - DNA, 20 bp, human
ggcccgcgggcgattgcgaa

SEQ ID NO: 304612 - DNA, 20 bp, human
gttcctgttaagtaggtaag

SEQ ID NO: 304613 - DNA, 20 bp, human
ggggcgcctgcgcgatgggt

SEQ ID NO: 304614 - DNA, 20 bp, human
gggaaactccattggataaa

SEQ ID NO: 304615 - DNA, 20 bp, human
ggccgaaccccgaaagctga

SEQ ID NO: 304616 - DNA, 20 bp, human
gaaatcccggcctgcgtcat

SEQ ID NO: 304617 - DNA, 20 bp, human
gtgaaccggcgacctgggcc

SEQ ID NO: 304618 - DNA, 20 bp, human
gaaagagactccaatgacgc

SEQ ID NO: 304619 - DNA, 20 bp, human
gcgcgccgcgaagcattctg

SEQ ID NO: 304620 - DNA, 20 bp, human
gccgcacgcattcattgaac

SEQ ID NO: 304621 - DNA, 20 bp, human
ggctcgtgctccgcaaatcc

SEQ ID NO: 304622 - DNA, 20 bp, human
gagcagtgaccaagatcaag

SEQ ID NO: 304623 - DNA, 20 bp, human
gtccttcccaggctccggca

SEQ ID NO: 304624 - DNA, 20 bp, human
gtgagctgatggcgctgcag

SEQ ID NO: 304625 - DNA, 20 bp, human
gtcagggagccacttgatct

SEQ ID NO: 304626 - DNA, 20 bp, human
gaggaggcggtgcgaggcgc

SEQ ID NO: 304627 - DNA, 20 bp, human
gccccggcccgggtggaacg

SEQ ID NO: 304628 - DNA, 20 bp, human
gggccggggggcgtggtacg

SEQ ID NO: 304629 - DNA, 20 bp, human
ggaggacagacacccagtat

SEQ ID NO: 304630 - DNA, 20 bp, human
ggcgttaacctgtcagctat

SEQ ID NO: 304631 - DNA, 20 bp, human
ggggttgcactgcgccgaag

SEQ ID NO: 304632 - DNA, 20 bp, human
gtatgggaggaggcggtgcg

SEQ ID NO: 304633 - DNA, 20 bp, human
gacagacggggaaactgcgc

SEQ ID NO: 304634 - DNA, 20 bp, human
ggcctcctcccatagctgac

SEQ ID NO: 304635 - DNA, 20 bp, human
gtgagctggcaggaagcgtc

SEQ ID NO: 304636 - DNA, 20 bp, human
gctggttggggcgggatcct

SEQ ID NO: 304637 - DNA, 20 bp, human
ggcgtggcctggcgctggtt

SEQ ID NO: 304638 - DNA, 20 bp, human
ggacctacgtggaatgaaaa

SEQ ID NO: 304639 - DNA, 20 bp, human
gagtgagcgccgcgacgcga

SEQ ID NO: 304640 - DNA, 20 bp, human
gcgtgcgcgccgtcgcgtcg

SEQ ID NO: 304641 - DNA, 20 bp, human
ggcgggatcctaggtggagt

SEQ ID NO: 304642 - DNA, 20 bp, human
gtgcgtcacacgccggggcg

SEQ ID NO: 304643 - DNA, 20 bp, human
gcgtgcttgcgtcacacgcc

SEQ ID NO: 304644 - DNA, 20 bp, human
ggtggaaggtgtgcatataa

SEQ ID NO: 304645 - DNA, 20 bp, human
gtaaggataaatgacctacg

SEQ ID NO: 304646 - DNA, 20 bp, human
gcggcgcggggcatgctggg

SEQ ID NO: 304647 - DNA, 20 bp, human
ggtggctcccggctcattcg

SEQ ID NO: 304648 - DNA, 20 bp, human
gcgctctcgcgagacttggc

SEQ ID NO: 304649 - DNA, 20 bp, human
ggagtcccggcagcgcttgt

SEQ ID NO: 304650 - DNA, 20 bp, human
ggccgtggccgccttgtcgt

SEQ ID NO: 304651 - DNA, 20 bp, human
gagacttggccggctactgg

SEQ ID NO: 304652 - DNA, 20 bp, human
gcccgaggccacgaatgagc

SEQ ID NO: 304653 - DNA, 20 bp, human
ggactacggtggtggtcttg

SEQ ID NO: 304654 - DNA, 20 bp, human
gggtcttggggccgcgtgag

SEQ ID NO: 304655 - DNA, 20 bp, human
gacggcctgagtcaaaagga

SEQ ID NO: 304656 - DNA, 20 bp, human
gggcggcgagcgtgaagggg

SEQ ID NO: 304657 - DNA, 20 bp, human
gctgcgcaggaacgacgcga

SEQ ID NO: 304658 - DNA, 20 bp, human
ggcggcccggccatatttaa

SEQ ID NO: 304659 - DNA, 20 bp, human
gaatgggcggcgagcgtgaa

SEQ ID NO: 304660 - DNA, 20 bp, human
ggagacccgcccccggccag

SEQ ID NO: 304661 - DNA, 20 bp, human
gagggtggggcggatcgccg

SEQ ID NO: 304662 - DNA, 20 bp, human
gtggccgggccgccagctgg

SEQ ID NO: 304663 - DNA, 20 bp, human
gcgagggcccgccccccagc

SEQ ID NO: 304664 - DNA, 20 bp, human
gtgggagcacgagactgagc

SEQ ID NO: 304665 - DNA, 20 bp, human
ggaggggtgggaagcggccc

SEQ ID NO: 304666 - DNA, 20 bp, human
gcaggcgcggaccctagcct

SEQ ID NO: 304667 - DNA, 20 bp, human
ggcaagctgggtagagtaga

SEQ ID NO: 304668 - DNA, 20 bp, human
gactcagcgcctgagctcaa

SEQ ID NO: 304669 - DNA, 20 bp, human
gcggctggggagcgcaagct

SEQ ID NO: 304670 - DNA, 20 bp, human
ggctgtagatggcaggattc

SEQ ID NO: 304671 - DNA, 20 bp, human
ggggtccgcgcctgcgcaat

SEQ ID NO: 304672 - DNA, 20 bp, human
gagggaggaagtcggaatga

SEQ ID NO: 304673 - DNA, 20 bp, human
gggaggaggaagccgggaaa

SEQ ID NO: 304674 - DNA, 20 bp, human
gcgtctggcagcccaggcta

SEQ ID NO: 304675 - DNA, 20 bp, human
ggggcgaggcgggaccgcgc

SEQ ID NO: 304676 - DNA, 20 bp, human
gggccacgccccttcgttgg

SEQ ID NO: 304677 - DNA, 20 bp, human
gtggccaagcgcaccgcctc

SEQ ID NO: 304678 - DNA, 20 bp, human
gcaagcgcaccgcctcgggg

SEQ ID NO: 304679 - DNA, 20 bp, human
gtggggtggagcttccttta

SEQ ID NO: 304680 - DNA, 20 bp, human
gcttggccacgccccttcgt

SEQ ID NO: 304681 - DNA, 20 bp, human
gtgactaggcctccaacgaa

SEQ ID NO: 304682 - DNA, 20 bp, human
gaagctccaccccatacccg

SEQ ID NO: 304683 - DNA, 20 bp, human
gccgcgatgcgctagaacgc

SEQ ID NO: 304684 - DNA, 20 bp, human
gggcctagtcacgcccctaa

SEQ ID NO: 304685 - DNA, 20 bp, human
gcaagagcaacgtcaatctc

SEQ ID NO: 304686 - DNA, 20 bp, human
gcgagagccgtaaagtgccg

SEQ ID NO: 304687 - DNA, 20 bp, human
gtgttcccgccggaggaacg

SEQ ID NO: 304688 - DNA, 20 bp, human
ggagcccaggagaccgacga

SEQ ID NO: 304689 - DNA, 20 bp, human
gggccccgccctactccgcg

SEQ ID NO: 304690 - DNA, 20 bp, human
gggcccgctgggcgaaaggg

SEQ ID NO: 304691 - DNA, 20 bp, human
gcggcgcggggtgcattgtg

SEQ ID NO: 304692 - DNA, 20 bp, human
gagtcagcaccgggctcgaa

SEQ ID NO: 304693 - DNA, 20 bp, human
ggaggcggagcaacgcgcgc

SEQ ID NO: 304694 - DNA, 20 bp, human
gcggggcccgctgggcgaaa

SEQ ID NO: 304695 - DNA, 20 bp, human
gtacaagccgcggcacttta

SEQ ID NO: 304696 - DNA, 20 bp, human
gttccccggcaagtgagatc

SEQ ID NO: 304697 - DNA, 20 bp, human
gacgatctagtcagctgcgt

SEQ ID NO: 304698 - DNA, 20 bp, human
gtcaccggatctcacttgcc

SEQ ID NO: 304699 - DNA, 20 bp, human
gaacaggctcgaccaatctg

SEQ ID NO: 304700 - DNA, 20 bp, human
gactggacattttaccatct

SEQ ID NO: 304701 - DNA, 20 bp, human
gcgtgcgctcggcctcagat

SEQ ID NO: 304702 - DNA, 20 bp, human
gctgcgtgggtcgcgttcac

SEQ ID NO: 304703 - DNA, 20 bp, human
gagaggaaatgcaactttac

SEQ ID NO: 304704 - DNA, 20 bp, human
gaagaagactcaaacgttac

SEQ ID NO: 304705 - DNA, 20 bp, human
gcgtctctccaaaacttcaa

SEQ ID NO: 304706 - DNA, 20 bp, human
gaggagagatcgactctgtg

SEQ ID NO: 304707 - DNA, 20 bp, human
gaagctgcggaagcggatga

SEQ ID NO: 304708 - DNA, 20 bp, human
gagagatcgactctgtgggg

SEQ ID NO: 304709 - DNA, 20 bp, human
gagcggggtgggtctaggag

SEQ ID NO: 304710 - DNA, 20 bp, human
ggggctgtcacctgacacgg

SEQ ID NO: 304711 - DNA, 20 bp, human
gaggccgggagggccctgac

SEQ ID NO: 304712 - DNA, 20 bp, human
gtgcggaagcggatgaggga

SEQ ID NO: 304713 - DNA, 20 bp, human
gcggcggcggccgccgtgtc

SEQ ID NO: 304714 - DNA, 20 bp, human
gtccgggctgtcacctgaca

SEQ ID NO: 304715 - DNA, 20 bp, human
ggagggccgcacagggagat

SEQ ID NO: 304716 - DNA, 20 bp, human
gcgcgcaaatccaagattcc

SEQ ID NO: 304717 - DNA, 20 bp, human
gctgctacggcagcccgctg

SEQ ID NO: 304718 - DNA, 20 bp, human
ggaagagcactgattggctg

SEQ ID NO: 304719 - DNA, 20 bp, human
gtgcgcgctttggtgctgac

SEQ ID NO: 304720 - DNA, 20 bp, human
gaggctttttcggccccagc

SEQ ID NO: 304721 - DNA, 20 bp, human
gtcagtgctcttctctgcta

SEQ ID NO: 304722 - DNA, 20 bp, human
gctagacaaaccaggaatct

SEQ ID NO: 304723 - DNA, 20 bp, human
gagtagcaaaattggtgcag

SEQ ID NO: 304724 - DNA, 20 bp, human
ggtactcagatttctgttag

SEQ ID NO: 304725 - DNA, 20 bp, human
gacttgaagtcataggaaac

SEQ ID NO: 304726 - DNA, 20 bp, human
gtgggccgcgaggagcagaa

SEQ ID NO: 304727 - DNA, 20 bp, human
gccggccgacatggcggcag

SEQ ID NO: 304728 - DNA, 20 bp, human
gcgggcaccggccgacatgg

SEQ ID NO: 304729 - DNA, 20 bp, human
gacacggcgcgacaagatgg

SEQ ID NO: 304730 - DNA, 20 bp, human
gaccccgctcggcccgtctt

SEQ ID NO: 304731 - DNA, 20 bp, human
gaccggtgccgcgctcacct

SEQ ID NO: 304732 - DNA, 20 bp, human
gagcgcggcaccggtcccga

SEQ ID NO: 304733 - DNA, 20 bp, human
gccggccgacaacgcgggga

SEQ ID NO: 304734 - DNA, 20 bp, human
gcatgcgtggcccggggtct

SEQ ID NO: 304735 - DNA, 20 bp, human
ggcgcgtgggggaggtcaaa

SEQ ID NO: 304736 - DNA, 20 bp, human
gcatggcaggagtgctggaa

SEQ ID NO: 304737 - DNA, 20 bp, human
gcagcaggatactaacagtg

SEQ ID NO: 304738 - DNA, 20 bp, human
gtacaaaaagcgattgtgag

SEQ ID NO: 304739 - DNA, 20 bp, human
gcgtgtttattgcagttctc

SEQ ID NO: 304740 - DNA, 20 bp, human
gtgattatgacatcataaca

SEQ ID NO: 304741 - DNA, 20 bp, human
gtgcagttctctggtttgtc

SEQ ID NO: 304742 - DNA, 20 bp, human
gtgcaagtcagtcatcatag

SEQ ID NO: 304743 - DNA, 20 bp, human
gggagtgcttccttcacctg

SEQ ID NO: 304744 - DNA, 20 bp, human
gtgtagctactggaagcact

SEQ ID NO: 304745 - DNA, 20 bp, human
gggaaaggcggccgatgaga

SEQ ID NO: 304746 - DNA, 20 bp, human
gagcctgcctccactagtcc

SEQ ID NO: 304747 - DNA, 20 bp, human
gtggcagccaagacagacaa

SEQ ID NO: 304748 - DNA, 20 bp, human
gtccactagtccaggtgccc

SEQ ID NO: 304749 - DNA, 20 bp, human
gcacctggactagtggaggc

SEQ ID NO: 304750 - DNA, 20 bp, human
gctcccccatacatccagaa

SEQ ID NO: 304751 - DNA, 20 bp, human
gggagtctgcaggggtagag

SEQ ID NO: 304752 - DNA, 20 bp, human
ggtgcccagggaccttcaag

SEQ ID NO: 304753 - DNA, 20 bp, human
gtggccaaatagagatgcac

SEQ ID NO: 304754 - DNA, 20 bp, human
gtgaactatctacctggtga

SEQ ID NO: 304755 - DNA, 20 bp, human
gcctctaaatatagcccagt

SEQ ID NO: 304756 - DNA, 20 bp, human
gctcggataacattctgcat

SEQ ID NO: 304757 - DNA, 20 bp, human
gaaaaatttagcacacggcg

SEQ ID NO: 304758 - DNA, 20 bp, human
ggataacattctgcataggc

SEQ ID NO: 304759 - DNA, 20 bp, human
gggaaatctccttttaactt

SEQ ID NO: 304760 - DNA, 20 bp, human
gaaaaaagtccacaaagcac

SEQ ID NO: 304761 - DNA, 20 bp, human
gttaagtaagctttaaaaaa

SEQ ID NO: 304762 - DNA, 20 bp, human
gttaggaaattttagaaaat

SEQ ID NO: 304763 - DNA, 20 bp, human
gtgtcaaaaaatttagcaca

SEQ ID NO: 304764 - DNA, 20 bp, human
gtagcacacggcgcgggcgc

SEQ ID NO: 304765 - DNA, 20 bp, human
ggttcattgaaaataaaaac

SEQ ID NO: 304766 - DNA, 20 bp, human
gtgggcttaggggtgagcgg

SEQ ID NO: 304767 - DNA, 20 bp, human
ggttcggcccaggtacacaa

SEQ ID NO: 304768 - DNA, 20 bp, human
gcgtaaacgacgtggacaaa

SEQ ID NO: 304769 - DNA, 20 bp, human
gacacaagggtgggagccga

SEQ ID NO: 304770 - DNA, 20 bp, human
gagggcccgaaccaagtgac

SEQ ID NO: 304771 - DNA, 20 bp, human
gccggtgaatggttcggccc

SEQ ID NO: 304772 - DNA, 20 bp, human
gcagcgggtggagtgtggct

SEQ ID NO: 304773 - DNA, 20 bp, human
gcggacttggagtagggaca

SEQ ID NO: 304774 - DNA, 20 bp, human
gcggtccggaggaaccccag

SEQ ID NO: 304775 - DNA, 20 bp, human
gcccggaagtgggctgaccc

SEQ ID NO: 304776 - DNA, 20 bp, human
gcaccccggggtcacgctcg

SEQ ID NO: 304777 - DNA, 20 bp, human
gcaggcgctcaggcttaggt

SEQ ID NO: 304778 - DNA, 20 bp, human
gagcgccgcgagcgtgaccc

SEQ ID NO: 304779 - DNA, 20 bp, human
ggccccgccccacgccgcat

SEQ ID NO: 304780 - DNA, 20 bp, human
ggtgtgccaggcgaccacag

SEQ ID NO: 304781 - DNA, 20 bp, human
gcaggcctcggcaggcgctc

SEQ ID NO: 304782 - DNA, 20 bp, human
gacgctcgcggcgctctgat

SEQ ID NO: 304783 - DNA, 20 bp, human
ggcgctctgattggttgcgt

SEQ ID NO: 304784 - DNA, 20 bp, human
gcctcccgcgcgcactacgc

SEQ ID NO: 304785 - DNA, 20 bp, human
gtcggcaggcgctcaggctt

SEQ ID NO: 304786 - DNA, 20 bp, human
gagtgaaatgactggagctg

SEQ ID NO: 304787 - DNA, 20 bp, human
gaagttcggctccagggtta

SEQ ID NO: 304788 - DNA, 20 bp, human
gaaggaggtgtgggcaatac

SEQ ID NO: 304789 - DNA, 20 bp, human
ggagctgcagaacaccaagt

SEQ ID NO: 304790 - DNA, 20 bp, human
gggctcatgtagatctagta

SEQ ID NO: 304791 - DNA, 20 bp, human
ggagaggaagttcggctcca

SEQ ID NO: 304792 - DNA, 20 bp, human
ggcaggatcagtgaaatgac

SEQ ID NO: 304793 - DNA, 20 bp, human
ggaggtgtgggcaatacagg

SEQ ID NO: 304794 - DNA, 20 bp, human
gtcaacagatgcagtgtaag

SEQ ID NO: 304795 - DNA, 20 bp, human
ggacaagttggtgacaggaa

SEQ ID NO: 304796 - DNA, 20 bp, human
ggttctggggattagcagtg

SEQ ID NO: 304797 - DNA, 20 bp, human
ggggtgacctagtaaagtcc

SEQ ID NO: 304798 - DNA, 20 bp, human
gggtgctggtaaggggatga

SEQ ID NO: 304799 - DNA, 20 bp, human
gcgggtctttacttgggcaa

SEQ ID NO: 304800 - DNA, 20 bp, human
gcccagaacatagggtatca

SEQ ID NO: 304801 - DNA, 20 bp, human
gaaccccagctccacctttc

SEQ ID NO: 304802 - DNA, 20 bp, human
gcagcacctagaaccatcca

SEQ ID NO: 304803 - DNA, 20 bp, human
gctgggctgaccacgtggtt

SEQ ID NO: 304804 - DNA, 20 bp, human
ggaatctcgggtctttactt

SEQ ID NO: 304805 - DNA, 20 bp, human
gtaggtcacccatcccagaa

SEQ ID NO: 304806 - DNA, 20 bp, human
gcagcgggcgggttctaggt

SEQ ID NO: 304807 - DNA, 20 bp, human
ggttcaggcgactgagttct

SEQ ID NO: 304808 - DNA, 20 bp, human
ggtcgggtcaggggaatcgt

SEQ ID NO: 304809 - DNA, 20 bp, human
gaggcctaggagagaaccac

SEQ ID NO: 304810 - DNA, 20 bp, human
ggcgactgagttctgggaaa

SEQ ID NO: 304811 - DNA, 20 bp, human
gggaaagggagtcgggtcag

SEQ ID NO: 304812 - DNA, 20 bp, human
gagaagcctgtactcagcca

SEQ ID NO: 304813 - DNA, 20 bp, human
gggtcaggggaatcgtgggc

SEQ ID NO: 304814 - DNA, 20 bp, human
gtaggcctgaccccactccc

SEQ ID NO: 304815 - DNA, 20 bp, human
gctgccgcttcctctataaa

SEQ ID NO: 304816 - DNA, 20 bp, human
gtgtgtgttagggatgttga

SEQ ID NO: 304817 - DNA, 20 bp, human
gaaagtcagacgagcgttgg

SEQ ID NO: 304818 - DNA, 20 bp, human
ggctcctggagctgaagaag

SEQ ID NO: 304819 - DNA, 20 bp, human
gacctgggagcgtgtgtgtt

SEQ ID NO: 304820 - DNA, 20 bp, human
gggagtaggggcagttagaa

SEQ ID NO: 304821 - DNA, 20 bp, human
gcagacgagcgttgggggat

SEQ ID NO: 304822 - DNA, 20 bp, human
gcagttagaagggtggccga

SEQ ID NO: 304823 - DNA, 20 bp, human
ggaaggaactacaagttcca

SEQ ID NO: 304824 - DNA, 20 bp, human
gagcgggcgcttggctacct

SEQ ID NO: 304825 - DNA, 20 bp, human
gccctaacacacacgctccc

SEQ ID NO: 304826 - DNA, 20 bp, human
ggcctgggttctctgaactg

SEQ ID NO: 304827 - DNA, 20 bp, human
gaagttgaggttagggagac

SEQ ID NO: 304828 - DNA, 20 bp, human
gtgtgcggaaagtcccagcc

SEQ ID NO: 304829 - DNA, 20 bp, human
gcaggggtgggaggctccag

SEQ ID NO: 304830 - DNA, 20 bp, human
ggctctcagggtggaaccaa

SEQ ID NO: 304831 - DNA, 20 bp, human
ggaaccagagccagagcagg

SEQ ID NO: 304832 - DNA, 20 bp, human
ggctctggttcagtctcaat

SEQ ID NO: 304833 - DNA, 20 bp, human
gccaggtgtgcaggtctaca

SEQ ID NO: 304834 - DNA, 20 bp, human
gcaagggccggactaggaca

SEQ ID NO: 304835 - DNA, 20 bp, human
gtagacctgcacacctggct

SEQ ID NO: 304836 - DNA, 20 bp, human
gggggcccagagcaagccga

SEQ ID NO: 304837 - DNA, 20 bp, human
gtcgccaaggccccttccgg

SEQ ID NO: 304838 - DNA, 20 bp, human
gaagccgaaggcaagcacga

SEQ ID NO: 304839 - DNA, 20 bp, human
gcgtgacgctggcacggctg

SEQ ID NO: 304840 - DNA, 20 bp, human
gcacaggtggcggtagacgg

SEQ ID NO: 304841 - DNA, 20 bp, human
gtggggctccgggcggcacg

SEQ ID NO: 304842 - DNA, 20 bp, human
gcggcggcgtggaccggcga

SEQ ID NO: 304843 - DNA, 20 bp, human
gaggttgactgcgtggtagg

SEQ ID NO: 304844 - DNA, 20 bp, human
gctacagcgtgacgctggca

SEQ ID NO: 304845 - DNA, 20 bp, human
ggggacggcgagcaacaggg

SEQ ID NO: 304846 - DNA, 20 bp, human
ggggcagtaagattccctgg

SEQ ID NO: 304847 - DNA, 20 bp, human
gaaacagcacaagctgaagt

SEQ ID NO: 304848 - DNA, 20 bp, human
gaatggggagggacaagatg

SEQ ID NO: 304849 - DNA, 20 bp, human
gagcccggtgagagccctga

SEQ ID NO: 304850 - DNA, 20 bp, human
gcgcctgggtgcgttggtga

SEQ ID NO: 304851 - DNA, 20 bp, human
gggaggactctgctgaatcc

SEQ ID NO: 304852 - DNA, 20 bp, human
gcctggacgcctgggtgcgt

SEQ ID NO: 304853 - DNA, 20 bp, human
gcatggaggcataatggtta

SEQ ID NO: 304854 - DNA, 20 bp, human
gacaagatgaggctcatcct

SEQ ID NO: 304855 - DNA, 20 bp, human
ggtggggcagtaagattccc

SEQ ID NO: 304856 - DNA, 20 bp, human
ggaagtcgagtcactggagt

SEQ ID NO: 304857 - DNA, 20 bp, human
ggggttggccgtgcacctag

SEQ ID NO: 304858 - DNA, 20 bp, human
gcagacaaagagcaataccg

SEQ ID NO: 304859 - DNA, 20 bp, human
gaatgctgcactttattcac

SEQ ID NO: 304860 - DNA, 20 bp, human
gacaggcagatgtaatgcaa

SEQ ID NO: 304861 - DNA, 20 bp, human
gttaaagagccaaccctgac

SEQ ID NO: 304862 - DNA, 20 bp, human
gctcgctgctctgtattcag

SEQ ID NO: 304863 - DNA, 20 bp, human
ggaacggggcccatctttaa

SEQ ID NO: 304864 - DNA, 20 bp, human
gtcgacttcaaatgtggttt

SEQ ID NO: 304865 - DNA, 20 bp, human
gagatgtaatgcaaaggggt

SEQ ID NO: 304866 - DNA, 20 bp, human
gaggggcgggagaacgattc

SEQ ID NO: 304867 - DNA, 20 bp, human
ggaggcccgcgtaggggaac

SEQ ID NO: 304868 - DNA, 20 bp, human
ggccgccccctgctccgcac

SEQ ID NO: 304869 - DNA, 20 bp, human
gtccctctccggtaatgagg

SEQ ID NO: 304870 - DNA, 20 bp, human
gcgggagaacgattcggggc

SEQ ID NO: 304871 - DNA, 20 bp, human
ggaccctcacgccagtggaa

SEQ ID NO: 304872 - DNA, 20 bp, human
gcggcccagtgtcccggtcg

SEQ ID NO: 304873 - DNA, 20 bp, human
ggctgacccaggcgctggtc

SEQ ID NO: 304874 - DNA, 20 bp, human
gggccagggcgcaagcggag

SEQ ID NO: 304875 - DNA, 20 bp, human
gctccggccggccctgcgga

SEQ ID NO: 304876 - DNA, 20 bp, human
gtggagaagcgagggtgtgc

SEQ ID NO: 304877 - DNA, 20 bp, human
gcgggggcgggcatctgggg

SEQ ID NO: 304878 - DNA, 20 bp, human
ggcgctgggccctttccaga

SEQ ID NO: 304879 - DNA, 20 bp, human
gtgcgtagagcgagataccg

SEQ ID NO: 304880 - DNA, 20 bp, human
gccgcggccgcggggaggca

SEQ ID NO: 304881 - DNA, 20 bp, human
ggccagacggtcccaggtga

SEQ ID NO: 304882 - DNA, 20 bp, human
gggacgctggccccgggcca

SEQ ID NO: 304883 - DNA, 20 bp, human
gcggccggccagacggtccc

SEQ ID NO: 304884 - DNA, 20 bp, human
gggtgagggccctctggaaa

SEQ ID NO: 304885 - DNA, 20 bp, human
gcgcggccgcgggttccggc

SEQ ID NO: 304886 - DNA, 20 bp, human
ggctgggcgctagactcgca

SEQ ID NO: 304887 - DNA, 20 bp, human
gtagccagaggctcgcaggc

SEQ ID NO: 304888 - DNA, 20 bp, human
gtagactcgcaggggtgagc

SEQ ID NO: 304889 - DNA, 20 bp, human
gcgcgcaccaacaagtggac

SEQ ID NO: 304890 - DNA, 20 bp, human
gtggcccccactactcttaa

SEQ ID NO: 304891 - DNA, 20 bp, human
gcgcgggggcgcgtggggct

SEQ ID NO: 304892 - DNA, 20 bp, human
gaagtggaccgggcctgtag

SEQ ID NO: 304893 - DNA, 20 bp, human
gacaggcccggtccacttgt

SEQ ID NO: 304894 - DNA, 20 bp, human
gggcctgtaggggagcggcg

SEQ ID NO: 304895 - DNA, 20 bp, human
gcacttgttggtgcgcggat

SEQ ID NO: 304896 - DNA, 20 bp, human
gcggggagtcgaagggagga

SEQ ID NO: 304897 - DNA, 20 bp, human
gcggcgagtcggggagtcga

SEQ ID NO: 304898 - DNA, 20 bp, human
ggagtcggggagtcgaaggg

SEQ ID NO: 304899 - DNA, 20 bp, human
ggggaggccaatcggcgagt

SEQ ID NO: 304900 - DNA, 20 bp, human
gagagccgaggggcggtgga

SEQ ID NO: 304901 - DNA, 20 bp, human
gcggggcctctcaccgaggc

SEQ ID NO: 304902 - DNA, 20 bp, human
gcggacctcgcctcctgcct

SEQ ID NO: 304903 - DNA, 20 bp, human
gggaggacagatgcactcga

SEQ ID NO: 304904 - DNA, 20 bp, human
gctcaccgaggcaggaggcg

SEQ ID NO: 304905 - DNA, 20 bp, human
gtcgaaggagccgtcggtgt

SEQ ID NO: 304906 - DNA, 20 bp, human
gcggccgggaaagcacgtga

SEQ ID NO: 304907 - DNA, 20 bp, human
gtgtctgcctcgatgcgggg

SEQ ID NO: 304908 - DNA, 20 bp, human
gctgtcgcaatcgcagccca

SEQ ID NO: 304909 - DNA, 20 bp, human
gccctgcgaggcttgtccaa

SEQ ID NO: 304910 - DNA, 20 bp, human
gcggccctcacgtgctttcc

SEQ ID NO: 304911 - DNA, 20 bp, human
gcctggcccagccgagggaa

SEQ ID NO: 304912 - DNA, 20 bp, human
gcgatcgggcttccgaagaa

SEQ ID NO: 304913 - DNA, 20 bp, human
gaaagcacgtgagggccgcg

SEQ ID NO: 304914 - DNA, 20 bp, human
gcccctcccgccccgcatcg

SEQ ID NO: 304915 - DNA, 20 bp, human
ggaagggaggaggccggttc

SEQ ID NO: 304916 - DNA, 20 bp, human
gggagccaggccaagccagc

SEQ ID NO: 304917 - DNA, 20 bp, human
gtggggacagggaacagata

SEQ ID NO: 304918 - DNA, 20 bp, human
ggcaggggagagcagctagc

SEQ ID NO: 304919 - DNA, 20 bp, human
gagggaggaaaccaaagtct

SEQ ID NO: 304920 - DNA, 20 bp, human
ggacagggaacagataaggt

SEQ ID NO: 304921 - DNA, 20 bp, human
gaaagtggggtggtgcagca

SEQ ID NO: 304922 - DNA, 20 bp, human
gcagtggagggggtgcacgg

SEQ ID NO: 304923 - DNA, 20 bp, human
gtggggcggggagagcaccg

SEQ ID NO: 304924 - DNA, 20 bp, human
gacgcgggactaggcaagga

SEQ ID NO: 304925 - DNA, 20 bp, human
ggctggctccagcatgatgt

SEQ ID NO: 304926 - DNA, 20 bp, human
gagggggctgcgactcctag

SEQ ID NO: 304927 - DNA, 20 bp, human
gttcctctcgcagcgcggtg

SEQ ID NO: 304928 - DNA, 20 bp, human
gcctaggagccagttagggc

SEQ ID NO: 304929 - DNA, 20 bp, human
gtggtctcagtgccttctag

SEQ ID NO: 304930 - DNA, 20 bp, human
gaagaagatagcagtctcac

SEQ ID NO: 304931 - DNA, 20 bp, human
gctgtgtcctgccctctaga

SEQ ID NO: 304932 - DNA, 20 bp, human
gctcaaggaacaagtagacc

SEQ ID NO: 304933 - DNA, 20 bp, human
gacttgttccttgaggatcc

SEQ ID NO: 304934 - DNA, 20 bp, human
gggtgcctaggagccagtta

SEQ ID NO: 304935 - DNA, 20 bp, human
gtggctttcctctcgcagcg

SEQ ID NO: 304936 - DNA, 20 bp, human
gcaggctgcggcacatctga

SEQ ID NO: 304937 - DNA, 20 bp, human
gcctgggtggggactcctta

SEQ ID NO: 304938 - DNA, 20 bp, human
ggggagctccggtaggtttg

SEQ ID NO: 304939 - DNA, 20 bp, human
gagcccccacctggtgtccg

SEQ ID NO: 304940 - DNA, 20 bp, human
gaaactagaacccctgggtg

SEQ ID NO: 304941 - DNA, 20 bp, human
gaggtccctacgcttccggg

SEQ ID NO: 304942 - DNA, 20 bp, human
gcagaccagctttaggtccg

SEQ ID NO: 304943 - DNA, 20 bp, human
gtctccggcctcaaacctac

SEQ ID NO: 304944 - DNA, 20 bp, human
gctgcggcacatctgacggc

SEQ ID NO: 304945 - DNA, 20 bp, human
gacctaccggagctcccagc

SEQ ID NO: 304946 - DNA, 20 bp, human
gttagctgtgacgtctccgg

SEQ ID NO: 304947 - DNA, 20 bp, human
ggggaggcgggagcggaagt

SEQ ID NO: 304948 - DNA, 20 bp, human
gctccggtggcggatggtca

SEQ ID NO: 304949 - DNA, 20 bp, human
gagtggggcagcaaatggac

SEQ ID NO: 304950 - DNA, 20 bp, human
ggctttagctgtgacgtctc

SEQ ID NO: 304951 - DNA, 20 bp, human
gcggatggtcagggacacag

SEQ ID NO: 304952 - DNA, 20 bp, human
gaagccaagcattggacccg

SEQ ID NO: 304953 - DNA, 20 bp, human
gctagcttctgaaagcgggg

SEQ ID NO: 304954 - DNA, 20 bp, human
ggggcagcaaatggacaggg

SEQ ID NO: 304955 - DNA, 20 bp, human
ggtccctgaccatccgccac

SEQ ID NO: 304956 - DNA, 20 bp, human
gatcgcgagaagccaccggg

SEQ ID NO: 304957 - DNA, 20 bp, human
ggccgggcaaagggaatcgt

SEQ ID NO: 304958 - DNA, 20 bp, human
ggagaagccaccgggaggtg

SEQ ID NO: 304959 - DNA, 20 bp, human
gtcgcgaccggaagttacat

SEQ ID NO: 304960 - DNA, 20 bp, human
gcaatcgccgaggagctgat

SEQ ID NO: 304961 - DNA, 20 bp, human
gggaaacggaccaatcgccg

SEQ ID NO: 304962 - DNA, 20 bp, human
ggaaaagtacagcccgccca

SEQ ID NO: 304963 - DNA, 20 bp, human
gcggtggcttctcgcgatcg

SEQ ID NO: 304964 - DNA, 20 bp, human
gacgttgaggcgccacagag

SEQ ID NO: 304965 - DNA, 20 bp, human
gggagctgatgggtcgcgac

SEQ ID NO: 304966 - DNA, 20 bp, human
gacgccgggaggaagtacga

SEQ ID NO: 304967 - DNA, 20 bp, human
gcggcgggaaagagccgagt

SEQ ID NO: 304968 - DNA, 20 bp, human
ggacctcaaacgagtctcta

SEQ ID NO: 304969 - DNA, 20 bp, human
gggggtctagagtaaaatca

SEQ ID NO: 304970 - DNA, 20 bp, human
gagggcccgcatctgcgcct

SEQ ID NO: 304971 - DNA, 20 bp, human
gtgcctgagagaagtcgtcg

SEQ ID NO: 304972 - DNA, 20 bp, human
gaaagagccgagtgggctcg

SEQ ID NO: 304973 - DNA, 20 bp, human
gtttctggggtgggtgctta

SEQ ID NO: 304974 - DNA, 20 bp, human
gcgacaaacgatggtcgcgt

SEQ ID NO: 304975 - DNA, 20 bp, human
ggtggtcgcaagttgtccaa

SEQ ID NO: 304976 - DNA, 20 bp, human
gcacgcgcccagagccgtta

SEQ ID NO: 304977 - DNA, 20 bp, human
ggagatccggggtaaagggg

SEQ ID NO: 304978 - DNA, 20 bp, human
gtcgcgagatccggggtaaa

SEQ ID NO: 304979 - DNA, 20 bp, human
ggagtggagttccaccctaa

SEQ ID NO: 304980 - DNA, 20 bp, human
ggcgcccagagccgttaggg

SEQ ID NO: 304981 - DNA, 20 bp, human
gtggcgcctcggggcggatc

SEQ ID NO: 304982 - DNA, 20 bp, human
gcgggagggaatgtaatgta

SEQ ID NO: 304983 - DNA, 20 bp, human
gggcgtcagagcttgagggg

SEQ ID NO: 304984 - DNA, 20 bp, human
ggggtggaactccactcggg

SEQ ID NO: 304985 - DNA, 20 bp, human
gtccgcccgccccgcccgag

SEQ ID NO: 304986 - DNA, 20 bp, human
ggacctctaacccagaacaa

SEQ ID NO: 304987 - DNA, 20 bp, human
ggtaccttcagttaacagtc

SEQ ID NO: 304988 - DNA, 20 bp, human
gtaacccagaacaagggttt

SEQ ID NO: 304989 - DNA, 20 bp, human
gcactgctcgtcagtcgata

SEQ ID NO: 304990 - DNA, 20 bp, human
gcggtcaacggacaagtgag

SEQ ID NO: 304991 - DNA, 20 bp, human
gcctgggccttcgattaata

SEQ ID NO: 304992 - DNA, 20 bp, human
gctccggcccaggcgcctaa

SEQ ID NO: 304993 - DNA, 20 bp, human
ggaggggttttcagggtcgt

SEQ ID NO: 304994 - DNA, 20 bp, human
gcgaccaaccgctgagtctc

SEQ ID NO: 304995 - DNA, 20 bp, human
gaaacccgactgttaactga

SEQ ID NO: 304996 - DNA, 20 bp, human
gccccgcggcctctagacag

SEQ ID NO: 304997 - DNA, 20 bp, human
gcgcccctgtctagaggccg

SEQ ID NO: 304998 - DNA, 20 bp, human
gcaggggcggagtccctacc

SEQ ID NO: 304999 - DNA, 20 bp, human
ggggccccgcccccggacgg

SEQ ID NO: 305000 - DNA, 20 bp, human
gggactccgcccctgtctag

SEQ ID NO: 305001 - DNA, 20 bp, human
gagtccctacccggcctccg

SEQ ID NO: 305002 - DNA, 20 bp, human
gcagaggctacccgtccccg

SEQ ID NO: 305003 - DNA, 20 bp, human
ggggcctgggcgtgtcccac

SEQ ID NO: 305004 - DNA, 20 bp, human
gctcggcttccgccgtccgg

SEQ ID NO: 305005 - DNA, 20 bp, human
ggagctcgccctctccgccc

SEQ ID NO: 305006 - DNA, 20 bp, human
gacgaagtgcaggtgaacgt

SEQ ID NO: 305007 - DNA, 20 bp, human
gcagcccagctcattcccta

SEQ ID NO: 305008 - DNA, 20 bp, human
gaatggagttatgtcattgt

SEQ ID NO: 305009 - DNA, 20 bp, human
gtgatacaagagctgaaggg

SEQ ID NO: 305010 - DNA, 20 bp, human
gtgtcattgtggggatcttg

SEQ ID NO: 305011 - DNA, 20 bp, human
gaactctgtcaggacggaac

SEQ ID NO: 305012 - DNA, 20 bp, human
gagactggcgtgactgggct

SEQ ID NO: 305013 - DNA, 20 bp, human
gctgctctctaacgaagtgc

SEQ ID NO: 305014 - DNA, 20 bp, human
gattccatagggaatgagct

SEQ ID NO: 305015 - DNA, 20 bp, human
gcacagccacagatgtaaag

SEQ ID NO: 305016 - DNA, 20 bp, human
gtctggccctggattgcgtg

SEQ ID NO: 305017 - DNA, 20 bp, human
ggcccagccccacgcaatcc

SEQ ID NO: 305018 - DNA, 20 bp, human
ggtgctgcgcacacaacctc

SEQ ID NO: 305019 - DNA, 20 bp, human
gcgcacacaacctctggccc

SEQ ID NO: 305020 - DNA, 20 bp, human
gagccgcgcagcaccgtctg

SEQ ID NO: 305021 - DNA, 20 bp, human
gaaagcggagcaaaaccggt

SEQ ID NO: 305022 - DNA, 20 bp, human
gggtaacagagagctgcaga

SEQ ID NO: 305023 - DNA, 20 bp, human
ggggtggggcgaaggcgctg

SEQ ID NO: 305024 - DNA, 20 bp, human
ggcggcttttctgagtgtta

SEQ ID NO: 305025 - DNA, 20 bp, human
gtgctaaagcggagcaaaac

SEQ ID NO: 305026 - DNA, 20 bp, human
gaactctgctactagcgaca

SEQ ID NO: 305027 - DNA, 20 bp, human
gtgctactagcgacagggtt

SEQ ID NO: 305028 - DNA, 20 bp, human
gacggtagaagggttggtcc

SEQ ID NO: 305029 - DNA, 20 bp, human
ggacagggttgggaaaattc

SEQ ID NO: 305030 - DNA, 20 bp, human
gttaaaggttgtagctagtc

SEQ ID NO: 305031 - DNA, 20 bp, human
gtcaaagccctgctttagtt

SEQ ID NO: 305032 - DNA, 20 bp, human
gctggcaggtggaccaaacc

SEQ ID NO: 305033 - DNA, 20 bp, human
gggtattcctaactaaagca

SEQ ID NO: 305034 - DNA, 20 bp, human
ggtctgtgatatacggtaga

SEQ ID NO: 305035 - DNA, 20 bp, human
gaggaaagtcttctaaagag

SEQ ID NO: 305036 - DNA, 20 bp, human
ggcgccctgggaaatcgaaa

SEQ ID NO: 305037 - DNA, 20 bp, human
gtccgcgggactgacaatga

SEQ ID NO: 305038 - DNA, 20 bp, human
gttggtggagtctaagtcct

SEQ ID NO: 305039 - DNA, 20 bp, human
ggatgggcggggttgtctgt

SEQ ID NO: 305040 - DNA, 20 bp, human
ggggaaaaaaaggacggagg

SEQ ID NO: 305041 - DNA, 20 bp, human
gggactgacaatgaggggcg

SEQ ID NO: 305042 - DNA, 20 bp, human
gtggagtctaagtcctggga

SEQ ID NO: 305043 - DNA, 20 bp, human
ggcacaggacccagctacgg

SEQ ID NO: 305044 - DNA, 20 bp, human
gggtcctgtgctaggcgccc

SEQ ID NO: 305045 - DNA, 20 bp, human
gcccgccggtaagctaaagt

SEQ ID NO: 305046 - DNA, 20 bp, human
gggctgcgctctggtcagtc

SEQ ID NO: 305047 - DNA, 20 bp, human
gtggtcagtcgggtgagcac

SEQ ID NO: 305048 - DNA, 20 bp, human
gcccggtgaccgaagcgcac

SEQ ID NO: 305049 - DNA, 20 bp, human
ggggagcgaggagtatcttc

SEQ ID NO: 305050 - DNA, 20 bp, human
gagccctgccggggattgtt

SEQ ID NO: 305051 - DNA, 20 bp, human
gccccgccccgcgccatcct

SEQ ID NO: 305052 - DNA, 20 bp, human
ggagatgagacccaattcac

SEQ ID NO: 305053 - DNA, 20 bp, human
gcgccgctccggagcccgga

SEQ ID NO: 305054 - DNA, 20 bp, human
gccccgtgcgcttcggtcac

SEQ ID NO: 305055 - DNA, 20 bp, human
ggcgatcgccccgtgcgctt

SEQ ID NO: 305056 - DNA, 20 bp, human
gagcgagccaagctcctgat

SEQ ID NO: 305057 - DNA, 20 bp, human
ggggtcctaggaactgtgaa

SEQ ID NO: 305058 - DNA, 20 bp, human
gttagaaaggggtatcgggt

SEQ ID NO: 305059 - DNA, 20 bp, human
gaagtctcctatcaggagct

SEQ ID NO: 305060 - DNA, 20 bp, human
gcgaagggagaggctatgat

SEQ ID NO: 305061 - DNA, 20 bp, human
gcctcaccaagtctcctatc

SEQ ID NO: 305062 - DNA, 20 bp, human
gtgctcctcctgcgcggtga

SEQ ID NO: 305063 - DNA, 20 bp, human
gagccccaaggggtggagct

SEQ ID NO: 305064 - DNA, 20 bp, human
gaggctatgattggaggatc

SEQ ID NO: 305065 - DNA, 20 bp, human
gtaccaccccctcaccgcgc

SEQ ID NO: 305066 - DNA, 20 bp, human
gtatatggatggcaagtcaa

SEQ ID NO: 305067 - DNA, 20 bp, human
ggtttcccagagttgttgat

SEQ ID NO: 305068 - DNA, 20 bp, human
gtggggtgagatttactgtt

SEQ ID NO: 305069 - DNA, 20 bp, human
gctcaccccagtgatagctt

SEQ ID NO: 305070 - DNA, 20 bp, human
ggaagcctatcaacaactct

SEQ ID NO: 305071 - DNA, 20 bp, human
gtcataagaacaccatttta

SEQ ID NO: 305072 - DNA, 20 bp, human
gctgcaccaaagctatcact

SEQ ID NO: 305073 - DNA, 20 bp, human
gatatattatgcaggtgggt

SEQ ID NO: 305074 - DNA, 20 bp, human
ggcctctctcagacccatct

SEQ ID NO: 305075 - DNA, 20 bp, human
gtttagcaagcttatatgga

SEQ ID NO: 305076 - DNA, 20 bp, human
ggaagctgctgtttgggccc

SEQ ID NO: 305077 - DNA, 20 bp, human
gccctgcatccgagagccct

SEQ ID NO: 305078 - DNA, 20 bp, human
gtccgcctgctggttcctac

SEQ ID NO: 305079 - DNA, 20 bp, human
gggaaccagcaggcggagta

SEQ ID NO: 305080 - DNA, 20 bp, human
gccaccctgcacttctataa

SEQ ID NO: 305081 - DNA, 20 bp, human
gcccgctgcaggcagtagtg

SEQ ID NO: 305082 - DNA, 20 bp, human
ggggagggagtcagtgggct

SEQ ID NO: 305083 - DNA, 20 bp, human
ggctgcaggcagtagtgggg

SEQ ID NO: 305084 - DNA, 20 bp, human
ggaggaagaagactgactga

SEQ ID NO: 305085 - DNA, 20 bp, human
gcctgggctgactgcttctg

SEQ ID NO: 305086 - DNA, 20 bp, human
gaggccactgggccccgttg

SEQ ID NO: 305087 - DNA, 20 bp, human
gcagcgacagccaggctggt

SEQ ID NO: 305088 - DNA, 20 bp, human
gggagacctggggaccggga

SEQ ID NO: 305089 - DNA, 20 bp, human
gtggcccacgcccaccagcc

SEQ ID NO: 305090 - DNA, 20 bp, human
gggccctgtagccacagcca

SEQ ID NO: 305091 - DNA, 20 bp, human
ggcaagcgtcagcccaggac

SEQ ID NO: 305092 - DNA, 20 bp, human
gccactgggccccgttgcgg

SEQ ID NO: 305093 - DNA, 20 bp, human
gaggtctgccctccgcaacg

SEQ ID NO: 305094 - DNA, 20 bp, human
gcgcccagcgacagccaggc

SEQ ID NO: 305095 - DNA, 20 bp, human
gaatgcagggacaaagacac

SEQ ID NO: 305096 - DNA, 20 bp, human
gtatcccaaggagccggggt

SEQ ID NO: 305097 - DNA, 20 bp, human
ggctcaggcgccacctcact

SEQ ID NO: 305098 - DNA, 20 bp, human
ggcgccgcccaggcctaccc

SEQ ID NO: 305099 - DNA, 20 bp, human
gccggctccttgggatagat

SEQ ID NO: 305100 - DNA, 20 bp, human
gggcgcggggacccccaccg

SEQ ID NO: 305101 - DNA, 20 bp, human
ggccggacaggggaccaggt

SEQ ID NO: 305102 - DNA, 20 bp, human
gaggcctaccccggctcctt

SEQ ID NO: 305103 - DNA, 20 bp, human
gcacagcagggccgggtgga

SEQ ID NO: 305104 - DNA, 20 bp, human
gacgcgggaggggcctccgg

SEQ ID NO: 305105 - DNA, 20 bp, human
ggacctggcgaggccggaca

SEQ ID NO: 305106 - DNA, 20 bp, human
ggcccgcagcccctggatat

SEQ ID NO: 305107 - DNA, 20 bp, human
gggtgccctgcccatatcca

SEQ ID NO: 305108 - DNA, 20 bp, human
gggacagagtggtatgggtt

SEQ ID NO: 305109 - DNA, 20 bp, human
gtgcccatatccaggggctg

SEQ ID NO: 305110 - DNA, 20 bp, human
ggaggctgaaaaggtgtgaa

SEQ ID NO: 305111 - DNA, 20 bp, human
gccaaaatgcgtttcctcat

SEQ ID NO: 305112 - DNA, 20 bp, human
gaggaaacgcattttggaat

SEQ ID NO: 305113 - DNA, 20 bp, human
ggcatgggacccagaaacct

SEQ ID NO: 305114 - DNA, 20 bp, human
gtgtccagaggccccttctc

SEQ ID NO: 305115 - DNA, 20 bp, human
ggcagagaggcctcaccatc

SEQ ID NO: 305116 - DNA, 20 bp, human
ggggtccccagcggagaaaa

SEQ ID NO: 305117 - DNA, 20 bp, human
gagtcaagactgagctggtg

SEQ ID NO: 305118 - DNA, 20 bp, human
ggtagcagggaacccgagtt

SEQ ID NO: 305119 - DNA, 20 bp, human
gcagtcccaggatgataagg

SEQ ID NO: 305120 - DNA, 20 bp, human
gtctccagaattcgcctggg

SEQ ID NO: 305121 - DNA, 20 bp, human
gggtggggaccgagtaggcg

SEQ ID NO: 305122 - DNA, 20 bp, human
gctccctcccaggcgaattc

SEQ ID NO: 305123 - DNA, 20 bp, human
gtcacccattttctccgctg

SEQ ID NO: 305124 - DNA, 20 bp, human
gtcgttgggctgtgcgttag

SEQ ID NO: 305125 - DNA, 20 bp, human
gcgtctggaggttctggtcg

SEQ ID NO: 305126 - DNA, 20 bp, human
ggggtgggaaggcactgagc

SEQ ID NO: 305127 - DNA, 20 bp, human
gctgaccagagaaaagacaa

SEQ ID NO: 305128 - DNA, 20 bp, human
gcactgagcaggactgagtg

SEQ ID NO: 305129 - DNA, 20 bp, human
gggaggggctaccagaggca

SEQ ID NO: 305130 - DNA, 20 bp, human
gccaccccttgtcttttctc

SEQ ID NO: 305131 - DNA, 20 bp, human
gccaagaaccacaatggcat

SEQ ID NO: 305132 - DNA, 20 bp, human
gctgagtggggagtagggat

SEQ ID NO: 305133 - DNA, 20 bp, human
ggagcagcaggactcttagc

SEQ ID NO: 305134 - DNA, 20 bp, human
gtcttagctggggaccagga

SEQ ID NO: 305135 - DNA, 20 bp, human
gaatgcccagcagggaccca

SEQ ID NO: 305136 - DNA, 20 bp, human
gggcaccaagggccccagtg

SEQ ID NO: 305137 - DNA, 20 bp, human
ggatgctgagagcatgctgt

SEQ ID NO: 305138 - DNA, 20 bp, human
gggaccaacaagaacccctg

SEQ ID NO: 305139 - DNA, 20 bp, human
ggcatgctctcagcatcctc

SEQ ID NO: 305140 - DNA, 20 bp, human
gggcacgggggatataaggc

SEQ ID NO: 305141 - DNA, 20 bp, human
gtgcaaaaggaggaccctca

SEQ ID NO: 305142 - DNA, 20 bp, human
gagactgctgctgaggataa

SEQ ID NO: 305143 - DNA, 20 bp, human
ggaagcagataggaaaaccc

SEQ ID NO: 305144 - DNA, 20 bp, human
gctataaagctcaaggcacg

SEQ ID NO: 305145 - DNA, 20 bp, human
gcctttcacagggtccttga

SEQ ID NO: 305146 - DNA, 20 bp, human
gcccagcagcatgtctacta

SEQ ID NO: 305147 - DNA, 20 bp, human
gggaggggatgggaatgctg

SEQ ID NO: 305148 - DNA, 20 bp, human
gtctctccaggatagaaaag

SEQ ID NO: 305149 - DNA, 20 bp, human
gcgctggtctggagtgacaa

SEQ ID NO: 305150 - DNA, 20 bp, human
ggataaaggcccacactcgc

SEQ ID NO: 305151 - DNA, 20 bp, human
ggtcatcttcagagtggcct

SEQ ID NO: 305152 - DNA, 20 bp, human
gggaagcagagtccagataa

SEQ ID NO: 305153 - DNA, 20 bp, human
gcaaggggctctggagggga

SEQ ID NO: 305154 - DNA, 20 bp, human
gctccaggatagaaaagtgg

SEQ ID NO: 305155 - DNA, 20 bp, human
gagactgacaagagctagac

SEQ ID NO: 305156 - DNA, 20 bp, human
gggagcgcgcgcgccagcaa

SEQ ID NO: 305157 - DNA, 20 bp, human
ggggaaacgggtatgaggtt

SEQ ID NO: 305158 - DNA, 20 bp, human
gaaacggggaaacgggtatg

SEQ ID NO: 305159 - DNA, 20 bp, human
gcggccccctacccaggcgt

SEQ ID NO: 305160 - DNA, 20 bp, human
ggggccagctacctgcgtgg

SEQ ID NO: 305161 - DNA, 20 bp, human
gtcagccaagcagaggggga

SEQ ID NO: 305162 - DNA, 20 bp, human
ggggctcgcggcccccacgc

SEQ ID NO: 305163 - DNA, 20 bp, human
gaacggggaaacggggaaac

SEQ ID NO: 305164 - DNA, 20 bp, human
gcggcccccacgcaggtagc

SEQ ID NO: 305165 - DNA, 20 bp, human
gcggcgccacgcgcaggtcc

SEQ ID NO: 305166 - DNA, 20 bp, human
ggtgagcccgtgctcttcag

SEQ ID NO: 305167 - DNA, 20 bp, human
gacctcacacactagtgcgc

SEQ ID NO: 305168 - DNA, 20 bp, human
ggcactagtgtgtgaggtca

SEQ ID NO: 305169 - DNA, 20 bp, human
gggagtgtgtcattagcatc

SEQ ID NO: 305170 - DNA, 20 bp, human
gtccagcgcactagtgtgtg

SEQ ID NO: 305171 - DNA, 20 bp, human
gctcttgatgagagttttac

SEQ ID NO: 305172 - DNA, 20 bp, human
gtcagtcgctactcacgctg

SEQ ID NO: 305173 - DNA, 20 bp, human
gttactagtaagcacgtttt

SEQ ID NO: 305174 - DNA, 20 bp, human
gggaagtcctcagggcacgc

SEQ ID NO: 305175 - DNA, 20 bp, human
gacggtgcctgcgtgccctg

SEQ ID NO: 305176 - DNA, 20 bp, human
gggcggagcgggccaggtgt

SEQ ID NO: 305177 - DNA, 20 bp, human
gcccccagaggcctagacag

SEQ ID NO: 305178 - DNA, 20 bp, human
ggggcgctagatacctgcgt

SEQ ID NO: 305179 - DNA, 20 bp, human
ggaggagacgcacgtctgat

SEQ ID NO: 305180 - DNA, 20 bp, human
gacgtgcgtctcctcggccc

SEQ ID NO: 305181 - DNA, 20 bp, human
gccaggtgtgggaaatgaac

SEQ ID NO: 305182 - DNA, 20 bp, human
gcccgcccgcacctctgtct

SEQ ID NO: 305183 - DNA, 20 bp, human
ggtgggaaatgaacagggct

SEQ ID NO: 305184 - DNA, 20 bp, human
ggcggtgccaagtcccagta

SEQ ID NO: 305185 - DNA, 20 bp, human
gggaagaggtacgtgcggat

SEQ ID NO: 305186 - DNA, 20 bp, human
gggcggagcgggccaggtgt

SEQ ID NO: 305187 - DNA, 20 bp, human
gcccccagaggcctagacag

SEQ ID NO: 305188 - DNA, 20 bp, human
ggggcgctagatacctgcgt

SEQ ID NO: 305189 - DNA, 20 bp, human
ggaggagacgcacgtctgat

SEQ ID NO: 305190 - DNA, 20 bp, human
gacgtgcgtctcctcggccc

SEQ ID NO: 305191 - DNA, 20 bp, human
gccaggtgtgggaaatgaac

SEQ ID NO: 305192 - DNA, 20 bp, human
gcccgcccgcacctctgtct

SEQ ID NO: 305193 - DNA, 20 bp, human
ggtgggaaatgaacagggct

SEQ ID NO: 305194 - DNA, 20 bp, human
ggcggtgccaagtcccagta

SEQ ID NO: 305195 - DNA, 20 bp, human
gggaagaggtacgtgcggat

SEQ ID NO: 305196 - DNA, 20 bp, human
gaaccacagtcagaagtaaa

SEQ ID NO: 305197 - DNA, 20 bp, human
gcctgtagattcaaggtcct

SEQ ID NO: 305198 - DNA, 20 bp, human
ggaccttgaatctacaggtg

SEQ ID NO: 305199 - DNA, 20 bp, human
gagagcctgcagagactcgg

SEQ ID NO: 305200 - DNA, 20 bp, human
ggttctgaggggcccccaag

SEQ ID NO: 305201 - DNA, 20 bp, human
gggagaggaaagtgacaata

SEQ ID NO: 305202 - DNA, 20 bp, human
gagccacacctgtagattca

SEQ ID NO: 305203 - DNA, 20 bp, human
gaggtgtggctggtctggtc

SEQ ID NO: 305204 - DNA, 20 bp, human
gatgcgtgaacttacctctt

SEQ ID NO: 305205 - DNA, 20 bp, human
gttctgctttcacagggaga

SEQ ID NO: 305206 - DNA, 20 bp, human
gtatgtgtgtgtgtctcaga

SEQ ID NO: 305207 - DNA, 20 bp, human
gcatctgcgcaggcaggtag

SEQ ID NO: 305208 - DNA, 20 bp, human
gagactcctcccatctgcgc

SEQ ID NO: 305209 - DNA, 20 bp, human
ggaggtcccaagtctattca

SEQ ID NO: 305210 - DNA, 20 bp, human
gtccacatcagtcacaaatg

SEQ ID NO: 305211 - DNA, 20 bp, human
ggtgacacgtgcggaagctg

SEQ ID NO: 305212 - DNA, 20 bp, human
gtcctcccatctgcgcaggc

SEQ ID NO: 305213 - DNA, 20 bp, human
ggtagggagacagagatagt

SEQ ID NO: 305214 - DNA, 20 bp, human
gctcccctcagtgtaaggta

SEQ ID NO: 305215 - DNA, 20 bp, human
gagaagaggtgattacacag

SEQ ID NO: 305216 - DNA, 20 bp, human
gaaagaggaaacagttggat

SEQ ID NO: 305217 - DNA, 20 bp, human
ggcaggagcttcactttatc

SEQ ID NO: 305218 - DNA, 20 bp, human
gttcagggggacctagggac

SEQ ID NO: 305219 - DNA, 20 bp, human
gtgtaacaaaaccagtccct

SEQ ID NO: 305220 - DNA, 20 bp, human
gtcttttctgcttactgaaa

SEQ ID NO: 305221 - DNA, 20 bp, human
gggttttgttacagttgact

SEQ ID NO: 305222 - DNA, 20 bp, human
gatttgagcacttcctgtaa

SEQ ID NO: 305223 - DNA, 20 bp, human
gaaaacaagacactttggcc

SEQ ID NO: 305224 - DNA, 20 bp, human
ggagcttcactttatctggg

SEQ ID NO: 305225 - DNA, 20 bp, human
gaaaataaaacaagacactt

SEQ ID NO: 305226 - DNA, 20 bp, human
ggctgctgcaggtgaagagt

SEQ ID NO: 305227 - DNA, 20 bp, human
gtcgctgcgagtggccttga

SEQ ID NO: 305228 - DNA, 20 bp, human
ggctgcaggtgaagagtagg

SEQ ID NO: 305229 - DNA, 20 bp, human
gggaagcaggaaggcggttc

SEQ ID NO: 305230 - DNA, 20 bp, human
gccagtggaagtgacgccaa

SEQ ID NO: 305231 - DNA, 20 bp, human
gcatcacgacaacgccccct

SEQ ID NO: 305232 - DNA, 20 bp, human
gccggccaccttaccctcgg

SEQ ID NO: 305233 - DNA, 20 bp, human
gggcactcgaggatacccgg

SEQ ID NO: 305234 - DNA, 20 bp, human
gcgagtgcccagagacggga

SEQ ID NO: 305235 - DNA, 20 bp, human
gaaggtggccggccttgcga

SEQ ID NO: 305236 - DNA, 20 bp, human
gaagcagagcgcctagacca

SEQ ID NO: 305237 - DNA, 20 bp, human
ggtagcccaaaaacctgtct

SEQ ID NO: 305238 - DNA, 20 bp, human
ggagcgcctagaccaggggt

SEQ ID NO: 305239 - DNA, 20 bp, human
gagctgccaacccctggtct

SEQ ID NO: 305240 - DNA, 20 bp, human
gcagacccagacaggttttt

SEQ ID NO: 305241 - DNA, 20 bp, human
gtctcatgctacaatgtcag

SEQ ID NO: 305242 - DNA, 20 bp, human
gttttcttacagacccagac

SEQ ID NO: 305243 - DNA, 20 bp, human
gttctttactacacaggtgg

SEQ ID NO: 305244 - DNA, 20 bp, human
gactttctttactacacagg

SEQ ID NO: 305245 - DNA, 20 bp, human
gaaaactttctttactacac

SEQ ID NO: 305246 - DNA, 20 bp, human
ggatcattggtacaggacga

SEQ ID NO: 305247 - DNA, 20 bp, human
gaagctcctctaatgatcat

SEQ ID NO: 305248 - DNA, 20 bp, human
gctctaatgatcattggtac

SEQ ID NO: 305249 - DNA, 20 bp, human
gcagcgtggctctactgctg

SEQ ID NO: 305250 - DNA, 20 bp, human
ggcaggagacccaatatttc

SEQ ID NO: 305251 - DNA, 20 bp, human
gaggtgacccaattaataag

SEQ ID NO: 305252 - DNA, 20 bp, human
gtatgcctcctgagcaactt

SEQ ID NO: 305253 - DNA, 20 bp, human
ggatcatatgacattggaat

SEQ ID NO: 305254 - DNA, 20 bp, human
gagcaacttgggggttcatt

SEQ ID NO: 305255 - DNA, 20 bp, human
gcagtagatcactgcgcacc

SEQ ID NO: 305256 - DNA, 20 bp, human
gagaatactatcttgaaaca

SEQ ID NO: 305257 - DNA, 20 bp, human
ggtggtgttaccaagcttag

SEQ ID NO: 305258 - DNA, 20 bp, human
ggtgttaccaagcttagagg

SEQ ID NO: 305259 - DNA, 20 bp, human
gggctcagtacatagtttgt

SEQ ID NO: 305260 - DNA, 20 bp, human
ggatccttgaagccaggggt

SEQ ID NO: 305261 - DNA, 20 bp, human
gagggaaatgagtagtgaat

SEQ ID NO: 305262 - DNA, 20 bp, human
gaaaactgatccttgaagcc

SEQ ID NO: 305263 - DNA, 20 bp, human
gtagttattcaccctacccc

SEQ ID NO: 305264 - DNA, 20 bp, human
gttcaagatagtattctcac

SEQ ID NO: 305265 - DNA, 20 bp, human
gccaagcttagaggtgggat

SEQ ID NO: 305266 - DNA, 20 bp, human
gctcggtccgccacccctca

SEQ ID NO: 305267 - DNA, 20 bp, human
gaggcccggggtccctacag

SEQ ID NO: 305268 - DNA, 20 bp, human
ggggtccctacagtggctgg

SEQ ID NO: 305269 - DNA, 20 bp, human
gagcggaaggcgaagccctg

SEQ ID NO: 305270 - DNA, 20 bp, human
gtagggaccccgggcctctg

SEQ ID NO: 305271 - DNA, 20 bp, human
gctggggcccgggtccccag

SEQ ID NO: 305272 - DNA, 20 bp, human
gcgctcccccagccactgta

SEQ ID NO: 305273 - DNA, 20 bp, human
gggccccaacgggccggaaa

SEQ ID NO: 305274 - DNA, 20 bp, human
gtgaccccggaggaaaccag

SEQ ID NO: 305275 - DNA, 20 bp, human
gcagactcggacataagagg

SEQ ID NO: 305276 - DNA, 20 bp, human
gttggtccctgcccaaggtt

SEQ ID NO: 305277 - DNA, 20 bp, human
gccttcaaagccctgcgcga

SEQ ID NO: 305278 - DNA, 20 bp, human
gcggacggaaggatctccag

SEQ ID NO: 305279 - DNA, 20 bp, human
ggggcggggaagtgaccgtt

SEQ ID NO: 305280 - DNA, 20 bp, human
gagaacccctaatgttggaa

SEQ ID NO: 305281 - DNA, 20 bp, human
gcgtccctacaggagaaggc

SEQ ID NO: 305282 - DNA, 20 bp, human
gcccgggctgctccactccc

SEQ ID NO: 305283 - DNA, 20 bp, human
gcgtccgtccctacaggaga

SEQ ID NO: 305284 - DNA, 20 bp, human
gcaccaaacacccaaacctt

SEQ ID NO: 305285 - DNA, 20 bp, human
ggggccagccttctcctgta

SEQ ID NO: 305286 - DNA, 20 bp, human
gcggggggttgctcaggagg

SEQ ID NO: 305287 - DNA, 20 bp, human
gtggtgagtagcccaggagg

SEQ ID NO: 305288 - DNA, 20 bp, human
gcccagcgcgagctcaccgc

SEQ ID NO: 305289 - DNA, 20 bp, human
gtcggctcggggggttgctc

SEQ ID NO: 305290 - DNA, 20 bp, human
gcgcgctgggcgggctgttc

SEQ ID NO: 305291 - DNA, 20 bp, human
gcgagccggcggtccgggga

SEQ ID NO: 305292 - DNA, 20 bp, human
ggctgggcgggctgttccgg

SEQ ID NO: 305293 - DNA, 20 bp, human
gaccaagccgcgctcactgc

SEQ ID NO: 305294 - DNA, 20 bp, human
gtgggcctgcggtgagcatc

SEQ ID NO: 305295 - DNA, 20 bp, human
ggcctgcggtgagctcgcgc

SEQ ID NO: 305296 - DNA, 20 bp, human
gtcccaggaacgtgcggagg

SEQ ID NO: 305297 - DNA, 20 bp, human
ggggctggacccagtcgctg

SEQ ID NO: 305298 - DNA, 20 bp, human
ggggtgcggactagggtctg

SEQ ID NO: 305299 - DNA, 20 bp, human
gcactccaggcatcacgtga

SEQ ID NO: 305300 - DNA, 20 bp, human
gcccgcctccgcacgttcct

SEQ ID NO: 305301 - DNA, 20 bp, human
gagggcgcagcaggtgccgt

SEQ ID NO: 305302 - DNA, 20 bp, human
ggggacagcctcagttgtgt

SEQ ID NO: 305303 - DNA, 20 bp, human
gagaaaaggcgagacttttg

SEQ ID NO: 305304 - DNA, 20 bp, human
gacctgccgggtgcggacta

SEQ ID NO: 305305 - DNA, 20 bp, human
ggacggctgccgagttgggg

SEQ ID NO: 305306 - DNA, 20 bp, human
gtctgcagacaggtgagtaa

SEQ ID NO: 305307 - DNA, 20 bp, human
gcagactctgatcttacaat

SEQ ID NO: 305308 - DNA, 20 bp, human
gtactatctctggagcaaaa

SEQ ID NO: 305309 - DNA, 20 bp, human
gttggctaaattactatctc

SEQ ID NO: 305310 - DNA, 20 bp, human
gtctatttggttaacccctc

SEQ ID NO: 305311 - DNA, 20 bp, human
ggtacaggagcttgtaaact

SEQ ID NO: 305312 - DNA, 20 bp, human
gagtaactgactgggccaaa

SEQ ID NO: 305313 - DNA, 20 bp, human
gagcatttcagtctccccga

SEQ ID NO: 305314 - DNA, 20 bp, human
gaatatttttaggatctata

SEQ ID NO: 305315 - DNA, 20 bp, human
gttgtatgatcagtgttatt

SEQ ID NO: 305316 - DNA, 20 bp, human
gagctggaggggtcaggaaa

SEQ ID NO: 305317 - DNA, 20 bp, human
gtgggtggggtgggcctaga

SEQ ID NO: 305318 - DNA, 20 bp, human
ggggaccggcctgatactgg

SEQ ID NO: 305319 - DNA, 20 bp, human
gatactggaggaatgaggaa

SEQ ID NO: 305320 - DNA, 20 bp, human
gacagggtgtgtaggagtca

SEQ ID NO: 305321 - DNA, 20 bp, human
gagggagggtcccagttggg

SEQ ID NO: 305322 - DNA, 20 bp, human
ggaggggaccggcctgatac

SEQ ID NO: 305323 - DNA, 20 bp, human
gtaggcccaccccacccaac

SEQ ID NO: 305324 - DNA, 20 bp, human
ggggagaagagccgagcaca

SEQ ID NO: 305325 - DNA, 20 bp, human
gcccccttccaggcagtctg

SEQ ID NO: 305326 - DNA, 20 bp, human
gcccctaggcgcgtcatcca

SEQ ID NO: 305327 - DNA, 20 bp, human
gagtagtggggcttaaagac

SEQ ID NO: 305328 - DNA, 20 bp, human
gggcagggaccgctctccct

SEQ ID NO: 305329 - DNA, 20 bp, human
gctgccctgtgaagttgcca

SEQ ID NO: 305330 - DNA, 20 bp, human
gcgcgtcatccaagggagag

SEQ ID NO: 305331 - DNA, 20 bp, human
ggaagttgccaaggagggaa

SEQ ID NO: 305332 - DNA, 20 bp, human
gccaactcagcgtcggctgt

SEQ ID NO: 305333 - DNA, 20 bp, human
ggatgtgcagtctagaagtg

SEQ ID NO: 305334 - DNA, 20 bp, human
gaaccgggccaactcagcgt

SEQ ID NO: 305335 - DNA, 20 bp, human
gatctgagatgcaacctcaa

SEQ ID NO: 305336 - DNA, 20 bp, human
gggccacctgcctcgaaagg

SEQ ID NO: 305337 - DNA, 20 bp, human
gccgaggcagacgaccaatg

SEQ ID NO: 305338 - DNA, 20 bp, human
gtcgaggcaggtggccaatg

SEQ ID NO: 305339 - DNA, 20 bp, human
ggccagcctcggtccaataa

SEQ ID NO: 305340 - DNA, 20 bp, human
ggggcccgcgaggcagggaa

SEQ ID NO: 305341 - DNA, 20 bp, human
gttagggagtccggctaaga

SEQ ID NO: 305342 - DNA, 20 bp, human
gcaggcgggccgttcctggg

SEQ ID NO: 305343 - DNA, 20 bp, human
gggcgggcaggacgtgcgga

SEQ ID NO: 305344 - DNA, 20 bp, human
gaggggcgggacatcagttc

SEQ ID NO: 305345 - DNA, 20 bp, human
gtgttcgtgcagctagttca

SEQ ID NO: 305346 - DNA, 20 bp, human
ggacgcgccgtcccaaactt

SEQ ID NO: 305347 - DNA, 20 bp, human
gctaaagggattcccccgaa

SEQ ID NO: 305348 - DNA, 20 bp, human
gaggcgcaggaacccttcgg

SEQ ID NO: 305349 - DNA, 20 bp, human
gttgggacggcgcgtcccaa

SEQ ID NO: 305350 - DNA, 20 bp, human
ggctccgagtgcgtaggcgc

SEQ ID NO: 305351 - DNA, 20 bp, human
gcgtaggcgcaggaaccctt

SEQ ID NO: 305352 - DNA, 20 bp, human
gagtcccgggccggaaacgc

SEQ ID NO: 305353 - DNA, 20 bp, human
ggacgccagaaacccaagtt

SEQ ID NO: 305354 - DNA, 20 bp, human
gcgggggaatccctttagca

SEQ ID NO: 305355 - DNA, 20 bp, human
gcgtcccaaacttgggtttc

SEQ ID NO: 305356 - DNA, 20 bp, human
gttagagcagagtgctggga

SEQ ID NO: 305357 - DNA, 20 bp, human
ggaggagagaactagaagtc

SEQ ID NO: 305358 - DNA, 20 bp, human
ggagacccgcccacataggg

SEQ ID NO: 305359 - DNA, 20 bp, human
gagcactctgctctaatctg

SEQ ID NO: 305360 - DNA, 20 bp, human
gccaggattggaagctgtgt

SEQ ID NO: 305361 - DNA, 20 bp, human
ggaagagacccgcccacata

SEQ ID NO: 305362 - DNA, 20 bp, human
gccgcccacatagggagggt

SEQ ID NO: 305363 - DNA, 20 bp, human
ggcccagcctagtttgatca

SEQ ID NO: 305364 - DNA, 20 bp, human
gtgaatgattggtgtcttgt

SEQ ID NO: 305365 - DNA, 20 bp, human
gtgtgggcgggtctcttcct

SEQ ID NO: 305366 - DNA, 20 bp, human
ggcggccggcccggcctcga

SEQ ID NO: 305367 - DNA, 20 bp, human
ggaagtgggaatccggttat

SEQ ID NO: 305368 - DNA, 20 bp, human
gctcccgcccgcagggtgag

SEQ ID NO: 305369 - DNA, 20 bp, human
ggggagcggagccctccgcg

SEQ ID NO: 305370 - DNA, 20 bp, human
ggaagctccgaacccaggga

SEQ ID NO: 305371 - DNA, 20 bp, human
gggcccaactccgggagaat

SEQ ID NO: 305372 - DNA, 20 bp, human
gcggggagccggggtgaccg

SEQ ID NO: 305373 - DNA, 20 bp, human
ggcgcgcgcggcccaactcc

SEQ ID NO: 305374 - DNA, 20 bp, human
gtagagccttagagtggaag

SEQ ID NO: 305375 - DNA, 20 bp, human
ggaggctggcggctagggag

SEQ ID NO: 305376 - DNA, 20 bp, human
ggcgggcggcagtgtggtag

SEQ ID NO: 305377 - DNA, 20 bp, human
gccaccacgaggttgaaagg

SEQ ID NO: 305378 - DNA, 20 bp, human
ggagccctgcggtttcccag

SEQ ID NO: 305379 - DNA, 20 bp, human
gcacccagccagcccggctc

SEQ ID NO: 305380 - DNA, 20 bp, human
gcccggggctgctccctcgc

SEQ ID NO: 305381 - DNA, 20 bp, human
ggctccgctgggaaaccgca

SEQ ID NO: 305382 - DNA, 20 bp, human
gggtgcaggtgagttagttc

SEQ ID NO: 305383 - DNA, 20 bp, human
gccgcgccccaggtggttca

SEQ ID NO: 305384 - DNA, 20 bp, human
gaaccacctggggcgcggga

SEQ ID NO: 305385 - DNA, 20 bp, human
gttcacttcctgagccgggc

SEQ ID NO: 305386 - DNA, 20 bp, human
gcaagaacaccacgcggtaa

SEQ ID NO: 305387 - DNA, 20 bp, human
gcaggtggcggtgggagtct

SEQ ID NO: 305388 - DNA, 20 bp, human
gtcccaccgccacctgaccc

SEQ ID NO: 305389 - DNA, 20 bp, human
gaagaactaagagcaggcgt

SEQ ID NO: 305390 - DNA, 20 bp, human
gtctctctaccattaccgcg

SEQ ID NO: 305391 - DNA, 20 bp, human
gcaggtgaagaactaagagc

SEQ ID NO: 305392 - DNA, 20 bp, human
ggctggaaggtgaggaaacc

SEQ ID NO: 305393 - DNA, 20 bp, human
gcacgggagatgtgagtccc

SEQ ID NO: 305394 - DNA, 20 bp, human
gaactaagagcaggcgtggg

SEQ ID NO: 305395 - DNA, 20 bp, human
gccaggagtctgcttcctcc

SEQ ID NO: 305396 - DNA, 20 bp, human
ggagccgcccggacattgtg

SEQ ID NO: 305397 - DNA, 20 bp, human
gtgccgccgcagccaatcgg

SEQ ID NO: 305398 - DNA, 20 bp, human
gccgcagccaatcggaggga

SEQ ID NO: 305399 - DNA, 20 bp, human
ggcacctcacaatgtccggg

SEQ ID NO: 305400 - DNA, 20 bp, human
ggcggctccctccctccgat

SEQ ID NO: 305401 - DNA, 20 bp, human
gggacattgtgaggtgccga

SEQ ID NO: 305402 - DNA, 20 bp, human
gctagggaaaatgtgctctc

SEQ ID NO: 305403 - DNA, 20 bp, human
gcctgagcgtgcgcccggtg

SEQ ID NO: 305404 - DNA, 20 bp, human
gaggtagcgcggggccgcgt

SEQ ID NO: 305405 - DNA, 20 bp, human
gagcgtgcgcccggtggggc

SEQ ID NO: 305406 - DNA, 20 bp, human
gactgcgcggctgaatgaca

SEQ ID NO: 305407 - DNA, 20 bp, human
gtgagaacccagcgactgcg

SEQ ID NO: 305408 - DNA, 20 bp, human
gggtagcaagtgggagtctt

SEQ ID NO: 305409 - DNA, 20 bp, human
ggaacccggaagcggggacc

SEQ ID NO: 305410 - DNA, 20 bp, human
gaggtgtgtcccatgaggat

SEQ ID NO: 305411 - DNA, 20 bp, human
gcgaatctacaaggtgggag

SEQ ID NO: 305412 - DNA, 20 bp, human
gagcggggacccggcttcgc

SEQ ID NO: 305413 - DNA, 20 bp, human
gaagccgggtccccgcttcc

SEQ ID NO: 305414 - DNA, 20 bp, human
gacagtacggaacccggaag

SEQ ID NO: 305415 - DNA, 20 bp, human
gagccccgccgcctccaaca

SEQ ID NO: 305416 - DNA, 20 bp, human
ggccccgcgcggcaacgcag

SEQ ID NO: 305417 - DNA, 20 bp, human
ggctgctggcccgctctctg

SEQ ID NO: 305418 - DNA, 20 bp, human
ggccgcgcacgcaaatacgc

SEQ ID NO: 305419 - DNA, 20 bp, human
gcacgcgcgggagcacgccc

SEQ ID NO: 305420 - DNA, 20 bp, human
ggctgcgcatgcgcgctccc

SEQ ID NO: 305421 - DNA, 20 bp, human
gcaaatacgcaggcacgcgc

SEQ ID NO: 305422 - DNA, 20 bp, human
gcgcgcatgcgcagcgctgc

SEQ ID NO: 305423 - DNA, 20 bp, human
gtgaaagctcctcagagagc

SEQ ID NO: 305424 - DNA, 20 bp, human
ggaggagctttcaatacttt

SEQ ID NO: 305425 - DNA, 20 bp, human
gtacgtgtgtcagcctcgtg

SEQ ID NO: 305426 - DNA, 20 bp, human
gcaaagacctagcaacccgg

SEQ ID NO: 305427 - DNA, 20 bp, human
gcgaagccgtcgccaagtaa

SEQ ID NO: 305428 - DNA, 20 bp, human
gagcaccagttccaggtctg

SEQ ID NO: 305429 - DNA, 20 bp, human
gtagcaacccggagggagct

SEQ ID NO: 305430 - DNA, 20 bp, human
gttaccggaagtgatgatgc

SEQ ID NO: 305431 - DNA, 20 bp, human
ggccgtggccgaccgagcac

SEQ ID NO: 305432 - DNA, 20 bp, human
gatgcaggaggcgatggagg

SEQ ID NO: 305433 - DNA, 20 bp, human
gtgggcccggtggtttggtc

SEQ ID NO: 305434 - DNA, 20 bp, human
gttacgggaatggagcgggg

SEQ ID NO: 305435 - DNA, 20 bp, human
gactcccccagacctggaac

SEQ ID NO: 305436 - DNA, 20 bp, human
gtcggccagcgcagcagcta

SEQ ID NO: 305437 - DNA, 20 bp, human
gcggaagtggggttcgacca

SEQ ID NO: 305438 - DNA, 20 bp, human
gaacccgccccgttggggat

SEQ ID NO: 305439 - DNA, 20 bp, human
gctggccgaagttttctcgt

SEQ ID NO: 305440 - DNA, 20 bp, human
gacggcccgcgggttgctct

SEQ ID NO: 305441 - DNA, 20 bp, human
ggactgagagcgcgaggctt

SEQ ID NO: 305442 - DNA, 20 bp, human
gcccaacggggcgggttccg

SEQ ID NO: 305443 - DNA, 20 bp, human
gctcctgcgcgctgaggctc

SEQ ID NO: 305444 - DNA, 20 bp, human
ggtggcgagcccggtttcct

SEQ ID NO: 305445 - DNA, 20 bp, human
gagcccggtttcctaggaga

SEQ ID NO: 305446 - DNA, 20 bp, human
ggcgtcccgcgccgcttcgg

SEQ ID NO: 305447 - DNA, 20 bp, human
gcctgcgcccgcccccgaag

SEQ ID NO: 305448 - DNA, 20 bp, human
gggcgtgggaggggcatcgg

SEQ ID NO: 305449 - DNA, 20 bp, human
gcagggctcggggcagctaa

SEQ ID NO: 305450 - DNA, 20 bp, human
gcagccctgcggatcgcgga

SEQ ID NO: 305451 - DNA, 20 bp, human
ggggctgcccgcttaggctt

SEQ ID NO: 305452 - DNA, 20 bp, human
ggggagggcggggaaataag

SEQ ID NO: 305453 - DNA, 20 bp, human
gggcggggaaataagaggac

SEQ ID NO: 305454 - DNA, 20 bp, human
gtctccgccaagaccccaga

SEQ ID NO: 305455 - DNA, 20 bp, human
gggtcccgagcctccgggcg

SEQ ID NO: 305456 - DNA, 20 bp, human
gtgggcggggcctgtcgtcc

SEQ ID NO: 305457 - DNA, 20 bp, human
gagtcggagcagaaattgtg

SEQ ID NO: 305458 - DNA, 20 bp, human
gggccggaagagcctccgcg

SEQ ID NO: 305459 - DNA, 20 bp, human
gcctggagctcaagtgggcg

SEQ ID NO: 305460 - DNA, 20 bp, human
gtgtgtggacaaacgctccc

SEQ ID NO: 305461 - DNA, 20 bp, human
gcaaacgctcccgggttgcc

SEQ ID NO: 305462 - DNA, 20 bp, human
gcctgtcgtccgggcaaccc

SEQ ID NO: 305463 - DNA, 20 bp, human
ggggcaacctgtcagtaaag

SEQ ID NO: 305464 - DNA, 20 bp, human
gctgcagtagtccgcagagt

SEQ ID NO: 305465 - DNA, 20 bp, human
gaacctgtcagtaaaggggg

SEQ ID NO: 305466 - DNA, 20 bp, human
gggaggagggcggggctaaa

SEQ ID NO: 305467 - DNA, 20 bp, human
gtggacgccatgttagttag

SEQ ID NO: 305468 - DNA, 20 bp, human
gtagcagacgatccctgcgc

SEQ ID NO: 305469 - DNA, 20 bp, human
gtagccccgccctcctccaa

SEQ ID NO: 305470 - DNA, 20 bp, human
gctcctccaaaggacggagg

SEQ ID NO: 305471 - DNA, 20 bp, human
ggctaaaggcgtttgctaaa

SEQ ID NO: 305472 - DNA, 20 bp, human
gactgtgcccctaactaaca

SEQ ID NO: 305473 - DNA, 20 bp, human
gggccagtaattgggctctg

SEQ ID NO: 305474 - DNA, 20 bp, human
gggaggaggcgtttgctaaa

SEQ ID NO: 305475 - DNA, 20 bp, human
gagccgcagagcccaattac

SEQ ID NO: 305476 - DNA, 20 bp, human
gtggggtcggatctaggaag

SEQ ID NO: 305477 - DNA, 20 bp, human
ggtaacgaaggctgttagtg

SEQ ID NO: 305478 - DNA, 20 bp, human
gcgggactcggggtcctact

SEQ ID NO: 305479 - DNA, 20 bp, human
gactgggtggggtcggatct

SEQ ID NO: 305480 - DNA, 20 bp, human
gagtggggacagctttcaac

SEQ ID NO: 305481 - DNA, 20 bp, human
ggggacagctttcaactggg

SEQ ID NO: 305482 - DNA, 20 bp, human
ggcgctgggctcaccgtcgc

SEQ ID NO: 305483 - DNA, 20 bp, human
ggggctcaccgtcgccgggc

SEQ ID NO: 305484 - DNA, 20 bp, human
gagtgggtgtttgaggtaac

SEQ ID NO: 305485 - DNA, 20 bp, human
gcaccgcccctgcccggcga

SEQ ID NO: 305486 - DNA, 20 bp, human
gtgcgtccccggaagtacgg

SEQ ID NO: 305487 - DNA, 20 bp, human
gcggaagtacggaggccgac

SEQ ID NO: 305488 - DNA, 20 bp, human
gtgtcccgctcttgctacgg

SEQ ID NO: 305489 - DNA, 20 bp, human
gccactctctggtgctcgga

SEQ ID NO: 305490 - DNA, 20 bp, human
gtccgcgtctgcggagtcgc

SEQ ID NO: 305491 - DNA, 20 bp, human
gggatcgcgcaatgcatgcg

SEQ ID NO: 305492 - DNA, 20 bp, human
ggagggaactgcatttccta

SEQ ID NO: 305493 - DNA, 20 bp, human
gatgcgtggaagtgcgtccc

SEQ ID NO: 305494 - DNA, 20 bp, human
gtcttgctacggtggcctgg

SEQ ID NO: 305495 - DNA, 20 bp, human
gcctggaggagtggcgaaac

SEQ ID NO: 305496 - DNA, 20 bp, human
ggcagcaggccgttccgcgg

SEQ ID NO: 305497 - DNA, 20 bp, human
ggggtcggggagcttgccaa

SEQ ID NO: 305498 - DNA, 20 bp, human
gggcctgcggctccccgcct

SEQ ID NO: 305499 - DNA, 20 bp, human
gggcggcggacgggaagccg

SEQ ID NO: 305500 - DNA, 20 bp, human
ggctgcagcaggccgttccg

SEQ ID NO: 305501 - DNA, 20 bp, human
gggccgttggggctaagaga

SEQ ID NO: 305502 - DNA, 20 bp, human
ggtccgccgcccccgcggaa

SEQ ID NO: 305503 - DNA, 20 bp, human
gcgcggcacacgcacctgca

SEQ ID NO: 305504 - DNA, 20 bp, human
gcctgctggggaatcaataa

SEQ ID NO: 305505 - DNA, 20 bp, human
ggggtcttcccggtaccggc

SEQ ID NO: 305506 - DNA, 20 bp, human
ggggagtgaagcggcacgga

SEQ ID NO: 305507 - DNA, 20 bp, human
gcgtcatcgcgtcaagtggg

SEQ ID NO: 305508 - DNA, 20 bp, human
gggagtcaagggcggggctg

SEQ ID NO: 305509 - DNA, 20 bp, human
ggcggagggcagcccaaaac

SEQ ID NO: 305510 - DNA, 20 bp, human
gaggcgcagggactcctccg

SEQ ID NO: 305511 - DNA, 20 bp, human
ggtccctgcgcctgcgtgcc

SEQ ID NO: 305512 - DNA, 20 bp, human
ggcgtcaagtgggcggaggt

SEQ ID NO: 305513 - DNA, 20 bp, human
gtgacgcgatgacgcatctc

SEQ ID NO: 305514 - DNA, 20 bp, human
gcatcgcgtcaagtgggcgg

SEQ ID NO: 305515 - DNA, 20 bp, human
gtgaagcggcacggaaggag

SEQ ID NO: 305516 - DNA, 20 bp, human
gtgcgcggagagctcatccc

SEQ ID NO: 305517 - DNA, 20 bp, human
gggggcgagggccacttccg

SEQ ID NO: 305518 - DNA, 20 bp, human
ggctcggggcggggctcgac

SEQ ID NO: 305519 - DNA, 20 bp, human
gcgcccagcgctgacttcat

SEQ ID NO: 305520 - DNA, 20 bp, human
ggtagacctggtaggcgggt

SEQ ID NO: 305521 - DNA, 20 bp, human
gagctcatcccgggaccaca

SEQ ID NO: 305522 - DNA, 20 bp, human
gctaccaggtctacccgcgc

SEQ ID NO: 305523 - DNA, 20 bp, human
gtacccacaagtggggtcaa

SEQ ID NO: 305524 - DNA, 20 bp, human
gtcgacagggttccacaccc

SEQ ID NO: 305525 - DNA, 20 bp, human
ggggcccgcgcgggtagacc

SEQ ID NO: 305526 - DNA, 20 bp, human
gctgcagccggggcccggtc

SEQ ID NO: 305527 - DNA, 20 bp, human
gtggaactgccgagccaata

SEQ ID NO: 305528 - DNA, 20 bp, human
gagggcagcgccggcgtcgc

SEQ ID NO: 305529 - DNA, 20 bp, human
gtgccctcccagaggaggcg

SEQ ID NO: 305530 - DNA, 20 bp, human
gggcgcacgcgcagacgagc

SEQ ID NO: 305531 - DNA, 20 bp, human
gcgggtctgggtccggacga

SEQ ID NO: 305532 - DNA, 20 bp, human
gacgcgcgaggcggagccaa

SEQ ID NO: 305533 - DNA, 20 bp, human
gcgcgcagacgagcgggtct

SEQ ID NO: 305534 - DNA, 20 bp, human
gtctgggtccggacgagggg

SEQ ID NO: 305535 - DNA, 20 bp, human
gtcccagggctctgcgtagt

SEQ ID NO: 305536 - DNA, 20 bp, human
ggcacagtgtgaactgctaa

SEQ ID NO: 305537 - DNA, 20 bp, human
ggtacagcctgggcgttcaa

SEQ ID NO: 305538 - DNA, 20 bp, human
gagcagggaatatgggaatt

SEQ ID NO: 305539 - DNA, 20 bp, human
ggacttgtcaaggtcactgg

SEQ ID NO: 305540 - DNA, 20 bp, human
gcatccacaaagtacagcct

SEQ ID NO: 305541 - DNA, 20 bp, human
gggatgtctcggttatgaag

SEQ ID NO: 305542 - DNA, 20 bp, human
gacaaggccgaacagctggg

SEQ ID NO: 305543 - DNA, 20 bp, human
gcctaaaggagactgagcat

SEQ ID NO: 305544 - DNA, 20 bp, human
gtctaggagtacataaacga

SEQ ID NO: 305545 - DNA, 20 bp, human
gaagtcagaagcttgaaagc

SEQ ID NO: 305546 - DNA, 20 bp, human
ggtcctaagaattagtctac

SEQ ID NO: 305547 - DNA, 20 bp, human
ggtactggctctggaagaat

SEQ ID NO: 305548 - DNA, 20 bp, human
gctccaccctttcagttgtg

SEQ ID NO: 305549 - DNA, 20 bp, human
ggttttccacacaactgaaa

SEQ ID NO: 305550 - DNA, 20 bp, human
gttccacacaactgaaaggg

SEQ ID NO: 305551 - DNA, 20 bp, human
gttcttccccttgtggtttg

SEQ ID NO: 305552 - DNA, 20 bp, human
gaaaatctctttagagtcag

SEQ ID NO: 305553 - DNA, 20 bp, human
gcagaagaaagttcctgtct

SEQ ID NO: 305554 - DNA, 20 bp, human
gcatgtgcctgttgtcttaa

SEQ ID NO: 305555 - DNA, 20 bp, human
gttgtttaaagtactggctc

SEQ ID NO: 305556 - DNA, 20 bp, human
ggccaagttgtgtaatgagg

SEQ ID NO: 305557 - DNA, 20 bp, human
gcctcagaacacaagcatgc

SEQ ID NO: 305558 - DNA, 20 bp, human
ggtaatgaggagggttgttg

SEQ ID NO: 305559 - DNA, 20 bp, human
ggcaggtgataactgtcttc

SEQ ID NO: 305560 - DNA, 20 bp, human
gactcaatgtacatctaaag

SEQ ID NO: 305561 - DNA, 20 bp, human
gttgaaaattaatgacatag

SEQ ID NO: 305562 - DNA, 20 bp, human
gaactaaagggctgttttca

SEQ ID NO: 305563 - DNA, 20 bp, human
ggcttaactttctttattaa

SEQ ID NO: 305564 - DNA, 20 bp, human
gtttgtgaatcaataactaa

SEQ ID NO: 305565 - DNA, 20 bp, human
gggaaaagacaaaaaacaag

SEQ ID NO: 305566 - DNA, 20 bp, human
gagtgaggacagttgttgag

SEQ ID NO: 305567 - DNA, 20 bp, human
gcacgcttgtgttctgaagc

SEQ ID NO: 305568 - DNA, 20 bp, human
gcaggtgctaactctcttct

SEQ ID NO: 305569 - DNA, 20 bp, human
ggaaaaaacgagaggtatta

SEQ ID NO: 305570 - DNA, 20 bp, human
gctgtcctcactacacaact

SEQ ID NO: 305571 - DNA, 20 bp, human
gaataaaatattgtcaaagg

SEQ ID NO: 305572 - DNA, 20 bp, human
gacatgcttaactttattaa

SEQ ID NO: 305573 - DNA, 20 bp, human
gatttaatatacatctaaag

SEQ ID NO: 305574 - DNA, 20 bp, human
gaaatctgaaaatgaatgag

SEQ ID NO: 305575 - DNA, 20 bp, human
gattaataaaatattgtcaa

SEQ ID NO: 305576 - DNA, 20 bp, human
ggggctgtgctccttcccaa

SEQ ID NO: 305577 - DNA, 20 bp, human
ggagacccatttctgacttc

SEQ ID NO: 305578 - DNA, 20 bp, human
gaatcctcttctaaagcctt

SEQ ID NO: 305579 - DNA, 20 bp, human
gtcttctaaagcctttggga

SEQ ID NO: 305580 - DNA, 20 bp, human
gcaacaacctcaatgagcaa

SEQ ID NO: 305581 - DNA, 20 bp, human
gagcaactgatgtcatagaa

SEQ ID NO: 305582 - DNA, 20 bp, human
ggagtccttagacagggaag

SEQ ID NO: 305583 - DNA, 20 bp, human
gtaaagtttctgcagtcaca

SEQ ID NO: 305584 - DNA, 20 bp, human
gacatcagttgctatgcacc

SEQ ID NO: 305585 - DNA, 20 bp, human
gaggatattctgaaaaaggg

SEQ ID NO: 305586 - DNA, 20 bp, human
gaaaatggccgggtgggata

SEQ ID NO: 305587 - DNA, 20 bp, human
ggtgaggaaaatggccgggt

SEQ ID NO: 305588 - DNA, 20 bp, human
gcaccaccccccataagcat

SEQ ID NO: 305589 - DNA, 20 bp, human
gatggccgggtgggataggg

SEQ ID NO: 305590 - DNA, 20 bp, human
gcccccactaaaaccccatg

SEQ ID NO: 305591 - DNA, 20 bp, human
gccagaaagggtggaccctg

SEQ ID NO: 305592 - DNA, 20 bp, human
gaagcattcctatgcttatg

SEQ ID NO: 305593 - DNA, 20 bp, human
gtggatgacgtcacagaact

SEQ ID NO: 305594 - DNA, 20 bp, human
ggtgaagagggagcggagtc

SEQ ID NO: 305595 - DNA, 20 bp, human
gttccctcatggggttttag

SEQ ID NO: 305596 - DNA, 20 bp, human
gtcgggccggcggacagtga

SEQ ID NO: 305597 - DNA, 20 bp, human
gtgctaccggagatcaccag

SEQ ID NO: 305598 - DNA, 20 bp, human
gggcacagggggaatcccgg

SEQ ID NO: 305599 - DNA, 20 bp, human
gccggcggacagtgagggcg

SEQ ID NO: 305600 - DNA, 20 bp, human
gccgggccgctggtgatctc

SEQ ID NO: 305601 - DNA, 20 bp, human
gccgccaggccagtgccctc

SEQ ID NO: 305602 - DNA, 20 bp, human
gaggcccggaaggagtttcg

SEQ ID NO: 305603 - DNA, 20 bp, human
gtccagcggaagtgctcccc

SEQ ID NO: 305604 - DNA, 20 bp, human
gtctccggtagcactcgggc

SEQ ID NO: 305605 - DNA, 20 bp, human
ggtgatctccggtagcactc

SEQ ID NO: 305606 - DNA, 20 bp, human
gacaggaagtattgcgtaac

SEQ ID NO: 305607 - DNA, 20 bp, human
gtgaactggcacaaaaaggt

SEQ ID NO: 305608 - DNA, 20 bp, human
gttgactgccacatgcgcat

SEQ ID NO: 305609 - DNA, 20 bp, human
gtgcagttgcagaaggtagc

SEQ ID NO: 305610 - DNA, 20 bp, human
ggttgcagaaggtagcggga

SEQ ID NO: 305611 - DNA, 20 bp, human
gcacaaaaaggtgggacttc

SEQ ID NO: 305612 - DNA, 20 bp, human
ggtcctcaggatcacgcgac

SEQ ID NO: 305613 - DNA, 20 bp, human
gcacgaggcgcgaagcgcgt

SEQ ID NO: 305614 - DNA, 20 bp, human
gctggaagccaatgcgcatg

SEQ ID NO: 305615 - DNA, 20 bp, human
gtcagctcccaaaagtgaac

SEQ ID NO: 305616 - DNA, 20 bp, human
ggcgagcgtgggaccttctg

SEQ ID NO: 305617 - DNA, 20 bp, human
gagcagtcgcgacggggcta

SEQ ID NO: 305618 - DNA, 20 bp, human
ggagccctgcgctgacggtg

SEQ ID NO: 305619 - DNA, 20 bp, human
gcgcgggcgagcgcaggatg

SEQ ID NO: 305620 - DNA, 20 bp, human
gaccttctggggagcgtttc

SEQ ID NO: 305621 - DNA, 20 bp, human
ggggaagagcagtcgcgacg

SEQ ID NO: 305622 - DNA, 20 bp, human
gtcgaccgcgcggcgagcgt

SEQ ID NO: 305623 - DNA, 20 bp, human
gagcccggaaccctccatgg

SEQ ID NO: 305624 - DNA, 20 bp, human
gggcaagcggtaggcttgtc

SEQ ID NO: 305625 - DNA, 20 bp, human
gaggtcccacgctcgccgcg

SEQ ID NO: 305626 - DNA, 20 bp, human
ggctcggcggcctttgttcc

SEQ ID NO: 305627 - DNA, 20 bp, human
gccgccgagcggcacagacc

SEQ ID NO: 305628 - DNA, 20 bp, human
gggggcagggtcgcccaatg

SEQ ID NO: 305629 - DNA, 20 bp, human
gggggctgctcgcgacctcg

SEQ ID NO: 305630 - DNA, 20 bp, human
gagagcagagagacgggacc

SEQ ID NO: 305631 - DNA, 20 bp, human
gcgggcgcgaaggagccgcg

SEQ ID NO: 305632 - DNA, 20 bp, human
gggtcgcccaatggggctga

SEQ ID NO: 305633 - DNA, 20 bp, human
gcagagccggcgccgctgat

SEQ ID NO: 305634 - DNA, 20 bp, human
gaaagggggccaggcaagaa

SEQ ID NO: 305635 - DNA, 20 bp, human
gagctgtcagcccggaacaa

SEQ ID NO: 305636 - DNA, 20 bp, human
gtcacagggcgtcggaggga

SEQ ID NO: 305637 - DNA, 20 bp, human
gaatccgccggggcgcacgt

SEQ ID NO: 305638 - DNA, 20 bp, human
ggcgcaggggagggtccgag

SEQ ID NO: 305639 - DNA, 20 bp, human
gcccccagacacgcagtcac

SEQ ID NO: 305640 - DNA, 20 bp, human
ggcacgtaggggctgctcgg

SEQ ID NO: 305641 - DNA, 20 bp, human
ggcagtcacagggcgtcgga

SEQ ID NO: 305642 - DNA, 20 bp, human
gacacgcagtcacagggcgt

SEQ ID NO: 305643 - DNA, 20 bp, human
gcggtgccgcccactcgcac

SEQ ID NO: 305644 - DNA, 20 bp, human
ggcgtcacgcgaatccgccg

SEQ ID NO: 305645 - DNA, 20 bp, human
ggcgccgtggccctttgtgc

SEQ ID NO: 305646 - DNA, 20 bp, human
gccaccgtcgagtcactctt

SEQ ID NO: 305647 - DNA, 20 bp, human
gcagcctaagagtgactcga

SEQ ID NO: 305648 - DNA, 20 bp, human
gccaccctccctgctccgat

SEQ ID NO: 305649 - DNA, 20 bp, human
ggatgctcgcccccttcccc

SEQ ID NO: 305650 - DNA, 20 bp, human
ggccaagagtggaccgggtt

SEQ ID NO: 305651 - DNA, 20 bp, human
gagtgactcgacggtggccg

SEQ ID NO: 305652 - DNA, 20 bp, human
ggctcccatcggagcaggga

SEQ ID NO: 305653 - DNA, 20 bp, human
ggaccgggttgggctcccat

SEQ ID NO: 305654 - DNA, 20 bp, human
gtgtgaagtcagaggccaga

SEQ ID NO: 305655 - DNA, 20 bp, human
gcatcacgtgaccgagaatt

SEQ ID NO: 305656 - DNA, 20 bp, human
ggcggggcgcagcgacgaag

SEQ ID NO: 305657 - DNA, 20 bp, human
ggcagccaatgcccgggctg

SEQ ID NO: 305658 - DNA, 20 bp, human
gcgcagcgacgaaggggtta

SEQ ID NO: 305659 - DNA, 20 bp, human
gcaaacgcgagcccgccctc

SEQ ID NO: 305660 - DNA, 20 bp, human
ggtaacgagcgatgagcaga

SEQ ID NO: 305661 - DNA, 20 bp, human
gcctccggccacgcccccca

SEQ ID NO: 305662 - DNA, 20 bp, human
gctgcgccctagagagggtg

SEQ ID NO: 305663 - DNA, 20 bp, human
gggcctgagcccaagcccaa

SEQ ID NO: 305664 - DNA, 20 bp, human
gcccgccccagcccgggcat

SEQ ID NO: 305665 - DNA, 20 bp, human
gctagagagggtgaggctga

SEQ ID NO: 305666 - DNA, 20 bp, human
gccacctgaagcgcaccctg

SEQ ID NO: 305667 - DNA, 20 bp, human
gtctacctaagggacaaaga

SEQ ID NO: 305668 - DNA, 20 bp, human
gaggtggcgcttcaggaaaa

SEQ ID NO: 305669 - DNA, 20 bp, human
gacaaagaaggactgttctc

SEQ ID NO: 305670 - DNA, 20 bp, human
gcagccgcgccggcctgagg

SEQ ID NO: 305671 - DNA, 20 bp, human
gactgttctcagggtatcta

SEQ ID NO: 305672 - DNA, 20 bp, human
gagctactggcatgtttcat

SEQ ID NO: 305673 - DNA, 20 bp, human
gctggctgaaggaaatgatg

SEQ ID NO: 305674 - DNA, 20 bp, human
ggctcactgcgggcaaggcg

SEQ ID NO: 305675 - DNA, 20 bp, human
gaaaccaagaaaacggtcgg

SEQ ID NO: 305676 - DNA, 20 bp, human
gggagctgatggaacgaggg

SEQ ID NO: 305677 - DNA, 20 bp, human
gagccgagaggccctggaag

SEQ ID NO: 305678 - DNA, 20 bp, human
ggagcccgggaaggggaaag

SEQ ID NO: 305679 - DNA, 20 bp, human
ggggaggagcggttgcccag

SEQ ID NO: 305680 - DNA, 20 bp, human
gattggagctgatggaacga

SEQ ID NO: 305681 - DNA, 20 bp, human
gcgacaacctcgatagtgat

SEQ ID NO: 305682 - DNA, 20 bp, human
gaaggggcgaaatggttcta

SEQ ID NO: 305683 - DNA, 20 bp, human
gtcccagagtcccgcttcca

SEQ ID NO: 305684 - DNA, 20 bp, human
ggccctggaagcgggactct

SEQ ID NO: 305685 - DNA, 20 bp, human
ggcctgaccgctcccgggta

SEQ ID NO: 305686 - DNA, 20 bp, human
gtactccagagccagcgggg

SEQ ID NO: 305687 - DNA, 20 bp, human
gggcgcgcagggataggggg

SEQ ID NO: 305688 - DNA, 20 bp, human
ggctggctctggagtataga

SEQ ID NO: 305689 - DNA, 20 bp, human
gtctcccagggatttccgag

SEQ ID NO: 305690 - DNA, 20 bp, human
gccgccggcgcgcagggata

SEQ ID NO: 305691 - DNA, 20 bp, human
gagcaagggaccagcgggtc

SEQ ID NO: 305692 - DNA, 20 bp, human
ggtagcctctcggaaatccc

SEQ ID NO: 305693 - DNA, 20 bp, human
gacttctctccactcctctt

SEQ ID NO: 305694 - DNA, 20 bp, human
gggcacccaattattctaga

SEQ ID NO: 305695 - DNA, 20 bp, human
gtaacggccgccggcgcgca

SEQ ID NO: 305696 - DNA, 20 bp, human
gaatccccactcatggatat

SEQ ID NO: 305697 - DNA, 20 bp, human
gtgccggcggaaaaccactc

SEQ ID NO: 305698 - DNA, 20 bp, human
gaggcacacaaactaaaggt

SEQ ID NO: 305699 - DNA, 20 bp, human
gtcaggccacctagacagtt

SEQ ID NO: 305700 - DNA, 20 bp, human
ggcctccttcagctccaacc

SEQ ID NO: 305701 - DNA, 20 bp, human
gagacagtttggaaatcaag

SEQ ID NO: 305702 - DNA, 20 bp, human
gcaaatacaggtgtattaat

SEQ ID NO: 305703 - DNA, 20 bp, human
gggcctgagtggttttccgc

SEQ ID NO: 305704 - DNA, 20 bp, human
ggatttccaaactgtctagg

SEQ ID NO: 305705 - DNA, 20 bp, human
gtgtgcctatatccatgagt

SEQ ID NO: 305706 - DNA, 20 bp, human
ggggcgagaaagaggtcgga

SEQ ID NO: 305707 - DNA, 20 bp, human
gagagagcgagcacgaggaa

SEQ ID NO: 305708 - DNA, 20 bp, human
gggtcccagggccatcatga

SEQ ID NO: 305709 - DNA, 20 bp, human
gagcggggcgagaaagaggt

SEQ ID NO: 305710 - DNA, 20 bp, human
gtaactccaggaaacagcga

SEQ ID NO: 305711 - DNA, 20 bp, human
ggagcgagcacgaggaaggg

SEQ ID NO: 305712 - DNA, 20 bp, human
ggatggctggaataacgcga

SEQ ID NO: 305713 - DNA, 20 bp, human
gcaccccctcatgatggccc

SEQ ID NO: 305714 - DNA, 20 bp, human
gtctttatcaagtgcagtgg

SEQ ID NO: 305715 - DNA, 20 bp, human
ggaagggactctcctggaga

SEQ ID NO: 305716 - DNA, 20 bp, human
gggtgctatcagagggtcat

SEQ ID NO: 305717 - DNA, 20 bp, human
ggtggggcacagagcagcta

SEQ ID NO: 305718 - DNA, 20 bp, human
gtatcagagggtcattggag

SEQ ID NO: 305719 - DNA, 20 bp, human
gttttgaggggtgctatcag

SEQ ID NO: 305720 - DNA, 20 bp, human
gaaaatcaaggctgttttga

SEQ ID NO: 305721 - DNA, 20 bp, human
gaaagctggaggtaatgacg

SEQ ID NO: 305722 - DNA, 20 bp, human
gctggaggtaatgacgtggg

SEQ ID NO: 305723 - DNA, 20 bp, human
ggagcacatgagagaaacag

SEQ ID NO: 305724 - DNA, 20 bp, human
ggggtctttcctaatgttcg

SEQ ID NO: 305725 - DNA, 20 bp, human
gttaggaaagaccccaccgg

SEQ ID NO: 305726 - DNA, 20 bp, human
gggtgaggagcctgaattgt

SEQ ID NO: 305727 - DNA, 20 bp, human
gctcacccgaaaccagaaga

SEQ ID NO: 305728 - DNA, 20 bp, human
ggaaaccagaagagggcgta

SEQ ID NO: 305729 - DNA, 20 bp, human
gctagccatacgccctcttc

SEQ ID NO: 305730 - DNA, 20 bp, human
gagggtgccttcttactccc

SEQ ID NO: 305731 - DNA, 20 bp, human
gtggtagaacttcaagtccc

SEQ ID NO: 305732 - DNA, 20 bp, human
gacttgaagttctaccactg

SEQ ID NO: 305733 - DNA, 20 bp, human
ggccttttggggtttctagt

SEQ ID NO: 305734 - DNA, 20 bp, human
gcccaactagaaaccccaaa

SEQ ID NO: 305735 - DNA, 20 bp, human
gttcaagtcccaggtggctc

SEQ ID NO: 305736 - DNA, 20 bp, human
gtgcccacacgggtccccca

SEQ ID NO: 305737 - DNA, 20 bp, human
gcctggggccgaggactcgc

SEQ ID NO: 305738 - DNA, 20 bp, human
ggcccctgggggacccgtgt

SEQ ID NO: 305739 - DNA, 20 bp, human
gacaaaggagggtttctccc

SEQ ID NO: 305740 - DNA, 20 bp, human
gccgaacggcagggagaccc

SEQ ID NO: 305741 - DNA, 20 bp, human
gggactggggcccgagccga

SEQ ID NO: 305742 - DNA, 20 bp, human
ggcccacgcgggagtcccgc

SEQ ID NO: 305743 - DNA, 20 bp, human
ggggagtcccgctgggtggg

SEQ ID NO: 305744 - DNA, 20 bp, human
gctctcgcgcccctcggctc

SEQ ID NO: 305745 - DNA, 20 bp, human
ggtcccgctcccggcggcgt

SEQ ID NO: 305746 - DNA, 20 bp, human
gggccacgggagaagtcgaa

SEQ ID NO: 305747 - DNA, 20 bp, human
ggggagaagtcgaagggctc

SEQ ID NO: 305748 - DNA, 20 bp, human
ggggaggcgcctggcggcca

SEQ ID NO: 305749 - DNA, 20 bp, human
gagtgcgtgggcccatccgg

SEQ ID NO: 305750 - DNA, 20 bp, human
gaagtcgaagggctcaggcg

SEQ ID NO: 305751 - DNA, 20 bp, human
ggcggccgaggtctcgcgga

SEQ ID NO: 305752 - DNA, 20 bp, human
gccgaggtctcgcggagggg

SEQ ID NO: 305753 - DNA, 20 bp, human
gcgtgtgtatacgagtgcgt

SEQ ID NO: 305754 - DNA, 20 bp, human
ggaggcgcggccagaaaacc

SEQ ID NO: 305755 - DNA, 20 bp, human
gagctggggaggagagtcga

SEQ ID NO: 305756 - DNA, 20 bp, human
gacgacgctagggagctgga

SEQ ID NO: 305757 - DNA, 20 bp, human
ggctccgccccctcgctccc

SEQ ID NO: 305758 - DNA, 20 bp, human
gcgccctggggcccaagttg

SEQ ID NO: 305759 - DNA, 20 bp, human
ggtggctagaacacggagag

SEQ ID NO: 305760 - DNA, 20 bp, human
gccacggcgcgccccaactt

SEQ ID NO: 305761 - DNA, 20 bp, human
gcgcctgcgcgtgcgccctg

SEQ ID NO: 305762 - DNA, 20 bp, human
gctcgacgccgacgacgcta

SEQ ID NO: 305763 - DNA, 20 bp, human
gtccctctcccactaggcgt

SEQ ID NO: 305764 - DNA, 20 bp, human
gggagctgtcctcgagacgt

SEQ ID NO: 305765 - DNA, 20 bp, human
gcgccccaacttgggcccca

SEQ ID NO: 305766 - DNA, 20 bp, human
gtccgtgcggagtctcccag

SEQ ID NO: 305767 - DNA, 20 bp, human
gacccctgggagactccgca

SEQ ID NO: 305768 - DNA, 20 bp, human
gactccgcacggaaaggact

SEQ ID NO: 305769 - DNA, 20 bp, human
gtgagccaaggcgcagtcgg

SEQ ID NO: 305770 - DNA, 20 bp, human
gcggagtctcccaggggtgg

SEQ ID NO: 305771 - DNA, 20 bp, human
gaagaaccgagtctgcgcac

SEQ ID NO: 305772 - DNA, 20 bp, human
ggggccccccggctttgcgc

SEQ ID NO: 305773 - DNA, 20 bp, human
gtctgcgcaccggctgatcc

SEQ ID NO: 305774 - DNA, 20 bp, human
ggggactccgcgtccgcacc

SEQ ID NO: 305775 - DNA, 20 bp, human
ggcggctccgggtgcggacg

SEQ ID NO: 305776 - DNA, 20 bp, human
gctcccgcgacatcacagga

SEQ ID NO: 305777 - DNA, 20 bp, human
ggccgctcccgcgacatcac

SEQ ID NO: 305778 - DNA, 20 bp, human
gtaagcccagccccacgcag

SEQ ID NO: 305779 - DNA, 20 bp, human
gtgtgccgggtgtgacacta

SEQ ID NO: 305780 - DNA, 20 bp, human
ggtgacactacggtaggtgt

SEQ ID NO: 305781 - DNA, 20 bp, human
gttcgcgcaggcgcagttgg

SEQ ID NO: 305782 - DNA, 20 bp, human
gcaggcgcagttggtggacc

SEQ ID NO: 305783 - DNA, 20 bp, human
gactacggtaggtgtaggtt

SEQ ID NO: 305784 - DNA, 20 bp, human
gggacctggtcgcgctgtgc

SEQ ID NO: 305785 - DNA, 20 bp, human
ggggagcggccggttcgcgc

SEQ ID NO: 305786 - DNA, 20 bp, human
gcgtcgccgcagtgtggggg

SEQ ID NO: 305787 - DNA, 20 bp, human
gggagtgaatagatgcaaga

SEQ ID NO: 305788 - DNA, 20 bp, human
gaggtctcgcggggcatcat

SEQ ID NO: 305789 - DNA, 20 bp, human
gcgcgggccccgtgctcaag

SEQ ID NO: 305790 - DNA, 20 bp, human
gccaactgagccggaagtgg

SEQ ID NO: 305791 - DNA, 20 bp, human
gaagcccgcgcctccacttc

SEQ ID NO: 305792 - DNA, 20 bp, human
gtccctgctgggcaagggtt

SEQ ID NO: 305793 - DNA, 20 bp, human
gcagtgtgggggaggttaag

SEQ ID NO: 305794 - DNA, 20 bp, human
gaactcctgggttccctgct

SEQ ID NO: 305795 - DNA, 20 bp, human
gagacagcggagaacaagcc

SEQ ID NO: 305796 - DNA, 20 bp, human
gcccacccgaagttgaaggg

SEQ ID NO: 305797 - DNA, 20 bp, human
gtgcgggggcgggtctccga

SEQ ID NO: 305798 - DNA, 20 bp, human
ggctgcagggatggtgactc

SEQ ID NO: 305799 - DNA, 20 bp, human
ggcgagagaaatgccctcgg

SEQ ID NO: 305800 - DNA, 20 bp, human
gttgaagggaggtggcgcgg

SEQ ID NO: 305801 - DNA, 20 bp, human
gcccaaaccgggcctcgcag

SEQ ID NO: 305802 - DNA, 20 bp, human
gcgccacctcccttcaactt

SEQ ID NO: 305803 - DNA, 20 bp, human
gagcgcagagccggtactgg

SEQ ID NO: 305804 - DNA, 20 bp, human
gacctcccttcaacttcggg

SEQ ID NO: 305805 - DNA, 20 bp, human
ggcggggccgggcccgatct

SEQ ID NO: 305806 - DNA, 20 bp, human
gggtcctccgagttcgtggc

SEQ ID NO: 305807 - DNA, 20 bp, human
gcatcagcccgccacgaact

SEQ ID NO: 305808 - DNA, 20 bp, human
gccagcgcgcaaagccttgt

SEQ ID NO: 305809 - DNA, 20 bp, human
gccttgtgggccacacgccc

SEQ ID NO: 305810 - DNA, 20 bp, human
gcacaactcccgccatgccg

SEQ ID NO: 305811 - DNA, 20 bp, human
gccgcggtcctccgagttcg

SEQ ID NO: 305812 - DNA, 20 bp, human
ggcacccgcggaaaaggagg

SEQ ID NO: 305813 - DNA, 20 bp, human
gaacgcgaggagaccgacca

SEQ ID NO: 305814 - DNA, 20 bp, human
ggctgatgcgggcttggggc

SEQ ID NO: 305815 - DNA, 20 bp, human
gcgcgctggaagactcgcgg

SEQ ID NO: 305816 - DNA, 20 bp, human
ggcggggcggggccgacctc

SEQ ID NO: 305817 - DNA, 20 bp, human
gggccgacctcgggagacag

SEQ ID NO: 305818 - DNA, 20 bp, human
ggggaggatgtcctgaggcg

SEQ ID NO: 305819 - DNA, 20 bp, human
gcggccgcggttacctccac

SEQ ID NO: 305820 - DNA, 20 bp, human
gcgagccgagcgccgcgggg

SEQ ID NO: 305821 - DNA, 20 bp, human
gcccctgctgggatccgggt

SEQ ID NO: 305822 - DNA, 20 bp, human
gccccccgggctgaatggta

SEQ ID NO: 305823 - DNA, 20 bp, human
gtgcccccgctgcccaggat

SEQ ID NO: 305824 - DNA, 20 bp, human
gcgcccggtggaggtaaccg

SEQ ID NO: 305825 - DNA, 20 bp, human
gagggcctggggaccgacac

SEQ ID NO: 305826 - DNA, 20 bp, human
gagccggggctatcgttgat

SEQ ID NO: 305827 - DNA, 20 bp, human
gtatccgcccagtcggccgg

SEQ ID NO: 305828 - DNA, 20 bp, human
gggctgaacgagaggaaacc

SEQ ID NO: 305829 - DNA, 20 bp, human
gccgcccagtcggccggagg

SEQ ID NO: 305830 - DNA, 20 bp, human
gccgactgggcggatacgat

SEQ ID NO: 305831 - DNA, 20 bp, human
gggcgtctgcggcctgaacc

SEQ ID NO: 305832 - DNA, 20 bp, human
gcccggtagcgaattcaagg

SEQ ID NO: 305833 - DNA, 20 bp, human
gcttccgcctccggccgact

SEQ ID NO: 305834 - DNA, 20 bp, human
ggaacccggtagcgaattca

SEQ ID NO: 305835 - DNA, 20 bp, human
ggaggaaacccggcagtgat

SEQ ID NO: 305836 - DNA, 20 bp, human
gcagtggaggggagctttta

SEQ ID NO: 305837 - DNA, 20 bp, human
gtctggggggcgtggatgtg

SEQ ID NO: 305838 - DNA, 20 bp, human
ggtgctgagtcccccggaag

SEQ ID NO: 305839 - DNA, 20 bp, human
gaaagcaccgcctcctcttc

SEQ ID NO: 305840 - DNA, 20 bp, human
gggactcagcacgtgactcc

SEQ ID NO: 305841 - DNA, 20 bp, human
gagaggaggcggtgctttcc

SEQ ID NO: 305842 - DNA, 20 bp, human
gagctcccctccactggcct

SEQ ID NO: 305843 - DNA, 20 bp, human
ggcaccgcctcctcttccgg

SEQ ID NO: 305844 - DNA, 20 bp, human
gctatccaatctgagttcag

SEQ ID NO: 305845 - DNA, 20 bp, human
gaggcggtgctttccggggc

SEQ ID NO: 305846 - DNA, 20 bp, human
gggaggcattgtcacgtggg

SEQ ID NO: 305847 - DNA, 20 bp, human
gccgccttgcgggtgaggtg

SEQ ID NO: 305848 - DNA, 20 bp, human
gggcggaggcattgtcacgt

SEQ ID NO: 305849 - DNA, 20 bp, human
gggggggagagcgccgtcgc

SEQ ID NO: 305850 - DNA, 20 bp, human
gtcgtgccgccttgcgggtg

SEQ ID NO: 305851 - DNA, 20 bp, human
ggcgtaatgtgcgacaaagt

SEQ ID NO: 305852 - DNA, 20 bp, human
gaggtgccaagtgctctgat

SEQ ID NO: 305853 - DNA, 20 bp, human
ggattggctgggtgcgtggc

SEQ ID NO: 305854 - DNA, 20 bp, human
gtccccccacctcacccgca

SEQ ID NO: 305855 - DNA, 20 bp, human
gcagtcgcattgccccgcgg

SEQ ID NO: 305856 - DNA, 20 bp, human
gcaatgggaggcggcgagag

SEQ ID NO: 305857 - DNA, 20 bp, human
ggcgccgctgcctacccggg

SEQ ID NO: 305858 - DNA, 20 bp, human
gttccctcccgggtaggcag

SEQ ID NO: 305859 - DNA, 20 bp, human
gggcactccgggccaatggg

SEQ ID NO: 305860 - DNA, 20 bp, human
ggcctcgttccctcccgggt

SEQ ID NO: 305861 - DNA, 20 bp, human
gcctgcgccgctgcctaccc

SEQ ID NO: 305862 - DNA, 20 bp, human
gactgtcagctgggacgggc

SEQ ID NO: 305863 - DNA, 20 bp, human
gagaaattgactggcactcc

SEQ ID NO: 305864 - DNA, 20 bp, human
gttttcggagctgtcaatca

SEQ ID NO: 305865 - DNA, 20 bp, human
ggcctacccgggagggaacg

SEQ ID NO: 305866 - DNA, 20 bp, human
gtacggggtcgaccccccta

SEQ ID NO: 305867 - DNA, 20 bp, human
gggcggagctagagaggcca

SEQ ID NO: 305868 - DNA, 20 bp, human
gaatgaacgccgggggtaag

SEQ ID NO: 305869 - DNA, 20 bp, human
gggccacggccaatgaacgc

SEQ ID NO: 305870 - DNA, 20 bp, human
gcccacacgtcgcactaggt

SEQ ID NO: 305871 - DNA, 20 bp, human
gcccgcgcctcactggttac

SEQ ID NO: 305872 - DNA, 20 bp, human
ggtactaacccgcttacccc

SEQ ID NO: 305873 - DNA, 20 bp, human
gcacggccaatgaacgccgg

SEQ ID NO: 305874 - DNA, 20 bp, human
gcagaactgagtggcgggta

SEQ ID NO: 305875 - DNA, 20 bp, human
gactggagcgggccattcag

SEQ ID NO: 305876 - DNA, 20 bp, human
gcccagctgtcaatctcctg

SEQ ID NO: 305877 - DNA, 20 bp, human
gggccgccggctagaggaga

SEQ ID NO: 305878 - DNA, 20 bp, human
gcccgtgcagtgccccgtga

SEQ ID NO: 305879 - DNA, 20 bp, human
gtgggcccgcctccccggga

SEQ ID NO: 305880 - DNA, 20 bp, human
ggggacgggccgccggctag

SEQ ID NO: 305881 - DNA, 20 bp, human
gagagggcgcgccgcctcag

SEQ ID NO: 305882 - DNA, 20 bp, human
gcaggcacccggctctataa

SEQ ID NO: 305883 - DNA, 20 bp, human
gagagggcagggccctctgg

SEQ ID NO: 305884 - DNA, 20 bp, human
gccctctggtggccatcacg

SEQ ID NO: 305885 - DNA, 20 bp, human
ggccccgtgatggccaccag

SEQ ID NO: 305886 - DNA, 20 bp, human
ggccccccgcgtcagctgac

SEQ ID NO: 305887 - DNA, 20 bp, human
gccccgcgtcagctgactgg

SEQ ID NO: 305888 - DNA, 20 bp, human
ggcctggcggagcgctggag

SEQ ID NO: 305889 - DNA, 20 bp, human
gcggaggcctggcggagcgc

SEQ ID NO: 305890 - DNA, 20 bp, human
gactccaggcgagcgtgcgt

SEQ ID NO: 305891 - DNA, 20 bp, human
gcggagcgctggagcggagt

SEQ ID NO: 305892 - DNA, 20 bp, human
ggaggagagtgcgcgaggag

SEQ ID NO: 305893 - DNA, 20 bp, human
gcccgcaccccagtgacatc

SEQ ID NO: 305894 - DNA, 20 bp, human
gccagtggagtcgaacctca

SEQ ID NO: 305895 - DNA, 20 bp, human
ggccgccagtcagctgacgc

SEQ ID NO: 305896 - DNA, 20 bp, human
gctccggaaatacaaacctg

SEQ ID NO: 305897 - DNA, 20 bp, human
gaggtctaggtcgaaagaag

SEQ ID NO: 305898 - DNA, 20 bp, human
ggggcggggtcatacggggg

SEQ ID NO: 305899 - DNA, 20 bp, human
gagggggcggggtcatacgg

SEQ ID NO: 305900 - DNA, 20 bp, human
gagaatcgcggcagccccgg

SEQ ID NO: 305901 - DNA, 20 bp, human
ggcggggccgagggaccaag

SEQ ID NO: 305902 - DNA, 20 bp, human
ggccgctcctggccggaggg

SEQ ID NO: 305903 - DNA, 20 bp, human
gtggcaagggagcagaggta

SEQ ID NO: 305904 - DNA, 20 bp, human
gggaaccaggcagagaatcg

SEQ ID NO: 305905 - DNA, 20 bp, human
gcccggaattactcactcac

SEQ ID NO: 305906 - DNA, 20 bp, human
gccgtcgtccctggcaacac

SEQ ID NO: 305907 - DNA, 20 bp, human
ggcgcctggcggggtctcac

SEQ ID NO: 305908 - DNA, 20 bp, human
gagagcagccagtgttgcca

SEQ ID NO: 305909 - DNA, 20 bp, human
gcctggcggggtctcacggg

SEQ ID NO: 305910 - DNA, 20 bp, human
gcccaggccggcactcgagg

SEQ ID NO: 305911 - DNA, 20 bp, human
ggggtctcacgggcgggcct

SEQ ID NO: 305912 - DNA, 20 bp, human
gcggccggccggcgcttaaa

SEQ ID NO: 305913 - DNA, 20 bp, human
gtccggctgcaggacgccgg

SEQ ID NO: 305914 - DNA, 20 bp, human
gacccgcgcgccgtcgtccc

SEQ ID NO: 305915 - DNA, 20 bp, human
gcttaaaggggaaggcgcgg

SEQ ID NO: 305916 - DNA, 20 bp, human
gccccccgggcgggagagga

SEQ ID NO: 305917 - DNA, 20 bp, human
gcctgcgggaagatctctgg

SEQ ID NO: 305918 - DNA, 20 bp, human
gggccctgcgggaagatctc

SEQ ID NO: 305919 - DNA, 20 bp, human
gacaccgcttccgggatccg

SEQ ID NO: 305920 - DNA, 20 bp, human
ggggattgcaggtgcgcgcg

SEQ ID NO: 305921 - DNA, 20 bp, human
gggaagcggtgtcagatgct

SEQ ID NO: 305922 - DNA, 20 bp, human
gagatgctggggagccgggc

SEQ ID NO: 305923 - DNA, 20 bp, human
gcggtgtgacgcgcgcgccg

SEQ ID NO: 305924 - DNA, 20 bp, human
gcgcagggcctcccaaagcg

SEQ ID NO: 305925 - DNA, 20 bp, human
gcattaaggccagctgggaa

SEQ ID NO: 305926 - DNA, 20 bp, human
gacccagaatcagggtgtac

SEQ ID NO: 305927 - DNA, 20 bp, human
gtcaccacggggctcggact

SEQ ID NO: 305928 - DNA, 20 bp, human
gcccccgggacccagaatca

SEQ ID NO: 305929 - DNA, 20 bp, human
gttgccaccaagattccctg

SEQ ID NO: 305930 - DNA, 20 bp, human
gactgggcagcctgacgcct

SEQ ID NO: 305931 - DNA, 20 bp, human
gcgggggaggggggcacaaa

SEQ ID NO: 305932 - DNA, 20 bp, human
gacccctccaggaaagagct

SEQ ID NO: 305933 - DNA, 20 bp, human
ggaaagagctaggagaaccc

SEQ ID NO: 305934 - DNA, 20 bp, human
gaggggcccttgtcaccacg

SEQ ID NO: 305935 - DNA, 20 bp, human
gagctcctccctacccccgg

SEQ ID NO: 305936 - DNA, 20 bp, human
ggctgggcggatgggcatca

SEQ ID NO: 305937 - DNA, 20 bp, human
ggggtcacgggagtgagcat

SEQ ID NO: 305938 - DNA, 20 bp, human
gcactgacttgcgcattgtg

SEQ ID NO: 305939 - DNA, 20 bp, human
ggtggaatggctgggcggat

SEQ ID NO: 305940 - DNA, 20 bp, human
gggagtgagcattggagtgg

SEQ ID NO: 305941 - DNA, 20 bp, human
gcacccggatgtttcctggc

SEQ ID NO: 305942 - DNA, 20 bp, human
gggggtgagggtggaatggc

SEQ ID NO: 305943 - DNA, 20 bp, human
gttcccgccaggaaacatcc

SEQ ID NO: 305944 - DNA, 20 bp, human
gagctcgtgtgatcagggaa

SEQ ID NO: 305945 - DNA, 20 bp, human
gaaccggatcctgcctgggt

SEQ ID NO: 305946 - DNA, 20 bp, human
gtgaggggagggttgtggta

SEQ ID NO: 305947 - DNA, 20 bp, human
ggtggggtacgggtgaggat

SEQ ID NO: 305948 - DNA, 20 bp, human
gtggtggtgaagatgagtgt

SEQ ID NO: 305949 - DNA, 20 bp, human
gtgagggtgggagtccgggt

SEQ ID NO: 305950 - DNA, 20 bp, human
gtcaagagacctggtttaag

SEQ ID NO: 305951 - DNA, 20 bp, human
gggaggtgggaactgggatg

SEQ ID NO: 305952 - DNA, 20 bp, human
gcggtccccggggcttccct

SEQ ID NO: 305953 - DNA, 20 bp, human
ggaactgggatggggatctt

SEQ ID NO: 305954 - DNA, 20 bp, human
ggactcggagtcttccaagg

SEQ ID NO: 305955 - DNA, 20 bp, human
ggtacgggtgaggatggggt

SEQ ID NO: 305956 - DNA, 20 bp, human
gtgaggggagggttgtggta

SEQ ID NO: 305957 - DNA, 20 bp, human
ggtggggtacgggtgaggat

SEQ ID NO: 305958 - DNA, 20 bp, human
gtggtggtgaagatgagtgt

SEQ ID NO: 305959 - DNA, 20 bp, human
gtgagggtgggagtccgggt

SEQ ID NO: 305960 - DNA, 20 bp, human
gtcaagagacctggtttaag

SEQ ID NO: 305961 - DNA, 20 bp, human
gggaggtgggaactgggatg

SEQ ID NO: 305962 - DNA, 20 bp, human
gcggtccccggggcttccct

SEQ ID NO: 305963 - DNA, 20 bp, human
ggaactgggatggggatctt

SEQ ID NO: 305964 - DNA, 20 bp, human
ggactcggagtcttccaagg

SEQ ID NO: 305965 - DNA, 20 bp, human
ggtacgggtgaggatggggt

SEQ ID NO: 305966 - DNA, 20 bp, human
gagatgtggtcgagggtcat

SEQ ID NO: 305967 - DNA, 20 bp, human
ggggggaaaagtagtggcga

SEQ ID NO: 305968 - DNA, 20 bp, human
gcccccacacgggcagaatc

SEQ ID NO: 305969 - DNA, 20 bp, human
gcgagaggagcagacatcat

SEQ ID NO: 305970 - DNA, 20 bp, human
gaacccgattctgcccgtgt

SEQ ID NO: 305971 - DNA, 20 bp, human
ggagcgggaggtgtgaggtc

SEQ ID NO: 305972 - DNA, 20 bp, human
gacattgccaaggtcttccg

SEQ ID NO: 305973 - DNA, 20 bp, human
ggcagtgagcgggaggtgtg

SEQ ID NO: 305974 - DNA, 20 bp, human
gcccttgcagacaatagctg

SEQ ID NO: 305975 - DNA, 20 bp, human
ggaaagaaccagtagccaag

SEQ ID NO: 305976 - DNA, 20 bp, human
ggggaacagaagcccttgca

SEQ ID NO: 305977 - DNA, 20 bp, human
gaagtcttagtaaaagggtc

SEQ ID NO: 305978 - DNA, 20 bp, human
gtacatagggcgagttctgg

SEQ ID NO: 305979 - DNA, 20 bp, human
gtggagggtctgccctgcaa

SEQ ID NO: 305980 - DNA, 20 bp, human
gaggtacatagggcgagttc

SEQ ID NO: 305981 - DNA, 20 bp, human
gtcttagtaaaagggtcagg

SEQ ID NO: 305982 - DNA, 20 bp, human
ggtaaaagggtcaggaggac

SEQ ID NO: 305983 - DNA, 20 bp, human
gttcatggaggcttccagaa

SEQ ID NO: 305984 - DNA, 20 bp, human
ggcagcactctcctggcacg

SEQ ID NO: 305985 - DNA, 20 bp, human
gccaatgaagtcttagtaaa

SEQ ID NO: 305986 - DNA, 20 bp, human
gacttccctgggttcacagc

SEQ ID NO: 305987 - DNA, 20 bp, human
gatggggatccagatggagg

SEQ ID NO: 305988 - DNA, 20 bp, human
gagcatgaagatggtgttgg

SEQ ID NO: 305989 - DNA, 20 bp, human
gaggtcctgacttggatgcc

SEQ ID NO: 305990 - DNA, 20 bp, human
gccaccctcccccacgtagt

SEQ ID NO: 305991 - DNA, 20 bp, human
gtctgtggtcccactacgtg

SEQ ID NO: 305992 - DNA, 20 bp, human
gcctgaagtggcactggggg

SEQ ID NO: 305993 - DNA, 20 bp, human
gtgtcagccctgataaactt

SEQ ID NO: 305994 - DNA, 20 bp, human
ggcttacctccacctccatc

SEQ ID NO: 305995 - DNA, 20 bp, human
gggtcccactacgtggggga

SEQ ID NO: 305996 - DNA, 20 bp, human
gcccggatggggatctggat

SEQ ID NO: 305997 - DNA, 20 bp, human
ggatggggatctggatgggg

SEQ ID NO: 305998 - DNA, 20 bp, human
gtgaagatggtgttggtgta

SEQ ID NO: 305999 - DNA, 20 bp, human
gttccctgggttcacggcaa

SEQ ID NO: 306000 - DNA, 20 bp, human
gttctgcccggatggggatc

SEQ ID NO: 306001 - DNA, 20 bp, human
ggaaccggattctgcccgga

SEQ ID NO: 306002 - DNA, 20 bp, human
gtccccatccgggcagaatc

SEQ ID NO: 306003 - DNA, 20 bp, human
gactctgagtcggcccgaag

SEQ ID NO: 306004 - DNA, 20 bp, human
gcctgggttcacggcaaggg

SEQ ID NO: 306005 - DNA, 20 bp, human
gatggtgttggtgtaggggt

SEQ ID NO: 306006 - DNA, 20 bp, human
ggggtcgtcttcgtcacctc

SEQ ID NO: 306007 - DNA, 20 bp, human
ggttggatgaagtgatgggc

SEQ ID NO: 306008 - DNA, 20 bp, human
gcttcgtcacctctggctgt

SEQ ID NO: 306009 - DNA, 20 bp, human
ggcctggatggggatcggat

SEQ ID NO: 306010 - DNA, 20 bp, human
gcctggcaacggtactaccc

SEQ ID NO: 306011 - DNA, 20 bp, human
gggtgatggggcaaggggta

SEQ ID NO: 306012 - DNA, 20 bp, human
gggggcaaggggtaaggatt

SEQ ID NO: 306013 - DNA, 20 bp, human
gggggtaaggattgggacgg

SEQ ID NO: 306014 - DNA, 20 bp, human
ggatggggatcggatggggg

SEQ ID NO: 306015 - DNA, 20 bp, human
gcaaggggtaaggattggga

SEQ ID NO: 306016 - DNA, 20 bp, human
ggggtcgtcttcgtcacctc

SEQ ID NO: 306017 - DNA, 20 bp, human
gcttcgtcacctctggctgt

SEQ ID NO: 306018 - DNA, 20 bp, human
ggcctggatggggatcggat

SEQ ID NO: 306019 - DNA, 20 bp, human
gcctggcaacggtactaccc

SEQ ID NO: 306020 - DNA, 20 bp, human
gggtgatggggcaaggggta

SEQ ID NO: 306021 - DNA, 20 bp, human
ggatggggatcggatggggg

SEQ ID NO: 306022 - DNA, 20 bp, human
gattctgcctggatggggat

SEQ ID NO: 306023 - DNA, 20 bp, human
gggggcaaggggtaaggatt

SEQ ID NO: 306024 - DNA, 20 bp, human
gtaccctgggttccgggcag

SEQ ID NO: 306025 - DNA, 20 bp, human
gtggcgtcacatcctggcaa

SEQ ID NO: 306026 - DNA, 20 bp, human
gagggtgcgggggttgaatt

SEQ ID NO: 306027 - DNA, 20 bp, human
gggaggatggggtgctggta

SEQ ID NO: 306028 - DNA, 20 bp, human
gggggtatgagggtggcacg

SEQ ID NO: 306029 - DNA, 20 bp, human
gaccggggatcctgcctgga

SEQ ID NO: 306030 - DNA, 20 bp, human
gcctgcctggatgggggtat

SEQ ID NO: 306031 - DNA, 20 bp, human
gctgtgaggaggcaaggtgg

SEQ ID NO: 306032 - DNA, 20 bp, human
gtcggccagggtgggagttg

SEQ ID NO: 306033 - DNA, 20 bp, human
gtgtgccaggcgtcaaagtc

SEQ ID NO: 306034 - DNA, 20 bp, human
ggcgggggttgaattgggga

SEQ ID NO: 306035 - DNA, 20 bp, human
gtgaaagcgggggcggaacc

SEQ ID NO: 306036 - DNA, 20 bp, human
ggggtcgtcttcgtcacctc

SEQ ID NO: 306037 - DNA, 20 bp, human
ggttggatgaagtgatgggc

SEQ ID NO: 306038 - DNA, 20 bp, human
gcttcgtcacctctggctgt

SEQ ID NO: 306039 - DNA, 20 bp, human
gcctggcaacggtactaccc

SEQ ID NO: 306040 - DNA, 20 bp, human
ggcctggatggggatcggat

SEQ ID NO: 306041 - DNA, 20 bp, human
gtaccctgggttccgggcag

SEQ ID NO: 306042 - DNA, 20 bp, human
gggtgatggggcaaggggta

SEQ ID NO: 306043 - DNA, 20 bp, human
ggatggggatcggatggggg

SEQ ID NO: 306044 - DNA, 20 bp, human
gggggcaaggggtaaggatt

SEQ ID NO: 306045 - DNA, 20 bp, human
gattctgcctggatggggat

SEQ ID NO: 306046 - DNA, 20 bp, human
ggaaccggattctagtgggg

SEQ ID NO: 306047 - DNA, 20 bp, human
gtcacctgggtggacaacag

SEQ ID NO: 306048 - DNA, 20 bp, human
ggcggaaccggattctagtg

SEQ ID NO: 306049 - DNA, 20 bp, human
gtccacccacaccacataga

SEQ ID NO: 306050 - DNA, 20 bp, human
gtctcaaagtgagaaccttg

SEQ ID NO: 306051 - DNA, 20 bp, human
gtgtccacccaggtgagccc

SEQ ID NO: 306052 - DNA, 20 bp, human
ggcggttcagtcatccctca

SEQ ID NO: 306053 - DNA, 20 bp, human
gtggcccctctatgtggtgt

SEQ ID NO: 306054 - DNA, 20 bp, human
ggagctccgtactctgctga

SEQ ID NO: 306055 - DNA, 20 bp, human
gaggttctcactttgagatc

SEQ ID NO: 306056 - DNA, 20 bp, human
gaagatgcacaccatcccat

SEQ ID NO: 306057 - DNA, 20 bp, human
gctgcagcacctgtgattgt

SEQ ID NO: 306058 - DNA, 20 bp, human
gggtgtgcatcttctctcac

SEQ ID NO: 306059 - DNA, 20 bp, human
gtcacaggtcctacaatcac

SEQ ID NO: 306060 - DNA, 20 bp, human
gcgagaggagcagacccaat

SEQ ID NO: 306061 - DNA, 20 bp, human
gccccctgagggatgactga

SEQ ID NO: 306062 - DNA, 20 bp, human
gacccaatgggcagagaatg

SEQ ID NO: 306063 - DNA, 20 bp, human
ggatcgagacccaggcatca

SEQ ID NO: 306064 - DNA, 20 bp, human
gttctggcggagtaggggtg

SEQ ID NO: 306065 - DNA, 20 bp, human
ggccctcagtcatccctcag

SEQ ID NO: 306066 - DNA, 20 bp, human
gaagatgcacaccatcccat

SEQ ID NO: 306067 - DNA, 20 bp, human
gctgcagcacctgtgattgt

SEQ ID NO: 306068 - DNA, 20 bp, human
gggtgtgcatcttctctcac

SEQ ID NO: 306069 - DNA, 20 bp, human
gtcacaggtcctacaatcac

SEQ ID NO: 306070 - DNA, 20 bp, human
gccccctgagggatgactga

SEQ ID NO: 306071 - DNA, 20 bp, human
gcgagaggagcagacccaat

SEQ ID NO: 306072 - DNA, 20 bp, human
gacccaatgggcagagaatg

SEQ ID NO: 306073 - DNA, 20 bp, human
gttctggcggagtaggggtg

SEQ ID NO: 306074 - DNA, 20 bp, human
ggccctcagtcatccctcag

SEQ ID NO: 306075 - DNA, 20 bp, human
ggatcgagacccaggcatca

SEQ ID NO: 306076 - DNA, 20 bp, human
ggctcagatttccaccttgg

SEQ ID NO: 306077 - DNA, 20 bp, human
gtggggctattgtttgaggc

SEQ ID NO: 306078 - DNA, 20 bp, human
gggcaggggtggtacgcttc

SEQ ID NO: 306079 - DNA, 20 bp, human
gccgtcagcccggaggccac

SEQ ID NO: 306080 - DNA, 20 bp, human
gagaaggcctctgcccaaaa

SEQ ID NO: 306081 - DNA, 20 bp, human
ggtaactgttctagcgtcgc

SEQ ID NO: 306082 - DNA, 20 bp, human
gacccctgccgtcagcccgg

SEQ ID NO: 306083 - DNA, 20 bp, human
gcttgggggctgagagaggt

SEQ ID NO: 306084 - DNA, 20 bp, human
gtctgtgaaagtcccgtttt

SEQ ID NO: 306085 - DNA, 20 bp, human
gggaaggtctcatggaggat

SEQ ID NO: 306086 - DNA, 20 bp, human
gcttaatggagggaagacaa

SEQ ID NO: 306087 - DNA, 20 bp, human
gaataactccacagtaaaat

SEQ ID NO: 306088 - DNA, 20 bp, human
ggtagaatctgaagatagaa

SEQ ID NO: 306089 - DNA, 20 bp, human
ggtaaaagttgctttattcg

SEQ ID NO: 306090 - DNA, 20 bp, human
gataacacggcatgggagta

SEQ ID NO: 306091 - DNA, 20 bp, human
ggagcaaaataacacggcat

SEQ ID NO: 306092 - DNA, 20 bp, human
gtgaataatctaagcaaacc

SEQ ID NO: 306093 - DNA, 20 bp, human
ggattctacctattttactg

SEQ ID NO: 306094 - DNA, 20 bp, human
gagattattcaagaatgtgg

SEQ ID NO: 306095 - DNA, 20 bp, human
gtaaagtcttctcttaatgg

SEQ ID NO: 306096 - DNA, 20 bp, human
gcggaagtagatccatattt

SEQ ID NO: 306097 - DNA, 20 bp, human
gaggccgcagcacaaaggta

SEQ ID NO: 306098 - DNA, 20 bp, human
gggaagtgtacgtgacatcc

SEQ ID NO: 306099 - DNA, 20 bp, human
gaactatggggtctcttcac

SEQ ID NO: 306100 - DNA, 20 bp, human
ggcaccctacctttgtgctg

SEQ ID NO: 306101 - DNA, 20 bp, human
gaagagaggccgcagcacaa

SEQ ID NO: 306102 - DNA, 20 bp, human
gtttgcgttccaggcttgat

SEQ ID NO: 306103 - DNA, 20 bp, human
ggataatgggtttgcgttcc

SEQ ID NO: 306104 - DNA, 20 bp, human
ggcaaacccattatccgtaa

SEQ ID NO: 306105 - DNA, 20 bp, human
gctgtccagagcttattgtt

SEQ ID NO: 306106 - DNA, 20 bp, human
ggcctcccagagttgactgc

SEQ ID NO: 306107 - DNA, 20 bp, human
gactgtgacgaccttatctg

SEQ ID NO: 306108 - DNA, 20 bp, human
gaggccctgcagtcaactct

SEQ ID NO: 306109 - DNA, 20 bp, human
gtaaaggtggtccaagtaaa

SEQ ID NO: 306110 - DNA, 20 bp, human
gccctgcagtcaactctggg

SEQ ID NO: 306111 - DNA, 20 bp, human
gataaggtcgtcacagtcct

SEQ ID NO: 306112 - DNA, 20 bp, human
gaggtaaaactctgagactg

SEQ ID NO: 306113 - DNA, 20 bp, human
ggtaactggatgtgacgccc

SEQ ID NO: 306114 - DNA, 20 bp, human
ggtaaaggggacttgaacca

SEQ ID NO: 306115 - DNA, 20 bp, human
ggtcaactctgggaggccgt

SEQ ID NO: 306116 - DNA, 20 bp, human
gaggaccgagagtgacataa

SEQ ID NO: 306117 - DNA, 20 bp, human
ggacactgagtacactggag

SEQ ID NO: 306118 - DNA, 20 bp, human
gtgggaagctgccggaagtg

SEQ ID NO: 306119 - DNA, 20 bp, human
gggaagggagaatcttggtc

SEQ ID NO: 306120 - DNA, 20 bp, human
gtcagctgaggtctttgcta

SEQ ID NO: 306121 - DNA, 20 bp, human
gtggacactcattggagtcc

SEQ ID NO: 306122 - DNA, 20 bp, human
gtctcccagggctgaaagcg

SEQ ID NO: 306123 - DNA, 20 bp, human
ggacccagcagggacttgat

SEQ ID NO: 306124 - DNA, 20 bp, human
gcagggctgaaagcggggcg

SEQ ID NO: 306125 - DNA, 20 bp, human
ggggtagtgactctgtctaa

SEQ ID NO: 306126 - DNA, 20 bp, human
ggagcccagcagccacgcct

SEQ ID NO: 306127 - DNA, 20 bp, human
gtaagctgggagagcaaagt

SEQ ID NO: 306128 - DNA, 20 bp, human
ggactcccaagattgacagt

SEQ ID NO: 306129 - DNA, 20 bp, human
gcgcccctactgtcaatctt

SEQ ID NO: 306130 - DNA, 20 bp, human
ggcaaatggttctgcgttcg

SEQ ID NO: 306131 - DNA, 20 bp, human
gtccaccttacttcctactc

SEQ ID NO: 306132 - DNA, 20 bp, human
ggacttgaggccatcaaata

SEQ ID NO: 306133 - DNA, 20 bp, human
gggttctgcgttcgggggag

SEQ ID NO: 306134 - DNA, 20 bp, human
gtccagagtaggaagtaagg

SEQ ID NO: 306135 - DNA, 20 bp, human
gtgggagagcaaagtgggcg

SEQ ID NO: 306136 - DNA, 20 bp, human
gcggcagcccgtggcgtctg

SEQ ID NO: 306137 - DNA, 20 bp, human
gggtcccttcgtctccacta

SEQ ID NO: 306138 - DNA, 20 bp, human
ggacccctagtggagacgaa

SEQ ID NO: 306139 - DNA, 20 bp, human
ggcgtctgagggctgacggc

SEQ ID NO: 306140 - DNA, 20 bp, human
ggtcagccctcagacgccac

SEQ ID NO: 306141 - DNA, 20 bp, human
ggctgacggctggacgctac

SEQ ID NO: 306142 - DNA, 20 bp, human
gcagcacgcatattcgtccc

SEQ ID NO: 306143 - DNA, 20 bp, human
gaggtgggggtattgtttgg

SEQ ID NO: 306144 - DNA, 20 bp, human
gttgaaaaaaaagacccgag

SEQ ID NO: 306145 - DNA, 20 bp, human
ggtcactgttctagcgttgc

SEQ ID NO: 306146 - DNA, 20 bp, human
gtaactagagggaggatcca

SEQ ID NO: 306147 - DNA, 20 bp, human
ggccccgttatcttttggtg

SEQ ID NO: 306148 - DNA, 20 bp, human
ggtgacctcagttaactaga

SEQ ID NO: 306149 - DNA, 20 bp, human
gaggaccttgaatgaagaac

SEQ ID NO: 306150 - DNA, 20 bp, human
gcagggtctggcagatatca

SEQ ID NO: 306151 - DNA, 20 bp, human
gaagtgagagttttgaccta

SEQ ID NO: 306152 - DNA, 20 bp, human
gcaaccacaccaaaagataa

SEQ ID NO: 306153 - DNA, 20 bp, human
gcacatccctgcaaactctt

SEQ ID NO: 306154 - DNA, 20 bp, human
gcagtctgactgcactgcct

SEQ ID NO: 306155 - DNA, 20 bp, human
gagattgccccgttatcttt

SEQ ID NO: 306156 - DNA, 20 bp, human
gtcacaacaccaatagaggg

SEQ ID NO: 306157 - DNA, 20 bp, human
gggctgactgggtgacaaca

SEQ ID NO: 306158 - DNA, 20 bp, human
gggcctgagcctccctctat

SEQ ID NO: 306159 - DNA, 20 bp, human
ggacaacaaggctcgcagtg

SEQ ID NO: 306160 - DNA, 20 bp, human
ggcttctaggcaggggtggt

SEQ ID NO: 306161 - DNA, 20 bp, human
gtctgtgttctggcttggag

SEQ ID NO: 306162 - DNA, 20 bp, human
ggcagcttgccaaccctgcc

SEQ ID NO: 306163 - DNA, 20 bp, human
ggcactaaatgcttctaggc

SEQ ID NO: 306164 - DNA, 20 bp, human
gcaccaatagagggaggctc

SEQ ID NO: 306165 - DNA, 20 bp, human
ggctgacatgacaattctaa

SEQ ID NO: 306166 - DNA, 20 bp, human
gctgaagcagagagtcatct

SEQ ID NO: 306167 - DNA, 20 bp, human
gatcagagtcaacatgtctc

SEQ ID NO: 306168 - DNA, 20 bp, human
gcagagagtcatcttggatc

SEQ ID NO: 306169 - DNA, 20 bp, human
gcagcagcagatgagctctg

SEQ ID NO: 306170 - DNA, 20 bp, human
ggtagtgtttctcacaagtg

SEQ ID NO: 306171 - DNA, 20 bp, human
gagcaggcaggagaatgagt

SEQ ID NO: 306172 - DNA, 20 bp, human
gggtcaagagagcccactgg

SEQ ID NO: 306173 - DNA, 20 bp, human
gggagaatgagtaggagaac

SEQ ID NO: 306174 - DNA, 20 bp, human
gggggaatatccccaagaat

SEQ ID NO: 306175 - DNA, 20 bp, human
gacccctcaactcagaagac

SEQ ID NO: 306176 - DNA, 20 bp, human
gagggctgccagtaagggtg

SEQ ID NO: 306177 - DNA, 20 bp, human
gtattccagggctgccagta

SEQ ID NO: 306178 - DNA, 20 bp, human
gtggcagccctggaatacat

SEQ ID NO: 306179 - DNA, 20 bp, human
gcacggagccccacccttac

SEQ ID NO: 306180 - DNA, 20 bp, human
gtatgagggcttagtctgag

SEQ ID NO: 306181 - DNA, 20 bp, human
gagaccctatagtagggagg

SEQ ID NO: 306182 - DNA, 20 bp, human
ggtaagtacgttaataactg

SEQ ID NO: 306183 - DNA, 20 bp, human
ggagggcttagtctgagggg

SEQ ID NO: 306184 - DNA, 20 bp, human
gcagcagctagaggatttcc

SEQ ID NO: 306185 - DNA, 20 bp, human
gttggtctgattgtgagtta

SEQ ID NO: 306186 - DNA, 20 bp, human
ggtgggtgcagcagattcca

SEQ ID NO: 306187 - DNA, 20 bp, human
ggaatgagagcctctatctc

SEQ ID NO: 306188 - DNA, 20 bp, human
gcaacagatagagaagtcca

SEQ ID NO: 306189 - DNA, 20 bp, human
gcggcatggctcccgagctc

SEQ ID NO: 306190 - DNA, 20 bp, human
gtgcaccttacttccaactc

SEQ ID NO: 306191 - DNA, 20 bp, human
gctgcacccacagaacacaa

SEQ ID NO: 306192 - DNA, 20 bp, human
gttccaactctggactctca

SEQ ID NO: 306193 - DNA, 20 bp, human
gaggtgggcgtggccggaag

SEQ ID NO: 306194 - DNA, 20 bp, human
ggcctggggcctcctaaacc

SEQ ID NO: 306195 - DNA, 20 bp, human
ggaagcgacgacactgagtg

SEQ ID NO: 306196 - DNA, 20 bp, human
gactctgtcagggttgatca

SEQ ID NO: 306197 - DNA, 20 bp, human
ggtcagccctggaaaaaggt

SEQ ID NO: 306198 - DNA, 20 bp, human
ggaggctgacaagcgggcgg

SEQ ID NO: 306199 - DNA, 20 bp, human
gtgacagcccggatagcgtg

SEQ ID NO: 306200 - DNA, 20 bp, human
ggccccgccccacgctatcc

SEQ ID NO: 306201 - DNA, 20 bp, human
gcacatccgggaactctgtc

SEQ ID NO: 306202 - DNA, 20 bp, human
gagcccggatagcgtggggc

SEQ ID NO: 306203 - DNA, 20 bp, human
gggtgtgagtgtcaaggact

SEQ ID NO: 306204 - DNA, 20 bp, human
gaagaagagaactctgtcga

SEQ ID NO: 306205 - DNA, 20 bp, human
gcctgtgcctcccccgtgtt

SEQ ID NO: 306206 - DNA, 20 bp, human
gaccctgccgtggttgtcca

SEQ ID NO: 306207 - DNA, 20 bp, human
gacgcagcgtcaatgtgggg

SEQ ID NO: 306208 - DNA, 20 bp, human
gggctgacgcagcgtcaatg

SEQ ID NO: 306209 - DNA, 20 bp, human
ggagtggggtgtcaaggact

SEQ ID NO: 306210 - DNA, 20 bp, human
gtggttcctcctcagagagg

SEQ ID NO: 306211 - DNA, 20 bp, human
gccccactctcctttttcca

SEQ ID NO: 306212 - DNA, 20 bp, human
gaggctgttgtctctgagga

SEQ ID NO: 306213 - DNA, 20 bp, human
gcccggatgtgctttcccga

SEQ ID NO: 306214 - DNA, 20 bp, human
gttttccaggggtgtcagca

SEQ ID NO: 306215 - DNA, 20 bp, human
gtgagagtcagcagaagggg

SEQ ID NO: 306216 - DNA, 20 bp, human
gtaagtgtcttgctcgactt

SEQ ID NO: 306217 - DNA, 20 bp, human
gccattttgtcttaccaagt

SEQ ID NO: 306218 - DNA, 20 bp, human
gcacttagacattgagatac

SEQ ID NO: 306219 - DNA, 20 bp, human
gtctgttcgttcctttttta

SEQ ID NO: 306220 - DNA, 20 bp, human
gtaagcatacttatcccact

SEQ ID NO: 306221 - DNA, 20 bp, human
ggttgttagatagattccaa

SEQ ID NO: 306222 - DNA, 20 bp, human
ggtatctgtttaggaattga

SEQ ID NO: 306223 - DNA, 20 bp, human
gaaatcactgatagcccaga

SEQ ID NO: 306224 - DNA, 20 bp, human
gttagacattgagatacagg

SEQ ID NO: 306225 - DNA, 20 bp, human
ggagatagagaccataaaaa

SEQ ID NO: 306226 - DNA, 20 bp, human
gattgctgggtgagaggtgc

SEQ ID NO: 306227 - DNA, 20 bp, human
gctctcacccagcaatgaga

SEQ ID NO: 306228 - DNA, 20 bp, human
ggggtgagaggtgcagggaa

SEQ ID NO: 306229 - DNA, 20 bp, human
gcggcagccctctcattgct

SEQ ID NO: 306230 - DNA, 20 bp, human
gtccctgtgctgatttgcca

SEQ ID NO: 306231 - DNA, 20 bp, human
gcccgtggcaaatcagcaca

SEQ ID NO: 306232 - DNA, 20 bp, human
gccagtcagctcaggctgag

SEQ ID NO: 306233 - DNA, 20 bp, human
ggtgcatcagaacagatgtg

SEQ ID NO: 306234 - DNA, 20 bp, human
ggccagcccaactgcccccg

SEQ ID NO: 306235 - DNA, 20 bp, human
gaccacgggggcagttgggc

SEQ ID NO: 306236 - DNA, 20 bp, human
gctctcctgacctatgtcaa

SEQ ID NO: 306237 - DNA, 20 bp, human
gcaactgttgctgtcgggac

SEQ ID NO: 306238 - DNA, 20 bp, human
gacagaacaactgttgctgt

SEQ ID NO: 306239 - DNA, 20 bp, human
gtacttaaagtagaaggttt

SEQ ID NO: 306240 - DNA, 20 bp, human
gcggtagtacttaaagtaga

SEQ ID NO: 306241 - DNA, 20 bp, human
gtggaaggagtaaaaccttg

SEQ ID NO: 306242 - DNA, 20 bp, human
ggatgcacaggggacttttc

SEQ ID NO: 306243 - DNA, 20 bp, human
gaaggggggagtgccggccc

SEQ ID NO: 306244 - DNA, 20 bp, human
gaaagacaatggatttttct

SEQ ID NO: 306245 - DNA, 20 bp, human
gacctcaaaagagatgcaca

SEQ ID NO: 306246 - DNA, 20 bp, human
gcaagccggcctgacaggag

SEQ ID NO: 306247 - DNA, 20 bp, human
gaggcacagcgcatctgtgg

SEQ ID NO: 306248 - DNA, 20 bp, human
gcccaacaaaagcttcgtcc

SEQ ID NO: 306249 - DNA, 20 bp, human
gcatgcgcatcatggtctcc

SEQ ID NO: 306250 - DNA, 20 bp, human
gacaggaggggccttgaata

SEQ ID NO: 306251 - DNA, 20 bp, human
gtgtcgacctggttggtggt

SEQ ID NO: 306252 - DNA, 20 bp, human
gggggtggtgtgttggcaaa

SEQ ID NO: 306253 - DNA, 20 bp, human
gacagcgcatctgtggggga

SEQ ID NO: 306254 - DNA, 20 bp, human
gaagaggcacagcgcatctg

SEQ ID NO: 306255 - DNA, 20 bp, human
ggccttgaataggggaggga

SEQ ID NO: 306256 - DNA, 20 bp, human
gcaacgtaggtgttgatcta

SEQ ID NO: 306257 - DNA, 20 bp, human
gcgtaggtgttgatctaggg

SEQ ID NO: 306258 - DNA, 20 bp, human
gaaaatgaggcctgagttaa

SEQ ID NO: 306259 - DNA, 20 bp, human
gccggtttacatcacaacgt

SEQ ID NO: 306260 - DNA, 20 bp, human
gttgcctgaagtgaaggagg

SEQ ID NO: 306261 - DNA, 20 bp, human
gaggaagttgcctgaagtga

SEQ ID NO: 306262 - DNA, 20 bp, human
gatgaagggagatatttcta

SEQ ID NO: 306263 - DNA, 20 bp, human
gaggtggcgaattgtacatg

SEQ ID NO: 306264 - DNA, 20 bp, human
ggagcttgctagagaggcac

SEQ ID NO: 306265 - DNA, 20 bp, human
gagttaagggactaagatga

SEQ ID NO: 306266 - DNA, 20 bp, human
gccacccccgaggaaggcga

SEQ ID NO: 306267 - DNA, 20 bp, human
ggggcaatggggccccgctc

SEQ ID NO: 306268 - DNA, 20 bp, human
gcccccgaggaaggcgaggg

SEQ ID NO: 306269 - DNA, 20 bp, human
gaaggcgagggggggtggca

SEQ ID NO: 306270 - DNA, 20 bp, human
gggcagggggctgcggaaag

SEQ ID NO: 306271 - DNA, 20 bp, human
gccccccctcgccttcctcg

SEQ ID NO: 306272 - DNA, 20 bp, human
gtcctcgggggtggggcaat

SEQ ID NO: 306273 - DNA, 20 bp, human
gaagagcttcagactgagcc

SEQ ID NO: 306274 - DNA, 20 bp, human
gttcagggggcggtttgagt

SEQ ID NO: 306275 - DNA, 20 bp, human
gcgtcagacagccctgagcg

SEQ ID NO: 306276 - DNA, 20 bp, human
gcgtgctgggaaagcgggcg

SEQ ID NO: 306277 - DNA, 20 bp, human
gcatgcgctctatcgacctg

SEQ ID NO: 306278 - DNA, 20 bp, human
gagggctcgtgctgggaaag

SEQ ID NO: 306279 - DNA, 20 bp, human
gacggtggacatcaaagaaa

SEQ ID NO: 306280 - DNA, 20 bp, human
gtgcgcatgcgcaatggtcg

SEQ ID NO: 306281 - DNA, 20 bp, human
gcaaagaaagggctcgtgct

SEQ ID NO: 306282 - DNA, 20 bp, human
gggtactgcggacctggaga

SEQ ID NO: 306283 - DNA, 20 bp, human
gactatgtttcgctagaaag

SEQ ID NO: 306284 - DNA, 20 bp, human
gcgatagagcgcatgcgcgt

SEQ ID NO: 306285 - DNA, 20 bp, human
gcgacctgcggctgggtggg

SEQ ID NO: 306286 - DNA, 20 bp, human
ggggcggtggggtcgaaggt

SEQ ID NO: 306287 - DNA, 20 bp, human
gtgtgcgcgcccgcggtagg

SEQ ID NO: 306288 - DNA, 20 bp, human
gaaaaggggcggggtggtcc

SEQ ID NO: 306289 - DNA, 20 bp, human
gggtgcacggagaaaagggg

SEQ ID NO: 306290 - DNA, 20 bp, human
gcgcggaatcgcatgcgcac

SEQ ID NO: 306291 - DNA, 20 bp, human
ggggtcgaaggtagggtgcg

SEQ ID NO: 306292 - DNA, 20 bp, human
ggggactgagaagagatgat

SEQ ID NO: 306293 - DNA, 20 bp, human
gagaggtgaagtggatctgg

SEQ ID NO: 306294 - DNA, 20 bp, human
ggggggtgcacggagaaaag

SEQ ID NO: 306295 - DNA, 20 bp, human
gaacctgcggggctacgaaa

SEQ ID NO: 306296 - DNA, 20 bp, human
ggggcggtggggtcgaaggt

SEQ ID NO: 306297 - DNA, 20 bp, human
ggggactgagaagagatgat

SEQ ID NO: 306298 - DNA, 20 bp, human
gtgtgcgcgcccgcggtagg

SEQ ID NO: 306299 - DNA, 20 bp, human
gagaggtgaagtggatctgg

SEQ ID NO: 306300 - DNA, 20 bp, human
gaagcattgtgcaaaagtgg

SEQ ID NO: 306301 - DNA, 20 bp, human
ggggtcgaaggtagggtgcg

SEQ ID NO: 306302 - DNA, 20 bp, human
gcgcggaatcgcatgcgcac

SEQ ID NO: 306303 - DNA, 20 bp, human
gcaggctacccagccgcggg

SEQ ID NO: 306304 - DNA, 20 bp, human
gtgagaagagatgattgggt

SEQ ID NO: 306305 - DNA, 20 bp, human
gtgggtcgagctgcactgca

SEQ ID NO: 306306 - DNA, 20 bp, human
gtcccctgggcctgagaaag

SEQ ID NO: 306307 - DNA, 20 bp, human
gcctgagaaagtggatgcgg

SEQ ID NO: 306308 - DNA, 20 bp, human
gaaggagagcactagcagaa

SEQ ID NO: 306309 - DNA, 20 bp, human
gactagcagaagggaaactt

SEQ ID NO: 306310 - DNA, 20 bp, human
gtctgcgcctgcgcggactg

SEQ ID NO: 306311 - DNA, 20 bp, human
gcatccactttctcaggccc

SEQ ID NO: 306312 - DNA, 20 bp, human
ggcagaagggaaactttggt

SEQ ID NO: 306313 - DNA, 20 bp, human
gcgcggactgcggcagaggg

SEQ ID NO: 306314 - DNA, 20 bp, human
gtgcggtggttctgcaccaa

SEQ ID NO: 306315 - DNA, 20 bp, human
gctgcgcggactgcggcaga

SEQ ID NO: 306316 - DNA, 20 bp, human
gctgccccctcacctctgaa

SEQ ID NO: 306317 - DNA, 20 bp, human
gtggagggagcatcactgaa

SEQ ID NO: 306318 - DNA, 20 bp, human
ggcaaaagggtcaagggatg

SEQ ID NO: 306319 - DNA, 20 bp, human
ggcggcaaaataacgctctg

SEQ ID NO: 306320 - DNA, 20 bp, human
gtctgaagggcaggctaggc

SEQ ID NO: 306321 - DNA, 20 bp, human
gagacaaagcatggaagacg

SEQ ID NO: 306322 - DNA, 20 bp, human
gggcggtagaggattcagag

SEQ ID NO: 306323 - DNA, 20 bp, human
gagcctgcccttcagaggtg

SEQ ID NO: 306324 - DNA, 20 bp, human
gcacttgaagtttttctgtg

SEQ ID NO: 306325 - DNA, 20 bp, human
gcagaaaaacttcaagtgga

SEQ ID NO: 306326 - DNA, 20 bp, human
gagaagggaccggaaaagga

SEQ ID NO: 306327 - DNA, 20 bp, human
gacccagaagggaccggaaa

SEQ ID NO: 306328 - DNA, 20 bp, human
gtcagtccgcgcccgcgcga

SEQ ID NO: 306329 - DNA, 20 bp, human
ggcgccctgtgacggatttt

SEQ ID NO: 306330 - DNA, 20 bp, human
gtacacgggccgaggggtgt

SEQ ID NO: 306331 - DNA, 20 bp, human
gcccccaacccagaagggac

SEQ ID NO: 306332 - DNA, 20 bp, human
gggggcgggggaatgtaacc

SEQ ID NO: 306333 - DNA, 20 bp, human
ggtgcccaggctgctataag

SEQ ID NO: 306334 - DNA, 20 bp, human
gtccggtcccttctgggttg

SEQ ID NO: 306335 - DNA, 20 bp, human
gtcccccggggcttgcgcgg

SEQ ID NO: 306336 - DNA, 20 bp, human
gaaaaggggcaggcagcgac

SEQ ID NO: 306337 - DNA, 20 bp, human
gctagcaccaaagaggaagt

SEQ ID NO: 306338 - DNA, 20 bp, human
ggggacttccgctagcagat

SEQ ID NO: 306339 - DNA, 20 bp, human
gctagcggaagtccctgtgg

SEQ ID NO: 306340 - DNA, 20 bp, human
gcgctagcagataggaaaag

SEQ ID NO: 306341 - DNA, 20 bp, human
gcacactcctagcaccaaag

SEQ ID NO: 306342 - DNA, 20 bp, human
gtgacagctagagattggag

SEQ ID NO: 306343 - DNA, 20 bp, human
gagcccgtcgtcagtgggaa

SEQ ID NO: 306344 - DNA, 20 bp, human
gctgctagcggaagtccctg

SEQ ID NO: 306345 - DNA, 20 bp, human
ggctgctcgcgcaagtcagc

SEQ ID NO: 306346 - DNA, 20 bp, human
gggggcgtctaccggagtcc

SEQ ID NO: 306347 - DNA, 20 bp, human
gcacaagtggatattgcata

SEQ ID NO: 306348 - DNA, 20 bp, human
gtggtctgggctaagatgtg

SEQ ID NO: 306349 - DNA, 20 bp, human
gaaggtatccaagacggcgg

SEQ ID NO: 306350 - DNA, 20 bp, human
gaagagaggctgatgagtat

SEQ ID NO: 306351 - DNA, 20 bp, human
ggctttccgcagtaaggagg

SEQ ID NO: 306352 - DNA, 20 bp, human
gagaccagtcagactccaca

SEQ ID NO: 306353 - DNA, 20 bp, human
gctgtgaaaagtcatccatg

SEQ ID NO: 306354 - DNA, 20 bp, human
gctggtctgcatttggggac

SEQ ID NO: 306355 - DNA, 20 bp, human
ggagcagaccactggaaaca

SEQ ID NO: 306356 - DNA, 20 bp, human
gggaatctctcccttcgggg

SEQ ID NO: 306357 - DNA, 20 bp, human
ggacccatcgggaagcacgt

SEQ ID NO: 306358 - DNA, 20 bp, human
gcgcgcgcgtctcctgtcgc

SEQ ID NO: 306359 - DNA, 20 bp, human
gggtcctaaaaccgacctgc

SEQ ID NO: 306360 - DNA, 20 bp, human
gacgttggaatctctccctt

SEQ ID NO: 306361 - DNA, 20 bp, human
gctctcccttcggggaggag

SEQ ID NO: 306362 - DNA, 20 bp, human
gggactccgcggattccttt

SEQ ID NO: 306363 - DNA, 20 bp, human
gtaggggttcaggaagggtt

SEQ ID NO: 306364 - DNA, 20 bp, human
gattccaacgtgcttcccga

SEQ ID NO: 306365 - DNA, 20 bp, human
gggagagaggataggggttc

SEQ ID NO: 306366 - DNA, 20 bp, human
ggggtcaagctgcggaggga

SEQ ID NO: 306367 - DNA, 20 bp, human
gtgtactagttctactgtac

SEQ ID NO: 306368 - DNA, 20 bp, human
gaggggcgcgcgcgccgggt

SEQ ID NO: 306369 - DNA, 20 bp, human
gctggcagacgggaggaggc

SEQ ID NO: 306370 - DNA, 20 bp, human
gctaccgggtcaagctgcgg

SEQ ID NO: 306371 - DNA, 20 bp, human
gcagcttgacccggtagtga

SEQ ID NO: 306372 - DNA, 20 bp, human
gggtccgcctggcagcctac

SEQ ID NO: 306373 - DNA, 20 bp, human
gtactgtactggcagacggg

SEQ ID NO: 306374 - DNA, 20 bp, human
gccgcctggcagcctacggg

SEQ ID NO: 306375 - DNA, 20 bp, human
gttctactgtactggcagac

SEQ ID NO: 306376 - DNA, 20 bp, human
gggcggaccgccaacgagaa

SEQ ID NO: 306377 - DNA, 20 bp, human
ggccctggactctcgcgcca

SEQ ID NO: 306378 - DNA, 20 bp, human
gcagtggtccccattctcgt

SEQ ID NO: 306379 - DNA, 20 bp, human
gcccgccgggggccaatccc

SEQ ID NO: 306380 - DNA, 20 bp, human
gtggtcggtgcgagtggagg

SEQ ID NO: 306381 - DNA, 20 bp, human
gtccctggcgcgagagtcca

SEQ ID NO: 306382 - DNA, 20 bp, human
gcgcgccagggattggcccc

SEQ ID NO: 306383 - DNA, 20 bp, human
gggcgcttgggaacgagccc

SEQ ID NO: 306384 - DNA, 20 bp, human
ggccagggattggcccccgg

SEQ ID NO: 306385 - DNA, 20 bp, human
ggcgcgagagtccagggccg

SEQ ID NO: 306386 - DNA, 20 bp, human
gcgtccggaagcataggggt

SEQ ID NO: 306387 - DNA, 20 bp, human
gacttggggcggggatcgga

SEQ ID NO: 306388 - DNA, 20 bp, human
gacggtcggggatcgcgtga

SEQ ID NO: 306389 - DNA, 20 bp, human
gcggaaggagggtgagtgac

SEQ ID NO: 306390 - DNA, 20 bp, human
gtagggcccgcgagcgggga

SEQ ID NO: 306391 - DNA, 20 bp, human
gtgacctccgaaactatcga

SEQ ID NO: 306392 - DNA, 20 bp, human
gggcctgaaatgtgagtcac

SEQ ID NO: 306393 - DNA, 20 bp, human
gcccgcccccatgggactat

SEQ ID NO: 306394 - DNA, 20 bp, human
ggagggttcggagaggagtt

SEQ ID NO: 306395 - DNA, 20 bp, human
ggcgcgagctgcggtcgacg

SEQ ID NO: 306396 - DNA, 20 bp, human
gcgctcccgcgtccagctgg

SEQ ID NO: 306397 - DNA, 20 bp, human
gcccgtcgtcgctgcgtgga

SEQ ID NO: 306398 - DNA, 20 bp, human
gggcgcgcggaagtgacgtc

SEQ ID NO: 306399 - DNA, 20 bp, human
gtaacctcttcgcccggaag

SEQ ID NO: 306400 - DNA, 20 bp, human
gtacgactcacacaagtcgg

SEQ ID NO: 306401 - DNA, 20 bp, human
gggttgaggttcatacccct

SEQ ID NO: 306402 - DNA, 20 bp, human
gccgccgcaaacgtcagtgt

SEQ ID NO: 306403 - DNA, 20 bp, human
gcccggggttcaaagcccag

SEQ ID NO: 306404 - DNA, 20 bp, human
gggcccgccaggctcaacct

SEQ ID NO: 306405 - DNA, 20 bp, human
ggcggctggctctccgcctc

SEQ ID NO: 306406 - DNA, 20 bp, human
gtccggaggcgctgaaggga

SEQ ID NO: 306407 - DNA, 20 bp, human
ggtatcgcgtgagagtccgg

SEQ ID NO: 306408 - DNA, 20 bp, human
gagagtccggaggcgctgaa

SEQ ID NO: 306409 - DNA, 20 bp, human
gcgagtatcgcgtgagagtc

SEQ ID NO: 306410 - DNA, 20 bp, human
gaccctcccttcagcgcctc

SEQ ID NO: 306411 - DNA, 20 bp, human
gtagtctagggctgcactgc

SEQ ID NO: 306412 - DNA, 20 bp, human
gcctagtaaagcgaaagtca

SEQ ID NO: 306413 - DNA, 20 bp, human
gcacaaacgccgcaaggatt

SEQ ID NO: 306414 - DNA, 20 bp, human
ggctttcacgctttagtcta

SEQ ID NO: 306415 - DNA, 20 bp, human
gttcgctttactaggaatgg

SEQ ID NO: 306416 - DNA, 20 bp, human
ggcgctgtgacgtaatgtga

SEQ ID NO: 306417 - DNA, 20 bp, human
gctacacgcccgctaaaaga

SEQ ID NO: 306418 - DNA, 20 bp, human
ggagctggaccaatgaggaa

SEQ ID NO: 306419 - DNA, 20 bp, human
ggccccttgcctttcctcat

SEQ ID NO: 306420 - DNA, 20 bp, human
gtgtgaggggtctcccggca

SEQ ID NO: 306421 - DNA, 20 bp, human
gtaatctggagcgttttcat

SEQ ID NO: 306422 - DNA, 20 bp, human
ggagggtggggcgtgagaac

SEQ ID NO: 306423 - DNA, 20 bp, human
gggcgggtcattatctttag

SEQ ID NO: 306424 - DNA, 20 bp, human
gtacgtatcgagaaaggggc

SEQ ID NO: 306425 - DNA, 20 bp, human
gcgtaatgtgaggggtctcc

SEQ ID NO: 306426 - DNA, 20 bp, human
gcatggagccgggggactgt

SEQ ID NO: 306427 - DNA, 20 bp, human
gcctacggccggcccagaga

SEQ ID NO: 306428 - DNA, 20 bp, human
gcggggcttcatggagccgg

SEQ ID NO: 306429 - DNA, 20 bp, human
gaggcggggcctgcgggaat

SEQ ID NO: 306430 - DNA, 20 bp, human
ggctccatgaagccccgccc

SEQ ID NO: 306431 - DNA, 20 bp, human
ggggcctgcgggaattggcg

SEQ ID NO: 306432 - DNA, 20 bp, human
gaatccccgccaattcccgc

SEQ ID NO: 306433 - DNA, 20 bp, human
gcagcaggcgggcctacggc

SEQ ID NO: 306434 - DNA, 20 bp, human
gcctaaaccccaagtctaaa

SEQ ID NO: 306435 - DNA, 20 bp, human
gaagacgccggagcttcaca

SEQ ID NO: 306436 - DNA, 20 bp, human
gcgcgcccgtccgcaatgct

SEQ ID NO: 306437 - DNA, 20 bp, human
gcgcggcgacgagactgcca

SEQ ID NO: 306438 - DNA, 20 bp, human
gccagcgtggtgaagacgcg

SEQ ID NO: 306439 - DNA, 20 bp, human
ggtccccgcgctccaggatt

SEQ ID NO: 306440 - DNA, 20 bp, human
gtggagctgggaaccctgtt

SEQ ID NO: 306441 - DNA, 20 bp, human
gatcgcactgggtcccaaca

SEQ ID NO: 306442 - DNA, 20 bp, human
gcaagcccagcattgcggac

SEQ ID NO: 306443 - DNA, 20 bp, human
gtgggacccagtgcgatccg

SEQ ID NO: 306444 - DNA, 20 bp, human
gaggctgcgcgttccggaac

SEQ ID NO: 306445 - DNA, 20 bp, human
gccggtgccgcacccaacgt

SEQ ID NO: 306446 - DNA, 20 bp, human
gccgcagcggggcctcgaag

SEQ ID NO: 306447 - DNA, 20 bp, human
gctgcgggcgtccagagctg

SEQ ID NO: 306448 - DNA, 20 bp, human
ggctctggacgcccgcagcg

SEQ ID NO: 306449 - DNA, 20 bp, human
gaagaggtggcacccacggc

SEQ ID NO: 306450 - DNA, 20 bp, human
gaccgccctgaacctcttcg

SEQ ID NO: 306451 - DNA, 20 bp, human
gggggcctcgaagaggttca

SEQ ID NO: 306452 - DNA, 20 bp, human
gccctgcttcccgcaagagg

SEQ ID NO: 306453 - DNA, 20 bp, human
gaggttcagggcggtgcccg

SEQ ID NO: 306454 - DNA, 20 bp, human
ggggcaaaaccactttggtc

SEQ ID NO: 306455 - DNA, 20 bp, human
ggctcgggccgggtctcccg

SEQ ID NO: 306456 - DNA, 20 bp, human
gagggcgcgctgtgagagct

SEQ ID NO: 306457 - DNA, 20 bp, human
gtcacctgggcccacgtgac

SEQ ID NO: 306458 - DNA, 20 bp, human
gagcacaggtgcaaactaag

SEQ ID NO: 306459 - DNA, 20 bp, human
gcaggtgcaaactaagggga

SEQ ID NO: 306460 - DNA, 20 bp, human
ggagctgggaggaccgcgcc

SEQ ID NO: 306461 - DNA, 20 bp, human
gcgctcgcgatcacgtgcac

SEQ ID NO: 306462 - DNA, 20 bp, human
ggcgatcacgtgcacaggtg

SEQ ID NO: 306463 - DNA, 20 bp, human
gagcggctcgggcgccaggg

SEQ ID NO: 306464 - DNA, 20 bp, human
ggaggtgaggtcggcggagc

SEQ ID NO: 306465 - DNA, 20 bp, human
gatagcgatcaggggtatgg

SEQ ID NO: 306466 - DNA, 20 bp, human
ggcagccagcagatcctcag

SEQ ID NO: 306467 - DNA, 20 bp, human
ggccgctgggccgcccactg

SEQ ID NO: 306468 - DNA, 20 bp, human
gccgcccactgaggatctgc

SEQ ID NO: 306469 - DNA, 20 bp, human
gcctcgtagccaagcagctt

SEQ ID NO: 306470 - DNA, 20 bp, human
ggtgggcggcccagcggcat

SEQ ID NO: 306471 - DNA, 20 bp, human
gcccctggaataacatgctc

SEQ ID NO: 306472 - DNA, 20 bp, human
gctcccaggcgacgtccgat

SEQ ID NO: 306473 - DNA, 20 bp, human
gacacccatcggacgtcgcc

SEQ ID NO: 306474 - DNA, 20 bp, human
gcagcttgggcctacactct

SEQ ID NO: 306475 - DNA, 20 bp, human
gcccggagcatgttattcca

SEQ ID NO: 306476 - DNA, 20 bp, human
gaagagctacttggggatta

SEQ ID NO: 306477 - DNA, 20 bp, human
ggacccggaagagctacttg

SEQ ID NO: 306478 - DNA, 20 bp, human
gggcctgaaggacggaccat

SEQ ID NO: 306479 - DNA, 20 bp, human
gcacccgcgacgccgacgca

SEQ ID NO: 306480 - DNA, 20 bp, human
ggctgctcgccccactaatg

SEQ ID NO: 306481 - DNA, 20 bp, human
gaaattctacgtcgatgcgt

SEQ ID NO: 306482 - DNA, 20 bp, human
gacggaccatgggcggagtc

SEQ ID NO: 306483 - DNA, 20 bp, human
gcgcccatggtccgtccttc

SEQ ID NO: 306484 - DNA, 20 bp, human
gctgctgctatggggccggg

SEQ ID NO: 306485 - DNA, 20 bp, human
ggacgcaaggctgctgctat

SEQ ID NO: 306486 - DNA, 20 bp, human
ggcggggcacggagcctcga

SEQ ID NO: 306487 - DNA, 20 bp, human
gcctcgaggggcgggacctt

SEQ ID NO: 306488 - DNA, 20 bp, human
gcgccccggcagctcctcta

SEQ ID NO: 306489 - DNA, 20 bp, human
gctcccgagcaggaaaggac

SEQ ID NO: 306490 - DNA, 20 bp, human
gcagccctcccgagcaggaa

SEQ ID NO: 306491 - DNA, 20 bp, human
gcgagcaggaaaggacgggt

SEQ ID NO: 306492 - DNA, 20 bp, human
gcctccctcgccctcccccg

SEQ ID NO: 306493 - DNA, 20 bp, human
ggcagccgcacgcacgcagt

SEQ ID NO: 306494 - DNA, 20 bp, human
gaaacccagccctcccgagc

SEQ ID NO: 306495 - DNA, 20 bp, human
gccagccgcgcaaaggggcg

SEQ ID NO: 306496 - DNA, 20 bp, human
ggggaactcgcttatttctg

SEQ ID NO: 306497 - DNA, 20 bp, human
ggcctcgggtcccaacccag

SEQ ID NO: 306498 - DNA, 20 bp, human
ggggagaagaagttaaaatt

SEQ ID NO: 306499 - DNA, 20 bp, human
gggactgacatgccagatgc

SEQ ID NO: 306500 - DNA, 20 bp, human
gcgggtcccaacccagcgga

SEQ ID NO: 306501 - DNA, 20 bp, human
gaagtgggggtggtattcca

SEQ ID NO: 306502 - DNA, 20 bp, human
gaataagcgagttcccaccg

SEQ ID NO: 306503 - DNA, 20 bp, human
gctggcatgtcagtcccgca

SEQ ID NO: 306504 - DNA, 20 bp, human
gggagtccctccgctgggtt

SEQ ID NO: 306505 - DNA, 20 bp, human
gccaccggctaaaaaaagtg

SEQ ID NO: 306506 - DNA, 20 bp, human
ggggaggctcccactggaat

SEQ ID NO: 306507 - DNA, 20 bp, human
gggtccctccccattccagt

SEQ ID NO: 306508 - DNA, 20 bp, human
gctccctcagacacaaggtc

SEQ ID NO: 306509 - DNA, 20 bp, human
gctgccgagcagagtcctgg

SEQ ID NO: 306510 - DNA, 20 bp, human
gcctgccctgcctggtgaag

SEQ ID NO: 306511 - DNA, 20 bp, human
gagaacgcagggaccagctc

SEQ ID NO: 306512 - DNA, 20 bp, human
gggcaggtgggagctgaccc

SEQ ID NO: 306513 - DNA, 20 bp, human
gcccggctccctcagacaca

SEQ ID NO: 306514 - DNA, 20 bp, human
gtaaccgcacggaacttccc

SEQ ID NO: 306515 - DNA, 20 bp, human
ggagtcctggtggggtgcct

SEQ ID NO: 306516 - DNA, 20 bp, human
ggcgcgctcgggcgccagag

SEQ ID NO: 306517 - DNA, 20 bp, human
ggggcgggccttaatcctgg

SEQ ID NO: 306518 - DNA, 20 bp, human
gggaagaaccggccgcccga

SEQ ID NO: 306519 - DNA, 20 bp, human
gagcacgcaagaggcgcgct

SEQ ID NO: 306520 - DNA, 20 bp, human
gagctccgcccccaggatta

SEQ ID NO: 306521 - DNA, 20 bp, human
gcctgggcgggccttaatcc

SEQ ID NO: 306522 - DNA, 20 bp, human
gtgacaggagcccgtccaag

SEQ ID NO: 306523 - DNA, 20 bp, human
ggtggggacgagcacgcaag

SEQ ID NO: 306524 - DNA, 20 bp, human
gaaaggaattctcaagcgaa

SEQ ID NO: 306525 - DNA, 20 bp, human
gaccggccgcccgagggcgt

SEQ ID NO: 306526 - DNA, 20 bp, human
gagtaatcgcagccaggcac

SEQ ID NO: 306527 - DNA, 20 bp, human
ggggcgggagagctcgttcg

SEQ ID NO: 306528 - DNA, 20 bp, human
gaacgcagagggcctcccag

SEQ ID NO: 306529 - DNA, 20 bp, human
gagggcagctgagatgcgca

SEQ ID NO: 306530 - DNA, 20 bp, human
gagactcggttaagcgggga

SEQ ID NO: 306531 - DNA, 20 bp, human
ggcagccaggcaccggggaa

SEQ ID NO: 306532 - DNA, 20 bp, human
ggagctcgttcgaggctccc

SEQ ID NO: 306533 - DNA, 20 bp, human
gcggggaaaggggaacgcag

SEQ ID NO: 306534 - DNA, 20 bp, human
gtggtgaaatggttgtgtag

SEQ ID NO: 306535 - DNA, 20 bp, human
gcgagtgagtaatcgcagcc

SEQ ID NO: 306536 - DNA, 20 bp, human
ggatcgcttgatactttcct

SEQ ID NO: 306537 - DNA, 20 bp, human
gtctgggcttctcggcgggg

SEQ ID NO: 306538 - DNA, 20 bp, human
ggcgccgaggcgacggagac

SEQ ID NO: 306539 - DNA, 20 bp, human
gcggggcggtagtgtggttg

SEQ ID NO: 306540 - DNA, 20 bp, human
gagagaagaaagattctggg

SEQ ID NO: 306541 - DNA, 20 bp, human
gtcctgccgggtgagagtcc

SEQ ID NO: 306542 - DNA, 20 bp, human
gcggctggaggccgtgagac

SEQ ID NO: 306543 - DNA, 20 bp, human
ggtgccgcgcccgctcctgc

SEQ ID NO: 306544 - DNA, 20 bp, human
gagcccagagccgtcggcga

SEQ ID NO: 306545 - DNA, 20 bp, human
gagctcagtaaacacggcag

SEQ ID NO: 306546 - DNA, 20 bp, human
ggctcgtcgccgtgagtgtg

SEQ ID NO: 306547 - DNA, 20 bp, human
gtccgcgccgcgcgcccgga

SEQ ID NO: 306548 - DNA, 20 bp, human
gactgctgtgtcactcgggg

SEQ ID NO: 306549 - DNA, 20 bp, human
gcgaaccagggcagctgggg

SEQ ID NO: 306550 - DNA, 20 bp, human
gtctccagtcggctcgaacc

SEQ ID NO: 306551 - DNA, 20 bp, human
gctcactgctgtgtcactcg

SEQ ID NO: 306552 - DNA, 20 bp, human
gttctcctctaaagactggt

SEQ ID NO: 306553 - DNA, 20 bp, human
gcgagcggctccggccttaa

SEQ ID NO: 306554 - DNA, 20 bp, human
gccggaaggtggagtttcgg

SEQ ID NO: 306555 - DNA, 20 bp, human
gttcgggctggcggggtcgc

SEQ ID NO: 306556 - DNA, 20 bp, human
gaggcgggaggcccgaggaa

SEQ ID NO: 306557 - DNA, 20 bp, human
gacagcctgtgcaggcgggt

SEQ ID NO: 306558 - DNA, 20 bp, human
gggcagcaggctcccttcct

SEQ ID NO: 306559 - DNA, 20 bp, human
gcgcctgcacaggctgtgta

SEQ ID NO: 306560 - DNA, 20 bp, human
ggcgggccagcgccattctg

SEQ ID NO: 306561 - DNA, 20 bp, human
gctgcacaggctgtgtaagg

SEQ ID NO: 306562 - DNA, 20 bp, human
gtgcggagagtgttgactgt

SEQ ID NO: 306563 - DNA, 20 bp, human
gagatagcacagaaagtagc

SEQ ID NO: 306564 - DNA, 20 bp, human
gctggctcgtagccccagaa

SEQ ID NO: 306565 - DNA, 20 bp, human
ggggagctgcagttgttggc

SEQ ID NO: 306566 - DNA, 20 bp, human
ggggtgagagcggggacgtc

SEQ ID NO: 306567 - DNA, 20 bp, human
gcggggacgtcagggttccc

SEQ ID NO: 306568 - DNA, 20 bp, human
gagggcctgtgcgggccttg

SEQ ID NO: 306569 - DNA, 20 bp, human
gcgccggggaccctgagaag

SEQ ID NO: 306570 - DNA, 20 bp, human
gatgctggggggtgagagcg

SEQ ID NO: 306571 - DNA, 20 bp, human
gaaggggtgggagcacccgc

SEQ ID NO: 306572 - DNA, 20 bp, human
gagaagcaggtgcccggaga

SEQ ID NO: 306573 - DNA, 20 bp, human
ggcaactggagtcaagttca

SEQ ID NO: 306574 - DNA, 20 bp, human
gcctggggttgtggggtcgg

SEQ ID NO: 306575 - DNA, 20 bp, human
gccacaaccccaggacgtgc

SEQ ID NO: 306576 - DNA, 20 bp, human
gacgggaagcgcagcctcgg

SEQ ID NO: 306577 - DNA, 20 bp, human
ggcgcggggcggggagttta

SEQ ID NO: 306578 - DNA, 20 bp, human
gcggccgcgccgtcactctc

SEQ ID NO: 306579 - DNA, 20 bp, human
ggcgaggagggggatgcgcg

SEQ ID NO: 306580 - DNA, 20 bp, human
gaagcggcaggcagagttcg

SEQ ID NO: 306581 - DNA, 20 bp, human
ggaggcccagcgccgagaag

SEQ ID NO: 306582 - DNA, 20 bp, human
gcggccggagagtgacggcg

SEQ ID NO: 306583 - DNA, 20 bp, human
gaggaggacggtcgaacccg

SEQ ID NO: 306584 - DNA, 20 bp, human
gcgacgcggccggagagtga

SEQ ID NO: 306585 - DNA, 20 bp, human
gggcaggcagagttcggggt

SEQ ID NO: 306586 - DNA, 20 bp, human
gaagccccggcgtgtcctgg

SEQ ID NO: 306587 - DNA, 20 bp, human
ggcgccggggttcactgaac

SEQ ID NO: 306588 - DNA, 20 bp, human
gcggccggttcagtgaaccc

SEQ ID NO: 306589 - DNA, 20 bp, human
ggctcggggagcaggcgccg

SEQ ID NO: 306590 - DNA, 20 bp, human
gctaccgcacgggtctgtca

SEQ ID NO: 306591 - DNA, 20 bp, human
gggccccggctcggcttctt

SEQ ID NO: 306592 - DNA, 20 bp, human
gcggccggcggcctagctcg

SEQ ID NO: 306593 - DNA, 20 bp, human
gcactgaaccggccgcggag

SEQ ID NO: 306594 - DNA, 20 bp, human
gcgcctaagaagccgagccg

SEQ ID NO: 306595 - DNA, 20 bp, human
gcctcccccaggacacgccg

SEQ ID NO: 306596 - DNA, 20 bp, human
gcgtccggcagcgcctgccc

SEQ ID NO: 306597 - DNA, 20 bp, human
gcgtacggggctgcgtccta

SEQ ID NO: 306598 - DNA, 20 bp, human
gcgcaatgaacctgagggca

SEQ ID NO: 306599 - DNA, 20 bp, human
gcccacgtggttcgcctcat

SEQ ID NO: 306600 - DNA, 20 bp, human
gcgtgcgctgcgtctctatg

SEQ ID NO: 306601 - DNA, 20 bp, human
gcgcatgcgcaatgaacctg

SEQ ID NO: 306602 - DNA, 20 bp, human
ggtagctgtagcaacggggc

SEQ ID NO: 306603 - DNA, 20 bp, human
gcgcgtatccgtgtgatggg

SEQ ID NO: 306604 - DNA, 20 bp, human
ggcgcagcggagacaggcgc

SEQ ID NO: 306605 - DNA, 20 bp, human
gggggcgtggtcgctgtctg

SEQ ID NO: 306606 - DNA, 20 bp, human
gggctcccgcccgcgctggt

SEQ ID NO: 306607 - DNA, 20 bp, human
ggcggagggcggcttggtgc

SEQ ID NO: 306608 - DNA, 20 bp, human
ggcgcgggcgggagcctagg

SEQ ID NO: 306609 - DNA, 20 bp, human
gtcccggctgtccgcgccga

SEQ ID NO: 306610 - DNA, 20 bp, human
ggaccgtcacatgccgtccg

SEQ ID NO: 306611 - DNA, 20 bp, human
gcgcgccgaggggcgcccgc

SEQ ID NO: 306612 - DNA, 20 bp, human
gggcgcctaccagcgcgggc

SEQ ID NO: 306613 - DNA, 20 bp, human
gcgccagccccccatcgcct

SEQ ID NO: 306614 - DNA, 20 bp, human
ggcgcccgggctcgactatc

SEQ ID NO: 306615 - DNA, 20 bp, human
gccggaggggaccgaggcga

SEQ ID NO: 306616 - DNA, 20 bp, human
gggcccagccgcagcgtcgg

SEQ ID NO: 306617 - DNA, 20 bp, human
ggcacgaaggggctcagtcg

SEQ ID NO: 306618 - DNA, 20 bp, human
ggtcccgcccagaagttgta

SEQ ID NO: 306619 - DNA, 20 bp, human
gcgggcgacgcgctgtgatt

SEQ ID NO: 306620 - DNA, 20 bp, human
gcgggcgcctattgacccag

SEQ ID NO: 306621 - DNA, 20 bp, human
gacactgggaggcaggcgcg

SEQ ID NO: 306622 - DNA, 20 bp, human
ggctgggccgatgtgcaccc

SEQ ID NO: 306623 - DNA, 20 bp, human
ggctcagtcggggtaggcgg

SEQ ID NO: 306624 - DNA, 20 bp, human
gcagcagccgctgggtcaat

SEQ ID NO: 306625 - DNA, 20 bp, human
gcggagcctgggtccgggag

SEQ ID NO: 306626 - DNA, 20 bp, human
gcagctgcggaacctcagga

SEQ ID NO: 306627 - DNA, 20 bp, human
gcactgcagcccagcggagc

SEQ ID NO: 306628 - DNA, 20 bp, human
gcagtcgcgcgtccctcctg

SEQ ID NO: 306629 - DNA, 20 bp, human
gtaagcgcatgatcgggcag

SEQ ID NO: 306630 - DNA, 20 bp, human
gtggccagctgcggaacctc

SEQ ID NO: 306631 - DNA, 20 bp, human
gcagcccagcggagcgggcc

SEQ ID NO: 306632 - DNA, 20 bp, human
gtgtgcccggcggagctgac

SEQ ID NO: 306633 - DNA, 20 bp, human
ggcgcaacgacagagaccta

SEQ ID NO: 306634 - DNA, 20 bp, human
gtagcggggtgcgttctccg

SEQ ID NO: 306635 - DNA, 20 bp, human
gctccggcccaggtagcctt

SEQ ID NO: 306636 - DNA, 20 bp, human
gtagccctgggcaatcccgg

SEQ ID NO: 306637 - DNA, 20 bp, human
gcaatcccgggggtcgttac

SEQ ID NO: 306638 - DNA, 20 bp, human
ggcgcggtctggaggctcac

SEQ ID NO: 306639 - DNA, 20 bp, human
gccaccctcagggcactggt

SEQ ID NO: 306640 - DNA, 20 bp, human
gcccgggggtcgttacagga

SEQ ID NO: 306641 - DNA, 20 bp, human
gccggccgggccaatcgggg

SEQ ID NO: 306642 - DNA, 20 bp, human
gctggaggctcacgggagag

SEQ ID NO: 306643 - DNA, 20 bp, human
gggagagaggctgtagccct

SEQ ID NO: 306644 - DNA, 20 bp, human
gggggtcgttacaggaaggt

SEQ ID NO: 306645 - DNA, 20 bp, human
ggtctcacgggctatgaaga

SEQ ID NO: 306646 - DNA, 20 bp, human
gggacctcttcactggtagg

SEQ ID NO: 306647 - DNA, 20 bp, human
gtctgaagcccatcctgggt

SEQ ID NO: 306648 - DNA, 20 bp, human
gtcctggaattcctatagtc

SEQ ID NO: 306649 - DNA, 20 bp, human
gcaggtcacaccaagttcaa

SEQ ID NO: 306650 - DNA, 20 bp, human
gtgaagaggtccgcggtcgg

SEQ ID NO: 306651 - DNA, 20 bp, human
gccggctttgaaaccaggga

SEQ ID NO: 306652 - DNA, 20 bp, human
gatgggccaccccttgaact

SEQ ID NO: 306653 - DNA, 20 bp, human
gcccagcacagattccttgg

SEQ ID NO: 306654 - DNA, 20 bp, human
gagcctgaagcccccgaccg

SEQ ID NO: 306655 - DNA, 20 bp, human
gcctgcatttccttttgcat

SEQ ID NO: 306656 - DNA, 20 bp, human
ggaccccgggaagctcggga

SEQ ID NO: 306657 - DNA, 20 bp, human
ggggcccattggttgccggc

SEQ ID NO: 306658 - DNA, 20 bp, human
gcccacttccgggtccgcga

SEQ ID NO: 306659 - DNA, 20 bp, human
gaggcgcggggccctcagcg

SEQ ID NO: 306660 - DNA, 20 bp, human
gcggggccctcagcggggca

SEQ ID NO: 306661 - DNA, 20 bp, human
gcccgggaagctcgggaagg

SEQ ID NO: 306662 - DNA, 20 bp, human
gaggcgccctgccccgctga

SEQ ID NO: 306663 - DNA, 20 bp, human
gggcggggcccattggttgc

SEQ ID NO: 306664 - DNA, 20 bp, human
gtcccggagccgagtccaga

SEQ ID NO: 306665 - DNA, 20 bp, human
gcgtccagccggcaaccaat

SEQ ID NO: 306666 - DNA, 20 bp, human
gtccctgcggcccactattt

SEQ ID NO: 306667 - DNA, 20 bp, human
gccactatttcggacaacat

SEQ ID NO: 306668 - DNA, 20 bp, human
gagagggcgcctcccagtcc

SEQ ID NO: 306669 - DNA, 20 bp, human
gaaagctgcccgggactggg

SEQ ID NO: 306670 - DNA, 20 bp, human
ggcttttcttggaacaccgg

SEQ ID NO: 306671 - DNA, 20 bp, human
gaaaggttccggcgtccaga

SEQ ID NO: 306672 - DNA, 20 bp, human
gggaggcgccctctggacgc

SEQ ID NO: 306673 - DNA, 20 bp, human
gctcccggttgctgcttctg

SEQ ID NO: 306674 - DNA, 20 bp, human
ggagcggaacggtagcgcca

SEQ ID NO: 306675 - DNA, 20 bp, human
gtctgaactttgagccgagt

SEQ ID NO: 306676 - DNA, 20 bp, human
gagcctgtagctattctcgg

SEQ ID NO: 306677 - DNA, 20 bp, human
gcctgcacccgctgaaagcc

SEQ ID NO: 306678 - DNA, 20 bp, human
ggctgaaagccgggcgtcgc

SEQ ID NO: 306679 - DNA, 20 bp, human
gctcccgcacccgcgacgcc

SEQ ID NO: 306680 - DNA, 20 bp, human
ggggaagaagcgccgaggga

SEQ ID NO: 306681 - DNA, 20 bp, human
ggggcggggacctaaagcct

SEQ ID NO: 306682 - DNA, 20 bp, human
gaaagcctcggctacttccg

SEQ ID NO: 306683 - DNA, 20 bp, human
ggctctccgggcgcagccgc

SEQ ID NO: 306684 - DNA, 20 bp, human
gaagccgggcgtcgcgggtg

SEQ ID NO: 306685 - DNA, 20 bp, human
gagcccccgagaatagctac

SEQ ID NO: 306686 - DNA, 20 bp, human
gaacgcgggcggaacagagc

SEQ ID NO: 306687 - DNA, 20 bp, human
gagaaacctggcaacgcggg

SEQ ID NO: 306688 - DNA, 20 bp, human
gggtcgcagggaactacttc

SEQ ID NO: 306689 - DNA, 20 bp, human
gcgggcggaacagagccggt

SEQ ID NO: 306690 - DNA, 20 bp, human
gcgcagggaactacttccgg

SEQ ID NO: 306691 - DNA, 20 bp, human
ggctcagtgcgcgtcacttc

SEQ ID NO: 306692 - DNA, 20 bp, human
gagctcgaacccacagaaca

SEQ ID NO: 306693 - DNA, 20 bp, human
gagctggacaaagaggtttg

SEQ ID NO: 306694 - DNA, 20 bp, human
gaaaagtcgacaaaacccag

SEQ ID NO: 306695 - DNA, 20 bp, human
gctgttccgcccgcgttgcc

SEQ ID NO: 306696 - DNA, 20 bp, human
gcgcgggtctaagaggacta

SEQ ID NO: 306697 - DNA, 20 bp, human
gggtctaagaggactagggc

SEQ ID NO: 306698 - DNA, 20 bp, human
gaggggaaggacgtgtggat

SEQ ID NO: 306699 - DNA, 20 bp, human
ggacccgcgaccggaggctc

SEQ ID NO: 306700 - DNA, 20 bp, human
gagcggcgcggaagaaagag

SEQ ID NO: 306701 - DNA, 20 bp, human
gttttggggcgttctgtcag

SEQ ID NO: 306702 - DNA, 20 bp, human
gttcaggggcgggacgggtg

SEQ ID NO: 306703 - DNA, 20 bp, human
gaaagagaggactgcgtttt

SEQ ID NO: 306704 - DNA, 20 bp, human
gctccggtcgcgggtctaag

SEQ ID NO: 306705 - DNA, 20 bp, human
ggtcctcttagacccgcgac

SEQ ID NO: 306706 - DNA, 20 bp, human
gtcggcgtgcagttccccct

SEQ ID NO: 306707 - DNA, 20 bp, human
gtcggcacacaggacgcagg

SEQ ID NO: 306708 - DNA, 20 bp, human
gccaagtggccgcgagccga

SEQ ID NO: 306709 - DNA, 20 bp, human
gaggagcaggggcctgagtc

SEQ ID NO: 306710 - DNA, 20 bp, human
ggacgaagaaggaaatcctt

SEQ ID NO: 306711 - DNA, 20 bp, human
gggctcggcacacaggacgc

SEQ ID NO: 306712 - DNA, 20 bp, human
ggggccagtgaagtgagtaa

SEQ ID NO: 306713 - DNA, 20 bp, human
gcaacgcaaggcccagcgaa

SEQ ID NO: 306714 - DNA, 20 bp, human
gggaaagaagcgcgcgtcgg

SEQ ID NO: 306715 - DNA, 20 bp, human
ggggtcacgcggcctgactc

SEQ ID NO: 306716 - DNA, 20 bp, human
gagcggccgacaactgtcta

SEQ ID NO: 306717 - DNA, 20 bp, human
gccagcccgggttcaatcag

SEQ ID NO: 306718 - DNA, 20 bp, human
gccacgctgccctccctcat

SEQ ID NO: 306719 - DNA, 20 bp, human
gtgggtaagggcagcgactg

SEQ ID NO: 306720 - DNA, 20 bp, human
gagccgcgagcccagacggg

SEQ ID NO: 306721 - DNA, 20 bp, human
gactacagcagcgacggaag

SEQ ID NO: 306722 - DNA, 20 bp, human
ggggccgccatcttgggtaa

SEQ ID NO: 306723 - DNA, 20 bp, human
gtcggccgctgattgaaccc

SEQ ID NO: 306724 - DNA, 20 bp, human
gctcgcggctcctggaccaa

SEQ ID NO: 306725 - DNA, 20 bp, human
ggaagcgactacagcagcga

SEQ ID NO: 306726 - DNA, 20 bp, human
gcagccacaccgctgacccc

SEQ ID NO: 306727 - DNA, 20 bp, human
gggctgggcgcgctgcgagg

SEQ ID NO: 306728 - DNA, 20 bp, human
gtgagctgggggggagcgcg

SEQ ID NO: 306729 - DNA, 20 bp, human
gctccctgctggtggcccga

SEQ ID NO: 306730 - DNA, 20 bp, human
gagggacgcgctaatgttgc

SEQ ID NO: 306731 - DNA, 20 bp, human
gggaagcagctccgggttgc

SEQ ID NO: 306732 - DNA, 20 bp, human
gagaccctcgggccaccagc

SEQ ID NO: 306733 - DNA, 20 bp, human
gactggggcacgggggtgag

SEQ ID NO: 306734 - DNA, 20 bp, human
gaggagggagactaggagac

SEQ ID NO: 306735 - DNA, 20 bp, human
ggcgacggcaagtttgccgc

SEQ ID NO: 306736 - DNA, 20 bp, human
gaacttaagttctggcattc

SEQ ID NO: 306737 - DNA, 20 bp, human
ggtcacttgacatcagataa

SEQ ID NO: 306738 - DNA, 20 bp, human
gacaagacatgattttgtga

SEQ ID NO: 306739 - DNA, 20 bp, human
gtaatttttttgcactggtt

SEQ ID NO: 306740 - DNA, 20 bp, human
gggtttgatttttctgggac

SEQ ID NO: 306741 - DNA, 20 bp, human
gttgtttggtttgatttttc

SEQ ID NO: 306742 - DNA, 20 bp, human
gagtgcaaaaaaattatttt

SEQ ID NO: 306743 - DNA, 20 bp, human
gaatgcccaaacatttgaaa

SEQ ID NO: 306744 - DNA, 20 bp, human
gtttctttgaacttaagttc

SEQ ID NO: 306745 - DNA, 20 bp, human
gtttgaaaaggcagtgaaaa

SEQ ID NO: 306746 - DNA, 20 bp, human
ggagctgggcactgagagcg

SEQ ID NO: 306747 - DNA, 20 bp, human
gacactcggcgagagttatt

SEQ ID NO: 306748 - DNA, 20 bp, human
gtcagtgcctgacactccgc

SEQ ID NO: 306749 - DNA, 20 bp, human
gctgatacccggggggagct

SEQ ID NO: 306750 - DNA, 20 bp, human
gctgggcactgagagcgggg

SEQ ID NO: 306751 - DNA, 20 bp, human
gtagacgcctgccttgacac

SEQ ID NO: 306752 - DNA, 20 bp, human
gggaaaggattactgggtgc

SEQ ID NO: 306753 - DNA, 20 bp, human
ggcgaaaggtcattgggtat

SEQ ID NO: 306754 - DNA, 20 bp, human
ggacactggggggatgttat

SEQ ID NO: 306755 - DNA, 20 bp, human
gccccgggggagttgataga

SEQ ID NO: 306756 - DNA, 20 bp, human
gggcggggagaagtgactct

SEQ ID NO: 306757 - DNA, 20 bp, human
ggaaaccctgccactgggcg

SEQ ID NO: 306758 - DNA, 20 bp, human
gctcccggcccagtcagggg

SEQ ID NO: 306759 - DNA, 20 bp, human
gagagtgggggagtagacgt

SEQ ID NO: 306760 - DNA, 20 bp, human
gcgggaaggcggagccaggc

SEQ ID NO: 306761 - DNA, 20 bp, human
gcgctggaaaccctgccact

SEQ ID NO: 306762 - DNA, 20 bp, human
gggggctggtctctaagagt

SEQ ID NO: 306763 - DNA, 20 bp, human
ggacgtgggtgtagccgcgt

SEQ ID NO: 306764 - DNA, 20 bp, human
gcgggctcccggcccagtca

SEQ ID NO: 306765 - DNA, 20 bp, human
gacgatgccactgcaggcgg

SEQ ID NO: 306766 - DNA, 20 bp, human
gggcgggtgcctgggcggag

SEQ ID NO: 306767 - DNA, 20 bp, human
gcccggggctggtaatatag

SEQ ID NO: 306768 - DNA, 20 bp, human
ggtgcactagggaggctgat

SEQ ID NO: 306769 - DNA, 20 bp, human
gctgcgcgtccgggctcccg

SEQ ID NO: 306770 - DNA, 20 bp, human
gagggccccaattactcctt

SEQ ID NO: 306771 - DNA, 20 bp, human
gcgcccgcctacgcgcaggc

SEQ ID NO: 306772 - DNA, 20 bp, human
gctgggcggagaggtcacct

SEQ ID NO: 306773 - DNA, 20 bp, human
ggctgggaggacggcaaatt

SEQ ID NO: 306774 - DNA, 20 bp, human
gtacacccaaggagtaattg

SEQ ID NO: 306775 - DNA, 20 bp, human
gacccggcctgcctgcgcgt

SEQ ID NO: 306776 - DNA, 20 bp, human
gcacaagtatgcatacaaag

SEQ ID NO: 306777 - DNA, 20 bp, human
gcaaggttggtggcaaaaaa

SEQ ID NO: 306778 - DNA, 20 bp, human
gaagcgctccagcgggtctc

SEQ ID NO: 306779 - DNA, 20 bp, human
gtctcgggcggtgtctgctt

SEQ ID NO: 306780 - DNA, 20 bp, human
gtgtcttaatacaaggttgg

SEQ ID NO: 306781 - DNA, 20 bp, human
gaactggctctgtttagcat

SEQ ID NO: 306782 - DNA, 20 bp, human
ggcaaatctcgcgagatagc

SEQ ID NO: 306783 - DNA, 20 bp, human
gccggggtctcacgagaaac

SEQ ID NO: 306784 - DNA, 20 bp, human
gcactggcaaaaactctcct

SEQ ID NO: 306785 - DNA, 20 bp, human
gggcttcagcttctcgtttg

SEQ ID NO: 306786 - DNA, 20 bp, human
ggggccataggacattgcag

SEQ ID NO: 306787 - DNA, 20 bp, human
gtggagctcagacgtcgtga

SEQ ID NO: 306788 - DNA, 20 bp, human
gtgggagagaaaggtcctat

SEQ ID NO: 306789 - DNA, 20 bp, human
ggagcctctgcaatgtccta

SEQ ID NO: 306790 - DNA, 20 bp, human
gctggtccgtgacgaggcac

SEQ ID NO: 306791 - DNA, 20 bp, human
ggctgggggcccaaaagcat

SEQ ID NO: 306792 - DNA, 20 bp, human
gcacagagcgaggctatagg

SEQ ID NO: 306793 - DNA, 20 bp, human
gagtctgcagcacttagggt

SEQ ID NO: 306794 - DNA, 20 bp, human
gagaccaaagccccatgcta

SEQ ID NO: 306795 - DNA, 20 bp, human
ggggtgcttgatgaggaggg

SEQ ID NO: 306796 - DNA, 20 bp, human
gggtgtgcggacaatggtcg

SEQ ID NO: 306797 - DNA, 20 bp, human
gggacgaggtgtgcggacaa

SEQ ID NO: 306798 - DNA, 20 bp, human
gccaacggctggaagagcgg

SEQ ID NO: 306799 - DNA, 20 bp, human
gagtgcgcggcggagaggag

SEQ ID NO: 306800 - DNA, 20 bp, human
gcggaggcagccaccgcgtg

SEQ ID NO: 306801 - DNA, 20 bp, human
gcggggagtgagagagggcg

SEQ ID NO: 306802 - DNA, 20 bp, human
gccggcacatcctcacgcgg

SEQ ID NO: 306803 - DNA, 20 bp, human
gcccggaagctggagggacg

SEQ ID NO: 306804 - DNA, 20 bp, human
gccgcggcccggaagctgga

SEQ ID NO: 306805 - DNA, 20 bp, human
gtcttccagccgttggcccg

SEQ ID NO: 306806 - DNA, 20 bp, human
ggcgctgcccatgacgtcac

SEQ ID NO: 306807 - DNA, 20 bp, human
gtccgcggaccgggacgcga

SEQ ID NO: 306808 - DNA, 20 bp, human
gcgcagagagcctgggtccg

SEQ ID NO: 306809 - DNA, 20 bp, human
gcacagtcccgtgacgtcat

SEQ ID NO: 306810 - DNA, 20 bp, human
gagagcctgggtccgcggac

SEQ ID NO: 306811 - DNA, 20 bp, human
gcgtcccggtccgcggaccc

SEQ ID NO: 306812 - DNA, 20 bp, human
gcgggccttaccttgagttc

SEQ ID NO: 306813 - DNA, 20 bp, human
gtctctgcgccgtgacgtca

SEQ ID NO: 306814 - DNA, 20 bp, human
ggggcgggcgggttgtgcgt

SEQ ID NO: 306815 - DNA, 20 bp, human
ggcagcccgaactcaaggta

SEQ ID NO: 306816 - DNA, 20 bp, human
gcagcagcggcacgcagcgt

SEQ ID NO: 306817 - DNA, 20 bp, human
ggggccgcaccccgggtctg

SEQ ID NO: 306818 - DNA, 20 bp, human
gggtgtgtgcgcgtgcgcga

SEQ ID NO: 306819 - DNA, 20 bp, human
ggccgccgccatgacgggcg

SEQ ID NO: 306820 - DNA, 20 bp, human
gtgtcccggggcactcttga

SEQ ID NO: 306821 - DNA, 20 bp, human
gcccctgaggtgacggttgt

SEQ ID NO: 306822 - DNA, 20 bp, human
gcgcccacagacccggggtg

SEQ ID NO: 306823 - DNA, 20 bp, human
gcccgagcgcccacagaccc

SEQ ID NO: 306824 - DNA, 20 bp, human
ggcgcccagcggtgctgggc

SEQ ID NO: 306825 - DNA, 20 bp, human
ggccacgcccgtcatggcgg

SEQ ID NO: 306826 - DNA, 20 bp, human
gagtcttagagacccagctg

SEQ ID NO: 306827 - DNA, 20 bp, human
gaatagaaggcaccccagtt

SEQ ID NO: 306828 - DNA, 20 bp, human
ggagtcaagactgtttttca

SEQ ID NO: 306829 - DNA, 20 bp, human
ggtctctaagactcagttcc

SEQ ID NO: 306830 - DNA, 20 bp, human
gggggtcttattcaagcctt

SEQ ID NO: 306831 - DNA, 20 bp, human
gctaagactcagttccagga

SEQ ID NO: 306832 - DNA, 20 bp, human
gttaactctatgcctaactg

SEQ ID NO: 306833 - DNA, 20 bp, human
ggtaaatatatgatggtgtg

SEQ ID NO: 306834 - DNA, 20 bp, human
ggagttgcattggagagcag

SEQ ID NO: 306835 - DNA, 20 bp, human
gtactttgacaatcactcaa

SEQ ID NO: 306836 - DNA, 20 bp, human
gaggtcagttctgatggaaa

SEQ ID NO: 306837 - DNA, 20 bp, human
gtgggcagcggactgtggag

SEQ ID NO: 306838 - DNA, 20 bp, human
ggaactggtcatgaacaaag

SEQ ID NO: 306839 - DNA, 20 bp, human
ggtcactcagccctacataa

SEQ ID NO: 306840 - DNA, 20 bp, human
gacccccccttgctactgaa

SEQ ID NO: 306841 - DNA, 20 bp, human
gttgcccttcagtagcaagg

SEQ ID NO: 306842 - DNA, 20 bp, human
gaaaacctagagctgtacac

SEQ ID NO: 306843 - DNA, 20 bp, human
ggcacccagtgtacagctct

SEQ ID NO: 306844 - DNA, 20 bp, human
gaggaaacctatactaagaa

SEQ ID NO: 306845 - DNA, 20 bp, human
gttctttgcaaaagaaatta

SEQ ID NO: 306846 - DNA, 20 bp, human
gtaaaggggccgcaccggaa

SEQ ID NO: 306847 - DNA, 20 bp, human
gacctcaaagggcctgtaag

SEQ ID NO: 306848 - DNA, 20 bp, human
ggcggcggtggctggatctg

SEQ ID NO: 306849 - DNA, 20 bp, human
gaggggatgcgggcgttaaa

SEQ ID NO: 306850 - DNA, 20 bp, human
ggggagaggcggctcccaag

SEQ ID NO: 306851 - DNA, 20 bp, human
ggggatgcggtggttccggg

SEQ ID NO: 306852 - DNA, 20 bp, human
gcaagcggacacccaggagt

SEQ ID NO: 306853 - DNA, 20 bp, human
gatgcgggcgttaaaggggt

SEQ ID NO: 306854 - DNA, 20 bp, human
gtggtcgacaaaaaggggcg

SEQ ID NO: 306855 - DNA, 20 bp, human
gggctcccaagcggacaccc

SEQ ID NO: 306856 - DNA, 20 bp, human
gaccgccgcagtgtccggga

SEQ ID NO: 306857 - DNA, 20 bp, human
ggagtctggcgggacctgcg

SEQ ID NO: 306858 - DNA, 20 bp, human
gctgccaccgccgcagtgtc

SEQ ID NO: 306859 - DNA, 20 bp, human
gccagactccgcgagcccgt

SEQ ID NO: 306860 - DNA, 20 bp, human
ggactccgcgagcccgtggg

SEQ ID NO: 306861 - DNA, 20 bp, human
gtgagagcggcgcccccagc

SEQ ID NO: 306862 - DNA, 20 bp, human
gcccctcccggacactgcgg

SEQ ID NO: 306863 - DNA, 20 bp, human
gggaagcagggggtctgcgg

SEQ ID NO: 306864 - DNA, 20 bp, human
gttgtcgcgggaggggacca

SEQ ID NO: 306865 - DNA, 20 bp, human
ggcgagcccgtgggcggccg

SEQ ID NO: 306866 - DNA, 20 bp, human
gtcctattgtcagtgaatga

SEQ ID NO: 306867 - DNA, 20 bp, human
ggccatcattcactgacaat

SEQ ID NO: 306868 - DNA, 20 bp, human
gaaccgctaaatcgtaagtg

SEQ ID NO: 306869 - DNA, 20 bp, human
gaaaatgcctgtcaggcatt

SEQ ID NO: 306870 - DNA, 20 bp, human
gagtccccgcagtggcgaac

SEQ ID NO: 306871 - DNA, 20 bp, human
gttggtaccagaagccccta

SEQ ID NO: 306872 - DNA, 20 bp, human
gctgatagactcgactcctg

SEQ ID NO: 306873 - DNA, 20 bp, human
gagtggcgaacaggaaaata

SEQ ID NO: 306874 - DNA, 20 bp, human
gatttagcggtttgccatag

SEQ ID NO: 306875 - DNA, 20 bp, human
ggccctcacttacgatttag

SEQ ID NO: 306876 - DNA, 20 bp, human
gggagcgcggcgcactgcct

SEQ ID NO: 306877 - DNA, 20 bp, human
ggcctcgcagacaaccaatg

SEQ ID NO: 306878 - DNA, 20 bp, human
gaataggggcggagccgagt

SEQ ID NO: 306879 - DNA, 20 bp, human
gatgacgcggaaatacgtca

SEQ ID NO: 306880 - DNA, 20 bp, human
gcaatgggggcaagcctcgg

SEQ ID NO: 306881 - DNA, 20 bp, human
gggcgccacggcgtccgcga

SEQ ID NO: 306882 - DNA, 20 bp, human
ggaaatacgtcacgggagcg

SEQ ID NO: 306883 - DNA, 20 bp, human
gtccgcgtcatctgccgccg

SEQ ID NO: 306884 - DNA, 20 bp, human
ggtctgcgaggcaatagggg

SEQ ID NO: 306885 - DNA, 20 bp, human
ggttgtctgcgaggcaatag

SEQ ID NO: 306886 - DNA, 20 bp, human
gtcccggcaccgcctcgcgt

SEQ ID NO: 306887 - DNA, 20 bp, human
gccgcctttcggaggggaaa

SEQ ID NO: 306888 - DNA, 20 bp, human
gacaaggccgcctttcggag

SEQ ID NO: 306889 - DNA, 20 bp, human
gaggggcggccacaagatcg

SEQ ID NO: 306890 - DNA, 20 bp, human
gaagcgagggcgcccggtcc

SEQ ID NO: 306891 - DNA, 20 bp, human
ggcgcctgcgcagcagcaca

SEQ ID NO: 306892 - DNA, 20 bp, human
gcggccttgtgctgctgcgc

SEQ ID NO: 306893 - DNA, 20 bp, human
ggccgtggtaaggcaagcga

SEQ ID NO: 306894 - DNA, 20 bp, human
gacgggatcgggagccgcga

SEQ ID NO: 306895 - DNA, 20 bp, human
ggcagcacaaggccgccttt

SEQ ID NO: 306896 - DNA, 20 bp, human
gggacttgacagagagcggg

SEQ ID NO: 306897 - DNA, 20 bp, human
gtggcggacttgacagagag

SEQ ID NO: 306898 - DNA, 20 bp, human
ggcggagcctgaccggacct

SEQ ID NO: 306899 - DNA, 20 bp, human
gggcgcggctttagtccagg

SEQ ID NO: 306900 - DNA, 20 bp, human
gtgggtcccgggagtgggtg

SEQ ID NO: 306901 - DNA, 20 bp, human
gcggacctgggtttttcggg

SEQ ID NO: 306902 - DNA, 20 bp, human
gggacaggccggcgtctgat

SEQ ID NO: 306903 - DNA, 20 bp, human
ggcgctgcccagtctgtctc

SEQ ID NO: 306904 - DNA, 20 bp, human
gggtggggcgtgtgcttgac

SEQ ID NO: 306905 - DNA, 20 bp, human
gcctccttaggcccaggatc

SEQ ID NO: 306906 - DNA, 20 bp, human
ggtgtcaggaggcgtgtccg

SEQ ID NO: 306907 - DNA, 20 bp, human
gagacagctgtcttggacca

SEQ ID NO: 306908 - DNA, 20 bp, human
gtgcagaaccgcccggctct

SEQ ID NO: 306909 - DNA, 20 bp, human
gctggcgggggcgtgtcagg

SEQ ID NO: 306910 - DNA, 20 bp, human
ggggagtcacagacctccat

SEQ ID NO: 306911 - DNA, 20 bp, human
gtcgcgcacccagagccggg

SEQ ID NO: 306912 - DNA, 20 bp, human
gggtttgcagaattaaaggt

SEQ ID NO: 306913 - DNA, 20 bp, human
ggtgaagcagacagctgtct

SEQ ID NO: 306914 - DNA, 20 bp, human
gcggcctctcgcacggccga

SEQ ID NO: 306915 - DNA, 20 bp, human
gaggcgtgtccggggcgtgt

SEQ ID NO: 306916 - DNA, 20 bp, human
gggaggcgggtcccgctcgt

SEQ ID NO: 306917 - DNA, 20 bp, human
gggcgctctgtgggcgatga

SEQ ID NO: 306918 - DNA, 20 bp, human
gcctcggcttcccacgccgg

SEQ ID NO: 306919 - DNA, 20 bp, human
gtccccgcgggaggttcaag

SEQ ID NO: 306920 - DNA, 20 bp, human
ggcgtgggaagccgaggaac

SEQ ID NO: 306921 - DNA, 20 bp, human
ggcctcccgcggcgccatgt

SEQ ID NO: 306922 - DNA, 20 bp, human
gcgcggcgccatgttggaaa

SEQ ID NO: 306923 - DNA, 20 bp, human
ggcgccctgtgtctccgggt

SEQ ID NO: 306924 - DNA, 20 bp, human
ggcgtggcgcgtggcgagtc

SEQ ID NO: 306925 - DNA, 20 bp, human
gaccccgggagccgacgagc

SEQ ID NO: 306926 - DNA, 20 bp, human
ggttctccggcggagtccac

SEQ ID NO: 306927 - DNA, 20 bp, human
ggctctgatttaaggaaacg

SEQ ID NO: 306928 - DNA, 20 bp, human
ggggtaatgtagttctccgg

SEQ ID NO: 306929 - DNA, 20 bp, human
gtaaggaaacgtggtcgccc

SEQ ID NO: 306930 - DNA, 20 bp, human
gacacactcagtagagtgat

SEQ ID NO: 306931 - DNA, 20 bp, human
gcagacgtccttcctgcgaa

SEQ ID NO: 306932 - DNA, 20 bp, human
gaggttagctaaagagcttt

SEQ ID NO: 306933 - DNA, 20 bp, human
ggaagggcgcgaaggccgct

SEQ ID NO: 306934 - DNA, 20 bp, human
gcttcgcgcccttcgcagga

SEQ ID NO: 306935 - DNA, 20 bp, human
gaagcggcaaggccaagacg

SEQ ID NO: 306936 - DNA, 20 bp, human
gcgcatgcgcactacggtgg

SEQ ID NO: 306937 - DNA, 20 bp, human
gccgaagcacgcacgcgcgg

SEQ ID NO: 306938 - DNA, 20 bp, human
gtggcgcatgcgcactacgg

SEQ ID NO: 306939 - DNA, 20 bp, human
gctcaggagcgatcgggaat

SEQ ID NO: 306940 - DNA, 20 bp, human
gacggtggtggtggcgacga

SEQ ID NO: 306941 - DNA, 20 bp, human
gctaggtggcgtcatccttc

SEQ ID NO: 306942 - DNA, 20 bp, human
ggtggtggcgacgaaggcgg

SEQ ID NO: 306943 - DNA, 20 bp, human
ggccacctagagctcgaggc

SEQ ID NO: 306944 - DNA, 20 bp, human
gaattggcgcatgcgcacta

SEQ ID NO: 306945 - DNA, 20 bp, human
ggtggtggtggcgacgaagg

SEQ ID NO: 306946 - DNA, 20 bp, human
gcggcctgcggcagaggtgt

SEQ ID NO: 306947 - DNA, 20 bp, human
gcgggcgggcgcactgggtc

SEQ ID NO: 306948 - DNA, 20 bp, human
gcccgcccgtcggtcagtcc

SEQ ID NO: 306949 - DNA, 20 bp, human
gcgggcgggcgaggtggact

SEQ ID NO: 306950 - DNA, 20 bp, human
gcggcccggcggccgcaggt

SEQ ID NO: 306951 - DNA, 20 bp, human
ggcgggcgaggtggactggg

SEQ ID NO: 306952 - DNA, 20 bp, human
gtccaggccaggcgcccggc

SEQ ID NO: 306953 - DNA, 20 bp, human
gcctggcctggactgaccga

SEQ ID NO: 306954 - DNA, 20 bp, human
ggaggtggactgggaggcgg

SEQ ID NO: 306955 - DNA, 20 bp, human
ggcactgcgccgccagcgta

SEQ ID NO: 306956 - DNA, 20 bp, human
gctccccgggaggactcctt

SEQ ID NO: 306957 - DNA, 20 bp, human
gagccgaaggagtcctcccg

SEQ ID NO: 306958 - DNA, 20 bp, human
gaggactccttcggcttcgt

SEQ ID NO: 306959 - DNA, 20 bp, human
gtacgccgcgtccgaaggag

SEQ ID NO: 306960 - DNA, 20 bp, human
gctgggccgcggcccccaca

SEQ ID NO: 306961 - DNA, 20 bp, human
ggaggccgggctcatctccc

SEQ ID NO: 306962 - DNA, 20 bp, human
gtcggcccctccttcggacg

SEQ ID NO: 306963 - DNA, 20 bp, human
gcctcccggggagatgagcc

SEQ ID NO: 306964 - DNA, 20 bp, human
gcgctcctcacagaccctgt

SEQ ID NO: 306965 - DNA, 20 bp, human
gggtggttggagcaagttag

SEQ ID NO: 306966 - DNA, 20 bp, human
gaaacagcatcagatgacgc

SEQ ID NO: 306967 - DNA, 20 bp, human
ggctccaggcggggagttcc

SEQ ID NO: 306968 - DNA, 20 bp, human
gcccggggccaaagtacaaa

SEQ ID NO: 306969 - DNA, 20 bp, human
gcagcatcagatgacgcggg

SEQ ID NO: 306970 - DNA, 20 bp, human
gccgccgatgcggatgcaga

SEQ ID NO: 306971 - DNA, 20 bp, human
gactccccgcctggagcctc

SEQ ID NO: 306972 - DNA, 20 bp, human
gctgccctctgcatccgcat

SEQ ID NO: 306973 - DNA, 20 bp, human
gggggagttcccgggtaggc

SEQ ID NO: 306974 - DNA, 20 bp, human
gctctcctggcccgcctacc

SEQ ID NO: 306975 - DNA, 20 bp, human
gaggcggggagttcccgggt

SEQ ID NO: 306976 - DNA, 20 bp, human
gtgggtaacggcaaagtaat

SEQ ID NO: 306977 - DNA, 20 bp, human
gcggggaaaaggtggaggcg

SEQ ID NO: 306978 - DNA, 20 bp, human
gcaacccagggtagacgact

SEQ ID NO: 306979 - DNA, 20 bp, human
gacgccgctgggagcgaaat

SEQ ID NO: 306980 - DNA, 20 bp, human
ggacgcgaggggtgcccttt

SEQ ID NO: 306981 - DNA, 20 bp, human
gcccaggcgttgccaaccca

SEQ ID NO: 306982 - DNA, 20 bp, human
gttgagtagccattgggtaa

SEQ ID NO: 306983 - DNA, 20 bp, human
gcagaactctcgctgctact

SEQ ID NO: 306984 - DNA, 20 bp, human
gggccgagaggggcgtgctt

SEQ ID NO: 306985 - DNA, 20 bp, human
gggctactcaactgtctctt

SEQ ID NO: 306986 - DNA, 20 bp, human
gagcagcgggctcctttaag

SEQ ID NO: 306987 - DNA, 20 bp, human
gcgcgctccaggctcgtacc

SEQ ID NO: 306988 - DNA, 20 bp, human
gtgaactcccgctccttcca

SEQ ID NO: 306989 - DNA, 20 bp, human
gccgagcagggacggggcta

SEQ ID NO: 306990 - DNA, 20 bp, human
ggggacggacacgccctgag

SEQ ID NO: 306991 - DNA, 20 bp, human
gtgtgacagcgccccgggtc

SEQ ID NO: 306992 - DNA, 20 bp, human
gaggggtcatccaggaacac

SEQ ID NO: 306993 - DNA, 20 bp, human
gttcaagccgagcagggacg

SEQ ID NO: 306994 - DNA, 20 bp, human
gtgagcgggggatgctgcga

SEQ ID NO: 306995 - DNA, 20 bp, human
gggagccgccggcctcttaa

SEQ ID NO: 306996 - DNA, 20 bp, human
gcacaggcggagaagcaaac

SEQ ID NO: 306997 - DNA, 20 bp, human
gaggcggtacctggttgtgg

SEQ ID NO: 306998 - DNA, 20 bp, human
ggcaagatctggagcgcatc

SEQ ID NO: 306999 - DNA, 20 bp, human
gcgctccagatcttgcttgt

SEQ ID NO: 307000 - DNA, 20 bp, human
ggatgagtccaagctacaga

SEQ ID NO: 307001 - DNA, 20 bp, human
ggggaggcggtacctggttg

SEQ ID NO: 307002 - DNA, 20 bp, human
gttgtcggattttatttcgc

SEQ ID NO: 307003 - DNA, 20 bp, human
ggtgacgtcactagccgagt

SEQ ID NO: 307004 - DNA, 20 bp, human
ggaagtggctgccgaaaaga

SEQ ID NO: 307005 - DNA, 20 bp, human
ggcactcttagcactccact

SEQ ID NO: 307006 - DNA, 20 bp, human
ggcagtggcagatgcctgat

SEQ ID NO: 307007 - DNA, 20 bp, human
gtggcagatgcctgattggc

SEQ ID NO: 307008 - DNA, 20 bp, human
gccactgccttaagacagac

SEQ ID NO: 307009 - DNA, 20 bp, human
gggcccagccaataggcttc

SEQ ID NO: 307010 - DNA, 20 bp, human
gtaaacagagcccgccaatc

SEQ ID NO: 307011 - DNA, 20 bp, human
gagaggggcgggtccagagt

SEQ ID NO: 307012 - DNA, 20 bp, human
gaataggcttcaggcagaca

SEQ ID NO: 307013 - DNA, 20 bp, human
gtggccttccttcttttaga

SEQ ID NO: 307014 - DNA, 20 bp, human
gcaccacagcgaagtctgtg

SEQ ID NO: 307015 - DNA, 20 bp, human
gtgcctgaagcctattggct

SEQ ID NO: 307016 - DNA, 20 bp, human
gcgggcggactgacagaagg

SEQ ID NO: 307017 - DNA, 20 bp, human
gtcgcggtgcggccaaagaa

SEQ ID NO: 307018 - DNA, 20 bp, human
gcggtgcggccaaagaaagg

SEQ ID NO: 307019 - DNA, 20 bp, human
gaccggggcggggcgaccac

SEQ ID NO: 307020 - DNA, 20 bp, human
ggcggactgacagaaggcgg

SEQ ID NO: 307021 - DNA, 20 bp, human
ggaacgcgcgcgacccacga

SEQ ID NO: 307022 - DNA, 20 bp, human
gtccggacgatgtttgtaga

SEQ ID NO: 307023 - DNA, 20 bp, human
ggccgggacgaccgtctcat

SEQ ID NO: 307024 - DNA, 20 bp, human
ggcttcgcgcctcctttctt

SEQ ID NO: 307025 - DNA, 20 bp, human
gcactccctgccactgactt

SEQ ID NO: 307026 - DNA, 20 bp, human
ggccgggagacgccgaacac

SEQ ID NO: 307027 - DNA, 20 bp, human
gcgaacacgggaacaggaat

SEQ ID NO: 307028 - DNA, 20 bp, human
ggggacgtcagggcgagcga

SEQ ID NO: 307029 - DNA, 20 bp, human
gagacgccgaacacgggaac

SEQ ID NO: 307030 - DNA, 20 bp, human
gaatacgtctgtattgagtt

SEQ ID NO: 307031 - DNA, 20 bp, human
ggttcggcgtctcccggctg

SEQ ID NO: 307032 - DNA, 20 bp, human
gtcccgtgttcggcgtctcc

SEQ ID NO: 307033 - DNA, 20 bp, human
gctaatggtggtcaggctag

SEQ ID NO: 307034 - DNA, 20 bp, human
ggcgggggctggggacgtca

SEQ ID NO: 307035 - DNA, 20 bp, human
gcgtcagggcgagcgagggg

SEQ ID NO: 307036 - DNA, 20 bp, human
gaaacccctatgtacttcca

SEQ ID NO: 307037 - DNA, 20 bp, human
gccaaccatggaagtacata

SEQ ID NO: 307038 - DNA, 20 bp, human
gggcccttctggcaccttgt

SEQ ID NO: 307039 - DNA, 20 bp, human
gcaccttgtggggattacaa

SEQ ID NO: 307040 - DNA, 20 bp, human
gaagctaaatgcacagtgga

SEQ ID NO: 307041 - DNA, 20 bp, human
gtccccacaaggtgccagaa

SEQ ID NO: 307042 - DNA, 20 bp, human
ggcacagtggatggttgcct

SEQ ID NO: 307043 - DNA, 20 bp, human
gaagcaggacagtctcatcc

SEQ ID NO: 307044 - DNA, 20 bp, human
gccctttcaaagctgcatat

SEQ ID NO: 307045 - DNA, 20 bp, human
gcaaatgccgggtgacctta

SEQ ID NO: 307046 - DNA, 20 bp, human
gaatccccgcgccgtccggc

SEQ ID NO: 307047 - DNA, 20 bp, human
gcgcgcacacggaacagcac

SEQ ID NO: 307048 - DNA, 20 bp, human
ggcgctacgcccgacgtcac

SEQ ID NO: 307049 - DNA, 20 bp, human
gaacagcacaggctgccccg

SEQ ID NO: 307050 - DNA, 20 bp, human
gcggtagcggaacccgccgc

SEQ ID NO: 307051 - DNA, 20 bp, human
gcccctccgcccggcggtag

SEQ ID NO: 307052 - DNA, 20 bp, human
gaccgcccccaccggccgga

SEQ ID NO: 307053 - DNA, 20 bp, human
gtactcggatgtctgggatc

SEQ ID NO: 307054 - DNA, 20 bp, human
ggtcacgggtccgtgtgtag

SEQ ID NO: 307055 - DNA, 20 bp, human
gcacacggacccgtgacgtc

SEQ ID NO: 307056 - DNA, 20 bp, human
gccgctgagagttagggtgt

SEQ ID NO: 307057 - DNA, 20 bp, human
gagctggccgctgagagtta

SEQ ID NO: 307058 - DNA, 20 bp, human
gaagccaaggcggtttccga

SEQ ID NO: 307059 - DNA, 20 bp, human
gccaatgggcgaagccaagg

SEQ ID NO: 307060 - DNA, 20 bp, human
gcaatcccgcctactctcac

SEQ ID NO: 307061 - DNA, 20 bp, human
gtcaccagccaataacaaga

SEQ ID NO: 307062 - DNA, 20 bp, human
gccgacttccttcttgttat

SEQ ID NO: 307063 - DNA, 20 bp, human
gcagccctcggaaaccgcct

SEQ ID NO: 307064 - DNA, 20 bp, human
gccggcgtgagtgacagaca

SEQ ID NO: 307065 - DNA, 20 bp, human
ggggtggtgcgacggcccag

SEQ ID NO: 307066 - DNA, 20 bp, human
gggggagcgccgtcaagtgt

SEQ ID NO: 307067 - DNA, 20 bp, human
gcaccggccggggcgacacc

SEQ ID NO: 307068 - DNA, 20 bp, human
gtgtcggcgcgattcggtcc

SEQ ID NO: 307069 - DNA, 20 bp, human
gccggaatgcgaccggacgg

SEQ ID NO: 307070 - DNA, 20 bp, human
gagctcgcccggtgtcgccc

SEQ ID NO: 307071 - DNA, 20 bp, human
gcgggcgagctggcgagacc

SEQ ID NO: 307072 - DNA, 20 bp, human
gtcgccccggccggtggcag

SEQ ID NO: 307073 - DNA, 20 bp, human
gaggcttcccaggcggtcgt

SEQ ID NO: 307074 - DNA, 20 bp, human
gctcctggaaggtgggatcc

SEQ ID NO: 307075 - DNA, 20 bp, human
gggggactgtggagcggagc

SEQ ID NO: 307076 - DNA, 20 bp, human
ggcgccgcggtgcagctcaa

SEQ ID NO: 307077 - DNA, 20 bp, human
gcgtcccggccgctctggga

SEQ ID NO: 307078 - DNA, 20 bp, human
gctcaagggcgccgcgctcg

SEQ ID NO: 307079 - DNA, 20 bp, human
ggggagccagcccgctcgta

SEQ ID NO: 307080 - DNA, 20 bp, human
gccaggtagctccgcaccca

SEQ ID NO: 307081 - DNA, 20 bp, human
gcgtcccggaacagcagcag

SEQ ID NO: 307082 - DNA, 20 bp, human
ggaccctcctccctcttagg

SEQ ID NO: 307083 - DNA, 20 bp, human
ggccaggaagggcgccccct

SEQ ID NO: 307084 - DNA, 20 bp, human
ggaagccgggtgagcgggaa

SEQ ID NO: 307085 - DNA, 20 bp, human
gcgggacggaaggagctgcg

SEQ ID NO: 307086 - DNA, 20 bp, human
gagggagcggctctgcccca

SEQ ID NO: 307087 - DNA, 20 bp, human
ggtgagcagtccacagtctt

SEQ ID NO: 307088 - DNA, 20 bp, human
gaaagctccaccctcggccc

SEQ ID NO: 307089 - DNA, 20 bp, human
gctgccctgccttcacttgt

SEQ ID NO: 307090 - DNA, 20 bp, human
ggtctcaagccgctagggag

SEQ ID NO: 307091 - DNA, 20 bp, human
gagggtggagctttctgggt

SEQ ID NO: 307092 - DNA, 20 bp, human
ggctgagtctcaagccgcta

SEQ ID NO: 307093 - DNA, 20 bp, human
ggggccgtgtccccggtccg

SEQ ID NO: 307094 - DNA, 20 bp, human
gttctctcccgccagaactt

SEQ ID NO: 307095 - DNA, 20 bp, human
ggaacaatgggtgtcctccc

SEQ ID NO: 307096 - DNA, 20 bp, human
gacatgacggaaaatcagta

SEQ ID NO: 307097 - DNA, 20 bp, human
ggtaagctaagaagcaaact

SEQ ID NO: 307098 - DNA, 20 bp, human
ggccgtaaactccggggtag

SEQ ID NO: 307099 - DNA, 20 bp, human
gaaaaggagggacaggttgg

SEQ ID NO: 307100 - DNA, 20 bp, human
ggaagtggcgcggaacatga

SEQ ID NO: 307101 - DNA, 20 bp, human
gtggaaagaaaaggagggac

SEQ ID NO: 307102 - DNA, 20 bp, human
gtaaactccggggtagggga

SEQ ID NO: 307103 - DNA, 20 bp, human
gaggagggccgtaaactccg

SEQ ID NO: 307104 - DNA, 20 bp, human
gcctctctcgcggtatcatc

SEQ ID NO: 307105 - DNA, 20 bp, human
gtaaagtgcgcgaacggaag

SEQ ID NO: 307106 - DNA, 20 bp, human
ggctgtcaggaactccgatc

SEQ ID NO: 307107 - DNA, 20 bp, human
gtttgacagtgataccggat

SEQ ID NO: 307108 - DNA, 20 bp, human
gcgattcagccaaatgtttt

SEQ ID NO: 307109 - DNA, 20 bp, human
gagtggctgccttctttgac

SEQ ID NO: 307110 - DNA, 20 bp, human
gaacaaacttaactgctgtc

SEQ ID NO: 307111 - DNA, 20 bp, human
ggactcagacttacgcaaat

SEQ ID NO: 307112 - DNA, 20 bp, human
gtcttaggatacattttgct

SEQ ID NO: 307113 - DNA, 20 bp, human
gaaaaagctaaatttgctag

SEQ ID NO: 307114 - DNA, 20 bp, human
ggtcttgcacaataaataat

SEQ ID NO: 307115 - DNA, 20 bp, human
ggatgatgaatcactggatt

SEQ ID NO: 307116 - DNA, 20 bp, human
gagacccagccaacttggac

SEQ ID NO: 307117 - DNA, 20 bp, human
gaaaaccctcctcctgtcag

SEQ ID NO: 307118 - DNA, 20 bp, human
gcagccagacccagccaact

SEQ ID NO: 307119 - DNA, 20 bp, human
ggagtcatcaagcccaacat

SEQ ID NO: 307120 - DNA, 20 bp, human
gtggcctgtccaagttggct

SEQ ID NO: 307121 - DNA, 20 bp, human
ggtcttcagcgtgacccaat

SEQ ID NO: 307122 - DNA, 20 bp, human
gctccagtcagcaaaaatgt

SEQ ID NO: 307123 - DNA, 20 bp, human
gatagacacagacaccgatt

SEQ ID NO: 307124 - DNA, 20 bp, human
gtgtgtctattccagcaaac

SEQ ID NO: 307125 - DNA, 20 bp, human
gttgaggttgagcccatgtt

SEQ ID NO: 307126 - DNA, 20 bp, human
gcgcccagagggcaaatgag

SEQ ID NO: 307127 - DNA, 20 bp, human
gtaagccagagcccccgcgc

SEQ ID NO: 307128 - DNA, 20 bp, human
ggctggaggcgggactaggg

SEQ ID NO: 307129 - DNA, 20 bp, human
gctccgcccgggcgcccaga

SEQ ID NO: 307130 - DNA, 20 bp, human
gaaagagactgcccggttgc

SEQ ID NO: 307131 - DNA, 20 bp, human
gagggcaaatgaggggcggc

SEQ ID NO: 307132 - DNA, 20 bp, human
gacgcggaatttcccagcgc

SEQ ID NO: 307133 - DNA, 20 bp, human
ggaaaactcgtccccgtccc

SEQ ID NO: 307134 - DNA, 20 bp, human
gctcagacgccgtgagtcag

SEQ ID NO: 307135 - DNA, 20 bp, human
gccgaatcgagagcctggga

SEQ ID NO: 307136 - DNA, 20 bp, human
gtaggctgccccaaccacgg

SEQ ID NO: 307137 - DNA, 20 bp, human
ggctgccccaaccacggcgg

SEQ ID NO: 307138 - DNA, 20 bp, human
gccaaccacggcggaggaac

SEQ ID NO: 307139 - DNA, 20 bp, human
gagctaggctgccccaacca

SEQ ID NO: 307140 - DNA, 20 bp, human
ggggaagagtgggtcgacct

SEQ ID NO: 307141 - DNA, 20 bp, human
gggcggcgcagggggtgaga

SEQ ID NO: 307142 - DNA, 20 bp, human
ggagccccctggggtccgca

SEQ ID NO: 307143 - DNA, 20 bp, human
gggagggcacggtgcgacgg

SEQ ID NO: 307144 - DNA, 20 bp, human
gactgggcggccgcagccaa

SEQ ID NO: 307145 - DNA, 20 bp, human
gccgccgcagctccctccat

SEQ ID NO: 307146 - DNA, 20 bp, human
gcggcgtccctcccttgcgc

SEQ ID NO: 307147 - DNA, 20 bp, human
gctcttgagggccggcgcaa

SEQ ID NO: 307148 - DNA, 20 bp, human
gaacagcgaaggcagtcgat

SEQ ID NO: 307149 - DNA, 20 bp, human
gcggccaataagcgtggcga

SEQ ID NO: 307150 - DNA, 20 bp, human
gttggggcgaggtgcgcctg

SEQ ID NO: 307151 - DNA, 20 bp, human
gggccatcatagaacagcga

SEQ ID NO: 307152 - DNA, 20 bp, human
gccgctccggccaataagcg

SEQ ID NO: 307153 - DNA, 20 bp, human
gtcgcgggccatctgggctc

SEQ ID NO: 307154 - DNA, 20 bp, human
gcggcagggccagcacccat

SEQ ID NO: 307155 - DNA, 20 bp, human
gagggctgtggcggaccaat

SEQ ID NO: 307156 - DNA, 20 bp, human
ggcactgcacgactgtgcaa

SEQ ID NO: 307157 - DNA, 20 bp, human
ggggctctgagagcctctga

SEQ ID NO: 307158 - DNA, 20 bp, human
gggggcaggaagcgagagtg

SEQ ID NO: 307159 - DNA, 20 bp, human
gaaggcggcaggtctgcaaa

SEQ ID NO: 307160 - DNA, 20 bp, human
gcgcctgcgcagtgcagagg

SEQ ID NO: 307161 - DNA, 20 bp, human
ggacgggggcgggggttcta

SEQ ID NO: 307162 - DNA, 20 bp, human
gagcttgtcttgggacccaa

SEQ ID NO: 307163 - DNA, 20 bp, human
gatcttaatcgtaactgggt

SEQ ID NO: 307164 - DNA, 20 bp, human
gcggcaggtctgcaaaggga

SEQ ID NO: 307165 - DNA, 20 bp, human
gcggaggcaaggcgggtgca

SEQ ID NO: 307166 - DNA, 20 bp, human
gagtggcggcggaaggacgt

SEQ ID NO: 307167 - DNA, 20 bp, human
ggccccaccgccagtccggg

SEQ ID NO: 307168 - DNA, 20 bp, human
gggagcgcgagcgacagtgg

SEQ ID NO: 307169 - DNA, 20 bp, human
gggaagccccaaggccgggg

SEQ ID NO: 307170 - DNA, 20 bp, human
gtcctcccggactggcggtg

SEQ ID NO: 307171 - DNA, 20 bp, human
gcggggctcaggatgctcat

SEQ ID NO: 307172 - DNA, 20 bp, human
gcgccgagggcccgtcccgc

SEQ ID NO: 307173 - DNA, 20 bp, human
ggatgccccaccgccagtcc

SEQ ID NO: 307174 - DNA, 20 bp, human
gtctacaaggtgcgacggga

SEQ ID NO: 307175 - DNA, 20 bp, human
gcgctcgcgctccacaggta

SEQ ID NO: 307176 - DNA, 20 bp, human
ggccggcggcggaacagctt

SEQ ID NO: 307177 - DNA, 20 bp, human
gcgggtccgcagaaaagccg

SEQ ID NO: 307178 - DNA, 20 bp, human
ggcgcagccgcgatcccgga

SEQ ID NO: 307179 - DNA, 20 bp, human
gaggagccggagtaagggga

SEQ ID NO: 307180 - DNA, 20 bp, human
gatcccggagggagcgcgcc

SEQ ID NO: 307181 - DNA, 20 bp, human
gcggagccggaacgcgcaag

SEQ ID NO: 307182 - DNA, 20 bp, human
ggccggaacgcgcaaggggt

SEQ ID NO: 307183 - DNA, 20 bp, human
gcccgagcgaggggctgcga

SEQ ID NO: 307184 - DNA, 20 bp, human
ggaacctggtcacacccaca

SEQ ID NO: 307185 - DNA, 20 bp, human
gccgcgcgcctgccaggccg

SEQ ID NO: 307186 - DNA, 20 bp, human
ggcccgcgccctacccggca

SEQ ID NO: 307187 - DNA, 20 bp, human
gccctacccggcagggctcg

SEQ ID NO: 307188 - DNA, 20 bp, human
gcctcggcccgcgccctacc

SEQ ID NO: 307189 - DNA, 20 bp, human
gaccccgagccctgccgggt

SEQ ID NO: 307190 - DNA, 20 bp, human
gcggcgtgaatattcatcag

SEQ ID NO: 307191 - DNA, 20 bp, human
ggccctgccgggtagggcgc

SEQ ID NO: 307192 - DNA, 20 bp, human
gtgaatattcatcaggggtg

SEQ ID NO: 307193 - DNA, 20 bp, human
gctcctcaggcaggaaaaac

SEQ ID NO: 307194 - DNA, 20 bp, human
gctcaggcaggaaaaaccgg

SEQ ID NO: 307195 - DNA, 20 bp, human
gggtgtgagtgcgtttccgc

SEQ ID NO: 307196 - DNA, 20 bp, human
gcacacgcctgggcattcgt

SEQ ID NO: 307197 - DNA, 20 bp, human
ggaaccagagtgccgccctg

SEQ ID NO: 307198 - DNA, 20 bp, human
gaggacgcgcccggctaggg

SEQ ID NO: 307199 - DNA, 20 bp, human
ggctgggcgccgacccatgc

SEQ ID NO: 307200 - DNA, 20 bp, human
ggggcggcactctggttctg

SEQ ID NO: 307201 - DNA, 20 bp, human
gggggcgcggtggcgcggtc

SEQ ID NO: 307202 - DNA, 20 bp, human
gagggtgttgtgttctcagc

SEQ ID NO: 307203 - DNA, 20 bp, human
ggcaaggacgcgcccggcta

SEQ ID NO: 307204 - DNA, 20 bp, human
gtgcggccggagtgctcggg

SEQ ID NO: 307205 - DNA, 20 bp, human
ggcggcccgcccgagcactc

SEQ ID NO: 307206 - DNA, 20 bp, human
ggaggagggcgaactagctc

SEQ ID NO: 307207 - DNA, 20 bp, human
ggcggctgcggcatcctcgc

SEQ ID NO: 307208 - DNA, 20 bp, human
gctccccgggtgctcgctga

SEQ ID NO: 307209 - DNA, 20 bp, human
ggcgtggccgtgcatcacga

SEQ ID NO: 307210 - DNA, 20 bp, human
gtgcagccggccacctagca

SEQ ID NO: 307211 - DNA, 20 bp, human
gacaccctcgccggggactc

SEQ ID NO: 307212 - DNA, 20 bp, human
gtgggctggctgcgtctcta

SEQ ID NO: 307213 - DNA, 20 bp, human
gcggctgcagcatcattcgc

SEQ ID NO: 307214 - DNA, 20 bp, human
ggagagctgcagaaaagggt

SEQ ID NO: 307215 - DNA, 20 bp, human
gtggcaaccgcgcgcgccga

SEQ ID NO: 307216 - DNA, 20 bp, human
gagccggccccggccaagtg

SEQ ID NO: 307217 - DNA, 20 bp, human
ggcaccgccccccggcacga

SEQ ID NO: 307218 - DNA, 20 bp, human
ggacgcccaccctcgtgccg

SEQ ID NO: 307219 - DNA, 20 bp, human
gcaaataggcggcgactcac

SEQ ID NO: 307220 - DNA, 20 bp, human
gctggagggagcgcggatgg

SEQ ID NO: 307221 - DNA, 20 bp, human
gcgggagggggcgcactcgg

SEQ ID NO: 307222 - DNA, 20 bp, human
gttccggtgccccctggcga

SEQ ID NO: 307223 - DNA, 20 bp, human
gaggctgcaccgtcgccagg

SEQ ID NO: 307224 - DNA, 20 bp, human
gtgtgcccgcggagtccatg

SEQ ID NO: 307225 - DNA, 20 bp, human
gactcggcggcagccccact

SEQ ID NO: 307226 - DNA, 20 bp, human
gacgccgcacctgcccgcga

SEQ ID NO: 307227 - DNA, 20 bp, human
ggaccccgctccatatctcc

SEQ ID NO: 307228 - DNA, 20 bp, human
ggcagtccggggatggcgga

SEQ ID NO: 307229 - DNA, 20 bp, human
ggagactcggcagcggcggt

SEQ ID NO: 307230 - DNA, 20 bp, human
gcgctcttccagccgagact

SEQ ID NO: 307231 - DNA, 20 bp, human
ggccgcggccgaccagctga

SEQ ID NO: 307232 - DNA, 20 bp, human
gggctcccggagatatggag

SEQ ID NO: 307233 - DNA, 20 bp, human
gccgcggcgaccggaagctc

SEQ ID NO: 307234 - DNA, 20 bp, human
gaagctccggactgaggtac

SEQ ID NO: 307235 - DNA, 20 bp, human
gatatggagcggggtcagcg

SEQ ID NO: 307236 - DNA, 20 bp, human
gagcggcagcgcagcaggat

SEQ ID NO: 307237 - DNA, 20 bp, human
gctgctgcgctgccgctgag

SEQ ID NO: 307238 - DNA, 20 bp, human
gcaagcccctggatgaatga

SEQ ID NO: 307239 - DNA, 20 bp, human
ggctgccgctgagaggaaga

SEQ ID NO: 307240 - DNA, 20 bp, human
gttggcagcaccagtcatga

SEQ ID NO: 307241 - DNA, 20 bp, human
gctggggtggtaagaatgtc

SEQ ID NO: 307242 - DNA, 20 bp, human
gggcttctgtctccatactg

SEQ ID NO: 307243 - DNA, 20 bp, human
gccctggatgaatgaaggca

SEQ ID NO: 307244 - DNA, 20 bp, human
gtcacgctgtaaccctctgc

SEQ ID NO: 307245 - DNA, 20 bp, human
gcactggtggccctcatgac

SEQ ID NO: 307246 - DNA, 20 bp, human
gggactaagtagggagcgct

SEQ ID NO: 307247 - DNA, 20 bp, human
ggggtgactcacccgccgcg

SEQ ID NO: 307248 - DNA, 20 bp, human
gcagcccgggcggtacaata

SEQ ID NO: 307249 - DNA, 20 bp, human
gcgaacggcgcggacggcgc

SEQ ID NO: 307250 - DNA, 20 bp, human
gcccgctcggccgtggccgt

SEQ ID NO: 307251 - DNA, 20 bp, human
gagcgcctgaggactaagta

SEQ ID NO: 307252 - DNA, 20 bp, human
gcgggcggtacaatagggtt

SEQ ID NO: 307253 - DNA, 20 bp, human
ggcggcgcgaacggcgcgga

SEQ ID NO: 307254 - DNA, 20 bp, human
ggtacaatagggttgggccg

SEQ ID NO: 307255 - DNA, 20 bp, human
gaagacgcggacgcaggggg

SEQ ID NO: 307256 - DNA, 20 bp, human
ggggcgcccgccacactctg

SEQ ID NO: 307257 - DNA, 20 bp, human
gcgtgcgctgtgcgtggaag

SEQ ID NO: 307258 - DNA, 20 bp, human
ggcggggaacctctctccca

SEQ ID NO: 307259 - DNA, 20 bp, human
gcgcccgtacgcgctgtgtg

SEQ ID NO: 307260 - DNA, 20 bp, human
ggcgcgcgccgcgtgagaac

SEQ ID NO: 307261 - DNA, 20 bp, human
gtgcggccggcgcatcccga

SEQ ID NO: 307262 - DNA, 20 bp, human
gaggcgcaccggttctcacg

SEQ ID NO: 307263 - DNA, 20 bp, human
gcggcctgaggggactgcgc

SEQ ID NO: 307264 - DNA, 20 bp, human
ggcatcccgatggagcgcgg

SEQ ID NO: 307265 - DNA, 20 bp, human
ggacctctcagcccaactac

SEQ ID NO: 307266 - DNA, 20 bp, human
ggggcggggcggggcccgaa

SEQ ID NO: 307267 - DNA, 20 bp, human
gtcggacctgcgaaccgggc

SEQ ID NO: 307268 - DNA, 20 bp, human
gccgcctcggacctgcgaac

SEQ ID NO: 307269 - DNA, 20 bp, human
gagtcgctgcccagccggtc

SEQ ID NO: 307270 - DNA, 20 bp, human
ggcccagccggtcaggacgt

SEQ ID NO: 307271 - DNA, 20 bp, human
gtcccacgtcctgaccggct

SEQ ID NO: 307272 - DNA, 20 bp, human
ggacgcctgcgcaatgtatg

SEQ ID NO: 307273 - DNA, 20 bp, human
gcggctgggcagcgactacc

SEQ ID NO: 307274 - DNA, 20 bp, human
gcgcaaggggcaatcctgcc

SEQ ID NO: 307275 - DNA, 20 bp, human
gtcaggacgtgggacgcaag

SEQ ID NO: 307276 - DNA, 20 bp, human
gagcccctctccaaagaccc

SEQ ID NO: 307277 - DNA, 20 bp, human
gccccaccgccgggtctctc

SEQ ID NO: 307278 - DNA, 20 bp, human
gtcggcccaacgtgtcgctg

SEQ ID NO: 307279 - DNA, 20 bp, human
ggggctaataacagaggcgg

SEQ ID NO: 307280 - DNA, 20 bp, human
ggggtacccgagagacccgg

SEQ ID NO: 307281 - DNA, 20 bp, human
gttcctgggtctttggagag

SEQ ID NO: 307282 - DNA, 20 bp, human
gtgggcgggtcctgtctcct

SEQ ID NO: 307283 - DNA, 20 bp, human
gtgggccgaagagcggtgtt

SEQ ID NO: 307284 - DNA, 20 bp, human
gttggagaggggctcattat

SEQ ID NO: 307285 - DNA, 20 bp, human
gaatcgaagtacggtgtcag

SEQ ID NO: 307286 - DNA, 20 bp, human
gacagcccggggtccctcgc

SEQ ID NO: 307287 - DNA, 20 bp, human
ggaagcggcgggcttcggga

SEQ ID NO: 307288 - DNA, 20 bp, human
ggacgtggggcagaactcat

SEQ ID NO: 307289 - DNA, 20 bp, human
gttcgggaggggcactgcga

SEQ ID NO: 307290 - DNA, 20 bp, human
gtgcgacggcgttgactgag

SEQ ID NO: 307291 - DNA, 20 bp, human
gagagccagcgagggacccc

SEQ ID NO: 307292 - DNA, 20 bp, human
gtcctcccggtcagcgtcgg

SEQ ID NO: 307293 - DNA, 20 bp, human
gccgcgcgggccggcggaag

SEQ ID NO: 307294 - DNA, 20 bp, human
gacacccagggagacagacg

SEQ ID NO: 307295 - DNA, 20 bp, human
gaagaagtgtgcatgcggat

SEQ ID NO: 307296 - DNA, 20 bp, human
gcccagagaggtctagggag

SEQ ID NO: 307297 - DNA, 20 bp, human
gtcaaagcccagagaggtct

SEQ ID NO: 307298 - DNA, 20 bp, human
ggtaaaggaataaggttcgt

SEQ ID NO: 307299 - DNA, 20 bp, human
gtgcctggtcctcatttcac

SEQ ID NO: 307300 - DNA, 20 bp, human
gttggggaatggggttgcta

SEQ ID NO: 307301 - DNA, 20 bp, human
gccccctccctagacctctc

SEQ ID NO: 307302 - DNA, 20 bp, human
ggggccagaactgcatcgaa

SEQ ID NO: 307303 - DNA, 20 bp, human
gatgtcgtagttgctgatgt

SEQ ID NO: 307304 - DNA, 20 bp, human
gggttgctatggcaaccgaa

SEQ ID NO: 307305 - DNA, 20 bp, human
gacgtcatgtgtgctccttt

SEQ ID NO: 307306 - DNA, 20 bp, human
gaggcccgggcggatttccc

SEQ ID NO: 307307 - DNA, 20 bp, human
gtcggcgccccccccgggaa

SEQ ID NO: 307308 - DNA, 20 bp, human
gtgcgccccgggaaccttcc

SEQ ID NO: 307309 - DNA, 20 bp, human
ggcggcgccctccccaacga

SEQ ID NO: 307310 - DNA, 20 bp, human
gggtcgcgcctctctcagag

SEQ ID NO: 307311 - DNA, 20 bp, human
gccagccctccccttcccgg

SEQ ID NO: 307312 - DNA, 20 bp, human
gggagggcgccgccggggta

SEQ ID NO: 307313 - DNA, 20 bp, human
gccaagaggtgagagccgga

SEQ ID NO: 307314 - DNA, 20 bp, human
gctgacctcccctctgagag

SEQ ID NO: 307315 - DNA, 20 bp, human
ggaggcctggaaggttcccg

SEQ ID NO: 307316 - DNA, 20 bp, human
ggccgcctcgggtttccgga

SEQ ID NO: 307317 - DNA, 20 bp, human
ggagccccgtccccggtcgt

SEQ ID NO: 307318 - DNA, 20 bp, human
gcggcccctccggaaacccg

SEQ ID NO: 307319 - DNA, 20 bp, human
gcccctccggaaacccgagg

SEQ ID NO: 307320 - DNA, 20 bp, human
gtccccctgcgcttcccccc

SEQ ID NO: 307321 - DNA, 20 bp, human
gccgcgtccggccctttatg

SEQ ID NO: 307322 - DNA, 20 bp, human
gggcggtgcccccacgaccg

SEQ ID NO: 307323 - DNA, 20 bp, human
ggccgtgcgcagcctgggtc

SEQ ID NO: 307324 - DNA, 20 bp, human
ggtgcccccacgaccgggga

SEQ ID NO: 307325 - DNA, 20 bp, human
ggacgccctcgcccgccctc

SEQ ID NO: 307326 - DNA, 20 bp, human
gcggcccgacggagccactg

SEQ ID NO: 307327 - DNA, 20 bp, human
gtgggccgcacctgccgcag

SEQ ID NO: 307328 - DNA, 20 bp, human
gcgccggggccgccacgccc

SEQ ID NO: 307329 - DNA, 20 bp, human
gggcccccgccctcgcgcgg

SEQ ID NO: 307330 - DNA, 20 bp, human
gcagccccgaccccgtgcct

SEQ ID NO: 307331 - DNA, 20 bp, human
gtacggagaccggggctgga

SEQ ID NO: 307332 - DNA, 20 bp, human
gctgccgcagtggctccgtc

SEQ ID NO: 307333 - DNA, 20 bp, human
gcaggtgcggcccaggcacg

SEQ ID NO: 307334 - DNA, 20 bp, human
gtcacagggagctcttccta

SEQ ID NO: 307335 - DNA, 20 bp, human
gccggcgcacctgggcgagc

SEQ ID NO: 307336 - DNA, 20 bp, human
gcagttggggagtcatgaaa

SEQ ID NO: 307337 - DNA, 20 bp, human
gtcagtgtcagcagagtcgg

SEQ ID NO: 307338 - DNA, 20 bp, human
gccccaactggatcctccaa

SEQ ID NO: 307339 - DNA, 20 bp, human
gttggggagtcatgaaaggg

SEQ ID NO: 307340 - DNA, 20 bp, human
ggagtaatgcagagccagtc

SEQ ID NO: 307341 - DNA, 20 bp, human
gccagtcaggcccagagtag

SEQ ID NO: 307342 - DNA, 20 bp, human
gctggagaagcagggtatcc

SEQ ID NO: 307343 - DNA, 20 bp, human
ggcccttggaggatccagtt

SEQ ID NO: 307344 - DNA, 20 bp, human
gatgctcttgagcaagggtc

SEQ ID NO: 307345 - DNA, 20 bp, human
gagggtcactcaggtcatcc

SEQ ID NO: 307346 - DNA, 20 bp, human
gcggggcttcgtgagagaag

SEQ ID NO: 307347 - DNA, 20 bp, human
gcgcgaaggcggaccgggga

SEQ ID NO: 307348 - DNA, 20 bp, human
ggcgagaagagaacaataac

SEQ ID NO: 307349 - DNA, 20 bp, human
gaacaataactggagaccaa

SEQ ID NO: 307350 - DNA, 20 bp, human
gtgccccgccggccacggtg

SEQ ID NO: 307351 - DNA, 20 bp, human
gcttcgtgagagaagaggat

SEQ ID NO: 307352 - DNA, 20 bp, human
gggccggcggggcaaatacc

SEQ ID NO: 307353 - DNA, 20 bp, human
gaccaaaggcagaaactccc

SEQ ID NO: 307354 - DNA, 20 bp, human
gcccagggactgtctcctta

SEQ ID NO: 307355 - DNA, 20 bp, human
gcccttaaggagacagtccc

SEQ ID NO: 307356 - DNA, 20 bp, human
gcgtgggcggggcgcattga

SEQ ID NO: 307357 - DNA, 20 bp, human
gggcggggcgcattgagggg

SEQ ID NO: 307358 - DNA, 20 bp, human
ggcggggccggtggggacgt

SEQ ID NO: 307359 - DNA, 20 bp, human
gaggtggggtgggcccactg

SEQ ID NO: 307360 - DNA, 20 bp, human
gggtgggcggggcgcactgt

SEQ ID NO: 307361 - DNA, 20 bp, human
gtgggcgtggtcctgcgagg

SEQ ID NO: 307362 - DNA, 20 bp, human
gcccggctccgccccacagt

SEQ ID NO: 307363 - DNA, 20 bp, human
gttgccgtgggaaccgacgg

SEQ ID NO: 307364 - DNA, 20 bp, human
ggggccgccgtcggttccca

SEQ ID NO: 307365 - DNA, 20 bp, human
ggcgtggtcctgcgaggagg

SEQ ID NO: 307366 - DNA, 20 bp, human
gaggtggagcccatccccct

SEQ ID NO: 307367 - DNA, 20 bp, human
ggactcggaggaaacgccag

SEQ ID NO: 307368 - DNA, 20 bp, human
gccgccaggcctagggggat

SEQ ID NO: 307369 - DNA, 20 bp, human
gcgggccgcagtaccgccag

SEQ ID NO: 307370 - DNA, 20 bp, human
gccaccaggggaaagcggcc

SEQ ID NO: 307371 - DNA, 20 bp, human
ggcccggagccggcgccagg

SEQ ID NO: 307372 - DNA, 20 bp, human
gcggagttccgaggactcgg

SEQ ID NO: 307373 - DNA, 20 bp, human
gccgctttcccctggtgggc

SEQ ID NO: 307374 - DNA, 20 bp, human
ggccgggaagccgtgaacat

SEQ ID NO: 307375 - DNA, 20 bp, human
gtccacctggcgccggctcc

SEQ ID NO: 307376 - DNA, 20 bp, human
gacccatggcccccgaacct

SEQ ID NO: 307377 - DNA, 20 bp, human
ggcggcgctgccgaacctcc

SEQ ID NO: 307378 - DNA, 20 bp, human
gaacctggggcaagaagggc

SEQ ID NO: 307379 - DNA, 20 bp, human
ggggagccccgtagaaccga

SEQ ID NO: 307380 - DNA, 20 bp, human
ggaacctcccggtgacctgg

SEQ ID NO: 307381 - DNA, 20 bp, human
gccttcttgccccaggttcg

SEQ ID NO: 307382 - DNA, 20 bp, human
gcccgggcccaggttctggt

SEQ ID NO: 307383 - DNA, 20 bp, human
gcggcctccaggtcaccggg

SEQ ID NO: 307384 - DNA, 20 bp, human
gggccctgcgggtgacaggc

SEQ ID NO: 307385 - DNA, 20 bp, human
ggtgacaggcaggcgggaag

SEQ ID NO: 307386 - DNA, 20 bp, human
gccacggcgggcgtgaggaa

SEQ ID NO: 307387 - DNA, 20 bp, human
gcgccaccgccgcagcaggt

SEQ ID NO: 307388 - DNA, 20 bp, human
gagggcagagcagggcgcgc

SEQ ID NO: 307389 - DNA, 20 bp, human
gaaggccaggctacccggga

SEQ ID NO: 307390 - DNA, 20 bp, human
gccaggaccgcgcggctgag

SEQ ID NO: 307391 - DNA, 20 bp, human
gggaaggggcactgggccga

SEQ ID NO: 307392 - DNA, 20 bp, human
ggcgggagactgccgccccc

SEQ ID NO: 307393 - DNA, 20 bp, human
ggcactgggccgagggtcga

SEQ ID NO: 307394 - DNA, 20 bp, human
gcgctggggagccgggccct

SEQ ID NO: 307395 - DNA, 20 bp, human
gggacggggctcggctcccc

SEQ ID NO: 307396 - DNA, 20 bp, human
gccacgccccctcacgtcac

SEQ ID NO: 307397 - DNA, 20 bp, human
gtaaccccgacccgcgagag

SEQ ID NO: 307398 - DNA, 20 bp, human
ggagtgagcctgtgacgtga

SEQ ID NO: 307399 - DNA, 20 bp, human
ggcgggtcggggttacatgg

SEQ ID NO: 307400 - DNA, 20 bp, human
gtcacgggcgctggaaattc

SEQ ID NO: 307401 - DNA, 20 bp, human
gggctcgtccggcgtctcct

SEQ ID NO: 307402 - DNA, 20 bp, human
gtcagctgaggccgagtcac

SEQ ID NO: 307403 - DNA, 20 bp, human
ggagtcaccgggtgggatgg

SEQ ID NO: 307404 - DNA, 20 bp, human
gcgtgcgggtgcgctgggca

SEQ ID NO: 307405 - DNA, 20 bp, human
ggaaaggcacgcggctcgtc

SEQ ID NO: 307406 - DNA, 20 bp, human
gggtgcccggcacttcgcag

SEQ ID NO: 307407 - DNA, 20 bp, human
ggcgtccaatcctagcccac

SEQ ID NO: 307408 - DNA, 20 bp, human
gcagtcgggcgccaagtgaa

SEQ ID NO: 307409 - DNA, 20 bp, human
gccggcgggagccgcccaaa

SEQ ID NO: 307410 - DNA, 20 bp, human
gatggagcaccgcccctcta

SEQ ID NO: 307411 - DNA, 20 bp, human
ggaagtgccgggcacccttt

SEQ ID NO: 307412 - DNA, 20 bp, human
gcaggcgtggctttctcggc

SEQ ID NO: 307413 - DNA, 20 bp, human
ggcgccaggcgtggctttct

SEQ ID NO: 307414 - DNA, 20 bp, human
ggagccgcccaaagggtgcc

SEQ ID NO: 307415 - DNA, 20 bp, human
gttggacgcagtaggtagaa

SEQ ID NO: 307416 - DNA, 20 bp, human
gcggggacggcgctactcca

SEQ ID NO: 307417 - DNA, 20 bp, human
gccgcggagagagcctccga

SEQ ID NO: 307418 - DNA, 20 bp, human
ggttacgagaggacttgcgg

SEQ ID NO: 307419 - DNA, 20 bp, human
gctactccaggggttacgag

SEQ ID NO: 307420 - DNA, 20 bp, human
gtgcggaggtcgcttggagg

SEQ ID NO: 307421 - DNA, 20 bp, human
ggagtagcgccgtccccggg

SEQ ID NO: 307422 - DNA, 20 bp, human
gcccggggcccggattgcgg

SEQ ID NO: 307423 - DNA, 20 bp, human
gacttgcggaggtcgcttgg

SEQ ID NO: 307424 - DNA, 20 bp, human
gaggacttgcggaggtcgct

SEQ ID NO: 307425 - DNA, 20 bp, human
gggccccaggggaccgcatc

SEQ ID NO: 307426 - DNA, 20 bp, human
gggagggcgcaaggagtccg

SEQ ID NO: 307427 - DNA, 20 bp, human
ggggaggtgctggccgtcag

SEQ ID NO: 307428 - DNA, 20 bp, human
gcaggggccgccggagactg

SEQ ID NO: 307429 - DNA, 20 bp, human
gaggcacggctggatcgggg

SEQ ID NO: 307430 - DNA, 20 bp, human
gcagaggcacggctggatcg

SEQ ID NO: 307431 - DNA, 20 bp, human
ggcgagagcgccccagtctc

SEQ ID NO: 307432 - DNA, 20 bp, human
gcccgggcgagtccattctg

SEQ ID NO: 307433 - DNA, 20 bp, human
gtgggctcggcttacaaccc

SEQ ID NO: 307434 - DNA, 20 bp, human
gacagcggtgacttcactct

SEQ ID NO: 307435 - DNA, 20 bp, human
ggcgcaaggagtccggggtg

SEQ ID NO: 307436 - DNA, 20 bp, human
gacaaagcccacaccggcca

SEQ ID NO: 307437 - DNA, 20 bp, human
gagagtcgatgtcggattta

SEQ ID NO: 307438 - DNA, 20 bp, human
gcacaccggccacggggtgg

SEQ ID NO: 307439 - DNA, 20 bp, human
gggtggaggagagtcgatgt

SEQ ID NO: 307440 - DNA, 20 bp, human
ggcccacaccggccacgggg

SEQ ID NO: 307441 - DNA, 20 bp, human
gtgaaccaagcccagggccg

SEQ ID NO: 307442 - DNA, 20 bp, human
gcggggctgaaccaagccca

SEQ ID NO: 307443 - DNA, 20 bp, human
gcggaaaaggagggtcgtgg

SEQ ID NO: 307444 - DNA, 20 bp, human
gcggagagcgccatctccgg

SEQ ID NO: 307445 - DNA, 20 bp, human
gcgatgtcggatttagggcg

SEQ ID NO: 307446 - DNA, 20 bp, human
ggcacctcgcccggactccg

SEQ ID NO: 307447 - DNA, 20 bp, human
ggccccgcgcgggtcctcca

SEQ ID NO: 307448 - DNA, 20 bp, human
gggccggggacgctggttgg

SEQ ID NO: 307449 - DNA, 20 bp, human
gctcctccaaccagcgtccc

SEQ ID NO: 307450 - DNA, 20 bp, human
gcacggggacgtctgcacga

SEQ ID NO: 307451 - DNA, 20 bp, human
gtcactgccgggcgctggtt

SEQ ID NO: 307452 - DNA, 20 bp, human
gcacctcgtgacacgccctg

SEQ ID NO: 307453 - DNA, 20 bp, human
gtccgccgtcgggtgctgat

SEQ ID NO: 307454 - DNA, 20 bp, human
gcccgcgccgccgcggagtc

SEQ ID NO: 307455 - DNA, 20 bp, human
ggccccggtcagcaccccgt

SEQ ID NO: 307456 - DNA, 20 bp, human
ggcaggggccgtgacgtcag

SEQ ID NO: 307457 - DNA, 20 bp, human
gagctcccggccaggccggt

SEQ ID NO: 307458 - DNA, 20 bp, human
gagcggggcgcggtgctgta

SEQ ID NO: 307459 - DNA, 20 bp, human
gcccgcggatcccaccggcc

SEQ ID NO: 307460 - DNA, 20 bp, human
ggtcagaggaagccgggctt

SEQ ID NO: 307461 - DNA, 20 bp, human
ggggcttcgggccggaagcg

SEQ ID NO: 307462 - DNA, 20 bp, human
gtcccgccctccagccggag

SEQ ID NO: 307463 - DNA, 20 bp, human
gacgggcgcagcctcggcag

SEQ ID NO: 307464 - DNA, 20 bp, human
gccggaagcgcgggtgagcc

SEQ ID NO: 307465 - DNA, 20 bp, human
ggcggccgggattgaggcgc

SEQ ID NO: 307466 - DNA, 20 bp, human
gaaccccggcccaggacctc

SEQ ID NO: 307467 - DNA, 20 bp, human
gccgagtggccatggcgctc

SEQ ID NO: 307468 - DNA, 20 bp, human
gcgcccgaggtcctgggccg

SEQ ID NO: 307469 - DNA, 20 bp, human
gggggcgggccgatggaggg

SEQ ID NO: 307470 - DNA, 20 bp, human
gcccgcgccactgaaaggcc

SEQ ID NO: 307471 - DNA, 20 bp, human
gtcgcccccgggcctttcag

SEQ ID NO: 307472 - DNA, 20 bp, human
gcggcggcagcggcggagaa

SEQ ID NO: 307473 - DNA, 20 bp, human
gcgggtgcgcgcagtgcacg

SEQ ID NO: 307474 - DNA, 20 bp, human
ggcgccactgaaaggcccgg

SEQ ID NO: 307475 - DNA, 20 bp, human
ggagcccgctctccctgcga

SEQ ID NO: 307476 - DNA, 20 bp, human
gtgcagggaaaggcctgggt

SEQ ID NO: 307477 - DNA, 20 bp, human
gcgttccggaagtccccgac

SEQ ID NO: 307478 - DNA, 20 bp, human
ggcgccgcttctccagtgca

SEQ ID NO: 307479 - DNA, 20 bp, human
gaggagcggtagcttcccgc

SEQ ID NO: 307480 - DNA, 20 bp, human
gtttccctgcactggagaag

SEQ ID NO: 307481 - DNA, 20 bp, human
gccagaggctccttcccggt

SEQ ID NO: 307482 - DNA, 20 bp, human
gcggaagtccccgaccggga

SEQ ID NO: 307483 - DNA, 20 bp, human
gtcaaggcaagtccaggcac

SEQ ID NO: 307484 - DNA, 20 bp, human
gcggtagcttcccgcggggc

SEQ ID NO: 307485 - DNA, 20 bp, human
gtccagtgcagggaaaggcc

SEQ ID NO: 307486 - DNA, 20 bp, human
gttggcttaaggcttttcaa

SEQ ID NO: 307487 - DNA, 20 bp, human
gaggcctagacagagagctc

SEQ ID NO: 307488 - DNA, 20 bp, human
gagaactagctaagaaaagg

SEQ ID NO: 307489 - DNA, 20 bp, human
ggaaccttgccagtctgtgg

SEQ ID NO: 307490 - DNA, 20 bp, human
gggaaggcagactcttgcca

SEQ ID NO: 307491 - DNA, 20 bp, human
ggtctgaggcaaggggaatt

SEQ ID NO: 307492 - DNA, 20 bp, human
gacagctaactgcagaaatg

SEQ ID NO: 307493 - DNA, 20 bp, human
gcaccctgagctctctgtct

SEQ ID NO: 307494 - DNA, 20 bp, human
gaaaggaagccaccacagac

SEQ ID NO: 307495 - DNA, 20 bp, human
ggaagatggctccacaacaa

SEQ ID NO: 307496 - DNA, 20 bp, human
ggccggtccttaaaggggag

SEQ ID NO: 307497 - DNA, 20 bp, human
gggaggatcgcggagtaggc

SEQ ID NO: 307498 - DNA, 20 bp, human
gccttaaaggggaggacgcg

SEQ ID NO: 307499 - DNA, 20 bp, human
gggatcgcggagtaggctgg

SEQ ID NO: 307500 - DNA, 20 bp, human
ggctgggaggatcgcggagt

SEQ ID NO: 307501 - DNA, 20 bp, human
ggcctggggaggcgtggcgt

SEQ ID NO: 307502 - DNA, 20 bp, human
gtccggggccggtccttaaa

SEQ ID NO: 307503 - DNA, 20 bp, human
gacgcgcggtgccgggagct

SEQ ID NO: 307504 - DNA, 20 bp, human
gcggcagcgaattgggagag

SEQ ID NO: 307505 - DNA, 20 bp, human
ggctaagaagcccagacaat

SEQ ID NO: 307506 - DNA, 20 bp, human
gccccgagccggaacaaaat

SEQ ID NO: 307507 - DNA, 20 bp, human
gaggaggcgtggcttcccga

SEQ ID NO: 307508 - DNA, 20 bp, human
gatgacgcgcagggagcggg

SEQ ID NO: 307509 - DNA, 20 bp, human
ggggcccgcctggcccttta

SEQ ID NO: 307510 - DNA, 20 bp, human
gacctagcggggccccaagt

SEQ ID NO: 307511 - DNA, 20 bp, human
gcggaacaaaataggaggcg

SEQ ID NO: 307512 - DNA, 20 bp, human
gcgagccggaacaaaatagg

SEQ ID NO: 307513 - DNA, 20 bp, human
gcccgctaggtcagccttaa

SEQ ID NO: 307514 - DNA, 20 bp, human
gccagtacaggggcctccct

SEQ ID NO: 307515 - DNA, 20 bp, human
gcagccttaaagggccaggc

SEQ ID NO: 307516 - DNA, 20 bp, human
gcgggtgcgcggttcggggg

SEQ ID NO: 307517 - DNA, 20 bp, human
ggctgcgctaatgacgtcat

SEQ ID NO: 307518 - DNA, 20 bp, human
gcaggggcctgtcctgtatg

SEQ ID NO: 307519 - DNA, 20 bp, human
gagtcgggtgcgcggttcgg

SEQ ID NO: 307520 - DNA, 20 bp, human
gcaggcggacgcctgcaagt

SEQ ID NO: 307521 - DNA, 20 bp, human
gggcggctcggaaaccccag

SEQ ID NO: 307522 - DNA, 20 bp, human
gtggaaaacgctcttctgag

SEQ ID NO: 307523 - DNA, 20 bp, human
gatcgccgcggaaggcccag

SEQ ID NO: 307524 - DNA, 20 bp, human
ggatctgtggaggtcaaccc

SEQ ID NO: 307525 - DNA, 20 bp, human
gcccttgctgccttccgctg

SEQ ID NO: 307526 - DNA, 20 bp, human
gcccaggaagcagacggctt

SEQ ID NO: 307527 - DNA, 20 bp, human
gggacgagcaaggtttacgg

SEQ ID NO: 307528 - DNA, 20 bp, human
gcaggccgcgcccctcgcgt

SEQ ID NO: 307529 - DNA, 20 bp, human
gaagcagacggcttgggact

SEQ ID NO: 307530 - DNA, 20 bp, human
gaggggcgcggcctgtagtc

SEQ ID NO: 307531 - DNA, 20 bp, human
gtgggcggagccgacgcgag

SEQ ID NO: 307532 - DNA, 20 bp, human
ggaggcgtggttatcgtctt

SEQ ID NO: 307533 - DNA, 20 bp, human
ggggggcggagccaatgaaa

SEQ ID NO: 307534 - DNA, 20 bp, human
gaaaccttgctcgtccactc

SEQ ID NO: 307535 - DNA, 20 bp, human
ggaagcgctctcctgactac

SEQ ID NO: 307536 - DNA, 20 bp, human
gccacgtgccgcagtcgccc

SEQ ID NO: 307537 - DNA, 20 bp, human
gctcagttacaaaatcccta

SEQ ID NO: 307538 - DNA, 20 bp, human
gggccgaggcgggacctcat

SEQ ID NO: 307539 - DNA, 20 bp, human
gccgaccgccggggcgactg

SEQ ID NO: 307540 - DNA, 20 bp, human
gcccctcggctaccgttctg

SEQ ID NO: 307541 - DNA, 20 bp, human
gctaccgttctgtggatcag

SEQ ID NO: 307542 - DNA, 20 bp, human
gagtcacaccgggccgaggc

SEQ ID NO: 307543 - DNA, 20 bp, human
gtacgtcggcgcgtaacgag

SEQ ID NO: 307544 - DNA, 20 bp, human
gtccacagaacggtagccga

SEQ ID NO: 307545 - DNA, 20 bp, human
gtggtcggtcgcagccaatg

SEQ ID NO: 307546 - DNA, 20 bp, human
gaccggggcaggcctacatc

SEQ ID NO: 307547 - DNA, 20 bp, human
gacaaggcgagtctgcgagg

SEQ ID NO: 307548 - DNA, 20 bp, human
gacctcgcctcaattcgcac

SEQ ID NO: 307549 - DNA, 20 bp, human
gcgcgaccctgtgcgaattg

SEQ ID NO: 307550 - DNA, 20 bp, human
ggcagctgacgtcagagcgc

SEQ ID NO: 307551 - DNA, 20 bp, human
gcagcagcaccctggtcacg

SEQ ID NO: 307552 - DNA, 20 bp, human
gccctgtgcgaattgaggcg

SEQ ID NO: 307553 - DNA, 20 bp, human
gggcgaggtgatgagttagc

SEQ ID NO: 307554 - DNA, 20 bp, human
gtcggaaaggaaatggttag

SEQ ID NO: 307555 - DNA, 20 bp, human
ggcggggcgcgagcgagagc

SEQ ID NO: 307556 - DNA, 20 bp, human
ggcgctggccggactctctc

SEQ ID NO: 307557 - DNA, 20 bp, human
gacagcgtcttcaggcgggt

SEQ ID NO: 307558 - DNA, 20 bp, human
gctggccggactctctcggg

SEQ ID NO: 307559 - DNA, 20 bp, human
ggagtccacccgagagagtc

SEQ ID NO: 307560 - DNA, 20 bp, human
gtgcaggtgggcgccccact

SEQ ID NO: 307561 - DNA, 20 bp, human
gtgcgagtcacgtgcgacag

SEQ ID NO: 307562 - DNA, 20 bp, human
gcggctcggacctgcccagt

SEQ ID NO: 307563 - DNA, 20 bp, human
gggggcttgcacaccaactg

SEQ ID NO: 307564 - DNA, 20 bp, human
gggcctgagacagcgtcttc

SEQ ID NO: 307565 - DNA, 20 bp, human
gctcgggtggactcccggag

SEQ ID NO: 307566 - DNA, 20 bp, human
gctaaggcaaggtggaggta

SEQ ID NO: 307567 - DNA, 20 bp, human
gcctcccgccgcaatcgcta

SEQ ID NO: 307568 - DNA, 20 bp, human
ggggctgttcccagttgcta

SEQ ID NO: 307569 - DNA, 20 bp, human
gagggcacccgccgtctcca

SEQ ID NO: 307570 - DNA, 20 bp, human
gggcggggggcgacaggaac

SEQ ID NO: 307571 - DNA, 20 bp, human
gtccaaggcaactgagccgc

SEQ ID NO: 307572 - DNA, 20 bp, human
gggtaggggctgtcctcccg

SEQ ID NO: 307573 - DNA, 20 bp, human
gacgtgtgcggcggtaccga

SEQ ID NO: 307574 - DNA, 20 bp, human
gagaccgcttcagacgtgtg

SEQ ID NO: 307575 - DNA, 20 bp, human
gccgccgctgtcagtccgag

SEQ ID NO: 307576 - DNA, 20 bp, human
gggaacgagccgggagacgc

SEQ ID NO: 307577 - DNA, 20 bp, human
gcactagtggccggaggaga

SEQ ID NO: 307578 - DNA, 20 bp, human
ggcctgaggcgtagcgggag

SEQ ID NO: 307579 - DNA, 20 bp, human
ggaggagaaggctcccgcgg

SEQ ID NO: 307580 - DNA, 20 bp, human
gtctcccggctcgttcctct

SEQ ID NO: 307581 - DNA, 20 bp, human
gagcgccgagaggaacgagc

SEQ ID NO: 307582 - DNA, 20 bp, human
ggggaacgcgagcctcccca

SEQ ID NO: 307583 - DNA, 20 bp, human
ggcgcgcgcccactagtggc

SEQ ID NO: 307584 - DNA, 20 bp, human
gcgcgcccactagtggccgg

SEQ ID NO: 307585 - DNA, 20 bp, human
gcgggagggggaccgcgaaa

SEQ ID NO: 307586 - DNA, 20 bp, human
gtgcagcgatcgtggggtgg

SEQ ID NO: 307587 - DNA, 20 bp, human
gcagtggggcgccgaccaag

SEQ ID NO: 307588 - DNA, 20 bp, human
gagcccctgggcagactgag

SEQ ID NO: 307589 - DNA, 20 bp, human
gagagcagtgcgtccttctg

SEQ ID NO: 307590 - DNA, 20 bp, human
ggcacagcgccctgcagcgc

SEQ ID NO: 307591 - DNA, 20 bp, human
gctgcagcgcaggcgacgga

SEQ ID NO: 307592 - DNA, 20 bp, human
gtggtcacttgcagcgatcg

SEQ ID NO: 307593 - DNA, 20 bp, human
gcgccctgcagcgcaggcga

SEQ ID NO: 307594 - DNA, 20 bp, human
gcctgggaatagtggagagc

SEQ ID NO: 307595 - DNA, 20 bp, human
gcggaaggttgcagaggcag

SEQ ID NO: 307596 - DNA, 20 bp, human
gaacccgccttcacgttctg

SEQ ID NO: 307597 - DNA, 20 bp, human
gggtaactgtcgtgttgtag

SEQ ID NO: 307598 - DNA, 20 bp, human
ggcagtattagcagagaagg

SEQ ID NO: 307599 - DNA, 20 bp, human
ggctgaaggtcatgttgcat

SEQ ID NO: 307600 - DNA, 20 bp, human
gttaggcggcagcggagggt

SEQ ID NO: 307601 - DNA, 20 bp, human
gcaaagcaagcgagctaatg

SEQ ID NO: 307602 - DNA, 20 bp, human
gaactgtcgtgttgtagggg

SEQ ID NO: 307603 - DNA, 20 bp, human
gacagcggcgggggtaccct

SEQ ID NO: 307604 - DNA, 20 bp, human
ggtgaaggcgggttgcccaa

SEQ ID NO: 307605 - DNA, 20 bp, human
gagcaagcgagctaatgggg

SEQ ID NO: 307606 - DNA, 20 bp, human
gaaaaccaggggttacaagg

SEQ ID NO: 307607 - DNA, 20 bp, human
gaaaaaaaccaggggttaca

SEQ ID NO: 307608 - DNA, 20 bp, human
ggaaaataacacttagaacc

SEQ ID NO: 307609 - DNA, 20 bp, human
ggaaatatgtagatattatc

SEQ ID NO: 307610 - DNA, 20 bp, human
ggtagatattatcaggaacc

SEQ ID NO: 307611 - DNA, 20 bp, human
gggcctgtattcgatttatt

SEQ ID NO: 307612 - DNA, 20 bp, human
gcaagaaataagaatagacc

SEQ ID NO: 307613 - DNA, 20 bp, human
gagccgaataaatcgaatac

SEQ ID NO: 307614 - DNA, 20 bp, human
gtgacaaatattactcattc

SEQ ID NO: 307615 - DNA, 20 bp, human
gcgatttattcggcttctgt

SEQ ID NO: 307616 - DNA, 20 bp, human
gtgggccgggtgggcgcggt

SEQ ID NO: 307617 - DNA, 20 bp, human
gaggctccgagggtgtatgt

SEQ ID NO: 307618 - DNA, 20 bp, human
gttccactggatgacatcat

SEQ ID NO: 307619 - DNA, 20 bp, human
gaggggagtctgcggaaagc

SEQ ID NO: 307620 - DNA, 20 bp, human
gtgcggaaagcaggctccga

SEQ ID NO: 307621 - DNA, 20 bp, human
gaggtgccccatctcggtga

SEQ ID NO: 307622 - DNA, 20 bp, human
gtaggtgtccatcaccgaga

SEQ ID NO: 307623 - DNA, 20 bp, human
gaaactgatggcagatgcca

SEQ ID NO: 307624 - DNA, 20 bp, human
ggggaacgcagagcaggcgg

SEQ ID NO: 307625 - DNA, 20 bp, human
ggcggggaacgcagagcagg

SEQ ID NO: 307626 - DNA, 20 bp, human
ggagtcagagccacgctggt

SEQ ID NO: 307627 - DNA, 20 bp, human
gcggggaggcgcggttgcta

SEQ ID NO: 307628 - DNA, 20 bp, human
gggcgcccgccggttgccgt

SEQ ID NO: 307629 - DNA, 20 bp, human
ggctgcacctggtcgcgcgg

SEQ ID NO: 307630 - DNA, 20 bp, human
gccccgccccgtgctctcgg

SEQ ID NO: 307631 - DNA, 20 bp, human
gggggtcccaagccagtcgt

SEQ ID NO: 307632 - DNA, 20 bp, human
ggggcgcccacgactggctt

SEQ ID NO: 307633 - DNA, 20 bp, human
gaacgaggcgggctgcagtc

SEQ ID NO: 307634 - DNA, 20 bp, human
gaagccaggcacccagtcag

SEQ ID NO: 307635 - DNA, 20 bp, human
ggcagcccgcctcgttccca

SEQ ID NO: 307636 - DNA, 20 bp, human
ggcgctgcgccgtttggaga

SEQ ID NO: 307637 - DNA, 20 bp, human
gcccgcgctcacgtcggttc

SEQ ID NO: 307638 - DNA, 20 bp, human
ggatcagtgggacggagttc

SEQ ID NO: 307639 - DNA, 20 bp, human
gggagaggggtcatccgccc

SEQ ID NO: 307640 - DNA, 20 bp, human
ggctcacgtcggttccgggg

SEQ ID NO: 307641 - DNA, 20 bp, human
gtgagagccgcgccgcggaa

SEQ ID NO: 307642 - DNA, 20 bp, human
gatggaggcggcgccgaatt

SEQ ID NO: 307643 - DNA, 20 bp, human
ggatccctcagccgcctcca

SEQ ID NO: 307644 - DNA, 20 bp, human
gggcccgcgccacatcccac

SEQ ID NO: 307645 - DNA, 20 bp, human
gctccaagcgcggggagcga

SEQ ID NO: 307646 - DNA, 20 bp, human
ggaggccacagggacgactt

SEQ ID NO: 307647 - DNA, 20 bp, human
gccccctcgtgcctggggcg

SEQ ID NO: 307648 - DNA, 20 bp, human
gtgggggcggagccaagacg

SEQ ID NO: 307649 - DNA, 20 bp, human
gcacgtcccgccctaagagg

SEQ ID NO: 307650 - DNA, 20 bp, human
ggcggcccaagtcgtccctg

SEQ ID NO: 307651 - DNA, 20 bp, human
gagccaagacgcggcagggg

SEQ ID NO: 307652 - DNA, 20 bp, human
ggcggagccaagacgcggca

SEQ ID NO: 307653 - DNA, 20 bp, human
gagccccgccccaggcacga

SEQ ID NO: 307654 - DNA, 20 bp, human
ggcgggacgtgcaaggcgat

SEQ ID NO: 307655 - DNA, 20 bp, human
gcctccggccccgcctctta

SEQ ID NO: 307656 - DNA, 20 bp, human
ggccctgtgggtgttatctc

SEQ ID NO: 307657 - DNA, 20 bp, human
ggacccaagaggaagactgc

SEQ ID NO: 307658 - DNA, 20 bp, human
gccaaaggcagggacccaag

SEQ ID NO: 307659 - DNA, 20 bp, human
gtaaagacctagcctcagaa

SEQ ID NO: 307660 - DNA, 20 bp, human
gagtggccgggcctgacaca

SEQ ID NO: 307661 - DNA, 20 bp, human
ggcctgagataacacccaca

SEQ ID NO: 307662 - DNA, 20 bp, human
ggttctggttgcagggactt

SEQ ID NO: 307663 - DNA, 20 bp, human
gataagcaagtattgcccaa

SEQ ID NO: 307664 - DNA, 20 bp, human
ggggctctttacgggaaggc

SEQ ID NO: 307665 - DNA, 20 bp, human
ggataacacccacagggcag

SEQ ID NO: 307666 - DNA, 20 bp, human
gggacccgagcagctctaga

SEQ ID NO: 307667 - DNA, 20 bp, human
gtgtcggctccgccagtcat

SEQ ID NO: 307668 - DNA, 20 bp, human
ggccgcaggcgactggacgg

SEQ ID NO: 307669 - DNA, 20 bp, human
ggtcccagcgccaccacgac

SEQ ID NO: 307670 - DNA, 20 bp, human
gcgtcccgccagcctgccct

SEQ ID NO: 307671 - DNA, 20 bp, human
gggcgactggacggcggtta

SEQ ID NO: 307672 - DNA, 20 bp, human
gctggacggcggttacgggg

SEQ ID NO: 307673 - DNA, 20 bp, human
gggcgtcatcagcccatgac

SEQ ID NO: 307674 - DNA, 20 bp, human
gtcggccgcaggcgactgga

SEQ ID NO: 307675 - DNA, 20 bp, human
ggggctggctccgcccctag

SEQ ID NO: 307676 - DNA, 20 bp, human
ggtgctgaatgcagcagcgg

SEQ ID NO: 307677 - DNA, 20 bp, human
gaccccgcgcgtcacgctcg

SEQ ID NO: 307678 - DNA, 20 bp, human
gcctccgcggcgtctgcgtc

SEQ ID NO: 307679 - DNA, 20 bp, human
gtgacgcgcggggtctgggt

SEQ ID NO: 307680 - DNA, 20 bp, human
ggggagctgtccactcgccc

SEQ ID NO: 307681 - DNA, 20 bp, human
ggggcctgacgcagacgccg

SEQ ID NO: 307682 - DNA, 20 bp, human
gcccacgagcgtgacgcgcg

SEQ ID NO: 307683 - DNA, 20 bp, human
gagcgtgacgcgcggggtct

SEQ ID NO: 307684 - DNA, 20 bp, human
gaaggttcttgcagcgaggg

SEQ ID NO: 307685 - DNA, 20 bp, human
ggctgctgcattcagcaccc

SEQ ID NO: 307686 - DNA, 20 bp, human
ggcggcaggcgcggaggcgt

SEQ ID NO: 307687 - DNA, 20 bp, human
ggagggcgccggccagacgg

SEQ ID NO: 307688 - DNA, 20 bp, human
gcggaggcgttggtccgggc

SEQ ID NO: 307689 - DNA, 20 bp, human
ggaccggaacctcgggccga

SEQ ID NO: 307690 - DNA, 20 bp, human
gctggaggaaggaaacggga

SEQ ID NO: 307691 - DNA, 20 bp, human
gaggcgcggaggcgttggtc

SEQ ID NO: 307692 - DNA, 20 bp, human
ggcgcctgccgccgtctggc

SEQ ID NO: 307693 - DNA, 20 bp, human
gagaggctgcacagcccgcc

SEQ ID NO: 307694 - DNA, 20 bp, human
ggaaggaaacgggagggcgc

SEQ ID NO: 307695 - DNA, 20 bp, human
gccagggttacgacgcaggg

SEQ ID NO: 307696 - DNA, 20 bp, human
gggaggggcgggaacaccta

SEQ ID NO: 307697 - DNA, 20 bp, human
ggcggggcgccgaggcggaa

SEQ ID NO: 307698 - DNA, 20 bp, human
gcggccgcggcgtgcactgt

SEQ ID NO: 307699 - DNA, 20 bp, human
gaggggaggcacctgcatct

SEQ ID NO: 307700 - DNA, 20 bp, human
gggcgtgcactgtcggtcgg

SEQ ID NO: 307701 - DNA, 20 bp, human
gtcggtcggcggctaaggag

SEQ ID NO: 307702 - DNA, 20 bp, human
gtctcggcgactaccccagg

SEQ ID NO: 307703 - DNA, 20 bp, human
gaaagcgagcgacacgggag

SEQ ID NO: 307704 - DNA, 20 bp, human
gcactgtcggtcggcggcta

SEQ ID NO: 307705 - DNA, 20 bp, human
gaagtgacagcgcctgtcgt

SEQ ID NO: 307706 - DNA, 20 bp, human
gcccgggggcagctcttcaa

SEQ ID NO: 307707 - DNA, 20 bp, human
gtgcccccggggagtcagcg

SEQ ID NO: 307708 - DNA, 20 bp, human
gaggaagtccgcgaagtggg

SEQ ID NO: 307709 - DNA, 20 bp, human
gtcagagcaccaccccgcgg

SEQ ID NO: 307710 - DNA, 20 bp, human
gcgccactggtaagcggcag

SEQ ID NO: 307711 - DNA, 20 bp, human
ggggaggggtaggtcggaaa

SEQ ID NO: 307712 - DNA, 20 bp, human
gggctggaggtaccccaccg

SEQ ID NO: 307713 - DNA, 20 bp, human
gcggggtggtgctctgactg

SEQ ID NO: 307714 - DNA, 20 bp, human
ggaggggcacttaacggtgg

SEQ ID NO: 307715 - DNA, 20 bp, human
gtggctcagagactatagac

SEQ ID NO: 307716 - DNA, 20 bp, human
ggacgcgggcgtcacgtgtc

SEQ ID NO: 307717 - DNA, 20 bp, human
ggcaacgcctccacccaact

SEQ ID NO: 307718 - DNA, 20 bp, human
gaaggggtggaagcacagaa

SEQ ID NO: 307719 - DNA, 20 bp, human
ggcccaggcgacaacccact

SEQ ID NO: 307720 - DNA, 20 bp, human
ggtcgcctgggcactgcgaa

SEQ ID NO: 307721 - DNA, 20 bp, human
gcccagcgcgctgcagtcgc

SEQ ID NO: 307722 - DNA, 20 bp, human
gtcctcccgcggaggggcgt

SEQ ID NO: 307723 - DNA, 20 bp, human
gtcacgtgtccggccgagtt

SEQ ID NO: 307724 - DNA, 20 bp, human
gcgggaggacaccgagtggc

SEQ ID NO: 307725 - DNA, 20 bp, human
gaggggcgtagggtgtaaac

SEQ ID NO: 307726 - DNA, 20 bp, human
gccggggagcgggtgaagga

SEQ ID NO: 307727 - DNA, 20 bp, human
gcaagtgtgggatcccgagg

SEQ ID NO: 307728 - DNA, 20 bp, human
gcctgggacacctgctcgtg

SEQ ID NO: 307729 - DNA, 20 bp, human
ggggcaagtgtgggatcccg

SEQ ID NO: 307730 - DNA, 20 bp, human
gggctgaaaagtgtgatcga

SEQ ID NO: 307731 - DNA, 20 bp, human
gaggtgtgagggaggtacat

SEQ ID NO: 307732 - DNA, 20 bp, human
gacacctgctcgtgcggggc

SEQ ID NO: 307733 - DNA, 20 bp, human
gcacacttgcccccgcccct

SEQ ID NO: 307734 - DNA, 20 bp, human
gggtgaggcttgtgcaaaat

SEQ ID NO: 307735 - DNA, 20 bp, human
ggggaggtaggcgtgctaaa

SEQ ID NO: 307736 - DNA, 20 bp, human
gcccaagtgcacagatgaat

SEQ ID NO: 307737 - DNA, 20 bp, human
gacgcggcccccgcgcgcgt

SEQ ID NO: 307738 - DNA, 20 bp, human
gctgcgcgcctggcgaacaa

SEQ ID NO: 307739 - DNA, 20 bp, human
gcatctgtgcacttgggcgt

SEQ ID NO: 307740 - DNA, 20 bp, human
ggcgccgcacacaaagcagg

SEQ ID NO: 307741 - DNA, 20 bp, human
ggacattaattctcggtctg

SEQ ID NO: 307742 - DNA, 20 bp, human
ggggctcgcgggcgctgacg

SEQ ID NO: 307743 - DNA, 20 bp, human
ggaggggggtacttgtgcat

SEQ ID NO: 307744 - DNA, 20 bp, human
gcacagatgaatgggctcgc

SEQ ID NO: 307745 - DNA, 20 bp, human
gtaaacacacggaaagatgg

SEQ ID NO: 307746 - DNA, 20 bp, human
gtcaagcgggagactgccag

SEQ ID NO: 307747 - DNA, 20 bp, human
ggccagtcctcccgcgagct

SEQ ID NO: 307748 - DNA, 20 bp, human
gtgcccctgggattcgggtg

SEQ ID NO: 307749 - DNA, 20 bp, human
gcccaggggcaggtagagtc

SEQ ID NO: 307750 - DNA, 20 bp, human
ggggcaggtagagtccggtg

SEQ ID NO: 307751 - DNA, 20 bp, human
gccaccccacccgaatccca

SEQ ID NO: 307752 - DNA, 20 bp, human
ggcgcagcaggcgacgctgg

SEQ ID NO: 307753 - DNA, 20 bp, human
gggggcgcccaccggagagg

SEQ ID NO: 307754 - DNA, 20 bp, human
ggtcgcctgctgcgcaagtg

SEQ ID NO: 307755 - DNA, 20 bp, human
gtaaatgcgcgcccaatcga

SEQ ID NO: 307756 - DNA, 20 bp, human
gacagtgctgctgcttgtta

SEQ ID NO: 307757 - DNA, 20 bp, human
ggagtgacgggtgcattcag

SEQ ID NO: 307758 - DNA, 20 bp, human
ggtccaatcctgatcatgtc

SEQ ID NO: 307759 - DNA, 20 bp, human
gacaagcagcagcactgtgt

SEQ ID NO: 307760 - DNA, 20 bp, human
gaccagctgcagtggttcga

SEQ ID NO: 307761 - DNA, 20 bp, human
ggccaaccaagccctgccat

SEQ ID NO: 307762 - DNA, 20 bp, human
ggtgctgctgcttgttaagg

SEQ ID NO: 307763 - DNA, 20 bp, human
gtgggacagagagctgagtc

SEQ ID NO: 307764 - DNA, 20 bp, human
ggctttgggacacaagttac

SEQ ID NO: 307765 - DNA, 20 bp, human
gctgcagtggttcgatggga

SEQ ID NO: 307766 - DNA, 20 bp, human
gaaaaggaggggtaggatcc

SEQ ID NO: 307767 - DNA, 20 bp, human
gcggccccgcatccctaatg

SEQ ID NO: 307768 - DNA, 20 bp, human
gcaggcgggcaagagagcgc

SEQ ID NO: 307769 - DNA, 20 bp, human
gagggtgaccctgaacctaa

SEQ ID NO: 307770 - DNA, 20 bp, human
gtcccccggcgcgaatgtct

SEQ ID NO: 307771 - DNA, 20 bp, human
gccgccgccgcgcctcagtc

SEQ ID NO: 307772 - DNA, 20 bp, human
ggccccacccgcagagttta

SEQ ID NO: 307773 - DNA, 20 bp, human
ggggcggcgccgtacacctg

SEQ ID NO: 307774 - DNA, 20 bp, human
ggggccgctcctcctgactg

SEQ ID NO: 307775 - DNA, 20 bp, human
ggaccgtaaactctgcgggt

SEQ ID NO: 307776 - DNA, 20 bp, human
gtcctcccggccacagacta

SEQ ID NO: 307777 - DNA, 20 bp, human
gagagccgaagcttcgtctt

SEQ ID NO: 307778 - DNA, 20 bp, human
gtggctggatggccgtggac

SEQ ID NO: 307779 - DNA, 20 bp, human
gacagactacgggtgaattc

SEQ ID NO: 307780 - DNA, 20 bp, human
ggaggaggagagcgcgtccc

SEQ ID NO: 307781 - DNA, 20 bp, human
gccccggggtttaccttctt

SEQ ID NO: 307782 - DNA, 20 bp, human
gaaacgaccgggtgctcgga

SEQ ID NO: 307783 - DNA, 20 bp, human
gcggctagaaacgggaggtg

SEQ ID NO: 307784 - DNA, 20 bp, human
gcagccggaaacatccgaag

SEQ ID NO: 307785 - DNA, 20 bp, human
gtcacccgtagtctgtggcc

SEQ ID NO: 307786 - DNA, 20 bp, human
gtacccagcaaagcaccttg

SEQ ID NO: 307787 - DNA, 20 bp, human
gaacagctggcgagaggtcg

SEQ ID NO: 307788 - DNA, 20 bp, human
gcctccccaaggtgctttgc

SEQ ID NO: 307789 - DNA, 20 bp, human
ggtggggctgcccacttccg

SEQ ID NO: 307790 - DNA, 20 bp, human
gaggagactcactgcagcca

SEQ ID NO: 307791 - DNA, 20 bp, human
gggcaggtgggacctgggta

SEQ ID NO: 307792 - DNA, 20 bp, human
gcaccccctcaagaacgaag

SEQ ID NO: 307793 - DNA, 20 bp, human
gctccccacttcgttcttga

SEQ ID NO: 307794 - DNA, 20 bp, human
gacaaagcctccaatagggc

SEQ ID NO: 307795 - DNA, 20 bp, human
gtcctccccagccctattgg

SEQ ID NO: 307796 - DNA, 20 bp, human
ggggctggatagtgctggtc

SEQ ID NO: 307797 - DNA, 20 bp, human
gggcccggctgttgttgcta

SEQ ID NO: 307798 - DNA, 20 bp, human
gggtccagacctcgccgcgg

SEQ ID NO: 307799 - DNA, 20 bp, human
ggcagagggctggatagtgc

SEQ ID NO: 307800 - DNA, 20 bp, human
gccgcccccgcggcgaggtc

SEQ ID NO: 307801 - DNA, 20 bp, human
gcgcagcccgcgggagtcag

SEQ ID NO: 307802 - DNA, 20 bp, human
gggtctccgctgactcccgc

SEQ ID NO: 307803 - DNA, 20 bp, human
gggctgccggaagtgacgac

SEQ ID NO: 307804 - DNA, 20 bp, human
gggagtcccgccaatcagca

SEQ ID NO: 307805 - DNA, 20 bp, human
gcagcatggcctgagaaagc

SEQ ID NO: 307806 - DNA, 20 bp, human
gcagccacataactgttcag

SEQ ID NO: 307807 - DNA, 20 bp, human
gacgggctgtagtgaggctc

SEQ ID NO: 307808 - DNA, 20 bp, human
gaaagtatctagcacttcaa

SEQ ID NO: 307809 - DNA, 20 bp, human
gcgtggctgtcatataaaat

SEQ ID NO: 307810 - DNA, 20 bp, human
gttccccctgaacagttatg

SEQ ID NO: 307811 - DNA, 20 bp, human
gcgggaatccagattctcta

SEQ ID NO: 307812 - DNA, 20 bp, human
gactacagcccgtgcagcag

SEQ ID NO: 307813 - DNA, 20 bp, human
gtattgcagcacacgtcaca

SEQ ID NO: 307814 - DNA, 20 bp, human
ggagtaaaagggctaccttc

SEQ ID NO: 307815 - DNA, 20 bp, human
ggaagttcaattgagtgttc

SEQ ID NO: 307816 - DNA, 20 bp, human
gccagtgcgcctctcgtctc

SEQ ID NO: 307817 - DNA, 20 bp, human
gccccgccgccggcccttaa

SEQ ID NO: 307818 - DNA, 20 bp, human
ggcgagaacacgctccccgc

SEQ ID NO: 307819 - DNA, 20 bp, human
gcgcaggcccgggctggtcg

SEQ ID NO: 307820 - DNA, 20 bp, human
gtaaaggcgcaggcccgggc

SEQ ID NO: 307821 - DNA, 20 bp, human
ggaggcgggtctgggcacgc

SEQ ID NO: 307822 - DNA, 20 bp, human
ggagaggcgcaaggagatga

SEQ ID NO: 307823 - DNA, 20 bp, human
ggacgagaggcgcactggag

SEQ ID NO: 307824 - DNA, 20 bp, human
gtgttctcgcccgagacgag

SEQ ID NO: 307825 - DNA, 20 bp, human
ggaagggacgtcagggggag

SEQ ID NO: 307826 - DNA, 20 bp, human
gactgccctggcaccgctac

SEQ ID NO: 307827 - DNA, 20 bp, human
gatgaagaggccgcagatgc

SEQ ID NO: 307828 - DNA, 20 bp, human
ggcagtctagcccgcatctg

SEQ ID NO: 307829 - DNA, 20 bp, human
gaggccgctgaactcagaag

SEQ ID NO: 307830 - DNA, 20 bp, human
gaatacggaactccatttcc

SEQ ID NO: 307831 - DNA, 20 bp, human
gaatccctcgctgatgcaac

SEQ ID NO: 307832 - DNA, 20 bp, human
gtgtcttagcgttgcatgat

SEQ ID NO: 307833 - DNA, 20 bp, human
gggagaaatagtctactttc

SEQ ID NO: 307834 - DNA, 20 bp, human
ggttccggttgcatcagcga

SEQ ID NO: 307835 - DNA, 20 bp, human
gcgctgaactcagaagcggg

SEQ ID NO: 307836 - DNA, 20 bp, human
gagaggccgccaatggacgg

SEQ ID NO: 307837 - DNA, 20 bp, human
ggctcggggccgcgtttcat

SEQ ID NO: 307838 - DNA, 20 bp, human
gccggaaagccaatgaaacg

SEQ ID NO: 307839 - DNA, 20 bp, human
gccgaaagccgcggcgccag

SEQ ID NO: 307840 - DNA, 20 bp, human
ggcggctttcggcgtgcgga

SEQ ID NO: 307841 - DNA, 20 bp, human
gctggcaagccgccgtccat

SEQ ID NO: 307842 - DNA, 20 bp, human
gcaactctgagctgtttttc

SEQ ID NO: 307843 - DNA, 20 bp, human
ggcaagccgccgtccattgg

SEQ ID NO: 307844 - DNA, 20 bp, human
gagtatgccagccacggacg

SEQ ID NO: 307845 - DNA, 20 bp, human
gttctgacagcacgtgtgag

SEQ ID NO: 307846 - DNA, 20 bp, human
ggcctggcgcagaggggaaa

SEQ ID NO: 307847 - DNA, 20 bp, human
gcgggggaggagacagccga

SEQ ID NO: 307848 - DNA, 20 bp, human
gagggcggaaggcccgcgtc

SEQ ID NO: 307849 - DNA, 20 bp, human
gcacgggcggacagggcgga

SEQ ID NO: 307850 - DNA, 20 bp, human
gtgccctggcccgaggacga

SEQ ID NO: 307851 - DNA, 20 bp, human
ggacgaaggaatccgagctg

SEQ ID NO: 307852 - DNA, 20 bp, human
gaggcccggggtgggcgcta

SEQ ID NO: 307853 - DNA, 20 bp, human
gcggaaggcccgcgtcgggc

SEQ ID NO: 307854 - DNA, 20 bp, human
gacttggcgcagcagcgcac

SEQ ID NO: 307855 - DNA, 20 bp, human
ggcaggggcggccccagatg

SEQ ID NO: 307856 - DNA, 20 bp, human
gtgggcccagagcggttgtc

SEQ ID NO: 307857 - DNA, 20 bp, human
gtggtggcaccgagcagcct

SEQ ID NO: 307858 - DNA, 20 bp, human
ggccaccagccggcacgtcg

SEQ ID NO: 307859 - DNA, 20 bp, human
ggatccgggcggggcaaagc

SEQ ID NO: 307860 - DNA, 20 bp, human
gtcggcccgacaaccgctct

SEQ ID NO: 307861 - DNA, 20 bp, human
gttgccccgcccggatctgt

SEQ ID NO: 307862 - DNA, 20 bp, human
ggctgctcggtgccaccagc

SEQ ID NO: 307863 - DNA, 20 bp, human
gggtaagtgggaccggggtg

SEQ ID NO: 307864 - DNA, 20 bp, human
gcggggtggggccacgtgac

SEQ ID NO: 307865 - DNA, 20 bp, human
ggccgcgacgtgccggctgg

SEQ ID NO: 307866 - DNA, 20 bp, human
gaacgggcgccctcaggggg

SEQ ID NO: 307867 - DNA, 20 bp, human
ggggtgaatgaatgagtgtc

SEQ ID NO: 307868 - DNA, 20 bp, human
ggagaacgggcgccctcagg

SEQ ID NO: 307869 - DNA, 20 bp, human
gggcggcctgagcgcgtctg

SEQ ID NO: 307870 - DNA, 20 bp, human
gcctgagcgcgtctggggcc

SEQ ID NO: 307871 - DNA, 20 bp, human
ggggcagaaaggtgcggctg

SEQ ID NO: 307872 - DNA, 20 bp, human
gggcctaagggagccaactg

SEQ ID NO: 307873 - DNA, 20 bp, human
gcgctcaggccgccccctga

SEQ ID NO: 307874 - DNA, 20 bp, human
gtcaccaaggggttacttcg

SEQ ID NO: 307875 - DNA, 20 bp, human
gtgagaggatgggtacctct

SEQ ID NO: 307876 - DNA, 20 bp, human
ggggtcccgcacagggcact

SEQ ID NO: 307877 - DNA, 20 bp, human
gtcaggccagaactggaaat

SEQ ID NO: 307878 - DNA, 20 bp, human
gctggaaatgggtcccgcac

SEQ ID NO: 307879 - DNA, 20 bp, human
ggtaaggagagggagtgcct

SEQ ID NO: 307880 - DNA, 20 bp, human
gttgtggcttagtgccaaaa

SEQ ID NO: 307881 - DNA, 20 bp, human
gatcagttctcagtcttatc

SEQ ID NO: 307882 - DNA, 20 bp, human
ggtggccgagtgccctgtgc

SEQ ID NO: 307883 - DNA, 20 bp, human
gcctccattcatttgcctga

SEQ ID NO: 307884 - DNA, 20 bp, human
gctggcctgagctttcctaa

SEQ ID NO: 307885 - DNA, 20 bp, human
gctatatcattgtgtgcttg

SEQ ID NO: 307886 - DNA, 20 bp, human
gcaggagatgtgttagggga

SEQ ID NO: 307887 - DNA, 20 bp, human
gacaacaggagatgtgttag

SEQ ID NO: 307888 - DNA, 20 bp, human
gagacccaatatcttgttgt

SEQ ID NO: 307889 - DNA, 20 bp, human
gctggggcatcctgtacaac

SEQ ID NO: 307890 - DNA, 20 bp, human
gactacatatcagagtggat

SEQ ID NO: 307891 - DNA, 20 bp, human
ggtgtctcatgagtagaacc

SEQ ID NO: 307892 - DNA, 20 bp, human
ggtgcccaacaacaagatat

SEQ ID NO: 307893 - DNA, 20 bp, human
gccagcctaggaaaatgtag

SEQ ID NO: 307894 - DNA, 20 bp, human
gttgttgttgggcactaatg

SEQ ID NO: 307895 - DNA, 20 bp, human
gggaatagaacacccattgt

SEQ ID NO: 307896 - DNA, 20 bp, human
gggggaaggcgtgacctgaa

SEQ ID NO: 307897 - DNA, 20 bp, human
ggggagaggggatctgttgc

SEQ ID NO: 307898 - DNA, 20 bp, human
gtctgtctgcaaataactac

SEQ ID NO: 307899 - DNA, 20 bp, human
gaagcaccaagtcctgaagt

SEQ ID NO: 307900 - DNA, 20 bp, human
gcaggggtgtagaaagacct

SEQ ID NO: 307901 - DNA, 20 bp, human
gccttgagagaaaataactg

SEQ ID NO: 307902 - DNA, 20 bp, human
gaggagcagatcttttcggt

SEQ ID NO: 307903 - DNA, 20 bp, human
gggacctcagaacaaagata

SEQ ID NO: 307904 - DNA, 20 bp, human
gtatttgcagacagacgctc

SEQ ID NO: 307905 - DNA, 20 bp, human
ggaggggatctgttgcaggc

SEQ ID NO: 307906 - DNA, 20 bp, human
gcctgcctggaactctgagc

SEQ ID NO: 307907 - DNA, 20 bp, human
ggttacctaggtccgactcc

SEQ ID NO: 307908 - DNA, 20 bp, human
gagagccaggatttgtttcc

SEQ ID NO: 307909 - DNA, 20 bp, human
gcctggaactctgagcaggc

SEQ ID NO: 307910 - DNA, 20 bp, human
ggcaccaggtccttctgaca

SEQ ID NO: 307911 - DNA, 20 bp, human
gaaaccctgtcagaaggacc

SEQ ID NO: 307912 - DNA, 20 bp, human
gaattagccagcctgaggct

SEQ ID NO: 307913 - DNA, 20 bp, human
gggagccaggagtcggacct

SEQ ID NO: 307914 - DNA, 20 bp, human
gcaaaaaaaagggaggggtg

SEQ ID NO: 307915 - DNA, 20 bp, human
gtgctctgggagccaggagt

SEQ ID NO: 307916 - DNA, 20 bp, human
gcccaccccggcgggagaag

SEQ ID NO: 307917 - DNA, 20 bp, human
gcaaaggggcaaaacgatga

SEQ ID NO: 307918 - DNA, 20 bp, human
ggcgccccgcctgtgtacgt

SEQ ID NO: 307919 - DNA, 20 bp, human
gctggggagagacgtggcgg

SEQ ID NO: 307920 - DNA, 20 bp, human
gagcctggggagagacgtgg

SEQ ID NO: 307921 - DNA, 20 bp, human
gaccccggcgggagaagggg

SEQ ID NO: 307922 - DNA, 20 bp, human
gtggccgccccttctcccgc

SEQ ID NO: 307923 - DNA, 20 bp, human
gagggggcgctgctgcgtgc

SEQ ID NO: 307924 - DNA, 20 bp, human
gagcagaagcagggtaagac

SEQ ID NO: 307925 - DNA, 20 bp, human
ggggcaggggcaaatccttc

SEQ ID NO: 307926 - DNA, 20 bp, human
ggggcgcccagacgcagtga

SEQ ID NO: 307927 - DNA, 20 bp, human
gcggcgccgtcactgcgtct

SEQ ID NO: 307928 - DNA, 20 bp, human
ggcgggggcggagcgaagtg

SEQ ID NO: 307929 - DNA, 20 bp, human
gcccccgccagcgcgggcag

SEQ ID NO: 307930 - DNA, 20 bp, human
gaccgctgcccgcgctggcg

SEQ ID NO: 307931 - DNA, 20 bp, human
gtctgggggatgaatgtaga

SEQ ID NO: 307932 - DNA, 20 bp, human
ggcgtctgggcgcccgagcc

SEQ ID NO: 307933 - DNA, 20 bp, human
gccagaggagagatattctc

SEQ ID NO: 307934 - DNA, 20 bp, human
gtcaccaagggggtctctgg

SEQ ID NO: 307935 - DNA, 20 bp, human
gagcctcctggtgcccccat

SEQ ID NO: 307936 - DNA, 20 bp, human
gggccctggcgcgcagtcgg

SEQ ID NO: 307937 - DNA, 20 bp, human
ggtcctttgcgaccgttcgc

SEQ ID NO: 307938 - DNA, 20 bp, human
gcagaagcgagcggggctct

SEQ ID NO: 307939 - DNA, 20 bp, human
gcgccagcgaacggtcgcaa

SEQ ID NO: 307940 - DNA, 20 bp, human
gtcggaggaccagaagcgag

SEQ ID NO: 307941 - DNA, 20 bp, human
gggcgcgccgtcagcggctg

SEQ ID NO: 307942 - DNA, 20 bp, human
gcgtggccctggcgcgcagt

SEQ ID NO: 307943 - DNA, 20 bp, human
gggcccagcagtttcatgaa

SEQ ID NO: 307944 - DNA, 20 bp, human
ggtcgcaaaggacccgcccg

SEQ ID NO: 307945 - DNA, 20 bp, human
ggtcctccgactgcgcgcca

SEQ ID NO: 307946 - DNA, 20 bp, human
gggggcggggccctgtggtc

SEQ ID NO: 307947 - DNA, 20 bp, human
ggggccagctcgcccagtgg

SEQ ID NO: 307948 - DNA, 20 bp, human
gtcccggggagcccgaccac

SEQ ID NO: 307949 - DNA, 20 bp, human
gccctgtggtcgggctcccc

SEQ ID NO: 307950 - DNA, 20 bp, human
gccccgccgccaggtgccat

SEQ ID NO: 307951 - DNA, 20 bp, human
gccgcccccactgggcgagc

SEQ ID NO: 307952 - DNA, 20 bp, human
gacttctgcgctctgctgga

SEQ ID NO: 307953 - DNA, 20 bp, human
gccaggccggtcagctgaca

SEQ ID NO: 307954 - DNA, 20 bp, human
gtgcgcccggccaatgcgct

SEQ ID NO: 307955 - DNA, 20 bp, human
gatgctgccttacttctgag

SEQ ID NO: 307956 - DNA, 20 bp, human
gagcccagaatcggagccaa

SEQ ID NO: 307957 - DNA, 20 bp, human
ggcgacgcctccggccatga

SEQ ID NO: 307958 - DNA, 20 bp, human
ggagactccgaacttagcgg

SEQ ID NO: 307959 - DNA, 20 bp, human
gagcccttggctccgattct

SEQ ID NO: 307960 - DNA, 20 bp, human
ggccatgagggcctcaggta

SEQ ID NO: 307961 - DNA, 20 bp, human
ggcagggcaggcgcgctggt

SEQ ID NO: 307962 - DNA, 20 bp, human
gcgagcggatggtgagacct

SEQ ID NO: 307963 - DNA, 20 bp, human
gagcgcgcctgccctgccat

SEQ ID NO: 307964 - DNA, 20 bp, human
gaccgtccttgggacgtcag

SEQ ID NO: 307965 - DNA, 20 bp, human
gtggtcccgctggagcgcct

SEQ ID NO: 307966 - DNA, 20 bp, human
ggccgcccacgaagagtgta

SEQ ID NO: 307967 - DNA, 20 bp, human
gagggtgggaggtcgtgtat

SEQ ID NO: 307968 - DNA, 20 bp, human
ggcagccttacactcttcgt

SEQ ID NO: 307969 - DNA, 20 bp, human
gaatgatgtcagtggggccg

SEQ ID NO: 307970 - DNA, 20 bp, human
gatgaggaatgatgtcagtg

SEQ ID NO: 307971 - DNA, 20 bp, human
gtgcgtaggggaggtgacga

SEQ ID NO: 307972 - DNA, 20 bp, human
gcctccgtccgcgtctgcgt

SEQ ID NO: 307973 - DNA, 20 bp, human
gttctgggccgaccagaaaa

SEQ ID NO: 307974 - DNA, 20 bp, human
gagtgtaaggctgcgaagtc

SEQ ID NO: 307975 - DNA, 20 bp, human
gtaggggaggtgacgagggc

SEQ ID NO: 307976 - DNA, 20 bp, human
gtaagcacctggtcaaggta

SEQ ID NO: 307977 - DNA, 20 bp, human
gaggggacacccaacagcaa

SEQ ID NO: 307978 - DNA, 20 bp, human
ggcaagctgtggcaagctgg

SEQ ID NO: 307979 - DNA, 20 bp, human
ggtaagaagacccccctctt

SEQ ID NO: 307980 - DNA, 20 bp, human
ggagggagtggatggaacac

SEQ ID NO: 307981 - DNA, 20 bp, human
gagctgaaggagagtcccaa

SEQ ID NO: 307982 - DNA, 20 bp, human
gagacccccctcttaggaaa

SEQ ID NO: 307983 - DNA, 20 bp, human
gggtcaaggtaaggtaaaga

SEQ ID NO: 307984 - DNA, 20 bp, human
gcctgagcgactcctatata

SEQ ID NO: 307985 - DNA, 20 bp, human
gcaaggtgggttgtgaactc

SEQ ID NO: 307986 - DNA, 20 bp, human
gacctccgggaaagctatcc

SEQ ID NO: 307987 - DNA, 20 bp, human
ggggaggtgccgtggcaatc

SEQ ID NO: 307988 - DNA, 20 bp, human
gccaatgcaccacttgcgcg

SEQ ID NO: 307989 - DNA, 20 bp, human
gagctcgccccgcggagtcc

SEQ ID NO: 307990 - DNA, 20 bp, human
gcagacgcgaggagacgtgg

SEQ ID NO: 307991 - DNA, 20 bp, human
gaggtcgcgtcccccagcgg

SEQ ID NO: 307992 - DNA, 20 bp, human
gtagctgaacggtctctgga

SEQ ID NO: 307993 - DNA, 20 bp, human
ggtgggagaaaaagcgactg

SEQ ID NO: 307994 - DNA, 20 bp, human
gcgggctgaaccacactgcg

SEQ ID NO: 307995 - DNA, 20 bp, human
gtggttcagcccggactccg

SEQ ID NO: 307996 - DNA, 20 bp, human
gcgctttaagcatcggcgcg

SEQ ID NO: 307997 - DNA, 20 bp, human
gcgtacccgccctctttctg

SEQ ID NO: 307998 - DNA, 20 bp, human
gccgccgacgccccagaaag

SEQ ID NO: 307999 - DNA, 20 bp, human
gtaagcatcggcgcgtgggc

SEQ ID NO: 308000 - DNA, 20 bp, human
gaaagaaaggccctgacctt

SEQ ID NO: 308001 - DNA, 20 bp, human
gcgtggccaatcaacgggcg

SEQ ID NO: 308002 - DNA, 20 bp, human
gcggagcgtggccaatcaac

SEQ ID NO: 308003 - DNA, 20 bp, human
gcggcgagcggggtcgttct

SEQ ID NO: 308004 - DNA, 20 bp, human
gcgccctctttctggggcgt

SEQ ID NO: 308005 - DNA, 20 bp, human
gcaatcaacgggcgcggcta

SEQ ID NO: 308006 - DNA, 20 bp, human
gtctccacatggcagtaagc

SEQ ID NO: 308007 - DNA, 20 bp, human
ggagaactgcacgagattcc

SEQ ID NO: 308008 - DNA, 20 bp, human
gctaccagcttactgccatg

SEQ ID NO: 308009 - DNA, 20 bp, human
ggaagctgctcctcacgttt

SEQ ID NO: 308010 - DNA, 20 bp, human
gaaacatgaaacttctcatt

SEQ ID NO: 308011 - DNA, 20 bp, human
ggcaggcacgccaaaacgtg

SEQ ID NO: 308012 - DNA, 20 bp, human
gggtattttcgagactacta

SEQ ID NO: 308013 - DNA, 20 bp, human
ggcgtgcctgcgctctctgc

SEQ ID NO: 308014 - DNA, 20 bp, human
gaatcttgacaggaagttgt

SEQ ID NO: 308015 - DNA, 20 bp, human
gttaattgccagtcaagcct

SEQ ID NO: 308016 - DNA, 20 bp, human
gcggcggggaccgggggtga

SEQ ID NO: 308017 - DNA, 20 bp, human
ggaaccccgcttcccagggt

SEQ ID NO: 308018 - DNA, 20 bp, human
gagagtgagctgcccgtccg

SEQ ID NO: 308019 - DNA, 20 bp, human
gcgccccgggaccccgcccg

SEQ ID NO: 308020 - DNA, 20 bp, human
ggcctcccgcgcgccccggg

SEQ ID NO: 308021 - DNA, 20 bp, human
gaagaagggtcggggagtgg

SEQ ID NO: 308022 - DNA, 20 bp, human
gcgtctcagagggctattgg

SEQ ID NO: 308023 - DNA, 20 bp, human
gcgcacgcgggctccacgcc

SEQ ID NO: 308024 - DNA, 20 bp, human
ggccaagcccggactcccag

SEQ ID NO: 308025 - DNA, 20 bp, human
gccggcgctaggacccgcgg

SEQ ID NO: 308026 - DNA, 20 bp, human
gcggggcttgggctgaatgg

SEQ ID NO: 308027 - DNA, 20 bp, human
ggaggtgtgtgtgccctgag

SEQ ID NO: 308028 - DNA, 20 bp, human
gaaggagcccttgtggtcag

SEQ ID NO: 308029 - DNA, 20 bp, human
gaggctctcccgccctctca

SEQ ID NO: 308030 - DNA, 20 bp, human
gcaagccccgccctttgggg

SEQ ID NO: 308031 - DNA, 20 bp, human
gcagcccaagccccgccctt

SEQ ID NO: 308032 - DNA, 20 bp, human
ggggccgggccattggactc

SEQ ID NO: 308033 - DNA, 20 bp, human
gtgggaaatctcaggtgggt

SEQ ID NO: 308034 - DNA, 20 bp, human
gggcccccagcccccccaaa

SEQ ID NO: 308035 - DNA, 20 bp, human
gcccaactgacgactgacgt

SEQ ID NO: 308036 - DNA, 20 bp, human
ggggacaaggacagcaagac

SEQ ID NO: 308037 - DNA, 20 bp, human
ggcagccgaagctaagggat

SEQ ID NO: 308038 - DNA, 20 bp, human
gcagccccatcccttagctt

SEQ ID NO: 308039 - DNA, 20 bp, human
ggtcccttgggcatccacat

SEQ ID NO: 308040 - DNA, 20 bp, human
gaggacagcaagacgggaga

SEQ ID NO: 308041 - DNA, 20 bp, human
gtggaccagggaaccgacgg

SEQ ID NO: 308042 - DNA, 20 bp, human
gccagggtccccggtcttac

SEQ ID NO: 308043 - DNA, 20 bp, human
ggggatccggtggttccaca

SEQ ID NO: 308044 - DNA, 20 bp, human
ggctgggtggggggatccgg

SEQ ID NO: 308045 - DNA, 20 bp, human
gcatgggagtggccctccgt

SEQ ID NO: 308046 - DNA, 20 bp, human
ggatggggaaggcgcggaga

SEQ ID NO: 308047 - DNA, 20 bp, human
gccagagtgcccagctcccg

SEQ ID NO: 308048 - DNA, 20 bp, human
gaggaggggtgtcctctttg

SEQ ID NO: 308049 - DNA, 20 bp, human
gagcgggccgggcggaagga

SEQ ID NO: 308050 - DNA, 20 bp, human
gaacttggggtcatgacctg

SEQ ID NO: 308051 - DNA, 20 bp, human
ggcacccactgacgcgggga

SEQ ID NO: 308052 - DNA, 20 bp, human
gggaacacaggcagctttag

SEQ ID NO: 308053 - DNA, 20 bp, human
gggctcaggcacggacggag

SEQ ID NO: 308054 - DNA, 20 bp, human
ggggtccggagccgcaggca

SEQ ID NO: 308055 - DNA, 20 bp, human
gcccgcactcccaacccgac

SEQ ID NO: 308056 - DNA, 20 bp, human
ggggctacttaagctctcaa

SEQ ID NO: 308057 - DNA, 20 bp, human
gttaagtagcccccgttggt

SEQ ID NO: 308058 - DNA, 20 bp, human
gaagaagagcctaccaacgg

SEQ ID NO: 308059 - DNA, 20 bp, human
gtccaagaagagcctaccaa

SEQ ID NO: 308060 - DNA, 20 bp, human
gttcttggacgctccgagca

SEQ ID NO: 308061 - DNA, 20 bp, human
ggtgttggcacagtggttat

SEQ ID NO: 308062 - DNA, 20 bp, human
gagggcagggtgagatttcc

SEQ ID NO: 308063 - DNA, 20 bp, human
gcaaaggccaaacacacaaa

SEQ ID NO: 308064 - DNA, 20 bp, human
gcaactatgcatgccctgct

SEQ ID NO: 308065 - DNA, 20 bp, human
ggagcttaagtagcccccgt

SEQ ID NO: 308066 - DNA, 20 bp, human
gggtccccatcccgtacctg

SEQ ID NO: 308067 - DNA, 20 bp, human
ggtacgggatggggacccct

SEQ ID NO: 308068 - DNA, 20 bp, human
gcaggccccgctggggtggg

SEQ ID NO: 308069 - DNA, 20 bp, human
gtgcgccccaggtacgggat

SEQ ID NO: 308070 - DNA, 20 bp, human
gggctcggggcttagggcag

SEQ ID NO: 308071 - DNA, 20 bp, human
ggcagccggctcggggctta

SEQ ID NO: 308072 - DNA, 20 bp, human
ggggcctgcgccccaggtac

SEQ ID NO: 308073 - DNA, 20 bp, human
gccccgagccggctgcaact

SEQ ID NO: 308074 - DNA, 20 bp, human
gcacccagttgcagccggct

SEQ ID NO: 308075 - DNA, 20 bp, human
ggggcaaaccagtggcagaa

SEQ ID NO: 308076 - DNA, 20 bp, human
gtccaagcgtggtaggagca

SEQ ID NO: 308077 - DNA, 20 bp, human
ggcagggagcaagtagagga

SEQ ID NO: 308078 - DNA, 20 bp, human
gcagctacagcgggagactg

SEQ ID NO: 308079 - DNA, 20 bp, human
gacgcttggagctgcagaca

SEQ ID NO: 308080 - DNA, 20 bp, human
gccaaggggtggagcggtcc

SEQ ID NO: 308081 - DNA, 20 bp, human
ggcaacccctcccactggca

SEQ ID NO: 308082 - DNA, 20 bp, human
gctccacagccggaattcat

SEQ ID NO: 308083 - DNA, 20 bp, human
gtccctccctgccagtggga

SEQ ID NO: 308084 - DNA, 20 bp, human
ggaattccggctgtggagtg

SEQ ID NO: 308085 - DNA, 20 bp, human
gtgccccccctcaggaggaa

SEQ ID NO: 308086 - DNA, 20 bp, human
gggtgcgcgcgctgagtagg

SEQ ID NO: 308087 - DNA, 20 bp, human
ggcgcgccgaaccagatcga

SEQ ID NO: 308088 - DNA, 20 bp, human
gccaccccctcgatctggtt

SEQ ID NO: 308089 - DNA, 20 bp, human
ggcaggcgagtgcacgagcg

SEQ ID NO: 308090 - DNA, 20 bp, human
ggcgcgcgctgagtaggggg

SEQ ID NO: 308091 - DNA, 20 bp, human
gatgacggagagggatctcc

SEQ ID NO: 308092 - DNA, 20 bp, human
gcctctccgtcatccagctg

SEQ ID NO: 308093 - DNA, 20 bp, human
gcgaggtgcgcgcgctgagt

SEQ ID NO: 308094 - DNA, 20 bp, human
gcgcccccaccccctcgatc

SEQ ID NO: 308095 - DNA, 20 bp, human
gtctcccagcgagcgggacg

SEQ ID NO: 308096 - DNA, 20 bp, human
ggctccgggaaggtgtaaaa

SEQ ID NO: 308097 - DNA, 20 bp, human
gaatagggcgagtctgaccg

SEQ ID NO: 308098 - DNA, 20 bp, human
gagggcgagtctgaccgagg

SEQ ID NO: 308099 - DNA, 20 bp, human
gggacttaggcatcgctgat

SEQ ID NO: 308100 - DNA, 20 bp, human
gtgctccggcgccccttaag

SEQ ID NO: 308101 - DNA, 20 bp, human
gaggcgatgcacactataac

SEQ ID NO: 308102 - DNA, 20 bp, human
gcggggccgggctctcctcg

SEQ ID NO: 308103 - DNA, 20 bp, human
gcgccggagcattgtgggat

SEQ ID NO: 308104 - DNA, 20 bp, human
ggaagcaggcgcgcgagacg

SEQ ID NO: 308105 - DNA, 20 bp, human
gtataacagggccccttaag

SEQ ID NO: 308106 - DNA, 20 bp, human
gcggcctcggagtcatcggg

SEQ ID NO: 308107 - DNA, 20 bp, human
gggtcgggaagcgctagact

SEQ ID NO: 308108 - DNA, 20 bp, human
ggcgcagcggggacggtcac

SEQ ID NO: 308109 - DNA, 20 bp, human
gcagtctcgagcaacttcca

SEQ ID NO: 308110 - DNA, 20 bp, human
ggtcactgggccttggtttg

SEQ ID NO: 308111 - DNA, 20 bp, human
ggggccttggtttgcgggtc

SEQ ID NO: 308112 - DNA, 20 bp, human
ggcaacttccaggggaagtc

SEQ ID NO: 308113 - DNA, 20 bp, human
gcacctgcctggtttctggc

SEQ ID NO: 308114 - DNA, 20 bp, human
gaggaggggctgcttcactt

SEQ ID NO: 308115 - DNA, 20 bp, human
gcttcccgacccgcaaacca

SEQ ID NO: 308116 - DNA, 20 bp, human
gtacaacagggttggggggt

SEQ ID NO: 308117 - DNA, 20 bp, human
gtcacacattacaacagggt

SEQ ID NO: 308118 - DNA, 20 bp, human
ggggagtggggctggacaaa

SEQ ID NO: 308119 - DNA, 20 bp, human
gacagatcacacattacaac

SEQ ID NO: 308120 - DNA, 20 bp, human
gactttgggaggccaatttg

SEQ ID NO: 308121 - DNA, 20 bp, human
gcctcggcctcccaagtttg

SEQ ID NO: 308122 - DNA, 20 bp, human
gcacattacaacagggttgg

SEQ ID NO: 308123 - DNA, 20 bp, human
gaagagatggggtctcgggc

SEQ ID NO: 308124 - DNA, 20 bp, human
gtgtaatccccaaacttggg

SEQ ID NO: 308125 - DNA, 20 bp, human
gcacctgtaatccccaaact

SEQ ID NO: 308126 - DNA, 20 bp, human
gcggcccccgccacgtgacc

SEQ ID NO: 308127 - DNA, 20 bp, human
gcgcctgcgcgtcccgggga

SEQ ID NO: 308128 - DNA, 20 bp, human
gacccgggccgtctgttaga

SEQ ID NO: 308129 - DNA, 20 bp, human
gtccctctaacagacggccc

SEQ ID NO: 308130 - DNA, 20 bp, human
gcgccagcccggcttgttga

SEQ ID NO: 308131 - DNA, 20 bp, human
gggacaagaactacaagtct

SEQ ID NO: 308132 - DNA, 20 bp, human
gcatccaggcgacgccagcc

SEQ ID NO: 308133 - DNA, 20 bp, human
gcctggatgcggtttcttcc

SEQ ID NO: 308134 - DNA, 20 bp, human
gtgggctccgtcaacaagcc

SEQ ID NO: 308135 - DNA, 20 bp, human
gcaaggcgcctgcgcgtccc

SEQ ID NO: 308136 - DNA, 20 bp, human
gccagccggcgcctcgggga

SEQ ID NO: 308137 - DNA, 20 bp, human
gcaccgggcgcgcggagggg

SEQ ID NO: 308138 - DNA, 20 bp, human
ggggggagggagttgttacc

SEQ ID NO: 308139 - DNA, 20 bp, human
ggcgcccagccggcgcctcg

SEQ ID NO: 308140 - DNA, 20 bp, human
ggggacagctgcgcgcgcac

SEQ ID NO: 308141 - DNA, 20 bp, human
gggcgacgccccctgggtgg

SEQ ID NO: 308142 - DNA, 20 bp, human
ggggatccatggcggaggga

SEQ ID NO: 308143 - DNA, 20 bp, human
gagcacactacgcgcgggga

SEQ ID NO: 308144 - DNA, 20 bp, human
gtgctgggatccatggcgga

SEQ ID NO: 308145 - DNA, 20 bp, human
ggtggctcgcgctcaccctg

SEQ ID NO: 308146 - DNA, 20 bp, human
ggaaaagattagaccctccc

SEQ ID NO: 308147 - DNA, 20 bp, human
gtggcgaggcaggacagctc

SEQ ID NO: 308148 - DNA, 20 bp, human
gcacatgggaagctatttta

SEQ ID NO: 308149 - DNA, 20 bp, human
gcagctcaggccacaggggg

SEQ ID NO: 308150 - DNA, 20 bp, human
gaaacatgacaggtcctctt

SEQ ID NO: 308151 - DNA, 20 bp, human
gccatgtgagggctagagaa

SEQ ID NO: 308152 - DNA, 20 bp, human
gggccagccggggcacctgg

SEQ ID NO: 308153 - DNA, 20 bp, human
gtctgtggtgccctttctgt

SEQ ID NO: 308154 - DNA, 20 bp, human
gatgacaggtcctcttggga

SEQ ID NO: 308155 - DNA, 20 bp, human
gtgggaagctattttagggc

SEQ ID NO: 308156 - DNA, 20 bp, human
gccagcctggggttcccctt

SEQ ID NO: 308157 - DNA, 20 bp, human
ggccgcggccagcctcttcg

SEQ ID NO: 308158 - DNA, 20 bp, human
ggtcttaagaagatgaggta

SEQ ID NO: 308159 - DNA, 20 bp, human
gccccaggctgggaagtcgc

SEQ ID NO: 308160 - DNA, 20 bp, human
gtgtaacctcagcatccgag

SEQ ID NO: 308161 - DNA, 20 bp, human
gtcttcttaagacaggggca

SEQ ID NO: 308162 - DNA, 20 bp, human
gcctcttcgcggcatgggcg

SEQ ID NO: 308163 - DNA, 20 bp, human
ggacaggggcacggattgcc

SEQ ID NO: 308164 - DNA, 20 bp, human
gcaagagtctgcgacccgaa

SEQ ID NO: 308165 - DNA, 20 bp, human
gcccagcgacttcccagcct

SEQ ID NO: 308166 - DNA, 20 bp, human
gggcgtggggccggagaaaa

SEQ ID NO: 308167 - DNA, 20 bp, human
gtgcagcgagggtgcgtgtg

SEQ ID NO: 308168 - DNA, 20 bp, human
gacgcccagagcgcacggag

SEQ ID NO: 308169 - DNA, 20 bp, human
gcccagagcgcacggagcgg

SEQ ID NO: 308170 - DNA, 20 bp, human
gggttggcgggcgggcgtct

SEQ ID NO: 308171 - DNA, 20 bp, human
ggacagcgcacccagtggaa

SEQ ID NO: 308172 - DNA, 20 bp, human
gtgggaagacgcgcgaggtg

SEQ ID NO: 308173 - DNA, 20 bp, human
gaaagcctgggagcctgcga

SEQ ID NO: 308174 - DNA, 20 bp, human
gggacgcgcagcatcggggc

SEQ ID NO: 308175 - DNA, 20 bp, human
gtaaatggagacgctggtgc

SEQ ID NO: 308176 - DNA, 20 bp, human
ggcaactgccagtccctcga

SEQ ID NO: 308177 - DNA, 20 bp, human
gcgctcccacagctgttcgg

SEQ ID NO: 308178 - DNA, 20 bp, human
gtccttgccgcgttcggtat

SEQ ID NO: 308179 - DNA, 20 bp, human
ggaagggaagcggtcgggga

SEQ ID NO: 308180 - DNA, 20 bp, human
gaacctgaagggaagcggtc

SEQ ID NO: 308181 - DNA, 20 bp, human
gcaactggctctcggcaggg

SEQ ID NO: 308182 - DNA, 20 bp, human
ggggtctatcctgtgttcgt

SEQ ID NO: 308183 - DNA, 20 bp, human
gggctgtggagaccgcggga

SEQ ID NO: 308184 - DNA, 20 bp, human
gatgtcgcgtgcccttaata

SEQ ID NO: 308185 - DNA, 20 bp, human
gtcgcgtgcccttaataggg

SEQ ID NO: 308186 - DNA, 20 bp, human
gagggggcgtggccccgaga

SEQ ID NO: 308187 - DNA, 20 bp, human
gagcgcttggaggacctaag

SEQ ID NO: 308188 - DNA, 20 bp, human
gccagctccgcgcgcccagt

SEQ ID NO: 308189 - DNA, 20 bp, human
ggggcgtggccccgagaagg

SEQ ID NO: 308190 - DNA, 20 bp, human
gtggaggacctaagaggcgg

SEQ ID NO: 308191 - DNA, 20 bp, human
gggccggaaaagcgcgggag

SEQ ID NO: 308192 - DNA, 20 bp, human
gtaggtcctccaagcgctat

SEQ ID NO: 308193 - DNA, 20 bp, human
gggagctgggaaggttggtc

SEQ ID NO: 308194 - DNA, 20 bp, human
gcgggtctccgggattccaa

SEQ ID NO: 308195 - DNA, 20 bp, human
ggtggccggggccacgcccc

SEQ ID NO: 308196 - DNA, 20 bp, human
gctcgccagcccccgctcgg

SEQ ID NO: 308197 - DNA, 20 bp, human
ggattggcggggccgtagag

SEQ ID NO: 308198 - DNA, 20 bp, human
gcaggcgcgcacgccactta

SEQ ID NO: 308199 - DNA, 20 bp, human
gggccagagtccccaagact

SEQ ID NO: 308200 - DNA, 20 bp, human
gctcccagcgcgctgattgg

SEQ ID NO: 308201 - DNA, 20 bp, human
gagagacagggcacagtaaa

SEQ ID NO: 308202 - DNA, 20 bp, human
gccatgcccccgcccctcta

SEQ ID NO: 308203 - DNA, 20 bp, human
ggctgtgcccggagtccgcg

SEQ ID NO: 308204 - DNA, 20 bp, human
ggaagtcgaggtccagtcac

SEQ ID NO: 308205 - DNA, 20 bp, human
gcgcggggagggggccgaaa

SEQ ID NO: 308206 - DNA, 20 bp, human
gtgtcatgagagggagtatc

SEQ ID NO: 308207 - DNA, 20 bp, human
ggagcatttaagagtgacaa

SEQ ID NO: 308208 - DNA, 20 bp, human
gaggtcagacctatccccag

SEQ ID NO: 308209 - DNA, 20 bp, human
gaaacaaggagggggtttgc

SEQ ID NO: 308210 - DNA, 20 bp, human
gtgcttcctgggacatcatc

SEQ ID NO: 308211 - DNA, 20 bp, human
gaaatagtactcaaacaagg

SEQ ID NO: 308212 - DNA, 20 bp, human
gggggtttgcaggatgatga

SEQ ID NO: 308213 - DNA, 20 bp, human
gataaaatagtactcaaaca

SEQ ID NO: 308214 - DNA, 20 bp, human
gataggtctgacctgcttcc

SEQ ID NO: 308215 - DNA, 20 bp, human
gcaccatgcctggctgtttg

SEQ ID NO: 308216 - DNA, 20 bp, human
gcggggcggtaccgtgggag

SEQ ID NO: 308217 - DNA, 20 bp, human
ggaagcgcggggcggtaccg

SEQ ID NO: 308218 - DNA, 20 bp, human
ggccgactcgcggggacgga

SEQ ID NO: 308219 - DNA, 20 bp, human
gtccctccgtccccgcgagt

SEQ ID NO: 308220 - DNA, 20 bp, human
ggccaaaagcgccgactcgc

SEQ ID NO: 308221 - DNA, 20 bp, human
gtgcgctgcacgtccccttc

SEQ ID NO: 308222 - DNA, 20 bp, human
gctcggtgagcgactggcgg

SEQ ID NO: 308223 - DNA, 20 bp, human
gcctctccccagaccggaag

SEQ ID NO: 308224 - DNA, 20 bp, human
ggccgggctcggtgagcgac

SEQ ID NO: 308225 - DNA, 20 bp, human
ggggctcgggtccgagtcca

SEQ ID NO: 308226 - DNA, 20 bp, human
gggagacagggcgttcccta

SEQ ID NO: 308227 - DNA, 20 bp, human
gacgccctgtctccacccat

SEQ ID NO: 308228 - DNA, 20 bp, human
gtaccaccccgccacacaca

SEQ ID NO: 308229 - DNA, 20 bp, human
ggaaataagaatggaattgt

SEQ ID NO: 308230 - DNA, 20 bp, human
gtgtgttggtaacaccatat

SEQ ID NO: 308231 - DNA, 20 bp, human
gctagctcctcttttataga

SEQ ID NO: 308232 - DNA, 20 bp, human
gcaaagatgtttgagagaat

SEQ ID NO: 308233 - DNA, 20 bp, human
gcattctacggaaataagaa

SEQ ID NO: 308234 - DNA, 20 bp, human
gaagaatggaattgtcggcc

SEQ ID NO: 308235 - DNA, 20 bp, human
gatcactccctctataaaag

SEQ ID NO: 308236 - DNA, 20 bp, human
gggagacagggtgttccctg

SEQ ID NO: 308237 - DNA, 20 bp, human
gtgtgtaggtaacaccacat

SEQ ID NO: 308238 - DNA, 20 bp, human
gacaccctgtctccgcccat

SEQ ID NO: 308239 - DNA, 20 bp, human
ggaaagtattcaaagatgtt

SEQ ID NO: 308240 - DNA, 20 bp, human
gctctactaacactctgtgt

SEQ ID NO: 308241 - DNA, 20 bp, human
gcaaagatgtttggaaaact

SEQ ID NO: 308242 - DNA, 20 bp, human
ggaatactttctatagaaat

SEQ ID NO: 308243 - DNA, 20 bp, human
gctactttggccgggagagg

SEQ ID NO: 308244 - DNA, 20 bp, human
gtgcaaagaaattactactt

SEQ ID NO: 308245 - DNA, 20 bp, human
gactgtgtgatatattctat

SEQ ID NO: 308246 - DNA, 20 bp, human
gggagacagggtgttccctg

SEQ ID NO: 308247 - DNA, 20 bp, human
gtgtgtaggtaacaccacat

SEQ ID NO: 308248 - DNA, 20 bp, human
gacaccctgtctccgcccat

SEQ ID NO: 308249 - DNA, 20 bp, human
ggaaagtattcaaagatgtt

SEQ ID NO: 308250 - DNA, 20 bp, human
gctctactaacactctgtgt

SEQ ID NO: 308251 - DNA, 20 bp, human
gcaaagatgtttggaaaact

SEQ ID NO: 308252 - DNA, 20 bp, human
ggaatactttctatagaaat

SEQ ID NO: 308253 - DNA, 20 bp, human
gctactttggccgggagagg

SEQ ID NO: 308254 - DNA, 20 bp, human
gtgcaaagaaattactactt

SEQ ID NO: 308255 - DNA, 20 bp, human
gactgtgtgatatattctat

SEQ ID NO: 308256 - DNA, 20 bp, human
gggagacagggtgttccctg

SEQ ID NO: 308257 - DNA, 20 bp, human
gtgtgtaggtaacaccacat

SEQ ID NO: 308258 - DNA, 20 bp, human
gacaccctgtctccgcccat

SEQ ID NO: 308259 - DNA, 20 bp, human
ggaaagtattcaaagatgtt

SEQ ID NO: 308260 - DNA, 20 bp, human
gctctactaacactctgtgt

SEQ ID NO: 308261 - DNA, 20 bp, human
gcaaagatgtttggaaaact

SEQ ID NO: 308262 - DNA, 20 bp, human
ggaatactttctatagaaat

SEQ ID NO: 308263 - DNA, 20 bp, human
gctactttggccgggagagg

SEQ ID NO: 308264 - DNA, 20 bp, human
gtgcaaagaaattactactt

SEQ ID NO: 308265 - DNA, 20 bp, human
gactgtgtgatatattctat

SEQ ID NO: 308266 - DNA, 20 bp, human
gcgcggtaagctgagtgcga

SEQ ID NO: 308267 - DNA, 20 bp, human
ggtaacgcaggtagccaaag

SEQ ID NO: 308268 - DNA, 20 bp, human
gagagcgcgagcgattggtc

SEQ ID NO: 308269 - DNA, 20 bp, human
gcaaccagagcgcgagcgat

SEQ ID NO: 308270 - DNA, 20 bp, human
gcgagcgcgcatgtccgaaa

SEQ ID NO: 308271 - DNA, 20 bp, human
gccctggcaacgtacatgcg

SEQ ID NO: 308272 - DNA, 20 bp, human
gtggttgcgctggcgcctta

SEQ ID NO: 308273 - DNA, 20 bp, human
gacgttgccaggggtaacgc

SEQ ID NO: 308274 - DNA, 20 bp, human
ggcaaaagcaatggtggcac

SEQ ID NO: 308275 - DNA, 20 bp, human
ggctcgcgctctggttgcgc

SEQ ID NO: 308276 - DNA, 20 bp, human
ggcgggaggtacaggagcgg

SEQ ID NO: 308277 - DNA, 20 bp, human
gaaagtggaggaacggaagt

SEQ ID NO: 308278 - DNA, 20 bp, human
gacccggaagacattgtagc

SEQ ID NO: 308279 - DNA, 20 bp, human
gcgtcgaggcgctagcgacc

SEQ ID NO: 308280 - DNA, 20 bp, human
ggggcgtggacggagacgaa

SEQ ID NO: 308281 - DNA, 20 bp, human
gctaagggaaagtggaggaa

SEQ ID NO: 308282 - DNA, 20 bp, human
ggaacggaagtgggcgtgga

SEQ ID NO: 308283 - DNA, 20 bp, human
gtcccgctacaatgtcttcc

SEQ ID NO: 308284 - DNA, 20 bp, human
gcgaaaggaggtcacgtgtt

SEQ ID NO: 308285 - DNA, 20 bp, human
gccttcctaagggaaagtgg

SEQ ID NO: 308286 - DNA, 20 bp, human
gccgctgcccggacgggaga

SEQ ID NO: 308287 - DNA, 20 bp, human
gtgcccggacgggagagggg

SEQ ID NO: 308288 - DNA, 20 bp, human
gcctccgccgctgcccggac

SEQ ID NO: 308289 - DNA, 20 bp, human
gttctcttggggattaatgg

SEQ ID NO: 308290 - DNA, 20 bp, human
gcagcgacgagccaactgga

SEQ ID NO: 308291 - DNA, 20 bp, human
gcccccccgccctccgcgga

SEQ ID NO: 308292 - DNA, 20 bp, human
gagcctgcgcagtgccttct

SEQ ID NO: 308293 - DNA, 20 bp, human
gtggctcgtcgctgtccgct

SEQ ID NO: 308294 - DNA, 20 bp, human
gaggggctgcagtgcgcatg

SEQ ID NO: 308295 - DNA, 20 bp, human
ggcctcccgcgcatgcgcca

SEQ ID NO: 308296 - DNA, 20 bp, human
gaacacctaggagtcaaggt

SEQ ID NO: 308297 - DNA, 20 bp, human
gtaacatggcggtgtggagt

SEQ ID NO: 308298 - DNA, 20 bp, human
gaggctggaatgctgtgttt

SEQ ID NO: 308299 - DNA, 20 bp, human
gtgacgtaagacacggagtc

SEQ ID NO: 308300 - DNA, 20 bp, human
gactaaagctggaagggagg

SEQ ID NO: 308301 - DNA, 20 bp, human
ggaagcttgctggtcaggga

SEQ ID NO: 308302 - DNA, 20 bp, human
ggcttgtcattcacatagag

SEQ ID NO: 308303 - DNA, 20 bp, human
gccaagcgactaaagctgga

SEQ ID NO: 308304 - DNA, 20 bp, human
gtgtgagcaaatcttggtgg

SEQ ID NO: 308305 - DNA, 20 bp, human
gcggggttgtgagcaaatct

SEQ ID NO: 308306 - DNA, 20 bp, human
gagcagtggggatcctaagg

SEQ ID NO: 308307 - DNA, 20 bp, human
gtagcctgcacccagattgt

SEQ ID NO: 308308 - DNA, 20 bp, human
gcacagatgaacccctcctt

SEQ ID NO: 308309 - DNA, 20 bp, human
ggaagctcctacagacacct

SEQ ID NO: 308310 - DNA, 20 bp, human
ggtgtgagaaaactcaggga

SEQ ID NO: 308311 - DNA, 20 bp, human
gaggcactatgatgagcagt

SEQ ID NO: 308312 - DNA, 20 bp, human
ggcagcaacgccaggtgtct

SEQ ID NO: 308313 - DNA, 20 bp, human
ggccctctgtcctacaatct

SEQ ID NO: 308314 - DNA, 20 bp, human
gctagtcacgcagtgtcaca

SEQ ID NO: 308315 - DNA, 20 bp, human
gaatccccagctagaggcca

SEQ ID NO: 308316 - DNA, 20 bp, human
gagttgctggggttgcggag

SEQ ID NO: 308317 - DNA, 20 bp, human
gctcctcgggcacacggtga

SEQ ID NO: 308318 - DNA, 20 bp, human
ggaaccctcctcaaagctaa

SEQ ID NO: 308319 - DNA, 20 bp, human
gggaactacagctacctccg

SEQ ID NO: 308320 - DNA, 20 bp, human
ggcagtgcaaagaagttgct

SEQ ID NO: 308321 - DNA, 20 bp, human
gcggagaaccgccaggaggc

SEQ ID NO: 308322 - DNA, 20 bp, human
gggagcggagaaccgccagg

SEQ ID NO: 308323 - DNA, 20 bp, human
gtgcggagcggagaaccgcc

SEQ ID NO: 308324 - DNA, 20 bp, human
gaaccaggggttcaagactg

SEQ ID NO: 308325 - DNA, 20 bp, human
gcgccttcaccgtgtgcccg

SEQ ID NO: 308326 - DNA, 20 bp, human
gtcggtgcgcgcttctcccg

SEQ ID NO: 308327 - DNA, 20 bp, human
gagggtagaggggaattaaa

SEQ ID NO: 308328 - DNA, 20 bp, human
gacagcagaggcccgcagtg

SEQ ID NO: 308329 - DNA, 20 bp, human
gagaaagtgtggggcctcgc

SEQ ID NO: 308330 - DNA, 20 bp, human
gccctgcagagccagtgggt

SEQ ID NO: 308331 - DNA, 20 bp, human
gtggggccttcctagggagt

SEQ ID NO: 308332 - DNA, 20 bp, human
gactgccgcccgttccacct

SEQ ID NO: 308333 - DNA, 20 bp, human
gcagaggcccgcagtgaggg

SEQ ID NO: 308334 - DNA, 20 bp, human
gccagctggcgcagaaagtg

SEQ ID NO: 308335 - DNA, 20 bp, human
ggtgccggccggcaaggaaa

SEQ ID NO: 308336 - DNA, 20 bp, human
gcgggcgccgtggatcccct

SEQ ID NO: 308337 - DNA, 20 bp, human
gcgcaagagcgggtcatggg

SEQ ID NO: 308338 - DNA, 20 bp, human
ggatcccctcggcctcccgt

SEQ ID NO: 308339 - DNA, 20 bp, human
gacaggcgaccctgtggccc

SEQ ID NO: 308340 - DNA, 20 bp, human
gagctcgacgagtccgccct

SEQ ID NO: 308341 - DNA, 20 bp, human
ggtgcagcctcttatcgccg

SEQ ID NO: 308342 - DNA, 20 bp, human
ggataccaacgggaggccga

SEQ ID NO: 308343 - DNA, 20 bp, human
ggcccgcaagagcgggtcat

SEQ ID NO: 308344 - DNA, 20 bp, human
gcggttgacaggcgaccctg

SEQ ID NO: 308345 - DNA, 20 bp, human
gcggacagagcccgcaagag

SEQ ID NO: 308346 - DNA, 20 bp, human
gggccagtttcagacgagta

SEQ ID NO: 308347 - DNA, 20 bp, human
ggtctgaaactggccctaat

SEQ ID NO: 308348 - DNA, 20 bp, human
gagccctactcgtctgaaac

SEQ ID NO: 308349 - DNA, 20 bp, human
gtgtgtcagtcatcctatta

SEQ ID NO: 308350 - DNA, 20 bp, human
gacgagtagggctgacgagc

SEQ ID NO: 308351 - DNA, 20 bp, human
ggagctggctggggattggc

SEQ ID NO: 308352 - DNA, 20 bp, human
gccggctgggagggatttgt

SEQ ID NO: 308353 - DNA, 20 bp, human
gctgggagggatttgtcgga

SEQ ID NO: 308354 - DNA, 20 bp, human
gagacaaagtggcacataat

SEQ ID NO: 308355 - DNA, 20 bp, human
gtcgagctggctgtcttcaa

SEQ ID NO: 308356 - DNA, 20 bp, human
gtgtggaatggtctcagatc

SEQ ID NO: 308357 - DNA, 20 bp, human
ggaccattccacaaatcgaa

SEQ ID NO: 308358 - DNA, 20 bp, human
ggggcagggaacggtatggt

SEQ ID NO: 308359 - DNA, 20 bp, human
gcagttggcttcttaagagt

SEQ ID NO: 308360 - DNA, 20 bp, human
gctggctgcccttcgatttg

SEQ ID NO: 308361 - DNA, 20 bp, human
gcacaccaggttcggcgggg

SEQ ID NO: 308362 - DNA, 20 bp, human
gacaagcacaccaggttcgg

SEQ ID NO: 308363 - DNA, 20 bp, human
gtgcccttcgatttgtggaa

SEQ ID NO: 308364 - DNA, 20 bp, human
gtcgttgcaaaatcaagtgg

SEQ ID NO: 308365 - DNA, 20 bp, human
gaattcttttgaaagtctgc

SEQ ID NO: 308366 - DNA, 20 bp, human
gacggccccgagaggaggga

SEQ ID NO: 308367 - DNA, 20 bp, human
gcgggccgggcggcgcttgg

SEQ ID NO: 308368 - DNA, 20 bp, human
gaaagtggggactccgagcc

SEQ ID NO: 308369 - DNA, 20 bp, human
gccaatgggcgcggagagga

SEQ ID NO: 308370 - DNA, 20 bp, human
gtcccggtcggcctcggtgc

SEQ ID NO: 308371 - DNA, 20 bp, human
gcccgagcggccgggccaat

SEQ ID NO: 308372 - DNA, 20 bp, human
ggtcagcccgggaggaggaa

SEQ ID NO: 308373 - DNA, 20 bp, human
gctctcggggccgtcccgag

SEQ ID NO: 308374 - DNA, 20 bp, human
gagagggaaagcgacgccag

SEQ ID NO: 308375 - DNA, 20 bp, human
gaccgaggccgaccgggaga

SEQ ID NO: 308376 - DNA, 20 bp, human
gggaagctgctggaagtcgg

SEQ ID NO: 308377 - DNA, 20 bp, human
gcgccggggcggggacgacg

SEQ ID NO: 308378 - DNA, 20 bp, human
ggtgccgaggacccgggcga

SEQ ID NO: 308379 - DNA, 20 bp, human
gcagctgcgcgacccaatcg

SEQ ID NO: 308380 - DNA, 20 bp, human
ggagcgagagcgcgcgaggt

SEQ ID NO: 308381 - DNA, 20 bp, human
gaacggctggccagcgtcgt

SEQ ID NO: 308382 - DNA, 20 bp, human
gggggggccgcgacattcca

SEQ ID NO: 308383 - DNA, 20 bp, human
gcacccctctctgggagaga

SEQ ID NO: 308384 - DNA, 20 bp, human
gacgctggccagccgttctc

SEQ ID NO: 308385 - DNA, 20 bp, human
ggacgggccgcgcctgtgca

SEQ ID NO: 308386 - DNA, 20 bp, human
gcggggctagggtgagcaaa

SEQ ID NO: 308387 - DNA, 20 bp, human
gaatacgacagcatgatgac

SEQ ID NO: 308388 - DNA, 20 bp, human
gtgattgaggaactgcacta

SEQ ID NO: 308389 - DNA, 20 bp, human
gctgtggacagacaactctg

SEQ ID NO: 308390 - DNA, 20 bp, human
ggagttgtctgtccacagtt

SEQ ID NO: 308391 - DNA, 20 bp, human
gaactctgtggactgaaaag

SEQ ID NO: 308392 - DNA, 20 bp, human
ggcactaaaaacattgcttt

SEQ ID NO: 308393 - DNA, 20 bp, human
gatctggtttagcggggcta

SEQ ID NO: 308394 - DNA, 20 bp, human
gaacattgcttttggaagcg

SEQ ID NO: 308395 - DNA, 20 bp, human
ggacagcatgatgactggaa

SEQ ID NO: 308396 - DNA, 20 bp, human
ggtgcccgaaggaacccgaa

SEQ ID NO: 308397 - DNA, 20 bp, human
ggacccgaaggggaacagac

SEQ ID NO: 308398 - DNA, 20 bp, human
gtctcccttcgggttccttc

SEQ ID NO: 308399 - DNA, 20 bp, human
ggaagcggggccacaaactt

SEQ ID NO: 308400 - DNA, 20 bp, human
ggaccccgcctcattcctca

SEQ ID NO: 308401 - DNA, 20 bp, human
gatgaggcggggtctccctt

SEQ ID NO: 308402 - DNA, 20 bp, human
ggagctcgccgtgaggaatg

SEQ ID NO: 308403 - DNA, 20 bp, human
gtctgtggccccgcccacat

SEQ ID NO: 308404 - DNA, 20 bp, human
ggggtctggagctcgccgtg

SEQ ID NO: 308405 - DNA, 20 bp, human
gacgggctccggaaaggagg

SEQ ID NO: 308406 - DNA, 20 bp, human
gaacaatgggacctcctctc

SEQ ID NO: 308407 - DNA, 20 bp, human
gctaggccaagggctttatg

SEQ ID NO: 308408 - DNA, 20 bp, human
gcagatgcgaaccagaacaa

SEQ ID NO: 308409 - DNA, 20 bp, human
gaaaagaggcggatcaagtg

SEQ ID NO: 308410 - DNA, 20 bp, human
gcatcctgccaggcattctt

SEQ ID NO: 308411 - DNA, 20 bp, human
gcaagtgggggcggctccct

SEQ ID NO: 308412 - DNA, 20 bp, human
ggacccgaagaatgcctggc

SEQ ID NO: 308413 - DNA, 20 bp, human
gtagctccatcctaggccaa

SEQ ID NO: 308414 - DNA, 20 bp, human
gaccgctgtgtcctgagagg

SEQ ID NO: 308415 - DNA, 20 bp, human
ggaggcggatcaagtggggg

SEQ ID NO: 308416 - DNA, 20 bp, human
gaagggtggaaagcgtattg

SEQ ID NO: 308417 - DNA, 20 bp, human
gaggaccgtaccaagacgaa

SEQ ID NO: 308418 - DNA, 20 bp, human
gcgagagaggagggtatgta

SEQ ID NO: 308419 - DNA, 20 bp, human
ggggagcgggagttacgtag

SEQ ID NO: 308420 - DNA, 20 bp, human
gtagggggaagcggcgtgac

SEQ ID NO: 308421 - DNA, 20 bp, human
gtagggaagtgggccaatcg

SEQ ID NO: 308422 - DNA, 20 bp, human
gggaagcggcgtgactggag

SEQ ID NO: 308423 - DNA, 20 bp, human
gcccacggtggaagcgagag

SEQ ID NO: 308424 - DNA, 20 bp, human
gcgggagttacgtagaggga

SEQ ID NO: 308425 - DNA, 20 bp, human
ggggcttgtgtcaagtcaag

SEQ ID NO: 308426 - DNA, 20 bp, human
gtgcgcgctctggacgccgt

SEQ ID NO: 308427 - DNA, 20 bp, human
gacgccgggaggatggacga

SEQ ID NO: 308428 - DNA, 20 bp, human
gacagggcacgctgggtcgg

SEQ ID NO: 308429 - DNA, 20 bp, human
gagaccttcgtccatcctcc

SEQ ID NO: 308430 - DNA, 20 bp, human
gggtctcgcgacatttgcgg

SEQ ID NO: 308431 - DNA, 20 bp, human
ggtgggcagcgggaccacgc

SEQ ID NO: 308432 - DNA, 20 bp, human
gaggcggcgagaacgcgctg

SEQ ID NO: 308433 - DNA, 20 bp, human
gtcgccgcctggcagctcgc

SEQ ID NO: 308434 - DNA, 20 bp, human
ggccggtggcagggtggaag

SEQ ID NO: 308435 - DNA, 20 bp, human
ggcagcgggaccacgccggg

SEQ ID NO: 308436 - DNA, 20 bp, human
gcgctcgggcgctgccgtcc

SEQ ID NO: 308437 - DNA, 20 bp, human
gccaggcagtagttcgaact

SEQ ID NO: 308438 - DNA, 20 bp, human
gcccactggaagagtccggt

SEQ ID NO: 308439 - DNA, 20 bp, human
gtcttccagtggggacatac

SEQ ID NO: 308440 - DNA, 20 bp, human
gtgaccagaactggcgagaa

SEQ ID NO: 308441 - DNA, 20 bp, human
gagtaccggaaatggcacgg

SEQ ID NO: 308442 - DNA, 20 bp, human
gggttcctgagcggatgctg

SEQ ID NO: 308443 - DNA, 20 bp, human
gtcccaccggactcttccag

SEQ ID NO: 308444 - DNA, 20 bp, human
ggacgaccccaaatcctcat

SEQ ID NO: 308445 - DNA, 20 bp, human
gagtcttgtagcgatttctt

SEQ ID NO: 308446 - DNA, 20 bp, human
gggaaaggaggcaacggtgc

SEQ ID NO: 308447 - DNA, 20 bp, human
gctgaagggtggaagcggga

SEQ ID NO: 308448 - DNA, 20 bp, human
gaaaactgaaaaccctgatg

SEQ ID NO: 308449 - DNA, 20 bp, human
gtggcagttgggcgagagac

SEQ ID NO: 308450 - DNA, 20 bp, human
gcatggaggtggcttgtgag

SEQ ID NO: 308451 - DNA, 20 bp, human
ggtcctcacacacatggagg

SEQ ID NO: 308452 - DNA, 20 bp, human
gatggtcagagtttggcagt

SEQ ID NO: 308453 - DNA, 20 bp, human
gcggtgcaggcaccgcatca

SEQ ID NO: 308454 - DNA, 20 bp, human
gattaatgtcctcacacaca

SEQ ID NO: 308455 - DNA, 20 bp, human
gttattattgtcagccatgg

SEQ ID NO: 308456 - DNA, 20 bp, human
gtccggtgatgcatgtgttc

SEQ ID NO: 308457 - DNA, 20 bp, human
ggaaacattgtcataaacat

SEQ ID NO: 308458 - DNA, 20 bp, human
gagtggaccttgggccggga

SEQ ID NO: 308459 - DNA, 20 bp, human
gcatgtgttccggcccttcc

SEQ ID NO: 308460 - DNA, 20 bp, human
gcaagtgcacatatgacgca

SEQ ID NO: 308461 - DNA, 20 bp, human
gaacaatctagctgtatctc

SEQ ID NO: 308462 - DNA, 20 bp, human
ggccggaacacatgcatcac

SEQ ID NO: 308463 - DNA, 20 bp, human
gagaagcattggcagaacac

SEQ ID NO: 308464 - DNA, 20 bp, human
gaataaatgcaactctaaag

SEQ ID NO: 308465 - DNA, 20 bp, human
gtcttgtgaaatagggataa

SEQ ID NO: 308466 - DNA, 20 bp, human
gtgaggagagacaaacagag

SEQ ID NO: 308467 - DNA, 20 bp, human
gtacctgctgtcagtcagag

SEQ ID NO: 308468 - DNA, 20 bp, human
gcagctggtaagagacccta

SEQ ID NO: 308469 - DNA, 20 bp, human
gggaacagaaaacctgccac

SEQ ID NO: 308470 - DNA, 20 bp, human
ggagacagaaggaagacagc

SEQ ID NO: 308471 - DNA, 20 bp, human
gcacctctctgactgacagc

SEQ ID NO: 308472 - DNA, 20 bp, human
gagaggtgcccgatgctcag

SEQ ID NO: 308473 - DNA, 20 bp, human
ggttcccaggtggggaagtg

SEQ ID NO: 308474 - DNA, 20 bp, human
gagcatgcaagtttgtagct

SEQ ID NO: 308475 - DNA, 20 bp, human
gtttgtagcttggagacata

SEQ ID NO: 308476 - DNA, 20 bp, human
gcaatgggagtctgtgagac

SEQ ID NO: 308477 - DNA, 20 bp, human
gtttcagagacacaaattgc

SEQ ID NO: 308478 - DNA, 20 bp, human
gctgaagtcgagaagcaagc

SEQ ID NO: 308479 - DNA, 20 bp, human
gctgaccaatcccaatgcaa

SEQ ID NO: 308480 - DNA, 20 bp, human
gtatcacagaatggcctcta

SEQ ID NO: 308481 - DNA, 20 bp, human
gatggctggaagaactatgt

SEQ ID NO: 308482 - DNA, 20 bp, human
gtcacagactcccattgcat

SEQ ID NO: 308483 - DNA, 20 bp, human
gaaacagatactctgctttt

SEQ ID NO: 308484 - DNA, 20 bp, human
gaaaaaaaacatgttcacgg

SEQ ID NO: 308485 - DNA, 20 bp, human
ggaaacaacttgatccctag

SEQ ID NO: 308486 - DNA, 20 bp, human
ggacctgcgttcctgagacc

SEQ ID NO: 308487 - DNA, 20 bp, human
gtgtccaggggcactcttcc

SEQ ID NO: 308488 - DNA, 20 bp, human
ggggcactcttccaggtctc

SEQ ID NO: 308489 - DNA, 20 bp, human
gaatgtgaacattgggagac

SEQ ID NO: 308490 - DNA, 20 bp, human
gctagtaagatgcatgtgaa

SEQ ID NO: 308491 - DNA, 20 bp, human
gattctaatctgcgtgtcca

SEQ ID NO: 308492 - DNA, 20 bp, human
gagactggctgggattttgt

SEQ ID NO: 308493 - DNA, 20 bp, human
gttccaggtctcaggaacgc

SEQ ID NO: 308494 - DNA, 20 bp, human
gggtctgggcagtcttaaat

SEQ ID NO: 308495 - DNA, 20 bp, human
gaagtgtcaggacaagtgtt

SEQ ID NO: 308496 - DNA, 20 bp, human
gcccgcgcgccgcagcccta

SEQ ID NO: 308497 - DNA, 20 bp, human
gtacctccggcagcgctcct

SEQ ID NO: 308498 - DNA, 20 bp, human
gtcccccaggaggtccccta

SEQ ID NO: 308499 - DNA, 20 bp, human
gtagcccctaggggacctcc

SEQ ID NO: 308500 - DNA, 20 bp, human
gtccggctctggcctacctc

SEQ ID NO: 308501 - DNA, 20 bp, human
ggagcctgggagtccggctc

SEQ ID NO: 308502 - DNA, 20 bp, human
ggcgccgcagccctaggggg

SEQ ID NO: 308503 - DNA, 20 bp, human
gccagccaatgtagccccta

SEQ ID NO: 308504 - DNA, 20 bp, human
ggggctacattggctggcag

SEQ ID NO: 308505 - DNA, 20 bp, human
gggtcccctaggggctacat

SEQ ID NO: 308506 - DNA, 20 bp, human
ggcagacgctggttccgccc

SEQ ID NO: 308507 - DNA, 20 bp, human
gccgaagggcctcagagccg

SEQ ID NO: 308508 - DNA, 20 bp, human
gccccagaacgcagcccgaa

SEQ ID NO: 308509 - DNA, 20 bp, human
gtaaacgcatgagtccctcc

SEQ ID NO: 308510 - DNA, 20 bp, human
ggcccttcgggctgcgttct

SEQ ID NO: 308511 - DNA, 20 bp, human
gtggttccgccccggctctg

SEQ ID NO: 308512 - DNA, 20 bp, human
ggcttccggggcaccgggag

SEQ ID NO: 308513 - DNA, 20 bp, human
ggaccgaggcccgactgcgg

SEQ ID NO: 308514 - DNA, 20 bp, human
gcccggcaggaaatgcgtca

SEQ ID NO: 308515 - DNA, 20 bp, human
ggaacctttcttcccgctcc

SEQ ID NO: 308516 - DNA, 20 bp, human
gaaggacccgagtccaggag

SEQ ID NO: 308517 - DNA, 20 bp, human
ggagcagaggagaccgtgct

SEQ ID NO: 308518 - DNA, 20 bp, human
ggcggggctagagggagaaa

SEQ ID NO: 308519 - DNA, 20 bp, human
ggtgggggcgagtagcctgg

SEQ ID NO: 308520 - DNA, 20 bp, human
gtactccccctcctggactc

SEQ ID NO: 308521 - DNA, 20 bp, human
ggctagagggagaaaagggt

SEQ ID NO: 308522 - DNA, 20 bp, human
gcaggagggggagtagaaac

SEQ ID NO: 308523 - DNA, 20 bp, human
gaacacagctgtctagctgc

SEQ ID NO: 308524 - DNA, 20 bp, human
gctgctggccacggggtgcg

SEQ ID NO: 308525 - DNA, 20 bp, human
gtaattaaggacccgagtcc

SEQ ID NO: 308526 - DNA, 20 bp, human
gccaggggacgcagaaacaa

SEQ ID NO: 308527 - DNA, 20 bp, human
gggagcctgagcctaccttt

SEQ ID NO: 308528 - DNA, 20 bp, human
gtctggccacgtgctcgtgg

SEQ ID NO: 308529 - DNA, 20 bp, human
gtcagcccaaaggtaggctc

SEQ ID NO: 308530 - DNA, 20 bp, human
gcagtgacaggcaaccaaga

SEQ ID NO: 308531 - DNA, 20 bp, human
gggcttcagtagcgacgatt

SEQ ID NO: 308532 - DNA, 20 bp, human
ggggtcacgaggcttcgtag

SEQ ID NO: 308533 - DNA, 20 bp, human
gcagtctggccacgtgctcg

SEQ ID NO: 308534 - DNA, 20 bp, human
gtagcgacgattgggcagtc

SEQ ID NO: 308535 - DNA, 20 bp, human
gggctgatccaagaatgtga

SEQ ID NO: 308536 - DNA, 20 bp, human
gccccctgacccagccaata

SEQ ID NO: 308537 - DNA, 20 bp, human
gctgccgcaccgcttcgtga

SEQ ID NO: 308538 - DNA, 20 bp, human
ggggactagacgcgacctcg

SEQ ID NO: 308539 - DNA, 20 bp, human
gcgaccctcacgaagcggtg

SEQ ID NO: 308540 - DNA, 20 bp, human
ggacctgctctcctgcgctc

SEQ ID NO: 308541 - DNA, 20 bp, human
gacgcgacctcgcggggctg

SEQ ID NO: 308542 - DNA, 20 bp, human
gggagagcaggtctccccgg

SEQ ID NO: 308543 - DNA, 20 bp, human
gcagtgagagagctgcggtt

SEQ ID NO: 308544 - DNA, 20 bp, human
gcgcgtctagtcccgagcgc

SEQ ID NO: 308545 - DNA, 20 bp, human
gcgtgagggtcgatccgccg

SEQ ID NO: 308546 - DNA, 20 bp, human
ggccaggctgggagagacgt

SEQ ID NO: 308547 - DNA, 20 bp, human
gctggccccagacagagtcc

SEQ ID NO: 308548 - DNA, 20 bp, human
gcacagacctgtggtaggct

SEQ ID NO: 308549 - DNA, 20 bp, human
gagatgcgtaggctatctgc

SEQ ID NO: 308550 - DNA, 20 bp, human
gaaaatcacagacctgtggt

SEQ ID NO: 308551 - DNA, 20 bp, human
ggccaagagagccacggcct

SEQ ID NO: 308552 - DNA, 20 bp, human
gcatctccctatgcttgttg

SEQ ID NO: 308553 - DNA, 20 bp, human
gttagcggtagctgtggagc

SEQ ID NO: 308554 - DNA, 20 bp, human
gcagggacatttttcacatc

SEQ ID NO: 308555 - DNA, 20 bp, human
gttgttcctggactctgtct

SEQ ID NO: 308556 - DNA, 20 bp, human
gagcgctttcgcaggagggt

SEQ ID NO: 308557 - DNA, 20 bp, human
ggagccgcccggaaaccgcg

SEQ ID NO: 308558 - DNA, 20 bp, human
gttgccgcgcggtttccggg

SEQ ID NO: 308559 - DNA, 20 bp, human
gaaggtcaggggcgtggcga

SEQ ID NO: 308560 - DNA, 20 bp, human
gtagctaaaacagaaacgta

SEQ ID NO: 308561 - DNA, 20 bp, human
gttccgcggcgcacaggttc

SEQ ID NO: 308562 - DNA, 20 bp, human
ggcgcgtctctcaacctccg

SEQ ID NO: 308563 - DNA, 20 bp, human
gtgccattggctctggctga

SEQ ID NO: 308564 - DNA, 20 bp, human
gaggacgggtcaccctttgt

SEQ ID NO: 308565 - DNA, 20 bp, human
gagacgcgcggcagagggcg

SEQ ID NO: 308566 - DNA, 20 bp, human
gtcctaggagcaggcttgat

SEQ ID NO: 308567 - DNA, 20 bp, human
gtggactgctcaagaagatc

SEQ ID NO: 308568 - DNA, 20 bp, human
gggcatgtcctaagagtgga

SEQ ID NO: 308569 - DNA, 20 bp, human
gctgctcctaggaagagagc

SEQ ID NO: 308570 - DNA, 20 bp, human
gtaaaaatcaaactgcgcag

SEQ ID NO: 308571 - DNA, 20 bp, human
gatcaggcatgtcctaagag

SEQ ID NO: 308572 - DNA, 20 bp, human
gtaatccacaaggttcaatc

SEQ ID NO: 308573 - DNA, 20 bp, human
gctgaattacaaggagcaga

SEQ ID NO: 308574 - DNA, 20 bp, human
gttagcctgattgaaccttg

SEQ ID NO: 308575 - DNA, 20 bp, human
gcaaactatagcctttcaca

SEQ ID NO: 308576 - DNA, 20 bp, human
ggccccggggctcaccaacg

SEQ ID NO: 308577 - DNA, 20 bp, human
gggctccccgacgaccgcgg

SEQ ID NO: 308578 - DNA, 20 bp, human
gcggggctccccgacgaccg

SEQ ID NO: 308579 - DNA, 20 bp, human
gcacttgtgcggcacccgcg

SEQ ID NO: 308580 - DNA, 20 bp, human
gggctcccaggtgaccccgg

SEQ ID NO: 308581 - DNA, 20 bp, human
ggtggcgcggaaccaatcct

SEQ ID NO: 308582 - DNA, 20 bp, human
ggtgtcaccgccgcggtcgt

SEQ ID NO: 308583 - DNA, 20 bp, human
gtgcaccgccggggtcacct

SEQ ID NO: 308584 - DNA, 20 bp, human
gtgacctcgttggtgagccc

SEQ ID NO: 308585 - DNA, 20 bp, human
gtgacacaggtgacacttcc

SEQ ID NO: 308586 - DNA, 20 bp, human
ggaggagccgcggagagaag

SEQ ID NO: 308587 - DNA, 20 bp, human
gcatccggcaggacccggag

SEQ ID NO: 308588 - DNA, 20 bp, human
gcttccgcgccgggtgtctg

SEQ ID NO: 308589 - DNA, 20 bp, human
gcacccggcgcggaagaagg

SEQ ID NO: 308590 - DNA, 20 bp, human
gagccccgggcgccacccgt

SEQ ID NO: 308591 - DNA, 20 bp, human
gagagctgccgccatccggc

SEQ ID NO: 308592 - DNA, 20 bp, human
gcctccgcagacacccggcg

SEQ ID NO: 308593 - DNA, 20 bp, human
gctcacccagcctcccgctc

SEQ ID NO: 308594 - DNA, 20 bp, human
gaggcgctccagtcgcaccg

SEQ ID NO: 308595 - DNA, 20 bp, human
gcggatggcggcagctctcc

SEQ ID NO: 308596 - DNA, 20 bp, human
gtccagcggcccaactggag

SEQ ID NO: 308597 - DNA, 20 bp, human
gcgtgcgcagggcaggtcgg

SEQ ID NO: 308598 - DNA, 20 bp, human
ggggcgtccagcggcccaac

SEQ ID NO: 308599 - DNA, 20 bp, human
gcgtggaactacgttcctga

SEQ ID NO: 308600 - DNA, 20 bp, human
gggagccgagtgtcgccctt

SEQ ID NO: 308601 - DNA, 20 bp, human
ggccgggcccctcccgctgg

SEQ ID NO: 308602 - DNA, 20 bp, human
gcacgggcgacgtaggatgg

SEQ ID NO: 308603 - DNA, 20 bp, human
gggcccgggccgattacacg

SEQ ID NO: 308604 - DNA, 20 bp, human
gtgggccgctggacgcccta

SEQ ID NO: 308605 - DNA, 20 bp, human
gcactcggctccactccagt

SEQ ID NO: 308606 - DNA, 20 bp, human
gaggaccttcctaactgccc

SEQ ID NO: 308607 - DNA, 20 bp, human
gccccaccgcggtccgaggg

SEQ ID NO: 308608 - DNA, 20 bp, human
gagcgcgcccagacagtcct

SEQ ID NO: 308609 - DNA, 20 bp, human
gccgaagcagacaggggcga

SEQ ID NO: 308610 - DNA, 20 bp, human
gctcttaagactagcacggt

SEQ ID NO: 308611 - DNA, 20 bp, human
gaagagcagccagggcagtt

SEQ ID NO: 308612 - DNA, 20 bp, human
gaaaatcacatgtggtttgg

SEQ ID NO: 308613 - DNA, 20 bp, human
gtgtcggccgaggactgtct

SEQ ID NO: 308614 - DNA, 20 bp, human
ggccccccaccgcggtccga

SEQ ID NO: 308615 - DNA, 20 bp, human
gacagtcctcggccgacagc

SEQ ID NO: 308616 - DNA, 20 bp, human
gaggcagccccatcaggaaa

SEQ ID NO: 308617 - DNA, 20 bp, human
gtggcccagccacccatacc

SEQ ID NO: 308618 - DNA, 20 bp, human
gccacccatacctggaatag

SEQ ID NO: 308619 - DNA, 20 bp, human
gtagacacattaacattcgg

SEQ ID NO: 308620 - DNA, 20 bp, human
gaggagatccctttcctgat

SEQ ID NO: 308621 - DNA, 20 bp, human
gaagatcgaggtctctgcaa

SEQ ID NO: 308622 - DNA, 20 bp, human
ggtgtctaggtgatgtcagt

SEQ ID NO: 308623 - DNA, 20 bp, human
gttagcccctattccaggta

SEQ ID NO: 308624 - DNA, 20 bp, human
gccgtcagggcacagggaag

SEQ ID NO: 308625 - DNA, 20 bp, human
ggggtgccctgagtgtgcat

SEQ ID NO: 308626 - DNA, 20 bp, human
gagtaccaaatgagcaactg

SEQ ID NO: 308627 - DNA, 20 bp, human
ggtaccaaaggtttaaagga

SEQ ID NO: 308628 - DNA, 20 bp, human
gttcaagtgcttatctagac

SEQ ID NO: 308629 - DNA, 20 bp, human
gcgtatgaggctcccttggg

SEQ ID NO: 308630 - DNA, 20 bp, human
gctgaggtggaatgcggggc

SEQ ID NO: 308631 - DNA, 20 bp, human
ggaaacccataataccacca

SEQ ID NO: 308632 - DNA, 20 bp, human
gataaagctgaggtggaatg

SEQ ID NO: 308633 - DNA, 20 bp, human
gagttccttggtggtattat

SEQ ID NO: 308634 - DNA, 20 bp, human
gacttgttcatataaaatgg

SEQ ID NO: 308635 - DNA, 20 bp, human
ggtgcgtcgtgctcttttct

SEQ ID NO: 308636 - DNA, 20 bp, human
gcccgcgcgcagattgtccc

SEQ ID NO: 308637 - DNA, 20 bp, human
gtggcaaccgggcttccccc

SEQ ID NO: 308638 - DNA, 20 bp, human
ggcgccaaagctcgccgaaa

SEQ ID NO: 308639 - DNA, 20 bp, human
gacaatctgcgcgcgggcgg

SEQ ID NO: 308640 - DNA, 20 bp, human
gaagacggtacccagggcga

SEQ ID NO: 308641 - DNA, 20 bp, human
gaggtgctgagagatggcgg

SEQ ID NO: 308642 - DNA, 20 bp, human
gcggcccgccagcgccgttt

SEQ ID NO: 308643 - DNA, 20 bp, human
ggacgcgccaggcgaagaga

SEQ ID NO: 308644 - DNA, 20 bp, human
ggaagcccggttgccaggtt

SEQ ID NO: 308645 - DNA, 20 bp, human
gttcgcctggcgcgtccggg

SEQ ID NO: 308646 - DNA, 20 bp, human
gactcagagcctccgaagac

SEQ ID NO: 308647 - DNA, 20 bp, human
gagcggggccttccggtctt

SEQ ID NO: 308648 - DNA, 20 bp, human
gagtgccggttacgtaacgg

SEQ ID NO: 308649 - DNA, 20 bp, human
gtggcgccaccccgtaggac

SEQ ID NO: 308650 - DNA, 20 bp, human
gggggccttccggtcttcgg

SEQ ID NO: 308651 - DNA, 20 bp, human
ggcccggccgggcagctggt

SEQ ID NO: 308652 - DNA, 20 bp, human
gggagccgccgttacgtaac

SEQ ID NO: 308653 - DNA, 20 bp, human
gagagcctccgaagaccgga

SEQ ID NO: 308654 - DNA, 20 bp, human
gttcgctggcgccaccccgt

SEQ ID NO: 308655 - DNA, 20 bp, human
ggaaggccccgctcaggccc

SEQ ID NO: 308656 - DNA, 20 bp, human
gcccttgcccccaacaaaga

SEQ ID NO: 308657 - DNA, 20 bp, human
ggggaccgcagggaaaatac

SEQ ID NO: 308658 - DNA, 20 bp, human
gggccctggcacagagcaat

SEQ ID NO: 308659 - DNA, 20 bp, human
gtggcacagagcaatcggat

SEQ ID NO: 308660 - DNA, 20 bp, human
ggagactggcttctaccgac

SEQ ID NO: 308661 - DNA, 20 bp, human
gctggcttctaccgacagga

SEQ ID NO: 308662 - DNA, 20 bp, human
gtggctacgccagcgaatcc

SEQ ID NO: 308663 - DNA, 20 bp, human
ggtagaagccagtctccttt

SEQ ID NO: 308664 - DNA, 20 bp, human
gtgccagggccgggattcgc

SEQ ID NO: 308665 - DNA, 20 bp, human
gtgcgtctgacgtcaaggca

SEQ ID NO: 308666 - DNA, 20 bp, human
gcgccgggccgcacacctcc

SEQ ID NO: 308667 - DNA, 20 bp, human
ggaacgcgacgtcatgacgt

SEQ ID NO: 308668 - DNA, 20 bp, human
gcgcctcgggcgttgtaggc

SEQ ID NO: 308669 - DNA, 20 bp, human
ggggacccgacgacacttgc

SEQ ID NO: 308670 - DNA, 20 bp, human
gcgaccagaagggacacgga

SEQ ID NO: 308671 - DNA, 20 bp, human
gcacacctccgggctctggg

SEQ ID NO: 308672 - DNA, 20 bp, human
gcgctcgcctgcgctgtggt

SEQ ID NO: 308673 - DNA, 20 bp, human
gcgtgcgctcgcctgcgctg

SEQ ID NO: 308674 - DNA, 20 bp, human
ggctctgggcggagcgcctc

SEQ ID NO: 308675 - DNA, 20 bp, human
gtaggcgggaccggaccctc

SEQ ID NO: 308676 - DNA, 20 bp, human
gacgagcaaactgaccaata

SEQ ID NO: 308677 - DNA, 20 bp, human
ggaccaatagggctgagagg

SEQ ID NO: 308678 - DNA, 20 bp, human
gggcgggaaacgtaccatcc

SEQ ID NO: 308679 - DNA, 20 bp, human
gggtcattgagcagctggag

SEQ ID NO: 308680 - DNA, 20 bp, human
gggtacgtttcccgccaccg

SEQ ID NO: 308681 - DNA, 20 bp, human
gagcatataagcattatgat

SEQ ID NO: 308682 - DNA, 20 bp, human
gtgctcgtcagtgagtgagg

SEQ ID NO: 308683 - DNA, 20 bp, human
gggggaggaacagagaatcc

SEQ ID NO: 308684 - DNA, 20 bp, human
gaggctggtcattgagcagc

SEQ ID NO: 308685 - DNA, 20 bp, human
gtgattggctgagttctctg

SEQ ID NO: 308686 - DNA, 20 bp, human
gcgctctcgcgtcctttgct

SEQ ID NO: 308687 - DNA, 20 bp, human
ggagagaaggggctggaatg

SEQ ID NO: 308688 - DNA, 20 bp, human
gggcgcccgcagacccacgc

SEQ ID NO: 308689 - DNA, 20 bp, human
gaaaacccgcccggacgtac

SEQ ID NO: 308690 - DNA, 20 bp, human
ggcggggcttccggtcggga

SEQ ID NO: 308691 - DNA, 20 bp, human
gcgggcgccccagaccccag

SEQ ID NO: 308692 - DNA, 20 bp, human
ggcggggaggggcaacggct

SEQ ID NO: 308693 - DNA, 20 bp, human
ggcgtcgcattcacccgcgt

SEQ ID NO: 308694 - DNA, 20 bp, human
ggggttgtggggagcggaac

SEQ ID NO: 308695 - DNA, 20 bp, human
gccgggtcctctggggtctg

SEQ ID NO: 308696 - DNA, 20 bp, human
ggggaggcgccactgcgcat

SEQ ID NO: 308697 - DNA, 20 bp, human
gcgccactgcgcatcggcag

SEQ ID NO: 308698 - DNA, 20 bp, human
ggcgcagtggcgcctcccgg

SEQ ID NO: 308699 - DNA, 20 bp, human
gcccccctgccgatgcgcag

SEQ ID NO: 308700 - DNA, 20 bp, human
ggctccctagccaacgctag

SEQ ID NO: 308701 - DNA, 20 bp, human
gtcctacagcaccagctctc

SEQ ID NO: 308702 - DNA, 20 bp, human
gtcagaccatctggaccaag

SEQ ID NO: 308703 - DNA, 20 bp, human
gtgcgcggcagcgttttcgc

SEQ ID NO: 308704 - DNA, 20 bp, human
gctacttctggtttacgcac

SEQ ID NO: 308705 - DNA, 20 bp, human
gacgtggctccgcctccggg

SEQ ID NO: 308706 - DNA, 20 bp, human
gactgtctgccgaagatgat

SEQ ID NO: 308707 - DNA, 20 bp, human
gcgaaccaatgggagcgcag

SEQ ID NO: 308708 - DNA, 20 bp, human
gcatcttcggcagacagtcc

SEQ ID NO: 308709 - DNA, 20 bp, human
ggcagccgctgcgctcccat

SEQ ID NO: 308710 - DNA, 20 bp, human
gcggacgcaaagatggcgga

SEQ ID NO: 308711 - DNA, 20 bp, human
gggggcggacgcaaagatgg

SEQ ID NO: 308712 - DNA, 20 bp, human
gcttcggcagacagtccggg

SEQ ID NO: 308713 - DNA, 20 bp, human
gctttgcagccaatcatctt

SEQ ID NO: 308714 - DNA, 20 bp, human
ggacggggcggacgcaaaga

SEQ ID NO: 308715 - DNA, 20 bp, human
gctcagaacggtccaatcgc

SEQ ID NO: 308716 - DNA, 20 bp, human
gttggagaggcgccgttcat

SEQ ID NO: 308717 - DNA, 20 bp, human
ggcgcgaaatccctttccgt

SEQ ID NO: 308718 - DNA, 20 bp, human
gggaacaagttcgaatctga

SEQ ID NO: 308719 - DNA, 20 bp, human
ggaggcgccgttcattggtc

SEQ ID NO: 308720 - DNA, 20 bp, human
gccagctcctgtgtcacgat

SEQ ID NO: 308721 - DNA, 20 bp, human
gcgtggcccgcgggtatttt

SEQ ID NO: 308722 - DNA, 20 bp, human
gcgcctgcgcagtgtagccg

SEQ ID NO: 308723 - DNA, 20 bp, human
gggccgtgcaggtcggaaga

SEQ ID NO: 308724 - DNA, 20 bp, human
gccggaaccaatcgtgacac

SEQ ID NO: 308725 - DNA, 20 bp, human
gtgcaggtcggaagaggggg

SEQ ID NO: 308726 - DNA, 20 bp, human
gcgggcctagaatgagtgac

SEQ ID NO: 308727 - DNA, 20 bp, human
gcgtgcgggccaatcggaca

SEQ ID NO: 308728 - DNA, 20 bp, human
gggcccgcacgcagtggcgc

SEQ ID NO: 308729 - DNA, 20 bp, human
gggcgtcggaagggaatctc

SEQ ID NO: 308730 - DNA, 20 bp, human
gtctaggcccgcacggtgat

SEQ ID NO: 308731 - DNA, 20 bp, human
gtcggaagggaatctccggg

SEQ ID NO: 308732 - DNA, 20 bp, human
gggggaggcggtgcgggcgt

SEQ ID NO: 308733 - DNA, 20 bp, human
gcgcaagccaatcaccgtgc

SEQ ID NO: 308734 - DNA, 20 bp, human
gcctccccgtcactcattct

SEQ ID NO: 308735 - DNA, 20 bp, human
gcagtccgcggggacagtgg

SEQ ID NO: 308736 - DNA, 20 bp, human
gaagcggcgtgcaacacgtg

SEQ ID NO: 308737 - DNA, 20 bp, human
gcggaagcggtcttgaggtc

SEQ ID NO: 308738 - DNA, 20 bp, human
gctgggccggaaagcggaag

SEQ ID NO: 308739 - DNA, 20 bp, human
ggggggcggtgccggtcgga

SEQ ID NO: 308740 - DNA, 20 bp, human
ggcactaggagccctccgac

SEQ ID NO: 308741 - DNA, 20 bp, human
gtggccagacggaagccgag

SEQ ID NO: 308742 - DNA, 20 bp, human
gtggcgacaaccgaggagga

SEQ ID NO: 308743 - DNA, 20 bp, human
ggcggtggcgacaaccgagg

SEQ ID NO: 308744 - DNA, 20 bp, human
gggcgtgcaacacgtggggg

SEQ ID NO: 308745 - DNA, 20 bp, human
ggcttccggaagcggtcttg

SEQ ID NO: 308746 - DNA, 20 bp, human
gggacccgagcagtgacctc

SEQ ID NO: 308747 - DNA, 20 bp, human
gccagagcagggttgtgcgg

SEQ ID NO: 308748 - DNA, 20 bp, human
gccccggcggctcttccgga

SEQ ID NO: 308749 - DNA, 20 bp, human
gaggctaagtggccagagca

SEQ ID NO: 308750 - DNA, 20 bp, human
gcggctcagatcggatctta

SEQ ID NO: 308751 - DNA, 20 bp, human
gcggaagagccgccggggca

SEQ ID NO: 308752 - DNA, 20 bp, human
ggttgtgcggcggctcagat

SEQ ID NO: 308753 - DNA, 20 bp, human
gcgccggggcagggaagttg

SEQ ID NO: 308754 - DNA, 20 bp, human
ggagcggagcgggcggattg

SEQ ID NO: 308755 - DNA, 20 bp, human
ggcagtgacctcaggctaag

SEQ ID NO: 308756 - DNA, 20 bp, human
gtggagacgggcaaaaggaa

SEQ ID NO: 308757 - DNA, 20 bp, human
gcggcgacgcgctccaaggg

SEQ ID NO: 308758 - DNA, 20 bp, human
ggcccggcgacgcgctccaa

SEQ ID NO: 308759 - DNA, 20 bp, human
gtctgcgcggcgaggaggag

SEQ ID NO: 308760 - DNA, 20 bp, human
ggcgccgccatcttggagac

SEQ ID NO: 308761 - DNA, 20 bp, human
ggctggaggctgcgcagcgc

SEQ ID NO: 308762 - DNA, 20 bp, human
ggcgactgcagaaggagcgt

SEQ ID NO: 308763 - DNA, 20 bp, human
gagacctcagagtcatctct

SEQ ID NO: 308764 - DNA, 20 bp, human
gcccctgggccggcgtgtag

SEQ ID NO: 308765 - DNA, 20 bp, human
gccatagtgggcttataaga

SEQ ID NO: 308766 - DNA, 20 bp, human
ggtcagcaggggaactagcc

SEQ ID NO: 308767 - DNA, 20 bp, human
gcgcgccctcgggtcagcag

SEQ ID NO: 308768 - DNA, 20 bp, human
gagttcccctgctgacccga

SEQ ID NO: 308769 - DNA, 20 bp, human
gtgaagctattaaaacgtaa

SEQ ID NO: 308770 - DNA, 20 bp, human
ggctgacccgagggcgcggg

SEQ ID NO: 308771 - DNA, 20 bp, human
ggcgcgcacgtcccggccgt

SEQ ID NO: 308772 - DNA, 20 bp, human
ggagtccttcgagggaatac

SEQ ID NO: 308773 - DNA, 20 bp, human
gaatgcccatcaccgattaa

SEQ ID NO: 308774 - DNA, 20 bp, human
ggaaaaaataggtctacgtt

SEQ ID NO: 308775 - DNA, 20 bp, human
gcggccgttggctgcgtcgc

SEQ ID NO: 308776 - DNA, 20 bp, human
gccggcgccctctgggtcga

SEQ ID NO: 308777 - DNA, 20 bp, human
gcgactgccttcgacccaga

SEQ ID NO: 308778 - DNA, 20 bp, human
gcatgcgcgctgttccggca

SEQ ID NO: 308779 - DNA, 20 bp, human
ggaccagaggcggtcacgtg

SEQ ID NO: 308780 - DNA, 20 bp, human
gtgggtcgaaggcagtcgct

SEQ ID NO: 308781 - DNA, 20 bp, human
gcgcgcatgcgtgcctctgc

SEQ ID NO: 308782 - DNA, 20 bp, human
gaggggttgtcgtggcgcag

SEQ ID NO: 308783 - DNA, 20 bp, human
gccgacgcgctctgggtggc

SEQ ID NO: 308784 - DNA, 20 bp, human
ggttccggcaggggttgtcg

SEQ ID NO: 308785 - DNA, 20 bp, human
gtcctagcgccgacgcgctc

SEQ ID NO: 308786 - DNA, 20 bp, human
gtcccctaggaccccaactg

SEQ ID NO: 308787 - DNA, 20 bp, human
gtccccgcgctcccggagaa

SEQ ID NO: 308788 - DNA, 20 bp, human
ggaccggagcttccccagtt

SEQ ID NO: 308789 - DNA, 20 bp, human
gaccccaactggggaagctc

SEQ ID NO: 308790 - DNA, 20 bp, human
gtccccagttggggtcctag

SEQ ID NO: 308791 - DNA, 20 bp, human
gggaagctccggtccccggt

SEQ ID NO: 308792 - DNA, 20 bp, human
ggcctcggttccatccccta

SEQ ID NO: 308793 - DNA, 20 bp, human
gcgtcgccgacccccttctc

SEQ ID NO: 308794 - DNA, 20 bp, human
gggcggcggtggggccccca

SEQ ID NO: 308795 - DNA, 20 bp, human
ggaagtaagcagtcccaaaa

SEQ ID NO: 308796 - DNA, 20 bp, human
gggaacccgagccgggagta

SEQ ID NO: 308797 - DNA, 20 bp, human
gaaacccgagcagggcggtg

SEQ ID NO: 308798 - DNA, 20 bp, human
gaacgccggcttcctccgga

SEQ ID NO: 308799 - DNA, 20 bp, human
ggagcccggcaaccacctga

SEQ ID NO: 308800 - DNA, 20 bp, human
ggggcggtgcgggttgctca

SEQ ID NO: 308801 - DNA, 20 bp, human
ggaggccgtccggaggaagc

SEQ ID NO: 308802 - DNA, 20 bp, human
gtgaaaagcggcccccgaca

SEQ ID NO: 308803 - DNA, 20 bp, human
ggcacaacgccggcttcctc

SEQ ID NO: 308804 - DNA, 20 bp, human
gccgcccagagtcagacggg

SEQ ID NO: 308805 - DNA, 20 bp, human
gttcccgccgcgccctgtcg

SEQ ID NO: 308806 - DNA, 20 bp, human
gaggcgcggcgaggcggaat

SEQ ID NO: 308807 - DNA, 20 bp, human
gcggaatcgggccccctccc

SEQ ID NO: 308808 - DNA, 20 bp, human
gaggctcgcaagcaccgcgt

SEQ ID NO: 308809 - DNA, 20 bp, human
gggtcccgccgcgtccgcga

SEQ ID NO: 308810 - DNA, 20 bp, human
gcagcggagcgcggtgacgg

SEQ ID NO: 308811 - DNA, 20 bp, human
gctcacctacagagaaatcc

SEQ ID NO: 308812 - DNA, 20 bp, human
ggctacccggcgcctcatct

SEQ ID NO: 308813 - DNA, 20 bp, human
gaaggctaattcaggggtta

SEQ ID NO: 308814 - DNA, 20 bp, human
ggggcacagtcattccctcg

SEQ ID NO: 308815 - DNA, 20 bp, human
ggagccggacctccgatccc

SEQ ID NO: 308816 - DNA, 20 bp, human
ggagatgtggcggacagaaa

SEQ ID NO: 308817 - DNA, 20 bp, human
gttggcaacgtgtgtgaagg

SEQ ID NO: 308818 - DNA, 20 bp, human
ggggctaattgaggcgaccc

SEQ ID NO: 308819 - DNA, 20 bp, human
gaattgaggcgacccgggga

SEQ ID NO: 308820 - DNA, 20 bp, human
ggtaacccggcttgaggggt

SEQ ID NO: 308821 - DNA, 20 bp, human
gggcttgaggggttggttaa

SEQ ID NO: 308822 - DNA, 20 bp, human
gctagttgggacagcatata

SEQ ID NO: 308823 - DNA, 20 bp, human
ggcggggccccaaacttggg

SEQ ID NO: 308824 - DNA, 20 bp, human
gtcaagccgggttacctctc

SEQ ID NO: 308825 - DNA, 20 bp, human
gaaagggaaaggcgagactt

SEQ ID NO: 308826 - DNA, 20 bp, human
ggtactaacagttttgcaat

SEQ ID NO: 308827 - DNA, 20 bp, human
gtcaactctcaaaccagtaa

SEQ ID NO: 308828 - DNA, 20 bp, human
gcacaaggtaatgacagcgt

SEQ ID NO: 308829 - DNA, 20 bp, human
gataacaaacatcatatctg

SEQ ID NO: 308830 - DNA, 20 bp, human
gactgcatgtttgatttagc

SEQ ID NO: 308831 - DNA, 20 bp, human
gggtaatgacagcgtaggaa

SEQ ID NO: 308832 - DNA, 20 bp, human
gaagtcactaacattcccat

SEQ ID NO: 308833 - DNA, 20 bp, human
ggcgtaggaaaggatttctg

SEQ ID NO: 308834 - DNA, 20 bp, human
gtgttgtggcttttgccatg

SEQ ID NO: 308835 - DNA, 20 bp, human
gtgggaaactcttcccttac

SEQ ID NO: 308836 - DNA, 20 bp, human
gtaagactgcaacatttgat

SEQ ID NO: 308837 - DNA, 20 bp, human
gaaccttcttggtggcagta

SEQ ID NO: 308838 - DNA, 20 bp, human
gaaaacatgaaccttcttgg

SEQ ID NO: 308839 - DNA, 20 bp, human
gaagaatgagatgataaggt

SEQ ID NO: 308840 - DNA, 20 bp, human
gtctttagctccgcttcctc

SEQ ID NO: 308841 - DNA, 20 bp, human
gggtaacttgtataaatatt

SEQ ID NO: 308842 - DNA, 20 bp, human
gtcagtatgatcaaggggtg

SEQ ID NO: 308843 - DNA, 20 bp, human
gttagacttggtgggccaga

SEQ ID NO: 308844 - DNA, 20 bp, human
gtgttcttcagtatgatcaa

SEQ ID NO: 308845 - DNA, 20 bp, human
gaacgaagaatgagatgata

SEQ ID NO: 308846 - DNA, 20 bp, human
ggaaagggcgggacttgaga

SEQ ID NO: 308847 - DNA, 20 bp, human
ggaggaaccggttgcctaaa

SEQ ID NO: 308848 - DNA, 20 bp, human
ggccggcaaaagcgcctacg

SEQ ID NO: 308849 - DNA, 20 bp, human
gtcagttacgggttcctcaa

SEQ ID NO: 308850 - DNA, 20 bp, human
ggcgcctacgtggagtccag

SEQ ID NO: 308851 - DNA, 20 bp, human
ggctcctctggactccacgt

SEQ ID NO: 308852 - DNA, 20 bp, human
gcaaccggttcctcagcagt

SEQ ID NO: 308853 - DNA, 20 bp, human
gtccacgtaggcgcttttgc

SEQ ID NO: 308854 - DNA, 20 bp, human
gatggcacttgcgtcagtta

SEQ ID NO: 308855 - DNA, 20 bp, human
ggataggtagcaacgaagca

SEQ ID NO: 308856 - DNA, 20 bp, human
gacaggcgggagaaccacac

SEQ ID NO: 308857 - DNA, 20 bp, human
ggcagcgcagcggacggcca

SEQ ID NO: 308858 - DNA, 20 bp, human
gggactggcagcttccagtg

SEQ ID NO: 308859 - DNA, 20 bp, human
gtgactgagttgatgaggcg

SEQ ID NO: 308860 - DNA, 20 bp, human
gcctgcaaggtccaatcgac

SEQ ID NO: 308861 - DNA, 20 bp, human
gactataggtaactctggaa

SEQ ID NO: 308862 - DNA, 20 bp, human
gcaattacgggcaaattcta

SEQ ID NO: 308863 - DNA, 20 bp, human
ggcaaggtccaatcgacagg

SEQ ID NO: 308864 - DNA, 20 bp, human
ggtcccactataggtaactc

SEQ ID NO: 308865 - DNA, 20 bp, human
ggctttagttggcccggcgt

SEQ ID NO: 308866 - DNA, 20 bp, human
ggcctctctgcgctctccga

SEQ ID NO: 308867 - DNA, 20 bp, human
gccagtgaactgctcgggga

SEQ ID NO: 308868 - DNA, 20 bp, human
ggtcgcctagcgaatggggt

SEQ ID NO: 308869 - DNA, 20 bp, human
ggctcccgctgtcggactct

SEQ ID NO: 308870 - DNA, 20 bp, human
gcgcagcgcccccagaccgt

SEQ ID NO: 308871 - DNA, 20 bp, human
gggccggcgccaaaagcgag

SEQ ID NO: 308872 - DNA, 20 bp, human
gcggcggccaagcgcgggga

SEQ ID NO: 308873 - DNA, 20 bp, human
gcaggcccagagtccgacag

SEQ ID NO: 308874 - DNA, 20 bp, human
gcgggccagtgaactgctcg

SEQ ID NO: 308875 - DNA, 20 bp, human
gaccgtcggagagcgcagag

SEQ ID NO: 308876 - DNA, 20 bp, human
gcaaataggtggtgtctccc

SEQ ID NO: 308877 - DNA, 20 bp, human
ggctgccggcaacggataga

SEQ ID NO: 308878 - DNA, 20 bp, human
gtaactgatctcagcagcct

SEQ ID NO: 308879 - DNA, 20 bp, human
gcagctggcgccagactctc

SEQ ID NO: 308880 - DNA, 20 bp, human
ggtgggcgggcaagcggtag

SEQ ID NO: 308881 - DNA, 20 bp, human
gacgtccgacgtgtctggta

SEQ ID NO: 308882 - DNA, 20 bp, human
ggcgccagactctctggtcg

SEQ ID NO: 308883 - DNA, 20 bp, human
ggtcgattgggcagctccaa

SEQ ID NO: 308884 - DNA, 20 bp, human
ggcccccttagagttcaaat

SEQ ID NO: 308885 - DNA, 20 bp, human
gctggccttaccagacacgt

SEQ ID NO: 308886 - DNA, 20 bp, human
ggggcctcacccacctccga

SEQ ID NO: 308887 - DNA, 20 bp, human
gggtgcagcactgaggtctg

SEQ ID NO: 308888 - DNA, 20 bp, human
gcgtgcgcgcccaggtaagc

SEQ ID NO: 308889 - DNA, 20 bp, human
gagacggtgaggattgcctt

SEQ ID NO: 308890 - DNA, 20 bp, human
ggaggtctggggttcgggag

SEQ ID NO: 308891 - DNA, 20 bp, human
gagggggccctatacgcggg

SEQ ID NO: 308892 - DNA, 20 bp, human
gacgggacgcgcccgcgcct

SEQ ID NO: 308893 - DNA, 20 bp, human
gtgaggattgccttcggagg

SEQ ID NO: 308894 - DNA, 20 bp, human
ggggagggggccctatacgc

SEQ ID NO: 308895 - DNA, 20 bp, human
gcgggctgagtcacccggac

SEQ ID NO: 308896 - DNA, 20 bp, human
gagggcgcagcgcccgggtg

SEQ ID NO: 308897 - DNA, 20 bp, human
ggtcgcgccgctcccagcat

SEQ ID NO: 308898 - DNA, 20 bp, human
ggccgctagccaagagttcg

SEQ ID NO: 308899 - DNA, 20 bp, human
gctgggaaaggggagtgaat

SEQ ID NO: 308900 - DNA, 20 bp, human
gcagccggctcccctgcgag

SEQ ID NO: 308901 - DNA, 20 bp, human
gcctgcccccagaccgacgg

SEQ ID NO: 308902 - DNA, 20 bp, human
ggggagggaacgtcccgcag

SEQ ID NO: 308903 - DNA, 20 bp, human
ggcctcgaactcttggctag

SEQ ID NO: 308904 - DNA, 20 bp, human
gacagagggagaagtgtttc

SEQ ID NO: 308905 - DNA, 20 bp, human
gcgccccggtggcctgacga

SEQ ID NO: 308906 - DNA, 20 bp, human
gaggcgaggaaattggacag

SEQ ID NO: 308907 - DNA, 20 bp, human
gagagcgagcgacaacgggt

SEQ ID NO: 308908 - DNA, 20 bp, human
gacaggagagcgagcgacaa

SEQ ID NO: 308909 - DNA, 20 bp, human
gaactggaggggaatcaaac

SEQ ID NO: 308910 - DNA, 20 bp, human
ggagctgggctgcctttaat

SEQ ID NO: 308911 - DNA, 20 bp, human
gcgaacgaggagacgcgagg

SEQ ID NO: 308912 - DNA, 20 bp, human
ggagagcgagagaccgaacg

SEQ ID NO: 308913 - DNA, 20 bp, human
ggggttgggggggaatgtta

SEQ ID NO: 308914 - DNA, 20 bp, human
gggctcctttttttaactgg

SEQ ID NO: 308915 - DNA, 20 bp, human
gaatgttagggggcggagag

SEQ ID NO: 308916 - DNA, 20 bp, human
gaggaggaaagggtccaaca

SEQ ID NO: 308917 - DNA, 20 bp, human
gagtggggctaggggaacgg

SEQ ID NO: 308918 - DNA, 20 bp, human
gagggagcggagtgtgcgtc

SEQ ID NO: 308919 - DNA, 20 bp, human
gcgggcgctaaaggctattt

SEQ ID NO: 308920 - DNA, 20 bp, human
gggccggccgcaccaattcc

SEQ ID NO: 308921 - DNA, 20 bp, human
gggccagagcacctctacgc

SEQ ID NO: 308922 - DNA, 20 bp, human
gcaccgccacttgcaagaga

SEQ ID NO: 308923 - DNA, 20 bp, human
gggccagcgtagaggtgctc

SEQ ID NO: 308924 - DNA, 20 bp, human
gtacgctggccgggcgctaa

SEQ ID NO: 308925 - DNA, 20 bp, human
gggagccgaaagcagagtcc

SEQ ID NO: 308926 - DNA, 20 bp, human
ggaaaaaaacctctggtatc

SEQ ID NO: 308927 - DNA, 20 bp, human
ggattgcaaagtagtccctg

SEQ ID NO: 308928 - DNA, 20 bp, human
gtgtcgtcctccaatcacag

SEQ ID NO: 308929 - DNA, 20 bp, human
gtcccgacgcggcgctctct

SEQ ID NO: 308930 - DNA, 20 bp, human
gcgcggaactgactcggaga

SEQ ID NO: 308931 - DNA, 20 bp, human
gcagtctcagtcacgcgcgt

SEQ ID NO: 308932 - DNA, 20 bp, human
gaaacggatggtttgggctc

SEQ ID NO: 308933 - DNA, 20 bp, human
ggaggacgacaacaaacgga

SEQ ID NO: 308934 - DNA, 20 bp, human
ggacaacaaacggatggttt

SEQ ID NO: 308935 - DNA, 20 bp, human
gttcccagagagcgccgcgt

SEQ ID NO: 308936 - DNA, 20 bp, human
gcatacaggagtggggctcg

SEQ ID NO: 308937 - DNA, 20 bp, human
gctggcgcccagcagaggtt

SEQ ID NO: 308938 - DNA, 20 bp, human
gcttctcggggaagctgtca

SEQ ID NO: 308939 - DNA, 20 bp, human
ggcagccaagggcaaggcgc

SEQ ID NO: 308940 - DNA, 20 bp, human
ggataccacagagcttataa

SEQ ID NO: 308941 - DNA, 20 bp, human
ggcaggcgcactacaaagtc

SEQ ID NO: 308942 - DNA, 20 bp, human
ggtcaaaaagcatatgttcg

SEQ ID NO: 308943 - DNA, 20 bp, human
gcgcttctcacgagatctta

SEQ ID NO: 308944 - DNA, 20 bp, human
gtgtgctctaaggtgagtgg

SEQ ID NO: 308945 - DNA, 20 bp, human
gatcgcccttataagctctg

SEQ ID NO: 308946 - DNA, 20 bp, human
gagaacccagccaaacaccg

SEQ ID NO: 308947 - DNA, 20 bp, human
ggaaagctgtgggaccatcc

SEQ ID NO: 308948 - DNA, 20 bp, human
gccacttccgggagtcggaa

SEQ ID NO: 308949 - DNA, 20 bp, human
ggagtcggaaaggaaagctg

SEQ ID NO: 308950 - DNA, 20 bp, human
gtagccgtctgtgtggccgg

SEQ ID NO: 308951 - DNA, 20 bp, human
gcacggccacttccgggagt

SEQ ID NO: 308952 - DNA, 20 bp, human
gctgcccagcgcctgctctc

SEQ ID NO: 308953 - DNA, 20 bp, human
gccgggatctcgtgagatca

SEQ ID NO: 308954 - DNA, 20 bp, human
gcggaaaggtagggtcaggg

SEQ ID NO: 308955 - DNA, 20 bp, human
gccagtctgcacccaagagg

SEQ ID NO: 308956 - DNA, 20 bp, human
ggccccccgcgcttctactc

SEQ ID NO: 308957 - DNA, 20 bp, human
ggtcgcagcgcagagggcac

SEQ ID NO: 308958 - DNA, 20 bp, human
ggccctctgcgctgcgacgg

SEQ ID NO: 308959 - DNA, 20 bp, human
ggacgccggagtagaagcgc

SEQ ID NO: 308960 - DNA, 20 bp, human
ggcagcgcagagggcaccgg

SEQ ID NO: 308961 - DNA, 20 bp, human
ggaccaccgctcggaagatg

SEQ ID NO: 308962 - DNA, 20 bp, human
ggggcggcggcgcagggagt

SEQ ID NO: 308963 - DNA, 20 bp, human
gggacgcggggccgggaaca

SEQ ID NO: 308964 - DNA, 20 bp, human
ggcggggcgggtccttccct

SEQ ID NO: 308965 - DNA, 20 bp, human
gcggggagacgcgaggacgc

SEQ ID NO: 308966 - DNA, 20 bp, human
gggtccctaggctccaaaaa

SEQ ID NO: 308967 - DNA, 20 bp, human
gaaggctcccggaaccgggc

SEQ ID NO: 308968 - DNA, 20 bp, human
ggcactctgcgagtctctat

SEQ ID NO: 308969 - DNA, 20 bp, human
gggcggaaggccggccaata

SEQ ID NO: 308970 - DNA, 20 bp, human
gcggggaaaaacagaccgac

SEQ ID NO: 308971 - DNA, 20 bp, human
gtccctggggctgatagaga

SEQ ID NO: 308972 - DNA, 20 bp, human
gtcaaatcctaatggaggta

SEQ ID NO: 308973 - DNA, 20 bp, human
gtgaccaatgagtggccgaa

SEQ ID NO: 308974 - DNA, 20 bp, human
gcgagtctctattggtccct

SEQ ID NO: 308975 - DNA, 20 bp, human
gtctatcagccccagggatt

SEQ ID NO: 308976 - DNA, 20 bp, human
ggggagcgcgcgggtcgtcg

SEQ ID NO: 308977 - DNA, 20 bp, human
ggccgagccccggacccaat

SEQ ID NO: 308978 - DNA, 20 bp, human
ggagccccggacccaattgg

SEQ ID NO: 308979 - DNA, 20 bp, human
gcttccgccaattgggtccg

SEQ ID NO: 308980 - DNA, 20 bp, human
gacctccgggatgatggagt

SEQ ID NO: 308981 - DNA, 20 bp, human
ggcgagcttggctgcttctg

SEQ ID NO: 308982 - DNA, 20 bp, human
gggccccgcttccgccaatt

SEQ ID NO: 308983 - DNA, 20 bp, human
ggacccaattggcggaagcg

SEQ ID NO: 308984 - DNA, 20 bp, human
gtcacagcgccaaaccttgc

SEQ ID NO: 308985 - DNA, 20 bp, human
gtgttggccgcgagctgaga

SEQ ID NO: 308986 - DNA, 20 bp, human
gagtccggggagagagtcgt

SEQ ID NO: 308987 - DNA, 20 bp, human
gcggactaggatctactcta

SEQ ID NO: 308988 - DNA, 20 bp, human
ggaggactagagagctagaa

SEQ ID NO: 308989 - DNA, 20 bp, human
ggagagtcgtggggcccgaa

SEQ ID NO: 308990 - DNA, 20 bp, human
gggccccacgactctctccc

SEQ ID NO: 308991 - DNA, 20 bp, human
gccctcgtgtgaggccgtgt

SEQ ID NO: 308992 - DNA, 20 bp, human
gcaccggaagccctcgtgtg

SEQ ID NO: 308993 - DNA, 20 bp, human
gtgacgactttcaaccgttc

SEQ ID NO: 308994 - DNA, 20 bp, human
ggaaaccatagatggagcaa

SEQ ID NO: 308995 - DNA, 20 bp, human
gcccttggggagtaagggtg

SEQ ID NO: 308996 - DNA, 20 bp, human
gctgtcccgccttttccggg

SEQ ID NO: 308997 - DNA, 20 bp, human
gcgcgaacacagcacgtggt

SEQ ID NO: 308998 - DNA, 20 bp, human
gttaggccggggaggaaaga

SEQ ID NO: 308999 - DNA, 20 bp, human
ggactcgcgaacacagcacg

SEQ ID NO: 309000 - DNA, 20 bp, human
gccagcgcctacaccgggag

SEQ ID NO: 309001 - DNA, 20 bp, human
gcggctacgctgcgccctcc

SEQ ID NO: 309002 - DNA, 20 bp, human
gatggaaacaaaaatctagt

SEQ ID NO: 309003 - DNA, 20 bp, human
gaaggcgggacagcgaagac

SEQ ID NO: 309004 - DNA, 20 bp, human
gtggcgtttccgccgctgag

SEQ ID NO: 309005 - DNA, 20 bp, human
gtgacgtcatcagctcggga

SEQ ID NO: 309006 - DNA, 20 bp, human
gtgggtggagtggagaagta

SEQ ID NO: 309007 - DNA, 20 bp, human
ggcactcttgcgccatctcc

SEQ ID NO: 309008 - DNA, 20 bp, human
ggttgcatgtgtggtcgtgt

SEQ ID NO: 309009 - DNA, 20 bp, human
gcaagagtgccatctgatgc

SEQ ID NO: 309010 - DNA, 20 bp, human
gggaggttccgcactctcta

SEQ ID NO: 309011 - DNA, 20 bp, human
gggggaagaggattgcagcg

SEQ ID NO: 309012 - DNA, 20 bp, human
gcctgcctgccatagacaaa

SEQ ID NO: 309013 - DNA, 20 bp, human
gcagcagtcaagtctttcta

SEQ ID NO: 309014 - DNA, 20 bp, human
gtggctgacactgtactcta

SEQ ID NO: 309015 - DNA, 20 bp, human
ggactagagcgtcgccactc

SEQ ID NO: 309016 - DNA, 20 bp, human
gagaagcgctgagtcatggc

SEQ ID NO: 309017 - DNA, 20 bp, human
gtccgagccggcgtgtgagg

SEQ ID NO: 309018 - DNA, 20 bp, human
gggcaggagatcatccgagc

SEQ ID NO: 309019 - DNA, 20 bp, human
ggaagccggtgtccccagca

SEQ ID NO: 309020 - DNA, 20 bp, human
gcgggcgtgggtggcgagag

SEQ ID NO: 309021 - DNA, 20 bp, human
ggtgatcataagcccatggt

SEQ ID NO: 309022 - DNA, 20 bp, human
gagaggccctatggagccaa

SEQ ID NO: 309023 - DNA, 20 bp, human
gtcctcctcacacgccggct

SEQ ID NO: 309024 - DNA, 20 bp, human
gatgactcagcgcttctcgc

SEQ ID NO: 309025 - DNA, 20 bp, human
gtcatccgagccggcgtgtg

SEQ ID NO: 309026 - DNA, 20 bp, human
gaggacaggaaccccagcgc

SEQ ID NO: 309027 - DNA, 20 bp, human
ggcccacggtggagacggac

SEQ ID NO: 309028 - DNA, 20 bp, human
gtggagacggacgggctcgc

SEQ ID NO: 309029 - DNA, 20 bp, human
gaggcaggaaccggccggag

SEQ ID NO: 309030 - DNA, 20 bp, human
gtgaggaaggcgcggaggac

SEQ ID NO: 309031 - DNA, 20 bp, human
gacctccaggagctgggttg

SEQ ID NO: 309032 - DNA, 20 bp, human
gtcgcgggccaattggaggc

SEQ ID NO: 309033 - DNA, 20 bp, human
ggcccggaaggcgtggccca

SEQ ID NO: 309034 - DNA, 20 bp, human
gccgaagagcggccgagaga

SEQ ID NO: 309035 - DNA, 20 bp, human
gagcccgtccgtctccaccg

SEQ ID NO: 309036 - DNA, 20 bp, human
gtgccaagatggagagtctc

SEQ ID NO: 309037 - DNA, 20 bp, human
ggccccacgcgcgtcctcag

SEQ ID NO: 309038 - DNA, 20 bp, human
gcaggcggggtgaggagctg

SEQ ID NO: 309039 - DNA, 20 bp, human
gcgcgtcctcaggggaagcc

SEQ ID NO: 309040 - DNA, 20 bp, human
ggcactgagaacaaaggttg

SEQ ID NO: 309041 - DNA, 20 bp, human
gcgcctgagactctccatct

SEQ ID NO: 309042 - DNA, 20 bp, human
gttcccctgaggacgcgcgt

SEQ ID NO: 309043 - DNA, 20 bp, human
gagcgcggtccacccattgg

SEQ ID NO: 309044 - DNA, 20 bp, human
gtctcccaacattcggggaa

SEQ ID NO: 309045 - DNA, 20 bp, human
gctccccgagcagcgcaggt

SEQ ID NO: 309046 - DNA, 20 bp, human
gcgtttcctgagggacgaga

SEQ ID NO: 309047 - DNA, 20 bp, human
gcattacccagtggcctcct

SEQ ID NO: 309048 - DNA, 20 bp, human
gtcaatcatggatatggggc

SEQ ID NO: 309049 - DNA, 20 bp, human
gtcgttggggactaaggcgt

SEQ ID NO: 309050 - DNA, 20 bp, human
gaatgacggaggcggggcaa

SEQ ID NO: 309051 - DNA, 20 bp, human
gagcccgcggcctccacttc

SEQ ID NO: 309052 - DNA, 20 bp, human
gtcgtccctcaggaaacgta

SEQ ID NO: 309053 - DNA, 20 bp, human
gcaaatatgtgtcgagaccg

SEQ ID NO: 309054 - DNA, 20 bp, human
gtcgagaccgaggaggccac

SEQ ID NO: 309055 - DNA, 20 bp, human
gccagcgtcaatcatggata

SEQ ID NO: 309056 - DNA, 20 bp, human
gtcggagagctctagagatg

SEQ ID NO: 309057 - DNA, 20 bp, human
gctaaggccggggctctcga

SEQ ID NO: 309058 - DNA, 20 bp, human
ggggcgcacaggagactcgg

SEQ ID NO: 309059 - DNA, 20 bp, human
gccgagcttcgctaaggccg

SEQ ID NO: 309060 - DNA, 20 bp, human
ggcggggcgcacaggagact

SEQ ID NO: 309061 - DNA, 20 bp, human
gacggcgctgcacgcgtctc

SEQ ID NO: 309062 - DNA, 20 bp, human
gtctctagagctctccgaga

SEQ ID NO: 309063 - DNA, 20 bp, human
gggactgaagcggggcgcac

SEQ ID NO: 309064 - DNA, 20 bp, human
gaaagccggcggccagccga

SEQ ID NO: 309065 - DNA, 20 bp, human
ggatcccaggtcaagctcta

SEQ ID NO: 309066 - DNA, 20 bp, human
gacacctcgcccaaaaaaag

SEQ ID NO: 309067 - DNA, 20 bp, human
gaggcggagaaagggagccg

SEQ ID NO: 309068 - DNA, 20 bp, human
gcagatggcaatcgccgagg

SEQ ID NO: 309069 - DNA, 20 bp, human
gatggcaatcgccgaggagg

SEQ ID NO: 309070 - DNA, 20 bp, human
ggcgaacgcagggagccaga

SEQ ID NO: 309071 - DNA, 20 bp, human
gcgaggtgtctgctcccctc

SEQ ID NO: 309072 - DNA, 20 bp, human
ggcggcgctgagatgttgga

SEQ ID NO: 309073 - DNA, 20 bp, human
gtgtcagatggcaatcgccg

SEQ ID NO: 309074 - DNA, 20 bp, human
ggggggaattgaaaaggctt

SEQ ID NO: 309075 - DNA, 20 bp, human
ggtctagcgcgcatgtgcga

SEQ ID NO: 309076 - DNA, 20 bp, human
gctgcgagcccgcccgtcat

SEQ ID NO: 309077 - DNA, 20 bp, human
gcatcacagccaatgacggg

SEQ ID NO: 309078 - DNA, 20 bp, human
ggggctcgcagcggcgccga

SEQ ID NO: 309079 - DNA, 20 bp, human
gcgtcattggctgtgatggc

SEQ ID NO: 309080 - DNA, 20 bp, human
gtggggaaaagaggcggctt

SEQ ID NO: 309081 - DNA, 20 bp, human
gttccctggccgaaatggac

SEQ ID NO: 309082 - DNA, 20 bp, human
gcccttttccctggccgaaa

SEQ ID NO: 309083 - DNA, 20 bp, human
gcgcgggccggccaagaggg

SEQ ID NO: 309084 - DNA, 20 bp, human
gcagccaatcaacagctgga

SEQ ID NO: 309085 - DNA, 20 bp, human
gaggaaatctcgccaattga

SEQ ID NO: 309086 - DNA, 20 bp, human
gtagccaggcgccaccactt

SEQ ID NO: 309087 - DNA, 20 bp, human
ggggccccggagggatccgg

SEQ ID NO: 309088 - DNA, 20 bp, human
gtggtcacccggcggggcag

SEQ ID NO: 309089 - DNA, 20 bp, human
gccgcacccccggatccctc

SEQ ID NO: 309090 - DNA, 20 bp, human
gtgtgggccccggagggatc

SEQ ID NO: 309091 - DNA, 20 bp, human
ggaaggaaacgcccttcaaa

SEQ ID NO: 309092 - DNA, 20 bp, human
gcccccttggtccctttgaa

SEQ ID NO: 309093 - DNA, 20 bp, human
gccacttgggcagcgaagga

SEQ ID NO: 309094 - DNA, 20 bp, human
gggggagtggtcacccggcg

SEQ ID NO: 309095 - DNA, 20 bp, human
ggccaccacttgggcagcga

SEQ ID NO: 309096 - DNA, 20 bp, human
gtgagacagctcagatcaaa

SEQ ID NO: 309097 - DNA, 20 bp, human
gggagccgaaagctaccggc

SEQ ID NO: 309098 - DNA, 20 bp, human
gcaggggagccgaaagctac

SEQ ID NO: 309099 - DNA, 20 bp, human
gaaaatggcggtttccgcag

SEQ ID NO: 309100 - DNA, 20 bp, human
gcgaatattggtcaatgcgt

SEQ ID NO: 309101 - DNA, 20 bp, human
gcggcaggtttaatatccag

SEQ ID NO: 309102 - DNA, 20 bp, human
gcctgccggccggtagcttt

SEQ ID NO: 309103 - DNA, 20 bp, human
ggtctcaggcctcgcgccgc

SEQ ID NO: 309104 - DNA, 20 bp, human
gattttgggaagttccgttg

SEQ ID NO: 309105 - DNA, 20 bp, human
gggatattaaacctgccggc

SEQ ID NO: 309106 - DNA, 20 bp, human
gggagcgcgggcgagctctt

SEQ ID NO: 309107 - DNA, 20 bp, human
gggagcctcgttatcgggac

SEQ ID NO: 309108 - DNA, 20 bp, human
ggggacgggcgtgttggggc

SEQ ID NO: 309109 - DNA, 20 bp, human
gcacgcccgtcccgataacg

SEQ ID NO: 309110 - DNA, 20 bp, human
gtatcgggacgggcgtgttg

SEQ ID NO: 309111 - DNA, 20 bp, human
gggggcggggcctaagtgcg

SEQ ID NO: 309112 - DNA, 20 bp, human
gcggggcctaagtgcggggc

SEQ ID NO: 309113 - DNA, 20 bp, human
gcggggcagggcgggctttc

SEQ ID NO: 309114 - DNA, 20 bp, human
gcccgccctgccccgcactt

SEQ ID NO: 309115 - DNA, 20 bp, human
gggctttcggggatgcggtc

SEQ ID NO: 309116 - DNA, 20 bp, human
gccactgtcgcctctgacta

SEQ ID NO: 309117 - DNA, 20 bp, human
gctgactacgggtggtcctg

SEQ ID NO: 309118 - DNA, 20 bp, human
gtacacggtgccctctgcgc

SEQ ID NO: 309119 - DNA, 20 bp, human
gtctgaatggcctcgggcta

SEQ ID NO: 309120 - DNA, 20 bp, human
gggacaggtctgaatggcct

SEQ ID NO: 309121 - DNA, 20 bp, human
gttcatcaagcggaccgagg

SEQ ID NO: 309122 - DNA, 20 bp, human
gaatcgtagtgctcgctaca

SEQ ID NO: 309123 - DNA, 20 bp, human
gtggaatatcccctagcccg

SEQ ID NO: 309124 - DNA, 20 bp, human
gggagttgtagttcatcaag

SEQ ID NO: 309125 - DNA, 20 bp, human
gatcttcttgacactgtctg

SEQ ID NO: 309126 - DNA, 20 bp, human
gtgccccgggagtttttcgg

SEQ ID NO: 309127 - DNA, 20 bp, human
gaggtggggcctggcccggt

SEQ ID NO: 309128 - DNA, 20 bp, human
gcggaggcgcagaatgagct

SEQ ID NO: 309129 - DNA, 20 bp, human
ggaggtacgccgggaaccat

SEQ ID NO: 309130 - DNA, 20 bp, human
ggagggaagccgaggtacgc

SEQ ID NO: 309131 - DNA, 20 bp, human
gccaccgccgaaaaactccc

SEQ ID NO: 309132 - DNA, 20 bp, human
gctgtgccccgggagttttt

SEQ ID NO: 309133 - DNA, 20 bp, human
ggagctggggatgcaaacca

SEQ ID NO: 309134 - DNA, 20 bp, human
gcggacaataccgactgcag

SEQ ID NO: 309135 - DNA, 20 bp, human
gctgactgggggaacgggaa

SEQ ID NO: 309136 - DNA, 20 bp, human
gcggctgcgaaaacccggag

SEQ ID NO: 309137 - DNA, 20 bp, human
gaaaacccggagaggcggat

SEQ ID NO: 309138 - DNA, 20 bp, human
gctggccctggggtgaacct

SEQ ID NO: 309139 - DNA, 20 bp, human
ggggaccgcgacctctgggg

SEQ ID NO: 309140 - DNA, 20 bp, human
gggccggaccgcggaggagt

SEQ ID NO: 309141 - DNA, 20 bp, human
ggccgtgggggcgagaacgc

SEQ ID NO: 309142 - DNA, 20 bp, human
ggaggagttggctgagagcg

SEQ ID NO: 309143 - DNA, 20 bp, human
gctctgcggctgcgaaaacc

SEQ ID NO: 309144 - DNA, 20 bp, human
gcgctccaatccgcctctcc

SEQ ID NO: 309145 - DNA, 20 bp, human
ggccccgaagcgaggagcga

SEQ ID NO: 309146 - DNA, 20 bp, human
gcgcccgggagaaccgtcct

SEQ ID NO: 309147 - DNA, 20 bp, human
gcccctccgtcccccagaga

SEQ ID NO: 309148 - DNA, 20 bp, human
ggacgctcgtccctctctgg

SEQ ID NO: 309149 - DNA, 20 bp, human
gcgcccgcacaggagcggga

SEQ ID NO: 309150 - DNA, 20 bp, human
ggagcgggaagggcgagaac

SEQ ID NO: 309151 - DNA, 20 bp, human
gagcccaggacggttctccc

SEQ ID NO: 309152 - DNA, 20 bp, human
ggcagacgctcgtccctctc

SEQ ID NO: 309153 - DNA, 20 bp, human
gcggggggggggtagtggtt

SEQ ID NO: 309154 - DNA, 20 bp, human
gtgcgggcgcctctccgccc

SEQ ID NO: 309155 - DNA, 20 bp, human
gagacaccggggagggccgg

SEQ ID NO: 309156 - DNA, 20 bp, human
ggaggggtccggagtggcgg

SEQ ID NO: 309157 - DNA, 20 bp, human
gggtcctccggccgggaaga

SEQ ID NO: 309158 - DNA, 20 bp, human
ggcgccacgccagccggcct

SEQ ID NO: 309159 - DNA, 20 bp, human
gggccgcgcggggggagcga

SEQ ID NO: 309160 - DNA, 20 bp, human
gcgggccgagccgcggtcgg

SEQ ID NO: 309161 - DNA, 20 bp, human
gggagaagcgaggctgactg

SEQ ID NO: 309162 - DNA, 20 bp, human
gtgcactgatcgtggcgggg

SEQ ID NO: 309163 - DNA, 20 bp, human
gtggcgcttggtcacgtgac

SEQ ID NO: 309164 - DNA, 20 bp, human
ggcggtgcactgatcgtggc

SEQ ID NO: 309165 - DNA, 20 bp, human
gcacgatcagtgcaccgcga

SEQ ID NO: 309166 - DNA, 20 bp, human
gcggaagtcgatcggcagag

SEQ ID NO: 309167 - DNA, 20 bp, human
ggcgcgcgggagagcggaaa

SEQ ID NO: 309168 - DNA, 20 bp, human
ggccgccggaaaccagggtg

SEQ ID NO: 309169 - DNA, 20 bp, human
ggcccgaggcggaagtcgat

SEQ ID NO: 309170 - DNA, 20 bp, human
gccgccccctggcgttgtaa

SEQ ID NO: 309171 - DNA, 20 bp, human
gagggagagcggcgagggta

SEQ ID NO: 309172 - DNA, 20 bp, human
gcgcgcgccgccggaaacca

SEQ ID NO: 309173 - DNA, 20 bp, human
gagagcggcgagggtaaggg

SEQ ID NO: 309174 - DNA, 20 bp, human
ggggcaactgctgacgttcc

SEQ ID NO: 309175 - DNA, 20 bp, human
gacgttcccggtgacgactc

SEQ ID NO: 309176 - DNA, 20 bp, human
gttggcctggcatcccggag

SEQ ID NO: 309177 - DNA, 20 bp, human
gaccgagaccgcttcgtccc

SEQ ID NO: 309178 - DNA, 20 bp, human
gaagcggtctcggttccgcc

SEQ ID NO: 309179 - DNA, 20 bp, human
gcgtgtgtctcccagccggg

SEQ ID NO: 309180 - DNA, 20 bp, human
gccgtgtccgacagctgcac

SEQ ID NO: 309181 - DNA, 20 bp, human
ggggaaatgaagttccccgc

SEQ ID NO: 309182 - DNA, 20 bp, human
gcggaggggtctggatctca

SEQ ID NO: 309183 - DNA, 20 bp, human
gtcggccgagccggaagtga

SEQ ID NO: 309184 - DNA, 20 bp, human
ggccgagccggaagtgaagg

SEQ ID NO: 309185 - DNA, 20 bp, human
gtcggccgaggcactgcgga

SEQ ID NO: 309186 - DNA, 20 bp, human
ggcgcggcgcacccacgtga

SEQ ID NO: 309187 - DNA, 20 bp, human
ggaggctgggcgagaggagc

SEQ ID NO: 309188 - DNA, 20 bp, human
gcccgcgctgctacccggcc

SEQ ID NO: 309189 - DNA, 20 bp, human
ggggccagacgtaggcccgg

SEQ ID NO: 309190 - DNA, 20 bp, human
ggaacccccgggcctacgtc

SEQ ID NO: 309191 - DNA, 20 bp, human
gtgggccggggacaagctag

SEQ ID NO: 309192 - DNA, 20 bp, human
gcgccgggcgggccagacgt

SEQ ID NO: 309193 - DNA, 20 bp, human
gtccccgccacgtcaggccg

SEQ ID NO: 309194 - DNA, 20 bp, human
gtagcggcgcggagtccgag

SEQ ID NO: 309195 - DNA, 20 bp, human
gaggcgtgagccgaacgggc

SEQ ID NO: 309196 - DNA, 20 bp, human
gctaccaaatatagctacgg

SEQ ID NO: 309197 - DNA, 20 bp, human
gcgccctcccagaagtcttt

SEQ ID NO: 309198 - DNA, 20 bp, human
gcagccaccgtagctatatt

SEQ ID NO: 309199 - DNA, 20 bp, human
gcctcccaaagacttctggg

SEQ ID NO: 309200 - DNA, 20 bp, human
gcgtatgcaaatagccccgg

SEQ ID NO: 309201 - DNA, 20 bp, human
gaactaacgtagttattgac

SEQ ID NO: 309202 - DNA, 20 bp, human
ggacttctgggagggcggtg

SEQ ID NO: 309203 - DNA, 20 bp, human
gaacaaatgtctgtacacat

SEQ ID NO: 309204 - DNA, 20 bp, human
gatgcaaatagccccggagg

SEQ ID NO: 309205 - DNA, 20 bp, human
gtgctgggaattactggaaa

SEQ ID NO: 309206 - DNA, 20 bp, human
gggcaggcgcggaagctcca

SEQ ID NO: 309207 - DNA, 20 bp, human
gtccgggcctataagaggcg

SEQ ID NO: 309208 - DNA, 20 bp, human
gtgccggccacgcctcttat

SEQ ID NO: 309209 - DNA, 20 bp, human
ggcagaggctagaagagtta

SEQ ID NO: 309210 - DNA, 20 bp, human
gcagggtggggtaaacttcc

SEQ ID NO: 309211 - DNA, 20 bp, human
gaagaggcgtggccggcaga

SEQ ID NO: 309212 - DNA, 20 bp, human
gaatatacccgccacactct

SEQ ID NO: 309213 - DNA, 20 bp, human
gggcctataagaggcgtggc

SEQ ID NO: 309214 - DNA, 20 bp, human
gagggagggaaagagcggtt

SEQ ID NO: 309215 - DNA, 20 bp, human
gtgggagccgagagtgtggc

SEQ ID NO: 309216 - DNA, 20 bp, human
gctgccgttcccaaacgtat

SEQ ID NO: 309217 - DNA, 20 bp, human
gtccgaccggaagtgagaag

SEQ ID NO: 309218 - DNA, 20 bp, human
gcgggctgctgtatgaaaga

SEQ ID NO: 309219 - DNA, 20 bp, human
gaggccgaagagcttcattg

SEQ ID NO: 309220 - DNA, 20 bp, human
gaggcgcatgcgcaaaattc

SEQ ID NO: 309221 - DNA, 20 bp, human
gaaacgtatgggtgccgaga

SEQ ID NO: 309222 - DNA, 20 bp, human
gattgcggacagacaatcag

SEQ ID NO: 309223 - DNA, 20 bp, human
gcggaggaaagcgccaaagg

SEQ ID NO: 309224 - DNA, 20 bp, human
gtgtccgcaatgaagctctt

SEQ ID NO: 309225 - DNA, 20 bp, human
ggcccggaggaaagcgccaa

SEQ ID NO: 309226 - DNA, 20 bp, human
ggggctatatcgcaaacgta

SEQ ID NO: 309227 - DNA, 20 bp, human
gtcaaggagccgcttgtcat

SEQ ID NO: 309228 - DNA, 20 bp, human
gtccgcctaagtcattttat

SEQ ID NO: 309229 - DNA, 20 bp, human
gggggcgagacctacgacgc

SEQ ID NO: 309230 - DNA, 20 bp, human
gcgttcagagaactacatcc

SEQ ID NO: 309231 - DNA, 20 bp, human
gtcgccttatgagaacgttc

SEQ ID NO: 309232 - DNA, 20 bp, human
gtgaggcatccaatgacaag

SEQ ID NO: 309233 - DNA, 20 bp, human
gcttcctgaacgttctcata

SEQ ID NO: 309234 - DNA, 20 bp, human
gcactgctcgccggcgtcgt

SEQ ID NO: 309235 - DNA, 20 bp, human
gtgtagttctctgaacgctg

SEQ ID NO: 309236 - DNA, 20 bp, human
gtcagtggaggcgtcaccga

SEQ ID NO: 309237 - DNA, 20 bp, human
gaatccgcagatgatgtcag

SEQ ID NO: 309238 - DNA, 20 bp, human
gcctccactgacatcatctg

SEQ ID NO: 309239 - DNA, 20 bp, human
ggcacgtggggactgaagaa

SEQ ID NO: 309240 - DNA, 20 bp, human
ggagacacgccccattcctt

SEQ ID NO: 309241 - DNA, 20 bp, human
gctcctagcttcatggatgt

SEQ ID NO: 309242 - DNA, 20 bp, human
gaacccgggagctcttttag

SEQ ID NO: 309243 - DNA, 20 bp, human
gcacgccttccccaaggaat

SEQ ID NO: 309244 - DNA, 20 bp, human
gaaatccagacattcccgtt

SEQ ID NO: 309245 - DNA, 20 bp, human
gctggcctccgaatgctagg

SEQ ID NO: 309246 - DNA, 20 bp, human
gctagagcgggctacacctg

SEQ ID NO: 309247 - DNA, 20 bp, human
gggtgtagcccgctctagaa

SEQ ID NO: 309248 - DNA, 20 bp, human
gtccccgccccgtcaggagt

SEQ ID NO: 309249 - DNA, 20 bp, human
ggtaccacccactcctgacg

SEQ ID NO: 309250 - DNA, 20 bp, human
gtccttggaacgggtggggt

SEQ ID NO: 309251 - DNA, 20 bp, human
gctgcgtccttggaacgggt

SEQ ID NO: 309252 - DNA, 20 bp, human
ggtgggtggtactcccgagg

SEQ ID NO: 309253 - DNA, 20 bp, human
gggagtgggtggtactcccg

SEQ ID NO: 309254 - DNA, 20 bp, human
gcgctctagaaaggccgcct

SEQ ID NO: 309255 - DNA, 20 bp, human
gccacccactcctgacgggg

SEQ ID NO: 309256 - DNA, 20 bp, human
gacagctcactcaccatctt

SEQ ID NO: 309257 - DNA, 20 bp, human
gggcgctggggcgggtatga

SEQ ID NO: 309258 - DNA, 20 bp, human
gcggggaagagagactgcgg

SEQ ID NO: 309259 - DNA, 20 bp, human
gagatcgcgagagttgatac

SEQ ID NO: 309260 - DNA, 20 bp, human
gaggagagccccactcggtg

SEQ ID NO: 309261 - DNA, 20 bp, human
ggagaaaggaaagggaattg

SEQ ID NO: 309262 - DNA, 20 bp, human
gaaagctaaaaatcgaggcg

SEQ ID NO: 309263 - DNA, 20 bp, human
gaggagcaggaggccctccg

SEQ ID NO: 309264 - DNA, 20 bp, human
gtcaactctcgcgatctccg

SEQ ID NO: 309265 - DNA, 20 bp, human
gccgccctaggccgacccgg

SEQ ID NO: 309266 - DNA, 20 bp, human
ggggctcaaggttccgtttg

SEQ ID NO: 309267 - DNA, 20 bp, human
gggacgagagcgcccccaaa

SEQ ID NO: 309268 - DNA, 20 bp, human
gaggttccgtctgtggagaa

SEQ ID NO: 309269 - DNA, 20 bp, human
gccaacagcaggaacctgta

SEQ ID NO: 309270 - DNA, 20 bp, human
gagaagggcggcccgcaagc

SEQ ID NO: 309271 - DNA, 20 bp, human
gcaccagaaggttccgtctg

SEQ ID NO: 309272 - DNA, 20 bp, human
ggccacctcccggctggaga

SEQ ID NO: 309273 - DNA, 20 bp, human
gtccggggtccttgggctca

SEQ ID NO: 309274 - DNA, 20 bp, human
gaagcgacgccgaggagcta

SEQ ID NO: 309275 - DNA, 20 bp, human
gacgatgcctccggggtcct

SEQ ID NO: 309276 - DNA, 20 bp, human
gcggtcgacagtgacgtcgt

SEQ ID NO: 309277 - DNA, 20 bp, human
gaaagggtgtcggaatatga

SEQ ID NO: 309278 - DNA, 20 bp, human
gagtcccttagtttcctcgc

SEQ ID NO: 309279 - DNA, 20 bp, human
ggtgacgtcgtgggcgacgc

SEQ ID NO: 309280 - DNA, 20 bp, human
gcagagactcagggactcga

SEQ ID NO: 309281 - DNA, 20 bp, human
gcctggatgtcctcccttaa

SEQ ID NO: 309282 - DNA, 20 bp, human
gctaacgaatgaaagggtgt

SEQ ID NO: 309283 - DNA, 20 bp, human
gaaaccgtatttgtctgcgc

SEQ ID NO: 309284 - DNA, 20 bp, human
gggactcgagggagctcgaa

SEQ ID NO: 309285 - DNA, 20 bp, human
ggcgccggcgaggaaactaa

SEQ ID NO: 309286 - DNA, 20 bp, human
gtggacgccccgctcaaaga

SEQ ID NO: 309287 - DNA, 20 bp, human
gcgcgtggaagactcagaaa

SEQ ID NO: 309288 - DNA, 20 bp, human
gccgcacggggtatggtccc

SEQ ID NO: 309289 - DNA, 20 bp, human
gtacgcgttgcatagcaacc

SEQ ID NO: 309290 - DNA, 20 bp, human
gcattccgcggcgtcggctg

SEQ ID NO: 309291 - DNA, 20 bp, human
ggctcgcgtcgggcggttta

SEQ ID NO: 309292 - DNA, 20 bp, human
gggaaacagcactcactcga

SEQ ID NO: 309293 - DNA, 20 bp, human
gggcatagttagcccttcta

SEQ ID NO: 309294 - DNA, 20 bp, human
ggtatggtccccgggtccga

SEQ ID NO: 309295 - DNA, 20 bp, human
gcccctcgaagtagggtccc

SEQ ID NO: 309296 - DNA, 20 bp, human
gctaggcagccgttgggagg

SEQ ID NO: 309297 - DNA, 20 bp, human
ggcgggaaaatccttcctct

SEQ ID NO: 309298 - DNA, 20 bp, human
gcggctgggcggggcgtcac

SEQ ID NO: 309299 - DNA, 20 bp, human
gcctccgcgcaagcgcgcgc

SEQ ID NO: 309300 - DNA, 20 bp, human
gccgccccgtgacctggacg

SEQ ID NO: 309301 - DNA, 20 bp, human
gaggcgcggggcgtggcaca

SEQ ID NO: 309302 - DNA, 20 bp, human
gcgtcggcgccacgctgagg

SEQ ID NO: 309303 - DNA, 20 bp, human
gcagccgttgggaggaggtt

SEQ ID NO: 309304 - DNA, 20 bp, human
gcctcagagggtgtgggaat

SEQ ID NO: 309305 - DNA, 20 bp, human
ggcgccacgctgaggaggtt

SEQ ID NO: 309306 - DNA, 20 bp, human
ggggaaatgcagttcgcgcg

SEQ ID NO: 309307 - DNA, 20 bp, human
gtccccaaacttgcactctg

SEQ ID NO: 309308 - DNA, 20 bp, human
gacgtatctccgaagacctc

SEQ ID NO: 309309 - DNA, 20 bp, human
gttctcaacttggggaagtc

SEQ ID NO: 309310 - DNA, 20 bp, human
gattccccagagtgcaagtt

SEQ ID NO: 309311 - DNA, 20 bp, human
gagaaagcactttcgaaaaa

SEQ ID NO: 309312 - DNA, 20 bp, human
ggcactcccggtttgcttaa

SEQ ID NO: 309313 - DNA, 20 bp, human
ggtgcaagtttggggaaatg

SEQ ID NO: 309314 - DNA, 20 bp, human
gttgcactctggggaatcat

SEQ ID NO: 309315 - DNA, 20 bp, human
gcatgcattagtttagctca

SEQ ID NO: 309316 - DNA, 20 bp, human
gtctgagccggcttccgcgc

SEQ ID NO: 309317 - DNA, 20 bp, human
gccgagcgatgggaggattc

SEQ ID NO: 309318 - DNA, 20 bp, human
gctcacgtggctggtgtagt

SEQ ID NO: 309319 - DNA, 20 bp, human
gactgcgcctgcgcggaagc

SEQ ID NO: 309320 - DNA, 20 bp, human
ggacaggaccgagcgatggg

SEQ ID NO: 309321 - DNA, 20 bp, human
gcgtgacaggaccgagcgat

SEQ ID NO: 309322 - DNA, 20 bp, human
ggattctggtgcaccccgga

SEQ ID NO: 309323 - DNA, 20 bp, human
gggagccgccatgtttggaa

SEQ ID NO: 309324 - DNA, 20 bp, human
ggagccctcctgcgagagtc

SEQ ID NO: 309325 - DNA, 20 bp, human
ggccacgtgagcttctgagc

SEQ ID NO: 309326 - DNA, 20 bp, human
gagagaggtgcttctgtgat

SEQ ID NO: 309327 - DNA, 20 bp, human
gtggcgagcgtctgggtgaa

SEQ ID NO: 309328 - DNA, 20 bp, human
gtgagagtgacgtaacgttg

SEQ ID NO: 309329 - DNA, 20 bp, human
gcggcctgaggagacccgtt

SEQ ID NO: 309330 - DNA, 20 bp, human
gcaaacggggactagaaata

SEQ ID NO: 309331 - DNA, 20 bp, human
gcgagcgtctgggtgaaggg

SEQ ID NO: 309332 - DNA, 20 bp, human
gacgctcgccaatccgtgtg

SEQ ID NO: 309333 - DNA, 20 bp, human
gaggcaattaagccaatgga

SEQ ID NO: 309334 - DNA, 20 bp, human
gaagacgctgaggacccaac

SEQ ID NO: 309335 - DNA, 20 bp, human
gtccggctcggaaccacaca

SEQ ID NO: 309336 - DNA, 20 bp, human
gcagaggggcgatgttcttg

SEQ ID NO: 309337 - DNA, 20 bp, human
gctggagcgcaattggtgat

SEQ ID NO: 309338 - DNA, 20 bp, human
gacccctgggcgggaaagga

SEQ ID NO: 309339 - DNA, 20 bp, human
ggagccgggctggattggat

SEQ ID NO: 309340 - DNA, 20 bp, human
ggagcggagccgggctggat

SEQ ID NO: 309341 - DNA, 20 bp, human
gagaacatcgcccctctggc

SEQ ID NO: 309342 - DNA, 20 bp, human
gggtccaatccaatccagcc

SEQ ID NO: 309343 - DNA, 20 bp, human
gaactgtctccgagcggagc

SEQ ID NO: 309344 - DNA, 20 bp, human
gtcggcgaactgtctccgag

SEQ ID NO: 309345 - DNA, 20 bp, human
gcggagacagttcgccgagt

SEQ ID NO: 309346 - DNA, 20 bp, human
gcgcgggtggagccatccca

SEQ ID NO: 309347 - DNA, 20 bp, human
gggcactgtgggatatgggg

SEQ ID NO: 309348 - DNA, 20 bp, human
gctggctccaaaatagcgag

SEQ ID NO: 309349 - DNA, 20 bp, human
gcccagggctggtcggggat

SEQ ID NO: 309350 - DNA, 20 bp, human
gaagcaccatggtccttcga

SEQ ID NO: 309351 - DNA, 20 bp, human
gccggggcactgtgggatat

SEQ ID NO: 309352 - DNA, 20 bp, human
gtcaggcgctcccacggccc

SEQ ID NO: 309353 - DNA, 20 bp, human
ggtcaccgcaggcagaagag

SEQ ID NO: 309354 - DNA, 20 bp, human
gccccgccccctcgctattt

SEQ ID NO: 309355 - DNA, 20 bp, human
gtgtgggatatggggcgggg

SEQ ID NO: 309356 - DNA, 20 bp, human
ggacaccggcgccatctgtt

SEQ ID NO: 309357 - DNA, 20 bp, human
gccggcccaacagatggcgc

SEQ ID NO: 309358 - DNA, 20 bp, human
gccatctgttgggccggcga

SEQ ID NO: 309359 - DNA, 20 bp, human
gcaggtgcgtggcgagaagg

SEQ ID NO: 309360 - DNA, 20 bp, human
ggcgagaaggcgggctcgga

SEQ ID NO: 309361 - DNA, 20 bp, human
gagttcagctgtcgctccca

SEQ ID NO: 309362 - DNA, 20 bp, human
gtggcgagagcgcccccttt

SEQ ID NO: 309363 - DNA, 20 bp, human
gcggaagagtcacccaggag

SEQ ID NO: 309364 - DNA, 20 bp, human
gtggaccagaaagccctcgc

SEQ ID NO: 309365 - DNA, 20 bp, human
ggcgcctccaggcccaaagg

SEQ ID NO: 309366 - DNA, 20 bp, human
gaggcgggaaacgtggggtg

SEQ ID NO: 309367 - DNA, 20 bp, human
ggcgggaggcgggaaacgtg

SEQ ID NO: 309368 - DNA, 20 bp, human
ggggacgtagagcggaagag

SEQ ID NO: 309369 - DNA, 20 bp, human
gggtgaggagggacgtagag

SEQ ID NO: 309370 - DNA, 20 bp, human
gggttgaagagagtgcgcat

SEQ ID NO: 309371 - DNA, 20 bp, human
gcggaaagcgggagaggcgc

SEQ ID NO: 309372 - DNA, 20 bp, human
gcctaggccgccggaagcag

SEQ ID NO: 309373 - DNA, 20 bp, human
gacgcgagggggcggaaagc

SEQ ID NO: 309374 - DNA, 20 bp, human
gccaaagaaggagaacggga

SEQ ID NO: 309375 - DNA, 20 bp, human
ggacgcagaaagattggtgc

SEQ ID NO: 309376 - DNA, 20 bp, human
ggactaagtcagtaaaagag

SEQ ID NO: 309377 - DNA, 20 bp, human
gcttttaaaagtcgtagctg

SEQ ID NO: 309378 - DNA, 20 bp, human
gaggcgcaacagcgagggat

SEQ ID NO: 309379 - DNA, 20 bp, human
gtacgtaggcgcaacagcga

SEQ ID NO: 309380 - DNA, 20 bp, human
gcagctcttacagccaatca

SEQ ID NO: 309381 - DNA, 20 bp, human
gcaatcaaggacagagtcgg

SEQ ID NO: 309382 - DNA, 20 bp, human
gaagggggtggaatatacgc

SEQ ID NO: 309383 - DNA, 20 bp, human
gcagtaaaagagtggtaatg

SEQ ID NO: 309384 - DNA, 20 bp, human
gagagtcggtggcttcttcc

SEQ ID NO: 309385 - DNA, 20 bp, human
gccaacttccggtctcctcc

SEQ ID NO: 309386 - DNA, 20 bp, human
gtgggccccgagatccgagg

SEQ ID NO: 309387 - DNA, 20 bp, human
ggccgaggtagcgaggtcag

SEQ ID NO: 309388 - DNA, 20 bp, human
gacccctgacctcgctacct

SEQ ID NO: 309389 - DNA, 20 bp, human
gcactgggccccgagatccg

SEQ ID NO: 309390 - DNA, 20 bp, human
ggggaccagcccagcccgga

SEQ ID NO: 309391 - DNA, 20 bp, human
ggcgccggcccgggccagtg

SEQ ID NO: 309392 - DNA, 20 bp, human
gcggccctcccaccaacttc

SEQ ID NO: 309393 - DNA, 20 bp, human
gccccgagatccgaggggga

SEQ ID NO: 309394 - DNA, 20 bp, human
gcccagcaggaaccggaagt

SEQ ID NO: 309395 - DNA, 20 bp, human
gagatccgagggggagggtc

SEQ ID NO: 309396 - DNA, 20 bp, human
gctgggcagtcggcgggaaa

SEQ ID NO: 309397 - DNA, 20 bp, human
gagcgtgcgcactgggcagt

SEQ ID NO: 309398 - DNA, 20 bp, human
gtcggcgggaaaaggcgcgg

SEQ ID NO: 309399 - DNA, 20 bp, human
gggtctggggtgcctggatt

SEQ ID NO: 309400 - DNA, 20 bp, human
gttgctaggcaacgggccgt

SEQ ID NO: 309401 - DNA, 20 bp, human
gaacgggccgtgggtgggtc

SEQ ID NO: 309402 - DNA, 20 bp, human
gtgcgcactgggcagtcggc

SEQ ID NO: 309403 - DNA, 20 bp, human
gctaggcaacgggccgtggg

SEQ ID NO: 309404 - DNA, 20 bp, human
gtcaccaccgcgcgccctgc

SEQ ID NO: 309405 - DNA, 20 bp, human
gtgactcacaatccaaatcc

SEQ ID NO: 309406 - DNA, 20 bp, human
gttgagtagtggaccccagg

SEQ ID NO: 309407 - DNA, 20 bp, human
gactctgccccgagcctctg

SEQ ID NO: 309408 - DNA, 20 bp, human
ggggacccagaggctgtcaa

SEQ ID NO: 309409 - DNA, 20 bp, human
gcagcgctggtgttgagtag

SEQ ID NO: 309410 - DNA, 20 bp, human
ggtgttgagtagtggacccc

SEQ ID NO: 309411 - DNA, 20 bp, human
gcctctggggtcgtggccgt

SEQ ID NO: 309412 - DNA, 20 bp, human
ggtcccaggtggaatgggta

SEQ ID NO: 309413 - DNA, 20 bp, human
ggccacgaccccagaggctc

SEQ ID NO: 309414 - DNA, 20 bp, human
gcctgcctggcggacactgc

SEQ ID NO: 309415 - DNA, 20 bp, human
gtctgggtcccaggtggaat

SEQ ID NO: 309416 - DNA, 20 bp, human
ggatggggagaagcgaggaa

SEQ ID NO: 309417 - DNA, 20 bp, human
ggggctgcggagggacaccg

SEQ ID NO: 309418 - DNA, 20 bp, human
gaaactgatggggagaagcg

SEQ ID NO: 309419 - DNA, 20 bp, human
gcacaggaagaagatgacgg

SEQ ID NO: 309420 - DNA, 20 bp, human
gcacagaacgagttccggtc

SEQ ID NO: 309421 - DNA, 20 bp, human
gcgcgcacggatccccacac

SEQ ID NO: 309422 - DNA, 20 bp, human
gtcccggcctgggctcccgg

SEQ ID NO: 309423 - DNA, 20 bp, human
ggtcctgaaaagaaactgat

SEQ ID NO: 309424 - DNA, 20 bp, human
gagtcacggtgcttggaagc

SEQ ID NO: 309425 - DNA, 20 bp, human
ggatccgtgcgcggatgtcc

SEQ ID NO: 309426 - DNA, 20 bp, human
gaaggaggcacacccggggg

SEQ ID NO: 309427 - DNA, 20 bp, human
ggggcgtctggaacttaaag

SEQ ID NO: 309428 - DNA, 20 bp, human
gggccctctgacaccggaac

SEQ ID NO: 309429 - DNA, 20 bp, human
gagggaaggaggcacacccg

SEQ ID NO: 309430 - DNA, 20 bp, human
gagggcgggccctctgacac

SEQ ID NO: 309431 - DNA, 20 bp, human
gggggcagagggctaaagaa

SEQ ID NO: 309432 - DNA, 20 bp, human
gtccctctggaaaaatctgt

SEQ ID NO: 309433 - DNA, 20 bp, human
ggtcccttctgcggtctcaa

SEQ ID NO: 309434 - DNA, 20 bp, human
gaagaagtaggggaagtacg

SEQ ID NO: 309435 - DNA, 20 bp, human
ggcgacacccaggcaggaga

SEQ ID NO: 309436 - DNA, 20 bp, human
ggggcgtctggaacttaaag

SEQ ID NO: 309437 - DNA, 20 bp, human
gcattccctccgagtcggtg

SEQ ID NO: 309438 - DNA, 20 bp, human
gtccctctggaaaaatctgt

SEQ ID NO: 309439 - DNA, 20 bp, human
gaaggaggcacacccggggg

SEQ ID NO: 309440 - DNA, 20 bp, human
gccctccgagtcggtgagga

SEQ ID NO: 309441 - DNA, 20 bp, human
gaagaagtaggggaagtacg

SEQ ID NO: 309442 - DNA, 20 bp, human
gccctcccctaagtcttaaa

SEQ ID NO: 309443 - DNA, 20 bp, human
gccgcccattccctccgagt

SEQ ID NO: 309444 - DNA, 20 bp, human
gggccctctgacaccggaac

SEQ ID NO: 309445 - DNA, 20 bp, human
gggggcagagggctaaagaa

SEQ ID NO: 309446 - DNA, 20 bp, human
gaaggaggcacacccggggg

SEQ ID NO: 309447 - DNA, 20 bp, human
ggggcgtctggaacttaaag

SEQ ID NO: 309448 - DNA, 20 bp, human
gggccctctgacaccggaac

SEQ ID NO: 309449 - DNA, 20 bp, human
gagggaaggaggcacacccg

SEQ ID NO: 309450 - DNA, 20 bp, human
gagggcgggccctctgacac

SEQ ID NO: 309451 - DNA, 20 bp, human
gggggcagagggctaaagaa

SEQ ID NO: 309452 - DNA, 20 bp, human
gtccctctggaaaaatctgt

SEQ ID NO: 309453 - DNA, 20 bp, human
ggtcccttctgcggtctcaa

SEQ ID NO: 309454 - DNA, 20 bp, human
gaagaagtaggggaagtacg

SEQ ID NO: 309455 - DNA, 20 bp, human
ggcgacacccaggcaggaga

SEQ ID NO: 309456 - DNA, 20 bp, human
gcgccgaggccgctcggaag

SEQ ID NO: 309457 - DNA, 20 bp, human
gggggggattgaaggatact

SEQ ID NO: 309458 - DNA, 20 bp, human
gtcaacggtttgggattgtg

SEQ ID NO: 309459 - DNA, 20 bp, human
gaggaaagagtcaacggttt

SEQ ID NO: 309460 - DNA, 20 bp, human
gggattgaaggatactggga

SEQ ID NO: 309461 - DNA, 20 bp, human
gctcgcgaggaaagagtcaa

SEQ ID NO: 309462 - DNA, 20 bp, human
gtgaaggatactgggagggg

SEQ ID NO: 309463 - DNA, 20 bp, human
gtgggggcgggggggattga

SEQ ID NO: 309464 - DNA, 20 bp, human
ggaagtgacagaagacgaat

SEQ ID NO: 309465 - DNA, 20 bp, human
gctcctcttccgagcggcct

SEQ ID NO: 309466 - DNA, 20 bp, human
gccagccctggggaagcgag

SEQ ID NO: 309467 - DNA, 20 bp, human
gaggggcggggccgcgtcct

SEQ ID NO: 309468 - DNA, 20 bp, human
gtccgccccgccacccccac

SEQ ID NO: 309469 - DNA, 20 bp, human
gcgtcggcctcgactcccgg

SEQ ID NO: 309470 - DNA, 20 bp, human
gagacccagaggcctttaaa

SEQ ID NO: 309471 - DNA, 20 bp, human
ggggctggaggagttacctt

SEQ ID NO: 309472 - DNA, 20 bp, human
gcgccgcagcctagcttggg

SEQ ID NO: 309473 - DNA, 20 bp, human
gcccaccgccctcccaagct

SEQ ID NO: 309474 - DNA, 20 bp, human
ggtgctccgaggggcaccgt

SEQ ID NO: 309475 - DNA, 20 bp, human
gcagcgccgcagcctagctt

SEQ ID NO: 309476 - DNA, 20 bp, human
gggaactgagactaagggta

SEQ ID NO: 309477 - DNA, 20 bp, human
gttggtgggaactgagacta

SEQ ID NO: 309478 - DNA, 20 bp, human
gtgtctgtggtctagtgtgg

SEQ ID NO: 309479 - DNA, 20 bp, human
gagtgtggaggcgaggtcca

SEQ ID NO: 309480 - DNA, 20 bp, human
gcagatgggcaagtctgcaa

SEQ ID NO: 309481 - DNA, 20 bp, human
gtgggggcacatgtctgcca

SEQ ID NO: 309482 - DNA, 20 bp, human
ggctggcagagcgggtgagt

SEQ ID NO: 309483 - DNA, 20 bp, human
gtggcaggaaggaagattgg

SEQ ID NO: 309484 - DNA, 20 bp, human
ggaagattggagggggtgtc

SEQ ID NO: 309485 - DNA, 20 bp, human
gaaatgctctgtgtcttggt

SEQ ID NO: 309486 - DNA, 20 bp, human
gcccgagcggccaactggag

SEQ ID NO: 309487 - DNA, 20 bp, human
gaatgttggggtcaccgcag

SEQ ID NO: 309488 - DNA, 20 bp, human
gcaggggcgactcacgatcg

SEQ ID NO: 309489 - DNA, 20 bp, human
ggtggaagccgctcaggcag

SEQ ID NO: 309490 - DNA, 20 bp, human
ggcaacatgcaggatcttcc

SEQ ID NO: 309491 - DNA, 20 bp, human
gtacatggaaaggtggggcg

SEQ ID NO: 309492 - DNA, 20 bp, human
gcaggcggtggaagccgctc

SEQ ID NO: 309493 - DNA, 20 bp, human
gaccgaaggggtgtcagagt

SEQ ID NO: 309494 - DNA, 20 bp, human
gaccgcagggggtgaccgaa

SEQ ID NO: 309495 - DNA, 20 bp, human
gtggtgggtgaccccgccaa

SEQ ID NO: 309496 - DNA, 20 bp, human
gcgtaacagcaggatctgaa

SEQ ID NO: 309497 - DNA, 20 bp, human
gcgagcgcgcgcgtaacagc

SEQ ID NO: 309498 - DNA, 20 bp, human
gtcctcctctatgctctcga

SEQ ID NO: 309499 - DNA, 20 bp, human
gctctcgatgggagatcccg

SEQ ID NO: 309500 - DNA, 20 bp, human
ggacgcgcgagaaggttagc

SEQ ID NO: 309501 - DNA, 20 bp, human
gcactcccccaggagggaaa

SEQ ID NO: 309502 - DNA, 20 bp, human
gccgagggacgaagcgggtg

SEQ ID NO: 309503 - DNA, 20 bp, human
ggaggggccgagggacgaag

SEQ ID NO: 309504 - DNA, 20 bp, human
gagatcccggggatgggagt

SEQ ID NO: 309505 - DNA, 20 bp, human
gaaaaaatgaggggggtgtg

SEQ ID NO: 309506 - DNA, 20 bp, human
gcgctggtggggtaggagat

SEQ ID NO: 309507 - DNA, 20 bp, human
gcgccagccccgcggggtct

SEQ ID NO: 309508 - DNA, 20 bp, human
gagggatacgggcaagtaca

SEQ ID NO: 309509 - DNA, 20 bp, human
ggcgggactcgggaaggctg

SEQ ID NO: 309510 - DNA, 20 bp, human
gaaggtggacggagcgtcca

SEQ ID NO: 309511 - DNA, 20 bp, human
ggcactgtgctcaacgcgcc

SEQ ID NO: 309512 - DNA, 20 bp, human
gagtacaggggccgtgccgg

SEQ ID NO: 309513 - DNA, 20 bp, human
ggcaagtacaggggccgtgc

SEQ ID NO: 309514 - DNA, 20 bp, human
gcccacggggaagccagcct

SEQ ID NO: 309515 - DNA, 20 bp, human
ggggtgaggtgtcagggcga

SEQ ID NO: 309516 - DNA, 20 bp, human
gcatgcggttgggaacaaat

SEQ ID NO: 309517 - DNA, 20 bp, human
ggaggcgagaagttacagag

SEQ ID NO: 309518 - DNA, 20 bp, human
gcaaccccaaccctccataa

SEQ ID NO: 309519 - DNA, 20 bp, human
gccgagcagccgctgtggga

SEQ ID NO: 309520 - DNA, 20 bp, human
gctcccagggccgctctgac

SEQ ID NO: 309521 - DNA, 20 bp, human
ggcgctccgcagtcctccca

SEQ ID NO: 309522 - DNA, 20 bp, human
gacccgctgtgggagggcga

SEQ ID NO: 309523 - DNA, 20 bp, human
gcggccggtcagagcggccc

SEQ ID NO: 309524 - DNA, 20 bp, human
gcaaagcatgggccactgga

SEQ ID NO: 309525 - DNA, 20 bp, human
ggaggacgctgctgcgcatg

SEQ ID NO: 309526 - DNA, 20 bp, human
gggcctacggggctacaaag

SEQ ID NO: 309527 - DNA, 20 bp, human
gagcccggcgggctagagct

SEQ ID NO: 309528 - DNA, 20 bp, human
gcgcggctgccaatcgagga

SEQ ID NO: 309529 - DNA, 20 bp, human
ggcagccgcgcctaaccaat

SEQ ID NO: 309530 - DNA, 20 bp, human
gggcccgcgccccactcttt

SEQ ID NO: 309531 - DNA, 20 bp, human
gcggtccgtgaggcgggaga

SEQ ID NO: 309532 - DNA, 20 bp, human
gtacaaagaggccgggaagc

SEQ ID NO: 309533 - DNA, 20 bp, human
gtcagaggacgtccaggaga

SEQ ID NO: 309534 - DNA, 20 bp, human
gcgggcgggccccagcgcgg

SEQ ID NO: 309535 - DNA, 20 bp, human
gaccgcccgccctcctcgat

SEQ ID NO: 309536 - DNA, 20 bp, human
gcagcgccctgggtccgcgc

SEQ ID NO: 309537 - DNA, 20 bp, human
gttggaggacggacctgcgt

SEQ ID NO: 309538 - DNA, 20 bp, human
gagacgagcagcagccactg

SEQ ID NO: 309539 - DNA, 20 bp, human
gtggtaaagacattcctgca

SEQ ID NO: 309540 - DNA, 20 bp, human
gtctaagcacaaaccgcttt

SEQ ID NO: 309541 - DNA, 20 bp, human
gcgcatgcgcacttggagga

SEQ ID NO: 309542 - DNA, 20 bp, human
ggtggtggacgcaagtgctc

SEQ ID NO: 309543 - DNA, 20 bp, human
ggtccaccacttgccctcag

SEQ ID NO: 309544 - DNA, 20 bp, human
gaatgcgcctgcgcggaccc

SEQ ID NO: 309545 - DNA, 20 bp, human
ggcgcattccacaccgacgc

SEQ ID NO: 309546 - DNA, 20 bp, human
gcataaaagcccactcccgg

SEQ ID NO: 309547 - DNA, 20 bp, human
gaggccccgcccccgggagt

SEQ ID NO: 309548 - DNA, 20 bp, human
gccaggtaggagcgctgcca

SEQ ID NO: 309549 - DNA, 20 bp, human
gcagagatggagggcgaaaa

SEQ ID NO: 309550 - DNA, 20 bp, human
gtcctacctgggacctacat

SEQ ID NO: 309551 - DNA, 20 bp, human
gctagctgggcggggcctga

SEQ ID NO: 309552 - DNA, 20 bp, human
gcttttatgcgcatgcgcga

SEQ ID NO: 309553 - DNA, 20 bp, human
gtatgcgcatgcgcgagggc

SEQ ID NO: 309554 - DNA, 20 bp, human
gttgtctgggattcaagtag

SEQ ID NO: 309555 - DNA, 20 bp, human
ggccaatgtaggtcccaggt

SEQ ID NO: 309556 - DNA, 20 bp, human
ggctcagactcagccctcgg

SEQ ID NO: 309557 - DNA, 20 bp, human
gagactcagccctcggggga

SEQ ID NO: 309558 - DNA, 20 bp, human
ggggctgagtctgagcgcgt

SEQ ID NO: 309559 - DNA, 20 bp, human
ggtccctctaactcccaaga

SEQ ID NO: 309560 - DNA, 20 bp, human
gagtctgagcgcgttggggg

SEQ ID NO: 309561 - DNA, 20 bp, human
gctgagtctgagcgcgttgg

SEQ ID NO: 309562 - DNA, 20 bp, human
ggggcggagtcgctgaggac

SEQ ID NO: 309563 - DNA, 20 bp, human
gttcccgtttcctccttctt

SEQ ID NO: 309564 - DNA, 20 bp, human
gctccttcttgggagttaga

SEQ ID NO: 309565 - DNA, 20 bp, human
ggggcggggcctcgcgctaa

SEQ ID NO: 309566 - DNA, 20 bp, human
ggtgtgttgcacaggcggag

SEQ ID NO: 309567 - DNA, 20 bp, human
ggcaagtaggctcctcggca

SEQ ID NO: 309568 - DNA, 20 bp, human
gaagtagtggtggccataac

SEQ ID NO: 309569 - DNA, 20 bp, human
gaagcgagctctggccgcac

SEQ ID NO: 309570 - DNA, 20 bp, human
gggcacacgcacacaaacgc

SEQ ID NO: 309571 - DNA, 20 bp, human
gcctctctgcctctccagtg

SEQ ID NO: 309572 - DNA, 20 bp, human
gcgcgtcttacacaatgcat

SEQ ID NO: 309573 - DNA, 20 bp, human
ggcattgggctgcagcaagt

SEQ ID NO: 309574 - DNA, 20 bp, human
gcgcgcacccacccctgccg

SEQ ID NO: 309575 - DNA, 20 bp, human
ggtaggctcctcggcagggg

SEQ ID NO: 309576 - DNA, 20 bp, human
ggcaggcttgctgatttgct

SEQ ID NO: 309577 - DNA, 20 bp, human
gagcaagcctgctcctccac

SEQ ID NO: 309578 - DNA, 20 bp, human
gcctgctcctccacggggat

SEQ ID NO: 309579 - DNA, 20 bp, human
gcgcgcgcgaacagggagag

SEQ ID NO: 309580 - DNA, 20 bp, human
gcgcactcgttgcatatcag

SEQ ID NO: 309581 - DNA, 20 bp, human
gtacggcggagacacatccc

SEQ ID NO: 309582 - DNA, 20 bp, human
ggagacacatcccgggagtg

SEQ ID NO: 309583 - DNA, 20 bp, human
gtcccccacccccccagccg

SEQ ID NO: 309584 - DNA, 20 bp, human
ggggaggggaggctcgagcc

SEQ ID NO: 309585 - DNA, 20 bp, human
gaggggaggctcgagccggg

SEQ ID NO: 309586 - DNA, 20 bp, human
gttccggtgggagtcgggga

SEQ ID NO: 309587 - DNA, 20 bp, human
gccaccaaggagcgggatag

SEQ ID NO: 309588 - DNA, 20 bp, human
gagccctgggtaggagagga

SEQ ID NO: 309589 - DNA, 20 bp, human
gcagcacttccggtgggagt

SEQ ID NO: 309590 - DNA, 20 bp, human
gaaacagaaccaccaaggag

SEQ ID NO: 309591 - DNA, 20 bp, human
ggagctacagcacgagggat

SEQ ID NO: 309592 - DNA, 20 bp, human
gagaggggagagcctacggt

SEQ ID NO: 309593 - DNA, 20 bp, human
gctgcagagctacagcacga

SEQ ID NO: 309594 - DNA, 20 bp, human
gagactgagaaacccggagc

SEQ ID NO: 309595 - DNA, 20 bp, human
ggggtccgtggtgtgtccag

SEQ ID NO: 309596 - DNA, 20 bp, human
gaggggtgagggagacttag

SEQ ID NO: 309597 - DNA, 20 bp, human
ggggatcccctggtgtagga

SEQ ID NO: 309598 - DNA, 20 bp, human
gggagacttagaggcatctg

SEQ ID NO: 309599 - DNA, 20 bp, human
gtagagggatcccctggtgt

SEQ ID NO: 309600 - DNA, 20 bp, human
gaccaggggatccctctacc

SEQ ID NO: 309601 - DNA, 20 bp, human
ggcaccctgccctgcgaagg

SEQ ID NO: 309602 - DNA, 20 bp, human
gaactcatccccactgatcc

SEQ ID NO: 309603 - DNA, 20 bp, human
gactcagtctatcctggtag

SEQ ID NO: 309604 - DNA, 20 bp, human
gtggagccttccgaggtatt

SEQ ID NO: 309605 - DNA, 20 bp, human
ggggcggggcctagctaagg

SEQ ID NO: 309606 - DNA, 20 bp, human
ggcgccggatcccagggaag

SEQ ID NO: 309607 - DNA, 20 bp, human
gcgcgcggcgccggatccca

SEQ ID NO: 309608 - DNA, 20 bp, human
gcgaccgcgagccgttgccc

SEQ ID NO: 309609 - DNA, 20 bp, human
gtcgctgtggagccgtgaaa

SEQ ID NO: 309610 - DNA, 20 bp, human
gcaacggctcgcggtcgctg

SEQ ID NO: 309611 - DNA, 20 bp, human
gaggtccactgggctgcgag

SEQ ID NO: 309612 - DNA, 20 bp, human
gggacgcgcacggcaggcgg

SEQ ID NO: 309613 - DNA, 20 bp, human
gggggcgcgcacagtgccgg

SEQ ID NO: 309614 - DNA, 20 bp, human
gcgtgcgcgtccgcttccct

SEQ ID NO: 309615 - DNA, 20 bp, human
gaaatctcccgggccggaag

SEQ ID NO: 309616 - DNA, 20 bp, human
gcctgcgcagaacctcccgg

SEQ ID NO: 309617 - DNA, 20 bp, human
gctggggtggcgctcttcgt

SEQ ID NO: 309618 - DNA, 20 bp, human
ggggtggcgctcttcgtggg

SEQ ID NO: 309619 - DNA, 20 bp, human
ggaaccatcgtcagtccccg

SEQ ID NO: 309620 - DNA, 20 bp, human
ggagcctcggggactgacga

SEQ ID NO: 309621 - DNA, 20 bp, human
gtgaccagcccagttagaag

SEQ ID NO: 309622 - DNA, 20 bp, human
gaccttggccaggactcacg

SEQ ID NO: 309623 - DNA, 20 bp, human
ggcggactgcagagagcctc

SEQ ID NO: 309624 - DNA, 20 bp, human
gtccgcgtgagtcctggcca

SEQ ID NO: 309625 - DNA, 20 bp, human
ggcgcctgcgcagaacctcc

SEQ ID NO: 309626 - DNA, 20 bp, human
gtccacgaggacagtcccgc

SEQ ID NO: 309627 - DNA, 20 bp, human
gctcaaatggagagcaccta

SEQ ID NO: 309628 - DNA, 20 bp, human
gacccgcgggactgtcctcg

SEQ ID NO: 309629 - DNA, 20 bp, human
gcggggtttagcggcagcag

SEQ ID NO: 309630 - DNA, 20 bp, human
gggagagcacctagggctcg

SEQ ID NO: 309631 - DNA, 20 bp, human
gggagcaggacgcagccgca

SEQ ID NO: 309632 - DNA, 20 bp, human
ggccgctaaaccccggagag

SEQ ID NO: 309633 - DNA, 20 bp, human
gaccctaggaatgagacctt

SEQ ID NO: 309634 - DNA, 20 bp, human
gcacctagggctcgcggatg

SEQ ID NO: 309635 - DNA, 20 bp, human
gcaccgctgcctacccgccg

SEQ ID NO: 309636 - DNA, 20 bp, human
gcctgagtatctcgggaagg

SEQ ID NO: 309637 - DNA, 20 bp, human
gctggtcggcctgaagggaa

SEQ ID NO: 309638 - DNA, 20 bp, human
gcctgcctggtcggcctgaa

SEQ ID NO: 309639 - DNA, 20 bp, human
gccgctgcgctgtggcttct

SEQ ID NO: 309640 - DNA, 20 bp, human
gccggcccgccactatttcc

SEQ ID NO: 309641 - DNA, 20 bp, human
gggcactacctgcagactcg

SEQ ID NO: 309642 - DNA, 20 bp, human
gtctgggatctctaggtccg

SEQ ID NO: 309643 - DNA, 20 bp, human
gctacctgcagactcggggt

SEQ ID NO: 309644 - DNA, 20 bp, human
gcctgcagactcggggtggg

SEQ ID NO: 309645 - DNA, 20 bp, human
gatctctaggtccgcggctc

SEQ ID NO: 309646 - DNA, 20 bp, human
gcatcaaatgccaaattcca

SEQ ID NO: 309647 - DNA, 20 bp, human
gctgaagtgaaatgtgagag

SEQ ID NO: 309648 - DNA, 20 bp, human
gcccattagatgtgcatata

SEQ ID NO: 309649 - DNA, 20 bp, human
gtgctagggttttggttgga

SEQ ID NO: 309650 - DNA, 20 bp, human
gctactgctgcctgcgaaaa

SEQ ID NO: 309651 - DNA, 20 bp, human
ggattaatagttgcctgcta

SEQ ID NO: 309652 - DNA, 20 bp, human
gtgcctgcgaaaaaggaagg

SEQ ID NO: 309653 - DNA, 20 bp, human
gaacttcatagtgttacagg

SEQ ID NO: 309654 - DNA, 20 bp, human
gtgctgcctgcgaaaaagga

SEQ ID NO: 309655 - DNA, 20 bp, human
ggtcactctctccccaccgc

SEQ ID NO: 309656 - DNA, 20 bp, human
gcaggcctccagagtctgga

SEQ ID NO: 309657 - DNA, 20 bp, human
gaatcagggtgctaggttgg

SEQ ID NO: 309658 - DNA, 20 bp, human
gccgggcgggacttagacgt

SEQ ID NO: 309659 - DNA, 20 bp, human
gcgtccgtccagcaggagat

SEQ ID NO: 309660 - DNA, 20 bp, human
gaactgggagcgcgtggcgc

SEQ ID NO: 309661 - DNA, 20 bp, human
ggtcacctgcagaaaagcta

SEQ ID NO: 309662 - DNA, 20 bp, human
gggagataggaagtggaact

SEQ ID NO: 309663 - DNA, 20 bp, human
ggagctgctgccctcccggg

SEQ ID NO: 309664 - DNA, 20 bp, human
gaggaatcagggtgctaggt

SEQ ID NO: 309665 - DNA, 20 bp, human
gcggctgccaggactacaag

SEQ ID NO: 309666 - DNA, 20 bp, human
gtgtaccgtagtgccaataa

SEQ ID NO: 309667 - DNA, 20 bp, human
gatggctatggctgccctat

SEQ ID NO: 309668 - DNA, 20 bp, human
gacaacctttattggcacta

SEQ ID NO: 309669 - DNA, 20 bp, human
gcactacggtacatatggaa

SEQ ID NO: 309670 - DNA, 20 bp, human
gcgtcagggtaaagtctaaa

SEQ ID NO: 309671 - DNA, 20 bp, human
ggaactaataacattcctat

SEQ ID NO: 309672 - DNA, 20 bp, human
gaacatcattgactctttcg

SEQ ID NO: 309673 - DNA, 20 bp, human
gaatctaacagggttttcag

SEQ ID NO: 309674 - DNA, 20 bp, human
gctaaacggtatttatgaca

SEQ ID NO: 309675 - DNA, 20 bp, human
gatgcttaagctccaaagac

SEQ ID NO: 309676 - DNA, 20 bp, human
gcagcatggggctatatgag

SEQ ID NO: 309677 - DNA, 20 bp, human
gggacatgggtcataaaagt

SEQ ID NO: 309678 - DNA, 20 bp, human
gtggactttcatcccttgat

SEQ ID NO: 309679 - DNA, 20 bp, human
gctctgcggagttggtttgt

SEQ ID NO: 309680 - DNA, 20 bp, human
gggcacttaattgttgacac

SEQ ID NO: 309681 - DNA, 20 bp, human
gcatggggctatatgagagg

SEQ ID NO: 309682 - DNA, 20 bp, human
ggtaataatacctccaatca

SEQ ID NO: 309683 - DNA, 20 bp, human
gatcaagctgacctgcaata

SEQ ID NO: 309684 - DNA, 20 bp, human
gtgcttgatgggaattttta

SEQ ID NO: 309685 - DNA, 20 bp, human
gtatggatcattgagatcaa

SEQ ID NO: 309686 - DNA, 20 bp, human
gaccgggcggcgcatctccc

SEQ ID NO: 309687 - DNA, 20 bp, human
gcaggcgctgcccactaggg

SEQ ID NO: 309688 - DNA, 20 bp, human
gcgcccggtctccctgccag

SEQ ID NO: 309689 - DNA, 20 bp, human
gtacccgcgcaagcccaaaa

SEQ ID NO: 309690 - DNA, 20 bp, human
gcgcctgcgcacaccctttt

SEQ ID NO: 309691 - DNA, 20 bp, human
ggagtgctgggccgaggaca

SEQ ID NO: 309692 - DNA, 20 bp, human
ggcccagcactccgctggca

SEQ ID NO: 309693 - DNA, 20 bp, human
gtccctgccagcggagtgct

SEQ ID NO: 309694 - DNA, 20 bp, human
ggcgccccgccccccgtctt

SEQ ID NO: 309695 - DNA, 20 bp, human
gggcctctcaacacccaccg

SEQ ID NO: 309696 - DNA, 20 bp, human
gcgcccacagataaccatag

SEQ ID NO: 309697 - DNA, 20 bp, human
ggatttcagaactgctaatt

SEQ ID NO: 309698 - DNA, 20 bp, human
gaccccctatggttatctgt

SEQ ID NO: 309699 - DNA, 20 bp, human
gcaacatgatgtccaaactg

SEQ ID NO: 309700 - DNA, 20 bp, human
gtgagtgagccagtgctgat

SEQ ID NO: 309701 - DNA, 20 bp, human
gaaaattacttcacccccta

SEQ ID NO: 309702 - DNA, 20 bp, human
gttctgtttatcccactttc

SEQ ID NO: 309703 - DNA, 20 bp, human
gtggagcttagaatccaata

SEQ ID NO: 309704 - DNA, 20 bp, human
gtacctaacaagtttagaaa

SEQ ID NO: 309705 - DNA, 20 bp, human
ggtgacatatactaagtcta

SEQ ID NO: 309706 - DNA, 20 bp, human
gccggcgggcccagcaggtt

SEQ ID NO: 309707 - DNA, 20 bp, human
ggaggggcgtaaaggggaaa

SEQ ID NO: 309708 - DNA, 20 bp, human
gggggaggaggggcgtaaag

SEQ ID NO: 309709 - DNA, 20 bp, human
gccagcgaagctccctgtcc

SEQ ID NO: 309710 - DNA, 20 bp, human
gaaggccgccgctgggcaga

SEQ ID NO: 309711 - DNA, 20 bp, human
ggcaggggggcgagtcccgg

SEQ ID NO: 309712 - DNA, 20 bp, human
ggagtcccggcgggcccagc

SEQ ID NO: 309713 - DNA, 20 bp, human
gcgggccgaaggccgccgct

SEQ ID NO: 309714 - DNA, 20 bp, human
gtgcccgggccgcccggaca

SEQ ID NO: 309715 - DNA, 20 bp, human
ggggggctgagagacccgga

SEQ ID NO: 309716 - DNA, 20 bp, human
ggggctctgcgcacacccat

SEQ ID NO: 309717 - DNA, 20 bp, human
gggaagctgggtggctgcgg

SEQ ID NO: 309718 - DNA, 20 bp, human
gcagccacccagcttcccgg

SEQ ID NO: 309719 - DNA, 20 bp, human
gtgaactcccccgtggtcct

SEQ ID NO: 309720 - DNA, 20 bp, human
ggcctcggccgtaacctccc

SEQ ID NO: 309721 - DNA, 20 bp, human
gccacccagcttcccggggg

SEQ ID NO: 309722 - DNA, 20 bp, human
gcgcaagcatccgggagcgg

SEQ ID NO: 309723 - DNA, 20 bp, human
ggtcctgggccgagagactg

SEQ ID NO: 309724 - DNA, 20 bp, human
gcggcagcgtccgcgttggg

SEQ ID NO: 309725 - DNA, 20 bp, human
gcatccgggagcggcggagg

SEQ ID NO: 309726 - DNA, 20 bp, human
ggggcccggtaggctagcga

SEQ ID NO: 309727 - DNA, 20 bp, human
ggcggggcttccagaggcgg

SEQ ID NO: 309728 - DNA, 20 bp, human
gaggaggagccagtggggcg

SEQ ID NO: 309729 - DNA, 20 bp, human
gcagtggggcggggccaaaa

SEQ ID NO: 309730 - DNA, 20 bp, human
ggggaggcggggcctcggaa

SEQ ID NO: 309731 - DNA, 20 bp, human
gcggctgaggcgctctgtcc

SEQ ID NO: 309732 - DNA, 20 bp, human
gcctcagccggaccaagagg

SEQ ID NO: 309733 - DNA, 20 bp, human
ggcggggccaaaatggcgga

SEQ ID NO: 309734 - DNA, 20 bp, human
gtgaggcgctctgtcccggc

SEQ ID NO: 309735 - DNA, 20 bp, human
ggcgcctcagccggaccaag

SEQ ID NO: 309736 - DNA, 20 bp, human
ggcgccgcgcctacctacgg

SEQ ID NO: 309737 - DNA, 20 bp, human
ggccgcgcggggctcgccac

SEQ ID NO: 309738 - DNA, 20 bp, human
gcgcgcgccgcgcctaccta

SEQ ID NO: 309739 - DNA, 20 bp, human
ggagtctggggacgagacga

SEQ ID NO: 309740 - DNA, 20 bp, human
gccccctccgtaggtaggcg

SEQ ID NO: 309741 - DNA, 20 bp, human
ggtctcgtccccagactcat

SEQ ID NO: 309742 - DNA, 20 bp, human
gcggccgccgccctccgaca

SEQ ID NO: 309743 - DNA, 20 bp, human
ggaggcagagcgccagtgag

SEQ ID NO: 309744 - DNA, 20 bp, human
gcacggacggcggtagaaag

SEQ ID NO: 309745 - DNA, 20 bp, human
gcggccgcagtccttgtcgg

SEQ ID NO: 309746 - DNA, 20 bp, human
ggggcacgaacccgacgaat

SEQ ID NO: 309747 - DNA, 20 bp, human
gctcgggagctgcagctcgg

SEQ ID NO: 309748 - DNA, 20 bp, human
gcggaccagcgggcggacag

SEQ ID NO: 309749 - DNA, 20 bp, human
gagtccgcgggcgccgtcgc

SEQ ID NO: 309750 - DNA, 20 bp, human
ggacgtggagtcccagtggc

SEQ ID NO: 309751 - DNA, 20 bp, human
ggcctcctcctccgattcgt

SEQ ID NO: 309752 - DNA, 20 bp, human
ggaacccgacgaatcggagg

SEQ ID NO: 309753 - DNA, 20 bp, human
gggcgaagatccagtggtcg

SEQ ID NO: 309754 - DNA, 20 bp, human
ggtccggtgcgcgctcgtct

SEQ ID NO: 309755 - DNA, 20 bp, human
gcacgaacccgacgaatcgg

SEQ ID NO: 309756 - DNA, 20 bp, human
gctaaaggagccactgttag

SEQ ID NO: 309757 - DNA, 20 bp, human
ggaaagagttggggcactca

SEQ ID NO: 309758 - DNA, 20 bp, human
gccctgaaggtgccccctaa

SEQ ID NO: 309759 - DNA, 20 bp, human
gaccgccatggccacaaaga

SEQ ID NO: 309760 - DNA, 20 bp, human
gagcaagggagcaggcggta

SEQ ID NO: 309761 - DNA, 20 bp, human
ggccttaactcatcagggga

SEQ ID NO: 309762 - DNA, 20 bp, human
gtggggtgcccctctaacag

SEQ ID NO: 309763 - DNA, 20 bp, human
gcagggttggcggttaacga

SEQ ID NO: 309764 - DNA, 20 bp, human
gtgcccacaagccccacagg

SEQ ID NO: 309765 - DNA, 20 bp, human
gaggggctctgcggcgagca

SEQ ID NO: 309766 - DNA, 20 bp, human
gagagcacggggtagagaga

SEQ ID NO: 309767 - DNA, 20 bp, human
ggcagcacatgctgggctcg

SEQ ID NO: 309768 - DNA, 20 bp, human
gctccctgggaacagggtga

SEQ ID NO: 309769 - DNA, 20 bp, human
ggaaggcggcagcacatgct

SEQ ID NO: 309770 - DNA, 20 bp, human
gggtatgaaatggcaggccg

SEQ ID NO: 309771 - DNA, 20 bp, human
gtcagcgccacctattgcaa

SEQ ID NO: 309772 - DNA, 20 bp, human
gaataggtggcgctgacgcc

SEQ ID NO: 309773 - DNA, 20 bp, human
gggaagggctgaaatacgga

SEQ ID NO: 309774 - DNA, 20 bp, human
ggcaaagggtatgaaatggc

SEQ ID NO: 309775 - DNA, 20 bp, human
ggtagagagagggctggcga

SEQ ID NO: 309776 - DNA, 20 bp, human
ggaacccgcggactagggga

SEQ ID NO: 309777 - DNA, 20 bp, human
ggggaggcgagtgtcacccc

SEQ ID NO: 309778 - DNA, 20 bp, human
gggccgcgcgcgccgatgcc

SEQ ID NO: 309779 - DNA, 20 bp, human
gactcggtcccgcttatctc

SEQ ID NO: 309780 - DNA, 20 bp, human
ggcggcgcggacggcaggaa

SEQ ID NO: 309781 - DNA, 20 bp, human
gggcagacagacacgtgctg

SEQ ID NO: 309782 - DNA, 20 bp, human
ggcctcccaagcgccaggag

SEQ ID NO: 309783 - DNA, 20 bp, human
gaggggacggacagcacgcg

SEQ ID NO: 309784 - DNA, 20 bp, human
ggggactggcaccacccaga

SEQ ID NO: 309785 - DNA, 20 bp, human
gtccgaggaccgctgaggtg

SEQ ID NO: 309786 - DNA, 20 bp, human
ggcccgaaggcgccgaatgg

SEQ ID NO: 309787 - DNA, 20 bp, human
gaactgccgggcggagggga

SEQ ID NO: 309788 - DNA, 20 bp, human
gaggggagagagaccgagtc

SEQ ID NO: 309789 - DNA, 20 bp, human
gcgggtgtcggggatgatca

SEQ ID NO: 309790 - DNA, 20 bp, human
ggaggagctgggcccgccgc

SEQ ID NO: 309791 - DNA, 20 bp, human
gagagtgcgccgcgagaggg

SEQ ID NO: 309792 - DNA, 20 bp, human
gtcccggcggcgcgcacatt

SEQ ID NO: 309793 - DNA, 20 bp, human
gcctgcgtgcccaagcctcc

SEQ ID NO: 309794 - DNA, 20 bp, human
gagggcggctcctcaccgtc

SEQ ID NO: 309795 - DNA, 20 bp, human
ggcgtgcccaagcctcccgg

SEQ ID NO: 309796 - DNA, 20 bp, human
ggggcaagcagcagaacccg

SEQ ID NO: 309797 - DNA, 20 bp, human
gaggcgtcgaggccgcccga

SEQ ID NO: 309798 - DNA, 20 bp, human
gggagcccgcctctcgcggc

SEQ ID NO: 309799 - DNA, 20 bp, human
gacgcctcagggcttcggca

SEQ ID NO: 309800 - DNA, 20 bp, human
ggcgcgcgcggggctgactg

SEQ ID NO: 309801 - DNA, 20 bp, human
gcagccctgccgaagccctg

SEQ ID NO: 309802 - DNA, 20 bp, human
gcctggctgggaagcggcta

SEQ ID NO: 309803 - DNA, 20 bp, human
gaagcagcagaacccgcggc

SEQ ID NO: 309804 - DNA, 20 bp, human
gggaagcggctagggcaccc

SEQ ID NO: 309805 - DNA, 20 bp, human
gggctggagcccgcctctcg

SEQ ID NO: 309806 - DNA, 20 bp, human
ggccgggcgtgcaggagtct

SEQ ID NO: 309807 - DNA, 20 bp, human
gcggacgaagcagtcgggtc

SEQ ID NO: 309808 - DNA, 20 bp, human
gggcaccggacgaagcagtc

SEQ ID NO: 309809 - DNA, 20 bp, human
ggtagggacgcagggaatgc

SEQ ID NO: 309810 - DNA, 20 bp, human
gcgcctggctggagtcgact

SEQ ID NO: 309811 - DNA, 20 bp, human
gggaagctgctctcgatggt

SEQ ID NO: 309812 - DNA, 20 bp, human
gagggtgtcgggctagcttc

SEQ ID NO: 309813 - DNA, 20 bp, human
ggcgtgcaggagtctcggct

SEQ ID NO: 309814 - DNA, 20 bp, human
gtaggcgggtggagaaggat

SEQ ID NO: 309815 - DNA, 20 bp, human
gcgccggaagctgctctcga

SEQ ID NO: 309816 - DNA, 20 bp, human
gggaccgtgggatagtcctc

SEQ ID NO: 309817 - DNA, 20 bp, human
gcacggtccaagcgcctcga

SEQ ID NO: 309818 - DNA, 20 bp, human
gccgccggaggactatccca

SEQ ID NO: 309819 - DNA, 20 bp, human
gcaagcgcctcgagggttgg

SEQ ID NO: 309820 - DNA, 20 bp, human
gccccccgcgctgtcccgat

SEQ ID NO: 309821 - DNA, 20 bp, human
gtccgccccgcgcctgctat

SEQ ID NO: 309822 - DNA, 20 bp, human
ggccccgcgcctgctattgg

SEQ ID NO: 309823 - DNA, 20 bp, human
ggagacgcacagcgcggggc

SEQ ID NO: 309824 - DNA, 20 bp, human
gactccgatcgggacagcgc

SEQ ID NO: 309825 - DNA, 20 bp, human
gtccgccaatagcaggcgcg

SEQ ID NO: 309826 - DNA, 20 bp, human
gcgagtcagcagcgaatcgg

SEQ ID NO: 309827 - DNA, 20 bp, human
gtcggactcgccaacttcag

SEQ ID NO: 309828 - DNA, 20 bp, human
ggccgccgagcctctgaagt

SEQ ID NO: 309829 - DNA, 20 bp, human
gcgcgccggaaactcctccc

SEQ ID NO: 309830 - DNA, 20 bp, human
gcggaggggttgcaaggcga

SEQ ID NO: 309831 - DNA, 20 bp, human
gaggggttgcaaggcgaggg

SEQ ID NO: 309832 - DNA, 20 bp, human
gagtccgagtccgcccggcc

SEQ ID NO: 309833 - DNA, 20 bp, human
ggactcggtgtctgcgcgtc

SEQ ID NO: 309834 - DNA, 20 bp, human
gggcgcgcgacgtgaccacc

SEQ ID NO: 309835 - DNA, 20 bp, human
gcaccgagtcagcagcgaat

SEQ ID NO: 309836 - DNA, 20 bp, human
ggtaaggagcgagtgctgga

SEQ ID NO: 309837 - DNA, 20 bp, human
gttggaggctaacggtgcgg

SEQ ID NO: 309838 - DNA, 20 bp, human
gcgttagcctccaactggga

SEQ ID NO: 309839 - DNA, 20 bp, human
gcagttggaggctaacggtg

SEQ ID NO: 309840 - DNA, 20 bp, human
gggtccgagaccaggagtaa

SEQ ID NO: 309841 - DNA, 20 bp, human
gacgcagccatgcgcgttgg

SEQ ID NO: 309842 - DNA, 20 bp, human
gcccagctgaatttgctctt

SEQ ID NO: 309843 - DNA, 20 bp, human
ggaactgccaccaacgcgca

SEQ ID NO: 309844 - DNA, 20 bp, human
gaggcggggctcgttccaca

SEQ ID NO: 309845 - DNA, 20 bp, human
gtgcaccccacaggtgagag

SEQ ID NO: 309846 - DNA, 20 bp, human
gggggctggagcagtcgaga

SEQ ID NO: 309847 - DNA, 20 bp, human
gacgccctctgctctacccc

SEQ ID NO: 309848 - DNA, 20 bp, human
ggaccggcgcctctaggcgg

SEQ ID NO: 309849 - DNA, 20 bp, human
gtggggccgccatagagacg

SEQ ID NO: 309850 - DNA, 20 bp, human
ggggatgccactaacgctgt

SEQ ID NO: 309851 - DNA, 20 bp, human
ggctggagcagtcgagaggg

SEQ ID NO: 309852 - DNA, 20 bp, human
ggagagcgcacggtccccgc

SEQ ID NO: 309853 - DNA, 20 bp, human
gcagcccccgcgctggggct

SEQ ID NO: 309854 - DNA, 20 bp, human
gtggggactgctgttcgtga

SEQ ID NO: 309855 - DNA, 20 bp, human
gacaggcgcacgcagtggag

SEQ ID NO: 309856 - DNA, 20 bp, human
gagagaggcgtgctttttcc

SEQ ID NO: 309857 - DNA, 20 bp, human
gcacccaagcaatcagacgg

SEQ ID NO: 309858 - DNA, 20 bp, human
gtgctcttgcctgtttgaag

SEQ ID NO: 309859 - DNA, 20 bp, human
gagccagcaggtgctaagta

SEQ ID NO: 309860 - DNA, 20 bp, human
gagtggtggctaaaggagag

SEQ ID NO: 309861 - DNA, 20 bp, human
gtccctccgtctgattgctt

SEQ ID NO: 309862 - DNA, 20 bp, human
ggaggattcagtgttctacg

SEQ ID NO: 309863 - DNA, 20 bp, human
gcgaggagtgatggaaatca

SEQ ID NO: 309864 - DNA, 20 bp, human
gctgatgaaaggagcatgag

SEQ ID NO: 309865 - DNA, 20 bp, human
ggacaccactccaagccagc

SEQ ID NO: 309866 - DNA, 20 bp, human
ggcgactatgggagctccgg

SEQ ID NO: 309867 - DNA, 20 bp, human
gggagtggaatcgcgactat

SEQ ID NO: 309868 - DNA, 20 bp, human
gtacggaccgtgaactggag

SEQ ID NO: 309869 - DNA, 20 bp, human
gcgggccaatcgcaactcgg

SEQ ID NO: 309870 - DNA, 20 bp, human
gggaagtacggaccgtgaac

SEQ ID NO: 309871 - DNA, 20 bp, human
ggggcggagccccgcggatc

SEQ ID NO: 309872 - DNA, 20 bp, human
gcccccacacagtcaccgtt

SEQ ID NO: 309873 - DNA, 20 bp, human
gctccgccccggccttccgc

SEQ ID NO: 309874 - DNA, 20 bp, human
ggggtcctcgggctatataa

SEQ ID NO: 309875 - DNA, 20 bp, human
gcggggctgtgatagaccaa

SEQ ID NO: 309876 - DNA, 20 bp, human
gcgacggagcctccggagaa

SEQ ID NO: 309877 - DNA, 20 bp, human
gaggtggcaaaataaggcgg

SEQ ID NO: 309878 - DNA, 20 bp, human
gcgcacccggatatggttat

SEQ ID NO: 309879 - DNA, 20 bp, human
ggaccattcacggaacgggg

SEQ ID NO: 309880 - DNA, 20 bp, human
gggcgggagcgtactggtag

SEQ ID NO: 309881 - DNA, 20 bp, human
ggtgagaactaggtcacgtc

SEQ ID NO: 309882 - DNA, 20 bp, human
ggggagcgtactggtagagg

SEQ ID NO: 309883 - DNA, 20 bp, human
gaagcacgtcgcagccaatg

SEQ ID NO: 309884 - DNA, 20 bp, human
ggcggcaggcgggagcgtac

SEQ ID NO: 309885 - DNA, 20 bp, human
gccgcgggccggagttgtgg

SEQ ID NO: 309886 - DNA, 20 bp, human
ggtggtctgagctagtctga

SEQ ID NO: 309887 - DNA, 20 bp, human
ggcgccggaagtctctactg

SEQ ID NO: 309888 - DNA, 20 bp, human
gagaccaccccaacctgcga

SEQ ID NO: 309889 - DNA, 20 bp, human
gccagggccctcgcaggttg

SEQ ID NO: 309890 - DNA, 20 bp, human
ggtctgagctagtctgaagg

SEQ ID NO: 309891 - DNA, 20 bp, human
ggggccaagcgagccaattc

SEQ ID NO: 309892 - DNA, 20 bp, human
gtagccaaggccactcgtct

SEQ ID NO: 309893 - DNA, 20 bp, human
gttgcgccacaggggtctcc

SEQ ID NO: 309894 - DNA, 20 bp, human
gcggaagtcccgcctccttc

SEQ ID NO: 309895 - DNA, 20 bp, human
gcaagcgtccagaaggaggc

SEQ ID NO: 309896 - DNA, 20 bp, human
gtccagcctcagctgccaaa

SEQ ID NO: 309897 - DNA, 20 bp, human
gagctgccaaagggtcctgt

SEQ ID NO: 309898 - DNA, 20 bp, human
gagacggtcctcagttgctt

SEQ ID NO: 309899 - DNA, 20 bp, human
gcggtcctcagttgcttggg

SEQ ID NO: 309900 - DNA, 20 bp, human
gctggaaacagcggaaccaa

SEQ ID NO: 309901 - DNA, 20 bp, human
gttcccccaggaaagtcgtt

SEQ ID NO: 309902 - DNA, 20 bp, human
gttgtaaggacggacagatt

SEQ ID NO: 309903 - DNA, 20 bp, human
gtaacagtgttcagatgatg

SEQ ID NO: 309904 - DNA, 20 bp, human
ggagcaaggtggcacagtag

SEQ ID NO: 309905 - DNA, 20 bp, human
gggtttccaaacgactttcc

SEQ ID NO: 309906 - DNA, 20 bp, human
gcggacgctgtcacggctcg

SEQ ID NO: 309907 - DNA, 20 bp, human
gtcgcgtgatgtcatcacgt

SEQ ID NO: 309908 - DNA, 20 bp, human
gccaatgaaacgaagcgctg

SEQ ID NO: 309909 - DNA, 20 bp, human
gtggccaccgcctccggaaa

SEQ ID NO: 309910 - DNA, 20 bp, human
gggcttgggtttgaatattg

SEQ ID NO: 309911 - DNA, 20 bp, human
gatcacgtcggacgctgtca

SEQ ID NO: 309912 - DNA, 20 bp, human
gcgcgcgcggccgtttccgg

SEQ ID NO: 309913 - DNA, 20 bp, human
gaacgaagcgctgaggaaag

SEQ ID NO: 309914 - DNA, 20 bp, human
gggttgcggtaacctggcct

SEQ ID NO: 309915 - DNA, 20 bp, human
ggtcacggctcgcggcagct

SEQ ID NO: 309916 - DNA, 20 bp, human
gcaaaccccaggtgtcgcga

SEQ ID NO: 309917 - DNA, 20 bp, human
ggaaaccctcgcgacacctg

SEQ ID NO: 309918 - DNA, 20 bp, human
gcgcccccgcgccttctgtt

SEQ ID NO: 309919 - DNA, 20 bp, human
gtcctcctgccatacctcaa

SEQ ID NO: 309920 - DNA, 20 bp, human
ggcgggggcgtggtgacgag

SEQ ID NO: 309921 - DNA, 20 bp, human
gctcctaacagaaggcgcgg

SEQ ID NO: 309922 - DNA, 20 bp, human
ggggcaggttatgaagatga

SEQ ID NO: 309923 - DNA, 20 bp, human
gagccacaggtcgcgcgaga

SEQ ID NO: 309924 - DNA, 20 bp, human
gagggatgtgtccaatcacg

SEQ ID NO: 309925 - DNA, 20 bp, human
gatccctctcgcgcgacctg

SEQ ID NO: 309926 - DNA, 20 bp, human
gcccaacgcagccttcaagt

SEQ ID NO: 309927 - DNA, 20 bp, human
ggtcgggagaagttctgcga

SEQ ID NO: 309928 - DNA, 20 bp, human
gacgggggcgggatggggtt

SEQ ID NO: 309929 - DNA, 20 bp, human
gcccagaaatcaagagggtg

SEQ ID NO: 309930 - DNA, 20 bp, human
gaaacactcgctcttctcgt

SEQ ID NO: 309931 - DNA, 20 bp, human
gccggccccagaaatcaaga

SEQ ID NO: 309932 - DNA, 20 bp, human
gcgccagcaaagactgtttc

SEQ ID NO: 309933 - DNA, 20 bp, human
gcgtgtttgggccgacttga

SEQ ID NO: 309934 - DNA, 20 bp, human
gtgaggcagaaaccgtgttt

SEQ ID NO: 309935 - DNA, 20 bp, human
gcaagactcagagttctccg

SEQ ID NO: 309936 - DNA, 20 bp, human
gagagcgcgcaagggttggc

SEQ ID NO: 309937 - DNA, 20 bp, human
ggacccgccaaagcccagac

SEQ ID NO: 309938 - DNA, 20 bp, human
ggcggagagcgcgcaagggt

SEQ ID NO: 309939 - DNA, 20 bp, human
gtggcgggactgcgagtttc

SEQ ID NO: 309940 - DNA, 20 bp, human
gacaaccaaggaaggatatg

SEQ ID NO: 309941 - DNA, 20 bp, human
gccagctagcgcggttcccc

SEQ ID NO: 309942 - DNA, 20 bp, human
gaaaaccatagagaggaggg

SEQ ID NO: 309943 - DNA, 20 bp, human
gtagaagtgacaaccaagga

SEQ ID NO: 309944 - DNA, 20 bp, human
gtccaaaaccatagagagga

SEQ ID NO: 309945 - DNA, 20 bp, human
gagaagcccgactttctttc

SEQ ID NO: 309946 - DNA, 20 bp, human
gaaaaagggcggggccgcga

SEQ ID NO: 309947 - DNA, 20 bp, human
gtgagcgggaacagtcgcca

SEQ ID NO: 309948 - DNA, 20 bp, human
ggggtggagtcgatcttaaa

SEQ ID NO: 309949 - DNA, 20 bp, human
ggctgctgggaaaaagggcg

SEQ ID NO: 309950 - DNA, 20 bp, human
gagagcgccgcggcccggca

SEQ ID NO: 309951 - DNA, 20 bp, human
ggccctcggaagtaaagcat

SEQ ID NO: 309952 - DNA, 20 bp, human
gctagagcgtggctcagttt

SEQ ID NO: 309953 - DNA, 20 bp, human
gacagaagcgcgaaaccaaa

SEQ ID NO: 309954 - DNA, 20 bp, human
gagtcgccagggcgagtgac

SEQ ID NO: 309955 - DNA, 20 bp, human
gtgaatgtaggcagcacaga

SEQ ID NO: 309956 - DNA, 20 bp, human
gcccacagcgcctccctcgg

SEQ ID NO: 309957 - DNA, 20 bp, human
gcccccggagctcacggcga

SEQ ID NO: 309958 - DNA, 20 bp, human
ggaggagtgacgttgcggga

SEQ ID NO: 309959 - DNA, 20 bp, human
gcgggagcaagagtgagatc

SEQ ID NO: 309960 - DNA, 20 bp, human
gcggtggaggagtgacgttg

SEQ ID NO: 309961 - DNA, 20 bp, human
ggccgcccgcccccgcgtcg

SEQ ID NO: 309962 - DNA, 20 bp, human
gaatgcgtggctccgggccg

SEQ ID NO: 309963 - DNA, 20 bp, human
gaagtcgtccgtgtaccctg

SEQ ID NO: 309964 - DNA, 20 bp, human
ggcccggagccacgcatttc

SEQ ID NO: 309965 - DNA, 20 bp, human
gccgccctcgccgtgagctc

SEQ ID NO: 309966 - DNA, 20 bp, human
gggtccgagaccaggagtaa

SEQ ID NO: 309967 - DNA, 20 bp, human
ggtaaggagcgagtgctgga

SEQ ID NO: 309968 - DNA, 20 bp, human
ggggaccacaagagtcagac

SEQ ID NO: 309969 - DNA, 20 bp, human
gctgccatgatcccagtccg

SEQ ID NO: 309970 - DNA, 20 bp, human
ggactcttgtggtcccgtgt

SEQ ID NO: 309971 - DNA, 20 bp, human
gccggccacgttccgagtct

SEQ ID NO: 309972 - DNA, 20 bp, human
gggactgatgccactgtaga

SEQ ID NO: 309973 - DNA, 20 bp, human
gcgttagcctccaactggga

SEQ ID NO: 309974 - DNA, 20 bp, human
ggcagccgagactcggaacg

SEQ ID NO: 309975 - DNA, 20 bp, human
gccacaagagtcagaccggg

SEQ ID NO: 309976 - DNA, 20 bp, human
gttactatgaggtaacatct

SEQ ID NO: 309977 - DNA, 20 bp, human
ggcacagctagatcaagaag

SEQ ID NO: 309978 - DNA, 20 bp, human
gtttcagtgccctctgtctc

SEQ ID NO: 309979 - DNA, 20 bp, human
gggggtatgagacatcacct

SEQ ID NO: 309980 - DNA, 20 bp, human
gagaagtggcatgaggaacc

SEQ ID NO: 309981 - DNA, 20 bp, human
gggtaaccttctaaaagctc

SEQ ID NO: 309982 - DNA, 20 bp, human
gaaaaattcttgcatgaccc

SEQ ID NO: 309983 - DNA, 20 bp, human
gtcattccagagcttttaga

SEQ ID NO: 309984 - DNA, 20 bp, human
gaccctgaagatgaggaaga

SEQ ID NO: 309985 - DNA, 20 bp, human
gaggtaacatctgggtaagg

SEQ ID NO: 309986 - DNA, 20 bp, human
gtcgcccgcgaccagagcga

SEQ ID NO: 309987 - DNA, 20 bp, human
ggggccgcgcatgcgtccga

SEQ ID NO: 309988 - DNA, 20 bp, human
ggggcgaggcgtgtttgctg

SEQ ID NO: 309989 - DNA, 20 bp, human
ggaaggctacaggtgcccgc

SEQ ID NO: 309990 - DNA, 20 bp, human
gtagccttcgctctggtcgc

SEQ ID NO: 309991 - DNA, 20 bp, human
gacggtgcggggcagtcgga

SEQ ID NO: 309992 - DNA, 20 bp, human
ggcacctgtagccttcgctc

SEQ ID NO: 309993 - DNA, 20 bp, human
gctggggggacccgcctagg

SEQ ID NO: 309994 - DNA, 20 bp, human
ggcgtccgagggttgccggc

SEQ ID NO: 309995 - DNA, 20 bp, human
gggtaggtggagccacggtg

SEQ ID NO: 309996 - DNA, 20 bp, human
ggtcggggcggggaagacgg

SEQ ID NO: 309997 - DNA, 20 bp, human
gcaacccgaggctcgggagg

SEQ ID NO: 309998 - DNA, 20 bp, human
gaaaaccgcgagaggcgtcg

SEQ ID NO: 309999 - DNA, 20 bp, human
gcggccgcttgcccaacccg

SEQ ID NO: 310000 - DNA, 20 bp, human
gcacccctccccggcctggg

SEQ ID NO: 310001 - DNA, 20 bp, human
gaccgcgagaggcgtcgggg

SEQ ID NO: 310002 - DNA, 20 bp, human
ggcctctcgcggttttccat

SEQ ID NO: 310003 - DNA, 20 bp, human
gatgtgaaggagtaccccag

SEQ ID NO: 310004 - DNA, 20 bp, human
gggaggcccgccgtatgtga

SEQ ID NO: 310005 - DNA, 20 bp, human
gtggcgcgaccggaagtgat

SEQ ID NO: 310006 - DNA, 20 bp, human
ggggccgaacgcggtcacag

SEQ ID NO: 310007 - DNA, 20 bp, human
gcgccccgccgctggaacgg

SEQ ID NO: 310008 - DNA, 20 bp, human
gcgctcggcagggcaggata

SEQ ID NO: 310009 - DNA, 20 bp, human
ggggcaggataaggttacgc

SEQ ID NO: 310010 - DNA, 20 bp, human
gccgccgctggaacggtggt

SEQ ID NO: 310011 - DNA, 20 bp, human
ggggcggagggcacctcttg

SEQ ID NO: 310012 - DNA, 20 bp, human
gtgacggagctgaaagacat

SEQ ID NO: 310013 - DNA, 20 bp, human
gtgccagggcccggctgtac

SEQ ID NO: 310014 - DNA, 20 bp, human
gcggcccaccaccgttccag

SEQ ID NO: 310015 - DNA, 20 bp, human
ggcgcgccccgccgctggaa

SEQ ID NO: 310016 - DNA, 20 bp, human
gtgggcaggtccggggtcac

SEQ ID NO: 310017 - DNA, 20 bp, human
gggtccggggtcaccgggag

SEQ ID NO: 310018 - DNA, 20 bp, human
gacttcgcggaccgcctcac

SEQ ID NO: 310019 - DNA, 20 bp, human
ggctgtaggtggcgcaaaca

SEQ ID NO: 310020 - DNA, 20 bp, human
ggcgccacctacagcctcgg

SEQ ID NO: 310021 - DNA, 20 bp, human
gtagtcggctgcaatggcgc

SEQ ID NO: 310022 - DNA, 20 bp, human
gtctgagcgattgattgctt

SEQ ID NO: 310023 - DNA, 20 bp, human
gcaatcgctcagaaggaatc

SEQ ID NO: 310024 - DNA, 20 bp, human
gagcctgcctgtgctaattt

SEQ ID NO: 310025 - DNA, 20 bp, human
ggctcagtagagctccgagc

SEQ ID NO: 310026 - DNA, 20 bp, human
gcgaagggctctctaggaga

SEQ ID NO: 310027 - DNA, 20 bp, human
gcattgaactgggtctcaag

SEQ ID NO: 310028 - DNA, 20 bp, human
gtgagacccagttcaatgct

SEQ ID NO: 310029 - DNA, 20 bp, human
ggaagaaggtagcaagcagc

SEQ ID NO: 310030 - DNA, 20 bp, human
gtattcagctcttaatagtg

SEQ ID NO: 310031 - DNA, 20 bp, human
gtatattttggttggggtag

SEQ ID NO: 310032 - DNA, 20 bp, human
gtttcctgttttataacttg

SEQ ID NO: 310033 - DNA, 20 bp, human
gtgtatatatattttggttg

SEQ ID NO: 310034 - DNA, 20 bp, human
ggaaagagggcgtggtccgc

SEQ ID NO: 310035 - DNA, 20 bp, human
ggcaggaagttctcacgtta

SEQ ID NO: 310036 - DNA, 20 bp, human
gaagccccgccgtgaagggt

SEQ ID NO: 310037 - DNA, 20 bp, human
gtgtcccgggtgctctcccg

SEQ ID NO: 310038 - DNA, 20 bp, human
gccgcgggcaacggggtttg

SEQ ID NO: 310039 - DNA, 20 bp, human
ggcccgggacgcacacgacg

SEQ ID NO: 310040 - DNA, 20 bp, human
gacgacgtggcgcacgtccg

SEQ ID NO: 310041 - DNA, 20 bp, human
ggccccaccccgcgggcaac

SEQ ID NO: 310042 - DNA, 20 bp, human
ggccacgtcgtgtgcgtccc

SEQ ID NO: 310043 - DNA, 20 bp, human
gaaaataacgagtggggtag

SEQ ID NO: 310044 - DNA, 20 bp, human
gtccaaaagtacacgtcgtg

SEQ ID NO: 310045 - DNA, 20 bp, human
gcggggcttcacggacacga

SEQ ID NO: 310046 - DNA, 20 bp, human
gacagggcggtcctggagtc

SEQ ID NO: 310047 - DNA, 20 bp, human
gtggcgggacagggcggtcc

SEQ ID NO: 310048 - DNA, 20 bp, human
ggttggcgaagggctctcta

SEQ ID NO: 310049 - DNA, 20 bp, human
ggccacccggaccagactcc

SEQ ID NO: 310050 - DNA, 20 bp, human
ggcgaagggctctctaggga

SEQ ID NO: 310051 - DNA, 20 bp, human
gtgaggcccagttcattgct

SEQ ID NO: 310052 - DNA, 20 bp, human
ggtgggagacattccacttg

SEQ ID NO: 310053 - DNA, 20 bp, human
gcaatgaactgggcctcaag

SEQ ID NO: 310054 - DNA, 20 bp, human
gtagtcagctcttcatagtg

SEQ ID NO: 310055 - DNA, 20 bp, human
gtgtgtatatatattttggt

SEQ ID NO: 310056 - DNA, 20 bp, human
ggctctgccaacacctaacg

SEQ ID NO: 310057 - DNA, 20 bp, human
gtccggaagcatgagagagc

SEQ ID NO: 310058 - DNA, 20 bp, human
gtggttgccatgttggtgac

SEQ ID NO: 310059 - DNA, 20 bp, human
gaaagagccacgttaggtgt

SEQ ID NO: 310060 - DNA, 20 bp, human
gctaaccggaaaatgacccc

SEQ ID NO: 310061 - DNA, 20 bp, human
gtgcgcgtctataagcaaca

SEQ ID NO: 310062 - DNA, 20 bp, human
gtctcacgcggacaccccga

SEQ ID NO: 310063 - DNA, 20 bp, human
gtaggtgttggcagagcggc

SEQ ID NO: 310064 - DNA, 20 bp, human
ggaggctgtggttgccatgt

SEQ ID NO: 310065 - DNA, 20 bp, human
ggcgggtatgaggactatac

SEQ ID NO: 310066 - DNA, 20 bp, human
gcgaccgcctcgtcgctgga

SEQ ID NO: 310067 - DNA, 20 bp, human
gaaaacaccaggtccttcct

SEQ ID NO: 310068 - DNA, 20 bp, human
gtcggtccctgggtcgtgtc

SEQ ID NO: 310069 - DNA, 20 bp, human
gtgcgtaatgacgtcagcgc

SEQ ID NO: 310070 - DNA, 20 bp, human
gtgtctagcagatacttgca

SEQ ID NO: 310071 - DNA, 20 bp, human
gaggctcgggagaggaaacg

SEQ ID NO: 310072 - DNA, 20 bp, human
gaacggggaagaattgaagg

SEQ ID NO: 310073 - DNA, 20 bp, human
gggagaatttcaaattcgaa

SEQ ID NO: 310074 - DNA, 20 bp, human
gggacaagagaggactcgtt

SEQ ID NO: 310075 - DNA, 20 bp, human
gggacactgatgaggagtgg

SEQ ID NO: 310076 - DNA, 20 bp, human
gagtacctgcgggccctcaa

SEQ ID NO: 310077 - DNA, 20 bp, human
ggtactcatggcaaactaga

SEQ ID NO: 310078 - DNA, 20 bp, human
ggacaggcggcgaggactgg

SEQ ID NO: 310079 - DNA, 20 bp, human
gagggtaatgagcacgcgac

SEQ ID NO: 310080 - DNA, 20 bp, human
ggtgggtcagcaagtagcgc

SEQ ID NO: 310081 - DNA, 20 bp, human
ggtaatgagcacgcgacagg

SEQ ID NO: 310082 - DNA, 20 bp, human
gtgcgggccctcaaaggatg

SEQ ID NO: 310083 - DNA, 20 bp, human
ggtagcgcaggctttgcagg

SEQ ID NO: 310084 - DNA, 20 bp, human
gcaagtagcgcaggctttgc

SEQ ID NO: 310085 - DNA, 20 bp, human
ggggttccgctggccacctg

SEQ ID NO: 310086 - DNA, 20 bp, human
gcaggtgcggggccatgaat

SEQ ID NO: 310087 - DNA, 20 bp, human
gagaacttgcttctggaccc

SEQ ID NO: 310088 - DNA, 20 bp, human
gtgcttccgggccaccgctc

SEQ ID NO: 310089 - DNA, 20 bp, human
gtctggcgctggcgtctggg

SEQ ID NO: 310090 - DNA, 20 bp, human
gaagacaaggagagccgagc

SEQ ID NO: 310091 - DNA, 20 bp, human
gcaccgggagagcgccgatc

SEQ ID NO: 310092 - DNA, 20 bp, human
ggcttctggcgctggcgtct

SEQ ID NO: 310093 - DNA, 20 bp, human
gaacccgctgctggaccgcg

SEQ ID NO: 310094 - DNA, 20 bp, human
gacctgcctcgcacccagat

SEQ ID NO: 310095 - DNA, 20 bp, human
ggcgccagaagctcggatcg

SEQ ID NO: 310096 - DNA, 20 bp, human
ggtgctggaaagtcaaatca

SEQ ID NO: 310097 - DNA, 20 bp, human
gaaaagaaaacagaattcgt

SEQ ID NO: 310098 - DNA, 20 bp, human
gtggcagcactcttctggtg

SEQ ID NO: 310099 - DNA, 20 bp, human
gggtcactggagagcccggt

SEQ ID NO: 310100 - DNA, 20 bp, human
ggtctccaaacccagagaag

SEQ ID NO: 310101 - DNA, 20 bp, human
gagaaaacagaattcgtggg

SEQ ID NO: 310102 - DNA, 20 bp, human
ggggatgtgttatgataaag

SEQ ID NO: 310103 - DNA, 20 bp, human
gcagagccaatcagctgcag

SEQ ID NO: 310104 - DNA, 20 bp, human
ggaaaaagaactggctgtgc

SEQ ID NO: 310105 - DNA, 20 bp, human
gagtgtacttacaccccacc

SEQ ID NO: 310106 - DNA, 20 bp, human
ggctgctgagtcatctcaga

SEQ ID NO: 310107 - DNA, 20 bp, human
gccccagaactcaggaacat

SEQ ID NO: 310108 - DNA, 20 bp, human
gtcttcaatgacttttatgt

SEQ ID NO: 310109 - DNA, 20 bp, human
gtgggacctgcgccctctgg

SEQ ID NO: 310110 - DNA, 20 bp, human
gctgtgggacctgcgccctc

SEQ ID NO: 310111 - DNA, 20 bp, human
gccagagttgagtgggtgta

SEQ ID NO: 310112 - DNA, 20 bp, human
gtgtatggaattcctccaga

SEQ ID NO: 310113 - DNA, 20 bp, human
gaagtcattgaagagcttgt

SEQ ID NO: 310114 - DNA, 20 bp, human
gcatggcgggggagtgtcgg

SEQ ID NO: 310115 - DNA, 20 bp, human
gcccagctgaaggggggcag

SEQ ID NO: 310116 - DNA, 20 bp, human
gcacctatagcctatgagag

SEQ ID NO: 310117 - DNA, 20 bp, human
gagcctggggcagatcgaaa

SEQ ID NO: 310118 - DNA, 20 bp, human
ggcagggcgcacacacgggg

SEQ ID NO: 310119 - DNA, 20 bp, human
gggaggctgcgctgtcttgc

SEQ ID NO: 310120 - DNA, 20 bp, human
gaggcagcccggcttctccc

SEQ ID NO: 310121 - DNA, 20 bp, human
gagtgcagggcgcacacacg

SEQ ID NO: 310122 - DNA, 20 bp, human
gcaagcccggaatctgggat

SEQ ID NO: 310123 - DNA, 20 bp, human
gccggccggccgcgcggtac

SEQ ID NO: 310124 - DNA, 20 bp, human
ggtagttcctgggagaagcc

SEQ ID NO: 310125 - DNA, 20 bp, human
ggccggagccgctctctcac

SEQ ID NO: 310126 - DNA, 20 bp, human
gcggcccgctcattggacgg

SEQ ID NO: 310127 - DNA, 20 bp, human
gctcccagcggcccgctcat

SEQ ID NO: 310128 - DNA, 20 bp, human
gcgctcattggacggaggga

SEQ ID NO: 310129 - DNA, 20 bp, human
ggggacacgagaacgcgctc

SEQ ID NO: 310130 - DNA, 20 bp, human
gcagcggcccgctcattgga

SEQ ID NO: 310131 - DNA, 20 bp, human
gcgctgggaggcgggacaaa

SEQ ID NO: 310132 - DNA, 20 bp, human
gcatccggagcacttacgag

SEQ ID NO: 310133 - DNA, 20 bp, human
gccgccgtggagtgggatga

SEQ ID NO: 310134 - DNA, 20 bp, human
gaagtgctccggatggaaac

SEQ ID NO: 310135 - DNA, 20 bp, human
gcacgagaacgcgctccggg

SEQ ID NO: 310136 - DNA, 20 bp, human
gggacaaattccttgacccg

SEQ ID NO: 310137 - DNA, 20 bp, human
gctccggggcaagctaggag

SEQ ID NO: 310138 - DNA, 20 bp, human
gtccttgacccgaggaggat

SEQ ID NO: 310139 - DNA, 20 bp, human
gagctgcgaggaaagaccga

SEQ ID NO: 310140 - DNA, 20 bp, human
gtccccgcgcccccaagggc

SEQ ID NO: 310141 - DNA, 20 bp, human
ggggctccgggatcgactct

SEQ ID NO: 310142 - DNA, 20 bp, human
gaggagtgggatggaagtcg

SEQ ID NO: 310143 - DNA, 20 bp, human
ggtagtatgcggaaacagag

SEQ ID NO: 310144 - DNA, 20 bp, human
gcatgaaactgacgggaggg

SEQ ID NO: 310145 - DNA, 20 bp, human
ggcagcatgaaactgacggg

SEQ ID NO: 310146 - DNA, 20 bp, human
gctactgacactatcgctgg

SEQ ID NO: 310147 - DNA, 20 bp, human
gaggccgcgggttgagcgag

SEQ ID NO: 310148 - DNA, 20 bp, human
ggagggaggcgcaacgtcac

SEQ ID NO: 310149 - DNA, 20 bp, human
ggaggcgcaacgtcacaggc

SEQ ID NO: 310150 - DNA, 20 bp, human
ggcagccagacgactccgga

SEQ ID NO: 310151 - DNA, 20 bp, human
gcggagtcgtctggctgcag

SEQ ID NO: 310152 - DNA, 20 bp, human
ggaggctcagtcaagaggcg

SEQ ID NO: 310153 - DNA, 20 bp, human
gaggaaaaagcgctgagtga

SEQ ID NO: 310154 - DNA, 20 bp, human
ggtccccctccggagtcgtc

SEQ ID NO: 310155 - DNA, 20 bp, human
gcgactccggagggggacga

SEQ ID NO: 310156 - DNA, 20 bp, human
ggggaccagcagcagcgcag

SEQ ID NO: 310157 - DNA, 20 bp, human
gcgggagccgggtcaaaagt

SEQ ID NO: 310158 - DNA, 20 bp, human
ggctcagggcggggctaggg

SEQ ID NO: 310159 - DNA, 20 bp, human
gaaagctcagggcggggcta

SEQ ID NO: 310160 - DNA, 20 bp, human
gggtacacctacacagcggg

SEQ ID NO: 310161 - DNA, 20 bp, human
ggtgcgcaaagctcagggcg

SEQ ID NO: 310162 - DNA, 20 bp, human
ggggggtgggcgtgatgctg

SEQ ID NO: 310163 - DNA, 20 bp, human
gcctcagtgccatcccccga

SEQ ID NO: 310164 - DNA, 20 bp, human
ggcggctacccagcgcctgg

SEQ ID NO: 310165 - DNA, 20 bp, human
ggaagcactgccaagcgagc

SEQ ID NO: 310166 - DNA, 20 bp, human
ggccgcccggagaccggaga

SEQ ID NO: 310167 - DNA, 20 bp, human
gaggggcggggcccgaagga

SEQ ID NO: 310168 - DNA, 20 bp, human
gcgtgccgggaggaatgaga

SEQ ID NO: 310169 - DNA, 20 bp, human
gaagccggcgcgctctgatt

SEQ ID NO: 310170 - DNA, 20 bp, human
ggacgaaggcgctgcagcag

SEQ ID NO: 310171 - DNA, 20 bp, human
gagagcgcgccggcttcatt

SEQ ID NO: 310172 - DNA, 20 bp, human
gtcacccaatcagagagctc

SEQ ID NO: 310173 - DNA, 20 bp, human
ggccgctctccgaatgaagc

SEQ ID NO: 310174 - DNA, 20 bp, human
gaggagtaggcttcgggaac

SEQ ID NO: 310175 - DNA, 20 bp, human
ggacggaaggagtaggcttc

SEQ ID NO: 310176 - DNA, 20 bp, human
gcgcacgtgcggatgcgccc

SEQ ID NO: 310177 - DNA, 20 bp, human
ggcgcgaggcagggactctc

SEQ ID NO: 310178 - DNA, 20 bp, human
gtggaccacgtgcccggcgc

SEQ ID NO: 310179 - DNA, 20 bp, human
gcacgccgcggcccaacaat

SEQ ID NO: 310180 - DNA, 20 bp, human
gcaacaatgggcggccccca

SEQ ID NO: 310181 - DNA, 20 bp, human
gaagtccagtgggatcgcga

SEQ ID NO: 310182 - DNA, 20 bp, human
ggccgcggcccaacaatggg

SEQ ID NO: 310183 - DNA, 20 bp, human
gggggcgacccggatctcta

SEQ ID NO: 310184 - DNA, 20 bp, human
gggcagggactctcaggctt

SEQ ID NO: 310185 - DNA, 20 bp, human
gcggatctctaggggaaatt

SEQ ID NO: 310186 - DNA, 20 bp, human
gctgcgacgtagaggacatg

SEQ ID NO: 310187 - DNA, 20 bp, human
gtgacgagaggattgtggga

SEQ ID NO: 310188 - DNA, 20 bp, human
gggtttctgcgcatgctcat

SEQ ID NO: 310189 - DNA, 20 bp, human
gtacgtgacgagaggattgt

SEQ ID NO: 310190 - DNA, 20 bp, human
ggggatggtggacgacgttt

SEQ ID NO: 310191 - DNA, 20 bp, human
ggactcgacttcctagctgt

SEQ ID NO: 310192 - DNA, 20 bp, human
gtcctctacgtcgcagaatt

SEQ ID NO: 310193 - DNA, 20 bp, human
gagtcgcgcagctgtgttcg

SEQ ID NO: 310194 - DNA, 20 bp, human
gaccggaaatacgtgacgag

SEQ ID NO: 310195 - DNA, 20 bp, human
gctgatagagaaactactta

SEQ ID NO: 310196 - DNA, 20 bp, human
gccaggagatggaaccccga

SEQ ID NO: 310197 - DNA, 20 bp, human
ggctcctcactcgacgtcga

SEQ ID NO: 310198 - DNA, 20 bp, human
gcgggcgccagccccgtcgg

SEQ ID NO: 310199 - DNA, 20 bp, human
gcccgggcgcctctaccccg

SEQ ID NO: 310200 - DNA, 20 bp, human
gccgccacgccgtgccctcg

SEQ ID NO: 310201 - DNA, 20 bp, human
gggcaggcagggcagaacac

SEQ ID NO: 310202 - DNA, 20 bp, human
gctgaaagaggtgctggtta

SEQ ID NO: 310203 - DNA, 20 bp, human
ggaagctttgcacagacgtg

SEQ ID NO: 310204 - DNA, 20 bp, human
gagatggaaccccgagggca

SEQ ID NO: 310205 - DNA, 20 bp, human
ggaaccccgagggcacggcg

SEQ ID NO: 310206 - DNA, 20 bp, human
gcatctcgcggcagggtcga

SEQ ID NO: 310207 - DNA, 20 bp, human
ggcagccgaagtcgttaggg

SEQ ID NO: 310208 - DNA, 20 bp, human
gcgggcagccgaagtcgtta

SEQ ID NO: 310209 - DNA, 20 bp, human
gaccgcctccctaacgactt

SEQ ID NO: 310210 - DNA, 20 bp, human
gaggaggggtgcgaggttca

SEQ ID NO: 310211 - DNA, 20 bp, human
ggggtcgagggctgtgaaag

SEQ ID NO: 310212 - DNA, 20 bp, human
gaacgccgagtcggctgccg

SEQ ID NO: 310213 - DNA, 20 bp, human
gcttcctgaacgaggcagga

SEQ ID NO: 310214 - DNA, 20 bp, human
gcagtgacgcgatatgtgag

SEQ ID NO: 310215 - DNA, 20 bp, human
gcgctgaaggagcacttccg

SEQ ID NO: 310216 - DNA, 20 bp, human
gggctgccgcgaaaacccgg

SEQ ID NO: 310217 - DNA, 20 bp, human
ggccgctccgcagcaccgac

SEQ ID NO: 310218 - DNA, 20 bp, human
gcggtgcggcgcgagccagt

SEQ ID NO: 310219 - DNA, 20 bp, human
gcgcgagccagtcggtgctg

SEQ ID NO: 310220 - DNA, 20 bp, human
gtgtagccgccgggttttcg

SEQ ID NO: 310221 - DNA, 20 bp, human
ggactgaatgcgggactccc

SEQ ID NO: 310222 - DNA, 20 bp, human
gcccagtgcggctcgccggg

SEQ ID NO: 310223 - DNA, 20 bp, human
gcaccggaggctgtagttgc

SEQ ID NO: 310224 - DNA, 20 bp, human
ggaggcgcgggtgtagccgc

SEQ ID NO: 310225 - DNA, 20 bp, human
ggcgacgcccacagaagttg

SEQ ID NO: 310226 - DNA, 20 bp, human
ggtacggggcccagggtcgg

SEQ ID NO: 310227 - DNA, 20 bp, human
gaggactaatgagacacagg

SEQ ID NO: 310228 - DNA, 20 bp, human
ggggcccagcgcataactct

SEQ ID NO: 310229 - DNA, 20 bp, human
gggggcccacaggtctagca

SEQ ID NO: 310230 - DNA, 20 bp, human
ggcggatggagtgggatcca

SEQ ID NO: 310231 - DNA, 20 bp, human
gcatgaaggtacggggccca

SEQ ID NO: 310232 - DNA, 20 bp, human
gtctgcagctacgggaaggg

SEQ ID NO: 310233 - DNA, 20 bp, human
gaataaacagacatctgcag

SEQ ID NO: 310234 - DNA, 20 bp, human
ggctggctccaactgttccc

SEQ ID NO: 310235 - DNA, 20 bp, human
ggccacagagggcactatga

SEQ ID NO: 310236 - DNA, 20 bp, human
gggaccagatcgtgagagga

SEQ ID NO: 310237 - DNA, 20 bp, human
gaaaggcaatacatgagctg

SEQ ID NO: 310238 - DNA, 20 bp, human
gcgctgaaacaatgagatga

SEQ ID NO: 310239 - DNA, 20 bp, human
ggctggggccaacacttcca

SEQ ID NO: 310240 - DNA, 20 bp, human
ggctgggaccagatcgtgag

SEQ ID NO: 310241 - DNA, 20 bp, human
gaggagggaaaataggctaa

SEQ ID NO: 310242 - DNA, 20 bp, human
gtgctgctccctggaagtgt

SEQ ID NO: 310243 - DNA, 20 bp, human
ggagagctcttgctgctccc

SEQ ID NO: 310244 - DNA, 20 bp, human
gaggaggagacggaactttt

SEQ ID NO: 310245 - DNA, 20 bp, human
gaagaagagtctaaatgtgt

SEQ ID NO: 310246 - DNA, 20 bp, human
gcgtggcccacgcactggaa

SEQ ID NO: 310247 - DNA, 20 bp, human
gtggtcatgtgacgcggaaa

SEQ ID NO: 310248 - DNA, 20 bp, human
gggcgaaacgaggtgaccgc

SEQ ID NO: 310249 - DNA, 20 bp, human
gggacgcgtggcccacgcac

SEQ ID NO: 310250 - DNA, 20 bp, human
gacgcactggaacggctcca

SEQ ID NO: 310251 - DNA, 20 bp, human
gcatgtgacgcggaaaaggg

SEQ ID NO: 310252 - DNA, 20 bp, human
gtgttcgtggtcatgtgacg

SEQ ID NO: 310253 - DNA, 20 bp, human
gcacgaacactcttccgcta

SEQ ID NO: 310254 - DNA, 20 bp, human
gtgcgcagacatctttgttg

SEQ ID NO: 310255 - DNA, 20 bp, human
gtaagcaagggcttcctggg

SEQ ID NO: 310256 - DNA, 20 bp, human
gggtgtggcagtggcggaag

SEQ ID NO: 310257 - DNA, 20 bp, human
ggcggaagaggcagatatcg

SEQ ID NO: 310258 - DNA, 20 bp, human
gcgggacgccggtgtggcag

SEQ ID NO: 310259 - DNA, 20 bp, human
gtccgcggctgggagggaat

SEQ ID NO: 310260 - DNA, 20 bp, human
gctccgcccaagctggccag

SEQ ID NO: 310261 - DNA, 20 bp, human
gcgcccaagctggccagagg

SEQ ID NO: 310262 - DNA, 20 bp, human
gtgggagggaattggttgaa

SEQ ID NO: 310263 - DNA, 20 bp, human
gacgacgcgggacgccggtg

SEQ ID NO: 310264 - DNA, 20 bp, human
gggagcgcacggccagtggg

SEQ ID NO: 310265 - DNA, 20 bp, human
gccggccgttggcacgacgc

SEQ ID NO: 310266 - DNA, 20 bp, human
gggagcggcccccacgtgac

SEQ ID NO: 310267 - DNA, 20 bp, human
gccccgcccagcatggtccg

SEQ ID NO: 310268 - DNA, 20 bp, human
gggagggcgcgattgggaag

SEQ ID NO: 310269 - DNA, 20 bp, human
gtccgcgccccggaccatgc

SEQ ID NO: 310270 - DNA, 20 bp, human
gcgtcccagcggcggatgtg

SEQ ID NO: 310271 - DNA, 20 bp, human
gctgcggagggcgccgggtg

SEQ ID NO: 310272 - DNA, 20 bp, human
ggatgagtaagggaagccgg

SEQ ID NO: 310273 - DNA, 20 bp, human
ggcgggcgaacccaccaggg

SEQ ID NO: 310274 - DNA, 20 bp, human
gcggaggcgccgcgttttcc

SEQ ID NO: 310275 - DNA, 20 bp, human
gttttcccggcaccgccccg

SEQ ID NO: 310276 - DNA, 20 bp, human
gataccctggaacgcggggt

SEQ ID NO: 310277 - DNA, 20 bp, human
gggaggataccctggaacgc

SEQ ID NO: 310278 - DNA, 20 bp, human
gaggcctcccgctcgggccc

SEQ ID NO: 310279 - DNA, 20 bp, human
gcgaggaggggaggataccc

SEQ ID NO: 310280 - DNA, 20 bp, human
gcgagcgggaggcctccagc

SEQ ID NO: 310281 - DNA, 20 bp, human
ggcggccgcgagttcccggg

SEQ ID NO: 310282 - DNA, 20 bp, human
gagaaaagctcagacgtgga

SEQ ID NO: 310283 - DNA, 20 bp, human
gctttctagggcgcgaggag

SEQ ID NO: 310284 - DNA, 20 bp, human
gggtcagaatcccagagtcg

SEQ ID NO: 310285 - DNA, 20 bp, human
gaagctcagacgtggaagga

SEQ ID NO: 310286 - DNA, 20 bp, human
gggtgcttccaggacctgtt

SEQ ID NO: 310287 - DNA, 20 bp, human
gcagacgacctgctcctcac

SEQ ID NO: 310288 - DNA, 20 bp, human
gaggtcttggccatgatagt

SEQ ID NO: 310289 - DNA, 20 bp, human
gtgcagctagcggcactggg

SEQ ID NO: 310290 - DNA, 20 bp, human
gtcctcactgggctcaggca

SEQ ID NO: 310291 - DNA, 20 bp, human
gagggccccaccactctgat

SEQ ID NO: 310292 - DNA, 20 bp, human
gaatttgcagctagcggcac

SEQ ID NO: 310293 - DNA, 20 bp, human
ggagacgaccacaataagaa

SEQ ID NO: 310294 - DNA, 20 bp, human
gggagcaggtcgtctgcctg

SEQ ID NO: 310295 - DNA, 20 bp, human
gtcgactcctccaactatca

SEQ ID NO: 310296 - DNA, 20 bp, human
ggagactgctaccaggagag

SEQ ID NO: 310297 - DNA, 20 bp, human
gcagaaggcaaggtttgttg

SEQ ID NO: 310298 - DNA, 20 bp, human
gggcaaagggcggtcacttc

SEQ ID NO: 310299 - DNA, 20 bp, human
gccaggcgccattttcctta

SEQ ID NO: 310300 - DNA, 20 bp, human
gcctaggctgggcagatact

SEQ ID NO: 310301 - DNA, 20 bp, human
ggtgggcagagactgctacc

SEQ ID NO: 310302 - DNA, 20 bp, human
ggaacggaaaaccactctcc

SEQ ID NO: 310303 - DNA, 20 bp, human
ggatacttggacactttgag

SEQ ID NO: 310304 - DNA, 20 bp, human
gcctggcatagatgcgcttc

SEQ ID NO: 310305 - DNA, 20 bp, human
gcgtcagccaccaccatcat

SEQ ID NO: 310306 - DNA, 20 bp, human
gcagcagaggcgtaaggagt

SEQ ID NO: 310307 - DNA, 20 bp, human
gtcccaagcggacgacgcag

SEQ ID NO: 310308 - DNA, 20 bp, human
gccgagtcgcggggcagcag

SEQ ID NO: 310309 - DNA, 20 bp, human
gtcaaggggcgaaaaaccaa

SEQ ID NO: 310310 - DNA, 20 bp, human
ggaggcgtaaggagtaggcg

SEQ ID NO: 310311 - DNA, 20 bp, human
gccggcggaggagtggcgcg

SEQ ID NO: 310312 - DNA, 20 bp, human
gcgggtcgaggggcaatctg

SEQ ID NO: 310313 - DNA, 20 bp, human
gtaggcggggcgagccggct

SEQ ID NO: 310314 - DNA, 20 bp, human
ggcggggcagcagaggcgta

SEQ ID NO: 310315 - DNA, 20 bp, human
gtccgccggcgcgtcccaag

SEQ ID NO: 310316 - DNA, 20 bp, human
ggaaaaaaacgcagaggtgt

SEQ ID NO: 310317 - DNA, 20 bp, human
gcatgtgaggaagtgccctg

SEQ ID NO: 310318 - DNA, 20 bp, human
gcctggggaaaaaaacgcag

SEQ ID NO: 310319 - DNA, 20 bp, human
gggtgcctcaaacccgcaca

SEQ ID NO: 310320 - DNA, 20 bp, human
ggtggaacagctgactattg

SEQ ID NO: 310321 - DNA, 20 bp, human
gaggtattggggagttgcgc

SEQ ID NO: 310322 - DNA, 20 bp, human
ggcctcaaacccgcacatgg

SEQ ID NO: 310323 - DNA, 20 bp, human
gtctggatgtacctttccca

SEQ ID NO: 310324 - DNA, 20 bp, human
gggaatacgtgtgcacagtc

SEQ ID NO: 310325 - DNA, 20 bp, human
gggaaaggtacatccagaga

SEQ ID NO: 310326 - DNA, 20 bp, human
ggacagaggcggctgaaagg

SEQ ID NO: 310327 - DNA, 20 bp, human
gaggggcggggccagacgaa

SEQ ID NO: 310328 - DNA, 20 bp, human
gcccttccaccgggcacgga

SEQ ID NO: 310329 - DNA, 20 bp, human
ggaggacactcccttccacc

SEQ ID NO: 310330 - DNA, 20 bp, human
gtagaactcagcctagtgga

SEQ ID NO: 310331 - DNA, 20 bp, human
gggccgagctgacagctctc

SEQ ID NO: 310332 - DNA, 20 bp, human
gaaagtaatgggtgttgaat

SEQ ID NO: 310333 - DNA, 20 bp, human
gggtgaggctggtggaatat

SEQ ID NO: 310334 - DNA, 20 bp, human
gacaaaccctccgtgcccgg

SEQ ID NO: 310335 - DNA, 20 bp, human
gctgggggagtggacggtgc

SEQ ID NO: 310336 - DNA, 20 bp, human
gtgtgcggggatgtgacgag

SEQ ID NO: 310337 - DNA, 20 bp, human
gttcttaaaggcacaggcgg

SEQ ID NO: 310338 - DNA, 20 bp, human
gacagggtggcagttcttaa

SEQ ID NO: 310339 - DNA, 20 bp, human
ggaggtcaagcccctggcac

SEQ ID NO: 310340 - DNA, 20 bp, human
gaaactaggtgctctgtgcg

SEQ ID NO: 310341 - DNA, 20 bp, human
gagaaggtgcccaggtcttg

SEQ ID NO: 310342 - DNA, 20 bp, human
gaactgccaccctgtgccag

SEQ ID NO: 310343 - DNA, 20 bp, human
gcactgagtgagcacttagg

SEQ ID NO: 310344 - DNA, 20 bp, human
gcactcagtgccttgggtga

SEQ ID NO: 310345 - DNA, 20 bp, human
gaaggcccctggtagatcac

SEQ ID NO: 310346 - DNA, 20 bp, human
gagggccacgcccatgtgag

SEQ ID NO: 310347 - DNA, 20 bp, human
gcgctcgcggccgctcacat

SEQ ID NO: 310348 - DNA, 20 bp, human
ggacccagcggtcgatgaca

SEQ ID NO: 310349 - DNA, 20 bp, human
ggctgggaggacggacccag

SEQ ID NO: 310350 - DNA, 20 bp, human
gaggccctgtcatcgaccgc

SEQ ID NO: 310351 - DNA, 20 bp, human
gctggaagtgggcacctcga

SEQ ID NO: 310352 - DNA, 20 bp, human
gacggcggtcacatgactcc

SEQ ID NO: 310353 - DNA, 20 bp, human
gcgccccggcaggtcacgca

SEQ ID NO: 310354 - DNA, 20 bp, human
gtccgtcctcccagcgctcg

SEQ ID NO: 310355 - DNA, 20 bp, human
gtggaacactgtcaagacgg

SEQ ID NO: 310356 - DNA, 20 bp, human
gagaaccccgccactgactc

SEQ ID NO: 310357 - DNA, 20 bp, human
ggggttagcagcaccctgag

SEQ ID NO: 310358 - DNA, 20 bp, human
gcggcctcggggttacgcgg

SEQ ID NO: 310359 - DNA, 20 bp, human
gaagcagcgacccgcaggac

SEQ ID NO: 310360 - DNA, 20 bp, human
gacggacggtcgcacagacg

SEQ ID NO: 310361 - DNA, 20 bp, human
gccgccgccgcgtaaccccg

SEQ ID NO: 310362 - DNA, 20 bp, human
gggcaccaggcacgccgcca

SEQ ID NO: 310363 - DNA, 20 bp, human
gccgcagggcgcagacgatg

SEQ ID NO: 310364 - DNA, 20 bp, human
gcgtcccgagcgcgcagccg

SEQ ID NO: 310365 - DNA, 20 bp, human
gtccgcggggcaggcgtcgt

SEQ ID NO: 310366 - DNA, 20 bp, human
ggggctgtgcgcaggcgctt

SEQ ID NO: 310367 - DNA, 20 bp, human
gcggctctgcgtcctggcgg

SEQ ID NO: 310368 - DNA, 20 bp, human
gtggcggtggggactccccg

SEQ ID NO: 310369 - DNA, 20 bp, human
gaggccggacgatcgcgatt

SEQ ID NO: 310370 - DNA, 20 bp, human
gtgcgcgtgccaggccaccc

SEQ ID NO: 310371 - DNA, 20 bp, human
gcggcagggtcgttacgaag

SEQ ID NO: 310372 - DNA, 20 bp, human
ggggcgtgaacttggagtat

SEQ ID NO: 310373 - DNA, 20 bp, human
gggcacgcgcaagcgctccg

SEQ ID NO: 310374 - DNA, 20 bp, human
gcagacggagacggggctga

SEQ ID NO: 310375 - DNA, 20 bp, human
gtcactgcggccaggcgacc

SEQ ID NO: 310376 - DNA, 20 bp, human
gtgggcgcccgtcgtagagg

SEQ ID NO: 310377 - DNA, 20 bp, human
gggttcgccctcatacccgg

SEQ ID NO: 310378 - DNA, 20 bp, human
ggaaccgcagccaatcgcca

SEQ ID NO: 310379 - DNA, 20 bp, human
gcggggttcgccctcatacc

SEQ ID NO: 310380 - DNA, 20 bp, human
gggggtgccggccactcctg

SEQ ID NO: 310381 - DNA, 20 bp, human
gctagcgcccgccgggtatg

SEQ ID NO: 310382 - DNA, 20 bp, human
ggcgtgggcgcccgtcgtag

SEQ ID NO: 310383 - DNA, 20 bp, human
gagaggcggaacgagccctg

SEQ ID NO: 310384 - DNA, 20 bp, human
ggggaaggaaatggaccaga

SEQ ID NO: 310385 - DNA, 20 bp, human
ggcgggcgctaggaccgcgt

SEQ ID NO: 310386 - DNA, 20 bp, human
gcaggcagatgccggttccg

SEQ ID NO: 310387 - DNA, 20 bp, human
gaaccggcatctgcctgcgc

SEQ ID NO: 310388 - DNA, 20 bp, human
gagccagcgcaggcagatgc

SEQ ID NO: 310389 - DNA, 20 bp, human
gggattggccgcaaccgaga

SEQ ID NO: 310390 - DNA, 20 bp, human
gcttggagaacgtggctcgg

SEQ ID NO: 310391 - DNA, 20 bp, human
gggctgggcagaactataag

SEQ ID NO: 310392 - DNA, 20 bp, human
ggggtcatggccaaaggaga

SEQ ID NO: 310393 - DNA, 20 bp, human
gggccgcaaccgagagggct

SEQ ID NO: 310394 - DNA, 20 bp, human
gagaactataagaggcgcgg

SEQ ID NO: 310395 - DNA, 20 bp, human
gacgggattggctggaggcg

SEQ ID NO: 310396 - DNA, 20 bp, human
gcccccggggatccacccca

SEQ ID NO: 310397 - DNA, 20 bp, human
gccaaggagaacggtcctga

SEQ ID NO: 310398 - DNA, 20 bp, human
gaccgcgaagggcaccccaa

SEQ ID NO: 310399 - DNA, 20 bp, human
gaagaaccaaaatccgcggg

SEQ ID NO: 310400 - DNA, 20 bp, human
gcgtgagcgcccgcagacgg

SEQ ID NO: 310401 - DNA, 20 bp, human
gaggaccgttctccttgggg

SEQ ID NO: 310402 - DNA, 20 bp, human
gccaagggcgataaccccga

SEQ ID NO: 310403 - DNA, 20 bp, human
gtccttggggtggatccccg

SEQ ID NO: 310404 - DNA, 20 bp, human
gcggcggccctgcgcgctaa

SEQ ID NO: 310405 - DNA, 20 bp, human
gagcgaagaaccaaaatccg

SEQ ID NO: 310406 - DNA, 20 bp, human
gcacccgcgcaggacctcgg

SEQ ID NO: 310407 - DNA, 20 bp, human
gctcccaccgaggtcctgcg

SEQ ID NO: 310408 - DNA, 20 bp, human
gtggcccgttgcggtctctg

SEQ ID NO: 310409 - DNA, 20 bp, human
gcgggccacagagaccgcaa

SEQ ID NO: 310410 - DNA, 20 bp, human
gcgcccgcgagctgacgctc

SEQ ID NO: 310411 - DNA, 20 bp, human
gataccgcaggtgaggggag

SEQ ID NO: 310412 - DNA, 20 bp, human
ggccccgccctctttacctg

SEQ ID NO: 310413 - DNA, 20 bp, human
gagcccggactggccaccgg

SEQ ID NO: 310414 - DNA, 20 bp, human
ggggccagagcgtcagctcg

SEQ ID NO: 310415 - DNA, 20 bp, human
gtgggagcgcgcacgtggcg

SEQ ID NO: 310416 - DNA, 20 bp, human
ggcctggcaccgcacgggga

SEQ ID NO: 310417 - DNA, 20 bp, human
gcatgtgcgctcgggtagga

SEQ ID NO: 310418 - DNA, 20 bp, human
gccggcgcctggcaccgcac

SEQ ID NO: 310419 - DNA, 20 bp, human
gcaccgcacggggaaggcgc

SEQ ID NO: 310420 - DNA, 20 bp, human
gagggcgagcatgtgcgctc

SEQ ID NO: 310421 - DNA, 20 bp, human
gcgagcatgtgcgctcgggt

SEQ ID NO: 310422 - DNA, 20 bp, human
gctcccgcgccttccccgtg

SEQ ID NO: 310423 - DNA, 20 bp, human
gcctccggatgcagccccca

SEQ ID NO: 310424 - DNA, 20 bp, human
gggtctccgcagccggggga

SEQ ID NO: 310425 - DNA, 20 bp, human
gcccggctgcggagaccaac

SEQ ID NO: 310426 - DNA, 20 bp, human
gaactcctgacgcctggggt

SEQ ID NO: 310427 - DNA, 20 bp, human
ggggaaggggcgaccatagg

SEQ ID NO: 310428 - DNA, 20 bp, human
gtccgcgcccgggtaaggga

SEQ ID NO: 310429 - DNA, 20 bp, human
gcgcccgggtaagggaagga

SEQ ID NO: 310430 - DNA, 20 bp, human
gctgacgcctggggtgggtc

SEQ ID NO: 310431 - DNA, 20 bp, human
gcctggggtgggtcgggaag

SEQ ID NO: 310432 - DNA, 20 bp, human
gcgccctccttcccttaccc

SEQ ID NO: 310433 - DNA, 20 bp, human
gaggagcaggtgtcacggga

SEQ ID NO: 310434 - DNA, 20 bp, human
gcgcggaactcctgacgcct

SEQ ID NO: 310435 - DNA, 20 bp, human
ggagttccgcgcccgggtaa

SEQ ID NO: 310436 - DNA, 20 bp, human
ggggtccagccggtagtgac

SEQ ID NO: 310437 - DNA, 20 bp, human
ggtggggccacggaggacgg

SEQ ID NO: 310438 - DNA, 20 bp, human
gggcggcgactgtgaggccg

SEQ ID NO: 310439 - DNA, 20 bp, human
gcgccgccgccggtcactac

SEQ ID NO: 310440 - DNA, 20 bp, human
ggcgaccttctctcccgctg

SEQ ID NO: 310441 - DNA, 20 bp, human
gtccagccggtagtgaccgg

SEQ ID NO: 310442 - DNA, 20 bp, human
gcccggggagcacgctgagg

SEQ ID NO: 310443 - DNA, 20 bp, human
ggccctgaaacgggtccagc

SEQ ID NO: 310444 - DNA, 20 bp, human
ggccgccggtcactaccggc

SEQ ID NO: 310445 - DNA, 20 bp, human
gcgaggcgagggatgcggac

SEQ ID NO: 310446 - DNA, 20 bp, human
ggacgtgcgcaggtgcgcta

SEQ ID NO: 310447 - DNA, 20 bp, human
gggactgcgcccccggtctg

SEQ ID NO: 310448 - DNA, 20 bp, human
gggagccagaatggaatgaa

SEQ ID NO: 310449 - DNA, 20 bp, human
gcggccccaggtacccggga

SEQ ID NO: 310450 - DNA, 20 bp, human
gcacctgcccggacgtgcgc

SEQ ID NO: 310451 - DNA, 20 bp, human
gagctcagagcgcaccctac

SEQ ID NO: 310452 - DNA, 20 bp, human
gggaatgaatggtatccacc

SEQ ID NO: 310453 - DNA, 20 bp, human
gcagtccaggcgtttagctc

SEQ ID NO: 310454 - DNA, 20 bp, human
gcctccctcccgggtacctg

SEQ ID NO: 310455 - DNA, 20 bp, human
gcgtcagagtcggcgtgggg

SEQ ID NO: 310456 - DNA, 20 bp, human
gtccgccccaaggactacgg

SEQ ID NO: 310457 - DNA, 20 bp, human
ggaccctcctccgtagtcct

SEQ ID NO: 310458 - DNA, 20 bp, human
ggccccaaggactacggagg

SEQ ID NO: 310459 - DNA, 20 bp, human
gagttccgccccaaggacta

SEQ ID NO: 310460 - DNA, 20 bp, human
ggaagtgcagagcttctgct

SEQ ID NO: 310461 - DNA, 20 bp, human
gaagctctgcacttcctgaa

SEQ ID NO: 310462 - DNA, 20 bp, human
gctgtgaccggggcccttcc

SEQ ID NO: 310463 - DNA, 20 bp, human
gttcccgcaggggctgtaga

SEQ ID NO: 310464 - DNA, 20 bp, human
gacttccagcctgaggccga

SEQ ID NO: 310465 - DNA, 20 bp, human
ggcatggggtaggagggcga

SEQ ID NO: 310466 - DNA, 20 bp, human
ggtatctggcgctaataaaa

SEQ ID NO: 310467 - DNA, 20 bp, human
gtgaccccgcctatgacctc

SEQ ID NO: 310468 - DNA, 20 bp, human
gtgggctctcagtccccgtc

SEQ ID NO: 310469 - DNA, 20 bp, human
gcctgacggtcagacgtagg

SEQ ID NO: 310470 - DNA, 20 bp, human
gcggaacgccccgaggtcat

SEQ ID NO: 310471 - DNA, 20 bp, human
gggcagcgcagggcgaaagg

SEQ ID NO: 310472 - DNA, 20 bp, human
ggcggggtcacgcggaaggc

SEQ ID NO: 310473 - DNA, 20 bp, human
gctgccgcgccgccctgctc

SEQ ID NO: 310474 - DNA, 20 bp, human
gcagtccccgtcaggatggg

SEQ ID NO: 310475 - DNA, 20 bp, human
ggagagcccaggagagctcg

SEQ ID NO: 310476 - DNA, 20 bp, human
gcgcgcctgcgcagagagag

SEQ ID NO: 310477 - DNA, 20 bp, human
gactgggcacatcatcaata

SEQ ID NO: 310478 - DNA, 20 bp, human
gaccctgctgcccctatcgt

SEQ ID NO: 310479 - DNA, 20 bp, human
gggctcccggggtaggtccg

SEQ ID NO: 310480 - DNA, 20 bp, human
ggtgctacctggcagctccg

SEQ ID NO: 310481 - DNA, 20 bp, human
gtctggtctcaggcaaggtg

SEQ ID NO: 310482 - DNA, 20 bp, human
gcctcctagcacaactccat

SEQ ID NO: 310483 - DNA, 20 bp, human
gagcaccggccacgcacccg

SEQ ID NO: 310484 - DNA, 20 bp, human
gctgctgcccctatcgttgg

SEQ ID NO: 310485 - DNA, 20 bp, human
gcagcagggtctgtacccag

SEQ ID NO: 310486 - DNA, 20 bp, human
ggagcagcagcaagaccctt

SEQ ID NO: 310487 - DNA, 20 bp, human
gcggcgggctccgagcgggt

SEQ ID NO: 310488 - DNA, 20 bp, human
gccaacaccaggagtccaaa

SEQ ID NO: 310489 - DNA, 20 bp, human
gctgctgctctggggccgtt

SEQ ID NO: 310490 - DNA, 20 bp, human
ggagccggcgaggagcccta

SEQ ID NO: 310491 - DNA, 20 bp, human
gggaggcacctaaactcctc

SEQ ID NO: 310492 - DNA, 20 bp, human
ggcgggtaggagcgcgtgcg

SEQ ID NO: 310493 - DNA, 20 bp, human
gggtctgcggagccccgtgt

SEQ ID NO: 310494 - DNA, 20 bp, human
ggcagcggcttccactcggg

SEQ ID NO: 310495 - DNA, 20 bp, human
gctcggggggcgggtcccaa

SEQ ID NO: 310496 - DNA, 20 bp, human
gaggggatggagtgggtcat

SEQ ID NO: 310497 - DNA, 20 bp, human
ggcactgaatgtttaatcgg

SEQ ID NO: 310498 - DNA, 20 bp, human
gtaaatagttaccagatctt

SEQ ID NO: 310499 - DNA, 20 bp, human
gcactgactccgaatctctc

SEQ ID NO: 310500 - DNA, 20 bp, human
gtgaggacaccctgtatgtc

SEQ ID NO: 310501 - DNA, 20 bp, human
ggctttcaaatgcaaatgaa

SEQ ID NO: 310502 - DNA, 20 bp, human
gtcgtggtcttgctctaaga

SEQ ID NO: 310503 - DNA, 20 bp, human
gaccaaagcaaccaaagatc

SEQ ID NO: 310504 - DNA, 20 bp, human
gagggctcttttggaatact

SEQ ID NO: 310505 - DNA, 20 bp, human
gtaacattttcttgataggt

SEQ ID NO: 310506 - DNA, 20 bp, human
ggtcagctctagagacctca

SEQ ID NO: 310507 - DNA, 20 bp, human
gaggatggtgaggactacaa

SEQ ID NO: 310508 - DNA, 20 bp, human
gacagagctggagatgggtt

SEQ ID NO: 310509 - DNA, 20 bp, human
ggaccgcggcatctcagaaa

SEQ ID NO: 310510 - DNA, 20 bp, human
gcacccagtgcgctaatgga

SEQ ID NO: 310511 - DNA, 20 bp, human
gtagcaacagagctggagat

SEQ ID NO: 310512 - DNA, 20 bp, human
gagctctgttgctatccctg

SEQ ID NO: 310513 - DNA, 20 bp, human
ggcaggcgacggcgacttgt

SEQ ID NO: 310514 - DNA, 20 bp, human
gcctctcctaggaaagctaa

SEQ ID NO: 310515 - DNA, 20 bp, human
gaggtctctagagctgaccg

SEQ ID NO: 310516 - DNA, 20 bp, human
ggggtcgggcgtccaccctc

SEQ ID NO: 310517 - DNA, 20 bp, human
ggcggggcggggcggactga

SEQ ID NO: 310518 - DNA, 20 bp, human
gctccctggcgcaaccctga

SEQ ID NO: 310519 - DNA, 20 bp, human
ggctcccagcccttggccta

SEQ ID NO: 310520 - DNA, 20 bp, human
gcaccctcagggttgcgcca

SEQ ID NO: 310521 - DNA, 20 bp, human
gtcaccaaaccctaggccaa

SEQ ID NO: 310522 - DNA, 20 bp, human
gctggagccgcgcctgaagt

SEQ ID NO: 310523 - DNA, 20 bp, human
ggaaagccgactcccgaagt

SEQ ID NO: 310524 - DNA, 20 bp, human
gaaccagggtgcccgacggg

SEQ ID NO: 310525 - DNA, 20 bp, human
ggggcctggcggacgccggc

SEQ ID NO: 310526 - DNA, 20 bp, human
gtgctctggaacacggggga

SEQ ID NO: 310527 - DNA, 20 bp, human
ggggttgatgtcaggggcgt

SEQ ID NO: 310528 - DNA, 20 bp, human
gaccacaggccgcagagttc

SEQ ID NO: 310529 - DNA, 20 bp, human
ggcacccgcaggcccctgcg

SEQ ID NO: 310530 - DNA, 20 bp, human
gggggaggggttgatgtcag

SEQ ID NO: 310531 - DNA, 20 bp, human
gtagaaccctgcacgattcg

SEQ ID NO: 310532 - DNA, 20 bp, human
ggctaaggggtcaccaggca

SEQ ID NO: 310533 - DNA, 20 bp, human
gggtcaccaggcatggtgag

SEQ ID NO: 310534 - DNA, 20 bp, human
gaaactgctaaggggtcacc

SEQ ID NO: 310535 - DNA, 20 bp, human
gtgaaaccacgaatcgtgca

SEQ ID NO: 310536 - DNA, 20 bp, human
gcacccgtcagcagcctcga

SEQ ID NO: 310537 - DNA, 20 bp, human
gggaagaaacaggcggaagt

SEQ ID NO: 310538 - DNA, 20 bp, human
ggccgtggccggctgcctat

SEQ ID NO: 310539 - DNA, 20 bp, human
gcgaaggcgcctgaccgccg

SEQ ID NO: 310540 - DNA, 20 bp, human
gggcgcctgaccgccgtggc

SEQ ID NO: 310541 - DNA, 20 bp, human
gaggctgtagcggctccaat

SEQ ID NO: 310542 - DNA, 20 bp, human
gggcccgccccttagaccgt

SEQ ID NO: 310543 - DNA, 20 bp, human
gtctaaggggcgggccggag

SEQ ID NO: 310544 - DNA, 20 bp, human
gctgacgggtgactgtgctt

SEQ ID NO: 310545 - DNA, 20 bp, human
gcgaaaggcgagagctgcga

SEQ ID NO: 310546 - DNA, 20 bp, human
gtgcgccggcccacggcccg

SEQ ID NO: 310547 - DNA, 20 bp, human
ggacgtgcagatccgtgttg

SEQ ID NO: 310548 - DNA, 20 bp, human
gcctgtgcccgcgtgaacct

SEQ ID NO: 310549 - DNA, 20 bp, human
gccggcgcacgcacggtcac

SEQ ID NO: 310550 - DNA, 20 bp, human
gcgcacgcacggtcacagga

SEQ ID NO: 310551 - DNA, 20 bp, human
gttccgcagcgtgcccgggt

SEQ ID NO: 310552 - DNA, 20 bp, human
ggcggggaatgcgggtagtt

SEQ ID NO: 310553 - DNA, 20 bp, human
gacacggagtcacaccgacc

SEQ ID NO: 310554 - DNA, 20 bp, human
gtgcacgtccatgcacacac

SEQ ID NO: 310555 - DNA, 20 bp, human
ggggtcggacggaaggacac

SEQ ID NO: 310556 - DNA, 20 bp, human
gagcctgcggagcgttcggg

SEQ ID NO: 310557 - DNA, 20 bp, human
ggcgccccgcgccccaccag

SEQ ID NO: 310558 - DNA, 20 bp, human
ggtcgcgcgggccactggtg

SEQ ID NO: 310559 - DNA, 20 bp, human
gcccgcgcgactgtcactta

SEQ ID NO: 310560 - DNA, 20 bp, human
gcccctaagtgacagtcgcg

SEQ ID NO: 310561 - DNA, 20 bp, human
gggccggccaatggctggcg

SEQ ID NO: 310562 - DNA, 20 bp, human
ggccgccccgctgccacatc

SEQ ID NO: 310563 - DNA, 20 bp, human
gggaggctggcccggctcat

SEQ ID NO: 310564 - DNA, 20 bp, human
gcgtgcagggaccgctccgg

SEQ ID NO: 310565 - DNA, 20 bp, human
gacgcagcctgcggagcgtt

SEQ ID NO: 310566 - DNA, 20 bp, human
gcggcggccgggatcccgat

SEQ ID NO: 310567 - DNA, 20 bp, human
gggctcccgcagccccgcgt

SEQ ID NO: 310568 - DNA, 20 bp, human
ggatctggggcctggatctg

SEQ ID NO: 310569 - DNA, 20 bp, human
gggggcggcccggatttaaa

SEQ ID NO: 310570 - DNA, 20 bp, human
gggggccgccgcggagtcga

SEQ ID NO: 310571 - DNA, 20 bp, human
gccgcggcggccccagatcc

SEQ ID NO: 310572 - DNA, 20 bp, human
gcggggctgcgggagccgat

SEQ ID NO: 310573 - DNA, 20 bp, human
ggctgcggcccctttaaatc

SEQ ID NO: 310574 - DNA, 20 bp, human
ggccggcgacggcggtgctg

SEQ ID NO: 310575 - DNA, 20 bp, human
gaggctcactgcagatatca

SEQ ID NO: 310576 - DNA, 20 bp, human
gcaactgggtgtactctcat

SEQ ID NO: 310577 - DNA, 20 bp, human
gctgttctatgtactctgac

SEQ ID NO: 310578 - DNA, 20 bp, human
gcagtcttagcataattaga

SEQ ID NO: 310579 - DNA, 20 bp, human
gcacacaaaagcgagataat

SEQ ID NO: 310580 - DNA, 20 bp, human
ggatgtcacaaacatcaact

SEQ ID NO: 310581 - DNA, 20 bp, human
gaaagtaatgttgagctcct

SEQ ID NO: 310582 - DNA, 20 bp, human
gtttcagtttgtgatccccc

SEQ ID NO: 310583 - DNA, 20 bp, human
gtgagtttcttaaatctcag

SEQ ID NO: 310584 - DNA, 20 bp, human
gcagcacagtgccattatga

SEQ ID NO: 310585 - DNA, 20 bp, human
gttgacagaatggatattaa

SEQ ID NO: 310586 - DNA, 20 bp, human
gactctgttccgcagcccaa

SEQ ID NO: 310587 - DNA, 20 bp, human
gaagctggggcgttccgaat

SEQ ID NO: 310588 - DNA, 20 bp, human
gcggaacgccccagcttctc

SEQ ID NO: 310589 - DNA, 20 bp, human
gggagaagtcctcctagaca

SEQ ID NO: 310590 - DNA, 20 bp, human
gggctgcggaacagagtggc

SEQ ID NO: 310591 - DNA, 20 bp, human
gccagcttctcaggggccgt

SEQ ID NO: 310592 - DNA, 20 bp, human
gagcagcgaagcccactgat

SEQ ID NO: 310593 - DNA, 20 bp, human
gaatatcctaacaaggtcag

SEQ ID NO: 310594 - DNA, 20 bp, human
gagggttgagagtttgccga

SEQ ID NO: 310595 - DNA, 20 bp, human
gactctcaaccctgtctagg

SEQ ID NO: 310596 - DNA, 20 bp, human
gcgtcctcgaagctggtcct

SEQ ID NO: 310597 - DNA, 20 bp, human
ggaccagcttcgaggacggg

SEQ ID NO: 310598 - DNA, 20 bp, human
ggcgccgcattgttcctcgg

SEQ ID NO: 310599 - DNA, 20 bp, human
ggcgcgccggcgccacctcg

SEQ ID NO: 310600 - DNA, 20 bp, human
gcccgctgtgcgccctgccc

SEQ ID NO: 310601 - DNA, 20 bp, human
gcaagcgaaatcgtgggaag

SEQ ID NO: 310602 - DNA, 20 bp, human
ggcccgcccgtcctcgaagc

SEQ ID NO: 310603 - DNA, 20 bp, human
gtcggcgtcccagccccgca

SEQ ID NO: 310604 - DNA, 20 bp, human
gaggtggcgccggcgcgcct

SEQ ID NO: 310605 - DNA, 20 bp, human
gctggctagtggaggatctg

SEQ ID NO: 310606 - DNA, 20 bp, human
gggaccattacccgccccga

SEQ ID NO: 310607 - DNA, 20 bp, human
gtgccgccggttggggcaat

SEQ ID NO: 310608 - DNA, 20 bp, human
gggtgccaggcttgtttcgg

SEQ ID NO: 310609 - DNA, 20 bp, human
gccaccctccgaaacaagcc

SEQ ID NO: 310610 - DNA, 20 bp, human
gggaggaggctgccgccggt

SEQ ID NO: 310611 - DNA, 20 bp, human
ggtaatggtccgtccgtccc

SEQ ID NO: 310612 - DNA, 20 bp, human
gcctggcaccctgggacgga

SEQ ID NO: 310613 - DNA, 20 bp, human
gggaggggaccggtctgagc

SEQ ID NO: 310614 - DNA, 20 bp, human
gaggagacgcgaaaagcaga

SEQ ID NO: 310615 - DNA, 20 bp, human
gaggctagccccaaagaagg

SEQ ID NO: 310616 - DNA, 20 bp, human
gcgcggaggagaggagtgcg

SEQ ID NO: 310617 - DNA, 20 bp, human
gcccaccggcaggctctccg

SEQ ID NO: 310618 - DNA, 20 bp, human
gggccgcccgaggactgtca

SEQ ID NO: 310619 - DNA, 20 bp, human
gctccctgacagtcctcggg

SEQ ID NO: 310620 - DNA, 20 bp, human
gccgcgggccgggcacacgt

SEQ ID NO: 310621 - DNA, 20 bp, human
gagtgcgtggctgggtcggc

SEQ ID NO: 310622 - DNA, 20 bp, human
gggggcggcccgaggtgggt

SEQ ID NO: 310623 - DNA, 20 bp, human
gtatccctgggccggctcgg

SEQ ID NO: 310624 - DNA, 20 bp, human
ggggccgggaggcagttacc

SEQ ID NO: 310625 - DNA, 20 bp, human
gcgcggctgtccacgaggcg

SEQ ID NO: 310626 - DNA, 20 bp, human
gccaacgcgccaccagttag

SEQ ID NO: 310627 - DNA, 20 bp, human
gactccctgcctctaactgg

SEQ ID NO: 310628 - DNA, 20 bp, human
gagacgccggcccttccgct

SEQ ID NO: 310629 - DNA, 20 bp, human
gagtacctctccgagcggaa

SEQ ID NO: 310630 - DNA, 20 bp, human
ggccgacgaaagcctcgggt

SEQ ID NO: 310631 - DNA, 20 bp, human
gccccacccgaggctttcgt

SEQ ID NO: 310632 - DNA, 20 bp, human
gggccggcgtctccgaagcg

SEQ ID NO: 310633 - DNA, 20 bp, human
gccggcccttccgctcggag

SEQ ID NO: 310634 - DNA, 20 bp, human
gactcagcccgagtccaaga

SEQ ID NO: 310635 - DNA, 20 bp, human
gctcgctgccatcttggact

SEQ ID NO: 310636 - DNA, 20 bp, human
gggcatgcgccgacccggtc

SEQ ID NO: 310637 - DNA, 20 bp, human
gtgttcccgcccgaccgggt

SEQ ID NO: 310638 - DNA, 20 bp, human
ggcagtctgcgcatcctcgc

SEQ ID NO: 310639 - DNA, 20 bp, human
gggtcggcgcatgccctgtg

SEQ ID NO: 310640 - DNA, 20 bp, human
gcggcgcatgccctgtgcgg

SEQ ID NO: 310641 - DNA, 20 bp, human
gggcccggcgccgccgcaca

SEQ ID NO: 310642 - DNA, 20 bp, human
gtgcgccgacccggtcgggc

SEQ ID NO: 310643 - DNA, 20 bp, human
gccgaagggccatccgggtc

SEQ ID NO: 310644 - DNA, 20 bp, human
gaaagcaagagagcgcgcgg

SEQ ID NO: 310645 - DNA, 20 bp, human
gcgtggggcggggtctagag

SEQ ID NO: 310646 - DNA, 20 bp, human
gagagtagataatatctgga

SEQ ID NO: 310647 - DNA, 20 bp, human
gggacctgactgtgttacac

SEQ ID NO: 310648 - DNA, 20 bp, human
gtctggaaggaatgactgtt

SEQ ID NO: 310649 - DNA, 20 bp, human
gcagtcaggtccagcagtta

SEQ ID NO: 310650 - DNA, 20 bp, human
gggtaacaaacagaacacta

SEQ ID NO: 310651 - DNA, 20 bp, human
gtgagaggggaggaaccagt

SEQ ID NO: 310652 - DNA, 20 bp, human
gagggtagatcatgtgtttg

SEQ ID NO: 310653 - DNA, 20 bp, human
gcccaaaagccctgcggtca

SEQ ID NO: 310654 - DNA, 20 bp, human
gcctcctggccctgaccgca

SEQ ID NO: 310655 - DNA, 20 bp, human
gcctctgtgggcttttgccc

SEQ ID NO: 310656 - DNA, 20 bp, human
gtcaacccgtcagagggcct

SEQ ID NO: 310657 - DNA, 20 bp, human
ggggaaagatagttcccaga

SEQ ID NO: 310658 - DNA, 20 bp, human
ggcagcgcgggaagcccgtc

SEQ ID NO: 310659 - DNA, 20 bp, human
gtgcttgtcaacccgtcaga

SEQ ID NO: 310660 - DNA, 20 bp, human
gcccggggcacgtcgggaaa

SEQ ID NO: 310661 - DNA, 20 bp, human
gcactccgggacaaaccaaa

SEQ ID NO: 310662 - DNA, 20 bp, human
ggggcgggagacaaactcag

SEQ ID NO: 310663 - DNA, 20 bp, human
ggcctgggaacggagcatcc

SEQ ID NO: 310664 - DNA, 20 bp, human
ggacgggttgacaagcactc

SEQ ID NO: 310665 - DNA, 20 bp, human
gggcccggggaccgacgcca

SEQ ID NO: 310666 - DNA, 20 bp, human
ggtcgggctttaaacgtggg

SEQ ID NO: 310667 - DNA, 20 bp, human
gcaggggaggtgaagtctaa

SEQ ID NO: 310668 - DNA, 20 bp, human
gctaagggcgccaaatagaa

SEQ ID NO: 310669 - DNA, 20 bp, human
gagcaggcgatggttactgt

SEQ ID NO: 310670 - DNA, 20 bp, human
gggtaaatcaggtgatttag

SEQ ID NO: 310671 - DNA, 20 bp, human
gcccctaatcagtgggaagg

SEQ ID NO: 310672 - DNA, 20 bp, human
gaaagggaatcagcaggcga

SEQ ID NO: 310673 - DNA, 20 bp, human
ggtcccccttcccactgatt

SEQ ID NO: 310674 - DNA, 20 bp, human
gtgcctgcgtccggcccgcg

SEQ ID NO: 310675 - DNA, 20 bp, human
gaatcaggtgatttagagga

SEQ ID NO: 310676 - DNA, 20 bp, human
gcagcctggtgcaggggata

SEQ ID NO: 310677 - DNA, 20 bp, human
ggcaaggccctaggagggaa

SEQ ID NO: 310678 - DNA, 20 bp, human
gccctaggagggaagggcgt

SEQ ID NO: 310679 - DNA, 20 bp, human
gtctcagcaaggccctagga

SEQ ID NO: 310680 - DNA, 20 bp, human
gagcgtgaatacattagaac

SEQ ID NO: 310681 - DNA, 20 bp, human
gagccctgcccgctggccgt

SEQ ID NO: 310682 - DNA, 20 bp, human
gaactggcactgcggctgga

SEQ ID NO: 310683 - DNA, 20 bp, human
ggcagagaagatagtgtaac

SEQ ID NO: 310684 - DNA, 20 bp, human
gtgagaggcagcctggtgca

SEQ ID NO: 310685 - DNA, 20 bp, human
gaaggtctcagcaaggccct

SEQ ID NO: 310686 - DNA, 20 bp, human
gaggtcatacctcccggatt

SEQ ID NO: 310687 - DNA, 20 bp, human
gccaaccagtggccctgagt

SEQ ID NO: 310688 - DNA, 20 bp, human
gccagccaggtcatacctcc

SEQ ID NO: 310689 - DNA, 20 bp, human
gtccctgaggcgcgtagctg

SEQ ID NO: 310690 - DNA, 20 bp, human
gagcgccaggagccccgcct

SEQ ID NO: 310691 - DNA, 20 bp, human
ggccaggagccccgccttgg

SEQ ID NO: 310692 - DNA, 20 bp, human
gcgcggccacgcccccaagg

SEQ ID NO: 310693 - DNA, 20 bp, human
ggggcggcgcttggtgtccc

SEQ ID NO: 310694 - DNA, 20 bp, human
gctcagggacacatcgattg

SEQ ID NO: 310695 - DNA, 20 bp, human
gagagcgcctaaaaccgcta

SEQ ID NO: 310696 - DNA, 20 bp, human
ggggggcgggacaagaggcg

SEQ ID NO: 310697 - DNA, 20 bp, human
ggacaagaggcgcggattgg

SEQ ID NO: 310698 - DNA, 20 bp, human
gcgggacaagaggcgcggat

SEQ ID NO: 310699 - DNA, 20 bp, human
ggggggcagagtcgagtctc

SEQ ID NO: 310700 - DNA, 20 bp, human
gtgagaaggaccaagcccaa

SEQ ID NO: 310701 - DNA, 20 bp, human
gccaggcgacgctttccgaa

SEQ ID NO: 310702 - DNA, 20 bp, human
gggagcgggtcgcgccggag

SEQ ID NO: 310703 - DNA, 20 bp, human
gttccgaagggcgggattgg

SEQ ID NO: 310704 - DNA, 20 bp, human
gcagagtcgagtctccggat

SEQ ID NO: 310705 - DNA, 20 bp, human
ggatacaaatgcaaagaagg

SEQ ID NO: 310706 - DNA, 20 bp, human
gccctcctcaacaatcacag

SEQ ID NO: 310707 - DNA, 20 bp, human
gtggccagaggggacagcgg

SEQ ID NO: 310708 - DNA, 20 bp, human
gttgaggagggggctgtcac

SEQ ID NO: 310709 - DNA, 20 bp, human
gggaaagttgtgagctgctt

SEQ ID NO: 310710 - DNA, 20 bp, human
gccaaggtggttttctttac

SEQ ID NO: 310711 - DNA, 20 bp, human
ggaagtttgggactggttta

SEQ ID NO: 310712 - DNA, 20 bp, human
gagcacaggaaattccaagg

SEQ ID NO: 310713 - DNA, 20 bp, human
gcacagaggcctagataagg

SEQ ID NO: 310714 - DNA, 20 bp, human
gcatttcaaggatagggtaa

SEQ ID NO: 310715 - DNA, 20 bp, human
gccaaggaaattcccagata

SEQ ID NO: 310716 - DNA, 20 bp, human
gtaagtaggcctccgcaaaa

SEQ ID NO: 310717 - DNA, 20 bp, human
gggtaactacccttttgcgg

SEQ ID NO: 310718 - DNA, 20 bp, human
gaagtgagacagttttacat

SEQ ID NO: 310719 - DNA, 20 bp, human
ggcaggtaactacccttttg

SEQ ID NO: 310720 - DNA, 20 bp, human
gactcaatggcacatatgag

SEQ ID NO: 310721 - DNA, 20 bp, human
gcactgaaattagtatttgc

SEQ ID NO: 310722 - DNA, 20 bp, human
gaaggtaccttgtgttcaac

SEQ ID NO: 310723 - DNA, 20 bp, human
gaacttcatagtaacaataa

SEQ ID NO: 310724 - DNA, 20 bp, human
gttggactaatgtgttataa

SEQ ID NO: 310725 - DNA, 20 bp, human
gggaaaagaaatgttaacct

SEQ ID NO: 310726 - DNA, 20 bp, human
ggaagacaagcgcagagggg

SEQ ID NO: 310727 - DNA, 20 bp, human
gcggagcgccgggggcatgt

SEQ ID NO: 310728 - DNA, 20 bp, human
gtgggaagacaagcgcagag

SEQ ID NO: 310729 - DNA, 20 bp, human
ggggaccaggcggagcgccg

SEQ ID NO: 310730 - DNA, 20 bp, human
gaccagaggagaaggcttcg

SEQ ID NO: 310731 - DNA, 20 bp, human
gaggagaaggcttcgaggag

SEQ ID NO: 310732 - DNA, 20 bp, human
gcggcagcgaccagaggaga

SEQ ID NO: 310733 - DNA, 20 bp, human
gaaactgctcagaccttcgc

SEQ ID NO: 310734 - DNA, 20 bp, human
gtcacgcggaggtgctgcga

SEQ ID NO: 310735 - DNA, 20 bp, human
gagaaggcttcgaggagagg

SEQ ID NO: 310736 - DNA, 20 bp, human
gcggacggaaccaactatcg

SEQ ID NO: 310737 - DNA, 20 bp, human
gcgggagagaagagcgaata

SEQ ID NO: 310738 - DNA, 20 bp, human
ggaaccaactatcgagggga

SEQ ID NO: 310739 - DNA, 20 bp, human
gagagcgaatagggctagag

SEQ ID NO: 310740 - DNA, 20 bp, human
gccctggcctcattactctg

SEQ ID NO: 310741 - DNA, 20 bp, human
gaggccagggatttacctgg

SEQ ID NO: 310742 - DNA, 20 bp, human
gcaaaggagccggccggcga

SEQ ID NO: 310743 - DNA, 20 bp, human
gctcccgtcccctcgatagt

SEQ ID NO: 310744 - DNA, 20 bp, human
gaaaaagaggcggaagtgac

SEQ ID NO: 310745 - DNA, 20 bp, human
gcctcctccaggtaaatccc

SEQ ID NO: 310746 - DNA, 20 bp, human
gccaccgggcggcaactcca

SEQ ID NO: 310747 - DNA, 20 bp, human
ggcggggctggagaaagtga

SEQ ID NO: 310748 - DNA, 20 bp, human
gtgcgcgcggtctagaaaaa

SEQ ID NO: 310749 - DNA, 20 bp, human
gtgagggtggggaagctacc

SEQ ID NO: 310750 - DNA, 20 bp, human
ggatccctggagttgccgcc

SEQ ID NO: 310751 - DNA, 20 bp, human
gagctatgaggaaagcggtt

SEQ ID NO: 310752 - DNA, 20 bp, human
ggaccctggagagacgctta

SEQ ID NO: 310753 - DNA, 20 bp, human
gcgatggaggggcgggccca

SEQ ID NO: 310754 - DNA, 20 bp, human
ggcgcgcccaatgagctatg

SEQ ID NO: 310755 - DNA, 20 bp, human
ggagctgtgcggctgtgatg

SEQ ID NO: 310756 - DNA, 20 bp, human
gagccccagcccatcccgtg

SEQ ID NO: 310757 - DNA, 20 bp, human
ggggagctggagtcccgcgc

SEQ ID NO: 310758 - DNA, 20 bp, human
gcgtagggtccgcacgggat

SEQ ID NO: 310759 - DNA, 20 bp, human
ggtccgcacgggatgggctg

SEQ ID NO: 310760 - DNA, 20 bp, human
gggaaactgtgggacccgaa

SEQ ID NO: 310761 - DNA, 20 bp, human
ggcgatgcgggccgtcctct

SEQ ID NO: 310762 - DNA, 20 bp, human
gactcggcgtagggtccgca

SEQ ID NO: 310763 - DNA, 20 bp, human
gccgggctggactcggcgta

SEQ ID NO: 310764 - DNA, 20 bp, human
ggcggagaacgactcgggga

SEQ ID NO: 310765 - DNA, 20 bp, human
gccagagcggagaacgactc

SEQ ID NO: 310766 - DNA, 20 bp, human
gtggaagagaaaattccagt

SEQ ID NO: 310767 - DNA, 20 bp, human
ggacctggggcccagaaaat

SEQ ID NO: 310768 - DNA, 20 bp, human
gggccaatcacgagcggaga

SEQ ID NO: 310769 - DNA, 20 bp, human
gcgggagcgcagcctaaagc

SEQ ID NO: 310770 - DNA, 20 bp, human
gcgctcatccaatgaaactg

SEQ ID NO: 310771 - DNA, 20 bp, human
gttccgggccccagtttcat

SEQ ID NO: 310772 - DNA, 20 bp, human
gcgccctctccgctcgtgat

SEQ ID NO: 310773 - DNA, 20 bp, human
gtcattggatgagcggtcgg

SEQ ID NO: 310774 - DNA, 20 bp, human
gaggcccgcgctcctcgggg

SEQ ID NO: 310775 - DNA, 20 bp, human
gcagaaaatggggagcacgc

SEQ ID NO: 310776 - DNA, 20 bp, human
gccctcgggcgccaccctgc

SEQ ID NO: 310777 - DNA, 20 bp, human
gggagtgtgggcttccgcga

SEQ ID NO: 310778 - DNA, 20 bp, human
ggggcccgcccatgcctgca

SEQ ID NO: 310779 - DNA, 20 bp, human
ggaaacgccgagatcgggcg

SEQ ID NO: 310780 - DNA, 20 bp, human
ggggcggaaacgccgagatc

SEQ ID NO: 310781 - DNA, 20 bp, human
gtccccgctggaggcggtag

SEQ ID NO: 310782 - DNA, 20 bp, human
gcggacaccccgttccgctc

SEQ ID NO: 310783 - DNA, 20 bp, human
gctggagtcgcgcggagtgt

SEQ ID NO: 310784 - DNA, 20 bp, human
gcgactccaggcgcacgccc

SEQ ID NO: 310785 - DNA, 20 bp, human
gtcccagcgccgggccgaga

SEQ ID NO: 310786 - DNA, 20 bp, human
ggtagcccggcccagaacgc

SEQ ID NO: 310787 - DNA, 20 bp, human
gtctccgccctgtgcgggtc

SEQ ID NO: 310788 - DNA, 20 bp, human
gagcccgccccgcccccgtg

SEQ ID NO: 310789 - DNA, 20 bp, human
gcagggcggagaccagggga

SEQ ID NO: 310790 - DNA, 20 bp, human
gcggccactccctgcgttct

SEQ ID NO: 310791 - DNA, 20 bp, human
gccgctgccgccggcgcacg

SEQ ID NO: 310792 - DNA, 20 bp, human
ggtgacagccggccccacgg

SEQ ID NO: 310793 - DNA, 20 bp, human
gcaccctgacccgcacaggg

SEQ ID NO: 310794 - DNA, 20 bp, human
gcagcggcgcggccaatgac

SEQ ID NO: 310795 - DNA, 20 bp, human
gcgcacagggcggagaccag

SEQ ID NO: 310796 - DNA, 20 bp, human
ggagacgggaaagaactgat

SEQ ID NO: 310797 - DNA, 20 bp, human
gcaagcggcccccgtcctca

SEQ ID NO: 310798 - DNA, 20 bp, human
ggggggacggagaggacgaa

SEQ ID NO: 310799 - DNA, 20 bp, human
gcgggcacatggaagggcgg

SEQ ID NO: 310800 - DNA, 20 bp, human
ggggaaagaactgattggtt

SEQ ID NO: 310801 - DNA, 20 bp, human
gatggagtccctgaggacgg

SEQ ID NO: 310802 - DNA, 20 bp, human
gggccgcttgccagttttcg

SEQ ID NO: 310803 - DNA, 20 bp, human
gcatgtgcccgcccatcccc

SEQ ID NO: 310804 - DNA, 20 bp, human
gggccctcgggccggaccac

SEQ ID NO: 310805 - DNA, 20 bp, human
ggtaccatatggatcctgca

SEQ ID NO: 310806 - DNA, 20 bp, human
gggcgtgggacgcttgggtg

SEQ ID NO: 310807 - DNA, 20 bp, human
gagtaacgtgtgtcgaggaa

SEQ ID NO: 310808 - DNA, 20 bp, human
gagcgccgtggcaacgcgag

SEQ ID NO: 310809 - DNA, 20 bp, human
gtggttagcaggattcgctg

SEQ ID NO: 310810 - DNA, 20 bp, human
gggagcgcgcgctgctggct

SEQ ID NO: 310811 - DNA, 20 bp, human
gcacgttactagcacctcga

SEQ ID NO: 310812 - DNA, 20 bp, human
ggtgctagtaacgtgtgtcg

SEQ ID NO: 310813 - DNA, 20 bp, human
ggcgcccgctcgcgttgcca

SEQ ID NO: 310814 - DNA, 20 bp, human
gcgtgtgtcgaggaaggggt

SEQ ID NO: 310815 - DNA, 20 bp, human
gtgctgaagccactgcaagg

SEQ ID NO: 310816 - DNA, 20 bp, human
ggtctcaaatatttgatgcc

SEQ ID NO: 310817 - DNA, 20 bp, human
gttgaggcattctctgaggg

SEQ ID NO: 310818 - DNA, 20 bp, human
gttaaagctaaggtcatcac

SEQ ID NO: 310819 - DNA, 20 bp, human
gtggtacctgtcccatagca

SEQ ID NO: 310820 - DNA, 20 bp, human
gctgatgatcttagtaatga

SEQ ID NO: 310821 - DNA, 20 bp, human
gtacatatatggaacattga

SEQ ID NO: 310822 - DNA, 20 bp, human
gatatttgagaccctgctat

SEQ ID NO: 310823 - DNA, 20 bp, human
gaatttgaggcattctctga

SEQ ID NO: 310824 - DNA, 20 bp, human
gtgagaccctgctatgggac

SEQ ID NO: 310825 - DNA, 20 bp, human
gtgtttgcttgtcaccaggc

SEQ ID NO: 310826 - DNA, 20 bp, human
gggacgcccgctcccacgac

SEQ ID NO: 310827 - DNA, 20 bp, human
gtgcccgctcgcctcattgt

SEQ ID NO: 310828 - DNA, 20 bp, human
gcgagcgggcagcgcggagt

SEQ ID NO: 310829 - DNA, 20 bp, human
gcgccggcccgtcttggtag

SEQ ID NO: 310830 - DNA, 20 bp, human
gccacgaccggcccacaatg

SEQ ID NO: 310831 - DNA, 20 bp, human
ggcgctgctcgggcaggtta

SEQ ID NO: 310832 - DNA, 20 bp, human
gggcccgtcttggtaggggt

SEQ ID NO: 310833 - DNA, 20 bp, human
ggctgggtggggcgcgcctc

SEQ ID NO: 310834 - DNA, 20 bp, human
gggagcccggcgccgtcgag

SEQ ID NO: 310835 - DNA, 20 bp, human
ggcggcggtgaagtcatcgt

SEQ ID NO: 310836 - DNA, 20 bp, human
gtgggcgggagcctatgccg

SEQ ID NO: 310837 - DNA, 20 bp, human
gtgccggggccaggaggcgt

SEQ ID NO: 310838 - DNA, 20 bp, human
gcacctcccagccccggcat

SEQ ID NO: 310839 - DNA, 20 bp, human
ggccaggaggcgtgggaacg

SEQ ID NO: 310840 - DNA, 20 bp, human
gcgggagcctatgccggggc

SEQ ID NO: 310841 - DNA, 20 bp, human
gggcggggcctgtccggagt

SEQ ID NO: 310842 - DNA, 20 bp, human
gtggagcgggagcctgtgcc

SEQ ID NO: 310843 - DNA, 20 bp, human
gtactggggccgggcggcgt

SEQ ID NO: 310844 - DNA, 20 bp, human
gagggcgcgagcccgtactg

SEQ ID NO: 310845 - DNA, 20 bp, human
ggccgggctcggcttctctt

SEQ ID NO: 310846 - DNA, 20 bp, human
ggacctggcggccagaaaag

SEQ ID NO: 310847 - DNA, 20 bp, human
ggggccaatcatgagtggag

SEQ ID NO: 310848 - DNA, 20 bp, human
gcggggctggtccttgattt

SEQ ID NO: 310849 - DNA, 20 bp, human
gggggtgggaatgcggggat

SEQ ID NO: 310850 - DNA, 20 bp, human
gcgccctctccactcatgat

SEQ ID NO: 310851 - DNA, 20 bp, human
ggtgaagcccgcgctccttg

SEQ ID NO: 310852 - DNA, 20 bp, human
gagagaaaattctagcggcc

SEQ ID NO: 310853 - DNA, 20 bp, human
gatgggaggaccggcgaaag

SEQ ID NO: 310854 - DNA, 20 bp, human
gcaggtcgtgctcataagtt

SEQ ID NO: 310855 - DNA, 20 bp, human
gtgagagccggcctgatggg

SEQ ID NO: 310856 - DNA, 20 bp, human
gcggtcgctcacaaaattca

SEQ ID NO: 310857 - DNA, 20 bp, human
ggggagggccgagctgcctc

SEQ ID NO: 310858 - DNA, 20 bp, human
gcgctcacaaaattcagggc

SEQ ID NO: 310859 - DNA, 20 bp, human
gaaaagctttcgggcgccga

SEQ ID NO: 310860 - DNA, 20 bp, human
gaaacggaataacggcactt

SEQ ID NO: 310861 - DNA, 20 bp, human
gttgcgggcaaagccgtgcg

SEQ ID NO: 310862 - DNA, 20 bp, human
ggaataacggcactttgggc

SEQ ID NO: 310863 - DNA, 20 bp, human
gattttgtgagcgaccgcgc

SEQ ID NO: 310864 - DNA, 20 bp, human
gttttccgtagaccagggaa

SEQ ID NO: 310865 - DNA, 20 bp, human
gcaaaattcaaaacgcttgc

SEQ ID NO: 310866 - DNA, 20 bp, human
gtaaacgctgaggggagtaa

SEQ ID NO: 310867 - DNA, 20 bp, human
gagaggaaaaggaacgggga

SEQ ID NO: 310868 - DNA, 20 bp, human
gggagtaagggggagtgacg

SEQ ID NO: 310869 - DNA, 20 bp, human
gaggagagtcacgtgagagt

SEQ ID NO: 310870 - DNA, 20 bp, human
ggcacagaggaaaaggaacg

SEQ ID NO: 310871 - DNA, 20 bp, human
gagggggagtgacggggcta

SEQ ID NO: 310872 - DNA, 20 bp, human
gttcccgcctaaacgctgag

SEQ ID NO: 310873 - DNA, 20 bp, human
gtcccctccacaagggtcat

SEQ ID NO: 310874 - DNA, 20 bp, human
ggagtgacggggctagggcg

SEQ ID NO: 310875 - DNA, 20 bp, human
gtcacgtgagagtgggcgga

SEQ ID NO: 310876 - DNA, 20 bp, human
gaaccgaaggccacctcttg

SEQ ID NO: 310877 - DNA, 20 bp, human
ggctgtggggatgggatgac

SEQ ID NO: 310878 - DNA, 20 bp, human
gaggcggggcggaagcctgt

SEQ ID NO: 310879 - DNA, 20 bp, human
ggttccggggctgccttcta

SEQ ID NO: 310880 - DNA, 20 bp, human
gcctaccgggcctgcgccgt

SEQ ID NO: 310881 - DNA, 20 bp, human
gcgggcctgcgccgtgggtg

SEQ ID NO: 310882 - DNA, 20 bp, human
gcttctaaggctgtggggat

SEQ ID NO: 310883 - DNA, 20 bp, human
gaactctcgcgacatccgac

SEQ ID NO: 310884 - DNA, 20 bp, human
ggggcggaaaactgcgacgg

SEQ ID NO: 310885 - DNA, 20 bp, human
ggggctgccttctaaggctg

SEQ ID NO: 310886 - DNA, 20 bp, human
gcgagtgtaggggtcgctct

SEQ ID NO: 310887 - DNA, 20 bp, human
gcggggccgcgcgagtgtag

SEQ ID NO: 310888 - DNA, 20 bp, human
gtgtaggggtcgctctcggc

SEQ ID NO: 310889 - DNA, 20 bp, human
gacgctgaaggtggcgtcgc

SEQ ID NO: 310890 - DNA, 20 bp, human
gcggtcccgtggttcggccc

SEQ ID NO: 310891 - DNA, 20 bp, human
ggttcggcccgggaagatca

SEQ ID NO: 310892 - DNA, 20 bp, human
gcccgggaagatcatggaag

SEQ ID NO: 310893 - DNA, 20 bp, human
gatcttcccgggccgaacca

SEQ ID NO: 310894 - DNA, 20 bp, human
ggtgccgcgagcttcgcggc

SEQ ID NO: 310895 - DNA, 20 bp, human
gagcgacccctacactcgcg

SEQ ID NO: 310896 - DNA, 20 bp, human
gttctcagagacgttgtagg

SEQ ID NO: 310897 - DNA, 20 bp, human
gcagagacgttgtaggtggc

SEQ ID NO: 310898 - DNA, 20 bp, human
ggcgcccctaatcctcgcgg

SEQ ID NO: 310899 - DNA, 20 bp, human
ggctgcctccgcgaggatta

SEQ ID NO: 310900 - DNA, 20 bp, human
gagaactcatcctttacttt

SEQ ID NO: 310901 - DNA, 20 bp, human
ggattggcgaagctcctccg

SEQ ID NO: 310902 - DNA, 20 bp, human
gaaagcgcccctaatcctcg

SEQ ID NO: 310903 - DNA, 20 bp, human
gcctgcgaccgacttttcat

SEQ ID NO: 310904 - DNA, 20 bp, human
gcagaaaggctgcctccgcg

SEQ ID NO: 310905 - DNA, 20 bp, human
gcttcgccaatcagaagcaa

SEQ ID NO: 310906 - DNA, 20 bp, human
gagcccgggtatcaggcgag

SEQ ID NO: 310907 - DNA, 20 bp, human
gcccgcccccgctgtagaaa

SEQ ID NO: 310908 - DNA, 20 bp, human
gcgcctctcgcctgataccc

SEQ ID NO: 310909 - DNA, 20 bp, human
gcccccgctgtagaaagggc

SEQ ID NO: 310910 - DNA, 20 bp, human
gaccgcgagtaacactcgcc

SEQ ID NO: 310911 - DNA, 20 bp, human
ggcaccgagataaaaggccc

SEQ ID NO: 310912 - DNA, 20 bp, human
ggcgagaggcggagctggcc

SEQ ID NO: 310913 - DNA, 20 bp, human
gctccctcagcccgggtatc

SEQ ID NO: 310914 - DNA, 20 bp, human
gcgcccggccctttctacag

SEQ ID NO: 310915 - DNA, 20 bp, human
gagtccaggaaaggtgtcgc

SEQ ID NO: 310916 - DNA, 20 bp, human
gacaccgagagggacccgga

SEQ ID NO: 310917 - DNA, 20 bp, human
gtaaacgtgcctccagagga

SEQ ID NO: 310918 - DNA, 20 bp, human
ggctggggctgacaccccaa

SEQ ID NO: 310919 - DNA, 20 bp, human
gcagcgccctgtcatcttga

SEQ ID NO: 310920 - DNA, 20 bp, human
gtgggaagggcccaagaaga

SEQ ID NO: 310921 - DNA, 20 bp, human
ggaaggaagacacaccgaga

SEQ ID NO: 310922 - DNA, 20 bp, human
gcacacacgcacacccgtcc

SEQ ID NO: 310923 - DNA, 20 bp, human
gtctccggtcactcctgcca

SEQ ID NO: 310924 - DNA, 20 bp, human
ggcaagcaaaggcagccggt

SEQ ID NO: 310925 - DNA, 20 bp, human
gggcggcggaaggtgagcct

SEQ ID NO: 310926 - DNA, 20 bp, human
ggtgccgcggcggctctcat

SEQ ID NO: 310927 - DNA, 20 bp, human
gcgcgcgccgagcgcccagt

SEQ ID NO: 310928 - DNA, 20 bp, human
gcgggcccggctgccacgtg

SEQ ID NO: 310929 - DNA, 20 bp, human
gcggcggctctcataggccc

SEQ ID NO: 310930 - DNA, 20 bp, human
gcggcggagtaagtagtgaa

SEQ ID NO: 310931 - DNA, 20 bp, human
ggcgaccaaggggagcgcag

SEQ ID NO: 310932 - DNA, 20 bp, human
gtctcataggcccgggctcg

SEQ ID NO: 310933 - DNA, 20 bp, human
gggctccgggcgcttatgaa

SEQ ID NO: 310934 - DNA, 20 bp, human
gcccgggctcgcggccgact

SEQ ID NO: 310935 - DNA, 20 bp, human
gccagcgcccaggcgaccaa

SEQ ID NO: 310936 - DNA, 20 bp, human
ggaagaggggcctgagtcag

SEQ ID NO: 310937 - DNA, 20 bp, human
gcgggccgagacccttggct

SEQ ID NO: 310938 - DNA, 20 bp, human
gttccctcggggtggagtta

SEQ ID NO: 310939 - DNA, 20 bp, human
gtggccctggggcgccttga

SEQ ID NO: 310940 - DNA, 20 bp, human
gcaggcttggcgcagttcat

SEQ ID NO: 310941 - DNA, 20 bp, human
ggcttggcgcagttcatggg

SEQ ID NO: 310942 - DNA, 20 bp, human
gcagccgtcaaggcgcccca

SEQ ID NO: 310943 - DNA, 20 bp, human
ggggaaggcggcgcggataa

SEQ ID NO: 310944 - DNA, 20 bp, human
gcgccctaactccaccccga

SEQ ID NO: 310945 - DNA, 20 bp, human
gccgggtggcccagccgtca

SEQ ID NO: 310946 - DNA, 20 bp, human
gcggaggcggggctcaggat

SEQ ID NO: 310947 - DNA, 20 bp, human
gggagcacgagggcgagtgg

SEQ ID NO: 310948 - DNA, 20 bp, human
gcggacaccggagtcctctg

SEQ ID NO: 310949 - DNA, 20 bp, human
gtccgtgtgtgacctcacca

SEQ ID NO: 310950 - DNA, 20 bp, human
gtgcgcacggagctgcgaag

SEQ ID NO: 310951 - DNA, 20 bp, human
ggggcggaatcatgcgcagg

SEQ ID NO: 310952 - DNA, 20 bp, human
gcctctgcaggccagtccct

SEQ ID NO: 310953 - DNA, 20 bp, human
gggcggggctcaggattggg

SEQ ID NO: 310954 - DNA, 20 bp, human
gggggggcggaatcatgcgc

SEQ ID NO: 310955 - DNA, 20 bp, human
gcgtgcgcaaggtcgtgtcc

SEQ ID NO: 310956 - DNA, 20 bp, human
gccgacagccgcactccctc

SEQ ID NO: 310957 - DNA, 20 bp, human
gtcagggagtcccgccccag

SEQ ID NO: 310958 - DNA, 20 bp, human
gcccccggggccctagtcgt

SEQ ID NO: 310959 - DNA, 20 bp, human
gggcgggacctgcccttcat

SEQ ID NO: 310960 - DNA, 20 bp, human
gtcccgccccagagggagtg

SEQ ID NO: 310961 - DNA, 20 bp, human
gagtgcggctgtcggctggg

SEQ ID NO: 310962 - DNA, 20 bp, human
gaacgcacagacgtcctgga

SEQ ID NO: 310963 - DNA, 20 bp, human
gagcgctccgattggagtta

SEQ ID NO: 310964 - DNA, 20 bp, human
ggggactccctgacgcagtc

SEQ ID NO: 310965 - DNA, 20 bp, human
gcaggtgccaaaatactgcg

SEQ ID NO: 310966 - DNA, 20 bp, human
gcactccgggagaccgggcc

SEQ ID NO: 310967 - DNA, 20 bp, human
ggaaccgcgggcacgtgacg

SEQ ID NO: 310968 - DNA, 20 bp, human
gcgctccccgggcaggggct

SEQ ID NO: 310969 - DNA, 20 bp, human
gcttccctggcccggtctcc

SEQ ID NO: 310970 - DNA, 20 bp, human
gctgcccggggagcgagctc

SEQ ID NO: 310971 - DNA, 20 bp, human
gcagtggcggagacccgcag

SEQ ID NO: 310972 - DNA, 20 bp, human
gagctccggagctcgctccc

SEQ ID NO: 310973 - DNA, 20 bp, human
gcgaggtcaaaacgtagcag

SEQ ID NO: 310974 - DNA, 20 bp, human
gtggtggggcaagcatcctg

SEQ ID NO: 310975 - DNA, 20 bp, human
gtccagcggacaccgggagt

SEQ ID NO: 310976 - DNA, 20 bp, human
gccaccgtcgccatgacgcc

SEQ ID NO: 310977 - DNA, 20 bp, human
ggcggccgcttgttgagcca

SEQ ID NO: 310978 - DNA, 20 bp, human
gcggccgcgcggttggctgg

SEQ ID NO: 310979 - DNA, 20 bp, human
gttgccgggcgtcatggcga

SEQ ID NO: 310980 - DNA, 20 bp, human
gggagccctggctcaacaag

SEQ ID NO: 310981 - DNA, 20 bp, human
gcctcggcccgagccgctaa

SEQ ID NO: 310982 - DNA, 20 bp, human
ggtgccgccagccaaccgcg

SEQ ID NO: 310983 - DNA, 20 bp, human
gcaacaagcggccgcgcggt

SEQ ID NO: 310984 - DNA, 20 bp, human
gggctggcggcacgaggccg

SEQ ID NO: 310985 - DNA, 20 bp, human
gggaagctccggacgacgac

SEQ ID NO: 310986 - DNA, 20 bp, human
gcctccccgggaagagcgga

SEQ ID NO: 310987 - DNA, 20 bp, human
gaggaggtgggcaaccgcgc

SEQ ID NO: 310988 - DNA, 20 bp, human
gaccgcgcggggcgcttcgc

SEQ ID NO: 310989 - DNA, 20 bp, human
ggagggggcggagtcaaggt

SEQ ID NO: 310990 - DNA, 20 bp, human
ggccccctccgctcttcccg

SEQ ID NO: 310991 - DNA, 20 bp, human
gaggcggagggggttgtcta

SEQ ID NO: 310992 - DNA, 20 bp, human
gccagctgatccgccactcc

SEQ ID NO: 310993 - DNA, 20 bp, human
gcaaccccctccgcctggag

SEQ ID NO: 310994 - DNA, 20 bp, human
gagcgagcacgcgccggagc

SEQ ID NO: 310995 - DNA, 20 bp, human
ggatccgccactccaggcgg

SEQ ID NO: 310996 - DNA, 20 bp, human
gagcgggccgggcgcgtagt

SEQ ID NO: 310997 - DNA, 20 bp, human
gcgggcgcgtagtaggtgcg

SEQ ID NO: 310998 - DNA, 20 bp, human
ggcccctcatccggggatcc

SEQ ID NO: 310999 - DNA, 20 bp, human
gcgcagccgagcgtggccgg

SEQ ID NO: 311000 - DNA, 20 bp, human
gagaagccgccggccacgct

SEQ ID NO: 311001 - DNA, 20 bp, human
gtgaggggccgcgcactcat

SEQ ID NO: 311002 - DNA, 20 bp, human
gcaagctcgccagaagccgc

SEQ ID NO: 311003 - DNA, 20 bp, human
ggccgcgcactcattggctg

SEQ ID NO: 311004 - DNA, 20 bp, human
ggtagtaggtgcgcgggcgc

SEQ ID NO: 311005 - DNA, 20 bp, human
ggcagcccggacaccaattc

SEQ ID NO: 311006 - DNA, 20 bp, human
ggtgcgggtctggccggctg

SEQ ID NO: 311007 - DNA, 20 bp, human
gggagaaggacggtgcgcgc

SEQ ID NO: 311008 - DNA, 20 bp, human
gggcggcacggccccttata

SEQ ID NO: 311009 - DNA, 20 bp, human
ggggccgccctgccctataa

SEQ ID NO: 311010 - DNA, 20 bp, human
ggcctccactggctggacgt

SEQ ID NO: 311011 - DNA, 20 bp, human
ggcacggccccttatagggc

SEQ ID NO: 311012 - DNA, 20 bp, human
gaaccgacccacagacaccg

SEQ ID NO: 311013 - DNA, 20 bp, human
gtcccgcgccgcggtgtctg

SEQ ID NO: 311014 - DNA, 20 bp, human
ggcgcgggagggcgtgcggg

SEQ ID NO: 311015 - DNA, 20 bp, human
gtggctcaggcgccccatcc

SEQ ID NO: 311016 - DNA, 20 bp, human
gccagggtcctgccctgcgg

SEQ ID NO: 311017 - DNA, 20 bp, human
gggaacgggcggagtcgccc

SEQ ID NO: 311018 - DNA, 20 bp, human
gtagccgccaagtggagaac

SEQ ID NO: 311019 - DNA, 20 bp, human
gcggttgctggaggaacggg

SEQ ID NO: 311020 - DNA, 20 bp, human
ggtgacttccccactcgggg

SEQ ID NO: 311021 - DNA, 20 bp, human
ggggaagtcaccgcctgcct

SEQ ID NO: 311022 - DNA, 20 bp, human
gccctgcgggggtcgagccg

SEQ ID NO: 311023 - DNA, 20 bp, human
gcggcggtgaacccggaaga

SEQ ID NO: 311024 - DNA, 20 bp, human
gagggtaaggggccatcttc

SEQ ID NO: 311025 - DNA, 20 bp, human
ggcctcctggcgactaacat

SEQ ID NO: 311026 - DNA, 20 bp, human
gcccaggcgcaccgggtgaa

SEQ ID NO: 311027 - DNA, 20 bp, human
gtcgcagggtcccacgcagg

SEQ ID NO: 311028 - DNA, 20 bp, human
gaggccagggcagtgccccg

SEQ ID NO: 311029 - DNA, 20 bp, human
ggggcgagccgacccttccc

SEQ ID NO: 311030 - DNA, 20 bp, human
ggcgtcgcagggtcccacgc

SEQ ID NO: 311031 - DNA, 20 bp, human
gggctgggtggcagcgtcgc

SEQ ID NO: 311032 - DNA, 20 bp, human
gcgaggagatgagctcacgg

SEQ ID NO: 311033 - DNA, 20 bp, human
gggggcccggcaggtggcgc

SEQ ID NO: 311034 - DNA, 20 bp, human
gggagcgcgcaaccagcgtc

SEQ ID NO: 311035 - DNA, 20 bp, human
ggtgccggcgggtccggcgt

SEQ ID NO: 311036 - DNA, 20 bp, human
gaatggggcgggccccggaa

SEQ ID NO: 311037 - DNA, 20 bp, human
ggatacgctgagttcagcag

SEQ ID NO: 311038 - DNA, 20 bp, human
gcggaacggcggggtaggtg

SEQ ID NO: 311039 - DNA, 20 bp, human
gcgcaggcggcagtccggaa

SEQ ID NO: 311040 - DNA, 20 bp, human
ggaggtcgattcctggaatg

SEQ ID NO: 311041 - DNA, 20 bp, human
gcggaagggcgagctccgat

SEQ ID NO: 311042 - DNA, 20 bp, human
gccggccgaggcccctggaa

SEQ ID NO: 311043 - DNA, 20 bp, human
ggaggcccctggaacggctc

SEQ ID NO: 311044 - DNA, 20 bp, human
ggcggagctacacaaccgat

SEQ ID NO: 311045 - DNA, 20 bp, human
gagcagcggcagtttcagtc

SEQ ID NO: 311046 - DNA, 20 bp, human
ggaaaactatagactcaaca

SEQ ID NO: 311047 - DNA, 20 bp, human
gcaccgctcctccaagccag

SEQ ID NO: 311048 - DNA, 20 bp, human
gaataaatcagaacagcccc

SEQ ID NO: 311049 - DNA, 20 bp, human
gccaaactgttgtctaacaa

SEQ ID NO: 311050 - DNA, 20 bp, human
gagttcaggcataatctgat

SEQ ID NO: 311051 - DNA, 20 bp, human
gagagagtgacttgctccaa

SEQ ID NO: 311052 - DNA, 20 bp, human
gagactattctcttcagcga

SEQ ID NO: 311053 - DNA, 20 bp, human
gatcttcaagagagtgtaaa

SEQ ID NO: 311054 - DNA, 20 bp, human
gagtggcactatcgtgatct

SEQ ID NO: 311055 - DNA, 20 bp, human
gtctctgtttcagaactttg

SEQ ID NO: 311056 - DNA, 20 bp, human
gcggaggcctggctacccgg

SEQ ID NO: 311057 - DNA, 20 bp, human
gcacgccggcccgcaagtgg

SEQ ID NO: 311058 - DNA, 20 bp, human
ggggcagcgtgggcacgctc

SEQ ID NO: 311059 - DNA, 20 bp, human
gcgtgaacgcggaacaccgc

SEQ ID NO: 311060 - DNA, 20 bp, human
gccgcaacgcagtgggctcg

SEQ ID NO: 311061 - DNA, 20 bp, human
gtgggtggggcccggatcta

SEQ ID NO: 311062 - DNA, 20 bp, human
ggtgagtggggcgctctcgt

SEQ ID NO: 311063 - DNA, 20 bp, human
gcccgcaagtggtggcagcc

SEQ ID NO: 311064 - DNA, 20 bp, human
gccgctgcgccgcaacgcag

SEQ ID NO: 311065 - DNA, 20 bp, human
ggcccggaggcctggctacc

SEQ ID NO: 311066 - DNA, 20 bp, human
ggagcgaccgcgcactggga

SEQ ID NO: 311067 - DNA, 20 bp, human
ggcgtgaaagaagtgggcgg

SEQ ID NO: 311068 - DNA, 20 bp, human
gcctcccccggagaccgggg

SEQ ID NO: 311069 - DNA, 20 bp, human
gtgcgcctgcgcgcaggtgt

SEQ ID NO: 311070 - DNA, 20 bp, human
ggagcctggcgtgaaagaag

SEQ ID NO: 311071 - DNA, 20 bp, human
gcgcacgcgcaccagctggt

SEQ ID NO: 311072 - DNA, 20 bp, human
gcgaccgcgcactgggaggg

SEQ ID NO: 311073 - DNA, 20 bp, human
gggcgccgacacctgcgcgc

SEQ ID NO: 311074 - DNA, 20 bp, human
ggcgcaggcgagcaggcgaa

SEQ ID NO: 311075 - DNA, 20 bp, human
gcaggagaggtggtaggctc

SEQ ID NO: 311076 - DNA, 20 bp, human
gaaggtgacgagttgtctgg

SEQ ID NO: 311077 - DNA, 20 bp, human
gccaactgaaaaaaccggaa

SEQ ID NO: 311078 - DNA, 20 bp, human
gagtcccaggtcaggaaggc

SEQ ID NO: 311079 - DNA, 20 bp, human
gaccttggggctgcgcctat

SEQ ID NO: 311080 - DNA, 20 bp, human
gcgaggtgaccctgaccttg

SEQ ID NO: 311081 - DNA, 20 bp, human
gaggaggaaaggcctggtca

SEQ ID NO: 311082 - DNA, 20 bp, human
ggtcaaggtgacgagttgtc

SEQ ID NO: 311083 - DNA, 20 bp, human
ggtcagcctcgcaaacccat

SEQ ID NO: 311084 - DNA, 20 bp, human
gaaaggcctggtcacggctt

SEQ ID NO: 311085 - DNA, 20 bp, human
gccgctgcttccatcccttc

SEQ ID NO: 311086 - DNA, 20 bp, human
gaaggtgacgagttgtctgg

SEQ ID NO: 311087 - DNA, 20 bp, human
gccaactgaaaaaaccggaa

SEQ ID NO: 311088 - DNA, 20 bp, human
gagtcccaggtcaggaaggc

SEQ ID NO: 311089 - DNA, 20 bp, human
gaccttggggctgcgcctat

SEQ ID NO: 311090 - DNA, 20 bp, human
gcgaggtgaccctgaccttg

SEQ ID NO: 311091 - DNA, 20 bp, human
gaggaggaaaggcctggtca

SEQ ID NO: 311092 - DNA, 20 bp, human
ggtcaaggtgacgagttgtc

SEQ ID NO: 311093 - DNA, 20 bp, human
ggtcagcctcgcaaacccat

SEQ ID NO: 311094 - DNA, 20 bp, human
gaaaggcctggtcacggctt

SEQ ID NO: 311095 - DNA, 20 bp, human
gccgctgcttccatcccttc

SEQ ID NO: 311096 - DNA, 20 bp, human
ggaaactcgcccacgctcca

SEQ ID NO: 311097 - DNA, 20 bp, human
ggaggagtcctgtagacttg

SEQ ID NO: 311098 - DNA, 20 bp, human
gacgcaagacccaccgccag

SEQ ID NO: 311099 - DNA, 20 bp, human
ggtcccggcggaaagctccg

SEQ ID NO: 311100 - DNA, 20 bp, human
gcgtcgctgccctggagcgt

SEQ ID NO: 311101 - DNA, 20 bp, human
gactcctcggagctttccgc

SEQ ID NO: 311102 - DNA, 20 bp, human
gaggaggtaccaacctctgg

SEQ ID NO: 311103 - DNA, 20 bp, human
gacagcgaagcgcatcccga

SEQ ID NO: 311104 - DNA, 20 bp, human
gaagacccaccgccagaggt

SEQ ID NO: 311105 - DNA, 20 bp, human
gggtgggtcttgcgtcccgg

SEQ ID NO: 311106 - DNA, 20 bp, human
gaacccggggatccggcctg

SEQ ID NO: 311107 - DNA, 20 bp, human
ggccggatccccgggttcct

SEQ ID NO: 311108 - DNA, 20 bp, human
ggatccggcctgtggaccca

SEQ ID NO: 311109 - DNA, 20 bp, human
gggtccacaggccggatccc

SEQ ID NO: 311110 - DNA, 20 bp, human
ggtgcaccggcgctttcggg

SEQ ID NO: 311111 - DNA, 20 bp, human
gggcgctttcgggcggaagg

SEQ ID NO: 311112 - DNA, 20 bp, human
gggaagggcggggctcgcgc

SEQ ID NO: 311113 - DNA, 20 bp, human
ggcccgtgacctggaccact

SEQ ID NO: 311114 - DNA, 20 bp, human
ggcctaggaacccggggatc

SEQ ID NO: 311115 - DNA, 20 bp, human
gaagcgccggtgcaccccgc

SEQ ID NO: 311116 - DNA, 20 bp, human
gagtcagggccagaggatgt

SEQ ID NO: 311117 - DNA, 20 bp, human
gataaccctaggcaggtcag

SEQ ID NO: 311118 - DNA, 20 bp, human
gtgggcccacagataaccct

SEQ ID NO: 311119 - DNA, 20 bp, human
gcccacagataaccctaggc

SEQ ID NO: 311120 - DNA, 20 bp, human
gcgagccgctgacctgccta

SEQ ID NO: 311121 - DNA, 20 bp, human
gacctgcctagggttatctg

SEQ ID NO: 311122 - DNA, 20 bp, human
gtgtggggtcccacaagtag

SEQ ID NO: 311123 - DNA, 20 bp, human
gtgggcccagcctcccactt

SEQ ID NO: 311124 - DNA, 20 bp, human
ggccccccgtgattctgggt

SEQ ID NO: 311125 - DNA, 20 bp, human
gccccacccagaatcacggg

SEQ ID NO: 311126 - DNA, 20 bp, human
gcaagagagactacgagaag

SEQ ID NO: 311127 - DNA, 20 bp, human
gaggggcaggctgaggtagc

SEQ ID NO: 311128 - DNA, 20 bp, human
gaccccttcacagctgtgga

SEQ ID NO: 311129 - DNA, 20 bp, human
gagatgagccgagagagcca

SEQ ID NO: 311130 - DNA, 20 bp, human
gcagctgtgaaggggttaag

SEQ ID NO: 311131 - DNA, 20 bp, human
gtagccctccacagctgtga

SEQ ID NO: 311132 - DNA, 20 bp, human
gtctcccagttgagaaaggc

SEQ ID NO: 311133 - DNA, 20 bp, human
ggagagactacgagaagtgg

SEQ ID NO: 311134 - DNA, 20 bp, human
gagtgggggtgaagaacagc

SEQ ID NO: 311135 - DNA, 20 bp, human
gtggggttcagcagggaagt

SEQ ID NO: 311136 - DNA, 20 bp, human
gcacccctagtcaacttggg

SEQ ID NO: 311137 - DNA, 20 bp, human
gtccctcccaagttgactag

SEQ ID NO: 311138 - DNA, 20 bp, human
gacaacgtgcccacgtcctg

SEQ ID NO: 311139 - DNA, 20 bp, human
ggggcggtaaaccgggaggg

SEQ ID NO: 311140 - DNA, 20 bp, human
ggacacagggggcggtaaac

SEQ ID NO: 311141 - DNA, 20 bp, human
gcgcccacccctagtcaact

SEQ ID NO: 311142 - DNA, 20 bp, human
gttactctggacacaggggg

SEQ ID NO: 311143 - DNA, 20 bp, human
ggggcgcggcctcaggacgt

SEQ ID NO: 311144 - DNA, 20 bp, human
ggggcagggatctgcgttgg

SEQ ID NO: 311145 - DNA, 20 bp, human
ggcagggcagggatctgcgt

SEQ ID NO: 311146 - DNA, 20 bp, human
ggcggcgcgtggggcctacg

SEQ ID NO: 311147 - DNA, 20 bp, human
gccgcaggggagagcgcaag

SEQ ID NO: 311148 - DNA, 20 bp, human
gtcctccgccggatcgtctg

SEQ ID NO: 311149 - DNA, 20 bp, human
ggcgcgtggggcctacgggg

SEQ ID NO: 311150 - DNA, 20 bp, human
ggaggagcggggcggcgcgt

SEQ ID NO: 311151 - DNA, 20 bp, human
gcgtggggcctacggggcgg

SEQ ID NO: 311152 - DNA, 20 bp, human
ggactcacccacagacgatc

SEQ ID NO: 311153 - DNA, 20 bp, human
gtcacccacagacgatccgg

SEQ ID NO: 311154 - DNA, 20 bp, human
gcggcgcgccgccgccccgt

SEQ ID NO: 311155 - DNA, 20 bp, human
gcgcgcttgccgagtttctc

SEQ ID NO: 311156 - DNA, 20 bp, human
gaatggagaggtctttctgc

SEQ ID NO: 311157 - DNA, 20 bp, human
gcaggggtgtgggttctgag

SEQ ID NO: 311158 - DNA, 20 bp, human
ggcagtgtctctccaactct

SEQ ID NO: 311159 - DNA, 20 bp, human
gcccctctccccgattaggt

SEQ ID NO: 311160 - DNA, 20 bp, human
ggactaaggcttcaggtgca

SEQ ID NO: 311161 - DNA, 20 bp, human
gtgggggaccatgaatggag

SEQ ID NO: 311162 - DNA, 20 bp, human
gcccgattaggtaggtctct

SEQ ID NO: 311163 - DNA, 20 bp, human
ggacctacctaatcggggag

SEQ ID NO: 311164 - DNA, 20 bp, human
gcacaacaatgagaaagtac

SEQ ID NO: 311165 - DNA, 20 bp, human
ggttgtgtgaacaccagaaa

SEQ ID NO: 311166 - DNA, 20 bp, human
gacagactccggtggaatga

SEQ ID NO: 311167 - DNA, 20 bp, human
ggggaggggtaggagtattc

SEQ ID NO: 311168 - DNA, 20 bp, human
gcatcccggaatcacacatt

SEQ ID NO: 311169 - DNA, 20 bp, human
gcaggtaatgcagtgtctac

SEQ ID NO: 311170 - DNA, 20 bp, human
gggtatgagacagactccgg

SEQ ID NO: 311171 - DNA, 20 bp, human
gatgcagtgtctacaggctg

SEQ ID NO: 311172 - DNA, 20 bp, human
gatactcctacccctcccat

SEQ ID NO: 311173 - DNA, 20 bp, human
gttggaggatgtgatcctat

SEQ ID NO: 311174 - DNA, 20 bp, human
gagacagtgctgagttgggg

SEQ ID NO: 311175 - DNA, 20 bp, human
gtgtgattccgggatgccaa

SEQ ID NO: 311176 - DNA, 20 bp, human
gcgggcgggaaagttagctg

SEQ ID NO: 311177 - DNA, 20 bp, human
gcgggaaagttagctgtggc

SEQ ID NO: 311178 - DNA, 20 bp, human
gtggcgacgcaactcgtgat

SEQ ID NO: 311179 - DNA, 20 bp, human
gatgacagaaaggggccggg

SEQ ID NO: 311180 - DNA, 20 bp, human
ggggaaaaacgagtaagtac

SEQ ID NO: 311181 - DNA, 20 bp, human
ggccggcggggattggcaga

SEQ ID NO: 311182 - DNA, 20 bp, human
gagctgtggccggcggggat

SEQ ID NO: 311183 - DNA, 20 bp, human
gatactctcgcgttcctgat

SEQ ID NO: 311184 - DNA, 20 bp, human
gggtggggcaggcgacggtg

SEQ ID NO: 311185 - DNA, 20 bp, human
gcggttgcttggcgttgatt

SEQ ID NO: 311186 - DNA, 20 bp, human
gcatgcgcgccgtgcggcct

SEQ ID NO: 311187 - DNA, 20 bp, human
gaaaggggtgaataatcctt

SEQ ID NO: 311188 - DNA, 20 bp, human
ggctgcccctcccacggaaa

SEQ ID NO: 311189 - DNA, 20 bp, human
gaggctggaaaacctgacgc

SEQ ID NO: 311190 - DNA, 20 bp, human
ggcgcagtgactatcacgct

SEQ ID NO: 311191 - DNA, 20 bp, human
gagaaggggcaaaagcctga

SEQ ID NO: 311192 - DNA, 20 bp, human
gtgactatcacgcttggcca

SEQ ID NO: 311193 - DNA, 20 bp, human
gccgccccgcgcatgagcag

SEQ ID NO: 311194 - DNA, 20 bp, human
gacgcttggccaaggccgca

SEQ ID NO: 311195 - DNA, 20 bp, human
gctgcatcatcaatttcttc

SEQ ID NO: 311196 - DNA, 20 bp, human
ggcgccaccgtgcgtctcac

SEQ ID NO: 311197 - DNA, 20 bp, human
gaggcggcctctgcactccg

SEQ ID NO: 311198 - DNA, 20 bp, human
gtcccgagcgtgccaatccc

SEQ ID NO: 311199 - DNA, 20 bp, human
ggtggacacactgccgtcca

SEQ ID NO: 311200 - DNA, 20 bp, human
ggtccctgtgagacgcacgg

SEQ ID NO: 311201 - DNA, 20 bp, human
gggaaaggcgggattcaggg

SEQ ID NO: 311202 - DNA, 20 bp, human
gcgcgggcaggatacaccgt

SEQ ID NO: 311203 - DNA, 20 bp, human
ggcacgccccggcactactg

SEQ ID NO: 311204 - DNA, 20 bp, human
gggacgacgtgggacgccgt

SEQ ID NO: 311205 - DNA, 20 bp, human
gggcgaccctaagctgtcac

SEQ ID NO: 311206 - DNA, 20 bp, human
gtctcagcaccgctcagaga

SEQ ID NO: 311207 - DNA, 20 bp, human
ggggcagccggcagcgggca

SEQ ID NO: 311208 - DNA, 20 bp, human
gtctgagcggtgctgagagg

SEQ ID NO: 311209 - DNA, 20 bp, human
gcctgcccgccaggttgcca

SEQ ID NO: 311210 - DNA, 20 bp, human
gtggcccagcccaccccttg

SEQ ID NO: 311211 - DNA, 20 bp, human
gcgggcaccgtgcccgctgc

SEQ ID NO: 311212 - DNA, 20 bp, human
gactcagccgaaacctccct

SEQ ID NO: 311213 - DNA, 20 bp, human
gagaaggcacggacgggatt

SEQ ID NO: 311214 - DNA, 20 bp, human
gtgggccagaaggcacggac

SEQ ID NO: 311215 - DNA, 20 bp, human
ggtctcctggggggccggag

SEQ ID NO: 311216 - DNA, 20 bp, human
gccggtgagtggggaatgag

SEQ ID NO: 311217 - DNA, 20 bp, human
ggaggtcgcgctcactgcga

SEQ ID NO: 311218 - DNA, 20 bp, human
gacccgctcaacttcatcct

SEQ ID NO: 311219 - DNA, 20 bp, human
gcgcctgcgctctctttcta

SEQ ID NO: 311220 - DNA, 20 bp, human
gctgctctgcttcccttcgg

SEQ ID NO: 311221 - DNA, 20 bp, human
gaagtggtcatgtgataccc

SEQ ID NO: 311222 - DNA, 20 bp, human
gtcgcgctcactgcgacggc

SEQ ID NO: 311223 - DNA, 20 bp, human
gggcgaaatccctcccactc

SEQ ID NO: 311224 - DNA, 20 bp, human
gaaagagagcgcaggcgcct

SEQ ID NO: 311225 - DNA, 20 bp, human
ggccaatgtgacgggatcag

SEQ ID NO: 311226 - DNA, 20 bp, human
gggcattcccagctcgcctg

SEQ ID NO: 311227 - DNA, 20 bp, human
gtgggagctgtagttttcgt

SEQ ID NO: 311228 - DNA, 20 bp, human
gcaaacaggagttgcactag

SEQ ID NO: 311229 - DNA, 20 bp, human
ggggatctgtagttcggccc

SEQ ID NO: 311230 - DNA, 20 bp, human
gtctcccccgcctggccttc

SEQ ID NO: 311231 - DNA, 20 bp, human
gacgttgcctctcccccgcc

SEQ ID NO: 311232 - DNA, 20 bp, human
gtgcttcaagggtacagact

SEQ ID NO: 311233 - DNA, 20 bp, human
gctctccccacttgcttcaa

SEQ ID NO: 311234 - DNA, 20 bp, human
gcactcgcacccgggcggga

SEQ ID NO: 311235 - DNA, 20 bp, human
gtaaactccccgcgctgggg

SEQ ID NO: 311236 - DNA, 20 bp, human
ggatagctcgtcacttaaaa

SEQ ID NO: 311237 - DNA, 20 bp, human
gcacataagggccttttttt

SEQ ID NO: 311238 - DNA, 20 bp, human
ggacctcacatcaggaagac

SEQ ID NO: 311239 - DNA, 20 bp, human
gcaaactcactgtcagatca

SEQ ID NO: 311240 - DNA, 20 bp, human
ggcccggtcttcctgatgtg

SEQ ID NO: 311241 - DNA, 20 bp, human
gaagaccaggatgcaagaag

SEQ ID NO: 311242 - DNA, 20 bp, human
gaaagcatgacgtcaagcca

SEQ ID NO: 311243 - DNA, 20 bp, human
gctaaagatgaatagtgaat

SEQ ID NO: 311244 - DNA, 20 bp, human
gtaatagcagaatgcccctt

SEQ ID NO: 311245 - DNA, 20 bp, human
gcgtagggcttccaaaaaaa

SEQ ID NO: 311246 - DNA, 20 bp, human
ggggcggtgcgatcaaaggt

SEQ ID NO: 311247 - DNA, 20 bp, human
gggcggaagcgattattccc

SEQ ID NO: 311248 - DNA, 20 bp, human
gggcggggaagaacacggag

SEQ ID NO: 311249 - DNA, 20 bp, human
ggggactagggcaaggctca

SEQ ID NO: 311250 - DNA, 20 bp, human
ggggagacccgtgtctcctc

SEQ ID NO: 311251 - DNA, 20 bp, human
ggaggcgtgaacttgggtcc

SEQ ID NO: 311252 - DNA, 20 bp, human
gcccaggcaaatagtccttc

SEQ ID NO: 311253 - DNA, 20 bp, human
gcccaggccatgtaaggcac

SEQ ID NO: 311254 - DNA, 20 bp, human
gtccgccggctgcgggatgc

SEQ ID NO: 311255 - DNA, 20 bp, human
ggcgcaatccacatccccga

SEQ ID NO: 311256 - DNA, 20 bp, human
ggaacgggaaagcgcggcat

SEQ ID NO: 311257 - DNA, 20 bp, human
gggcatgggaccaataggaa

SEQ ID NO: 311258 - DNA, 20 bp, human
gggcgagccactcacgcatc

SEQ ID NO: 311259 - DNA, 20 bp, human
gggcggggctggcgtgtccg

SEQ ID NO: 311260 - DNA, 20 bp, human
ggaaaccgggctcgcggggc

SEQ ID NO: 311261 - DNA, 20 bp, human
ggcacccaggtattttcctc

SEQ ID NO: 311262 - DNA, 20 bp, human
gcatccggaggaaaatacct

SEQ ID NO: 311263 - DNA, 20 bp, human
gagcgcggcatgggaccaat

SEQ ID NO: 311264 - DNA, 20 bp, human
gtgcgtgagtggctcgcccg

SEQ ID NO: 311265 - DNA, 20 bp, human
ggcaggacgggttatctcgg

SEQ ID NO: 311266 - DNA, 20 bp, human
gagggccatgagtcgggcgc

SEQ ID NO: 311267 - DNA, 20 bp, human
gggcggggagggccatgagt

SEQ ID NO: 311268 - DNA, 20 bp, human
ggggcgtgacgaggagcgga

SEQ ID NO: 311269 - DNA, 20 bp, human
gcaaccccgcgcccgactca

SEQ ID NO: 311270 - DNA, 20 bp, human
ggagttgcccggagaagcgg

SEQ ID NO: 311271 - DNA, 20 bp, human
gcggggcataaattgcgcca

SEQ ID NO: 311272 - DNA, 20 bp, human
ggaagcgctaaggcgaggcg

SEQ ID NO: 311273 - DNA, 20 bp, human
gcaggagttgcccggagaag

SEQ ID NO: 311274 - DNA, 20 bp, human
gtcgcgcggaggcgcgacat

SEQ ID NO: 311275 - DNA, 20 bp, human
gggggcggggcgaagcgcta

SEQ ID NO: 311276 - DNA, 20 bp, human
gaaaacccggagaagcggag

SEQ ID NO: 311277 - DNA, 20 bp, human
gcggccgtcaccggaaaaaa

SEQ ID NO: 311278 - DNA, 20 bp, human
gcagctctgcggtcgacgcc

SEQ ID NO: 311279 - DNA, 20 bp, human
ggcgcgacgcgaaggttgtc

SEQ ID NO: 311280 - DNA, 20 bp, human
ggtgccctcgcgcgacgcga

SEQ ID NO: 311281 - DNA, 20 bp, human
ggcacagagaggcgggatac

SEQ ID NO: 311282 - DNA, 20 bp, human
gcaaccttcgcgtcgcgcga

SEQ ID NO: 311283 - DNA, 20 bp, human
gagccaacagcggccgtcac

SEQ ID NO: 311284 - DNA, 20 bp, human
gcgcccccactccgcttctc

SEQ ID NO: 311285 - DNA, 20 bp, human
gacccggagaagcggagtgg

SEQ ID NO: 311286 - DNA, 20 bp, human
ggcgccgtgccgtcagtcac

SEQ ID NO: 311287 - DNA, 20 bp, human
ggatcggcggactaaagggc

SEQ ID NO: 311288 - DNA, 20 bp, human
ggcctgatcggggtcgtgat

SEQ ID NO: 311289 - DNA, 20 bp, human
gtgatcggggtcgtgatcgg

SEQ ID NO: 311290 - DNA, 20 bp, human
ggaaggaagcggcatgaaga

SEQ ID NO: 311291 - DNA, 20 bp, human
gccaatcagaggcctgatcg

SEQ ID NO: 311292 - DNA, 20 bp, human
gcggcgcagccaatgggcaa

SEQ ID NO: 311293 - DNA, 20 bp, human
ggtcgtgatcggcggactaa

SEQ ID NO: 311294 - DNA, 20 bp, human
gactaaagggcgggcggaga

SEQ ID NO: 311295 - DNA, 20 bp, human
gtccgctggagaagtgacgg

SEQ ID NO: 311296 - DNA, 20 bp, human
gtagcccgctgcagttctcc

SEQ ID NO: 311297 - DNA, 20 bp, human
gaagcctggagaactgcagc

SEQ ID NO: 311298 - DNA, 20 bp, human
gctgcagcgggctaagagtt

SEQ ID NO: 311299 - DNA, 20 bp, human
gggctaagagttcgggtgct

SEQ ID NO: 311300 - DNA, 20 bp, human
gataggttctcgaacaattt

SEQ ID NO: 311301 - DNA, 20 bp, human
ggtactgttgttacacatat

SEQ ID NO: 311302 - DNA, 20 bp, human
ggttacacatatgggaaaac

SEQ ID NO: 311303 - DNA, 20 bp, human
gcagacaaggttgtgtctct

SEQ ID NO: 311304 - DNA, 20 bp, human
gcctcagcagtgctaagaat

SEQ ID NO: 311305 - DNA, 20 bp, human
gtttgaatacagtcgtgtat

SEQ ID NO: 311306 - DNA, 20 bp, human
gcggccctgagcctctgcaa

SEQ ID NO: 311307 - DNA, 20 bp, human
ggcgcagcgagcactcagga

SEQ ID NO: 311308 - DNA, 20 bp, human
gcacgcagggacggagtcgg

SEQ ID NO: 311309 - DNA, 20 bp, human
ggcagtgtgaggaccgaagg

SEQ ID NO: 311310 - DNA, 20 bp, human
gagcgagcactcaggacggg

SEQ ID NO: 311311 - DNA, 20 bp, human
gcatgcgcatgtccggggct

SEQ ID NO: 311312 - DNA, 20 bp, human
gtctgcaaaggcttggacgg

SEQ ID NO: 311313 - DNA, 20 bp, human
ggtgcgcatgcgcatgtccg

SEQ ID NO: 311314 - DNA, 20 bp, human
gaggctggtaatacccactt

SEQ ID NO: 311315 - DNA, 20 bp, human
ggtgcacgcagggacggagt

SEQ ID NO: 311316 - DNA, 20 bp, human
ggtcaaggagcgagcgacgt

SEQ ID NO: 311317 - DNA, 20 bp, human
ggggccaatgtcctatctca

SEQ ID NO: 311318 - DNA, 20 bp, human
gctgggctcgggtaacgatg

SEQ ID NO: 311319 - DNA, 20 bp, human
gacgtgggaaaccctgagat

SEQ ID NO: 311320 - DNA, 20 bp, human
gaaaccctgagataggacat

SEQ ID NO: 311321 - DNA, 20 bp, human
gaccgctggcagcgaacggg

SEQ ID NO: 311322 - DNA, 20 bp, human
gtacacctcagacccagtgt

SEQ ID NO: 311323 - DNA, 20 bp, human
gtgtagttatggagcaggaa

SEQ ID NO: 311324 - DNA, 20 bp, human
gtggcagcgaacgggaggag

SEQ ID NO: 311325 - DNA, 20 bp, human
gctcgggtaacgatgcgggg

SEQ ID NO: 311326 - DNA, 20 bp, human
ggaactgcgcaggcgtgaca

SEQ ID NO: 311327 - DNA, 20 bp, human
ggctacccagggccgcctga

SEQ ID NO: 311328 - DNA, 20 bp, human
gcggccctgggtagccatca

SEQ ID NO: 311329 - DNA, 20 bp, human
gcggggagaggggagattgc

SEQ ID NO: 311330 - DNA, 20 bp, human
ggcgccctgatggctaccca

SEQ ID NO: 311331 - DNA, 20 bp, human
gcattcggaaaagaaagcgc

SEQ ID NO: 311332 - DNA, 20 bp, human
ggtgggcccgatcagagagg

SEQ ID NO: 311333 - DNA, 20 bp, human
ggattgctggcaagcgggtg

SEQ ID NO: 311334 - DNA, 20 bp, human
gaggggagattgctggcaag

SEQ ID NO: 311335 - DNA, 20 bp, human
gagaagcccgggaaggtagg

SEQ ID NO: 311336 - DNA, 20 bp, human
gggcgagtgcgtctgtgtac

SEQ ID NO: 311337 - DNA, 20 bp, human
gtggactttccgggaaggtg

SEQ ID NO: 311338 - DNA, 20 bp, human
gcggggaggggcggagaaag

SEQ ID NO: 311339 - DNA, 20 bp, human
gtgccaggagctgaggatat

SEQ ID NO: 311340 - DNA, 20 bp, human
gccagcttccccttggacaa

SEQ ID NO: 311341 - DNA, 20 bp, human
ggtccaaggaagcaccgaga

SEQ ID NO: 311342 - DNA, 20 bp, human
gccttcccggaaagtccata

SEQ ID NO: 311343 - DNA, 20 bp, human
gccacgccgcggccacgggg

SEQ ID NO: 311344 - DNA, 20 bp, human
ggacgcagacgattctagga

SEQ ID NO: 311345 - DNA, 20 bp, human
ggaaaacgctcggcttcttc

SEQ ID NO: 311346 - DNA, 20 bp, human
ggctctccgggaacccagtg

SEQ ID NO: 311347 - DNA, 20 bp, human
gcggtggggcgtgtccgaaa

SEQ ID NO: 311348 - DNA, 20 bp, human
gccggagcgcgcagccgcac

SEQ ID NO: 311349 - DNA, 20 bp, human
ggggtctcggtgcggaacct

SEQ ID NO: 311350 - DNA, 20 bp, human
gcgggcggagcctgcgtcgg

SEQ ID NO: 311351 - DNA, 20 bp, human
gcaccccctgcgcacgacgt

SEQ ID NO: 311352 - DNA, 20 bp, human
ggggccccgcgagcctcagg

SEQ ID NO: 311353 - DNA, 20 bp, human
gcccggagagcgccctcttc

SEQ ID NO: 311354 - DNA, 20 bp, human
gaacctaggcagcgaccctg

SEQ ID NO: 311355 - DNA, 20 bp, human
gacgtgggcggagccagaag

SEQ ID NO: 311356 - DNA, 20 bp, human
ggccgggcccgaccaatcag

SEQ ID NO: 311357 - DNA, 20 bp, human
gagcaggcgccccaacgcgt

SEQ ID NO: 311358 - DNA, 20 bp, human
ggcgcccccgcccaatcagc

SEQ ID NO: 311359 - DNA, 20 bp, human
gaccccgcccaaccaatcag

SEQ ID NO: 311360 - DNA, 20 bp, human
gcaacagccgctgattggtt

SEQ ID NO: 311361 - DNA, 20 bp, human
gggctcggccgcctgctctg

SEQ ID NO: 311362 - DNA, 20 bp, human
gaaccgagcccgggtaactg

SEQ ID NO: 311363 - DNA, 20 bp, human
gtgggcggggtgtcgcggcg

SEQ ID NO: 311364 - DNA, 20 bp, human
ggccccaacgcgtcggtgtt

SEQ ID NO: 311365 - DNA, 20 bp, human
gcggccaaacaccgacgcgt

SEQ ID NO: 311366 - DNA, 20 bp, human
gaaaggggcggggcaaacgg

SEQ ID NO: 311367 - DNA, 20 bp, human
gccacggcgccgctcattgg

SEQ ID NO: 311368 - DNA, 20 bp, human
ggggacgtctcctccggaaa

SEQ ID NO: 311369 - DNA, 20 bp, human
gtagcaggcggggaccgaac

SEQ ID NO: 311370 - DNA, 20 bp, human
gggcaaacgggggtctgtac

SEQ ID NO: 311371 - DNA, 20 bp, human
gtgtcctaggctcgaaaccc

SEQ ID NO: 311372 - DNA, 20 bp, human
gcgcccacggcgccgctcat

SEQ ID NO: 311373 - DNA, 20 bp, human
ggcgccgctcattggtggag

SEQ ID NO: 311374 - DNA, 20 bp, human
ggtggaggggacgtctcctc

SEQ ID NO: 311375 - DNA, 20 bp, human
gcagatacgcgacgcgtagc

SEQ ID NO: 311376 - DNA, 20 bp, human
gggacagccggcccgatccc

SEQ ID NO: 311377 - DNA, 20 bp, human
gcaaaggtgccacaccggag

SEQ ID NO: 311378 - DNA, 20 bp, human
gggcgtgcgccggcgtgacg

SEQ ID NO: 311379 - DNA, 20 bp, human
gtccgcaccggggatcgggc

SEQ ID NO: 311380 - DNA, 20 bp, human
ggcacgccgcccctccggtg

SEQ ID NO: 311381 - DNA, 20 bp, human
gttacccgccggcgctacaa

SEQ ID NO: 311382 - DNA, 20 bp, human
ggcggaaccaattgtgacga

SEQ ID NO: 311383 - DNA, 20 bp, human
ggagtggtgaagtgcctcga

SEQ ID NO: 311384 - DNA, 20 bp, human
ggcgatcggggcagaatcgc

SEQ ID NO: 311385 - DNA, 20 bp, human
gccgcgtagccgcgtcacgc

SEQ ID NO: 311386 - DNA, 20 bp, human
gaaggcagacaaaaggggct

SEQ ID NO: 311387 - DNA, 20 bp, human
gcagacaaaaggggctgggt

SEQ ID NO: 311388 - DNA, 20 bp, human
gcctgtgcccggaagtaggt

SEQ ID NO: 311389 - DNA, 20 bp, human
gggtaggaacacacagtcag

SEQ ID NO: 311390 - DNA, 20 bp, human
ggctgcctgtgcccggaagt

SEQ ID NO: 311391 - DNA, 20 bp, human
ggaaaattgcggtaaaaacc

SEQ ID NO: 311392 - DNA, 20 bp, human
ggcatggcggacacttcctg

SEQ ID NO: 311393 - DNA, 20 bp, human
ggcaacgtacgtgctctgcc

SEQ ID NO: 311394 - DNA, 20 bp, human
ggtcagagggacccaaaagc

SEQ ID NO: 311395 - DNA, 20 bp, human
gcctctgcttcgctgtgttc

SEQ ID NO: 311396 - DNA, 20 bp, human
gcgaacgcccaagagggctc

SEQ ID NO: 311397 - DNA, 20 bp, human
gccaagccgaacgcccaaga

SEQ ID NO: 311398 - DNA, 20 bp, human
ggggctgcacttgcactgtg

SEQ ID NO: 311399 - DNA, 20 bp, human
gaggaccccggagccctctt

SEQ ID NO: 311400 - DNA, 20 bp, human
gcgtggcgccgtgacgggaa

SEQ ID NO: 311401 - DNA, 20 bp, human
gatggtaagcggtgatcggt

SEQ ID NO: 311402 - DNA, 20 bp, human
gtgcgaccgtggcgccgtga

SEQ ID NO: 311403 - DNA, 20 bp, human
gcaacccgccgttcccgtca

SEQ ID NO: 311404 - DNA, 20 bp, human
ggcaacggagacgctggatc

SEQ ID NO: 311405 - DNA, 20 bp, human
ggtgtggccaactgcgaccg

SEQ ID NO: 311406 - DNA, 20 bp, human
ggcagcggctcctctgctag

SEQ ID NO: 311407 - DNA, 20 bp, human
ggcgcggtatccacgttccc

SEQ ID NO: 311408 - DNA, 20 bp, human
gccagccggcgaacatcctg

SEQ ID NO: 311409 - DNA, 20 bp, human
gactgcaaggccggcggatc

SEQ ID NO: 311410 - DNA, 20 bp, human
gcggtatccacgttcccggg

SEQ ID NO: 311411 - DNA, 20 bp, human
gtccggctccagaagctgag

SEQ ID NO: 311412 - DNA, 20 bp, human
gccgggcccgccgagtcctc

SEQ ID NO: 311413 - DNA, 20 bp, human
ggggttaacagcagcccccg

SEQ ID NO: 311414 - DNA, 20 bp, human
gtgctccacgactgcaaggc

SEQ ID NO: 311415 - DNA, 20 bp, human
gcgcccggctccggaggact

SEQ ID NO: 311416 - DNA, 20 bp, human
gaagagggcaggtacctgtc

SEQ ID NO: 311417 - DNA, 20 bp, human
gccaactcggggcgtcagga

SEQ ID NO: 311418 - DNA, 20 bp, human
gattcccggttgtagttctg

SEQ ID NO: 311419 - DNA, 20 bp, human
gatcgcccaggcaaggaaga

SEQ ID NO: 311420 - DNA, 20 bp, human
ggggatcgatcgcccaggca

SEQ ID NO: 311421 - DNA, 20 bp, human
ggggtccctgccagttgcgg

SEQ ID NO: 311422 - DNA, 20 bp, human
gtggggagtgaagggattgg

SEQ ID NO: 311423 - DNA, 20 bp, human
ggggaatcattcacccgcag

SEQ ID NO: 311424 - DNA, 20 bp, human
gggcgccgccgcaactggca

SEQ ID NO: 311425 - DNA, 20 bp, human
gcgggggcgtgtagccaact

SEQ ID NO: 311426 - DNA, 20 bp, human
ggtcccagtgctctatccta

SEQ ID NO: 311427 - DNA, 20 bp, human
gctaaacccgtgactatcat

SEQ ID NO: 311428 - DNA, 20 bp, human
gcttccctaggatagagcac

SEQ ID NO: 311429 - DNA, 20 bp, human
gtgagtcccatgatagtcac

SEQ ID NO: 311430 - DNA, 20 bp, human
gaaaaagtcacagctgactg

SEQ ID NO: 311431 - DNA, 20 bp, human
gcacgggtttagatttctga

SEQ ID NO: 311432 - DNA, 20 bp, human
gtcgtctgtaattgctaaat

SEQ ID NO: 311433 - DNA, 20 bp, human
gtgacatggcaatcctatgg

SEQ ID NO: 311434 - DNA, 20 bp, human
gatgtgacatggcaatccta

SEQ ID NO: 311435 - DNA, 20 bp, human
gcatggcaatcctatggagg

SEQ ID NO: 311436 - DNA, 20 bp, human
gtgggaggtgggaaactact

SEQ ID NO: 311437 - DNA, 20 bp, human
ggggccagggccgctgggat

SEQ ID NO: 311438 - DNA, 20 bp, human
gtgggaaactacttggacac

SEQ ID NO: 311439 - DNA, 20 bp, human
gccacactgggcaccccacc

SEQ ID NO: 311440 - DNA, 20 bp, human
gcgtcaaagtccatatgaag

SEQ ID NO: 311441 - DNA, 20 bp, human
gcagcacctggatctaaccc

SEQ ID NO: 311442 - DNA, 20 bp, human
gatgccgatcccagcggccc

SEQ ID NO: 311443 - DNA, 20 bp, human
ggagaggctcctaaagacct

SEQ ID NO: 311444 - DNA, 20 bp, human
gctctcaagtgtgtgcccac

SEQ ID NO: 311445 - DNA, 20 bp, human
gccacaggaactctgctaat

SEQ ID NO: 311446 - DNA, 20 bp, human
ggctctgtggcgagtggcac

SEQ ID NO: 311447 - DNA, 20 bp, human
ggagctgtcagaacccaact

SEQ ID NO: 311448 - DNA, 20 bp, human
gacccgagctctgtggcgag

SEQ ID NO: 311449 - DNA, 20 bp, human
gtggtgggattctattctta

SEQ ID NO: 311450 - DNA, 20 bp, human
ggccactcgccacagagctc

SEQ ID NO: 311451 - DNA, 20 bp, human
ggccccttcctttcctagtt

SEQ ID NO: 311452 - DNA, 20 bp, human
gtcccaccgtgtggctgtgg

SEQ ID NO: 311453 - DNA, 20 bp, human
gctcagaatgtgtacttggt

SEQ ID NO: 311454 - DNA, 20 bp, human
ggtcagaacccaactaggaa

SEQ ID NO: 311455 - DNA, 20 bp, human
gcaaaccacagggccgaatc

SEQ ID NO: 311456 - DNA, 20 bp, human
gccgggaggcgcccgctcat

SEQ ID NO: 311457 - DNA, 20 bp, human
gggctgtcaggcgcgggaaa

SEQ ID NO: 311458 - DNA, 20 bp, human
gcgcgcagagggagtgagtt

SEQ ID NO: 311459 - DNA, 20 bp, human
ggggtggtgggtaattaatg

SEQ ID NO: 311460 - DNA, 20 bp, human
gtggtgcccgactgctgggc

SEQ ID NO: 311461 - DNA, 20 bp, human
gaggtgggaggcggtacccg

SEQ ID NO: 311462 - DNA, 20 bp, human
gccagcagtcgggcaccaga

SEQ ID NO: 311463 - DNA, 20 bp, human
gcggaatcccacagctgaat

SEQ ID NO: 311464 - DNA, 20 bp, human
gcagatggagcgcgcgcaga

SEQ ID NO: 311465 - DNA, 20 bp, human
gcgcccgctcattggctgtc

SEQ ID NO: 311466 - DNA, 20 bp, human
ggtccagtctggttatcttg

SEQ ID NO: 311467 - DNA, 20 bp, human
gccggatgaggctgaagctt

SEQ ID NO: 311468 - DNA, 20 bp, human
gaaaagccgtgctcataggg

SEQ ID NO: 311469 - DNA, 20 bp, human
gagccccaagataaccagac

SEQ ID NO: 311470 - DNA, 20 bp, human
gctctcttacttaaatgctg

SEQ ID NO: 311471 - DNA, 20 bp, human
gtagaaaaagccgtgctcat

SEQ ID NO: 311472 - DNA, 20 bp, human
gcttcagcctcatccgggat

SEQ ID NO: 311473 - DNA, 20 bp, human
gggctctgtaaaagtagaac

SEQ ID NO: 311474 - DNA, 20 bp, human
ggcttatttgctgcttttaa

SEQ ID NO: 311475 - DNA, 20 bp, human
gaagtagcagaaatagcctc

SEQ ID NO: 311476 - DNA, 20 bp, human
ggcaaccgcaatcaacacag

SEQ ID NO: 311477 - DNA, 20 bp, human
gacagtggaggcgagaagtc

SEQ ID NO: 311478 - DNA, 20 bp, human
gtgacgtcaccaggacgagg

SEQ ID NO: 311479 - DNA, 20 bp, human
gctgtgacgtcaccaggacg

SEQ ID NO: 311480 - DNA, 20 bp, human
gaaagggtggtctaatgttt

SEQ ID NO: 311481 - DNA, 20 bp, human
ggagaagtctggccttgcgc

SEQ ID NO: 311482 - DNA, 20 bp, human
gtcacagagcaatgtccaat

SEQ ID NO: 311483 - DNA, 20 bp, human
gcggtgcccgccgggatagg

SEQ ID NO: 311484 - DNA, 20 bp, human
gaccgcaatcaacacagtgg

SEQ ID NO: 311485 - DNA, 20 bp, human
ggcctccactgtgttgattg

SEQ ID NO: 311486 - DNA, 20 bp, human
gccgcacaaccagttaccta

SEQ ID NO: 311487 - DNA, 20 bp, human
ggaaaactggcgatgcgggt

SEQ ID NO: 311488 - DNA, 20 bp, human
gtattacagcgcaacggagc

SEQ ID NO: 311489 - DNA, 20 bp, human
gcgtgggcaggtaagagggt

SEQ ID NO: 311490 - DNA, 20 bp, human
gcacaaggggccgtcccacg

SEQ ID NO: 311491 - DNA, 20 bp, human
gtccctggcctggagcgtga

SEQ ID NO: 311492 - DNA, 20 bp, human
ggggacggccccttgtgggg

SEQ ID NO: 311493 - DNA, 20 bp, human
ggccgtcccacgtggctccc

SEQ ID NO: 311494 - DNA, 20 bp, human
ggctagtgtccctgagtcgt

SEQ ID NO: 311495 - DNA, 20 bp, human
gtgagtcgtgggcaggtaag

SEQ ID NO: 311496 - DNA, 20 bp, human
gaggccgagaggggtcccct

SEQ ID NO: 311497 - DNA, 20 bp, human
ggggccatgggccaagctca

SEQ ID NO: 311498 - DNA, 20 bp, human
gagtccccggagtgacgcag

SEQ ID NO: 311499 - DNA, 20 bp, human
gtcccctgggcacgaagaag

SEQ ID NO: 311500 - DNA, 20 bp, human
gccacccggggccgggccgt

SEQ ID NO: 311501 - DNA, 20 bp, human
gcctggcgcgggtggtgaga

SEQ ID NO: 311502 - DNA, 20 bp, human
ggcgcgggtggtgagatggc

SEQ ID NO: 311503 - DNA, 20 bp, human
gccccggcgcccctgggact

SEQ ID NO: 311504 - DNA, 20 bp, human
ggaggcggggcggatccctg

SEQ ID NO: 311505 - DNA, 20 bp, human
gaacctcggccaggcccggg

SEQ ID NO: 311506 - DNA, 20 bp, human
ggcagtagccgcttcaggga

SEQ ID NO: 311507 - DNA, 20 bp, human
gcacgaggcactgaggtgat

SEQ ID NO: 311508 - DNA, 20 bp, human
gcgcaagcgcatatccttct

SEQ ID NO: 311509 - DNA, 20 bp, human
gctactgcccgctacctaga

SEQ ID NO: 311510 - DNA, 20 bp, human
gatagctgccgctgaagggt

SEQ ID NO: 311511 - DNA, 20 bp, human
gcgtggcaggggttattcgg

SEQ ID NO: 311512 - DNA, 20 bp, human
ggaaacgtctagatgctcaa

SEQ ID NO: 311513 - DNA, 20 bp, human
gggagcagagatgccggaac

SEQ ID NO: 311514 - DNA, 20 bp, human
gaaggaagaacgtgagcacg

SEQ ID NO: 311515 - DNA, 20 bp, human
gttcagcggcagctattgat

SEQ ID NO: 311516 - DNA, 20 bp, human
gtaccggttcactgaaccct

SEQ ID NO: 311517 - DNA, 20 bp, human
gctccgaagcgcatgctcgt

SEQ ID NO: 311518 - DNA, 20 bp, human
ggccaaggatccgcatccca

SEQ ID NO: 311519 - DNA, 20 bp, human
gtgcccacgagcatgcgctt

SEQ ID NO: 311520 - DNA, 20 bp, human
gggattgagactgtaggtac

SEQ ID NO: 311521 - DNA, 20 bp, human
gaccatgccaaaagggaata

SEQ ID NO: 311522 - DNA, 20 bp, human
gaccctgggatgcggatcct

SEQ ID NO: 311523 - DNA, 20 bp, human
gttcacatagcttacattct

SEQ ID NO: 311524 - DNA, 20 bp, human
ggaataaggattgagactgt

SEQ ID NO: 311525 - DNA, 20 bp, human
gtcggtgcctaccataggcc

SEQ ID NO: 311526 - DNA, 20 bp, human
gcagaatgttccaacaggtt

SEQ ID NO: 311527 - DNA, 20 bp, human
gtaaccagaaattatcgcta

SEQ ID NO: 311528 - DNA, 20 bp, human
gttcagggagcctaacctgt

SEQ ID NO: 311529 - DNA, 20 bp, human
ggagccctagcgataatttc

SEQ ID NO: 311530 - DNA, 20 bp, human
gggacatttatcattatcta

SEQ ID NO: 311531 - DNA, 20 bp, human
gttcagcagaatgttccaac

SEQ ID NO: 311532 - DNA, 20 bp, human
ggtcctaggctctcacaact

SEQ ID NO: 311533 - DNA, 20 bp, human
gggctctctgatagtgtcct

SEQ ID NO: 311534 - DNA, 20 bp, human
gacagtactaggttgcaaat

SEQ ID NO: 311535 - DNA, 20 bp, human
gcaaacatatctacagtact

SEQ ID NO: 311536 - DNA, 20 bp, human
gcggggtggggagggtacga

SEQ ID NO: 311537 - DNA, 20 bp, human
gtctctgtgctggataatat

SEQ ID NO: 311538 - DNA, 20 bp, human
gagtaccaagccttctttag

SEQ ID NO: 311539 - DNA, 20 bp, human
gaggcaggaagagtgtggaa

SEQ ID NO: 311540 - DNA, 20 bp, human
ggtgctggataatattggcg

SEQ ID NO: 311541 - DNA, 20 bp, human
gaccaggacacagtatgaga

SEQ ID NO: 311542 - DNA, 20 bp, human
gctccctggagccgctttct

SEQ ID NO: 311543 - DNA, 20 bp, human
gtagttacccagtgactttg

SEQ ID NO: 311544 - DNA, 20 bp, human
gctggataatattggcgggg

SEQ ID NO: 311545 - DNA, 20 bp, human
gcagctggagccacgtcgga

SEQ ID NO: 311546 - DNA, 20 bp, human
ggaagcccgcagccaatggg

SEQ ID NO: 311547 - DNA, 20 bp, human
gggtgtgcgccgcacgtgga

SEQ ID NO: 311548 - DNA, 20 bp, human
gaggcgcgaggcgagcctgg

SEQ ID NO: 311549 - DNA, 20 bp, human
ggctgcgggcttcgtccctc

SEQ ID NO: 311550 - DNA, 20 bp, human
gagccacctgggccaatcga

SEQ ID NO: 311551 - DNA, 20 bp, human
ggacgaagcccgcagccaat

SEQ ID NO: 311552 - DNA, 20 bp, human
gtccggtcccggcctcccat

SEQ ID NO: 311553 - DNA, 20 bp, human
ggtgcgccgcacgtggaggg

SEQ ID NO: 311554 - DNA, 20 bp, human
ggcgaggcgagcctggcgga

SEQ ID NO: 311555 - DNA, 20 bp, human
ggggcccccgccgccgacta

SEQ ID NO: 311556 - DNA, 20 bp, human
gcacccccagcacacctcgg

SEQ ID NO: 311557 - DNA, 20 bp, human
gcccccgcgcccgttcattc

SEQ ID NO: 311558 - DNA, 20 bp, human
gccgccgccgaggtgtgctg

SEQ ID NO: 311559 - DNA, 20 bp, human
gtgcccccggcctacctccg

SEQ ID NO: 311560 - DNA, 20 bp, human
gggccccggaggtaggccgg

SEQ ID NO: 311561 - DNA, 20 bp, human
gggcgtgcgcgcccgtcctg

SEQ ID NO: 311562 - DNA, 20 bp, human
gcgcggaggccggaatgaac

SEQ ID NO: 311563 - DNA, 20 bp, human
gcctgcggccggcgtgaggg

SEQ ID NO: 311564 - DNA, 20 bp, human
ggctgggccaggggcagcga

SEQ ID NO: 311565 - DNA, 20 bp, human
gccgccctctgcagcgctgg

SEQ ID NO: 311566 - DNA, 20 bp, human
gacgatgaaagcatctccct

SEQ ID NO: 311567 - DNA, 20 bp, human
gcgggggtgctggaagagat

SEQ ID NO: 311568 - DNA, 20 bp, human
ggaatccttccgcccttctt

SEQ ID NO: 311569 - DNA, 20 bp, human
ggggcccccagtcagcacgg

SEQ ID NO: 311570 - DNA, 20 bp, human
gcttccgcccttcttaggag

SEQ ID NO: 311571 - DNA, 20 bp, human
gttaggaggggctgcattgc

SEQ ID NO: 311572 - DNA, 20 bp, human
gcgccccctcctgcctgact

SEQ ID NO: 311573 - DNA, 20 bp, human
ggcgcagaccaatgagccta

SEQ ID NO: 311574 - DNA, 20 bp, human
gttccagaacacttgaggga

SEQ ID NO: 311575 - DNA, 20 bp, human
gagcatctccctaggctcat

SEQ ID NO: 311576 - DNA, 20 bp, human
ggggccgccggggtttcggg

SEQ ID NO: 311577 - DNA, 20 bp, human
ggcgagcagagtttacacag

SEQ ID NO: 311578 - DNA, 20 bp, human
gccacctcccgaaaccccgg

SEQ ID NO: 311579 - DNA, 20 bp, human
ggcggcccgcagcgccacac

SEQ ID NO: 311580 - DNA, 20 bp, human
gtaacaggttcctgctgggg

SEQ ID NO: 311581 - DNA, 20 bp, human
gtaaagtaacaggttcctgc

SEQ ID NO: 311582 - DNA, 20 bp, human
ggaggcagagcgagcgagcc

SEQ ID NO: 311583 - DNA, 20 bp, human
gccgagcctcacagggcgga

SEQ ID NO: 311584 - DNA, 20 bp, human
gtaagcgaggctttccagtg

SEQ ID NO: 311585 - DNA, 20 bp, human
ggccgtggcgcctgacaccc

SEQ ID NO: 311586 - DNA, 20 bp, human
ggcagcagcacctagtggag

SEQ ID NO: 311587 - DNA, 20 bp, human
gcgggccccgcgcggtgcta

SEQ ID NO: 311588 - DNA, 20 bp, human
gcggaaccctagcaccgcgc

SEQ ID NO: 311589 - DNA, 20 bp, human
gggaaggaacccggtaccgc

SEQ ID NO: 311590 - DNA, 20 bp, human
ggcggtgctagggttccgtc

SEQ ID NO: 311591 - DNA, 20 bp, human
gcgcgctgctggatctaaat

SEQ ID NO: 311592 - DNA, 20 bp, human
ggaacccggtaccgccggtt

SEQ ID NO: 311593 - DNA, 20 bp, human
ggggtcccaaccggcggtac

SEQ ID NO: 311594 - DNA, 20 bp, human
gccaccaccgccagtccaga

SEQ ID NO: 311595 - DNA, 20 bp, human
gacctccgggccgctccact

SEQ ID NO: 311596 - DNA, 20 bp, human
gagccgccgggtaaagtctt

SEQ ID NO: 311597 - DNA, 20 bp, human
gaacctaagactttacccgg

SEQ ID NO: 311598 - DNA, 20 bp, human
ggggcccgagacgggagtgc

SEQ ID NO: 311599 - DNA, 20 bp, human
ggggtaaagtcttaggttca

SEQ ID NO: 311600 - DNA, 20 bp, human
ggcgccgagtggcacatcgc

SEQ ID NO: 311601 - DNA, 20 bp, human
gaaaagctccctaccaagcc

SEQ ID NO: 311602 - DNA, 20 bp, human
ggctggagactcggggaccc

SEQ ID NO: 311603 - DNA, 20 bp, human
ggagcggaggcgcgcggcca

SEQ ID NO: 311604 - DNA, 20 bp, human
ggaacaaagcctggcttggt

SEQ ID NO: 311605 - DNA, 20 bp, human
gagacgaagacttggcggag

SEQ ID NO: 311606 - DNA, 20 bp, human
ggcagggctagccacgctat

SEQ ID NO: 311607 - DNA, 20 bp, human
gaacagcgacagtcagggtt

SEQ ID NO: 311608 - DNA, 20 bp, human
ggggagaatgccatctgggt

SEQ ID NO: 311609 - DNA, 20 bp, human
ggaaggaacagcgacagtca

SEQ ID NO: 311610 - DNA, 20 bp, human
ggccacgctatgggcttcca

SEQ ID NO: 311611 - DNA, 20 bp, human
gagcgacagtcagggttcgg

SEQ ID NO: 311612 - DNA, 20 bp, human
gaatctgatcactagagcat

SEQ ID NO: 311613 - DNA, 20 bp, human
ggccctggaagcccatagcg

SEQ ID NO: 311614 - DNA, 20 bp, human
ggctttgggggccctcagag

SEQ ID NO: 311615 - DNA, 20 bp, human
gatccaggctccccctctga

SEQ ID NO: 311616 - DNA, 20 bp, human
gaactgcatgggcccgggag

SEQ ID NO: 311617 - DNA, 20 bp, human
gcccgggcccatgcagttcc

SEQ ID NO: 311618 - DNA, 20 bp, human
gagggctcatggtaatcctc

SEQ ID NO: 311619 - DNA, 20 bp, human
gaagcgccctggaactgcat

SEQ ID NO: 311620 - DNA, 20 bp, human
ggccgcttgacggtggagga

SEQ ID NO: 311621 - DNA, 20 bp, human
gggtagggctcgtgcgctaa

SEQ ID NO: 311622 - DNA, 20 bp, human
gtcgctcaccggaccgggta

SEQ ID NO: 311623 - DNA, 20 bp, human
gggtagctgccgcttgacgg

SEQ ID NO: 311624 - DNA, 20 bp, human
ggtactccgggcaccttcga

SEQ ID NO: 311625 - DNA, 20 bp, human
gccctggaactgcatgggcc

SEQ ID NO: 311626 - DNA, 20 bp, human
gcgtgcccaaggcaggaccg

SEQ ID NO: 311627 - DNA, 20 bp, human
gctgaagcgcccagtcttgg

SEQ ID NO: 311628 - DNA, 20 bp, human
gggaacggaacggacacctg

SEQ ID NO: 311629 - DNA, 20 bp, human
ggggcgcagcccacgtggtt

SEQ ID NO: 311630 - DNA, 20 bp, human
gcctcccgcccgaaccacgt

SEQ ID NO: 311631 - DNA, 20 bp, human
gcgcgccgcggtcctgcctt

SEQ ID NO: 311632 - DNA, 20 bp, human
ggcggggcccgcaagctcag

SEQ ID NO: 311633 - DNA, 20 bp, human
ggtcctgccttgggcacggt

SEQ ID NO: 311634 - DNA, 20 bp, human
gcgacccccaagccagtttg

SEQ ID NO: 311635 - DNA, 20 bp, human
gcagtcttggaggatgaggg

SEQ ID NO: 311636 - DNA, 20 bp, human
gagccggagcgagtcgatcg

SEQ ID NO: 311637 - DNA, 20 bp, human
gcgggcccgcggccgcgcac

SEQ ID NO: 311638 - DNA, 20 bp, human
ggagtgcggagccgcccgta

SEQ ID NO: 311639 - DNA, 20 bp, human
gggcctcgatcgactcgctc

SEQ ID NO: 311640 - DNA, 20 bp, human
gcccctcgccgtcctggaca

SEQ ID NO: 311641 - DNA, 20 bp, human
gcggtccccgtgcgcggccg

SEQ ID NO: 311642 - DNA, 20 bp, human
gcggagccgcccgtaaggta

SEQ ID NO: 311643 - DNA, 20 bp, human
ggaagctgcggctttctctc

SEQ ID NO: 311644 - DNA, 20 bp, human
ggcccagcgtggcgcagtag

SEQ ID NO: 311645 - DNA, 20 bp, human
gtcggagcggtccccgtgcg

SEQ ID NO: 311646 - DNA, 20 bp, human
gccactgcctaacccgggga

SEQ ID NO: 311647 - DNA, 20 bp, human
gcggggagcagtctcgaagg

SEQ ID NO: 311648 - DNA, 20 bp, human
gaatccgcgaccgagaggtg

SEQ ID NO: 311649 - DNA, 20 bp, human
gcggcggggagcagtctcga

SEQ ID NO: 311650 - DNA, 20 bp, human
ggccaagcgccgggccttga

SEQ ID NO: 311651 - DNA, 20 bp, human
gcgcgtgcacacactatctg

SEQ ID NO: 311652 - DNA, 20 bp, human
gtgcctgccctccccgggtt

SEQ ID NO: 311653 - DNA, 20 bp, human
gcccgggttaggcagtggaa

SEQ ID NO: 311654 - DNA, 20 bp, human
gagcgccgggccttgacggc

SEQ ID NO: 311655 - DNA, 20 bp, human
gtgcctaacccggggagggc

SEQ ID NO: 311656 - DNA, 20 bp, human
gcacccacggacgccgggag

SEQ ID NO: 311657 - DNA, 20 bp, human
gaggtggcgaggggcacggc

SEQ ID NO: 311658 - DNA, 20 bp, human
gcctcagcacccacggacgc

SEQ ID NO: 311659 - DNA, 20 bp, human
ggagaggcgtcggcagagtg

SEQ ID NO: 311660 - DNA, 20 bp, human
gctcctctcccggcgtccgt

SEQ ID NO: 311661 - DNA, 20 bp, human
gaagccacagggcgactccc

SEQ ID NO: 311662 - DNA, 20 bp, human
gcgccccgggagtcgccctg

SEQ ID NO: 311663 - DNA, 20 bp, human
gggtccgcctagctaaggaa

SEQ ID NO: 311664 - DNA, 20 bp, human
gccggccggctccacgtggt

SEQ ID NO: 311665 - DNA, 20 bp, human
gccccggcgtgacgtcaccg

SEQ ID NO: 311666 - DNA, 20 bp, human
gaggtgagaacccggtgctc

SEQ ID NO: 311667 - DNA, 20 bp, human
gcttacgccaggtgagaacc

SEQ ID NO: 311668 - DNA, 20 bp, human
gcgccagagctccagagcac

SEQ ID NO: 311669 - DNA, 20 bp, human
gactccaaggaaagacggga

SEQ ID NO: 311670 - DNA, 20 bp, human
gcaggccccgcccacccgat

SEQ ID NO: 311671 - DNA, 20 bp, human
gaagtaggggcggctctatc

SEQ ID NO: 311672 - DNA, 20 bp, human
ggggcggggctatgttaatg

SEQ ID NO: 311673 - DNA, 20 bp, human
gccccacaccataggccgat

SEQ ID NO: 311674 - DNA, 20 bp, human
gtaggccgatcgggtgggcg

SEQ ID NO: 311675 - DNA, 20 bp, human
gcaccataggccgatcgggt

SEQ ID NO: 311676 - DNA, 20 bp, human
gtggggacgcggccaatagg

SEQ ID NO: 311677 - DNA, 20 bp, human
gggaggccaagtgtggctaa

SEQ ID NO: 311678 - DNA, 20 bp, human
gggcggccggaggccaagtg

SEQ ID NO: 311679 - DNA, 20 bp, human
gaataggagggcggggcggt

SEQ ID NO: 311680 - DNA, 20 bp, human
ggcgccggccccattggccg

SEQ ID NO: 311681 - DNA, 20 bp, human
gcggctggcggcttgtactc

SEQ ID NO: 311682 - DNA, 20 bp, human
gtacaagccgccagccgcgc

SEQ ID NO: 311683 - DNA, 20 bp, human
gtgccccacaacagctgccg

SEQ ID NO: 311684 - DNA, 20 bp, human
ggggcctgctcccgcgcggc

SEQ ID NO: 311685 - DNA, 20 bp, human
gctcgcggcctcggccaatg

SEQ ID NO: 311686 - DNA, 20 bp, human
gcgactcgagggtgtcgcga

SEQ ID NO: 311687 - DNA, 20 bp, human
gggagagcgagtgagcgtga

SEQ ID NO: 311688 - DNA, 20 bp, human
gcggcctccgtccgactcga

SEQ ID NO: 311689 - DNA, 20 bp, human
gcctgcgtgggaggatccgg

SEQ ID NO: 311690 - DNA, 20 bp, human
gtggggcccggggatcgcct

SEQ ID NO: 311691 - DNA, 20 bp, human
gccgggaagttctctggcgg

SEQ ID NO: 311692 - DNA, 20 bp, human
gacaccctcgagtcggacgg

SEQ ID NO: 311693 - DNA, 20 bp, human
ggccgcgcagttccggcgtg

SEQ ID NO: 311694 - DNA, 20 bp, human
gtctgcgccgggaagttctc

SEQ ID NO: 311695 - DNA, 20 bp, human
gcaggcgcagcgccgactgc

SEQ ID NO: 311696 - DNA, 20 bp, human
gggggcgggaaaacccgtgt

SEQ ID NO: 311697 - DNA, 20 bp, human
gccagggcgggacactccca

SEQ ID NO: 311698 - DNA, 20 bp, human
ggggaaaacccgtgtcggct

SEQ ID NO: 311699 - DNA, 20 bp, human
gcaatgggaaacaagtccct

SEQ ID NO: 311700 - DNA, 20 bp, human
gcagagcgcccgtgcctcaa

SEQ ID NO: 311701 - DNA, 20 bp, human
gccggagtacctttaccaat

SEQ ID NO: 311702 - DNA, 20 bp, human
gcggtggcgcggccagctgt

SEQ ID NO: 311703 - DNA, 20 bp, human
gggttcgcagttctcacccc

SEQ ID NO: 311704 - DNA, 20 bp, human
ggaccaatgttcaagcctat

SEQ ID NO: 311705 - DNA, 20 bp, human
gtggtttaacggaaggagcg

SEQ ID NO: 311706 - DNA, 20 bp, human
ggagacagccacacgaaatc

SEQ ID NO: 311707 - DNA, 20 bp, human
gtcccggcaagctacacggt

SEQ ID NO: 311708 - DNA, 20 bp, human
gcgtgtggctgtctccaagg

SEQ ID NO: 311709 - DNA, 20 bp, human
ggagtcttcctgatttcgtg

SEQ ID NO: 311710 - DNA, 20 bp, human
ggcatcgcgcataggcaata

SEQ ID NO: 311711 - DNA, 20 bp, human
ggccgccgggttcaaaactt

SEQ ID NO: 311712 - DNA, 20 bp, human
ggcctatgcgcgatgcatct

SEQ ID NO: 311713 - DNA, 20 bp, human
gcgaacacaaccggcgatgg

SEQ ID NO: 311714 - DNA, 20 bp, human
ggctggggaatgaagtctca

SEQ ID NO: 311715 - DNA, 20 bp, human
gagcgccacctgggaaactg

SEQ ID NO: 311716 - DNA, 20 bp, human
gtgccattgggtaaacgcaa

SEQ ID NO: 311717 - DNA, 20 bp, human
gaggtggggcaggggtgatt

SEQ ID NO: 311718 - DNA, 20 bp, human
gtggcaggtcggctccacgt

SEQ ID NO: 311719 - DNA, 20 bp, human
ggtggagccgacctgccatt

SEQ ID NO: 311720 - DNA, 20 bp, human
gctcccttgcgtttacccaa

SEQ ID NO: 311721 - DNA, 20 bp, human
gagggcttccgacctgcgtt

SEQ ID NO: 311722 - DNA, 20 bp, human
gggggcaggggtgatttggg

SEQ ID NO: 311723 - DNA, 20 bp, human
gtaactgacccgcctaacgc

SEQ ID NO: 311724 - DNA, 20 bp, human
gtgacccgcctaacgcaggt

SEQ ID NO: 311725 - DNA, 20 bp, human
ggtggtagcacctacgctgg

SEQ ID NO: 311726 - DNA, 20 bp, human
gtgcgtgcacccgcggtcgc

SEQ ID NO: 311727 - DNA, 20 bp, human
gcgccgctcggggtgccgat

SEQ ID NO: 311728 - DNA, 20 bp, human
gagccaatcggcaccccgag

SEQ ID NO: 311729 - DNA, 20 bp, human
ggcacgcaggcgaacagagc

SEQ ID NO: 311730 - DNA, 20 bp, human
gcgcaggcgaacagagccgg

SEQ ID NO: 311731 - DNA, 20 bp, human
ggggctcgggcagcgaggcg

SEQ ID NO: 311732 - DNA, 20 bp, human
ggtagccgccgcgccgctcg

SEQ ID NO: 311733 - DNA, 20 bp, human
gaggcgaacagagccggcgg

SEQ ID NO: 311734 - DNA, 20 bp, human
gagcgcgccggtcagccaat

SEQ ID NO: 311735 - DNA, 20 bp, human
gggggtgccgattggctgac

SEQ ID NO: 311736 - DNA, 20 bp, human
gaggagggtcgtggggagat

SEQ ID NO: 311737 - DNA, 20 bp, human
ggaagtgggcgtaaggagtg

SEQ ID NO: 311738 - DNA, 20 bp, human
gtaaggagtgggggcgggac

SEQ ID NO: 311739 - DNA, 20 bp, human
gcccccgccaccatctgctc

SEQ ID NO: 311740 - DNA, 20 bp, human
gggggcacgggggggctccc

SEQ ID NO: 311741 - DNA, 20 bp, human
gagcgggaagtggtagtagg

SEQ ID NO: 311742 - DNA, 20 bp, human
ggggtgaggaagtgggcgta

SEQ ID NO: 311743 - DNA, 20 bp, human
gccctcctccacctcagcgg

SEQ ID NO: 311744 - DNA, 20 bp, human
ggggaacagggggtgctgga

SEQ ID NO: 311745 - DNA, 20 bp, human
gggagagtgggaatggacgt

SEQ ID NO: 311746 - DNA, 20 bp, human
ggggtcacggtgagtctctg

SEQ ID NO: 311747 - DNA, 20 bp, human
gcagcggcgaggcggggtag

SEQ ID NO: 311748 - DNA, 20 bp, human
gctggcgcgggatctgctga

SEQ ID NO: 311749 - DNA, 20 bp, human
gtctgtgggtgcgggtcgga

SEQ ID NO: 311750 - DNA, 20 bp, human
gggagcagccgcccaactcc

SEQ ID NO: 311751 - DNA, 20 bp, human
ggggatctgctgaggggtca

SEQ ID NO: 311752 - DNA, 20 bp, human
ggccgcccaactcctggcgc

SEQ ID NO: 311753 - DNA, 20 bp, human
ggagagaggagcagttccct

SEQ ID NO: 311754 - DNA, 20 bp, human
gcgcctccgcccgggccgtg

SEQ ID NO: 311755 - DNA, 20 bp, human
gagttccctgggtgacctga

SEQ ID NO: 311756 - DNA, 20 bp, human
ggggaaggggtggtcctgaa

SEQ ID NO: 311757 - DNA, 20 bp, human
ggcccctaaccacccggtgg

SEQ ID NO: 311758 - DNA, 20 bp, human
gaaacccaggctagtatctc

SEQ ID NO: 311759 - DNA, 20 bp, human
ggaagggcacccatgaggca

SEQ ID NO: 311760 - DNA, 20 bp, human
gaaccccccaccgggtggtt

SEQ ID NO: 311761 - DNA, 20 bp, human
gtccactgggggtgtggcat

SEQ ID NO: 311762 - DNA, 20 bp, human
ggttacaaaggccccaccct

SEQ ID NO: 311763 - DNA, 20 bp, human
gtgccaaggtgcaaggggaa

SEQ ID NO: 311764 - DNA, 20 bp, human
gggaaggagggcggcttggg

SEQ ID NO: 311765 - DNA, 20 bp, human
gcctgagaagggcacccatg

SEQ ID NO: 311766 - DNA, 20 bp, human
gggcctgcgtagagaacgtg

SEQ ID NO: 311767 - DNA, 20 bp, human
gacgcgcggggcccgcacga

SEQ ID NO: 311768 - DNA, 20 bp, human
gcgagggtgggtgtagccga

SEQ ID NO: 311769 - DNA, 20 bp, human
gggcggggtaggcagacggg

SEQ ID NO: 311770 - DNA, 20 bp, human
gcgcggggcccgcacgaggg

SEQ ID NO: 311771 - DNA, 20 bp, human
gtgggtgggcgtagccgggg

SEQ ID NO: 311772 - DNA, 20 bp, human
gggtgggtgtagccgagggg

SEQ ID NO: 311773 - DNA, 20 bp, human
gcgagggcggggcctacggg

SEQ ID NO: 311774 - DNA, 20 bp, human
gtgagcgcaaagtgtctcag

SEQ ID NO: 311775 - DNA, 20 bp, human
ggcggggcctacgggaggat

SEQ ID NO: 311776 - DNA, 20 bp, human
ggagaaaaccactgtttaca

SEQ ID NO: 311777 - DNA, 20 bp, human
gggctcttcggggttctctg

SEQ ID NO: 311778 - DNA, 20 bp, human
ggtaccaggcagcttaacaa

SEQ ID NO: 311779 - DNA, 20 bp, human
gtgactcctagcagattatt

SEQ ID NO: 311780 - DNA, 20 bp, human
gactaggcaatcattagaaa

SEQ ID NO: 311781 - DNA, 20 bp, human
gtgcgcacctgatggctgtt

SEQ ID NO: 311782 - DNA, 20 bp, human
gtcaaacaagatgtgtgcga

SEQ ID NO: 311783 - DNA, 20 bp, human
ggatggtcataaagtgctac

SEQ ID NO: 311784 - DNA, 20 bp, human
gccaccgtaaagtgagtgct

SEQ ID NO: 311785 - DNA, 20 bp, human
gcaggtgccgaacagccatc

SEQ ID NO: 311786 - DNA, 20 bp, human
gtgaaggaaaatactgatgt

SEQ ID NO: 311787 - DNA, 20 bp, human
gtataaaagaaaggccacta

SEQ ID NO: 311788 - DNA, 20 bp, human
ggaaagaatgattaatcccc

SEQ ID NO: 311789 - DNA, 20 bp, human
gcatgcatgaatcatactgt

SEQ ID NO: 311790 - DNA, 20 bp, human
ggagtaggggtattgtgaga

SEQ ID NO: 311791 - DNA, 20 bp, human
ggatttactggccgtggagt

SEQ ID NO: 311792 - DNA, 20 bp, human
gtatagtcgtggtctaaatg

SEQ ID NO: 311793 - DNA, 20 bp, human
gcagatggatttactggccg

SEQ ID NO: 311794 - DNA, 20 bp, human
ggattttcagatggatttac

SEQ ID NO: 311795 - DNA, 20 bp, human
gtcacaaacatttaatgtaa

SEQ ID NO: 311796 - DNA, 20 bp, human
gtacggcccagcggggtcga

SEQ ID NO: 311797 - DNA, 20 bp, human
gggctggcaaagtccctatc

SEQ ID NO: 311798 - DNA, 20 bp, human
ggaggtgaacggggagggta

SEQ ID NO: 311799 - DNA, 20 bp, human
gggtggggcggaagctataa

SEQ ID NO: 311800 - DNA, 20 bp, human
ggggtcacccagcaccagat

SEQ ID NO: 311801 - DNA, 20 bp, human
ggggcggaagctataagggg

SEQ ID NO: 311802 - DNA, 20 bp, human
gtggccaacccgtgccgctc

SEQ ID NO: 311803 - DNA, 20 bp, human
gctccggccctcgaccccgc

SEQ ID NO: 311804 - DNA, 20 bp, human
gggggagggtacggcccagc

SEQ ID NO: 311805 - DNA, 20 bp, human
gcaaaggtgggggtacggat

SEQ ID NO: 311806 - DNA, 20 bp, human
gctctgaattgcttgagtga

SEQ ID NO: 311807 - DNA, 20 bp, human
ggtaggataggtggacgtag

SEQ ID NO: 311808 - DNA, 20 bp, human
ggactaagggctatataaag

SEQ ID NO: 311809 - DNA, 20 bp, human
gttcacagaacccggactaa

SEQ ID NO: 311810 - DNA, 20 bp, human
gtgtttttgagatagatcaa

SEQ ID NO: 311811 - DNA, 20 bp, human
ggactttattcagacgacaa

SEQ ID NO: 311812 - DNA, 20 bp, human
ggcttattttgtaggatagg

SEQ ID NO: 311813 - DNA, 20 bp, human
gtctgagccggtacaacacg

SEQ ID NO: 311814 - DNA, 20 bp, human
gatagaatcaggatctgagc

SEQ ID NO: 311815 - DNA, 20 bp, human
gtttattccacgtgttgtac

SEQ ID NO: 311816 - DNA, 20 bp, human
gccacaaaccacactcggga

SEQ ID NO: 311817 - DNA, 20 bp, human
gagcatctcttgtttcagca

SEQ ID NO: 311818 - DNA, 20 bp, human
gtgagtcatcacttatggat

SEQ ID NO: 311819 - DNA, 20 bp, human
gtctaccacaaaccacactc

SEQ ID NO: 311820 - DNA, 20 bp, human
gccacttcccagtcacttga

SEQ ID NO: 311821 - DNA, 20 bp, human
gaacggcctcagcatattta

SEQ ID NO: 311822 - DNA, 20 bp, human
gtgcaggcctataaaagtaa

SEQ ID NO: 311823 - DNA, 20 bp, human
gtgtttaccttcaagtgact

SEQ ID NO: 311824 - DNA, 20 bp, human
gtggtttgtggtagaatttg

SEQ ID NO: 311825 - DNA, 20 bp, human
ggccgtttattttgccagat

SEQ ID NO: 311826 - DNA, 20 bp, human
gaggccgcgatggacagcag

SEQ ID NO: 311827 - DNA, 20 bp, human
ggtccccaaccaggaaagga

SEQ ID NO: 311828 - DNA, 20 bp, human
ggatccaggggacgggatgt

SEQ ID NO: 311829 - DNA, 20 bp, human
gaaaggagggcactggggcg

SEQ ID NO: 311830 - DNA, 20 bp, human
gagccccctgctgtccatcg

SEQ ID NO: 311831 - DNA, 20 bp, human
ggcaggggttgaggccgcga

SEQ ID NO: 311832 - DNA, 20 bp, human
gctcagggtgggaattattg

SEQ ID NO: 311833 - DNA, 20 bp, human
gtatgtggctaggggcaacg

SEQ ID NO: 311834 - DNA, 20 bp, human
gctccctctgcaggtctcat

SEQ ID NO: 311835 - DNA, 20 bp, human
gccacaaaaaggcaacttag

SEQ ID NO: 311836 - DNA, 20 bp, human
gcggccgaggcccgacaggt

SEQ ID NO: 311837 - DNA, 20 bp, human
gtgtgagaagcctgcggctg

SEQ ID NO: 311838 - DNA, 20 bp, human
gcggccgccgcgctcttaaa

SEQ ID NO: 311839 - DNA, 20 bp, human
gtctcacaagcaggtgcggg

SEQ ID NO: 311840 - DNA, 20 bp, human
gcaacccagcgcctaggggg

SEQ ID NO: 311841 - DNA, 20 bp, human
gcccaatgcgcggacccggg

SEQ ID NO: 311842 - DNA, 20 bp, human
gactcccaacccagcgccta

SEQ ID NO: 311843 - DNA, 20 bp, human
gcccaccaggtatgagaagg

SEQ ID NO: 311844 - DNA, 20 bp, human
gcaacgcgaccccccgcgga

SEQ ID NO: 311845 - DNA, 20 bp, human
gcgggcggccgaggcccgac

SEQ ID NO: 311846 - DNA, 20 bp, human
gtacggatgaacattctgga

SEQ ID NO: 311847 - DNA, 20 bp, human
gcaaaccagggcccttgtcg

SEQ ID NO: 311848 - DNA, 20 bp, human
ggtgcctgcctcggggatgc

SEQ ID NO: 311849 - DNA, 20 bp, human
gccggtgcgccctaccgtag

SEQ ID NO: 311850 - DNA, 20 bp, human
gacgcacgcgcgcttcttaa

SEQ ID NO: 311851 - DNA, 20 bp, human
gtaaaggagacggctcataa

SEQ ID NO: 311852 - DNA, 20 bp, human
gggcaggcacccaggaactt

SEQ ID NO: 311853 - DNA, 20 bp, human
gctccttcccggggtctgcc

SEQ ID NO: 311854 - DNA, 20 bp, human
gttcctgggtgcctgcctcg

SEQ ID NO: 311855 - DNA, 20 bp, human
ggtcgcgggctggatacctc

SEQ ID NO: 311856 - DNA, 20 bp, human
gcgccccgccgtgtccgcga

SEQ ID NO: 311857 - DNA, 20 bp, human
gctcccgggtccacccccca

SEQ ID NO: 311858 - DNA, 20 bp, human
ggggacgcgcgggatgggcg

SEQ ID NO: 311859 - DNA, 20 bp, human
gggggtggcagcgtccgagg

SEQ ID NO: 311860 - DNA, 20 bp, human
gtgaacccgggtctgaaccc

SEQ ID NO: 311861 - DNA, 20 bp, human
gcacagggaaggcgtttccc

SEQ ID NO: 311862 - DNA, 20 bp, human
gagtcccgtcgcggacacgg

SEQ ID NO: 311863 - DNA, 20 bp, human
ggcagcctcaagcggcgggg

SEQ ID NO: 311864 - DNA, 20 bp, human
ggcgccgtggggggtggacc

SEQ ID NO: 311865 - DNA, 20 bp, human
gcgcggacccagtcccgtcg

SEQ ID NO: 311866 - DNA, 20 bp, human
gccgctctctggtagggcaa

SEQ ID NO: 311867 - DNA, 20 bp, human
gcccctcagctgttataaag

SEQ ID NO: 311868 - DNA, 20 bp, human
ggactctgagggaagcgatt

SEQ ID NO: 311869 - DNA, 20 bp, human
gtagggagactcaaaggtag

SEQ ID NO: 311870 - DNA, 20 bp, human
gtggcttccgctctctggta

SEQ ID NO: 311871 - DNA, 20 bp, human
gagcgattgggaactctctt

SEQ ID NO: 311872 - DNA, 20 bp, human
gtaacagctgaggggaattt

SEQ ID NO: 311873 - DNA, 20 bp, human
gaaaacttcatactgcccta

SEQ ID NO: 311874 - DNA, 20 bp, human
gggacgagaaccagaatctc

SEQ ID NO: 311875 - DNA, 20 bp, human
gtacctctcagcttattcta

SEQ ID NO: 311876 - DNA, 20 bp, human
gtgacgaggtcgtgcactga

SEQ ID NO: 311877 - DNA, 20 bp, human
ggcactgagggtggacgtag

SEQ ID NO: 311878 - DNA, 20 bp, human
ggcaggcggccggggaaaag

SEQ ID NO: 311879 - DNA, 20 bp, human
gtctaacctcaggacgtcaa

SEQ ID NO: 311880 - DNA, 20 bp, human
gatcgcgagagaggcaagtg

SEQ ID NO: 311881 - DNA, 20 bp, human
gtgcgcccagatcgcgagag

SEQ ID NO: 311882 - DNA, 20 bp, human
ggtactactaggagggacgc

SEQ ID NO: 311883 - DNA, 20 bp, human
gcgtagaggccaggagtagc

SEQ ID NO: 311884 - DNA, 20 bp, human
gcccagccggctacatctgg

SEQ ID NO: 311885 - DNA, 20 bp, human
gcaggagtagcaggcggccg

SEQ ID NO: 311886 - DNA, 20 bp, human
ggggtaacacaactgtacac

SEQ ID NO: 311887 - DNA, 20 bp, human
gggtctggaccctccgagca

SEQ ID NO: 311888 - DNA, 20 bp, human
gcatttctctccctgatgat

SEQ ID NO: 311889 - DNA, 20 bp, human
ggcaggagatacaggcgatt

SEQ ID NO: 311890 - DNA, 20 bp, human
ggttgtgttaccccatcatc

SEQ ID NO: 311891 - DNA, 20 bp, human
gtgaatcatccttgctcgga

SEQ ID NO: 311892 - DNA, 20 bp, human
ggcgattgggttgaatgcat

SEQ ID NO: 311893 - DNA, 20 bp, human
gactctataaaaggagctca

SEQ ID NO: 311894 - DNA, 20 bp, human
gttgaatgcatggggagttt

SEQ ID NO: 311895 - DNA, 20 bp, human
gtccttttatagagtcaaac

SEQ ID NO: 311896 - DNA, 20 bp, human
ggtgagcctggggtcttcaa

SEQ ID NO: 311897 - DNA, 20 bp, human
gtcctagcgggcacacttca

SEQ ID NO: 311898 - DNA, 20 bp, human
gttcaaaggcagcacgccca

SEQ ID NO: 311899 - DNA, 20 bp, human
gtaaggagcaggacctaggg

SEQ ID NO: 311900 - DNA, 20 bp, human
gacgcccagggcctgccacg

SEQ ID NO: 311901 - DNA, 20 bp, human
gtaaggagaggtgacgggga

SEQ ID NO: 311902 - DNA, 20 bp, human
gctctgagaggcatgttgtt

SEQ ID NO: 311903 - DNA, 20 bp, human
gcaacaagaaaggtgagcct

SEQ ID NO: 311904 - DNA, 20 bp, human
gggtcctgctccttaaggag

SEQ ID NO: 311905 - DNA, 20 bp, human
gtgccacgtggcctcctagc

SEQ ID NO: 311906 - DNA, 20 bp, human
gtgggcggggtcctcggagg

SEQ ID NO: 311907 - DNA, 20 bp, human
gaaccagctggcccgtccgt

SEQ ID NO: 311908 - DNA, 20 bp, human
gcccctggcccacgggacgc

SEQ ID NO: 311909 - DNA, 20 bp, human
ggcccccggctggagacagc

SEQ ID NO: 311910 - DNA, 20 bp, human
ggccagctggttcccttcag

SEQ ID NO: 311911 - DNA, 20 bp, human
ggcctgctgtctccagccgg

SEQ ID NO: 311912 - DNA, 20 bp, human
gggcagctcggccaacggac

SEQ ID NO: 311913 - DNA, 20 bp, human
gcctccggggaggatccgga

SEQ ID NO: 311914 - DNA, 20 bp, human
ggacccgcgtcccgtgggcc

SEQ ID NO: 311915 - DNA, 20 bp, human
ggcccctgaagggaaccagc

SEQ ID NO: 311916 - DNA, 20 bp, human
gctagaggcagggtccgaag

SEQ ID NO: 311917 - DNA, 20 bp, human
gtccgaaggggtggaactgg

SEQ ID NO: 311918 - DNA, 20 bp, human
gacccgggcgggacctgcga

SEQ ID NO: 311919 - DNA, 20 bp, human
ggggtcctagggagtggcat

SEQ ID NO: 311920 - DNA, 20 bp, human
gggaacatatccggggttgg

SEQ ID NO: 311921 - DNA, 20 bp, human
ggctaaaagaacagttctag

SEQ ID NO: 311922 - DNA, 20 bp, human
gggggtggaactggaggtcg

SEQ ID NO: 311923 - DNA, 20 bp, human
gggaactggaggtcggggtc

SEQ ID NO: 311924 - DNA, 20 bp, human
gggctccccgaccagccctg

SEQ ID NO: 311925 - DNA, 20 bp, human
gcctccccagcgccgctccg

SEQ ID NO: 311926 - DNA, 20 bp, human
gcccacaggagcggggatct

SEQ ID NO: 311927 - DNA, 20 bp, human
gccgcccgggcgtcctgcgt

SEQ ID NO: 311928 - DNA, 20 bp, human
gccggggagtcccacaggag

SEQ ID NO: 311929 - DNA, 20 bp, human
gacgtccagcgacaaggggc

SEQ ID NO: 311930 - DNA, 20 bp, human
gttcggacgtccagcgacaa

SEQ ID NO: 311931 - DNA, 20 bp, human
gaggggcgggatacagggat

SEQ ID NO: 311932 - DNA, 20 bp, human
gttggcccgccccttgtcgc

SEQ ID NO: 311933 - DNA, 20 bp, human
gaggagaggggcgggataca

SEQ ID NO: 311934 - DNA, 20 bp, human
gtgccccacggggtcctggg

SEQ ID NO: 311935 - DNA, 20 bp, human
gctctccgggcgcgagcgga

SEQ ID NO: 311936 - DNA, 20 bp, human
gcatcatccatacctgctga

SEQ ID NO: 311937 - DNA, 20 bp, human
gcagagtgaccagcatgcaa

SEQ ID NO: 311938 - DNA, 20 bp, human
gtggtcactctgccctcagc

SEQ ID NO: 311939 - DNA, 20 bp, human
gcctgtggcccgggatgctg

SEQ ID NO: 311940 - DNA, 20 bp, human
gggggaaaacaagaaacagg

SEQ ID NO: 311941 - DNA, 20 bp, human
gggcctggttaaggaaatac

SEQ ID NO: 311942 - DNA, 20 bp, human
gtgatggtcctcagcatccc

SEQ ID NO: 311943 - DNA, 20 bp, human
gcaggtcagtctcagaatat

SEQ ID NO: 311944 - DNA, 20 bp, human
ggacctgtatttccttaacc

SEQ ID NO: 311945 - DNA, 20 bp, human
gattcaaagaaagggcaaac

SEQ ID NO: 311946 - DNA, 20 bp, human
gttaaggtctgtctgtacat

SEQ ID NO: 311947 - DNA, 20 bp, human
gggtggctgtgctatcggtt

SEQ ID NO: 311948 - DNA, 20 bp, human
gctcttcttcagctttcccc

SEQ ID NO: 311949 - DNA, 20 bp, human
gaacatcagaaagatagatg

SEQ ID NO: 311950 - DNA, 20 bp, human
ggagagagagaaaccgtggg

SEQ ID NO: 311951 - DNA, 20 bp, human
gtgatgttccagcagctagc

SEQ ID NO: 311952 - DNA, 20 bp, human
gatgacaattttactattca

SEQ ID NO: 311953 - DNA, 20 bp, human
ggagaaaatagaagaaaaaa

SEQ ID NO: 311954 - DNA, 20 bp, human
gttataatctatgttcacct

SEQ ID NO: 311955 - DNA, 20 bp, human
gaaagagagagagaaaccgt

SEQ ID NO: 311956 - DNA, 20 bp, human
gtgcactggggcttgcacta

SEQ ID NO: 311957 - DNA, 20 bp, human
gggacaaaaaggaggcaagt

SEQ ID NO: 311958 - DNA, 20 bp, human
gcctgtgaatgcaatcttgt

SEQ ID NO: 311959 - DNA, 20 bp, human
ggtgtttactaaacaattgc

SEQ ID NO: 311960 - DNA, 20 bp, human
gataaaaagacaaatgaatc

SEQ ID NO: 311961 - DNA, 20 bp, human
gaaagactaagaagggccaa

SEQ ID NO: 311962 - DNA, 20 bp, human
gaggcaatctcagaatatct

SEQ ID NO: 311963 - DNA, 20 bp, human
gttcaaaagaaaactttgca

SEQ ID NO: 311964 - DNA, 20 bp, human
ggcttatgagtgtggccttg

SEQ ID NO: 311965 - DNA, 20 bp, human
gataagcaatgatctgcctt

SEQ ID NO: 311966 - DNA, 20 bp, human
ggctgtgcagcgaacggaag

SEQ ID NO: 311967 - DNA, 20 bp, human
gccgccaccgccctgcggat

SEQ ID NO: 311968 - DNA, 20 bp, human
ggcgagaggaccgatccgca

SEQ ID NO: 311969 - DNA, 20 bp, human
ggacccggatctgtccaggg

SEQ ID NO: 311970 - DNA, 20 bp, human
gccgggtcaactggaggtgg

SEQ ID NO: 311971 - DNA, 20 bp, human
ggatccgggtcaactggagg

SEQ ID NO: 311972 - DNA, 20 bp, human
gagaggaccgatccgcaggg

SEQ ID NO: 311973 - DNA, 20 bp, human
gccgctgctggaacgcgagg

SEQ ID NO: 311974 - DNA, 20 bp, human
gtggacagatccgggtcaac

SEQ ID NO: 311975 - DNA, 20 bp, human
gacagatccgggtcaactgg

SEQ ID NO: 311976 - DNA, 20 bp, human
gttgccttgcaaaattggga

SEQ ID NO: 311977 - DNA, 20 bp, human
gtgccatttggatgaaagca

SEQ ID NO: 311978 - DNA, 20 bp, human
gaacacagtgattaatctcc

SEQ ID NO: 311979 - DNA, 20 bp, human
gctgtgttgccttgcaaaat

SEQ ID NO: 311980 - DNA, 20 bp, human
gttttctcctctaccaagac

SEQ ID NO: 311981 - DNA, 20 bp, human
ggcctgctattgactgtcgt

SEQ ID NO: 311982 - DNA, 20 bp, human
gaaatggtcctgctgccatt

SEQ ID NO: 311983 - DNA, 20 bp, human
gtccttttgagagaagaagt

SEQ ID NO: 311984 - DNA, 20 bp, human
gaatttggaatgtttggaaa

SEQ ID NO: 311985 - DNA, 20 bp, human
gcaaccttcccaattttgca

SEQ ID NO: 311986 - DNA, 20 bp, human
gtcacctatttccacattcg

SEQ ID NO: 311987 - DNA, 20 bp, human
gcagcctcgaatgtggaaat

SEQ ID NO: 311988 - DNA, 20 bp, human
gggaagtattacatcgttat

SEQ ID NO: 311989 - DNA, 20 bp, human
ggctctcataggtatcattc

SEQ ID NO: 311990 - DNA, 20 bp, human
ggtattacatcgttattggc

SEQ ID NO: 311991 - DNA, 20 bp, human
gggtatcattcaggacatta

SEQ ID NO: 311992 - DNA, 20 bp, human
gaaaaaaatgaggtttctca

SEQ ID NO: 311993 - DNA, 20 bp, human
gcccctgtatggagaaccac

SEQ ID NO: 311994 - DNA, 20 bp, human
gagcttctcagcctcgaatg

SEQ ID NO: 311995 - DNA, 20 bp, human
gatcctgtggttctccatac

SEQ ID NO: 311996 - DNA, 20 bp, human
ggggaagggccctacccaga

SEQ ID NO: 311997 - DNA, 20 bp, human
gcaggaatatgaagcaacat

SEQ ID NO: 311998 - DNA, 20 bp, human
ggaaagactcccccatttgg

SEQ ID NO: 311999 - DNA, 20 bp, human
gaacgtcagggtgctcgcca

SEQ ID NO: 312000 - DNA, 20 bp, human
gcagggtgctcgccagggaa

SEQ ID NO: 312001 - DNA, 20 bp, human
gtatgcaggggaatattttg

SEQ ID NO: 312002 - DNA, 20 bp, human
gttaagacatggctttaaag

SEQ ID NO: 312003 - DNA, 20 bp, human
ggggaatattttgaggtttg

SEQ ID NO: 312004 - DNA, 20 bp, human
gtctccacatacaatgaggg

SEQ ID NO: 312005 - DNA, 20 bp, human
gtgatttagtacccccaaat

SEQ ID NO: 312006 - DNA, 20 bp, human
ggcagcaccagcatgagaaa

SEQ ID NO: 312007 - DNA, 20 bp, human
gaaccgcaggccctcagggg

SEQ ID NO: 312008 - DNA, 20 bp, human
gacaggcaagtgctgactca

SEQ ID NO: 312009 - DNA, 20 bp, human
ggtcttgcctgacttggcag

SEQ ID NO: 312010 - DNA, 20 bp, human
ggtcagccaagggaaagtga

SEQ ID NO: 312011 - DNA, 20 bp, human
gcttgcctgtcaaggagggg

SEQ ID NO: 312012 - DNA, 20 bp, human
gcttgtgggaactgtatgaa

SEQ ID NO: 312013 - DNA, 20 bp, human
gggacagagcctggagtgtg

SEQ ID NO: 312014 - DNA, 20 bp, human
gacttggcagtggagactgc

SEQ ID NO: 312015 - DNA, 20 bp, human
gcagacccgcaggaaaccgc

SEQ ID NO: 312016 - DNA, 20 bp, human
ggtgaaaccagggtgtgctc

SEQ ID NO: 312017 - DNA, 20 bp, human
ggctctatggaagtgctgaa

SEQ ID NO: 312018 - DNA, 20 bp, human
ggacaaagctaagggtaaat

SEQ ID NO: 312019 - DNA, 20 bp, human
ggtagcgtactcaggaagtt

SEQ ID NO: 312020 - DNA, 20 bp, human
ggggtctctgacaaagctaa

SEQ ID NO: 312021 - DNA, 20 bp, human
gtcagtgaaacgtgaaacca

SEQ ID NO: 312022 - DNA, 20 bp, human
gagcacaggcaattattatc

SEQ ID NO: 312023 - DNA, 20 bp, human
ggtgatctgtgacctctagt

SEQ ID NO: 312024 - DNA, 20 bp, human
gctctagtgggatggctcta

SEQ ID NO: 312025 - DNA, 20 bp, human
gacaaaaaccctacagaaac

SEQ ID NO: 312026 - DNA, 20 bp, human
gaccctggctggccccacag

SEQ ID NO: 312027 - DNA, 20 bp, human
gaaaccggttggaggatctg

SEQ ID NO: 312028 - DNA, 20 bp, human
gggcagcaggtcccctgaga

SEQ ID NO: 312029 - DNA, 20 bp, human
ggggccagccagggtagttg

SEQ ID NO: 312030 - DNA, 20 bp, human
gaggacaagacccaccgggt

SEQ ID NO: 312031 - DNA, 20 bp, human
ggacttggctcagggactct

SEQ ID NO: 312032 - DNA, 20 bp, human
gctgggaatgtggtagacat

SEQ ID NO: 312033 - DNA, 20 bp, human
gtggaggatctgaggtgggt

SEQ ID NO: 312034 - DNA, 20 bp, human
gccaccaaatgcatccttat

SEQ ID NO: 312035 - DNA, 20 bp, human
ggggcaggacaagacccacc

SEQ ID NO: 312036 - DNA, 20 bp, human
gcctcccgagccaatctccg

SEQ ID NO: 312037 - DNA, 20 bp, human
gttctgcctaggcagttcca

SEQ ID NO: 312038 - DNA, 20 bp, human
gcggctgctgggcacgcagc

SEQ ID NO: 312039 - DNA, 20 bp, human
gaaaatcaggcccagcccta

SEQ ID NO: 312040 - DNA, 20 bp, human
ggcctccggtgcatggggac

SEQ ID NO: 312041 - DNA, 20 bp, human
gggggcggtacgcaccacgg

SEQ ID NO: 312042 - DNA, 20 bp, human
gcgagccggcggaagggaga

SEQ ID NO: 312043 - DNA, 20 bp, human
gaatctccggggaagcgcaa

SEQ ID NO: 312044 - DNA, 20 bp, human
gggtgccaccgccccatttc

SEQ ID NO: 312045 - DNA, 20 bp, human
gctgggcctgattttctcat

SEQ ID NO: 312046 - DNA, 20 bp, human
gactctcgcgagaattcgtg

SEQ ID NO: 312047 - DNA, 20 bp, human
gagtccgtcagtccgggacg

SEQ ID NO: 312048 - DNA, 20 bp, human
gcgcccgcgctccggaaagg

SEQ ID NO: 312049 - DNA, 20 bp, human
ggtacctcgtcccggactga

SEQ ID NO: 312050 - DNA, 20 bp, human
gcgcgagagtccgtcagtcc

SEQ ID NO: 312051 - DNA, 20 bp, human
gaggcggaggagaggactta

SEQ ID NO: 312052 - DNA, 20 bp, human
gagaactgctgctgaggcgg

SEQ ID NO: 312053 - DNA, 20 bp, human
gggtgcgttcggctgaaagg

SEQ ID NO: 312054 - DNA, 20 bp, human
ggcgcgcccgcgctccggaa

SEQ ID NO: 312055 - DNA, 20 bp, human
gtcgcgaggcgattggtagc

SEQ ID NO: 312056 - DNA, 20 bp, human
gcccgagcccggaacttggg

SEQ ID NO: 312057 - DNA, 20 bp, human
gacggggcgctcagacaatg

SEQ ID NO: 312058 - DNA, 20 bp, human
gggagcgagacccaccgggt

SEQ ID NO: 312059 - DNA, 20 bp, human
ggcggggctcgctcttaagg

SEQ ID NO: 312060 - DNA, 20 bp, human
gtgggtctcgctccagttgg

SEQ ID NO: 312061 - DNA, 20 bp, human
ggggtagtgcgggttcgtgg

SEQ ID NO: 312062 - DNA, 20 bp, human
gttaaggtggtccggggtcc

SEQ ID NO: 312063 - DNA, 20 bp, human
gcccgcctctcctcggggtc

SEQ ID NO: 312064 - DNA, 20 bp, human
gtagtgcgggttcgtggcgg

SEQ ID NO: 312065 - DNA, 20 bp, human
gcccagagctggggtagtgc

SEQ ID NO: 312066 - DNA, 20 bp, human
gtcccccggtcttgcatcta

SEQ ID NO: 312067 - DNA, 20 bp, human
gcgcgaaagagcaccggcaa

SEQ ID NO: 312068 - DNA, 20 bp, human
ggccctagatgcaagaccgg

SEQ ID NO: 312069 - DNA, 20 bp, human
gcacccagttgcatttttca

SEQ ID NO: 312070 - DNA, 20 bp, human
gcgctgcaacacaaacgttc

SEQ ID NO: 312071 - DNA, 20 bp, human
gaactgggtgcgtggagata

SEQ ID NO: 312072 - DNA, 20 bp, human
ggaccgggggaactgactgc

SEQ ID NO: 312073 - DNA, 20 bp, human
gtcccttcgcgaaagagcac

SEQ ID NO: 312074 - DNA, 20 bp, human
gttccggcagtcagttcccc

SEQ ID NO: 312075 - DNA, 20 bp, human
ggcagcgcctcgccccttgc

SEQ ID NO: 312076 - DNA, 20 bp, human
gggctcggatgggtcgctag

SEQ ID NO: 312077 - DNA, 20 bp, human
ggggcggagcagcgagacgg

SEQ ID NO: 312078 - DNA, 20 bp, human
gcggagcagcgagacggtgg

SEQ ID NO: 312079 - DNA, 20 bp, human
gccatccgagccgccggcgg

SEQ ID NO: 312080 - DNA, 20 bp, human
gcaacccgtccactgagacg

SEQ ID NO: 312081 - DNA, 20 bp, human
ggcagcgagacggtggaggt

SEQ ID NO: 312082 - DNA, 20 bp, human
gcgggggcggagcagcgaga

SEQ ID NO: 312083 - DNA, 20 bp, human
gtcacagaataccgaggaga

SEQ ID NO: 312084 - DNA, 20 bp, human
ggtgtccgcgtctcagtgga

SEQ ID NO: 312085 - DNA, 20 bp, human
ggagcgtgtccgcgtctcag

SEQ ID NO: 312086 - DNA, 20 bp, human
gtggcaggagcaggagatct

SEQ ID NO: 312087 - DNA, 20 bp, human
gctacaaaggctgataggcg

SEQ ID NO: 312088 - DNA, 20 bp, human
gaccggtagccgcttgaata

SEQ ID NO: 312089 - DNA, 20 bp, human
gttcctgttcacagagtggc

SEQ ID NO: 312090 - DNA, 20 bp, human
ggtaagtaatctcagtcaca

SEQ ID NO: 312091 - DNA, 20 bp, human
gagtcaaaaaagcgaagaag

SEQ ID NO: 312092 - DNA, 20 bp, human
gtacacctggagcttgacag

SEQ ID NO: 312093 - DNA, 20 bp, human
gtcatctcttggataggggt

SEQ ID NO: 312094 - DNA, 20 bp, human
gtgacttcatctcttggata

SEQ ID NO: 312095 - DNA, 20 bp, human
ggagattacttactacaaag

SEQ ID NO: 312096 - DNA, 20 bp, human
gggacgcgataagatacaat

SEQ ID NO: 312097 - DNA, 20 bp, human
gaatcggcattgagcttctt

SEQ ID NO: 312098 - DNA, 20 bp, human
ggcagaacgtggcctcccat

SEQ ID NO: 312099 - DNA, 20 bp, human
ggcaggagggctacttctat

SEQ ID NO: 312100 - DNA, 20 bp, human
gagaagtagccctcctgccc

SEQ ID NO: 312101 - DNA, 20 bp, human
gagcttcttaggaccagggc

SEQ ID NO: 312102 - DNA, 20 bp, human
gccctccagcggccgaactg

SEQ ID NO: 312103 - DNA, 20 bp, human
gaagcgggaagttcagactg

SEQ ID NO: 312104 - DNA, 20 bp, human
gcattgagcttcttaggacc

SEQ ID NO: 312105 - DNA, 20 bp, human
ggtatcttatcgcgtccaat

SEQ ID NO: 312106 - DNA, 20 bp, human
gtgcaagccacaagttgggc

SEQ ID NO: 312107 - DNA, 20 bp, human
gcgtctcgcgaagggagggg

SEQ ID NO: 312108 - DNA, 20 bp, human
ggggccgcggcgtctcgcga

SEQ ID NO: 312109 - DNA, 20 bp, human
gtgtgcgcgcgccggatccg

SEQ ID NO: 312110 - DNA, 20 bp, human
gcgcacacgtggcccgggca

SEQ ID NO: 312111 - DNA, 20 bp, human
ggcggcgtctcgcgaaggga

SEQ ID NO: 312112 - DNA, 20 bp, human
gaccgccccggcccaacttg

SEQ ID NO: 312113 - DNA, 20 bp, human
gccggctgcaagccacaagt

SEQ ID NO: 312114 - DNA, 20 bp, human
gggagggagaggtccgagcg

SEQ ID NO: 312115 - DNA, 20 bp, human
gaccggagcccccgcccgca

SEQ ID NO: 312116 - DNA, 20 bp, human
gccgccgcggggctctccag

SEQ ID NO: 312117 - DNA, 20 bp, human
gcagcgccgcgcaacagccc

SEQ ID NO: 312118 - DNA, 20 bp, human
ggcgggcggggacaccaacg

SEQ ID NO: 312119 - DNA, 20 bp, human
gcggctccgcacccagggga

SEQ ID NO: 312120 - DNA, 20 bp, human
ggcaacagcccgggctgctt

SEQ ID NO: 312121 - DNA, 20 bp, human
ggggctccgccattggccga

SEQ ID NO: 312122 - DNA, 20 bp, human
gacggggagtggatactccg

SEQ ID NO: 312123 - DNA, 20 bp, human
ggcgaggtcctaagcagccc

SEQ ID NO: 312124 - DNA, 20 bp, human
gggcgcacctgtcaccgtcc

SEQ ID NO: 312125 - DNA, 20 bp, human
gtactccgaggctcaacctg

SEQ ID NO: 312126 - DNA, 20 bp, human
ggggctggccaccacgggac

SEQ ID NO: 312127 - DNA, 20 bp, human
gactgcggcggcatccggga

SEQ ID NO: 312128 - DNA, 20 bp, human
gccggaagctccgactgcgg

SEQ ID NO: 312129 - DNA, 20 bp, human
gcggcggcatccgggacggc

SEQ ID NO: 312130 - DNA, 20 bp, human
gatctcaccttcctgtcccg

SEQ ID NO: 312131 - DNA, 20 bp, human
ggggcgatctgacgtcatga

SEQ ID NO: 312132 - DNA, 20 bp, human
ggagccggaagctccgactg

SEQ ID NO: 312133 - DNA, 20 bp, human
gagaacctgacccggcaggg

SEQ ID NO: 312134 - DNA, 20 bp, human
gtctcagagcgggtctccgg

SEQ ID NO: 312135 - DNA, 20 bp, human
gatctgacgtcatgaggggc

SEQ ID NO: 312136 - DNA, 20 bp, human
gtcgccacgcctccggggga

SEQ ID NO: 312137 - DNA, 20 bp, human
gcgggcgccgaggtttgcaa

SEQ ID NO: 312138 - DNA, 20 bp, human
ggggcgcgacaagtccctcc

SEQ ID NO: 312139 - DNA, 20 bp, human
gaggacgaggcggagcgaaa

SEQ ID NO: 312140 - DNA, 20 bp, human
gtggcttggagagcgatgat

SEQ ID NO: 312141 - DNA, 20 bp, human
gtccgcctcgtcctagaact

SEQ ID NO: 312142 - DNA, 20 bp, human
gaggatggcggtcctgcgga

SEQ ID NO: 312143 - DNA, 20 bp, human
ggaggtccctgcataaccta

SEQ ID NO: 312144 - DNA, 20 bp, human
gatcctcgccacgcctccgg

SEQ ID NO: 312145 - DNA, 20 bp, human
ggccatcctcgccacgcctc

SEQ ID NO: 312146 - DNA, 20 bp, human
gcaccccggccctccggctg

SEQ ID NO: 312147 - DNA, 20 bp, human
gggccctccggctgcggcat

SEQ ID NO: 312148 - DNA, 20 bp, human
gactcctaaccgggtggaca

SEQ ID NO: 312149 - DNA, 20 bp, human
gcccccctgtccacccggtt

SEQ ID NO: 312150 - DNA, 20 bp, human
gcagccgcggcgcacacgct

SEQ ID NO: 312151 - DNA, 20 bp, human
gtcgtcttgaatcactccag

SEQ ID NO: 312152 - DNA, 20 bp, human
gagttccaatggcaggggga

SEQ ID NO: 312153 - DNA, 20 bp, human
gacgcccagcgtgtgcgccg

SEQ ID NO: 312154 - DNA, 20 bp, human
gaggaagtgggcttcagctc

SEQ ID NO: 312155 - DNA, 20 bp, human
ggcgtcgtccctagcagcag

SEQ ID NO: 312156 - DNA, 20 bp, human
gcctggcccgagcactgact

SEQ ID NO: 312157 - DNA, 20 bp, human
ggatggccctggagagagaa

SEQ ID NO: 312158 - DNA, 20 bp, human
gcgtccttggcctgcaagaa

SEQ ID NO: 312159 - DNA, 20 bp, human
gcagctggaggcactcaaag

SEQ ID NO: 312160 - DNA, 20 bp, human
ggaggggagtgccatcgacc

SEQ ID NO: 312161 - DNA, 20 bp, human
ggctaggctgggccggacaa

SEQ ID NO: 312162 - DNA, 20 bp, human
gtgggccggacaagggagag

SEQ ID NO: 312163 - DNA, 20 bp, human
gcagctgcgtacacactgca

SEQ ID NO: 312164 - DNA, 20 bp, human
gaggcaccgcagaagctggt

SEQ ID NO: 312165 - DNA, 20 bp, human
gggaaaggccttctgaacac

SEQ ID NO: 312166 - DNA, 20 bp, human
gccggggctccgcgcagaag

SEQ ID NO: 312167 - DNA, 20 bp, human
gaagcccgcgggaccgagtc

SEQ ID NO: 312168 - DNA, 20 bp, human
gaaccggggccgcggcctgt

SEQ ID NO: 312169 - DNA, 20 bp, human
gtaaggggcccgggcggcga

SEQ ID NO: 312170 - DNA, 20 bp, human
gcggagccccgggcccttta

SEQ ID NO: 312171 - DNA, 20 bp, human
gggccccggttgctaggcaa

SEQ ID NO: 312172 - DNA, 20 bp, human
ggggcaccggccattggcac

SEQ ID NO: 312173 - DNA, 20 bp, human
gagccggcgccgtcagtagt

SEQ ID NO: 312174 - DNA, 20 bp, human
gccgccccgtgtcgcagcca

SEQ ID NO: 312175 - DNA, 20 bp, human
gtgcaggggtctcccagact

SEQ ID NO: 312176 - DNA, 20 bp, human
gaggcgcctcccgtgctctg

SEQ ID NO: 312177 - DNA, 20 bp, human
gcgctgccccagagcacggg

SEQ ID NO: 312178 - DNA, 20 bp, human
gcggtccccgaggcagtggc

SEQ ID NO: 312179 - DNA, 20 bp, human
gcactcagggcttgtctctc

SEQ ID NO: 312180 - DNA, 20 bp, human
gggaaacctccggaaggaag

SEQ ID NO: 312181 - DNA, 20 bp, human
gccgaggcagtggcaggatg

SEQ ID NO: 312182 - DNA, 20 bp, human
gggggaggggtcataccagt

SEQ ID NO: 312183 - DNA, 20 bp, human
gagctgctacacctcggtgg

SEQ ID NO: 312184 - DNA, 20 bp, human
gtctggggcagcggtccccg

SEQ ID NO: 312185 - DNA, 20 bp, human
ggtgagctgctacacctcgg

SEQ ID NO: 312186 - DNA, 20 bp, human
gggacatgaccagtctaagg

SEQ ID NO: 312187 - DNA, 20 bp, human
ggacccctggcggccgcctg

SEQ ID NO: 312188 - DNA, 20 bp, human
ggccgccaggggtccccgct

SEQ ID NO: 312189 - DNA, 20 bp, human
ggacgccgagcggggacccc

SEQ ID NO: 312190 - DNA, 20 bp, human
gggagagaaaagtcgtcttt

SEQ ID NO: 312191 - DNA, 20 bp, human
ggcgcgctgggtgcatgagg

SEQ ID NO: 312192 - DNA, 20 bp, human
gatgggacatgaccagtcta

SEQ ID NO: 312193 - DNA, 20 bp, human
gtgtcccatctctttccgga

SEQ ID NO: 312194 - DNA, 20 bp, human
gcttccctccggaaagagat

SEQ ID NO: 312195 - DNA, 20 bp, human
gtccacaacggccacttcca

SEQ ID NO: 312196 - DNA, 20 bp, human
gtggctgcaagcactggagg

SEQ ID NO: 312197 - DNA, 20 bp, human
gcggccaccggggattccca

SEQ ID NO: 312198 - DNA, 20 bp, human
ggagggcggcaggccaatga

SEQ ID NO: 312199 - DNA, 20 bp, human
gtgagtgtggctgcaagcac

SEQ ID NO: 312200 - DNA, 20 bp, human
gccgcccagctggcagcggg

SEQ ID NO: 312201 - DNA, 20 bp, human
ggctccctgggaatccccgg

SEQ ID NO: 312202 - DNA, 20 bp, human
ggaggaagcgacgccctcat

SEQ ID NO: 312203 - DNA, 20 bp, human
gcactcagaagccgcccagc

SEQ ID NO: 312204 - DNA, 20 bp, human
ggtgtggctgcaagcactgg

SEQ ID NO: 312205 - DNA, 20 bp, human
gggactacgggatatcccag

SEQ ID NO: 312206 - DNA, 20 bp, human
gtagaagcgggctaggcgga

SEQ ID NO: 312207 - DNA, 20 bp, human
gaggaacagccggacggcgt

SEQ ID NO: 312208 - DNA, 20 bp, human
ggagccgtccgggtagaagc

SEQ ID NO: 312209 - DNA, 20 bp, human
gcggagggagagggcgaacg

SEQ ID NO: 312210 - DNA, 20 bp, human
gcctgcgccgggagccgtcc

SEQ ID NO: 312211 - DNA, 20 bp, human
gtagcccgcttctacccgga

SEQ ID NO: 312212 - DNA, 20 bp, human
gcgcctagcccgcttctacc

SEQ ID NO: 312213 - DNA, 20 bp, human
gcgaacgaggaacagccgga

SEQ ID NO: 312214 - DNA, 20 bp, human
gagggcgaacgaggaacagc

SEQ ID NO: 312215 - DNA, 20 bp, human
gggactgaggcaccggaagg

SEQ ID NO: 312216 - DNA, 20 bp, human
gtggtggcatagcatgttgg

SEQ ID NO: 312217 - DNA, 20 bp, human
gtatgtggaatgaaccttga

SEQ ID NO: 312218 - DNA, 20 bp, human
gtggaatatgtgaatgttgg

SEQ ID NO: 312219 - DNA, 20 bp, human
gaggggtgagttttcacatg

SEQ ID NO: 312220 - DNA, 20 bp, human
gggcatagcatgttggtgga

SEQ ID NO: 312221 - DNA, 20 bp, human
ggatgtgtgagtgaggtatg

SEQ ID NO: 312222 - DNA, 20 bp, human
gtagggagaggttatagatc

SEQ ID NO: 312223 - DNA, 20 bp, human
gcatggggtgttgattatgt

SEQ ID NO: 312224 - DNA, 20 bp, human
gtgtgaaaactcacccctca

SEQ ID NO: 312225 - DNA, 20 bp, human
ggggtgggatggcgctgtgg

SEQ ID NO: 312226 - DNA, 20 bp, human
gggaatccgcagcctaggtg

SEQ ID NO: 312227 - DNA, 20 bp, human
ggggcgccacacctaggctg

SEQ ID NO: 312228 - DNA, 20 bp, human
gctggccagaagtgaaagtc

SEQ ID NO: 312229 - DNA, 20 bp, human
gcagaagtgaaagtccggtc

SEQ ID NO: 312230 - DNA, 20 bp, human
ggctgcggattccgagagac

SEQ ID NO: 312231 - DNA, 20 bp, human
gcggattccgagagactggg

SEQ ID NO: 312232 - DNA, 20 bp, human
gcccgggaagtgcgcgaagc

SEQ ID NO: 312233 - DNA, 20 bp, human
gttcccgcttgagagggtga

SEQ ID NO: 312234 - DNA, 20 bp, human
gctctcggaatccgcagcct

SEQ ID NO: 312235 - DNA, 20 bp, human
gcttgaacttggcattccaa

SEQ ID NO: 312236 - DNA, 20 bp, human
gagggcagaagggtaaactc

SEQ ID NO: 312237 - DNA, 20 bp, human
gcccggggtcatcccagcaa

SEQ ID NO: 312238 - DNA, 20 bp, human
gcagtcccgcgtggccttgt

SEQ ID NO: 312239 - DNA, 20 bp, human
ggggccggggtagcgctcta

SEQ ID NO: 312240 - DNA, 20 bp, human
gcgggacccgcgcagccaat

SEQ ID NO: 312241 - DNA, 20 bp, human
gctgccctagagcgctaccc

SEQ ID NO: 312242 - DNA, 20 bp, human
gggactgcgtcctcgcctat

SEQ ID NO: 312243 - DNA, 20 bp, human
ggtaaactcaggtaaggaac

SEQ ID NO: 312244 - DNA, 20 bp, human
gagtaggcaggacaggacaa

SEQ ID NO: 312245 - DNA, 20 bp, human
gcccgcgcagccaataggcg

SEQ ID NO: 312246 - DNA, 20 bp, human
gtgcgaagcaaaactaatcc

SEQ ID NO: 312247 - DNA, 20 bp, human
gtccgtgcaggcgcaggcgg

SEQ ID NO: 312248 - DNA, 20 bp, human
ggagcgcaggcgtaacccga

SEQ ID NO: 312249 - DNA, 20 bp, human
gaaacagctagagcccggcg

SEQ ID NO: 312250 - DNA, 20 bp, human
ggcgtggaacaggccgcctg

SEQ ID NO: 312251 - DNA, 20 bp, human
ggagggaaacagctagagcc

SEQ ID NO: 312252 - DNA, 20 bp, human
gacgcaggcggcaagtgtcc

SEQ ID NO: 312253 - DNA, 20 bp, human
gtgagaggaagcaatcagta

SEQ ID NO: 312254 - DNA, 20 bp, human
gcaccacgacctccctcctg

SEQ ID NO: 312255 - DNA, 20 bp, human
gactaatcctggcgtggaac

SEQ ID NO: 312256 - DNA, 20 bp, human
gggcgcggaaaaggacgggt

SEQ ID NO: 312257 - DNA, 20 bp, human
ggcggaactgagccagatgc

SEQ ID NO: 312258 - DNA, 20 bp, human
gacgtaatgtggcgcggaaa

SEQ ID NO: 312259 - DNA, 20 bp, human
gggactacgactgacttcca

SEQ ID NO: 312260 - DNA, 20 bp, human
gaatgtggcgcggaaaagga

SEQ ID NO: 312261 - DNA, 20 bp, human
ggaagcggaattacgtaatg

SEQ ID NO: 312262 - DNA, 20 bp, human
ggtaccaaattcggaagcgg

SEQ ID NO: 312263 - DNA, 20 bp, human
gcagccagctgccgacaccc

SEQ ID NO: 312264 - DNA, 20 bp, human
gcatcccccgcttccgaatt

SEQ ID NO: 312265 - DNA, 20 bp, human
gcagctgccgacacccgggc

SEQ ID NO: 312266 - DNA, 20 bp, human
gtggatctccaggagggagt

SEQ ID NO: 312267 - DNA, 20 bp, human
gcccaagggaagatcttgga

SEQ ID NO: 312268 - DNA, 20 bp, human
ggccaggcactcacacaaaa

SEQ ID NO: 312269 - DNA, 20 bp, human
ggcagcaattaccggagtgg

SEQ ID NO: 312270 - DNA, 20 bp, human
gtcttctaggggctaatcag

SEQ ID NO: 312271 - DNA, 20 bp, human
gacagactgaggggatgacc

SEQ ID NO: 312272 - DNA, 20 bp, human
gcccctagaagacccttcaa

SEQ ID NO: 312273 - DNA, 20 bp, human
ggcacagctgcagcaattac

SEQ ID NO: 312274 - DNA, 20 bp, human
gagcagaggctgcctggtac

SEQ ID NO: 312275 - DNA, 20 bp, human
ggcctggcaagggtgacgtg

SEQ ID NO: 312276 - DNA, 20 bp, human
ggacggggagaggggtcaac

SEQ ID NO: 312277 - DNA, 20 bp, human
ggcgtgggacacgagggacg

SEQ ID NO: 312278 - DNA, 20 bp, human
gtgcgccgcgtgggacacga

SEQ ID NO: 312279 - DNA, 20 bp, human
gtggcgagagtgcgccgcgt

SEQ ID NO: 312280 - DNA, 20 bp, human
gaggacctgggatctccacc

SEQ ID NO: 312281 - DNA, 20 bp, human
ggacacgagggacggggaga

SEQ ID NO: 312282 - DNA, 20 bp, human
gggcgcccggcgcttgtgat

SEQ ID NO: 312283 - DNA, 20 bp, human
gcgcgccagccaatgcgccc

SEQ ID NO: 312284 - DNA, 20 bp, human
gtacagcggcccgggcgcat

SEQ ID NO: 312285 - DNA, 20 bp, human
gctgaacaatggtcagatcc

SEQ ID NO: 312286 - DNA, 20 bp, human
gcacctgcctagttatagga

SEQ ID NO: 312287 - DNA, 20 bp, human
gtcattgaataggtgggaag

SEQ ID NO: 312288 - DNA, 20 bp, human
ggggagggaacaaaaacctg

SEQ ID NO: 312289 - DNA, 20 bp, human
gagcagaaaaatggggcagg

SEQ ID NO: 312290 - DNA, 20 bp, human
gctccccaggttgtagaagc

SEQ ID NO: 312291 - DNA, 20 bp, human
ggacctggccccaaggtcaa

SEQ ID NO: 312292 - DNA, 20 bp, human
gtgggtggggatttttaggt

SEQ ID NO: 312293 - DNA, 20 bp, human
gaaaggcagccatgcagata

SEQ ID NO: 312294 - DNA, 20 bp, human
gggtgagattgcatatgctt

SEQ ID NO: 312295 - DNA, 20 bp, human
ggatttaagcaattggggaa

SEQ ID NO: 312296 - DNA, 20 bp, human
gtggggctgggaggcgtaag

SEQ ID NO: 312297 - DNA, 20 bp, human
gtgggtcccaggtgctggaa

SEQ ID NO: 312298 - DNA, 20 bp, human
ggtgcctcaggaattgatgt

SEQ ID NO: 312299 - DNA, 20 bp, human
gtaaggggtgtgcaagggag

SEQ ID NO: 312300 - DNA, 20 bp, human
ggaggcgtaaggggtgtgca

SEQ ID NO: 312301 - DNA, 20 bp, human
gggtgacacccgagtgcctc

SEQ ID NO: 312302 - DNA, 20 bp, human
gtgacctccagtcggggtgg

SEQ ID NO: 312303 - DNA, 20 bp, human
gaggtcaaatagtctcagca

SEQ ID NO: 312304 - DNA, 20 bp, human
gaaaaaacccagagacatct

SEQ ID NO: 312305 - DNA, 20 bp, human
gactccaacatcaattcctg

SEQ ID NO: 312306 - DNA, 20 bp, human
ggctgcctgcggcttgacac

SEQ ID NO: 312307 - DNA, 20 bp, human
gagtccggaaccgctgcctg

SEQ ID NO: 312308 - DNA, 20 bp, human
gggtacgtagcgtctgtcct

SEQ ID NO: 312309 - DNA, 20 bp, human
gtaaccggacggtggtcgcc

SEQ ID NO: 312310 - DNA, 20 bp, human
gaagccgcaggcagcggttc

SEQ ID NO: 312311 - DNA, 20 bp, human
gcagataaacgcaatcccgg

SEQ ID NO: 312312 - DNA, 20 bp, human
gttaacctaacgtggcgggg

SEQ ID NO: 312313 - DNA, 20 bp, human
gcctcagcccaacgttagat

SEQ ID NO: 312314 - DNA, 20 bp, human
ggggacttaacctaacgtgg

SEQ ID NO: 312315 - DNA, 20 bp, human
gtcctgggcgttggtccacc

SEQ ID NO: 312316 - DNA, 20 bp, human
gcgaaggtcgcctgtgtcaa

SEQ ID NO: 312317 - DNA, 20 bp, human
ggggagagcgagccgagcga

SEQ ID NO: 312318 - DNA, 20 bp, human
gttacatggaagcggaggaa

SEQ ID NO: 312319 - DNA, 20 bp, human
gcgacagctcatggcgttca

SEQ ID NO: 312320 - DNA, 20 bp, human
ggcagcccgtcccctcagcc

SEQ ID NO: 312321 - DNA, 20 bp, human
gatagccttgagctttaatt

SEQ ID NO: 312322 - DNA, 20 bp, human
ggcactgcgcacgcgtacat

SEQ ID NO: 312323 - DNA, 20 bp, human
gaggtcgcctgtgtcaaagg

SEQ ID NO: 312324 - DNA, 20 bp, human
gctgcgcacgcgtacatggg

SEQ ID NO: 312325 - DNA, 20 bp, human
gctcggctcgctctccctgc

SEQ ID NO: 312326 - DNA, 20 bp, human
ggcgccgagggactggttct

SEQ ID NO: 312327 - DNA, 20 bp, human
ggcgccggatgaggcaatcg

SEQ ID NO: 312328 - DNA, 20 bp, human
gtggccgcctgcggcgccga

SEQ ID NO: 312329 - DNA, 20 bp, human
gcgcccccggggtgcattgt

SEQ ID NO: 312330 - DNA, 20 bp, human
gtcccagcagagccgtgggc

SEQ ID NO: 312331 - DNA, 20 bp, human
gcgcaggcggccaaacgcta

SEQ ID NO: 312332 - DNA, 20 bp, human
gctagtcccagcagagccgt

SEQ ID NO: 312333 - DNA, 20 bp, human
gaggcgcccaggcccctaga

SEQ ID NO: 312334 - DNA, 20 bp, human
gggcccctagaaggcggcgc

SEQ ID NO: 312335 - DNA, 20 bp, human
ggtccagggctgttctgtgt

SEQ ID NO: 312336 - DNA, 20 bp, human
gaggggacacccgtaggcgg

SEQ ID NO: 312337 - DNA, 20 bp, human
ggagacgtcaatcaatggat

SEQ ID NO: 312338 - DNA, 20 bp, human
ggcaacacaacgcacagtat

SEQ ID NO: 312339 - DNA, 20 bp, human
ggagtcttcgattgggtcga

SEQ ID NO: 312340 - DNA, 20 bp, human
gtaccagtggttggcgtgag

SEQ ID NO: 312341 - DNA, 20 bp, human
ggtcgcgccctatgtactcc

SEQ ID NO: 312342 - DNA, 20 bp, human
gacaacgcacagtattggtt

SEQ ID NO: 312343 - DNA, 20 bp, human
gtggctacggctgctaaccc

SEQ ID NO: 312344 - DNA, 20 bp, human
gatgaggggacacccgtagg

SEQ ID NO: 312345 - DNA, 20 bp, human
gtaggctcgagtcttcgatt

SEQ ID NO: 312346 - DNA, 20 bp, human
gactagtggccccaaatcag

SEQ ID NO: 312347 - DNA, 20 bp, human
gagattcgaaatgaagcggg

SEQ ID NO: 312348 - DNA, 20 bp, human
gggcaggcgggattccgggt

SEQ ID NO: 312349 - DNA, 20 bp, human
gaaccccggcggcaggccgt

SEQ ID NO: 312350 - DNA, 20 bp, human
ggccacggtacccggaagtg

SEQ ID NO: 312351 - DNA, 20 bp, human
gctcggggcaggcgggattc

SEQ ID NO: 312352 - DNA, 20 bp, human
gcccacccccggaatcaagt

SEQ ID NO: 312353 - DNA, 20 bp, human
gcccggcggcaggccgtcgg

SEQ ID NO: 312354 - DNA, 20 bp, human
gtggctggtgacacccggtg

SEQ ID NO: 312355 - DNA, 20 bp, human
gccgcggggcccagccacac

SEQ ID NO: 312356 - DNA, 20 bp, human
gtgcgcgtgagcgtgggcgt

SEQ ID NO: 312357 - DNA, 20 bp, human
ggccctctgcgcgtgagcgt

SEQ ID NO: 312358 - DNA, 20 bp, human
gcagctggggagtgattgag

SEQ ID NO: 312359 - DNA, 20 bp, human
gtcgactcagttgtctcgcg

SEQ ID NO: 312360 - DNA, 20 bp, human
gcttcgcggtcccgccgcaa

SEQ ID NO: 312361 - DNA, 20 bp, human
gcgacgcagtgggagcttcg

SEQ ID NO: 312362 - DNA, 20 bp, human
gactgagtcgacgacgcagt

SEQ ID NO: 312363 - DNA, 20 bp, human
ggcccacgctcacgcgcaga

SEQ ID NO: 312364 - DNA, 20 bp, human
gggaaaatggagcccaaaac

SEQ ID NO: 312365 - DNA, 20 bp, human
gtatctgagttagagtctcc

SEQ ID NO: 312366 - DNA, 20 bp, human
gccggggctgtgtgcactat

SEQ ID NO: 312367 - DNA, 20 bp, human
gggagctgcagctttgtgat

SEQ ID NO: 312368 - DNA, 20 bp, human
ggacacgcagcccgccaatc

SEQ ID NO: 312369 - DNA, 20 bp, human
gcaagcccccgaggcctccg

SEQ ID NO: 312370 - DNA, 20 bp, human
gaggctgtacatcagggcgg

SEQ ID NO: 312371 - DNA, 20 bp, human
gtgcactatcggagacaaag

SEQ ID NO: 312372 - DNA, 20 bp, human
gaggaggctgtacatcaggg

SEQ ID NO: 312373 - DNA, 20 bp, human
gaatcaggaggctgtacatc

SEQ ID NO: 312374 - DNA, 20 bp, human
gggaccggccaaccaagatc

SEQ ID NO: 312375 - DNA, 20 bp, human
gacgcagcccgccaatcagg

SEQ ID NO: 312376 - DNA, 20 bp, human
ggaagtgggcggtacccata

SEQ ID NO: 312377 - DNA, 20 bp, human
gtgcctgactggttaaagca

SEQ ID NO: 312378 - DNA, 20 bp, human
gcctggaggcggaagtgggt

SEQ ID NO: 312379 - DNA, 20 bp, human
gaatgccgaattgggagctt

SEQ ID NO: 312380 - DNA, 20 bp, human
gcctccaggcaatgccgaat

SEQ ID NO: 312381 - DNA, 20 bp, human
gtccagctgggtgtcgagac

SEQ ID NO: 312382 - DNA, 20 bp, human
gaacgactgtggagccctat

SEQ ID NO: 312383 - DNA, 20 bp, human
gcatgcgccctaggcccgca

SEQ ID NO: 312384 - DNA, 20 bp, human
gtgggtgtcgagacgggtac

SEQ ID NO: 312385 - DNA, 20 bp, human
gtggttaaagcagggtacag

SEQ ID NO: 312386 - DNA, 20 bp, human
gcgtgaatgaagcaagagga

SEQ ID NO: 312387 - DNA, 20 bp, human
gctggaacctagtcccgctt

SEQ ID NO: 312388 - DNA, 20 bp, human
ggaggagggagagcatgtat

SEQ ID NO: 312389 - DNA, 20 bp, human
gagagcatgtatgggatttc

SEQ ID NO: 312390 - DNA, 20 bp, human
gtcaaggagcggctgtcagg

SEQ ID NO: 312391 - DNA, 20 bp, human
gagcgggaaagcgcgggggg

SEQ ID NO: 312392 - DNA, 20 bp, human
gaggtcgccatatttctgta

SEQ ID NO: 312393 - DNA, 20 bp, human
gtacgccaataattaattag

SEQ ID NO: 312394 - DNA, 20 bp, human
gcgctcggcggcctggccta

SEQ ID NO: 312395 - DNA, 20 bp, human
gaattattggcgtatgccat

SEQ ID NO: 312396 - DNA, 20 bp, human
ggggactggtagttcggagt

SEQ ID NO: 312397 - DNA, 20 bp, human
gaccaacccgcagcagccgg

SEQ ID NO: 312398 - DNA, 20 bp, human
gactggtagttcggagtcgg

SEQ ID NO: 312399 - DNA, 20 bp, human
gtaaggcggagctggcgatg

SEQ ID NO: 312400 - DNA, 20 bp, human
gcacgccgggactggtagtt

SEQ ID NO: 312401 - DNA, 20 bp, human
ggcccccggctgctgcgggt

SEQ ID NO: 312402 - DNA, 20 bp, human
ggaagtagtcggagagaata

SEQ ID NO: 312403 - DNA, 20 bp, human
ggtgcgcggcgggctgtcgt

SEQ ID NO: 312404 - DNA, 20 bp, human
gcccagttgcgacgtccctt

SEQ ID NO: 312405 - DNA, 20 bp, human
gactacttcaacatcaacgg

SEQ ID NO: 312406 - DNA, 20 bp, human
gctagcacccgcctttactg

SEQ ID NO: 312407 - DNA, 20 bp, human
gactaacggaggaagaggat

SEQ ID NO: 312408 - DNA, 20 bp, human
gtagacaagacgattgtgat

SEQ ID NO: 312409 - DNA, 20 bp, human
gaagtgtcattgctgacgtg

SEQ ID NO: 312410 - DNA, 20 bp, human
gtggccggaactcgtactaa

SEQ ID NO: 312411 - DNA, 20 bp, human
ggggcatacgccctcctcca

SEQ ID NO: 312412 - DNA, 20 bp, human
gcggctgtcacgcttttgga

SEQ ID NO: 312413 - DNA, 20 bp, human
gctaagagggcgaacgtcat

SEQ ID NO: 312414 - DNA, 20 bp, human
gaccttaacagtgaagaagc

SEQ ID NO: 312415 - DNA, 20 bp, human
gggcagacacgtcaccctgg

SEQ ID NO: 312416 - DNA, 20 bp, human
gccaaatcccagcaaaggat

SEQ ID NO: 312417 - DNA, 20 bp, human
gtaaatagcactagtaggca

SEQ ID NO: 312418 - DNA, 20 bp, human
ggctgaacggtaatatctat

SEQ ID NO: 312419 - DNA, 20 bp, human
gccgttcagcaaatcagaaa

SEQ ID NO: 312420 - DNA, 20 bp, human
gtgccgccaaatcccagcaa

SEQ ID NO: 312421 - DNA, 20 bp, human
gatggatatcgttcattcct

SEQ ID NO: 312422 - DNA, 20 bp, human
gcagcaaaggattggctgtt

SEQ ID NO: 312423 - DNA, 20 bp, human
gatctagtggcagactcgag

SEQ ID NO: 312424 - DNA, 20 bp, human
gagcaaaattatttggatct

SEQ ID NO: 312425 - DNA, 20 bp, human
ggggatttggcggcatctag

SEQ ID NO: 312426 - DNA, 20 bp, human
gccggcggaagagacgacag

SEQ ID NO: 312427 - DNA, 20 bp, human
gggcccccaagatggcgcga

SEQ ID NO: 312428 - DNA, 20 bp, human
gcagacgcgcaggccgttgg

SEQ ID NO: 312429 - DNA, 20 bp, human
gtctgcgccggaagcggaaa

SEQ ID NO: 312430 - DNA, 20 bp, human
ggcggaagagacgacagcgg

SEQ ID NO: 312431 - DNA, 20 bp, human
gtagccgggcccggagccag

SEQ ID NO: 312432 - DNA, 20 bp, human
gacggcctgcgcgtctgcgc

SEQ ID NO: 312433 - DNA, 20 bp, human
gcgccctcgcgccatcttgg

SEQ ID NO: 312434 - DNA, 20 bp, human
gcgcgcaggccgttggcggg

SEQ ID NO: 312435 - DNA, 20 bp, human
gcagcggcggaaacgcgcac

SEQ ID NO: 312436 - DNA, 20 bp, human
gagtcccggcgccttctgat

SEQ ID NO: 312437 - DNA, 20 bp, human
gtgcggtggcccagctgcag

SEQ ID NO: 312438 - DNA, 20 bp, human
ggtcgggaggtgctgcccaa

SEQ ID NO: 312439 - DNA, 20 bp, human
gcccggaagcgaatacgcga

SEQ ID NO: 312440 - DNA, 20 bp, human
gcaagtgagaatcgtgaggg

SEQ ID NO: 312441 - DNA, 20 bp, human
gctccaagtgagaatcgtga

SEQ ID NO: 312442 - DNA, 20 bp, human
ggcagagttgggtcccgagc

SEQ ID NO: 312443 - DNA, 20 bp, human
ggggtcccgagccggctgtc

SEQ ID NO: 312444 - DNA, 20 bp, human
gtgagcgtggacaacctcag

SEQ ID NO: 312445 - DNA, 20 bp, human
gcccctcgcgtattcgcttc

SEQ ID NO: 312446 - DNA, 20 bp, human
gagaccccccggcccctgaa

SEQ ID NO: 312447 - DNA, 20 bp, human
gaggggccggggggtctcta

SEQ ID NO: 312448 - DNA, 20 bp, human
gggtagcggcaaaatttgat

SEQ ID NO: 312449 - DNA, 20 bp, human
gggaaggggcgggcactgct

SEQ ID NO: 312450 - DNA, 20 bp, human
gcgggcactgcttggttggt

SEQ ID NO: 312451 - DNA, 20 bp, human
gtcctgccgagacccggtag

SEQ ID NO: 312452 - DNA, 20 bp, human
gactgctctgagcgtctaat

SEQ ID NO: 312453 - DNA, 20 bp, human
ggcgcagctgacggacattg

SEQ ID NO: 312454 - DNA, 20 bp, human
gagtcggcttcagtcactct

SEQ ID NO: 312455 - DNA, 20 bp, human
gcaagtaactgtggttatag

SEQ ID NO: 312456 - DNA, 20 bp, human
ggccgagtgtttgcgaaccc

SEQ ID NO: 312457 - DNA, 20 bp, human
gggggcccttgacagcagtg

SEQ ID NO: 312458 - DNA, 20 bp, human
ggcaacgcagataaagacag

SEQ ID NO: 312459 - DNA, 20 bp, human
ggtacccagtgcggtcgccc

SEQ ID NO: 312460 - DNA, 20 bp, human
gcacaaagatggcgtggagc

SEQ ID NO: 312461 - DNA, 20 bp, human
ggggctgggccaatgcggag

SEQ ID NO: 312462 - DNA, 20 bp, human
gggctgactatgtgaaagag

SEQ ID NO: 312463 - DNA, 20 bp, human
ggagcaacgccactccgcat

SEQ ID NO: 312464 - DNA, 20 bp, human
gtacaattcccgctgcccat

SEQ ID NO: 312465 - DNA, 20 bp, human
gtgcctaggtaacagccaat

SEQ ID NO: 312466 - DNA, 20 bp, human
gcggtcgaaaggggagttca

SEQ ID NO: 312467 - DNA, 20 bp, human
gtggcactcggcggtcgaaa

SEQ ID NO: 312468 - DNA, 20 bp, human
gcctgcccaaccacgagcga

SEQ ID NO: 312469 - DNA, 20 bp, human
ggatccgcggagcccaaggg

SEQ ID NO: 312470 - DNA, 20 bp, human
ggcggctgagggcttctcgt

SEQ ID NO: 312471 - DNA, 20 bp, human
gagggcttctcgtcggggtc

SEQ ID NO: 312472 - DNA, 20 bp, human
gttgccggatgcgcatgcgc

SEQ ID NO: 312473 - DNA, 20 bp, human
ggcggggtggggcttcgatt

SEQ ID NO: 312474 - DNA, 20 bp, human
gtgcgcatccggcaacacgc

SEQ ID NO: 312475 - DNA, 20 bp, human
gtcgaccgccgagtgccaca

SEQ ID NO: 312476 - DNA, 20 bp, human
ggggccgcgcgtccaccgat

SEQ ID NO: 312477 - DNA, 20 bp, human
gaggtaggggcgtagggcca

SEQ ID NO: 312478 - DNA, 20 bp, human
gactccgccgagatgctagt

SEQ ID NO: 312479 - DNA, 20 bp, human
ggataacatcgtgcgcgtgg

SEQ ID NO: 312480 - DNA, 20 bp, human
ggcaggtgtgcttgctgcag

SEQ ID NO: 312481 - DNA, 20 bp, human
ggcttcgcaggtagctctga

SEQ ID NO: 312482 - DNA, 20 bp, human
gtatggccacaggaacaccg

SEQ ID NO: 312483 - DNA, 20 bp, human
gggagctggagggtttggct

SEQ ID NO: 312484 - DNA, 20 bp, human
gtgtacaaggcgacttaccg

SEQ ID NO: 312485 - DNA, 20 bp, human
gcggagcgagttttccccat

SEQ ID NO: 312486 - DNA, 20 bp, human
gagccgcggctcatcctcta

SEQ ID NO: 312487 - DNA, 20 bp, human
ggcgagaggaagaagaggtg

SEQ ID NO: 312488 - DNA, 20 bp, human
gcgccctagaggatgagccg

SEQ ID NO: 312489 - DNA, 20 bp, human
gaggatgagccgcggctcgg

SEQ ID NO: 312490 - DNA, 20 bp, human
ggggcttcggccttgccacc

SEQ ID NO: 312491 - DNA, 20 bp, human
gtcttcaaggggaggcggga

SEQ ID NO: 312492 - DNA, 20 bp, human
ggaaaccccaagaggccagg

SEQ ID NO: 312493 - DNA, 20 bp, human
gccacctctctccgccctag

SEQ ID NO: 312494 - DNA, 20 bp, human
gaggcaagagggactgccta

SEQ ID NO: 312495 - DNA, 20 bp, human
gcatcctctagggcggagag

SEQ ID NO: 312496 - DNA, 20 bp, human
ggggcgggaccgcagtgcgg

SEQ ID NO: 312497 - DNA, 20 bp, human
gaggccagacgagaatcgaa

SEQ ID NO: 312498 - DNA, 20 bp, human
ggcagtgcgggggatgtcgc

SEQ ID NO: 312499 - DNA, 20 bp, human
gcgaatgggacctaggctga

SEQ ID NO: 312500 - DNA, 20 bp, human
gcgagaatcgaatgggacct

SEQ ID NO: 312501 - DNA, 20 bp, human
gcaatccaatgcggacgcct

SEQ ID NO: 312502 - DNA, 20 bp, human
gggaagcgccggcgatctcg

SEQ ID NO: 312503 - DNA, 20 bp, human
gagagcccgcgagctctcta

SEQ ID NO: 312504 - DNA, 20 bp, human
gctagggcggagctccgcgg

SEQ ID NO: 312505 - DNA, 20 bp, human
ggcggtcgcgtgacaccgga

SEQ ID NO: 312506 - DNA, 20 bp, human
gaggaagcaggcggcgtcac

SEQ ID NO: 312507 - DNA, 20 bp, human
ggcagcgggcggagtctggc

SEQ ID NO: 312508 - DNA, 20 bp, human
gcgtccgggaacgcccggaa

SEQ ID NO: 312509 - DNA, 20 bp, human
gcagactccgcccgctgcag

SEQ ID NO: 312510 - DNA, 20 bp, human
gccctccctaagctcggaca

SEQ ID NO: 312511 - DNA, 20 bp, human
ggggcccgtgtccgagctta

SEQ ID NO: 312512 - DNA, 20 bp, human
gacgtcctagccaatgacag

SEQ ID NO: 312513 - DNA, 20 bp, human
ggccgtacggcctctgtcat

SEQ ID NO: 312514 - DNA, 20 bp, human
gtacggcggaagtatagaaa

SEQ ID NO: 312515 - DNA, 20 bp, human
ggcgtcacaggtcgctctgc

SEQ ID NO: 312516 - DNA, 20 bp, human
ggacctccgagcctcagcca

SEQ ID NO: 312517 - DNA, 20 bp, human
gggggccctctgaacagccc

SEQ ID NO: 312518 - DNA, 20 bp, human
ggccctctgaacagcccggg

SEQ ID NO: 312519 - DNA, 20 bp, human
ggtcctcccgggctgttcag

SEQ ID NO: 312520 - DNA, 20 bp, human
gtcccgaggctctggagggt

SEQ ID NO: 312521 - DNA, 20 bp, human
gagaacgtggctaccgcttg

SEQ ID NO: 312522 - DNA, 20 bp, human
gggtagccctggctgaggct

SEQ ID NO: 312523 - DNA, 20 bp, human
ggcgtctgaaagcccgagaa

SEQ ID NO: 312524 - DNA, 20 bp, human
gtcgggactcagtgaaaagc

SEQ ID NO: 312525 - DNA, 20 bp, human
gtgagtcccgaggctctgga

SEQ ID NO: 312526 - DNA, 20 bp, human
gtagtcagctgtaaactggc

SEQ ID NO: 312527 - DNA, 20 bp, human
ggctgaggcggcaaatcaca

SEQ ID NO: 312528 - DNA, 20 bp, human
gcaaaacctaatctaggaag

SEQ ID NO: 312529 - DNA, 20 bp, human
gaacttagtcagctgtaaac

SEQ ID NO: 312530 - DNA, 20 bp, human
gagtcaccacttcctagatt

SEQ ID NO: 312531 - DNA, 20 bp, human
gttgaaaagatcttcatgcc

SEQ ID NO: 312532 - DNA, 20 bp, human
gggaatgtctcctttattcc

SEQ ID NO: 312533 - DNA, 20 bp, human
gcagctgtaaactggctggc

SEQ ID NO: 312534 - DNA, 20 bp, human
gaagtcaaaaggtcattttt

SEQ ID NO: 312535 - DNA, 20 bp, human
gattttggttttagaaatcc

SEQ ID NO: 312536 - DNA, 20 bp, human
gggacccgacgggacggaac

SEQ ID NO: 312537 - DNA, 20 bp, human
ggggaccaagtcaggggtcg

SEQ ID NO: 312538 - DNA, 20 bp, human
ggggctgggacccgacggga

SEQ ID NO: 312539 - DNA, 20 bp, human
ggggctgcaagtggatccgc

SEQ ID NO: 312540 - DNA, 20 bp, human
gtggcggggctgggacccga

SEQ ID NO: 312541 - DNA, 20 bp, human
ggggacgtcactgggaacaa

SEQ ID NO: 312542 - DNA, 20 bp, human
gccgccccgggccgcctgca

SEQ ID NO: 312543 - DNA, 20 bp, human
gccgacgggacggaacggga

SEQ ID NO: 312544 - DNA, 20 bp, human
ggggcagggtgagagttggc

SEQ ID NO: 312545 - DNA, 20 bp, human
ggcacagaaaggcccgtcca

SEQ ID NO: 312546 - DNA, 20 bp, human
gtggccctgcgccctgtcat

SEQ ID NO: 312547 - DNA, 20 bp, human
gcggctctcggccaatgaca

SEQ ID NO: 312548 - DNA, 20 bp, human
gggggcccgctgccgtaaaa

SEQ ID NO: 312549 - DNA, 20 bp, human
gcgcccccgtgcgccaccga

SEQ ID NO: 312550 - DNA, 20 bp, human
gtcggccaatgacagggcgc

SEQ ID NO: 312551 - DNA, 20 bp, human
gcgctgccgtaaaacggctg

SEQ ID NO: 312552 - DNA, 20 bp, human
gcagtccgcgccaccatctc

SEQ ID NO: 312553 - DNA, 20 bp, human
ggatggtggcgcggactggc

SEQ ID NO: 312554 - DNA, 20 bp, human
ggacacccggccacgcctta

SEQ ID NO: 312555 - DNA, 20 bp, human
gcccagccccagccgtttta

SEQ ID NO: 312556 - DNA, 20 bp, human
gcctcggggcgggccaatca

SEQ ID NO: 312557 - DNA, 20 bp, human
gcggggcgggccaatcatgg

SEQ ID NO: 312558 - DNA, 20 bp, human
ggcgcagcgcagacttggtg

SEQ ID NO: 312559 - DNA, 20 bp, human
gccgagctgcccgccatgat

SEQ ID NO: 312560 - DNA, 20 bp, human
gttctccaacatggcctcga

SEQ ID NO: 312561 - DNA, 20 bp, human
ggcagggcgcagcgcagact

SEQ ID NO: 312562 - DNA, 20 bp, human
gttggcccgccccgaggcgc

SEQ ID NO: 312563 - DNA, 20 bp, human
ggctggcagcgcgcttgcgc

SEQ ID NO: 312564 - DNA, 20 bp, human
gcatgccctcgaggccatgt

SEQ ID NO: 312565 - DNA, 20 bp, human
gcgccccgcgaaggttgagg

SEQ ID NO: 312566 - DNA, 20 bp, human
gaaaggcaggggtgtaaatc

SEQ ID NO: 312567 - DNA, 20 bp, human
ggaagcgtcaacaaaggcgt

SEQ ID NO: 312568 - DNA, 20 bp, human
gcacgcgcaacgaaagtcaa

SEQ ID NO: 312569 - DNA, 20 bp, human
ggtgggaggtctaaccgcgc

SEQ ID NO: 312570 - DNA, 20 bp, human
ggggtagcgtcagaaagagc

SEQ ID NO: 312571 - DNA, 20 bp, human
gtacgccactagagtgaggg

SEQ ID NO: 312572 - DNA, 20 bp, human
gggcgggccagcttcgccgc

SEQ ID NO: 312573 - DNA, 20 bp, human
ggtcagaaagagcggggcac

SEQ ID NO: 312574 - DNA, 20 bp, human
ggcgcaacgaaagtcaatgg

SEQ ID NO: 312575 - DNA, 20 bp, human
ggccgcgggaaaagaacggg

SEQ ID NO: 312576 - DNA, 20 bp, human
gcgacctggggtgtgggtag

SEQ ID NO: 312577 - DNA, 20 bp, human
ggccgctcgacctggggtgt

SEQ ID NO: 312578 - DNA, 20 bp, human
gtcctgggccgctcgacctg

SEQ ID NO: 312579 - DNA, 20 bp, human
gccgccgccccgccggtcgc

SEQ ID NO: 312580 - DNA, 20 bp, human
gccgccggtcgcaggcgtca

SEQ ID NO: 312581 - DNA, 20 bp, human
gacccacaccccaggtcgag

SEQ ID NO: 312582 - DNA, 20 bp, human
gcaagtgcggcgcgcgctgg

SEQ ID NO: 312583 - DNA, 20 bp, human
ggcgcgccttggccaatcag

SEQ ID NO: 312584 - DNA, 20 bp, human
gctcggccgcgtcccctgat

SEQ ID NO: 312585 - DNA, 20 bp, human
gcctccgcggcagccccggt

SEQ ID NO: 312586 - DNA, 20 bp, human
gtggggaaacgagagttggt

SEQ ID NO: 312587 - DNA, 20 bp, human
gtcccaagagacagcagtca

SEQ ID NO: 312588 - DNA, 20 bp, human
gggaggaagcagtagggtgt

SEQ ID NO: 312589 - DNA, 20 bp, human
gaaaatggggaaacgagagt

SEQ ID NO: 312590 - DNA, 20 bp, human
gacacccctacatgcctaac

SEQ ID NO: 312591 - DNA, 20 bp, human
gctacctgttaggcatgtag

SEQ ID NO: 312592 - DNA, 20 bp, human
gcccaaagacagaattgcta

SEQ ID NO: 312593 - DNA, 20 bp, human
gagcagtagggtgtggggtc

SEQ ID NO: 312594 - DNA, 20 bp, human
gagcttgctggccgctgtgt

SEQ ID NO: 312595 - DNA, 20 bp, human
gcagggtgtttcagtaaggg

SEQ ID NO: 312596 - DNA, 20 bp, human
gggcgccggggcacagtgcg

SEQ ID NO: 312597 - DNA, 20 bp, human
gccgcatcgggcccgggaat

SEQ ID NO: 312598 - DNA, 20 bp, human
gacggaagccgggagaaggg

SEQ ID NO: 312599 - DNA, 20 bp, human
gggcagtgagcgccgggaac

SEQ ID NO: 312600 - DNA, 20 bp, human
gtcgggcccgggaatcggtc

SEQ ID NO: 312601 - DNA, 20 bp, human
gccctggccggggttgtcac

SEQ ID NO: 312602 - DNA, 20 bp, human
gcgcctcgcaggcaccgcat

SEQ ID NO: 312603 - DNA, 20 bp, human
ggggacggaagccgggagaa

SEQ ID NO: 312604 - DNA, 20 bp, human
ggcggacagctcattgggag

SEQ ID NO: 312605 - DNA, 20 bp, human
gggaatcggtccggacctgg

SEQ ID NO: 312606 - DNA, 20 bp, human
gagcgctttcgcaggagggt

SEQ ID NO: 312607 - DNA, 20 bp, human
gacgtcaagactagccacgg

SEQ ID NO: 312608 - DNA, 20 bp, human
gctgtggaacgcgcccccgg

SEQ ID NO: 312609 - DNA, 20 bp, human
ggagccgcccggaaaccgcg

SEQ ID NO: 312610 - DNA, 20 bp, human
gaatgccgtaggtgaatacc

SEQ ID NO: 312611 - DNA, 20 bp, human
gttccgcggcgcacaggttc

SEQ ID NO: 312612 - DNA, 20 bp, human
gttgccgcgcggtttccggg

SEQ ID NO: 312613 - DNA, 20 bp, human
ggcgcgtctctcaacctccg

SEQ ID NO: 312614 - DNA, 20 bp, human
gacagggagcgtgggaacgg

SEQ ID NO: 312615 - DNA, 20 bp, human
gaaggtcaggggcgtggcga

SEQ ID NO: 312616 - DNA, 20 bp, human
gcgcccgcgcgcaagacaca

SEQ ID NO: 312617 - DNA, 20 bp, human
ggggcgctctgctgactgag

SEQ ID NO: 312618 - DNA, 20 bp, human
gcgcgggcgcggccactcag

SEQ ID NO: 312619 - DNA, 20 bp, human
gcgcgcgcaagacacagggg

SEQ ID NO: 312620 - DNA, 20 bp, human
gagaggctcgggtaagctcg

SEQ ID NO: 312621 - DNA, 20 bp, human
ggcgggcgcggggatgagcg

SEQ ID NO: 312622 - DNA, 20 bp, human
ggggcggcgcgcactacgcg

SEQ ID NO: 312623 - DNA, 20 bp, human
ggtcccgggaaggcgacccg

SEQ ID NO: 312624 - DNA, 20 bp, human
gagggaggatgggcctccga

SEQ ID NO: 312625 - DNA, 20 bp, human
ggggtaagctcgcggggtgg

SEQ ID NO: 312626 - DNA, 20 bp, human
gaagcctcaggtgcggacgt

SEQ ID NO: 312627 - DNA, 20 bp, human
gacgtcggtagggccagagc

SEQ ID NO: 312628 - DNA, 20 bp, human
gtctgtagctgtggcggaaa

SEQ ID NO: 312629 - DNA, 20 bp, human
ggagcccgcgggacgcaggt

SEQ ID NO: 312630 - DNA, 20 bp, human
gcccaagcgctcttccgcct

SEQ ID NO: 312631 - DNA, 20 bp, human
ggagtggcgcgacgctgggg

SEQ ID NO: 312632 - DNA, 20 bp, human
gctgtggcggaaaaggtcaa

SEQ ID NO: 312633 - DNA, 20 bp, human
gcccgcgggacgcaggtggg

SEQ ID NO: 312634 - DNA, 20 bp, human
gccagcgtcgcgccactcgg

SEQ ID NO: 312635 - DNA, 20 bp, human
gtggggcggagggcgtccca

SEQ ID NO: 312636 - DNA, 20 bp, human
gtgactcagcaaacaggtct

SEQ ID NO: 312637 - DNA, 20 bp, human
ggtgagggcaagtgtgagtc

SEQ ID NO: 312638 - DNA, 20 bp, human
gtagcatacgatttcagctt

SEQ ID NO: 312639 - DNA, 20 bp, human
gaaacaggtcttggcggtga

SEQ ID NO: 312640 - DNA, 20 bp, human
gtttgctgagtcagagatag

SEQ ID NO: 312641 - DNA, 20 bp, human
gaagaagttgagattctgct

SEQ ID NO: 312642 - DNA, 20 bp, human
gagtcctttcactcccactt

SEQ ID NO: 312643 - DNA, 20 bp, human
ggagtgaaaggactcaggta

SEQ ID NO: 312644 - DNA, 20 bp, human
ggcattggtaactactttgt

SEQ ID NO: 312645 - DNA, 20 bp, human
gtttctaagaccctggatcc

SEQ ID NO: 312646 - DNA, 20 bp, human
gaaccccgggggagtgacaa

SEQ ID NO: 312647 - DNA, 20 bp, human
ggagagacatccaaccccgg

SEQ ID NO: 312648 - DNA, 20 bp, human
gtggacgcgcgcgccatgcg

SEQ ID NO: 312649 - DNA, 20 bp, human
gggagccagccgctgccacg

SEQ ID NO: 312650 - DNA, 20 bp, human
ggcccccttgtcactccccc

SEQ ID NO: 312651 - DNA, 20 bp, human
gcgcgcgctccctcgggtaa

SEQ ID NO: 312652 - DNA, 20 bp, human
gacggcgcgtgcgcagatca

SEQ ID NO: 312653 - DNA, 20 bp, human
gtggttggagctgcgcgagg

SEQ ID NO: 312654 - DNA, 20 bp, human
gagaaaccgcgatcggagta

SEQ ID NO: 312655 - DNA, 20 bp, human
gccggcgtctctccagtgat

SEQ ID NO: 312656 - DNA, 20 bp, human
gccggggcacccgtgcccag

SEQ ID NO: 312657 - DNA, 20 bp, human
gggcttacggccgcgatctt

SEQ ID NO: 312658 - DNA, 20 bp, human
ggccgtaagcctctgggcac

SEQ ID NO: 312659 - DNA, 20 bp, human
gagcgttccgccaggccccg

SEQ ID NO: 312660 - DNA, 20 bp, human
gacccgtgcccagaggctta

SEQ ID NO: 312661 - DNA, 20 bp, human
ggatcgcggccgtaagcctc

SEQ ID NO: 312662 - DNA, 20 bp, human
gagtaccacggactgttcta

SEQ ID NO: 312663 - DNA, 20 bp, human
gggactgtgccgggcgtgtt

SEQ ID NO: 312664 - DNA, 20 bp, human
gcagagcaaggcgggaatgt

SEQ ID NO: 312665 - DNA, 20 bp, human
gtcaaggccacaaaaagtaa

SEQ ID NO: 312666 - DNA, 20 bp, human
ggggcccatccagaccacac

SEQ ID NO: 312667 - DNA, 20 bp, human
gggccccagtgtggtctgga

SEQ ID NO: 312668 - DNA, 20 bp, human
ggtctggatgggccccagag

SEQ ID NO: 312669 - DNA, 20 bp, human
gccctggccccagtgtggtc

SEQ ID NO: 312670 - DNA, 20 bp, human
gacgtggggctgtatctgac

SEQ ID NO: 312671 - DNA, 20 bp, human
gtaaggcaggcacacagtgg

SEQ ID NO: 312672 - DNA, 20 bp, human
gacacaggccttttggtgtg

SEQ ID NO: 312673 - DNA, 20 bp, human
gctgaagggaggatgggcta

SEQ ID NO: 312674 - DNA, 20 bp, human
gccatctccctcacaccaaa

SEQ ID NO: 312675 - DNA, 20 bp, human
gctggcctgggaggggattg

SEQ ID NO: 312676 - DNA, 20 bp, human
ggccacccgccgccactggg

SEQ ID NO: 312677 - DNA, 20 bp, human
gcgcccgaggaggcaagctg

SEQ ID NO: 312678 - DNA, 20 bp, human
gagtctgtcggtcagaccaa

SEQ ID NO: 312679 - DNA, 20 bp, human
ggcaagcggcgaactccgtg

SEQ ID NO: 312680 - DNA, 20 bp, human
gagaccaagggcactcagac

SEQ ID NO: 312681 - DNA, 20 bp, human
ggggccagcttctagtctgt

SEQ ID NO: 312682 - DNA, 20 bp, human
gtctcagatggcatcggtcc

SEQ ID NO: 312683 - DNA, 20 bp, human
ggacttggcgagagactcag

SEQ ID NO: 312684 - DNA, 20 bp, human
gcacccagaccgaatctcgg

SEQ ID NO: 312685 - DNA, 20 bp, human
ggccctgaggagagcaatta

SEQ ID NO: 312686 - DNA, 20 bp, human
gcccacgcgggagagagatc

SEQ ID NO: 312687 - DNA, 20 bp, human
ggggaacattcgggaaactg

SEQ ID NO: 312688 - DNA, 20 bp, human
gtggccgtcgccggggtcgg

SEQ ID NO: 312689 - DNA, 20 bp, human
ggggctcggcgcgctggggt

SEQ ID NO: 312690 - DNA, 20 bp, human
gcgggaaactgaggcgtgac

SEQ ID NO: 312691 - DNA, 20 bp, human
ggcgtgacggggtgttgacc

SEQ ID NO: 312692 - DNA, 20 bp, human
gggaagggctcggcgcgctg

SEQ ID NO: 312693 - DNA, 20 bp, human
gatcgggaactcagccctct

SEQ ID NO: 312694 - DNA, 20 bp, human
gggcctcggggatgcccacg

SEQ ID NO: 312695 - DNA, 20 bp, human
gtcagccctctgggaacatt

SEQ ID NO: 312696 - DNA, 20 bp, human
ggcccctgaaatggggggaa

SEQ ID NO: 312697 - DNA, 20 bp, human
gacagaggggcccctgaaat

SEQ ID NO: 312698 - DNA, 20 bp, human
gaggtggggtccttggaagc

SEQ ID NO: 312699 - DNA, 20 bp, human
gaggtggggctgaggtacaa

SEQ ID NO: 312700 - DNA, 20 bp, human
gtgtaccttccaaccccagt

SEQ ID NO: 312701 - DNA, 20 bp, human
ggatgacagcagctggcaag

SEQ ID NO: 312702 - DNA, 20 bp, human
gaatatcaggtgagctgtgg

SEQ ID NO: 312703 - DNA, 20 bp, human
ggaggggcccctgaaatggg

SEQ ID NO: 312704 - DNA, 20 bp, human
gaagaggagctgacaatatc

SEQ ID NO: 312705 - DNA, 20 bp, human
gttggaaggtacacacagag

SEQ ID NO: 312706 - DNA, 20 bp, human
gaggaagtcgtagctgtagg

SEQ ID NO: 312707 - DNA, 20 bp, human
gtccgagaagcggcccttaa

SEQ ID NO: 312708 - DNA, 20 bp, human
gctccctgcgctccgagaag

SEQ ID NO: 312709 - DNA, 20 bp, human
ggtgccctggccaaattcgt

SEQ ID NO: 312710 - DNA, 20 bp, human
ggggcgtgggagacttccat

SEQ ID NO: 312711 - DNA, 20 bp, human
gacttccatgggcggagcga

SEQ ID NO: 312712 - DNA, 20 bp, human
gacttcctcaggccctttaa

SEQ ID NO: 312713 - DNA, 20 bp, human
gcctcccggcgcaccgcctg

SEQ ID NO: 312714 - DNA, 20 bp, human
gtgcggggctgcggagaagg

SEQ ID NO: 312715 - DNA, 20 bp, human
gcgcagggagccgcggagtc

SEQ ID NO: 312716 - DNA, 20 bp, human
gctcccaaggatcccttaaa

SEQ ID NO: 312717 - DNA, 20 bp, human
ggcccctttaagggatcctt

SEQ ID NO: 312718 - DNA, 20 bp, human
ggggcggaggtccggaggag

SEQ ID NO: 312719 - DNA, 20 bp, human
gagtacccgctggtgcccct

SEQ ID NO: 312720 - DNA, 20 bp, human
gagtcccactgggaagggtt

SEQ ID NO: 312721 - DNA, 20 bp, human
gggtctaagccaagatgggt

SEQ ID NO: 312722 - DNA, 20 bp, human
gtaaaagtgcctaatgagac

SEQ ID NO: 312723 - DNA, 20 bp, human
gtggtgcccctcggctccca

SEQ ID NO: 312724 - DNA, 20 bp, human
gcggcaaggcctctccgcga

SEQ ID NO: 312725 - DNA, 20 bp, human
gccactgggaagggttaggg

SEQ ID NO: 312726 - DNA, 20 bp, human
gcgcgggcggaagggaagtc

SEQ ID NO: 312727 - DNA, 20 bp, human
gcgggccgggctccgctagc

SEQ ID NO: 312728 - DNA, 20 bp, human
gggacacaggcaggggactc

SEQ ID NO: 312729 - DNA, 20 bp, human
gggaggccgccctccgcgtc

SEQ ID NO: 312730 - DNA, 20 bp, human
gggtgcggcggtgccagacg

SEQ ID NO: 312731 - DNA, 20 bp, human
ggcgggagcgggtacgacgc

SEQ ID NO: 312732 - DNA, 20 bp, human
gctggcaccgccgcaccctc

SEQ ID NO: 312733 - DNA, 20 bp, human
gtccacccctccactcgcgg

SEQ ID NO: 312734 - DNA, 20 bp, human
gtggctgtgtgccagggtgc

SEQ ID NO: 312735 - DNA, 20 bp, human
gcgggtacgacgccggctag

SEQ ID NO: 312736 - DNA, 20 bp, human
ggatgtgcagagattttatc

SEQ ID NO: 312737 - DNA, 20 bp, human
gaggctgggttaggcatctg

SEQ ID NO: 312738 - DNA, 20 bp, human
ggggagcagtgaggtgactt

SEQ ID NO: 312739 - DNA, 20 bp, human
gactgcagggagtgctcagt

SEQ ID NO: 312740 - DNA, 20 bp, human
gaacaagcatagtaagggta

SEQ ID NO: 312741 - DNA, 20 bp, human
gaataaggttagtaggttat

SEQ ID NO: 312742 - DNA, 20 bp, human
gatacatcttctggtaactg

SEQ ID NO: 312743 - DNA, 20 bp, human
gtcagaacagtggcttggga

SEQ ID NO: 312744 - DNA, 20 bp, human
ggaagccagctatttttgta

SEQ ID NO: 312745 - DNA, 20 bp, human
gagtgctttctgtctcagat

SEQ ID NO: 312746 - DNA, 20 bp, human
gcactgcgccagagtcccgg

SEQ ID NO: 312747 - DNA, 20 bp, human
gagaccgcgcacgcgccccc

SEQ ID NO: 312748 - DNA, 20 bp, human
gcgcgccagcctctcacggg

SEQ ID NO: 312749 - DNA, 20 bp, human
ggggcgcgtgcgcggtctcg

SEQ ID NO: 312750 - DNA, 20 bp, human
gagcctctcacgggcggggt

SEQ ID NO: 312751 - DNA, 20 bp, human
ggcggggactaaggattctg

SEQ ID NO: 312752 - DNA, 20 bp, human
ggcccactgcgccagagtcc

SEQ ID NO: 312753 - DNA, 20 bp, human
gggagagagcgcccgctcat

SEQ ID NO: 312754 - DNA, 20 bp, human
gtcacgggcggggtgggact

SEQ ID NO: 312755 - DNA, 20 bp, human
gacggaggaggcaggcggtg

SEQ ID NO: 312756 - DNA, 20 bp, human
ggcggggcccggctttccgg

SEQ ID NO: 312757 - DNA, 20 bp, human
gtgggcgctcagaagctggg

SEQ ID NO: 312758 - DNA, 20 bp, human
gggctgggagcgcgcccaag

SEQ ID NO: 312759 - DNA, 20 bp, human
ggcgcccagccgcggcggga

SEQ ID NO: 312760 - DNA, 20 bp, human
gtcgcgcgtgcgccggacgt

SEQ ID NO: 312761 - DNA, 20 bp, human
gggggcagagtggggagcga

SEQ ID NO: 312762 - DNA, 20 bp, human
gcgcagagcgcagtcagtct

SEQ ID NO: 312763 - DNA, 20 bp, human
gcggcccaggagacccggcg

SEQ ID NO: 312764 - DNA, 20 bp, human
gcccggccggctcgcttcag

SEQ ID NO: 312765 - DNA, 20 bp, human
gctgggagggggctccacct

SEQ ID NO: 312766 - DNA, 20 bp, human
gcaccgcccgcgggtaagag

SEQ ID NO: 312767 - DNA, 20 bp, human
ggtcccgcccctccgagggt

SEQ ID NO: 312768 - DNA, 20 bp, human
gggcaggggtggaacttgcg

SEQ ID NO: 312769 - DNA, 20 bp, human
ggataggctgcgaaggcgat

SEQ ID NO: 312770 - DNA, 20 bp, human
ggggcgggaccgcggttgga

SEQ ID NO: 312771 - DNA, 20 bp, human
gcgcggtcccgcccctccga

SEQ ID NO: 312772 - DNA, 20 bp, human
gtgcggggactgcgggtatg

SEQ ID NO: 312773 - DNA, 20 bp, human
gagcaggcccctcttacccg

SEQ ID NO: 312774 - DNA, 20 bp, human
gacctgggagtgggaaccaa

SEQ ID NO: 312775 - DNA, 20 bp, human
gaccaatgagggagttctgc

SEQ ID NO: 312776 - DNA, 20 bp, human
gcctgccaggcacttcgcgg

SEQ ID NO: 312777 - DNA, 20 bp, human
gcggaagcgggtcgtctgaa

SEQ ID NO: 312778 - DNA, 20 bp, human
ggtcgtctgaaggggcccgg

SEQ ID NO: 312779 - DNA, 20 bp, human
gcaaaccggccgtgggactc

SEQ ID NO: 312780 - DNA, 20 bp, human
gcgccccggcgacctcaggc

SEQ ID NO: 312781 - DNA, 20 bp, human
ggcccggcgccggagtccca

SEQ ID NO: 312782 - DNA, 20 bp, human
gggcgccggagtcccacggc

SEQ ID NO: 312783 - DNA, 20 bp, human
gtgtccgctctggggatcac

SEQ ID NO: 312784 - DNA, 20 bp, human
gaagcggctccgggaagact

SEQ ID NO: 312785 - DNA, 20 bp, human
gcggcctgtgatccccagag

SEQ ID NO: 312786 - DNA, 20 bp, human
ggccccacgaaggaggagtc

SEQ ID NO: 312787 - DNA, 20 bp, human
gccggcgggtggcggcgcaa

SEQ ID NO: 312788 - DNA, 20 bp, human
gtcctccttcgtggggcggg

SEQ ID NO: 312789 - DNA, 20 bp, human
ggcgaggctccgagcctcct

SEQ ID NO: 312790 - DNA, 20 bp, human
gccgcgctgcggaaaaggga

SEQ ID NO: 312791 - DNA, 20 bp, human
ggccccccgccccacgaagg

SEQ ID NO: 312792 - DNA, 20 bp, human
gagccagactcctccttcgt

SEQ ID NO: 312793 - DNA, 20 bp, human
ggccgggaggggcgcgctcg

SEQ ID NO: 312794 - DNA, 20 bp, human
gcgggtggcggcgcaagggc

SEQ ID NO: 312795 - DNA, 20 bp, human
gggggcccgcgctgcggaaa

SEQ ID NO: 312796 - DNA, 20 bp, human
ggggcttcggggcaccggtg

SEQ ID NO: 312797 - DNA, 20 bp, human
gtgggcagggactgcgggag

SEQ ID NO: 312798 - DNA, 20 bp, human
ggaagccccagggtttcgag

SEQ ID NO: 312799 - DNA, 20 bp, human
gccggtgccccgaagcccca

SEQ ID NO: 312800 - DNA, 20 bp, human
gtcctcctctcgaaaccctg

SEQ ID NO: 312801 - DNA, 20 bp, human
gagcgagcggtgcagtgaca

SEQ ID NO: 312802 - DNA, 20 bp, human
gaggagagggagcgagggcg

SEQ ID NO: 312803 - DNA, 20 bp, human
gtggtgctcccgggtcaagc

SEQ ID NO: 312804 - DNA, 20 bp, human
gccaggaagcagggcggccg

SEQ ID NO: 312805 - DNA, 20 bp, human
ggcaccgctcgctctccctc

SEQ ID NO: 312806 - DNA, 20 bp, human
ggggccgcgcccgacgcgat

SEQ ID NO: 312807 - DNA, 20 bp, human
gggcatgggacgttcaggtt

SEQ ID NO: 312808 - DNA, 20 bp, human
gggccaatggcagtcggggg

SEQ ID NO: 312809 - DNA, 20 bp, human
gccaaccccattggccggtg

SEQ ID NO: 312810 - DNA, 20 bp, human
ggcagccccaccggccaatg

SEQ ID NO: 312811 - DNA, 20 bp, human
gagcgcaaggtaagttgtgc

SEQ ID NO: 312812 - DNA, 20 bp, human
gtctgggccaatggcagtcg

SEQ ID NO: 312813 - DNA, 20 bp, human
gggaaggcggagccgacctc

SEQ ID NO: 312814 - DNA, 20 bp, human
ggagagcgcgccaaccccat

SEQ ID NO: 312815 - DNA, 20 bp, human
ggcgccggcatgggacgttc

SEQ ID NO: 312816 - DNA, 20 bp, human
ggggacccgcgggggtctga

SEQ ID NO: 312817 - DNA, 20 bp, human
gcggagcgggcgtaccccca

SEQ ID NO: 312818 - DNA, 20 bp, human
gcgtccccctcagacccccg

SEQ ID NO: 312819 - DNA, 20 bp, human
gagacccccgcgggtcccgg

SEQ ID NO: 312820 - DNA, 20 bp, human
ggcccggccagtggaaggcg

SEQ ID NO: 312821 - DNA, 20 bp, human
gccacggcccggccagtgga

SEQ ID NO: 312822 - DNA, 20 bp, human
gggaacccctgatccaccta

SEQ ID NO: 312823 - DNA, 20 bp, human
gcaacctgcagcggaccaaa

SEQ ID NO: 312824 - DNA, 20 bp, human
gcccgcgccttccactggcc

SEQ ID NO: 312825 - DNA, 20 bp, human
gcgtccggggcgagtgagtg

SEQ ID NO: 312826 - DNA, 20 bp, human
ggggtctctcacagagtggg

SEQ ID NO: 312827 - DNA, 20 bp, human
ggggtctcgcgcggagagaa

SEQ ID NO: 312828 - DNA, 20 bp, human
ggaggcagagggtcgaactt

SEQ ID NO: 312829 - DNA, 20 bp, human
gcgaaggacgctgggaggaa

SEQ ID NO: 312830 - DNA, 20 bp, human
ggtgagtggcgggtgatctg

SEQ ID NO: 312831 - DNA, 20 bp, human
gtaatccgaaggacgctggg

SEQ ID NO: 312832 - DNA, 20 bp, human
gatggccagttatgcgggga

SEQ ID NO: 312833 - DNA, 20 bp, human
ggggtccggcacagtccagc

SEQ ID NO: 312834 - DNA, 20 bp, human
gacccgggcctctctcaatc

SEQ ID NO: 312835 - DNA, 20 bp, human
ggaaggggcgggacttgtgg

SEQ ID NO: 312836 - DNA, 20 bp, human
ggacacaaaataccgagaac

SEQ ID NO: 312837 - DNA, 20 bp, human
gtcgctccggagcttctgga

SEQ ID NO: 312838 - DNA, 20 bp, human
ggtgggtcgctcaatcgctc

SEQ ID NO: 312839 - DNA, 20 bp, human
gggaggcccggacccggtgc

SEQ ID NO: 312840 - DNA, 20 bp, human
gggtcggcgtcttcctgcac

SEQ ID NO: 312841 - DNA, 20 bp, human
ggagccgtaaagcagcacgt

SEQ ID NO: 312842 - DNA, 20 bp, human
gcaggaagacgccgaccacg

SEQ ID NO: 312843 - DNA, 20 bp, human
ggtcttcctgcaccgggtcc

SEQ ID NO: 312844 - DNA, 20 bp, human
gccaccaacgtgctgcttta

SEQ ID NO: 312845 - DNA, 20 bp, human
gtaaaaaaagggggtgcatt

SEQ ID NO: 312846 - DNA, 20 bp, human
gtgggcgtgtcggtaggacg

SEQ ID NO: 312847 - DNA, 20 bp, human
gaagctcgggaggtcgttgg

SEQ ID NO: 312848 - DNA, 20 bp, human
gcataggctggcacagaaag

SEQ ID NO: 312849 - DNA, 20 bp, human
gcgggcaatgtggctccccg

SEQ ID NO: 312850 - DNA, 20 bp, human
gggctgcgacggtttcccat

SEQ ID NO: 312851 - DNA, 20 bp, human
gcgacgcgttcaccaatcgc

SEQ ID NO: 312852 - DNA, 20 bp, human
gagagtgcaacgttaccaat

SEQ ID NO: 312853 - DNA, 20 bp, human
gggtgaacgcgtcgcggctc

SEQ ID NO: 312854 - DNA, 20 bp, human
ggtgaagctcgggaggtcgt

SEQ ID NO: 312855 - DNA, 20 bp, human
gccgtcctgggcgtgtcggt

SEQ ID NO: 312856 - DNA, 20 bp, human
ggggcattgtatagtctggg

SEQ ID NO: 312857 - DNA, 20 bp, human
gccaggctgcaattggttac

SEQ ID NO: 312858 - DNA, 20 bp, human
gaagccctctgtgtatgggg

SEQ ID NO: 312859 - DNA, 20 bp, human
gggcatgtgcagttgagagg

SEQ ID NO: 312860 - DNA, 20 bp, human
gctagggccccagcatgagg

SEQ ID NO: 312861 - DNA, 20 bp, human
ggaaggggcattgtatagtc

SEQ ID NO: 312862 - DNA, 20 bp, human
gaggacagccccctcatgct

SEQ ID NO: 312863 - DNA, 20 bp, human
gcacaaagccctctgtgtat

SEQ ID NO: 312864 - DNA, 20 bp, human
gtgtgcagttgagaggtggt

SEQ ID NO: 312865 - DNA, 20 bp, human
ggccctaggggattttaagc

SEQ ID NO: 312866 - DNA, 20 bp, human
gcagaggaggctcaggtaag

SEQ ID NO: 312867 - DNA, 20 bp, human
gtgggcggagactactccag

SEQ ID NO: 312868 - DNA, 20 bp, human
gtacctgagcctcctctgca

SEQ ID NO: 312869 - DNA, 20 bp, human
gtacctagttggcactagga

SEQ ID NO: 312870 - DNA, 20 bp, human
gttctgggagctgtgatcgg

SEQ ID NO: 312871 - DNA, 20 bp, human
gactactccagtgggtggga

SEQ ID NO: 312872 - DNA, 20 bp, human
ggtagtctccgcccagatgg

SEQ ID NO: 312873 - DNA, 20 bp, human
gtcggtactgctggctacgc

SEQ ID NO: 312874 - DNA, 20 bp, human
gggagtagtctccgcccaga

SEQ ID NO: 312875 - DNA, 20 bp, human
gcggagactactccagtggg

SEQ ID NO: 312876 - DNA, 20 bp, human
gcggggccgaggcgcctggg

SEQ ID NO: 312877 - DNA, 20 bp, human
gggaaggctcggctcggcct

SEQ ID NO: 312878 - DNA, 20 bp, human
ggcagacccggcctccgcgc

SEQ ID NO: 312879 - DNA, 20 bp, human
ggcggaggccgggtctgcag

SEQ ID NO: 312880 - DNA, 20 bp, human
gccgggtctgcagcggtccc

SEQ ID NO: 312881 - DNA, 20 bp, human
gcggtcccacccaggcgcct

SEQ ID NO: 312882 - DNA, 20 bp, human
gagacaatgaagaggaccac

SEQ ID NO: 312883 - DNA, 20 bp, human
ggcctgcccgcaccctttta

SEQ ID NO: 312884 - DNA, 20 bp, human
ggccctcgctgtccgctcat

SEQ ID NO: 312885 - DNA, 20 bp, human
gcttcccggcggacggatga

SEQ ID NO: 312886 - DNA, 20 bp, human
gcccagggccacattcactt

SEQ ID NO: 312887 - DNA, 20 bp, human
gaaatgtcccagactgttat

SEQ ID NO: 312888 - DNA, 20 bp, human
gcatgagcacgtctgcacaa

SEQ ID NO: 312889 - DNA, 20 bp, human
gggccaaacccataacagtc

SEQ ID NO: 312890 - DNA, 20 bp, human
gtggcctcggaaacagccag

SEQ ID NO: 312891 - DNA, 20 bp, human
gtgctcgttcgtgtagaggg

SEQ ID NO: 312892 - DNA, 20 bp, human
gtcccagactgttatgggtt

SEQ ID NO: 312893 - DNA, 20 bp, human
gagtctgggacatttcagac

SEQ ID NO: 312894 - DNA, 20 bp, human
gaattccttaggaccctctg

SEQ ID NO: 312895 - DNA, 20 bp, human
gcctcctctggctgtttccg

SEQ ID NO: 312896 - DNA, 20 bp, human
gcgaagttaccataggaacc

SEQ ID NO: 312897 - DNA, 20 bp, human
ggaagtgacgtcagagcagg

SEQ ID NO: 312898 - DNA, 20 bp, human
gggcgatccgaagttaccat

SEQ ID NO: 312899 - DNA, 20 bp, human
ggaaagaagccaggttccta

SEQ ID NO: 312900 - DNA, 20 bp, human
ggtaacgacacaggtaacac

SEQ ID NO: 312901 - DNA, 20 bp, human
gggccgagagacaacttaaa

SEQ ID NO: 312902 - DNA, 20 bp, human
gttaccgggagctgtaaaca

SEQ ID NO: 312903 - DNA, 20 bp, human
gcagctcccggtaacgacac

SEQ ID NO: 312904 - DNA, 20 bp, human
gctgaaagttaataaatctc

SEQ ID NO: 312905 - DNA, 20 bp, human
gcgtctcgagatttagttga

SEQ ID NO: 312906 - DNA, 20 bp, human
gaaagcatgaacaccttctt

SEQ ID NO: 312907 - DNA, 20 bp, human
gtagccacagcttgatcttg

SEQ ID NO: 312908 - DNA, 20 bp, human
gccttctcccaataagaaca

SEQ ID NO: 312909 - DNA, 20 bp, human
ggtcccgtaatcttcaactt

SEQ ID NO: 312910 - DNA, 20 bp, human
gggcttggaactccctgctc

SEQ ID NO: 312911 - DNA, 20 bp, human
gtcaccaagaggttctcaga

SEQ ID NO: 312912 - DNA, 20 bp, human
ggacctaagttgaagattac

SEQ ID NO: 312913 - DNA, 20 bp, human
gaacctcttggtgacacaca

SEQ ID NO: 312914 - DNA, 20 bp, human
gctgcccatggtcaaatagt

SEQ ID NO: 312915 - DNA, 20 bp, human
gctgtggctacactgtcata

SEQ ID NO: 312916 - DNA, 20 bp, human
ggggaagctctgctggatgc

SEQ ID NO: 312917 - DNA, 20 bp, human
ggctggaagaaaggtcaggg

SEQ ID NO: 312918 - DNA, 20 bp, human
gttggctggaagaaaggtca

SEQ ID NO: 312919 - DNA, 20 bp, human
gcacacagagagggatccta

SEQ ID NO: 312920 - DNA, 20 bp, human
gccaaatagctctgataagt

SEQ ID NO: 312921 - DNA, 20 bp, human
gaatcgtccaagtgtgtctg

SEQ ID NO: 312922 - DNA, 20 bp, human
ggcaggagaacggctttcca

SEQ ID NO: 312923 - DNA, 20 bp, human
gagggatcctagggctgccc

SEQ ID NO: 312924 - DNA, 20 bp, human
gagctatttggctggaagaa

SEQ ID NO: 312925 - DNA, 20 bp, human
gttggagttttatcaagaag

SEQ ID NO: 312926 - DNA, 20 bp, human
ggctctgacccggactcgga

SEQ ID NO: 312927 - DNA, 20 bp, human
gccaaggcggcctcgcgctg

SEQ ID NO: 312928 - DNA, 20 bp, human
gtcggaggggcaaagtgagc

SEQ ID NO: 312929 - DNA, 20 bp, human
gcgaggccgccttggccaag

SEQ ID NO: 312930 - DNA, 20 bp, human
gtcaggctctgacccggact

SEQ ID NO: 312931 - DNA, 20 bp, human
ggggtccctcgggtcaactt

SEQ ID NO: 312932 - DNA, 20 bp, human
gttacccaaagttgacccga

SEQ ID NO: 312933 - DNA, 20 bp, human
gagtggggtatcatgaatca

SEQ ID NO: 312934 - DNA, 20 bp, human
ggggaggcggctctcgcgct

SEQ ID NO: 312935 - DNA, 20 bp, human
gggcggctctcgcgctgggg

SEQ ID NO: 312936 - DNA, 20 bp, human
gcgggtgggctggacttcgt

SEQ ID NO: 312937 - DNA, 20 bp, human
ggggcccaggggactcggcg

SEQ ID NO: 312938 - DNA, 20 bp, human
gcacccgcgccgagtcccct

SEQ ID NO: 312939 - DNA, 20 bp, human
gagggcgcgctagagcgcca

SEQ ID NO: 312940 - DNA, 20 bp, human
gccgcggcccagcacttacc

SEQ ID NO: 312941 - DNA, 20 bp, human
ggagtcccctgggcccggca

SEQ ID NO: 312942 - DNA, 20 bp, human
gcgctcggggcgcacgctgg

SEQ ID NO: 312943 - DNA, 20 bp, human
gcctgcggggagagacgctg

SEQ ID NO: 312944 - DNA, 20 bp, human
gtggcggcggaggttcgcct

SEQ ID NO: 312945 - DNA, 20 bp, human
ggagacgctggggcatgatc

SEQ ID NO: 312946 - DNA, 20 bp, human
gaggctctaagcactgaatg

SEQ ID NO: 312947 - DNA, 20 bp, human
gcactgaatgtggaaactga

SEQ ID NO: 312948 - DNA, 20 bp, human
ggagcctttcttttttttct

SEQ ID NO: 312949 - DNA, 20 bp, human
ggggagaaagggacacgtgt

SEQ ID NO: 312950 - DNA, 20 bp, human
gaagagcagacgcagaggaa

SEQ ID NO: 312951 - DNA, 20 bp, human
gctgagaagagcagacgcag

SEQ ID NO: 312952 - DNA, 20 bp, human
gctcccggcctgctcagatg

SEQ ID NO: 312953 - DNA, 20 bp, human
gacgcagaggaaggggagaa

SEQ ID NO: 312954 - DNA, 20 bp, human
gacgtgtgggagaggagtgg

SEQ ID NO: 312955 - DNA, 20 bp, human
gaaagggacacgtgtgggag

SEQ ID NO: 312956 - DNA, 20 bp, human
ggggtctggggctagagcgt

SEQ ID NO: 312957 - DNA, 20 bp, human
gtggggctagagcgtcggga

SEQ ID NO: 312958 - DNA, 20 bp, human
gggaagtgggcagcgtggga

SEQ ID NO: 312959 - DNA, 20 bp, human
gaggacacgccgggtccagg

SEQ ID NO: 312960 - DNA, 20 bp, human
gaggagggttcgaggggtag

SEQ ID NO: 312961 - DNA, 20 bp, human
gaaccggggaggagggttcg

SEQ ID NO: 312962 - DNA, 20 bp, human
gagttgtgacgcagcgtctg

SEQ ID NO: 312963 - DNA, 20 bp, human
ggcgcacgctggggtcctcc

SEQ ID NO: 312964 - DNA, 20 bp, human
ggctggggtcctcctggacc

SEQ ID NO: 312965 - DNA, 20 bp, human
gacgcagcgtctggggatcc

SEQ ID NO: 312966 - DNA, 20 bp, human
ggctaccgcacgcagtgagg

SEQ ID NO: 312967 - DNA, 20 bp, human
gcgaggccccgccctcacgc

SEQ ID NO: 312968 - DNA, 20 bp, human
gggcggggaaagtagcggcg

SEQ ID NO: 312969 - DNA, 20 bp, human
gaacaacccacctgacagaa

SEQ ID NO: 312970 - DNA, 20 bp, human
gaaaaagcgaggtccgggac

SEQ ID NO: 312971 - DNA, 20 bp, human
ggcaggctaggagacgaacc

SEQ ID NO: 312972 - DNA, 20 bp, human
gcccgccccctcactgcgtg

SEQ ID NO: 312973 - DNA, 20 bp, human
gttcgtctcctagcctgctc

SEQ ID NO: 312974 - DNA, 20 bp, human
gagccaatcctgagcaggct

SEQ ID NO: 312975 - DNA, 20 bp, human
gtagccaatgagagccgaac

SEQ ID NO: 312976 - DNA, 20 bp, human
ggccctctaagggtgaagca

SEQ ID NO: 312977 - DNA, 20 bp, human
gcacccttagagggcggtag

SEQ ID NO: 312978 - DNA, 20 bp, human
ggccccgctaccgccctcta

SEQ ID NO: 312979 - DNA, 20 bp, human
gagccacagagcacgaggtt

SEQ ID NO: 312980 - DNA, 20 bp, human
ggccctgggattttgaggac

SEQ ID NO: 312981 - DNA, 20 bp, human
gagccagtcctcaaaatccc

SEQ ID NO: 312982 - DNA, 20 bp, human
gtccctgcttcacccttaga

SEQ ID NO: 312983 - DNA, 20 bp, human
gccggtgccctgggattttg

SEQ ID NO: 312984 - DNA, 20 bp, human
gtgaaggcctgtaggggtgg

SEQ ID NO: 312985 - DNA, 20 bp, human
gatcccagggcaccggaggc

SEQ ID NO: 312986 - DNA, 20 bp, human
ggggtgacgcacagaggtaa

SEQ ID NO: 312987 - DNA, 20 bp, human
gcgcaggcacgcgcaggtac

SEQ ID NO: 312988 - DNA, 20 bp, human
gcgcgcacgtctagaaagag

SEQ ID NO: 312989 - DNA, 20 bp, human
ggaaagagaggcaccggcgg

SEQ ID NO: 312990 - DNA, 20 bp, human
gcgcgcagagcgctggttga

SEQ ID NO: 312991 - DNA, 20 bp, human
ggccgcaacgcgcagagcgc

SEQ ID NO: 312992 - DNA, 20 bp, human
gcccggctgtgtcgtgaaag

SEQ ID NO: 312993 - DNA, 20 bp, human
ggccgcacggacgcgcacgc

SEQ ID NO: 312994 - DNA, 20 bp, human
gcgcccccctgaccgtaaag

SEQ ID NO: 312995 - DNA, 20 bp, human
gaaacaggggtgacgcacag

SEQ ID NO: 312996 - DNA, 20 bp, human
gcgggcgcgtgcacgtaaag

SEQ ID NO: 312997 - DNA, 20 bp, human
gctaaattagagggcgagga

SEQ ID NO: 312998 - DNA, 20 bp, human
ggccaccgatctaaattaga

SEQ ID NO: 312999 - DNA, 20 bp, human
ggtgcacgtaaaggggcctc

SEQ ID NO: 313000 - DNA, 20 bp, human
ggccgaaggcgtgaccgtaa

SEQ ID NO: 313001 - DNA, 20 bp, human
gctcgccctctaatttagat

SEQ ID NO: 313002 - DNA, 20 bp, human
gaatttagatcggtggcggc

SEQ ID NO: 313003 - DNA, 20 bp, human
gaaagtaaaagcccgctgaa

SEQ ID NO: 313004 - DNA, 20 bp, human
gttcggcaagaccaggtagc

SEQ ID NO: 313005 - DNA, 20 bp, human
gtcgtgaaagggccgcaaaa

SEQ ID NO: 313006 - DNA, 20 bp, human
gcaggcgcagccgaggtctc

SEQ ID NO: 313007 - DNA, 20 bp, human
ggggaagggacccgagacct

SEQ ID NO: 313008 - DNA, 20 bp, human
ggcggagtccccggcgggaa

SEQ ID NO: 313009 - DNA, 20 bp, human
gctccgccgggtacgcgctc

SEQ ID NO: 313010 - DNA, 20 bp, human
gagcccgagcgcgtacccgg

SEQ ID NO: 313011 - DNA, 20 bp, human
gcgagcaaggagcccccggc

SEQ ID NO: 313012 - DNA, 20 bp, human
gcgggctcacgcgccggcgt

SEQ ID NO: 313013 - DNA, 20 bp, human
gcgggccgcggccatgggag

SEQ ID NO: 313014 - DNA, 20 bp, human
ggtgagcccgagcgcgtacc

SEQ ID NO: 313015 - DNA, 20 bp, human
gggggcgccgcaggcgacaa

SEQ ID NO: 313016 - DNA, 20 bp, human
gtgagtgagtcacaggagtg

SEQ ID NO: 313017 - DNA, 20 bp, human
ggctataaaggtgaccctgg

SEQ ID NO: 313018 - DNA, 20 bp, human
gaggttaagcctcccggtca

SEQ ID NO: 313019 - DNA, 20 bp, human
ggtagctataaaggtgaccc

SEQ ID NO: 313020 - DNA, 20 bp, human
ggtaacagaccatgaccggg

SEQ ID NO: 313021 - DNA, 20 bp, human
gaacagctttgtagctataa

SEQ ID NO: 313022 - DNA, 20 bp, human
gtctgaagctggaaattcga

SEQ ID NO: 313023 - DNA, 20 bp, human
ggtctgttacataaagaacc

SEQ ID NO: 313024 - DNA, 20 bp, human
gtatgtaacagaccatgacc

SEQ ID NO: 313025 - DNA, 20 bp, human
gggcacccaggggtcccccg

SEQ ID NO: 313026 - DNA, 20 bp, human
gctctcagccggcccctccg

SEQ ID NO: 313027 - DNA, 20 bp, human
gggcccctccgaggcacaga

SEQ ID NO: 313028 - DNA, 20 bp, human
ggtccctaaagggccctaca

SEQ ID NO: 313029 - DNA, 20 bp, human
gaggagcggggatgtgcgtg

SEQ ID NO: 313030 - DNA, 20 bp, human
ggaggggccggctgagagcc

SEQ ID NO: 313031 - DNA, 20 bp, human
ggaaagaagtggtccctaaa

SEQ ID NO: 313032 - DNA, 20 bp, human
gcggtagcccggctctcagc

SEQ ID NO: 313033 - DNA, 20 bp, human
gtactctgtgcctgcgaacg

SEQ ID NO: 313034 - DNA, 20 bp, human
gaaaccacgagatctctggg

SEQ ID NO: 313035 - DNA, 20 bp, human
gttcgcaggcacagagtaga

SEQ ID NO: 313036 - DNA, 20 bp, human
gccaacgtgacgtcaccagg

SEQ ID NO: 313037 - DNA, 20 bp, human
gcggagagatgagttcccgg

SEQ ID NO: 313038 - DNA, 20 bp, human
ggactcgggctgcagtgctc

SEQ ID NO: 313039 - DNA, 20 bp, human
gtgcccaggagagggagcac

SEQ ID NO: 313040 - DNA, 20 bp, human
ggggccaacgtgacgtcacc

SEQ ID NO: 313041 - DNA, 20 bp, human
gtgccgagcagcagaatgtg

SEQ ID NO: 313042 - DNA, 20 bp, human
gtgccccgaaatgcccactg

SEQ ID NO: 313043 - DNA, 20 bp, human
gtctggggggggctcctgag

SEQ ID NO: 313044 - DNA, 20 bp, human
ggggccaggaattgggtttg

SEQ ID NO: 313045 - DNA, 20 bp, human
gccccccccagagccccacc

SEQ ID NO: 313046 - DNA, 20 bp, human
ggcctgacctgaggtgcaga

SEQ ID NO: 313047 - DNA, 20 bp, human
gggtgcagagggctgagacc

SEQ ID NO: 313048 - DNA, 20 bp, human
gcctgccctcaggtatgggg

SEQ ID NO: 313049 - DNA, 20 bp, human
gtccctcatggatgtggtga

SEQ ID NO: 313050 - DNA, 20 bp, human
gggggcacaaaagactcctg

SEQ ID NO: 313051 - DNA, 20 bp, human
ggagaagctcccacctctgg

SEQ ID NO: 313052 - DNA, 20 bp, human
gtgcatggggaacccacgtg

SEQ ID NO: 313053 - DNA, 20 bp, human
ggaccacccttcccagcggc

SEQ ID NO: 313054 - DNA, 20 bp, human
gacaagggtctgcagacaga

SEQ ID NO: 313055 - DNA, 20 bp, human
gccagcggcgggacctcagc

SEQ ID NO: 313056 - DNA, 20 bp, human
ggggagaggcttatctctat

SEQ ID NO: 313057 - DNA, 20 bp, human
ggtggcgcagtttgagagaa

SEQ ID NO: 313058 - DNA, 20 bp, human
ggtactctattgagtctcaa

SEQ ID NO: 313059 - DNA, 20 bp, human
gggcttatctctattggata

SEQ ID NO: 313060 - DNA, 20 bp, human
gcctccagcagcaaaacgtt

SEQ ID NO: 313061 - DNA, 20 bp, human
gtggacaaatcagtggccag

SEQ ID NO: 313062 - DNA, 20 bp, human
gttgataaagtttctgatgc

SEQ ID NO: 313063 - DNA, 20 bp, human
ggaacaagatggaatgtgat

SEQ ID NO: 313064 - DNA, 20 bp, human
gtggctgctgaaggtaagac

SEQ ID NO: 313065 - DNA, 20 bp, human
gagatggaatgtgatgggag

SEQ ID NO: 313066 - DNA, 20 bp, human
gagaaaccaagataagtgat

SEQ ID NO: 313067 - DNA, 20 bp, human
gcctctgtacaggaaatcac

SEQ ID NO: 313068 - DNA, 20 bp, human
ggagtggggccggagagggt

SEQ ID NO: 313069 - DNA, 20 bp, human
gaaagctcacgtcgcttgat

SEQ ID NO: 313070 - DNA, 20 bp, human
gtgctgagaaacatctcatg

SEQ ID NO: 313071 - DNA, 20 bp, human
gcttcctggatgctcattgt

SEQ ID NO: 313072 - DNA, 20 bp, human
gtgaaaggtcaagtaagcca

SEQ ID NO: 313073 - DNA, 20 bp, human
gaggacggtgattccttgca

SEQ ID NO: 313074 - DNA, 20 bp, human
ggtgattccttgcagggagt

SEQ ID NO: 313075 - DNA, 20 bp, human
gagataagtgattggagtca

SEQ ID NO: 313076 - DNA, 20 bp, human
ggaacaagatgggacgtgat

SEQ ID NO: 313077 - DNA, 20 bp, human
gtagatcatgggaccattca

SEQ ID NO: 313078 - DNA, 20 bp, human
gagatgggacgtgataggag

SEQ ID NO: 313079 - DNA, 20 bp, human
gctagagtcccattgtccag

SEQ ID NO: 313080 - DNA, 20 bp, human
gggccattgtcagccttgaa

SEQ ID NO: 313081 - DNA, 20 bp, human
ggaccattcaaggctgacaa

SEQ ID NO: 313082 - DNA, 20 bp, human
gtgccagagaagtgtatgca

SEQ ID NO: 313083 - DNA, 20 bp, human
gcaccttgcatacacttctc

SEQ ID NO: 313084 - DNA, 20 bp, human
gcatgatctactttttcatt

SEQ ID NO: 313085 - DNA, 20 bp, human
gggcttaaatgtactggata

SEQ ID NO: 313086 - DNA, 20 bp, human
gaatgcatgcatgagactaa

SEQ ID NO: 313087 - DNA, 20 bp, human
gtgcatgagactaatggtac

SEQ ID NO: 313088 - DNA, 20 bp, human
ggaggtctgagtgtaactga

SEQ ID NO: 313089 - DNA, 20 bp, human
gtagaacacacacgtataac

SEQ ID NO: 313090 - DNA, 20 bp, human
gagtggtcaatttcaagttt

SEQ ID NO: 313091 - DNA, 20 bp, human
ggtgtgctgctcatggaaat

SEQ ID NO: 313092 - DNA, 20 bp, human
ggctcatggaaataggcact

SEQ ID NO: 313093 - DNA, 20 bp, human
gtgtacacagtgtttgggta

SEQ ID NO: 313094 - DNA, 20 bp, human
gaagatgaaagcacaatgta

SEQ ID NO: 313095 - DNA, 20 bp, human
gcatttcaaaggcacatcag

SEQ ID NO: 313096 - DNA, 20 bp, human
ggggacgcctagtggatacc

SEQ ID NO: 313097 - DNA, 20 bp, human
gggaacccgtggaatcgggt

SEQ ID NO: 313098 - DNA, 20 bp, human
ggaggcggctcactccgttc

SEQ ID NO: 313099 - DNA, 20 bp, human
ggactcctgccaagcccgaa

SEQ ID NO: 313100 - DNA, 20 bp, human
gcactccgttcgggcttggc

SEQ ID NO: 313101 - DNA, 20 bp, human
ggcatccaacccgattccac

SEQ ID NO: 313102 - DNA, 20 bp, human
gtgcgtgtctctttttccgg

SEQ ID NO: 313103 - DNA, 20 bp, human
gaggagtcgtggagtgggtt

SEQ ID NO: 313104 - DNA, 20 bp, human
gcgcgcacttgggagcgggg

SEQ ID NO: 313105 - DNA, 20 bp, human
gctcctcggaaccacaaaag

SEQ ID NO: 313106 - DNA, 20 bp, human
gtccctcaaggctagaggag

SEQ ID NO: 313107 - DNA, 20 bp, human
gccccacagcgcctccctca

SEQ ID NO: 313108 - DNA, 20 bp, human
gggaagcgagggacccacgt

SEQ ID NO: 313109 - DNA, 20 bp, human
gccagcgccgggatgtgggg

SEQ ID NO: 313110 - DNA, 20 bp, human
gtccttaaagggcccttcac

SEQ ID NO: 313111 - DNA, 20 bp, human
ggggcccttcactggtgcgt

SEQ ID NO: 313112 - DNA, 20 bp, human
gtcgaggtcccaggaggccg

SEQ ID NO: 313113 - DNA, 20 bp, human
ggccgctcctctagccttga

SEQ ID NO: 313114 - DNA, 20 bp, human
gctcccgaacccggaagcga

SEQ ID NO: 313115 - DNA, 20 bp, human
gcgctcccaggctcccacgt

SEQ ID NO: 313116 - DNA, 20 bp, human
gagggtctgtccaggataac

SEQ ID NO: 313117 - DNA, 20 bp, human
gtctgtccaggataacgggt

SEQ ID NO: 313118 - DNA, 20 bp, human
gagatggcggcatgactcaa

SEQ ID NO: 313119 - DNA, 20 bp, human
gacgggtcggcacagagtgt

SEQ ID NO: 313120 - DNA, 20 bp, human
ggcaggggagggaattgttc

SEQ ID NO: 313121 - DNA, 20 bp, human
gaaaccgacaagaatattgt

SEQ ID NO: 313122 - DNA, 20 bp, human
gccaaggcccgttccccatg

SEQ ID NO: 313123 - DNA, 20 bp, human
gtcgcggccgcatggggaac

SEQ ID NO: 313124 - DNA, 20 bp, human
ggcggcatgactcaatggac

SEQ ID NO: 313125 - DNA, 20 bp, human
gtctgcagaaagtgtcgacc

SEQ ID NO: 313126 - DNA, 20 bp, human
gaagtctacaagggtcccac

SEQ ID NO: 313127 - DNA, 20 bp, human
gggttctggctggtgagact

SEQ ID NO: 313128 - DNA, 20 bp, human
gttggagtcagaagtctaca

SEQ ID NO: 313129 - DNA, 20 bp, human
gcagaagcaatccttcccag

SEQ ID NO: 313130 - DNA, 20 bp, human
gcgggggctgcttcccttcc

SEQ ID NO: 313131 - DNA, 20 bp, human
gactaagacaaatgccttgt

SEQ ID NO: 313132 - DNA, 20 bp, human
ggtggctctttctgcagctt

SEQ ID NO: 313133 - DNA, 20 bp, human
ggacagtttgttctcctaca

SEQ ID NO: 313134 - DNA, 20 bp, human
gcttcccaggggcaccagga

SEQ ID NO: 313135 - DNA, 20 bp, human
gaatccttcccaggggcacc

SEQ ID NO: 313136 - DNA, 20 bp, human
ggaagagtgcacagggctct

SEQ ID NO: 313137 - DNA, 20 bp, human
gaagggagatggtagaagtg

SEQ ID NO: 313138 - DNA, 20 bp, human
ggaagtacaggggcctgttt

SEQ ID NO: 313139 - DNA, 20 bp, human
gacaggggcctgtttgggaa

SEQ ID NO: 313140 - DNA, 20 bp, human
ggtgcactcttcaaagacct

SEQ ID NO: 313141 - DNA, 20 bp, human
gagtcatgtgagccctgggt

SEQ ID NO: 313142 - DNA, 20 bp, human
ggtggtcaggacagttggag

SEQ ID NO: 313143 - DNA, 20 bp, human
gactcctccttcccggggac

SEQ ID NO: 313144 - DNA, 20 bp, human
gctgcaagtcatccagtccc

SEQ ID NO: 313145 - DNA, 20 bp, human
gaacacagtcatgtgagccc

SEQ ID NO: 313146 - DNA, 20 bp, human
gcacttcaggggcagttgga

SEQ ID NO: 313147 - DNA, 20 bp, human
gcaagatcctgaacatgcca

SEQ ID NO: 313148 - DNA, 20 bp, human
gatggaggatgatagagaaa

SEQ ID NO: 313149 - DNA, 20 bp, human
gtgggaagcggaaaatgttg

SEQ ID NO: 313150 - DNA, 20 bp, human
gcagggaggaattaatggag

SEQ ID NO: 313151 - DNA, 20 bp, human
ggcagtactgctagtctata

SEQ ID NO: 313152 - DNA, 20 bp, human
gcagagaaaaagcctgagcc

SEQ ID NO: 313153 - DNA, 20 bp, human
gtccagactctatgtgaata

SEQ ID NO: 313154 - DNA, 20 bp, human
gatagggctaaatgtagaat

SEQ ID NO: 313155 - DNA, 20 bp, human
gttggccatcttaacttcat

SEQ ID NO: 313156 - DNA, 20 bp, human
gtgggtgcgtgctcagacgt

SEQ ID NO: 313157 - DNA, 20 bp, human
ggggagacccgtggatgatc

SEQ ID NO: 313158 - DNA, 20 bp, human
gctcagacgtgggtcctcaa

SEQ ID NO: 313159 - DNA, 20 bp, human
gttgtctcctgggagacccg

SEQ ID NO: 313160 - DNA, 20 bp, human
ggcccaagccggatcatcca

SEQ ID NO: 313161 - DNA, 20 bp, human
gagcacgcacccacaaacac

SEQ ID NO: 313162 - DNA, 20 bp, human
ggtctcccaggagacaactg

SEQ ID NO: 313163 - DNA, 20 bp, human
gtgggtcctcaaggggtccc

SEQ ID NO: 313164 - DNA, 20 bp, human
ggcaggcccgggaccccttg

SEQ ID NO: 313165 - DNA, 20 bp, human
gctagggtctgtctgtgttg

SEQ ID NO: 313166 - DNA, 20 bp, human
gctggcagatccacgaagaa

SEQ ID NO: 313167 - DNA, 20 bp, human
gtaccagcccctgttgacca

SEQ ID NO: 313168 - DNA, 20 bp, human
gctgttctcagggccctggt

SEQ ID NO: 313169 - DNA, 20 bp, human
gggtgtggctctacccacca

SEQ ID NO: 313170 - DNA, 20 bp, human
gcccgggcgggaccacggac

SEQ ID NO: 313171 - DNA, 20 bp, human
gagccacaccacaggcactc

SEQ ID NO: 313172 - DNA, 20 bp, human
ggaacaggatccccaagagc

SEQ ID NO: 313173 - DNA, 20 bp, human
gtgagctccctggtcaacag

SEQ ID NO: 313174 - DNA, 20 bp, human
gcccctcaaaggcccattgt

SEQ ID NO: 313175 - DNA, 20 bp, human
gtgggccccaccctgagtcg

SEQ ID NO: 313176 - DNA, 20 bp, human
gtgggagggagaaactggag

SEQ ID NO: 313177 - DNA, 20 bp, human
gggtcaggagggaagaaatc

SEQ ID NO: 313178 - DNA, 20 bp, human
gaatctgggacggagacact

SEQ ID NO: 313179 - DNA, 20 bp, human
gtgggcgacagcaggcggga

SEQ ID NO: 313180 - DNA, 20 bp, human
ggcgggacacggccctggag

SEQ ID NO: 313181 - DNA, 20 bp, human
gacactggggggacggggcc

SEQ ID NO: 313182 - DNA, 20 bp, human
gcggaaggaaaagtcgagcg

SEQ ID NO: 313183 - DNA, 20 bp, human
gggagggaagaaatctggga

SEQ ID NO: 313184 - DNA, 20 bp, human
gcgagcggggaggagcttgg

SEQ ID NO: 313185 - DNA, 20 bp, human
gagggagagactgtaggggc

SEQ ID NO: 313186 - DNA, 20 bp, human
ggtgggagcaggggtctcat

SEQ ID NO: 313187 - DNA, 20 bp, human
ggtaagctgaggggcagctc

SEQ ID NO: 313188 - DNA, 20 bp, human
gtgacaagggctttgaaatc

SEQ ID NO: 313189 - DNA, 20 bp, human
ggaggctgaagagagtctca

SEQ ID NO: 313190 - DNA, 20 bp, human
gcagtgaagtcctttccggg

SEQ ID NO: 313191 - DNA, 20 bp, human
ggggaagcctaggtaagctg

SEQ ID NO: 313192 - DNA, 20 bp, human
gaagcccgtaacactggcct

SEQ ID NO: 313193 - DNA, 20 bp, human
gctgctcccacctatatagt

SEQ ID NO: 313194 - DNA, 20 bp, human
gtccaaggtcatatggtgag

SEQ ID NO: 313195 - DNA, 20 bp, human
gcagcccaggccagtgttac

SEQ ID NO: 313196 - DNA, 20 bp, human
ggcgccgggaccagaacctt

SEQ ID NO: 313197 - DNA, 20 bp, human
gcggcctaaggttctggtcc

SEQ ID NO: 313198 - DNA, 20 bp, human
gcgcgcgagtgaaatgaatg

SEQ ID NO: 313199 - DNA, 20 bp, human
gcaaaacctcacacggagta

SEQ ID NO: 313200 - DNA, 20 bp, human
ggggttacacaatgaatacg

SEQ ID NO: 313201 - DNA, 20 bp, human
ggccaggcggcctaaggttc

SEQ ID NO: 313202 - DNA, 20 bp, human
gttcactcgcgcgggcttct

SEQ ID NO: 313203 - DNA, 20 bp, human
gaccagaaccttaggccgcc

SEQ ID NO: 313204 - DNA, 20 bp, human
gcggagtaaggggcagcgcc

SEQ ID NO: 313205 - DNA, 20 bp, human
gggggtgcagcgcggagcta

SEQ ID NO: 313206 - DNA, 20 bp, human
gctcacctgtcattattgag

SEQ ID NO: 313207 - DNA, 20 bp, human
gtgaggggtgggtaagtttc

SEQ ID NO: 313208 - DNA, 20 bp, human
gcccacccctcaataatgac

SEQ ID NO: 313209 - DNA, 20 bp, human
gatgtcctggcatgcccaag

SEQ ID NO: 313210 - DNA, 20 bp, human
gccagcttctactggactgt

SEQ ID NO: 313211 - DNA, 20 bp, human
gacctgtcattattgagggg

SEQ ID NO: 313212 - DNA, 20 bp, human
gtgagcattagtagccactt

SEQ ID NO: 313213 - DNA, 20 bp, human
ggacctagaactggaaattc

SEQ ID NO: 313214 - DNA, 20 bp, human
gtgaatgtggtagaatgtcc

SEQ ID NO: 313215 - DNA, 20 bp, human
gcactctatggacctagaac

SEQ ID NO: 313216 - DNA, 20 bp, human
ggggcctcggcgagagactt

SEQ ID NO: 313217 - DNA, 20 bp, human
gaccctatccggagcttctg

SEQ ID NO: 313218 - DNA, 20 bp, human
ggcagagccgaggacgcgtc

SEQ ID NO: 313219 - DNA, 20 bp, human
ggattcaaactagtggcggg

SEQ ID NO: 313220 - DNA, 20 bp, human
gtaagcgcacccgtctcgcg

SEQ ID NO: 313221 - DNA, 20 bp, human
gcgtctcgcggggtctcctg

SEQ ID NO: 313222 - DNA, 20 bp, human
gcgcgtcctcggctctgcgc

SEQ ID NO: 313223 - DNA, 20 bp, human
gcacccgccctgcgcctcgg

SEQ ID NO: 313224 - DNA, 20 bp, human
gcccgcagaagctccggata

SEQ ID NO: 313225 - DNA, 20 bp, human
gccgagattcaaactagtgg

SEQ ID NO: 313226 - DNA, 20 bp, human
gacgaaacacacagggtcct

SEQ ID NO: 313227 - DNA, 20 bp, human
gcggaaccacgaaacacaca

SEQ ID NO: 313228 - DNA, 20 bp, human
gaaaaagagaaagaggaacg

SEQ ID NO: 313229 - DNA, 20 bp, human
gccggcagcaaagctcattt

SEQ ID NO: 313230 - DNA, 20 bp, human
gggtggttaaccagccatac

SEQ ID NO: 313231 - DNA, 20 bp, human
gtcagagcgacaattttaac

SEQ ID NO: 313232 - DNA, 20 bp, human
ggtgtttcgtggttccggta

SEQ ID NO: 313233 - DNA, 20 bp, human
gaacagtaacaccgccacgc

SEQ ID NO: 313234 - DNA, 20 bp, human
gttagtcctccgtgttgccc

SEQ ID NO: 313235 - DNA, 20 bp, human
gatggctggttaaccacctt

SEQ ID NO: 313236 - DNA, 20 bp, human
gacgccgagtggggaggtaa

SEQ ID NO: 313237 - DNA, 20 bp, human
gaagcagtgggcgtacccgc

SEQ ID NO: 313238 - DNA, 20 bp, human
gagtctcttagcaacgactc

SEQ ID NO: 313239 - DNA, 20 bp, human
gaagagactggacgccgagt

SEQ ID NO: 313240 - DNA, 20 bp, human
ggaaagagctaaggattgtg

SEQ ID NO: 313241 - DNA, 20 bp, human
gcagcaagctggggtgttgt

SEQ ID NO: 313242 - DNA, 20 bp, human
ggactggacgccgagtgggg

SEQ ID NO: 313243 - DNA, 20 bp, human
gccccggggccggaagcagt

SEQ ID NO: 313244 - DNA, 20 bp, human
gaggtaaaggcgggctccgt

SEQ ID NO: 313245 - DNA, 20 bp, human
ggcaacgactccggcttcct

SEQ ID NO: 313246 - DNA, 20 bp, human
ggcacacggtgataatccta

SEQ ID NO: 313247 - DNA, 20 bp, human
gtgcctgtgcgcgttcctgt

SEQ ID NO: 313248 - DNA, 20 bp, human
ggacagctaaccagtagggt

SEQ ID NO: 313249 - DNA, 20 bp, human
gctggcgcatagcaattggc

SEQ ID NO: 313250 - DNA, 20 bp, human
gcctactggttagctgtccg

SEQ ID NO: 313251 - DNA, 20 bp, human
gttgactccgtgtgcaggtc

SEQ ID NO: 313252 - DNA, 20 bp, human
gcgccctggcgcatagcaat

SEQ ID NO: 313253 - DNA, 20 bp, human
ggggtcctcacgttaggcta

SEQ ID NO: 313254 - DNA, 20 bp, human
gtgtgcagcagatggcgccc

SEQ ID NO: 313255 - DNA, 20 bp, human
gaccatacccacaatgctat

SEQ ID NO: 313256 - DNA, 20 bp, human
gccgccttgtgggtaatctc

SEQ ID NO: 313257 - DNA, 20 bp, human
ggggtcgcgcaaacgagcga

SEQ ID NO: 313258 - DNA, 20 bp, human
gtgtggcggcagctagacat

SEQ ID NO: 313259 - DNA, 20 bp, human
ggacgcaaaagcgtcgtctg

SEQ ID NO: 313260 - DNA, 20 bp, human
gacgaggctagcgcgaggta

SEQ ID NO: 313261 - DNA, 20 bp, human
ggtaatctcagggtgagacg

SEQ ID NO: 313262 - DNA, 20 bp, human
gaacgtcgcggtcgaggcta

SEQ ID NO: 313263 - DNA, 20 bp, human
gccgccgggcattcgagctg

SEQ ID NO: 313264 - DNA, 20 bp, human
gcaccctgagattacccaca

SEQ ID NO: 313265 - DNA, 20 bp, human
gtgcgcagcgcgccgccttg

SEQ ID NO: 313266 - DNA, 20 bp, human
gtccagccgacctaaacgaa

SEQ ID NO: 313267 - DNA, 20 bp, human
gaaaaactgcggaaaaccga

SEQ ID NO: 313268 - DNA, 20 bp, human
gtcgcttggtggaaaaactg

SEQ ID NO: 313269 - DNA, 20 bp, human
gaagccgacaagtgctcgac

SEQ ID NO: 313270 - DNA, 20 bp, human
gggaggaaactcgaggaaga

SEQ ID NO: 313271 - DNA, 20 bp, human
gaccccccaactttaggtct

SEQ ID NO: 313272 - DNA, 20 bp, human
gcgacctaaacgaagggaac

SEQ ID NO: 313273 - DNA, 20 bp, human
ggaagactggaggaaactcg

SEQ ID NO: 313274 - DNA, 20 bp, human
gtagcccgtcgagcacttgt

SEQ ID NO: 313275 - DNA, 20 bp, human
ggtttcccgccgggccagta

SEQ ID NO: 313276 - DNA, 20 bp, human
gcggccgcggcagtgtatgg

SEQ ID NO: 313277 - DNA, 20 bp, human
gccaacccggggctccgagc

SEQ ID NO: 313278 - DNA, 20 bp, human
gcgcggcagtgtatggggga

SEQ ID NO: 313279 - DNA, 20 bp, human
gaagaggccgcgtggggcga

SEQ ID NO: 313280 - DNA, 20 bp, human
gaggccgcgtggggcgaagg

SEQ ID NO: 313281 - DNA, 20 bp, human
gggtcccgcaggaggttgaa

SEQ ID NO: 313282 - DNA, 20 bp, human
ggggtcgcgtactcaccccc

SEQ ID NO: 313283 - DNA, 20 bp, human
ggcgcgcaggcgctaggaag

SEQ ID NO: 313284 - DNA, 20 bp, human
gccaggcgcagactcggctc

SEQ ID NO: 313285 - DNA, 20 bp, human
gaaaagagcgagggctgggt

SEQ ID NO: 313286 - DNA, 20 bp, human
ggggagtcgggcagaggcgt

SEQ ID NO: 313287 - DNA, 20 bp, human
gaagcccgggagtcgggcag

SEQ ID NO: 313288 - DNA, 20 bp, human
gcgcgcgcaagcccgggagt

SEQ ID NO: 313289 - DNA, 20 bp, human
gcgcggctgcagcgcgacag

SEQ ID NO: 313290 - DNA, 20 bp, human
gggagtctgcaaccttgtct

SEQ ID NO: 313291 - DNA, 20 bp, human
gtaaaaggacaaccgagaca

SEQ ID NO: 313292 - DNA, 20 bp, human
gggaggccacgtggtctcgg

SEQ ID NO: 313293 - DNA, 20 bp, human
gcgaggacaaagcaggatct

SEQ ID NO: 313294 - DNA, 20 bp, human
ggctgcagcgcgacaggggc

SEQ ID NO: 313295 - DNA, 20 bp, human
gggcgccctgagctgctcgg

SEQ ID NO: 313296 - DNA, 20 bp, human
ggggccctgttggctctcta

SEQ ID NO: 313297 - DNA, 20 bp, human
gaaagaaactcgagcgacgg

SEQ ID NO: 313298 - DNA, 20 bp, human
gccactccgcagagtcccga

SEQ ID NO: 313299 - DNA, 20 bp, human
gagcgacgggggttgagttc

SEQ ID NO: 313300 - DNA, 20 bp, human
gcgtccgcccagccacgccc

SEQ ID NO: 313301 - DNA, 20 bp, human
ggacgggggttgagttccgg

SEQ ID NO: 313302 - DNA, 20 bp, human
gagaaccctagagagccaac

SEQ ID NO: 313303 - DNA, 20 bp, human
gggacggcgcctttgaccgc

SEQ ID NO: 313304 - DNA, 20 bp, human
gagggcccctgggcgtggct

SEQ ID NO: 313305 - DNA, 20 bp, human
gaacttccggccccactgag

SEQ ID NO: 313306 - DNA, 20 bp, human
gtcgttggcaatctcgggaa

SEQ ID NO: 313307 - DNA, 20 bp, human
gccccctagtgtgggataag

SEQ ID NO: 313308 - DNA, 20 bp, human
gccgagattgccaacgaggc

SEQ ID NO: 313309 - DNA, 20 bp, human
ggggccatcgggtttttttt

SEQ ID NO: 313310 - DNA, 20 bp, human
gaccaggcgccccctagtgt

SEQ ID NO: 313311 - DNA, 20 bp, human
gctgtggcggccgaagaacc

SEQ ID NO: 313312 - DNA, 20 bp, human
gggaggccggaactggaaac

SEQ ID NO: 313313 - DNA, 20 bp, human
gttggcaatctcgggaaggg

SEQ ID NO: 313314 - DNA, 20 bp, human
ggcccgcttatcccacacta

SEQ ID NO: 313315 - DNA, 20 bp, human
gcatccagagcgctctgtgg

SEQ ID NO: 313316 - DNA, 20 bp, human
gtagctacgaggtggttggt

SEQ ID NO: 313317 - DNA, 20 bp, human
gcttgggcgtagctacgagg

SEQ ID NO: 313318 - DNA, 20 bp, human
gaatcatcgctcacgtcgag

SEQ ID NO: 313319 - DNA, 20 bp, human
gaagcaacaagcgtggtctt

SEQ ID NO: 313320 - DNA, 20 bp, human
gggcgtagctacgaggtggt

SEQ ID NO: 313321 - DNA, 20 bp, human
ggagagaaacaggactgtga

SEQ ID NO: 313322 - DNA, 20 bp, human
gagctggggtgtaactggag

SEQ ID NO: 313323 - DNA, 20 bp, human
gtgcttaagtccggggtcaa

SEQ ID NO: 313324 - DNA, 20 bp, human
gagctcctgggacatcgctc

SEQ ID NO: 313325 - DNA, 20 bp, human
ggagaacggaagtcggatgt

SEQ ID NO: 313326 - DNA, 20 bp, human
ggctgtctgccaccatatgg

SEQ ID NO: 313327 - DNA, 20 bp, human
ggggagaacacccctgtgga

SEQ ID NO: 313328 - DNA, 20 bp, human
gcctgtggaggggtgtaact

SEQ ID NO: 313329 - DNA, 20 bp, human
gaagatagagtggattcata

SEQ ID NO: 313330 - DNA, 20 bp, human
gggctgggagaacacccctg

SEQ ID NO: 313331 - DNA, 20 bp, human
gcagtgccccgctgcaatgc

SEQ ID NO: 313332 - DNA, 20 bp, human
ggggaaagacggcctacaat

SEQ ID NO: 313333 - DNA, 20 bp, human
gcggctgctatgggacaaaa

SEQ ID NO: 313334 - DNA, 20 bp, human
ggctcctttcctgatgtctt

SEQ ID NO: 313335 - DNA, 20 bp, human
gcgtgagctagctggcatgg

SEQ ID NO: 313336 - DNA, 20 bp, human
ggccgtgagagccaatccgc

SEQ ID NO: 313337 - DNA, 20 bp, human
ggctctcacggcgttcaggt

SEQ ID NO: 313338 - DNA, 20 bp, human
gcacggcgttcaggtaggaa

SEQ ID NO: 313339 - DNA, 20 bp, human
gggcggggaagaatcgcgaa

SEQ ID NO: 313340 - DNA, 20 bp, human
ggtagtgcgagaataagaga

SEQ ID NO: 313341 - DNA, 20 bp, human
gaggtcactgagtcagtcgg

SEQ ID NO: 313342 - DNA, 20 bp, human
gaaggaggcgggcagaaaac

SEQ ID NO: 313343 - DNA, 20 bp, human
ggcaagagcggcagccacac

SEQ ID NO: 313344 - DNA, 20 bp, human
gcgctccgcaataacgtaaa

SEQ ID NO: 313345 - DNA, 20 bp, human
gattagagctgcccgcggat

SEQ ID NO: 313346 - DNA, 20 bp, human
gcgccccggaagtatcgcag

SEQ ID NO: 313347 - DNA, 20 bp, human
gtgtgctcctgaactcgcgg

SEQ ID NO: 313348 - DNA, 20 bp, human
gggccgcggcggggactgaa

SEQ ID NO: 313349 - DNA, 20 bp, human
gttgcccgggtcggaaatgg

SEQ ID NO: 313350 - DNA, 20 bp, human
gagcggatgtggggccgcgg

SEQ ID NO: 313351 - DNA, 20 bp, human
gagcccctgcgatacttccg

SEQ ID NO: 313352 - DNA, 20 bp, human
ggacccgggcaagatggcag

SEQ ID NO: 313353 - DNA, 20 bp, human
gcggccggggagctcgggtg

SEQ ID NO: 313354 - DNA, 20 bp, human
gcgcggtggtggtgcgtgtt

SEQ ID NO: 313355 - DNA, 20 bp, human
ggtgttggggagcggatgtg

SEQ ID NO: 313356 - DNA, 20 bp, human
gcggcgcagaagcgggacgt

SEQ ID NO: 313357 - DNA, 20 bp, human
gccggcggcggcgatggcct

SEQ ID NO: 313358 - DNA, 20 bp, human
gccgcagcctcggccggaaa

SEQ ID NO: 313359 - DNA, 20 bp, human
gtaggggcccaggccggcgg

SEQ ID NO: 313360 - DNA, 20 bp, human
gaagcgggacgtcggcttct

SEQ ID NO: 313361 - DNA, 20 bp, human
ggggctcggcctcatagtct

SEQ ID NO: 313362 - DNA, 20 bp, human
gaggtggaggagcgcaggta

SEQ ID NO: 313363 - DNA, 20 bp, human
gactctgcccgggacacggc

SEQ ID NO: 313364 - DNA, 20 bp, human
ggtccgctgtaacaccggcc

SEQ ID NO: 313365 - DNA, 20 bp, human
gtgcccctgactcgaagggt

SEQ ID NO: 313366 - DNA, 20 bp, human
gaggtgtggtcaggcgaacc

SEQ ID NO: 313367 - DNA, 20 bp, human
gcggcgctcgaggtgtggtc

SEQ ID NO: 313368 - DNA, 20 bp, human
gcacgaagatcgcaagcact

SEQ ID NO: 313369 - DNA, 20 bp, human
gagcactgggccggcgctcg

SEQ ID NO: 313370 - DNA, 20 bp, human
ggggtgtaagtactgcttgt

SEQ ID NO: 313371 - DNA, 20 bp, human
gggtcaggcgaacctggctt

SEQ ID NO: 313372 - DNA, 20 bp, human
gacaaactagaaaggagtag

SEQ ID NO: 313373 - DNA, 20 bp, human
gaacaagccacctaatccgg

SEQ ID NO: 313374 - DNA, 20 bp, human
gtgaggaccaccggattagg

SEQ ID NO: 313375 - DNA, 20 bp, human
gaatactctggatttcctgt

SEQ ID NO: 313376 - DNA, 20 bp, human
gggaacgtggggtgcgggac

SEQ ID NO: 313377 - DNA, 20 bp, human
gcggcggcgggaggtctctg

SEQ ID NO: 313378 - DNA, 20 bp, human
ggcagggctggggacggcac

SEQ ID NO: 313379 - DNA, 20 bp, human
gcggggaggaacgtggggtg

SEQ ID NO: 313380 - DNA, 20 bp, human
ggcgcggcctccggaagcga

SEQ ID NO: 313381 - DNA, 20 bp, human
gagggagaagaaggcggcgc

SEQ ID NO: 313382 - DNA, 20 bp, human
gcccgcgccgcagactccac

SEQ ID NO: 313383 - DNA, 20 bp, human
gccgcgtcctgtggagtctg

SEQ ID NO: 313384 - DNA, 20 bp, human
gctgggaggggtgcgggcgt

SEQ ID NO: 313385 - DNA, 20 bp, human
gcggcacgggcgcgcggcac

SEQ ID NO: 313386 - DNA, 20 bp, human
ggaaacaggaagtttggcgg

SEQ ID NO: 313387 - DNA, 20 bp, human
gaagcatgtcgggaatcgaa

SEQ ID NO: 313388 - DNA, 20 bp, human
gacacaccatgaagcatgtc

SEQ ID NO: 313389 - DNA, 20 bp, human
gtgctgagaggtaagattcg

SEQ ID NO: 313390 - DNA, 20 bp, human
gccgctagaaagctggaaac

SEQ ID NO: 313391 - DNA, 20 bp, human
gatcgaaaggcaagctggtt

SEQ ID NO: 313392 - DNA, 20 bp, human
ggggccgccctttccagaca

SEQ ID NO: 313393 - DNA, 20 bp, human
gcaactcccagcatgctgag

SEQ ID NO: 313394 - DNA, 20 bp, human
gcgattcccgacatgcttca

SEQ ID NO: 313395 - DNA, 20 bp, human
gctccacgcagagcatgcgc

SEQ ID NO: 313396 - DNA, 20 bp, human
gcaggcctgcggattgggca

SEQ ID NO: 313397 - DNA, 20 bp, human
ggacccggacagccggtaat

SEQ ID NO: 313398 - DNA, 20 bp, human
ggtccccggtcgcaggcctg

SEQ ID NO: 313399 - DNA, 20 bp, human
ggaagccctgcccaatccgc

SEQ ID NO: 313400 - DNA, 20 bp, human
gggtgagcgtccccggtcgc

SEQ ID NO: 313401 - DNA, 20 bp, human
gggacgcagtagtcagagcg

SEQ ID NO: 313402 - DNA, 20 bp, human
gtggcagttgaaagagtggc

SEQ ID NO: 313403 - DNA, 20 bp, human
gctgcagagcggtgttcagg

SEQ ID NO: 313404 - DNA, 20 bp, human
gatcgaaagcatggcgtcgg

SEQ ID NO: 313405 - DNA, 20 bp, human
gcaatccgcaggcctgcgac

SEQ ID NO: 313406 - DNA, 20 bp, human
gcggggccgcacgtagctaa

SEQ ID NO: 313407 - DNA, 20 bp, human
gggccccggcgtttccgcga

SEQ ID NO: 313408 - DNA, 20 bp, human
gaaccctgaaaggtgggcgc

SEQ ID NO: 313409 - DNA, 20 bp, human
gccgcccttcgcggaaacgc

SEQ ID NO: 313410 - DNA, 20 bp, human
gttcccgggtagggtaagtg

SEQ ID NO: 313411 - DNA, 20 bp, human
ggagctgctgctgctgtatg

SEQ ID NO: 313412 - DNA, 20 bp, human
gtttccgcgaagggcggcac

SEQ ID NO: 313413 - DNA, 20 bp, human
gccagtcagcggtgggagga

SEQ ID NO: 313414 - DNA, 20 bp, human
ggggccggagtgagaaccgg

SEQ ID NO: 313415 - DNA, 20 bp, human
gggacgagggggtagacgga

SEQ ID NO: 313416 - DNA, 20 bp, human
gagttggagtaggtaggggt

SEQ ID NO: 313417 - DNA, 20 bp, human
gtctccaggggtaaaataaa

SEQ ID NO: 313418 - DNA, 20 bp, human
gggactgactcgcctctcca

SEQ ID NO: 313419 - DNA, 20 bp, human
ggggcactcgagtcgctccc

SEQ ID NO: 313420 - DNA, 20 bp, human
ggcaccggaagtgggtccgg

SEQ ID NO: 313421 - DNA, 20 bp, human
gatccaaagtaggacaacgg

SEQ ID NO: 313422 - DNA, 20 bp, human
gaagccgccggacccacttc

SEQ ID NO: 313423 - DNA, 20 bp, human
gcggccgatgctctctgcga

SEQ ID NO: 313424 - DNA, 20 bp, human
gaataaggacagacttcctg

SEQ ID NO: 313425 - DNA, 20 bp, human
gtgtgagttggagtaggtag

SEQ ID NO: 313426 - DNA, 20 bp, human
gacccgctcaacttcatcct

SEQ ID NO: 313427 - DNA, 20 bp, human
gcgcctgcgctctctttcta

SEQ ID NO: 313428 - DNA, 20 bp, human
gaagtggtcatgtgataccc

SEQ ID NO: 313429 - DNA, 20 bp, human
gccaaggcggggaggacctg

SEQ ID NO: 313430 - DNA, 20 bp, human
gaaagagagcgcaggcgcct

SEQ ID NO: 313431 - DNA, 20 bp, human
gtcatcctgggttgaggcgg

SEQ ID NO: 313432 - DNA, 20 bp, human
gaacccaggatgaagttgag

SEQ ID NO: 313433 - DNA, 20 bp, human
gagcgggtctgctgcgcttc

SEQ ID NO: 313434 - DNA, 20 bp, human
gggcgaaatccctcccactc

SEQ ID NO: 313435 - DNA, 20 bp, human
gttctcctccgcctcaaccc

SEQ ID NO: 313436 - DNA, 20 bp, human
gatgctgccccgccccctga

SEQ ID NO: 313437 - DNA, 20 bp, human
gcgcctagtctctccgcctg

SEQ ID NO: 313438 - DNA, 20 bp, human
gtctccgcctgcggagccgt

SEQ ID NO: 313439 - DNA, 20 bp, human
gtggggtcccggcagcccgc

SEQ ID NO: 313440 - DNA, 20 bp, human
gcccgcaggagtgctaagta

SEQ ID NO: 313441 - DNA, 20 bp, human
gaacggccagccctgggcga

SEQ ID NO: 313442 - DNA, 20 bp, human
gaacctggttcccgccctga

SEQ ID NO: 313443 - DNA, 20 bp, human
ggctaagtaagggtccttca

SEQ ID NO: 313444 - DNA, 20 bp, human
gcgtgacagcacagagataa

SEQ ID NO: 313445 - DNA, 20 bp, human
gaaggcctgccggttgctcg

SEQ ID NO: 313446 - DNA, 20 bp, human
gactacgctgaagacctcga

SEQ ID NO: 313447 - DNA, 20 bp, human
ggccgcacacatgcgcactg

SEQ ID NO: 313448 - DNA, 20 bp, human
gggtaaagatggcggagcgc

SEQ ID NO: 313449 - DNA, 20 bp, human
gactacattcaggtatggaa

SEQ ID NO: 313450 - DNA, 20 bp, human
gctccaatcatagagagtaa

SEQ ID NO: 313451 - DNA, 20 bp, human
gtgtgcgcatgctgaaagca

SEQ ID NO: 313452 - DNA, 20 bp, human
ggcttctggagggtccagta

SEQ ID NO: 313453 - DNA, 20 bp, human
ggaggtcttcagcgtagtcg

SEQ ID NO: 313454 - DNA, 20 bp, human
gacaacaccccgcatgctct

SEQ ID NO: 313455 - DNA, 20 bp, human
gctggagcttccttggtcgg

SEQ ID NO: 313456 - DNA, 20 bp, human
gacgactggaggcaggttcc

SEQ ID NO: 313457 - DNA, 20 bp, human
gccccggaagcagttgttgt

SEQ ID NO: 313458 - DNA, 20 bp, human
ggacggagactgcccaggtg

SEQ ID NO: 313459 - DNA, 20 bp, human
gcggggaaggatgtgcgaac

SEQ ID NO: 313460 - DNA, 20 bp, human
ggggctggagacgccggtag

SEQ ID NO: 313461 - DNA, 20 bp, human
gccggggcacggcccggttc

SEQ ID NO: 313462 - DNA, 20 bp, human
gtccgcggtcttctgtaagt

SEQ ID NO: 313463 - DNA, 20 bp, human
gccggtaggggttacggcga

SEQ ID NO: 313464 - DNA, 20 bp, human
gcctgggcagtctccgtcac

SEQ ID NO: 313465 - DNA, 20 bp, human
ggacatccggcagtcgcccg

SEQ ID NO: 313466 - DNA, 20 bp, human
gttggtcttcccgcccccag

SEQ ID NO: 313467 - DNA, 20 bp, human
ggaaagcccagagtggcgca

SEQ ID NO: 313468 - DNA, 20 bp, human
ggcgcgccagtctatatccg

SEQ ID NO: 313469 - DNA, 20 bp, human
gccgttcgccggctacctgt

SEQ ID NO: 313470 - DNA, 20 bp, human
gtggcgcgcctctgttgcgc

SEQ ID NO: 313471 - DNA, 20 bp, human
ggcaccctctgccggtcaat

SEQ ID NO: 313472 - DNA, 20 bp, human
ggctctgcatacacaccaac

SEQ ID NO: 313473 - DNA, 20 bp, human
ggtgccccgcggatatagac

SEQ ID NO: 313474 - DNA, 20 bp, human
gctcagaaggcgccgttcgc

SEQ ID NO: 313475 - DNA, 20 bp, human
gcacaaggcattatctcccg

SEQ ID NO: 313476 - DNA, 20 bp, human
gataggcagtcgttttacag

SEQ ID NO: 313477 - DNA, 20 bp, human
gagcggcgaagaacggaacc

SEQ ID NO: 313478 - DNA, 20 bp, human
gaagcaaggaggcggagtca

SEQ ID NO: 313479 - DNA, 20 bp, human
gtaaaacgactgcctataga

SEQ ID NO: 313480 - DNA, 20 bp, human
ggttttacagcggcgaagaa

SEQ ID NO: 313481 - DNA, 20 bp, human
gattttgtagaaccttctat

SEQ ID NO: 313482 - DNA, 20 bp, human
gtgaagggaaagcaaggagg

SEQ ID NO: 313483 - DNA, 20 bp, human
gaagagcaaaagagaatgaa

SEQ ID NO: 313484 - DNA, 20 bp, human
ggaatgaagggaaagcaagg

SEQ ID NO: 313485 - DNA, 20 bp, human
gacattgaataaatgttgag

SEQ ID NO: 313486 - DNA, 20 bp, human
gggcgtgcccacgtccagtg

SEQ ID NO: 313487 - DNA, 20 bp, human
gccaaacagcacgacgatcc

SEQ ID NO: 313488 - DNA, 20 bp, human
gcgcagagtgcgcgcagtcg

SEQ ID NO: 313489 - DNA, 20 bp, human
gtgcgccccgcactggacgt

SEQ ID NO: 313490 - DNA, 20 bp, human
gaacagcacgacgatcccgg

SEQ ID NO: 313491 - DNA, 20 bp, human
ggacgcagcagcgagtgcgc

SEQ ID NO: 313492 - DNA, 20 bp, human
gcgcgcactctgcgggccac

SEQ ID NO: 313493 - DNA, 20 bp, human
gggaaggcgaatggagttac

SEQ ID NO: 313494 - DNA, 20 bp, human
gggacaggagaaatgtaaac

SEQ ID NO: 313495 - DNA, 20 bp, human
gtccgggaaacgagtggaga

SEQ ID NO: 313496 - DNA, 20 bp, human
gagaaaatgagaatgggttg

SEQ ID NO: 313497 - DNA, 20 bp, human
gaggtgaagcgcaggcgagt

SEQ ID NO: 313498 - DNA, 20 bp, human
gctcacgtgaggtgaagcgc

SEQ ID NO: 313499 - DNA, 20 bp, human
gtccccgcctacccagagac

SEQ ID NO: 313500 - DNA, 20 bp, human
gcctgcgcgcggcaacatgg

SEQ ID NO: 313501 - DNA, 20 bp, human
ggtaggtgagtggtcgtggt

SEQ ID NO: 313502 - DNA, 20 bp, human
gtgctgggaacgaatgagac

SEQ ID NO: 313503 - DNA, 20 bp, human
gccaaagctcgttttgggaa

SEQ ID NO: 313504 - DNA, 20 bp, human
gtgactgtgattggttgaat

SEQ ID NO: 313505 - DNA, 20 bp, human
ggcgagtaggtgagtggtcg

SEQ ID NO: 313506 - DNA, 20 bp, human
gcctccgggacaggcgtctg

SEQ ID NO: 313507 - DNA, 20 bp, human
ggtctgtagacgcccggctc

SEQ ID NO: 313508 - DNA, 20 bp, human
gaatcaggacgcagcgtcca

SEQ ID NO: 313509 - DNA, 20 bp, human
ggccgggcgtctacagaccg

SEQ ID NO: 313510 - DNA, 20 bp, human
gcacctgcgcccgaggcaga

SEQ ID NO: 313511 - DNA, 20 bp, human
gcgcaggtggaaggtggccg

SEQ ID NO: 313512 - DNA, 20 bp, human
gggaagtgcccgttggacgg

SEQ ID NO: 313513 - DNA, 20 bp, human
gtccggaagtgcccgttgga

SEQ ID NO: 313514 - DNA, 20 bp, human
gcccctgcaccgtctgcctc

SEQ ID NO: 313515 - DNA, 20 bp, human
gcggctccggaagtgcccgt

SEQ ID NO: 313516 - DNA, 20 bp, human
gggcctcgctggggattcag

SEQ ID NO: 313517 - DNA, 20 bp, human
ggggccctgcacctctgggt

SEQ ID NO: 313518 - DNA, 20 bp, human
gagaccccgagactcggagc

SEQ ID NO: 313519 - DNA, 20 bp, human
ggccccggctccgagtctcg

SEQ ID NO: 313520 - DNA, 20 bp, human
gactgctcgcctccaccggg

SEQ ID NO: 313521 - DNA, 20 bp, human
gtggctgagaccccgagact

SEQ ID NO: 313522 - DNA, 20 bp, human
ggagcacaggtaacgcgccc

SEQ ID NO: 313523 - DNA, 20 bp, human
gggcctgccgcccaccacgt

SEQ ID NO: 313524 - DNA, 20 bp, human
ggcgcccaggtatcgagcac

SEQ ID NO: 313525 - DNA, 20 bp, human
gggcgagcagtctgagtgct

SEQ ID NO: 313526 - DNA, 20 bp, human
gcggaggcgggacccaaagt

SEQ ID NO: 313527 - DNA, 20 bp, human
gtgggccagagaggtctcat

SEQ ID NO: 313528 - DNA, 20 bp, human
gcttcaggcttaacagtcat

SEQ ID NO: 313529 - DNA, 20 bp, human
gagccttggaggcgggatga

SEQ ID NO: 313530 - DNA, 20 bp, human
gaggaccctccgtaacactg

SEQ ID NO: 313531 - DNA, 20 bp, human
ggtgacccccgcccataagt

SEQ ID NO: 313532 - DNA, 20 bp, human
ggggtctgggggttagtcct

SEQ ID NO: 313533 - DNA, 20 bp, human
gggagtgaaaattgggtctg

SEQ ID NO: 313534 - DNA, 20 bp, human
ggcgactccgcgctggaaag

SEQ ID NO: 313535 - DNA, 20 bp, human
gggtggaggtctgggcacgc

SEQ ID NO: 313536 - DNA, 20 bp, human
gctaggcggggctgcgtcgg

SEQ ID NO: 313537 - DNA, 20 bp, human
gcagaccgaccaaccggcta

SEQ ID NO: 313538 - DNA, 20 bp, human
ggcacagggcggggacggaa

SEQ ID NO: 313539 - DNA, 20 bp, human
ggcccagcgctcaggcgttc

SEQ ID NO: 313540 - DNA, 20 bp, human
gagggcgcagaccgaccaac

SEQ ID NO: 313541 - DNA, 20 bp, human
gtgtgcgcagctgacaccct

SEQ ID NO: 313542 - DNA, 20 bp, human
gggagccgaggcccgcgcga

SEQ ID NO: 313543 - DNA, 20 bp, human
gggccgctccggctgcactg

SEQ ID NO: 313544 - DNA, 20 bp, human
gcaaccggctagggcctgac

SEQ ID NO: 313545 - DNA, 20 bp, human
gcagggcggggacggaaggg

SEQ ID NO: 313546 - DNA, 20 bp, human
gtccaatagcggccccaatc

SEQ ID NO: 313547 - DNA, 20 bp, human
ggcggccccaatctggtagg

SEQ ID NO: 313548 - DNA, 20 bp, human
gaggtggcgtcgggaggtcg

SEQ ID NO: 313549 - DNA, 20 bp, human
gccaatgcgaggagcgcgcg

SEQ ID NO: 313550 - DNA, 20 bp, human
gcgctgcgtcgcagcaagag

SEQ ID NO: 313551 - DNA, 20 bp, human
gccacctggcggacgaacac

SEQ ID NO: 313552 - DNA, 20 bp, human
gaggtggccggcggtttccc

SEQ ID NO: 313553 - DNA, 20 bp, human
gaggagccgcgcccggcgga

SEQ ID NO: 313554 - DNA, 20 bp, human
ggccacaccccctaccagat

SEQ ID NO: 313555 - DNA, 20 bp, human
ggcgggcagtggagacgcca

SEQ ID NO: 313556 - DNA, 20 bp, human
ggcccgggtgcagagagaaa

SEQ ID NO: 313557 - DNA, 20 bp, human
gaatgccccgcgggctggga

SEQ ID NO: 313558 - DNA, 20 bp, human
gccagcccgcggggcattct

SEQ ID NO: 313559 - DNA, 20 bp, human
gcgtggccgcagtgttacta

SEQ ID NO: 313560 - DNA, 20 bp, human
ggccacgcttccccaactaa

SEQ ID NO: 313561 - DNA, 20 bp, human
gcacccgggccgctttcccg

SEQ ID NO: 313562 - DNA, 20 bp, human
gcgcgccgtcccagcccgcg

SEQ ID NO: 313563 - DNA, 20 bp, human
gaaagggaggattgttgcta

SEQ ID NO: 313564 - DNA, 20 bp, human
ggggcaccttagtaacactg

SEQ ID NO: 313565 - DNA, 20 bp, human
gttctaagggtatgtgtttg

SEQ ID NO: 313566 - DNA, 20 bp, human
gtcaaggcgagtagcatgtg

SEQ ID NO: 313567 - DNA, 20 bp, human
gggagctcggagtagtagag

SEQ ID NO: 313568 - DNA, 20 bp, human
gagcctaagcagcgaggaga

SEQ ID NO: 313569 - DNA, 20 bp, human
gtagagcggagtgaagacac

SEQ ID NO: 313570 - DNA, 20 bp, human
gactccgagctccgccgcgc

SEQ ID NO: 313571 - DNA, 20 bp, human
gggagcggtcgtcccggaac

SEQ ID NO: 313572 - DNA, 20 bp, human
gggggcgggactaaacctcg

SEQ ID NO: 313573 - DNA, 20 bp, human
gactcacgttgccggcgaag

SEQ ID NO: 313574 - DNA, 20 bp, human
gccccctctcctcgctgctt

SEQ ID NO: 313575 - DNA, 20 bp, human
ggacctcggaagcaaaactc

SEQ ID NO: 313576 - DNA, 20 bp, human
ggggcggggcgactgagaga

SEQ ID NO: 313577 - DNA, 20 bp, human
gcgcaagcgtagcctcaagg

SEQ ID NO: 313578 - DNA, 20 bp, human
gaacgcggaacgcgaagaga

SEQ ID NO: 313579 - DNA, 20 bp, human
gggtgattgcggccgccttg

SEQ ID NO: 313580 - DNA, 20 bp, human
gcggaacgcgaagagaaggc

SEQ ID NO: 313581 - DNA, 20 bp, human
gaaccggagggaccagcttg

SEQ ID NO: 313582 - DNA, 20 bp, human
gggggcggagacagcccccg

SEQ ID NO: 313583 - DNA, 20 bp, human
gcggttcggggagtgaagaa

SEQ ID NO: 313584 - DNA, 20 bp, human
gtccgcgttccgggttccgg

SEQ ID NO: 313585 - DNA, 20 bp, human
ggccctcaagtccggatcat

SEQ ID NO: 313586 - DNA, 20 bp, human
gtcaagcgctctctcgctgg

SEQ ID NO: 313587 - DNA, 20 bp, human
gcgaggctttctgaaggccg

SEQ ID NO: 313588 - DNA, 20 bp, human
gtttctgaaggccggggaat

SEQ ID NO: 313589 - DNA, 20 bp, human
gtacagcaatgcccattccc

SEQ ID NO: 313590 - DNA, 20 bp, human
ggtagtcccagctgcttgta

SEQ ID NO: 313591 - DNA, 20 bp, human
gggggagggtggagtaagga

SEQ ID NO: 313592 - DNA, 20 bp, human
gtgcgcagggagacaacgtt

SEQ ID NO: 313593 - DNA, 20 bp, human
gcgccgaaatgtgagcagcg

SEQ ID NO: 313594 - DNA, 20 bp, human
gaggacgcgcacgtgctcgc

SEQ ID NO: 313595 - DNA, 20 bp, human
ggggagacaacgttgggcgt

SEQ ID NO: 313596 - DNA, 20 bp, human
gcgcgggagcggcaaactag

SEQ ID NO: 313597 - DNA, 20 bp, human
ggatccctcagccgcgggag

SEQ ID NO: 313598 - DNA, 20 bp, human
ggtaaggcggacgctgttag

SEQ ID NO: 313599 - DNA, 20 bp, human
gacgctgttaggggtggcgg

SEQ ID NO: 313600 - DNA, 20 bp, human
gtggctcaagggacacgagt

SEQ ID NO: 313601 - DNA, 20 bp, human
ggaaccattcgcatatggag

SEQ ID NO: 313602 - DNA, 20 bp, human
ggtaccatgagtgcctgtcg

SEQ ID NO: 313603 - DNA, 20 bp, human
gcaccccctccatatgcgaa

SEQ ID NO: 313604 - DNA, 20 bp, human
gctaggggaaagctcagtcc

SEQ ID NO: 313605 - DNA, 20 bp, human
ggggtcaattcaagtcatgc

SEQ ID NO: 313606 - DNA, 20 bp, human
gatggccgccatggctacta

SEQ ID NO: 313607 - DNA, 20 bp, human
gctcctgcccgtagtagcca

SEQ ID NO: 313608 - DNA, 20 bp, human
ggaagaagggaggcgggtca

SEQ ID NO: 313609 - DNA, 20 bp, human
gcgggtgcggggcgagaaaa

SEQ ID NO: 313610 - DNA, 20 bp, human
gctgcccgtagtagccatgg

SEQ ID NO: 313611 - DNA, 20 bp, human
gatgtggccatcttaagtga

SEQ ID NO: 313612 - DNA, 20 bp, human
gacccgccgcaacaaactca

SEQ ID NO: 313613 - DNA, 20 bp, human
gctccctccggatcccacca

SEQ ID NO: 313614 - DNA, 20 bp, human
gccggaagtgacgctatcgt

SEQ ID NO: 313615 - DNA, 20 bp, human
gaatccgaggcgagtgccaa

SEQ ID NO: 313616 - DNA, 20 bp, human
gaatgtgacaacctgagtga

SEQ ID NO: 313617 - DNA, 20 bp, human
gctgagtgagggtggaaagc

SEQ ID NO: 313618 - DNA, 20 bp, human
ggaagttgagtgagtctcgg

SEQ ID NO: 313619 - DNA, 20 bp, human
ggaattgtgtgctaagtact

SEQ ID NO: 313620 - DNA, 20 bp, human
ggtggaagttgagtgagtct

SEQ ID NO: 313621 - DNA, 20 bp, human
gtgaaggaacggccttgacc

SEQ ID NO: 313622 - DNA, 20 bp, human
gtgaaaggaattaatcagac

SEQ ID NO: 313623 - DNA, 20 bp, human
gttgctgctgcacctggtca

SEQ ID NO: 313624 - DNA, 20 bp, human
ggggcgtctgaaaacactga

SEQ ID NO: 313625 - DNA, 20 bp, human
gatctgtgctagacgctgaa

SEQ ID NO: 313626 - DNA, 20 bp, human
gctcccaaggagttcggata

SEQ ID NO: 313627 - DNA, 20 bp, human
ggcgcgtcagtacagaccgt

SEQ ID NO: 313628 - DNA, 20 bp, human
gcggtgcgagcgtaaagggg

SEQ ID NO: 313629 - DNA, 20 bp, human
gtcgccggtgcgagcgtaaa

SEQ ID NO: 313630 - DNA, 20 bp, human
ggtcccagctaccgcgaaga

SEQ ID NO: 313631 - DNA, 20 bp, human
gttgggcggtacaaatagca

SEQ ID NO: 313632 - DNA, 20 bp, human
ggatccgaagggcttgtagc

SEQ ID NO: 313633 - DNA, 20 bp, human
gggcggagctaggactgcct

SEQ ID NO: 313634 - DNA, 20 bp, human
ggggccttggctggatccga

SEQ ID NO: 313635 - DNA, 20 bp, human
gagctcgcgcaggacggggc

SEQ ID NO: 313636 - DNA, 20 bp, human
gacgggagttgtagttgagg

SEQ ID NO: 313637 - DNA, 20 bp, human
gtcccagcgtgcaaagggcg

SEQ ID NO: 313638 - DNA, 20 bp, human
gggctctagcgaggcctgaa

SEQ ID NO: 313639 - DNA, 20 bp, human
gcgcccgcccccggaccaga

SEQ ID NO: 313640 - DNA, 20 bp, human
gtgggtgacgccttctggtc

SEQ ID NO: 313641 - DNA, 20 bp, human
ggctggcggcgtctggaccg

SEQ ID NO: 313642 - DNA, 20 bp, human
gcggggaggaggctctagcg

SEQ ID NO: 313643 - DNA, 20 bp, human
gcaatcggatacaatcccag

SEQ ID NO: 313644 - DNA, 20 bp, human
gatgctcggaaagagcgccg

SEQ ID NO: 313645 - DNA, 20 bp, human
gcgtaaccaggcaggagtag

SEQ ID NO: 313646 - DNA, 20 bp, human
gagcaaggcagttttcaagt

SEQ ID NO: 313647 - DNA, 20 bp, human
gcggaccggaagcactgagg

SEQ ID NO: 313648 - DNA, 20 bp, human
gacagcggaagactgttgtg

SEQ ID NO: 313649 - DNA, 20 bp, human
gtacctggggatctcacccg

SEQ ID NO: 313650 - DNA, 20 bp, human
gcggccaaggagggattcgc

SEQ ID NO: 313651 - DNA, 20 bp, human
gacgccaaagaaagcggaaa

SEQ ID NO: 313652 - DNA, 20 bp, human
gaatccggccaatccccggc

SEQ ID NO: 313653 - DNA, 20 bp, human
gtgaaggacgccaaagaaag

SEQ ID NO: 313654 - DNA, 20 bp, human
gaggcggaccggaagcactg

SEQ ID NO: 313655 - DNA, 20 bp, human
gagggcttggtcattggaag

SEQ ID NO: 313656 - DNA, 20 bp, human
ggccacgcgcgacgctatcg

SEQ ID NO: 313657 - DNA, 20 bp, human
ggtacgatgacccaagatgg

SEQ ID NO: 313658 - DNA, 20 bp, human
gagccggggtagccggaagt

SEQ ID NO: 313659 - DNA, 20 bp, human
gaccgctgtagggaggttgt

SEQ ID NO: 313660 - DNA, 20 bp, human
ggcgtcgcgcgtggccaccg

SEQ ID NO: 313661 - DNA, 20 bp, human
gccgaggccacgcctacttc

SEQ ID NO: 313662 - DNA, 20 bp, human
ggggtagccggaagtaggcg

SEQ ID NO: 313663 - DNA, 20 bp, human
ggggcacaggacccctgatc

SEQ ID NO: 313664 - DNA, 20 bp, human
ggcgacgctatcggggaagc

SEQ ID NO: 313665 - DNA, 20 bp, human
gcagaacggcttaatctggg

SEQ ID NO: 313666 - DNA, 20 bp, human
gtcctagcccaggcggagga

SEQ ID NO: 313667 - DNA, 20 bp, human
ggctctgggcttcctagccc

SEQ ID NO: 313668 - DNA, 20 bp, human
ggcatgggggagcccaaagt

SEQ ID NO: 313669 - DNA, 20 bp, human
gtgcacgagttcttccgggg

SEQ ID NO: 313670 - DNA, 20 bp, human
ggcccagagctgcggttcgc

SEQ ID NO: 313671 - DNA, 20 bp, human
gggcttcctagcccaggcgg

SEQ ID NO: 313672 - DNA, 20 bp, human
gggaagtgtcgcattgcgtg

SEQ ID NO: 313673 - DNA, 20 bp, human
gccggaagaactcgtgcagg

SEQ ID NO: 313674 - DNA, 20 bp, human
gcttctgcgggatagacttc

SEQ ID NO: 313675 - DNA, 20 bp, human
gggtctgcggcctgtcaaac

SEQ ID NO: 313676 - DNA, 20 bp, human
ggtaggccccgtggaagtgt

SEQ ID NO: 313677 - DNA, 20 bp, human
gggaagtgtaggccccgtgg

SEQ ID NO: 313678 - DNA, 20 bp, human
gtaggccccgtggaggtgtc

SEQ ID NO: 313679 - DNA, 20 bp, human
gtataggaggaggcgttcaa

SEQ ID NO: 313680 - DNA, 20 bp, human
gacaactcccaaacaccctt

SEQ ID NO: 313681 - DNA, 20 bp, human
gcggggcctacacttccacg

SEQ ID NO: 313682 - DNA, 20 bp, human
gcagtggcccaagggtgttt

SEQ ID NO: 313683 - DNA, 20 bp, human
gggaagacgtcagtggccca

SEQ ID NO: 313684 - DNA, 20 bp, human
gtttcccagacacctccacg

SEQ ID NO: 313685 - DNA, 20 bp, human
gacacagttactataggagg

SEQ ID NO: 313686 - DNA, 20 bp, human
gcgtgatgtaatctcggggg

SEQ ID NO: 313687 - DNA, 20 bp, human
gcggcgtgatgtaatctcgg

SEQ ID NO: 313688 - DNA, 20 bp, human
gcgcctgccagtgacgtcgt

SEQ ID NO: 313689 - DNA, 20 bp, human
gccgccctggtcctcccggt

SEQ ID NO: 313690 - DNA, 20 bp, human
gcgccggccccgcccaacag

SEQ ID NO: 313691 - DNA, 20 bp, human
ggggcgggacgaagcctagg

SEQ ID NO: 313692 - DNA, 20 bp, human
gtgtggcggtacaagaaccc

SEQ ID NO: 313693 - DNA, 20 bp, human
gctgcagcccacgacgtcac

SEQ ID NO: 313694 - DNA, 20 bp, human
ggcgcggcgtgatgtaatct

SEQ ID NO: 313695 - DNA, 20 bp, human
gcgggggcgggacgaagcct

SEQ ID NO: 313696 - DNA, 20 bp, human
gcggggaacagatggcaccg

SEQ ID NO: 313697 - DNA, 20 bp, human
ggagcgggccggggaacaga

SEQ ID NO: 313698 - DNA, 20 bp, human
gtgagcgaaagtatggggag

SEQ ID NO: 313699 - DNA, 20 bp, human
gtgcctgcggcgcgccggta

SEQ ID NO: 313700 - DNA, 20 bp, human
ggaaagtatggggagcgggc

SEQ ID NO: 313701 - DNA, 20 bp, human
ggggaggaccccggcgtcgg

SEQ ID NO: 313702 - DNA, 20 bp, human
gggcgcgccgcaggcagcac

SEQ ID NO: 313703 - DNA, 20 bp, human
gcaaagcccacactttcaag

SEQ ID NO: 313704 - DNA, 20 bp, human
gcgccgcaggcagcactggc

SEQ ID NO: 313705 - DNA, 20 bp, human
gtgagggaggaccccggcgt

SEQ ID NO: 313706 - DNA, 20 bp, human
gggccaggctggtttggctc

SEQ ID NO: 313707 - DNA, 20 bp, human
gtaactatccagacactggc

SEQ ID NO: 313708 - DNA, 20 bp, human
ggcacaggttcatgtctcta

SEQ ID NO: 313709 - DNA, 20 bp, human
gtcccgcccccaaaaagcac

SEQ ID NO: 313710 - DNA, 20 bp, human
ggacatgaacctgtgctttt

SEQ ID NO: 313711 - DNA, 20 bp, human
ggcgggacagttggctggcc

SEQ ID NO: 313712 - DNA, 20 bp, human
gttggtaactatccagacac

SEQ ID NO: 313713 - DNA, 20 bp, human
gcttcttttgcggaactcta

SEQ ID NO: 313714 - DNA, 20 bp, human
gtgcggaactctatggtctg

SEQ ID NO: 313715 - DNA, 20 bp, human
gattgcttccggggttacag

SEQ ID NO: 313716 - DNA, 20 bp, human
gcgcgggagcggcaaactag

SEQ ID NO: 313717 - DNA, 20 bp, human
ggatccctcagccgcgggag

SEQ ID NO: 313718 - DNA, 20 bp, human
ggaaccattcgcatatggag

SEQ ID NO: 313719 - DNA, 20 bp, human
gcaccccctccatatgcgaa

SEQ ID NO: 313720 - DNA, 20 bp, human
gctaggggaaagctcagtcc

SEQ ID NO: 313721 - DNA, 20 bp, human
gagaacgaaccattcgcata

SEQ ID NO: 313722 - DNA, 20 bp, human
ggtaccatgagtgcctgtcg

SEQ ID NO: 313723 - DNA, 20 bp, human
ggtaaggcggacgctgttag

SEQ ID NO: 313724 - DNA, 20 bp, human
gacgctgttaggggtggcgg

SEQ ID NO: 313725 - DNA, 20 bp, human
gcccagggatccctcagccg

SEQ ID NO: 313726 - DNA, 20 bp, human
gacgagccaatcagatcctg

SEQ ID NO: 313727 - DNA, 20 bp, human
ggcgacgaaggactctatcg

SEQ ID NO: 313728 - DNA, 20 bp, human
gcgggacacagacgacgatt

SEQ ID NO: 313729 - DNA, 20 bp, human
gggtctaaacgcggagtggg

SEQ ID NO: 313730 - DNA, 20 bp, human
gtgattggctcgtcacggtc

SEQ ID NO: 313731 - DNA, 20 bp, human
ggacgacgattgggcgacga

SEQ ID NO: 313732 - DNA, 20 bp, human
gacgccctggagctccgcaa

SEQ ID NO: 313733 - DNA, 20 bp, human
gacccccgacgagtcagcaa

SEQ ID NO: 313734 - DNA, 20 bp, human
gtcccccttgcggagctcca

SEQ ID NO: 313735 - DNA, 20 bp, human
gggcgtgtgcggcctcttct

SEQ ID NO: 313736 - DNA, 20 bp, human
gggaaagcggggttagtttt

SEQ ID NO: 313737 - DNA, 20 bp, human
ggcaacacacggggcgggtc

SEQ ID NO: 313738 - DNA, 20 bp, human
ggggctgcaacacacggggc

SEQ ID NO: 313739 - DNA, 20 bp, human
ggggagagaagggtattaca

SEQ ID NO: 313740 - DNA, 20 bp, human
gacacgggctgcaacacacg

SEQ ID NO: 313741 - DNA, 20 bp, human
gtgcgccatcagcatcaacg

SEQ ID NO: 313742 - DNA, 20 bp, human
ggaatagcgcaggacacgag

SEQ ID NO: 313743 - DNA, 20 bp, human
gagaagatgaccccaactgt

SEQ ID NO: 313744 - DNA, 20 bp, human
gtagcgcaggacacgagggg

SEQ ID NO: 313745 - DNA, 20 bp, human
ggagctctcgcgatatttca

SEQ ID NO: 313746 - DNA, 20 bp, human
gccagcacgctgctaaacgt

SEQ ID NO: 313747 - DNA, 20 bp, human
ggcgcgtgatcgggccgtgg

SEQ ID NO: 313748 - DNA, 20 bp, human
gggttcccgctgcgcgtgat

SEQ ID NO: 313749 - DNA, 20 bp, human
ggatgacgcaacgcacgggg

SEQ ID NO: 313750 - DNA, 20 bp, human
gcgtgggcacacaaccacca

SEQ ID NO: 313751 - DNA, 20 bp, human
gcggtcccatccttgtctaa

SEQ ID NO: 313752 - DNA, 20 bp, human
gacggcccgatcacgcgcag

SEQ ID NO: 313753 - DNA, 20 bp, human
gtctgatgacgcaacgcacg

SEQ ID NO: 313754 - DNA, 20 bp, human
gaacctatgtgggccctgta

SEQ ID NO: 313755 - DNA, 20 bp, human
ggcctcgattggtcgatcct

SEQ ID NO: 313756 - DNA, 20 bp, human
ggcaaaagaggcgtttctcg

SEQ ID NO: 313757 - DNA, 20 bp, human
gagggactcacaagtctgag

SEQ ID NO: 313758 - DNA, 20 bp, human
gaaaacctcgactccggaag

SEQ ID NO: 313759 - DNA, 20 bp, human
ggtttctcgtggtgtcttgt

SEQ ID NO: 313760 - DNA, 20 bp, human
ggggtcaccgtgttgcattg

SEQ ID NO: 313761 - DNA, 20 bp, human
ggcgaatcccaggcgcgcca

SEQ ID NO: 313762 - DNA, 20 bp, human
gagtatagggcggcaagcgg

SEQ ID NO: 313763 - DNA, 20 bp, human
gccaacgcttgcaagatgga

SEQ ID NO: 313764 - DNA, 20 bp, human
gagcccgaaaacctcgactc

SEQ ID NO: 313765 - DNA, 20 bp, human
gggcaccaacgcttgcaaga

SEQ ID NO: 313766 - DNA, 20 bp, human
gggtccctttaagggagagt

SEQ ID NO: 313767 - DNA, 20 bp, human
gccgccgcgggtccctttaa

SEQ ID NO: 313768 - DNA, 20 bp, human
gcctacgagaggggtagtgt

SEQ ID NO: 313769 - DNA, 20 bp, human
gtagccgtgggcggagttaa

SEQ ID NO: 313770 - DNA, 20 bp, human
gtccactagctgcgcgcgtt

SEQ ID NO: 313771 - DNA, 20 bp, human
ggcgcgcagctagtggacag

SEQ ID NO: 313772 - DNA, 20 bp, human
gggtcgggggcgctgacctc

SEQ ID NO: 313773 - DNA, 20 bp, human
ggatgcacggcctacgagag

SEQ ID NO: 313774 - DNA, 20 bp, human
gccctttaagggagagtggg

SEQ ID NO: 313775 - DNA, 20 bp, human
gcccgcccactctcccttaa

SEQ ID NO: 313776 - DNA, 20 bp, human
gcgcccgccgccgcagtggt

SEQ ID NO: 313777 - DNA, 20 bp, human
gtggtggggcaggaacggcg

SEQ ID NO: 313778 - DNA, 20 bp, human
gcgcagtggtggggcaggaa

SEQ ID NO: 313779 - DNA, 20 bp, human
gtctctcacctgtccgcttt

SEQ ID NO: 313780 - DNA, 20 bp, human
ggtgagagaaatgatgtgac

SEQ ID NO: 313781 - DNA, 20 bp, human
gtgccccaccactgcggcgg

SEQ ID NO: 313782 - DNA, 20 bp, human
gtacgttccggaagcggaaa

SEQ ID NO: 313783 - DNA, 20 bp, human
gcgctttgggatacgaagag

SEQ ID NO: 313784 - DNA, 20 bp, human
ggggcgctacgttccggaag

SEQ ID NO: 313785 - DNA, 20 bp, human
gttcgtatcccaaagcggac

SEQ ID NO: 313786 - DNA, 20 bp, human
ggacggaagcgtgaaaggga

SEQ ID NO: 313787 - DNA, 20 bp, human
gtcaggacggaagcgtgaaa

SEQ ID NO: 313788 - DNA, 20 bp, human
ggacaagcccgcagtgcgga

SEQ ID NO: 313789 - DNA, 20 bp, human
gagggaaaggggcggagcaa

SEQ ID NO: 313790 - DNA, 20 bp, human
ggggtgagaaatgttctcca

SEQ ID NO: 313791 - DNA, 20 bp, human
ggggccgccttccgcactgc

SEQ ID NO: 313792 - DNA, 20 bp, human
gtggtcacgcgcacgcgaca

SEQ ID NO: 313793 - DNA, 20 bp, human
gcgtgaaagggaaggcatgg

SEQ ID NO: 313794 - DNA, 20 bp, human
gacgcgaggcgtgaactcat

SEQ ID NO: 313795 - DNA, 20 bp, human
ggcggaagtggcggaagcag

SEQ ID NO: 313796 - DNA, 20 bp, human
ggtgacctgccgcgtaggga

SEQ ID NO: 313797 - DNA, 20 bp, human
gctacgcggcaggtcacgtg

SEQ ID NO: 313798 - DNA, 20 bp, human
gagccctgagagctaacttg

SEQ ID NO: 313799 - DNA, 20 bp, human
gggtcctcagcgttctcctg

SEQ ID NO: 313800 - DNA, 20 bp, human
ggtcacgtgaggcttatgat

SEQ ID NO: 313801 - DNA, 20 bp, human
ggaccccaagttagctctca

SEQ ID NO: 313802 - DNA, 20 bp, human
gcccaaggtggatgtagaag

SEQ ID NO: 313803 - DNA, 20 bp, human
gaacttggggtcttttccca

SEQ ID NO: 313804 - DNA, 20 bp, human
gcgtgccctccctacgcggc

SEQ ID NO: 313805 - DNA, 20 bp, human
gagctcgtgcccggagatga

SEQ ID NO: 313806 - DNA, 20 bp, human
gcggggcacgcgaggggtca

SEQ ID NO: 313807 - DNA, 20 bp, human
gcgtgggccgggttcctctg

SEQ ID NO: 313808 - DNA, 20 bp, human
ggcccagcgggcttccccaa

SEQ ID NO: 313809 - DNA, 20 bp, human
gtcctgggcttgagagtctc

SEQ ID NO: 313810 - DNA, 20 bp, human
ggtgccgcctacaggcccgg

SEQ ID NO: 313811 - DNA, 20 bp, human
ggagccacagcgctgtcccc

SEQ ID NO: 313812 - DNA, 20 bp, human
gcggatggcgacggaagggg

SEQ ID NO: 313813 - DNA, 20 bp, human
gctcacgcggtagtagtcgc

SEQ ID NO: 313814 - DNA, 20 bp, human
ggcgggggcggggcacgcga

SEQ ID NO: 313815 - DNA, 20 bp, human
gggcttgagagtctcgggcg

SEQ ID NO: 313816 - DNA, 20 bp, human
gccgagggagacaacgtgcg

SEQ ID NO: 313817 - DNA, 20 bp, human
gagtacctagcccaccggaa

SEQ ID NO: 313818 - DNA, 20 bp, human
gcagcgccgcgcaaagaaac

SEQ ID NO: 313819 - DNA, 20 bp, human
gcgaggtgaggagttgtgca

SEQ ID NO: 313820 - DNA, 20 bp, human
ggccagaaaggacgttgcta

SEQ ID NO: 313821 - DNA, 20 bp, human
gagggcgagaaacgtgtttc

SEQ ID NO: 313822 - DNA, 20 bp, human
ggtactgagcgcgcgaggtg

SEQ ID NO: 313823 - DNA, 20 bp, human
ggcgcaaagaaacaggccga

SEQ ID NO: 313824 - DNA, 20 bp, human
gccggtagtgagaacccttc

SEQ ID NO: 313825 - DNA, 20 bp, human
gtagtgagaacccttccggt

SEQ ID NO: 313826 - DNA, 20 bp, human
ggcgccggaagtggttggga

SEQ ID NO: 313827 - DNA, 20 bp, human
gcacttgcgccggaagtggt

SEQ ID NO: 313828 - DNA, 20 bp, human
gggaaatgtagtctagttaa

SEQ ID NO: 313829 - DNA, 20 bp, human
gaatccctcccaaccacttc

SEQ ID NO: 313830 - DNA, 20 bp, human
gtaagggcccggaagacttc

SEQ ID NO: 313831 - DNA, 20 bp, human
gaagccacttgcgccggaag

SEQ ID NO: 313832 - DNA, 20 bp, human
gtagaacgatggaaacgggt

SEQ ID NO: 313833 - DNA, 20 bp, human
gggagcaggccaccgtgcca

SEQ ID NO: 313834 - DNA, 20 bp, human
gcggaacaactgtattgctg

SEQ ID NO: 313835 - DNA, 20 bp, human
gtagaagaaacaatctataa

SEQ ID NO: 313836 - DNA, 20 bp, human
ggctttcaccgcagcccctg

SEQ ID NO: 313837 - DNA, 20 bp, human
ggcaggcagaagcaagtgat

SEQ ID NO: 313838 - DNA, 20 bp, human
ggagtgctcctgcctgaacc

SEQ ID NO: 313839 - DNA, 20 bp, human
gtgaacctggcaagtaacct

SEQ ID NO: 313840 - DNA, 20 bp, human
gcgctccgaggttacttgcc

SEQ ID NO: 313841 - DNA, 20 bp, human
gtggctcgctcctgcccttt

SEQ ID NO: 313842 - DNA, 20 bp, human
ggcgcggaggagaagtagtg

SEQ ID NO: 313843 - DNA, 20 bp, human
gatagccgagccaaaagggc

SEQ ID NO: 313844 - DNA, 20 bp, human
gtgggagggattcatcatga

SEQ ID NO: 313845 - DNA, 20 bp, human
gtaaagggcgcataagttgc

SEQ ID NO: 313846 - DNA, 20 bp, human
ggcgggagagcgaacagcgg

SEQ ID NO: 313847 - DNA, 20 bp, human
gaccgcggacgagaccaagt

SEQ ID NO: 313848 - DNA, 20 bp, human
gggcgggatgagcattcaca

SEQ ID NO: 313849 - DNA, 20 bp, human
gaccacagcgcgctgagggg

SEQ ID NO: 313850 - DNA, 20 bp, human
gctgcccaacctgcaccctc

SEQ ID NO: 313851 - DNA, 20 bp, human
gctcgtactctgtactctgg

SEQ ID NO: 313852 - DNA, 20 bp, human
gaccgcgggagagcgaacag

SEQ ID NO: 313853 - DNA, 20 bp, human
gggtgactggcccctgagga

SEQ ID NO: 313854 - DNA, 20 bp, human
ggtactctgtactctggcgg

SEQ ID NO: 313855 - DNA, 20 bp, human
gcctatgcaagcagcaaccg

SEQ ID NO: 313856 - DNA, 20 bp, human
ggacccggcgcggcgagaac

SEQ ID NO: 313857 - DNA, 20 bp, human
gtctcgccgcgccgggtcga

SEQ ID NO: 313858 - DNA, 20 bp, human
ggcacgccgcggagcactct

SEQ ID NO: 313859 - DNA, 20 bp, human
gcacaggagacgcttcccgg

SEQ ID NO: 313860 - DNA, 20 bp, human
gacaacctaaaccttccaag

SEQ ID NO: 313861 - DNA, 20 bp, human
gacttcccgcgcagacgcac

SEQ ID NO: 313862 - DNA, 20 bp, human
gcctaaaccttccaagggga

SEQ ID NO: 313863 - DNA, 20 bp, human
gctgcgcgggaagtggaacc

SEQ ID NO: 313864 - DNA, 20 bp, human
gggaagtggaacctggctct

SEQ ID NO: 313865 - DNA, 20 bp, human
gttgtaggcggccttcgacc

SEQ ID NO: 313866 - DNA, 20 bp, human
gggtctcagcggggaagaca

SEQ ID NO: 313867 - DNA, 20 bp, human
gaagcggcgcggggaacctt

SEQ ID NO: 313868 - DNA, 20 bp, human
ggtggcctctggaaccgaag

SEQ ID NO: 313869 - DNA, 20 bp, human
gcgcgggcgggagtaactaa

SEQ ID NO: 313870 - DNA, 20 bp, human
gggcgggagtaactaaggga

SEQ ID NO: 313871 - DNA, 20 bp, human
ggagacccttccctgcgtgg

SEQ ID NO: 313872 - DNA, 20 bp, human
gaaccgaagcggcgaccctg

SEQ ID NO: 313873 - DNA, 20 bp, human
ggggactgggggggacgaga

SEQ ID NO: 313874 - DNA, 20 bp, human
ggcagggaagggtctcagcg

SEQ ID NO: 313875 - DNA, 20 bp, human
gtggcccggccttcccgcca

SEQ ID NO: 313876 - DNA, 20 bp, human
gtcgccccggttccagtagt

SEQ ID NO: 313877 - DNA, 20 bp, human
gctctcggggcgcccagaat

SEQ ID NO: 313878 - DNA, 20 bp, human
gataccaactactggaaccg

SEQ ID NO: 313879 - DNA, 20 bp, human
ggtcgtcgagagcgacaaaa

SEQ ID NO: 313880 - DNA, 20 bp, human
ggatacctccgagagggcag

SEQ ID NO: 313881 - DNA, 20 bp, human
ggccgcggatacctccgaga

SEQ ID NO: 313882 - DNA, 20 bp, human
gatcccagctagcatctctg

SEQ ID NO: 313883 - DNA, 20 bp, human
ggttacagctcgacctctcg

SEQ ID NO: 313884 - DNA, 20 bp, human
ggccctctcggaggtatccg

SEQ ID NO: 313885 - DNA, 20 bp, human
gccaggccagtgagtgactt

SEQ ID NO: 313886 - DNA, 20 bp, human
ggacccgcgcgcttgcggag

SEQ ID NO: 313887 - DNA, 20 bp, human
gcttgcggaggggaggtcaa

SEQ ID NO: 313888 - DNA, 20 bp, human
gaaaggaagacacgcctcgt

SEQ ID NO: 313889 - DNA, 20 bp, human
gctgtgtcggacccgtgctg

SEQ ID NO: 313890 - DNA, 20 bp, human
gccccccggacgcagagctc

SEQ ID NO: 313891 - DNA, 20 bp, human
gaagcgcgcgggtcacgggg

SEQ ID NO: 313892 - DNA, 20 bp, human
gagagctctggaggccaacg

SEQ ID NO: 313893 - DNA, 20 bp, human
gtgggcggggtcgggaatag

SEQ ID NO: 313894 - DNA, 20 bp, human
gcacgccactcccagatgaa

SEQ ID NO: 313895 - DNA, 20 bp, human
gtgctggcggccatgtaggg

SEQ ID NO: 313896 - DNA, 20 bp, human
gggaaaggacgattctcagt

SEQ ID NO: 313897 - DNA, 20 bp, human
gactggagaagttatatgat

SEQ ID NO: 313898 - DNA, 20 bp, human
ggacgattctcagtgggcgt

SEQ ID NO: 313899 - DNA, 20 bp, human
ggcaaaggaggttgccgtat

SEQ ID NO: 313900 - DNA, 20 bp, human
ggtagggaccaatcggaaag

SEQ ID NO: 313901 - DNA, 20 bp, human
gtgtgcttagacctgacgct

SEQ ID NO: 313902 - DNA, 20 bp, human
ggtcctacaagtaacctagg

SEQ ID NO: 313903 - DNA, 20 bp, human
gaaacgcaggaaaccacgac

SEQ ID NO: 313904 - DNA, 20 bp, human
gttacttgtaggaccctata

SEQ ID NO: 313905 - DNA, 20 bp, human
gggttatgttgcgtcattca

SEQ ID NO: 313906 - DNA, 20 bp, human
gcggcgaacccgacagtgga

SEQ ID NO: 313907 - DNA, 20 bp, human
gtacaatcgcggggtgggtc

SEQ ID NO: 313908 - DNA, 20 bp, human
gcccgcgattgtagtcctag

SEQ ID NO: 313909 - DNA, 20 bp, human
ggccgaggcgggtcccagac

SEQ ID NO: 313910 - DNA, 20 bp, human
gtagcccaccggagcgcaaa

SEQ ID NO: 313911 - DNA, 20 bp, human
ggaaggcgccaggccggaag

SEQ ID NO: 313912 - DNA, 20 bp, human
gtggtcacgccctccactgt

SEQ ID NO: 313913 - DNA, 20 bp, human
gcctcgccagagttcagcaa

SEQ ID NO: 313914 - DNA, 20 bp, human
gaactggctccgcccggccg

SEQ ID NO: 313915 - DNA, 20 bp, human
ggcgctccggtgggctacag

SEQ ID NO: 313916 - DNA, 20 bp, human
gctcgcgcaggcaactatta

SEQ ID NO: 313917 - DNA, 20 bp, human
ggggctggggagagttagaa

SEQ ID NO: 313918 - DNA, 20 bp, human
ggagggggagccagtaactc

SEQ ID NO: 313919 - DNA, 20 bp, human
gaactccgggtcgttcacta

SEQ ID NO: 313920 - DNA, 20 bp, human
gcgcctgtgcggaggacccg

SEQ ID NO: 313921 - DNA, 20 bp, human
gggcgccaggtacacctcgg

SEQ ID NO: 313922 - DNA, 20 bp, human
gggaagcttggcagctagag

SEQ ID NO: 313923 - DNA, 20 bp, human
gagcgccgccgcctgtgcgg

SEQ ID NO: 313924 - DNA, 20 bp, human
ggctagcgccgccgcctgtg

SEQ ID NO: 313925 - DNA, 20 bp, human
ggtgaacgacccggagttac

SEQ ID NO: 313926 - DNA, 20 bp, human
gcggtccggccggaagtcac

SEQ ID NO: 313927 - DNA, 20 bp, human
ggcggaagaaggtgcgtccg

SEQ ID NO: 313928 - DNA, 20 bp, human
gcatggcgcgggttggaccc

SEQ ID NO: 313929 - DNA, 20 bp, human
gccggaagcgaggaagaggt

SEQ ID NO: 313930 - DNA, 20 bp, human
ggcgcgggttggacccggga

SEQ ID NO: 313931 - DNA, 20 bp, human
gccggcggagtcctcagcgt

SEQ ID NO: 313932 - DNA, 20 bp, human
gtcggagtctgagatctccc

SEQ ID NO: 313933 - DNA, 20 bp, human
gagcgaggaagaggtcggtc

SEQ ID NO: 313934 - DNA, 20 bp, human
gtcagcggcgacctccaacc

SEQ ID NO: 313935 - DNA, 20 bp, human
ggggcccgcctcccagtcgg

SEQ ID NO: 313936 - DNA, 20 bp, human
gaccgtagggataggggttg

SEQ ID NO: 313937 - DNA, 20 bp, human
gggagaaagaggaaacacgt

SEQ ID NO: 313938 - DNA, 20 bp, human
gaagcggcgttcagtgtcag

SEQ ID NO: 313939 - DNA, 20 bp, human
gaaggcgggcgtgctctggg

SEQ ID NO: 313940 - DNA, 20 bp, human
gaggggttgcggctcactga

SEQ ID NO: 313941 - DNA, 20 bp, human
gagagccgagtcaaatgtgc

SEQ ID NO: 313942 - DNA, 20 bp, human
ggttgcggctcactgaaggc

SEQ ID NO: 313943 - DNA, 20 bp, human
ggataaagaccgtagggata

SEQ ID NO: 313944 - DNA, 20 bp, human
ggggtagaccgcctgactct

SEQ ID NO: 313945 - DNA, 20 bp, human
gagtcaggcggtctacccga

SEQ ID NO: 313946 - DNA, 20 bp, human
ggaaacaatagaacacacgt

SEQ ID NO: 313947 - DNA, 20 bp, human
gggagccagccccacggcgg

SEQ ID NO: 313948 - DNA, 20 bp, human
gacgtgggtggatcctagta

SEQ ID NO: 313949 - DNA, 20 bp, human
gtcccgggacgtcacggagg

SEQ ID NO: 313950 - DNA, 20 bp, human
gagcgagccgcggcgatcac

SEQ ID NO: 313951 - DNA, 20 bp, human
gtggatcctagtagggagaa

SEQ ID NO: 313952 - DNA, 20 bp, human
gcggaggcggagaccggact

SEQ ID NO: 313953 - DNA, 20 bp, human
gacaatagaacacacgtggg

SEQ ID NO: 313954 - DNA, 20 bp, human
ggtgggcggggtcaggcaca

SEQ ID NO: 313955 - DNA, 20 bp, human
gtgggctctcctccgccgtg

SEQ ID NO: 313956 - DNA, 20 bp, human
gcgaccgcggacagccccgc

SEQ ID NO: 313957 - DNA, 20 bp, human
gcccgccctcgggtcctaac

SEQ ID NO: 313958 - DNA, 20 bp, human
ggggctgtccgcggtcgcgc

SEQ ID NO: 313959 - DNA, 20 bp, human
gcccgcgggcgcctcccgtt

SEQ ID NO: 313960 - DNA, 20 bp, human
gagggcggggcttggactgg

SEQ ID NO: 313961 - DNA, 20 bp, human
ggcctcccgttaggacccga

SEQ ID NO: 313962 - DNA, 20 bp, human
gagagagggcaggaccggcc

SEQ ID NO: 313963 - DNA, 20 bp, human
gaggaccggccgggtggatt

SEQ ID NO: 313964 - DNA, 20 bp, human
gtcctgcagcgccggagaga

SEQ ID NO: 313965 - DNA, 20 bp, human
gccgggctccgcctgcagtg

SEQ ID NO: 313966 - DNA, 20 bp, human
gaggggcggtgctgcagacg

SEQ ID NO: 313967 - DNA, 20 bp, human
gggcaggcagggtcgcgagg

SEQ ID NO: 313968 - DNA, 20 bp, human
ggcccccagccacaactctc

SEQ ID NO: 313969 - DNA, 20 bp, human
gtcccgcccggggtcggtag

SEQ ID NO: 313970 - DNA, 20 bp, human
gcgggcgaggggcacgcgca

SEQ ID NO: 313971 - DNA, 20 bp, human
gagcccgccggccgcggcta

SEQ ID NO: 313972 - DNA, 20 bp, human
gatggcaggaggcggggtag

SEQ ID NO: 313973 - DNA, 20 bp, human
gaggtagcaggcatggcagg

SEQ ID NO: 313974 - DNA, 20 bp, human
ggggcggcggcaaggcgcgc

SEQ ID NO: 313975 - DNA, 20 bp, human
gcgccggccgcggctagggg

SEQ ID NO: 313976 - DNA, 20 bp, human
gccagactgcgacggataca

SEQ ID NO: 313977 - DNA, 20 bp, human
ggggccgggcggctgcaata

SEQ ID NO: 313978 - DNA, 20 bp, human
gactgcgacggatacaggga

SEQ ID NO: 313979 - DNA, 20 bp, human
gacggatacagggagggcaa

SEQ ID NO: 313980 - DNA, 20 bp, human
gctggcgcggccctcggtga

SEQ ID NO: 313981 - DNA, 20 bp, human
gccggcgccctgatagggaa

SEQ ID NO: 313982 - DNA, 20 bp, human
gagggaaggggcgtgatcgc

SEQ ID NO: 313983 - DNA, 20 bp, human
ggagtgagtgccgtcaccga

SEQ ID NO: 313984 - DNA, 20 bp, human
gggcggctgcaatatggcgg

SEQ ID NO: 313985 - DNA, 20 bp, human
ggacggcactcactcctctc

SEQ ID NO: 313986 - DNA, 20 bp, human
gtgggtgcatggtgtccgcg

SEQ ID NO: 313987 - DNA, 20 bp, human
gacgagctgtcgcggatcgc

SEQ ID NO: 313988 - DNA, 20 bp, human
gtcaggacgtgaagagaaag

SEQ ID NO: 313989 - DNA, 20 bp, human
ggacacgccccctgatccaa

SEQ ID NO: 313990 - DNA, 20 bp, human
gccaccagcgatccttcttg

SEQ ID NO: 313991 - DNA, 20 bp, human
gtgaggtcgacaccgagcag

SEQ ID NO: 313992 - DNA, 20 bp, human
gtggagtcggatacgccccg

SEQ ID NO: 313993 - DNA, 20 bp, human
gtaatggcgcggggttccag

SEQ ID NO: 313994 - DNA, 20 bp, human
gaatcagcgacgagctgtcg

SEQ ID NO: 313995 - DNA, 20 bp, human
gccggctcgaggtgcagcaa

SEQ ID NO: 313996 - DNA, 20 bp, human
ggaggtgcagggacatgtcg

SEQ ID NO: 313997 - DNA, 20 bp, human
gagctgagagcaccacgccg

SEQ ID NO: 313998 - DNA, 20 bp, human
ggcgtcgggacctggtttcc

SEQ ID NO: 313999 - DNA, 20 bp, human
gaaaccaggtcccgacgccg

SEQ ID NO: 314000 - DNA, 20 bp, human
gccagcgacaggacaatccg

SEQ ID NO: 314001 - DNA, 20 bp, human
gtcccgacgccgcggtcaga

SEQ ID NO: 314002 - DNA, 20 bp, human
gcgaggccacgaggtgagtt

SEQ ID NO: 314003 - DNA, 20 bp, human
gtacaggaggccgccctcgc

SEQ ID NO: 314004 - DNA, 20 bp, human
gctagaggtccgtctgaccg

SEQ ID NO: 314005 - DNA, 20 bp, human
gcgcaggcttaacgcgtcac

SEQ ID NO: 314006 - DNA, 20 bp, human
gtaggcaagcaaacgtctat

SEQ ID NO: 314007 - DNA, 20 bp, human
gtgccccctcacttaggtac

SEQ ID NO: 314008 - DNA, 20 bp, human
ggtaccttccgagcatgcgt

SEQ ID NO: 314009 - DNA, 20 bp, human
gcacctgtacctaagtgagg

SEQ ID NO: 314010 - DNA, 20 bp, human
gctgtccaacctaggttctt

SEQ ID NO: 314011 - DNA, 20 bp, human
gagcaaacgtctattggctg

SEQ ID NO: 314012 - DNA, 20 bp, human
gttccccacgcatgctcgga

SEQ ID NO: 314013 - DNA, 20 bp, human
gagcgcccaagaacctaggt

SEQ ID NO: 314014 - DNA, 20 bp, human
ggggcccgaaagccagacag

SEQ ID NO: 314015 - DNA, 20 bp, human
ggggaagtagcacgcaggcg

SEQ ID NO: 314016 - DNA, 20 bp, human
gagcgcgcgaggccctcggt

SEQ ID NO: 314017 - DNA, 20 bp, human
gcagctctgtggtcccgcgg

SEQ ID NO: 314018 - DNA, 20 bp, human
gacgggacgctcgggattca

SEQ ID NO: 314019 - DNA, 20 bp, human
ggcatgcgctcgcatcatgg

SEQ ID NO: 314020 - DNA, 20 bp, human
gcaccccgttaggaccccgg

SEQ ID NO: 314021 - DNA, 20 bp, human
gactctgggacggccctcgg

SEQ ID NO: 314022 - DNA, 20 bp, human
gcgcgaggccctcggtcgga

SEQ ID NO: 314023 - DNA, 20 bp, human
ggcgcgctatcccagctctg

SEQ ID NO: 314024 - DNA, 20 bp, human
gtgggtcaggcacacgcgag

SEQ ID NO: 314025 - DNA, 20 bp, human
ggcaccacccaccgccgtcc

SEQ ID NO: 314026 - DNA, 20 bp, human
gcgcacgcctcctctgagag

SEQ ID NO: 314027 - DNA, 20 bp, human
gtcccagcccctctcagagg

SEQ ID NO: 314028 - DNA, 20 bp, human
gcaccctgggcccctccgat

SEQ ID NO: 314029 - DNA, 20 bp, human
gtggggcagtcgctcaccct

SEQ ID NO: 314030 - DNA, 20 bp, human
ggggactgccatctgctgtg

SEQ ID NO: 314031 - DNA, 20 bp, human
gtcctgtcctggggattcgg

SEQ ID NO: 314032 - DNA, 20 bp, human
gctgctgtgtggatacccat

SEQ ID NO: 314033 - DNA, 20 bp, human
gcagaggaggcgtgcggccg

SEQ ID NO: 314034 - DNA, 20 bp, human
ggcttctcggctctgagctc

SEQ ID NO: 314035 - DNA, 20 bp, human
gccccgagccaggccggagt

SEQ ID NO: 314036 - DNA, 20 bp, human
gcatgccaggcagtcccctg

SEQ ID NO: 314037 - DNA, 20 bp, human
gcagcccccaccctataagc

SEQ ID NO: 314038 - DNA, 20 bp, human
gcacacctgcttatagggtg

SEQ ID NO: 314039 - DNA, 20 bp, human
gctgatagacatcaggtgac

SEQ ID NO: 314040 - DNA, 20 bp, human
ggaaatcgctgatagacatc

SEQ ID NO: 314041 - DNA, 20 bp, human
gcaagaagtgaaacctggta

SEQ ID NO: 314042 - DNA, 20 bp, human
gccaatgaggacaatatttg

SEQ ID NO: 314043 - DNA, 20 bp, human
gacttcttgaaaaagacccc

SEQ ID NO: 314044 - DNA, 20 bp, human
gaaggtagcatgagcatgcc

SEQ ID NO: 314045 - DNA, 20 bp, human
gtggctgggtacatgtacta

SEQ ID NO: 314046 - DNA, 20 bp, human
gttcacctgccggggtttgg

SEQ ID NO: 314047 - DNA, 20 bp, human
gaatgggcacaggggtgtca

SEQ ID NO: 314048 - DNA, 20 bp, human
gggccaagagctgctgatgg

SEQ ID NO: 314049 - DNA, 20 bp, human
ggtagctcgcgaatgggcac

SEQ ID NO: 314050 - DNA, 20 bp, human
gctaagattttcacctgccg

SEQ ID NO: 314051 - DNA, 20 bp, human
gcctcccgccaaaccccggc

SEQ ID NO: 314052 - DNA, 20 bp, human
gtgtaatcgtcttagatcct

SEQ ID NO: 314053 - DNA, 20 bp, human
ggtggctgtagctcgcgaat

SEQ ID NO: 314054 - DNA, 20 bp, human
gtgacagcttccatgcaacc

SEQ ID NO: 314055 - DNA, 20 bp, human
ggctccccagagacagcgct

SEQ ID NO: 314056 - DNA, 20 bp, human
gtcccagtaaaaattagagg

SEQ ID NO: 314057 - DNA, 20 bp, human
gaatactaaagtgtttggga

SEQ ID NO: 314058 - DNA, 20 bp, human
ggcttcccagtaaaaattag

SEQ ID NO: 314059 - DNA, 20 bp, human
gtaaatgcaactgtaaagtt

SEQ ID NO: 314060 - DNA, 20 bp, human
gtagttccagagtcctttta

SEQ ID NO: 314061 - DNA, 20 bp, human
gataaagatacaagacaaat

SEQ ID NO: 314062 - DNA, 20 bp, human
gtgattgagcattagaaagc

SEQ ID NO: 314063 - DNA, 20 bp, human
ggttgcatttacatctcttg

SEQ ID NO: 314064 - DNA, 20 bp, human
gtgtttgggagggtcacaat

SEQ ID NO: 314065 - DNA, 20 bp, human
gtcctcctctaatttttact

SEQ ID NO: 314066 - DNA, 20 bp, human
ggcaccaaaacgtagttaac

SEQ ID NO: 314067 - DNA, 20 bp, human
gcacccggttaactacgttt

SEQ ID NO: 314068 - DNA, 20 bp, human
gacccactcaggaactgccg

SEQ ID NO: 314069 - DNA, 20 bp, human
gatgggcaatctcagaatag

SEQ ID NO: 314070 - DNA, 20 bp, human
gaaccgggtgtctgaccaca

SEQ ID NO: 314071 - DNA, 20 bp, human
ggccccggcagttcctgagt

SEQ ID NO: 314072 - DNA, 20 bp, human
gtaggctcctggcagccatg

SEQ ID NO: 314073 - DNA, 20 bp, human
gagttcctgagtgggtgcgc

SEQ ID NO: 314074 - DNA, 20 bp, human
gagtgaagtggctaaatcaa

SEQ ID NO: 314075 - DNA, 20 bp, human
gtcaggaactgccggggcgg

SEQ ID NO: 314076 - DNA, 20 bp, human
gggaagtccaggcacatctt

SEQ ID NO: 314077 - DNA, 20 bp, human
ggacttaaataattctatgt

SEQ ID NO: 314078 - DNA, 20 bp, human
gtgcagactagtgatttgta

SEQ ID NO: 314079 - DNA, 20 bp, human
gactgctctaagaaagggac

SEQ ID NO: 314080 - DNA, 20 bp, human
gaaatcactagtctgcacaa

SEQ ID NO: 314081 - DNA, 20 bp, human
ggacctcagaatttagaaag

SEQ ID NO: 314082 - DNA, 20 bp, human
gataattctatgtaggagta

SEQ ID NO: 314083 - DNA, 20 bp, human
gaattccactctgtgggtgt

SEQ ID NO: 314084 - DNA, 20 bp, human
ggtaagctgaaagcaacctg

SEQ ID NO: 314085 - DNA, 20 bp, human
gacacccaaaagaagtaaca

SEQ ID NO: 314086 - DNA, 20 bp, human
ggggccagccacgctctccg

SEQ ID NO: 314087 - DNA, 20 bp, human
gcatgcggtgcagggaatgt

SEQ ID NO: 314088 - DNA, 20 bp, human
gccagtggccaacaagcggg

SEQ ID NO: 314089 - DNA, 20 bp, human
gagtcctgagaaagccaggt

SEQ ID NO: 314090 - DNA, 20 bp, human
ggctctccgcggggccggca

SEQ ID NO: 314091 - DNA, 20 bp, human
gccgccctcctcccgcttgt

SEQ ID NO: 314092 - DNA, 20 bp, human
ggagaggcagctgctgcaca

SEQ ID NO: 314093 - DNA, 20 bp, human
gtgtgctttgtgggtcccgt

SEQ ID NO: 314094 - DNA, 20 bp, human
ggccccgcggagagcgtggc

SEQ ID NO: 314095 - DNA, 20 bp, human
gaggtgaggcatgcggtgca

SEQ ID NO: 314096 - DNA, 20 bp, human
gtggacccaaggactactgt

SEQ ID NO: 314097 - DNA, 20 bp, human
ggcaaatccaaatccgtaaa

SEQ ID NO: 314098 - DNA, 20 bp, human
ggcaagactagggtttcccg

SEQ ID NO: 314099 - DNA, 20 bp, human
gcaagaagctaagtagcctc

SEQ ID NO: 314100 - DNA, 20 bp, human
gccagggcagggggcaagat

SEQ ID NO: 314101 - DNA, 20 bp, human
gggcagggggcaagatgggg

SEQ ID NO: 314102 - DNA, 20 bp, human
gccatcccacagtagtcctt

SEQ ID NO: 314103 - DNA, 20 bp, human
gctggcaaagctgattgatc

SEQ ID NO: 314104 - DNA, 20 bp, human
gttaaaatgccaactgcagg

SEQ ID NO: 314105 - DNA, 20 bp, human
gtgcccactcaacaaactca

SEQ ID NO: 314106 - DNA, 20 bp, human
gcacccctggggtgattctg

SEQ ID NO: 314107 - DNA, 20 bp, human
ggggctcatcccagaccaaa

SEQ ID NO: 314108 - DNA, 20 bp, human
ggtgatgcgaatttgcactc

SEQ ID NO: 314109 - DNA, 20 bp, human
gcacaagtgtgcagagacac

SEQ ID NO: 314110 - DNA, 20 bp, human
ggtgccccagaatcacccca

SEQ ID NO: 314111 - DNA, 20 bp, human
gagcagaactgcgggcctgt

SEQ ID NO: 314112 - DNA, 20 bp, human
gctgagaatcacaggcataa

SEQ ID NO: 314113 - DNA, 20 bp, human
gatacaaatctctgagggta

SEQ ID NO: 314114 - DNA, 20 bp, human
gtgagggtagggtccacacc

SEQ ID NO: 314115 - DNA, 20 bp, human
ggatttgtatccatttggtc

SEQ ID NO: 314116 - DNA, 20 bp, human
ggctgaattgggacacaagt

SEQ ID NO: 314117 - DNA, 20 bp, human
gacaacagcacttcagtttt

SEQ ID NO: 314118 - DNA, 20 bp, human
gttagcttttacacactatc

SEQ ID NO: 314119 - DNA, 20 bp, human
gtgtaaatcctgctagtctc

SEQ ID NO: 314120 - DNA, 20 bp, human
gataacttctgccatagaaa

SEQ ID NO: 314121 - DNA, 20 bp, human
ggccagacagataagtttct

SEQ ID NO: 314122 - DNA, 20 bp, human
gtcaggcaaaattatgctcc

SEQ ID NO: 314123 - DNA, 20 bp, human
gaggaagacaagcttttcaa

SEQ ID NO: 314124 - DNA, 20 bp, human
gaagagatgtgcccttcttc

SEQ ID NO: 314125 - DNA, 20 bp, human
gcccaattcagccatttcta

SEQ ID NO: 314126 - DNA, 20 bp, human
ggatccattgtgtttcccca

SEQ ID NO: 314127 - DNA, 20 bp, human
ggaaacacaagcaacaatat

SEQ ID NO: 314128 - DNA, 20 bp, human
ggtgagggataactgtcttc

SEQ ID NO: 314129 - DNA, 20 bp, human
ggaaacacaatggatcagcg

SEQ ID NO: 314130 - DNA, 20 bp, human
ggattaggaaactggtgtga

SEQ ID NO: 314131 - DNA, 20 bp, human
gctaatcatcactaagccct

SEQ ID NO: 314132 - DNA, 20 bp, human
gcttggtgaaagtgttttgc

SEQ ID NO: 314133 - DNA, 20 bp, human
gtcctctaaagtgttgcata

SEQ ID NO: 314134 - DNA, 20 bp, human
gttggaggtagaacagtgtt

SEQ ID NO: 314135 - DNA, 20 bp, human
gtaagagaagcatctggagg

SEQ ID NO: 314136 - DNA, 20 bp, human
gtgtgtgaccctgtgaaagg

SEQ ID NO: 314137 - DNA, 20 bp, human
ggctagttcctcttttatat

SEQ ID NO: 314138 - DNA, 20 bp, human
gacgacttttgaagagagtc

SEQ ID NO: 314139 - DNA, 20 bp, human
gggagtgggggaagttgatt

SEQ ID NO: 314140 - DNA, 20 bp, human
gtccaaacatctgctagaag

SEQ ID NO: 314141 - DNA, 20 bp, human
gcaggaagacaagagtactg

SEQ ID NO: 314142 - DNA, 20 bp, human
gaaatgtgtgaccctgtgaa

SEQ ID NO: 314143 - DNA, 20 bp, human
gccacctttagagattcatc

SEQ ID NO: 314144 - DNA, 20 bp, human
ggtaaataccccctttcaca

SEQ ID NO: 314145 - DNA, 20 bp, human
gccaacttgttgccatttta

SEQ ID NO: 314146 - DNA, 20 bp, human
gttactgtgggtatcagtgg

SEQ ID NO: 314147 - DNA, 20 bp, human
gtctgggaagaagagtactg

SEQ ID NO: 314148 - DNA, 20 bp, human
gaatgtgtgaaattgtgaaa

SEQ ID NO: 314149 - DNA, 20 bp, human
gacaatctttgagcagagtc

SEQ ID NO: 314150 - DNA, 20 bp, human
gctgtgggtatcagtggtgg

SEQ ID NO: 314151 - DNA, 20 bp, human
gaatagtaacagtagttctc

SEQ ID NO: 314152 - DNA, 20 bp, human
gtccaaacatctactagaaa

SEQ ID NO: 314153 - DNA, 20 bp, human
gtcccctgaacctgattcat

SEQ ID NO: 314154 - DNA, 20 bp, human
gacatgaatagccacaaaat

SEQ ID NO: 314155 - DNA, 20 bp, human
gaccaatgaatcaggttcag

SEQ ID NO: 314156 - DNA, 20 bp, human
gagaacctgacaagtagtcc

SEQ ID NO: 314157 - DNA, 20 bp, human
gtaaaccaggactacttgtc

SEQ ID NO: 314158 - DNA, 20 bp, human
gagtaaaatgcctgggactg

SEQ ID NO: 314159 - DNA, 20 bp, human
gtggctataagtaaaatgcc

SEQ ID NO: 314160 - DNA, 20 bp, human
gaagtagtcctggtttagtt

SEQ ID NO: 314161 - DNA, 20 bp, human
gactgctcaagatcccaaga

SEQ ID NO: 314162 - DNA, 20 bp, human
gtagatcatctagtccaatt

SEQ ID NO: 314163 - DNA, 20 bp, human
gaagtcacatccccctctcc

SEQ ID NO: 314164 - DNA, 20 bp, human
ggtaaactcctaactaaacc

SEQ ID NO: 314165 - DNA, 20 bp, human
gttcagctcaaggaaacctc

SEQ ID NO: 314166 - DNA, 20 bp, human
gaagtggcaattcacacata

SEQ ID NO: 314167 - DNA, 20 bp, human
gagaggagcaataccaacac

SEQ ID NO: 314168 - DNA, 20 bp, human
gtaaacactggaataaggaa

SEQ ID NO: 314169 - DNA, 20 bp, human
gccagtgtttacagctatac

SEQ ID NO: 314170 - DNA, 20 bp, human
ggtaagtagaaaccgttgat

SEQ ID NO: 314171 - DNA, 20 bp, human
ggatgactttcagaagatga

SEQ ID NO: 314172 - DNA, 20 bp, human
gaacagacttgcctaacaac

SEQ ID NO: 314173 - DNA, 20 bp, human
gtatgacaattctccagtgt

SEQ ID NO: 314174 - DNA, 20 bp, human
gaaacttgtatgtctcgaag

SEQ ID NO: 314175 - DNA, 20 bp, human
gtttacagaaaaggaagtgc

SEQ ID NO: 314176 - DNA, 20 bp, human
gaggccaagtctggactaat

SEQ ID NO: 314177 - DNA, 20 bp, human
ggtacagagctcccaagttc

SEQ ID NO: 314178 - DNA, 20 bp, human
gctaacacacaggccaagtc

SEQ ID NO: 314179 - DNA, 20 bp, human
gtgatggtctcattggaaat

SEQ ID NO: 314180 - DNA, 20 bp, human
gctgccaattagtccagact

SEQ ID NO: 314181 - DNA, 20 bp, human
gcaagttctggctgcaaaac

SEQ ID NO: 314182 - DNA, 20 bp, human
gtgtcagtaggactgggcaa

SEQ ID NO: 314183 - DNA, 20 bp, human
gagtgaaagccacacaacct

SEQ ID NO: 314184 - DNA, 20 bp, human
gataatggtgttgccaacta

SEQ ID NO: 314185 - DNA, 20 bp, human
gaaaaatcctcatgatacca

SEQ ID NO: 314186 - DNA, 20 bp, human
gggaagtccaggcacatctt

SEQ ID NO: 314187 - DNA, 20 bp, human
ggacttaaataattctatgt

SEQ ID NO: 314188 - DNA, 20 bp, human
gtgcagactagtgatttgta

SEQ ID NO: 314189 - DNA, 20 bp, human
gactgctctaagaaagggac

SEQ ID NO: 314190 - DNA, 20 bp, human
gaaatcactagtctgcacaa

SEQ ID NO: 314191 - DNA, 20 bp, human
ggacctcagaatttagaaag

SEQ ID NO: 314192 - DNA, 20 bp, human
gataattctatgtaggagta

SEQ ID NO: 314193 - DNA, 20 bp, human
gaattccactctgtgggtgt

SEQ ID NO: 314194 - DNA, 20 bp, human
ggtaagctgaaagcaacctg

SEQ ID NO: 314195 - DNA, 20 bp, human
gacacccaaaagaagtaaca

SEQ ID NO: 314196 - DNA, 20 bp, human
gggagacacagaaatgaact

SEQ ID NO: 314197 - DNA, 20 bp, human
ggtctatggtataatctcca

SEQ ID NO: 314198 - DNA, 20 bp, human
gacagatttaccgttgaaga

SEQ ID NO: 314199 - DNA, 20 bp, human
gttctcctctgttctcctgt

SEQ ID NO: 314200 - DNA, 20 bp, human
gtggaatgccctcccatgga

SEQ ID NO: 314201 - DNA, 20 bp, human
ggggttgggctggttgctct

SEQ ID NO: 314202 - DNA, 20 bp, human
gagaaatgaactgggcaccc

SEQ ID NO: 314203 - DNA, 20 bp, human
gctctaagcagcatgtaacc

SEQ ID NO: 314204 - DNA, 20 bp, human
gttcaacggtaaatctgtca

SEQ ID NO: 314205 - DNA, 20 bp, human
ggttggacttgaagagatta

SEQ ID NO: 314206 - DNA, 20 bp, human
ggggccaggcccaaacccag

SEQ ID NO: 314207 - DNA, 20 bp, human
gccggggcggcactgaactg

SEQ ID NO: 314208 - DNA, 20 bp, human
ggagccgggccgctgggttt

SEQ ID NO: 314209 - DNA, 20 bp, human
gactgaaagcacaggaatca

SEQ ID NO: 314210 - DNA, 20 bp, human
gccgcctgggcggcggtgag

SEQ ID NO: 314211 - DNA, 20 bp, human
ggaatcagggctgcactgac

SEQ ID NO: 314212 - DNA, 20 bp, human
ggctcacgcaggccaagagg

SEQ ID NO: 314213 - DNA, 20 bp, human
ggtgccgccccggctcacgc

SEQ ID NO: 314214 - DNA, 20 bp, human
gccggctcacgcaggccaag

SEQ ID NO: 314215 - DNA, 20 bp, human
gcaccgccgcccaggcggat

SEQ ID NO: 314216 - DNA, 20 bp, human
gacgtccaggatggggaccg

SEQ ID NO: 314217 - DNA, 20 bp, human
gggctcgcggagaaaggccc

SEQ ID NO: 314218 - DNA, 20 bp, human
gagccccgagctgaagagaa

SEQ ID NO: 314219 - DNA, 20 bp, human
gtgggagggctcgcggagaa

SEQ ID NO: 314220 - DNA, 20 bp, human
gagggggcccggagttaagg

SEQ ID NO: 314221 - DNA, 20 bp, human
gtctcccggggcgaagggcg

SEQ ID NO: 314222 - DNA, 20 bp, human
ggctcctctcccggggcgaa

SEQ ID NO: 314223 - DNA, 20 bp, human
gggaggggtgaggccctcga

SEQ ID NO: 314224 - DNA, 20 bp, human
gcccgcgcatccggccaccg

SEQ ID NO: 314225 - DNA, 20 bp, human
gtaactccgggccccctcga

SEQ ID NO: 314226 - DNA, 20 bp, human
gagcccgaggatgtcaggag

SEQ ID NO: 314227 - DNA, 20 bp, human
gaccccgctcctgacatcct

SEQ ID NO: 314228 - DNA, 20 bp, human
ggccgcagctcggggaagtg

SEQ ID NO: 314229 - DNA, 20 bp, human
ggtcaggagcggggtcggtg

SEQ ID NO: 314230 - DNA, 20 bp, human
gtcggtgcggacgggcaggt

SEQ ID NO: 314231 - DNA, 20 bp, human
gccgccggcctccaggggac

SEQ ID NO: 314232 - DNA, 20 bp, human
gacgtcagcccgaggatgtc

SEQ ID NO: 314233 - DNA, 20 bp, human
gctgcggccgccggcctcca

SEQ ID NO: 314234 - DNA, 20 bp, human
ggagcggggtcggtgcggac

SEQ ID NO: 314235 - DNA, 20 bp, human
ggcacgaggacgtcagcccg

SEQ ID NO: 314236 - DNA, 20 bp, human
gcagcgtacctggcaggcgc

SEQ ID NO: 314237 - DNA, 20 bp, human
ggcggccaggagaaatacag

SEQ ID NO: 314238 - DNA, 20 bp, human
gcagacaagggaatcaagtc

SEQ ID NO: 314239 - DNA, 20 bp, human
gtggctatactgtgactatc

SEQ ID NO: 314240 - DNA, 20 bp, human
gtatcataattcaaccttaa

SEQ ID NO: 314241 - DNA, 20 bp, human
gaggttgaattatgatattc

SEQ ID NO: 314242 - DNA, 20 bp, human
gttaagcttcagtgatttat

SEQ ID NO: 314243 - DNA, 20 bp, human
gaagtactgtatttcagaca

SEQ ID NO: 314244 - DNA, 20 bp, human
gatttcaaagtggattgttg

SEQ ID NO: 314245 - DNA, 20 bp, human
gattatgatattcaggactc

SEQ ID NO: 314246 - DNA, 20 bp, human
gacagggaggtgaatcacga

SEQ ID NO: 314247 - DNA, 20 bp, human
gacgagggggcggaattcca

SEQ ID NO: 314248 - DNA, 20 bp, human
gagacggggcacagacaggg

SEQ ID NO: 314249 - DNA, 20 bp, human
gggcgggctctcagccagaa

SEQ ID NO: 314250 - DNA, 20 bp, human
gctggctgagagcccgccct

SEQ ID NO: 314251 - DNA, 20 bp, human
gcctaggcctggcctcacaa

SEQ ID NO: 314252 - DNA, 20 bp, human
gcactaacccggaaccggtt

SEQ ID NO: 314253 - DNA, 20 bp, human
gcagggcactaacccggaac

SEQ ID NO: 314254 - DNA, 20 bp, human
ggagctgcgcgccacagacg

SEQ ID NO: 314255 - DNA, 20 bp, human
ggctacaccattctaaccaa

SEQ ID NO: 314256 - DNA, 20 bp, human
gtcgcccagtgacaactcgt

SEQ ID NO: 314257 - DNA, 20 bp, human
gggaggagatggagcttcgg

SEQ ID NO: 314258 - DNA, 20 bp, human
ggacaactcgtcggcagagg

SEQ ID NO: 314259 - DNA, 20 bp, human
gaactcgtcggcagaggagg

SEQ ID NO: 314260 - DNA, 20 bp, human
gcaggataagtgagctttcg

SEQ ID NO: 314261 - DNA, 20 bp, human
gtctgccgacgagttgtcac

SEQ ID NO: 314262 - DNA, 20 bp, human
gtgagctttcggggagtgaa

SEQ ID NO: 314263 - DNA, 20 bp, human
gcctgcgcagacatgttgaa

SEQ ID NO: 314264 - DNA, 20 bp, human
ggcacagccggcagcgcgga

SEQ ID NO: 314265 - DNA, 20 bp, human
gaggacgcgtgtgggcaagg

SEQ ID NO: 314266 - DNA, 20 bp, human
gtagacttagcattgtgctg

SEQ ID NO: 314267 - DNA, 20 bp, human
gtgggggagaagtgatgaag

SEQ ID NO: 314268 - DNA, 20 bp, human
ggtagcaaagtgacccgaga

SEQ ID NO: 314269 - DNA, 20 bp, human
gtctagcaggtcctggtgga

SEQ ID NO: 314270 - DNA, 20 bp, human
gccgtgtaaagagagttcaa

SEQ ID NO: 314271 - DNA, 20 bp, human
gtccttgctgcggatgcccc

SEQ ID NO: 314272 - DNA, 20 bp, human
gctgtggaactcattaatga

SEQ ID NO: 314273 - DNA, 20 bp, human
ggaggggatggaggccctct

SEQ ID NO: 314274 - DNA, 20 bp, human
gggcctccatcccctccacc

SEQ ID NO: 314275 - DNA, 20 bp, human
gcaacagctcttatttccta

SEQ ID NO: 314276 - DNA, 20 bp, human
gggccgcgtctgcttatgat

SEQ ID NO: 314277 - DNA, 20 bp, human
gcctgggtggggtgtatgca

SEQ ID NO: 314278 - DNA, 20 bp, human
gttccagggctgcgtttcgg

SEQ ID NO: 314279 - DNA, 20 bp, human
ggcagccctggaagctgatt

SEQ ID NO: 314280 - DNA, 20 bp, human
gccagcgtgcgcgggaagct

SEQ ID NO: 314281 - DNA, 20 bp, human
gctaaagtcaccagcgtgcg

SEQ ID NO: 314282 - DNA, 20 bp, human
ggacgccgctcgggggacgt

SEQ ID NO: 314283 - DNA, 20 bp, human
gtgcctgcgcctaggtcgcg

SEQ ID NO: 314284 - DNA, 20 bp, human
ggtggggtgtatgcaagggt

SEQ ID NO: 314285 - DNA, 20 bp, human
ggggctgcgtttcggtgggt

SEQ ID NO: 314286 - DNA, 20 bp, human
gtgcacaaatggggacgagg

SEQ ID NO: 314287 - DNA, 20 bp, human
ggggcctcgcctgcacaaat

SEQ ID NO: 314288 - DNA, 20 bp, human
gccggcagatacctgagcgg

SEQ ID NO: 314289 - DNA, 20 bp, human
gcgcagacgcctgggaactg

SEQ ID NO: 314290 - DNA, 20 bp, human
gctcgcgcccgcagacgcct

SEQ ID NO: 314291 - DNA, 20 bp, human
gaggctgcccacggtcgggg

SEQ ID NO: 314292 - DNA, 20 bp, human
gcccggcgcacgcagggtcg

SEQ ID NO: 314293 - DNA, 20 bp, human
gggcccggcagatacctgag

SEQ ID NO: 314294 - DNA, 20 bp, human
ggactcccggcgagaggatg

SEQ ID NO: 314295 - DNA, 20 bp, human
gcggggcgatgggacccaaa

SEQ ID NO: 314296 - DNA, 20 bp, human
ggatgggccttgcagagttc

SEQ ID NO: 314297 - DNA, 20 bp, human
gggctgaggatgttccagtg

SEQ ID NO: 314298 - DNA, 20 bp, human
gataatggggctaacaaatc

SEQ ID NO: 314299 - DNA, 20 bp, human
gatggggctaacaaatcggg

SEQ ID NO: 314300 - DNA, 20 bp, human
gtggtcagtctgatacctgc

SEQ ID NO: 314301 - DNA, 20 bp, human
gtgggtgctgtgagaataat

SEQ ID NO: 314302 - DNA, 20 bp, human
ggcactgggtgtactgtgtt

SEQ ID NO: 314303 - DNA, 20 bp, human
gacacagcataacccaccta

SEQ ID NO: 314304 - DNA, 20 bp, human
ggctgtgtgcatagtagagt

SEQ ID NO: 314305 - DNA, 20 bp, human
gtttgggaatggctggaagc

SEQ ID NO: 314306 - DNA, 20 bp, human
ggaagagtctggacgctgat

SEQ ID NO: 314307 - DNA, 20 bp, human
ggggaagcccgcgagaaggt

SEQ ID NO: 314308 - DNA, 20 bp, human
gcgggaaaacgctgcgatgg

SEQ ID NO: 314309 - DNA, 20 bp, human
gccagcctagagatccgaca

SEQ ID NO: 314310 - DNA, 20 bp, human
gcccgcgagaaggtcggacc

SEQ ID NO: 314311 - DNA, 20 bp, human
gacagtgagtgctagaggcc

SEQ ID NO: 314312 - DNA, 20 bp, human
gctagagatccgacagggcg

SEQ ID NO: 314313 - DNA, 20 bp, human
gggcctatttgccttcgggg

SEQ ID NO: 314314 - DNA, 20 bp, human
gcgtccagactcttcagcta

SEQ ID NO: 314315 - DNA, 20 bp, human
ggcgggaagtttgaacgttc

SEQ ID NO: 314316 - DNA, 20 bp, human
gcgcgcggcgacgtggggaa

SEQ ID NO: 314317 - DNA, 20 bp, human
gcccgggcgcgcggcgacgt

SEQ ID NO: 314318 - DNA, 20 bp, human
ggcggggctggcacactggt

SEQ ID NO: 314319 - DNA, 20 bp, human
gcacactggtgggtaggggc

SEQ ID NO: 314320 - DNA, 20 bp, human
gcgcggggcccaggcgtcgg

SEQ ID NO: 314321 - DNA, 20 bp, human
gcgcccgggcggggataacc

SEQ ID NO: 314322 - DNA, 20 bp, human
gcctgctggcgggaaatctg

SEQ ID NO: 314323 - DNA, 20 bp, human
gggctggcacactggtgggt

SEQ ID NO: 314324 - DNA, 20 bp, human
gagccccgcggcgtgaggga

SEQ ID NO: 314325 - DNA, 20 bp, human
ggccgcaactaaccccgggt

SEQ ID NO: 314326 - DNA, 20 bp, human
gggcccgcaccgggattcgg

SEQ ID NO: 314327 - DNA, 20 bp, human
gcccaggagccccgcgggaa

SEQ ID NO: 314328 - DNA, 20 bp, human
gccggcaggtcggcccccgg

SEQ ID NO: 314329 - DNA, 20 bp, human
gcgggcccccgcgccggggt

SEQ ID NO: 314330 - DNA, 20 bp, human
gagacccccgaatcccggtg

SEQ ID NO: 314331 - DNA, 20 bp, human
gtggggactggggagcacta

SEQ ID NO: 314332 - DNA, 20 bp, human
gtgcggccgcgccctggtcc

SEQ ID NO: 314333 - DNA, 20 bp, human
gccctggtcccggcccgcac

SEQ ID NO: 314334 - DNA, 20 bp, human
gccgcccgcccgagcggggt

SEQ ID NO: 314335 - DNA, 20 bp, human
gaaccccaatctcctcgggt

SEQ ID NO: 314336 - DNA, 20 bp, human
gcgggggtgcgtgacgtcac

SEQ ID NO: 314337 - DNA, 20 bp, human
gccacgtgcgccggggagga

SEQ ID NO: 314338 - DNA, 20 bp, human
gctccccggcgcacgtgggg

SEQ ID NO: 314339 - DNA, 20 bp, human
gaactccgccccacgtgcgc

SEQ ID NO: 314340 - DNA, 20 bp, human
gggcgagagccgtcacacgt

SEQ ID NO: 314341 - DNA, 20 bp, human
gaagccgagcccacgtgtga

SEQ ID NO: 314342 - DNA, 20 bp, human
ggacgtcacgcacccccgtg

SEQ ID NO: 314343 - DNA, 20 bp, human
gcgctcgcagagagattcgg

SEQ ID NO: 314344 - DNA, 20 bp, human
ggagaggtggggatgggccg

SEQ ID NO: 314345 - DNA, 20 bp, human
gtgcgtgacgtcaccggcat

SEQ ID NO: 314346 - DNA, 20 bp, human
ggggccgcgctattgtgaaa

SEQ ID NO: 314347 - DNA, 20 bp, human
gaggacgcatgcgcggggag

SEQ ID NO: 314348 - DNA, 20 bp, human
gaggcgccgggggtgactgt

SEQ ID NO: 314349 - DNA, 20 bp, human
gggagcgggcgggagtgcac

SEQ ID NO: 314350 - DNA, 20 bp, human
gccaccccctcctgaggagg

SEQ ID NO: 314351 - DNA, 20 bp, human
gaaccggaggacgcatgcgc

SEQ ID NO: 314352 - DNA, 20 bp, human
gaaggtgggctgccgaggga

SEQ ID NO: 314353 - DNA, 20 bp, human
gtgcgtcctccggttggcgg

SEQ ID NO: 314354 - DNA, 20 bp, human
ggggtctgtcgcctctcccg

SEQ ID NO: 314355 - DNA, 20 bp, human
gagggcggccgcgggaagaa

SEQ ID NO: 314356 - DNA, 20 bp, human
gcacgcggaagggcgaaagg

SEQ ID NO: 314357 - DNA, 20 bp, human
ggtgagggactggcgcgagc

SEQ ID NO: 314358 - DNA, 20 bp, human
ggcggaagggcgaaaggcgg

SEQ ID NO: 314359 - DNA, 20 bp, human
gtggagtgagccggtagctc

SEQ ID NO: 314360 - DNA, 20 bp, human
gggtcaaagcgcacgcggaa

SEQ ID NO: 314361 - DNA, 20 bp, human
gtgcgcagtgagcccagggt

SEQ ID NO: 314362 - DNA, 20 bp, human
gggtgggttggcagcggtga

SEQ ID NO: 314363 - DNA, 20 bp, human
gtgggcggtcaaagcgcacg

SEQ ID NO: 314364 - DNA, 20 bp, human
gggagtctcggggatgacag

SEQ ID NO: 314365 - DNA, 20 bp, human
ggtgagccggtagctctggg

SEQ ID NO: 314366 - DNA, 20 bp, human
ggcctccgaggtcccggcag

SEQ ID NO: 314367 - DNA, 20 bp, human
ggccgctgccgggacctcgg

SEQ ID NO: 314368 - DNA, 20 bp, human
gtccccgcacgtccccgccg

SEQ ID NO: 314369 - DNA, 20 bp, human
gtccccgccggggctccggg

SEQ ID NO: 314370 - DNA, 20 bp, human
ggagccccggcggggacgtg

SEQ ID NO: 314371 - DNA, 20 bp, human
ggccccgagcgcccgctctc

SEQ ID NO: 314372 - DNA, 20 bp, human
gtcccggcagcggctcgggg

SEQ ID NO: 314373 - DNA, 20 bp, human
gcgagccgctgccgggacct

SEQ ID NO: 314374 - DNA, 20 bp, human
gccgtcgcccccatgggaga

SEQ ID NO: 314375 - DNA, 20 bp, human
ggcggtgcgccgtggccggg

SEQ ID NO: 314376 - DNA, 20 bp, human
gcccacacgtgggcctctaa

SEQ ID NO: 314377 - DNA, 20 bp, human
ggggccactcgggacctgga

SEQ ID NO: 314378 - DNA, 20 bp, human
gcgggccaatgcccacacgt

SEQ ID NO: 314379 - DNA, 20 bp, human
gaaggcaaagctgccctcgg

SEQ ID NO: 314380 - DNA, 20 bp, human
gttggcccgcgatctgaaag

SEQ ID NO: 314381 - DNA, 20 bp, human
ggccttctgcgcagttgggt

SEQ ID NO: 314382 - DNA, 20 bp, human
gcgccccaggaatgtgtggg

SEQ ID NO: 314383 - DNA, 20 bp, human
gggggctgcccgggcgttag

SEQ ID NO: 314384 - DNA, 20 bp, human
gcccacagccctgagacgga

SEQ ID NO: 314385 - DNA, 20 bp, human
gctaaagggcgatgtgaaag

SEQ ID NO: 314386 - DNA, 20 bp, human
gagcaaatgcagatcggggt

SEQ ID NO: 314387 - DNA, 20 bp, human
gacaaggtaaacacataact

SEQ ID NO: 314388 - DNA, 20 bp, human
gcagcagcaaatgcagatcg

SEQ ID NO: 314389 - DNA, 20 bp, human
gcacaacagccaggtggtaa

SEQ ID NO: 314390 - DNA, 20 bp, human
gcctaagggcagggtcatct

SEQ ID NO: 314391 - DNA, 20 bp, human
gacagccaggtggtaaaggt

SEQ ID NO: 314392 - DNA, 20 bp, human
gagccttcgccctatgctgg

SEQ ID NO: 314393 - DNA, 20 bp, human
gggtaaacacataacttggg

SEQ ID NO: 314394 - DNA, 20 bp, human
ggactatcaaaaggaaagta

SEQ ID NO: 314395 - DNA, 20 bp, human
gctagcaatccaccagcata

SEQ ID NO: 314396 - DNA, 20 bp, human
gctgctgagaggttatgatg

SEQ ID NO: 314397 - DNA, 20 bp, human
gcagagcccagccgagatcc

SEQ ID NO: 314398 - DNA, 20 bp, human
gtggcagagaacttcagcat

SEQ ID NO: 314399 - DNA, 20 bp, human
gaggctgaaattgtagaaca

SEQ ID NO: 314400 - DNA, 20 bp, human
ggtgctgtgtaccaggatct

SEQ ID NO: 314401 - DNA, 20 bp, human
ggcagctcagtccaaacaaa

SEQ ID NO: 314402 - DNA, 20 bp, human
ggtgtaccaggatctcggct

SEQ ID NO: 314403 - DNA, 20 bp, human
gtgaacaaaccagttaatct

SEQ ID NO: 314404 - DNA, 20 bp, human
gagcatgggcgactgcattt

SEQ ID NO: 314405 - DNA, 20 bp, human
gcccagaaattaccatgtta

SEQ ID NO: 314406 - DNA, 20 bp, human
gcgcgcgagtcacacgatgt

SEQ ID NO: 314407 - DNA, 20 bp, human
ggctccgcggtgccgaccat

SEQ ID NO: 314408 - DNA, 20 bp, human
gcatccgcggagccaatggc

SEQ ID NO: 314409 - DNA, 20 bp, human
gagcgcgccacggcgtgagg

SEQ ID NO: 314410 - DNA, 20 bp, human
gactccatccgcggagccaa

SEQ ID NO: 314411 - DNA, 20 bp, human
gaacctgcctcgcctggctt

SEQ ID NO: 314412 - DNA, 20 bp, human
gcgcgcgaacgagctcctgg

SEQ ID NO: 314413 - DNA, 20 bp, human
ggtcccagccattggctccg

SEQ ID NO: 314414 - DNA, 20 bp, human
gcggcccgtcctgtcgttat

SEQ ID NO: 314415 - DNA, 20 bp, human
gaggccaataacgacaggac

SEQ ID NO: 314416 - DNA, 20 bp, human
gcccggcacagctagaggga

SEQ ID NO: 314417 - DNA, 20 bp, human
gcatgccccggcacagctag

SEQ ID NO: 314418 - DNA, 20 bp, human
gcctccctccggtccaggca

SEQ ID NO: 314419 - DNA, 20 bp, human
ggccccctgctgagtagagc

SEQ ID NO: 314420 - DNA, 20 bp, human
gagatctggggaccacctgg

SEQ ID NO: 314421 - DNA, 20 bp, human
ggcaccctattgcagctcct

SEQ ID NO: 314422 - DNA, 20 bp, human
gacccctggtggtggcagtg

SEQ ID NO: 314423 - DNA, 20 bp, human
gcaccaggggtgtgtatgct

SEQ ID NO: 314424 - DNA, 20 bp, human
gaaacccaggagctgcaata

SEQ ID NO: 314425 - DNA, 20 bp, human
ggagctgcaatagggtgcga

SEQ ID NO: 314426 - DNA, 20 bp, human
gtagctaccctaggtccgcc

SEQ ID NO: 314427 - DNA, 20 bp, human
gctgggcccgggcggaccta

SEQ ID NO: 314428 - DNA, 20 bp, human
gcggcgcagccaggccacag

SEQ ID NO: 314429 - DNA, 20 bp, human
gtggaaggccaggacgtgga

SEQ ID NO: 314430 - DNA, 20 bp, human
ggccacagcggccacgtggg

SEQ ID NO: 314431 - DNA, 20 bp, human
gagaggagccgggtgggtct

SEQ ID NO: 314432 - DNA, 20 bp, human
gccaggacgtggaaggctag

SEQ ID NO: 314433 - DNA, 20 bp, human
ggggctggaaggccaggacg

SEQ ID NO: 314434 - DNA, 20 bp, human
ggctgagtaagcatctgtca

SEQ ID NO: 314435 - DNA, 20 bp, human
gagccagagctgtctagaga

SEQ ID NO: 314436 - DNA, 20 bp, human
gcacgcctgtagaacctggg

SEQ ID NO: 314437 - DNA, 20 bp, human
gggcacacgcctgtagaacc

SEQ ID NO: 314438 - DNA, 20 bp, human
gttttaaagcggcctaaatg

SEQ ID NO: 314439 - DNA, 20 bp, human
ggcatctggtacatgaagaa

SEQ ID NO: 314440 - DNA, 20 bp, human
gctcactcttcaccccattt

SEQ ID NO: 314441 - DNA, 20 bp, human
gtaagaaagattttcaacgc

SEQ ID NO: 314442 - DNA, 20 bp, human
gtgagtaaagactccatgtt

SEQ ID NO: 314443 - DNA, 20 bp, human
gaattaatgtatgttttaga

SEQ ID NO: 314444 - DNA, 20 bp, human
gcatagattacttataaaaa

SEQ ID NO: 314445 - DNA, 20 bp, human
gcattatagtaacgtgaaag

SEQ ID NO: 314446 - DNA, 20 bp, human
ggggccacaccccctgtcca

SEQ ID NO: 314447 - DNA, 20 bp, human
ggaagtacgtgaagctgcag

SEQ ID NO: 314448 - DNA, 20 bp, human
ggtggcccggcgagttcctg

SEQ ID NO: 314449 - DNA, 20 bp, human
gcacaccccctgtccaggga

SEQ ID NO: 314450 - DNA, 20 bp, human
ggtcatgacggccatcagaa

SEQ ID NO: 314451 - DNA, 20 bp, human
gaatcaaaccgcatccccaa

SEQ ID NO: 314452 - DNA, 20 bp, human
ggggccgtaccggctgtcac

SEQ ID NO: 314453 - DNA, 20 bp, human
gaaaacacgccgagcccttg

SEQ ID NO: 314454 - DNA, 20 bp, human
gagcaccattaaggcagtgt

SEQ ID NO: 314455 - DNA, 20 bp, human
gccgtaccggctgtcaccgg

SEQ ID NO: 314456 - DNA, 20 bp, human
ggaggccccgcccctcctca

SEQ ID NO: 314457 - DNA, 20 bp, human
gggtcccaaggagtcaacgt

SEQ ID NO: 314458 - DNA, 20 bp, human
gaacgtgggcggggccagct

SEQ ID NO: 314459 - DNA, 20 bp, human
gcccaaggagtcaacgtggg

SEQ ID NO: 314460 - DNA, 20 bp, human
gggaccaatcgctccccgga

SEQ ID NO: 314461 - DNA, 20 bp, human
gactccttgggaccactcct

SEQ ID NO: 314462 - DNA, 20 bp, human
gccagctgggaagatcgtat

SEQ ID NO: 314463 - DNA, 20 bp, human
gcctagccaccagggcgcga

SEQ ID NO: 314464 - DNA, 20 bp, human
gctccccggagggcgaatcc

SEQ ID NO: 314465 - DNA, 20 bp, human
gaatcccggcttccgcctcc

SEQ ID NO: 314466 - DNA, 20 bp, human
ggcccagggcacatagtggg

SEQ ID NO: 314467 - DNA, 20 bp, human
gagggagacgaggggactgg

SEQ ID NO: 314468 - DNA, 20 bp, human
ggaaagaggggcggggacct

SEQ ID NO: 314469 - DNA, 20 bp, human
gacgaggggactggcggtgt

SEQ ID NO: 314470 - DNA, 20 bp, human
gcaggcggacgggagagaat

SEQ ID NO: 314471 - DNA, 20 bp, human
gggcggtgtgggcggagcgt

SEQ ID NO: 314472 - DNA, 20 bp, human
ggagggaggccgactagcgc

SEQ ID NO: 314473 - DNA, 20 bp, human
ggccgactagcgcaggcgga

SEQ ID NO: 314474 - DNA, 20 bp, human
gctcctcccactatgtgccc

SEQ ID NO: 314475 - DNA, 20 bp, human
gggaggccgactagcgcagg

SEQ ID NO: 314476 - DNA, 20 bp, human
gtgggcgcttggctgtgttc

SEQ ID NO: 314477 - DNA, 20 bp, human
gcccccaggcagaaggcggc

SEQ ID NO: 314478 - DNA, 20 bp, human
ggagcataggagacgagcga

SEQ ID NO: 314479 - DNA, 20 bp, human
gagcgcgccggccgcggacg

SEQ ID NO: 314480 - DNA, 20 bp, human
ggggcagcgggccccgtccg

SEQ ID NO: 314481 - DNA, 20 bp, human
gcgagtccaaatatgagcat

SEQ ID NO: 314482 - DNA, 20 bp, human
gctgtgggaagacgtgtcag

SEQ ID NO: 314483 - DNA, 20 bp, human
gctgagaccgctgaaggagt

SEQ ID NO: 314484 - DNA, 20 bp, human
gctgtccggtctcttcgtgt

SEQ ID NO: 314485 - DNA, 20 bp, human
ggggttgttgagagcgttgg

SEQ ID NO: 314486 - DNA, 20 bp, human
ggatctgtccccctgcctga

SEQ ID NO: 314487 - DNA, 20 bp, human
gctccctaatgaggcaaaga

SEQ ID NO: 314488 - DNA, 20 bp, human
gtagagagaagccctcaggc

SEQ ID NO: 314489 - DNA, 20 bp, human
gagagaagccctcaggcagg

SEQ ID NO: 314490 - DNA, 20 bp, human
gcaaaggaaagtgatatgaa

SEQ ID NO: 314491 - DNA, 20 bp, human
gacacaggatgagttccccc

SEQ ID NO: 314492 - DNA, 20 bp, human
gttctctgccaagggggctc

SEQ ID NO: 314493 - DNA, 20 bp, human
ggatccctctttgcctcatt

SEQ ID NO: 314494 - DNA, 20 bp, human
gagaactccagagggtcctc

SEQ ID NO: 314495 - DNA, 20 bp, human
ggacttctgcactaatccaa

SEQ ID NO: 314496 - DNA, 20 bp, human
gccgacctccgcctgctctg

SEQ ID NO: 314497 - DNA, 20 bp, human
gcggcctttcagacgtttta

SEQ ID NO: 314498 - DNA, 20 bp, human
ggttgtgagccgggtcgctg

SEQ ID NO: 314499 - DNA, 20 bp, human
gcaggtcagcccacacccgg

SEQ ID NO: 314500 - DNA, 20 bp, human
ggggctctgccgccgggtgt

SEQ ID NO: 314501 - DNA, 20 bp, human
gtgagcggggcctctaagta

SEQ ID NO: 314502 - DNA, 20 bp, human
gggagcatccccagagcagg

SEQ ID NO: 314503 - DNA, 20 bp, human
ggtctcctacccatacttag

SEQ ID NO: 314504 - DNA, 20 bp, human
gaggcaggtcagcccacacc

SEQ ID NO: 314505 - DNA, 20 bp, human
gaacggacgccgtagccaag

SEQ ID NO: 314506 - DNA, 20 bp, human
gcgaaccagtcggtagtggg

SEQ ID NO: 314507 - DNA, 20 bp, human
gcgactcttccggcccttgg

SEQ ID NO: 314508 - DNA, 20 bp, human
gagggccggaagagtcggat

SEQ ID NO: 314509 - DNA, 20 bp, human
ggcgccaagacgccaggtga

SEQ ID NO: 314510 - DNA, 20 bp, human
gacaggagccaggcctccaa

SEQ ID NO: 314511 - DNA, 20 bp, human
ggactggttcgcagcgagaa

SEQ ID NO: 314512 - DNA, 20 bp, human
gaaaaaggcgccaagacgcc

SEQ ID NO: 314513 - DNA, 20 bp, human
gccacaggccgctgagaaaa

SEQ ID NO: 314514 - DNA, 20 bp, human
ggggcggagtcgggccgtgg

SEQ ID NO: 314515 - DNA, 20 bp, human
gaccatgcacatccacccac

SEQ ID NO: 314516 - DNA, 20 bp, human
gcagcgaagaggtttggctg

SEQ ID NO: 314517 - DNA, 20 bp, human
gacaccgcccggctgcgggg

SEQ ID NO: 314518 - DNA, 20 bp, human
gaaggctccaggcagcgaag

SEQ ID NO: 314519 - DNA, 20 bp, human
gcacgcggagaggagaaccc

SEQ ID NO: 314520 - DNA, 20 bp, human
gtccaggcagcgaagaggtt

SEQ ID NO: 314521 - DNA, 20 bp, human
gtggcctgggaggcggttgg

SEQ ID NO: 314522 - DNA, 20 bp, human
gagaggagaacccggggacc

SEQ ID NO: 314523 - DNA, 20 bp, human
gccgcagccgggcggtgtcg

SEQ ID NO: 314524 - DNA, 20 bp, human
gactctcccggcacgcggag

SEQ ID NO: 314525 - DNA, 20 bp, human
gtatgagggcgccccagatg

SEQ ID NO: 314526 - DNA, 20 bp, human
gtggtgacttgggacagaca

SEQ ID NO: 314527 - DNA, 20 bp, human
gcagtattttgttacagtca

SEQ ID NO: 314528 - DNA, 20 bp, human
gacacttgtctcatctaagt

SEQ ID NO: 314529 - DNA, 20 bp, human
gctgacagcgagattcattg

SEQ ID NO: 314530 - DNA, 20 bp, human
gaaaatactgcttggtgact

SEQ ID NO: 314531 - DNA, 20 bp, human
gagatgagacaagtgtcgtc

SEQ ID NO: 314532 - DNA, 20 bp, human
gtgtcgtcaggatctatgat

SEQ ID NO: 314533 - DNA, 20 bp, human
gtttttagtgccaagtaatt

SEQ ID NO: 314534 - DNA, 20 bp, human
gactgtaacaaaatactgct

SEQ ID NO: 314535 - DNA, 20 bp, human
ggaaaaacaaaagtctatgt

SEQ ID NO: 314536 - DNA, 20 bp, human
ggatctggaagccctggacg

SEQ ID NO: 314537 - DNA, 20 bp, human
gggagaaatcagaatcccag

SEQ ID NO: 314538 - DNA, 20 bp, human
gaaacagtcacacagtgggg

SEQ ID NO: 314539 - DNA, 20 bp, human
gaagtaaacagtcacacagt

SEQ ID NO: 314540 - DNA, 20 bp, human
gtgtcactcacccccgtcca

SEQ ID NO: 314541 - DNA, 20 bp, human
ggggaagctgacaggtggct

SEQ ID NO: 314542 - DNA, 20 bp, human
gattaagcagctctcccact

SEQ ID NO: 314543 - DNA, 20 bp, human
ggctcccacccaaggacaag

SEQ ID NO: 314544 - DNA, 20 bp, human
gacctggtccctaccatcgt

SEQ ID NO: 314545 - DNA, 20 bp, human
gtggctcgggtcgcaggccc

SEQ ID NO: 314546 - DNA, 20 bp, human
gcccgcagagagggcctctt

SEQ ID NO: 314547 - DNA, 20 bp, human
gcccaggcccagcgcgcctc

SEQ ID NO: 314548 - DNA, 20 bp, human
ggggcccggagcgatccatt

SEQ ID NO: 314549 - DNA, 20 bp, human
gcggcccaatggatcgctcc

SEQ ID NO: 314550 - DNA, 20 bp, human
ggcggccaatcagcgcgcga

SEQ ID NO: 314551 - DNA, 20 bp, human
gcgcctccgggcgagtcccc

SEQ ID NO: 314552 - DNA, 20 bp, human
ggactcgcccggaggcgcgc

SEQ ID NO: 314553 - DNA, 20 bp, human
gaatcagcgcgcgagggggc

SEQ ID NO: 314554 - DNA, 20 bp, human
gcaggggactcccgcagaga

SEQ ID NO: 314555 - DNA, 20 bp, human
gccccaggagcgcggcccaa

SEQ ID NO: 314556 - DNA, 20 bp, human
gaatcaggggcgagcgtctc

SEQ ID NO: 314557 - DNA, 20 bp, human
gcctgattggctcttcccga

SEQ ID NO: 314558 - DNA, 20 bp, human
gcgtctctggcgtcagcgcc

SEQ ID NO: 314559 - DNA, 20 bp, human
ggtctcccacttcccctcgg

SEQ ID NO: 314560 - DNA, 20 bp, human
gcaggcccggcgcggattgg

SEQ ID NO: 314561 - DNA, 20 bp, human
gccacttcccctcggaggaa

SEQ ID NO: 314562 - DNA, 20 bp, human
gggcgtgattataacccttc

SEQ ID NO: 314563 - DNA, 20 bp, human
ggaacttattctggcggtag

SEQ ID NO: 314564 - DNA, 20 bp, human
ggactcaaacttttttgctg

SEQ ID NO: 314565 - DNA, 20 bp, human
gtttgctgcggagacgggag

SEQ ID NO: 314566 - DNA, 20 bp, human
gtgggcggactcagcggggc

SEQ ID NO: 314567 - DNA, 20 bp, human
gggaggcgaccgaaacgcca

SEQ ID NO: 314568 - DNA, 20 bp, human
ggaacgcgcggggactaggg

SEQ ID NO: 314569 - DNA, 20 bp, human
gccggaacgcgcggggacta

SEQ ID NO: 314570 - DNA, 20 bp, human
ggaaaaccgtgagaggggtg

SEQ ID NO: 314571 - DNA, 20 bp, human
gctagggtggaaggcaactt

SEQ ID NO: 314572 - DNA, 20 bp, human
gcgggagtgagtttacgccc

SEQ ID NO: 314573 - DNA, 20 bp, human
gctcggctgggcggactcag

SEQ ID NO: 314574 - DNA, 20 bp, human
gagcggccccaaagcgggga

SEQ ID NO: 314575 - DNA, 20 bp, human
ggcgcggggactagggtgga

SEQ ID NO: 314576 - DNA, 20 bp, human
ggggttgcacacggtatcca

SEQ ID NO: 314577 - DNA, 20 bp, human
ggatcctgaaagttgaacac

SEQ ID NO: 314578 - DNA, 20 bp, human
gctgcccgtggtccatgcct

SEQ ID NO: 314579 - DNA, 20 bp, human
gtgcacacggtatccaggga

SEQ ID NO: 314580 - DNA, 20 bp, human
ggtgtgcaaaggactggtgg

SEQ ID NO: 314581 - DNA, 20 bp, human
gccgaggtggggacatactc

SEQ ID NO: 314582 - DNA, 20 bp, human
gtgggccatgagcagtgacc

SEQ ID NO: 314583 - DNA, 20 bp, human
ggggagagagttgtgtgcaa

SEQ ID NO: 314584 - DNA, 20 bp, human
gaaagttgaacacggggctg

SEQ ID NO: 314585 - DNA, 20 bp, human
gcacctcccccgactataaa

SEQ ID NO: 314586 - DNA, 20 bp, human
ggcccaccgcgcagagctca

SEQ ID NO: 314587 - DNA, 20 bp, human
gcgaacgggctccaaagggg

SEQ ID NO: 314588 - DNA, 20 bp, human
gctccaaaggggaggtcccg

SEQ ID NO: 314589 - DNA, 20 bp, human
gccgagcgaacgggctccaa

SEQ ID NO: 314590 - DNA, 20 bp, human
ggagcccgttcgctcgggtg

SEQ ID NO: 314591 - DNA, 20 bp, human
ggatccgctgagtgcggagc

SEQ ID NO: 314592 - DNA, 20 bp, human
gaaaaccgcggagctagggg

SEQ ID NO: 314593 - DNA, 20 bp, human
gcaacacggggaacacggat

SEQ ID NO: 314594 - DNA, 20 bp, human
ggtgcgggaccgaggaacct

SEQ ID NO: 314595 - DNA, 20 bp, human
ggtgcggagcggggaacgtg

SEQ ID NO: 314596 - DNA, 20 bp, human
gtacccggaaccccaagggg

SEQ ID NO: 314597 - DNA, 20 bp, human
gactccaaagggacggtccg

SEQ ID NO: 314598 - DNA, 20 bp, human
ggctgcgggaggtcctgggt

SEQ ID NO: 314599 - DNA, 20 bp, human
gcaggtacccggaaccccaa

SEQ ID NO: 314600 - DNA, 20 bp, human
gtgagcggactccaaaggga

SEQ ID NO: 314601 - DNA, 20 bp, human
gcgcttgagcggactccaaa

SEQ ID NO: 314602 - DNA, 20 bp, human
gcagcgctgcgggaggtcct

SEQ ID NO: 314603 - DNA, 20 bp, human
gcgggtgtagcaggcaatct

SEQ ID NO: 314604 - DNA, 20 bp, human
gtggagtccgctcaagcggg

SEQ ID NO: 314605 - DNA, 20 bp, human
gcacccgccccttggggttc

SEQ ID NO: 314606 - DNA, 20 bp, human
ggcgctgtgccccccgtgtg

SEQ ID NO: 314607 - DNA, 20 bp, human
gtcgcgagccggtgcgaaag

SEQ ID NO: 314608 - DNA, 20 bp, human
gtgggctgtgcgcaggagat

SEQ ID NO: 314609 - DNA, 20 bp, human
gtgcgaaaggggccgtcctg

SEQ ID NO: 314610 - DNA, 20 bp, human
gaaagtggagcacaagactg

SEQ ID NO: 314611 - DNA, 20 bp, human
gtaggcggaacgccaagggg

SEQ ID NO: 314612 - DNA, 20 bp, human
gaagcctttcctggagtcga

SEQ ID NO: 314613 - DNA, 20 bp, human
ggggtgtagcaggcaacctc

SEQ ID NO: 314614 - DNA, 20 bp, human
gaaagcggggagcatagcaa

SEQ ID NO: 314615 - DNA, 20 bp, human
gcagcccaggccgggaccgc

SEQ ID NO: 314616 - DNA, 20 bp, human
gtgtgcgcagcagacgggtc

SEQ ID NO: 314617 - DNA, 20 bp, human
gggagtagcaggtaatctca

SEQ ID NO: 314618 - DNA, 20 bp, human
gtgcgaaagggccgtccccg

SEQ ID NO: 314619 - DNA, 20 bp, human
gcgcgggagccgctgcgaaa

SEQ ID NO: 314620 - DNA, 20 bp, human
ggggcgcaggtcaggatctc

SEQ ID NO: 314621 - DNA, 20 bp, human
gcaccccctgtcaacagcta

SEQ ID NO: 314622 - DNA, 20 bp, human
gcgggcggctcggactcagt

SEQ ID NO: 314623 - DNA, 20 bp, human
gcaggtcggtgcacaccgcg

SEQ ID NO: 314624 - DNA, 20 bp, human
gaagtaccctgagcgcaggt

SEQ ID NO: 314625 - DNA, 20 bp, human
gccgagccgcccgcggtcct

SEQ ID NO: 314626 - DNA, 20 bp, human
gacaaaaaactggatggtgg

SEQ ID NO: 314627 - DNA, 20 bp, human
ggtgggggaagaggagattg

SEQ ID NO: 314628 - DNA, 20 bp, human
ggagacaaaaaactggatgg

SEQ ID NO: 314629 - DNA, 20 bp, human
gatggagacaaaaaactgga

SEQ ID NO: 314630 - DNA, 20 bp, human
gattcatggagacaaaaaac

SEQ ID NO: 314631 - DNA, 20 bp, human
ggcttatgtgagtttcctcg

SEQ ID NO: 314632 - DNA, 20 bp, human
gaaaaaggcaaatacaggcc

SEQ ID NO: 314633 - DNA, 20 bp, human
gacacctgctacaacatgga

SEQ ID NO: 314634 - DNA, 20 bp, human
ggtcacaaaaaggcaaatac

SEQ ID NO: 314635 - DNA, 20 bp, human
gtggggtgttattgttgaat

SEQ ID NO: 314636 - DNA, 20 bp, human
gcacccgccccgctgagtct

SEQ ID NO: 314637 - DNA, 20 bp, human
ggaacgctcggggacggaga

SEQ ID NO: 314638 - DNA, 20 bp, human
gcaggacggcacggacgccg

SEQ ID NO: 314639 - DNA, 20 bp, human
ggggcgcaaggtgtgcaccg

SEQ ID NO: 314640 - DNA, 20 bp, human
gacaggaggcccagactcag

SEQ ID NO: 314641 - DNA, 20 bp, human
gctgtgcgcccggtcgtccg

SEQ ID NO: 314642 - DNA, 20 bp, human
gacaaggaaatggggaatat

SEQ ID NO: 314643 - DNA, 20 bp, human
ggcctcctgtgggtacgtgg

SEQ ID NO: 314644 - DNA, 20 bp, human
gggcaggaggacagaaagta

SEQ ID NO: 314645 - DNA, 20 bp, human
gtggagggactgtgagcagc

SEQ ID NO: 314646 - DNA, 20 bp, human
gcaaacccgagccaaagggg

SEQ ID NO: 314647 - DNA, 20 bp, human
ggcactcggagcggagctca

SEQ ID NO: 314648 - DNA, 20 bp, human
gtcgaccgcccctttggctc

SEQ ID NO: 314649 - DNA, 20 bp, human
gtgcgcccggcacttatgct

SEQ ID NO: 314650 - DNA, 20 bp, human
gtcgcaccgccagcggtcct

SEQ ID NO: 314651 - DNA, 20 bp, human
gcgcgcaaacccgagccaaa

SEQ ID NO: 314652 - DNA, 20 bp, human
gggaggggctgtgcgccggg

SEQ ID NO: 314653 - DNA, 20 bp, human
gtccgcacacgaccgatccg

SEQ ID NO: 314654 - DNA, 20 bp, human
gggcggtcgagcggcgcact

SEQ ID NO: 314655 - DNA, 20 bp, human
gggctcgggtttgcgcggga

SEQ ID NO: 314656 - DNA, 20 bp, human
ggcacccggcccaggatcgc

SEQ ID NO: 314657 - DNA, 20 bp, human
gctgcaccgcccgcgatcct

SEQ ID NO: 314658 - DNA, 20 bp, human
gagtccctggatcacgtccc

SEQ ID NO: 314659 - DNA, 20 bp, human
gcaacccgtgagcccagcgc

SEQ ID NO: 314660 - DNA, 20 bp, human
gtactgccaggttctcaacg

SEQ ID NO: 314661 - DNA, 20 bp, human
ggggaaactcggaatcccgg

SEQ ID NO: 314662 - DNA, 20 bp, human
gcaacgaggtggagccaaag

SEQ ID NO: 314663 - DNA, 20 bp, human
gtggcagtacgtggcgtccc

SEQ ID NO: 314664 - DNA, 20 bp, human
gccgcccgcgatcctgggcc

SEQ ID NO: 314665 - DNA, 20 bp, human
gaggggcgggtgcaaggacg

SEQ ID NO: 314666 - DNA, 20 bp, human
gggacgcctcggcgcggaag

SEQ ID NO: 314667 - DNA, 20 bp, human
ggcgcccggcccagtgcgcg

SEQ ID NO: 314668 - DNA, 20 bp, human
ggcgtccccgaggcgcaagt

SEQ ID NO: 314669 - DNA, 20 bp, human
gcgcaagtgggccgccttca

SEQ ID NO: 314670 - DNA, 20 bp, human
ggcactgggccgggcgcacc

SEQ ID NO: 314671 - DNA, 20 bp, human
gtctgcacacgggccgcggg

SEQ ID NO: 314672 - DNA, 20 bp, human
gccccgcgctgagtcacttg

SEQ ID NO: 314673 - DNA, 20 bp, human
gacacccggccgcgcgcact

SEQ ID NO: 314674 - DNA, 20 bp, human
gcgggaggacacagtgtacc

SEQ ID NO: 314675 - DNA, 20 bp, human
ggccgcaagtgactcagcgc

SEQ ID NO: 314676 - DNA, 20 bp, human
gagggcaggggcaggtctca

SEQ ID NO: 314677 - DNA, 20 bp, human
ggggcgggggctcaccagaa

SEQ ID NO: 314678 - DNA, 20 bp, human
ggcggcgagcacgtcccctg

SEQ ID NO: 314679 - DNA, 20 bp, human
gacaagggcgcgcagtgcgc

SEQ ID NO: 314680 - DNA, 20 bp, human
ggggtcgtgcacgcggatgc

SEQ ID NO: 314681 - DNA, 20 bp, human
ggtgcacgcggatgcggggt

SEQ ID NO: 314682 - DNA, 20 bp, human
gacagatgcagtgcgtgcgc

SEQ ID NO: 314683 - DNA, 20 bp, human
ggcagtgcgcaggatgcgag

SEQ ID NO: 314684 - DNA, 20 bp, human
gggcagtgcgcgcacagcgg

SEQ ID NO: 314685 - DNA, 20 bp, human
gggtttctttgcaggtacaa

SEQ ID NO: 314686 - DNA, 20 bp, human
gcggcccagccagatgcctt

SEQ ID NO: 314687 - DNA, 20 bp, human
ggggaagagcaggcggagga

SEQ ID NO: 314688 - DNA, 20 bp, human
ggggccagacgccctgcaca

SEQ ID NO: 314689 - DNA, 20 bp, human
ggggcctcatcctatctccc

SEQ ID NO: 314690 - DNA, 20 bp, human
gccgagcagtacggtcattt

SEQ ID NO: 314691 - DNA, 20 bp, human
gagcagtacggtcatttggg

SEQ ID NO: 314692 - DNA, 20 bp, human
ggaaaccttgccaggcgggc

SEQ ID NO: 314693 - DNA, 20 bp, human
gttgggtggcttttcaccag

SEQ ID NO: 314694 - DNA, 20 bp, human
gactcccagcccaaggcatc

SEQ ID NO: 314695 - DNA, 20 bp, human
ggtttcagggaaccaggctc

SEQ ID NO: 314696 - DNA, 20 bp, human
gggcggcgcggggtcggtaa

SEQ ID NO: 314697 - DNA, 20 bp, human
ggcgccgagaggaactgtcc

SEQ ID NO: 314698 - DNA, 20 bp, human
ggcgccgccgcccaccgcac

SEQ ID NO: 314699 - DNA, 20 bp, human
ggagaggaactgtccgggaa

SEQ ID NO: 314700 - DNA, 20 bp, human
ggggtcggtaacggcccgtg

SEQ ID NO: 314701 - DNA, 20 bp, human
gtaacggcccgtgcggtggg

SEQ ID NO: 314702 - DNA, 20 bp, human
ggcacagggagggatcacca

SEQ ID NO: 314703 - DNA, 20 bp, human
ggcaaaggttaggcctggaa

SEQ ID NO: 314704 - DNA, 20 bp, human
ggaagggcccacccgggaag

SEQ ID NO: 314705 - DNA, 20 bp, human
gctggtgccctgggggtaga

SEQ ID NO: 314706 - DNA, 20 bp, human
gctctcccgccctcggaaaa

SEQ ID NO: 314707 - DNA, 20 bp, human
ggggtggggccgagctgcga

SEQ ID NO: 314708 - DNA, 20 bp, human
gcgagggcgggagaggagtc

SEQ ID NO: 314709 - DNA, 20 bp, human
gggccccacccccttttccg

SEQ ID NO: 314710 - DNA, 20 bp, human
gcctccttccggaacacctt

SEQ ID NO: 314711 - DNA, 20 bp, human
gcggccgaaggtgttccgga

SEQ ID NO: 314712 - DNA, 20 bp, human
gccacccccttttccgaggg

SEQ ID NO: 314713 - DNA, 20 bp, human
ggaaaagaggcgtgcggaaa

SEQ ID NO: 314714 - DNA, 20 bp, human
ggctacttccggaagaagtt

SEQ ID NO: 314715 - DNA, 20 bp, human
gcccactgctcggctcaggt

SEQ ID NO: 314716 - DNA, 20 bp, human
ggggccttgctggaagtgga

SEQ ID NO: 314717 - DNA, 20 bp, human
gccccagcgccaggctagca

SEQ ID NO: 314718 - DNA, 20 bp, human
gatggtacgccgaggggtgg

SEQ ID NO: 314719 - DNA, 20 bp, human
gctgctgcctcgccacgggg

SEQ ID NO: 314720 - DNA, 20 bp, human
gcaggctagcaaggccgagt

SEQ ID NO: 314721 - DNA, 20 bp, human
gaaaggggatggtacgccga

SEQ ID NO: 314722 - DNA, 20 bp, human
gggggccagcgggaattggg

SEQ ID NO: 314723 - DNA, 20 bp, human
gtccctggggaacccccctg

SEQ ID NO: 314724 - DNA, 20 bp, human
gccagcgggaattggggggg

SEQ ID NO: 314725 - DNA, 20 bp, human
ggggatggtacgccgagggg

SEQ ID NO: 314726 - DNA, 20 bp, human
gaaaacctggagaaccggaa

SEQ ID NO: 314727 - DNA, 20 bp, human
gggaacttcgatttggggaa

SEQ ID NO: 314728 - DNA, 20 bp, human
gaacgcgggaacttcgattt

SEQ ID NO: 314729 - DNA, 20 bp, human
gaaccggaaaggtctgcaaa

SEQ ID NO: 314730 - DNA, 20 bp, human
gctccccgggacagctggat

SEQ ID NO: 314731 - DNA, 20 bp, human
gtgcaaaaggggcggaacgc

SEQ ID NO: 314732 - DNA, 20 bp, human
gcggccacggagattctctt

SEQ ID NO: 314733 - DNA, 20 bp, human
ggcagccaatccagctgtcc

SEQ ID NO: 314734 - DNA, 20 bp, human
gtatccgttagttataactg

SEQ ID NO: 314735 - DNA, 20 bp, human
gagaacttctggaatgccgc

SEQ ID NO: 314736 - DNA, 20 bp, human
gaagccgacaagtgctcgac

SEQ ID NO: 314737 - DNA, 20 bp, human
gggaggaaactcgaggaaga

SEQ ID NO: 314738 - DNA, 20 bp, human
gaaggctgagtgacccggcg

SEQ ID NO: 314739 - DNA, 20 bp, human
ggaagactggaggaaactcg

SEQ ID NO: 314740 - DNA, 20 bp, human
gtagcccgtcgagcacttgt

SEQ ID NO: 314741 - DNA, 20 bp, human
gtccagccgacctaaacgaa

SEQ ID NO: 314742 - DNA, 20 bp, human
gctactaggagaaggacgta

SEQ ID NO: 314743 - DNA, 20 bp, human
ggtttcccgccgggccagta

SEQ ID NO: 314744 - DNA, 20 bp, human
gaaaaactgcggaaaaccga

SEQ ID NO: 314745 - DNA, 20 bp, human
gtcgcttggtggaaaaactg

SEQ ID NO: 314746 - DNA, 20 bp, human
gggccggggcgcaccactcc

SEQ ID NO: 314747 - DNA, 20 bp, human
ggctcgggagcgtggtgcgg

SEQ ID NO: 314748 - DNA, 20 bp, human
gtggctccccggccggttgg

SEQ ID NO: 314749 - DNA, 20 bp, human
ggggtgggacacgccggatg

SEQ ID NO: 314750 - DNA, 20 bp, human
gcgtgctctgggcatcccgg

SEQ ID NO: 314751 - DNA, 20 bp, human
gggagcgtggtgcggcgggt

SEQ ID NO: 314752 - DNA, 20 bp, human
ggccccctcaccggcgtcag

SEQ ID NO: 314753 - DNA, 20 bp, human
gccggccggggagccacatc

SEQ ID NO: 314754 - DNA, 20 bp, human
gccccctgacgccggtgagg

SEQ ID NO: 314755 - DNA, 20 bp, human
ggcaggccggggcgctcccc

SEQ ID NO: 314756 - DNA, 20 bp, human
gaaacggcaggcgctcgcga

SEQ ID NO: 314757 - DNA, 20 bp, human
gacggcagaggcaaggtcag

SEQ ID NO: 314758 - DNA, 20 bp, human
gcgcccttcaccaggaatga

SEQ ID NO: 314759 - DNA, 20 bp, human
gaagaatgggagtgtcagtg

SEQ ID NO: 314760 - DNA, 20 bp, human
gcgagcgcctgccgtttctc

SEQ ID NO: 314761 - DNA, 20 bp, human
ggcgagggggcgctgaggtc

SEQ ID NO: 314762 - DNA, 20 bp, human
gaggcgcatgcgttctgccg

SEQ ID NO: 314763 - DNA, 20 bp, human
gagtgtgaccgtgacggcag

SEQ ID NO: 314764 - DNA, 20 bp, human
gggcggggcttaagggacag

SEQ ID NO: 314765 - DNA, 20 bp, human
gaaaccgtcattcctggtga

SEQ ID NO: 314766 - DNA, 20 bp, human
gaacccgcgcgccgaaggcc

SEQ ID NO: 314767 - DNA, 20 bp, human
gggcccgcccagcagcacct

SEQ ID NO: 314768 - DNA, 20 bp, human
gctgcgccgcagcacccggt

SEQ ID NO: 314769 - DNA, 20 bp, human
gcacctgggaaacgcccgcg

SEQ ID NO: 314770 - DNA, 20 bp, human
gttggggcaggcgtggccgt

SEQ ID NO: 314771 - DNA, 20 bp, human
gcggcctgacgcccggaccg

SEQ ID NO: 314772 - DNA, 20 bp, human
ggaaacgcccgcgcggtttg

SEQ ID NO: 314773 - DNA, 20 bp, human
gcggcgcgcgggttcctagg

SEQ ID NO: 314774 - DNA, 20 bp, human
gcccgaggcggacgtgagaa

SEQ ID NO: 314775 - DNA, 20 bp, human
gctgacgcccggaccgcggc

SEQ ID NO: 314776 - DNA, 20 bp, human
gcgcgcgcggggacgaccgt

SEQ ID NO: 314777 - DNA, 20 bp, human
gtccctcggcggaacaatgg

SEQ ID NO: 314778 - DNA, 20 bp, human
ggggacgaccgtgggtcacg

SEQ ID NO: 314779 - DNA, 20 bp, human
ggtggggcaaaggcgtgtca

SEQ ID NO: 314780 - DNA, 20 bp, human
gtcacgtgggcgccagtggg

SEQ ID NO: 314781 - DNA, 20 bp, human
gtgtcagggaaggttggcgg

SEQ ID NO: 314782 - DNA, 20 bp, human
gcggggcgtgggcgtcacgt

SEQ ID NO: 314783 - DNA, 20 bp, human
gggcggaacaatggcggctt

SEQ ID NO: 314784 - DNA, 20 bp, human
ggcggggtcgggtggggcaa

SEQ ID NO: 314785 - DNA, 20 bp, human
ggggtcacgtgggcgccagt

SEQ ID NO: 314786 - DNA, 20 bp, human
gtcgcctgggcagatgtccg

SEQ ID NO: 314787 - DNA, 20 bp, human
ggtcctgcgccccctcgtgg

SEQ ID NO: 314788 - DNA, 20 bp, human
ggaacgccaaagaaggggtt

SEQ ID NO: 314789 - DNA, 20 bp, human
ggtattgaacgccaaagaag

SEQ ID NO: 314790 - DNA, 20 bp, human
gcgcgcagaggtgatgtcgt

SEQ ID NO: 314791 - DNA, 20 bp, human
gctgccaggcccctagcgtc

SEQ ID NO: 314792 - DNA, 20 bp, human
gggctgaagtaccgccacga

SEQ ID NO: 314793 - DNA, 20 bp, human
gagagaccgcggtgagcgcg

SEQ ID NO: 314794 - DNA, 20 bp, human
gccttcgcagcccgacgcta

SEQ ID NO: 314795 - DNA, 20 bp, human
gtagccgctccggaccccag

SEQ ID NO: 314796 - DNA, 20 bp, human
gcgggtctggcgcccagcaa

SEQ ID NO: 314797 - DNA, 20 bp, human
ggggttacgcggggagacag

SEQ ID NO: 314798 - DNA, 20 bp, human
gacagcgtggggacggccgg

SEQ ID NO: 314799 - DNA, 20 bp, human
gcgcgctcccgggcccacgt

SEQ ID NO: 314800 - DNA, 20 bp, human
gcaagtccacaggacttcag

SEQ ID NO: 314801 - DNA, 20 bp, human
gggaatagcgagccggagaa

SEQ ID NO: 314802 - DNA, 20 bp, human
gagtgggcgagaccatgtgc

SEQ ID NO: 314803 - DNA, 20 bp, human
gctggcgcccagcaaaggct

SEQ ID NO: 314804 - DNA, 20 bp, human
gcggacggcaaagccgggtc

SEQ ID NO: 314805 - DNA, 20 bp, human
gctgccccaggccgcggtgg

SEQ ID NO: 314806 - DNA, 20 bp, human
gccgcggggctcaggtgtcc

SEQ ID NO: 314807 - DNA, 20 bp, human
ggggccgccccttagaaagc

SEQ ID NO: 314808 - DNA, 20 bp, human
gctggcgctgggaacggcgt

SEQ ID NO: 314809 - DNA, 20 bp, human
gcggccttccggctttctaa

SEQ ID NO: 314810 - DNA, 20 bp, human
ggtgtggtggatcgtgattc

SEQ ID NO: 314811 - DNA, 20 bp, human
gagaggcggcggcacggtga

SEQ ID NO: 314812 - DNA, 20 bp, human
gggccggaagtgaaggacgg

SEQ ID NO: 314813 - DNA, 20 bp, human
ggagcgttcacggccccgcg

SEQ ID NO: 314814 - DNA, 20 bp, human
gccgaggcccccgaaggctg

SEQ ID NO: 314815 - DNA, 20 bp, human
gaacggcgtcggtgacggac

SEQ ID NO: 314816 - DNA, 20 bp, human
gtggctgcgttgggacgcgg

SEQ ID NO: 314817 - DNA, 20 bp, human
ggtccctccccgcaccacga

SEQ ID NO: 314818 - DNA, 20 bp, human
gccgactcgccctcgtggtg

SEQ ID NO: 314819 - DNA, 20 bp, human
gcacgagggcgagtcggagt

SEQ ID NO: 314820 - DNA, 20 bp, human
gtcgccctcgtggtgcgggg

SEQ ID NO: 314821 - DNA, 20 bp, human
gggcgagtcggagtgggaat

SEQ ID NO: 314822 - DNA, 20 bp, human
ggactggctgcgttgggacg

SEQ ID NO: 314823 - DNA, 20 bp, human
gttgtgtcccgcgctctgac

SEQ ID NO: 314824 - DNA, 20 bp, human
gaacgcagccagtcagagcg

SEQ ID NO: 314825 - DNA, 20 bp, human
ggacgcgggggcgtgtcttg

SEQ ID NO: 314826 - DNA, 20 bp, human
ggaggtgggttcatccgcgt

SEQ ID NO: 314827 - DNA, 20 bp, human
ggcggatgaacccacctcct

SEQ ID NO: 314828 - DNA, 20 bp, human
gcctccctggcgcctctggt

SEQ ID NO: 314829 - DNA, 20 bp, human
ggttggctcaggttgtcagg

SEQ ID NO: 314830 - DNA, 20 bp, human
gtgccccgctcgccaattgg

SEQ ID NO: 314831 - DNA, 20 bp, human
gagaagggaacgaatcccca

SEQ ID NO: 314832 - DNA, 20 bp, human
gttggcgagcggggcaccga

SEQ ID NO: 314833 - DNA, 20 bp, human
gcggaagtgacgttagggga

SEQ ID NO: 314834 - DNA, 20 bp, human
ggcaccggagtcaaggagaa

SEQ ID NO: 314835 - DNA, 20 bp, human
gcaccgaggggaaggcgccc

SEQ ID NO: 314836 - DNA, 20 bp, human
ggcgccctgcgtccccgact

SEQ ID NO: 314837 - DNA, 20 bp, human
gtgggagcgcggagcgactc

SEQ ID NO: 314838 - DNA, 20 bp, human
gaagctgcgctcctgatcgt

SEQ ID NO: 314839 - DNA, 20 bp, human
gagccccagtcggggacgca

SEQ ID NO: 314840 - DNA, 20 bp, human
gactctttaacgttgcagtg

SEQ ID NO: 314841 - DNA, 20 bp, human
gtgccagcctgccgacgatc

SEQ ID NO: 314842 - DNA, 20 bp, human
ggagcgactccggtgccgaa

SEQ ID NO: 314843 - DNA, 20 bp, human
gtgcgctcctgatcgtcggc

SEQ ID NO: 314844 - DNA, 20 bp, human
gcaggctggcactgttatac

SEQ ID NO: 314845 - DNA, 20 bp, human
ggctctccaaagccgcgggg

SEQ ID NO: 314846 - DNA, 20 bp, human
ggccctgcgcaggcgcatcg

SEQ ID NO: 314847 - DNA, 20 bp, human
gctgcgcaggcgcatcgggg

SEQ ID NO: 314848 - DNA, 20 bp, human
gggcggggtctggttggagt

SEQ ID NO: 314849 - DNA, 20 bp, human
gccggcggccgaggcgatga

SEQ ID NO: 314850 - DNA, 20 bp, human
gacaagggtgcagcctgggg

SEQ ID NO: 314851 - DNA, 20 bp, human
gaagacttattctggaggat

SEQ ID NO: 314852 - DNA, 20 bp, human
gggcttgcctgcttggaggc

SEQ ID NO: 314853 - DNA, 20 bp, human
gaatctagggccgctgtagc

SEQ ID NO: 314854 - DNA, 20 bp, human
gcggcccaggataagtcttt

SEQ ID NO: 314855 - DNA, 20 bp, human
gttaccaaaagacttatcct

SEQ ID NO: 314856 - DNA, 20 bp, human
gagacaggggatcaagttgg

SEQ ID NO: 314857 - DNA, 20 bp, human
gaagagacaggggatcaagt

SEQ ID NO: 314858 - DNA, 20 bp, human
gaaaacctacactcagtcct

SEQ ID NO: 314859 - DNA, 20 bp, human
gaatcctcggaaccatccta

SEQ ID NO: 314860 - DNA, 20 bp, human
gtaaaacccgagcctgggag

SEQ ID NO: 314861 - DNA, 20 bp, human
gccgcgccgaaggacaggtc

SEQ ID NO: 314862 - DNA, 20 bp, human
gaagtcccgcgccgaaggac

SEQ ID NO: 314863 - DNA, 20 bp, human
gaggctcgggttttacagac

SEQ ID NO: 314864 - DNA, 20 bp, human
gaggggcttcggtgcgcggg

SEQ ID NO: 314865 - DNA, 20 bp, human
ggccgaaagtcccgcgccga

SEQ ID NO: 314866 - DNA, 20 bp, human
gactctcagcagccggcttg

SEQ ID NO: 314867 - DNA, 20 bp, human
gcaaaagcacttcccaggac

SEQ ID NO: 314868 - DNA, 20 bp, human
gcacgcgcggagctctgaga

SEQ ID NO: 314869 - DNA, 20 bp, human
gcggcaaccgctccgcaagc

SEQ ID NO: 314870 - DNA, 20 bp, human
gtcccaggacaggacggtga

SEQ ID NO: 314871 - DNA, 20 bp, human
gcagcagccggcttgcggag

SEQ ID NO: 314872 - DNA, 20 bp, human
gctacagcgtggggtgaaat

SEQ ID NO: 314873 - DNA, 20 bp, human
gagatctgccgggtggacac

SEQ ID NO: 314874 - DNA, 20 bp, human
gtgattgatcagcctggctc

SEQ ID NO: 314875 - DNA, 20 bp, human
gtcaaggtaatacacatctg

SEQ ID NO: 314876 - DNA, 20 bp, human
gggggcacggtctcgatgga

SEQ ID NO: 314877 - DNA, 20 bp, human
gcagcgcctcgcccactcgg

SEQ ID NO: 314878 - DNA, 20 bp, human
ggggagcgcggcccccgagt

SEQ ID NO: 314879 - DNA, 20 bp, human
gtggaggggagtgtgctccg

SEQ ID NO: 314880 - DNA, 20 bp, human
ggagctggacccgcctcctg

SEQ ID NO: 314881 - DNA, 20 bp, human
gcctcggtgcgcagctgcgg

SEQ ID NO: 314882 - DNA, 20 bp, human
gtgaggtgagaaaggttcta

SEQ ID NO: 314883 - DNA, 20 bp, human
ggggtcagcggaagtgaggg

SEQ ID NO: 314884 - DNA, 20 bp, human
gggaggcgggtccagctcgg

SEQ ID NO: 314885 - DNA, 20 bp, human
gcgcgggggcacggtctcga

SEQ ID NO: 314886 - DNA, 20 bp, human
gcctgcccgtcagctcctat

SEQ ID NO: 314887 - DNA, 20 bp, human
ggacccgtaaccagcctcat

SEQ ID NO: 314888 - DNA, 20 bp, human
ggcatgatgtcaggcaattc

SEQ ID NO: 314889 - DNA, 20 bp, human
ggggcagggcaggtcgcgtt

SEQ ID NO: 314890 - DNA, 20 bp, human
gtccctgcgaagagttctgt

SEQ ID NO: 314891 - DNA, 20 bp, human
gggacagcgtcgctcccgca

SEQ ID NO: 314892 - DNA, 20 bp, human
gtcccgcagggcaaggtttt

SEQ ID NO: 314893 - DNA, 20 bp, human
gtcagccaataggagctgac

SEQ ID NO: 314894 - DNA, 20 bp, human
ggggaaggcggatgcgctta

SEQ ID NO: 314895 - DNA, 20 bp, human
ggaagacccgcctcttgaga

SEQ ID NO: 314896 - DNA, 20 bp, human
gggactgcgaggagacccgg

SEQ ID NO: 314897 - DNA, 20 bp, human
gccactccgggcttcgccgg

SEQ ID NO: 314898 - DNA, 20 bp, human
gcgggcttccggcgctccaa

SEQ ID NO: 314899 - DNA, 20 bp, human
ggcccagagggagggacgaa

SEQ ID NO: 314900 - DNA, 20 bp, human
gccgctgcgacccgcctctg

SEQ ID NO: 314901 - DNA, 20 bp, human
ggtgggtcgagcgtcggggc

SEQ ID NO: 314902 - DNA, 20 bp, human
gcgcagcgccggaacctcag

SEQ ID NO: 314903 - DNA, 20 bp, human
gcggaagcccgcagtgccgg

SEQ ID NO: 314904 - DNA, 20 bp, human
ggcacgcgcaggccgtggtg

SEQ ID NO: 314905 - DNA, 20 bp, human
gcagagggagggacgaatgg

SEQ ID NO: 314906 - DNA, 20 bp, human
gagggcgccggcgagaagcg

SEQ ID NO: 314907 - DNA, 20 bp, human
gctgcagccgcgcttctcgc

SEQ ID NO: 314908 - DNA, 20 bp, human
gagcaacggcaggagggatg

SEQ ID NO: 314909 - DNA, 20 bp, human
gggcggctgtccttgtgctc

SEQ ID NO: 314910 - DNA, 20 bp, human
gaagcaggagcaacggcagg

SEQ ID NO: 314911 - DNA, 20 bp, human
gggtgcagaaaacacgccga

SEQ ID NO: 314912 - DNA, 20 bp, human
ggcgaccttgtccctggtag

SEQ ID NO: 314913 - DNA, 20 bp, human
gaaaaggccccggaagtggt

SEQ ID NO: 314914 - DNA, 20 bp, human
gccgccccgcccgttccacc

SEQ ID NO: 314915 - DNA, 20 bp, human
gggcaccgggtggaacgggc

SEQ ID NO: 314916 - DNA, 20 bp, human
ggggactgcgggacggaaga

SEQ ID NO: 314917 - DNA, 20 bp, human
gactgcgggacggaagaggg

SEQ ID NO: 314918 - DNA, 20 bp, human
gtctccccctgcagacgcgg

SEQ ID NO: 314919 - DNA, 20 bp, human
gttagctctcggttagttaa

SEQ ID NO: 314920 - DNA, 20 bp, human
gggcgcatgcgcagttcgga

SEQ ID NO: 314921 - DNA, 20 bp, human
gtaaccgagagctaacaggt

SEQ ID NO: 314922 - DNA, 20 bp, human
gaatggctggcggaaatgat

SEQ ID NO: 314923 - DNA, 20 bp, human
gtccccgacctgttagctct

SEQ ID NO: 314924 - DNA, 20 bp, human
gggctggcggaaatgattgg

SEQ ID NO: 314925 - DNA, 20 bp, human
ggaagaaaatcggtgatgaa

SEQ ID NO: 314926 - DNA, 20 bp, human
gtaaaggggcggtgcggctg

SEQ ID NO: 314927 - DNA, 20 bp, human
gggcgcgacccagacggtaa

SEQ ID NO: 314928 - DNA, 20 bp, human
ggacccagacggtaaagggg

SEQ ID NO: 314929 - DNA, 20 bp, human
gggctctgatgcaatcgcgc

SEQ ID NO: 314930 - DNA, 20 bp, human
gccgcagcgcaggtgggcgt

SEQ ID NO: 314931 - DNA, 20 bp, human
gggagggaggctgagtctca

SEQ ID NO: 314932 - DNA, 20 bp, human
ggggcgtgggcatctccaat

SEQ ID NO: 314933 - DNA, 20 bp, human
gctggggcggaaaccagggg

SEQ ID NO: 314934 - DNA, 20 bp, human
ggtaagctgtaccagacaga

SEQ ID NO: 314935 - DNA, 20 bp, human
gcggctggggcggaaaccag

SEQ ID NO: 314936 - DNA, 20 bp, human
gggtccctgccgcatgccac

SEQ ID NO: 314937 - DNA, 20 bp, human
ggagccaggtggagccgaag

SEQ ID NO: 314938 - DNA, 20 bp, human
gcctggagcgaggtcctgta

SEQ ID NO: 314939 - DNA, 20 bp, human
gaacgtgccatgataggctg

SEQ ID NO: 314940 - DNA, 20 bp, human
gtggctcaacagacagccag

SEQ ID NO: 314941 - DNA, 20 bp, human
ggggaccaatgggtggcgga

SEQ ID NO: 314942 - DNA, 20 bp, human
gctcggcaacgtgccatgat

SEQ ID NO: 314943 - DNA, 20 bp, human
gacctcgctccaggctcttc

SEQ ID NO: 314944 - DNA, 20 bp, human
ggcatgcggcagggaccaat

SEQ ID NO: 314945 - DNA, 20 bp, human
gctggctccaatcaaaagca

SEQ ID NO: 314946 - DNA, 20 bp, human
gaaagccttagaggcttagg

SEQ ID NO: 314947 - DNA, 20 bp, human
gcatgccccctaagcctcta

SEQ ID NO: 314948 - DNA, 20 bp, human
gaacacagtcgtagatttga

SEQ ID NO: 314949 - DNA, 20 bp, human
gagcaataatgggtctccag

SEQ ID NO: 314950 - DNA, 20 bp, human
gttaggtgacctcagtgatg

SEQ ID NO: 314951 - DNA, 20 bp, human
ggattgagcaatacagtatt

SEQ ID NO: 314952 - DNA, 20 bp, human
gttgcagcttaaagccttag

SEQ ID NO: 314953 - DNA, 20 bp, human
gtatcccaaaactttgtcat

SEQ ID NO: 314954 - DNA, 20 bp, human
gctcgactgcggttcagttg

SEQ ID NO: 314955 - DNA, 20 bp, human
gggagacccattattgctca

SEQ ID NO: 314956 - DNA, 20 bp, human
ggggccaggacccaagtccc

SEQ ID NO: 314957 - DNA, 20 bp, human
gcggttcccaggaccgggga

SEQ ID NO: 314958 - DNA, 20 bp, human
ggccctgccagcccgggtga

SEQ ID NO: 314959 - DNA, 20 bp, human
gtgtctgccggaacctggct

SEQ ID NO: 314960 - DNA, 20 bp, human
gccggcagacacgcagagtg

SEQ ID NO: 314961 - DNA, 20 bp, human
gcccgggccctctgaggatg

SEQ ID NO: 314962 - DNA, 20 bp, human
gacagagtgccgggtccgca

SEQ ID NO: 314963 - DNA, 20 bp, human
gctgcgtgtctgccggaacc

SEQ ID NO: 314964 - DNA, 20 bp, human
gtccggaagccggggatccg

SEQ ID NO: 314965 - DNA, 20 bp, human
gcacgcttccacatcctcag

SEQ ID NO: 314966 - DNA, 20 bp, human
gctgaggctctagtaagggg

SEQ ID NO: 314967 - DNA, 20 bp, human
gagggctgaggctctagtaa

SEQ ID NO: 314968 - DNA, 20 bp, human
gaggctctagtaaggggagg

SEQ ID NO: 314969 - DNA, 20 bp, human
ggcaaggcttccaggcgagg

SEQ ID NO: 314970 - DNA, 20 bp, human
gggagctgcgacaaaggaag

SEQ ID NO: 314971 - DNA, 20 bp, human
gtgaacacacccgctgggga

SEQ ID NO: 314972 - DNA, 20 bp, human
gagctccagccagcacaagg

SEQ ID NO: 314973 - DNA, 20 bp, human
gccagcgggtgtgttcaact

SEQ ID NO: 314974 - DNA, 20 bp, human
gtgaggccaacaggcgttca

SEQ ID NO: 314975 - DNA, 20 bp, human
gtgagctgttccttctctgg

SEQ ID NO: 314976 - DNA, 20 bp, human
ggggtccagagtggcagtaa

SEQ ID NO: 314977 - DNA, 20 bp, human
gagggccacgtgaccgtccc

SEQ ID NO: 314978 - DNA, 20 bp, human
gacgtggccctctcgagctc

SEQ ID NO: 314979 - DNA, 20 bp, human
ggatctgcgcctcacgtgac

SEQ ID NO: 314980 - DNA, 20 bp, human
ggagtggctgcagacgggtg

SEQ ID NO: 314981 - DNA, 20 bp, human
gtcagtcccagagctcgaga

SEQ ID NO: 314982 - DNA, 20 bp, human
gtccagagtggcagtaaagg

SEQ ID NO: 314983 - DNA, 20 bp, human
gttggtagaggggtccagag

SEQ ID NO: 314984 - DNA, 20 bp, human
gccgtgcccacaggtctcgt

SEQ ID NO: 314985 - DNA, 20 bp, human
gcggcctccaacgagacctg

SEQ ID NO: 314986 - DNA, 20 bp, human
gggcccgcgtcccggaagcg

SEQ ID NO: 314987 - DNA, 20 bp, human
ggaccacggggaccgcacga

SEQ ID NO: 314988 - DNA, 20 bp, human
gaccgctcccctaaccgggg

SEQ ID NO: 314989 - DNA, 20 bp, human
ggggcggagaccgaacccga

SEQ ID NO: 314990 - DNA, 20 bp, human
gcgcgtcccggaagcggggt

SEQ ID NO: 314991 - DNA, 20 bp, human
gccgctcccaggtggatccg

SEQ ID NO: 314992 - DNA, 20 bp, human
gcagaggcgaggtaagcgcg

SEQ ID NO: 314993 - DNA, 20 bp, human
ggcctccgcggtcccggtga

SEQ ID NO: 314994 - DNA, 20 bp, human
gtaagcgcgcggcgcgccgc

SEQ ID NO: 314995 - DNA, 20 bp, human
gggctcgccctccccggtta

SEQ ID NO: 314996 - DNA, 20 bp, human
gacctcagagcgtcggggat

SEQ ID NO: 314997 - DNA, 20 bp, human
gggacccggaggggcgtgtc

SEQ ID NO: 314998 - DNA, 20 bp, human
gaggaccgccgagctcccga

SEQ ID NO: 314999 - DNA, 20 bp, human
gcaccgagggtcggccctgt

SEQ ID NO: 315000 - DNA, 20 bp, human
ggggatgggcgtggccccgt

SEQ ID NO: 315001 - DNA, 20 bp, human
ggcggggattggacccggag

SEQ ID NO: 315002 - DNA, 20 bp, human
gtcaccccgcctattggtct

SEQ ID NO: 315003 - DNA, 20 bp, human
gtcccacacgccgtataagt

SEQ ID NO: 315004 - DNA, 20 bp, human
gcgccccgtcgggagctcgg

SEQ ID NO: 315005 - DNA, 20 bp, human
gccaataggcggggtgaacg

SEQ ID NO: 315006 - DNA, 20 bp, human
gtccgcgccggggacagtca

SEQ ID NO: 315007 - DNA, 20 bp, human
gaggcccaggcgcgcatgct

SEQ ID NO: 315008 - DNA, 20 bp, human
gtgcgcgatggtaggagggg

SEQ ID NO: 315009 - DNA, 20 bp, human
gtccgcgcctgcgcgatggt

SEQ ID NO: 315010 - DNA, 20 bp, human
gtagctgaaagcaagagcga

SEQ ID NO: 315011 - DNA, 20 bp, human
gcgcctgcgcgatggtagga

SEQ ID NO: 315012 - DNA, 20 bp, human
ggtcgagcgccgcccgtgac

SEQ ID NO: 315013 - DNA, 20 bp, human
gaatgggtcccgagagacca

SEQ ID NO: 315014 - DNA, 20 bp, human
ggtctctcgggacccattgc

SEQ ID NO: 315015 - DNA, 20 bp, human
gccaggcgcgcatgctcggg

SEQ ID NO: 315016 - DNA, 20 bp, human
gaccacgcgcggctgaccct

SEQ ID NO: 315017 - DNA, 20 bp, human
ggaggcgctggttcaacctg

SEQ ID NO: 315018 - DNA, 20 bp, human
gctgggggtgggactgtctg

SEQ ID NO: 315019 - DNA, 20 bp, human
gtgtctgcggtgtccgcggc

SEQ ID NO: 315020 - DNA, 20 bp, human
gagcccggcggggaccgtag

SEQ ID NO: 315021 - DNA, 20 bp, human
gccaggctggacgcccgccg

SEQ ID NO: 315022 - DNA, 20 bp, human
ggaaccagcgcctcccaggc

SEQ ID NO: 315023 - DNA, 20 bp, human
gtgctgtcgccgctgggggt

SEQ ID NO: 315024 - DNA, 20 bp, human
gagaaacgattcaccacgcg

SEQ ID NO: 315025 - DNA, 20 bp, human
gacctaccgaccattcttcc

SEQ ID NO: 315026 - DNA, 20 bp, human
gacgcggaggaagtccctga

SEQ ID NO: 315027 - DNA, 20 bp, human
ggaaaatgcggagaacgcgg

SEQ ID NO: 315028 - DNA, 20 bp, human
gctggctcccgctgctccgc

SEQ ID NO: 315029 - DNA, 20 bp, human
ggtagcggacgcaagtacag

SEQ ID NO: 315030 - DNA, 20 bp, human
gttaaaggaaaggtgatggg

SEQ ID NO: 315031 - DNA, 20 bp, human
gcccgtcccgccggtaccga

SEQ ID NO: 315032 - DNA, 20 bp, human
ggcggtgcgcggaccggcat

SEQ ID NO: 315033 - DNA, 20 bp, human
gtcgctctccgtagtgggcg

SEQ ID NO: 315034 - DNA, 20 bp, human
gcgcaagtacagcggatctg

SEQ ID NO: 315035 - DNA, 20 bp, human
ggcgcggaccggcatcggga

SEQ ID NO: 315036 - DNA, 20 bp, human
gggaggagacagagtcgcga

SEQ ID NO: 315037 - DNA, 20 bp, human
gggaggtaaaggcggggcca

SEQ ID NO: 315038 - DNA, 20 bp, human
gtccccacctgagcctggat

SEQ ID NO: 315039 - DNA, 20 bp, human
gaggtgtggtgggcgtggtc

SEQ ID NO: 315040 - DNA, 20 bp, human
gaactcgggcagcgctaagt

SEQ ID NO: 315041 - DNA, 20 bp, human
ggagacagagtcgcgagggg

SEQ ID NO: 315042 - DNA, 20 bp, human
ggtgagggacaggaacctgg

SEQ ID NO: 315043 - DNA, 20 bp, human
gggacaggaacctgggggga

SEQ ID NO: 315044 - DNA, 20 bp, human
ggccgttggcggttggagaa

SEQ ID NO: 315045 - DNA, 20 bp, human
ggttcagccgatccaggctc

SEQ ID NO: 315046 - DNA, 20 bp, human
gagtgcgccgggtcgacctg

SEQ ID NO: 315047 - DNA, 20 bp, human
gcccagctgcctccatgcgt

SEQ ID NO: 315048 - DNA, 20 bp, human
gcctggggagcagctccgaa

SEQ ID NO: 315049 - DNA, 20 bp, human
gccaggggccatccctgtaa

SEQ ID NO: 315050 - DNA, 20 bp, human
gggagcagctccgaagggcg

SEQ ID NO: 315051 - DNA, 20 bp, human
ggcgtcggacccttcaaaat

SEQ ID NO: 315052 - DNA, 20 bp, human
gccaacttcccttacaggga

SEQ ID NO: 315053 - DNA, 20 bp, human
gcgggactgcatcacgtgac

SEQ ID NO: 315054 - DNA, 20 bp, human
ggctgggaagcccattttga

SEQ ID NO: 315055 - DNA, 20 bp, human
gcagtcccgccaaccggcac

SEQ ID NO: 315056 - DNA, 20 bp, human
gtggggattccgaaccccag

SEQ ID NO: 315057 - DNA, 20 bp, human
ggtcccagatccccgctgta

SEQ ID NO: 315058 - DNA, 20 bp, human
ggagccttacagcggggatc

SEQ ID NO: 315059 - DNA, 20 bp, human
gcccgcgcgcgcggccttgt

SEQ ID NO: 315060 - DNA, 20 bp, human
gccccgctgtaaggctccgt

SEQ ID NO: 315061 - DNA, 20 bp, human
gcgcccacggagccttacag

SEQ ID NO: 315062 - DNA, 20 bp, human
gcggcggggtgcgtatggag

SEQ ID NO: 315063 - DNA, 20 bp, human
ggtgggcgagcgcccaggtg

SEQ ID NO: 315064 - DNA, 20 bp, human
gtgggtgcgtacagagccac

SEQ ID NO: 315065 - DNA, 20 bp, human
gcgggttgactgcagagacg

SEQ ID NO: 315066 - DNA, 20 bp, human
gctagcacgggacacggtca

SEQ ID NO: 315067 - DNA, 20 bp, human
gggcccgcgggggcctacgg

SEQ ID NO: 315068 - DNA, 20 bp, human
gacgggacacggtcagggag

SEQ ID NO: 315069 - DNA, 20 bp, human
ggggcaccgggccccttccg

SEQ ID NO: 315070 - DNA, 20 bp, human
gggacacggtcagggagcgg

SEQ ID NO: 315071 - DNA, 20 bp, human
gccggctgagggcccgccag

SEQ ID NO: 315072 - DNA, 20 bp, human
gcgcgcgccgtctctcgggg

SEQ ID NO: 315073 - DNA, 20 bp, human
gcaagagcgcggcctctgga

SEQ ID NO: 315074 - DNA, 20 bp, human
gcttgcgcgcgccgtctctc

SEQ ID NO: 315075 - DNA, 20 bp, human
gggtgccccgccccgagaga

SEQ ID NO: 315076 - DNA, 20 bp, human
gaccacaagttgtgatgggg

SEQ ID NO: 315077 - DNA, 20 bp, human
gcatcagcggatggagactg

SEQ ID NO: 315078 - DNA, 20 bp, human
gagggaccacaagttgtgat

SEQ ID NO: 315079 - DNA, 20 bp, human
gaaactgggtatttctatcc

SEQ ID NO: 315080 - DNA, 20 bp, human
gtaagaccatcctagtgtca

SEQ ID NO: 315081 - DNA, 20 bp, human
ggtctccatccgctgatgga

SEQ ID NO: 315082 - DNA, 20 bp, human
ggcctccccatcacaacttg

SEQ ID NO: 315083 - DNA, 20 bp, human
gttctatccgggtggagtcc

SEQ ID NO: 315084 - DNA, 20 bp, human
gccaggaagtgaatcattca

SEQ ID NO: 315085 - DNA, 20 bp, human
ggggaatggagtgattttga

SEQ ID NO: 315086 - DNA, 20 bp, human
gggcccgcgcacgggatggg

SEQ ID NO: 315087 - DNA, 20 bp, human
gagagccgggagaccgcaac

SEQ ID NO: 315088 - DNA, 20 bp, human
ggcggggcgagcggtgtcag

SEQ ID NO: 315089 - DNA, 20 bp, human
gtgcgcgggcccagagagcc

SEQ ID NO: 315090 - DNA, 20 bp, human
gctctcctgacgtgatgggg

SEQ ID NO: 315091 - DNA, 20 bp, human
gcaaactctcctgacgtgat

SEQ ID NO: 315092 - DNA, 20 bp, human
ggaaggtggtgaatctcggc

SEQ ID NO: 315093 - DNA, 20 bp, human
ggggcggggcccacgggcct

SEQ ID NO: 315094 - DNA, 20 bp, human
ggcctccagttgcggtctcc

SEQ ID NO: 315095 - DNA, 20 bp, human
gctgggcccgcgcacgggat

SEQ ID NO: 315096 - DNA, 20 bp, human
gtatcagccagtggcctccc

SEQ ID NO: 315097 - DNA, 20 bp, human
gggcctccctggtggataga

SEQ ID NO: 315098 - DNA, 20 bp, human
gcgccccaaggggtttcccc

SEQ ID NO: 315099 - DNA, 20 bp, human
ggaagccgggctcaaccatt

SEQ ID NO: 315100 - DNA, 20 bp, human
gggggcgggccagtaatcgt

SEQ ID NO: 315101 - DNA, 20 bp, human
gtccccgggggaaacccctt

SEQ ID NO: 315102 - DNA, 20 bp, human
ggggccagtaatcgtaggcg

SEQ ID NO: 315103 - DNA, 20 bp, human
ggttgagcccggcttccccg

SEQ ID NO: 315104 - DNA, 20 bp, human
ggcgccccgcctacgattac

SEQ ID NO: 315105 - DNA, 20 bp, human
gccctcccccggcagcccaa

SEQ ID NO: 315106 - DNA, 20 bp, human
gggggtctggtgaagcggga

SEQ ID NO: 315107 - DNA, 20 bp, human
ggtggcggctcccagggtga

SEQ ID NO: 315108 - DNA, 20 bp, human
gacagggcgggagaagcgga

SEQ ID NO: 315109 - DNA, 20 bp, human
gaggaccagacccttatgga

SEQ ID NO: 315110 - DNA, 20 bp, human
ggacatctggtcttggggaa

SEQ ID NO: 315111 - DNA, 20 bp, human
gcaggcgcggtgcactctgg

SEQ ID NO: 315112 - DNA, 20 bp, human
ggggtctcaggaaggcgata

SEQ ID NO: 315113 - DNA, 20 bp, human
gggtgaagcgggagggatga

SEQ ID NO: 315114 - DNA, 20 bp, human
gcgcgcgacatctggtcttg

SEQ ID NO: 315115 - DNA, 20 bp, human
ggcccagcagcctacaggcg

SEQ ID NO: 315116 - DNA, 20 bp, human
gaagcccagcggagcaagaa

SEQ ID NO: 315117 - DNA, 20 bp, human
ggcaagaatggctagacaga

SEQ ID NO: 315118 - DNA, 20 bp, human
gtagccattcttgctccgct

SEQ ID NO: 315119 - DNA, 20 bp, human
gtcctgaccacaattgcagg

SEQ ID NO: 315120 - DNA, 20 bp, human
gtagacagatgggaaatggg

SEQ ID NO: 315121 - DNA, 20 bp, human
gtggctagacagatgggaaa

SEQ ID NO: 315122 - DNA, 20 bp, human
ggccccctttcccggacacc

SEQ ID NO: 315123 - DNA, 20 bp, human
gttccaagctctgtaaccct

SEQ ID NO: 315124 - DNA, 20 bp, human
gcccgcccccgtccaaccgg

SEQ ID NO: 315125 - DNA, 20 bp, human
gggggcgggtctccgccggt

SEQ ID NO: 315126 - DNA, 20 bp, human
gccgactcgaccaatgagtg

SEQ ID NO: 315127 - DNA, 20 bp, human
gagggcggtggctgcgtgat

SEQ ID NO: 315128 - DNA, 20 bp, human
gcgtccttgcggcagccaat

SEQ ID NO: 315129 - DNA, 20 bp, human
gtgagtggggtcgagagtga

SEQ ID NO: 315130 - DNA, 20 bp, human
ggggctgctggccactgctc

SEQ ID NO: 315131 - DNA, 20 bp, human
gtaggcatccgattggctaa

SEQ ID NO: 315132 - DNA, 20 bp, human
gacgcgctgtgatttcccat

SEQ ID NO: 315133 - DNA, 20 bp, human
gcgattggctaaaggctggg

SEQ ID NO: 315134 - DNA, 20 bp, human
ggaggggagacgcgaccaat

SEQ ID NO: 315135 - DNA, 20 bp, human
gtacaggctagagatatgat

SEQ ID NO: 315136 - DNA, 20 bp, human
ggaccctgggcctcgtagga

SEQ ID NO: 315137 - DNA, 20 bp, human
gctacgaggcccagggtccg

SEQ ID NO: 315138 - DNA, 20 bp, human
gcggggatgggtttgtaaga

SEQ ID NO: 315139 - DNA, 20 bp, human
ggagggcgtaccctactcca

SEQ ID NO: 315140 - DNA, 20 bp, human
gggtggctcaccttagaaga

SEQ ID NO: 315141 - DNA, 20 bp, human
gacgccctcctacgaggccc

SEQ ID NO: 315142 - DNA, 20 bp, human
gctccctccccgcggaccct

SEQ ID NO: 315143 - DNA, 20 bp, human
gtaggagctttcaggaatct

SEQ ID NO: 315144 - DNA, 20 bp, human
ggatccagagcaggcgtcgg

SEQ ID NO: 315145 - DNA, 20 bp, human
gcaggcgtcgggggaactta

SEQ ID NO: 315146 - DNA, 20 bp, human
gacaaagaccgcctcgggtg

SEQ ID NO: 315147 - DNA, 20 bp, human
gagcgtgtgtggaccgagag

SEQ ID NO: 315148 - DNA, 20 bp, human
ggccccgcgcgtccgctcgg

SEQ ID NO: 315149 - DNA, 20 bp, human
ggtggggtggtgagcagtac

SEQ ID NO: 315150 - DNA, 20 bp, human
gaccgccccgcgcgtccgct

SEQ ID NO: 315151 - DNA, 20 bp, human
ggggatgacaaagaccgcct

SEQ ID NO: 315152 - DNA, 20 bp, human
gctcaccaccccacccgagg

SEQ ID NO: 315153 - DNA, 20 bp, human
gcggcctcccgggggactcg

SEQ ID NO: 315154 - DNA, 20 bp, human
gcgagtaaagggttcttgtg

SEQ ID NO: 315155 - DNA, 20 bp, human
gagaatggatcccgagtaaa

SEQ ID NO: 315156 - DNA, 20 bp, human
gcgcggaggtgggctctcta

SEQ ID NO: 315157 - DNA, 20 bp, human
gcagaggcgcgtcgcggcgg

SEQ ID NO: 315158 - DNA, 20 bp, human
gcctctgcctggggttgccg

SEQ ID NO: 315159 - DNA, 20 bp, human
gcgccgcgcgcggaacacct

SEQ ID NO: 315160 - DNA, 20 bp, human
gagtgggcgggacgcggtct

SEQ ID NO: 315161 - DNA, 20 bp, human
gcctggggttgccggggcga

SEQ ID NO: 315162 - DNA, 20 bp, human
ggggctctctagggccgcgc

SEQ ID NO: 315163 - DNA, 20 bp, human
gtggccgtatagtgctccgc

SEQ ID NO: 315164 - DNA, 20 bp, human
gcctctgcggcgcgatggga

SEQ ID NO: 315165 - DNA, 20 bp, human
gcagccggcggagcactata

SEQ ID NO: 315166 - DNA, 20 bp, human
gagcccttatagcatcaaga

SEQ ID NO: 315167 - DNA, 20 bp, human
gagggcgggggtagaaaccc

SEQ ID NO: 315168 - DNA, 20 bp, human
gtggcaagtgcccttttctt

SEQ ID NO: 315169 - DNA, 20 bp, human
ggggtggcagtactcgaatc

SEQ ID NO: 315170 - DNA, 20 bp, human
gggagctttcgccgaggatc

SEQ ID NO: 315171 - DNA, 20 bp, human
gaatctgggacttaaagact

SEQ ID NO: 315172 - DNA, 20 bp, human
gaagatggcgggaacggcta

SEQ ID NO: 315173 - DNA, 20 bp, human
gttcccgccatcttgcttcc

SEQ ID NO: 315174 - DNA, 20 bp, human
gacggtcaaagtgtcgcgat

SEQ ID NO: 315175 - DNA, 20 bp, human
gagtttgagccaggaccggg

SEQ ID NO: 315176 - DNA, 20 bp, human
gtaggagtccctagcggcca

SEQ ID NO: 315177 - DNA, 20 bp, human
gcggtgcgggagaggcgctt

SEQ ID NO: 315178 - DNA, 20 bp, human
gggcgtggaagcggattctg

SEQ ID NO: 315179 - DNA, 20 bp, human
gctggagcccacaacaactc

SEQ ID NO: 315180 - DNA, 20 bp, human
gaagacgcggaagtcgcagc

SEQ ID NO: 315181 - DNA, 20 bp, human
gtcccgcgttggcaagcgga

SEQ ID NO: 315182 - DNA, 20 bp, human
gcttccgcccggagttgttg

SEQ ID NO: 315183 - DNA, 20 bp, human
gcgggtcccgcgttggcaag

SEQ ID NO: 315184 - DNA, 20 bp, human
gtagggactcctagcggaag

SEQ ID NO: 315185 - DNA, 20 bp, human
gcctagcgaggaccaacttc

SEQ ID NO: 315186 - DNA, 20 bp, human
ggccgtgcgcccacgaggag

SEQ ID NO: 315187 - DNA, 20 bp, human
gcctggggacggtgtcccag

SEQ ID NO: 315188 - DNA, 20 bp, human
gcccagaggcctctcctcgt

SEQ ID NO: 315189 - DNA, 20 bp, human
gaatccaagcgggctcgcgg

SEQ ID NO: 315190 - DNA, 20 bp, human
gtgcgggcggggaatccaag

SEQ ID NO: 315191 - DNA, 20 bp, human
gtggaggagcgcgcgggatg

SEQ ID NO: 315192 - DNA, 20 bp, human
gtgggcccggcttcccgcac

SEQ ID NO: 315193 - DNA, 20 bp, human
ggggaatccaagcgggctcg

SEQ ID NO: 315194 - DNA, 20 bp, human
gggccgacagcgccccggtg

SEQ ID NO: 315195 - DNA, 20 bp, human
ggggcggtggggcacacagc

SEQ ID NO: 315196 - DNA, 20 bp, human
gcctagacacagcttctctt

SEQ ID NO: 315197 - DNA, 20 bp, human
ggggtgcagccgttgtagaa

SEQ ID NO: 315198 - DNA, 20 bp, human
gtggaggaaatcggggtctc

SEQ ID NO: 315199 - DNA, 20 bp, human
ggacgcactcccttctacaa

SEQ ID NO: 315200 - DNA, 20 bp, human
ggagaagctgtgtctaggta

SEQ ID NO: 315201 - DNA, 20 bp, human
gaagggagtgcgtccctcag

SEQ ID NO: 315202 - DNA, 20 bp, human
gaggtagggacgtccaaccc

SEQ ID NO: 315203 - DNA, 20 bp, human
gggacgctgtggaggaaatc

SEQ ID NO: 315204 - DNA, 20 bp, human
gaggggatggagaaaaatat

SEQ ID NO: 315205 - DNA, 20 bp, human
gtggagaaggtgctgatggt

SEQ ID NO: 315206 - DNA, 20 bp, human
gagatgggtgatcgcacgga

SEQ ID NO: 315207 - DNA, 20 bp, human
gagggagatgggtgatcgca

SEQ ID NO: 315208 - DNA, 20 bp, human
gaaaaaagcccgcacgaact

SEQ ID NO: 315209 - DNA, 20 bp, human
ggctccaaaccgccaatcag

SEQ ID NO: 315210 - DNA, 20 bp, human
gcgccaatcagcggcgacgc

SEQ ID NO: 315211 - DNA, 20 bp, human
gtcgccgctgattggcggtt

SEQ ID NO: 315212 - DNA, 20 bp, human
gtgctttaatatcacggggt

SEQ ID NO: 315213 - DNA, 20 bp, human
gatcacccatctccctcacc

SEQ ID NO: 315214 - DNA, 20 bp, human
gaggaaagaaaatacacaac

SEQ ID NO: 315215 - DNA, 20 bp, human
gtggagctactttcctggtg

SEQ ID NO: 315216 - DNA, 20 bp, human
gggcaggtgaaaacaggctt

SEQ ID NO: 315217 - DNA, 20 bp, human
gtcaggacccggcttctcca

SEQ ID NO: 315218 - DNA, 20 bp, human
gaaaccacgcggccagtggc

SEQ ID NO: 315219 - DNA, 20 bp, human
gtccactcgggagaaccaat

SEQ ID NO: 315220 - DNA, 20 bp, human
gaatcctagcagcgccgtac

SEQ ID NO: 315221 - DNA, 20 bp, human
gaggaccaatcgacaggtat

SEQ ID NO: 315222 - DNA, 20 bp, human
gtcacagcccggatgcagaa

SEQ ID NO: 315223 - DNA, 20 bp, human
gaggtgaactcacgaccgat

SEQ ID NO: 315224 - DNA, 20 bp, human
ggccgtaccggatgtgtgag

SEQ ID NO: 315225 - DNA, 20 bp, human
gtccactcacacatccggta

SEQ ID NO: 315226 - DNA, 20 bp, human
ggggggggggcaaaagaaat

SEQ ID NO: 315227 - DNA, 20 bp, human
gaagcctcgagggtcaaact

SEQ ID NO: 315228 - DNA, 20 bp, human
ggaaagaagttcgcttttag

SEQ ID NO: 315229 - DNA, 20 bp, human
gcgttttcgcgcatgcgtcg

SEQ ID NO: 315230 - DNA, 20 bp, human
gaggtggagcgctccttcta

SEQ ID NO: 315231 - DNA, 20 bp, human
gagcttaggtatcttctttc

SEQ ID NO: 315232 - DNA, 20 bp, human
gcgcgcatgcgtcggggggg

SEQ ID NO: 315233 - DNA, 20 bp, human
gtcgcctagtttgaccctcg

SEQ ID NO: 315234 - DNA, 20 bp, human
gaaagaaatgggaagcctcg

SEQ ID NO: 315235 - DNA, 20 bp, human
gatacctaagctttcagaca

SEQ ID NO: 315236 - DNA, 20 bp, human
gggactgggaggcagaatga

SEQ ID NO: 315237 - DNA, 20 bp, human
gccgggaaggctagagtgga

SEQ ID NO: 315238 - DNA, 20 bp, human
ggctgccgggaaggctagag

SEQ ID NO: 315239 - DNA, 20 bp, human
gagtcccgcccacttgtcgc

SEQ ID NO: 315240 - DNA, 20 bp, human
gaggtcaagacagcgaatgg

SEQ ID NO: 315241 - DNA, 20 bp, human
gcccagagagaggcgttccg

SEQ ID NO: 315242 - DNA, 20 bp, human
ggtgcgcatgcgcaatgtac

SEQ ID NO: 315243 - DNA, 20 bp, human
ggcgccgcggacccagagag

SEQ ID NO: 315244 - DNA, 20 bp, human
gagagagaggcgttccgcgg

SEQ ID NO: 315245 - DNA, 20 bp, human
gaatgaaggaggcccggggg

SEQ ID NO: 315246 - DNA, 20 bp, human
ggggctaaacagcaggtgat

SEQ ID NO: 315247 - DNA, 20 bp, human
gagccccggggctaaacagc

SEQ ID NO: 315248 - DNA, 20 bp, human
gagacgcgaaaagctcccgc

SEQ ID NO: 315249 - DNA, 20 bp, human
gagcctaagtggcccctcta

SEQ ID NO: 315250 - DNA, 20 bp, human
gaggaggacgacgtgacatc

SEQ ID NO: 315251 - DNA, 20 bp, human
gcccgcgggaaactggggag

SEQ ID NO: 315252 - DNA, 20 bp, human
gcacctgctgtttagccccg

SEQ ID NO: 315253 - DNA, 20 bp, human
ggtttagccccggggctctc

SEQ ID NO: 315254 - DNA, 20 bp, human
ggagctcctcgcagccgcat

SEQ ID NO: 315255 - DNA, 20 bp, human
gccacttaggcttacacttc

SEQ ID NO: 315256 - DNA, 20 bp, human
ggataaggacggcgcggggg

SEQ ID NO: 315257 - DNA, 20 bp, human
gaacccggaagaagtgaacc

SEQ ID NO: 315258 - DNA, 20 bp, human
gcagagcgtgagcccagagc

SEQ ID NO: 315259 - DNA, 20 bp, human
gctcacgctctggataagga

SEQ ID NO: 315260 - DNA, 20 bp, human
gggctggatagtgagtggag

SEQ ID NO: 315261 - DNA, 20 bp, human
gtgggctcacgctctggata

SEQ ID NO: 315262 - DNA, 20 bp, human
gctctggataaggacggcgc

SEQ ID NO: 315263 - DNA, 20 bp, human
ggcgcccaccaaagaatcct

SEQ ID NO: 315264 - DNA, 20 bp, human
gaactcccaggattctttgg

SEQ ID NO: 315265 - DNA, 20 bp, human
gcgccactaccgctctccgg

SEQ ID NO: 315266 - DNA, 20 bp, human
gcggaggccaaaagttgagg

SEQ ID NO: 315267 - DNA, 20 bp, human
gtcccggaggccaaaagttg

SEQ ID NO: 315268 - DNA, 20 bp, human
gaacgctgcgaacttcccgg

SEQ ID NO: 315269 - DNA, 20 bp, human
gtggcaggaagttcccgcca

SEQ ID NO: 315270 - DNA, 20 bp, human
gggcgggcctgggagacctt

SEQ ID NO: 315271 - DNA, 20 bp, human
ggagcggagcgtgattgggg

SEQ ID NO: 315272 - DNA, 20 bp, human
gcgcaagcgttgctttttaa

SEQ ID NO: 315273 - DNA, 20 bp, human
gaagttcccgccaaggcttc

SEQ ID NO: 315274 - DNA, 20 bp, human
gcgcagtgcagggcagtcga

SEQ ID NO: 315275 - DNA, 20 bp, human
ggagaacgctgcgaacttcc

SEQ ID NO: 315276 - DNA, 20 bp, human
gtggggctagaattagctca

SEQ ID NO: 315277 - DNA, 20 bp, human
gaagcaccctgcttacacct

SEQ ID NO: 315278 - DNA, 20 bp, human
gggaccctcaggtttcataa

SEQ ID NO: 315279 - DNA, 20 bp, human
gggcgatagaaatgatatct

SEQ ID NO: 315280 - DNA, 20 bp, human
gaatagacataataccgcga

SEQ ID NO: 315281 - DNA, 20 bp, human
ggtggtgtgtgcgtgcttta

SEQ ID NO: 315282 - DNA, 20 bp, human
gtgggtaaatgttttagttg

SEQ ID NO: 315283 - DNA, 20 bp, human
ggtagaattagttgggtttg

SEQ ID NO: 315284 - DNA, 20 bp, human
gaatctcccaggtgtaagca

SEQ ID NO: 315285 - DNA, 20 bp, human
gttatatagaggagataagt

SEQ ID NO: 315286 - DNA, 20 bp, human
gatagctggttgtccaagat

SEQ ID NO: 315287 - DNA, 20 bp, human
gaatagacatagaaccgtca

SEQ ID NO: 315288 - DNA, 20 bp, human
gaagagctgtctaaacttat

SEQ ID NO: 315289 - DNA, 20 bp, human
gcgtctggttttggggaact

SEQ ID NO: 315290 - DNA, 20 bp, human
gttgaattaagatcccatct

SEQ ID NO: 315291 - DNA, 20 bp, human
gttctatgtctattgcgccg

SEQ ID NO: 315292 - DNA, 20 bp, human
gttgcctatacttttgtcta

SEQ ID NO: 315293 - DNA, 20 bp, human
gtgaggtttggagctagagt

SEQ ID NO: 315294 - DNA, 20 bp, human
gcattatgcagaagatataa

SEQ ID NO: 315295 - DNA, 20 bp, human
gtgtaggaaggttgtttcct

SEQ ID NO: 315296 - DNA, 20 bp, human
ggctgtggctcgtagtgttc

SEQ ID NO: 315297 - DNA, 20 bp, human
gtcctttgagttttaagctg

SEQ ID NO: 315298 - DNA, 20 bp, human
ggccacagcttaaaactcaa

SEQ ID NO: 315299 - DNA, 20 bp, human
ggcttaaaactcaaaggacc

SEQ ID NO: 315300 - DNA, 20 bp, human
gcctctatataaatgcgcag

SEQ ID NO: 315301 - DNA, 20 bp, human
gtcgacccttaaatttcata

SEQ ID NO: 315302 - DNA, 20 bp, human
ggtacccacgtaaagatgtt

SEQ ID NO: 315303 - DNA, 20 bp, human
gccatttcttgccagctcat

SEQ ID NO: 315304 - DNA, 20 bp, human
gtactttgcagccttcgtca

SEQ ID NO: 315305 - DNA, 20 bp, human
gataacccttatgaaattta

SEQ ID NO: 315306 - DNA, 20 bp, human
ggagcctggtgatagctggc

SEQ ID NO: 315307 - DNA, 20 bp, human
gcacctatgtggcaaaacag

SEQ ID NO: 315308 - DNA, 20 bp, human
ggacacagtactgtaaggga

SEQ ID NO: 315309 - DNA, 20 bp, human
gaatagacacagtactgtaa

SEQ ID NO: 315310 - DNA, 20 bp, human
gggatgaaagaactgtattg

SEQ ID NO: 315311 - DNA, 20 bp, human
ggcgatagaaatttctaccc

SEQ ID NO: 315312 - DNA, 20 bp, human
gggggctagagttgtctgag

SEQ ID NO: 315313 - DNA, 20 bp, human
gtagagttgtctgagtggtc

SEQ ID NO: 315314 - DNA, 20 bp, human
gataactttacatagaacta

SEQ ID NO: 315315 - DNA, 20 bp, human
gctaccctggtagatatttc

SEQ ID NO: 315316 - DNA, 20 bp, human
gccaaagagggacaatatta

SEQ ID NO: 315317 - DNA, 20 bp, human
gagctgtattgatctgtctg

SEQ ID NO: 315318 - DNA, 20 bp, human
gtctcattcagagtaggacc

SEQ ID NO: 315319 - DNA, 20 bp, human
gtaaacagctgtcccaaaga

SEQ ID NO: 315320 - DNA, 20 bp, human
ggaatctgctggtttttgaa

SEQ ID NO: 315321 - DNA, 20 bp, human
gtgaaaggcctgctctgtga

SEQ ID NO: 315322 - DNA, 20 bp, human
gagagggacaatattaagga

SEQ ID NO: 315323 - DNA, 20 bp, human
ggagaaaggatgcattttac

SEQ ID NO: 315324 - DNA, 20 bp, human
gaaagtgcccacaccttgct

SEQ ID NO: 315325 - DNA, 20 bp, human
gcgagagacggccagaggcc

SEQ ID NO: 315326 - DNA, 20 bp, human
gactacttgaagagggtgac

SEQ ID NO: 315327 - DNA, 20 bp, human
gaggtcaaggtgtagtccat

SEQ ID NO: 315328 - DNA, 20 bp, human
gtctagagcactacttgaag

SEQ ID NO: 315329 - DNA, 20 bp, human
ggggtgtaagccgagtgctt

SEQ ID NO: 315330 - DNA, 20 bp, human
ggagctggctcaaagcgatc

SEQ ID NO: 315331 - DNA, 20 bp, human
gcaaggtgtagtccatggga

SEQ ID NO: 315332 - DNA, 20 bp, human
gacaagtatgcactaggtca

SEQ ID NO: 315333 - DNA, 20 bp, human
gctaataatattttttagca

SEQ ID NO: 315334 - DNA, 20 bp, human
gtccatgggatggtaagaaa

SEQ ID NO: 315335 - DNA, 20 bp, human
gattgcttacacacatacag

SEQ ID NO: 315336 - DNA, 20 bp, human
gcagtggacgtagtactgca

SEQ ID NO: 315337 - DNA, 20 bp, human
gtctaaagtgatacttgagg

SEQ ID NO: 315338 - DNA, 20 bp, human
gtactacgtccactgcgcct

SEQ ID NO: 315339 - DNA, 20 bp, human
gtagggctagagttggcaca

SEQ ID NO: 315340 - DNA, 20 bp, human
gatccttgctattttattct

SEQ ID NO: 315341 - DNA, 20 bp, human
gtcaaattatggtgaaatct

SEQ ID NO: 315342 - DNA, 20 bp, human
gatctctaaagtgatacttg

SEQ ID NO: 315343 - DNA, 20 bp, human
gggcgaaagaaattttaccc

SEQ ID NO: 315344 - DNA, 20 bp, human
gaaccaagaataaaatagca

SEQ ID NO: 315345 - DNA, 20 bp, human
gaaattttacccaggcgcag

SEQ ID NO: 315346 - DNA, 20 bp, human
gcacctatgtggcaagatag

SEQ ID NO: 315347 - DNA, 20 bp, human
gaatagacttagtacagtaa

SEQ ID NO: 315348 - DNA, 20 bp, human
ggggtagcttggctggtttt

SEQ ID NO: 315349 - DNA, 20 bp, human
gtagttaagtgtttttgtgg

SEQ ID NO: 315350 - DNA, 20 bp, human
gagcaataagagatcttaaa

SEQ ID NO: 315351 - DNA, 20 bp, human
ggaaaacaaaagactgttac

SEQ ID NO: 315352 - DNA, 20 bp, human
gcagctgttcttgggtagct

SEQ ID NO: 315353 - DNA, 20 bp, human
gtcacctatacctttattta

SEQ ID NO: 315354 - DNA, 20 bp, human
gatgtagttaagtgtttttg

SEQ ID NO: 315355 - DNA, 20 bp, human
gaaccatttaccttaaataa

SEQ ID NO: 315356 - DNA, 20 bp, human
gcttcgtcagggtttgctga

SEQ ID NO: 315357 - DNA, 20 bp, human
ggctgtggctcgtagtgttc

SEQ ID NO: 315358 - DNA, 20 bp, human
gtcctttgagttttaagctg

SEQ ID NO: 315359 - DNA, 20 bp, human
ggccacagcttaaaactcaa

SEQ ID NO: 315360 - DNA, 20 bp, human
ggcttaaaactcaaaggacc

SEQ ID NO: 315361 - DNA, 20 bp, human
gcgacccttaaatttcatca

SEQ ID NO: 315362 - DNA, 20 bp, human
gcgtcagggtttgctgaagg

SEQ ID NO: 315363 - DNA, 20 bp, human
gtgacctaacgtctttacgt

SEQ ID NO: 315364 - DNA, 20 bp, human
ggtacccacgtaaagacgtt

SEQ ID NO: 315365 - DNA, 20 bp, human
gtactttgcggccttcgtca

SEQ ID NO: 315366 - DNA, 20 bp, human
gctctgccgggcaatcactc

SEQ ID NO: 315367 - DNA, 20 bp, human
gaccacccggagtgattgcc

SEQ ID NO: 315368 - DNA, 20 bp, human
gcggggcgggagcacgactc

SEQ ID NO: 315369 - DNA, 20 bp, human
gggaagcgcctgggcgtcgt

SEQ ID NO: 315370 - DNA, 20 bp, human
gcagggcggcgcaatgtgat

SEQ ID NO: 315371 - DNA, 20 bp, human
gggtctccgcgcagttggtc

SEQ ID NO: 315372 - DNA, 20 bp, human
gggtcctgggtaccgagcat

SEQ ID NO: 315373 - DNA, 20 bp, human
ggcgggagcacgactcaggg

SEQ ID NO: 315374 - DNA, 20 bp, human
gcgcgctggcgcaaggttgg

SEQ ID NO: 315375 - DNA, 20 bp, human
ggggacctgcgctgagacac

SEQ ID NO: 315376 - DNA, 20 bp, human
gtgcccgccagcagaccagc

SEQ ID NO: 315377 - DNA, 20 bp, human
gctcccggggacgttcggag

SEQ ID NO: 315378 - DNA, 20 bp, human
gggtgccccacgcgcctctc

SEQ ID NO: 315379 - DNA, 20 bp, human
gcgagcgcccacccctacaa

SEQ ID NO: 315380 - DNA, 20 bp, human
gcgggcgcgcaggagtgaaa

SEQ ID NO: 315381 - DNA, 20 bp, human
gtggggcacccgccgcaaag

SEQ ID NO: 315382 - DNA, 20 bp, human
gaagcggaggcgcgctctcg

SEQ ID NO: 315383 - DNA, 20 bp, human
gcccgcgtgcggcggccgca

SEQ ID NO: 315384 - DNA, 20 bp, human
gctgggagcgcgcgcccgag

SEQ ID NO: 315385 - DNA, 20 bp, human
gtcccagccccgcccgcgtg

SEQ ID NO: 315386 - DNA, 20 bp, human
gcattcacggccagaaacca

SEQ ID NO: 315387 - DNA, 20 bp, human
ggggcgctgccagactggtc

SEQ ID NO: 315388 - DNA, 20 bp, human
gcccgctcgccggaccagtc

SEQ ID NO: 315389 - DNA, 20 bp, human
gagcccgggcgctgccagac

SEQ ID NO: 315390 - DNA, 20 bp, human
gcgtgacgcccgatcctcgg

SEQ ID NO: 315391 - DNA, 20 bp, human
gccacgtgacgcccgatcct

SEQ ID NO: 315392 - DNA, 20 bp, human
gcgggcgcgggcgccaccga

SEQ ID NO: 315393 - DNA, 20 bp, human
gaatccgagccgccgaggat

SEQ ID NO: 315394 - DNA, 20 bp, human
ggggcgccaccgagggtcgg

SEQ ID NO: 315395 - DNA, 20 bp, human
ggctgtgggaacggccgcgc

SEQ ID NO: 315396 - DNA, 20 bp, human
gaggacctaagttcactgaa

SEQ ID NO: 315397 - DNA, 20 bp, human
gtacttctgcatttatagga

SEQ ID NO: 315398 - DNA, 20 bp, human
gaagagggtcactccctcac

SEQ ID NO: 315399 - DNA, 20 bp, human
gtaaatgcagaagtactgag

SEQ ID NO: 315400 - DNA, 20 bp, human
gcatttataggatggtagac

SEQ ID NO: 315401 - DNA, 20 bp, human
gttaatgattaaacgtaggt

SEQ ID NO: 315402 - DNA, 20 bp, human
gataggatggtagactggtt

SEQ ID NO: 315403 - DNA, 20 bp, human
gactattaatgattaaacgt

SEQ ID NO: 315404 - DNA, 20 bp, human
gtcacattacaatactatgt

SEQ ID NO: 315405 - DNA, 20 bp, human
gactatgtgggagggtagta

SEQ ID NO: 315406 - DNA, 20 bp, human
gaccacttgaaagatcgcta

SEQ ID NO: 315407 - DNA, 20 bp, human
gcgatctttcaagtggttac

SEQ ID NO: 315408 - DNA, 20 bp, human
gttcatccgagatggtaaag

SEQ ID NO: 315409 - DNA, 20 bp, human
gatccgagatggtaaagggg

SEQ ID NO: 315410 - DNA, 20 bp, human
gcccctagcgatctttcaag

SEQ ID NO: 315411 - DNA, 20 bp, human
gcaggacacagtttactttc

SEQ ID NO: 315412 - DNA, 20 bp, human
gttatggttttcatccgaga

SEQ ID NO: 315413 - DNA, 20 bp, human
ggaagaatagtccatcagat

SEQ ID NO: 315414 - DNA, 20 bp, human
gttaatgacagattgtcaaa

SEQ ID NO: 315415 - DNA, 20 bp, human
gttgtgaggtcctcagcatg

SEQ ID NO: 315416 - DNA, 20 bp, human
gggagcggccgcgcacccag

SEQ ID NO: 315417 - DNA, 20 bp, human
gccaatgccggctccctaaa

SEQ ID NO: 315418 - DNA, 20 bp, human
gcgctccaggcgtgtctgcg

SEQ ID NO: 315419 - DNA, 20 bp, human
gcgcgcacccagaggagagc

SEQ ID NO: 315420 - DNA, 20 bp, human
gcggaggcgcatccccgcca

SEQ ID NO: 315421 - DNA, 20 bp, human
gggcgggcgggagccaggaa

SEQ ID NO: 315422 - DNA, 20 bp, human
gcggacgcaggaagcacaaa

SEQ ID NO: 315423 - DNA, 20 bp, human
gggacagcctgctctcctct

SEQ ID NO: 315424 - DNA, 20 bp, human
gacgcccgaaagggctgcca

SEQ ID NO: 315425 - DNA, 20 bp, human
ggagagcaggctgtcctttt

SEQ ID NO: 315426 - DNA, 20 bp, human
gccgactggcagctgaactg

SEQ ID NO: 315427 - DNA, 20 bp, human
gcctccccggggatctcccc

SEQ ID NO: 315428 - DNA, 20 bp, human
gactggcagctgaactgcgg

SEQ ID NO: 315429 - DNA, 20 bp, human
gaagaagcctcgcctccccg

SEQ ID NO: 315430 - DNA, 20 bp, human
gcctccgatcgttgcggtca

SEQ ID NO: 315431 - DNA, 20 bp, human
gcggccgccggcccatccag

SEQ ID NO: 315432 - DNA, 20 bp, human
gcagaggtggcccacgtagc

SEQ ID NO: 315433 - DNA, 20 bp, human
gaggctgtcgcttaggtgac

SEQ ID NO: 315434 - DNA, 20 bp, human
gaggggccctggagcagtac

SEQ ID NO: 315435 - DNA, 20 bp, human
gaagaccaggggtacaggcg

SEQ ID NO: 315436 - DNA, 20 bp, human
gccctgggtgggagacgagt

SEQ ID NO: 315437 - DNA, 20 bp, human
ggggactggcaggggaatct

SEQ ID NO: 315438 - DNA, 20 bp, human
ggcgccggcgccccgtagga

SEQ ID NO: 315439 - DNA, 20 bp, human
gagccgcgccggcgccccgt

SEQ ID NO: 315440 - DNA, 20 bp, human
gccgcccccgcgccgtccta

SEQ ID NO: 315441 - DNA, 20 bp, human
ggctccgtccagccaattcc

SEQ ID NO: 315442 - DNA, 20 bp, human
ggcgccggaagtccctagcc

SEQ ID NO: 315443 - DNA, 20 bp, human
gaattccaggctctgcgctg

SEQ ID NO: 315444 - DNA, 20 bp, human
gtggacggagctagccgcgc

SEQ ID NO: 315445 - DNA, 20 bp, human
gctctgcgctgggggcccgc

SEQ ID NO: 315446 - DNA, 20 bp, human
gtactggtgggtctgactta

SEQ ID NO: 315447 - DNA, 20 bp, human
gtccggcacgtgaaacgcgg

SEQ ID NO: 315448 - DNA, 20 bp, human
ggggattaagaagaactctt

SEQ ID NO: 315449 - DNA, 20 bp, human
gaaacgcgggggcgtggcta

SEQ ID NO: 315450 - DNA, 20 bp, human
ggagagaaacaacgactgga

SEQ ID NO: 315451 - DNA, 20 bp, human
gcacacaactcttacccttt

SEQ ID NO: 315452 - DNA, 20 bp, human
gaggagcagcttggcctaaa

SEQ ID NO: 315453 - DNA, 20 bp, human
ggcgggggcgtggctaaggg

SEQ ID NO: 315454 - DNA, 20 bp, human
gtaggaggaaaagtacttcc

SEQ ID NO: 315455 - DNA, 20 bp, human
gaagggtttggaacactcta

SEQ ID NO: 315456 - DNA, 20 bp, human
gagaacaaacgggtagtcag

SEQ ID NO: 315457 - DNA, 20 bp, human
gccagggagtggttggtgaa

SEQ ID NO: 315458 - DNA, 20 bp, human
gtacccaggaatggttgggg

SEQ ID NO: 315459 - DNA, 20 bp, human
gtaccctacccaggaatggt

SEQ ID NO: 315460 - DNA, 20 bp, human
ggggagtggttggtgaaagg

SEQ ID NO: 315461 - DNA, 20 bp, human
gcccggagccagggagtggt

SEQ ID NO: 315462 - DNA, 20 bp, human
ggaggggcagtctggaactt

SEQ ID NO: 315463 - DNA, 20 bp, human
gggccagctggagaacaaac

SEQ ID NO: 315464 - DNA, 20 bp, human
ggggacagggagcggttaga

SEQ ID NO: 315465 - DNA, 20 bp, human
gtcagtggacccggggaggg

SEQ ID NO: 315466 - DNA, 20 bp, human
gcagtgaccgccctcagcca

SEQ ID NO: 315467 - DNA, 20 bp, human
gagagagggaccctggctga

SEQ ID NO: 315468 - DNA, 20 bp, human
gagggagggacggaggctag

SEQ ID NO: 315469 - DNA, 20 bp, human
gcaggacttataagggagga

SEQ ID NO: 315470 - DNA, 20 bp, human
gtgaggtgatgctgttgggt

SEQ ID NO: 315471 - DNA, 20 bp, human
ggctccaggacttataaggg

SEQ ID NO: 315472 - DNA, 20 bp, human
ggtggcacgtggtgaccaca

SEQ ID NO: 315473 - DNA, 20 bp, human
gagagagaggggcttctcgg

SEQ ID NO: 315474 - DNA, 20 bp, human
gtgggggccaagaagcaccg

SEQ ID NO: 315475 - DNA, 20 bp, human
gcaccactggtgacaaaagg

SEQ ID NO: 315476 - DNA, 20 bp, human
gggaagagatctatggtatt

SEQ ID NO: 315477 - DNA, 20 bp, human
ggtgacctcctaaaagatgg

SEQ ID NO: 315478 - DNA, 20 bp, human
gcgagcttttgagatagaag

SEQ ID NO: 315479 - DNA, 20 bp, human
gccaacctcacaaggatatt

SEQ ID NO: 315480 - DNA, 20 bp, human
gaactacagctggaggaaag

SEQ ID NO: 315481 - DNA, 20 bp, human
gggttggtggcacatgagtt

SEQ ID NO: 315482 - DNA, 20 bp, human
ggtcagaaaaatgattcgta

SEQ ID NO: 315483 - DNA, 20 bp, human
gctccaagccgccatctttt

SEQ ID NO: 315484 - DNA, 20 bp, human
ggcttttgagatagaagagg

SEQ ID NO: 315485 - DNA, 20 bp, human
ggaaagacagttaaaacgaa

SEQ ID NO: 315486 - DNA, 20 bp, human
ggctgagttgccttggttgg

SEQ ID NO: 315487 - DNA, 20 bp, human
gaacaaagataccaagtttg

SEQ ID NO: 315488 - DNA, 20 bp, human
gccactagtcgcagtttctg

SEQ ID NO: 315489 - DNA, 20 bp, human
ggaccaatctaggcaacttg

SEQ ID NO: 315490 - DNA, 20 bp, human
gagttgccttggttggtggc

SEQ ID NO: 315491 - DNA, 20 bp, human
gtccagaaaagaatgagttg

SEQ ID NO: 315492 - DNA, 20 bp, human
gttccccaagttgcctagat

SEQ ID NO: 315493 - DNA, 20 bp, human
gagattggtcataaacccct

SEQ ID NO: 315494 - DNA, 20 bp, human
gtatcagctgcagctactgt

SEQ ID NO: 315495 - DNA, 20 bp, human
gcagtacattgaataactaa

SEQ ID NO: 315496 - DNA, 20 bp, human
gccaaccctccagttttcat

SEQ ID NO: 315497 - DNA, 20 bp, human
gtagtgaggcgtctattctg

SEQ ID NO: 315498 - DNA, 20 bp, human
gaaggtattactctcgtcag

SEQ ID NO: 315499 - DNA, 20 bp, human
gagggaaacaaaattaggtg

SEQ ID NO: 315500 - DNA, 20 bp, human
gctcacctgcaaggagcagg

SEQ ID NO: 315501 - DNA, 20 bp, human
ggtgcagggcatgacttgtt

SEQ ID NO: 315502 - DNA, 20 bp, human
ggtgccagggaaacaaaatt

SEQ ID NO: 315503 - DNA, 20 bp, human
ggcaggtcagtcaggttcct

SEQ ID NO: 315504 - DNA, 20 bp, human
gacacctcacagcgttctca

SEQ ID NO: 315505 - DNA, 20 bp, human
gcgtcagtggtagcaaaaca

SEQ ID NO: 315506 - DNA, 20 bp, human
gtatttgaggaaattgtctg

SEQ ID NO: 315507 - DNA, 20 bp, human
ggggaagaattgagatcatc

SEQ ID NO: 315508 - DNA, 20 bp, human
gatcatcaggtgtttatttg

SEQ ID NO: 315509 - DNA, 20 bp, human
ggtgtgatgtcttagaaacc

SEQ ID NO: 315510 - DNA, 20 bp, human
gaatccgttaaaaagtttga

SEQ ID NO: 315511 - DNA, 20 bp, human
ggtcttagaaaccaggaacc

SEQ ID NO: 315512 - DNA, 20 bp, human
gtagaaaccaggaaccaggc

SEQ ID NO: 315513 - DNA, 20 bp, human
gctgcaacatctgcctccta

SEQ ID NO: 315514 - DNA, 20 bp, human
gcagatgttgcagtaagcca

SEQ ID NO: 315515 - DNA, 20 bp, human
gtaaaaataaatattgggtg

SEQ ID NO: 315516 - DNA, 20 bp, human
gcggcagcccataggcatga

SEQ ID NO: 315517 - DNA, 20 bp, human
gtcccaccaccctcggtcgg

SEQ ID NO: 315518 - DNA, 20 bp, human
gaacagaggggcagcccaga

SEQ ID NO: 315519 - DNA, 20 bp, human
gccctggcccggcagcccat

SEQ ID NO: 315520 - DNA, 20 bp, human
gagggcctgtaggagccagg

SEQ ID NO: 315521 - DNA, 20 bp, human
gtggctcctacaggccctct

SEQ ID NO: 315522 - DNA, 20 bp, human
ggatctcatcagttcccccc

SEQ ID NO: 315523 - DNA, 20 bp, human
gtccagactgactcaggctc

SEQ ID NO: 315524 - DNA, 20 bp, human
ggaagcttccagactgactc

SEQ ID NO: 315525 - DNA, 20 bp, human
ggaagcttccctcatgactt

SEQ ID NO: 315526 - DNA, 20 bp, human
gtggcaagaagacatgttct

SEQ ID NO: 315527 - DNA, 20 bp, human
ggcactaaacagactgaaag

SEQ ID NO: 315528 - DNA, 20 bp, human
ggcccatgatggcagacagt

SEQ ID NO: 315529 - DNA, 20 bp, human
ggggctaggtgtggtaaact

SEQ ID NO: 315530 - DNA, 20 bp, human
gtaccacacctagcccatga

SEQ ID NO: 315531 - DNA, 20 bp, human
gacttctgcagtgattaata

SEQ ID NO: 315532 - DNA, 20 bp, human
gttctgggtttggtatgagc

SEQ ID NO: 315533 - DNA, 20 bp, human
gaaacacaggttataagtat

SEQ ID NO: 315534 - DNA, 20 bp, human
gaccaggaactaaaagcccc

SEQ ID NO: 315535 - DNA, 20 bp, human
gtcctggggcttttagttcc

SEQ ID NO: 315536 - DNA, 20 bp, human
gggtaaacgcagccttcttc

SEQ ID NO: 315537 - DNA, 20 bp, human
gggctgcctcatcctgaaga

SEQ ID NO: 315538 - DNA, 20 bp, human
gcctcctgccaggacatata

SEQ ID NO: 315539 - DNA, 20 bp, human
gaacacatgcagctactaga

SEQ ID NO: 315540 - DNA, 20 bp, human
gcagaaaggggcctccccga

SEQ ID NO: 315541 - DNA, 20 bp, human
gtcctggggcccaagctctg

SEQ ID NO: 315542 - DNA, 20 bp, human
gcgggggcccgagccccaat

SEQ ID NO: 315543 - DNA, 20 bp, human
gtgttggcattcaggctaca

SEQ ID NO: 315544 - DNA, 20 bp, human
gatcggaggtcatctcttta

SEQ ID NO: 315545 - DNA, 20 bp, human
gtggcccccccggaccctga

SEQ ID NO: 315546 - DNA, 20 bp, human
gtcacaaatgtgcaggctga

SEQ ID NO: 315547 - DNA, 20 bp, human
gatcacctggtcacacacct

SEQ ID NO: 315548 - DNA, 20 bp, human
gctgcttcctcaaaccaggg

SEQ ID NO: 315549 - DNA, 20 bp, human
gaggagaattgttggatccc

SEQ ID NO: 315550 - DNA, 20 bp, human
gagaattgttggatcccggg

SEQ ID NO: 315551 - DNA, 20 bp, human
gttcctgcttcctcaaacca

SEQ ID NO: 315552 - DNA, 20 bp, human
gtaggcgcgcaccaccacgt

SEQ ID NO: 315553 - DNA, 20 bp, human
gaaaataaaagcacttggct

SEQ ID NO: 315554 - DNA, 20 bp, human
ggaaatttgatttgaagata

SEQ ID NO: 315555 - DNA, 20 bp, human
gataaatacacagatgtatt

SEQ ID NO: 315556 - DNA, 20 bp, human
gctgggacggaatagagcag

SEQ ID NO: 315557 - DNA, 20 bp, human
gagagcaggggtcaagagga

SEQ ID NO: 315558 - DNA, 20 bp, human
gccaagcaccctgcctagtg

SEQ ID NO: 315559 - DNA, 20 bp, human
gaacgataccaagcctggga

SEQ ID NO: 315560 - DNA, 20 bp, human
gaacccgatccctgcttcaa

SEQ ID NO: 315561 - DNA, 20 bp, human
ggttgcagcaggaagtagaa

SEQ ID NO: 315562 - DNA, 20 bp, human
ggatccctgcttcaaagggt

SEQ ID NO: 315563 - DNA, 20 bp, human
gtgacatgaccacactaggc

SEQ ID NO: 315564 - DNA, 20 bp, human
ggagatcatggttgtcagag

SEQ ID NO: 315565 - DNA, 20 bp, human
gagaatgacatgaccacact

SEQ ID NO: 315566 - DNA, 20 bp, human
gagggcgcacacatgaggag

SEQ ID NO: 315567 - DNA, 20 bp, human
gcgcacacatgaggaggggc

SEQ ID NO: 315568 - DNA, 20 bp, human
gcagagtcggcaagaccaga

SEQ ID NO: 315569 - DNA, 20 bp, human
gcctacaggaatcaaggcgg

SEQ ID NO: 315570 - DNA, 20 bp, human
gatgtaccctacaggaatca

SEQ ID NO: 315571 - DNA, 20 bp, human
ggggatcaaacttgtcggag

SEQ ID NO: 315572 - DNA, 20 bp, human
gcgcagaaatgcccctccct

SEQ ID NO: 315573 - DNA, 20 bp, human
ggtcaatagcagtctatcta

SEQ ID NO: 315574 - DNA, 20 bp, human
gtgaaaatgaggcataccca

SEQ ID NO: 315575 - DNA, 20 bp, human
gcacccttggagagctcaca

SEQ ID NO: 315576 - DNA, 20 bp, human
gggagggtacccttgaccga

SEQ ID NO: 315577 - DNA, 20 bp, human
gcacgggtgtcggggaggaa

SEQ ID NO: 315578 - DNA, 20 bp, human
ggtggggcggtgcaaaggtg

SEQ ID NO: 315579 - DNA, 20 bp, human
ggacaagtccaggaagtgtc

SEQ ID NO: 315580 - DNA, 20 bp, human
gggacacgggggaaaaagat

SEQ ID NO: 315581 - DNA, 20 bp, human
gcctccccgacacccgtgga

SEQ ID NO: 315582 - DNA, 20 bp, human
ggtaccctccacgggtgtcg

SEQ ID NO: 315583 - DNA, 20 bp, human
gctgtgggaagcgggacacg

SEQ ID NO: 315584 - DNA, 20 bp, human
gaggcaggaagagctgctat

SEQ ID NO: 315585 - DNA, 20 bp, human
gcagacagacgtcagcgctg

SEQ ID NO: 315586 - DNA, 20 bp, human
gcctgagctgagtggcggga

SEQ ID NO: 315587 - DNA, 20 bp, human
ggggaagcggggaaccatgt

SEQ ID NO: 315588 - DNA, 20 bp, human
gagaaaagggtgattagcgt

SEQ ID NO: 315589 - DNA, 20 bp, human
gctgggaagaggacaaaaga

SEQ ID NO: 315590 - DNA, 20 bp, human
gggtcacactggaaatgggt

SEQ ID NO: 315591 - DNA, 20 bp, human
gcaaagctctggtgggacag

SEQ ID NO: 315592 - DNA, 20 bp, human
gaggacccaggaacccggct

SEQ ID NO: 315593 - DNA, 20 bp, human
gcggagaaacgcacttggtt

SEQ ID NO: 315594 - DNA, 20 bp, human
gggaggagacatgggggaat

SEQ ID NO: 315595 - DNA, 20 bp, human
gccccagagggagcgacctt

SEQ ID NO: 315596 - DNA, 20 bp, human
ggccggtggcaggcggagat

SEQ ID NO: 315597 - DNA, 20 bp, human
gccagccccgtgcttcacgt

SEQ ID NO: 315598 - DNA, 20 bp, human
ggggtagagcccagtttccg

SEQ ID NO: 315599 - DNA, 20 bp, human
gggtgcccagggagagtcta

SEQ ID NO: 315600 - DNA, 20 bp, human
gtgggggggccctcggaaac

SEQ ID NO: 315601 - DNA, 20 bp, human
ggggcatggcacggtgccca

SEQ ID NO: 315602 - DNA, 20 bp, human
gcccacccacgtgaagcacg

SEQ ID NO: 315603 - DNA, 20 bp, human
gcctcacccaagtaaacagt

SEQ ID NO: 315604 - DNA, 20 bp, human
ggagcacccactgtttactt

SEQ ID NO: 315605 - DNA, 20 bp, human
gcggagatgggtgtgtctgc

SEQ ID NO: 315606 - DNA, 20 bp, human
ggcaaagccgctggaaggca

SEQ ID NO: 315607 - DNA, 20 bp, human
gctcggggacccatggtcag

SEQ ID NO: 315608 - DNA, 20 bp, human
ggcagcttctgagaatcgga

SEQ ID NO: 315609 - DNA, 20 bp, human
ggacccatggtcagtggctg

SEQ ID NO: 315610 - DNA, 20 bp, human
gacccccagccactgaccat

SEQ ID NO: 315611 - DNA, 20 bp, human
gctccctgctacataagctg

SEQ ID NO: 315612 - DNA, 20 bp, human
gaggggagctccagcctcgt

SEQ ID NO: 315613 - DNA, 20 bp, human
gacctggcacccgtcctaga

SEQ ID NO: 315614 - DNA, 20 bp, human
ggagaagggcctaccccacc

SEQ ID NO: 315615 - DNA, 20 bp, human
ggctggagcggggaagagca

SEQ ID NO: 315616 - DNA, 20 bp, human
ggctgggaatgggtgataat

SEQ ID NO: 315617 - DNA, 20 bp, human
gcgccggcagtggtgattaa

SEQ ID NO: 315618 - DNA, 20 bp, human
gtcagccccccgctgggaat

SEQ ID NO: 315619 - DNA, 20 bp, human
gatcacccattcccagcggg

SEQ ID NO: 315620 - DNA, 20 bp, human
gggcgccgcggtggccaaac

SEQ ID NO: 315621 - DNA, 20 bp, human
gtcccccaacaggtccatcc

SEQ ID NO: 315622 - DNA, 20 bp, human
ggttgacccagcagcgggga

SEQ ID NO: 315623 - DNA, 20 bp, human
gcgcggggcgcaggcaggtg

SEQ ID NO: 315624 - DNA, 20 bp, human
gcaggatggcccccatgcag

SEQ ID NO: 315625 - DNA, 20 bp, human
gggccgggatggacctgttg

SEQ ID NO: 315626 - DNA, 20 bp, human
ggctaaatgagcttggggat

SEQ ID NO: 315627 - DNA, 20 bp, human
ggcctgtactggtgtgtttg

SEQ ID NO: 315628 - DNA, 20 bp, human
gatggtgtgttgaggaagtg

SEQ ID NO: 315629 - DNA, 20 bp, human
gtggtggtcggtgtcattgg

SEQ ID NO: 315630 - DNA, 20 bp, human
gacttcaggatggtgtgttg

SEQ ID NO: 315631 - DNA, 20 bp, human
ggaggaagtgtggtaaggta

SEQ ID NO: 315632 - DNA, 20 bp, human
ggccgtgctaaatgagcttg

SEQ ID NO: 315633 - DNA, 20 bp, human
gagatgggagtggtccctgt

SEQ ID NO: 315634 - DNA, 20 bp, human
gatcgtggtcggtggaggaa

SEQ ID NO: 315635 - DNA, 20 bp, human
gtgatgttggtggtagaagt

SEQ ID NO: 315636 - DNA, 20 bp, human
gtgagcacagtgacgatcag

SEQ ID NO: 315637 - DNA, 20 bp, human
gaaacaaacaaccatggccc

SEQ ID NO: 315638 - DNA, 20 bp, human
gacggagaaacaaacaacca

SEQ ID NO: 315639 - DNA, 20 bp, human
ggtagtggaacagtaattga

SEQ ID NO: 315640 - DNA, 20 bp, human
gttatgtgcttgatgagtag

SEQ ID NO: 315641 - DNA, 20 bp, human
gcatcacattaactgtcaga

SEQ ID NO: 315642 - DNA, 20 bp, human
gcttactttgagagcccaac

SEQ ID NO: 315643 - DNA, 20 bp, human
ggttgggaggacctgggcca

SEQ ID NO: 315644 - DNA, 20 bp, human
gtggtgccaagtactggtgc

SEQ ID NO: 315645 - DNA, 20 bp, human
ggtggatgatctgttcctgt

SEQ ID NO: 315646 - DNA, 20 bp, human
gttcagtgaaggtcgagaaa

SEQ ID NO: 315647 - DNA, 20 bp, human
gtctggtgagctagcagtcc

SEQ ID NO: 315648 - DNA, 20 bp, human
gtaggtgaaggtggaagctt

SEQ ID NO: 315649 - DNA, 20 bp, human
ggggatgaatatattcctgt

SEQ ID NO: 315650 - DNA, 20 bp, human
gtgggggggttattaggtga

SEQ ID NO: 315651 - DNA, 20 bp, human
gcttttctgcagttcagtga

SEQ ID NO: 315652 - DNA, 20 bp, human
ggtgaggatttgggaatttg

SEQ ID NO: 315653 - DNA, 20 bp, human
gatgagatgagcggtatttg

SEQ ID NO: 315654 - DNA, 20 bp, human
gctgctgaccatgagatgag

SEQ ID NO: 315655 - DNA, 20 bp, human
gttgaattaccacattatcc

SEQ ID NO: 315656 - DNA, 20 bp, human
gggtgaccccgcaccccccg

SEQ ID NO: 315657 - DNA, 20 bp, human
gagggggaggggcaccgcgg

SEQ ID NO: 315658 - DNA, 20 bp, human
ggtcaccgcggagggggggc

SEQ ID NO: 315659 - DNA, 20 bp, human
ggggcaccgcggggggtgcg

SEQ ID NO: 315660 - DNA, 20 bp, human
ggagggggggcgggtcaccg

SEQ ID NO: 315661 - DNA, 20 bp, human
gaggggaagggcaccgcgga

SEQ ID NO: 315662 - DNA, 20 bp, human
ggaagggcaccgcggaggga

SEQ ID NO: 315663 - DNA, 20 bp, human
ggtgacccgccccccctccg

SEQ ID NO: 315664 - DNA, 20 bp, human
ggggtcaccgcggaggaggg

SEQ ID NO: 315665 - DNA, 20 bp, human
ggggtcaccgcggagggagg

SEQ ID NO: 315666 - DNA, 20 bp, human
gtccccctaggggaataatc

SEQ ID NO: 315667 - DNA, 20 bp, human
gtagacctctgtctccccct

SEQ ID NO: 315668 - DNA, 20 bp, human
gctaccctgattattcccct

SEQ ID NO: 315669 - DNA, 20 bp, human
gggcatctccaacctgtcat

SEQ ID NO: 315670 - DNA, 20 bp, human
gtatgcagagggcaccaatc

SEQ ID NO: 315671 - DNA, 20 bp, human
gctacatgtaagaggatgcc

SEQ ID NO: 315672 - DNA, 20 bp, human
gttcaggaaggctggttatg

SEQ ID NO: 315673 - DNA, 20 bp, human
gtgtgttgttgattctccag

SEQ ID NO: 315674 - DNA, 20 bp, human
gagaccatccggtgtaactc

SEQ ID NO: 315675 - DNA, 20 bp, human
ggaatcaacaacacagccag

SEQ ID NO: 315676 - DNA, 20 bp, human
gggaaccggaagcggggcaa

SEQ ID NO: 315677 - DNA, 20 bp, human
ggggtgtcggagagcgattg

SEQ ID NO: 315678 - DNA, 20 bp, human
ggctctccgacacccggctg

SEQ ID NO: 315679 - DNA, 20 bp, human
gccagtgcgccgtgtttcga

SEQ ID NO: 315680 - DNA, 20 bp, human
ggcggggcaaggggttgtag

SEQ ID NO: 315681 - DNA, 20 bp, human
gcaagctgctgcggcctcca

SEQ ID NO: 315682 - DNA, 20 bp, human
gccccccggcctaacctgac

SEQ ID NO: 315683 - DNA, 20 bp, human
ggcgatgggcgagtcagtca

SEQ ID NO: 315684 - DNA, 20 bp, human
gggttgtagagggaaccgga

SEQ ID NO: 315685 - DNA, 20 bp, human
ggggacggaaaccagggcga

SEQ ID NO: 315686 - DNA, 20 bp, human
gcggccgtggacgccggaga

SEQ ID NO: 315687 - DNA, 20 bp, human
gaaaaggggtagacgcgcgg

SEQ ID NO: 315688 - DNA, 20 bp, human
gtcgccctctccggcgtcca

SEQ ID NO: 315689 - DNA, 20 bp, human
gcgccctcgcgggtctcggt

SEQ ID NO: 315690 - DNA, 20 bp, human
gggtagacgcgcggcggaag

SEQ ID NO: 315691 - DNA, 20 bp, human
ggagtgctgcctgaggagac

SEQ ID NO: 315692 - DNA, 20 bp, human
gggaaaaaggggtagacgcg

SEQ ID NO: 315693 - DNA, 20 bp, human
gggagcgcgcgcgtcccatt

SEQ ID NO: 315694 - DNA, 20 bp, human
gcagcactcccgggaaaaag

SEQ ID NO: 315695 - DNA, 20 bp, human
gcccgccaaccggtctcctc

SEQ ID NO: 315696 - DNA, 20 bp, human
gccgccccctctccgtgatg

SEQ ID NO: 315697 - DNA, 20 bp, human
gagggggcggagcatcctct

SEQ ID NO: 315698 - DNA, 20 bp, human
ggctttccccatcacggaga

SEQ ID NO: 315699 - DNA, 20 bp, human
gatggaaattgaacagacat

SEQ ID NO: 315700 - DNA, 20 bp, human
gccgtgatggggaaagcacg

SEQ ID NO: 315701 - DNA, 20 bp, human
gcctaggataggtgttttaa

SEQ ID NO: 315702 - DNA, 20 bp, human
gtaaaccgaaatacagttaa

SEQ ID NO: 315703 - DNA, 20 bp, human
gaatttccattcaaccccct

SEQ ID NO: 315704 - DNA, 20 bp, human
gccattcaaccccctaggat

SEQ ID NO: 315705 - DNA, 20 bp, human
gcgaggttcttccttcgctt

SEQ ID NO: 315706 - DNA, 20 bp, human
gagtccccggtgctttgcaa

SEQ ID NO: 315707 - DNA, 20 bp, human
ggactcaaataagactgtgt

SEQ ID NO: 315708 - DNA, 20 bp, human
gtgaacccttgcaaagcacc

SEQ ID NO: 315709 - DNA, 20 bp, human
gaaaccccacccctagagaa

SEQ ID NO: 315710 - DNA, 20 bp, human
gaatacttgaccgttctcta

SEQ ID NO: 315711 - DNA, 20 bp, human
gtgaccgttctctaggggtg

SEQ ID NO: 315712 - DNA, 20 bp, human
ggtcagtcagcaagcatgtt

SEQ ID NO: 315713 - DNA, 20 bp, human
gatgcttgctgactgactaa

SEQ ID NO: 315714 - DNA, 20 bp, human
ggcatgtttggaacagtccc

SEQ ID NO: 315715 - DNA, 20 bp, human
gaaagcaaactccaaatgtt

SEQ ID NO: 315716 - DNA, 20 bp, human
ggggaaagggcgcgtctcaa

SEQ ID NO: 315717 - DNA, 20 bp, human
gtcagcctcaagcttgaagg

SEQ ID NO: 315718 - DNA, 20 bp, human
gggacagcgccccctgtgac

SEQ ID NO: 315719 - DNA, 20 bp, human
gagcgccccctgtgacgggg

SEQ ID NO: 315720 - DNA, 20 bp, human
ggggagggacacccagaaat

SEQ ID NO: 315721 - DNA, 20 bp, human
gcccctgtgacggggaggac

SEQ ID NO: 315722 - DNA, 20 bp, human
ggagccggtccaggctccgg

SEQ ID NO: 315723 - DNA, 20 bp, human
gagaccccgctctcgaatct

SEQ ID NO: 315724 - DNA, 20 bp, human
gtgtgtaggcgagaggaagg

SEQ ID NO: 315725 - DNA, 20 bp, human
gtaacggactaacctgagct

SEQ ID NO: 315726 - DNA, 20 bp, human
gacctctgggaatacagcga

SEQ ID NO: 315727 - DNA, 20 bp, human
gggtggggtgctgaattcga

SEQ ID NO: 315728 - DNA, 20 bp, human
gagaaggtacaaggactatt

SEQ ID NO: 315729 - DNA, 20 bp, human
gagctggtgagcatccacgt

SEQ ID NO: 315730 - DNA, 20 bp, human
gtcaggacacctatacctct

SEQ ID NO: 315731 - DNA, 20 bp, human
ggctgtattcccagaggtat

SEQ ID NO: 315732 - DNA, 20 bp, human
gtcttaaaagggattctaaa

SEQ ID NO: 315733 - DNA, 20 bp, human
gaatgcaagtgtagggctgg

SEQ ID NO: 315734 - DNA, 20 bp, human
gggccagtaatgcaagtgta

SEQ ID NO: 315735 - DNA, 20 bp, human
gtctggtttgagtccgggag

SEQ ID NO: 315736 - DNA, 20 bp, human
gcagccatctgctttcatca

SEQ ID NO: 315737 - DNA, 20 bp, human
gacagctgcttgattcgccg

SEQ ID NO: 315738 - DNA, 20 bp, human
ggcccccaggcagcagtact

SEQ ID NO: 315739 - DNA, 20 bp, human
ggctcccagtactgctgcct

SEQ ID NO: 315740 - DNA, 20 bp, human
gtcagagaggggggagtaag

SEQ ID NO: 315741 - DNA, 20 bp, human
gtccactggaatccagggga

SEQ ID NO: 315742 - DNA, 20 bp, human
gacaggctccctgatgattc

SEQ ID NO: 315743 - DNA, 20 bp, human
gagggttcatcccagtgtgt

SEQ ID NO: 315744 - DNA, 20 bp, human
gtcagggagcctgtcagagg

SEQ ID NO: 315745 - DNA, 20 bp, human
gggaatggagggccctagct

SEQ ID NO: 315746 - DNA, 20 bp, human
gaggagacccggaagtgggt

SEQ ID NO: 315747 - DNA, 20 bp, human
gcctgatgacgtttaggggt

SEQ ID NO: 315748 - DNA, 20 bp, human
gtgggtggatctaaagttca

SEQ ID NO: 315749 - DNA, 20 bp, human
gcatgagagcgctattagat

SEQ ID NO: 315750 - DNA, 20 bp, human
ggtgggaagaaagcggaaac

SEQ ID NO: 315751 - DNA, 20 bp, human
gagggtgcaagaagaatcag

SEQ ID NO: 315752 - DNA, 20 bp, human
gtctaagcgcggctctcaga

SEQ ID NO: 315753 - DNA, 20 bp, human
ggcggtggcgcggtttgtgt

SEQ ID NO: 315754 - DNA, 20 bp, human
gagagcgctattagattggc

SEQ ID NO: 315755 - DNA, 20 bp, human
ggagtctgccacaaacgcgt

SEQ ID NO: 315756 - DNA, 20 bp, human
gctcccgcctgagtcgtctg

SEQ ID NO: 315757 - DNA, 20 bp, human
ggactcaggcgggagacgag

SEQ ID NO: 315758 - DNA, 20 bp, human
gacggtgagcggcttcccag

SEQ ID NO: 315759 - DNA, 20 bp, human
gccaggctctggggcttact

SEQ ID NO: 315760 - DNA, 20 bp, human
ggcgtggctcgggtccaccc

SEQ ID NO: 315761 - DNA, 20 bp, human
gctggagcgttgggagcatg

SEQ ID NO: 315762 - DNA, 20 bp, human
gtacccacagacgactcagg

SEQ ID NO: 315763 - DNA, 20 bp, human
gcggacccgggacgtctgaa

SEQ ID NO: 315764 - DNA, 20 bp, human
gtggccgccgacagtgacga

SEQ ID NO: 315765 - DNA, 20 bp, human
ggcgccatcgtcactgtcgg

SEQ ID NO: 315766 - DNA, 20 bp, human
gcaaccctggcgacgcgtgg

SEQ ID NO: 315767 - DNA, 20 bp, human
gttgcgcgcgtgagcgatga

SEQ ID NO: 315768 - DNA, 20 bp, human
gcgcgcgtgagcgatgatgg

SEQ ID NO: 315769 - DNA, 20 bp, human
gagctgctggccaatggcgt

SEQ ID NO: 315770 - DNA, 20 bp, human
ggcgcaaccctggcgacgcg

SEQ ID NO: 315771 - DNA, 20 bp, human
gcccagaaggccatgcgggg

SEQ ID NO: 315772 - DNA, 20 bp, human
ggcggaaaaaaaggtcttgc

SEQ ID NO: 315773 - DNA, 20 bp, human
gcgcgcccagcaacttccgc

SEQ ID NO: 315774 - DNA, 20 bp, human
gctggcgacgcgtggtggcg

SEQ ID NO: 315775 - DNA, 20 bp, human
ggccggaaatgctacggcac

SEQ ID NO: 315776 - DNA, 20 bp, human
gaggcctacgagagctaagt

SEQ ID NO: 315777 - DNA, 20 bp, human
ggctggcgctggttcaggat

SEQ ID NO: 315778 - DNA, 20 bp, human
gctccctccgcgggccgcgg

SEQ ID NO: 315779 - DNA, 20 bp, human
gcgccgccgcggcccgcgga

SEQ ID NO: 315780 - DNA, 20 bp, human
gctggcggcggcggcgacaa

SEQ ID NO: 315781 - DNA, 20 bp, human
ggctgacgggctgggtcgag

SEQ ID NO: 315782 - DNA, 20 bp, human
gctcccgcccgagccagcct

SEQ ID NO: 315783 - DNA, 20 bp, human
gggccctgcctgcggctgac

SEQ ID NO: 315784 - DNA, 20 bp, human
gcgcccgaggctggctcggg

SEQ ID NO: 315785 - DNA, 20 bp, human
gtaagtgggctgagggtccc

SEQ ID NO: 315786 - DNA, 20 bp, human
gaatggacgggatcggacga

SEQ ID NO: 315787 - DNA, 20 bp, human
gtacctctcagccaatggac

SEQ ID NO: 315788 - DNA, 20 bp, human
gcgagcgcaccctgcgggtg

SEQ ID NO: 315789 - DNA, 20 bp, human
gcgtccgcgtcggcgatccg

SEQ ID NO: 315790 - DNA, 20 bp, human
ggcctggcgagcgcaccctg

SEQ ID NO: 315791 - DNA, 20 bp, human
gcgactcgccgctgattggt

SEQ ID NO: 315792 - DNA, 20 bp, human
gtcgcgcgccgaccaatcag

SEQ ID NO: 315793 - DNA, 20 bp, human
gctcgcacgggccaatcctg

SEQ ID NO: 315794 - DNA, 20 bp, human
gcctcctcacgcgctaccac

SEQ ID NO: 315795 - DNA, 20 bp, human
ggcctctggggtgggatcgc

SEQ ID NO: 315796 - DNA, 20 bp, human
gggggcgggaaaacccgtgt

SEQ ID NO: 315797 - DNA, 20 bp, human
gccagggcgggacactccca

SEQ ID NO: 315798 - DNA, 20 bp, human
ggggaaaacccgtgtcggct

SEQ ID NO: 315799 - DNA, 20 bp, human
gcaatgggaaacaagtccct

SEQ ID NO: 315800 - DNA, 20 bp, human
gcggtggcgcggccagctgt

SEQ ID NO: 315801 - DNA, 20 bp, human
gtccagagccgcggccctca

SEQ ID NO: 315802 - DNA, 20 bp, human
gaggttcccgtccagtccgc

SEQ ID NO: 315803 - DNA, 20 bp, human
ggggccgcggctctggaaac

SEQ ID NO: 315804 - DNA, 20 bp, human
gggttcgcagttctcacccc

SEQ ID NO: 315805 - DNA, 20 bp, human
gggtacgtcacaccgccgtg

SEQ ID NO: 315806 - DNA, 20 bp, human
ggctgcactggagtgggact

SEQ ID NO: 315807 - DNA, 20 bp, human
gtggaaaatgaaagccagat

SEQ ID NO: 315808 - DNA, 20 bp, human
gagaaacccatgagcactca

SEQ ID NO: 315809 - DNA, 20 bp, human
gatgggacaggtgctaactg

SEQ ID NO: 315810 - DNA, 20 bp, human
gtgcagcagaagcagcccgg

SEQ ID NO: 315811 - DNA, 20 bp, human
ggagggcacctctacccatc

SEQ ID NO: 315812 - DNA, 20 bp, human
gtgccgggaagtgatcccca

SEQ ID NO: 315813 - DNA, 20 bp, human
gggagggcccgagatgggac

SEQ ID NO: 315814 - DNA, 20 bp, human
gtaaagggcccgtgtgcagc

SEQ ID NO: 315815 - DNA, 20 bp, human
gttagcacctgtcccatctc

SEQ ID NO: 315816 - DNA, 20 bp, human
ggcgggagacgcaggttctc

SEQ ID NO: 315817 - DNA, 20 bp, human
gtctcccgcgagttcccgcg

SEQ ID NO: 315818 - DNA, 20 bp, human
gtgctccggaggctccctaa

SEQ ID NO: 315819 - DNA, 20 bp, human
gttgcctcgcgggaactcgc

SEQ ID NO: 315820 - DNA, 20 bp, human
ggaggcctagaagtgggcaa

SEQ ID NO: 315821 - DNA, 20 bp, human
gcggagccgccctcagcaca

SEQ ID NO: 315822 - DNA, 20 bp, human
gtaggttcaaggatacgtgc

SEQ ID NO: 315823 - DNA, 20 bp, human
gtccagggaggcctagaagt

SEQ ID NO: 315824 - DNA, 20 bp, human
gcctgcagcacttgcctcgc

SEQ ID NO: 315825 - DNA, 20 bp, human
gggcaagtgctgcaggtgcg

SEQ ID NO: 315826 - DNA, 20 bp, human
ggaccactctgtgagtcatc

SEQ ID NO: 315827 - DNA, 20 bp, human
ggctccgtcatcaacaaaca

SEQ ID NO: 315828 - DNA, 20 bp, human
gtccagctgcatccgaatcc

SEQ ID NO: 315829 - DNA, 20 bp, human
gttgatgacggagcagggga

SEQ ID NO: 315830 - DNA, 20 bp, human
gccagagagtctgatctgtc

SEQ ID NO: 315831 - DNA, 20 bp, human
gttcggatgcagctggagtt

SEQ ID NO: 315832 - DNA, 20 bp, human
ggtacctgagagcatgtcct

SEQ ID NO: 315833 - DNA, 20 bp, human
gccatccagtaccacctgtg

SEQ ID NO: 315834 - DNA, 20 bp, human
gccacagctctcccaggatt

SEQ ID NO: 315835 - DNA, 20 bp, human
gtaacaggagtgcatctgtg

SEQ ID NO: 315836 - DNA, 20 bp, human
gaggtccccgctattgtgga

SEQ ID NO: 315837 - DNA, 20 bp, human
gcgtggctgtgcagcaagca

SEQ ID NO: 315838 - DNA, 20 bp, human
gctggctaaaggcaggctga

SEQ ID NO: 315839 - DNA, 20 bp, human
ggcaaagtcggggaacttcc

SEQ ID NO: 315840 - DNA, 20 bp, human
gtggccctggcttctaccga

SEQ ID NO: 315841 - DNA, 20 bp, human
gagtcccatcagcaaagtcg

SEQ ID NO: 315842 - DNA, 20 bp, human
gagtcgtgggcggagctctg

SEQ ID NO: 315843 - DNA, 20 bp, human
gcggcatcatcccccatgca

SEQ ID NO: 315844 - DNA, 20 bp, human
gtgatcgcaaggctctgtgc

SEQ ID NO: 315845 - DNA, 20 bp, human
ggctgctgagagcgccctgc

SEQ ID NO: 315846 - DNA, 20 bp, human
ggaccaaccagcgagaggag

SEQ ID NO: 315847 - DNA, 20 bp, human
gttgttggtatagaaccaat

SEQ ID NO: 315848 - DNA, 20 bp, human
gcacttgtgcgattgggaga

SEQ ID NO: 315849 - DNA, 20 bp, human
gaggagcggactttgcgggg

SEQ ID NO: 315850 - DNA, 20 bp, human
ggagaggagcggactttgcg

SEQ ID NO: 315851 - DNA, 20 bp, human
ggtagctgggaggtttccga

SEQ ID NO: 315852 - DNA, 20 bp, human
ggtaggggcggggcattctt

SEQ ID NO: 315853 - DNA, 20 bp, human
gtggttggtcacacttgaca

SEQ ID NO: 315854 - DNA, 20 bp, human
gtcccaatcgcacaagtgta

SEQ ID NO: 315855 - DNA, 20 bp, human
gcaaagtccgctcctctcgc

SEQ ID NO: 315856 - DNA, 20 bp, human
ggggcccagccgctgcacgt

SEQ ID NO: 315857 - DNA, 20 bp, human
ggaaagtctgagaccactcg

SEQ ID NO: 315858 - DNA, 20 bp, human
gccagccaatagggcatcag

SEQ ID NO: 315859 - DNA, 20 bp, human
gagtctgagaccactcgggg

SEQ ID NO: 315860 - DNA, 20 bp, human
gcgaacgtgtggatcagcgg

SEQ ID NO: 315861 - DNA, 20 bp, human
gtccgtggcgggttccagag

SEQ ID NO: 315862 - DNA, 20 bp, human
ggccaatgagccggcgtggg

SEQ ID NO: 315863 - DNA, 20 bp, human
gcggcgtgggtggatgagtg

SEQ ID NO: 315864 - DNA, 20 bp, human
gtagcctgagggttcgctcc

SEQ ID NO: 315865 - DNA, 20 bp, human
ggtgggctgcggctccgtgg

SEQ ID NO: 315866 - DNA, 20 bp, human
gccgccagtcagctagcgcg

SEQ ID NO: 315867 - DNA, 20 bp, human
gttcctctcggcaacgcgtc

SEQ ID NO: 315868 - DNA, 20 bp, human
gggcccgcagagccaatggg

SEQ ID NO: 315869 - DNA, 20 bp, human
gggccgggctggggccaatg

SEQ ID NO: 315870 - DNA, 20 bp, human
gggctggggccaatggggac

SEQ ID NO: 315871 - DNA, 20 bp, human
ggcgctcgacccgtccccat

SEQ ID NO: 315872 - DNA, 20 bp, human
ggacgctcctgcgtcctaac

SEQ ID NO: 315873 - DNA, 20 bp, human
ggcgccccgccaccggccat

SEQ ID NO: 315874 - DNA, 20 bp, human
gactgcgagccaatggccgg

SEQ ID NO: 315875 - DNA, 20 bp, human
gggaccgcccgccgtcctgg

SEQ ID NO: 315876 - DNA, 20 bp, human
gtagaacactgtcttttaac

SEQ ID NO: 315877 - DNA, 20 bp, human
gatggcgacaggctcgcact

SEQ ID NO: 315878 - DNA, 20 bp, human
ggagcctgtcgccatcggac

SEQ ID NO: 315879 - DNA, 20 bp, human
gtcggaccggtcaaaataaa

SEQ ID NO: 315880 - DNA, 20 bp, human
ggagactagcgagcgaggca

SEQ ID NO: 315881 - DNA, 20 bp, human
gctactctgtggtaagcctt

SEQ ID NO: 315882 - DNA, 20 bp, human
gaggtggagactagcgagcg

SEQ ID NO: 315883 - DNA, 20 bp, human
ggcagggaagcctgcgggga

SEQ ID NO: 315884 - DNA, 20 bp, human
gggagattgaatgaacctac

SEQ ID NO: 315885 - DNA, 20 bp, human
gaggtgcacccagagacatc

SEQ ID NO: 315886 - DNA, 20 bp, human
gactccctgcggttgcccag

SEQ ID NO: 315887 - DNA, 20 bp, human
ggtagtgcacacgccgtttc

SEQ ID NO: 315888 - DNA, 20 bp, human
ggaacgcaggcgccctgaaa

SEQ ID NO: 315889 - DNA, 20 bp, human
ggtagtcccgcacccgcccg

SEQ ID NO: 315890 - DNA, 20 bp, human
gcgttccgcaagattcgcaa

SEQ ID NO: 315891 - DNA, 20 bp, human
gtccccgcgagcacggggga

SEQ ID NO: 315892 - DNA, 20 bp, human
gccacatcgtgtctggaggg

SEQ ID NO: 315893 - DNA, 20 bp, human
gcaagattcgcaaaggtcgt

SEQ ID NO: 315894 - DNA, 20 bp, human
ggggaagactaagaagttgc

SEQ ID NO: 315895 - DNA, 20 bp, human
gctacgattcccggcagccg

SEQ ID NO: 315896 - DNA, 20 bp, human
ggggcgcgggcccgagccaa

SEQ ID NO: 315897 - DNA, 20 bp, human
gccaagcgcggactctactg

SEQ ID NO: 315898 - DNA, 20 bp, human
ggggcgaggcatgcccaccc

SEQ ID NO: 315899 - DNA, 20 bp, human
ggcatctcgcccttccctcc

SEQ ID NO: 315900 - DNA, 20 bp, human
gattgcgcctgggcccgggt

SEQ ID NO: 315901 - DNA, 20 bp, human
gggccagggtcccttggctc

SEQ ID NO: 315902 - DNA, 20 bp, human
gggcatgcccacccgggccc

SEQ ID NO: 315903 - DNA, 20 bp, human
ggggccagacggtgttttct

SEQ ID NO: 315904 - DNA, 20 bp, human
gagagcgcctaagcagcgct

SEQ ID NO: 315905 - DNA, 20 bp, human
gtcgcagcgccgggaataaa

SEQ ID NO: 315906 - DNA, 20 bp, human
ggagggtgacgcacaggctg

SEQ ID NO: 315907 - DNA, 20 bp, human
gtcaccctcccggggccgga

SEQ ID NO: 315908 - DNA, 20 bp, human
ggcctgtgcgtcaccctccc

SEQ ID NO: 315909 - DNA, 20 bp, human
gtggaaacggcagcctggat

SEQ ID NO: 315910 - DNA, 20 bp, human
ggccgcgccccgcctcgggg

SEQ ID NO: 315911 - DNA, 20 bp, human
gctgggcagccttgacgctt

SEQ ID NO: 315912 - DNA, 20 bp, human
ggccaaagatgacaacctaa

SEQ ID NO: 315913 - DNA, 20 bp, human
gaagacgaaccgccgtacta

SEQ ID NO: 315914 - DNA, 20 bp, human
gtgctggcctcagctccgaa

SEQ ID NO: 315915 - DNA, 20 bp, human
gatgcctataaaaacggcag

SEQ ID NO: 315916 - DNA, 20 bp, human
gcccagcaggccagcaacga

SEQ ID NO: 315917 - DNA, 20 bp, human
gtggcctcccccatcgttgc

SEQ ID NO: 315918 - DNA, 20 bp, human
gcccaggcctgaccggtgag

SEQ ID NO: 315919 - DNA, 20 bp, human
gagcaggccagcaacgatgg

SEQ ID NO: 315920 - DNA, 20 bp, human
gtgggcctgtctacggtctg

SEQ ID NO: 315921 - DNA, 20 bp, human
gtcaccgcgggtgctaagga

SEQ ID NO: 315922 - DNA, 20 bp, human
ggaccttcttgtccctccaa

SEQ ID NO: 315923 - DNA, 20 bp, human
ggcccagcccctcaccggtc

SEQ ID NO: 315924 - DNA, 20 bp, human
gagcacccgcggtgacatca

SEQ ID NO: 315925 - DNA, 20 bp, human
gaggccagcaacgatggggg

SEQ ID NO: 315926 - DNA, 20 bp, human
gtacccgggagactcctcta

SEQ ID NO: 315927 - DNA, 20 bp, human
gcggggcgcagctccggcta

SEQ ID NO: 315928 - DNA, 20 bp, human
gcccaccccagtgagcaggg

SEQ ID NO: 315929 - DNA, 20 bp, human
ggcggcgtggagactcctgg

SEQ ID NO: 315930 - DNA, 20 bp, human
gccggctagggcggtggaca

SEQ ID NO: 315931 - DNA, 20 bp, human
gggcgcagctccggctaggg

SEQ ID NO: 315932 - DNA, 20 bp, human
gggctgggatagcccagact

SEQ ID NO: 315933 - DNA, 20 bp, human
gctcctcgacacagccctag

SEQ ID NO: 315934 - DNA, 20 bp, human
ggagtctcccgggtaggcca

SEQ ID NO: 315935 - DNA, 20 bp, human
gccccagagtaaaagtagcg

SEQ ID NO: 315936 - DNA, 20 bp, human
gttacccggggtcaccgcca

SEQ ID NO: 315937 - DNA, 20 bp, human
gagggggcggggcttacccg

SEQ ID NO: 315938 - DNA, 20 bp, human
gccctgcggagacaggaacg

SEQ ID NO: 315939 - DNA, 20 bp, human
gtaactgaacggggagggga

SEQ ID NO: 315940 - DNA, 20 bp, human
ggcgggagaaccctgggcgg

SEQ ID NO: 315941 - DNA, 20 bp, human
gccgactcgaagcccttata

SEQ ID NO: 315942 - DNA, 20 bp, human
gcagttaactgaacggggag

SEQ ID NO: 315943 - DNA, 20 bp, human
gcagttaactgtttgggctg

SEQ ID NO: 315944 - DNA, 20 bp, human
ggtgtctccgcgccttataa

SEQ ID NO: 315945 - DNA, 20 bp, human
gtgtgatcttaaccccgcgg

SEQ ID NO: 315946 - DNA, 20 bp, human
ggacgagacagaatgagggt

SEQ ID NO: 315947 - DNA, 20 bp, human
gttagggacgagacagaatg

SEQ ID NO: 315948 - DNA, 20 bp, human
gctctgccccaggcaggtta

SEQ ID NO: 315949 - DNA, 20 bp, human
ggtttgcaggggccattctg

SEQ ID NO: 315950 - DNA, 20 bp, human
gttactgttactgtttgcag

SEQ ID NO: 315951 - DNA, 20 bp, human
gaaagaggggccggacctag

SEQ ID NO: 315952 - DNA, 20 bp, human
ggtctcgtccctaacctgcc

SEQ ID NO: 315953 - DNA, 20 bp, human
gagtcaaatgtctctgcccc

SEQ ID NO: 315954 - DNA, 20 bp, human
gccctcttttttttcgagat

SEQ ID NO: 315955 - DNA, 20 bp, human
gagggtggggagcggggctc

SEQ ID NO: 315956 - DNA, 20 bp, human
gccgaatgggagcggcgacc

SEQ ID NO: 315957 - DNA, 20 bp, human
gagggcgcgtgcgcactgca

SEQ ID NO: 315958 - DNA, 20 bp, human
gcgcgagcgccgaatgggag

SEQ ID NO: 315959 - DNA, 20 bp, human
gaccgcggaggcggcgggca

SEQ ID NO: 315960 - DNA, 20 bp, human
ggccctggctgccgcccgcg

SEQ ID NO: 315961 - DNA, 20 bp, human
gcgcgctaggcgcaccgcgg

SEQ ID NO: 315962 - DNA, 20 bp, human
gcaggggcgccagatttggc

SEQ ID NO: 315963 - DNA, 20 bp, human
gactgcaggggcgccagatt

SEQ ID NO: 315964 - DNA, 20 bp, human
ggcgccagatttggcgggag

SEQ ID NO: 315965 - DNA, 20 bp, human
gcgcccccgcgacagtgagt

SEQ ID NO: 315966 - DNA, 20 bp, human
gcggaggcggaagaacccgg

SEQ ID NO: 315967 - DNA, 20 bp, human
gcatgcgcaccggtttgtgt

SEQ ID NO: 315968 - DNA, 20 bp, human
gatgggacgccgctaggcga

SEQ ID NO: 315969 - DNA, 20 bp, human
gggacttccgctcagagcta

SEQ ID NO: 315970 - DNA, 20 bp, human
gcggcccagagttaaaagag

SEQ ID NO: 315971 - DNA, 20 bp, human
ggggccgctctgggacgagt

SEQ ID NO: 315972 - DNA, 20 bp, human
ggcggaagaacccggagggg

SEQ ID NO: 315973 - DNA, 20 bp, human
ggctcggaggcggaagaacc

SEQ ID NO: 315974 - DNA, 20 bp, human
gggaaagatgggacgccgct

SEQ ID NO: 315975 - DNA, 20 bp, human
gcctccgagccgacacaaac

SEQ ID NO: 315976 - DNA, 20 bp, human
gagctgggactggaactcgc

SEQ ID NO: 315977 - DNA, 20 bp, human
ggccgcacgcgaagaagcga

SEQ ID NO: 315978 - DNA, 20 bp, human
gaactcgcgggagtcgggga

SEQ ID NO: 315979 - DNA, 20 bp, human
gactggaactcgcgggagtc

SEQ ID NO: 315980 - DNA, 20 bp, human
gggagagcgcgcgcggctga

SEQ ID NO: 315981 - DNA, 20 bp, human
gacgcggccctgaacctcat

SEQ ID NO: 315982 - DNA, 20 bp, human
gccgagaggcgcaccgcgcg

SEQ ID NO: 315983 - DNA, 20 bp, human
gacgcgaagaagcgagggcg

SEQ ID NO: 315984 - DNA, 20 bp, human
gccgcgggtggggccgtagg

SEQ ID NO: 315985 - DNA, 20 bp, human
gaaacggcggctcttgaggg

SEQ ID NO: 315986 - DNA, 20 bp, human
gctcacgtgtcagtccgggg

SEQ ID NO: 315987 - DNA, 20 bp, human
gcccgcgcgccaggactggg

SEQ ID NO: 315988 - DNA, 20 bp, human
gcagggccggctgcaggaca

SEQ ID NO: 315989 - DNA, 20 bp, human
gaccctccagggccggctgc

SEQ ID NO: 315990 - DNA, 20 bp, human
gccagccagggaaagcgcca

SEQ ID NO: 315991 - DNA, 20 bp, human
gggctctagggacccagtag

SEQ ID NO: 315992 - DNA, 20 bp, human
gtgggcaggtgccgccccgc

SEQ ID NO: 315993 - DNA, 20 bp, human
gtatctcccgccaagcgcgt

SEQ ID NO: 315994 - DNA, 20 bp, human
gtggctcacgtgtcagtccg

SEQ ID NO: 315995 - DNA, 20 bp, human
ggggagcgaggcgcgagcat

SEQ ID NO: 315996 - DNA, 20 bp, human
gtgctctctcgcctactgga

SEQ ID NO: 315997 - DNA, 20 bp, human
gtgcaggaacttgacagcta

SEQ ID NO: 315998 - DNA, 20 bp, human
ggcaggagattccttccagt

SEQ ID NO: 315999 - DNA, 20 bp, human
gcatcatgattgatgttcag

SEQ ID NO: 316000 - DNA, 20 bp, human
gactctgctctctcgcctac

SEQ ID NO: 316001 - DNA, 20 bp, human
gcagatgcatgtgctgactc

SEQ ID NO: 316002 - DNA, 20 bp, human
gaagagcaagacggagcacg

SEQ ID NO: 316003 - DNA, 20 bp, human
ggcatccttgtgctgaagaa

SEQ ID NO: 316004 - DNA, 20 bp, human
ggctgaatttagaaagttag

SEQ ID NO: 316005 - DNA, 20 bp, human
gttagtgaaaattaaggtat

SEQ ID NO: 316006 - DNA, 20 bp, human
gtccgcccgcatgttctaaa

SEQ ID NO: 316007 - DNA, 20 bp, human
ggggctggggctcggacacc

SEQ ID NO: 316008 - DNA, 20 bp, human
gcaggcgctcgtcctttcta

SEQ ID NO: 316009 - DNA, 20 bp, human
gtctgggagcagaagcaact

SEQ ID NO: 316010 - DNA, 20 bp, human
gaacatgcgggcggaatgtg

SEQ ID NO: 316011 - DNA, 20 bp, human
gctcggactccagaatctca

SEQ ID NO: 316012 - DNA, 20 bp, human
gggctctcagccatctccct

SEQ ID NO: 316013 - DNA, 20 bp, human
gagtctcaggactcattaaa

SEQ ID NO: 316014 - DNA, 20 bp, human
gggagccttctgggagtctc

SEQ ID NO: 316015 - DNA, 20 bp, human
ggccggggccccagctcttt

SEQ ID NO: 316016 - DNA, 20 bp, human
gaggcagaattgtgctgcgg

SEQ ID NO: 316017 - DNA, 20 bp, human
ggggaggcagaattgtgctg

SEQ ID NO: 316018 - DNA, 20 bp, human
ggtctctccagggagaaggt

SEQ ID NO: 316019 - DNA, 20 bp, human
gtgtaagagggacacacacg

SEQ ID NO: 316020 - DNA, 20 bp, human
gggtagggccacattgtccc

SEQ ID NO: 316021 - DNA, 20 bp, human
gggggcttggagtacccctg

SEQ ID NO: 316022 - DNA, 20 bp, human
gaccctaaggctaacgggtc

SEQ ID NO: 316023 - DNA, 20 bp, human
gtgaggcttgccaaaggttg

SEQ ID NO: 316024 - DNA, 20 bp, human
gtacccctgaggcttgccaa

SEQ ID NO: 316025 - DNA, 20 bp, human
gtgctgggcccataacccta

SEQ ID NO: 316026 - DNA, 20 bp, human
gaggccaggaatagctctgg

SEQ ID NO: 316027 - DNA, 20 bp, human
ggtcaagcaggaggactgga

SEQ ID NO: 316028 - DNA, 20 bp, human
gcccaggccaggaatagctc

SEQ ID NO: 316029 - DNA, 20 bp, human
gtggggtcaggtcaagcagg

SEQ ID NO: 316030 - DNA, 20 bp, human
gaggctgagggccctagaga

SEQ ID NO: 316031 - DNA, 20 bp, human
gcaaacgattcccagctgtg

SEQ ID NO: 316032 - DNA, 20 bp, human
gaggaggaagaacttctatc

SEQ ID NO: 316033 - DNA, 20 bp, human
gtcaggtcaagcaggaggac

SEQ ID NO: 316034 - DNA, 20 bp, human
gcctcccccagagctattcc

SEQ ID NO: 316035 - DNA, 20 bp, human
gtggctgttgaaggccagtc

SEQ ID NO: 316036 - DNA, 20 bp, human
gacctccagttcatcccgtg

SEQ ID NO: 316037 - DNA, 20 bp, human
gaatgccccacgggatgaac

SEQ ID NO: 316038 - DNA, 20 bp, human
gcagcagaaaggctgaagta

SEQ ID NO: 316039 - DNA, 20 bp, human
gagcccagaatagccccagg

SEQ ID NO: 316040 - DNA, 20 bp, human
ggaaaggctgaagtaggggt

SEQ ID NO: 316041 - DNA, 20 bp, human
gttgaacacaccatccaaaa

SEQ ID NO: 316042 - DNA, 20 bp, human
gtcagctacgcccagcagaa

SEQ ID NO: 316043 - DNA, 20 bp, human
gagtcctcctggggctattc

SEQ ID NO: 316044 - DNA, 20 bp, human
ggggacctctaatttctgta

SEQ ID NO: 316045 - DNA, 20 bp, human
gaatcctgggccccttcttt

SEQ ID NO: 316046 - DNA, 20 bp, human
gctgctttggcagcaaattg

SEQ ID NO: 316047 - DNA, 20 bp, human
gcctagcccagctctggaac

SEQ ID NO: 316048 - DNA, 20 bp, human
ggccgcgagcagcacagctc

SEQ ID NO: 316049 - DNA, 20 bp, human
gtataatgcgagggtctgga

SEQ ID NO: 316050 - DNA, 20 bp, human
gtgggcgcgcagtgcgttct

SEQ ID NO: 316051 - DNA, 20 bp, human
ggccgggccccggccgtccc

SEQ ID NO: 316052 - DNA, 20 bp, human
gtcccctcctgcctcgagaa

SEQ ID NO: 316053 - DNA, 20 bp, human
gggaggggcgcttatgggga

SEQ ID NO: 316054 - DNA, 20 bp, human
gcagaccctcgcattataaa

SEQ ID NO: 316055 - DNA, 20 bp, human
gggcgcttatggggagggtg

SEQ ID NO: 316056 - DNA, 20 bp, human
ggcggctccgacagccagag

SEQ ID NO: 316057 - DNA, 20 bp, human
gggccgggatcgccgaggtg

SEQ ID NO: 316058 - DNA, 20 bp, human
ggaggtgtggcctgttttca

SEQ ID NO: 316059 - DNA, 20 bp, human
gtggcccattacaaagtgag

SEQ ID NO: 316060 - DNA, 20 bp, human
gcacttgcaaaccaccggcc

SEQ ID NO: 316061 - DNA, 20 bp, human
gccaccggccgggatcgccg

SEQ ID NO: 316062 - DNA, 20 bp, human
gtccggcccccgtagcaatt

SEQ ID NO: 316063 - DNA, 20 bp, human
ggctcccaacccgccagtcg

SEQ ID NO: 316064 - DNA, 20 bp, human
ggccggagaccgcgactggc

SEQ ID NO: 316065 - DNA, 20 bp, human
gcctccggacgccaggacag

SEQ ID NO: 316066 - DNA, 20 bp, human
ggcctcggggctttgggttt

SEQ ID NO: 316067 - DNA, 20 bp, human
gagccccgaggcggagggag

SEQ ID NO: 316068 - DNA, 20 bp, human
gggaacgtgcccatcgccag

SEQ ID NO: 316069 - DNA, 20 bp, human
gccctccgcctcggggcttt

SEQ ID NO: 316070 - DNA, 20 bp, human
gacccaaagccccgaggcgg

SEQ ID NO: 316071 - DNA, 20 bp, human
gccaccccgggaatgtgagg

SEQ ID NO: 316072 - DNA, 20 bp, human
gactgagcatgtgcgaggag

SEQ ID NO: 316073 - DNA, 20 bp, human
gtcaagctgccagtaaaacc

SEQ ID NO: 316074 - DNA, 20 bp, human
gtcgacttcaggttccctcc

SEQ ID NO: 316075 - DNA, 20 bp, human
gttggggctgttgggttgtg

SEQ ID NO: 316076 - DNA, 20 bp, human
gtgggagtggctggctggta

SEQ ID NO: 316077 - DNA, 20 bp, human
gcgcgagttgcgggagccga

SEQ ID NO: 316078 - DNA, 20 bp, human
gtggccttagtcgaggaagg

SEQ ID NO: 316079 - DNA, 20 bp, human
ggggcccgcagggctttcta

SEQ ID NO: 316080 - DNA, 20 bp, human
ggaggacccccgcgagttgc

SEQ ID NO: 316081 - DNA, 20 bp, human
gcccctcacagcggttctgg

SEQ ID NO: 316082 - DNA, 20 bp, human
gcccccccagaaccgctgtg

SEQ ID NO: 316083 - DNA, 20 bp, human
gccctgctgctaggccacgg

SEQ ID NO: 316084 - DNA, 20 bp, human
gcgcatccaccgatcaactt

SEQ ID NO: 316085 - DNA, 20 bp, human
gtaaggccacatcctgtcga

SEQ ID NO: 316086 - DNA, 20 bp, human
ggggcgcgcgacgagatata

SEQ ID NO: 316087 - DNA, 20 bp, human
gcggcggcccggacgctctc

SEQ ID NO: 316088 - DNA, 20 bp, human
gcctgtcgactgcccgtagt

SEQ ID NO: 316089 - DNA, 20 bp, human
gacgctctcgggatcggcgc

SEQ ID NO: 316090 - DNA, 20 bp, human
gtacgggcagtcgacaggtg

SEQ ID NO: 316091 - DNA, 20 bp, human
gagggcggggtttgtcccat

SEQ ID NO: 316092 - DNA, 20 bp, human
gcccgtagtaggcagggaga

SEQ ID NO: 316093 - DNA, 20 bp, human
gactggggggcgggccctat

SEQ ID NO: 316094 - DNA, 20 bp, human
gcgggaccagcccaagttca

SEQ ID NO: 316095 - DNA, 20 bp, human
gcgagccgccgcgaggggta

SEQ ID NO: 316096 - DNA, 20 bp, human
ggggctgtggcgcagacaag

SEQ ID NO: 316097 - DNA, 20 bp, human
gcaagcccgggggtccaaaa

SEQ ID NO: 316098 - DNA, 20 bp, human
gaaaatcaggggaggcgcca

SEQ ID NO: 316099 - DNA, 20 bp, human
gcccgggggtccaaaagggc

SEQ ID NO: 316100 - DNA, 20 bp, human
gggggctgggttagaagcat

SEQ ID NO: 316101 - DNA, 20 bp, human
ggcgcctcccctgattttta

SEQ ID NO: 316102 - DNA, 20 bp, human
gtgtggcgcagacaaggggg

SEQ ID NO: 316103 - DNA, 20 bp, human
gcaacacgcagtcaaagcgg

SEQ ID NO: 316104 - DNA, 20 bp, human
gagtgcagccggtgcaagcc

SEQ ID NO: 316105 - DNA, 20 bp, human
gtatggaaatcaggagggcg

SEQ ID NO: 316106 - DNA, 20 bp, human
gcagacaaccgcactcgcag

SEQ ID NO: 316107 - DNA, 20 bp, human
gccccacaccgctgcgagtg

SEQ ID NO: 316108 - DNA, 20 bp, human
gtggaagaggacgttgtcgt

SEQ ID NO: 316109 - DNA, 20 bp, human
gagggggcatgcagatgcag

SEQ ID NO: 316110 - DNA, 20 bp, human
gaccgcactcgcagcggtgt

SEQ ID NO: 316111 - DNA, 20 bp, human
ggggaaggatttgtggatat

SEQ ID NO: 316112 - DNA, 20 bp, human
gtagctgggtcggagagcct

SEQ ID NO: 316113 - DNA, 20 bp, human
gacagcttgtacacaaaagg

SEQ ID NO: 316114 - DNA, 20 bp, human
ggctctccgacccagctacc

SEQ ID NO: 316115 - DNA, 20 bp, human
gccattcccggtagctgggt

SEQ ID NO: 316116 - DNA, 20 bp, human
gtcctcatcccctactgaca

SEQ ID NO: 316117 - DNA, 20 bp, human
ggcgaacacaagtatatgag

SEQ ID NO: 316118 - DNA, 20 bp, human
gggtgctgtagctgagagtt

SEQ ID NO: 316119 - DNA, 20 bp, human
gaactgcttttaggataaca

SEQ ID NO: 316120 - DNA, 20 bp, human
gttcctttccatgtcagtag

SEQ ID NO: 316121 - DNA, 20 bp, human
gtctgtatacatttaattca

SEQ ID NO: 316122 - DNA, 20 bp, human
ggcaactgtttttcttatct

SEQ ID NO: 316123 - DNA, 20 bp, human
gaatttatatagtaaattgg

SEQ ID NO: 316124 - DNA, 20 bp, human
gctaatttgagtataaaagc

SEQ ID NO: 316125 - DNA, 20 bp, human
gattttcaagcattggaacg

SEQ ID NO: 316126 - DNA, 20 bp, human
gacccgcctcgagacctcaa

SEQ ID NO: 316127 - DNA, 20 bp, human
ggccccgagcaaaagtgcgg

SEQ ID NO: 316128 - DNA, 20 bp, human
gtccacggcaccgccctcga

SEQ ID NO: 316129 - DNA, 20 bp, human
gccgagcaaaagtgcggagg

SEQ ID NO: 316130 - DNA, 20 bp, human
gaacccctcagattcctccg

SEQ ID NO: 316131 - DNA, 20 bp, human
gtacccttgaggtctcgagg

SEQ ID NO: 316132 - DNA, 20 bp, human
ggacctctccagatctcaaa

SEQ ID NO: 316133 - DNA, 20 bp, human
ggtctcgaggcgggtgatgt

SEQ ID NO: 316134 - DNA, 20 bp, human
ggagacctcaagggtagagg

SEQ ID NO: 316135 - DNA, 20 bp, human
ggccgccctgccctacaatc

SEQ ID NO: 316136 - DNA, 20 bp, human
gaggagtatcatcttgggaa

SEQ ID NO: 316137 - DNA, 20 bp, human
gggaaagatgagtacctcag

SEQ ID NO: 316138 - DNA, 20 bp, human
ggccctgggtgcagagcaca

SEQ ID NO: 316139 - DNA, 20 bp, human
gtgggtgcagagcacaaggg

SEQ ID NO: 316140 - DNA, 20 bp, human
gctctgaggagtatcatctt

SEQ ID NO: 316141 - DNA, 20 bp, human
gaaagtgccctttccaggag

SEQ ID NO: 316142 - DNA, 20 bp, human
ggcccagggttgcctaggca

SEQ ID NO: 316143 - DNA, 20 bp, human
gtgcctaggcaggggactct

SEQ ID NO: 316144 - DNA, 20 bp, human
gtaggcaggggactcttggc

SEQ ID NO: 316145 - DNA, 20 bp, human
gcccctgcctaggcaaccct

SEQ ID NO: 316146 - DNA, 20 bp, human
ggggccgactgcagcaacag

SEQ ID NO: 316147 - DNA, 20 bp, human
ggacatggcaccaccaccgg

SEQ ID NO: 316148 - DNA, 20 bp, human
gtcctgaaagcccccggtgg

SEQ ID NO: 316149 - DNA, 20 bp, human
gtgtgccgggtgcggggggt

SEQ ID NO: 316150 - DNA, 20 bp, human
gcgcgagaaccggtcgagac

SEQ ID NO: 316151 - DNA, 20 bp, human
gaagcgacaggcgggctggt

SEQ ID NO: 316152 - DNA, 20 bp, human
gcagtcctgaaagcccccgg

SEQ ID NO: 316153 - DNA, 20 bp, human
gctggtgccaagcgacaggc

SEQ ID NO: 316154 - DNA, 20 bp, human
gatggtgtgtgccgggtgcg

SEQ ID NO: 316155 - DNA, 20 bp, human
gaccaccaccgggggctttc

SEQ ID NO: 316156 - DNA, 20 bp, human
gcgagagagggaaatgttga

SEQ ID NO: 316157 - DNA, 20 bp, human
ggggtgggactaacccaggt

SEQ ID NO: 316158 - DNA, 20 bp, human
gcacctaggtcctacctgag

SEQ ID NO: 316159 - DNA, 20 bp, human
ggtaggacctaggtgagctg

SEQ ID NO: 316160 - DNA, 20 bp, human
gcctctctcggttaaggcca

SEQ ID NO: 316161 - DNA, 20 bp, human
gtggtgggtgggactaaccc

SEQ ID NO: 316162 - DNA, 20 bp, human
gttcccctcaggtaggacct

SEQ ID NO: 316163 - DNA, 20 bp, human
ggtggggctgcttgtgagtg

SEQ ID NO: 316164 - DNA, 20 bp, human
gtacctgaggggaacctaca

SEQ ID NO: 316165 - DNA, 20 bp, human
gtcacccagggcaggcctta

SEQ ID NO: 316166 - DNA, 20 bp, human
gcgtctgcaacgcctctgat

SEQ ID NO: 316167 - DNA, 20 bp, human
gccggccgccggcgcgtccg

SEQ ID NO: 316168 - DNA, 20 bp, human
gccggaggaccgcgcctctg

SEQ ID NO: 316169 - DNA, 20 bp, human
gctgtggtgcccgcccgctg

SEQ ID NO: 316170 - DNA, 20 bp, human
gccagcgcaaagacaaacgc

SEQ ID NO: 316171 - DNA, 20 bp, human
gctgcaacgcctctgatggg

SEQ ID NO: 316172 - DNA, 20 bp, human
gacatggcagatctagacgc

SEQ ID NO: 316173 - DNA, 20 bp, human
gggcgggcaccacagaggcg

SEQ ID NO: 316174 - DNA, 20 bp, human
ggtggccgcggacgcgccgg

SEQ ID NO: 316175 - DNA, 20 bp, human
gggatccggcctctggtcgg

SEQ ID NO: 316176 - DNA, 20 bp, human
gcccaccgcaacccccgcgg

SEQ ID NO: 316177 - DNA, 20 bp, human
gtgtccagacagcccccgcg

SEQ ID NO: 316178 - DNA, 20 bp, human
gtaaaacaagggatcactta

SEQ ID NO: 316179 - DNA, 20 bp, human
gctagagagtgcaaatgagc

SEQ ID NO: 316180 - DNA, 20 bp, human
gagtgcaaatgagcaggttg

SEQ ID NO: 316181 - DNA, 20 bp, human
gaacccccgcgggggctgtc

SEQ ID NO: 316182 - DNA, 20 bp, human
ggacctgccctcccaatcct

SEQ ID NO: 316183 - DNA, 20 bp, human
gaaaaccattagcgtcaaaa

SEQ ID NO: 316184 - DNA, 20 bp, human
gattgtctgtagaggaaagg

SEQ ID NO: 316185 - DNA, 20 bp, human
gtatcccaccgcaacccccg

SEQ ID NO: 316186 - DNA, 20 bp, human
gtaaactgcccaaaatggaa

SEQ ID NO: 316187 - DNA, 20 bp, human
gtagattgtcacaacactct

SEQ ID NO: 316188 - DNA, 20 bp, human
gcactagctgcaatcacatt

SEQ ID NO: 316189 - DNA, 20 bp, human
gctccatgacagctaaaagt

SEQ ID NO: 316190 - DNA, 20 bp, human
ggacaatctatgtgcagacc

SEQ ID NO: 316191 - DNA, 20 bp, human
gaaaagttggattgagtttc

SEQ ID NO: 316192 - DNA, 20 bp, human
gttagaattcagatgagcgc

SEQ ID NO: 316193 - DNA, 20 bp, human
gcattgaacccttccatttt

SEQ ID NO: 316194 - DNA, 20 bp, human
gtcagatgagcgcaggggga

SEQ ID NO: 316195 - DNA, 20 bp, human
gtaattaaatgccatctggg

SEQ ID NO: 316196 - DNA, 20 bp, human
gtacagatagtgtactcggg

SEQ ID NO: 316197 - DNA, 20 bp, human
gcagtaggcaacaaagtcca

SEQ ID NO: 316198 - DNA, 20 bp, human
gacactatctgtaactgcgc

SEQ ID NO: 316199 - DNA, 20 bp, human
gctttaatatgaggggaatt

SEQ ID NO: 316200 - DNA, 20 bp, human
gcagttacagatagtgtact

SEQ ID NO: 316201 - DNA, 20 bp, human
gaacttctgctctttagcag

SEQ ID NO: 316202 - DNA, 20 bp, human
gatatgaggggaattaggct

SEQ ID NO: 316203 - DNA, 20 bp, human
gtccaaacatctttaatatg

SEQ ID NO: 316204 - DNA, 20 bp, human
gagttgaaaagacttcacac

SEQ ID NO: 316205 - DNA, 20 bp, human
gaacatgtttttggcattga

SEQ ID NO: 316206 - DNA, 20 bp, human
gaatgagcgtcattccaggt

SEQ ID NO: 316207 - DNA, 20 bp, human
gcgggaaggtagcttcgttc

SEQ ID NO: 316208 - DNA, 20 bp, human
gggcgcgcaaaccaaccagt

SEQ ID NO: 316209 - DNA, 20 bp, human
gcatgagattggggcctctg

SEQ ID NO: 316210 - DNA, 20 bp, human
ggagggagccggactcggga

SEQ ID NO: 316211 - DNA, 20 bp, human
gagagccagcccatgagatt

SEQ ID NO: 316212 - DNA, 20 bp, human
gagccaatgagcgtcattcc

SEQ ID NO: 316213 - DNA, 20 bp, human
gtttgcgcgcccatctccaa

SEQ ID NO: 316214 - DNA, 20 bp, human
gtggctcttacgcccgtcat

SEQ ID NO: 316215 - DNA, 20 bp, human
gacctcccggagcctatgac

SEQ ID NO: 316216 - DNA, 20 bp, human
ggcgggagcgcaaggagctg

SEQ ID NO: 316217 - DNA, 20 bp, human
ggctccggatccctagagaa

SEQ ID NO: 316218 - DNA, 20 bp, human
ggctggggcgctcgggacaa

SEQ ID NO: 316219 - DNA, 20 bp, human
gctgcccgcggctgggaaag

SEQ ID NO: 316220 - DNA, 20 bp, human
gtgcagggcgcacccccggc

SEQ ID NO: 316221 - DNA, 20 bp, human
ggccggctgtgcagcgtgaa

SEQ ID NO: 316222 - DNA, 20 bp, human
ggcaaggagctggggcgctc

SEQ ID NO: 316223 - DNA, 20 bp, human
gcacggaacaggtgcgcaca

SEQ ID NO: 316224 - DNA, 20 bp, human
ggtctgcgaccgcctggggc

SEQ ID NO: 316225 - DNA, 20 bp, human
gtgcggccggaaccgactca

SEQ ID NO: 316226 - DNA, 20 bp, human
ggagacttagagagtcctag

SEQ ID NO: 316227 - DNA, 20 bp, human
gtacttggataaatgaccag

SEQ ID NO: 316228 - DNA, 20 bp, human
gtgctaagaaggtcactgaa

SEQ ID NO: 316229 - DNA, 20 bp, human
gtgcatagggattttgacgt

SEQ ID NO: 316230 - DNA, 20 bp, human
gaatgccaagtcagctgcat

SEQ ID NO: 316231 - DNA, 20 bp, human
gccagcccagcactctaact

SEQ ID NO: 316232 - DNA, 20 bp, human
gaatccctatgcagctgact

SEQ ID NO: 316233 - DNA, 20 bp, human
gctaacttggctatatttgg

SEQ ID NO: 316234 - DNA, 20 bp, human
gtcactcttgttaagttact

SEQ ID NO: 316235 - DNA, 20 bp, human
gcaatgggtgatcagtagtg

SEQ ID NO: 316236 - DNA, 20 bp, human
ggtcgaagggtgccagccgt

SEQ ID NO: 316237 - DNA, 20 bp, human
ggccaatcagaagttgtcga

SEQ ID NO: 316238 - DNA, 20 bp, human
gagccgccaatcaaaaagag

SEQ ID NO: 316239 - DNA, 20 bp, human
ggagctaggcggcgcggtcg

SEQ ID NO: 316240 - DNA, 20 bp, human
gcagccgtgggaaaagaacg

SEQ ID NO: 316241 - DNA, 20 bp, human
ggggccgtagcttgccgcag

SEQ ID NO: 316242 - DNA, 20 bp, human
gggcctctgctgctctcttg

SEQ ID NO: 316243 - DNA, 20 bp, human
ggtggaagccgaggcctgat

SEQ ID NO: 316244 - DNA, 20 bp, human
gagccgctctttttgattgg

SEQ ID NO: 316245 - DNA, 20 bp, human
gaatcaaaaagagcggctgg

SEQ ID NO: 316246 - DNA, 20 bp, human
gagaatatctgactctagca

SEQ ID NO: 316247 - DNA, 20 bp, human
gccccctccacgcctatcaa

SEQ ID NO: 316248 - DNA, 20 bp, human
gcttacccactagacataga

SEQ ID NO: 316249 - DNA, 20 bp, human
ggacatagcgaagagaaaga

SEQ ID NO: 316250 - DNA, 20 bp, human
gctgtgccttctatgtctag

SEQ ID NO: 316251 - DNA, 20 bp, human
gggcgtggaggggggtttcg

SEQ ID NO: 316252 - DNA, 20 bp, human
gtgtcagaactccatggcgc

SEQ ID NO: 316253 - DNA, 20 bp, human
gcaggcacttctgtctttta

SEQ ID NO: 316254 - DNA, 20 bp, human
gtatgactttcactgactac

SEQ ID NO: 316255 - DNA, 20 bp, human
gagaactccatggcgcaggg

SEQ ID NO: 316256 - DNA, 20 bp, human
ggggacgctagattgccaag

SEQ ID NO: 316257 - DNA, 20 bp, human
gtaaaagagcccttggaatg

SEQ ID NO: 316258 - DNA, 20 bp, human
gtgatctgaaagagtcaagc

SEQ ID NO: 316259 - DNA, 20 bp, human
gtatgtggataaatctccta

SEQ ID NO: 316260 - DNA, 20 bp, human
gcgagggaagccaggtatcc

SEQ ID NO: 316261 - DNA, 20 bp, human
gagctggtggataaaggcag

SEQ ID NO: 316262 - DNA, 20 bp, human
ggagtcaagctggtggataa

SEQ ID NO: 316263 - DNA, 20 bp, human
gtaagtcaaaaggaattgtt

SEQ ID NO: 316264 - DNA, 20 bp, human
gttccctcggaacttctttt

SEQ ID NO: 316265 - DNA, 20 bp, human
gcgagtcagcctcattccaa

SEQ ID NO: 316266 - DNA, 20 bp, human
gcgcagaatgtcaggagctt

SEQ ID NO: 316267 - DNA, 20 bp, human
gtgcggtcggaaaatggtga

SEQ ID NO: 316268 - DNA, 20 bp, human
gtgtggaagaagctggttct

SEQ ID NO: 316269 - DNA, 20 bp, human
gcggtgctccctcccctgat

SEQ ID NO: 316270 - DNA, 20 bp, human
ggctccctcccctgatggga

SEQ ID NO: 316271 - DNA, 20 bp, human
ggctcctgacattctgcggt

SEQ ID NO: 316272 - DNA, 20 bp, human
ggcaacgacaaagatacgtg

SEQ ID NO: 316273 - DNA, 20 bp, human
gcggccccaagttcagagaa

SEQ ID NO: 316274 - DNA, 20 bp, human
ggggcaccaaggactgaagt

SEQ ID NO: 316275 - DNA, 20 bp, human
gaggggctcacgccgcgttc

SEQ ID NO: 316276 - DNA, 20 bp, human
gaacaaggtattcttattgt

SEQ ID NO: 316277 - DNA, 20 bp, human
gcttgagttgaccctggcca

SEQ ID NO: 316278 - DNA, 20 bp, human
gcagctcgaggccaagatca

SEQ ID NO: 316279 - DNA, 20 bp, human
ggatgaccttgagttgaccc

SEQ ID NO: 316280 - DNA, 20 bp, human
gaccttactgaggaactctc

SEQ ID NO: 316281 - DNA, 20 bp, human
gttggcctcgagctggaatt

SEQ ID NO: 316282 - DNA, 20 bp, human
ggaaaatttgttggatgctg

SEQ ID NO: 316283 - DNA, 20 bp, human
gaaagccaaattccagctcg

SEQ ID NO: 316284 - DNA, 20 bp, human
gttgcttgcgaattcttctt

SEQ ID NO: 316285 - DNA, 20 bp, human
gaacttcgttgaatgatata

SEQ ID NO: 316286 - DNA, 20 bp, human
ggcacaatattcactgactg

SEQ ID NO: 316287 - DNA, 20 bp, human
gaatgatgcaacagccaaac

SEQ ID NO: 316288 - DNA, 20 bp, human
gcccataaataatttaacag

SEQ ID NO: 316289 - DNA, 20 bp, human
gagaggagtaagtgggaatc

SEQ ID NO: 316290 - DNA, 20 bp, human
gttcccagctaggacagctg

SEQ ID NO: 316291 - DNA, 20 bp, human
gtataggcagaggagtaagt

SEQ ID NO: 316292 - DNA, 20 bp, human
gtaggcatttgataggggat

SEQ ID NO: 316293 - DNA, 20 bp, human
gtttaacagaggatgatcta

SEQ ID NO: 316294 - DNA, 20 bp, human
gtctttataggcatttgata

SEQ ID NO: 316295 - DNA, 20 bp, human
gatgatctagggttctttat

SEQ ID NO: 316296 - DNA, 20 bp, human
gagagccaaaggatcaaagg

SEQ ID NO: 316297 - DNA, 20 bp, human
gtccagagccaaaggatcaa

SEQ ID NO: 316298 - DNA, 20 bp, human
gtgggagaggcggtgtgaga

SEQ ID NO: 316299 - DNA, 20 bp, human
gggggcagcagacctttctt

SEQ ID NO: 316300 - DNA, 20 bp, human
ggggctgatgagcagatagt

SEQ ID NO: 316301 - DNA, 20 bp, human
ggtgcccaaggactaaaaaa

SEQ ID NO: 316302 - DNA, 20 bp, human
gaggaaagcccatggttggg

SEQ ID NO: 316303 - DNA, 20 bp, human
gcatcagccctttgaagggg

SEQ ID NO: 316304 - DNA, 20 bp, human
ggccaaaggatcaaaggagg

SEQ ID NO: 316305 - DNA, 20 bp, human
ggcacattcctccccttcaa

SEQ ID NO: 316306 - DNA, 20 bp, human
gagaagcagagccctgagta

SEQ ID NO: 316307 - DNA, 20 bp, human
gcagagccctgagtagggga

SEQ ID NO: 316308 - DNA, 20 bp, human
gcccctgggtcagagacagg

SEQ ID NO: 316309 - DNA, 20 bp, human
ggaggagaggagcgggggta

SEQ ID NO: 316310 - DNA, 20 bp, human
gccctcctgtctctgaccca

SEQ ID NO: 316311 - DNA, 20 bp, human
ggccccaaagtcagccatct

SEQ ID NO: 316312 - DNA, 20 bp, human
gaacagcaggtgcctctccc

SEQ ID NO: 316313 - DNA, 20 bp, human
gttgcaccctcccctactca

SEQ ID NO: 316314 - DNA, 20 bp, human
gagaggacaaagccactcgc

SEQ ID NO: 316315 - DNA, 20 bp, human
gctgaaggacaatctctgta

SEQ ID NO: 316316 - DNA, 20 bp, human
gaggggagcactgtttggga

SEQ ID NO: 316317 - DNA, 20 bp, human
gttatggcatggactgtgca

SEQ ID NO: 316318 - DNA, 20 bp, human
gagggcacccccacccccaa

SEQ ID NO: 316319 - DNA, 20 bp, human
gggggaggggagcactgttt

SEQ ID NO: 316320 - DNA, 20 bp, human
gctctcccgcagggcacttc

SEQ ID NO: 316321 - DNA, 20 bp, human
gtctccagctaggaaacaat

SEQ ID NO: 316322 - DNA, 20 bp, human
gtccctagccggatttagaa

SEQ ID NO: 316323 - DNA, 20 bp, human
gctgccagctgtggaatgtg

SEQ ID NO: 316324 - DNA, 20 bp, human
gtgcagcaaaaatatctccc

SEQ ID NO: 316325 - DNA, 20 bp, human
gagctgtggaatgtgaggcc

SEQ ID NO: 316326 - DNA, 20 bp, human
gagatggtggggattacctt

SEQ ID NO: 316327 - DNA, 20 bp, human
gaagggtaacagcctagaaa

SEQ ID NO: 316328 - DNA, 20 bp, human
gctagaaaaggattgcaggg

SEQ ID NO: 316329 - DNA, 20 bp, human
gagcctagaaaaggattgca

SEQ ID NO: 316330 - DNA, 20 bp, human
gggtggggattaccttagga

SEQ ID NO: 316331 - DNA, 20 bp, human
ggctagatgttccactggga

SEQ ID NO: 316332 - DNA, 20 bp, human
gtacgagggaaagagatggt

SEQ ID NO: 316333 - DNA, 20 bp, human
gggaggaaatgagggacgag

SEQ ID NO: 316334 - DNA, 20 bp, human
gacaacaggaaaagcatcag

SEQ ID NO: 316335 - DNA, 20 bp, human
gtaggctgttacccttccta

SEQ ID NO: 316336 - DNA, 20 bp, human
gagcctgggtagcggcgcga

SEQ ID NO: 316337 - DNA, 20 bp, human
ggggccgggagaaccgttcg

SEQ ID NO: 316338 - DNA, 20 bp, human
gcggccacggcggccggcat

SEQ ID NO: 316339 - DNA, 20 bp, human
ggcggtcagcgcaagcgcac

SEQ ID NO: 316340 - DNA, 20 bp, human
ggcaactagtgtctagtgag

SEQ ID NO: 316341 - DNA, 20 bp, human
gagaaccgttcgcggaggaa

SEQ ID NO: 316342 - DNA, 20 bp, human
gccgggagaaccgttcgcgg

SEQ ID NO: 316343 - DNA, 20 bp, human
gtgcgctgaccgccccggct

SEQ ID NO: 316344 - DNA, 20 bp, human
gcgccgctacccaggctcag

SEQ ID NO: 316345 - DNA, 20 bp, human
gcaagagattggaattccgg

SEQ ID NO: 316346 - DNA, 20 bp, human
gtcactacaaactatgctga

SEQ ID NO: 316347 - DNA, 20 bp, human
gactagaaagcattctctgc

SEQ ID NO: 316348 - DNA, 20 bp, human
gcccaagggaatgcagtggg

SEQ ID NO: 316349 - DNA, 20 bp, human
gccccgggtatctgatcatt

SEQ ID NO: 316350 - DNA, 20 bp, human
ggcccaatggtggagactca

SEQ ID NO: 316351 - DNA, 20 bp, human
gccggggcacacggctgtca

SEQ ID NO: 316352 - DNA, 20 bp, human
gcaagagtgagcatctgtag

SEQ ID NO: 316353 - DNA, 20 bp, human
gtggcccaagggaatgcagt

SEQ ID NO: 316354 - DNA, 20 bp, human
gtgagtgggcactggcccaa

SEQ ID NO: 316355 - DNA, 20 bp, human
gatgcagtggggggttcccg

SEQ ID NO: 316356 - DNA, 20 bp, human
gaggccctgcgggagccgac

SEQ ID NO: 316357 - DNA, 20 bp, human
gggagcctctgcggccagat

SEQ ID NO: 316358 - DNA, 20 bp, human
gcccagccgggagccggctc

SEQ ID NO: 316359 - DNA, 20 bp, human
gggacccgccctagagggcg

SEQ ID NO: 316360 - DNA, 20 bp, human
gccttgatgggcagacgtat

SEQ ID NO: 316361 - DNA, 20 bp, human
gccggctgggaatggtcccg

SEQ ID NO: 316362 - DNA, 20 bp, human
gctcccgcctaggaagcgcg

SEQ ID NO: 316363 - DNA, 20 bp, human
gcagtgggtgtagcaggaag

SEQ ID NO: 316364 - DNA, 20 bp, human
gttcccccgcgcttcctagg

SEQ ID NO: 316365 - DNA, 20 bp, human
gggagccccgccctctaggg

SEQ ID NO: 316366 - DNA, 20 bp, human
ggtagacagccatagtgaga

SEQ ID NO: 316367 - DNA, 20 bp, human
ggcaggcttccatctcacta

SEQ ID NO: 316368 - DNA, 20 bp, human
ggctgtctactccaaggttc

SEQ ID NO: 316369 - DNA, 20 bp, human
gcatctaaaaatagctctca

SEQ ID NO: 316370 - DNA, 20 bp, human
gaagcctgccggtactttta

SEQ ID NO: 316371 - DNA, 20 bp, human
gaagaactctccaaggggtg

SEQ ID NO: 316372 - DNA, 20 bp, human
gagaccataaaagtaccggc

SEQ ID NO: 316373 - DNA, 20 bp, human
gaaagctaaagaactctcca

SEQ ID NO: 316374 - DNA, 20 bp, human
gtccactgtcatcaagagaa

SEQ ID NO: 316375 - DNA, 20 bp, human
gtgacctcacagctagcatc

SEQ ID NO: 316376 - DNA, 20 bp, human
gaaaaccctgagaccccagt

SEQ ID NO: 316377 - DNA, 20 bp, human
gacaaatgcccaggggaatt

SEQ ID NO: 316378 - DNA, 20 bp, human
gtgcccaggggaatttggct

SEQ ID NO: 316379 - DNA, 20 bp, human
gcgacagcactggcagatgc

SEQ ID NO: 316380 - DNA, 20 bp, human
gccccagtgggtacacacac

SEQ ID NO: 316381 - DNA, 20 bp, human
gctgaataacacaaatgccc

SEQ ID NO: 316382 - DNA, 20 bp, human
ggtgttattcagccagtcga

SEQ ID NO: 316383 - DNA, 20 bp, human
gatccccagccaaattcccc

SEQ ID NO: 316384 - DNA, 20 bp, human
ggatttttcccctgaagtca

SEQ ID NO: 316385 - DNA, 20 bp, human
gtcataggcacaggatgggc

SEQ ID NO: 316386 - DNA, 20 bp, human
gcacggaggggcgacagaga

SEQ ID NO: 316387 - DNA, 20 bp, human
gtgcctggccgcacattcca

SEQ ID NO: 316388 - DNA, 20 bp, human
ggggcgagggtcagtcacgt

SEQ ID NO: 316389 - DNA, 20 bp, human
gtgagaaggaagtgtaaagt

SEQ ID NO: 316390 - DNA, 20 bp, human
gccacgcccgctgaccacac

SEQ ID NO: 316391 - DNA, 20 bp, human
gccactctgcgggccaagaa

SEQ ID NO: 316392 - DNA, 20 bp, human
gcgggccaagaaaggtgacc

SEQ ID NO: 316393 - DNA, 20 bp, human
gtgggtctgacttcacggag

SEQ ID NO: 316394 - DNA, 20 bp, human
gcatctgcggaaaggatagg

SEQ ID NO: 316395 - DNA, 20 bp, human
gtgcggaaaggatagggggg

SEQ ID NO: 316396 - DNA, 20 bp, human
gtggagtgctgagatctagg

SEQ ID NO: 316397 - DNA, 20 bp, human
gacatcggaaacacattctt

SEQ ID NO: 316398 - DNA, 20 bp, human
gcacattcttagggtcactt

SEQ ID NO: 316399 - DNA, 20 bp, human
gcatacggtgctgtattgga

SEQ ID NO: 316400 - DNA, 20 bp, human
gtactgatttcactctgacc

SEQ ID NO: 316401 - DNA, 20 bp, human
gttccaagcaggtctaaaat

SEQ ID NO: 316402 - DNA, 20 bp, human
gtggcaaaacactatgccat

SEQ ID NO: 316403 - DNA, 20 bp, human
gctttggagtgctgagatct

SEQ ID NO: 316404 - DNA, 20 bp, human
gttgccatacggtgctgtat

SEQ ID NO: 316405 - DNA, 20 bp, human
ggagttatattcttccaagc

SEQ ID NO: 316406 - DNA, 20 bp, human
ggcgggaccaagtggaacgg

SEQ ID NO: 316407 - DNA, 20 bp, human
gcgggcccaggaatgcggaa

SEQ ID NO: 316408 - DNA, 20 bp, human
ggcaggccgcgatatcgcag

SEQ ID NO: 316409 - DNA, 20 bp, human
gggtctgcgtgtccgccgag

SEQ ID NO: 316410 - DNA, 20 bp, human
gcggatcggagcaggccgga

SEQ ID NO: 316411 - DNA, 20 bp, human
gggagctaccaaaggagcgg

SEQ ID NO: 316412 - DNA, 20 bp, human
ggcggcgggaccaagtggaa

SEQ ID NO: 316413 - DNA, 20 bp, human
gccaaaggagcgggggacga

SEQ ID NO: 316414 - DNA, 20 bp, human
gtatcgcagcggatcggagc

SEQ ID NO: 316415 - DNA, 20 bp, human
ggcccaggaatgcggaaggg

SEQ ID NO: 316416 - DNA, 20 bp, human
ggtagctgggtcatggtcac

SEQ ID NO: 316417 - DNA, 20 bp, human
ggtgaggcgggcaccaccta

SEQ ID NO: 316418 - DNA, 20 bp, human
gcagaagaacggcatggggt

SEQ ID NO: 316419 - DNA, 20 bp, human
gcgttcttctgaagtaaggg

SEQ ID NO: 316420 - DNA, 20 bp, human
gcacctgtgtgccctctacc

SEQ ID NO: 316421 - DNA, 20 bp, human
gagggtggctcactcgccac

SEQ ID NO: 316422 - DNA, 20 bp, human
gtacttcagaagaacggcat

SEQ ID NO: 316423 - DNA, 20 bp, human
gctctgcggtgcttgggccg

SEQ ID NO: 316424 - DNA, 20 bp, human
ggggctcacgtgtcacccag

SEQ ID NO: 316425 - DNA, 20 bp, human
ggaccgcttttggcagtcat

SEQ ID NO: 316426 - DNA, 20 bp, human
ggggtacagcatccacactc

SEQ ID NO: 316427 - DNA, 20 bp, human
gtaggtcaggcccctactct

SEQ ID NO: 316428 - DNA, 20 bp, human
gcactggtaccagagggctc

SEQ ID NO: 316429 - DNA, 20 bp, human
gtccaaacggtgatgctgga

SEQ ID NO: 316430 - DNA, 20 bp, human
gtgtgttcatctctgttgca

SEQ ID NO: 316431 - DNA, 20 bp, human
gggagtcaaaaaactaggtc

SEQ ID NO: 316432 - DNA, 20 bp, human
gtggagcaagggaaaattgt

SEQ ID NO: 316433 - DNA, 20 bp, human
ggatgaacacacccagagta

SEQ ID NO: 316434 - DNA, 20 bp, human
gtccctccagcatcaccgtt

SEQ ID NO: 316435 - DNA, 20 bp, human
gccgtttggagacctgagtg

SEQ ID NO: 316436 - DNA, 20 bp, human
gaggcttaggggctattttg

SEQ ID NO: 316437 - DNA, 20 bp, human
gcctggggagggcattgttc

SEQ ID NO: 316438 - DNA, 20 bp, human
gcaggctcaggaatgggtag

SEQ ID NO: 316439 - DNA, 20 bp, human
ggagggcattgttcaggctc

SEQ ID NO: 316440 - DNA, 20 bp, human
gaggtatccgggcaggataa

SEQ ID NO: 316441 - DNA, 20 bp, human
ggccctgtgtgggtatgtgc

SEQ ID NO: 316442 - DNA, 20 bp, human
ggctggggtcatgaggtatc

SEQ ID NO: 316443 - DNA, 20 bp, human
ggctcaggaatgggtagtgg

SEQ ID NO: 316444 - DNA, 20 bp, human
gttcccaacaggtgattggg

SEQ ID NO: 316445 - DNA, 20 bp, human
gtgttggggccagaaggact

SEQ ID NO: 316446 - DNA, 20 bp, human
gactcccccgggttccgagg

SEQ ID NO: 316447 - DNA, 20 bp, human
gcgcgccgaggggaagtggc

SEQ ID NO: 316448 - DNA, 20 bp, human
ggggacttcatggagctctc

SEQ ID NO: 316449 - DNA, 20 bp, human
gaggggagcggcagacgccg

SEQ ID NO: 316450 - DNA, 20 bp, human
ggaagtggccggagtcgggg

SEQ ID NO: 316451 - DNA, 20 bp, human
gggcgcgctcggagtaagtc

SEQ ID NO: 316452 - DNA, 20 bp, human
gtccccccggggccgcggac

SEQ ID NO: 316453 - DNA, 20 bp, human
gaggggaagtggccggagtc

SEQ ID NO: 316454 - DNA, 20 bp, human
gtcggagtaagtcggggctg

SEQ ID NO: 316455 - DNA, 20 bp, human
gcccgccttgccatggatgt

SEQ ID NO: 316456 - DNA, 20 bp, human
gcctagaggcccaactctcc

SEQ ID NO: 316457 - DNA, 20 bp, human
ggggctgcctctgctcggga

SEQ ID NO: 316458 - DNA, 20 bp, human
gctcacacaaagcccagggg

SEQ ID NO: 316459 - DNA, 20 bp, human
gtgctccggcatatttgaga

SEQ ID NO: 316460 - DNA, 20 bp, human
gctctcttcacctctaggac

SEQ ID NO: 316461 - DNA, 20 bp, human
gtcaagtcagctcatctctc

SEQ ID NO: 316462 - DNA, 20 bp, human
gagagagctgtggcatgaag

SEQ ID NO: 316463 - DNA, 20 bp, human
ggggctggtggccccaaacc

SEQ ID NO: 316464 - DNA, 20 bp, human
gggctcctgcccaggataaa

SEQ ID NO: 316465 - DNA, 20 bp, human
gtggaaacccagaaggacca

SEQ ID NO: 316466 - DNA, 20 bp, human
gggggcgcgcagtcaccctt

SEQ ID NO: 316467 - DNA, 20 bp, human
gcgcacgcgcacaaaggctg

SEQ ID NO: 316468 - DNA, 20 bp, human
gcgcgccccctggcgaccga

SEQ ID NO: 316469 - DNA, 20 bp, human
gcgcacgcatgcgccgtcag

SEQ ID NO: 316470 - DNA, 20 bp, human
gggagtgcgcggaggatcat

SEQ ID NO: 316471 - DNA, 20 bp, human
gccgtcagcggcgagagagc

SEQ ID NO: 316472 - DNA, 20 bp, human
gtcacccttcggtcgccagg

SEQ ID NO: 316473 - DNA, 20 bp, human
gcaagccagcaaagccttgg

SEQ ID NO: 316474 - DNA, 20 bp, human
ggcggcggtgacgtcacgtg

SEQ ID NO: 316475 - DNA, 20 bp, human
gacaaaggctggggagtgcg

SEQ ID NO: 316476 - DNA, 20 bp, human
gcggaggtggggggggtcgt

SEQ ID NO: 316477 - DNA, 20 bp, human
ggggcacagaacccgctcgg

SEQ ID NO: 316478 - DNA, 20 bp, human
gaccccccccacctccgagc

SEQ ID NO: 316479 - DNA, 20 bp, human
gaacccgctcggaggtgggg

SEQ ID NO: 316480 - DNA, 20 bp, human
gcacagaacccgctcggagg

SEQ ID NO: 316481 - DNA, 20 bp, human
ggctacattagtaatgactt

SEQ ID NO: 316482 - DNA, 20 bp, human
ggagcagcgggagacgggga

SEQ ID NO: 316483 - DNA, 20 bp, human
gcccaggccacggttcctat

SEQ ID NO: 316484 - DNA, 20 bp, human
gacgtactaagactagggtt

SEQ ID NO: 316485 - DNA, 20 bp, human
gcctctgagggtgacgtcat

SEQ ID NO: 316486 - DNA, 20 bp, human
gggcttccggcccatggcgg

SEQ ID NO: 316487 - DNA, 20 bp, human
gagtcaccaaccaccgccat

SEQ ID NO: 316488 - DNA, 20 bp, human
ggcagttgacgcgagggcgg

SEQ ID NO: 316489 - DNA, 20 bp, human
gcgcggggaactacgactcc

SEQ ID NO: 316490 - DNA, 20 bp, human
gtcaactgcaatctagagcg

SEQ ID NO: 316491 - DNA, 20 bp, human
gacgcgagggcggtggcttc

SEQ ID NO: 316492 - DNA, 20 bp, human
gcccgccagggttaagtagg

SEQ ID NO: 316493 - DNA, 20 bp, human
gagggtttttagggttgggg

SEQ ID NO: 316494 - DNA, 20 bp, human
gctagattgcagttgacgcg

SEQ ID NO: 316495 - DNA, 20 bp, human
gccaccggaattaacccttc

SEQ ID NO: 316496 - DNA, 20 bp, human
gcaccctaggtcctgatgaa

SEQ ID NO: 316497 - DNA, 20 bp, human
ggatcccttcatcaggacct

SEQ ID NO: 316498 - DNA, 20 bp, human
gagggcagtgtgtagttctg

SEQ ID NO: 316499 - DNA, 20 bp, human
gtcaaagctctcaccaccct

SEQ ID NO: 316500 - DNA, 20 bp, human
gtccaggcagacattgtgtc

SEQ ID NO: 316501 - DNA, 20 bp, human
gttacacgttgaggacatga

SEQ ID NO: 316502 - DNA, 20 bp, human
gggtcagatacaggagtaac

SEQ ID NO: 316503 - DNA, 20 bp, human
gtggggcatgaggtgcacac

SEQ ID NO: 316504 - DNA, 20 bp, human
gtcacctgaaggtccaaata

SEQ ID NO: 316505 - DNA, 20 bp, human
gcaaataaggagaggaacag

SEQ ID NO: 316506 - DNA, 20 bp, human
gcctgccagcccgtgggtcg

SEQ ID NO: 316507 - DNA, 20 bp, human
gggtcgaggccaaataaggc

SEQ ID NO: 316508 - DNA, 20 bp, human
gcgtgggtcgaggccaaata

SEQ ID NO: 316509 - DNA, 20 bp, human
gcgggctggcacagcaagga

SEQ ID NO: 316510 - DNA, 20 bp, human
gaaggccggacggcagccga

SEQ ID NO: 316511 - DNA, 20 bp, human
ggctgccgtccggccttatt

SEQ ID NO: 316512 - DNA, 20 bp, human
gaggggaagctgcactccca

SEQ ID NO: 316513 - DNA, 20 bp, human
gttggcctcgacccacgggc

SEQ ID NO: 316514 - DNA, 20 bp, human
ggggtctggactccaggcgg

SEQ ID NO: 316515 - DNA, 20 bp, human
gcacagagggccttgtaggg

SEQ ID NO: 316516 - DNA, 20 bp, human
gaaactcagccggctctggg

SEQ ID NO: 316517 - DNA, 20 bp, human
gggtcgaggggcgccgctat

SEQ ID NO: 316518 - DNA, 20 bp, human
ggcgccgagtgctgcgggaa

SEQ ID NO: 316519 - DNA, 20 bp, human
gccgcccgatcagccaatag

SEQ ID NO: 316520 - DNA, 20 bp, human
ggccccgcccccttcagctc

SEQ ID NO: 316521 - DNA, 20 bp, human
gatcgcccggggctccaggc

SEQ ID NO: 316522 - DNA, 20 bp, human
gaggcggctggtgtgttccg

SEQ ID NO: 316523 - DNA, 20 bp, human
gggcgccgctattggctgat

SEQ ID NO: 316524 - DNA, 20 bp, human
ggtcgcccagcggacagagg

SEQ ID NO: 316525 - DNA, 20 bp, human
gggcggggacccgagctgaa

SEQ ID NO: 316526 - DNA, 20 bp, human
gcgggtgggcgtggcgggaa

SEQ ID NO: 316527 - DNA, 20 bp, human
gcggtgcaggataagtgcga

SEQ ID NO: 316528 - DNA, 20 bp, human
gtctgcctcggagtccggag

SEQ ID NO: 316529 - DNA, 20 bp, human
gtgcgaggagttaactgggg

SEQ ID NO: 316530 - DNA, 20 bp, human
gctggcgctaggtttggctg

SEQ ID NO: 316531 - DNA, 20 bp, human
gcgccttctgcctcggagtc

SEQ ID NO: 316532 - DNA, 20 bp, human
gcaaacctagcgccagaccc

SEQ ID NO: 316533 - DNA, 20 bp, human
gtgcaggataagtgcgaggg

SEQ ID NO: 316534 - DNA, 20 bp, human
ggcccacccgccttctgcct

SEQ ID NO: 316535 - DNA, 20 bp, human
ggcctgcgaggagttaactg

SEQ ID NO: 316536 - DNA, 20 bp, human
ggggaagctggggacaagaa

SEQ ID NO: 316537 - DNA, 20 bp, human
ggacacacctgatgcctgaa

SEQ ID NO: 316538 - DNA, 20 bp, human
gggaaccggagtgtttgtct

SEQ ID NO: 316539 - DNA, 20 bp, human
gctgcctcctcaaaaccctg

SEQ ID NO: 316540 - DNA, 20 bp, human
gccatcccagacaaacactc

SEQ ID NO: 316541 - DNA, 20 bp, human
gtccccacagggttttgagg

SEQ ID NO: 316542 - DNA, 20 bp, human
gggaccctgggtgaggtaaa

SEQ ID NO: 316543 - DNA, 20 bp, human
gtggaggtgtggcttttacg

SEQ ID NO: 316544 - DNA, 20 bp, human
ggaaggggtcagtgaaaaga

SEQ ID NO: 316545 - DNA, 20 bp, human
ggtggacactgacctaactg

SEQ ID NO: 316546 - DNA, 20 bp, human
gcttcccatggcccgactgg

SEQ ID NO: 316547 - DNA, 20 bp, human
gctccccccagtcgggccat

SEQ ID NO: 316548 - DNA, 20 bp, human
gctgacttggacaggatcag

SEQ ID NO: 316549 - DNA, 20 bp, human
gcaagcaggtccagatgtcg

SEQ ID NO: 316550 - DNA, 20 bp, human
gggacacggcattcttccca

SEQ ID NO: 316551 - DNA, 20 bp, human
ggaacaagcgagaaaaggga

SEQ ID NO: 316552 - DNA, 20 bp, human
ggagaaaagggaggggtatc

SEQ ID NO: 316553 - DNA, 20 bp, human
gggtgtgggcagtggaggcg

SEQ ID NO: 316554 - DNA, 20 bp, human
ggaggggtatctgggacgct

SEQ ID NO: 316555 - DNA, 20 bp, human
ggaagggcaagagtatgccc

SEQ ID NO: 316556 - DNA, 20 bp, human
ggacaggccgaggtcagccc

SEQ ID NO: 316557 - DNA, 20 bp, human
gggcaggtgccgttctccaa

SEQ ID NO: 316558 - DNA, 20 bp, human
gtcactcacaggcccgtgta

SEQ ID NO: 316559 - DNA, 20 bp, human
gacctcggcctgtcactcac

SEQ ID NO: 316560 - DNA, 20 bp, human
gataagcaaagcaaaggcac

SEQ ID NO: 316561 - DNA, 20 bp, human
ggcccaggcccttctccttg

SEQ ID NO: 316562 - DNA, 20 bp, human
gtggggcccctttgacatca

SEQ ID NO: 316563 - DNA, 20 bp, human
gaggagggatcccagggcgg

SEQ ID NO: 316564 - DNA, 20 bp, human
gggcggaggaaggtccttag

SEQ ID NO: 316565 - DNA, 20 bp, human
gtcacaggcccgtgtagggt

SEQ ID NO: 316566 - DNA, 20 bp, human
gagggccccgggccagattc

SEQ ID NO: 316567 - DNA, 20 bp, human
gctgccctgaatctggcccg

SEQ ID NO: 316568 - DNA, 20 bp, human
gggctccctggaaacctaag

SEQ ID NO: 316569 - DNA, 20 bp, human
gtggagctgggcgaacaaat

SEQ ID NO: 316570 - DNA, 20 bp, human
gcagctgacacacgccactt

SEQ ID NO: 316571 - DNA, 20 bp, human
gcatcagccgtgcgtgagtg

SEQ ID NO: 316572 - DNA, 20 bp, human
gccagggaaacaatggtcta

SEQ ID NO: 316573 - DNA, 20 bp, human
gagctgtccccactcacgca

SEQ ID NO: 316574 - DNA, 20 bp, human
gcacgccacttaggtttcca

SEQ ID NO: 316575 - DNA, 20 bp, human
ggctaaatgcggtgcagtca

SEQ ID NO: 316576 - DNA, 20 bp, human
gtattgacacaatgatacga

SEQ ID NO: 316577 - DNA, 20 bp, human
gtaagatgggcaaacagagg

SEQ ID NO: 316578 - DNA, 20 bp, human
ggaggatgaaccgggaacac

SEQ ID NO: 316579 - DNA, 20 bp, human
gtgaaaggggcagaaggtcc

SEQ ID NO: 316580 - DNA, 20 bp, human
gaggtaaggagaggatgaac

SEQ ID NO: 316581 - DNA, 20 bp, human
gcttccccatctgactaaga

SEQ ID NO: 316582 - DNA, 20 bp, human
gacacaatgatacgagggaa

SEQ ID NO: 316583 - DNA, 20 bp, human
gtatgctcaaagcgtaagat

SEQ ID NO: 316584 - DNA, 20 bp, human
gacaaagctagatttgtcct

SEQ ID NO: 316585 - DNA, 20 bp, human
ggccaatggctccatttcag

SEQ ID NO: 316586 - DNA, 20 bp, human
gagggcctctcctttcttgg

SEQ ID NO: 316587 - DNA, 20 bp, human
gtgcgatgcatgtctcacta

SEQ ID NO: 316588 - DNA, 20 bp, human
gcactcaggggtacaggatc

SEQ ID NO: 316589 - DNA, 20 bp, human
ggaaaggagaggccctgagt

SEQ ID NO: 316590 - DNA, 20 bp, human
gcaacccaaggcatcattct

SEQ ID NO: 316591 - DNA, 20 bp, human
ggtgggcacccgcagggcta

SEQ ID NO: 316592 - DNA, 20 bp, human
gcgcagggctaaggttacct

SEQ ID NO: 316593 - DNA, 20 bp, human
gaccaaaatagcccaactca

SEQ ID NO: 316594 - DNA, 20 bp, human
gtctggggtgggcacccgca

SEQ ID NO: 316595 - DNA, 20 bp, human
gggaatgtgccagagtttag

SEQ ID NO: 316596 - DNA, 20 bp, human
gcccaaggaaggggagactc

SEQ ID NO: 316597 - DNA, 20 bp, human
ggctcagaggagctaggctc

SEQ ID NO: 316598 - DNA, 20 bp, human
ggcaaagaggtcccaaggaa

SEQ ID NO: 316599 - DNA, 20 bp, human
gagccacagacgggaatttg

SEQ ID NO: 316600 - DNA, 20 bp, human
gaggaagcttccacccattg

SEQ ID NO: 316601 - DNA, 20 bp, human
gaccctccaggcacccaaga

SEQ ID NO: 316602 - DNA, 20 bp, human
gaaaagtagaggctcaaaca

SEQ ID NO: 316603 - DNA, 20 bp, human
gagggtgagggttgaacaaa

SEQ ID NO: 316604 - DNA, 20 bp, human
gctcaaacagggcaaatgag

SEQ ID NO: 316605 - DNA, 20 bp, human
gaagcttccacccattgtgg

SEQ ID NO: 316606 - DNA, 20 bp, human
ggctggggagtgggtctctg

SEQ ID NO: 316607 - DNA, 20 bp, human
gccctggcatgctggggagt

SEQ ID NO: 316608 - DNA, 20 bp, human
ggtgctgtgctgccgggcct

SEQ ID NO: 316609 - DNA, 20 bp, human
ggaacctcccgcactgccac

SEQ ID NO: 316610 - DNA, 20 bp, human
ggacgtgacgccaccgtgga

SEQ ID NO: 316611 - DNA, 20 bp, human
gatgacgcctgctgcttcgg

SEQ ID NO: 316612 - DNA, 20 bp, human
gcaccgtggaaggaagggag

SEQ ID NO: 316613 - DNA, 20 bp, human
gcccggcagcacagcaccgc

SEQ ID NO: 316614 - DNA, 20 bp, human
ggcgccggccagggcggtac

SEQ ID NO: 316615 - DNA, 20 bp, human
gacccactccccagcatgcc

SEQ ID NO: 316616 - DNA, 20 bp, human
ggctgcttcgggcttagagt

SEQ ID NO: 316617 - DNA, 20 bp, human
gagacggtgtggttggcgga

SEQ ID NO: 316618 - DNA, 20 bp, human
ggcagccgcaggctcgttag

SEQ ID NO: 316619 - DNA, 20 bp, human
gggccccgccctcccgctcg

SEQ ID NO: 316620 - DNA, 20 bp, human
gaacgagcctgcggctgctt

SEQ ID NO: 316621 - DNA, 20 bp, human
gcggggcctggtcgggaagg

SEQ ID NO: 316622 - DNA, 20 bp, human
gtcgctgggctgtagtcccg

SEQ ID NO: 316623 - DNA, 20 bp, human
gcccctccccacgcctacgt

SEQ ID NO: 316624 - DNA, 20 bp, human
gtagtcccgcgggcgagagc

SEQ ID NO: 316625 - DNA, 20 bp, human
ggggtccgctaacgagcctg

SEQ ID NO: 316626 - DNA, 20 bp, human
ggacctctgagcagcgggga

SEQ ID NO: 316627 - DNA, 20 bp, human
gccccgctggagtgtggagc

SEQ ID NO: 316628 - DNA, 20 bp, human
gggaggggtagagttcccgg

SEQ ID NO: 316629 - DNA, 20 bp, human
gcagctctccaggctgttcg

SEQ ID NO: 316630 - DNA, 20 bp, human
gccaccacgccgaccgcctg

SEQ ID NO: 316631 - DNA, 20 bp, human
gctgctgcatccatctcaaa

SEQ ID NO: 316632 - DNA, 20 bp, human
gctcgggccccgctggagtg

SEQ ID NO: 316633 - DNA, 20 bp, human
gaaaggagtgagcagctgac

SEQ ID NO: 316634 - DNA, 20 bp, human
ggacagcagaacactgtggg

SEQ ID NO: 316635 - DNA, 20 bp, human
ggcggtcggcgtggtgggct

SEQ ID NO: 316636 - DNA, 20 bp, human
gggacagcagccaaccgctg

SEQ ID NO: 316637 - DNA, 20 bp, human
gccgctgtgggctgaatttg

SEQ ID NO: 316638 - DNA, 20 bp, human
gccagaaaacacatcagctc

SEQ ID NO: 316639 - DNA, 20 bp, human
gccagctctccagtcataaa

SEQ ID NO: 316640 - DNA, 20 bp, human
gctcccagcaggtggagagg

SEQ ID NO: 316641 - DNA, 20 bp, human
ggctgctgtccttttatgac

SEQ ID NO: 316642 - DNA, 20 bp, human
gggaagccttagcctgctca

SEQ ID NO: 316643 - DNA, 20 bp, human
gagccccctctccacctgct

SEQ ID NO: 316644 - DNA, 20 bp, human
gaaggatcagaggctgctta

SEQ ID NO: 316645 - DNA, 20 bp, human
gctgtcaaaacactcccagc

SEQ ID NO: 316646 - DNA, 20 bp, human
ggggatggattgaaagaaac

SEQ ID NO: 316647 - DNA, 20 bp, human
gacacagtgatgaaatctgg

SEQ ID NO: 316648 - DNA, 20 bp, human
gctgtggtgcacacttatag

SEQ ID NO: 316649 - DNA, 20 bp, human
gttatagtggttataataat

SEQ ID NO: 316650 - DNA, 20 bp, human
gcaaagccctttttatagat

SEQ ID NO: 316651 - DNA, 20 bp, human
ggatgaaatctggaggcttt

SEQ ID NO: 316652 - DNA, 20 bp, human
gtatatgctgccaagtataa

SEQ ID NO: 316653 - DNA, 20 bp, human
gttagtattactcaattaga

SEQ ID NO: 316654 - DNA, 20 bp, human
gatttgcaatatcaagtgca

SEQ ID NO: 316655 - DNA, 20 bp, human
gtcatgacgctgttaattta

SEQ ID NO: 316656 - DNA, 20 bp, human
gccgcctggcccacgtctgg

SEQ ID NO: 316657 - DNA, 20 bp, human
gagtgcgcgccgccagacgt

SEQ ID NO: 316658 - DNA, 20 bp, human
gcggagtccacagcggacgg

SEQ ID NO: 316659 - DNA, 20 bp, human
gtggcagcctccgtccgctg

SEQ ID NO: 316660 - DNA, 20 bp, human
gcgcgcaggccgagccgaaa

SEQ ID NO: 316661 - DNA, 20 bp, human
ggacacagcgagaggggctt

SEQ ID NO: 316662 - DNA, 20 bp, human
gtccgaaaagggtccgaaag

SEQ ID NO: 316663 - DNA, 20 bp, human
gctctcagacacagcgagag

SEQ ID NO: 316664 - DNA, 20 bp, human
gcgcactggcgctgccaggc

SEQ ID NO: 316665 - DNA, 20 bp, human
gcactggaggctgtccgaaa

SEQ ID NO: 316666 - DNA, 20 bp, human
ggtctctgctgcctggtcaa

SEQ ID NO: 316667 - DNA, 20 bp, human
ggcctggtcaacggccaccc

SEQ ID NO: 316668 - DNA, 20 bp, human
gaaggggaagggatgtgtgt

SEQ ID NO: 316669 - DNA, 20 bp, human
gtcagctgctgctatcacat

SEQ ID NO: 316670 - DNA, 20 bp, human
gaggttgcaggaactgtttg

SEQ ID NO: 316671 - DNA, 20 bp, human
gaacctctggttatctgtgt

SEQ ID NO: 316672 - DNA, 20 bp, human
gtcacattggcccagaagga

SEQ ID NO: 316673 - DNA, 20 bp, human
gcagagaccatggacatatt

SEQ ID NO: 316674 - DNA, 20 bp, human
gctggccggttctacattcc

SEQ ID NO: 316675 - DNA, 20 bp, human
ggggaaaaaccctacctcat

SEQ ID NO: 316676 - DNA, 20 bp, human
gtcggccggctcctccctag

SEQ ID NO: 316677 - DNA, 20 bp, human
ggcggggcgcgcacgtggct

SEQ ID NO: 316678 - DNA, 20 bp, human
gggggcggggcgagcactcg

SEQ ID NO: 316679 - DNA, 20 bp, human
gcggctgcggcactgctaag

SEQ ID NO: 316680 - DNA, 20 bp, human
gttggccgggacgcctggtc

SEQ ID NO: 316681 - DNA, 20 bp, human
gggcagcttcccacgttctg

SEQ ID NO: 316682 - DNA, 20 bp, human
ggcacgagcgccatgatggg

SEQ ID NO: 316683 - DNA, 20 bp, human
ggaagccagcaagccggacc

SEQ ID NO: 316684 - DNA, 20 bp, human
ggggcgagcactcgcggcgc

SEQ ID NO: 316685 - DNA, 20 bp, human
gccggctcctccctaggggc

SEQ ID NO: 316686 - DNA, 20 bp, human
ggagaggcttaactaaagga

SEQ ID NO: 316687 - DNA, 20 bp, human
gagctgagaggcttaactaa

SEQ ID NO: 316688 - DNA, 20 bp, human
ggctccctctaggtaggaaa

SEQ ID NO: 316689 - DNA, 20 bp, human
gactcaagctccctctaggt

SEQ ID NO: 316690 - DNA, 20 bp, human
gagcttgagtgtctccctct

SEQ ID NO: 316691 - DNA, 20 bp, human
gataccctttcctacctaga

SEQ ID NO: 316692 - DNA, 20 bp, human
gccctgactcccgataagat

SEQ ID NO: 316693 - DNA, 20 bp, human
gggctcacttaacccttcac

SEQ ID NO: 316694 - DNA, 20 bp, human
gattttgtcaaggacaggta

SEQ ID NO: 316695 - DNA, 20 bp, human
gtgtgctgatcagccatctc

SEQ ID NO: 316696 - DNA, 20 bp, human
ggacatgaacatcacagcta

SEQ ID NO: 316697 - DNA, 20 bp, human
gacataatgctatgtgtagg

SEQ ID NO: 316698 - DNA, 20 bp, human
gactgaatgggtggacatgc

SEQ ID NO: 316699 - DNA, 20 bp, human
gatcacctatttaccagtgg

SEQ ID NO: 316700 - DNA, 20 bp, human
gcatgcaggtaaaccccaga

SEQ ID NO: 316701 - DNA, 20 bp, human
gagcagtatccatgtcctag

SEQ ID NO: 316702 - DNA, 20 bp, human
gggtcacaccactgcaaacc

SEQ ID NO: 316703 - DNA, 20 bp, human
gtccgcctgtgggacacagt

SEQ ID NO: 316704 - DNA, 20 bp, human
gtcgtgagtaagcacatagt

SEQ ID NO: 316705 - DNA, 20 bp, human
gaaaatgagatggcactctc

SEQ ID NO: 316706 - DNA, 20 bp, human
gcgccgcgacgctcaccggg

SEQ ID NO: 316707 - DNA, 20 bp, human
ggattcgcccctcggcgcgc

SEQ ID NO: 316708 - DNA, 20 bp, human
gcgggcggacagaggtgagt

SEQ ID NO: 316709 - DNA, 20 bp, human
ggcgccgaggggcgaatccc

SEQ ID NO: 316710 - DNA, 20 bp, human
gaggtgagtcggctcggagg

SEQ ID NO: 316711 - DNA, 20 bp, human
gaggccgccgcgacgctcac

SEQ ID NO: 316712 - DNA, 20 bp, human
gcgccccccggtgagcgtcg

SEQ ID NO: 316713 - DNA, 20 bp, human
ggcgctgtgaagccggcacc

SEQ ID NO: 316714 - DNA, 20 bp, human
gcagaggtgagtcggctcgg

SEQ ID NO: 316715 - DNA, 20 bp, human
ggtcgggccgcaaacccgca

SEQ ID NO: 316716 - DNA, 20 bp, human
gctggggtcccctccaggtg

SEQ ID NO: 316717 - DNA, 20 bp, human
gcaggcccggaagtgagttc

SEQ ID NO: 316718 - DNA, 20 bp, human
gccgacccggaactcacttc

SEQ ID NO: 316719 - DNA, 20 bp, human
gtccaccaaccccacctgga

SEQ ID NO: 316720 - DNA, 20 bp, human
ggggaagccccgcgcttcag

SEQ ID NO: 316721 - DNA, 20 bp, human
ggtggcggcggcgtcagcga

SEQ ID NO: 316722 - DNA, 20 bp, human
gctggaaaacctgactcagg

SEQ ID NO: 316723 - DNA, 20 bp, human
gagggacgccgttggcacca

SEQ ID NO: 316724 - DNA, 20 bp, human
ggtgccaacggcgtccctcc

SEQ ID NO: 316725 - DNA, 20 bp, human
gtggtccgagcctcgaaccc

SEQ ID NO: 316726 - DNA, 20 bp, human
gctggcccggcccgcaggaa

SEQ ID NO: 316727 - DNA, 20 bp, human
gccgcctcggcccgttcccg

SEQ ID NO: 316728 - DNA, 20 bp, human
gccctgcccgggatgacgac

SEQ ID NO: 316729 - DNA, 20 bp, human
ggtgcgtgcggcccccgcct

SEQ ID NO: 316730 - DNA, 20 bp, human
ggtcacgggtgggtagaaac

SEQ ID NO: 316731 - DNA, 20 bp, human
gcgcgtgttcgctgtggccc

SEQ ID NO: 316732 - DNA, 20 bp, human
gtcgctgtggccccgggaac

SEQ ID NO: 316733 - DNA, 20 bp, human
gtgggtgaagggtcacgggt

SEQ ID NO: 316734 - DNA, 20 bp, human
ggatgcaaagggcccggagg

SEQ ID NO: 316735 - DNA, 20 bp, human
gcagaacagaaggacggtgt

SEQ ID NO: 316736 - DNA, 20 bp, human
gcgcccaggtgaagaggcgg

SEQ ID NO: 316737 - DNA, 20 bp, human
gggacaggcgctgggatctc

SEQ ID NO: 316738 - DNA, 20 bp, human
gtggtcccgcctccagcctg

SEQ ID NO: 316739 - DNA, 20 bp, human
ggatcccagcgcctgtcccc

SEQ ID NO: 316740 - DNA, 20 bp, human
gggccgccgcctcttcacct

SEQ ID NO: 316741 - DNA, 20 bp, human
ggggatctcaggcggccaag

SEQ ID NO: 316742 - DNA, 20 bp, human
gctcctcagtgggccgggag

SEQ ID NO: 316743 - DNA, 20 bp, human
gctgggtggcagcgccccct

SEQ ID NO: 316744 - DNA, 20 bp, human
gaccgagacggagacggcag

SEQ ID NO: 316745 - DNA, 20 bp, human
gtgttggcagctaccaagtg

SEQ ID NO: 316746 - DNA, 20 bp, human
gggtccgcagcgttcttcgg

SEQ ID NO: 316747 - DNA, 20 bp, human
gggcgcgggaggaggactac

SEQ ID NO: 316748 - DNA, 20 bp, human
gttaagacgaaagttagggt

SEQ ID NO: 316749 - DNA, 20 bp, human
gcgggcaatctgtccataaa

SEQ ID NO: 316750 - DNA, 20 bp, human
gtaaaacgcagcgaagtgaa

SEQ ID NO: 316751 - DNA, 20 bp, human
gcagccaccgaagaacgctg

SEQ ID NO: 316752 - DNA, 20 bp, human
gctgggtccgcagcgttctt

SEQ ID NO: 316753 - DNA, 20 bp, human
gtagcaagacccgaactgta

SEQ ID NO: 316754 - DNA, 20 bp, human
gggctactacggtttccctg

SEQ ID NO: 316755 - DNA, 20 bp, human
gccaagcttgttggctacta

SEQ ID NO: 316756 - DNA, 20 bp, human
gggcgtgagccacctcccct

SEQ ID NO: 316757 - DNA, 20 bp, human
ggggaggggtcagaacttga

SEQ ID NO: 316758 - DNA, 20 bp, human
ggcggggagctggctgtttg

SEQ ID NO: 316759 - DNA, 20 bp, human
ggcctcttccccaactcctt

SEQ ID NO: 316760 - DNA, 20 bp, human
gttggggctctgagcctgaa

SEQ ID NO: 316761 - DNA, 20 bp, human
ggagaaggggctgttgtaag

SEQ ID NO: 316762 - DNA, 20 bp, human
ggaatcgccctgaaaagagg

SEQ ID NO: 316763 - DNA, 20 bp, human
gcgggaggggccgaggccat

SEQ ID NO: 316764 - DNA, 20 bp, human
gacttgatggcagccactac

SEQ ID NO: 316765 - DNA, 20 bp, human
gtcacttcctttggcgggag

SEQ ID NO: 316766 - DNA, 20 bp, human
gaaggagtggcaagtgcgga

SEQ ID NO: 316767 - DNA, 20 bp, human
ggtccctgcgccccacaagg

SEQ ID NO: 316768 - DNA, 20 bp, human
gggcgcagggacaggaagca

SEQ ID NO: 316769 - DNA, 20 bp, human
gctggtgtaaagtaggaagt

SEQ ID NO: 316770 - DNA, 20 bp, human
ggcaggagacaagactccgt

SEQ ID NO: 316771 - DNA, 20 bp, human
ggggtttagagcacctcgag

SEQ ID NO: 316772 - DNA, 20 bp, human
gtaggcacagcctccttgtg

SEQ ID NO: 316773 - DNA, 20 bp, human
ggagacaagactccgtgggt

SEQ ID NO: 316774 - DNA, 20 bp, human
ggcaaacgggtcagaccgtt

SEQ ID NO: 316775 - DNA, 20 bp, human
gtgccactccttccccctcg

SEQ ID NO: 316776 - DNA, 20 bp, human
gctggctctctactatccca

SEQ ID NO: 316777 - DNA, 20 bp, human
gtgtaaactctaagtgaaga

SEQ ID NO: 316778 - DNA, 20 bp, human
gaggaatagcagcagctgat

SEQ ID NO: 316779 - DNA, 20 bp, human
ggtacctagcagtaaatact

SEQ ID NO: 316780 - DNA, 20 bp, human
gagacggcataatttaatgc

SEQ ID NO: 316781 - DNA, 20 bp, human
ggcgtcttttggcagatttt

SEQ ID NO: 316782 - DNA, 20 bp, human
gtcacttagagtttacaata

SEQ ID NO: 316783 - DNA, 20 bp, human
ggaaccaagtatttactgct

SEQ ID NO: 316784 - DNA, 20 bp, human
gttgtcaggaaagcaagtct

SEQ ID NO: 316785 - DNA, 20 bp, human
gtagagtttacaatatggtt

SEQ ID NO: 316786 - DNA, 20 bp, human
ggtagtgtggggaatttcct

SEQ ID NO: 316787 - DNA, 20 bp, human
gggccctgcgaggatgtgga

SEQ ID NO: 316788 - DNA, 20 bp, human
gccgaaggggccccttatcc

SEQ ID NO: 316789 - DNA, 20 bp, human
ggcccggagcccggcgagaa

SEQ ID NO: 316790 - DNA, 20 bp, human
gcaagggccctgcgaggatg

SEQ ID NO: 316791 - DNA, 20 bp, human
gaggatgtggatggcgcgga

SEQ ID NO: 316792 - DNA, 20 bp, human
gtagagggttggtgactaac

SEQ ID NO: 316793 - DNA, 20 bp, human
gagggcgggccgaaggtcgg

SEQ ID NO: 316794 - DNA, 20 bp, human
ggcgccatccacatcctcgc

SEQ ID NO: 316795 - DNA, 20 bp, human
ggtgtggggaatttcctggg

SEQ ID NO: 316796 - DNA, 20 bp, human
gcaaacaggatctgtgagaa

SEQ ID NO: 316797 - DNA, 20 bp, human
gaggagacactaaatagatc

SEQ ID NO: 316798 - DNA, 20 bp, human
gctcagatgactattgtggg

SEQ ID NO: 316799 - DNA, 20 bp, human
ggggctatatacagaacagt

SEQ ID NO: 316800 - DNA, 20 bp, human
gggttgggggaatatcacat

SEQ ID NO: 316801 - DNA, 20 bp, human
gaactcatggtgtttcccct

SEQ ID NO: 316802 - DNA, 20 bp, human
gaccaaaggactttcgatct

SEQ ID NO: 316803 - DNA, 20 bp, human
gtacagaacagtaggttaag

SEQ ID NO: 316804 - DNA, 20 bp, human
gtagtgaagcaaagtcacca

SEQ ID NO: 316805 - DNA, 20 bp, human
gtgttaaatgacatgcaaac

SEQ ID NO: 316806 - DNA, 20 bp, human
gagcccggggccctctgctg

SEQ ID NO: 316807 - DNA, 20 bp, human
ggggcctcgccatcactccc

SEQ ID NO: 316808 - DNA, 20 bp, human
ggcagcggaggcagcatcgc

SEQ ID NO: 316809 - DNA, 20 bp, human
gccacctgcccggggtccta

SEQ ID NO: 316810 - DNA, 20 bp, human
gggctcacgctgcctcccat

SEQ ID NO: 316811 - DNA, 20 bp, human
ggagcccagagcagccgcgg

SEQ ID NO: 316812 - DNA, 20 bp, human
gcgctccagcgctgccaccg

SEQ ID NO: 316813 - DNA, 20 bp, human
ggcggcgacccctaggaccc

SEQ ID NO: 316814 - DNA, 20 bp, human
gtgtgctcgtagccgatggg

SEQ ID NO: 316815 - DNA, 20 bp, human
gccctcggggctcacgtccc

SEQ ID NO: 316816 - DNA, 20 bp, human
gcgcgcgcggcgtccagcag

SEQ ID NO: 316817 - DNA, 20 bp, human
gaggtgtggggaggaggcga

SEQ ID NO: 316818 - DNA, 20 bp, human
gggacccgctcgcgtcagag

SEQ ID NO: 316819 - DNA, 20 bp, human
gcagagaggagctccgggac

SEQ ID NO: 316820 - DNA, 20 bp, human
gactccgcggggcccggtgc

SEQ ID NO: 316821 - DNA, 20 bp, human
ggtcgggccgggcaccggca

SEQ ID NO: 316822 - DNA, 20 bp, human
gcgcaggcacaggtgcgccc

SEQ ID NO: 316823 - DNA, 20 bp, human
gcgggagggcgcgtcgggcc

SEQ ID NO: 316824 - DNA, 20 bp, human
ggaaaaaagagaagcgtcta

SEQ ID NO: 316825 - DNA, 20 bp, human
ggggcggcccgcgccggtcc

SEQ ID NO: 316826 - DNA, 20 bp, human
gagcgcgggtggagaaggtt

SEQ ID NO: 316827 - DNA, 20 bp, human
gtggagaaggttggggcccg

SEQ ID NO: 316828 - DNA, 20 bp, human
gtagccgggccaagcttgga

SEQ ID NO: 316829 - DNA, 20 bp, human
gcaggaacagatgcatccgg

SEQ ID NO: 316830 - DNA, 20 bp, human
ggaggagctaacactcgggc

SEQ ID NO: 316831 - DNA, 20 bp, human
gggtccctccaagcttggcc

SEQ ID NO: 316832 - DNA, 20 bp, human
gcacctggcgggagcgcggg

SEQ ID NO: 316833 - DNA, 20 bp, human
gcccgccaggtgcagccgcc

SEQ ID NO: 316834 - DNA, 20 bp, human
ggctgcacctggcgggagcg

SEQ ID NO: 316835 - DNA, 20 bp, human
gaggcaggaacagatgcatc

SEQ ID NO: 316836 - DNA, 20 bp, human
ggagcctctggggcgagggt

SEQ ID NO: 316837 - DNA, 20 bp, human
gtcccggagcgcgcgcccga

SEQ ID NO: 316838 - DNA, 20 bp, human
gtccaagccggcccgatccg

SEQ ID NO: 316839 - DNA, 20 bp, human
gcgcagagcctctggggcga

SEQ ID NO: 316840 - DNA, 20 bp, human
gcccgcggcgcagagcctct

SEQ ID NO: 316841 - DNA, 20 bp, human
gcactgcggcgtgcacgtca

SEQ ID NO: 316842 - DNA, 20 bp, human
gcgcgcccgacggcctgccg

SEQ ID NO: 316843 - DNA, 20 bp, human
gagaaggggcgaggagtccg

SEQ ID NO: 316844 - DNA, 20 bp, human
gcggcgccccgccgagtccc

SEQ ID NO: 316845 - DNA, 20 bp, human
ggcagtgccggggactcggc

SEQ ID NO: 316846 - DNA, 20 bp, human
gcagggaggcggggtcattg

SEQ ID NO: 316847 - DNA, 20 bp, human
gggcctccaaggtctgggtg

SEQ ID NO: 316848 - DNA, 20 bp, human
gggtgcggtgacatcagcgt

SEQ ID NO: 316849 - DNA, 20 bp, human
gggctgggactaatgtccag

SEQ ID NO: 316850 - DNA, 20 bp, human
gagaccttggaggccccctc

SEQ ID NO: 316851 - DNA, 20 bp, human
ggcactggctgccgacaggg

SEQ ID NO: 316852 - DNA, 20 bp, human
gggcacctgaagctagcctg

SEQ ID NO: 316853 - DNA, 20 bp, human
gggccccccaggctagcttc

SEQ ID NO: 316854 - DNA, 20 bp, human
gcactccagagccttctccc

SEQ ID NO: 316855 - DNA, 20 bp, human
gcagagcactggctgccgac

SEQ ID NO: 316856 - DNA, 20 bp, human
gggggctgagggaggcgtgt

SEQ ID NO: 316857 - DNA, 20 bp, human
gtgactgtcaccatgggatc

SEQ ID NO: 316858 - DNA, 20 bp, human
gccaccctcaattagagctt

SEQ ID NO: 316859 - DNA, 20 bp, human
ggcagtctgtgcacctgctc

SEQ ID NO: 316860 - DNA, 20 bp, human
gtgctctgcagaaggggcct

SEQ ID NO: 316861 - DNA, 20 bp, human
gtgcaaaccctggtggcctc

SEQ ID NO: 316862 - DNA, 20 bp, human
gggggcctgggttaaagagc

SEQ ID NO: 316863 - DNA, 20 bp, human
ggtgcacagactgcaaaccc

SEQ ID NO: 316864 - DNA, 20 bp, human
gctcctgccatgcagcacct

SEQ ID NO: 316865 - DNA, 20 bp, human
gtattacaggactttgtccc

SEQ ID NO: 316866 - DNA, 20 bp, human
ggccgcctggggcgtaggaa

SEQ ID NO: 316867 - DNA, 20 bp, human
ggcctggggcgtaggaaagg

SEQ ID NO: 316868 - DNA, 20 bp, human
ggacccgtgctggcagtagg

SEQ ID NO: 316869 - DNA, 20 bp, human
gcacgtgcgggggcgggaca

SEQ ID NO: 316870 - DNA, 20 bp, human
ggaaagggatgtcgcaaggt

SEQ ID NO: 316871 - DNA, 20 bp, human
gcccccgcacgtgacgccac

SEQ ID NO: 316872 - DNA, 20 bp, human
gagttccctgctctgccgta

SEQ ID NO: 316873 - DNA, 20 bp, human
gtccagtggcgtcacgtgcg

SEQ ID NO: 316874 - DNA, 20 bp, human
gtccccggctgcaggcgagc

SEQ ID NO: 316875 - DNA, 20 bp, human
ggtgcgggggcgggacaggg

SEQ ID NO: 316876 - DNA, 20 bp, human
gtgtggagacgcaggagggg

SEQ ID NO: 316877 - DNA, 20 bp, human
gtggtctcgcccaccatcgg

SEQ ID NO: 316878 - DNA, 20 bp, human
ggggcgagaccaagtgcgag

SEQ ID NO: 316879 - DNA, 20 bp, human
gaggcagcgccggctaagtg

SEQ ID NO: 316880 - DNA, 20 bp, human
gtgggtgggacctgatctgt

SEQ ID NO: 316881 - DNA, 20 bp, human
gcatcggcggtagtgggtag

SEQ ID NO: 316882 - DNA, 20 bp, human
gcggcggtagtgggtagggg

SEQ ID NO: 316883 - DNA, 20 bp, human
gacccactaccgccgatggt

SEQ ID NO: 316884 - DNA, 20 bp, human
gcaggcgaagcgcgcgtctg

SEQ ID NO: 316885 - DNA, 20 bp, human
gacgccagcgctcctagggg

SEQ ID NO: 316886 - DNA, 20 bp, human
gggaactattattggggtat

SEQ ID NO: 316887 - DNA, 20 bp, human
gggggtatgggtgcataaat

SEQ ID NO: 316888 - DNA, 20 bp, human
gtggccacgtgaggctgggt

SEQ ID NO: 316889 - DNA, 20 bp, human
gtaaaaccaggtggagatat

SEQ ID NO: 316890 - DNA, 20 bp, human
gaatcttgctggcagcgtga

SEQ ID NO: 316891 - DNA, 20 bp, human
ggaggtggccacgtgaggct

SEQ ID NO: 316892 - DNA, 20 bp, human
gacacttacaccaggactac

SEQ ID NO: 316893 - DNA, 20 bp, human
ggggtgctgtccttgtgttc

SEQ ID NO: 316894 - DNA, 20 bp, human
gagccccacccagcctcacg

SEQ ID NO: 316895 - DNA, 20 bp, human
gacaaggacagcaccctacc

SEQ ID NO: 316896 - DNA, 20 bp, human
gcccgccctctgtgcctcgg

SEQ ID NO: 316897 - DNA, 20 bp, human
gtgctcctggccaacctccg

SEQ ID NO: 316898 - DNA, 20 bp, human
ggagccgccgaagccgtctc

SEQ ID NO: 316899 - DNA, 20 bp, human
ggggccaggggtcgggaatc

SEQ ID NO: 316900 - DNA, 20 bp, human
ggccgccgaggcacagaggg

SEQ ID NO: 316901 - DNA, 20 bp, human
gacatcagacaggaacgcct

SEQ ID NO: 316902 - DNA, 20 bp, human
gcgttcctgtctgatgtcat

SEQ ID NO: 316903 - DNA, 20 bp, human
gaggggcgcgagctaaagag

SEQ ID NO: 316904 - DNA, 20 bp, human
gtaagagccggttcccgaga

SEQ ID NO: 316905 - DNA, 20 bp, human
gtcccgccagccggctgcaa

SEQ ID NO: 316906 - DNA, 20 bp, human
gcgcgcacgccagtgtggag

SEQ ID NO: 316907 - DNA, 20 bp, human
gggcgcctggcgagaagcta

SEQ ID NO: 316908 - DNA, 20 bp, human
gcctccctccctgcccggta

SEQ ID NO: 316909 - DNA, 20 bp, human
gtgcgcgctaggtcccctac

SEQ ID NO: 316910 - DNA, 20 bp, human
gtacagccggggctcccgag

SEQ ID NO: 316911 - DNA, 20 bp, human
gcagcagtcgggtgttggag

SEQ ID NO: 316912 - DNA, 20 bp, human
ggtccccggggtggccgcag

SEQ ID NO: 316913 - DNA, 20 bp, human
gagccaagtgcagccgccta

SEQ ID NO: 316914 - DNA, 20 bp, human
ggggctggctggccagtctg

SEQ ID NO: 316915 - DNA, 20 bp, human
gccagcccgcccctccacac

SEQ ID NO: 316916 - DNA, 20 bp, human
gactgagtgggtgtgttcaa

SEQ ID NO: 316917 - DNA, 20 bp, human
gggagctaagaaatacgggt

SEQ ID NO: 316918 - DNA, 20 bp, human
gtgaacatagggttactgag

SEQ ID NO: 316919 - DNA, 20 bp, human
gtaagaaatacgggtaggtc

SEQ ID NO: 316920 - DNA, 20 bp, human
gggcaaaatgggtggacctc

SEQ ID NO: 316921 - DNA, 20 bp, human
gtgcgtagacgcggggagtt

SEQ ID NO: 316922 - DNA, 20 bp, human
gaaaatgggtggacctctgg

SEQ ID NO: 316923 - DNA, 20 bp, human
gctctggcggattttactga

SEQ ID NO: 316924 - DNA, 20 bp, human
gcgcgtctacgcagtgccgc

SEQ ID NO: 316925 - DNA, 20 bp, human
gcttatgaattcgggaaatg

SEQ ID NO: 316926 - DNA, 20 bp, human
ggggccatgcgggagaaaga

SEQ ID NO: 316927 - DNA, 20 bp, human
gagaagctggtgggtatagg

SEQ ID NO: 316928 - DNA, 20 bp, human
gtgaaaggagcagatgagag

SEQ ID NO: 316929 - DNA, 20 bp, human
gaacagcttagagggggctc

SEQ ID NO: 316930 - DNA, 20 bp, human
ggggctcctgtgcacgggtc

SEQ ID NO: 316931 - DNA, 20 bp, human
gccagctaggagtaattgaa

SEQ ID NO: 316932 - DNA, 20 bp, human
gcgaagaagctggtgggtat

SEQ ID NO: 316933 - DNA, 20 bp, human
gggcctcccgacccgtgcac

SEQ ID NO: 316934 - DNA, 20 bp, human
gcacatcaaggcgtttacag

SEQ ID NO: 316935 - DNA, 20 bp, human
gcgtgcacaggagcccgcct

SEQ ID NO: 316936 - DNA, 20 bp, human
gagggtagttccaaaccagg

SEQ ID NO: 316937 - DNA, 20 bp, human
ggggagggtagttccaaacc

SEQ ID NO: 316938 - DNA, 20 bp, human
ggctaaagacaggaccctgg

SEQ ID NO: 316939 - DNA, 20 bp, human
ggtagttccaaaccaggagg

SEQ ID NO: 316940 - DNA, 20 bp, human
gaagaggcagggctaaagac

SEQ ID NO: 316941 - DNA, 20 bp, human
ggataaatatagcagcagat

SEQ ID NO: 316942 - DNA, 20 bp, human
gccacacaaccagcctttta

SEQ ID NO: 316943 - DNA, 20 bp, human
gaaaaataatgcatgtggtc

SEQ ID NO: 316944 - DNA, 20 bp, human
gggtcaggcagtcgaatgtc

SEQ ID NO: 316945 - DNA, 20 bp, human
gctgccttcttggccataaa

SEQ ID NO: 316946 - DNA, 20 bp, human
gtcctgggaaaagtgcagtt

SEQ ID NO: 316947 - DNA, 20 bp, human
gtgcacttttcccaggaaac

SEQ ID NO: 316948 - DNA, 20 bp, human
gtggacacccgagttgaggt

SEQ ID NO: 316949 - DNA, 20 bp, human
gagttgcggggagggagcgt

SEQ ID NO: 316950 - DNA, 20 bp, human
gggaaatcacgattcaaaac

SEQ ID NO: 316951 - DNA, 20 bp, human
gccctctctttctgggtcgg

SEQ ID NO: 316952 - DNA, 20 bp, human
gtgcagtttgggactcagaa

SEQ ID NO: 316953 - DNA, 20 bp, human
gacgatgtgggtattgatgt

SEQ ID NO: 316954 - DNA, 20 bp, human
ggacccagaaagagagggca

SEQ ID NO: 316955 - DNA, 20 bp, human
gctgctatatatagacgcct

SEQ ID NO: 316956 - DNA, 20 bp, human
gtcaggcatggtcgtatgga

SEQ ID NO: 316957 - DNA, 20 bp, human
ggctgggcagcagcgacagg

SEQ ID NO: 316958 - DNA, 20 bp, human
gtgagacagtacaatgacaa

SEQ ID NO: 316959 - DNA, 20 bp, human
gggaaaggagggaacggctc

SEQ ID NO: 316960 - DNA, 20 bp, human
ggcagtgtggggggacgcgg

SEQ ID NO: 316961 - DNA, 20 bp, human
gcctgctgggcagcagcgac

SEQ ID NO: 316962 - DNA, 20 bp, human
gcactccggtagttactaca

SEQ ID NO: 316963 - DNA, 20 bp, human
gtaactaccggagtggtgga

SEQ ID NO: 316964 - DNA, 20 bp, human
ggatgagaactatggcatcg

SEQ ID NO: 316965 - DNA, 20 bp, human
gacagctgagaacgccgcac

SEQ ID NO: 316966 - DNA, 20 bp, human
gagactgcatgggaggggat

SEQ ID NO: 316967 - DNA, 20 bp, human
ggcacagcttgggaggtgcg

SEQ ID NO: 316968 - DNA, 20 bp, human
gtgaacctccatggcctggg

SEQ ID NO: 316969 - DNA, 20 bp, human
gtgactctgccgcacagctt

SEQ ID NO: 316970 - DNA, 20 bp, human
ggccctgctccctaacgtgg

SEQ ID NO: 316971 - DNA, 20 bp, human
gaaggtccgcctccgcacag

SEQ ID NO: 316972 - DNA, 20 bp, human
gctctgccgcacagcttggg

SEQ ID NO: 316973 - DNA, 20 bp, human
gcacaggctggagcaccggc

SEQ ID NO: 316974 - DNA, 20 bp, human
gttgggaagactgcatggga

SEQ ID NO: 316975 - DNA, 20 bp, human
ggatgttgggaagactgcat

SEQ ID NO: 316976 - DNA, 20 bp, human
ggagggaagggcagtgaata

SEQ ID NO: 316977 - DNA, 20 bp, human
ggggcagtgaatagggaaat

SEQ ID NO: 316978 - DNA, 20 bp, human
ggcaagctcatgtgagggaa

SEQ ID NO: 316979 - DNA, 20 bp, human
gaataagaccagtgatagat

SEQ ID NO: 316980 - DNA, 20 bp, human
gccagcataggtagatggac

SEQ ID NO: 316981 - DNA, 20 bp, human
gaatatctcacgtgtcttag

SEQ ID NO: 316982 - DNA, 20 bp, human
gttagtggtatttaaggagt

SEQ ID NO: 316983 - DNA, 20 bp, human
gcgtgtcttagtggtattta

SEQ ID NO: 316984 - DNA, 20 bp, human
gtactttgacatgccagcat

SEQ ID NO: 316985 - DNA, 20 bp, human
gagggcagtctgggcaaagc

SEQ ID NO: 316986 - DNA, 20 bp, human
gtcttttaaagttcctggat

SEQ ID NO: 316987 - DNA, 20 bp, human
gccctgggcagactgatccc

SEQ ID NO: 316988 - DNA, 20 bp, human
gagggagggatcttggttcc

SEQ ID NO: 316989 - DNA, 20 bp, human
gtccctccctccttgcccgg

SEQ ID NO: 316990 - DNA, 20 bp, human
gaatgtgaaggggagtccct

SEQ ID NO: 316991 - DNA, 20 bp, human
gtggctctgtgtggccctca

SEQ ID NO: 316992 - DNA, 20 bp, human
gctggctcagacagttcagt

SEQ ID NO: 316993 - DNA, 20 bp, human
gtagacagcaagtattggat

SEQ ID NO: 316994 - DNA, 20 bp, human
ggctctaggtgcaatgtgaa

SEQ ID NO: 316995 - DNA, 20 bp, human
gagcagctcaaatggcacag

SEQ ID NO: 316996 - DNA, 20 bp, human
gctggcgaaagggaggaaca

SEQ ID NO: 316997 - DNA, 20 bp, human
ggtgtttctagtttgtgaga

SEQ ID NO: 316998 - DNA, 20 bp, human
ggaacagatagtagccaaaa

SEQ ID NO: 316999 - DNA, 20 bp, human
gtatgtagactcaagaagaa

SEQ ID NO: 317000 - DNA, 20 bp, human
ggaagaaaggaagtaatgtg

SEQ ID NO: 317001 - DNA, 20 bp, human
gggttaaatgaaacgttcat

SEQ ID NO: 317002 - DNA, 20 bp, human
gtatgagtagctaaagtatt

SEQ ID NO: 317003 - DNA, 20 bp, human
gaaaagctgagactcataac

SEQ ID NO: 317004 - DNA, 20 bp, human
gtgtagtgagaactcatgct

SEQ ID NO: 317005 - DNA, 20 bp, human
ggcattcagctgacatcaac

SEQ ID NO: 317006 - DNA, 20 bp, human
gagggcacctgtcttcccta

SEQ ID NO: 317007 - DNA, 20 bp, human
ggcaagccctctgtctgcac

SEQ ID NO: 317008 - DNA, 20 bp, human
ggccaagaatggtgcttgat

SEQ ID NO: 317009 - DNA, 20 bp, human
gaggctcagggaatgtgaga

SEQ ID NO: 317010 - DNA, 20 bp, human
gaatgtgagaaggtagaggg

SEQ ID NO: 317011 - DNA, 20 bp, human
gttcgggctgcaataggagc

SEQ ID NO: 317012 - DNA, 20 bp, human
gcctattgcagcccgaaata

SEQ ID NO: 317013 - DNA, 20 bp, human
gtctgcacaggcctgttgcc

SEQ ID NO: 317014 - DNA, 20 bp, human
gaaggctgtgacccatggca

SEQ ID NO: 317015 - DNA, 20 bp, human
gaccagaccctagggaagac

SEQ ID NO: 317016 - DNA, 20 bp, human
gcatagcaggacagcaccta

SEQ ID NO: 317017 - DNA, 20 bp, human
gggacagcacctatgggggt

SEQ ID NO: 317018 - DNA, 20 bp, human
ggctataagggaaattctat

SEQ ID NO: 317019 - DNA, 20 bp, human
gagcaaagggattccatagc

SEQ ID NO: 317020 - DNA, 20 bp, human
gcatgggcctctagctataa

SEQ ID NO: 317021 - DNA, 20 bp, human
gttatttattgattgacgtt

SEQ ID NO: 317022 - DNA, 20 bp, human
ggaatttcccttatagctag

SEQ ID NO: 317023 - DNA, 20 bp, human
gttaaagctgagagcttttt

SEQ ID NO: 317024 - DNA, 20 bp, human
gttagaccttagcttcaggt

SEQ ID NO: 317025 - DNA, 20 bp, human
ggtgaaacattccacctgat

SEQ ID NO: 317026 - DNA, 20 bp, human
ggtaatgaagggtatttaca

SEQ ID NO: 317027 - DNA, 20 bp, human
ggccccgccagagtaatgaa

SEQ ID NO: 317028 - DNA, 20 bp, human
ggggttccgttgcagatcca

SEQ ID NO: 317029 - DNA, 20 bp, human
gcaaactgggactatggtca

SEQ ID NO: 317030 - DNA, 20 bp, human
gacgatgttcttagcctgca

SEQ ID NO: 317031 - DNA, 20 bp, human
gtggtaccaaactgggacta

SEQ ID NO: 317032 - DNA, 20 bp, human
gagacacaaaagtgccatga

SEQ ID NO: 317033 - DNA, 20 bp, human
gataatgactaagatgacta

SEQ ID NO: 317034 - DNA, 20 bp, human
gatacccttcattactctgg

SEQ ID NO: 317035 - DNA, 20 bp, human
gatggtcaaggcatttatta

SEQ ID NO: 317036 - DNA, 20 bp, human
ggaatgaaaccctggcggta

SEQ ID NO: 317037 - DNA, 20 bp, human
gtaagggcattggggccgac

SEQ ID NO: 317038 - DNA, 20 bp, human
gcagttgcggcctgctggtg

SEQ ID NO: 317039 - DNA, 20 bp, human
gcaggcgttgcgagcttgga

SEQ ID NO: 317040 - DNA, 20 bp, human
gggaagctggggtacccgcg

SEQ ID NO: 317041 - DNA, 20 bp, human
gtctgcgcctgcgctgtgct

SEQ ID NO: 317042 - DNA, 20 bp, human
gccgcgcggcgctaacgttg

SEQ ID NO: 317043 - DNA, 20 bp, human
gggcggggccgaaagagggg

SEQ ID NO: 317044 - DNA, 20 bp, human
ggccccgcatgccaaggcgc

SEQ ID NO: 317045 - DNA, 20 bp, human
gacctaccccagcacagcgc

SEQ ID NO: 317046 - DNA, 20 bp, human
gcggggccgtcccgggtcgg

SEQ ID NO: 317047 - DNA, 20 bp, human
gagaccgtcccaggcttgag

SEQ ID NO: 317048 - DNA, 20 bp, human
gggggacgcgagaccgtccc

SEQ ID NO: 317049 - DNA, 20 bp, human
ggtcgggagcgtggtgcccg

SEQ ID NO: 317050 - DNA, 20 bp, human
ggggcagtcctaggcttgcg

SEQ ID NO: 317051 - DNA, 20 bp, human
ggccttcccgggtcggggtg

SEQ ID NO: 317052 - DNA, 20 bp, human
ggtctcgcgtcccccgaccc

SEQ ID NO: 317053 - DNA, 20 bp, human
gaagggccgcttggcctctg

SEQ ID NO: 317054 - DNA, 20 bp, human
gggtggctaacgagagggat

SEQ ID NO: 317055 - DNA, 20 bp, human
ggcgcccctcaagcctggga

SEQ ID NO: 317056 - DNA, 20 bp, human
gtgacgtggtccccctccct

SEQ ID NO: 317057 - DNA, 20 bp, human
gttagcccccagcccaccac

SEQ ID NO: 317058 - DNA, 20 bp, human
gcgcgccccctcacctgacg

SEQ ID NO: 317059 - DNA, 20 bp, human
gggacagagcggccccctcg

SEQ ID NO: 317060 - DNA, 20 bp, human
ggggaaagggttttaccgaa

SEQ ID NO: 317061 - DNA, 20 bp, human
gggggaccacgtcaggtgag

SEQ ID NO: 317062 - DNA, 20 bp, human
gcgctgtgctgcagcccctt

SEQ ID NO: 317063 - DNA, 20 bp, human
gtatgcttggtgtgtgccca

SEQ ID NO: 317064 - DNA, 20 bp, human
gccggctgtaccagcctcga

SEQ ID NO: 317065 - DNA, 20 bp, human
gacacaccaagcataggtgc

SEQ ID NO: 317066 - DNA, 20 bp, human
gtgaccttgtaactcaaaaa

SEQ ID NO: 317067 - DNA, 20 bp, human
gtaatccagctgtctttgaa

SEQ ID NO: 317068 - DNA, 20 bp, human
gagttcattcaagataaatc

SEQ ID NO: 317069 - DNA, 20 bp, human
gtggattatactgttgaaaa

SEQ ID NO: 317070 - DNA, 20 bp, human
gtgaaggacattggcaaatc

SEQ ID NO: 317071 - DNA, 20 bp, human
gataaagatctggtcctaaa

SEQ ID NO: 317072 - DNA, 20 bp, human
ggctccatttttgagttaca

SEQ ID NO: 317073 - DNA, 20 bp, human
gatatttaaaattctgaggc

SEQ ID NO: 317074 - DNA, 20 bp, human
gcacagtcttgctaaactgc

SEQ ID NO: 317075 - DNA, 20 bp, human
gaaatggagctgaaggacat

SEQ ID NO: 317076 - DNA, 20 bp, human
gccggcgcaggcgcgatcgc

SEQ ID NO: 317077 - DNA, 20 bp, human
gtgctctggaggaaccggcc

SEQ ID NO: 317078 - DNA, 20 bp, human
gcgaggtgctctggaggaac

SEQ ID NO: 317079 - DNA, 20 bp, human
gaatcagaggcgcccggagc

SEQ ID NO: 317080 - DNA, 20 bp, human
gccgcgcgcccgaggtgctc

SEQ ID NO: 317081 - DNA, 20 bp, human
gacccagggactgtgaagtg

SEQ ID NO: 317082 - DNA, 20 bp, human
gggccagcaggtgtcggcgg

SEQ ID NO: 317083 - DNA, 20 bp, human
gtccgcaggctcccccgctc

SEQ ID NO: 317084 - DNA, 20 bp, human
gccgggccagcaggtgtcgg

SEQ ID NO: 317085 - DNA, 20 bp, human
ggacctggagtcgcacatgg

SEQ ID NO: 317086 - DNA, 20 bp, human
gaggcgtgggccacttccca

SEQ ID NO: 317087 - DNA, 20 bp, human
ggttgacatgtagagacctt

SEQ ID NO: 317088 - DNA, 20 bp, human
gtcgtctcgcgggatctctc

SEQ ID NO: 317089 - DNA, 20 bp, human
ggcagggcctaacgcgtcac

SEQ ID NO: 317090 - DNA, 20 bp, human
gaaggcgcccccagaggcct

SEQ ID NO: 317091 - DNA, 20 bp, human
gaaaccccgcctcccggcac

SEQ ID NO: 317092 - DNA, 20 bp, human
gcggcccctcccgtgccggg

SEQ ID NO: 317093 - DNA, 20 bp, human
gggcggggtttccagagcaa

SEQ ID NO: 317094 - DNA, 20 bp, human
gggcctaacgcgtcacgggg

SEQ ID NO: 317095 - DNA, 20 bp, human
gagatcccgcgagacgaaga

SEQ ID NO: 317096 - DNA, 20 bp, human
ggagaggtgtcccagtccgg

SEQ ID NO: 317097 - DNA, 20 bp, human
gaatcagtgtggacaaacat

SEQ ID NO: 317098 - DNA, 20 bp, human
gcagaggggggtgaatgtgg

SEQ ID NO: 317099 - DNA, 20 bp, human
gggtgagaggtgtcccagtc

SEQ ID NO: 317100 - DNA, 20 bp, human
gacgctacccatgaaccctt

SEQ ID NO: 317101 - DNA, 20 bp, human
gacacaggactccaccggac

SEQ ID NO: 317102 - DNA, 20 bp, human
gaaacataggcaccttctgt

SEQ ID NO: 317103 - DNA, 20 bp, human
gcgctgtagccatgctaacc

SEQ ID NO: 317104 - DNA, 20 bp, human
gaagcagaggggggtgaatg

SEQ ID NO: 317105 - DNA, 20 bp, human
ggatctaccatcataaagag

SEQ ID NO: 317106 - DNA, 20 bp, human
gaacagaaggtcatatgccg

SEQ ID NO: 317107 - DNA, 20 bp, human
ggataggctcgcaggcctca

SEQ ID NO: 317108 - DNA, 20 bp, human
ggcctcatagataatgatga

SEQ ID NO: 317109 - DNA, 20 bp, human
ggagtgggagcgtgtgcatg

SEQ ID NO: 317110 - DNA, 20 bp, human
ggaagtcaaacagatccctg

SEQ ID NO: 317111 - DNA, 20 bp, human
gtgtctgttggtggcaagaa

SEQ ID NO: 317112 - DNA, 20 bp, human
gaggtcatatgccggggatt

SEQ ID NO: 317113 - DNA, 20 bp, human
gatgacaaatgcagcgcgat

SEQ ID NO: 317114 - DNA, 20 bp, human
gaccaccccagctagttacc

SEQ ID NO: 317115 - DNA, 20 bp, human
gattctgctctcggttgcca

SEQ ID NO: 317116 - DNA, 20 bp, human
gcctcccagggtcagtccca

SEQ ID NO: 317117 - DNA, 20 bp, human
gcaggtggatctcaactctg

SEQ ID NO: 317118 - DNA, 20 bp, human
gtgggcgtccaggctgtcca

SEQ ID NO: 317119 - DNA, 20 bp, human
gagggcgtgcagaggctgta

SEQ ID NO: 317120 - DNA, 20 bp, human
gcgcgctcacccgacccgtc

SEQ ID NO: 317121 - DNA, 20 bp, human
gagggcgctgcgccctccca

SEQ ID NO: 317122 - DNA, 20 bp, human
gaggctgcattttctcccga

SEQ ID NO: 317123 - DNA, 20 bp, human
ggtaggtcgtgagactgaat

SEQ ID NO: 317124 - DNA, 20 bp, human
gaaaatgcagcctgacgggt

SEQ ID NO: 317125 - DNA, 20 bp, human
gtctcccgagggcgccgacc

SEQ ID NO: 317126 - DNA, 20 bp, human
gggcctaggcaggaacacat

SEQ ID NO: 317127 - DNA, 20 bp, human
gagaggggctgggcctaggc

SEQ ID NO: 317128 - DNA, 20 bp, human
gggagccagggtccagctag

SEQ ID NO: 317129 - DNA, 20 bp, human
gaacacctggcctagaccaa

SEQ ID NO: 317130 - DNA, 20 bp, human
gggccccgaagatgccacgt

SEQ ID NO: 317131 - DNA, 20 bp, human
gtggccagatcacaggatgt

SEQ ID NO: 317132 - DNA, 20 bp, human
gttgtcctctagctggaccc

SEQ ID NO: 317133 - DNA, 20 bp, human
ggggaccgccacagaacacc

SEQ ID NO: 317134 - DNA, 20 bp, human
gaatgcccacgtggcatctt

SEQ ID NO: 317135 - DNA, 20 bp, human
gtgccacttggccagatcac

SEQ ID NO: 317136 - DNA, 20 bp, human
gcgcgcgcacgtacacacga

SEQ ID NO: 317137 - DNA, 20 bp, human
gtcaacgcccgccgcgtctc

SEQ ID NO: 317138 - DNA, 20 bp, human
gagacgcggtggggcaccga

SEQ ID NO: 317139 - DNA, 20 bp, human
ggtgccccaccgcgtctcca

SEQ ID NO: 317140 - DNA, 20 bp, human
gctccatggcaactccctac

SEQ ID NO: 317141 - DNA, 20 bp, human
gaccgacggagttctaatga

SEQ ID NO: 317142 - DNA, 20 bp, human
ggacgttcctctgtgatcat

SEQ ID NO: 317143 - DNA, 20 bp, human
ggccgtcattagaactccgt

SEQ ID NO: 317144 - DNA, 20 bp, human
gtggcaactccctacaggaa

SEQ ID NO: 317145 - DNA, 20 bp, human
ggatgtcgagtcgtgtcccc

SEQ ID NO: 317146 - DNA, 20 bp, human
ggatggcgggacgacacgat

SEQ ID NO: 317147 - DNA, 20 bp, human
ggccgcgtaggaaattcgaa

SEQ ID NO: 317148 - DNA, 20 bp, human
ggaaccagccaatcgcacgg

SEQ ID NO: 317149 - DNA, 20 bp, human
gcgcgctcgccgccggcgtg

SEQ ID NO: 317150 - DNA, 20 bp, human
gaatcgcacggaggccgcgt

SEQ ID NO: 317151 - DNA, 20 bp, human
gtggctggttcgcggatggc

SEQ ID NO: 317152 - DNA, 20 bp, human
gcgattggctggttcgcgga

SEQ ID NO: 317153 - DNA, 20 bp, human
gcaacgcagcctcacgccgg

SEQ ID NO: 317154 - DNA, 20 bp, human
gacaagccccgtgccctggt

SEQ ID NO: 317155 - DNA, 20 bp, human
gcgcgaaccagccaatcgca

SEQ ID NO: 317156 - DNA, 20 bp, human
gcctctggcgccccaaggta

SEQ ID NO: 317157 - DNA, 20 bp, human
ggccgcctcctcggcgtcat

SEQ ID NO: 317158 - DNA, 20 bp, human
gactaggggtcgctcttcgg

SEQ ID NO: 317159 - DNA, 20 bp, human
gaatgcgcgtgcgcgtaagc

SEQ ID NO: 317160 - DNA, 20 bp, human
gtacgtgcgcaaagcgaaga

SEQ ID NO: 317161 - DNA, 20 bp, human
gttggagcccaacagttagt

SEQ ID NO: 317162 - DNA, 20 bp, human
ggagcggcgcgctaggcgtc

SEQ ID NO: 317163 - DNA, 20 bp, human
gtccaatgacgccgaggagg

SEQ ID NO: 317164 - DNA, 20 bp, human
ggcggtgggcgcatccgcta

SEQ ID NO: 317165 - DNA, 20 bp, human
gtgcgcaaagcgaagaaggc

SEQ ID NO: 317166 - DNA, 20 bp, human
gtccctgcagcgtcaacgtc

SEQ ID NO: 317167 - DNA, 20 bp, human
ggtggtgggcgcagccgcta

SEQ ID NO: 317168 - DNA, 20 bp, human
ggagcggcgctctaggagcc

SEQ ID NO: 317169 - DNA, 20 bp, human
gctggggagaaagtaccttg

SEQ ID NO: 317170 - DNA, 20 bp, human
ggcgctctaggagccgggag

SEQ ID NO: 317171 - DNA, 20 bp, human
ggggtggcagaagactcaac

SEQ ID NO: 317172 - DNA, 20 bp, human
ggcggggaagagaaatggcg

SEQ ID NO: 317173 - DNA, 20 bp, human
gttcaatgacgccgcggagg

SEQ ID NO: 317174 - DNA, 20 bp, human
gagaaagtaccttggggcgc

SEQ ID NO: 317175 - DNA, 20 bp, human
gttgaagcccaacagttatt

SEQ ID NO: 317176 - DNA, 20 bp, human
gtcaccctcagtcgccatgt

SEQ ID NO: 317177 - DNA, 20 bp, human
ggaggctcgccgccccctag

SEQ ID NO: 317178 - DNA, 20 bp, human
ggggcggcgagcctcaatga

SEQ ID NO: 317179 - DNA, 20 bp, human
gcccctaggggaagggagta

SEQ ID NO: 317180 - DNA, 20 bp, human
ggcggcggcaaaggggcgga

SEQ ID NO: 317181 - DNA, 20 bp, human
gtcaaccaacatggcgactg

SEQ ID NO: 317182 - DNA, 20 bp, human
gccggccgcagccgtcattg

SEQ ID NO: 317183 - DNA, 20 bp, human
gcgagcctcaatgacggctg

SEQ ID NO: 317184 - DNA, 20 bp, human
gctcgccgccccctagggga

SEQ ID NO: 317185 - DNA, 20 bp, human
gagggccgacgccgcctgac

SEQ ID NO: 317186 - DNA, 20 bp, human
gcgggtggggaggggtctcg

SEQ ID NO: 317187 - DNA, 20 bp, human
gacagccggcgggcttgggg

SEQ ID NO: 317188 - DNA, 20 bp, human
gaatggctgccacgtcgccc

SEQ ID NO: 317189 - DNA, 20 bp, human
gggggacgaagcagaggtcg

SEQ ID NO: 317190 - DNA, 20 bp, human
gaagcccgccgcgagagggc

SEQ ID NO: 317191 - DNA, 20 bp, human
gcccgcgggctcaagtcccc

SEQ ID NO: 317192 - DNA, 20 bp, human
ggacgaagcagaggtcgtgg

SEQ ID NO: 317193 - DNA, 20 bp, human
ggaacccgacactcgaagaa

SEQ ID NO: 317194 - DNA, 20 bp, human
gggtgggcggcgatccacct

SEQ ID NO: 317195 - DNA, 20 bp, human
gccacccgccctctcgcggc

SEQ ID NO: 317196 - DNA, 20 bp, human
ggcggagcgggggtcgaggt

SEQ ID NO: 317197 - DNA, 20 bp, human
ggccccgtctagtaggtctc

SEQ ID NO: 317198 - DNA, 20 bp, human
gcgtccccagctttccaggt

SEQ ID NO: 317199 - DNA, 20 bp, human
gcgtccctacctggaaagct

SEQ ID NO: 317200 - DNA, 20 bp, human
gggaaccgtgctgcgtggga

SEQ ID NO: 317201 - DNA, 20 bp, human
gcatgtgatggatagagggg

SEQ ID NO: 317202 - DNA, 20 bp, human
gcgccggaaccgtgctgcgt

SEQ ID NO: 317203 - DNA, 20 bp, human
gactcacagcccggaaaaca

SEQ ID NO: 317204 - DNA, 20 bp, human
ggtcccagagacctactaga

SEQ ID NO: 317205 - DNA, 20 bp, human
ggggaggggccccgtctagt

SEQ ID NO: 317206 - DNA, 20 bp, human
gaccggctccgtaaacctca

SEQ ID NO: 317207 - DNA, 20 bp, human
gctaggtctcccagaatcca

SEQ ID NO: 317208 - DNA, 20 bp, human
gacggagccggtgtgaacgt

SEQ ID NO: 317209 - DNA, 20 bp, human
gagttcctagatctggagca

SEQ ID NO: 317210 - DNA, 20 bp, human
gtttgtcacgccatggattc

SEQ ID NO: 317211 - DNA, 20 bp, human
gcgtttgcgccaggcattgt

SEQ ID NO: 317212 - DNA, 20 bp, human
gtgaagtccgacgttcacac

SEQ ID NO: 317213 - DNA, 20 bp, human
ggccgtgaggtttacggagc

SEQ ID NO: 317214 - DNA, 20 bp, human
gcgtgacaaacgcagtaatt

SEQ ID NO: 317215 - DNA, 20 bp, human
gcaaacgcctagttttggcc

SEQ ID NO: 317216 - DNA, 20 bp, human
gcgggcgaggcgaacggcgg

SEQ ID NO: 317217 - DNA, 20 bp, human
gccgccgtgcggcgcctctg

SEQ ID NO: 317218 - DNA, 20 bp, human
gtggcgggcgaaacctggac

SEQ ID NO: 317219 - DNA, 20 bp, human
gaaaacccggcctgactcac

SEQ ID NO: 317220 - DNA, 20 bp, human
ggcggcgcctctgcgggtca

SEQ ID NO: 317221 - DNA, 20 bp, human
gcggccccggcccccggatg

SEQ ID NO: 317222 - DNA, 20 bp, human
gccccggcccccggatgtgg

SEQ ID NO: 317223 - DNA, 20 bp, human
ggggcgctgtgcgctctctg

SEQ ID NO: 317224 - DNA, 20 bp, human
gcgccccggctcgttcccga

SEQ ID NO: 317225 - DNA, 20 bp, human
gaggcgccgcacggcggtgg

SEQ ID NO: 317226 - DNA, 20 bp, human
ggcgaccagtgtgttgttgt

SEQ ID NO: 317227 - DNA, 20 bp, human
gggcctgcgcatgagggtga

SEQ ID NO: 317228 - DNA, 20 bp, human
gatgcgcaggcctaggagtg

SEQ ID NO: 317229 - DNA, 20 bp, human
gtgaactagaacctgatagt

SEQ ID NO: 317230 - DNA, 20 bp, human
gaacaacacactggtcgccc

SEQ ID NO: 317231 - DNA, 20 bp, human
ggcaggcctaggagtggggc

SEQ ID NO: 317232 - DNA, 20 bp, human
gactcagaatgcccactatc

SEQ ID NO: 317233 - DNA, 20 bp, human
gctcctaggcctgcgcatga

SEQ ID NO: 317234 - DNA, 20 bp, human
gaggagtggggctggcgtcc

SEQ ID NO: 317235 - DNA, 20 bp, human
gttaattctaaatttgtcag

SEQ ID NO: 317236 - DNA, 20 bp, human
gcccgcgtttacaacactga

SEQ ID NO: 317237 - DNA, 20 bp, human
gcggctgatgagacaagcga

SEQ ID NO: 317238 - DNA, 20 bp, human
gcaagcgaaggaacgactcc

SEQ ID NO: 317239 - DNA, 20 bp, human
gcgcaagggcctgggcggga

SEQ ID NO: 317240 - DNA, 20 bp, human
gccactgcacacggcgagtc

SEQ ID NO: 317241 - DNA, 20 bp, human
ggccctcagtgttgtaaacg

SEQ ID NO: 317242 - DNA, 20 bp, human
gtcgccgtgtgcagtgggag

SEQ ID NO: 317243 - DNA, 20 bp, human
gttgagacgctgcggggaga

SEQ ID NO: 317244 - DNA, 20 bp, human
ggatggcctgccttgcgcaa

SEQ ID NO: 317245 - DNA, 20 bp, human
gccaggcccttgcgcaaggc

SEQ ID NO: 317246 - DNA, 20 bp, human
gacaggccagcgcacggggc

SEQ ID NO: 317247 - DNA, 20 bp, human
gctgccgaggcgcggaataa

SEQ ID NO: 317248 - DNA, 20 bp, human
ggggctgtcgcgccgaggga

SEQ ID NO: 317249 - DNA, 20 bp, human
gcggctgtgcgcgcgtctgt

SEQ ID NO: 317250 - DNA, 20 bp, human
ggagccggtcagcgcggggc

SEQ ID NO: 317251 - DNA, 20 bp, human
gcacggggcgggccaatgcg

SEQ ID NO: 317252 - DNA, 20 bp, human
gcgcacagccgcaggtggag

SEQ ID NO: 317253 - DNA, 20 bp, human
gcgggacaggccagcgcacg

SEQ ID NO: 317254 - DNA, 20 bp, human
ggctgagtccgctccacctg

SEQ ID NO: 317255 - DNA, 20 bp, human
ggctgaccggctccgcgcat

SEQ ID NO: 317256 - DNA, 20 bp, human
gtgcgtgcgcaggggttagg

SEQ ID NO: 317257 - DNA, 20 bp, human
ggggagagaggagttcattg

SEQ ID NO: 317258 - DNA, 20 bp, human
gtcactgatcccagccaatg

SEQ ID NO: 317259 - DNA, 20 bp, human
gttggaagcaggtactggaa

SEQ ID NO: 317260 - DNA, 20 bp, human
gcaatgaagcgaaacctcat

SEQ ID NO: 317261 - DNA, 20 bp, human
gaaaagatggtgccaaactg

SEQ ID NO: 317262 - DNA, 20 bp, human
gtgtgcgtgtgcgtgcgcag

SEQ ID NO: 317263 - DNA, 20 bp, human
gctaggtaatcgttattctt

SEQ ID NO: 317264 - DNA, 20 bp, human
ggtgtgcgtgcgcaggggtt

SEQ ID NO: 317265 - DNA, 20 bp, human
gccacctcgtgtatagctga

SEQ ID NO: 317266 - DNA, 20 bp, human
gagcttgccgggaaacctgg

SEQ ID NO: 317267 - DNA, 20 bp, human
gagctccgcgggcgcttcga

SEQ ID NO: 317268 - DNA, 20 bp, human
gaagctccgaaacccagagg

SEQ ID NO: 317269 - DNA, 20 bp, human
ggaagcgcccgcggagctac

SEQ ID NO: 317270 - DNA, 20 bp, human
ggtcacgcttcctaacacgc

SEQ ID NO: 317271 - DNA, 20 bp, human
gtccgaaacccagaggaggt

SEQ ID NO: 317272 - DNA, 20 bp, human
ggtcaccgcgcctgcgtgtt

SEQ ID NO: 317273 - DNA, 20 bp, human
ggcagccaaaatggcggacg

SEQ ID NO: 317274 - DNA, 20 bp, human
gtagcctcccgtagctccgc

SEQ ID NO: 317275 - DNA, 20 bp, human
gggcaagctccgaaacccag

SEQ ID NO: 317276 - DNA, 20 bp, human
ggggctgcgggtgactacgg

SEQ ID NO: 317277 - DNA, 20 bp, human
ggcaatctcggcaccccctg

SEQ ID NO: 317278 - DNA, 20 bp, human
gtaggagcaatggtgaatga

SEQ ID NO: 317279 - DNA, 20 bp, human
gggtgactacgggggcgtag

SEQ ID NO: 317280 - DNA, 20 bp, human
ggaggggctgcgggtgacta

SEQ ID NO: 317281 - DNA, 20 bp, human
gcgcgcatgcgcacaggatc

SEQ ID NO: 317282 - DNA, 20 bp, human
gtggtgactcaccaccccat

SEQ ID NO: 317283 - DNA, 20 bp, human
gcaaaaccttggagtcccat

SEQ ID NO: 317284 - DNA, 20 bp, human
gcggagcgccctttggcgag

SEQ ID NO: 317285 - DNA, 20 bp, human
ggtagcggggaccaaccgcg

SEQ ID NO: 317286 - DNA, 20 bp, human
gcgctcctgtaaggcctccg

SEQ ID NO: 317287 - DNA, 20 bp, human
gggaggggttccgaggttct

SEQ ID NO: 317288 - DNA, 20 bp, human
gctgcctgggaggggttccg

SEQ ID NO: 317289 - DNA, 20 bp, human
gaggccttacaggagcgacc

SEQ ID NO: 317290 - DNA, 20 bp, human
gacagccccggaggccttac

SEQ ID NO: 317291 - DNA, 20 bp, human
gacctggcaattcccgccgc

SEQ ID NO: 317292 - DNA, 20 bp, human
ggccggcggcgggaattgcc

SEQ ID NO: 317293 - DNA, 20 bp, human
gttgccaggtcgctcctgta

SEQ ID NO: 317294 - DNA, 20 bp, human
gaaagcaggcggcgacacct

SEQ ID NO: 317295 - DNA, 20 bp, human
gcaggcggcgacacctggga

SEQ ID NO: 317296 - DNA, 20 bp, human
gaagaggtggcaatcggcaa

SEQ ID NO: 317297 - DNA, 20 bp, human
gtgaacgcgcctgcgcggaa

SEQ ID NO: 317298 - DNA, 20 bp, human
gttagcaggtgggatcaagc

SEQ ID NO: 317299 - DNA, 20 bp, human
gccgggaaagggctattaaa

SEQ ID NO: 317300 - DNA, 20 bp, human
gaggtggcaatcggcaaggg

SEQ ID NO: 317301 - DNA, 20 bp, human
gggatcaagctggcaagagg

SEQ ID NO: 317302 - DNA, 20 bp, human
gctgactgggaagttaggag

SEQ ID NO: 317303 - DNA, 20 bp, human
gagtcactgactgggaagtt

SEQ ID NO: 317304 - DNA, 20 bp, human
gtctagctggttcttcagga

SEQ ID NO: 317305 - DNA, 20 bp, human
ggcgactgaacgcgcctgcg

SEQ ID NO: 317306 - DNA, 20 bp, human
ggggacaaaggtgtctcctg

SEQ ID NO: 317307 - DNA, 20 bp, human
ggggaaggccgcgtgctagt

SEQ ID NO: 317308 - DNA, 20 bp, human
gaggccgcgtgctagtgggt

SEQ ID NO: 317309 - DNA, 20 bp, human
gcccgcgtggcaagcaccgc

SEQ ID NO: 317310 - DNA, 20 bp, human
gtggcaagcaccgcaggttg

SEQ ID NO: 317311 - DNA, 20 bp, human
gctcctgcgggctgcgggga

SEQ ID NO: 317312 - DNA, 20 bp, human
gtggggccgggaagttgcag

SEQ ID NO: 317313 - DNA, 20 bp, human
ggcccccaaaccgaggaaga

SEQ ID NO: 317314 - DNA, 20 bp, human
gttacccggcctaacagctg

SEQ ID NO: 317315 - DNA, 20 bp, human
gttgaggcgcccccaaaccg

SEQ ID NO: 317316 - DNA, 20 bp, human
gtgcacgcatgcgtatgccc

SEQ ID NO: 317317 - DNA, 20 bp, human
ggcgaagtccccgggagtaa

SEQ ID NO: 317318 - DNA, 20 bp, human
gcccgggagtaagggagagg

SEQ ID NO: 317319 - DNA, 20 bp, human
ggccgccatcggccgaacgg

SEQ ID NO: 317320 - DNA, 20 bp, human
ggcacgctgccggtcgggct

SEQ ID NO: 317321 - DNA, 20 bp, human
gccggggagcgcgaagtccc

SEQ ID NO: 317322 - DNA, 20 bp, human
gaagagaaggcggccgccat

SEQ ID NO: 317323 - DNA, 20 bp, human
gtgcgtgcacgctgccggtc

SEQ ID NO: 317324 - DNA, 20 bp, human
gcgggaaccgcccactaccc

SEQ ID NO: 317325 - DNA, 20 bp, human
gtacccaggactccgacaga

SEQ ID NO: 317326 - DNA, 20 bp, human
ggccctgtgagtcggaaatt

SEQ ID NO: 317327 - DNA, 20 bp, human
gaagacgcttcctgaagttg

SEQ ID NO: 317328 - DNA, 20 bp, human
gtaagacaaaagcgaacgag

SEQ ID NO: 317329 - DNA, 20 bp, human
gccaaacagaagccgcacag

SEQ ID NO: 317330 - DNA, 20 bp, human
gcggcagcggatagcgcctg

SEQ ID NO: 317331 - DNA, 20 bp, human
ggacaaaagcgaacgagagg

SEQ ID NO: 317332 - DNA, 20 bp, human
gctctctcgtcaccgctgtg

SEQ ID NO: 317333 - DNA, 20 bp, human
gcgttcgcttttgtcttacg

SEQ ID NO: 317334 - DNA, 20 bp, human
gtcccaatttccgactcaca

SEQ ID NO: 317335 - DNA, 20 bp, human
gcgagtaaaaggcagtgtgg

SEQ ID NO: 317336 - DNA, 20 bp, human
ggagtcgctggccgcagggg

SEQ ID NO: 317337 - DNA, 20 bp, human
ggattggccgcctgggaagg

SEQ ID NO: 317338 - DNA, 20 bp, human
gtggccgagggtctccgacc

SEQ ID NO: 317339 - DNA, 20 bp, human
gcgcccgctaggctggccga

SEQ ID NO: 317340 - DNA, 20 bp, human
gggcgcgcgactcacggcct

SEQ ID NO: 317341 - DNA, 20 bp, human
gagggtctccgaccaggagg

SEQ ID NO: 317342 - DNA, 20 bp, human
gtacagacgcagccctgcga

SEQ ID NO: 317343 - DNA, 20 bp, human
gtcgcgccgggaatgacgtg

SEQ ID NO: 317344 - DNA, 20 bp, human
gcagagcccgccccctcgca

SEQ ID NO: 317345 - DNA, 20 bp, human
gtctggccgcacgtcattcc

SEQ ID NO: 317346 - DNA, 20 bp, human
gccacaagcagtgtcgtaag

SEQ ID NO: 317347 - DNA, 20 bp, human
gaagcagtgtcgtaagcggg

SEQ ID NO: 317348 - DNA, 20 bp, human
gtgcgcggaggcgagcagtg

SEQ ID NO: 317349 - DNA, 20 bp, human
gggaggagcatgaccccaga

SEQ ID NO: 317350 - DNA, 20 bp, human
gaaagatggaggttccggag

SEQ ID NO: 317351 - DNA, 20 bp, human
gggaggttccggagtggagg

SEQ ID NO: 317352 - DNA, 20 bp, human
gaggagaaagatggaggttc

SEQ ID NO: 317353 - DNA, 20 bp, human
gacgacactgcttgtggggc

SEQ ID NO: 317354 - DNA, 20 bp, human
gccacaaactgggaagaacg

SEQ ID NO: 317355 - DNA, 20 bp, human
gagtgtcgtaagcgggtggg

SEQ ID NO: 317356 - DNA, 20 bp, human
ggccccgcatacgggatcct

SEQ ID NO: 317357 - DNA, 20 bp, human
gaggcccaggatcccgtatg

SEQ ID NO: 317358 - DNA, 20 bp, human
gcggcagcgccggcctcagg

SEQ ID NO: 317359 - DNA, 20 bp, human
ggtcccgcggctctaccgag

SEQ ID NO: 317360 - DNA, 20 bp, human
gctcaccagtgccccgcata

SEQ ID NO: 317361 - DNA, 20 bp, human
gggtctggccggccatgtct

SEQ ID NO: 317362 - DNA, 20 bp, human
gctccccggcctagcgtgtg

SEQ ID NO: 317363 - DNA, 20 bp, human
gcctgccagggcctgtgcgg

SEQ ID NO: 317364 - DNA, 20 bp, human
gaacctgcccgctcccaaca

SEQ ID NO: 317365 - DNA, 20 bp, human
gcggcggccaatgggcttcc

SEQ ID NO: 317366 - DNA, 20 bp, human
gcgggctagtggatgcgcgg

SEQ ID NO: 317367 - DNA, 20 bp, human
ggcccgatggagagtcgggg

SEQ ID NO: 317368 - DNA, 20 bp, human
gacgggaggtgtcgccgctc

SEQ ID NO: 317369 - DNA, 20 bp, human
ggggcgggctagtggatgcg

SEQ ID NO: 317370 - DNA, 20 bp, human
gcccgccccgactctccatc

SEQ ID NO: 317371 - DNA, 20 bp, human
gaggcccgcaaggaaggcgc

SEQ ID NO: 317372 - DNA, 20 bp, human
gcgaatggggagggcgagtg

SEQ ID NO: 317373 - DNA, 20 bp, human
gcaggcccgatggagagtcg

SEQ ID NO: 317374 - DNA, 20 bp, human
gcctggaggtccctgaccgc

SEQ ID NO: 317375 - DNA, 20 bp, human
gagtgaggctggtcccaaag

SEQ ID NO: 317376 - DNA, 20 bp, human
gccccaggggccctcgatgg

SEQ ID NO: 317377 - DNA, 20 bp, human
ggtaacccggacatagtagg

SEQ ID NO: 317378 - DNA, 20 bp, human
gcacaggtccccagcgggta

SEQ ID NO: 317379 - DNA, 20 bp, human
gcccccaaaatgcccagttt

SEQ ID NO: 317380 - DNA, 20 bp, human
ggcctccgccctacccgctg

SEQ ID NO: 317381 - DNA, 20 bp, human
gtccccagcgggtagggcgg

SEQ ID NO: 317382 - DNA, 20 bp, human
gtcccgccacctactatgtc

SEQ ID NO: 317383 - DNA, 20 bp, human
ggcagtaacccggacatagt

SEQ ID NO: 317384 - DNA, 20 bp, human
gcggaggcgtggccttgcga

SEQ ID NO: 317385 - DNA, 20 bp, human
gaggtccccagcgggtaggg

SEQ ID NO: 317386 - DNA, 20 bp, human
gactgggtgggtaaaagaag

SEQ ID NO: 317387 - DNA, 20 bp, human
gaggagacggcgggacgact

SEQ ID NO: 317388 - DNA, 20 bp, human
gagacggcgggacgactggg

SEQ ID NO: 317389 - DNA, 20 bp, human
gacagccaacgctaccctta

SEQ ID NO: 317390 - DNA, 20 bp, human
gtgcaccctaagggtagcgt

SEQ ID NO: 317391 - DNA, 20 bp, human
gggacggggccgctacgggt

SEQ ID NO: 317392 - DNA, 20 bp, human
gcgggcggggctgaactagc

SEQ ID NO: 317393 - DNA, 20 bp, human
gagacgacgctctggacagg

SEQ ID NO: 317394 - DNA, 20 bp, human
gctagggtgccttaggagaa

SEQ ID NO: 317395 - DNA, 20 bp, human
gcagggtaggggatcgaaag

SEQ ID NO: 317396 - DNA, 20 bp, human
gaatatcaatgctcttttag

SEQ ID NO: 317397 - DNA, 20 bp, human
gtctgtgaagcttggtgtac

SEQ ID NO: 317398 - DNA, 20 bp, human
gcaccaagcttcacagagtt

SEQ ID NO: 317399 - DNA, 20 bp, human
ggcagtgtgaagacaagttt

SEQ ID NO: 317400 - DNA, 20 bp, human
ggattgaaaacactaatgta

SEQ ID NO: 317401 - DNA, 20 bp, human
gtgctaaacactgtgaataa

SEQ ID NO: 317402 - DNA, 20 bp, human
gcactttaatagccatacag

SEQ ID NO: 317403 - DNA, 20 bp, human
gtatcttttgatccactgta

SEQ ID NO: 317404 - DNA, 20 bp, human
gtttaaaccatagggaaata

SEQ ID NO: 317405 - DNA, 20 bp, human
ggaaaatataaatatgtttc

SEQ ID NO: 317406 - DNA, 20 bp, human
gcagctgggaggaaccaagt

SEQ ID NO: 317407 - DNA, 20 bp, human
gacaaagagggagacgggtg

SEQ ID NO: 317408 - DNA, 20 bp, human
ggcggcgaatgtagcaagag

SEQ ID NO: 317409 - DNA, 20 bp, human
ggctcccgcgagtcccgctc

SEQ ID NO: 317410 - DNA, 20 bp, human
gccaccccgcgctgtcacat

SEQ ID NO: 317411 - DNA, 20 bp, human
gcgcccggagcgggactcgc

SEQ ID NO: 317412 - DNA, 20 bp, human
gggccgtcctccggattccg

SEQ ID NO: 317413 - DNA, 20 bp, human
ggctgcggagtgaactggga

SEQ ID NO: 317414 - DNA, 20 bp, human
ggtgacgcagatcccggcgt

SEQ ID NO: 317415 - DNA, 20 bp, human
gtcactcggccgcgcgtggg

SEQ ID NO: 317416 - DNA, 20 bp, human
gtctcccagtctctaagccg

SEQ ID NO: 317417 - DNA, 20 bp, human
gacgccgcggcttagagact

SEQ ID NO: 317418 - DNA, 20 bp, human
gctccctgtgcgtcctgcgg

SEQ ID NO: 317419 - DNA, 20 bp, human
gagactgggagaggcggaga

SEQ ID NO: 317420 - DNA, 20 bp, human
gaggcggagacgggggggga

SEQ ID NO: 317421 - DNA, 20 bp, human
gcagagccggggcgccgaat

SEQ ID NO: 317422 - DNA, 20 bp, human
gctcggccgcggagacgccg

SEQ ID NO: 317423 - DNA, 20 bp, human
ggggtacgtgggcgccaaga

SEQ ID NO: 317424 - DNA, 20 bp, human
gctctcagctcggaggggtg

SEQ ID NO: 317425 - DNA, 20 bp, human
ggtcacctcggtccccaatt

SEQ ID NO: 317426 - DNA, 20 bp, human
ggcgcggcgacagctgaagt

SEQ ID NO: 317427 - DNA, 20 bp, human
gagagcgattggaaggacga

SEQ ID NO: 317428 - DNA, 20 bp, human
gagcccgcgctgacagcccc

SEQ ID NO: 317429 - DNA, 20 bp, human
gcggcgacagctgaagtggg

SEQ ID NO: 317430 - DNA, 20 bp, human
gaggcggggccgagagcgat

SEQ ID NO: 317431 - DNA, 20 bp, human
gggggccgagagcgattgga

SEQ ID NO: 317432 - DNA, 20 bp, human
ggaagtgggtggagaacggg

SEQ ID NO: 317433 - DNA, 20 bp, human
gccacgcccgcctggtgctg

SEQ ID NO: 317434 - DNA, 20 bp, human
gccccgggggctgtcagcgc

SEQ ID NO: 317435 - DNA, 20 bp, human
gcgcgcgccggcaggaccct

SEQ ID NO: 317436 - DNA, 20 bp, human
gggaaaaatccaccactaga

SEQ ID NO: 317437 - DNA, 20 bp, human
gctgccctgcccagccaatc

SEQ ID NO: 317438 - DNA, 20 bp, human
gggccctgtgcgccttctag

SEQ ID NO: 317439 - DNA, 20 bp, human
gagagactcgtgcgccgcga

SEQ ID NO: 317440 - DNA, 20 bp, human
ggggcaggcggcgggacgca

SEQ ID NO: 317441 - DNA, 20 bp, human
gacagagccaactatctcca

SEQ ID NO: 317442 - DNA, 20 bp, human
gacgagtctctgatcccgat

SEQ ID NO: 317443 - DNA, 20 bp, human
ggagatagttggctctgtag

SEQ ID NO: 317444 - DNA, 20 bp, human
gaaggaaccttggagatagt

SEQ ID NO: 317445 - DNA, 20 bp, human
gcaccactagaaggcgcaca

SEQ ID NO: 317446 - DNA, 20 bp, human
gtcccagcctctcccgggaa

SEQ ID NO: 317447 - DNA, 20 bp, human
ggcaaaggatccgtctgagg

SEQ ID NO: 317448 - DNA, 20 bp, human
gggggcaaaggatccgtctg

SEQ ID NO: 317449 - DNA, 20 bp, human
gtcccttcccttcccgggag

SEQ ID NO: 317450 - DNA, 20 bp, human
ggcctctcccgggaagggaa

SEQ ID NO: 317451 - DNA, 20 bp, human
ggtacgcaccgccctggaag

SEQ ID NO: 317452 - DNA, 20 bp, human
gtccacctaaaagagggtgt

SEQ ID NO: 317453 - DNA, 20 bp, human
gtaaacaaagaggcggggtt

SEQ ID NO: 317454 - DNA, 20 bp, human
gaggctgggacccggcacca

SEQ ID NO: 317455 - DNA, 20 bp, human
gtgaggcggcgacgagtggt

SEQ ID NO: 317456 - DNA, 20 bp, human
ggggtggtgacaaggactaa

SEQ ID NO: 317457 - DNA, 20 bp, human
gcaggccgttcccacggcgg

SEQ ID NO: 317458 - DNA, 20 bp, human
gagtcactcgtcaaaggaag

SEQ ID NO: 317459 - DNA, 20 bp, human
gcctgacagtcactcgtcaa

SEQ ID NO: 317460 - DNA, 20 bp, human
gcgcgcagagagctcctgct

SEQ ID NO: 317461 - DNA, 20 bp, human
gcgccctccggtccgcgaag

SEQ ID NO: 317462 - DNA, 20 bp, human
ggggactaggatccgattcc

SEQ ID NO: 317463 - DNA, 20 bp, human
gtgtcaggccgttcccacgg

SEQ ID NO: 317464 - DNA, 20 bp, human
gcgccacttcgcggaccgga

SEQ ID NO: 317465 - DNA, 20 bp, human
gaccacccccgccgtgggaa

SEQ ID NO: 317466 - DNA, 20 bp, human
ggtgagtggcacttgggaat

SEQ ID NO: 317467 - DNA, 20 bp, human
gcactgccatgaggtcaagt

SEQ ID NO: 317468 - DNA, 20 bp, human
gccatgaggtcaagttggaa

SEQ ID NO: 317469 - DNA, 20 bp, human
ggtaagttacgcggtctgag

SEQ ID NO: 317470 - DNA, 20 bp, human
gttacgcggtctgagtggtg

SEQ ID NO: 317471 - DNA, 20 bp, human
gctgagtggtgcggtgtgag

SEQ ID NO: 317472 - DNA, 20 bp, human
gggtcaagttggaatggaaa

SEQ ID NO: 317473 - DNA, 20 bp, human
gacggctcctatcaaaagat

SEQ ID NO: 317474 - DNA, 20 bp, human
gtgacccacgcttgttgcag

SEQ ID NO: 317475 - DNA, 20 bp, human
ggggagcaagaaaagatcga

SEQ ID NO: 317476 - DNA, 20 bp, human
gactgcggagggcgtagggg

SEQ ID NO: 317477 - DNA, 20 bp, human
gagggaggccacagccgggt

SEQ ID NO: 317478 - DNA, 20 bp, human
gggctcgccaggcactgcgg

SEQ ID NO: 317479 - DNA, 20 bp, human
gaggcactgcggagggcgta

SEQ ID NO: 317480 - DNA, 20 bp, human
gtcgctgtgggcggtttcgt

SEQ ID NO: 317481 - DNA, 20 bp, human
ggaaaccgcccacagcgaga

SEQ ID NO: 317482 - DNA, 20 bp, human
gcacgctcactcgctgggac

SEQ ID NO: 317483 - DNA, 20 bp, human
gcggcggcacggactgacgg

SEQ ID NO: 317484 - DNA, 20 bp, human
gcccgcgcacgctcactcgc

SEQ ID NO: 317485 - DNA, 20 bp, human
gtggaagctgggttgcctca

SEQ ID NO: 317486 - DNA, 20 bp, human
gatcccccaggggcatagag

SEQ ID NO: 317487 - DNA, 20 bp, human
gtactggcgaggatccccca

SEQ ID NO: 317488 - DNA, 20 bp, human
gagacggagccggttagaag

SEQ ID NO: 317489 - DNA, 20 bp, human
gaaggggcgcgctcggagct

SEQ ID NO: 317490 - DNA, 20 bp, human
ggggatcctcgccagtacgt

SEQ ID NO: 317491 - DNA, 20 bp, human
gggcgcgctcggagctcggc

SEQ ID NO: 317492 - DNA, 20 bp, human
gaggtcgcgggactagaagg

SEQ ID NO: 317493 - DNA, 20 bp, human
gccaaggtcgcgggactaga

SEQ ID NO: 317494 - DNA, 20 bp, human
gactagaaggtggcggggcc

SEQ ID NO: 317495 - DNA, 20 bp, human
gctggcctcgcctggagggc

SEQ ID NO: 317496 - DNA, 20 bp, human
gaggtgggctcccggggtcg

SEQ ID NO: 317497 - DNA, 20 bp, human
ggaaccccgagcgctgggga

SEQ ID NO: 317498 - DNA, 20 bp, human
gtggggaaccccgagcgctg

SEQ ID NO: 317499 - DNA, 20 bp, human
gccggaaggaggacgcgcga

SEQ ID NO: 317500 - DNA, 20 bp, human
gcgcgcgcgcactggcagcc

SEQ ID NO: 317501 - DNA, 20 bp, human
ggtgcccgcgggccgttaaa

SEQ ID NO: 317502 - DNA, 20 bp, human
gcccgcctgagcgtccaggg

SEQ ID NO: 317503 - DNA, 20 bp, human
gccgggagggtccccagtgg

SEQ ID NO: 317504 - DNA, 20 bp, human
gcccgcgcagggtcgaccgc

SEQ ID NO: 317505 - DNA, 20 bp, human
gcgccggcagctccggaagg

SEQ ID NO: 317506 - DNA, 20 bp, human
ggaagaggggcgaatcgcgg

SEQ ID NO: 317507 - DNA, 20 bp, human
gggggaagaggggcgaatcg

SEQ ID NO: 317508 - DNA, 20 bp, human
ggggacctcccggaccacgt

SEQ ID NO: 317509 - DNA, 20 bp, human
gtcccggcgccggtgggacc

SEQ ID NO: 317510 - DNA, 20 bp, human
ggctgggatcacaatgtcgg

SEQ ID NO: 317511 - DNA, 20 bp, human
gtgggacccggcagacgcgc

SEQ ID NO: 317512 - DNA, 20 bp, human
gaccacgtgggccggctcag

SEQ ID NO: 317513 - DNA, 20 bp, human
gggggtcggcgccccgagga

SEQ ID NO: 317514 - DNA, 20 bp, human
ggcgggacgccccacgtgcg

SEQ ID NO: 317515 - DNA, 20 bp, human
ggcggtggagagcagtgacc

SEQ ID NO: 317516 - DNA, 20 bp, human
ggctggagctccctacacag

SEQ ID NO: 317517 - DNA, 20 bp, human
gcccgccaaagaaaaagaac

SEQ ID NO: 317518 - DNA, 20 bp, human
gaaggccgcttctgtgggtg

SEQ ID NO: 317519 - DNA, 20 bp, human
gactctagaagattctactg

SEQ ID NO: 317520 - DNA, 20 bp, human
gccagccacacccacagaag

SEQ ID NO: 317521 - DNA, 20 bp, human
gaggcaaccagtgactgtcg

SEQ ID NO: 317522 - DNA, 20 bp, human
gtggggcccacgacagtcac

SEQ ID NO: 317523 - DNA, 20 bp, human
gcccagttctttttctttgg

SEQ ID NO: 317524 - DNA, 20 bp, human
gacacagcgggacacgcgaa

SEQ ID NO: 317525 - DNA, 20 bp, human
gacaggttgtgcaatttctc

SEQ ID NO: 317526 - DNA, 20 bp, human
gaccccacgcgggagaaagg

SEQ ID NO: 317527 - DNA, 20 bp, human
gctcggggaagcgtgtggtg

SEQ ID NO: 317528 - DNA, 20 bp, human
gcacgcgggagaaaggtggg

SEQ ID NO: 317529 - DNA, 20 bp, human
ggcgaagttagaggcccggg

SEQ ID NO: 317530 - DNA, 20 bp, human
ggagaccccacgcgggagaa

SEQ ID NO: 317531 - DNA, 20 bp, human
ggcccccaggctaactctat

SEQ ID NO: 317532 - DNA, 20 bp, human
gaatggaggccccagctagt

SEQ ID NO: 317533 - DNA, 20 bp, human
gggccgatagagttagcctg

SEQ ID NO: 317534 - DNA, 20 bp, human
gcggctagggggacgtaccc

SEQ ID NO: 317535 - DNA, 20 bp, human
ggccccgcgccgcctcagac

SEQ ID NO: 317536 - DNA, 20 bp, human
ggggccggggcctgggacgt

SEQ ID NO: 317537 - DNA, 20 bp, human
gacggggcggggcgatccgt

SEQ ID NO: 317538 - DNA, 20 bp, human
gcgcggtgccgtgaacgctg

SEQ ID NO: 317539 - DNA, 20 bp, human
gggccggagcctcaacggat

SEQ ID NO: 317540 - DNA, 20 bp, human
gccacctcgctgcgcaggcg

SEQ ID NO: 317541 - DNA, 20 bp, human
gcctccccgcccatccgttg

SEQ ID NO: 317542 - DNA, 20 bp, human
gcggtcgtgagctcctcaga

SEQ ID NO: 317543 - DNA, 20 bp, human
ggaggtggcctcagcgttca

SEQ ID NO: 317544 - DNA, 20 bp, human
gggcggggcgatccgtaggc

SEQ ID NO: 317545 - DNA, 20 bp, human
gcggggccgggcaacccgga

SEQ ID NO: 317546 - DNA, 20 bp, human
gtgcactgcgcacgcgtcgc

SEQ ID NO: 317547 - DNA, 20 bp, human
gcagacccgctcgggtacca

SEQ ID NO: 317548 - DNA, 20 bp, human
gagcgcgcaggagacggtag

SEQ ID NO: 317549 - DNA, 20 bp, human
gagcggccctggtacccgag

SEQ ID NO: 317550 - DNA, 20 bp, human
gggacagagggcaaattggc

SEQ ID NO: 317551 - DNA, 20 bp, human
gcggtacgccggggcctaag

SEQ ID NO: 317552 - DNA, 20 bp, human
gcaagagccccagacccgct

SEQ ID NO: 317553 - DNA, 20 bp, human
gggagacggtagcggcgaag

SEQ ID NO: 317554 - DNA, 20 bp, human
gtggggctcttggtccccat

SEQ ID NO: 317555 - DNA, 20 bp, human
gacgcgtcgccggtacgccg

SEQ ID NO: 317556 - DNA, 20 bp, human
ggaagagcgtgtgacgtatg

SEQ ID NO: 317557 - DNA, 20 bp, human
gggcccaggcagtgttgctg

SEQ ID NO: 317558 - DNA, 20 bp, human
gacggcgcgacggcgctcgc

SEQ ID NO: 317559 - DNA, 20 bp, human
gttcgaaaatcaggattagg

SEQ ID NO: 317560 - DNA, 20 bp, human
gatgtggcgcgacggcgcga

SEQ ID NO: 317561 - DNA, 20 bp, human
ggaaagcgttgctgcgtaaa

SEQ ID NO: 317562 - DNA, 20 bp, human
gtgtgacgtatgtggcgcga

SEQ ID NO: 317563 - DNA, 20 bp, human
gaaaatcaggattagggggt

SEQ ID NO: 317564 - DNA, 20 bp, human
gtgtagttacctgagaaacg

SEQ ID NO: 317565 - DNA, 20 bp, human
ggttgctgcgtaaatggcgg

SEQ ID NO: 317566 - DNA, 20 bp, human
gcctgcctcgctagcacgca

SEQ ID NO: 317567 - DNA, 20 bp, human
gagtggggaagggcttaggg

SEQ ID NO: 317568 - DNA, 20 bp, human
ggactcggggctgtccttcg

SEQ ID NO: 317569 - DNA, 20 bp, human
gaggccggacccatatgggc

SEQ ID NO: 317570 - DNA, 20 bp, human
gcccagtggggaagggctta

SEQ ID NO: 317571 - DNA, 20 bp, human
gtgccccgcccatatgggtc

SEQ ID NO: 317572 - DNA, 20 bp, human
gcccgccctgcgtgctagcg

SEQ ID NO: 317573 - DNA, 20 bp, human
gtgggaggccggacccatat

SEQ ID NO: 317574 - DNA, 20 bp, human
ggtgctagcgaggcaggcat

SEQ ID NO: 317575 - DNA, 20 bp, human
ggcggggcacagcgttgcta

SEQ ID NO: 317576 - DNA, 20 bp, human
ggctgccgggaccgcctcga

SEQ ID NO: 317577 - DNA, 20 bp, human
gcagacccccgcgaagctgt

SEQ ID NO: 317578 - DNA, 20 bp, human
gggaccgcagtcgctccacc

SEQ ID NO: 317579 - DNA, 20 bp, human
gaggtcagtgatgtgtccta

SEQ ID NO: 317580 - DNA, 20 bp, human
gtgagggacgcagccatccc

SEQ ID NO: 317581 - DNA, 20 bp, human
gcgggaggtcacgggaagtg

SEQ ID NO: 317582 - DNA, 20 bp, human
gcgcacgcgcaacctaacgc

SEQ ID NO: 317583 - DNA, 20 bp, human
gggatccaggaggacgggag

SEQ ID NO: 317584 - DNA, 20 bp, human
gcaaggaaggggagcggaat

SEQ ID NO: 317585 - DNA, 20 bp, human
gcaaagaggggtatctaggt

SEQ ID NO: 317586 - DNA, 20 bp, human
gggtggggagcgtgtgaccc

SEQ ID NO: 317587 - DNA, 20 bp, human
gtaccaggatactcccttgg

SEQ ID NO: 317588 - DNA, 20 bp, human
gtctcgtgaccgcacgcggt

SEQ ID NO: 317589 - DNA, 20 bp, human
gcgcccccaagggagtatcc

SEQ ID NO: 317590 - DNA, 20 bp, human
gacacgctccccaccgcgtg

SEQ ID NO: 317591 - DNA, 20 bp, human
gggctcagggccaggagtcg

SEQ ID NO: 317592 - DNA, 20 bp, human
gcccggctccagggccgaag

SEQ ID NO: 317593 - DNA, 20 bp, human
gtccggccacgtggacccga

SEQ ID NO: 317594 - DNA, 20 bp, human
gagggccagcgggtcccctt

SEQ ID NO: 317595 - DNA, 20 bp, human
gggtcacgagacgcccccaa

SEQ ID NO: 317596 - DNA, 20 bp, human
gagaagccagcgacccgtgg

SEQ ID NO: 317597 - DNA, 20 bp, human
gccggggcctcgggtcatgt

SEQ ID NO: 317598 - DNA, 20 bp, human
gccgaggccccggtccaata

SEQ ID NO: 317599 - DNA, 20 bp, human
gcgtccggcggcctcgactc

SEQ ID NO: 317600 - DNA, 20 bp, human
gccaatatggcgacctccac

SEQ ID NO: 317601 - DNA, 20 bp, human
gtcacgtgactcaagtccca

SEQ ID NO: 317602 - DNA, 20 bp, human
gaggagaagccagcgacccg

SEQ ID NO: 317603 - DNA, 20 bp, human
ggggaccccccgaaccaggc

SEQ ID NO: 317604 - DNA, 20 bp, human
gggcgagcccacatgacccg

SEQ ID NO: 317605 - DNA, 20 bp, human
gaggtcgccatattggaccg

SEQ ID NO: 317606 - DNA, 20 bp, human
ggggccgagactaaatgtgg

SEQ ID NO: 317607 - DNA, 20 bp, human
gagtgggttcagttcctcca

SEQ ID NO: 317608 - DNA, 20 bp, human
gggccccgccccctgactca

SEQ ID NO: 317609 - DNA, 20 bp, human
gtaggctcccccgcccctgg

SEQ ID NO: 317610 - DNA, 20 bp, human
ggaacccactatcggtcatg

SEQ ID NO: 317611 - DNA, 20 bp, human
gcggccccatgaccgatagt

SEQ ID NO: 317612 - DNA, 20 bp, human
gtcagttcctccaggggcgg

SEQ ID NO: 317613 - DNA, 20 bp, human
ggaggaactgaacccactat

SEQ ID NO: 317614 - DNA, 20 bp, human
gatggggccgagactaaatg

SEQ ID NO: 317615 - DNA, 20 bp, human
gaacccgccacatttagtct

SEQ ID NO: 317616 - DNA, 20 bp, human
gctgctgtgccattttttgg

SEQ ID NO: 317617 - DNA, 20 bp, human
ggccaagagctgcaaggtgc

SEQ ID NO: 317618 - DNA, 20 bp, human
gaaaaatggcacagcagcgg

SEQ ID NO: 317619 - DNA, 20 bp, human
gcagcccgagggagccgtag

SEQ ID NO: 317620 - DNA, 20 bp, human
gcagacccgccgccaaaaaa

SEQ ID NO: 317621 - DNA, 20 bp, human
gggcagagtagcacgctctg

SEQ ID NO: 317622 - DNA, 20 bp, human
gcctccgcaggtggacgagg

SEQ ID NO: 317623 - DNA, 20 bp, human
gtgggaggccaaggcgcagc

SEQ ID NO: 317624 - DNA, 20 bp, human
gccctccaggcctgccggac

SEQ ID NO: 317625 - DNA, 20 bp, human
gctggggctgccggccccta

SEQ ID NO: 317626 - DNA, 20 bp, human
gtaggtgggcggggccctct

SEQ ID NO: 317627 - DNA, 20 bp, human
ggagcagctaccaaccggga

SEQ ID NO: 317628 - DNA, 20 bp, human
ggaagtgaataaaggttagg

SEQ ID NO: 317629 - DNA, 20 bp, human
gcggcggaagaggcagattc

SEQ ID NO: 317630 - DNA, 20 bp, human
ggaaaaccggccttcccggt

SEQ ID NO: 317631 - DNA, 20 bp, human
gggcggggccctctgggcga

SEQ ID NO: 317632 - DNA, 20 bp, human
gcaaatatcacgtcgatcac

SEQ ID NO: 317633 - DNA, 20 bp, human
gcaggcgaattacagtaagc

SEQ ID NO: 317634 - DNA, 20 bp, human
gttcccggagaagcgctggg

SEQ ID NO: 317635 - DNA, 20 bp, human
gcgcctcccagcgcttctcc

SEQ ID NO: 317636 - DNA, 20 bp, human
gagcgagacccttagaaagt

SEQ ID NO: 317637 - DNA, 20 bp, human
gtgggtctcccatcaagcct

SEQ ID NO: 317638 - DNA, 20 bp, human
gggtaatttcccaggcttga

SEQ ID NO: 317639 - DNA, 20 bp, human
gtaatagaaggtaatttccc

SEQ ID NO: 317640 - DNA, 20 bp, human
gttatcaaataaataataga

SEQ ID NO: 317641 - DNA, 20 bp, human
gtttggtattcccactattc

SEQ ID NO: 317642 - DNA, 20 bp, human
gaattactcacctgaatagt

SEQ ID NO: 317643 - DNA, 20 bp, human
gttcttttcctactttctaa

SEQ ID NO: 317644 - DNA, 20 bp, human
gaaagagagtaacagacagt

SEQ ID NO: 317645 - DNA, 20 bp, human
gcagcccaatgaatgtagag

SEQ ID NO: 317646 - DNA, 20 bp, human
gacctccagagagggtaaaa

SEQ ID NO: 317647 - DNA, 20 bp, human
gttaccctctctggaggtcg

SEQ ID NO: 317648 - DNA, 20 bp, human
gcacgcctcgacctccagag

SEQ ID NO: 317649 - DNA, 20 bp, human
ggctatcccctgaaagacta

SEQ ID NO: 317650 - DNA, 20 bp, human
gatgacagtgagctaactgg

SEQ ID NO: 317651 - DNA, 20 bp, human
gcgaaagctctccaaacctg

SEQ ID NO: 317652 - DNA, 20 bp, human
gagtgagctaactggtggct

SEQ ID NO: 317653 - DNA, 20 bp, human
gaaaaaataaaccacaggtt

SEQ ID NO: 317654 - DNA, 20 bp, human
gccagagagggtaaaagggc

SEQ ID NO: 317655 - DNA, 20 bp, human
gtggttaaatcactggcaac

SEQ ID NO: 317656 - DNA, 20 bp, human
gaggctgcgccgcagttggt

SEQ ID NO: 317657 - DNA, 20 bp, human
gggactgcagtgatgccgaa

SEQ ID NO: 317658 - DNA, 20 bp, human
ggtactcaacagcacggcgg

SEQ ID NO: 317659 - DNA, 20 bp, human
ggacgcgggcccctcaccta

SEQ ID NO: 317660 - DNA, 20 bp, human
gagtccgccgggcacacgcg

SEQ ID NO: 317661 - DNA, 20 bp, human
ggtaccccgcgtgtgcccgg

SEQ ID NO: 317662 - DNA, 20 bp, human
gtggcgctccccaccaactg

SEQ ID NO: 317663 - DNA, 20 bp, human
gcgaagggcgggcaccgcag

SEQ ID NO: 317664 - DNA, 20 bp, human
ggaggaggctgcgccgcagt

SEQ ID NO: 317665 - DNA, 20 bp, human
ggcgggcccctcacctacgg

SEQ ID NO: 317666 - DNA, 20 bp, human
gggtgacggggtgaaggcgg

SEQ ID NO: 317667 - DNA, 20 bp, human
gtcaccccgtcaccctccgg

SEQ ID NO: 317668 - DNA, 20 bp, human
ggggcccgggagccgtgacg

SEQ ID NO: 317669 - DNA, 20 bp, human
ggctcgcagtctgggagctc

SEQ ID NO: 317670 - DNA, 20 bp, human
gggtgaaggcgggggaaccg

SEQ ID NO: 317671 - DNA, 20 bp, human
gaaggcgggggaaccgaggt

SEQ ID NO: 317672 - DNA, 20 bp, human
gccctccgggggccgagaaa

SEQ ID NO: 317673 - DNA, 20 bp, human
gtcggcccccggagggtgac

SEQ ID NO: 317674 - DNA, 20 bp, human
gggctcgcgtgctcgcagtc

SEQ ID NO: 317675 - DNA, 20 bp, human
gtccgggggccgagaaaggg

SEQ ID NO: 317676 - DNA, 20 bp, human
gcacaagggtgggtcagtag

SEQ ID NO: 317677 - DNA, 20 bp, human
gaatatggttcaacaggaat

SEQ ID NO: 317678 - DNA, 20 bp, human
gagggggtgtgcccgccagg

SEQ ID NO: 317679 - DNA, 20 bp, human
gatcaggaatatggttcaac

SEQ ID NO: 317680 - DNA, 20 bp, human
gtttactgggattacagggg

SEQ ID NO: 317681 - DNA, 20 bp, human
gaacttttaaatcaggaata

SEQ ID NO: 317682 - DNA, 20 bp, human
gtgtgcccgccaggaggggt

SEQ ID NO: 317683 - DNA, 20 bp, human
gtagacccacccctcctggc

SEQ ID NO: 317684 - DNA, 20 bp, human
gagtagggggtgtgcccgcc

SEQ ID NO: 317685 - DNA, 20 bp, human
gcagagtaacccagactagg

SEQ ID NO: 317686 - DNA, 20 bp, human
gcaaaatacagtggagagac

SEQ ID NO: 317687 - DNA, 20 bp, human
gtcagtatatctcactattt

SEQ ID NO: 317688 - DNA, 20 bp, human
gcccagtggcaattcacaaa

SEQ ID NO: 317689 - DNA, 20 bp, human
gctcactgtctgtccccgaa

SEQ ID NO: 317690 - DNA, 20 bp, human
gtccttttgtgaattgccac

SEQ ID NO: 317691 - DNA, 20 bp, human
gatttcctgacatctatttt

SEQ ID NO: 317692 - DNA, 20 bp, human
gaaaaaaaaaatgtagggct

SEQ ID NO: 317693 - DNA, 20 bp, human
gggctccaaaaatagatgtc

SEQ ID NO: 317694 - DNA, 20 bp, human
gcactgggtgctcatatttg

SEQ ID NO: 317695 - DNA, 20 bp, human
ggaaaagttttttttcttca

SEQ ID NO: 317696 - DNA, 20 bp, human
gtccgctccgcctccgtccg

SEQ ID NO: 317697 - DNA, 20 bp, human
gccgccccctcccggaatga

SEQ ID NO: 317698 - DNA, 20 bp, human
ggtcgggcggccttcattcc

SEQ ID NO: 317699 - DNA, 20 bp, human
gggagccgcgcgggctggag

SEQ ID NO: 317700 - DNA, 20 bp, human
ggccccggacggaggcggag

SEQ ID NO: 317701 - DNA, 20 bp, human
gtggtgggaacacggggagg

SEQ ID NO: 317702 - DNA, 20 bp, human
ggaggcgccgcctcgagccg

SEQ ID NO: 317703 - DNA, 20 bp, human
ggggcggccttcattccggg

SEQ ID NO: 317704 - DNA, 20 bp, human
gagcctcgccagctgtcggg

SEQ ID NO: 317705 - DNA, 20 bp, human
ggaggagtgggcccgataaa

SEQ ID NO: 317706 - DNA, 20 bp, human
ggagctgggaccagagatca

SEQ ID NO: 317707 - DNA, 20 bp, human
ggtggagcttaggatttaaa

SEQ ID NO: 317708 - DNA, 20 bp, human
gaagaactaaagtcagatgg

SEQ ID NO: 317709 - DNA, 20 bp, human
gccccacccctaggctggag

SEQ ID NO: 317710 - DNA, 20 bp, human
gtcagatgggggttatgggc

SEQ ID NO: 317711 - DNA, 20 bp, human
gctaagtaaaggtggagctt

SEQ ID NO: 317712 - DNA, 20 bp, human
ggtgcagcccctccagccta

SEQ ID NO: 317713 - DNA, 20 bp, human
gttcacagagatgtggaagg

SEQ ID NO: 317714 - DNA, 20 bp, human
gaaagtcagatgggggttat

SEQ ID NO: 317715 - DNA, 20 bp, human
gagactcttctaagtaaagg

SEQ ID NO: 317716 - DNA, 20 bp, human
ggggctgtggtgcacctcgc

SEQ ID NO: 317717 - DNA, 20 bp, human
gtccctggaggtgtgtacgg

SEQ ID NO: 317718 - DNA, 20 bp, human
gcctacaaggaggggaggca

SEQ ID NO: 317719 - DNA, 20 bp, human
gccccccgtacacacctcca

SEQ ID NO: 317720 - DNA, 20 bp, human
gaaaggagtgtggtagtccc

SEQ ID NO: 317721 - DNA, 20 bp, human
gctaaggactcctacaagga

SEQ ID NO: 317722 - DNA, 20 bp, human
gtcggccagcacagactccc

SEQ ID NO: 317723 - DNA, 20 bp, human
gtacacacctccagggaatt

SEQ ID NO: 317724 - DNA, 20 bp, human
gcaggacacagggtgtgtgg

SEQ ID NO: 317725 - DNA, 20 bp, human
gggactcctacaaggagggg

SEQ ID NO: 317726 - DNA, 20 bp, human
gggactgcccagagagacgt

SEQ ID NO: 317727 - DNA, 20 bp, human
gagatcccgcgagactccca

SEQ ID NO: 317728 - DNA, 20 bp, human
gcataccctgggagtctcgc

SEQ ID NO: 317729 - DNA, 20 bp, human
gggatgcggcgacttctcag

SEQ ID NO: 317730 - DNA, 20 bp, human
ggagccctggaaacgtgtgt

SEQ ID NO: 317731 - DNA, 20 bp, human
gttagggcacaggtactaaa

SEQ ID NO: 317732 - DNA, 20 bp, human
gcagggaatgagacagatcg

SEQ ID NO: 317733 - DNA, 20 bp, human
gtgtacgcgcaggtcactgt

SEQ ID NO: 317734 - DNA, 20 bp, human
gagatggtctggtgacttcg

SEQ ID NO: 317735 - DNA, 20 bp, human
gctgcccagagagacgtggg

SEQ ID NO: 317736 - DNA, 20 bp, human
ggggcctcccgcgggaaggg

SEQ ID NO: 317737 - DNA, 20 bp, human
gtcaagcctcgcacaggaga

SEQ ID NO: 317738 - DNA, 20 bp, human
gtctctcccgacagccaatc

SEQ ID NO: 317739 - DNA, 20 bp, human
gtcccgacagccaatcgggg

SEQ ID NO: 317740 - DNA, 20 bp, human
gtggtccgagaccacgctct

SEQ ID NO: 317741 - DNA, 20 bp, human
gcgacagccaatcggggcgg

SEQ ID NO: 317742 - DNA, 20 bp, human
gcgcggccctctcctgtgcg

SEQ ID NO: 317743 - DNA, 20 bp, human
gtcccgcgggaagggcggcg

SEQ ID NO: 317744 - DNA, 20 bp, human
gtggctgtcgggagagaggc

SEQ ID NO: 317745 - DNA, 20 bp, human
ggcacgcacggataccgcga

SEQ ID NO: 317746 - DNA, 20 bp, human
ggcgtccgccgtctaggctg

SEQ ID NO: 317747 - DNA, 20 bp, human
gctgcaggagtcctcggtgg

SEQ ID NO: 317748 - DNA, 20 bp, human
gaggcccaggcgccgcgctt

SEQ ID NO: 317749 - DNA, 20 bp, human
ggacctccatacccccaccg

SEQ ID NO: 317750 - DNA, 20 bp, human
ggcgttgctgggagactaca

SEQ ID NO: 317751 - DNA, 20 bp, human
ggcgagaggcgggtccaggc

SEQ ID NO: 317752 - DNA, 20 bp, human
gtcccagcaacgcgagcgag

SEQ ID NO: 317753 - DNA, 20 bp, human
gggagtcctcggtgggggta

SEQ ID NO: 317754 - DNA, 20 bp, human
ggccttccccacaactgatg

SEQ ID NO: 317755 - DNA, 20 bp, human
ggtgggggtatggaggtcgc

SEQ ID NO: 317756 - DNA, 20 bp, human
gggagatgggctagaggacg

SEQ ID NO: 317757 - DNA, 20 bp, human
gttagagcatagttgtggga

SEQ ID NO: 317758 - DNA, 20 bp, human
gcttcccaggctctctaaca

SEQ ID NO: 317759 - DNA, 20 bp, human
ggagattagagcatagttgt

SEQ ID NO: 317760 - DNA, 20 bp, human
ggggattccagaaaactctg

SEQ ID NO: 317761 - DNA, 20 bp, human
ggatgggctagaggacgagg

SEQ ID NO: 317762 - DNA, 20 bp, human
gagaaaactctgcgggagat

SEQ ID NO: 317763 - DNA, 20 bp, human
gtagctgcgtaatcatactg

SEQ ID NO: 317764 - DNA, 20 bp, human
ggatagatctaataatttac

SEQ ID NO: 317765 - DNA, 20 bp, human
gcagccatgttagagagcct

SEQ ID NO: 317766 - DNA, 20 bp, human
ggagcggcgtctgggaaggt

SEQ ID NO: 317767 - DNA, 20 bp, human
gggccaaacgccactactcc

SEQ ID NO: 317768 - DNA, 20 bp, human
gtgggaacgaaattaacggg

SEQ ID NO: 317769 - DNA, 20 bp, human
ggacccgtgacaaactaaac

SEQ ID NO: 317770 - DNA, 20 bp, human
gcaaatgaggagcgaactaa

SEQ ID NO: 317771 - DNA, 20 bp, human
gtaaggtggaccagcaaatg

SEQ ID NO: 317772 - DNA, 20 bp, human
gcagcgagcggcgtctggga

SEQ ID NO: 317773 - DNA, 20 bp, human
gcactgggaacgaaattaac

SEQ ID NO: 317774 - DNA, 20 bp, human
gtggctgaggtgcgacccct

SEQ ID NO: 317775 - DNA, 20 bp, human
gtcagccagcgagcggcgtc

SEQ ID NO: 317776 - DNA, 20 bp, human
gtggcgcggcgtttcttcgg

SEQ ID NO: 317777 - DNA, 20 bp, human
gtaaagaggcggaggaacgc

SEQ ID NO: 317778 - DNA, 20 bp, human
gctctctccgcgagcaagac

SEQ ID NO: 317779 - DNA, 20 bp, human
gccccccggaaccacacacg

SEQ ID NO: 317780 - DNA, 20 bp, human
gtgccccgccccatttaaag

SEQ ID NO: 317781 - DNA, 20 bp, human
gaaggtggagaccgcgtgtg

SEQ ID NO: 317782 - DNA, 20 bp, human
gaccgcgtgtgtggttccgg

SEQ ID NO: 317783 - DNA, 20 bp, human
gccgcaggaggcgtgaggtg

SEQ ID NO: 317784 - DNA, 20 bp, human
gagagaggagctaggagcct

SEQ ID NO: 317785 - DNA, 20 bp, human
gcccaaagcgagcgaagcta

SEQ ID NO: 317786 - DNA, 20 bp, human
gtctacaggggtgggtacat

SEQ ID NO: 317787 - DNA, 20 bp, human
gtacccacccctgtagagct

SEQ ID NO: 317788 - DNA, 20 bp, human
gacaggggtgggtacatggg

SEQ ID NO: 317789 - DNA, 20 bp, human
gacggccgtcagctgatagt

SEQ ID NO: 317790 - DNA, 20 bp, human
gtcccagcccagctctacag

SEQ ID NO: 317791 - DNA, 20 bp, human
gtgcactggcatttgtagaa

SEQ ID NO: 317792 - DNA, 20 bp, human
ggccccgcctcctgctttcg

SEQ ID NO: 317793 - DNA, 20 bp, human
gaagatgtcagggtagcaac

SEQ ID NO: 317794 - DNA, 20 bp, human
gagggtgtctgtccaacagg

SEQ ID NO: 317795 - DNA, 20 bp, human
gggtagcaacaggaggaatc

SEQ ID NO: 317796 - DNA, 20 bp, human
ggcggcgtgcggcggctggt

SEQ ID NO: 317797 - DNA, 20 bp, human
gagagtggagcgccgttcgc

SEQ ID NO: 317798 - DNA, 20 bp, human
gcggctggtgggggcgtgtc

SEQ ID NO: 317799 - DNA, 20 bp, human
gggtatgtgcgcatgcgttg

SEQ ID NO: 317800 - DNA, 20 bp, human
gaacgccgcgcccgctccgc

SEQ ID NO: 317801 - DNA, 20 bp, human
gaggtgaggtacagagcgct

SEQ ID NO: 317802 - DNA, 20 bp, human
gcaccggcgcgcgtcgcttg

SEQ ID NO: 317803 - DNA, 20 bp, human
gcagcagcaacaccgtgggg

SEQ ID NO: 317804 - DNA, 20 bp, human
ggagggctcctgctgattgg

SEQ ID NO: 317805 - DNA, 20 bp, human
ggtgaccctgtggaaggcaa

SEQ ID NO: 317806 - DNA, 20 bp, human
gccccctgcgccgacgtcct

SEQ ID NO: 317807 - DNA, 20 bp, human
gagtccgggtcctgtcatgg

SEQ ID NO: 317808 - DNA, 20 bp, human
gccgacgtcctgggagctag

SEQ ID NO: 317809 - DNA, 20 bp, human
gtcctgggaactgtagtagg

SEQ ID NO: 317810 - DNA, 20 bp, human
gttcccaggaggccccgggg

SEQ ID NO: 317811 - DNA, 20 bp, human
ggcccaggacccctttgggg

SEQ ID NO: 317812 - DNA, 20 bp, human
gggggcgtgacccccccaaa

SEQ ID NO: 317813 - DNA, 20 bp, human
gaccccgccccggggcctcc

SEQ ID NO: 317814 - DNA, 20 bp, human
ggcgacgcgcgaggcctttc

SEQ ID NO: 317815 - DNA, 20 bp, human
gagctagcggtgcgcaagct

SEQ ID NO: 317816 - DNA, 20 bp, human
ggcccgggatcccgagtgtc

SEQ ID NO: 317817 - DNA, 20 bp, human
gaggggcggccatcttggta

SEQ ID NO: 317818 - DNA, 20 bp, human
ggccggaagccgcggaactg

SEQ ID NO: 317819 - DNA, 20 bp, human
gggaagccgcggaactgagg

SEQ ID NO: 317820 - DNA, 20 bp, human
gtggccgcccctgtgggccg

SEQ ID NO: 317821 - DNA, 20 bp, human
ggcaaagcgccgccgcgtag

SEQ ID NO: 317822 - DNA, 20 bp, human
gcgccgccgcgtagcgggag

SEQ ID NO: 317823 - DNA, 20 bp, human
gtccggacactcgggatccc

SEQ ID NO: 317824 - DNA, 20 bp, human
gtgcgcggggactctgtggc

SEQ ID NO: 317825 - DNA, 20 bp, human
gtaacccgagcccgccgcgc

SEQ ID NO: 317826 - DNA, 20 bp, human
gtcaaggctggccccaccta

SEQ ID NO: 317827 - DNA, 20 bp, human
ggtgcagcgcgacagtcgag

SEQ ID NO: 317828 - DNA, 20 bp, human
gaatccgcccaaataggcgt

SEQ ID NO: 317829 - DNA, 20 bp, human
gcaagccgctgcgacgaagc

SEQ ID NO: 317830 - DNA, 20 bp, human
gcgcgacagtcgagcggcta

SEQ ID NO: 317831 - DNA, 20 bp, human
gacagtcgagcggctacgga

SEQ ID NO: 317832 - DNA, 20 bp, human
gggcgcggtgagatactgat

SEQ ID NO: 317833 - DNA, 20 bp, human
gcctgcgcaatgtctctttg

SEQ ID NO: 317834 - DNA, 20 bp, human
ggcgctagatgccctaggtg

SEQ ID NO: 317835 - DNA, 20 bp, human
gcgcctgcgctagatgccct

SEQ ID NO: 317836 - DNA, 20 bp, human
gactcgatggaggacgggtg

SEQ ID NO: 317837 - DNA, 20 bp, human
gcgggtggggctaatagtat

SEQ ID NO: 317838 - DNA, 20 bp, human
gttgtcttctgggtcggtgg

SEQ ID NO: 317839 - DNA, 20 bp, human
gaggccgttgggcctggagt

SEQ ID NO: 317840 - DNA, 20 bp, human
gcgacccagaagacaaccgc

SEQ ID NO: 317841 - DNA, 20 bp, human
ggcgcgtcacggggtcgggg

SEQ ID NO: 317842 - DNA, 20 bp, human
gctatggcgcactccctgtg

SEQ ID NO: 317843 - DNA, 20 bp, human
ggggctgaaacagctggacc

SEQ ID NO: 317844 - DNA, 20 bp, human
gtgccaggcggcggaaaggg

SEQ ID NO: 317845 - DNA, 20 bp, human
gggagcggcacgggactcga

SEQ ID NO: 317846 - DNA, 20 bp, human
gtggaggtggggcatgaaca

SEQ ID NO: 317847 - DNA, 20 bp, human
ggccacccaagtagggagtg

SEQ ID NO: 317848 - DNA, 20 bp, human
ggtagggagtgaggagcacc

SEQ ID NO: 317849 - DNA, 20 bp, human
gccaccactgccacccaagt

SEQ ID NO: 317850 - DNA, 20 bp, human
gacagcagctgaaggatggg

SEQ ID NO: 317851 - DNA, 20 bp, human
gtgtccgcaggtgacgcagt

SEQ ID NO: 317852 - DNA, 20 bp, human
gccccacctccaggtttaga

SEQ ID NO: 317853 - DNA, 20 bp, human
gtgggaggtggtgacggtgg

SEQ ID NO: 317854 - DNA, 20 bp, human
gaagtagcatcctgtgctcc

SEQ ID NO: 317855 - DNA, 20 bp, human
gtaaaactgacagcagctga

SEQ ID NO: 317856 - DNA, 20 bp, human
gggcctaggcaaagccgtaa

SEQ ID NO: 317857 - DNA, 20 bp, human
gcccttcccgacactgtcat

SEQ ID NO: 317858 - DNA, 20 bp, human
gcctaggccaatgacagtgt

SEQ ID NO: 317859 - DNA, 20 bp, human
ggccaatgacagtgtcggga

SEQ ID NO: 317860 - DNA, 20 bp, human
gccaatgagagcaccgggag

SEQ ID NO: 317861 - DNA, 20 bp, human
gtaagggtggggaatcctat

SEQ ID NO: 317862 - DNA, 20 bp, human
ggggggtgaggccgcgtcgg

SEQ ID NO: 317863 - DNA, 20 bp, human
gaggcaaagccgtaagggtg

SEQ ID NO: 317864 - DNA, 20 bp, human
gcgcaggctcactccacgta

SEQ ID NO: 317865 - DNA, 20 bp, human
gtggggaatcctattggccc

SEQ ID NO: 317866 - DNA, 20 bp, human
gggacgaagcggtaggtccc

SEQ ID NO: 317867 - DNA, 20 bp, human
gctgacgagccccggcgctg

SEQ ID NO: 317868 - DNA, 20 bp, human
gcaccccaacccggggcctg

SEQ ID NO: 317869 - DNA, 20 bp, human
gtcccgggttcccgcgaggt

SEQ ID NO: 317870 - DNA, 20 bp, human
ggggaggtggacgaagcggt

SEQ ID NO: 317871 - DNA, 20 bp, human
ggccctctgctgacgagccc

SEQ ID NO: 317872 - DNA, 20 bp, human
gcgccggggctcgtcagcag

SEQ ID NO: 317873 - DNA, 20 bp, human
gtgaaggcggagagactccg

SEQ ID NO: 317874 - DNA, 20 bp, human
gcccctccgcttccttgtga

SEQ ID NO: 317875 - DNA, 20 bp, human
gtaaacggcgcgaaacgaag

SEQ ID NO: 317876 - DNA, 20 bp, human
gaccttcgtcggggagagga

SEQ ID NO: 317877 - DNA, 20 bp, human
gtggcagcgaagtgcgagac

SEQ ID NO: 317878 - DNA, 20 bp, human
gctcgccaggcggaagtggt

SEQ ID NO: 317879 - DNA, 20 bp, human
gaggggagtgataaattgga

SEQ ID NO: 317880 - DNA, 20 bp, human
gcaagcgctcgctgtggttc

SEQ ID NO: 317881 - DNA, 20 bp, human
ggtctcagcgacatagtggg

SEQ ID NO: 317882 - DNA, 20 bp, human
gagcgagcgcttgtggcggg

SEQ ID NO: 317883 - DNA, 20 bp, human
ggacgtctcagcgacatagt

SEQ ID NO: 317884 - DNA, 20 bp, human
gcacagcgagcgcttgtggc

SEQ ID NO: 317885 - DNA, 20 bp, human
gaagtcctcgaccttcgtcg

SEQ ID NO: 317886 - DNA, 20 bp, human
gggaggggaagcgtgcgaag

SEQ ID NO: 317887 - DNA, 20 bp, human
gactctatgagtcacctccc

SEQ ID NO: 317888 - DNA, 20 bp, human
ggggaggtcgggggtgagga

SEQ ID NO: 317889 - DNA, 20 bp, human
gaaggcgcagccgggtatag

SEQ ID NO: 317890 - DNA, 20 bp, human
gttctgccctgggaggtcgg

SEQ ID NO: 317891 - DNA, 20 bp, human
gctcgagggaggttaaagaa

SEQ ID NO: 317892 - DNA, 20 bp, human
gtgagcggggcaacgcagaa

SEQ ID NO: 317893 - DNA, 20 bp, human
gagcctggggagtccctatc

SEQ ID NO: 317894 - DNA, 20 bp, human
gtgcacaaaggagttgtccc

SEQ ID NO: 317895 - DNA, 20 bp, human
gcagacgtctctctcctcgg

SEQ ID NO: 317896 - DNA, 20 bp, human
ggggccgccatctttggtga

SEQ ID NO: 317897 - DNA, 20 bp, human
gtgagggcgcctgcgagaat

SEQ ID NO: 317898 - DNA, 20 bp, human
ggcgctcggccgattctcgc

SEQ ID NO: 317899 - DNA, 20 bp, human
gcctctgccctcaccaaaga

SEQ ID NO: 317900 - DNA, 20 bp, human
gtgcacaaacgcgtggggcg

SEQ ID NO: 317901 - DNA, 20 bp, human
gccgagcgccgcggttccat

SEQ ID NO: 317902 - DNA, 20 bp, human
gcgagctgcacaaacgcgtg

SEQ ID NO: 317903 - DNA, 20 bp, human
gcctccagctggggcggaat

SEQ ID NO: 317904 - DNA, 20 bp, human
gtgagggcagaggcaacttc

SEQ ID NO: 317905 - DNA, 20 bp, human
gtgcgagacggggtgcgcgg

SEQ ID NO: 317906 - DNA, 20 bp, human
ggtcaggagccgagacgggg

SEQ ID NO: 317907 - DNA, 20 bp, human
ggcggggtcaggagccgaga

SEQ ID NO: 317908 - DNA, 20 bp, human
gtacttgtgacccaggctta

SEQ ID NO: 317909 - DNA, 20 bp, human
gtagggaggcgtgcgggagg

SEQ ID NO: 317910 - DNA, 20 bp, human
gcgcacgcctccctaagcct

SEQ ID NO: 317911 - DNA, 20 bp, human
ggggcggagctaatgcccta

SEQ ID NO: 317912 - DNA, 20 bp, human
gatcacgctacggggaagaa

SEQ ID NO: 317913 - DNA, 20 bp, human
gcggcccgggttctgttcgt

SEQ ID NO: 317914 - DNA, 20 bp, human
gaacgtgggagcacatctga

SEQ ID NO: 317915 - DNA, 20 bp, human
gggcgttggcgtggtgtggt

SEQ ID NO: 317916 - DNA, 20 bp, human
ggcaggaggtgtctagatag

SEQ ID NO: 317917 - DNA, 20 bp, human
ggaggtgtctagatagtggt

SEQ ID NO: 317918 - DNA, 20 bp, human
gccgcggagccatatggaga

SEQ ID NO: 317919 - DNA, 20 bp, human
gtgtctagatagtggtaggc

SEQ ID NO: 317920 - DNA, 20 bp, human
gacctcctgccctctccata

SEQ ID NO: 317921 - DNA, 20 bp, human
ggtaacggacggacacgcaa

SEQ ID NO: 317922 - DNA, 20 bp, human
gcctccccctcgggtttaaa

SEQ ID NO: 317923 - DNA, 20 bp, human
gtgaacatgcagagcagcac

SEQ ID NO: 317924 - DNA, 20 bp, human
ggcagcgactagaactgatc

SEQ ID NO: 317925 - DNA, 20 bp, human
ggggaggatccggaagtgga

SEQ ID NO: 317926 - DNA, 20 bp, human
gaaccctaatgtgactctgg

SEQ ID NO: 317927 - DNA, 20 bp, human
gtatccccatgccaccggct

SEQ ID NO: 317928 - DNA, 20 bp, human
gtcacattagggttacccca

SEQ ID NO: 317929 - DNA, 20 bp, human
gcgcccccagagtcacatta

SEQ ID NO: 317930 - DNA, 20 bp, human
gcctcccagccggtggcatg

SEQ ID NO: 317931 - DNA, 20 bp, human
ggggactcaggttgctcctg

SEQ ID NO: 317932 - DNA, 20 bp, human
ggcaggggaagtgctctcat

SEQ ID NO: 317933 - DNA, 20 bp, human
gggtaaccctaatgtgactc

SEQ ID NO: 317934 - DNA, 20 bp, human
gacatgggacatctagtgtc

SEQ ID NO: 317935 - DNA, 20 bp, human
gctctcattggatgtccaac

SEQ ID NO: 317936 - DNA, 20 bp, human
gggtagctgggtgttggctg

SEQ ID NO: 317937 - DNA, 20 bp, human
ggctcgcggtagctgggtgt

SEQ ID NO: 317938 - DNA, 20 bp, human
ggaggcctagatgtccactg

SEQ ID NO: 317939 - DNA, 20 bp, human
gtgtaagatcagtactgtgg

SEQ ID NO: 317940 - DNA, 20 bp, human
gtatcccagctaaagtacct

SEQ ID NO: 317941 - DNA, 20 bp, human
gctaaaatgcgcaaccgcag

SEQ ID NO: 317942 - DNA, 20 bp, human
gcccagctaccgcgagcagt

SEQ ID NO: 317943 - DNA, 20 bp, human
ggcaaccgcagtggacatct

SEQ ID NO: 317944 - DNA, 20 bp, human
ggacctacgtgggcaggccc

SEQ ID NO: 317945 - DNA, 20 bp, human
gcagagatggcgagcgagaa

SEQ ID NO: 317946 - DNA, 20 bp, human
ggaagccggcaggagacggg

SEQ ID NO: 317947 - DNA, 20 bp, human
gcctccgcagggtcacagct

SEQ ID NO: 317948 - DNA, 20 bp, human
gccccgttgctccttctcta

SEQ ID NO: 317949 - DNA, 20 bp, human
gacctggggaagaacgggag

SEQ ID NO: 317950 - DNA, 20 bp, human
gcaacgagggaacgtggggc

SEQ ID NO: 317951 - DNA, 20 bp, human
ggaaggagcaacggggaaag

SEQ ID NO: 317952 - DNA, 20 bp, human
gctgtgaccctgcggagggc

SEQ ID NO: 317953 - DNA, 20 bp, human
gtggccggctcctcccgcga

SEQ ID NO: 317954 - DNA, 20 bp, human
ggataggagaggtcgcttcc

SEQ ID NO: 317955 - DNA, 20 bp, human
gaacgggagcggaagccggc

SEQ ID NO: 317956 - DNA, 20 bp, human
ggggcgtggcaaactcccgg

SEQ ID NO: 317957 - DNA, 20 bp, human
ggcagaacagtcattcgccg

SEQ ID NO: 317958 - DNA, 20 bp, human
ggggcctcagattacagagc

SEQ ID NO: 317959 - DNA, 20 bp, human
gctgccggctctgtaatctg

SEQ ID NO: 317960 - DNA, 20 bp, human
gaggaagtcttgggggtgta

SEQ ID NO: 317961 - DNA, 20 bp, human
ggctcaccacgccccttcct

SEQ ID NO: 317962 - DNA, 20 bp, human
gtgccgtgctaccccaggcc

SEQ ID NO: 317963 - DNA, 20 bp, human
ggtggggcgtggcaaactcc

SEQ ID NO: 317964 - DNA, 20 bp, human
gctggggtagcacggcactt

SEQ ID NO: 317965 - DNA, 20 bp, human
gagcactccgcgtcaccacc

SEQ ID NO: 317966 - DNA, 20 bp, human
ggggcggagtctcgccagta

SEQ ID NO: 317967 - DNA, 20 bp, human
ggagactccgccctgtgtcc

SEQ ID NO: 317968 - DNA, 20 bp, human
gctggaggaggggtacttca

SEQ ID NO: 317969 - DNA, 20 bp, human
ggggacccccggacagagaa

SEQ ID NO: 317970 - DNA, 20 bp, human
gacccccggacagagaacgg

SEQ ID NO: 317971 - DNA, 20 bp, human
gactccccagccgggacaca

SEQ ID NO: 317972 - DNA, 20 bp, human
ggggtggcctcaagccctac

SEQ ID NO: 317973 - DNA, 20 bp, human
ggactcgtgccctgctggcg

SEQ ID NO: 317974 - DNA, 20 bp, human
gacccgggacggatccggag

SEQ ID NO: 317975 - DNA, 20 bp, human
ggaacggaggtgctgggcgt

SEQ ID NO: 317976 - DNA, 20 bp, human
gctaactagactctggtgtc

SEQ ID NO: 317977 - DNA, 20 bp, human
gagaactaggtgaaatacaa

SEQ ID NO: 317978 - DNA, 20 bp, human
ggcacagctctcctagcctg

SEQ ID NO: 317979 - DNA, 20 bp, human
gtctagttaggatcacctca

SEQ ID NO: 317980 - DNA, 20 bp, human
gttgcgtaagagattcacag

SEQ ID NO: 317981 - DNA, 20 bp, human
ggatcacctcagggatctct

SEQ ID NO: 317982 - DNA, 20 bp, human
gagaaaaagagaggccttat

SEQ ID NO: 317983 - DNA, 20 bp, human
gcatttcccagagatccctg

SEQ ID NO: 317984 - DNA, 20 bp, human
ggaaggtgagagcttgaaac

SEQ ID NO: 317985 - DNA, 20 bp, human
gttcccatgtgtgatataga

SEQ ID NO: 317986 - DNA, 20 bp, human
gaaggaggaggggcctgtat

SEQ ID NO: 317987 - DNA, 20 bp, human
gctggctgaagtgacgtgct

SEQ ID NO: 317988 - DNA, 20 bp, human
ggggaggaggcggactcaaa

SEQ ID NO: 317989 - DNA, 20 bp, human
gggacctaagctgtgacgca

SEQ ID NO: 317990 - DNA, 20 bp, human
gggaagaagccaaatcgagg

SEQ ID NO: 317991 - DNA, 20 bp, human
gcctggaagaagccaaatcg

SEQ ID NO: 317992 - DNA, 20 bp, human
gcttaggtcccgcctcgatt

SEQ ID NO: 317993 - DNA, 20 bp, human
gtccccacccggccccatac

SEQ ID NO: 317994 - DNA, 20 bp, human
ggtgacgcgcaaaccagggg

SEQ ID NO: 317995 - DNA, 20 bp, human
ggctctgacaagtctagctt

SEQ ID NO: 317996 - DNA, 20 bp, human
gcaaagggaacgacctggag

SEQ ID NO: 317997 - DNA, 20 bp, human
gtatatgtgtacaaggacca

SEQ ID NO: 317998 - DNA, 20 bp, human
ggtggatcgtatatgtggac

SEQ ID NO: 317999 - DNA, 20 bp, human
gcattcctctttgtggtcaa

SEQ ID NO: 318000 - DNA, 20 bp, human
gccagggtggatcgtatatg

SEQ ID NO: 318001 - DNA, 20 bp, human
gctggcacacttagtactct

SEQ ID NO: 318002 - DNA, 20 bp, human
ggtggtcaaagggaacgacc

SEQ ID NO: 318003 - DNA, 20 bp, human
gcaggtggcagagagatgca

SEQ ID NO: 318004 - DNA, 20 bp, human
gatgtgtacaaggaccaggg

SEQ ID NO: 318005 - DNA, 20 bp, human
gagatgcacggggcctgaac

SEQ ID NO: 318006 - DNA, 20 bp, human
gagccatgcaggcactcacg

SEQ ID NO: 318007 - DNA, 20 bp, human
ggtccctggagaagcaccaa

SEQ ID NO: 318008 - DNA, 20 bp, human
ggaaacttgtgcttggtcac

SEQ ID NO: 318009 - DNA, 20 bp, human
gggccacatgcccaaccctt

SEQ ID NO: 318010 - DNA, 20 bp, human
gaccctttggtgcttctcca

SEQ ID NO: 318011 - DNA, 20 bp, human
gttgagagagtacctacctc

SEQ ID NO: 318012 - DNA, 20 bp, human
gacaggatttctgcgatgta

SEQ ID NO: 318013 - DNA, 20 bp, human
gaacagggagacctgcttaa

SEQ ID NO: 318014 - DNA, 20 bp, human
gttccccaggcctggcgtaa

SEQ ID NO: 318015 - DNA, 20 bp, human
gaaagacctgcattggaatc

SEQ ID NO: 318016 - DNA, 20 bp, human
ggtcctagcgtccactgcat

SEQ ID NO: 318017 - DNA, 20 bp, human
gggtcaccatgtgatcgcgg

SEQ ID NO: 318018 - DNA, 20 bp, human
gcggccgcggagcgcgtgat

SEQ ID NO: 318019 - DNA, 20 bp, human
gtggctcgctgggcgcgacg

SEQ ID NO: 318020 - DNA, 20 bp, human
ggggggtcaccatgtgatcg

SEQ ID NO: 318021 - DNA, 20 bp, human
gcatgtgatcgcgggggtgg

SEQ ID NO: 318022 - DNA, 20 bp, human
gcctgggagcgccccgaccc

SEQ ID NO: 318023 - DNA, 20 bp, human
ggcgcccatcacgcgctccg

SEQ ID NO: 318024 - DNA, 20 bp, human
gatcgccagcggtcgggccc

SEQ ID NO: 318025 - DNA, 20 bp, human
gagcgcccgcggtggacctg

SEQ ID NO: 318026 - DNA, 20 bp, human
gcagcgcgcgcgaaaaaggt

SEQ ID NO: 318027 - DNA, 20 bp, human
gttctcacgcgcatgcggaa

SEQ ID NO: 318028 - DNA, 20 bp, human
ggcagcggaccggcgggaga

SEQ ID NO: 318029 - DNA, 20 bp, human
ggcgaaaaaggtgggctgtg

SEQ ID NO: 318030 - DNA, 20 bp, human
ggcggggcggcactagactc

SEQ ID NO: 318031 - DNA, 20 bp, human
ggccgtcagcatggcggaag

SEQ ID NO: 318032 - DNA, 20 bp, human
gccggccgggcctgggaacg

SEQ ID NO: 318033 - DNA, 20 bp, human
gcaatcagcgcgcgcgaaaa

SEQ ID NO: 318034 - DNA, 20 bp, human
gggagaggacgagacgggtc

SEQ ID NO: 318035 - DNA, 20 bp, human
gccggcagcagcggaccggc

SEQ ID NO: 318036 - DNA, 20 bp, human
ggcggatgagtggggggtag

SEQ ID NO: 318037 - DNA, 20 bp, human
gaacccgccccgcttctacg

SEQ ID NO: 318038 - DNA, 20 bp, human
gtagaagcggggcgggttct

SEQ ID NO: 318039 - DNA, 20 bp, human
gagccagccagcccgagtcg

SEQ ID NO: 318040 - DNA, 20 bp, human
gccaggggcggatgagtggg

SEQ ID NO: 318041 - DNA, 20 bp, human
gcgggttcttggattctcgg

SEQ ID NO: 318042 - DNA, 20 bp, human
gggtggaggaatggtatcca

SEQ ID NO: 318043 - DNA, 20 bp, human
gaggggagcgagtgtgcgca

SEQ ID NO: 318044 - DNA, 20 bp, human
ggcgagtgtgcgcacgggga

SEQ ID NO: 318045 - DNA, 20 bp, human
ggctccaggggcggatgagt

SEQ ID NO: 318046 - DNA, 20 bp, human
ggagcccagaggacaaatct

SEQ ID NO: 318047 - DNA, 20 bp, human
gtgtgccaaggagacagtga

SEQ ID NO: 318048 - DNA, 20 bp, human
gggtttctggggcagtaatg

SEQ ID NO: 318049 - DNA, 20 bp, human
gttgcccagatttgtcctct

SEQ ID NO: 318050 - DNA, 20 bp, human
gtggtatgtgcctcaggata

SEQ ID NO: 318051 - DNA, 20 bp, human
gcaagcgttcatcacagcgg

SEQ ID NO: 318052 - DNA, 20 bp, human
gaacgcttgcaggagccatg

SEQ ID NO: 318053 - DNA, 20 bp, human
gttgcaggagccatgagggg

SEQ ID NO: 318054 - DNA, 20 bp, human
gtcgcttcatgagagcccag

SEQ ID NO: 318055 - DNA, 20 bp, human
gcaccactgcctttgcaatg

SEQ ID NO: 318056 - DNA, 20 bp, human
gctctgacagttggactgaa

SEQ ID NO: 318057 - DNA, 20 bp, human
gtgctacaaagctccttctt

SEQ ID NO: 318058 - DNA, 20 bp, human
ggctggctatttctgaaatc

SEQ ID NO: 318059 - DNA, 20 bp, human
gggccaaaacaaacagctgt

SEQ ID NO: 318060 - DNA, 20 bp, human
gcatcggaccatagctgcct

SEQ ID NO: 318061 - DNA, 20 bp, human
gttttggctgctctgacagt

SEQ ID NO: 318062 - DNA, 20 bp, human
gtgcaacagaatgaacatcg

SEQ ID NO: 318063 - DNA, 20 bp, human
ggagctctttaatcctaaga

SEQ ID NO: 318064 - DNA, 20 bp, human
ggtcagtagtgaaaaatagc

SEQ ID NO: 318065 - DNA, 20 bp, human
ggttggaagaacttttagcc

SEQ ID NO: 318066 - DNA, 20 bp, human
gaatgaacaaggagtgtatc

SEQ ID NO: 318067 - DNA, 20 bp, human
gagggactattgcttgtctt

SEQ ID NO: 318068 - DNA, 20 bp, human
gtgaactctctctacgtgtt

SEQ ID NO: 318069 - DNA, 20 bp, human
gtctctacggaatccctcac

SEQ ID NO: 318070 - DNA, 20 bp, human
gggaaactgagttataagag

SEQ ID NO: 318071 - DNA, 20 bp, human
gacaaggagtgtatcaggac

SEQ ID NO: 318072 - DNA, 20 bp, human
gcgcggccgcttttgtttca

SEQ ID NO: 318073 - DNA, 20 bp, human
gtaagagaggctcaatgact

SEQ ID NO: 318074 - DNA, 20 bp, human
gttgggaacgacttgtgtcc

SEQ ID NO: 318075 - DNA, 20 bp, human
ggtccttcctactcataaaa

SEQ ID NO: 318076 - DNA, 20 bp, human
gcgcctgcgcacagcctccg

SEQ ID NO: 318077 - DNA, 20 bp, human
gccccccggaggctgtgcgc

SEQ ID NO: 318078 - DNA, 20 bp, human
gaaaagagggggtgcaccga

SEQ ID NO: 318079 - DNA, 20 bp, human
ggggagggacgaggggtgtc

SEQ ID NO: 318080 - DNA, 20 bp, human
gtatccgttcggggtggttg

SEQ ID NO: 318081 - DNA, 20 bp, human
gacaggtgagcaggtgcatg

SEQ ID NO: 318082 - DNA, 20 bp, human
ggggactgctgccagacact

SEQ ID NO: 318083 - DNA, 20 bp, human
gaacggatagacaggtgagc

SEQ ID NO: 318084 - DNA, 20 bp, human
gaggagggcagggcaaaaga

SEQ ID NO: 318085 - DNA, 20 bp, human
gcactggggcaagctggcag

SEQ ID NO: 318086 - DNA, 20 bp, human
gccggcgcccgccaagggat

SEQ ID NO: 318087 - DNA, 20 bp, human
gggtcgcgtaggctggggat

SEQ ID NO: 318088 - DNA, 20 bp, human
gagccagagcctgtcgactg

SEQ ID NO: 318089 - DNA, 20 bp, human
gccgcggccggcgcccgcca

SEQ ID NO: 318090 - DNA, 20 bp, human
gagctgttcaatggtcgcgt

SEQ ID NO: 318091 - DNA, 20 bp, human
gttgggcggcagctgttcaa

SEQ ID NO: 318092 - DNA, 20 bp, human
ggctctggctgcccatccct

SEQ ID NO: 318093 - DNA, 20 bp, human
gcggctgggtaaatcctcag

SEQ ID NO: 318094 - DNA, 20 bp, human
gctgcgcagccgcagtcgac

SEQ ID NO: 318095 - DNA, 20 bp, human
gtcaatggtcgcgtaggctg

SEQ ID NO: 318096 - DNA, 20 bp, human
ggtactactggggaagtctg

SEQ ID NO: 318097 - DNA, 20 bp, human
ggagcggcgcggtactactg

SEQ ID NO: 318098 - DNA, 20 bp, human
gaggaggagcgagcagactt

SEQ ID NO: 318099 - DNA, 20 bp, human
gggcggagggcgtcactccg

SEQ ID NO: 318100 - DNA, 20 bp, human
gtgccctcggccaggcccat

SEQ ID NO: 318101 - DNA, 20 bp, human
gggagggcgtcactccgggg

SEQ ID NO: 318102 - DNA, 20 bp, human
gctggggaagtctgcggctg

SEQ ID NO: 318103 - DNA, 20 bp, human
gtgggcggattcagaccctg

SEQ ID NO: 318104 - DNA, 20 bp, human
gaccctcgtcccggaggctc

SEQ ID NO: 318105 - DNA, 20 bp, human
ggccgagggcaaccggcggg

SEQ ID NO: 318106 - DNA, 20 bp, human
gagaccgcagggatgtgggg

SEQ ID NO: 318107 - DNA, 20 bp, human
ggggtggagtcacctgtcct

SEQ ID NO: 318108 - DNA, 20 bp, human
gggtgggacctgttacagag

SEQ ID NO: 318109 - DNA, 20 bp, human
ggcggggcgggacaaaggta

SEQ ID NO: 318110 - DNA, 20 bp, human
gaagcgcagagtcacggtgg

SEQ ID NO: 318111 - DNA, 20 bp, human
ggggacctgttacagagggg

SEQ ID NO: 318112 - DNA, 20 bp, human
ggcgacctggcctgcacaga

SEQ ID NO: 318113 - DNA, 20 bp, human
gttcctcccggcagaccgca

SEQ ID NO: 318114 - DNA, 20 bp, human
gagagctcttatccaggtga

SEQ ID NO: 318115 - DNA, 20 bp, human
gaggccttgcgcgcaggtca

SEQ ID NO: 318116 - DNA, 20 bp, human
gccccctcctgcgcacccgg

SEQ ID NO: 318117 - DNA, 20 bp, human
ggggagcggctccgacgtca

SEQ ID NO: 318118 - DNA, 20 bp, human
gcgggccaggagagggcccg

SEQ ID NO: 318119 - DNA, 20 bp, human
gtccctccgggtgcgcagga

SEQ ID NO: 318120 - DNA, 20 bp, human
gagcggctccgacgtcaggg

SEQ ID NO: 318121 - DNA, 20 bp, human
gcctctccctccgggtgcgc

SEQ ID NO: 318122 - DNA, 20 bp, human
gctccgacggcgtggtgggg

SEQ ID NO: 318123 - DNA, 20 bp, human
gctggggcgccccactctcg

SEQ ID NO: 318124 - DNA, 20 bp, human
gggccgcgcgcagaaagagc

SEQ ID NO: 318125 - DNA, 20 bp, human
gcgcgcgcagaaagagcggg

SEQ ID NO: 318126 - DNA, 20 bp, human
gcgcactcccgcctcatcca

SEQ ID NO: 318127 - DNA, 20 bp, human
gcccgggagcgcgcacgtcc

SEQ ID NO: 318128 - DNA, 20 bp, human
gatgaggcgggagtgcgact

SEQ ID NO: 318129 - DNA, 20 bp, human
gacgcaggctgccttggatg

SEQ ID NO: 318130 - DNA, 20 bp, human
gtgggcgcttgcccgccacc

SEQ ID NO: 318131 - DNA, 20 bp, human
gtaaggtgtcgctgaatgta

SEQ ID NO: 318132 - DNA, 20 bp, human
gcggagcccatgccgaccgc

SEQ ID NO: 318133 - DNA, 20 bp, human
gtccgggacgtgcgcgctcc

SEQ ID NO: 318134 - DNA, 20 bp, human
gttgggaagctactggaatt

SEQ ID NO: 318135 - DNA, 20 bp, human
gacgcacgaaactacataac

SEQ ID NO: 318136 - DNA, 20 bp, human
gggcgtgtcaggataaccca

SEQ ID NO: 318137 - DNA, 20 bp, human
gtgcactcggtccttcccct

SEQ ID NO: 318138 - DNA, 20 bp, human
gggctcctcaggatcccgat

SEQ ID NO: 318139 - DNA, 20 bp, human
gcggaggaaaggagtaaccc

SEQ ID NO: 318140 - DNA, 20 bp, human
gcgaacccgttgtgcagaag

SEQ ID NO: 318141 - DNA, 20 bp, human
gggaaggaccgagtgcagcg

SEQ ID NO: 318142 - DNA, 20 bp, human
gaggttaggggccgcgcagg

SEQ ID NO: 318143 - DNA, 20 bp, human
gaggagacacaccccctctg

SEQ ID NO: 318144 - DNA, 20 bp, human
gggtcgctccagccccagag

SEQ ID NO: 318145 - DNA, 20 bp, human
ggcacgcggtgcagtcgggc

SEQ ID NO: 318146 - DNA, 20 bp, human
gctaccttcacctggggagt

SEQ ID NO: 318147 - DNA, 20 bp, human
ggtgaaggtagcctagacta

SEQ ID NO: 318148 - DNA, 20 bp, human
gtagactagggtggtgatgg

SEQ ID NO: 318149 - DNA, 20 bp, human
gtctaggctaccttcacctg

SEQ ID NO: 318150 - DNA, 20 bp, human
gactagggtggtgatggagg

SEQ ID NO: 318151 - DNA, 20 bp, human
gacccccactccccaggtga

SEQ ID NO: 318152 - DNA, 20 bp, human
ggcctagactagggtggtga

SEQ ID NO: 318153 - DNA, 20 bp, human
gaaggtagcctagactaggg

SEQ ID NO: 318154 - DNA, 20 bp, human
gtataacagatttcgcagat

SEQ ID NO: 318155 - DNA, 20 bp, human
ggtagaagaggacagattca

SEQ ID NO: 318156 - DNA, 20 bp, human
gccggagctacccagcgttt

SEQ ID NO: 318157 - DNA, 20 bp, human
ggcctgcagtcctaaacgct

SEQ ID NO: 318158 - DNA, 20 bp, human
gggcgcagacgcacaggagt

SEQ ID NO: 318159 - DNA, 20 bp, human
ggagcccggaagtcagacta

SEQ ID NO: 318160 - DNA, 20 bp, human
gcagacgcacaggagtcgga

SEQ ID NO: 318161 - DNA, 20 bp, human
gcggaagtcagactatgggg

SEQ ID NO: 318162 - DNA, 20 bp, human
gtagctccgggcttccgagg

SEQ ID NO: 318163 - DNA, 20 bp, human
ggggtagctccgggcttccg

SEQ ID NO: 318164 - DNA, 20 bp, human
ggacttccgggctcggcccg

SEQ ID NO: 318165 - DNA, 20 bp, human
gaggggaaaggtagattatc

SEQ ID NO: 318166 - DNA, 20 bp, human
gctaccttcacctggggagt

SEQ ID NO: 318167 - DNA, 20 bp, human
ggtgaaggtagcctagacta

SEQ ID NO: 318168 - DNA, 20 bp, human
gtagactagggtggtgatgg

SEQ ID NO: 318169 - DNA, 20 bp, human
gtctaggctaccttcacctg

SEQ ID NO: 318170 - DNA, 20 bp, human
gactagggtggtgatggagg

SEQ ID NO: 318171 - DNA, 20 bp, human
gacccccactccccaggtga

SEQ ID NO: 318172 - DNA, 20 bp, human
ggcctagactagggtggtga

SEQ ID NO: 318173 - DNA, 20 bp, human
gaaggtagcctagactaggg

SEQ ID NO: 318174 - DNA, 20 bp, human
ggacttccgggctccgcccg

SEQ ID NO: 318175 - DNA, 20 bp, human
ggagcccggaagtcagacta

SEQ ID NO: 318176 - DNA, 20 bp, human
gcctgtctagaccctggtac

SEQ ID NO: 318177 - DNA, 20 bp, human
gaaaactctccccagtacca

SEQ ID NO: 318178 - DNA, 20 bp, human
gagactgaagagtaaagatg

SEQ ID NO: 318179 - DNA, 20 bp, human
ggaaatccctgtctagaccc

SEQ ID NO: 318180 - DNA, 20 bp, human
gtccagccttccactgaggc

SEQ ID NO: 318181 - DNA, 20 bp, human
gtggtcattgcctacaggac

SEQ ID NO: 318182 - DNA, 20 bp, human
gctggggagagttttgtcct

SEQ ID NO: 318183 - DNA, 20 bp, human
gacacacctgcctcagtgga

SEQ ID NO: 318184 - DNA, 20 bp, human
gaggagccaggtccatccca

SEQ ID NO: 318185 - DNA, 20 bp, human
gtgctgtggtcattgcctac

SEQ ID NO: 318186 - DNA, 20 bp, human
ggggtcccgcccggcgcgtc

SEQ ID NO: 318187 - DNA, 20 bp, human
gttgggctctcctgacgcgc

SEQ ID NO: 318188 - DNA, 20 bp, human
ggctctcctgacgcgccggg

SEQ ID NO: 318189 - DNA, 20 bp, human
gaaactttttcaacaagatt

SEQ ID NO: 318190 - DNA, 20 bp, human
gcgaacccgctgtgccgcag

SEQ ID NO: 318191 - DNA, 20 bp, human
gggctcctcagggtcccgcc

SEQ ID NO: 318192 - DNA, 20 bp, human
gggccgcctctgcggcacag

SEQ ID NO: 318193 - DNA, 20 bp, human
gcggcacagcgggttcgcgc

SEQ ID NO: 318194 - DNA, 20 bp, human
gaggaaaaggagtaaccgag

SEQ ID NO: 318195 - DNA, 20 bp, human
ggacagagtgcagcagagac

SEQ ID NO: 318196 - DNA, 20 bp, human
gacgctccgggcctccgagg

SEQ ID NO: 318197 - DNA, 20 bp, human
gagcaggttaggggccctgc

SEQ ID NO: 318198 - DNA, 20 bp, human
gggccctgcgggccgagaaa

SEQ ID NO: 318199 - DNA, 20 bp, human
gcgaacctgttgtgcagtag

SEQ ID NO: 318200 - DNA, 20 bp, human
gcaggcacaggcgaggggtt

SEQ ID NO: 318201 - DNA, 20 bp, human
gtgggcacgcggggacgctc

SEQ ID NO: 318202 - DNA, 20 bp, human
gtggtgctttgagagagacg

SEQ ID NO: 318203 - DNA, 20 bp, human
gtgcactcggtgcatcacct

SEQ ID NO: 318204 - DNA, 20 bp, human
gcaccgagtgcagctgggac

SEQ ID NO: 318205 - DNA, 20 bp, human
gtgctttgagagagacgcgg

SEQ ID NO: 318206 - DNA, 20 bp, human
gaaaaaccaaggaatctcta

SEQ ID NO: 318207 - DNA, 20 bp, human
gggtccaacgtcatgagagt

SEQ ID NO: 318208 - DNA, 20 bp, human
gaatcctactctcatgacgt

SEQ ID NO: 318209 - DNA, 20 bp, human
ggaatttgtcacatctgccc

SEQ ID NO: 318210 - DNA, 20 bp, human
ggtgagagatagtcttcagg

SEQ ID NO: 318211 - DNA, 20 bp, human
gtgggtaaaattccctattc

SEQ ID NO: 318212 - DNA, 20 bp, human
gactgtgagagatagtcttc

SEQ ID NO: 318213 - DNA, 20 bp, human
gtctatggtgatcagccttc

SEQ ID NO: 318214 - DNA, 20 bp, human
ggatcaccatagagattcct

SEQ ID NO: 318215 - DNA, 20 bp, human
ggaattttacccacagtttc

SEQ ID NO: 318216 - DNA, 20 bp, human
gaactatgattttgactcaa

SEQ ID NO: 318217 - DNA, 20 bp, human
ggaatttgtcacatctgccc

SEQ ID NO: 318218 - DNA, 20 bp, human
gggtcatgatagaaattcct

SEQ ID NO: 318219 - DNA, 20 bp, human
gaccgtgagagatatatttc

SEQ ID NO: 318220 - DNA, 20 bp, human
ggtgagagatatatttcagg

SEQ ID NO: 318221 - DNA, 20 bp, human
gtttcaggaggcctgaaggc

SEQ ID NO: 318222 - DNA, 20 bp, human
gaattgaaaagaaggggaag

SEQ ID NO: 318223 - DNA, 20 bp, human
ggtggattgttatgtgtgta

SEQ ID NO: 318224 - DNA, 20 bp, human
ggtttctgggagaaaaaccg

SEQ ID NO: 318225 - DNA, 20 bp, human
gtgcagaaattgaaaagaag

SEQ ID NO: 318226 - DNA, 20 bp, human
ggggaaggggaaatccgctc

SEQ ID NO: 318227 - DNA, 20 bp, human
gaactaggagtgcgcagatg

SEQ ID NO: 318228 - DNA, 20 bp, human
gggagattgcgtcgatgggg

SEQ ID NO: 318229 - DNA, 20 bp, human
gtggaagcgtagaggcgaga

SEQ ID NO: 318230 - DNA, 20 bp, human
gtacttgcccgagactcgtg

SEQ ID NO: 318231 - DNA, 20 bp, human
gataacaaacattgaggctg

SEQ ID NO: 318232 - DNA, 20 bp, human
gggtggagattgcgtcgatg

SEQ ID NO: 318233 - DNA, 20 bp, human
gtcaccaggggaggactggg

SEQ ID NO: 318234 - DNA, 20 bp, human
gtggtgagagccaatcatct

SEQ ID NO: 318235 - DNA, 20 bp, human
gaaacgaccacgccattgat

SEQ ID NO: 318236 - DNA, 20 bp, human
gtcaccgcggggttgcaggg

SEQ ID NO: 318237 - DNA, 20 bp, human
gaggctgaatctgacctccc

SEQ ID NO: 318238 - DNA, 20 bp, human
gcaagcttcgatttgagggg

SEQ ID NO: 318239 - DNA, 20 bp, human
gctaccgcagtgaagttcaa

SEQ ID NO: 318240 - DNA, 20 bp, human
gacccgaggaggcaagcaga

SEQ ID NO: 318241 - DNA, 20 bp, human
ggccccgcaggcagcctctc

SEQ ID NO: 318242 - DNA, 20 bp, human
gcaaatcgaagcttggaagg

SEQ ID NO: 318243 - DNA, 20 bp, human
ggcggtgagctaggactatg

SEQ ID NO: 318244 - DNA, 20 bp, human
gtggcccccctgcaaccccg

SEQ ID NO: 318245 - DNA, 20 bp, human
gaggactatggggcaccgtg

SEQ ID NO: 318246 - DNA, 20 bp, human
gagaaaggacagttacattg

SEQ ID NO: 318247 - DNA, 20 bp, human
ggcaaacattacaacgagga

SEQ ID NO: 318248 - DNA, 20 bp, human
gcacaaggagttagttacag

SEQ ID NO: 318249 - DNA, 20 bp, human
gaaaaataacaaggctgcaa

SEQ ID NO: 318250 - DNA, 20 bp, human
gctgcaaaggcaccgtgacc

SEQ ID NO: 318251 - DNA, 20 bp, human
gccggaggaagacatctaag

SEQ ID NO: 318252 - DNA, 20 bp, human
gtccttgtgcttgtcaaccc

SEQ ID NO: 318253 - DNA, 20 bp, human
gagatgaaaaatttgagggg

SEQ ID NO: 318254 - DNA, 20 bp, human
gaaaagcttaacaaaaaatc

SEQ ID NO: 318255 - DNA, 20 bp, human
gcaaccggtagagctaggaa

SEQ ID NO: 318256 - DNA, 20 bp, human
gtctgctgtgcatcctctac

SEQ ID NO: 318257 - DNA, 20 bp, human
gaaaacctagacagtgttac

SEQ ID NO: 318258 - DNA, 20 bp, human
gcagagagagcgtgaggtag

SEQ ID NO: 318259 - DNA, 20 bp, human
gtagaaagataggccagtag

SEQ ID NO: 318260 - DNA, 20 bp, human
ggaaccttttgctttcagga

SEQ ID NO: 318261 - DNA, 20 bp, human
gtctaggttttgcaacacac

SEQ ID NO: 318262 - DNA, 20 bp, human
ggctaatccaagtattagca

SEQ ID NO: 318263 - DNA, 20 bp, human
gaaggttcagagagagcgtg

SEQ ID NO: 318264 - DNA, 20 bp, human
ggttgagcttaaatttaaga

SEQ ID NO: 318265 - DNA, 20 bp, human
gcttaaatttaagaaggctg

SEQ ID NO: 318266 - DNA, 20 bp, human
gcaaggaggtaagagagaca

SEQ ID NO: 318267 - DNA, 20 bp, human
gcggctcccccaaaagctcc

SEQ ID NO: 318268 - DNA, 20 bp, human
ggctccaggccgcgttttgc

SEQ ID NO: 318269 - DNA, 20 bp, human
gccgagttgcgagtgtgctg

SEQ ID NO: 318270 - DNA, 20 bp, human
gatagtgccgaacatcaagg

SEQ ID NO: 318271 - DNA, 20 bp, human
gagaaatcccagctctccca

SEQ ID NO: 318272 - DNA, 20 bp, human
gtggaactgggatgggagcg

SEQ ID NO: 318273 - DNA, 20 bp, human
gcgttttgatggaactggga

SEQ ID NO: 318274 - DNA, 20 bp, human
gacgcggcctggagcttttg

SEQ ID NO: 318275 - DNA, 20 bp, human
ggcaaactgctgattaagga

SEQ ID NO: 318276 - DNA, 20 bp, human
gcgcgcgcctcgcggaagag

SEQ ID NO: 318277 - DNA, 20 bp, human
ggtgcctccgcctagagggg

SEQ ID NO: 318278 - DNA, 20 bp, human
gtccactgcggacgaatccc

SEQ ID NO: 318279 - DNA, 20 bp, human
ggagctcgaagtcacgggtt

SEQ ID NO: 318280 - DNA, 20 bp, human
gtcccgggattcgtccgcag

SEQ ID NO: 318281 - DNA, 20 bp, human
gcgccccggctcaacgtgaa

SEQ ID NO: 318282 - DNA, 20 bp, human
gtgaacctgcggatggccgg

SEQ ID NO: 318283 - DNA, 20 bp, human
gcggcggccgctcttccgcg

SEQ ID NO: 318284 - DNA, 20 bp, human
gcggccgccgtgcagcgcgg

SEQ ID NO: 318285 - DNA, 20 bp, human
gcctgagccgagaagggcgt

SEQ ID NO: 318286 - DNA, 20 bp, human
gcatgcgcagagagccctcg

SEQ ID NO: 318287 - DNA, 20 bp, human
gcctcatcctggggcataat

SEQ ID NO: 318288 - DNA, 20 bp, human
ggaggcctctggctgcgcga

SEQ ID NO: 318289 - DNA, 20 bp, human
ggcttataaaggggccgcga

SEQ ID NO: 318290 - DNA, 20 bp, human
ggcctctggctgcgcgaggg

SEQ ID NO: 318291 - DNA, 20 bp, human
gccgcctcagtgcttataaa

SEQ ID NO: 318292 - DNA, 20 bp, human
gtgggcggggtggggatttt

SEQ ID NO: 318293 - DNA, 20 bp, human
gacgtttaacgcggttcctg

SEQ ID NO: 318294 - DNA, 20 bp, human
gggcccctttataagcactg

SEQ ID NO: 318295 - DNA, 20 bp, human
ggggtggggattttaggcag

SEQ ID NO: 318296 - DNA, 20 bp, human
gagcaaggcagttttcaagt

SEQ ID NO: 318297 - DNA, 20 bp, human
gaatccggccaatccccggc

SEQ ID NO: 318298 - DNA, 20 bp, human
gtctgagtctggcaacgcgc

SEQ ID NO: 318299 - DNA, 20 bp, human
gcggccaaggagggattcgc

SEQ ID NO: 318300 - DNA, 20 bp, human
gaaagggccgcctctgagtc

SEQ ID NO: 318301 - DNA, 20 bp, human
gtccccgccgactgggcaaa

SEQ ID NO: 318302 - DNA, 20 bp, human
gacagcggaagactgttgtg

SEQ ID NO: 318303 - DNA, 20 bp, human
gaggtccccctttgcccagt

SEQ ID NO: 318304 - DNA, 20 bp, human
gcctacctgccccggataag

SEQ ID NO: 318305 - DNA, 20 bp, human
gccccgggcggcgctgtgat

SEQ ID NO: 318306 - DNA, 20 bp, human
gaactgggcgggccgaaaag

SEQ ID NO: 318307 - DNA, 20 bp, human
ggcacgctcagagaactggg

SEQ ID NO: 318308 - DNA, 20 bp, human
ggccgcacgctcagagaact

SEQ ID NO: 318309 - DNA, 20 bp, human
ggaaaagtggaagccaaaca

SEQ ID NO: 318310 - DNA, 20 bp, human
gcacccgcaggagccttgtt

SEQ ID NO: 318311 - DNA, 20 bp, human
gagcgtgcggcggacgacgc

SEQ ID NO: 318312 - DNA, 20 bp, human
gcattcgctcaaccaatcac

SEQ ID NO: 318313 - DNA, 20 bp, human
gtgagcgaatggaaacggct

SEQ ID NO: 318314 - DNA, 20 bp, human
ggggagtcccaggagcgtta

SEQ ID NO: 318315 - DNA, 20 bp, human
gggcgggaaaaacgctgtta

SEQ ID NO: 318316 - DNA, 20 bp, human
gactcggccggaagtagcgt

SEQ ID NO: 318317 - DNA, 20 bp, human
gcgcatgcgcccaaagcgcg

SEQ ID NO: 318318 - DNA, 20 bp, human
gcccgcgccgacgctacttc

SEQ ID NO: 318319 - DNA, 20 bp, human
gcaaagcgcggggtgcgagg

SEQ ID NO: 318320 - DNA, 20 bp, human
gagaagagagcgggaagcga

SEQ ID NO: 318321 - DNA, 20 bp, human
ggggaagggctgctggcgtt

SEQ ID NO: 318322 - DNA, 20 bp, human
ggagggaagtggcgtttcta

SEQ ID NO: 318323 - DNA, 20 bp, human
gagactgccgtaagcgcttt

SEQ ID NO: 318324 - DNA, 20 bp, human
ggctacttccggccgagtca

SEQ ID NO: 318325 - DNA, 20 bp, human
ggccttgccaccggagggga

SEQ ID NO: 318326 - DNA, 20 bp, human
ggaggccgcgccctaagagg

SEQ ID NO: 318327 - DNA, 20 bp, human
gtaagaggcggggcatagac

SEQ ID NO: 318328 - DNA, 20 bp, human
gtagacaggaagaagactgg

SEQ ID NO: 318329 - DNA, 20 bp, human
gagactggcgggcatgtggg

SEQ ID NO: 318330 - DNA, 20 bp, human
ggcggggcatgatctggagg

SEQ ID NO: 318331 - DNA, 20 bp, human
gagcgggcggtgttgtggga

SEQ ID NO: 318332 - DNA, 20 bp, human
ggtcctggggcctccgcgga

SEQ ID NO: 318333 - DNA, 20 bp, human
gcgttccgtagtgcccggta

SEQ ID NO: 318334 - DNA, 20 bp, human
gcacgcggggcgccacagct

SEQ ID NO: 318335 - DNA, 20 bp, human
gctcgaggccgcgccctaag

SEQ ID NO: 318336 - DNA, 20 bp, human
gcgcctgcgcagaccacctc

SEQ ID NO: 318337 - DNA, 20 bp, human
gcggcgtcagagtgagtttt

SEQ ID NO: 318338 - DNA, 20 bp, human
ggggaacccagcgtcgagca

SEQ ID NO: 318339 - DNA, 20 bp, human
gccgtctgattgggcttctt

SEQ ID NO: 318340 - DNA, 20 bp, human
gtgattgggcttcttggggt

SEQ ID NO: 318341 - DNA, 20 bp, human
gggcccgaggtggtctgcgc

SEQ ID NO: 318342 - DNA, 20 bp, human
gaacggccgcgtgacgtcgc

SEQ ID NO: 318343 - DNA, 20 bp, human
gttgaggaccccgtctgatt

SEQ ID NO: 318344 - DNA, 20 bp, human
gtcctgcacctagtcctcga

SEQ ID NO: 318345 - DNA, 20 bp, human
ggaccacctcgggcctccgc

SEQ ID NO: 318346 - DNA, 20 bp, human
gccgcgcagcgggagctcac

SEQ ID NO: 318347 - DNA, 20 bp, human
gcaccggaagagtcgcgggg

SEQ ID NO: 318348 - DNA, 20 bp, human
gtcgaagcctccgggagggg

SEQ ID NO: 318349 - DNA, 20 bp, human
ggggcggggtcgaagcctcc

SEQ ID NO: 318350 - DNA, 20 bp, human
gggggtcgaagcctccggga

SEQ ID NO: 318351 - DNA, 20 bp, human
ggcgccggggttcgcctctc

SEQ ID NO: 318352 - DNA, 20 bp, human
gagctcaccggaagagtcgc

SEQ ID NO: 318353 - DNA, 20 bp, human
ggaaccccggcgccgcgcag

SEQ ID NO: 318354 - DNA, 20 bp, human
gcccgcccaggaaaatgcgt

SEQ ID NO: 318355 - DNA, 20 bp, human
gccccgccccgcgactcttc

SEQ ID NO: 318356 - DNA, 20 bp, human
gccggcgtgaggaagctcag

SEQ ID NO: 318357 - DNA, 20 bp, human
gcaggcggaggcagcccgag

SEQ ID NO: 318358 - DNA, 20 bp, human
ggctaggcggagacagtgca

SEQ ID NO: 318359 - DNA, 20 bp, human
gtacgacgaccgcggcccgg

SEQ ID NO: 318360 - DNA, 20 bp, human
gcggaaggacatagagcgga

SEQ ID NO: 318361 - DNA, 20 bp, human
gcacatgcaaccgccccctc

SEQ ID NO: 318362 - DNA, 20 bp, human
gggagaaagaagtagccggc

SEQ ID NO: 318363 - DNA, 20 bp, human
gaaggacatagagcggaagg

SEQ ID NO: 318364 - DNA, 20 bp, human
gtgaaggcgggtcgtgccgg

SEQ ID NO: 318365 - DNA, 20 bp, human
gggaccggcctgagcggagg

SEQ ID NO: 318366 - DNA, 20 bp, human
ggccgcggggcggaagacga

SEQ ID NO: 318367 - DNA, 20 bp, human
ggcggggcggaagacgaggg

SEQ ID NO: 318368 - DNA, 20 bp, human
ggggcatagacgtccgggtc

SEQ ID NO: 318369 - DNA, 20 bp, human
gaagacgagggcggcgaggt

SEQ ID NO: 318370 - DNA, 20 bp, human
gggagaagatggtgctgcgg

SEQ ID NO: 318371 - DNA, 20 bp, human
gcgcgggggcatagacgtcc

SEQ ID NO: 318372 - DNA, 20 bp, human
gcacgaggctgcgtccgcga

SEQ ID NO: 318373 - DNA, 20 bp, human
ggacacgccgccctcggatt

SEQ ID NO: 318374 - DNA, 20 bp, human
gcggaagcggaaacgcgcgg

SEQ ID NO: 318375 - DNA, 20 bp, human
ggcggaggcgagcatctcat

SEQ ID NO: 318376 - DNA, 20 bp, human
gtaagagaggggcgtgtcgg

SEQ ID NO: 318377 - DNA, 20 bp, human
gctgagggaggagggtccga

SEQ ID NO: 318378 - DNA, 20 bp, human
ggggttaactgggagcggga

SEQ ID NO: 318379 - DNA, 20 bp, human
gctggctgacatttaagaga

SEQ ID NO: 318380 - DNA, 20 bp, human
gaaaattggggcaggaagtc

SEQ ID NO: 318381 - DNA, 20 bp, human
ggtctggggacctaaggagg

SEQ ID NO: 318382 - DNA, 20 bp, human
ggggggaggatcttgtccct

SEQ ID NO: 318383 - DNA, 20 bp, human
ggggctccgggctgtctaat

SEQ ID NO: 318384 - DNA, 20 bp, human
gccagcatggcaggattaag

SEQ ID NO: 318385 - DNA, 20 bp, human
ggctctgtcaggctcacgct

SEQ ID NO: 318386 - DNA, 20 bp, human
gctctggccaatggcaagtc

SEQ ID NO: 318387 - DNA, 20 bp, human
gcctccctggacagcgacgg

SEQ ID NO: 318388 - DNA, 20 bp, human
ggctggggctcgagcgaagg

SEQ ID NO: 318389 - DNA, 20 bp, human
ggctgcttcactccgggctc

SEQ ID NO: 318390 - DNA, 20 bp, human
gtgaggggagcgaaggttgg

SEQ ID NO: 318391 - DNA, 20 bp, human
gtaaaactacgcacaagcga

SEQ ID NO: 318392 - DNA, 20 bp, human
ggattcgtcaagagcggtgc

SEQ ID NO: 318393 - DNA, 20 bp, human
gcgcccccggccacctaccg

SEQ ID NO: 318394 - DNA, 20 bp, human
gaccgctcttgacgaatccg

SEQ ID NO: 318395 - DNA, 20 bp, human
gtccgcggctgcttcactcc

SEQ ID NO: 318396 - DNA, 20 bp, human
gtaggcacagcggactctgg

SEQ ID NO: 318397 - DNA, 20 bp, human
gtgcaaggacaccgtagagg

SEQ ID NO: 318398 - DNA, 20 bp, human
ggctctggccgtaggcacag

SEQ ID NO: 318399 - DNA, 20 bp, human
gcgcggacatgccccctcta

SEQ ID NO: 318400 - DNA, 20 bp, human
gctgtcgctgctctggccgt

SEQ ID NO: 318401 - DNA, 20 bp, human
gtactgcatgcgtgtgagga

SEQ ID NO: 318402 - DNA, 20 bp, human
gcctcctggaaggtctcaaa

SEQ ID NO: 318403 - DNA, 20 bp, human
gagtctctggacaaagcaag

SEQ ID NO: 318404 - DNA, 20 bp, human
gtcccgacgcagcctctgat

SEQ ID NO: 318405 - DNA, 20 bp, human
gtgactcagagtactgagaa

SEQ ID NO: 318406 - DNA, 20 bp, human
ggtggggcccgtgcaggcga

SEQ ID NO: 318407 - DNA, 20 bp, human
ggcccgtgcaggcgacggga

SEQ ID NO: 318408 - DNA, 20 bp, human
gcgggccccacgggttttgg

SEQ ID NO: 318409 - DNA, 20 bp, human
gagggaagatggtgaatggg

SEQ ID NO: 318410 - DNA, 20 bp, human
gaaacccgtggggcccgtgc

SEQ ID NO: 318411 - DNA, 20 bp, human
gggggacgcagcaaatgcaa

SEQ ID NO: 318412 - DNA, 20 bp, human
gaatggaggagagttatgga

SEQ ID NO: 318413 - DNA, 20 bp, human
ggcttgcagggtgtaaacat

SEQ ID NO: 318414 - DNA, 20 bp, human
gaggggggaaagatggtcaa

SEQ ID NO: 318415 - DNA, 20 bp, human
gagaggctgagaaaggtatg

SEQ ID NO: 318416 - DNA, 20 bp, human
gagagagagagggcgagtag

SEQ ID NO: 318417 - DNA, 20 bp, human
ggagagagggcgagtagggg

SEQ ID NO: 318418 - DNA, 20 bp, human
gtgacagagcagaagcattt

SEQ ID NO: 318419 - DNA, 20 bp, human
gggctctagaagcagaactt

SEQ ID NO: 318420 - DNA, 20 bp, human
gcctgtcattatcaccaggg

SEQ ID NO: 318421 - DNA, 20 bp, human
gtaggtcacgggtttcattt

SEQ ID NO: 318422 - DNA, 20 bp, human
gaggaaatgtccccaccttt

SEQ ID NO: 318423 - DNA, 20 bp, human
ggggtaaccttggcaggtag

SEQ ID NO: 318424 - DNA, 20 bp, human
gtgagaagttatcttaaggg

SEQ ID NO: 318425 - DNA, 20 bp, human
ggagccagggtaaccttggc

SEQ ID NO: 318426 - DNA, 20 bp, human
gaggtcacaagacaccctga

SEQ ID NO: 318427 - DNA, 20 bp, human
gcctgcaaacctggcacccg

SEQ ID NO: 318428 - DNA, 20 bp, human
ggcgccaaggactgacatca

SEQ ID NO: 318429 - DNA, 20 bp, human
gcccagctgcacagaaattg

SEQ ID NO: 318430 - DNA, 20 bp, human
gagggtgtcttgtgaccttg

SEQ ID NO: 318431 - DNA, 20 bp, human
gggcttctgatacccaactg

SEQ ID NO: 318432 - DNA, 20 bp, human
gaattgaggaagtggaccct

SEQ ID NO: 318433 - DNA, 20 bp, human
gggctgggcatggagatcta

SEQ ID NO: 318434 - DNA, 20 bp, human
ggctgggaccccatctctga

SEQ ID NO: 318435 - DNA, 20 bp, human
gaagtggaccctcgggtgcc

SEQ ID NO: 318436 - DNA, 20 bp, human
gggcccgcccaatcccagtg

SEQ ID NO: 318437 - DNA, 20 bp, human
ggcgccgtgcctgatgtgga

SEQ ID NO: 318438 - DNA, 20 bp, human
ggcggagagtagagagctag

SEQ ID NO: 318439 - DNA, 20 bp, human
ggggaagctcccagagcagt

SEQ ID NO: 318440 - DNA, 20 bp, human
gacggcgcttgattgacatg

SEQ ID NO: 318441 - DNA, 20 bp, human
ggctccctccacatcaggca

SEQ ID NO: 318442 - DNA, 20 bp, human
ggtctctgccgcactgggat

SEQ ID NO: 318443 - DNA, 20 bp, human
gccggtccctgacgcgacaa

SEQ ID NO: 318444 - DNA, 20 bp, human
gacaacggtctctgccgcac

SEQ ID NO: 318445 - DNA, 20 bp, human
gtcgcgtcagggaccgggga

SEQ ID NO: 318446 - DNA, 20 bp, human
gcgcgcccgggtcccggtac

SEQ ID NO: 318447 - DNA, 20 bp, human
gcggggacccgagacccacc

SEQ ID NO: 318448 - DNA, 20 bp, human
ggcgccgtgacgccgcccag

SEQ ID NO: 318449 - DNA, 20 bp, human
ggacggggggcgccccaggt

SEQ ID NO: 318450 - DNA, 20 bp, human
gccgtgctgcgcctccagag

SEQ ID NO: 318451 - DNA, 20 bp, human
gcccacccggcagtcatccc

SEQ ID NO: 318452 - DNA, 20 bp, human
gctatcccggcgcccgtacc

SEQ ID NO: 318453 - DNA, 20 bp, human
ggcggagcctggcgacgacg

SEQ ID NO: 318454 - DNA, 20 bp, human
gggcgcccgtaccgggaccc

SEQ ID NO: 318455 - DNA, 20 bp, human
gcctcccggaagcattccca

SEQ ID NO: 318456 - DNA, 20 bp, human
ggggccctcggtcacctgat

SEQ ID NO: 318457 - DNA, 20 bp, human
ggcccactacgcctgatgcc

SEQ ID NO: 318458 - DNA, 20 bp, human
ggtgaccgagggcccgtccg

SEQ ID NO: 318459 - DNA, 20 bp, human
gctgccgatcaggtgaccga

SEQ ID NO: 318460 - DNA, 20 bp, human
gtcccaagcggggactgagt

SEQ ID NO: 318461 - DNA, 20 bp, human
gggcggcgaggccatgccga

SEQ ID NO: 318462 - DNA, 20 bp, human
gtcccggcatcaggcgtagt

SEQ ID NO: 318463 - DNA, 20 bp, human
ggggatgggagtcccaagcg

SEQ ID NO: 318464 - DNA, 20 bp, human
gggcgccggcgctgccgatc

SEQ ID NO: 318465 - DNA, 20 bp, human
gccccactcagtccccgctt

SEQ ID NO: 318466 - DNA, 20 bp, human
ggaagcacaagaaggctctg

SEQ ID NO: 318467 - DNA, 20 bp, human
ggcctctgcaattggctcat

SEQ ID NO: 318468 - DNA, 20 bp, human
gggtaaggctatgaagtggg

SEQ ID NO: 318469 - DNA, 20 bp, human
ggaagaccagtgcaccaacc

SEQ ID NO: 318470 - DNA, 20 bp, human
gcccctgctgagtgtgcaag

SEQ ID NO: 318471 - DNA, 20 bp, human
gacccatgagccaattgcag

SEQ ID NO: 318472 - DNA, 20 bp, human
gaccagtgcaccaaccaggc

SEQ ID NO: 318473 - DNA, 20 bp, human
gggcataagaccaaaaaggt

SEQ ID NO: 318474 - DNA, 20 bp, human
gaccacgcccagctttgtct

SEQ ID NO: 318475 - DNA, 20 bp, human
gtggtgacaccctctggcgg

SEQ ID NO: 318476 - DNA, 20 bp, human
gcaaaatcggcatcttggag

SEQ ID NO: 318477 - DNA, 20 bp, human
gtgcagcaaaatcggcatct

SEQ ID NO: 318478 - DNA, 20 bp, human
gaagttgactcgaaacaggt

SEQ ID NO: 318479 - DNA, 20 bp, human
gaagtcccaaatgacatcac

SEQ ID NO: 318480 - DNA, 20 bp, human
gggtgggtaaacaatttggt

SEQ ID NO: 318481 - DNA, 20 bp, human
gaacaggtgggtaaacaatt

SEQ ID NO: 318482 - DNA, 20 bp, human
gttcctagatagattgtctt

SEQ ID NO: 318483 - DNA, 20 bp, human
gcagctattccagtgtaagc

SEQ ID NO: 318484 - DNA, 20 bp, human
gctattccagtgtaagctgg

SEQ ID NO: 318485 - DNA, 20 bp, human
gcacccaagacaatctatct

SEQ ID NO: 318486 - DNA, 20 bp, human
ggaggtccttcccaccaaag

SEQ ID NO: 318487 - DNA, 20 bp, human
gtcctgggaacatctggagg

SEQ ID NO: 318488 - DNA, 20 bp, human
gcagacttagctcgcgtcct

SEQ ID NO: 318489 - DNA, 20 bp, human
gcgagctaagtctgcccggc

SEQ ID NO: 318490 - DNA, 20 bp, human
ggcgtcctgggaacatctgg

SEQ ID NO: 318491 - DNA, 20 bp, human
ggacgcgagctaagtctgcc

SEQ ID NO: 318492 - DNA, 20 bp, human
gggaacatctggagggggct

SEQ ID NO: 318493 - DNA, 20 bp, human
gcgcgccgcttccgctttgg

SEQ ID NO: 318494 - DNA, 20 bp, human
gagaaagtgtttctataagg

SEQ ID NO: 318495 - DNA, 20 bp, human
gctgggaggggcgcgcatcc

SEQ ID NO: 318496 - DNA, 20 bp, human
gcgcctgcgtagtgtgtcac

SEQ ID NO: 318497 - DNA, 20 bp, human
gcgcgcggccccaagaggtg

SEQ ID NO: 318498 - DNA, 20 bp, human
gggccccaagaggtgcggcg

SEQ ID NO: 318499 - DNA, 20 bp, human
gcagccccgccgcacctctt

SEQ ID NO: 318500 - DNA, 20 bp, human
gtcacggggcgggacaaccg

SEQ ID NO: 318501 - DNA, 20 bp, human
gagtgagggtgcggtgtccg

SEQ ID NO: 318502 - DNA, 20 bp, human
ggccccgtgacacactacgc

SEQ ID NO: 318503 - DNA, 20 bp, human
gggcgctgctctccgatgcg

SEQ ID NO: 318504 - DNA, 20 bp, human
ggctgtatcgttccacgcat

SEQ ID NO: 318505 - DNA, 20 bp, human
gtgtctcctctggtccctcc

SEQ ID NO: 318506 - DNA, 20 bp, human
gggtctccggttcgccaatg

SEQ ID NO: 318507 - DNA, 20 bp, human
gccaatgtggctgggtccgt

SEQ ID NO: 318508 - DNA, 20 bp, human
gcgggggtggtggaatcggg

SEQ ID NO: 318509 - DNA, 20 bp, human
ggggtcccggcctgcgtcgt

SEQ ID NO: 318510 - DNA, 20 bp, human
ggcggggagtaggcgggccg

SEQ ID NO: 318511 - DNA, 20 bp, human
gaacgccagtcccacgacgc

SEQ ID NO: 318512 - DNA, 20 bp, human
gccgcgccgttcacggttag

SEQ ID NO: 318513 - DNA, 20 bp, human
ggcgagcctctaaccgtgaa

SEQ ID NO: 318514 - DNA, 20 bp, human
ggggctggcaacggcgccgt

SEQ ID NO: 318515 - DNA, 20 bp, human
ggcccacggcccaatcagcg

SEQ ID NO: 318516 - DNA, 20 bp, human
ggcaacctcagcaaagaagg

SEQ ID NO: 318517 - DNA, 20 bp, human
gggtgtggggctggacttac

SEQ ID NO: 318518 - DNA, 20 bp, human
ggtcgtttccccaacaaaaa

SEQ ID NO: 318519 - DNA, 20 bp, human
ggctgctttcttggctggtg

SEQ ID NO: 318520 - DNA, 20 bp, human
gcaactgcaaccttttttgt

SEQ ID NO: 318521 - DNA, 20 bp, human
ggctggtgtaactgtcttct

SEQ ID NO: 318522 - DNA, 20 bp, human
gggaccatggttatcttttt

SEQ ID NO: 318523 - DNA, 20 bp, human
gccaggtgtggtaactgctt

SEQ ID NO: 318524 - DNA, 20 bp, human
gttgctgctgcctttttgcc

SEQ ID NO: 318525 - DNA, 20 bp, human
gacgaccaccttctttgctg

SEQ ID NO: 318526 - DNA, 20 bp, human
gtgggcctacaactcccaca

SEQ ID NO: 318527 - DNA, 20 bp, human
ggggagttgtaggcccactc

SEQ ID NO: 318528 - DNA, 20 bp, human
gccactctggaactcccgga

SEQ ID NO: 318529 - DNA, 20 bp, human
gggcgctcgcggagccctgt

SEQ ID NO: 318530 - DNA, 20 bp, human
gaactcccggaaggtgcggc

SEQ ID NO: 318531 - DNA, 20 bp, human
ggaaggtgcggcaggctgtt

SEQ ID NO: 318532 - DNA, 20 bp, human
gaggggcgaaaggtggggac

SEQ ID NO: 318533 - DNA, 20 bp, human
ggcggtgcccacaggacctc

SEQ ID NO: 318534 - DNA, 20 bp, human
gtccgcgagcgccggacgga

SEQ ID NO: 318535 - DNA, 20 bp, human
gggcgcccgcaggaccccgg

SEQ ID NO: 318536 - DNA, 20 bp, human
gcaggagcggggacaccacg

SEQ ID NO: 318537 - DNA, 20 bp, human
ggagtggcggcgcctccccg

SEQ ID NO: 318538 - DNA, 20 bp, human
gtcctccgcggggtaaagag

SEQ ID NO: 318539 - DNA, 20 bp, human
gccccgtgcaggtgatcctg

SEQ ID NO: 318540 - DNA, 20 bp, human
ggcacccccggcgcgttctc

SEQ ID NO: 318541 - DNA, 20 bp, human
gaggccggagaacgcgccgg

SEQ ID NO: 318542 - DNA, 20 bp, human
ggagcccagggcgatatccc

SEQ ID NO: 318543 - DNA, 20 bp, human
ggtgccagggtcccgcacac

SEQ ID NO: 318544 - DNA, 20 bp, human
gcctgggtcctttttgggac

SEQ ID NO: 318545 - DNA, 20 bp, human
gccaaaaaggacccaggagc

SEQ ID NO: 318546 - DNA, 20 bp, human
ggggaactcggggaagtggg

SEQ ID NO: 318547 - DNA, 20 bp, human
ggggccgcgaggggaactcg

SEQ ID NO: 318548 - DNA, 20 bp, human
gcagccgcgccgggccgcga

SEQ ID NO: 318549 - DNA, 20 bp, human
gccgcggaggccctaggggg

SEQ ID NO: 318550 - DNA, 20 bp, human
ggaggggaactcggggaagt

SEQ ID NO: 318551 - DNA, 20 bp, human
gagcaggggtccccccgcag

SEQ ID NO: 318552 - DNA, 20 bp, human
gggcgccgccgccacggtcg

SEQ ID NO: 318553 - DNA, 20 bp, human
gagctgctccccgcccccta

SEQ ID NO: 318554 - DNA, 20 bp, human
ggacccctgctccggaggag

SEQ ID NO: 318555 - DNA, 20 bp, human
gcgtgacagctgcacccacc

SEQ ID NO: 318556 - DNA, 20 bp, human
ggggtccgcagcatctccgt

SEQ ID NO: 318557 - DNA, 20 bp, human
gcgagctcgcgagcagggga

SEQ ID NO: 318558 - DNA, 20 bp, human
gaaggggcaaaggtggacgc

SEQ ID NO: 318559 - DNA, 20 bp, human
gcgcaagtgcggagacgcgg

SEQ ID NO: 318560 - DNA, 20 bp, human
gcaccgggaaaaggacgggg

SEQ ID NO: 318561 - DNA, 20 bp, human
ggtggacgcagggttgtccg

SEQ ID NO: 318562 - DNA, 20 bp, human
gaagtcctgtcaccgggaaa

SEQ ID NO: 318563 - DNA, 20 bp, human
gagcgcgagctcgcgagcag

SEQ ID NO: 318564 - DNA, 20 bp, human
gcctgtcaccgggaaaagga

SEQ ID NO: 318565 - DNA, 20 bp, human
gcgccgccaagtcctgtcac

SEQ ID NO: 318566 - DNA, 20 bp, human
gccagcactaccggtcccag

SEQ ID NO: 318567 - DNA, 20 bp, human
gccctcgggatccggagaac

SEQ ID NO: 318568 - DNA, 20 bp, human
ggggagctcccagtcgatgc

SEQ ID NO: 318569 - DNA, 20 bp, human
ggcggagggcgtggcgacgt

SEQ ID NO: 318570 - DNA, 20 bp, human
ggtggcgacgtgggctcgtg

SEQ ID NO: 318571 - DNA, 20 bp, human
gacccccaccctggcttccg

SEQ ID NO: 318572 - DNA, 20 bp, human
gctttcgcccagcatcgact

SEQ ID NO: 318573 - DNA, 20 bp, human
gcccaccctggcttccgcgg

SEQ ID NO: 318574 - DNA, 20 bp, human
gccctccgccgcggaagcca

SEQ ID NO: 318575 - DNA, 20 bp, human
ggtcgccacgccctccgccg

SEQ ID NO: 318576 - DNA, 20 bp, human
gcctcctagagggcagtcaa

SEQ ID NO: 318577 - DNA, 20 bp, human
gggactaaaggacactgcaa

SEQ ID NO: 318578 - DNA, 20 bp, human
gggacactgcaagggcgggg

SEQ ID NO: 318579 - DNA, 20 bp, human
gtgcgctctgcgcctcctag

SEQ ID NO: 318580 - DNA, 20 bp, human
gctaaaggacactgcaaggg

SEQ ID NO: 318581 - DNA, 20 bp, human
gaagcccttgactgccctct

SEQ ID NO: 318582 - DNA, 20 bp, human
gctgtcagacgtatggcgag

SEQ ID NO: 318583 - DNA, 20 bp, human
ggacgtatggcgagaggtgt

SEQ ID NO: 318584 - DNA, 20 bp, human
gcgcgagactgtcagacgta

SEQ ID NO: 318585 - DNA, 20 bp, human
ggtctcgcgagatctccgct

SEQ ID NO: 318586 - DNA, 20 bp, human
gttacggcagggctgagttg

SEQ ID NO: 318587 - DNA, 20 bp, human
gtgcctagcaacagcgtcct

SEQ ID NO: 318588 - DNA, 20 bp, human
gaaaaagtactctggggcgg

SEQ ID NO: 318589 - DNA, 20 bp, human
ggggcgggagttgagaacgc

SEQ ID NO: 318590 - DNA, 20 bp, human
gaccgcgcgtgtttacggca

SEQ ID NO: 318591 - DNA, 20 bp, human
ggggctgaggcgaccaccgt

SEQ ID NO: 318592 - DNA, 20 bp, human
gtcgatctccttggcaatga

SEQ ID NO: 318593 - DNA, 20 bp, human
ggcagagggcgcgcacgtag

SEQ ID NO: 318594 - DNA, 20 bp, human
gtggggcccatcctcagcct

SEQ ID NO: 318595 - DNA, 20 bp, human
gtcccgggccctcattgcca

SEQ ID NO: 318596 - DNA, 20 bp, human
gggatctcgtgggtctctgt

SEQ ID NO: 318597 - DNA, 20 bp, human
gtcgcgctcccggggacgtc

SEQ ID NO: 318598 - DNA, 20 bp, human
ggggggcggggcggactcga

SEQ ID NO: 318599 - DNA, 20 bp, human
gccacgtgaccagacgtccc

SEQ ID NO: 318600 - DNA, 20 bp, human
gactaagcactcagcaccga

SEQ ID NO: 318601 - DNA, 20 bp, human
ggtgctgagtgcttagtgct

SEQ ID NO: 318602 - DNA, 20 bp, human
gactcagcaccgaagggagc

SEQ ID NO: 318603 - DNA, 20 bp, human
gccgtgaggccctgccgggt

SEQ ID NO: 318604 - DNA, 20 bp, human
ggcttagtgctgggatctcg

SEQ ID NO: 318605 - DNA, 20 bp, human
ggggcctcacggagccggcg

SEQ ID NO: 318606 - DNA, 20 bp, human
gggggccccgcgtccggatc

SEQ ID NO: 318607 - DNA, 20 bp, human
gcggctgcgcacacccgatc

SEQ ID NO: 318608 - DNA, 20 bp, human
ggccgcagtcggggtgtctt

SEQ ID NO: 318609 - DNA, 20 bp, human
ggcgccccccgtcagggcat

SEQ ID NO: 318610 - DNA, 20 bp, human
gctctcggcgggtggaagga

SEQ ID NO: 318611 - DNA, 20 bp, human
gctggcgaggcgtcgcgcgt

SEQ ID NO: 318612 - DNA, 20 bp, human
gcggcccatgccctgacggg

SEQ ID NO: 318613 - DNA, 20 bp, human
gtgcgcagccgccgcagtcg

SEQ ID NO: 318614 - DNA, 20 bp, human
gcgcacacccgatccggacg

SEQ ID NO: 318615 - DNA, 20 bp, human
ggctgaaggcgggcagtcac

SEQ ID NO: 318616 - DNA, 20 bp, human
ggaccctgcaaacccctccg

SEQ ID NO: 318617 - DNA, 20 bp, human
gggcgcctctcctacctcgg

SEQ ID NO: 318618 - DNA, 20 bp, human
gtcgcccagcatttcagtga

SEQ ID NO: 318619 - DNA, 20 bp, human
gaccgggcgcagcgcgaccc

SEQ ID NO: 318620 - DNA, 20 bp, human
gggtctcccaactctccgga

SEQ ID NO: 318621 - DNA, 20 bp, human
gaacccctccgcggcgtggt

SEQ ID NO: 318622 - DNA, 20 bp, human
gagctccgccgaggtaggag

SEQ ID NO: 318623 - DNA, 20 bp, human
gcgggaagctccgccgaggt

SEQ ID NO: 318624 - DNA, 20 bp, human
gccgccgctgccaggcctag

SEQ ID NO: 318625 - DNA, 20 bp, human
gcgcggagccgcggctaagg

SEQ ID NO: 318626 - DNA, 20 bp, human
gggccccgggccacacggct

SEQ ID NO: 318627 - DNA, 20 bp, human
gaaacagggagatgggtcga

SEQ ID NO: 318628 - DNA, 20 bp, human
gtagcctagccgtgtggccc

SEQ ID NO: 318629 - DNA, 20 bp, human
gcgtgtggcccggggcccct

SEQ ID NO: 318630 - DNA, 20 bp, human
ggacccatctccctgtttgt

SEQ ID NO: 318631 - DNA, 20 bp, human
ggggtcctctgggtagttaa

SEQ ID NO: 318632 - DNA, 20 bp, human
ggccacacggctaggctact

SEQ ID NO: 318633 - DNA, 20 bp, human
ggctacctatttgacagaga

SEQ ID NO: 318634 - DNA, 20 bp, human
gacacctgaaggatggggtc

SEQ ID NO: 318635 - DNA, 20 bp, human
gcccatgtgtcgtaagcact

SEQ ID NO: 318636 - DNA, 20 bp, human
gggtgctcgcgtgtcctcac

SEQ ID NO: 318637 - DNA, 20 bp, human
gaggacacgcgagcacccag

SEQ ID NO: 318638 - DNA, 20 bp, human
ggggaccacaggaacgactc

SEQ ID NO: 318639 - DNA, 20 bp, human
gcccggagaacaggtgagtg

SEQ ID NO: 318640 - DNA, 20 bp, human
gagccatgcaagccacgcaa

SEQ ID NO: 318641 - DNA, 20 bp, human
gaggcctctggtcccttgcg

SEQ ID NO: 318642 - DNA, 20 bp, human
ggtcccttgcgtggcttgca

SEQ ID NO: 318643 - DNA, 20 bp, human
gccatggagtgaagttggat

SEQ ID NO: 318644 - DNA, 20 bp, human
gaagccacgcaagggaccag

SEQ ID NO: 318645 - DNA, 20 bp, human
gccgacccccaccaccatgt

SEQ ID NO: 318646 - DNA, 20 bp, human
gggtccctctgacacatctg

SEQ ID NO: 318647 - DNA, 20 bp, human
gagaccacagatgtgtcaga

SEQ ID NO: 318648 - DNA, 20 bp, human
gtcgtacccagagctgactg

SEQ ID NO: 318649 - DNA, 20 bp, human
gtagatacacaggaagtggt

SEQ ID NO: 318650 - DNA, 20 bp, human
ggtgaaagcgctctggtgat

SEQ ID NO: 318651 - DNA, 20 bp, human
gtgagcttacagaaaggccg

SEQ ID NO: 318652 - DNA, 20 bp, human
gagacaattgtcagagttgc

SEQ ID NO: 318653 - DNA, 20 bp, human
gccgcacggcaagagaaaca

SEQ ID NO: 318654 - DNA, 20 bp, human
gtgtgcccaatcatgcccag

SEQ ID NO: 318655 - DNA, 20 bp, human
gggctgcaagatcactagac

SEQ ID NO: 318656 - DNA, 20 bp, human
gggaaactgtgggcgagtta

SEQ ID NO: 318657 - DNA, 20 bp, human
gagggtggatgacaaactca

SEQ ID NO: 318658 - DNA, 20 bp, human
gcccaagcctcactggtcac

SEQ ID NO: 318659 - DNA, 20 bp, human
ggggatgcatcagtggggtg

SEQ ID NO: 318660 - DNA, 20 bp, human
gaggccaggtcctggttcct

SEQ ID NO: 318661 - DNA, 20 bp, human
gctcaggggtaggtcatggt

SEQ ID NO: 318662 - DNA, 20 bp, human
gaggcttggggcttgtgatc

SEQ ID NO: 318663 - DNA, 20 bp, human
gggagcatgggatgcatcag

SEQ ID NO: 318664 - DNA, 20 bp, human
gcatcactgacccaccatgg

SEQ ID NO: 318665 - DNA, 20 bp, human
gatgcccaggcctccatggt

SEQ ID NO: 318666 - DNA, 20 bp, human
gtaacccaagggtgagtggg

SEQ ID NO: 318667 - DNA, 20 bp, human
gggggagggtggggcttaga

SEQ ID NO: 318668 - DNA, 20 bp, human
ggctcctggaggcttgttct

SEQ ID NO: 318669 - DNA, 20 bp, human
gaaatcttggagtagccctg

SEQ ID NO: 318670 - DNA, 20 bp, human
gttccaggaagggaatgggt

SEQ ID NO: 318671 - DNA, 20 bp, human
gtagatggctgctaacccaa

SEQ ID NO: 318672 - DNA, 20 bp, human
gcaagggtgagtgggcggtt

SEQ ID NO: 318673 - DNA, 20 bp, human
gggaatgggtgggatgggtc

SEQ ID NO: 318674 - DNA, 20 bp, human
gggaagggaatgggtgggat

SEQ ID NO: 318675 - DNA, 20 bp, human
ggtgggatgggtctgggtac

SEQ ID NO: 318676 - DNA, 20 bp, human
gggcccggggcgctgctcta

SEQ ID NO: 318677 - DNA, 20 bp, human
gcgaagggatctgaagaagt

SEQ ID NO: 318678 - DNA, 20 bp, human
gcgacttcgcagttgccgaa

SEQ ID NO: 318679 - DNA, 20 bp, human
ggcggcccggtagaaaccaa

SEQ ID NO: 318680 - DNA, 20 bp, human
ggccgcggcgatgacgtgga

SEQ ID NO: 318681 - DNA, 20 bp, human
gccccggtgcctctcgcgag

SEQ ID NO: 318682 - DNA, 20 bp, human
ggcttcctgcagtgcgaacc

SEQ ID NO: 318683 - DNA, 20 bp, human
ggctaaagtgcggcgcgggt

SEQ ID NO: 318684 - DNA, 20 bp, human
gagccgctcgcgagaggcac

SEQ ID NO: 318685 - DNA, 20 bp, human
gccgcactttagcccggggg

SEQ ID NO: 318686 - DNA, 20 bp, human
gggcgccgggcgctgagtgg

SEQ ID NO: 318687 - DNA, 20 bp, human
gcgcgcgccaggggtggacc

SEQ ID NO: 318688 - DNA, 20 bp, human
gacacggcggcccacgggac

SEQ ID NO: 318689 - DNA, 20 bp, human
gagccggaggggcgtcccct

SEQ ID NO: 318690 - DNA, 20 bp, human
ggggaggcctgcatgcccga

SEQ ID NO: 318691 - DNA, 20 bp, human
ggccgcggccaggcgggtgc

SEQ ID NO: 318692 - DNA, 20 bp, human
gcagcagcgagcatgtgccg

SEQ ID NO: 318693 - DNA, 20 bp, human
gcacccctggcgcgcgggtg

SEQ ID NO: 318694 - DNA, 20 bp, human
ggctcaacgcggccccaggg

SEQ ID NO: 318695 - DNA, 20 bp, human
gcccctccggctggctggcg

SEQ ID NO: 318696 - DNA, 20 bp, human
gaccactgacaccgtctctg

SEQ ID NO: 318697 - DNA, 20 bp, human
gtgacgtggaggcgtccgaa

SEQ ID NO: 318698 - DNA, 20 bp, human
gggggctcggattaagacat

SEQ ID NO: 318699 - DNA, 20 bp, human
gggcccggagcctaagagac

SEQ ID NO: 318700 - DNA, 20 bp, human
ggccacagagacggtgtcag

SEQ ID NO: 318701 - DNA, 20 bp, human
gcggattaagacatcggagt

SEQ ID NO: 318702 - DNA, 20 bp, human
gaggcgtccgaagggcagca

SEQ ID NO: 318703 - DNA, 20 bp, human
gggacccggaggaagacgga

SEQ ID NO: 318704 - DNA, 20 bp, human
gcaggcgcttccggaaaccg

SEQ ID NO: 318705 - DNA, 20 bp, human
ggcgcgcgggtcaaaggtag

SEQ ID NO: 318706 - DNA, 20 bp, human
gccccctgagaggaagtagg

SEQ ID NO: 318707 - DNA, 20 bp, human
gctgggaactgtagtctcga

SEQ ID NO: 318708 - DNA, 20 bp, human
gccgctggaccctgcttcga

SEQ ID NO: 318709 - DNA, 20 bp, human
gaactccaggaaccgccctc

SEQ ID NO: 318710 - DNA, 20 bp, human
gcagacacgtcccgcaaacg

SEQ ID NO: 318711 - DNA, 20 bp, human
gccagcggggcgccagaagc

SEQ ID NO: 318712 - DNA, 20 bp, human
gtggacaagctcaacaggcc

SEQ ID NO: 318713 - DNA, 20 bp, human
gaagcctcgcagggatgggt

SEQ ID NO: 318714 - DNA, 20 bp, human
ggggcgccagaagcaggtgg

SEQ ID NO: 318715 - DNA, 20 bp, human
gcatgcctcaaggcacctcc

SEQ ID NO: 318716 - DNA, 20 bp, human
gcgaccgcctcgtcgctgga

SEQ ID NO: 318717 - DNA, 20 bp, human
gtgcgtcaccccaggaactg

SEQ ID NO: 318718 - DNA, 20 bp, human
gtggccgtctctacgaagac

SEQ ID NO: 318719 - DNA, 20 bp, human
ggctgcggagtgggtggaat

SEQ ID NO: 318720 - DNA, 20 bp, human
gagggcgagttgagcgttca

SEQ ID NO: 318721 - DNA, 20 bp, human
gtggcacgacccctaaagtt

SEQ ID NO: 318722 - DNA, 20 bp, human
gtcttccgacctaactttag

SEQ ID NO: 318723 - DNA, 20 bp, human
gggagaaagctttttctctg

SEQ ID NO: 318724 - DNA, 20 bp, human
gtgcgtaatgacgtcagcgc

SEQ ID NO: 318725 - DNA, 20 bp, human
gttcgtagagacggccacac

SEQ ID NO: 318726 - DNA, 20 bp, human
gagcgcagagcagcgtcgtt

SEQ ID NO: 318727 - DNA, 20 bp, human
gtgcggtcggcgcctcccat

SEQ ID NO: 318728 - DNA, 20 bp, human
ggaaggctcctggccggagg

SEQ ID NO: 318729 - DNA, 20 bp, human
gccgaccgcaggctccgggg

SEQ ID NO: 318730 - DNA, 20 bp, human
ggccaagcggcgaaggctcc

SEQ ID NO: 318731 - DNA, 20 bp, human
gcgggcgcggcgcggccaag

SEQ ID NO: 318732 - DNA, 20 bp, human
gacacccgggaaacgggttt

SEQ ID NO: 318733 - DNA, 20 bp, human
gtctcaaaccccctccggcc

SEQ ID NO: 318734 - DNA, 20 bp, human
gagcggcgaaggctcctggc

SEQ ID NO: 318735 - DNA, 20 bp, human
ggacgctgctctgcgctgat

SEQ ID NO: 318736 - DNA, 20 bp, human
ggccccgcgcggacaggacg

SEQ ID NO: 318737 - DNA, 20 bp, human
gcatgctgggaaccccgggg

SEQ ID NO: 318738 - DNA, 20 bp, human
ggccgcgtcctgtccgcgcg

SEQ ID NO: 318739 - DNA, 20 bp, human
ggggcatgctgggaaccccg

SEQ ID NO: 318740 - DNA, 20 bp, human
ggtgcggaagcggaagtgaa

SEQ ID NO: 318741 - DNA, 20 bp, human
gcctgccggggtctggtcgc

SEQ ID NO: 318742 - DNA, 20 bp, human
gtgaagggtgcgcttggcgg

SEQ ID NO: 318743 - DNA, 20 bp, human
gcgacaggggcggtgcggtg

SEQ ID NO: 318744 - DNA, 20 bp, human
gggggccggaatgtgagcgg

SEQ ID NO: 318745 - DNA, 20 bp, human
ggcggcgggagctgcggagt

SEQ ID NO: 318746 - DNA, 20 bp, human
gagcatgcgcggcagcgcac

SEQ ID NO: 318747 - DNA, 20 bp, human
gagcgcacgggtatgcgggg

SEQ ID NO: 318748 - DNA, 20 bp, human
gcggcagcgcacgggtatgc

SEQ ID NO: 318749 - DNA, 20 bp, human
ggggcggggctggtgtcaca

SEQ ID NO: 318750 - DNA, 20 bp, human
gcgctcctggactctgcgac

SEQ ID NO: 318751 - DNA, 20 bp, human
gagtccctgacgtgtcgggg

SEQ ID NO: 318752 - DNA, 20 bp, human
gcgcgctgacgccaagctga

SEQ ID NO: 318753 - DNA, 20 bp, human
gggtacgctgagtggagctc

SEQ ID NO: 318754 - DNA, 20 bp, human
gcaagaggacgccgtcagct

SEQ ID NO: 318755 - DNA, 20 bp, human
gtggccagaaaactgaaggc

SEQ ID NO: 318756 - DNA, 20 bp, human
ggacccctggtttatgagta

SEQ ID NO: 318757 - DNA, 20 bp, human
gctgccagacacgagggatc

SEQ ID NO: 318758 - DNA, 20 bp, human
gccgccgccccgaggtgcac

SEQ ID NO: 318759 - DNA, 20 bp, human
gcgtcggagcaactacacca

SEQ ID NO: 318760 - DNA, 20 bp, human
gtcttccccaggggccgcgt

SEQ ID NO: 318761 - DNA, 20 bp, human
gcgggcgagacgctcttctc

SEQ ID NO: 318762 - DNA, 20 bp, human
gccccgaggtgcaccggccc

SEQ ID NO: 318763 - DNA, 20 bp, human
gcctcggaggctcaggtcgt

SEQ ID NO: 318764 - DNA, 20 bp, human
ggaggcggggactacgacga

SEQ ID NO: 318765 - DNA, 20 bp, human
gggagcaactacaccagggc

SEQ ID NO: 318766 - DNA, 20 bp, human
ggaaaagtaaggcaagtccg

SEQ ID NO: 318767 - DNA, 20 bp, human
gtgggagggtatagctgggt

SEQ ID NO: 318768 - DNA, 20 bp, human
gaagtccgggggagctgtct

SEQ ID NO: 318769 - DNA, 20 bp, human
ggcgccccggagcttctccg

SEQ ID NO: 318770 - DNA, 20 bp, human
gaccgctcgcgcagactcgc

SEQ ID NO: 318771 - DNA, 20 bp, human
gttgcgaccgcccactcgac

SEQ ID NO: 318772 - DNA, 20 bp, human
gcggccgctgcgggagccac

SEQ ID NO: 318773 - DNA, 20 bp, human
ggggaggagatggaaaagta

SEQ ID NO: 318774 - DNA, 20 bp, human
ggccagtgggagggtatagc

SEQ ID NO: 318775 - DNA, 20 bp, human
gaccaacgcggaggtctcgg

SEQ ID NO: 318776 - DNA, 20 bp, human
gatcccggggtttcctgttt

SEQ ID NO: 318777 - DNA, 20 bp, human
gacggggagggtccatggcg

SEQ ID NO: 318778 - DNA, 20 bp, human
ggcgcggggccccgacgggg

SEQ ID NO: 318779 - DNA, 20 bp, human
gggcagcgcggggccccgac

SEQ ID NO: 318780 - DNA, 20 bp, human
gtggatgcgtactggagaag

SEQ ID NO: 318781 - DNA, 20 bp, human
gtggagaaggggccagttta

SEQ ID NO: 318782 - DNA, 20 bp, human
gagcaggtgaagcctcgcca

SEQ ID NO: 318783 - DNA, 20 bp, human
gccatggaccctccccgtcg

SEQ ID NO: 318784 - DNA, 20 bp, human
gaagtgagatggatgcgtac

SEQ ID NO: 318785 - DNA, 20 bp, human
gccttccgcagcgacgggca

SEQ ID NO: 318786 - DNA, 20 bp, human
gagggggaggcaacgggcag

SEQ ID NO: 318787 - DNA, 20 bp, human
ggggaggcaacgggcagagg

SEQ ID NO: 318788 - DNA, 20 bp, human
gaaactctggggttgatctg

SEQ ID NO: 318789 - DNA, 20 bp, human
gcccgcgagggtcctgtttg

SEQ ID NO: 318790 - DNA, 20 bp, human
gacaatagagggaaactctg

SEQ ID NO: 318791 - DNA, 20 bp, human
gcccgagtggcgctaaggtt

SEQ ID NO: 318792 - DNA, 20 bp, human
ggggcgggcgggcagcggtg

SEQ ID NO: 318793 - DNA, 20 bp, human
gagaccggggtgcacaatag

SEQ ID NO: 318794 - DNA, 20 bp, human
gctcgcgggcggcatcgcga

SEQ ID NO: 318795 - DNA, 20 bp, human
gtccccaaacaggaccctcg

SEQ ID NO: 318796 - DNA, 20 bp, human
gccgccctgacgcaaggcgc

SEQ ID NO: 318797 - DNA, 20 bp, human
gggctgcggcgggtaccaaa

SEQ ID NO: 318798 - DNA, 20 bp, human
gaagcctgcgccttgcgtca

SEQ ID NO: 318799 - DNA, 20 bp, human
ggtacccgccgcagccgcgc

SEQ ID NO: 318800 - DNA, 20 bp, human
gcggtgcgcctgcgcggctg

SEQ ID NO: 318801 - DNA, 20 bp, human
gtgcgcgcgcctccaggcac

SEQ ID NO: 318802 - DNA, 20 bp, human
gctggaggcgcgcgcagtgt

SEQ ID NO: 318803 - DNA, 20 bp, human
ggcgcctgcgcggctgcggc

SEQ ID NO: 318804 - DNA, 20 bp, human
gggatggagggtatgaaatt

SEQ ID NO: 318805 - DNA, 20 bp, human
gcggaaaacgctgttccttt

SEQ ID NO: 318806 - DNA, 20 bp, human
gcgaggcgggcgttcacggg

SEQ ID NO: 318807 - DNA, 20 bp, human
gccgacccgggactcaaccc

SEQ ID NO: 318808 - DNA, 20 bp, human
gcgtgaacgcccgcctcgat

SEQ ID NO: 318809 - DNA, 20 bp, human
ggcggccagggttgagtccc

SEQ ID NO: 318810 - DNA, 20 bp, human
ggggcgttcacgggcggcca

SEQ ID NO: 318811 - DNA, 20 bp, human
gggggcatggcgtccgatcg

SEQ ID NO: 318812 - DNA, 20 bp, human
gttgagtcccgggtcggggc

SEQ ID NO: 318813 - DNA, 20 bp, human
ggtcggggccgggggattgc

SEQ ID NO: 318814 - DNA, 20 bp, human
gcggacgccatgcccccaca

SEQ ID NO: 318815 - DNA, 20 bp, human
gctagggacgcgccctgtgg

SEQ ID NO: 318816 - DNA, 20 bp, human
gggagccgagcggtgggcag

SEQ ID NO: 318817 - DNA, 20 bp, human
gcagcagcgcactagcaaat

SEQ ID NO: 318818 - DNA, 20 bp, human
ggaacagcgtagcagaacaa

SEQ ID NO: 318819 - DNA, 20 bp, human
gctagcaaatgggaatgcca

SEQ ID NO: 318820 - DNA, 20 bp, human
gccacggagcatcttacgat

SEQ ID NO: 318821 - DNA, 20 bp, human
gggaatgccacggaaatgtg

SEQ ID NO: 318822 - DNA, 20 bp, human
gaaggcaagccatgtgacag

SEQ ID NO: 318823 - DNA, 20 bp, human
gcgtaagatgctccgtggaa

SEQ ID NO: 318824 - DNA, 20 bp, human
gaccgctcggctcccttcca

SEQ ID NO: 318825 - DNA, 20 bp, human
gaatgtgaggcgctcgttat

SEQ ID NO: 318826 - DNA, 20 bp, human
gctgcgtgctgggactgcga

SEQ ID NO: 318827 - DNA, 20 bp, human
gcggggcccgggttgtgggt

SEQ ID NO: 318828 - DNA, 20 bp, human
gcaacaggcggcggctccag

SEQ ID NO: 318829 - DNA, 20 bp, human
ggcgcggccgggaggggcat

SEQ ID NO: 318830 - DNA, 20 bp, human
gccctcctcccgggcgcgcc

SEQ ID NO: 318831 - DNA, 20 bp, human
ggcaagcagtcgtaggggcg

SEQ ID NO: 318832 - DNA, 20 bp, human
gcgaggccctggactcggag

SEQ ID NO: 318833 - DNA, 20 bp, human
ggcatcggggcccgggttgt

SEQ ID NO: 318834 - DNA, 20 bp, human
gtgttgcgcaagcagtcgta

SEQ ID NO: 318835 - DNA, 20 bp, human
gcagagccgacccacaaccc

SEQ ID NO: 318836 - DNA, 20 bp, human
gggcggagttaaccctgcgg

SEQ ID NO: 318837 - DNA, 20 bp, human
gatggccaacagggactctg

SEQ ID NO: 318838 - DNA, 20 bp, human
gtgggacccaagagaccctg

SEQ ID NO: 318839 - DNA, 20 bp, human
gcgtcccgacgcctgctctc

SEQ ID NO: 318840 - DNA, 20 bp, human
ggggcacgggggaacgtcga

SEQ ID NO: 318841 - DNA, 20 bp, human
gaatgcctcaaggggcgcgg

SEQ ID NO: 318842 - DNA, 20 bp, human
gtcaggaaagggttgtgctg

SEQ ID NO: 318843 - DNA, 20 bp, human
gcggctgctccgggagaagt

SEQ ID NO: 318844 - DNA, 20 bp, human
gggggggccgctataaatag

SEQ ID NO: 318845 - DNA, 20 bp, human
gcagtctgggcggggtgaaa

SEQ ID NO: 318846 - DNA, 20 bp, human
gggaactaccgagaagatgg

SEQ ID NO: 318847 - DNA, 20 bp, human
gtcgggaactaccgagaaga

SEQ ID NO: 318848 - DNA, 20 bp, human
gcaggcgcgccgaggacgcc

SEQ ID NO: 318849 - DNA, 20 bp, human
ggtgctgtgcccgtccacct

SEQ ID NO: 318850 - DNA, 20 bp, human
gttctcggtagttcccgagg

SEQ ID NO: 318851 - DNA, 20 bp, human
gaatctgagattcttctctg

SEQ ID NO: 318852 - DNA, 20 bp, human
gagaaaaactacatcaaaga

SEQ ID NO: 318853 - DNA, 20 bp, human
gctaggcgccctgtgacctt

SEQ ID NO: 318854 - DNA, 20 bp, human
gggtccgcgcaggcgcgccg

SEQ ID NO: 318855 - DNA, 20 bp, human
gtgtaataggggtgatacaa

SEQ ID NO: 318856 - DNA, 20 bp, human
ggggtgggaggagcagtgac

SEQ ID NO: 318857 - DNA, 20 bp, human
gcaggggctggggaccatca

SEQ ID NO: 318858 - DNA, 20 bp, human
ggtctcccagcagccaatat

SEQ ID NO: 318859 - DNA, 20 bp, human
gggggctcctggtaagcgag

SEQ ID NO: 318860 - DNA, 20 bp, human
ggccccaagcccaacatctt

SEQ ID NO: 318861 - DNA, 20 bp, human
gtggtctcggcttttgtatt

SEQ ID NO: 318862 - DNA, 20 bp, human
gggagccccagctcccatat

SEQ ID NO: 318863 - DNA, 20 bp, human
gtcaaggatgatgtgtggct

SEQ ID NO: 318864 - DNA, 20 bp, human
gaggaggggctagctaggct

SEQ ID NO: 318865 - DNA, 20 bp, human
gagctcccatattggctgct

SEQ ID NO: 318866 - DNA, 20 bp, human
gcagccgccccggccctcgt

SEQ ID NO: 318867 - DNA, 20 bp, human
gtccccgaggcggtgacccc

SEQ ID NO: 318868 - DNA, 20 bp, human
gggaccgagcgctgctatcg

SEQ ID NO: 318869 - DNA, 20 bp, human
gagcaccgaatcggccggga

SEQ ID NO: 318870 - DNA, 20 bp, human
gcggctgcccggcgtccccg

SEQ ID NO: 318871 - DNA, 20 bp, human
gaatcggccgggagggccga

SEQ ID NO: 318872 - DNA, 20 bp, human
gggccgagggagaatccggg

SEQ ID NO: 318873 - DNA, 20 bp, human
ggctcggagataggggtcaa

SEQ ID NO: 318874 - DNA, 20 bp, human
gccctacccgctcggagata

SEQ ID NO: 318875 - DNA, 20 bp, human
ggagcagcaccgaatcggcc

SEQ ID NO: 318876 - DNA, 20 bp, human
gccatcgcgcggagaggagg

SEQ ID NO: 318877 - DNA, 20 bp, human
ggggccggcccactcggggg

SEQ ID NO: 318878 - DNA, 20 bp, human
ggcggagcccgccgtctcgg

SEQ ID NO: 318879 - DNA, 20 bp, human
gggcccggctccccctccgc

SEQ ID NO: 318880 - DNA, 20 bp, human
gggcactgccggccgagcgt

SEQ ID NO: 318881 - DNA, 20 bp, human
gtaaccggaggcgggaccag

SEQ ID NO: 318882 - DNA, 20 bp, human
gccgcggcctccgagacggc

SEQ ID NO: 318883 - DNA, 20 bp, human
gcatccactcagccccgcgg

SEQ ID NO: 318884 - DNA, 20 bp, human
ggagccgggccggcccactc

SEQ ID NO: 318885 - DNA, 20 bp, human
gggcgcggagcccgccgtct

SEQ ID NO: 318886 - DNA, 20 bp, human
gcggaccggccctgaggatc

SEQ ID NO: 318887 - DNA, 20 bp, human
gcccgggcagccagatcctc

SEQ ID NO: 318888 - DNA, 20 bp, human
gggagccgcctccatcgacc

SEQ ID NO: 318889 - DNA, 20 bp, human
gcgggcgggagcccggtcga

SEQ ID NO: 318890 - DNA, 20 bp, human
ggcgggagcccggtcgatgg

SEQ ID NO: 318891 - DNA, 20 bp, human
gcgggaggggcggtcggaac

SEQ ID NO: 318892 - DNA, 20 bp, human
gaggcgacgctggaagggtg

SEQ ID NO: 318893 - DNA, 20 bp, human
gaggggcggtcggaactggc

SEQ ID NO: 318894 - DNA, 20 bp, human
gcctcgacaaggagaccccg

SEQ ID NO: 318895 - DNA, 20 bp, human
gaggccggggcggaaccccc

SEQ ID NO: 318896 - DNA, 20 bp, human
gggacacgagaattacacca

SEQ ID NO: 318897 - DNA, 20 bp, human
gtgtgtaacatcccactgac

SEQ ID NO: 318898 - DNA, 20 bp, human
gttctggagatgtgagagag

SEQ ID NO: 318899 - DNA, 20 bp, human
gactataaaggcagctttgc

SEQ ID NO: 318900 - DNA, 20 bp, human
gttaacggtgtgctgaacag

SEQ ID NO: 318901 - DNA, 20 bp, human
ggcaggagcagctggtattc

SEQ ID NO: 318902 - DNA, 20 bp, human
gtgtgatgtcatccagtcag

SEQ ID NO: 318903 - DNA, 20 bp, human
gcacatctccagaactataa

SEQ ID NO: 318904 - DNA, 20 bp, human
ggatgattagctgaaggaat

SEQ ID NO: 318905 - DNA, 20 bp, human
gctcaagactttcaaggacc

SEQ ID NO: 318906 - DNA, 20 bp, human
gcaaaagacactgacggaag

SEQ ID NO: 318907 - DNA, 20 bp, human
gtgctagggcacaagagaga

SEQ ID NO: 318908 - DNA, 20 bp, human
gcaggggccaagtgcaaccc

SEQ ID NO: 318909 - DNA, 20 bp, human
gaacgtggagtgacgtgcag

SEQ ID NO: 318910 - DNA, 20 bp, human
gagcggggcggtgccacgta

SEQ ID NO: 318911 - DNA, 20 bp, human
gtcgaagcaaaagacactga

SEQ ID NO: 318912 - DNA, 20 bp, human
gacggctccggaagaagcga

SEQ ID NO: 318913 - DNA, 20 bp, human
ggcggtgccacgtacggctc

SEQ ID NO: 318914 - DNA, 20 bp, human
gacaagagagacgggcgctc

SEQ ID NO: 318915 - DNA, 20 bp, human
ggaagcgacggaatctgcta

SEQ ID NO: 318916 - DNA, 20 bp, human
ggccgcgccgaggccctcgg

SEQ ID NO: 318917 - DNA, 20 bp, human
gtctccgcggaagcccccga

SEQ ID NO: 318918 - DNA, 20 bp, human
gcccctggaaggttcccgac

SEQ ID NO: 318919 - DNA, 20 bp, human
gcaggaccctggcagcgcac

SEQ ID NO: 318920 - DNA, 20 bp, human
gcggaagcccccgagggcct

SEQ ID NO: 318921 - DNA, 20 bp, human
ggcgacggggccctctctcg

SEQ ID NO: 318922 - DNA, 20 bp, human
gagcgcactggctgtctccg

SEQ ID NO: 318923 - DNA, 20 bp, human
gctgccagggtcctgcgggt

SEQ ID NO: 318924 - DNA, 20 bp, human
ggctccccgcagaatccccc

SEQ ID NO: 318925 - DNA, 20 bp, human
gggtgcccgcggcgcctgtc

SEQ ID NO: 318926 - DNA, 20 bp, human
ggggccgtggacaggatcag

SEQ ID NO: 318927 - DNA, 20 bp, human
gacagccgcggggtgaacag

SEQ ID NO: 318928 - DNA, 20 bp, human
ggggactatctactagggga

SEQ ID NO: 318929 - DNA, 20 bp, human
gagggaggggacagtatcga

SEQ ID NO: 318930 - DNA, 20 bp, human
ggaggggccgggctcagact

SEQ ID NO: 318931 - DNA, 20 bp, human
gggcggggactatctactag

SEQ ID NO: 318932 - DNA, 20 bp, human
gctcagggagtcctaggtta

SEQ ID NO: 318933 - DNA, 20 bp, human
ggatcaggggcggggattat

SEQ ID NO: 318934 - DNA, 20 bp, human
ggggcgggactccagttgat

SEQ ID NO: 318935 - DNA, 20 bp, human
ggctgcgcgcgcaacctttc

SEQ ID NO: 318936 - DNA, 20 bp, human
gaaaccaattctgcctactt

SEQ ID NO: 318937 - DNA, 20 bp, human
gacgcgaacgccagacgtgg

SEQ ID NO: 318938 - DNA, 20 bp, human
gtgcctacgcggtcatgttc

SEQ ID NO: 318939 - DNA, 20 bp, human
gagccagaacatgaccgcgt

SEQ ID NO: 318940 - DNA, 20 bp, human
gtgcgccgagcaaaacccac

SEQ ID NO: 318941 - DNA, 20 bp, human
gctcacgcgaacgccagacg

SEQ ID NO: 318942 - DNA, 20 bp, human
gcgcgcagagccaccacgtc

SEQ ID NO: 318943 - DNA, 20 bp, human
gccgagcaaaacccaccgga

SEQ ID NO: 318944 - DNA, 20 bp, human
ggtgagaaccttctgggcgt

SEQ ID NO: 318945 - DNA, 20 bp, human
ggttcgcgtgagaaccttct

SEQ ID NO: 318946 - DNA, 20 bp, human
gcgaccgcgcgggaaagctc

SEQ ID NO: 318947 - DNA, 20 bp, human
gggcctgcgcaacaccccag

SEQ ID NO: 318948 - DNA, 20 bp, human
gaagcacttgagatggtccg

SEQ ID NO: 318949 - DNA, 20 bp, human
ggtggcggaagcacttgaga

SEQ ID NO: 318950 - DNA, 20 bp, human
gtcacaaagcagggaggcta

SEQ ID NO: 318951 - DNA, 20 bp, human
gagaggcaaggtgaacgcga

SEQ ID NO: 318952 - DNA, 20 bp, human
gagctctggcggcggaccct

SEQ ID NO: 318953 - DNA, 20 bp, human
ggggagcagaatccgttcca

SEQ ID NO: 318954 - DNA, 20 bp, human
gccgcgcgggaaagctctgg

SEQ ID NO: 318955 - DNA, 20 bp, human
gtacccagcccgtgactacg

SEQ ID NO: 318956 - DNA, 20 bp, human
gtgcgaacgcaaagcagtgt

SEQ ID NO: 318957 - DNA, 20 bp, human
gtgcgctcggggttggtcgg

SEQ ID NO: 318958 - DNA, 20 bp, human
gcataggctgcatgaggcag

SEQ ID NO: 318959 - DNA, 20 bp, human
gaccctaaagcctagcccat

SEQ ID NO: 318960 - DNA, 20 bp, human
ggagcgagatagtaaggctc

SEQ ID NO: 318961 - DNA, 20 bp, human
ggcaggggcggggtaaagct

SEQ ID NO: 318962 - DNA, 20 bp, human
gatgccggagcgagatagta

SEQ ID NO: 318963 - DNA, 20 bp, human
ggctccggtctgaccaaccg

SEQ ID NO: 318964 - DNA, 20 bp, human
gggtccgcggttggtcagac

SEQ ID NO: 318965 - DNA, 20 bp, human
gctttgcgctcggggttggt

SEQ ID NO: 318966 - DNA, 20 bp, human
gcacgcgcaggctccgaaag

SEQ ID NO: 318967 - DNA, 20 bp, human
gcgccctggagcacaagtag

SEQ ID NO: 318968 - DNA, 20 bp, human
gaacaaagatggagccgtgg

SEQ ID NO: 318969 - DNA, 20 bp, human
gaagcgggccgtcgcacaga

SEQ ID NO: 318970 - DNA, 20 bp, human
gagaggcgaaagcaaggacg

SEQ ID NO: 318971 - DNA, 20 bp, human
ggcgcgagaacccgctccca

SEQ ID NO: 318972 - DNA, 20 bp, human
gtcactccggagcgacttct

SEQ ID NO: 318973 - DNA, 20 bp, human
gttgtggtccctctgtgcga

SEQ ID NO: 318974 - DNA, 20 bp, human
gtgctgcgacccacctaagg

SEQ ID NO: 318975 - DNA, 20 bp, human
gcagaacaaagatggagccg

SEQ ID NO: 318976 - DNA, 20 bp, human
gaaggcatttcactatgaag

SEQ ID NO: 318977 - DNA, 20 bp, human
gctcctacctgaaggaccct

SEQ ID NO: 318978 - DNA, 20 bp, human
ggccgcgcgctccgtgagta

SEQ ID NO: 318979 - DNA, 20 bp, human
gaggaatgcggtcggagcgt

SEQ ID NO: 318980 - DNA, 20 bp, human
ggggagaggccccctactca

SEQ ID NO: 318981 - DNA, 20 bp, human
gggtcaggacgaacatatga

SEQ ID NO: 318982 - DNA, 20 bp, human
gccaagggtgccacgtactg

SEQ ID NO: 318983 - DNA, 20 bp, human
gtgaggggttagatctaagc

SEQ ID NO: 318984 - DNA, 20 bp, human
gtcccgcggcgcctgagagc

SEQ ID NO: 318985 - DNA, 20 bp, human
ggggcctctgcgcgcggacc

SEQ ID NO: 318986 - DNA, 20 bp, human
gtggggtcccgcccctgagt

SEQ ID NO: 318987 - DNA, 20 bp, human
ggacatctggaggagagagt

SEQ ID NO: 318988 - DNA, 20 bp, human
gtgtggaggggacagaacca

SEQ ID NO: 318989 - DNA, 20 bp, human
gagcctgtaggggaattgtc

SEQ ID NO: 318990 - DNA, 20 bp, human
gggacagaaccagggttctc

SEQ ID NO: 318991 - DNA, 20 bp, human
gaaagtgagctaagttgggg

SEQ ID NO: 318992 - DNA, 20 bp, human
gtggtccaggtgcagacatc

SEQ ID NO: 318993 - DNA, 20 bp, human
ggacagctctaagggtgtca

SEQ ID NO: 318994 - DNA, 20 bp, human
gccaggcccaaagcctgtag

SEQ ID NO: 318995 - DNA, 20 bp, human
gcgctcctggacagctctaa

SEQ ID NO: 318996 - DNA, 20 bp, human
gagacgattggggaaagaaa

SEQ ID NO: 318997 - DNA, 20 bp, human
gaccccttcaggatcgccaa

SEQ ID NO: 318998 - DNA, 20 bp, human
gacggcttgcccaaagattg

SEQ ID NO: 318999 - DNA, 20 bp, human
gggaacaggaacagacagct

SEQ ID NO: 319000 - DNA, 20 bp, human
gaactgagaaaggaaggttg

SEQ ID NO: 319001 - DNA, 20 bp, human
gctcctttggcgatcctgaa

SEQ ID NO: 319002 - DNA, 20 bp, human
gaggttgaggaatgcatcaa

SEQ ID NO: 319003 - DNA, 20 bp, human
gcctgctcaatcgaccaccg

SEQ ID NO: 319004 - DNA, 20 bp, human
ggcaagccgtcagcagtggc

SEQ ID NO: 319005 - DNA, 20 bp, human
gttctcttttaagatgggcg

SEQ ID NO: 319006 - DNA, 20 bp, human
ggactctgaggctctcggat

SEQ ID NO: 319007 - DNA, 20 bp, human
gcggcccgagcgtcccctgg

SEQ ID NO: 319008 - DNA, 20 bp, human
gcgtcccctggcggcaacgc

SEQ ID NO: 319009 - DNA, 20 bp, human
ggccccgcctgtatgctggg

SEQ ID NO: 319010 - DNA, 20 bp, human
ggcgctgcttgcaaaggggt

SEQ ID NO: 319011 - DNA, 20 bp, human
gaacgccccgcctgtatgct

SEQ ID NO: 319012 - DNA, 20 bp, human
ggaccccgaggtaactgctg

SEQ ID NO: 319013 - DNA, 20 bp, human
gggcgaatgtcttttcccat

SEQ ID NO: 319014 - DNA, 20 bp, human
gccggatagcaggacgctga

SEQ ID NO: 319015 - DNA, 20 bp, human
ggggacgccgagcgactgcg

SEQ ID NO: 319016 - DNA, 20 bp, human
ggtgctagaacgtcctataa

SEQ ID NO: 319017 - DNA, 20 bp, human
gccagcggtggagacgtcac

SEQ ID NO: 319018 - DNA, 20 bp, human
gtggtatcgcgagacgggag

SEQ ID NO: 319019 - DNA, 20 bp, human
gcggcgtggtatcgcgagac

SEQ ID NO: 319020 - DNA, 20 bp, human
ggagaggagtcacgtgcttc

SEQ ID NO: 319021 - DNA, 20 bp, human
gggggctgctgggaaagacg

SEQ ID NO: 319022 - DNA, 20 bp, human
gtatcaagctggccagggtg

SEQ ID NO: 319023 - DNA, 20 bp, human
gaggtgggggcccgaatttg

SEQ ID NO: 319024 - DNA, 20 bp, human
gacagtgcacgcaggtaatc

SEQ ID NO: 319025 - DNA, 20 bp, human
gggttcagacccggcccgtt

SEQ ID NO: 319026 - DNA, 20 bp, human
ggcggggtggggcttcgatt

SEQ ID NO: 319027 - DNA, 20 bp, human
gttaggatccggagtctcag

SEQ ID NO: 319028 - DNA, 20 bp, human
gcctgcccaaccacgagcga

SEQ ID NO: 319029 - DNA, 20 bp, human
ggccgtatccactgagactc

SEQ ID NO: 319030 - DNA, 20 bp, human
gtcactatgacaacctggag

SEQ ID NO: 319031 - DNA, 20 bp, human
gacagctggaagctaaaaac

SEQ ID NO: 319032 - DNA, 20 bp, human
gcggcatcactatgacaacc

SEQ ID NO: 319033 - DNA, 20 bp, human
gtatcggggaatatgtagat

SEQ ID NO: 319034 - DNA, 20 bp, human
gacacagggagcaaatatat

SEQ ID NO: 319035 - DNA, 20 bp, human
gtccggagtctcagtggata

SEQ ID NO: 319036 - DNA, 20 bp, human
gcagcactcccggctgacta

SEQ ID NO: 319037 - DNA, 20 bp, human
gaagaaagctgggaaagtga

SEQ ID NO: 319038 - DNA, 20 bp, human
gacggtttcgggtagattgt

SEQ ID NO: 319039 - DNA, 20 bp, human
gagcgctaaccaagaaacga

SEQ ID NO: 319040 - DNA, 20 bp, human
gtcccccacgacagcactcc

SEQ ID NO: 319041 - DNA, 20 bp, human
gaccaagaaacgacggtttc

SEQ ID NO: 319042 - DNA, 20 bp, human
gtcagccgggagtgctgtcg

SEQ ID NO: 319043 - DNA, 20 bp, human
gacaagaacgaggggaaaag

SEQ ID NO: 319044 - DNA, 20 bp, human
ggccgggagtgctgtcgtgg

SEQ ID NO: 319045 - DNA, 20 bp, human
gttgcgcagacaggcgagaa

SEQ ID NO: 319046 - DNA, 20 bp, human
gttcgtccccgaacctggat

SEQ ID NO: 319047 - DNA, 20 bp, human
gcctggaggcactgcgccct

SEQ ID NO: 319048 - DNA, 20 bp, human
ggaacctggatgggctccga

SEQ ID NO: 319049 - DNA, 20 bp, human
gcgccgccggaaaggaaccc

SEQ ID NO: 319050 - DNA, 20 bp, human
gggcgcgcaggcgacgcaca

SEQ ID NO: 319051 - DNA, 20 bp, human
gcgctgtcgggcaccgccgg

SEQ ID NO: 319052 - DNA, 20 bp, human
ggaaaggaaccctggtccgg

SEQ ID NO: 319053 - DNA, 20 bp, human
gcagcgctgtcgggcaccgc

SEQ ID NO: 319054 - DNA, 20 bp, human
gtcggggacgaacaactgct

SEQ ID NO: 319055 - DNA, 20 bp, human
gacgcacacggcagcgctgt

SEQ ID NO: 319056 - DNA, 20 bp, human
gtgggcggaaggtacactat

SEQ ID NO: 319057 - DNA, 20 bp, human
gcggccgagtacagaagccc

SEQ ID NO: 319058 - DNA, 20 bp, human
ggggtaaagtggcttctggg

SEQ ID NO: 319059 - DNA, 20 bp, human
gaaagcagatggacctatac

SEQ ID NO: 319060 - DNA, 20 bp, human
gctcactgcttccttacaac

SEQ ID NO: 319061 - DNA, 20 bp, human
gtggacctatacgggtaaag

SEQ ID NO: 319062 - DNA, 20 bp, human
gcgcctgaaaggatacagga

SEQ ID NO: 319063 - DNA, 20 bp, human
gcgtcagaacaccaaagttc

SEQ ID NO: 319064 - DNA, 20 bp, human
gaacctccaaaaacctcagt

SEQ ID NO: 319065 - DNA, 20 bp, human
gacctcagttggctgggcta

SEQ ID NO: 319066 - DNA, 20 bp, human
gccgcccctgagctctgtca

SEQ ID NO: 319067 - DNA, 20 bp, human
ggtgagcgccgttactagaa

SEQ ID NO: 319068 - DNA, 20 bp, human
ggtcgccatgacagagctca

SEQ ID NO: 319069 - DNA, 20 bp, human
gggtcagtcggtgatatatc

SEQ ID NO: 319070 - DNA, 20 bp, human
gcagagctcaggggcgggac

SEQ ID NO: 319071 - DNA, 20 bp, human
gccaccgaggcggagaagtc

SEQ ID NO: 319072 - DNA, 20 bp, human
gagggtcctccaaacccgtt

SEQ ID NO: 319073 - DNA, 20 bp, human
ggggcaaagcttacagtcat

SEQ ID NO: 319074 - DNA, 20 bp, human
gcgacgtccagtgctccagc

SEQ ID NO: 319075 - DNA, 20 bp, human
gcgaggcggagaagtcaggt

SEQ ID NO: 319076 - DNA, 20 bp, human
gcccttgcccatagtcccgg

SEQ ID NO: 319077 - DNA, 20 bp, human
ggtcgcgcgggtgacggtta

SEQ ID NO: 319078 - DNA, 20 bp, human
gggcgagtgtcctcagtctt

SEQ ID NO: 319079 - DNA, 20 bp, human
ggggcaccgcacagctcgac

SEQ ID NO: 319080 - DNA, 20 bp, human
ggggcggcaggtgctgacac

SEQ ID NO: 319081 - DNA, 20 bp, human
ggagaggccaacggtcgcgc

SEQ ID NO: 319082 - DNA, 20 bp, human
gcaccggcgccgttagtccc

SEQ ID NO: 319083 - DNA, 20 bp, human
gggcccaggcaacgccctga

SEQ ID NO: 319084 - DNA, 20 bp, human
gccaacggtcgcgcgggtga

SEQ ID NO: 319085 - DNA, 20 bp, human
ggcagccagagcaagcggaa

SEQ ID NO: 319086 - DNA, 20 bp, human
gcgccggaagcggccctcgt

SEQ ID NO: 319087 - DNA, 20 bp, human
gctgcccagggcatttaaaa

SEQ ID NO: 319088 - DNA, 20 bp, human
gctcccttcggggcgagtga

SEQ ID NO: 319089 - DNA, 20 bp, human
gcgagtgacggctcccacga

SEQ ID NO: 319090 - DNA, 20 bp, human
gagccgtcactcgccccgaa

SEQ ID NO: 319091 - DNA, 20 bp, human
gaaagggagcccctcccttc

SEQ ID NO: 319092 - DNA, 20 bp, human
gctcccacgagggccgcttc

SEQ ID NO: 319093 - DNA, 20 bp, human
gtcgccccctagcgctcggg

SEQ ID NO: 319094 - DNA, 20 bp, human
gtgggcagagaagcggtgtg

SEQ ID NO: 319095 - DNA, 20 bp, human
gtggcctcccgagcgctagg

SEQ ID NO: 319096 - DNA, 20 bp, human
gacggcggagcgtcacgcgg

SEQ ID NO: 319097 - DNA, 20 bp, human
ggtcctaccaagcctcacgt

SEQ ID NO: 319098 - DNA, 20 bp, human
gagggaacgtgcaagtagtt

SEQ ID NO: 319099 - DNA, 20 bp, human
ggtgaggcttggtaggactg

SEQ ID NO: 319100 - DNA, 20 bp, human
gttgaagagctcgagatgaa

SEQ ID NO: 319101 - DNA, 20 bp, human
gggactgcggacggtgagtg

SEQ ID NO: 319102 - DNA, 20 bp, human
gactccaaagatcttctcga

SEQ ID NO: 319103 - DNA, 20 bp, human
ggttccctcgagaagatctt

SEQ ID NO: 319104 - DNA, 20 bp, human
ggccccacgtgaggcttggt

SEQ ID NO: 319105 - DNA, 20 bp, human
gagggctggcccctgaacta

SEQ ID NO: 319106 - DNA, 20 bp, human
ggaagagccaggtgtcgctg

SEQ ID NO: 319107 - DNA, 20 bp, human
ggagcataggggaacctgca

SEQ ID NO: 319108 - DNA, 20 bp, human
gccgacggcggggggtcgaa

SEQ ID NO: 319109 - DNA, 20 bp, human
gctgccttcccgcgactcaa

SEQ ID NO: 319110 - DNA, 20 bp, human
gtccgcgcacggctctgtct

SEQ ID NO: 319111 - DNA, 20 bp, human
gaacgaaggccaaagagtcg

SEQ ID NO: 319112 - DNA, 20 bp, human
ggaaggccaaagagtcgcgg

SEQ ID NO: 319113 - DNA, 20 bp, human
gggccgccgccgcgactctt

SEQ ID NO: 319114 - DNA, 20 bp, human
gtagctgcgcgccgacggcg

SEQ ID NO: 319115 - DNA, 20 bp, human
gcgcgactcaaaggagcata

SEQ ID NO: 319116 - DNA, 20 bp, human
gccactggcagagcggaaat

SEQ ID NO: 319117 - DNA, 20 bp, human
ggtagaagatccggacgagg

SEQ ID NO: 319118 - DNA, 20 bp, human
ggcagtagaagatccggacg

SEQ ID NO: 319119 - DNA, 20 bp, human
gcccgccatggccgcagtca

SEQ ID NO: 319120 - DNA, 20 bp, human
gcggccttggcgccccgagg

SEQ ID NO: 319121 - DNA, 20 bp, human
gctcgctccgccaggagctg

SEQ ID NO: 319122 - DNA, 20 bp, human
gcaggcgtggagagttccga

SEQ ID NO: 319123 - DNA, 20 bp, human
gccgacaggaattacgccac

SEQ ID NO: 319124 - DNA, 20 bp, human
gtcggggcgccaaggccgct

SEQ ID NO: 319125 - DNA, 20 bp, human
gcacggcaaccgggcttcga

SEQ ID NO: 319126 - DNA, 20 bp, human
gtggagctggagactagcgg

SEQ ID NO: 319127 - DNA, 20 bp, human
ggggcgagaccatctccggg

SEQ ID NO: 319128 - DNA, 20 bp, human
gactagcggcggagacgagg

SEQ ID NO: 319129 - DNA, 20 bp, human
gcggtgctgtcggaaggcga

SEQ ID NO: 319130 - DNA, 20 bp, human
gttcgcctaggggttgggaa

SEQ ID NO: 319131 - DNA, 20 bp, human
ggagactagcggcggagacg

SEQ ID NO: 319132 - DNA, 20 bp, human
gccagggcgagaccatctcc

SEQ ID NO: 319133 - DNA, 20 bp, human
gtgggcacggtgctgtcgga

SEQ ID NO: 319134 - DNA, 20 bp, human
gccaacccctaggcgaatcc

SEQ ID NO: 319135 - DNA, 20 bp, human
gaggcctgacgaggcaagtg

SEQ ID NO: 319136 - DNA, 20 bp, human
gccagcgaccagcaccgcgt

SEQ ID NO: 319137 - DNA, 20 bp, human
gccgcagggcgcccccgcgt

SEQ ID NO: 319138 - DNA, 20 bp, human
ggaacggaggccccacgcgg

SEQ ID NO: 319139 - DNA, 20 bp, human
ggctcggcacagaccgagaa

SEQ ID NO: 319140 - DNA, 20 bp, human
gcggcacagaccgagaacgg

SEQ ID NO: 319141 - DNA, 20 bp, human
gtctgtgccgagcgcctacg

SEQ ID NO: 319142 - DNA, 20 bp, human
gctaggccgcgggacccgga

SEQ ID NO: 319143 - DNA, 20 bp, human
ggggacccggacggaggtag

SEQ ID NO: 319144 - DNA, 20 bp, human
gcgggacccgcctcgccgca

SEQ ID NO: 319145 - DNA, 20 bp, human
gtggcgccgcgatgcaccat

SEQ ID NO: 319146 - DNA, 20 bp, human
gcgactgtgcgcagctgcag

SEQ ID NO: 319147 - DNA, 20 bp, human
ggggccaaccattttcggcc

SEQ ID NO: 319148 - DNA, 20 bp, human
gggagcgttcgcaaggggtg

SEQ ID NO: 319149 - DNA, 20 bp, human
ggggtgggaaggggcatgca

SEQ ID NO: 319150 - DNA, 20 bp, human
ggggagatgcgcggaacgga

SEQ ID NO: 319151 - DNA, 20 bp, human
gctaggggagcgttcgcaag

SEQ ID NO: 319152 - DNA, 20 bp, human
ggcgacgacgagaagggagt

SEQ ID NO: 319153 - DNA, 20 bp, human
gtcgtggggccaaccatttt

SEQ ID NO: 319154 - DNA, 20 bp, human
gcgcgactgggacatgggat

SEQ ID NO: 319155 - DNA, 20 bp, human
gaagccccgccccatggata

SEQ ID NO: 319156 - DNA, 20 bp, human
gagcgccggggaagcgaagt

SEQ ID NO: 319157 - DNA, 20 bp, human
gcggggaagcgaagtaggca

SEQ ID NO: 319158 - DNA, 20 bp, human
ggaaggactcacagctaatc

SEQ ID NO: 319159 - DNA, 20 bp, human
ggagagccctacaggatcag

SEQ ID NO: 319160 - DNA, 20 bp, human
ggacccgcgctgtccgctac

SEQ ID NO: 319161 - DNA, 20 bp, human
gaaagcccacgcataactta

SEQ ID NO: 319162 - DNA, 20 bp, human
gagtcgctcatctccaggag

SEQ ID NO: 319163 - DNA, 20 bp, human
gcacagagtcgctcatctcc

SEQ ID NO: 319164 - DNA, 20 bp, human
ggactctgtgacgtcacggg

SEQ ID NO: 319165 - DNA, 20 bp, human
ggagtccgtcagtgagtgtg

SEQ ID NO: 319166 - DNA, 20 bp, human
gcaacaaccaaccctctcat

SEQ ID NO: 319167 - DNA, 20 bp, human
gatactgcagccaataaggg

SEQ ID NO: 319168 - DNA, 20 bp, human
ggccctgtgtgcggtgtcta

SEQ ID NO: 319169 - DNA, 20 bp, human
gagacagcagggtgacaggt

SEQ ID NO: 319170 - DNA, 20 bp, human
gggcatactgcagccaataa

SEQ ID NO: 319171 - DNA, 20 bp, human
gcagggtgacaggtaggcgg

SEQ ID NO: 319172 - DNA, 20 bp, human
ggtgttctcacccaatgaga

SEQ ID NO: 319173 - DNA, 20 bp, human
gtaggaagccggagacagca

SEQ ID NO: 319174 - DNA, 20 bp, human
ggagcaaggcggtgtcgtga

SEQ ID NO: 319175 - DNA, 20 bp, human
gtgcatcctcaatctgactg

SEQ ID NO: 319176 - DNA, 20 bp, human
gtgcgcgttagcagaggttg

SEQ ID NO: 319177 - DNA, 20 bp, human
gcggtgacagatgagtaggt

SEQ ID NO: 319178 - DNA, 20 bp, human
ggaacgcgccgtgttcggga

SEQ ID NO: 319179 - DNA, 20 bp, human
gagcgcggtgacagatgagt

SEQ ID NO: 319180 - DNA, 20 bp, human
gtgcgcctgcgcgttagcag

SEQ ID NO: 319181 - DNA, 20 bp, human
gtgaaggtcagcatagacaa

SEQ ID NO: 319182 - DNA, 20 bp, human
gtctcctaccttcccgaaca

SEQ ID NO: 319183 - DNA, 20 bp, human
ggttggggatgtcgttaaca

SEQ ID NO: 319184 - DNA, 20 bp, human
ggcgccgtgttcgggaaggt

SEQ ID NO: 319185 - DNA, 20 bp, human
ggagcgaacgcgccgtgttc

SEQ ID NO: 319186 - DNA, 20 bp, human
ggaagtgacgctatcgttgg

SEQ ID NO: 319187 - DNA, 20 bp, human
gccggaagtgacgctatcgt

SEQ ID NO: 319188 - DNA, 20 bp, human
gcaccgccggcttgagacgc

SEQ ID NO: 319189 - DNA, 20 bp, human
gttccggcgtctcaagccgg

SEQ ID NO: 319190 - DNA, 20 bp, human
gcacttccggcgtctcaagc

SEQ ID NO: 319191 - DNA, 20 bp, human
gttatgcgaaaacatggctg

SEQ ID NO: 319192 - DNA, 20 bp, human
gatgtggccatcttaagtga

SEQ ID NO: 319193 - DNA, 20 bp, human
ggcagagccggagcccactt

SEQ ID NO: 319194 - DNA, 20 bp, human
gtgaggagttattaacgatc

SEQ ID NO: 319195 - DNA, 20 bp, human
gggtaagtgatgtataaagt

SEQ ID NO: 319196 - DNA, 20 bp, human
gagtgtgtgggcatgcacaa

SEQ ID NO: 319197 - DNA, 20 bp, human
gtccccacccggtcctaatt

SEQ ID NO: 319198 - DNA, 20 bp, human
gggcgctcggcgttcccgca

SEQ ID NO: 319199 - DNA, 20 bp, human
ggaatctggggcccttgcag

SEQ ID NO: 319200 - DNA, 20 bp, human
gaggactggaggttttgcta

SEQ ID NO: 319201 - DNA, 20 bp, human
gacccgaccaaattaggacc

SEQ ID NO: 319202 - DNA, 20 bp, human
gaggtgggcgtagagagaac

SEQ ID NO: 319203 - DNA, 20 bp, human
gttaggaccgggtggggaca

SEQ ID NO: 319204 - DNA, 20 bp, human
gggtcgggtatagcggaggt

SEQ ID NO: 319205 - DNA, 20 bp, human
gcctggttccgcctctgcaa

SEQ ID NO: 319206 - DNA, 20 bp, human
ggggcagaaggggacggtgt

SEQ ID NO: 319207 - DNA, 20 bp, human
gactgaggggtcagtggttc

SEQ ID NO: 319208 - DNA, 20 bp, human
gtccgcctggcgtcacctcg

SEQ ID NO: 319209 - DNA, 20 bp, human
ggcggagatcatagagatga

SEQ ID NO: 319210 - DNA, 20 bp, human
gccatctgggcggggcagaa

SEQ ID NO: 319211 - DNA, 20 bp, human
gtccgcgaggtgacgccagg

SEQ ID NO: 319212 - DNA, 20 bp, human
gaggtgctgtgtctcttcgc

SEQ ID NO: 319213 - DNA, 20 bp, human
ggagccccagatagggtcga

SEQ ID NO: 319214 - DNA, 20 bp, human
ggatatggttggacccgaga

SEQ ID NO: 319215 - DNA, 20 bp, human
gtctcttcgcaggatatggt

SEQ ID NO: 319216 - DNA, 20 bp, human
ggaagccaagggttggatag

SEQ ID NO: 319217 - DNA, 20 bp, human
ggcgcaaaggcctgtcacgg

SEQ ID NO: 319218 - DNA, 20 bp, human
gtgagccgggccaaacgtga

SEQ ID NO: 319219 - DNA, 20 bp, human
gccaagggttggatagaggc

SEQ ID NO: 319220 - DNA, 20 bp, human
gcaaacgtgacggaggaagc

SEQ ID NO: 319221 - DNA, 20 bp, human
gaagccgaagggttcaacag

SEQ ID NO: 319222 - DNA, 20 bp, human
gtagacccatccagggatga

SEQ ID NO: 319223 - DNA, 20 bp, human
ggggagtgaagaaaagccga

SEQ ID NO: 319224 - DNA, 20 bp, human
gggaaggataagcgggaaga

SEQ ID NO: 319225 - DNA, 20 bp, human
gccgaagggttcaacagggg

SEQ ID NO: 319226 - DNA, 20 bp, human
gtgagcggggccagccggaa

SEQ ID NO: 319227 - DNA, 20 bp, human
ggacaagtcagaaagaccca

SEQ ID NO: 319228 - DNA, 20 bp, human
gagggcgcggggaggtttct

SEQ ID NO: 319229 - DNA, 20 bp, human
gaggacctccccagcggaag

SEQ ID NO: 319230 - DNA, 20 bp, human
gcgtcggtcaccaaggtcac

SEQ ID NO: 319231 - DNA, 20 bp, human
gggaagggcggagttgccgg

SEQ ID NO: 319232 - DNA, 20 bp, human
ggccggagggcgcaattcct

SEQ ID NO: 319233 - DNA, 20 bp, human
gggtctttctgacttgtccc

SEQ ID NO: 319234 - DNA, 20 bp, human
gtctgacttgtcccgggcgt

SEQ ID NO: 319235 - DNA, 20 bp, human
gctgctgcgggtgactgagc

SEQ ID NO: 319236 - DNA, 20 bp, human
gccggaagtgcgggactcga

SEQ ID NO: 319237 - DNA, 20 bp, human
gacctggcggccggaagtgc

SEQ ID NO: 319238 - DNA, 20 bp, human
gctgcagcagagctccgtgg

SEQ ID NO: 319239 - DNA, 20 bp, human
ggctctgcagcagagctccg

SEQ ID NO: 319240 - DNA, 20 bp, human
gtctacggctattcatcaag

SEQ ID NO: 319241 - DNA, 20 bp, human
ggcaaggttctctagcaccc

SEQ ID NO: 319242 - DNA, 20 bp, human
gcagccttctgtctatacag

SEQ ID NO: 319243 - DNA, 20 bp, human
ggatgaatagccgtagagat

SEQ ID NO: 319244 - DNA, 20 bp, human
ggtcaacgtgaattccagca

SEQ ID NO: 319245 - DNA, 20 bp, human
gtggggtgaaaaacccccag

SEQ ID NO: 319246 - DNA, 20 bp, human
gccaccccgtcactcttctc

SEQ ID NO: 319247 - DNA, 20 bp, human
gaggtggggcccattgcgag

SEQ ID NO: 319248 - DNA, 20 bp, human
gggggcccattgcgaggggg

SEQ ID NO: 319249 - DNA, 20 bp, human
gtgcgagggggcggttcggt

SEQ ID NO: 319250 - DNA, 20 bp, human
gtcactcttctcgggaggtg

SEQ ID NO: 319251 - DNA, 20 bp, human
gcgaaccgccccctcgcaat

SEQ ID NO: 319252 - DNA, 20 bp, human
gcctcccgagaagagtgacg

SEQ ID NO: 319253 - DNA, 20 bp, human
gggtggggctgtttcccgct

SEQ ID NO: 319254 - DNA, 20 bp, human
gcagtgtataagaaaagtct

SEQ ID NO: 319255 - DNA, 20 bp, human
gagctcagacttattcccta

SEQ ID NO: 319256 - DNA, 20 bp, human
gcccgcgctaattctctggt

SEQ ID NO: 319257 - DNA, 20 bp, human
gtccgcccgcgctaattctc

SEQ ID NO: 319258 - DNA, 20 bp, human
ggggagaggcaattctggtt

SEQ ID NO: 319259 - DNA, 20 bp, human
gacccggcacgcgaagttcc

SEQ ID NO: 319260 - DNA, 20 bp, human
ggctaattctctggtgggag

SEQ ID NO: 319261 - DNA, 20 bp, human
ggcagcgcccaaacgcttcc

SEQ ID NO: 319262 - DNA, 20 bp, human
gaccccaaacgagccaaact

SEQ ID NO: 319263 - DNA, 20 bp, human
gtcacgggcctggtaacgcg

SEQ ID NO: 319264 - DNA, 20 bp, human
gttcccgcagcaacacgtac

SEQ ID NO: 319265 - DNA, 20 bp, human
gttcccggtacgtgttgctg

SEQ ID NO: 319266 - DNA, 20 bp, human
gcccgcgctaattctctggt

SEQ ID NO: 319267 - DNA, 20 bp, human
gtccgcccgcgctaattctc

SEQ ID NO: 319268 - DNA, 20 bp, human
ggggagaggcaattctggtt

SEQ ID NO: 319269 - DNA, 20 bp, human
gacccggcacgcgaagttcc

SEQ ID NO: 319270 - DNA, 20 bp, human
ggctaattctctggtgggag

SEQ ID NO: 319271 - DNA, 20 bp, human
gaccccaaacgagccaaact

SEQ ID NO: 319272 - DNA, 20 bp, human
gggggagggagaggcaattc

SEQ ID NO: 319273 - DNA, 20 bp, human
gtcacgggcctggtaacgcg

SEQ ID NO: 319274 - DNA, 20 bp, human
gaattctggttggggaagtt

SEQ ID NO: 319275 - DNA, 20 bp, human
ggcagcgcccaaacgcttcc

SEQ ID NO: 319276 - DNA, 20 bp, human
gaggctggggccacttccgg

SEQ ID NO: 319277 - DNA, 20 bp, human
ggtcatctccggcgcttcta

SEQ ID NO: 319278 - DNA, 20 bp, human
ggacgcccggcctcgaggct

SEQ ID NO: 319279 - DNA, 20 bp, human
gcgaccagagggcggagctg

SEQ ID NO: 319280 - DNA, 20 bp, human
gcctcgaggccgggcgtctt

SEQ ID NO: 319281 - DNA, 20 bp, human
gcacggctcccgaagatgac

SEQ ID NO: 319282 - DNA, 20 bp, human
gggaagtggccccagcctcg

SEQ ID NO: 319283 - DNA, 20 bp, human
gggagatgaccgaagacgcc

SEQ ID NO: 319284 - DNA, 20 bp, human
ggccacttccggcggaactg

SEQ ID NO: 319285 - DNA, 20 bp, human
gccgtcagccgaccagaggg

SEQ ID NO: 319286 - DNA, 20 bp, human
ggaccctgccagcttccaag

SEQ ID NO: 319287 - DNA, 20 bp, human
gaagccgccctcttggaagc

SEQ ID NO: 319288 - DNA, 20 bp, human
ggcaagtgaagccgagtcac

SEQ ID NO: 319289 - DNA, 20 bp, human
gccctcagtaaagatgaccg

SEQ ID NO: 319290 - DNA, 20 bp, human
gacatccgggtcctgtgact

SEQ ID NO: 319291 - DNA, 20 bp, human
gaggtgagaagccaagaagg

SEQ ID NO: 319292 - DNA, 20 bp, human
gaccgcggtcatctttactg

SEQ ID NO: 319293 - DNA, 20 bp, human
ggggctaccctataagggca

SEQ ID NO: 319294 - DNA, 20 bp, human
gcgtcgaactgacaacatcc

SEQ ID NO: 319295 - DNA, 20 bp, human
gcacagtgaagccgccctct

SEQ ID NO: 319296 - DNA, 20 bp, human
gcgggcctgagcgggaagaa

SEQ ID NO: 319297 - DNA, 20 bp, human
gaaccaggcgggtgagagga

SEQ ID NO: 319298 - DNA, 20 bp, human
gagcccggaacctccgcttc

SEQ ID NO: 319299 - DNA, 20 bp, human
gagccggaagcggaggttcc

SEQ ID NO: 319300 - DNA, 20 bp, human
gcaagggcacggaccggaaa

SEQ ID NO: 319301 - DNA, 20 bp, human
gttccgggctccgggatgaa

SEQ ID NO: 319302 - DNA, 20 bp, human
gggcaggtagggaaatcgtg

SEQ ID NO: 319303 - DNA, 20 bp, human
ggcaggtgagaaagcgagac

SEQ ID NO: 319304 - DNA, 20 bp, human
gagcttggctcagagagcgg

SEQ ID NO: 319305 - DNA, 20 bp, human
gtgagccaagcttttgacga

SEQ ID NO: 319306 - DNA, 20 bp, human
gaaaggacggatcaccgcaa

SEQ ID NO: 319307 - DNA, 20 bp, human
gctggggcttaaaaaaagag

SEQ ID NO: 319308 - DNA, 20 bp, human
ggcaatgttgcgaaattctt

SEQ ID NO: 319309 - DNA, 20 bp, human
gcgcaacattgcgattgcac

SEQ ID NO: 319310 - DNA, 20 bp, human
ggaaggaagttagtcccttg

SEQ ID NO: 319311 - DNA, 20 bp, human
gtggatacgtgatctggcaa

SEQ ID NO: 319312 - DNA, 20 bp, human
gagggcttgcaaagtgaatc

SEQ ID NO: 319313 - DNA, 20 bp, human
gtaaagattacactttatgg

SEQ ID NO: 319314 - DNA, 20 bp, human
gagctctccagcttttccag

SEQ ID NO: 319315 - DNA, 20 bp, human
gaaaatctggatacgtgatc

SEQ ID NO: 319316 - DNA, 20 bp, human
gtggggagacggctgaggga

SEQ ID NO: 319317 - DNA, 20 bp, human
gccaacgggctcggtttcta

SEQ ID NO: 319318 - DNA, 20 bp, human
gcgagcccgttggcctggta

SEQ ID NO: 319319 - DNA, 20 bp, human
gctgagggaaggtcggcttc

SEQ ID NO: 319320 - DNA, 20 bp, human
gtttgtggggagacggctga

SEQ ID NO: 319321 - DNA, 20 bp, human
gtcgctgaggtcatccttta

SEQ ID NO: 319322 - DNA, 20 bp, human
gagccaccgtaccaggccaa

SEQ ID NO: 319323 - DNA, 20 bp, human
gtcggtttctatggttttgt

SEQ ID NO: 319324 - DNA, 20 bp, human
gcgctgcaaacgtctcgctg

SEQ ID NO: 319325 - DNA, 20 bp, human
ggctaggcagagtgcaagaa

SEQ ID NO: 319326 - DNA, 20 bp, human
ggatggttgacaatccagag

SEQ ID NO: 319327 - DNA, 20 bp, human
gaacagccctacaagatggc

SEQ ID NO: 319328 - DNA, 20 bp, human
gtatcaaacagtgttctaga

SEQ ID NO: 319329 - DNA, 20 bp, human
gcaccgctcctgaccgagaa

SEQ ID NO: 319330 - DNA, 20 bp, human
gagactccatctcacgtggt

SEQ ID NO: 319331 - DNA, 20 bp, human
gacggagactccatctcacg

SEQ ID NO: 319332 - DNA, 20 bp, human
gtgcgctttttcaaaactca

SEQ ID NO: 319333 - DNA, 20 bp, human
ggctcacctaccacgtgaga

SEQ ID NO: 319334 - DNA, 20 bp, human
gagtttggtgagaagaaatc

SEQ ID NO: 319335 - DNA, 20 bp, human
gtgcaccatgcgctgcagcc

SEQ ID NO: 319336 - DNA, 20 bp, human
gcagccgcaggctagagcta

SEQ ID NO: 319337 - DNA, 20 bp, human
gtagagctagggccctgatg

SEQ ID NO: 319338 - DNA, 20 bp, human
ggccctgatgaggcaggcaa

SEQ ID NO: 319339 - DNA, 20 bp, human
ggctccccgtaaccacacac

SEQ ID NO: 319340 - DNA, 20 bp, human
ggagcgcgggtcggggcaga

SEQ ID NO: 319341 - DNA, 20 bp, human
gctgaatcagagagcagctc

SEQ ID NO: 319342 - DNA, 20 bp, human
gcccagggcgaaataaatac

SEQ ID NO: 319343 - DNA, 20 bp, human
gaacgcatgcgcacggcttc

SEQ ID NO: 319344 - DNA, 20 bp, human
gttaagcggccccgttgcgc

SEQ ID NO: 319345 - DNA, 20 bp, human
gggaacgcttgccttgaacg

SEQ ID NO: 319346 - DNA, 20 bp, human
gcccgaggcggaaaggtcat

SEQ ID NO: 319347 - DNA, 20 bp, human
gtccgcctcgggtgatctgg

SEQ ID NO: 319348 - DNA, 20 bp, human
gcatcggagtgcgcacgtgg

SEQ ID NO: 319349 - DNA, 20 bp, human
gtcggtccgccgcagacccg

SEQ ID NO: 319350 - DNA, 20 bp, human
gtgcacccccagatcacccg

SEQ ID NO: 319351 - DNA, 20 bp, human
gcggcgcaacacgaccacgg

SEQ ID NO: 319352 - DNA, 20 bp, human
ggcacggcgcaacacgacca

SEQ ID NO: 319353 - DNA, 20 bp, human
gtcaccacgcgtccctgggt

SEQ ID NO: 319354 - DNA, 20 bp, human
gacccccagatcacccgagg

SEQ ID NO: 319355 - DNA, 20 bp, human
gtcggagcgcatgcggaaac

SEQ ID NO: 319356 - DNA, 20 bp, human
ggggccgccatgttggtttg

SEQ ID NO: 319357 - DNA, 20 bp, human
ggctggaggcgggacatccg

SEQ ID NO: 319358 - DNA, 20 bp, human
gggcgcttgaagtttgtagg

SEQ ID NO: 319359 - DNA, 20 bp, human
gtgggcccgccgggttgggt

SEQ ID NO: 319360 - DNA, 20 bp, human
ggaggcggaggctacactgt

SEQ ID NO: 319361 - DNA, 20 bp, human
gcctccccaaaccaacatgg

SEQ ID NO: 319362 - DNA, 20 bp, human
gagggtgggcccgccgggtt

SEQ ID NO: 319363 - DNA, 20 bp, human
gcgccgtgggtgcagagggt

SEQ ID NO: 319364 - DNA, 20 bp, human
gctcggaggtcttcacttat

SEQ ID NO: 319365 - DNA, 20 bp, human
gtgtcccgcctccagcggct

SEQ ID NO: 319366 - DNA, 20 bp, human
gctgggagatgtggtcccac

SEQ ID NO: 319367 - DNA, 20 bp, human
gtgaaggggcgcagcgatac

SEQ ID NO: 319368 - DNA, 20 bp, human
ggggagccggcgagctaagg

SEQ ID NO: 319369 - DNA, 20 bp, human
gggccgctggcgaagttgaa

SEQ ID NO: 319370 - DNA, 20 bp, human
gaggaaggcggaccccaggc

SEQ ID NO: 319371 - DNA, 20 bp, human
gagggaggaaggcggacccc

SEQ ID NO: 319372 - DNA, 20 bp, human
gtcctcgggggaggactgag

SEQ ID NO: 319373 - DNA, 20 bp, human
gccaccgctaaatgccagcc

SEQ ID NO: 319374 - DNA, 20 bp, human
ggcctctcagtcctcccccg

SEQ ID NO: 319375 - DNA, 20 bp, human
ggagggagcgaaagagcgag

SEQ ID NO: 319376 - DNA, 20 bp, human
gggagtcagcctataacttc

SEQ ID NO: 319377 - DNA, 20 bp, human
gtcatgactcctgaagttat

SEQ ID NO: 319378 - DNA, 20 bp, human
ggcattaggagcttcaccgt

SEQ ID NO: 319379 - DNA, 20 bp, human
ggcctcataggcctctcgga

SEQ ID NO: 319380 - DNA, 20 bp, human
gaaacgaagtagctactatc

SEQ ID NO: 319381 - DNA, 20 bp, human
gggagtcatgaagcccttga

SEQ ID NO: 319382 - DNA, 20 bp, human
ggtgaagctcctaatgctcc

SEQ ID NO: 319383 - DNA, 20 bp, human
gctgcaggtggccatccgag

SEQ ID NO: 319384 - DNA, 20 bp, human
gcctatgaggcaggtctgat

SEQ ID NO: 319385 - DNA, 20 bp, human
gttaggagcttcaccgtggg

SEQ ID NO: 319386 - DNA, 20 bp, human
gcggaaagggaggtgtccta

SEQ ID NO: 319387 - DNA, 20 bp, human
gagcccccgcccctcggcga

SEQ ID NO: 319388 - DNA, 20 bp, human
gcgctcccttcgccgagggg

SEQ ID NO: 319389 - DNA, 20 bp, human
gagtccgtgctcggaaaggg

SEQ ID NO: 319390 - DNA, 20 bp, human
gcgcccgcctggatttatag

SEQ ID NO: 319391 - DNA, 20 bp, human
gcgtcccggagctgcacctt

SEQ ID NO: 319392 - DNA, 20 bp, human
gcacgccgctcccttcgccg

SEQ ID NO: 319393 - DNA, 20 bp, human
gcgctcccgaccccaggcct

SEQ ID NO: 319394 - DNA, 20 bp, human
gaccccaggcctaggcgacc

SEQ ID NO: 319395 - DNA, 20 bp, human
gaccagtccgtgctcggaaa

SEQ ID NO: 319396 - DNA, 20 bp, human
gtgcgcgcgcatccccagta

SEQ ID NO: 319397 - DNA, 20 bp, human
gagcgtgagggacacgtcac

SEQ ID NO: 319398 - DNA, 20 bp, human
ggggctaagtgcctcccttg

SEQ ID NO: 319399 - DNA, 20 bp, human
ggaggcacttagccctactg

SEQ ID NO: 319400 - DNA, 20 bp, human
gcggggcgtggccccaaggg

SEQ ID NO: 319401 - DNA, 20 bp, human
gatccggggcgtggccccaa

SEQ ID NO: 319402 - DNA, 20 bp, human
gcacagggatcggcaccagc

SEQ ID NO: 319403 - DNA, 20 bp, human
ggatcgggaccaccaatcac

SEQ ID NO: 319404 - DNA, 20 bp, human
gtgagggacacgtcaccggc

SEQ ID NO: 319405 - DNA, 20 bp, human
ggattggtggtcccgatccg

SEQ ID NO: 319406 - DNA, 20 bp, human
gaaaagccagcgtgatgcct

SEQ ID NO: 319407 - DNA, 20 bp, human
gcggagcccaggcatcacgc

SEQ ID NO: 319408 - DNA, 20 bp, human
gtgaatggggcctcagtaaa

SEQ ID NO: 319409 - DNA, 20 bp, human
gaattccactaaaggataaa

SEQ ID NO: 319410 - DNA, 20 bp, human
gactgcacaggctggaagtt

SEQ ID NO: 319411 - DNA, 20 bp, human
ggtggtaaatgtactcactc

SEQ ID NO: 319412 - DNA, 20 bp, human
gagtggaattgatgaacagg

SEQ ID NO: 319413 - DNA, 20 bp, human
gtgggctccgaattatcatg

SEQ ID NO: 319414 - DNA, 20 bp, human
gtgagctacaggtaagttac

SEQ ID NO: 319415 - DNA, 20 bp, human
ggagcaactcaagatctgat

SEQ ID NO: 319416 - DNA, 20 bp, human
gcggcgcgcccggaccgaag

SEQ ID NO: 319417 - DNA, 20 bp, human
gcgcccggaccgaagtggca

SEQ ID NO: 319418 - DNA, 20 bp, human
gtggcagggaacgtgcacgt

SEQ ID NO: 319419 - DNA, 20 bp, human
gccgggggcaccctcatccc

SEQ ID NO: 319420 - DNA, 20 bp, human
gtcgggcaccctgggaggga

SEQ ID NO: 319421 - DNA, 20 bp, human
gaaagctccgcagaccgccg

SEQ ID NO: 319422 - DNA, 20 bp, human
gccgcgcaggccaaacccac

SEQ ID NO: 319423 - DNA, 20 bp, human
gcgcacagtcgcacccacgg

SEQ ID NO: 319424 - DNA, 20 bp, human
gggaggtgacaaacaccggt

SEQ ID NO: 319425 - DNA, 20 bp, human
gggcgcgaggctcactcccc

SEQ ID NO: 319426 - DNA, 20 bp, human
ggctacgtgcggggatgaca

SEQ ID NO: 319427 - DNA, 20 bp, human
gccacgacggccccaagtgc

SEQ ID NO: 319428 - DNA, 20 bp, human
gctgcccccggcacggccat

SEQ ID NO: 319429 - DNA, 20 bp, human
gtgagtggatgccataaata

SEQ ID NO: 319430 - DNA, 20 bp, human
ggacgccgtcaactacggga

SEQ ID NO: 319431 - DNA, 20 bp, human
gcgaccttccccaaaggcgg

SEQ ID NO: 319432 - DNA, 20 bp, human
ggccgtcgtggggctggtag

SEQ ID NO: 319433 - DNA, 20 bp, human
gacccctaccagccccacga

SEQ ID NO: 319434 - DNA, 20 bp, human
gccgcgcgttgctacgtgcg

SEQ ID NO: 319435 - DNA, 20 bp, human
gatccagacgccgtcaacta

SEQ ID NO: 319436 - DNA, 20 bp, human
gcggcgccggccagtccccg

SEQ ID NO: 319437 - DNA, 20 bp, human
ggccccggcgggcagtcctc

SEQ ID NO: 319438 - DNA, 20 bp, human
gtgacggggccgcggggcgt

SEQ ID NO: 319439 - DNA, 20 bp, human
gggagagcaggagacttttg

SEQ ID NO: 319440 - DNA, 20 bp, human
ggggcctgaggactgcccgc

SEQ ID NO: 319441 - DNA, 20 bp, human
gcgcgggcgcagccacagag

SEQ ID NO: 319442 - DNA, 20 bp, human
gacagagggggctacccgga

SEQ ID NO: 319443 - DNA, 20 bp, human
gcactcgcggcgcgcagcag

SEQ ID NO: 319444 - DNA, 20 bp, human
ggctgcgcgccgcgagtggg

SEQ ID NO: 319445 - DNA, 20 bp, human
gggggagcgggcacgtggct

SEQ ID NO: 319446 - DNA, 20 bp, human
gtccccctccgccgtggccg

SEQ ID NO: 319447 - DNA, 20 bp, human
ggctcccgacaggccgtcgc

SEQ ID NO: 319448 - DNA, 20 bp, human
ggcgctggagttggaccttg

SEQ ID NO: 319449 - DNA, 20 bp, human
gctgtcgggagcagaaccta

SEQ ID NO: 319450 - DNA, 20 bp, human
gggtcccgcgacggcctgtc

SEQ ID NO: 319451 - DNA, 20 bp, human
ggagttggaccttgaggcga

SEQ ID NO: 319452 - DNA, 20 bp, human
ggagggctccggtcccgcga

SEQ ID NO: 319453 - DNA, 20 bp, human
gtccgcggccacggcggagg

SEQ ID NO: 319454 - DNA, 20 bp, human
ggcgggcctccgcgcttccg

SEQ ID NO: 319455 - DNA, 20 bp, human
gaggtcagggtgacacaagt

SEQ ID NO: 319456 - DNA, 20 bp, human
gcgcctgcgaaccctgtcgg

SEQ ID NO: 319457 - DNA, 20 bp, human
gcgcccagacgcctccgaca

SEQ ID NO: 319458 - DNA, 20 bp, human
gagccgcagaggggtgaacg

SEQ ID NO: 319459 - DNA, 20 bp, human
gaaccctgtcggaggcgtct

SEQ ID NO: 319460 - DNA, 20 bp, human
gacagggttcgcaggcgcca

SEQ ID NO: 319461 - DNA, 20 bp, human
gaaagagtgcgtggcaaccc

SEQ ID NO: 319462 - DNA, 20 bp, human
gggaaggctccccgcgaagc

SEQ ID NO: 319463 - DNA, 20 bp, human
gtcgcggggagccttccccg

SEQ ID NO: 319464 - DNA, 20 bp, human
gttgccacgcactctttatt

SEQ ID NO: 319465 - DNA, 20 bp, human
ggcgtctgggcgcggagtcg

SEQ ID NO: 319466 - DNA, 20 bp, human
ggctccccgcgtcaccgaaa

SEQ ID NO: 319467 - DNA, 20 bp, human
gggctcaccgtcttggataa

SEQ ID NO: 319468 - DNA, 20 bp, human
ggctgcacggctcaccgtct

SEQ ID NO: 319469 - DNA, 20 bp, human
gttgaaacctggaaacgatg

SEQ ID NO: 319470 - DNA, 20 bp, human
gaccggaggcggagcacggg

SEQ ID NO: 319471 - DNA, 20 bp, human
ggggcgaaacgtaagaccgg

SEQ ID NO: 319472 - DNA, 20 bp, human
gtcttggataatggcaaaga

SEQ ID NO: 319473 - DNA, 20 bp, human
ggtgcagcctcatcgtttcc

SEQ ID NO: 319474 - DNA, 20 bp, human
ggtgcctggagtgtcctacg

SEQ ID NO: 319475 - DNA, 20 bp, human
gaagaccggaggcggagcac

SEQ ID NO: 319476 - DNA, 20 bp, human
gagagggcgcacaaacgagg

SEQ ID NO: 319477 - DNA, 20 bp, human
ggtaacccgtggtctgggtg

SEQ ID NO: 319478 - DNA, 20 bp, human
ggggagggagaagcctccgg

SEQ ID NO: 319479 - DNA, 20 bp, human
gaaacccggctcaagacacg

SEQ ID NO: 319480 - DNA, 20 bp, human
ggagccgggtttccagcaga

SEQ ID NO: 319481 - DNA, 20 bp, human
gacacgtggcgggcgacctc

SEQ ID NO: 319482 - DNA, 20 bp, human
gttacagaggggtctgtcca

SEQ ID NO: 319483 - DNA, 20 bp, human
gccggctcaagacacgtggc

SEQ ID NO: 319484 - DNA, 20 bp, human
gcgtggcgggcgacctccgg

SEQ ID NO: 319485 - DNA, 20 bp, human
ggggccctgagcatataagt

SEQ ID NO: 319486 - DNA, 20 bp, human
gacagaagtcggggtacaga

SEQ ID NO: 319487 - DNA, 20 bp, human
gggtacagagggtctggtca

SEQ ID NO: 319488 - DNA, 20 bp, human
gtctggccggacagaagtcg

SEQ ID NO: 319489 - DNA, 20 bp, human
ggggaagttatcccagtgtc

SEQ ID NO: 319490 - DNA, 20 bp, human
gagtcggggtacagagggtc

SEQ ID NO: 319491 - DNA, 20 bp, human
gtcgccccgtgacgtcactc

SEQ ID NO: 319492 - DNA, 20 bp, human
ggaggcgctgcgtgcggctg

SEQ ID NO: 319493 - DNA, 20 bp, human
gacaagcagttggcagtggc

SEQ ID NO: 319494 - DNA, 20 bp, human
gtgcggctgtggcttctggc

SEQ ID NO: 319495 - DNA, 20 bp, human
gccgtcgctggggcgtggag

SEQ ID NO: 319496 - DNA, 20 bp, human
gcagcgcggcgggaaaaggc

SEQ ID NO: 319497 - DNA, 20 bp, human
gcggcggggaccatggcgtg

SEQ ID NO: 319498 - DNA, 20 bp, human
gcgcggcgagcgggcactag

SEQ ID NO: 319499 - DNA, 20 bp, human
gcggcacccggcagcgcggc

SEQ ID NO: 319500 - DNA, 20 bp, human
gagcgtggcagcaaatgggg

SEQ ID NO: 319501 - DNA, 20 bp, human
gcctcccgggaagggaccga

SEQ ID NO: 319502 - DNA, 20 bp, human
gcagaggccgaactctgggt

SEQ ID NO: 319503 - DNA, 20 bp, human
gagcgggcactagcggcacc

SEQ ID NO: 319504 - DNA, 20 bp, human
gcgggcccgccggggagcca

SEQ ID NO: 319505 - DNA, 20 bp, human
gagcgcctcccgcggcgagc

SEQ ID NO: 319506 - DNA, 20 bp, human
gtgatgtgagccagtcacag

SEQ ID NO: 319507 - DNA, 20 bp, human
gtactgaaggtggagggccc

SEQ ID NO: 319508 - DNA, 20 bp, human
gcccaggaaagcagtctaca

SEQ ID NO: 319509 - DNA, 20 bp, human
gctacacggttgttcctctc

SEQ ID NO: 319510 - DNA, 20 bp, human
gaagataacatcaggtgtcc

SEQ ID NO: 319511 - DNA, 20 bp, human
gctggctcacatcaaatcac

SEQ ID NO: 319512 - DNA, 20 bp, human
gaagttttaacttgactccc

SEQ ID NO: 319513 - DNA, 20 bp, human
ggagaggaagcttttgcgtg

SEQ ID NO: 319514 - DNA, 20 bp, human
gagaggtaacttggcagtcc

SEQ ID NO: 319515 - DNA, 20 bp, human
gactgccaagttacctcttc

SEQ ID NO: 319516 - DNA, 20 bp, human
gccgcggggcggatccgcag

SEQ ID NO: 319517 - DNA, 20 bp, human
gaacggggagggtaccctcg

SEQ ID NO: 319518 - DNA, 20 bp, human
ggatccgcaggggcgtgtac

SEQ ID NO: 319519 - DNA, 20 bp, human
gagcgcagaggaggctcgga

SEQ ID NO: 319520 - DNA, 20 bp, human
gggggcgggctggacgtttg

SEQ ID NO: 319521 - DNA, 20 bp, human
ggtgcccgccccggcgaacg

SEQ ID NO: 319522 - DNA, 20 bp, human
gccgccccggcgaacgggga

SEQ ID NO: 319523 - DNA, 20 bp, human
ggcgacttgcggccacactg

SEQ ID NO: 319524 - DNA, 20 bp, human
gcgccccccaagccaatcac

SEQ ID NO: 319525 - DNA, 20 bp, human
ggccccctccctaaagcgga

SEQ ID NO: 319526 - DNA, 20 bp, human
gggaccgcctcctggcacga

SEQ ID NO: 319527 - DNA, 20 bp, human
gcccccactgggttccggaa

SEQ ID NO: 319528 - DNA, 20 bp, human
ggcccgggctagcgaaaagt

SEQ ID NO: 319529 - DNA, 20 bp, human
gcgctagcccgggctcgcca

SEQ ID NO: 319530 - DNA, 20 bp, human
gagcctttccggaacccagt

SEQ ID NO: 319531 - DNA, 20 bp, human
gtacaactcccagggggaaa

SEQ ID NO: 319532 - DNA, 20 bp, human
ggacgtcgtaaattggaatg

SEQ ID NO: 319533 - DNA, 20 bp, human
gcacgcactgaggttgctgt

SEQ ID NO: 319534 - DNA, 20 bp, human
ggtggagccagacagtgacc

SEQ ID NO: 319535 - DNA, 20 bp, human
gcgacgaattccagcttcgg

SEQ ID NO: 319536 - DNA, 20 bp, human
gggaccgcctcctggcacga

SEQ ID NO: 319537 - DNA, 20 bp, human
gcccccactgggttccggaa

SEQ ID NO: 319538 - DNA, 20 bp, human
ggcccgggctagcgaaaagt

SEQ ID NO: 319539 - DNA, 20 bp, human
gcgctagcccgggctcgcca

SEQ ID NO: 319540 - DNA, 20 bp, human
gagcctttccggaacccagt

SEQ ID NO: 319541 - DNA, 20 bp, human
gtacaactcccagggggaaa

SEQ ID NO: 319542 - DNA, 20 bp, human
ggacgtcgtaaattggaatg

SEQ ID NO: 319543 - DNA, 20 bp, human
gcacgcactgaggttgctgt

SEQ ID NO: 319544 - DNA, 20 bp, human
ggtggagccagacagtgacc

SEQ ID NO: 319545 - DNA, 20 bp, human
gcgacgaattccagcttcgg

SEQ ID NO: 319546 - DNA, 20 bp, human
ggcggggcggcatgcaaatg

SEQ ID NO: 319547 - DNA, 20 bp, human
gccgccccgccattggctag

SEQ ID NO: 319548 - DNA, 20 bp, human
ggacagagtaaggttcagga

SEQ ID NO: 319549 - DNA, 20 bp, human
ggtgggacaaggtaatgctc

SEQ ID NO: 319550 - DNA, 20 bp, human
gaccttgtcccactagccaa

SEQ ID NO: 319551 - DNA, 20 bp, human
ggtagagattgtgaggtgaa

SEQ ID NO: 319552 - DNA, 20 bp, human
gtgtcccactagccaatggc

SEQ ID NO: 319553 - DNA, 20 bp, human
gttgcatgccgccccgccat

SEQ ID NO: 319554 - DNA, 20 bp, human
gagagagagaggtatcagca

SEQ ID NO: 319555 - DNA, 20 bp, human
gcaggggtggttagtaaaaa

SEQ ID NO: 319556 - DNA, 20 bp, human
gcacacacgtcggatgtgag

SEQ ID NO: 319557 - DNA, 20 bp, human
ggtggcataagctccctcct

SEQ ID NO: 319558 - DNA, 20 bp, human
gccgcactgaagcaaaagtt

SEQ ID NO: 319559 - DNA, 20 bp, human
gtggactcagtatgttgcaa

SEQ ID NO: 319560 - DNA, 20 bp, human
gtcacctcacagcaaccgga

SEQ ID NO: 319561 - DNA, 20 bp, human
gctgtgaggtgatgttgtct

SEQ ID NO: 319562 - DNA, 20 bp, human
gtttccttccggttgctgtg

SEQ ID NO: 319563 - DNA, 20 bp, human
ggcttcagtgcggcctagga

SEQ ID NO: 319564 - DNA, 20 bp, human
gggaatagacaccatgctag

SEQ ID NO: 319565 - DNA, 20 bp, human
gaagaaagcttgttctcatc

SEQ ID NO: 319566 - DNA, 20 bp, human
gaggacccccgggtgcgcgt

SEQ ID NO: 319567 - DNA, 20 bp, human
gggaatcgacgctgcgtcag

SEQ ID NO: 319568 - DNA, 20 bp, human
gagaaaggggacttgaaaca

SEQ ID NO: 319569 - DNA, 20 bp, human
ggcgtcagaggagaccctcg

SEQ ID NO: 319570 - DNA, 20 bp, human
gcgcacccgggggtcctcac

SEQ ID NO: 319571 - DNA, 20 bp, human
gcccgcttccccgacctcga

SEQ ID NO: 319572 - DNA, 20 bp, human
gcggctccgccgcagtgaga

SEQ ID NO: 319573 - DNA, 20 bp, human
gggcagaggactcccggagt

SEQ ID NO: 319574 - DNA, 20 bp, human
gagtgtgttcggaataagaa

SEQ ID NO: 319575 - DNA, 20 bp, human
gaggtcggggaagcgggcag

SEQ ID NO: 319576 - DNA, 20 bp, human
gtggagggcagagaaagagt

SEQ ID NO: 319577 - DNA, 20 bp, human
gggaaggcggggtcgagcta

SEQ ID NO: 319578 - DNA, 20 bp, human
ggggcaatgcaggacgggag

SEQ ID NO: 319579 - DNA, 20 bp, human
gctgcgcaaaagggaaggcg

SEQ ID NO: 319580 - DNA, 20 bp, human
ggacgaccgccgcagctcct

SEQ ID NO: 319581 - DNA, 20 bp, human
ggcctcccggcgtataaata

SEQ ID NO: 319582 - DNA, 20 bp, human
gtgcgtgagtgagtacagaa

SEQ ID NO: 319583 - DNA, 20 bp, human
ggaaatgagtgagggggcat

SEQ ID NO: 319584 - DNA, 20 bp, human
gtgggatctcagagaaaatc

SEQ ID NO: 319585 - DNA, 20 bp, human
gggattctgcgcaaaaggga

SEQ ID NO: 319586 - DNA, 20 bp, human
gggtgcgaaacgcaatcggg

SEQ ID NO: 319587 - DNA, 20 bp, human
gtaaagaacaaggggaccac

SEQ ID NO: 319588 - DNA, 20 bp, human
gggaagcgctgcctgaacgg

SEQ ID NO: 319589 - DNA, 20 bp, human
gggcaccggtcggggaggag

SEQ ID NO: 319590 - DNA, 20 bp, human
ggctggcgatattcgcacca

SEQ ID NO: 319591 - DNA, 20 bp, human
gggactgcgggcaccggtcg

SEQ ID NO: 319592 - DNA, 20 bp, human
gcccaggccgcatgggaacc

SEQ ID NO: 319593 - DNA, 20 bp, human
gaggcggggactgcgggcac

SEQ ID NO: 319594 - DNA, 20 bp, human
gcaagggtgcgaaacgcaat

SEQ ID NO: 319595 - DNA, 20 bp, human
gtgggactgaaaggggacct

SEQ ID NO: 319596 - DNA, 20 bp, human
gaaagtgactactctcagaa

SEQ ID NO: 319597 - DNA, 20 bp, human
gggcaactgtctggcagtcc

SEQ ID NO: 319598 - DNA, 20 bp, human
gaccctccaggagttttcta

SEQ ID NO: 319599 - DNA, 20 bp, human
ggggcaaggttagtcattgt

SEQ ID NO: 319600 - DNA, 20 bp, human
gtccttagaaaactcctgga

SEQ ID NO: 319601 - DNA, 20 bp, human
gagtagctgggtgtggttag

SEQ ID NO: 319602 - DNA, 20 bp, human
gggtgtggttagtggactat

SEQ ID NO: 319603 - DNA, 20 bp, human
ggggccaagacttagtagct

SEQ ID NO: 319604 - DNA, 20 bp, human
gctaatggatctctactgca

SEQ ID NO: 319605 - DNA, 20 bp, human
gcattacattctgggtattg

SEQ ID NO: 319606 - DNA, 20 bp, human
ggggagggaaagcgaagagg

SEQ ID NO: 319607 - DNA, 20 bp, human
gcgagcgcgccggcgagtga

SEQ ID NO: 319608 - DNA, 20 bp, human
gaacacccaacaactggggt

SEQ ID NO: 319609 - DNA, 20 bp, human
gtcccctggcggggttgcta

SEQ ID NO: 319610 - DNA, 20 bp, human
ggaagactcgccagcaccag

SEQ ID NO: 319611 - DNA, 20 bp, human
gcgctcgcctcctcgctaga

SEQ ID NO: 319612 - DNA, 20 bp, human
gaaaacgcaccggtgaggga

SEQ ID NO: 319613 - DNA, 20 bp, human
ggccaaaagcaaccgagagg

SEQ ID NO: 319614 - DNA, 20 bp, human
ggctcgcacaccatctagcg

SEQ ID NO: 319615 - DNA, 20 bp, human
gaggtgtagtgtggtgccag

SEQ ID NO: 319616 - DNA, 20 bp, human
gtgtggctggagtatagctg

SEQ ID NO: 319617 - DNA, 20 bp, human
gggagtgcgggttcccgggg

SEQ ID NO: 319618 - DNA, 20 bp, human
gtggctgcagtggcgacgag

SEQ ID NO: 319619 - DNA, 20 bp, human
gggaagcggtcgcgattctt

SEQ ID NO: 319620 - DNA, 20 bp, human
gtgcaggatcgggttgtggg

SEQ ID NO: 319621 - DNA, 20 bp, human
gcgccactgcagccactaaa

SEQ ID NO: 319622 - DNA, 20 bp, human
gacgtagcagggtagtgtga

SEQ ID NO: 319623 - DNA, 20 bp, human
gtagcagggtagtgtgaagg

SEQ ID NO: 319624 - DNA, 20 bp, human
gaagtgcagactccacacgg

SEQ ID NO: 319625 - DNA, 20 bp, human
ggggagggggcgtgcaggat

SEQ ID NO: 319626 - DNA, 20 bp, human
ggggacgcccctgtaggtgg

SEQ ID NO: 319627 - DNA, 20 bp, human
gcggggctcctcccccaagt

SEQ ID NO: 319628 - DNA, 20 bp, human
ggacctagacccactttcca

SEQ ID NO: 319629 - DNA, 20 bp, human
gccggagtccacgcccactt

SEQ ID NO: 319630 - DNA, 20 bp, human
gtaggggacgcccctgtagg

SEQ ID NO: 319631 - DNA, 20 bp, human
gccgcagcctccacctacag

SEQ ID NO: 319632 - DNA, 20 bp, human
gggcgaggggttccatcccg

SEQ ID NO: 319633 - DNA, 20 bp, human
gctcctcccccaagtgggcg

SEQ ID NO: 319634 - DNA, 20 bp, human
ggcgtcccctaaggggacgg

SEQ ID NO: 319635 - DNA, 20 bp, human
gttccctggaaagtgggtct

SEQ ID NO: 319636 - DNA, 20 bp, human
ggcgtggaggacaactaact

SEQ ID NO: 319637 - DNA, 20 bp, human
gccctacggcgcatgcgctg

SEQ ID NO: 319638 - DNA, 20 bp, human
gggagcgacctcaacagcta

SEQ ID NO: 319639 - DNA, 20 bp, human
gccgccctaggtcttgctgt

SEQ ID NO: 319640 - DNA, 20 bp, human
gctgttgaggtcgctcccta

SEQ ID NO: 319641 - DNA, 20 bp, human
gctagggtgctgtttgggcg

SEQ ID NO: 319642 - DNA, 20 bp, human
gaacgcaaacgcgcgtgggg

SEQ ID NO: 319643 - DNA, 20 bp, human
gagaaaacgcaaacgcgcgt

SEQ ID NO: 319644 - DNA, 20 bp, human
gcagacaaggacagattaag

SEQ ID NO: 319645 - DNA, 20 bp, human
gaccacagcgcatgcgccgt

SEQ ID NO: 319646 - DNA, 20 bp, human
ggggctagaaccgtagggtc

SEQ ID NO: 319647 - DNA, 20 bp, human
gaggctgggctagaaccgta

SEQ ID NO: 319648 - DNA, 20 bp, human
gaagacagaaaggacgagac

SEQ ID NO: 319649 - DNA, 20 bp, human
gagaaccgtagggtcgggcg

SEQ ID NO: 319650 - DNA, 20 bp, human
gggcggggtgctgtgcgaag

SEQ ID NO: 319651 - DNA, 20 bp, human
gcgtggaaggcggcacgcag

SEQ ID NO: 319652 - DNA, 20 bp, human
ggacgtcagcgcgtggaagg

SEQ ID NO: 319653 - DNA, 20 bp, human
gagcaccccgcccgacccta

SEQ ID NO: 319654 - DNA, 20 bp, human
gcggactaagggagagcggc

SEQ ID NO: 319655 - DNA, 20 bp, human
ggccagcgccggtgacgcgc

SEQ ID NO: 319656 - DNA, 20 bp, human
gtggggcgcctcagccaatc

SEQ ID NO: 319657 - DNA, 20 bp, human
gaggcagcaagtgatgctga

SEQ ID NO: 319658 - DNA, 20 bp, human
gggtggatctagcgcgtctc

SEQ ID NO: 319659 - DNA, 20 bp, human
gcagcatggctgctcccgat

SEQ ID NO: 319660 - DNA, 20 bp, human
ggtgcagaacgccatagcga

SEQ ID NO: 319661 - DNA, 20 bp, human
ggtggcggaggaagaattgt

SEQ ID NO: 319662 - DNA, 20 bp, human
gcaggcgtcatccgtcgcta

SEQ ID NO: 319663 - DNA, 20 bp, human
gggctgctcccgattggctg

SEQ ID NO: 319664 - DNA, 20 bp, human
ggaggaagaattgtcggcat

SEQ ID NO: 319665 - DNA, 20 bp, human
gcctggccagcgctggttgg

SEQ ID NO: 319666 - DNA, 20 bp, human
gccaaggagcaggtgttctc

SEQ ID NO: 319667 - DNA, 20 bp, human
gtctcccggtgtgacgtctc

SEQ ID NO: 319668 - DNA, 20 bp, human
ggggcgaggcggcaccaagg

SEQ ID NO: 319669 - DNA, 20 bp, human
gcggggcatactgggaagtc

SEQ ID NO: 319670 - DNA, 20 bp, human
gggcgctaagtagctaaaga

SEQ ID NO: 319671 - DNA, 20 bp, human
gttccgaaatggctgctgtc

SEQ ID NO: 319672 - DNA, 20 bp, human
gtgggacgtacgttccgaaa

SEQ ID NO: 319673 - DNA, 20 bp, human
gagtgttcgccgacccaagt

SEQ ID NO: 319674 - DNA, 20 bp, human
ggaaagcagaggaggaccgg

SEQ ID NO: 319675 - DNA, 20 bp, human
ggagacggcgcggggcatac

SEQ ID NO: 319676 - DNA, 20 bp, human
gagaaggcatctggtggaag

SEQ ID NO: 319677 - DNA, 20 bp, human
gaggggaggaccttagatct

SEQ ID NO: 319678 - DNA, 20 bp, human
ggtgtgcaaagaagcctgag

SEQ ID NO: 319679 - DNA, 20 bp, human
ggccgcttcgcctctctcat

SEQ ID NO: 319680 - DNA, 20 bp, human
gtgtcactaggcaaccgcgt

SEQ ID NO: 319681 - DNA, 20 bp, human
gccaaggtaaccgagatcta

SEQ ID NO: 319682 - DNA, 20 bp, human
gggcgtctgcttttaacctg

SEQ ID NO: 319683 - DNA, 20 bp, human
gaaggtcagaaggcatctgg

SEQ ID NO: 319684 - DNA, 20 bp, human
gggagagaggaagcggcagc

SEQ ID NO: 319685 - DNA, 20 bp, human
gcctctgatagagatcgcca

SEQ ID NO: 319686 - DNA, 20 bp, human
ggcccggcgggtcgtctctc

SEQ ID NO: 319687 - DNA, 20 bp, human
ggcctcccgccagacccagg

SEQ ID NO: 319688 - DNA, 20 bp, human
ggggtcgtctctcgggttgc

SEQ ID NO: 319689 - DNA, 20 bp, human
ggacagaactcagttagtcg

SEQ ID NO: 319690 - DNA, 20 bp, human
ggcaaccggcggcttccgcg

SEQ ID NO: 319691 - DNA, 20 bp, human
gcaggccaaggagtggacta

SEQ ID NO: 319692 - DNA, 20 bp, human
gaacccgagagacgacccgc

SEQ ID NO: 319693 - DNA, 20 bp, human
gcggttgccaggccaaggag

SEQ ID NO: 319694 - DNA, 20 bp, human
gtggaaggggcccaaaaaga

SEQ ID NO: 319695 - DNA, 20 bp, human
gctaactgagttctgtctgc

SEQ ID NO: 319696 - DNA, 20 bp, human
ggagcctggcggagtcgctc

SEQ ID NO: 319697 - DNA, 20 bp, human
ggtggcggggatccggacgg

SEQ ID NO: 319698 - DNA, 20 bp, human
gcggggctgcggaacctctc

SEQ ID NO: 319699 - DNA, 20 bp, human
ggttgtggcggggatccgga

SEQ ID NO: 319700 - DNA, 20 bp, human
gctctatggcgggtcctccc

SEQ ID NO: 319701 - DNA, 20 bp, human
gccccgccacaacagagtca

SEQ ID NO: 319702 - DNA, 20 bp, human
gcggacgcacagaaagtgcg

SEQ ID NO: 319703 - DNA, 20 bp, human
gcaaacaagtgcacaaaaag

SEQ ID NO: 319704 - DNA, 20 bp, human
gacgccacgagcggccagag

SEQ ID NO: 319705 - DNA, 20 bp, human
gtccctgactctgttgtggc

SEQ ID NO: 319706 - DNA, 20 bp, human
ggcggggcgcgggtctggaa

SEQ ID NO: 319707 - DNA, 20 bp, human
gccgacccaaggcaacggga

SEQ ID NO: 319708 - DNA, 20 bp, human
gcaaggcaacgggacggttg

SEQ ID NO: 319709 - DNA, 20 bp, human
ggagccgcgcaaggaaacgc

SEQ ID NO: 319710 - DNA, 20 bp, human
gtccacctcgaggcagggtc

SEQ ID NO: 319711 - DNA, 20 bp, human
gtggggaccagtccacctcg

SEQ ID NO: 319712 - DNA, 20 bp, human
ggaccagtccacctcgaggc

SEQ ID NO: 319713 - DNA, 20 bp, human
gactgtagactgcaaagcaa

SEQ ID NO: 319714 - DNA, 20 bp, human
ggcctgaccctgcctcgagg

SEQ ID NO: 319715 - DNA, 20 bp, human
ggaatcccgacccaaggcaa

SEQ ID NO: 319716 - DNA, 20 bp, human
gccccggcggcgtccttcct

SEQ ID NO: 319717 - DNA, 20 bp, human
ggatcggccgcagaactcgg

SEQ ID NO: 319718 - DNA, 20 bp, human
gaagacgcacaggagtccaa

SEQ ID NO: 319719 - DNA, 20 bp, human
gagaactcggcggagtcgag

SEQ ID NO: 319720 - DNA, 20 bp, human
ggccacgcaagcttgagggg

SEQ ID NO: 319721 - DNA, 20 bp, human
gcgcgcccacggctccgcgg

SEQ ID NO: 319722 - DNA, 20 bp, human
gcgcacaggagtccaagggt

SEQ ID NO: 319723 - DNA, 20 bp, human
gctgccgccacgcaagcttg

SEQ ID NO: 319724 - DNA, 20 bp, human
gggcgtctccccatcttctc

SEQ ID NO: 319725 - DNA, 20 bp, human
ggggccccgcggcccggaga

SEQ ID NO: 319726 - DNA, 20 bp, human
gcaggccggctgcccgatgg

SEQ ID NO: 319727 - DNA, 20 bp, human
gtggactcacgacgcggggt

SEQ ID NO: 319728 - DNA, 20 bp, human
gccggcgctccctggagctg

SEQ ID NO: 319729 - DNA, 20 bp, human
gccggcctggactcacgacg

SEQ ID NO: 319730 - DNA, 20 bp, human
gcaggcgggaagcctccatc

SEQ ID NO: 319731 - DNA, 20 bp, human
ggaggaggatcgggagtcgc

SEQ ID NO: 319732 - DNA, 20 bp, human
gagcgacttcggctccagta

SEQ ID NO: 319733 - DNA, 20 bp, human
ggtccaggccggctgcccga

SEQ ID NO: 319734 - DNA, 20 bp, human
gccggcatccccgaggagag

SEQ ID NO: 319735 - DNA, 20 bp, human
ggaagcctccatcgggcagc

SEQ ID NO: 319736 - DNA, 20 bp, human
ggtcgtgaggggaaaagtga

SEQ ID NO: 319737 - DNA, 20 bp, human
ggcgtggggcagggtcgtga

SEQ ID NO: 319738 - DNA, 20 bp, human
ggagccagcgccctaggtgt

SEQ ID NO: 319739 - DNA, 20 bp, human
gtcactcgtgggcaagaagg

SEQ ID NO: 319740 - DNA, 20 bp, human
ggccacgcgtccgtatttgt

SEQ ID NO: 319741 - DNA, 20 bp, human
ggaacccacacctagggcgc

SEQ ID NO: 319742 - DNA, 20 bp, human
gtcacggcgagcggcttgcg

SEQ ID NO: 319743 - DNA, 20 bp, human
ggtaccgtgcccgccattgc

SEQ ID NO: 319744 - DNA, 20 bp, human
gcgctcgccgtgaaggggcg

SEQ ID NO: 319745 - DNA, 20 bp, human
gccacgcagtgtccaagaat

SEQ ID NO: 319746 - DNA, 20 bp, human
gtagccaagagggtaagcaa

SEQ ID NO: 319747 - DNA, 20 bp, human
ggccgctagactagccaaga

SEQ ID NO: 319748 - DNA, 20 bp, human
gaaagtgaggcctcgggcta

SEQ ID NO: 319749 - DNA, 20 bp, human
gacgtcaggtctgtgacaag

SEQ ID NO: 319750 - DNA, 20 bp, human
gggaaccgcgtggaaccgaa

SEQ ID NO: 319751 - DNA, 20 bp, human
gccaaggcttcccgctttcg

SEQ ID NO: 319752 - DNA, 20 bp, human
gcagggaccgagatgaccgg

SEQ ID NO: 319753 - DNA, 20 bp, human
gccaagagggtaagcaaagg

SEQ ID NO: 319754 - DNA, 20 bp, human
gtggaaccgaagggctccca

SEQ ID NO: 319755 - DNA, 20 bp, human
gttggctagtctagcggcca

SEQ ID NO: 319756 - DNA, 20 bp, human
ggcgccctctgctggctctc

SEQ ID NO: 319757 - DNA, 20 bp, human
gcggccgctacccggagacg

SEQ ID NO: 319758 - DNA, 20 bp, human
gcgcgcgagcagcaagtctg

SEQ ID NO: 319759 - DNA, 20 bp, human
gtgggtggcgaccgcgtctc

SEQ ID NO: 319760 - DNA, 20 bp, human
gtggcgcggtcccacgagcg

SEQ ID NO: 319761 - DNA, 20 bp, human
ggctgcgaccgggatcccgc

SEQ ID NO: 319762 - DNA, 20 bp, human
gttcccgggagagcgcttct

SEQ ID NO: 319763 - DNA, 20 bp, human
gcgaagacgcggccgctacc

SEQ ID NO: 319764 - DNA, 20 bp, human
gcccgggaagccccgctcgt

SEQ ID NO: 319765 - DNA, 20 bp, human
gtattcgcgtcttgggagcc

SEQ ID NO: 319766 - DNA, 20 bp, human
gggcgcgggcgggaccgggt

SEQ ID NO: 319767 - DNA, 20 bp, human
gctgccagaaagcccgggcg

SEQ ID NO: 319768 - DNA, 20 bp, human
gggcagaagagggcgggtga

SEQ ID NO: 319769 - DNA, 20 bp, human
gggtctctcgcgccgggtga

SEQ ID NO: 319770 - DNA, 20 bp, human
gccccggcggcgtttcccgg

SEQ ID NO: 319771 - DNA, 20 bp, human
gactcagggtccgtctgctc

SEQ ID NO: 319772 - DNA, 20 bp, human
gtgggagcagcgccctcacc

SEQ ID NO: 319773 - DNA, 20 bp, human
gaagagggcgggtgagggcg

SEQ ID NO: 319774 - DNA, 20 bp, human
gggcccccgggaaacgccgc

SEQ ID NO: 319775 - DNA, 20 bp, human
gcagcgcgcatgcgcccacc

SEQ ID NO: 319776 - DNA, 20 bp, human
gggctcggcactgggaacaa

SEQ ID NO: 319777 - DNA, 20 bp, human
ggtccacccgggcatcgctc

SEQ ID NO: 319778 - DNA, 20 bp, human
gagccggcgccgcaggggag

SEQ ID NO: 319779 - DNA, 20 bp, human
gcgatgcccgggtggaccag

SEQ ID NO: 319780 - DNA, 20 bp, human
ggggctgtgcacgaatccag

SEQ ID NO: 319781 - DNA, 20 bp, human
gagggccgcgggctcggcac

SEQ ID NO: 319782 - DNA, 20 bp, human
ggaacgcccccagtcgatcc

SEQ ID NO: 319783 - DNA, 20 bp, human
gcatcgctccgggatcgact

SEQ ID NO: 319784 - DNA, 20 bp, human
gaacaaaggggaccggcgga

SEQ ID NO: 319785 - DNA, 20 bp, human
gccggagagaggtttcccac

SEQ ID NO: 319786 - DNA, 20 bp, human
gccggaacgggcggaagtag

SEQ ID NO: 319787 - DNA, 20 bp, human
gacagagcgacttggtgagg

SEQ ID NO: 319788 - DNA, 20 bp, human
ggcctggcagcccggaagtg

SEQ ID NO: 319789 - DNA, 20 bp, human
gacttccgcccgttccgggg

SEQ ID NO: 319790 - DNA, 20 bp, human
ggtaagccccgccccggaac

SEQ ID NO: 319791 - DNA, 20 bp, human
gcggaagtagaggcaacttc

SEQ ID NO: 319792 - DNA, 20 bp, human
ggctctcggcggggctgtac

SEQ ID NO: 319793 - DNA, 20 bp, human
ggggaaaggtcaaaagtcag

SEQ ID NO: 319794 - DNA, 20 bp, human
gcggaggggcagacctggac

SEQ ID NO: 319795 - DNA, 20 bp, human
ggtgaactatcgctgcggag

SEQ ID NO: 319796 - DNA, 20 bp, human
gcgaaggaggcgaacggaat

SEQ ID NO: 319797 - DNA, 20 bp, human
gcgggcaggagcgcggggtt

SEQ ID NO: 319798 - DNA, 20 bp, human
ggctgcggctgcgttcgtct

SEQ ID NO: 319799 - DNA, 20 bp, human
gaacggaatcggcccccagt

SEQ ID NO: 319800 - DNA, 20 bp, human
gcccaccgctggcgcggcgg

SEQ ID NO: 319801 - DNA, 20 bp, human
gactcggcggggatgaactg

SEQ ID NO: 319802 - DNA, 20 bp, human
gagggcaacattggcgactg

SEQ ID NO: 319803 - DNA, 20 bp, human
ggcgcggggtttggctactg

SEQ ID NO: 319804 - DNA, 20 bp, human
gggtcctgggactccgactt

SEQ ID NO: 319805 - DNA, 20 bp, human
gtcggtgctccgggtgatag

SEQ ID NO: 319806 - DNA, 20 bp, human
ggggctccctagaccgggtt

SEQ ID NO: 319807 - DNA, 20 bp, human
gggatgccaaacccggtcta

SEQ ID NO: 319808 - DNA, 20 bp, human
ggacacgcgcccgaaatcga

SEQ ID NO: 319809 - DNA, 20 bp, human
gtcagcgtcggtctcccgca

SEQ ID NO: 319810 - DNA, 20 bp, human
gtgcccgggtcatcgagaga

SEQ ID NO: 319811 - DNA, 20 bp, human
gtggcatccaggagaccgtg

SEQ ID NO: 319812 - DNA, 20 bp, human
gccgcccgaacctgttgtaa

SEQ ID NO: 319813 - DNA, 20 bp, human
gtgaggctgcaacggctcct

SEQ ID NO: 319814 - DNA, 20 bp, human
ggtctcctggatgccaaacc

SEQ ID NO: 319815 - DNA, 20 bp, human
ggagactgctcctccgggga

SEQ ID NO: 319816 - DNA, 20 bp, human
gccagcaggggtcactatga

SEQ ID NO: 319817 - DNA, 20 bp, human
gtaaccagactggtccgtaa

SEQ ID NO: 319818 - DNA, 20 bp, human
ggtccgtaagggttccagga

SEQ ID NO: 319819 - DNA, 20 bp, human
gcgcctgcgcggaggagaag

SEQ ID NO: 319820 - DNA, 20 bp, human
gtccccacaggggggccgta

SEQ ID NO: 319821 - DNA, 20 bp, human
gagccctacggcccccctgt

SEQ ID NO: 319822 - DNA, 20 bp, human
gtggggcacggtaaccagac

SEQ ID NO: 319823 - DNA, 20 bp, human
ggaacccttacggaccagtc

SEQ ID NO: 319824 - DNA, 20 bp, human
gtaacgaaacggaactgctt

SEQ ID NO: 319825 - DNA, 20 bp, human
gccgtgccccattgtgtctt

SEQ ID NO: 319826 - DNA, 20 bp, human
ggcctcctgcgccccggggt

SEQ ID NO: 319827 - DNA, 20 bp, human
gcagctggaacctggaaatt

SEQ ID NO: 319828 - DNA, 20 bp, human
gggaacctggaaattaggat

SEQ ID NO: 319829 - DNA, 20 bp, human
gacgctgggcgggcgtgcta

SEQ ID NO: 319830 - DNA, 20 bp, human
ggcgaagggcgggagttctc

SEQ ID NO: 319831 - DNA, 20 bp, human
ggggcgcaggaggcgcgcga

SEQ ID NO: 319832 - DNA, 20 bp, human
gcagagcctccccgagggcg

SEQ ID NO: 319833 - DNA, 20 bp, human
ggggcgggactccgggacgc

SEQ ID NO: 319834 - DNA, 20 bp, human
gtctcgggtccccgccctcg

SEQ ID NO: 319835 - DNA, 20 bp, human
gtcacagtggttccttgatc

SEQ ID NO: 319836 - DNA, 20 bp, human
gcgcgccccgcacccgtcag

SEQ ID NO: 319837 - DNA, 20 bp, human
ggtctccgcccccctcgcgc

SEQ ID NO: 319838 - DNA, 20 bp, human
gcccccctcgcgctggtgtg

SEQ ID NO: 319839 - DNA, 20 bp, human
gaggggaggagagcgaagaa

SEQ ID NO: 319840 - DNA, 20 bp, human
gtcagcggctccggggagaa

SEQ ID NO: 319841 - DNA, 20 bp, human
ggcagccgggattggagcgg

SEQ ID NO: 319842 - DNA, 20 bp, human
gtgtgtggagccggagtcgg

SEQ ID NO: 319843 - DNA, 20 bp, human
ggggcccgccacggcccgag

SEQ ID NO: 319844 - DNA, 20 bp, human
ggcggcagccgggattggag

SEQ ID NO: 319845 - DNA, 20 bp, human
ggccgcctctcgggccgtgg

SEQ ID NO: 319846 - DNA, 20 bp, human
gcaaagaagaagctgtacca

SEQ ID NO: 319847 - DNA, 20 bp, human
gaagctgtaccatggagaat

SEQ ID NO: 319848 - DNA, 20 bp, human
gccactctctgacctctaag

SEQ ID NO: 319849 - DNA, 20 bp, human
gcatcagatccgattctcca

SEQ ID NO: 319850 - DNA, 20 bp, human
ggcacagaactgagcctgtg

SEQ ID NO: 319851 - DNA, 20 bp, human
gccaggccttaaccccttag

SEQ ID NO: 319852 - DNA, 20 bp, human
ggggtcacaatccccgaaaa

SEQ ID NO: 319853 - DNA, 20 bp, human
gtctgacctctaaggggtta

SEQ ID NO: 319854 - DNA, 20 bp, human
ggtaccaggacgttccagcc

SEQ ID NO: 319855 - DNA, 20 bp, human
gcctcttcccgcccgcctgg

SEQ ID NO: 319856 - DNA, 20 bp, human
gcctccccagaggtcatgtt

SEQ ID NO: 319857 - DNA, 20 bp, human
gagggcaatcacaacaggtg

SEQ ID NO: 319858 - DNA, 20 bp, human
gagggagccagtgtgaaggg

SEQ ID NO: 319859 - DNA, 20 bp, human
ggagcagagaggcctggttg

SEQ ID NO: 319860 - DNA, 20 bp, human
gcacactggctccctcaacc

SEQ ID NO: 319861 - DNA, 20 bp, human
gggtgaccaagcctccccag

SEQ ID NO: 319862 - DNA, 20 bp, human
gccacatcatcttccaccag

SEQ ID NO: 319863 - DNA, 20 bp, human
gtggggtcagagcctgccat

SEQ ID NO: 319864 - DNA, 20 bp, human
gcctgaagggcaatcacaac

SEQ ID NO: 319865 - DNA, 20 bp, human
gaggtctggatcccaggcga

SEQ ID NO: 319866 - DNA, 20 bp, human
gggcctctcagctttcgccc

SEQ ID NO: 319867 - DNA, 20 bp, human
gggcggggccacagccaacc

SEQ ID NO: 319868 - DNA, 20 bp, human
gacagccaaccgggccctgg

SEQ ID NO: 319869 - DNA, 20 bp, human
gaactgaagtcacgtggtgg

SEQ ID NO: 319870 - DNA, 20 bp, human
gcatgggaataagttcagta

SEQ ID NO: 319871 - DNA, 20 bp, human
ggttaactgaagtcacgtgg

SEQ ID NO: 319872 - DNA, 20 bp, human
gctggtgcttagtcacagac

SEQ ID NO: 319873 - DNA, 20 bp, human
ggcaccgaccccagggctcg

SEQ ID NO: 319874 - DNA, 20 bp, human
gacttcagttaactgagagc

SEQ ID NO: 319875 - DNA, 20 bp, human
gctctcagctttcgcccagg

SEQ ID NO: 319876 - DNA, 20 bp, human
ggagccccaagccatgacta

SEQ ID NO: 319877 - DNA, 20 bp, human
gggagaaaggagccggaaga

SEQ ID NO: 319878 - DNA, 20 bp, human
ggatcctcgtgccggacgga

SEQ ID NO: 319879 - DNA, 20 bp, human
ggagggcagagttaccaaat

SEQ ID NO: 319880 - DNA, 20 bp, human
gggctccttagtcatggctt

SEQ ID NO: 319881 - DNA, 20 bp, human
gctgccgcgcaccagccccg

SEQ ID NO: 319882 - DNA, 20 bp, human
gggctggtgcgcggcagaat

SEQ ID NO: 319883 - DNA, 20 bp, human
ggcgccccggggctggtgcg

SEQ ID NO: 319884 - DNA, 20 bp, human
gtacgcggatggaaaagaag

SEQ ID NO: 319885 - DNA, 20 bp, human
gccgagccggatcctcgtgc

SEQ ID NO: 319886 - DNA, 20 bp, human
gtccccgccggctgccgtta

SEQ ID NO: 319887 - DNA, 20 bp, human
gggacggcgtcgctccccgc

SEQ ID NO: 319888 - DNA, 20 bp, human
ggcggcctcgcgccgtggga

SEQ ID NO: 319889 - DNA, 20 bp, human
gggggagcgacgccgtccca

SEQ ID NO: 319890 - DNA, 20 bp, human
gagacccggcaggccggcga

SEQ ID NO: 319891 - DNA, 20 bp, human
ggtcagacgggaggcatcga

SEQ ID NO: 319892 - DNA, 20 bp, human
ggccgcgcagccacggcgag

SEQ ID NO: 319893 - DNA, 20 bp, human
gcgccgcggcctcgcgccgt

SEQ ID NO: 319894 - DNA, 20 bp, human
ggaagcgcggacatcggcag

SEQ ID NO: 319895 - DNA, 20 bp, human
gctgggcgcgggggtagtga

SEQ ID NO: 319896 - DNA, 20 bp, human
ggcgctccgggcctccaaga

SEQ ID NO: 319897 - DNA, 20 bp, human
gagatgctgcgtgatcacgt

SEQ ID NO: 319898 - DNA, 20 bp, human
gccggagcgcgtgacccgaa

SEQ ID NO: 319899 - DNA, 20 bp, human
gccaagagggccaatcggaa

SEQ ID NO: 319900 - DNA, 20 bp, human
gacccgaacgggaagcggac

SEQ ID NO: 319901 - DNA, 20 bp, human
ggcgtgacccgaacgggaag

SEQ ID NO: 319902 - DNA, 20 bp, human
gcggcggggcctccagaccg

SEQ ID NO: 319903 - DNA, 20 bp, human
gaggacacgtcacaggggcg

SEQ ID NO: 319904 - DNA, 20 bp, human
gaacgggaagcggactggct

SEQ ID NO: 319905 - DNA, 20 bp, human
gcgaagcttgcccttccgat

SEQ ID NO: 319906 - DNA, 20 bp, human
ggggtcttgagatgtaggaa

SEQ ID NO: 319907 - DNA, 20 bp, human
ggctgagtggaccaaagtca

SEQ ID NO: 319908 - DNA, 20 bp, human
gaagcagggtcttgagatgt

SEQ ID NO: 319909 - DNA, 20 bp, human
gctgcagccacacctgagat

SEQ ID NO: 319910 - DNA, 20 bp, human
gacaggtggtgctcaccccc

SEQ ID NO: 319911 - DNA, 20 bp, human
ggcctcggtggatatcggga

SEQ ID NO: 319912 - DNA, 20 bp, human
gggagcccacgcagcagcgg

SEQ ID NO: 319913 - DNA, 20 bp, human
gcaatccaggggcaaacctc

SEQ ID NO: 319914 - DNA, 20 bp, human
gtcctcccgaggtttgcccc

SEQ ID NO: 319915 - DNA, 20 bp, human
gggtttgcccctggattgat

SEQ ID NO: 319916 - DNA, 20 bp, human
ggcttgagctgagttggcga

SEQ ID NO: 319917 - DNA, 20 bp, human
gtggtgccggtcccacgccg

SEQ ID NO: 319918 - DNA, 20 bp, human
gcgtggtggggaccgagctg

SEQ ID NO: 319919 - DNA, 20 bp, human
gaagagaggaggcggccgtt

SEQ ID NO: 319920 - DNA, 20 bp, human
gcagcctgagagttgagcaa

SEQ ID NO: 319921 - DNA, 20 bp, human
gctgtggcactgaagagagg

SEQ ID NO: 319922 - DNA, 20 bp, human
gtcaccgcctaaagcttccc

SEQ ID NO: 319923 - DNA, 20 bp, human
gccggtcccacgccgtggtg

SEQ ID NO: 319924 - DNA, 20 bp, human
gtgagctgagttggcgaggg

SEQ ID NO: 319925 - DNA, 20 bp, human
gtcaactctcaggctgtcca

SEQ ID NO: 319926 - DNA, 20 bp, human
gcactggaatgagggcactg

SEQ ID NO: 319927 - DNA, 20 bp, human
gagcaccaggcactggaatg

SEQ ID NO: 319928 - DNA, 20 bp, human
gagagccccgtggctcccac

SEQ ID NO: 319929 - DNA, 20 bp, human
gagaagctccaaagccgagt

SEQ ID NO: 319930 - DNA, 20 bp, human
gctcccaggcaacacccacc

SEQ ID NO: 319931 - DNA, 20 bp, human
ggtgccctcattccagtgcc

SEQ ID NO: 319932 - DNA, 20 bp, human
gtgtgggcgcttctcaggtc

SEQ ID NO: 319933 - DNA, 20 bp, human
ggccctggtgggtgttgcct

SEQ ID NO: 319934 - DNA, 20 bp, human
ggggcatttggggcacgcat

SEQ ID NO: 319935 - DNA, 20 bp, human
gattcctgtgggcgcttctc

SEQ ID NO: 319936 - DNA, 20 bp, human
ggggcccacatgtgccaagg

SEQ ID NO: 319937 - DNA, 20 bp, human
gagccagcgccctcacacga

SEQ ID NO: 319938 - DNA, 20 bp, human
gtggcagccctgtccctgag

SEQ ID NO: 319939 - DNA, 20 bp, human
ggaggagcgagcgttgggtg

SEQ ID NO: 319940 - DNA, 20 bp, human
gcccgagtgagtccagcatg

SEQ ID NO: 319941 - DNA, 20 bp, human
gagctcaggttgtctctggg

SEQ ID NO: 319942 - DNA, 20 bp, human
gccccaaaaccaggccccct

SEQ ID NO: 319943 - DNA, 20 bp, human
gaggcccccttggcacatgt

SEQ ID NO: 319944 - DNA, 20 bp, human
gtgcgttccgctcagggaca

SEQ ID NO: 319945 - DNA, 20 bp, human
gctcgggcccacatgtgcca

SEQ ID NO: 319946 - DNA, 20 bp, human
gcgggtcggggtaagacatc

SEQ ID NO: 319947 - DNA, 20 bp, human
gcccccggggccatagagtc

SEQ ID NO: 319948 - DNA, 20 bp, human
gcgcgccccggggccacatc

SEQ ID NO: 319949 - DNA, 20 bp, human
gcgtagccgcaagctctcgg

SEQ ID NO: 319950 - DNA, 20 bp, human
ggctaggggcactagggcaa

SEQ ID NO: 319951 - DNA, 20 bp, human
gtcccgtagccgcaagctct

SEQ ID NO: 319952 - DNA, 20 bp, human
gtaggccagatgtggccccg

SEQ ID NO: 319953 - DNA, 20 bp, human
gagggaatcctggagactgc

SEQ ID NO: 319954 - DNA, 20 bp, human
gaaccggagcgagggaatcc

SEQ ID NO: 319955 - DNA, 20 bp, human
gttccctagctccaggtacc

SEQ ID NO: 319956 - DNA, 20 bp, human
ggggccccgcgcctggaaga

SEQ ID NO: 319957 - DNA, 20 bp, human
gcccgcccctgcactgttgg

SEQ ID NO: 319958 - DNA, 20 bp, human
gcaccgcctccaacagtgca

SEQ ID NO: 319959 - DNA, 20 bp, human
gcgggccgggaaggcgcgca

SEQ ID NO: 319960 - DNA, 20 bp, human
ggccaccggcccgggcccgc

SEQ ID NO: 319961 - DNA, 20 bp, human
gtctccaaagaggtctgccg

SEQ ID NO: 319962 - DNA, 20 bp, human
ggttggaggcggtgggaggc

SEQ ID NO: 319963 - DNA, 20 bp, human
ggaaagtttgcaccaggcgg

SEQ ID NO: 319964 - DNA, 20 bp, human
gtgccgatcctggcacccga

SEQ ID NO: 319965 - DNA, 20 bp, human
gagggcagctgggtgccctc

SEQ ID NO: 319966 - DNA, 20 bp, human
gtcctggagagcaaggacgc

SEQ ID NO: 319967 - DNA, 20 bp, human
ggccgccagcaactccccgg

SEQ ID NO: 319968 - DNA, 20 bp, human
ggatcggtgcgcggcagagg

SEQ ID NO: 319969 - DNA, 20 bp, human
ggcagaggaggctcgcgggt

SEQ ID NO: 319970 - DNA, 20 bp, human
gtctgccgcgcaccgatccc

SEQ ID NO: 319971 - DNA, 20 bp, human
ggcgcggctcggatcatcta

SEQ ID NO: 319972 - DNA, 20 bp, human
ggtgagctggcaccggaggc

SEQ ID NO: 319973 - DNA, 20 bp, human
gcgagcccgggatcggtgcg

SEQ ID NO: 319974 - DNA, 20 bp, human
gacacatgacttccagtccc

SEQ ID NO: 319975 - DNA, 20 bp, human
ggctctccaggaggcgcccg

SEQ ID NO: 319976 - DNA, 20 bp, human
gtgacggagcggctccgagg

SEQ ID NO: 319977 - DNA, 20 bp, human
gaggtgacggagcggctccg

SEQ ID NO: 319978 - DNA, 20 bp, human
gtgtcaccgccccctagcga

SEQ ID NO: 319979 - DNA, 20 bp, human
gttacggcatagcgaggtga

SEQ ID NO: 319980 - DNA, 20 bp, human
ggaacagaaggacacggggt

SEQ ID NO: 319981 - DNA, 20 bp, human
gagtccgagggatacgaccg

SEQ ID NO: 319982 - DNA, 20 bp, human
ggcatagcgaggtgacggag

SEQ ID NO: 319983 - DNA, 20 bp, human
gctagcgagggcggggtcgt

SEQ ID NO: 319984 - DNA, 20 bp, human
ggcgtcgggcagacagtccg

SEQ ID NO: 319985 - DNA, 20 bp, human
ggcaccgtggcaaccgcgtc

SEQ ID NO: 319986 - DNA, 20 bp, human
ggcaaggcgtggggagaagt

SEQ ID NO: 319987 - DNA, 20 bp, human
ggggagcggttgtcggagga

SEQ ID NO: 319988 - DNA, 20 bp, human
gcgggagacgagcaaggcgt

SEQ ID NO: 319989 - DNA, 20 bp, human
gtgaggggagcggttgtcgg

SEQ ID NO: 319990 - DNA, 20 bp, human
gggcggggccgctagctgag

SEQ ID NO: 319991 - DNA, 20 bp, human
ggggtgaggggagcggttgt

SEQ ID NO: 319992 - DNA, 20 bp, human
gcagaagggacggggataga

SEQ ID NO: 319993 - DNA, 20 bp, human
gccgcggcatacaaatgggc

SEQ ID NO: 319994 - DNA, 20 bp, human
gagcggttgtcggaggaggg

SEQ ID NO: 319995 - DNA, 20 bp, human
gggtccgcggagtctctaac

SEQ ID NO: 319996 - DNA, 20 bp, human
gaggcccccaaggtgggtca

SEQ ID NO: 319997 - DNA, 20 bp, human
gggacagagcgggaccctga

SEQ ID NO: 319998 - DNA, 20 bp, human
gaccccctcacgggaacaat

SEQ ID NO: 319999 - DNA, 20 bp, human
gggtccctgacccaccttgg

SEQ ID NO: 320000 - DNA, 20 bp, human
gacagatggcggcgggtccc

SEQ ID NO: 320001 - DNA, 20 bp, human
gccaccccattgttcccgtg

SEQ ID NO: 320002 - DNA, 20 bp, human
gagggaaagcagggattgag

SEQ ID NO: 320003 - DNA, 20 bp, human
gggggagagccggctccccc

SEQ ID NO: 320004 - DNA, 20 bp, human
gacccaccttgggggcctgc

SEQ ID NO: 320005 - DNA, 20 bp, human
gcctctatgccaggccatat

SEQ ID NO: 320006 - DNA, 20 bp, human
gcccacttgaaaggctcctc

SEQ ID NO: 320007 - DNA, 20 bp, human
gaaagggaggagttagactc

SEQ ID NO: 320008 - DNA, 20 bp, human
gaaagacacgcccacttgaa

SEQ ID NO: 320009 - DNA, 20 bp, human
gtgggcgtgtctttcggctg

SEQ ID NO: 320010 - DNA, 20 bp, human
gcaaaactggacctggccgg

SEQ ID NO: 320011 - DNA, 20 bp, human
ggggcaacatcactcctccc

SEQ ID NO: 320012 - DNA, 20 bp, human
ggtctttcggctggggaaaa

SEQ ID NO: 320013 - DNA, 20 bp, human
gcgggcggcaaaactggacc

SEQ ID NO: 320014 - DNA, 20 bp, human
gaccccagtccacatgtgta

SEQ ID NO: 320015 - DNA, 20 bp, human
gttgctctcccagctgacca

SEQ ID NO: 320016 - DNA, 20 bp, human
gaggctggtacccacttaca

SEQ ID NO: 320017 - DNA, 20 bp, human
gtgtgttgatgcatgaaggc

SEQ ID NO: 320018 - DNA, 20 bp, human
gatctggcatccctgtaagt

SEQ ID NO: 320019 - DNA, 20 bp, human
gggtacccaggtgcacaaat

SEQ ID NO: 320020 - DNA, 20 bp, human
gcatctgctagtgacgtcac

SEQ ID NO: 320021 - DNA, 20 bp, human
gcacagaaggttagactgat

SEQ ID NO: 320022 - DNA, 20 bp, human
gcgaactgcttcggtttcac

SEQ ID NO: 320023 - DNA, 20 bp, human
ggggaaagaaagccgtgaaa

SEQ ID NO: 320024 - DNA, 20 bp, human
gcctactgtacgtgaaatgc

SEQ ID NO: 320025 - DNA, 20 bp, human
gcccaggtgcacaaatggga

SEQ ID NO: 320026 - DNA, 20 bp, human
gcggccccgggagtcggctc

SEQ ID NO: 320027 - DNA, 20 bp, human
gcacactccgggttggggga

SEQ ID NO: 320028 - DNA, 20 bp, human
ggttgcgccgggtacttaag

SEQ ID NO: 320029 - DNA, 20 bp, human
gccactaagcagctggagag

SEQ ID NO: 320030 - DNA, 20 bp, human
gtagcccgagccgactcccg

SEQ ID NO: 320031 - DNA, 20 bp, human
ggtcgcgcggccccgggagt

SEQ ID NO: 320032 - DNA, 20 bp, human
ggattggccggcggtaatta

SEQ ID NO: 320033 - DNA, 20 bp, human
gtctccaggcagtgaaacag

SEQ ID NO: 320034 - DNA, 20 bp, human
ggccgcgcgacgccgccgat

SEQ ID NO: 320035 - DNA, 20 bp, human
gtcactgcctggagacgccc

SEQ ID NO: 320036 - DNA, 20 bp, human
gggagctggcgaagccgcag

SEQ ID NO: 320037 - DNA, 20 bp, human
gggaaaggcggtgaagaaag

SEQ ID NO: 320038 - DNA, 20 bp, human
ggggaggggaggtcggatag

SEQ ID NO: 320039 - DNA, 20 bp, human
gaggaggaggatggatggca

SEQ ID NO: 320040 - DNA, 20 bp, human
ggcagcgaggacgaaggcgg

SEQ ID NO: 320041 - DNA, 20 bp, human
gcgcgagccaccaatcacaa

SEQ ID NO: 320042 - DNA, 20 bp, human
gccagaggagggaaaagcgg

SEQ ID NO: 320043 - DNA, 20 bp, human
gtcggcggcagcgaggacga

SEQ ID NO: 320044 - DNA, 20 bp, human
ggcaggcctcccggagtcca

SEQ ID NO: 320045 - DNA, 20 bp, human
gcaccaatcacaatggacag

SEQ ID NO: 320046 - DNA, 20 bp, human
gacagctggattccggacaa

SEQ ID NO: 320047 - DNA, 20 bp, human
gctcgagagagcaaacagag

SEQ ID NO: 320048 - DNA, 20 bp, human
ggacaaagggccggggtcgg

SEQ ID NO: 320049 - DNA, 20 bp, human
gcacacgaggctcttctcac

SEQ ID NO: 320050 - DNA, 20 bp, human
gctcgcgtggcgcggcccca

SEQ ID NO: 320051 - DNA, 20 bp, human
gaggctcttctcactgggcg

SEQ ID NO: 320052 - DNA, 20 bp, human
ggattccggacaaagggccg

SEQ ID NO: 320053 - DNA, 20 bp, human
ggcctcgtgtggctctggtc

SEQ ID NO: 320054 - DNA, 20 bp, human
gctggtcaggccacctcaga

SEQ ID NO: 320055 - DNA, 20 bp, human
gccagggccccggcgctgat

SEQ ID NO: 320056 - DNA, 20 bp, human
gcccccactccgggtgataa

SEQ ID NO: 320057 - DNA, 20 bp, human
gcgggtgataacggcggagg

SEQ ID NO: 320058 - DNA, 20 bp, human
gcgccgttatcacccggagt

SEQ ID NO: 320059 - DNA, 20 bp, human
ggaggcaggcccaaagttag

SEQ ID NO: 320060 - DNA, 20 bp, human
ggtgataacggcggaggtgg

SEQ ID NO: 320061 - DNA, 20 bp, human
gacaaattctggcggaaagt

SEQ ID NO: 320062 - DNA, 20 bp, human
ggggaactggccttgtgttt

SEQ ID NO: 320063 - DNA, 20 bp, human
ggggtcagctcgcgcaccta

SEQ ID NO: 320064 - DNA, 20 bp, human
gggagacagacaaattctgg

SEQ ID NO: 320065 - DNA, 20 bp, human
gccgggagacagacaaattc

SEQ ID NO: 320066 - DNA, 20 bp, human
gcaaacccggaggccggcgg

SEQ ID NO: 320067 - DNA, 20 bp, human
gccagtctaggtgagcccca

SEQ ID NO: 320068 - DNA, 20 bp, human
gtgagagcgcggctgggaaa

SEQ ID NO: 320069 - DNA, 20 bp, human
gagcgtccctcaccgccgtg

SEQ ID NO: 320070 - DNA, 20 bp, human
ggagctagagattgagagcg

SEQ ID NO: 320071 - DNA, 20 bp, human
ggtgagggacgctcgccaga

SEQ ID NO: 320072 - DNA, 20 bp, human
gggggaggggacagctgtag

SEQ ID NO: 320073 - DNA, 20 bp, human
gtgtagggggcggtggggat

SEQ ID NO: 320074 - DNA, 20 bp, human
ggacgtcatctaactcctct

SEQ ID NO: 320075 - DNA, 20 bp, human
ggatgctcccgggtcagctc

SEQ ID NO: 320076 - DNA, 20 bp, human
ggcgctgcgcgtagtggtct

SEQ ID NO: 320077 - DNA, 20 bp, human
gtatgcgtcagcctccggtt

SEQ ID NO: 320078 - DNA, 20 bp, human
gacgcgcagcgcaaccgaac

SEQ ID NO: 320079 - DNA, 20 bp, human
ggacgcatagatgctgcgat

SEQ ID NO: 320080 - DNA, 20 bp, human
gaggccccgggctgtgggga

SEQ ID NO: 320081 - DNA, 20 bp, human
gcgcagcgcaaccgaaccgg

SEQ ID NO: 320082 - DNA, 20 bp, human
gcgggcgcgcggagtgagga

SEQ ID NO: 320083 - DNA, 20 bp, human
gggagtcaccccaaaggagg

SEQ ID NO: 320084 - DNA, 20 bp, human
gtctgggcgacctgagggcg

SEQ ID NO: 320085 - DNA, 20 bp, human
gtcggttgcgctgcgcgtag

SEQ ID NO: 320086 - DNA, 20 bp, human
gagctcttcttctggttgtg

SEQ ID NO: 320087 - DNA, 20 bp, human
gcttctgagcggaaggtcag

SEQ ID NO: 320088 - DNA, 20 bp, human
gctggaaaggggccgagaca

SEQ ID NO: 320089 - DNA, 20 bp, human
gacggggcccctgctggaaa

SEQ ID NO: 320090 - DNA, 20 bp, human
ggcttcgtggggaaagcaaa

SEQ ID NO: 320091 - DNA, 20 bp, human
gccgtctccagctcttcttc

SEQ ID NO: 320092 - DNA, 20 bp, human
gtgccaggttcctcatctgg

SEQ ID NO: 320093 - DNA, 20 bp, human
gtgccagggaggagcttcgt

SEQ ID NO: 320094 - DNA, 20 bp, human
gcacccagcgagaacctctg

SEQ ID NO: 320095 - DNA, 20 bp, human
gacactggtaactgtgcaga

SEQ ID NO: 320096 - DNA, 20 bp, human
gcggccgctaggagcgcgaa

SEQ ID NO: 320097 - DNA, 20 bp, human
gcgcgcacgcagggtgtcgg

SEQ ID NO: 320098 - DNA, 20 bp, human
ggctcctagcggccgctgag

SEQ ID NO: 320099 - DNA, 20 bp, human
ggccgccagccgccgcatta

SEQ ID NO: 320100 - DNA, 20 bp, human
gggaccaggacagaggcgga

SEQ ID NO: 320101 - DNA, 20 bp, human
gcctcccttcgcgctcctag

SEQ ID NO: 320102 - DNA, 20 bp, human
gggtctctgccctaatgcgg

SEQ ID NO: 320103 - DNA, 20 bp, human
ggccgcccggggacgcgcac

SEQ ID NO: 320104 - DNA, 20 bp, human
ggcctcaggtgaaaagagaa

SEQ ID NO: 320105 - DNA, 20 bp, human
ggggcgcgcacgcagggtgt

SEQ ID NO: 320106 - DNA, 20 bp, human
gagccgtggcggcccccgga

SEQ ID NO: 320107 - DNA, 20 bp, human
gtggcagcggggccctttcc

SEQ ID NO: 320108 - DNA, 20 bp, human
gcctgcgctgtgccccacgg

SEQ ID NO: 320109 - DNA, 20 bp, human
gcagggaacagcagcaacat

SEQ ID NO: 320110 - DNA, 20 bp, human
gggcctctggggtccgtccc

SEQ ID NO: 320111 - DNA, 20 bp, human
gctggcccggggtctcgcag

SEQ ID NO: 320112 - DNA, 20 bp, human
ggggctcagattcctgtcag

SEQ ID NO: 320113 - DNA, 20 bp, human
gcgggagcgcggaagagccg

SEQ ID NO: 320114 - DNA, 20 bp, human
gagggccccgctgccagggt

SEQ ID NO: 320115 - DNA, 20 bp, human
gtggcggcccccggagggcg

SEQ ID NO: 320116 - DNA, 20 bp, human
gcagcaggggcgtgatgtca

SEQ ID NO: 320117 - DNA, 20 bp, human
gcgcggcagccgctcgcctg

SEQ ID NO: 320118 - DNA, 20 bp, human
ggctcggcgactcgtccccg

SEQ ID NO: 320119 - DNA, 20 bp, human
gcgtgatgtcacggcaggga

SEQ ID NO: 320120 - DNA, 20 bp, human
gaggggcgtgatgtcacggc

SEQ ID NO: 320121 - DNA, 20 bp, human
gtggactcaggcgtcccgtc

SEQ ID NO: 320122 - DNA, 20 bp, human
gagccgctcgcctgggggca

SEQ ID NO: 320123 - DNA, 20 bp, human
gggcgggaacggggaatccg

SEQ ID NO: 320124 - DNA, 20 bp, human
gcggacacccgcgtggactc

SEQ ID NO: 320125 - DNA, 20 bp, human
gggggcgtaggggcgggaac

SEQ ID NO: 320126 - DNA, 20 bp, human
gacgcccctacccccgggtc

SEQ ID NO: 320127 - DNA, 20 bp, human
ggtacctggtgccgctcgtg

SEQ ID NO: 320128 - DNA, 20 bp, human
gcgcgcgcgcgcgaccgcag

SEQ ID NO: 320129 - DNA, 20 bp, human
ggagcggcaccaggtaccta

SEQ ID NO: 320130 - DNA, 20 bp, human
gtaaacccggaaacgccccg

SEQ ID NO: 320131 - DNA, 20 bp, human
gcctccggacccgggggtag

SEQ ID NO: 320132 - DNA, 20 bp, human
ggaagcgcagggattcccgc

SEQ ID NO: 320133 - DNA, 20 bp, human
gccagggcacaagaggccgg

SEQ ID NO: 320134 - DNA, 20 bp, human
ggggcgggggtcacgttacg

SEQ ID NO: 320135 - DNA, 20 bp, human
ggcaggctcctccggacccg

SEQ ID NO: 320136 - DNA, 20 bp, human
gccgccaccaggggaccgga

SEQ ID NO: 320137 - DNA, 20 bp, human
gaccaggggaccggagggga

SEQ ID NO: 320138 - DNA, 20 bp, human
ggtgtcgcactcacccgtgg

SEQ ID NO: 320139 - DNA, 20 bp, human
gagggcaaaagtcctagtgg

SEQ ID NO: 320140 - DNA, 20 bp, human
ggacagtgtggtcaggtccg

SEQ ID NO: 320141 - DNA, 20 bp, human
gacacgcgctgcgcgaacca

SEQ ID NO: 320142 - DNA, 20 bp, human
gggcccgggacagtgtggtc

SEQ ID NO: 320143 - DNA, 20 bp, human
gccagcgcccagcggtggcc

SEQ ID NO: 320144 - DNA, 20 bp, human
gcgcgtgtcgcactcacccg

SEQ ID NO: 320145 - DNA, 20 bp, human
ggcactcacccgtggagggt

SEQ ID NO: 320146 - DNA, 20 bp, human
gcgcggaggaggcgacgtca

SEQ ID NO: 320147 - DNA, 20 bp, human
gcgggcgacggcgagaagaa

SEQ ID NO: 320148 - DNA, 20 bp, human
gcgtccatctccaaaactaa

SEQ ID NO: 320149 - DNA, 20 bp, human
gtcctgcaaacttcacactc

SEQ ID NO: 320150 - DNA, 20 bp, human
gcacaagtccctgattgttc

SEQ ID NO: 320151 - DNA, 20 bp, human
gctggcggccgaaggagcca

SEQ ID NO: 320152 - DNA, 20 bp, human
gctgggagagggagcgaagc

SEQ ID NO: 320153 - DNA, 20 bp, human
ggacttgtgctggcggccga

SEQ ID NO: 320154 - DNA, 20 bp, human
gcgcccgcttggcaaatggg

SEQ ID NO: 320155 - DNA, 20 bp, human
ggggcagccagaggccgtga

SEQ ID NO: 320156 - DNA, 20 bp, human
gtccgggagaggctcgtctg

SEQ ID NO: 320157 - DNA, 20 bp, human
gaggtgggcgcatgatgagc

SEQ ID NO: 320158 - DNA, 20 bp, human
ggccctgcgactaaccaagc

SEQ ID NO: 320159 - DNA, 20 bp, human
ggcaaggcgaaagtcgctga

SEQ ID NO: 320160 - DNA, 20 bp, human
ggagaggctcgtctgtggag

SEQ ID NO: 320161 - DNA, 20 bp, human
gaaggcggatcccgcgcgtg

SEQ ID NO: 320162 - DNA, 20 bp, human
ggggaaatgtagtcctcgag

SEQ ID NO: 320163 - DNA, 20 bp, human
gaaccaagacaaccgtcttc

SEQ ID NO: 320164 - DNA, 20 bp, human
ggaccaatgaaaaggcggga

SEQ ID NO: 320165 - DNA, 20 bp, human
gggagaggtggcccagccaa

SEQ ID NO: 320166 - DNA, 20 bp, human
gggagaccgagttacgcgat

SEQ ID NO: 320167 - DNA, 20 bp, human
gtacgcgataggcctgtgag

SEQ ID NO: 320168 - DNA, 20 bp, human
gtacgcgcgcccaccctgcc

SEQ ID NO: 320169 - DNA, 20 bp, human
gcgcgagagcgcacccgcgg

SEQ ID NO: 320170 - DNA, 20 bp, human
gcgcctgttcgccgtgttag

SEQ ID NO: 320171 - DNA, 20 bp, human
gtgccgattggccactaaca

SEQ ID NO: 320172 - DNA, 20 bp, human
gggccactaacacggcgaac

SEQ ID NO: 320173 - DNA, 20 bp, human
gcagggtgggcgcgcgtagg

SEQ ID NO: 320174 - DNA, 20 bp, human
gtaactcggtctccgcgaga

SEQ ID NO: 320175 - DNA, 20 bp, human
gcctctcgggaattgtagtt

SEQ ID NO: 320176 - DNA, 20 bp, human
gcatccccggcagccaatca

SEQ ID NO: 320177 - DNA, 20 bp, human
gcctcctccagggatgagat

SEQ ID NO: 320178 - DNA, 20 bp, human
gactgagactaggggaggtg

SEQ ID NO: 320179 - DNA, 20 bp, human
gcccccagcctgtccctgat

SEQ ID NO: 320180 - DNA, 20 bp, human
ggtcacaacggcggaccaat

SEQ ID NO: 320181 - DNA, 20 bp, human
gtgtccctgattggctgccg

SEQ ID NO: 320182 - DNA, 20 bp, human
gggaccgctttgaagaagtt

SEQ ID NO: 320183 - DNA, 20 bp, human
ggccaatcagggacaggctg

SEQ ID NO: 320184 - DNA, 20 bp, human
ggaaatgattgtcacaacgg

SEQ ID NO: 320185 - DNA, 20 bp, human
ggaaccttgaactgagacta

SEQ ID NO: 320186 - DNA, 20 bp, human
gactcctgggctgaaaagga

SEQ ID NO: 320187 - DNA, 20 bp, human
gaggagagccacggggaaag

SEQ ID NO: 320188 - DNA, 20 bp, human
ggagccatgtgtgcccccgc

SEQ ID NO: 320189 - DNA, 20 bp, human
gtgtgggcagaaaccacatc

SEQ ID NO: 320190 - DNA, 20 bp, human
gggtcctcgcagattctcaa

SEQ ID NO: 320191 - DNA, 20 bp, human
gtgcccctttcggccaagag

SEQ ID NO: 320192 - DNA, 20 bp, human
gaggaaacttgagcccgatg

SEQ ID NO: 320193 - DNA, 20 bp, human
gccttgctcctggccagcgg

SEQ ID NO: 320194 - DNA, 20 bp, human
gcaccagcgtctgaagccct

SEQ ID NO: 320195 - DNA, 20 bp, human
gggagagccgtggggacaca

SEQ ID NO: 320196 - DNA, 20 bp, human
ggggcgatgttagtgggctt

SEQ ID NO: 320197 - DNA, 20 bp, human
gcccctcggccgcgccttcg

SEQ ID NO: 320198 - DNA, 20 bp, human
ggggcgaaggccctagtgtc

SEQ ID NO: 320199 - DNA, 20 bp, human
gaggaaagctggctccgggg

SEQ ID NO: 320200 - DNA, 20 bp, human
gccgaggccggggccgtcga

SEQ ID NO: 320201 - DNA, 20 bp, human
gggcgggcctaggtactcat

SEQ ID NO: 320202 - DNA, 20 bp, human
gatggactgggcagggttga

SEQ ID NO: 320203 - DNA, 20 bp, human
gcgcggggcccctccctgtc

SEQ ID NO: 320204 - DNA, 20 bp, human
gatggacccaccaatgagga

SEQ ID NO: 320205 - DNA, 20 bp, human
gcaaccctcccttctgggaa

SEQ ID NO: 320206 - DNA, 20 bp, human
ggcaagaagctcgcggtccg

SEQ ID NO: 320207 - DNA, 20 bp, human
gcaggcgggggacctagagg

SEQ ID NO: 320208 - DNA, 20 bp, human
ggggagggcaaactgaacgc

SEQ ID NO: 320209 - DNA, 20 bp, human
gggctgacgcaagaagctcg

SEQ ID NO: 320210 - DNA, 20 bp, human
gcgggaagggactgccagct

SEQ ID NO: 320211 - DNA, 20 bp, human
ggcgctgcccttatttgcgg

SEQ ID NO: 320212 - DNA, 20 bp, human
ggccggcaccggggagctaa

SEQ ID NO: 320213 - DNA, 20 bp, human
gcggagccccggaaaggcgt

SEQ ID NO: 320214 - DNA, 20 bp, human
ggaggtctccgttagctccc

SEQ ID NO: 320215 - DNA, 20 bp, human
gcaagggcggggcaagagtc

SEQ ID NO: 320216 - DNA, 20 bp, human
gccaacctgtcccttggccc

SEQ ID NO: 320217 - DNA, 20 bp, human
ggcaggaaagggccaaccga

SEQ ID NO: 320218 - DNA, 20 bp, human
gctcgccgcgccagggccaa

SEQ ID NO: 320219 - DNA, 20 bp, human
gctgtcccttggccctggcg

SEQ ID NO: 320220 - DNA, 20 bp, human
gcaaagacaaagccgctctg

SEQ ID NO: 320221 - DNA, 20 bp, human
gcacgctataaagcaggaaa

SEQ ID NO: 320222 - DNA, 20 bp, human
gcgtcacagcagccctcggt

SEQ ID NO: 320223 - DNA, 20 bp, human
gtgcaaacctcgccgcgcca

SEQ ID NO: 320224 - DNA, 20 bp, human
gggggcttctagttcggacg

SEQ ID NO: 320225 - DNA, 20 bp, human
gcagaagccccgacgtgtgg

SEQ ID NO: 320226 - DNA, 20 bp, human
ggcgttccccggacataaag

SEQ ID NO: 320227 - DNA, 20 bp, human
gcggcccctcccacgggcgc

SEQ ID NO: 320228 - DNA, 20 bp, human
gaacacgccccctgccgccc

SEQ ID NO: 320229 - DNA, 20 bp, human
gtgggagcagaagttgttct

SEQ ID NO: 320230 - DNA, 20 bp, human
gataaagaggctttgagctc

SEQ ID NO: 320231 - DNA, 20 bp, human
gaggtggtgggtagctgggt

SEQ ID NO: 320232 - DNA, 20 bp, human
ggcagggggcgtgttcctgt

SEQ ID NO: 320233 - DNA, 20 bp, human
ggggacaggatgtgtagact

SEQ ID NO: 320234 - DNA, 20 bp, human
ggggcctggcagcttgcaac

SEQ ID NO: 320235 - DNA, 20 bp, human
gggggaacgcaaggctttct

SEQ ID NO: 320236 - DNA, 20 bp, human
gccaacgcccgaaagcttga

SEQ ID NO: 320237 - DNA, 20 bp, human
gatttaaaatctacactttc

SEQ ID NO: 320238 - DNA, 20 bp, human
gaaatctacactttcaggca

SEQ ID NO: 320239 - DNA, 20 bp, human
gttttaaaatgttggactta

SEQ ID NO: 320240 - DNA, 20 bp, human
gaccctgccccctactcatt

SEQ ID NO: 320241 - DNA, 20 bp, human
gcgtcagcaccaaatgagta

SEQ ID NO: 320242 - DNA, 20 bp, human
gctgctatgtggtacccaga

SEQ ID NO: 320243 - DNA, 20 bp, human
gcctgggtgcaggcaggcta

SEQ ID NO: 320244 - DNA, 20 bp, human
ggagtaactcctctcttctc

SEQ ID NO: 320245 - DNA, 20 bp, human
gcaccaaatgagtagggggc

SEQ ID NO: 320246 - DNA, 20 bp, human
gcagctcgcgggcacccggc

SEQ ID NO: 320247 - DNA, 20 bp, human
ggtacagtaggcatgtatag

SEQ ID NO: 320248 - DNA, 20 bp, human
gcgggcgcgcgggcagctcg

SEQ ID NO: 320249 - DNA, 20 bp, human
gcatggagcggcaatagcgc

SEQ ID NO: 320250 - DNA, 20 bp, human
ggccgctcgcgctcgcaggc

SEQ ID NO: 320251 - DNA, 20 bp, human
gcgagcggccgcggaggctc

SEQ ID NO: 320252 - DNA, 20 bp, human
gcgggcagctcgcgggcacc

SEQ ID NO: 320253 - DNA, 20 bp, human
gggcacgtagagaaccgagg

SEQ ID NO: 320254 - DNA, 20 bp, human
gtctctacgtgcccacgcgg

SEQ ID NO: 320255 - DNA, 20 bp, human
gggtccgcggaggtctgcag

SEQ ID NO: 320256 - DNA, 20 bp, human
gagctcgagcggggtccaga

SEQ ID NO: 320257 - DNA, 20 bp, human
gcaccgaaatacctcttcca

SEQ ID NO: 320258 - DNA, 20 bp, human
gcctctccctcatttgttaa

SEQ ID NO: 320259 - DNA, 20 bp, human
gttccagggcgggttttcgg

SEQ ID NO: 320260 - DNA, 20 bp, human
ggccgcccgcgccgggtctt

SEQ ID NO: 320261 - DNA, 20 bp, human
gtcgagcggggtccagaggg

SEQ ID NO: 320262 - DNA, 20 bp, human
ggggcgcgagcgctgatctc

SEQ ID NO: 320263 - DNA, 20 bp, human
gcgagcgctgatctctgggg

SEQ ID NO: 320264 - DNA, 20 bp, human
gtctctccaaatcagactta

SEQ ID NO: 320265 - DNA, 20 bp, human
gcgccctggaagaggtattt

SEQ ID NO: 320266 - DNA, 20 bp, human
gaggcgggcggcgcgagaga

SEQ ID NO: 320267 - DNA, 20 bp, human
ggaagtgggaggttcggggt

SEQ ID NO: 320268 - DNA, 20 bp, human
gggcactagaccaggacccc

SEQ ID NO: 320269 - DNA, 20 bp, human
ggagcctcccccgacgtctc

SEQ ID NO: 320270 - DNA, 20 bp, human
gtgttgagaagtgggaggtt

SEQ ID NO: 320271 - DNA, 20 bp, human
gaagttggaggaaagagcca

SEQ ID NO: 320272 - DNA, 20 bp, human
gcgggggggtcctgagacgt

SEQ ID NO: 320273 - DNA, 20 bp, human
gggtcctgagacgtcggggg

SEQ ID NO: 320274 - DNA, 20 bp, human
gttgggtgttgagaagtggg

SEQ ID NO: 320275 - DNA, 20 bp, human
gccagctcgggggtgatggg

SEQ ID NO: 320276 - DNA, 20 bp, human
ggagcagcctgaggcgcggg

SEQ ID NO: 320277 - DNA, 20 bp, human
gcgcgggcggtgcgcgggac

SEQ ID NO: 320278 - DNA, 20 bp, human
gtccgcagcgagcccagccg

SEQ ID NO: 320279 - DNA, 20 bp, human
gccggcccggcccgcgcaag

SEQ ID NO: 320280 - DNA, 20 bp, human
ggggagcgagcgcgccaggg

SEQ ID NO: 320281 - DNA, 20 bp, human
ggtgcccggcggacacccac

SEQ ID NO: 320282 - DNA, 20 bp, human
ggtcctgcgggccggggggg

SEQ ID NO: 320283 - DNA, 20 bp, human
gcctgcggcccccccctcgc

SEQ ID NO: 320284 - DNA, 20 bp, human
gccccgggcctccccttgcg

SEQ ID NO: 320285 - DNA, 20 bp, human
ggcgactcggggacaccggc

SEQ ID NO: 320286 - DNA, 20 bp, human
gggcccgccgccaatggccg

SEQ ID NO: 320287 - DNA, 20 bp, human
gggccggggcgggcactccg

SEQ ID NO: 320288 - DNA, 20 bp, human
ggagggacgcgagctggtag

SEQ ID NO: 320289 - DNA, 20 bp, human
gagtggcgccgccgcggagg

SEQ ID NO: 320290 - DNA, 20 bp, human
ggccgtccgagcgcccgcga

SEQ ID NO: 320291 - DNA, 20 bp, human
gagggctggcgccccattcc

SEQ ID NO: 320292 - DNA, 20 bp, human
ggccctcagctccccctccg

SEQ ID NO: 320293 - DNA, 20 bp, human
gggtgcgggcgcggcgattg

SEQ ID NO: 320294 - DNA, 20 bp, human
gcggccgcggccattggcgg

SEQ ID NO: 320295 - DNA, 20 bp, human
gcgccgcggagggggagctg

SEQ ID NO: 320296 - DNA, 20 bp, human
gtggacgtgacatgtgtggc

SEQ ID NO: 320297 - DNA, 20 bp, human
gcggccgccctgacacgtgc

SEQ ID NO: 320298 - DNA, 20 bp, human
gtgtgtctgcgctggaacgc

SEQ ID NO: 320299 - DNA, 20 bp, human
gtgtcagcgtgtgtctgcgc

SEQ ID NO: 320300 - DNA, 20 bp, human
gaacgtgtggccaggcgttc

SEQ ID NO: 320301 - DNA, 20 bp, human
gtgtgctttgtgttcgaagg

SEQ ID NO: 320302 - DNA, 20 bp, human
ggacacacgctgacacgcag

SEQ ID NO: 320303 - DNA, 20 bp, human
gcgcgggccagcacgtgtca

SEQ ID NO: 320304 - DNA, 20 bp, human
gacacacaacccctacacac

SEQ ID NO: 320305 - DNA, 20 bp, human
gacggtgcatgtcagagcgt

SEQ ID NO: 320306 - DNA, 20 bp, human
ggcaatggagcatggggggg

SEQ ID NO: 320307 - DNA, 20 bp, human
gtgcctgatcggaggaaaag

SEQ ID NO: 320308 - DNA, 20 bp, human
gagggatagcaagcagagag

SEQ ID NO: 320309 - DNA, 20 bp, human
gggggagctcgcagattccc

SEQ ID NO: 320310 - DNA, 20 bp, human
gttggtgttctggggaatag

SEQ ID NO: 320311 - DNA, 20 bp, human
ggccggctgccacacacgcc

SEQ ID NO: 320312 - DNA, 20 bp, human
gttctgtgcaatggagcatg

SEQ ID NO: 320313 - DNA, 20 bp, human
gttgagaatccacccaagcc

SEQ ID NO: 320314 - DNA, 20 bp, human
gtcaaaagagttgtgagttg

SEQ ID NO: 320315 - DNA, 20 bp, human
gtcggctttggcagcggcac

SEQ ID NO: 320316 - DNA, 20 bp, human
ggggaagcccgcacttctag

SEQ ID NO: 320317 - DNA, 20 bp, human
gaacgcaggcagcacggagg

SEQ ID NO: 320318 - DNA, 20 bp, human
gcgccccgaagcggccccga

SEQ ID NO: 320319 - DNA, 20 bp, human
ggggcgctcccgaatcccaa

SEQ ID NO: 320320 - DNA, 20 bp, human
ggcagcgggggcgggaggta

SEQ ID NO: 320321 - DNA, 20 bp, human
gccaagggctggagccggta

SEQ ID NO: 320322 - DNA, 20 bp, human
gcccggcaggcgcttcctgg

SEQ ID NO: 320323 - DNA, 20 bp, human
gacacgcgcgcacgcagcgg

SEQ ID NO: 320324 - DNA, 20 bp, human
ggcgaggggcgcgcgttagg

SEQ ID NO: 320325 - DNA, 20 bp, human
ggcaggcccgagcagctgga

SEQ ID NO: 320326 - DNA, 20 bp, human
gggagcccgtagactgtcga

SEQ ID NO: 320327 - DNA, 20 bp, human
gggctcccgctgcttttcag

SEQ ID NO: 320328 - DNA, 20 bp, human
gcccgccctcgcgacgggag

SEQ ID NO: 320329 - DNA, 20 bp, human
ggaggccctcgacagtctac

SEQ ID NO: 320330 - DNA, 20 bp, human
gggcctggaaatgacgccac

SEQ ID NO: 320331 - DNA, 20 bp, human
gagaatccgggaagccccgg

SEQ ID NO: 320332 - DNA, 20 bp, human
gaacccccaccggggcttcc

SEQ ID NO: 320333 - DNA, 20 bp, human
gcagaggtctaggagaatcc

SEQ ID NO: 320334 - DNA, 20 bp, human
gactggccccgccctcgcga

SEQ ID NO: 320335 - DNA, 20 bp, human
ggcccctcccgtcgcgaggg

SEQ ID NO: 320336 - DNA, 20 bp, human
gtccctgcgatgagccacta

SEQ ID NO: 320337 - DNA, 20 bp, human
gaagcctaaaccctgagctg

SEQ ID NO: 320338 - DNA, 20 bp, human
ggaccctagtggctcatcgc

SEQ ID NO: 320339 - DNA, 20 bp, human
gtccctgtccgtgaccctag

SEQ ID NO: 320340 - DNA, 20 bp, human
ggaaccccagctcagggttt

SEQ ID NO: 320341 - DNA, 20 bp, human
gagccactagggtcacggac

SEQ ID NO: 320342 - DNA, 20 bp, human
ggcagagggacaggattaca

SEQ ID NO: 320343 - DNA, 20 bp, human
ggctgcagggaagtaccggg

SEQ ID NO: 320344 - DNA, 20 bp, human
gcgctggctggggatttctc

SEQ ID NO: 320345 - DNA, 20 bp, human
gaggacgcactgtggttagg

SEQ ID NO: 320346 - DNA, 20 bp, human
gtgaggggaactcggggtgt

SEQ ID NO: 320347 - DNA, 20 bp, human
gggaactcggggtgtgggtt

SEQ ID NO: 320348 - DNA, 20 bp, human
ggcacccaaccaggagacac

SEQ ID NO: 320349 - DNA, 20 bp, human
gacacgggttgaggggaact

SEQ ID NO: 320350 - DNA, 20 bp, human
gccaggagacacgggttgag

SEQ ID NO: 320351 - DNA, 20 bp, human
ggatgtgaagtaaaaggtga

SEQ ID NO: 320352 - DNA, 20 bp, human
gggaggagcagcacccaacc

SEQ ID NO: 320353 - DNA, 20 bp, human
gcctcctagacaggggggtg

SEQ ID NO: 320354 - DNA, 20 bp, human
gcaacccgtgtctcctggtt

SEQ ID NO: 320355 - DNA, 20 bp, human
gtgctgctcctcctagacag

SEQ ID NO: 320356 - DNA, 20 bp, human
gcgcccggaaaatgtgggaa

SEQ ID NO: 320357 - DNA, 20 bp, human
gtggtcaggatgcagtacga

SEQ ID NO: 320358 - DNA, 20 bp, human
gaagggcgcccggaaaatgt

SEQ ID NO: 320359 - DNA, 20 bp, human
gaatgggagtggccgtgata

SEQ ID NO: 320360 - DNA, 20 bp, human
gctgaccaatcagagtattc

SEQ ID NO: 320361 - DNA, 20 bp, human
gtcctcccgaatactctgat

SEQ ID NO: 320362 - DNA, 20 bp, human
gtcagcagccatgttggtaa

SEQ ID NO: 320363 - DNA, 20 bp, human
gcgggcgccctttaccaaca

SEQ ID NO: 320364 - DNA, 20 bp, human
ggtggcgtcagcagccatgt

SEQ ID NO: 320365 - DNA, 20 bp, human
gtcaggatgcagtacgaggg

SEQ ID NO: 320366 - DNA, 20 bp, human
gtgggcgcggcggacttggg

SEQ ID NO: 320367 - DNA, 20 bp, human
gggcaccgggctccaagagg

SEQ ID NO: 320368 - DNA, 20 bp, human
ggcgaacgcagtccctgaat

SEQ ID NO: 320369 - DNA, 20 bp, human
gcggactactcagtcccccc

SEQ ID NO: 320370 - DNA, 20 bp, human
gagtccgccgcgcccattca

SEQ ID NO: 320371 - DNA, 20 bp, human
gagtccctgaatgggcgcgg

SEQ ID NO: 320372 - DNA, 20 bp, human
gtcagtccccccgggaagga

SEQ ID NO: 320373 - DNA, 20 bp, human
gagggcccgcccacaggcct

SEQ ID NO: 320374 - DNA, 20 bp, human
gctactcagtccccccggga

SEQ ID NO: 320375 - DNA, 20 bp, human
gtctccctcctcttggagcc

SEQ ID NO: 320376 - DNA, 20 bp, human
gcgtcgcggaaagtgaggaa

SEQ ID NO: 320377 - DNA, 20 bp, human
gaagtcagcgggttggtggg

SEQ ID NO: 320378 - DNA, 20 bp, human
gtggggtggttgctgcagag

SEQ ID NO: 320379 - DNA, 20 bp, human
gcgcgacggtggtggaaagt

SEQ ID NO: 320380 - DNA, 20 bp, human
gcccctcctcgagaagtcaa

SEQ ID NO: 320381 - DNA, 20 bp, human
gaaaaggaaggaaacggcgg

SEQ ID NO: 320382 - DNA, 20 bp, human
gtcaaaacttggatatctgg

SEQ ID NO: 320383 - DNA, 20 bp, human
gttgaagtcagcgggttggt

SEQ ID NO: 320384 - DNA, 20 bp, human
gatttccgggtcaggttcta

SEQ ID NO: 320385 - DNA, 20 bp, human
gaagtcaaaggcctcacccc

SEQ ID NO: 320386 - DNA, 20 bp, human
gcctacgcagagcccgggaa

SEQ ID NO: 320387 - DNA, 20 bp, human
gtgcgtaggcttggagtctg

SEQ ID NO: 320388 - DNA, 20 bp, human
gtcaacgaaggagtgagtca

SEQ ID NO: 320389 - DNA, 20 bp, human
gccgcccctccggaccaaca

SEQ ID NO: 320390 - DNA, 20 bp, human
gggcgggcgcttccggaaag

SEQ ID NO: 320391 - DNA, 20 bp, human
gtccaagcctacgcagagcc

SEQ ID NO: 320392 - DNA, 20 bp, human
gcgaggaggaggacccgctt

SEQ ID NO: 320393 - DNA, 20 bp, human
gcgaccctgttggtccggag

SEQ ID NO: 320394 - DNA, 20 bp, human
gccgggaagggggattccgg

SEQ ID NO: 320395 - DNA, 20 bp, human
gccaacagggtcgcctcacg

SEQ ID NO: 320396 - DNA, 20 bp, human
ggaactgtgaggggcgttac

SEQ ID NO: 320397 - DNA, 20 bp, human
gtggccaagaactacccggt

SEQ ID NO: 320398 - DNA, 20 bp, human
gggaagggcggagacactcc

SEQ ID NO: 320399 - DNA, 20 bp, human
gaggacggaagtgaactgtg

SEQ ID NO: 320400 - DNA, 20 bp, human
gcaagcagagacgcaggtgg

SEQ ID NO: 320401 - DNA, 20 bp, human
gagaggagatggttcagtga

SEQ ID NO: 320402 - DNA, 20 bp, human
gaagaactacccggtcgggg

SEQ ID NO: 320403 - DNA, 20 bp, human
gatggcgcaagcagagacgc

SEQ ID NO: 320404 - DNA, 20 bp, human
ggtcggggcggaacgacatc

SEQ ID NO: 320405 - DNA, 20 bp, human
ggctctgggggtacttgggg

SEQ ID NO: 320406 - DNA, 20 bp, human
gcggctccgcccagaccgac

SEQ ID NO: 320407 - DNA, 20 bp, human
ggggcaggcaaacaaccggt

SEQ ID NO: 320408 - DNA, 20 bp, human
gtgaagggcaggcaaacaac

SEQ ID NO: 320409 - DNA, 20 bp, human
ggcaaacaaccggtcggtct

SEQ ID NO: 320410 - DNA, 20 bp, human
gaacaaccggtcggtctggg

SEQ ID NO: 320411 - DNA, 20 bp, human
ggtcggggtttcccggtgaa

SEQ ID NO: 320412 - DNA, 20 bp, human
gccggccattggcggtgccc

SEQ ID NO: 320413 - DNA, 20 bp, human
gggaggcgggagtcagtgga

SEQ ID NO: 320414 - DNA, 20 bp, human
gactggaaatcggacgcatc

SEQ ID NO: 320415 - DNA, 20 bp, human
gggaaatcggacgcatccgg

SEQ ID NO: 320416 - DNA, 20 bp, human
gtcttggagccggccctcga

SEQ ID NO: 320417 - DNA, 20 bp, human
gaggggaatgtccgggactc

SEQ ID NO: 320418 - DNA, 20 bp, human
gactcgggtcggtacctttt

SEQ ID NO: 320419 - DNA, 20 bp, human
gtcccggacattcccctcga

SEQ ID NO: 320420 - DNA, 20 bp, human
ggcaacccggttcgaaagag

SEQ ID NO: 320421 - DNA, 20 bp, human
gctttcgaaccgggttgcgt

SEQ ID NO: 320422 - DNA, 20 bp, human
gcctcagtgcccacgcaacc

SEQ ID NO: 320423 - DNA, 20 bp, human
gtgaaagcgaacgctataaa

SEQ ID NO: 320424 - DNA, 20 bp, human
ggaatgtccgggactcgggt

SEQ ID NO: 320425 - DNA, 20 bp, human
gctccactctagtgaggacg

SEQ ID NO: 320426 - DNA, 20 bp, human
ggagagcggagggtcggcga

SEQ ID NO: 320427 - DNA, 20 bp, human
ggctcgggagagcggagggt

SEQ ID NO: 320428 - DNA, 20 bp, human
gcggctgggcctggggatgc

SEQ ID NO: 320429 - DNA, 20 bp, human
ggcaaagacaggcactgtct

SEQ ID NO: 320430 - DNA, 20 bp, human
gggctgcagcacaaagacgg

SEQ ID NO: 320431 - DNA, 20 bp, human
gtgggcctgcgcggcggaag

SEQ ID NO: 320432 - DNA, 20 bp, human
gcggcgagggtgcctgcgcg

SEQ ID NO: 320433 - DNA, 20 bp, human
gtcgctcccgcaaggagtct

SEQ ID NO: 320434 - DNA, 20 bp, human
gctccaggacccgcccgctg

SEQ ID NO: 320435 - DNA, 20 bp, human
gaactcggaagcacaggctg

SEQ ID NO: 320436 - DNA, 20 bp, human
gcaagggctcaggggaagta

SEQ ID NO: 320437 - DNA, 20 bp, human
gcggggccggaacgcgaaga

SEQ ID NO: 320438 - DNA, 20 bp, human
gcccgcgagcgaggtgaggt

SEQ ID NO: 320439 - DNA, 20 bp, human
gggccggaacgcgaagaggg

SEQ ID NO: 320440 - DNA, 20 bp, human
gagtcgggcggggacggaag

SEQ ID NO: 320441 - DNA, 20 bp, human
ggggcggggacggaagcggt

SEQ ID NO: 320442 - DNA, 20 bp, human
ggggacggaagcggtaggct

SEQ ID NO: 320443 - DNA, 20 bp, human
ggctccggaagcgattcatc

SEQ ID NO: 320444 - DNA, 20 bp, human
gcggccaccggcatctgcgg

SEQ ID NO: 320445 - DNA, 20 bp, human
gtcacggaaaacgacgggga

SEQ ID NO: 320446 - DNA, 20 bp, human
gggaccgcccgcagccggta

SEQ ID NO: 320447 - DNA, 20 bp, human
gctgctgcggataagtgcgg

SEQ ID NO: 320448 - DNA, 20 bp, human
ggtcctgctgcggataagtg

SEQ ID NO: 320449 - DNA, 20 bp, human
gccccggcctctcttggtca

SEQ ID NO: 320450 - DNA, 20 bp, human
ggcaaacgggaaaggttccc

SEQ ID NO: 320451 - DNA, 20 bp, human
ggcgtcaccctgaccaagag

SEQ ID NO: 320452 - DNA, 20 bp, human
gcgcccgcagccggtagggt

SEQ ID NO: 320453 - DNA, 20 bp, human
gcggctgcgcagatctttcg

SEQ ID NO: 320454 - DNA, 20 bp, human
gcaccctgaccaagagaggc

SEQ ID NO: 320455 - DNA, 20 bp, human
gtgggaagagcccaccctac

SEQ ID NO: 320456 - DNA, 20 bp, human
ggcaacaatcgcaggaggga

SEQ ID NO: 320457 - DNA, 20 bp, human
gtcgggctgcgcaacctctg

SEQ ID NO: 320458 - DNA, 20 bp, human
gagacgcgccaggtgtcggg

SEQ ID NO: 320459 - DNA, 20 bp, human
gcgaacgcgccacacagatt

SEQ ID NO: 320460 - DNA, 20 bp, human
gaagtccggggcacgtgacc

SEQ ID NO: 320461 - DNA, 20 bp, human
ggatagacgcgccaggtgtc

SEQ ID NO: 320462 - DNA, 20 bp, human
gtgcgcagcccgaatctgtg

SEQ ID NO: 320463 - DNA, 20 bp, human
gggaggaggagactagtagc

SEQ ID NO: 320464 - DNA, 20 bp, human
ggaggagactagtagctgga

SEQ ID NO: 320465 - DNA, 20 bp, human
gtcgcggcgccggaagtccg

SEQ ID NO: 320466 - DNA, 20 bp, human
gcacgggccgcttccttatc

SEQ ID NO: 320467 - DNA, 20 bp, human
gcgcctgcgctggcccgaac

SEQ ID NO: 320468 - DNA, 20 bp, human
ggaggggtcgaaggtcatag

SEQ ID NO: 320469 - DNA, 20 bp, human
gccggcgtgctctggggcta

SEQ ID NO: 320470 - DNA, 20 bp, human
gcgggagttgtagttcccaa

SEQ ID NO: 320471 - DNA, 20 bp, human
gctggcccgaacaggccttt

SEQ ID NO: 320472 - DNA, 20 bp, human
gggcgactgcgtggcagcac

SEQ ID NO: 320473 - DNA, 20 bp, human
gaaaccccaagcgcctgcgc

SEQ ID NO: 320474 - DNA, 20 bp, human
gtaaagtgcgggggttgggt

SEQ ID NO: 320475 - DNA, 20 bp, human
gggaggcgggcgggtccgga

SEQ ID NO: 320476 - DNA, 20 bp, human
gtggccacttggaaaggggt

SEQ ID NO: 320477 - DNA, 20 bp, human
gggtgtcaaagcgggaaggt

SEQ ID NO: 320478 - DNA, 20 bp, human
ggggtgggcagctggcaaag

SEQ ID NO: 320479 - DNA, 20 bp, human
gactgggggtggtgtcaaag

SEQ ID NO: 320480 - DNA, 20 bp, human
ggcggctggagcctctgatt

SEQ ID NO: 320481 - DNA, 20 bp, human
gccgcaggggtgtgtcctag

SEQ ID NO: 320482 - DNA, 20 bp, human
gtgcgcgttgctcctccgaa

SEQ ID NO: 320483 - DNA, 20 bp, human
ggatcgccccaccccttcgg

SEQ ID NO: 320484 - DNA, 20 bp, human
gaacccgaacaaaggggaat

SEQ ID NO: 320485 - DNA, 20 bp, human
gctagtggccacttggaaag

SEQ ID NO: 320486 - DNA, 20 bp, human
gggaagcggcccgcggcgga

SEQ ID NO: 320487 - DNA, 20 bp, human
gtggagacgggagccaacca

SEQ ID NO: 320488 - DNA, 20 bp, human
gggaggcctcacaggaacgc

SEQ ID NO: 320489 - DNA, 20 bp, human
gcaaacagccgattggagac

SEQ ID NO: 320490 - DNA, 20 bp, human
gagaggagcggcatccggag

SEQ ID NO: 320491 - DNA, 20 bp, human
gtgtttggttggacagaaaa

SEQ ID NO: 320492 - DNA, 20 bp, human
gaggcccgcctagacccgaa

SEQ ID NO: 320493 - DNA, 20 bp, human
gggaggtttgtgtctcgctt

SEQ ID NO: 320494 - DNA, 20 bp, human
gcgccgcgggccgcttccct

SEQ ID NO: 320495 - DNA, 20 bp, human
gcctcacaggaacgcgggac

SEQ ID NO: 320496 - DNA, 20 bp, human
ggggaaggggcgacgacaga

SEQ ID NO: 320497 - DNA, 20 bp, human
gaaggggcgacgacagaggg

SEQ ID NO: 320498 - DNA, 20 bp, human
ggtctcgcgagaattgggaa

SEQ ID NO: 320499 - DNA, 20 bp, human
gcctccggatcccccgaaag

SEQ ID NO: 320500 - DNA, 20 bp, human
gatctcgagctcccgaaagg

SEQ ID NO: 320501 - DNA, 20 bp, human
gcagatctcgagctcccgaa

SEQ ID NO: 320502 - DNA, 20 bp, human
gagtccaggcgccaagggag

SEQ ID NO: 320503 - DNA, 20 bp, human
gtctgcgcaccgcacgatac

SEQ ID NO: 320504 - DNA, 20 bp, human
gttgaggtctcgcgagaatt

SEQ ID NO: 320505 - DNA, 20 bp, human
gacaaggataggcagggtgg

SEQ ID NO: 320506 - DNA, 20 bp, human
gaacgtaactgacatcgcgg

SEQ ID NO: 320507 - DNA, 20 bp, human
gctccctccgccagccgcta

SEQ ID NO: 320508 - DNA, 20 bp, human
gcgcatgcagcgcctacctg

SEQ ID NO: 320509 - DNA, 20 bp, human
gcagaacgtaactgacatcg

SEQ ID NO: 320510 - DNA, 20 bp, human
gtgacatcgcggaggctctc

SEQ ID NO: 320511 - DNA, 20 bp, human
gggccagggtggaatcttga

SEQ ID NO: 320512 - DNA, 20 bp, human
gcgcgccttgctggcctgga

SEQ ID NO: 320513 - DNA, 20 bp, human
gcacagtgccctcggggctc

SEQ ID NO: 320514 - DNA, 20 bp, human
ggggcaccagcacacgttgg

SEQ ID NO: 320515 - DNA, 20 bp, human
gctggcaatgcgtgagttga

SEQ ID NO: 320516 - DNA, 20 bp, human
gttggcaaagagcgtgtgat

SEQ ID NO: 320517 - DNA, 20 bp, human
gcgagaggaggagtctgatc

SEQ ID NO: 320518 - DNA, 20 bp, human
gagaaagcccttattcgtat

SEQ ID NO: 320519 - DNA, 20 bp, human
gccccaacaggataaacgag

SEQ ID NO: 320520 - DNA, 20 bp, human
gcaacaggataaacgagagg

SEQ ID NO: 320521 - DNA, 20 bp, human
gcaggacgaaaaaaagcact

SEQ ID NO: 320522 - DNA, 20 bp, human
gagactcagaaagagtcgtc

SEQ ID NO: 320523 - DNA, 20 bp, human
gcgctcaggaagtacgacac

SEQ ID NO: 320524 - DNA, 20 bp, human
gaggaagtacgacaccggaa

SEQ ID NO: 320525 - DNA, 20 bp, human
gaggagtctgatctggccaa

SEQ ID NO: 320526 - DNA, 20 bp, human
ggccgtgccccgacccggag

SEQ ID NO: 320527 - DNA, 20 bp, human
ggctctgcccctctccgggt

SEQ ID NO: 320528 - DNA, 20 bp, human
gggtcggggcacggcggcgc

SEQ ID NO: 320529 - DNA, 20 bp, human
ggcaggccccagcccgcagt

SEQ ID NO: 320530 - DNA, 20 bp, human
gccccgcgagcgccgactgc

SEQ ID NO: 320531 - DNA, 20 bp, human
gcccgggctgggcgcgaccc

SEQ ID NO: 320532 - DNA, 20 bp, human
gcggaggtctgcgggcactg

SEQ ID NO: 320533 - DNA, 20 bp, human
ggcggagactggggtctcag

SEQ ID NO: 320534 - DNA, 20 bp, human
gaccctgcgggagaccgcag

SEQ ID NO: 320535 - DNA, 20 bp, human
gaggcaaaggcgcagctcca

SEQ ID NO: 320536 - DNA, 20 bp, human
gaccagccccgcacctgctg

SEQ ID NO: 320537 - DNA, 20 bp, human
gcagacggatcgctcctgga

SEQ ID NO: 320538 - DNA, 20 bp, human
gaaacccactggggtctgag

SEQ ID NO: 320539 - DNA, 20 bp, human
ggggcagggcggagaggtga

SEQ ID NO: 320540 - DNA, 20 bp, human
gactacagacggatcgctcc

SEQ ID NO: 320541 - DNA, 20 bp, human
gcggcccctcagaccccagt

SEQ ID NO: 320542 - DNA, 20 bp, human
gaggtcaaagggaaacccac

SEQ ID NO: 320543 - DNA, 20 bp, human
gcgcgcgcgcaaagccggga

SEQ ID NO: 320544 - DNA, 20 bp, human
gtgtgactcaggagtacggg

SEQ ID NO: 320545 - DNA, 20 bp, human
gcccagggggagctccgcga

SEQ ID NO: 320546 - DNA, 20 bp, human
gccgccctgccgcctcgggg

SEQ ID NO: 320547 - DNA, 20 bp, human
gtgagaggctctaagggaca

SEQ ID NO: 320548 - DNA, 20 bp, human
gcgggcgggcgcggttccgg

SEQ ID NO: 320549 - DNA, 20 bp, human
ggggccgggaactgggtacc

SEQ ID NO: 320550 - DNA, 20 bp, human
ggggaactgggtaccagggc

SEQ ID NO: 320551 - DNA, 20 bp, human
gggtgggaagcagaggcaaa

SEQ ID NO: 320552 - DNA, 20 bp, human
ggatgggtgagaggctctaa

SEQ ID NO: 320553 - DNA, 20 bp, human
ggaccagggcgtccccactg

SEQ ID NO: 320554 - DNA, 20 bp, human
ggacggacgcgcagtagcgc

SEQ ID NO: 320555 - DNA, 20 bp, human
gtccccgggcccacagcatc

SEQ ID NO: 320556 - DNA, 20 bp, human
ggagcacggaaagggccggg

SEQ ID NO: 320557 - DNA, 20 bp, human
gcctgcagtcgagccggggt

SEQ ID NO: 320558 - DNA, 20 bp, human
gcatgcagacgggagtaggg

SEQ ID NO: 320559 - DNA, 20 bp, human
ggatggctgtgcacacgcaa

SEQ ID NO: 320560 - DNA, 20 bp, human
gacctcatgcagacgggagt

SEQ ID NO: 320561 - DNA, 20 bp, human
gctggggcacctcatgcaga

SEQ ID NO: 320562 - DNA, 20 bp, human
gcactggccgcccaagttgg

SEQ ID NO: 320563 - DNA, 20 bp, human
gtgacagggctgtgcgctct

SEQ ID NO: 320564 - DNA, 20 bp, human
gccaaggcctgaagtgagag

SEQ ID NO: 320565 - DNA, 20 bp, human
gtgcatatggcggtggcggg

SEQ ID NO: 320566 - DNA, 20 bp, human
gctaccgcagccaccggcag

SEQ ID NO: 320567 - DNA, 20 bp, human
ggggctgttcggaagaaggt

SEQ ID NO: 320568 - DNA, 20 bp, human
gtacggctgccccttcgcgg

SEQ ID NO: 320569 - DNA, 20 bp, human
gtggtcgtacaggttgggaa

SEQ ID NO: 320570 - DNA, 20 bp, human
gagttggggcctggtcgtac

SEQ ID NO: 320571 - DNA, 20 bp, human
gccgcagccaccggcagggg

SEQ ID NO: 320572 - DNA, 20 bp, human
gggccaggagcgggggagct

SEQ ID NO: 320573 - DNA, 20 bp, human
gacgaccaggccccaactct

SEQ ID NO: 320574 - DNA, 20 bp, human
ggccccttcgcggggggcaa

SEQ ID NO: 320575 - DNA, 20 bp, human
gcggggggcaaggggctgtt

SEQ ID NO: 320576 - DNA, 20 bp, human
gaagccctctccacagttac

SEQ ID NO: 320577 - DNA, 20 bp, human
gaaacgtgagggccgaaatg

SEQ ID NO: 320578 - DNA, 20 bp, human
gggtaagaccggaagtggaa

SEQ ID NO: 320579 - DNA, 20 bp, human
ggggcttccctgaaacgtga

SEQ ID NO: 320580 - DNA, 20 bp, human
gttacccccaccaagtgaag

SEQ ID NO: 320581 - DNA, 20 bp, human
gctgtctccgccacctcggt

SEQ ID NO: 320582 - DNA, 20 bp, human
gggaagtagccgggtaagac

SEQ ID NO: 320583 - DNA, 20 bp, human
gcgaggtggcggagacaggc

SEQ ID NO: 320584 - DNA, 20 bp, human
gtctgcctgtaactgtggag

SEQ ID NO: 320585 - DNA, 20 bp, human
gagccgggtaagaccggaag

SEQ ID NO: 320586 - DNA, 20 bp, human
gagaccggataggtagggga

SEQ ID NO: 320587 - DNA, 20 bp, human
ggggcagccggctagtagaa

SEQ ID NO: 320588 - DNA, 20 bp, human
gaggagcgccccagtggcca

SEQ ID NO: 320589 - DNA, 20 bp, human
gccggctagtagaagggtag

SEQ ID NO: 320590 - DNA, 20 bp, human
ggccagggtaagtggaggag

SEQ ID NO: 320591 - DNA, 20 bp, human
gctcctctcatcagtgtccc

SEQ ID NO: 320592 - DNA, 20 bp, human
gcaggggcggggcctatgcc

SEQ ID NO: 320593 - DNA, 20 bp, human
ggcgcgtcttggagtcacgc

SEQ ID NO: 320594 - DNA, 20 bp, human
ggcctctcctccacttaccc

SEQ ID NO: 320595 - DNA, 20 bp, human
gaccctgcctcctcttgcgg

SEQ ID NO: 320596 - DNA, 20 bp, human
gccagccaatggagagctgg

SEQ ID NO: 320597 - DNA, 20 bp, human
gcacacccccagctctccat

SEQ ID NO: 320598 - DNA, 20 bp, human
gtcacgctgggactccgaat

SEQ ID NO: 320599 - DNA, 20 bp, human
gagggatctgggaacccctc

SEQ ID NO: 320600 - DNA, 20 bp, human
gtgggaacccctcgggagct

SEQ ID NO: 320601 - DNA, 20 bp, human
ggactgagggggttcatctg

SEQ ID NO: 320602 - DNA, 20 bp, human
ggggactccgaatggggcca

SEQ ID NO: 320603 - DNA, 20 bp, human
gagaggctcccagcaagcta

SEQ ID NO: 320604 - DNA, 20 bp, human
gggggctggggcgagagcca

SEQ ID NO: 320605 - DNA, 20 bp, human
ggggctgtccaagtcacgct

SEQ ID NO: 320606 - DNA, 20 bp, human
gtggacatgagtcacttaat

SEQ ID NO: 320607 - DNA, 20 bp, human
gacggctagatactgtttag

SEQ ID NO: 320608 - DNA, 20 bp, human
ggagataaaggcttaggaag

SEQ ID NO: 320609 - DNA, 20 bp, human
gtttatggcacagattcagt

SEQ ID NO: 320610 - DNA, 20 bp, human
gaagagaaatagcctgacta

SEQ ID NO: 320611 - DNA, 20 bp, human
gttgacatctgtcacagtgt

SEQ ID NO: 320612 - DNA, 20 bp, human
ggactatcaaagaattcccc

SEQ ID NO: 320613 - DNA, 20 bp, human
gacagtatctagccgtagtc

SEQ ID NO: 320614 - DNA, 20 bp, human
gatcctattggacagaaacc

SEQ ID NO: 320615 - DNA, 20 bp, human
gtggctttgtaatatgccag

SEQ ID NO: 320616 - DNA, 20 bp, human
gtgccgcgcgtgcccaccaa

SEQ ID NO: 320617 - DNA, 20 bp, human
gcccgcggcgctcgacgtca

SEQ ID NO: 320618 - DNA, 20 bp, human
ggcgcggcactgtttcctga

SEQ ID NO: 320619 - DNA, 20 bp, human
gacagtcatggtcacggggt

SEQ ID NO: 320620 - DNA, 20 bp, human
ggcagcagatcgcagtgcag

SEQ ID NO: 320621 - DNA, 20 bp, human
gcggtcacagtcatggtcac

SEQ ID NO: 320622 - DNA, 20 bp, human
ggcgatctgctgccccttgg

SEQ ID NO: 320623 - DNA, 20 bp, human
ggcacccgggctggaagatt

SEQ ID NO: 320624 - DNA, 20 bp, human
gtgactgctgtgacgattac

SEQ ID NO: 320625 - DNA, 20 bp, human
gtcggtcacggtcacagtca

SEQ ID NO: 320626 - DNA, 20 bp, human
ggcggcgtggggaccgaaaa

SEQ ID NO: 320627 - DNA, 20 bp, human
gaagaccctaaaggtaaagc

SEQ ID NO: 320628 - DNA, 20 bp, human
gcgtggggaccgaaaagggg

SEQ ID NO: 320629 - DNA, 20 bp, human
gctgccactcggcaccccaa

SEQ ID NO: 320630 - DNA, 20 bp, human
gcctacccgctttaccttta

SEQ ID NO: 320631 - DNA, 20 bp, human
ggggcggtgagggtccttga

SEQ ID NO: 320632 - DNA, 20 bp, human
gtgccagtgccgtgtcgaat

SEQ ID NO: 320633 - DNA, 20 bp, human
gaattcccaatgtggagggt

SEQ ID NO: 320634 - DNA, 20 bp, human
gccaaatcggcgcagttccc

SEQ ID NO: 320635 - DNA, 20 bp, human
gagcgtcccagaggcgctaa

SEQ ID NO: 320636 - DNA, 20 bp, human
gtcagacacgaggtatggtg

SEQ ID NO: 320637 - DNA, 20 bp, human
gggtcctggtgtgggaatat

SEQ ID NO: 320638 - DNA, 20 bp, human
gaataaatggcgagcgatta

SEQ ID NO: 320639 - DNA, 20 bp, human
gcacactcagacacgaggta

SEQ ID NO: 320640 - DNA, 20 bp, human
gccgcgccgctgactttcag

SEQ ID NO: 320641 - DNA, 20 bp, human
gggaatataggcatccatag

SEQ ID NO: 320642 - DNA, 20 bp, human
gacagcccccaccagctcat

SEQ ID NO: 320643 - DNA, 20 bp, human
gtctacgggcgcccatactt

SEQ ID NO: 320644 - DNA, 20 bp, human
gggtggccactgaaagtcag

SEQ ID NO: 320645 - DNA, 20 bp, human
gagcgattaaggcatatcta

SEQ ID NO: 320646 - DNA, 20 bp, human
gcagcatggggagtcctcag

SEQ ID NO: 320647 - DNA, 20 bp, human
gggacgtgggaatagtgtcc

SEQ ID NO: 320648 - DNA, 20 bp, human
gggcaggaacaccacagcat

SEQ ID NO: 320649 - DNA, 20 bp, human
gtgcctccgcgccttgttgc

SEQ ID NO: 320650 - DNA, 20 bp, human
gagctgggccgggtggagga

SEQ ID NO: 320651 - DNA, 20 bp, human
gccagctgcgtccctgccag

SEQ ID NO: 320652 - DNA, 20 bp, human
gggagggagagtgcagtctc

SEQ ID NO: 320653 - DNA, 20 bp, human
gagcctgcaacaaggcgcgg

SEQ ID NO: 320654 - DNA, 20 bp, human
ggggtgggctgcatggcatc

SEQ ID NO: 320655 - DNA, 20 bp, human
gacccccaagcagggtcctt

SEQ ID NO: 320656 - DNA, 20 bp, human
gaagctgggcgtcaacgatt

SEQ ID NO: 320657 - DNA, 20 bp, human
gggactgggcggaaccgatt

SEQ ID NO: 320658 - DNA, 20 bp, human
gtaactacggagagcggaga

SEQ ID NO: 320659 - DNA, 20 bp, human
ggcggagcggagggaatgtg

SEQ ID NO: 320660 - DNA, 20 bp, human
gtgggcggaaccgattaggg

SEQ ID NO: 320661 - DNA, 20 bp, human
gcggagggaatgtgaggcaa

SEQ ID NO: 320662 - DNA, 20 bp, human
gcagtcccttggtccgggga

SEQ ID NO: 320663 - DNA, 20 bp, human
gggggccatccccggaccaa

SEQ ID NO: 320664 - DNA, 20 bp, human
gggggctctgggtgctggaa

SEQ ID NO: 320665 - DNA, 20 bp, human
gggcggagccctgggaatcg

SEQ ID NO: 320666 - DNA, 20 bp, human
gccgccctctacgggggcac

SEQ ID NO: 320667 - DNA, 20 bp, human
gtgacgctacgcgagcgagt

SEQ ID NO: 320668 - DNA, 20 bp, human
gggggcactggcgcggaaac

SEQ ID NO: 320669 - DNA, 20 bp, human
gcgcgccagtgcccccgtag

SEQ ID NO: 320670 - DNA, 20 bp, human
gactggccctgtgtcgaaga

SEQ ID NO: 320671 - DNA, 20 bp, human
gacagaagcagcagcggaaa

SEQ ID NO: 320672 - DNA, 20 bp, human
gtcgaagaaggaacgtactt

SEQ ID NO: 320673 - DNA, 20 bp, human
gtacgttccttcttcgacac

SEQ ID NO: 320674 - DNA, 20 bp, human
gcagaagcactcgcgtgcac

SEQ ID NO: 320675 - DNA, 20 bp, human
gcagcggaaatggccccgcg

SEQ ID NO: 320676 - DNA, 20 bp, human
gaggccgcgcgggggtgacg

SEQ ID NO: 320677 - DNA, 20 bp, human
ggggtgacggggcggacgca

SEQ ID NO: 320678 - DNA, 20 bp, human
gtgacggggcggacgcaggg

SEQ ID NO: 320679 - DNA, 20 bp, human
gcggggaggaggtttcggaa

SEQ ID NO: 320680 - DNA, 20 bp, human
ggactcccagcggccgcaca

SEQ ID NO: 320681 - DNA, 20 bp, human
gcagcgccctgtgcggccgc

SEQ ID NO: 320682 - DNA, 20 bp, human
ggggggcgcagcgccctgtg

SEQ ID NO: 320683 - DNA, 20 bp, human
gcgcctgaacgcgcccagca

SEQ ID NO: 320684 - DNA, 20 bp, human
gagtcctcaagttgggagta

SEQ ID NO: 320685 - DNA, 20 bp, human
gggccaccagtgactcccag

SEQ ID NO: 320686 - DNA, 20 bp, human
gtgaggcagaaagcctgatg

SEQ ID NO: 320687 - DNA, 20 bp, human
gtttcagcgcacgatgtcac

SEQ ID NO: 320688 - DNA, 20 bp, human
ggcagagcctggggcgtggt

SEQ ID NO: 320689 - DNA, 20 bp, human
gtactgaaacctaatcttta

SEQ ID NO: 320690 - DNA, 20 bp, human
gcataggggcctaatgaaat

SEQ ID NO: 320691 - DNA, 20 bp, human
gaagtctgcactatttttgt

SEQ ID NO: 320692 - DNA, 20 bp, human
ggctctgcctccgataccaa

SEQ ID NO: 320693 - DNA, 20 bp, human
gtagtgcagactttcctcta

SEQ ID NO: 320694 - DNA, 20 bp, human
gaaaagatctgggtgttcat

SEQ ID NO: 320695 - DNA, 20 bp, human
gtttgcatgacagccacatc

SEQ ID NO: 320696 - DNA, 20 bp, human
gaacggtgactgctaacccc

SEQ ID NO: 320697 - DNA, 20 bp, human
gcccttgggctgatctgcac

SEQ ID NO: 320698 - DNA, 20 bp, human
gcccctttcaagatgattgc

SEQ ID NO: 320699 - DNA, 20 bp, human
gtgaagagctgcatccgctg

SEQ ID NO: 320700 - DNA, 20 bp, human
gaacaaatgggctcgccctt

SEQ ID NO: 320701 - DNA, 20 bp, human
gctgcactggactatatgaa

SEQ ID NO: 320702 - DNA, 20 bp, human
ggacacctccctatctctcc

SEQ ID NO: 320703 - DNA, 20 bp, human
gtaacccaggagagataggg

SEQ ID NO: 320704 - DNA, 20 bp, human
gagccagcgcctgttactcc

SEQ ID NO: 320705 - DNA, 20 bp, human
ggggagcatgtgaacagaaa

SEQ ID NO: 320706 - DNA, 20 bp, human
gcgagctggagcgtgaaaga

SEQ ID NO: 320707 - DNA, 20 bp, human
gtgaggggggacgtaaggta

SEQ ID NO: 320708 - DNA, 20 bp, human
gcccggcgaagcagagtcag

SEQ ID NO: 320709 - DNA, 20 bp, human
gttaacgcttgatccgggag

SEQ ID NO: 320710 - DNA, 20 bp, human
gccgaagtagcagagctagg

SEQ ID NO: 320711 - DNA, 20 bp, human
gtggagctcctcaggaggac

SEQ ID NO: 320712 - DNA, 20 bp, human
gtacccgctggtgtgggcgc

SEQ ID NO: 320713 - DNA, 20 bp, human
gagaaggaatgtctgcgtga

SEQ ID NO: 320714 - DNA, 20 bp, human
gtagagcgccggctcccccg

SEQ ID NO: 320715 - DNA, 20 bp, human
gccctctgactctgcttcgc

SEQ ID NO: 320716 - DNA, 20 bp, human
gaatcaccgaagctcaggat

SEQ ID NO: 320717 - DNA, 20 bp, human
gcggctgaggatgccgggaa

SEQ ID NO: 320718 - DNA, 20 bp, human
gaccgaagctcaggatcggc

SEQ ID NO: 320719 - DNA, 20 bp, human
gcagccaatcaccgaagctc

SEQ ID NO: 320720 - DNA, 20 bp, human
gaaacccaaagggagccgaa

SEQ ID NO: 320721 - DNA, 20 bp, human
gctcaggatcggccgggagt

SEQ ID NO: 320722 - DNA, 20 bp, human
gcgggagtcggaagtgcctg

SEQ ID NO: 320723 - DNA, 20 bp, human
gggctgaagaagaacttcag

SEQ ID NO: 320724 - DNA, 20 bp, human
gtggctgggctggccgtacg

SEQ ID NO: 320725 - DNA, 20 bp, human
gcccggccgatcctgagctt

SEQ ID NO: 320726 - DNA, 20 bp, human
ggcgccgcggggcagcccaa

SEQ ID NO: 320727 - DNA, 20 bp, human
gcagcccaatggccgcgagg

SEQ ID NO: 320728 - DNA, 20 bp, human
gagggccccgccccgtccag

SEQ ID NO: 320729 - DNA, 20 bp, human
gcaccccgggaaatagggga

SEQ ID NO: 320730 - DNA, 20 bp, human
ggcgcgcccgctggacgggg

SEQ ID NO: 320731 - DNA, 20 bp, human
gccgcggcgcgcccgctgga

SEQ ID NO: 320732 - DNA, 20 bp, human
gaacctcccgccttgggcgc

SEQ ID NO: 320733 - DNA, 20 bp, human
gcaccggcgcccaaggcggg

SEQ ID NO: 320734 - DNA, 20 bp, human
gcctccccctcgcggccatt

SEQ ID NO: 320735 - DNA, 20 bp, human
gcggccattgggctgccccg

SEQ ID NO: 320736 - DNA, 20 bp, human
gtggctgaggccctcggctg

SEQ ID NO: 320737 - DNA, 20 bp, human
ggcccacccagcaagctaat

SEQ ID NO: 320738 - DNA, 20 bp, human
gcaggcgcccgcggagatcc

SEQ ID NO: 320739 - DNA, 20 bp, human
gcaccggctctgagaaagtt

SEQ ID NO: 320740 - DNA, 20 bp, human
gctctgagaaagttcggcag

SEQ ID NO: 320741 - DNA, 20 bp, human
gctggcgcggcgcggagagt

SEQ ID NO: 320742 - DNA, 20 bp, human
gaaccccgcagcggcgagtg

SEQ ID NO: 320743 - DNA, 20 bp, human
gccagcaagctaattggctg

SEQ ID NO: 320744 - DNA, 20 bp, human
gctcgaacctggatctccgc

SEQ ID NO: 320745 - DNA, 20 bp, human
gaggagcgcccgggacccca

SEQ ID NO: 320746 - DNA, 20 bp, human
gactcggctgccaaacggaa

SEQ ID NO: 320747 - DNA, 20 bp, human
gtccccgtagcgggagagct

SEQ ID NO: 320748 - DNA, 20 bp, human
gcggagcgccgacgcgggac

SEQ ID NO: 320749 - DNA, 20 bp, human
gccgcccagctctcccgcta

SEQ ID NO: 320750 - DNA, 20 bp, human
gggaagtggtcctttccgtt

SEQ ID NO: 320751 - DNA, 20 bp, human
ggcacttggctccccgtagc

SEQ ID NO: 320752 - DNA, 20 bp, human
gttccgggactggtgagtag

SEQ ID NO: 320753 - DNA, 20 bp, human
gaaggggcgttctctctctt

SEQ ID NO: 320754 - DNA, 20 bp, human
ggtcacttccggtcccgcgt

SEQ ID NO: 320755 - DNA, 20 bp, human
ggcccactactcaccagtcc

SEQ ID NO: 320756 - DNA, 20 bp, human
gggcacgaggcgtacgtcgg

SEQ ID NO: 320757 - DNA, 20 bp, human
gacacccagtgcagtcgctc

SEQ ID NO: 320758 - DNA, 20 bp, human
gcagtgcagtcgctcgggga

SEQ ID NO: 320759 - DNA, 20 bp, human
gtcacccggaggagctgtca

SEQ ID NO: 320760 - DNA, 20 bp, human
gcagctacacggccgaaagc

SEQ ID NO: 320761 - DNA, 20 bp, human
gggttccagcgcttcagcaa

SEQ ID NO: 320762 - DNA, 20 bp, human
gcctccgggtgagtcgggca

SEQ ID NO: 320763 - DNA, 20 bp, human
gcggcgtccgggtgcactac

SEQ ID NO: 320764 - DNA, 20 bp, human
gcccggaggagctgtcacgg

SEQ ID NO: 320765 - DNA, 20 bp, human
gcggcctggaccttgtaagc

SEQ ID NO: 320766 - DNA, 20 bp, human
gcgggagggcgcgtctgcga

SEQ ID NO: 320767 - DNA, 20 bp, human
gggcgcgtctgcgagggctc

SEQ ID NO: 320768 - DNA, 20 bp, human
gcacccggagctctggacgc

SEQ ID NO: 320769 - DNA, 20 bp, human
gtctggacgccggggaggaa

SEQ ID NO: 320770 - DNA, 20 bp, human
gctccgggtgcgggtgtagg

SEQ ID NO: 320771 - DNA, 20 bp, human
ggggctccgggtgcgggtgt

SEQ ID NO: 320772 - DNA, 20 bp, human
gagcgccagccccagctcgg

SEQ ID NO: 320773 - DNA, 20 bp, human
gaggaagggccgggcccgcg

SEQ ID NO: 320774 - DNA, 20 bp, human
ggggtcgcgctcgctctaca

SEQ ID NO: 320775 - DNA, 20 bp, human
ggcgcggctcaggcagcgga

SEQ ID NO: 320776 - DNA, 20 bp, human
ggggaccgtctcaggcccga

SEQ ID NO: 320777 - DNA, 20 bp, human
gggccccgcgggaccgtctc

SEQ ID NO: 320778 - DNA, 20 bp, human
gtctcaggcccgaggggttg

SEQ ID NO: 320779 - DNA, 20 bp, human
ggcggggccccacaagggag

SEQ ID NO: 320780 - DNA, 20 bp, human
ggggcctgagacggtcccgc

SEQ ID NO: 320781 - DNA, 20 bp, human
gcgctgagagcgcgcagttt

SEQ ID NO: 320782 - DNA, 20 bp, human
ggcgacgccgatggccccag

SEQ ID NO: 320783 - DNA, 20 bp, human
gcgtacagcctccaggcccc

SEQ ID NO: 320784 - DNA, 20 bp, human
gcagggtcctctggggccat

SEQ ID NO: 320785 - DNA, 20 bp, human
gtcagagcaagacgcagcgc

SEQ ID NO: 320786 - DNA, 20 bp, human
gaggcgctggagcacccggt

SEQ ID NO: 320787 - DNA, 20 bp, human
ggactgctcccatgatgtga

SEQ ID NO: 320788 - DNA, 20 bp, human
gcgctcccccctcacatcat

SEQ ID NO: 320789 - DNA, 20 bp, human
gtgctcccatgatgtgaggg

SEQ ID NO: 320790 - DNA, 20 bp, human
gtacctgagcgcaggaacca

SEQ ID NO: 320791 - DNA, 20 bp, human
ggtggcaaaacagtttctac

SEQ ID NO: 320792 - DNA, 20 bp, human
gaaaccggaagcagaggcgc

SEQ ID NO: 320793 - DNA, 20 bp, human
ggctgatggcagactcgttg

SEQ ID NO: 320794 - DNA, 20 bp, human
gcaagaggtcacatcttttc

SEQ ID NO: 320795 - DNA, 20 bp, human
gctgttttgccacttttggg

SEQ ID NO: 320796 - DNA, 20 bp, human
gaaagcagcagagactcaga

SEQ ID NO: 320797 - DNA, 20 bp, human
ggacgggcatcccacatcag

SEQ ID NO: 320798 - DNA, 20 bp, human
gctgtcactaccaactcaaa

SEQ ID NO: 320799 - DNA, 20 bp, human
ggcagcagagactcagacgg

SEQ ID NO: 320800 - DNA, 20 bp, human
gaaagctactagctcaaagc

SEQ ID NO: 320801 - DNA, 20 bp, human
gcccacatcagagggatgaa

SEQ ID NO: 320802 - DNA, 20 bp, human
gggaaggtcactggagccac

SEQ ID NO: 320803 - DNA, 20 bp, human
gtgctccaggaggtggcaca

SEQ ID NO: 320804 - DNA, 20 bp, human
gactccacccgtggcgactg

SEQ ID NO: 320805 - DNA, 20 bp, human
gaggtgcacacctcccccag

SEQ ID NO: 320806 - DNA, 20 bp, human
ggcggcctccgcaaatctca

SEQ ID NO: 320807 - DNA, 20 bp, human
gcagctccaagggtcacccc

SEQ ID NO: 320808 - DNA, 20 bp, human
gcgggtccgggattgcgggg

SEQ ID NO: 320809 - DNA, 20 bp, human
ggtcaccccaggctccaaac

SEQ ID NO: 320810 - DNA, 20 bp, human
ggggcgagcgaacgggagag

SEQ ID NO: 320811 - DNA, 20 bp, human
ggctccgacagggaccagcg

SEQ ID NO: 320812 - DNA, 20 bp, human
gcactgcgccgggacaccga

SEQ ID NO: 320813 - DNA, 20 bp, human
gggtcgggtccgggattgcg

SEQ ID NO: 320814 - DNA, 20 bp, human
gccagcgaggtcagctccaa

SEQ ID NO: 320815 - DNA, 20 bp, human
gccggcgcagtgggcgaaca

SEQ ID NO: 320816 - DNA, 20 bp, human
gaccgcggcgactatcccat

SEQ ID NO: 320817 - DNA, 20 bp, human
ggggcgctgactccgaactt

SEQ ID NO: 320818 - DNA, 20 bp, human
gttcccttccggaccacaag

SEQ ID NO: 320819 - DNA, 20 bp, human
gcgccccttgtggtccggaa

SEQ ID NO: 320820 - DNA, 20 bp, human
ggggaagtgacgttgttgct

SEQ ID NO: 320821 - DNA, 20 bp, human
gggtacggggctagagagga

SEQ ID NO: 320822 - DNA, 20 bp, human
ggatgagaaagcatagagac

SEQ ID NO: 320823 - DNA, 20 bp, human
gtcgctagcgcccaatagtc

SEQ ID NO: 320824 - DNA, 20 bp, human
gctgactccgaacttaggac

SEQ ID NO: 320825 - DNA, 20 bp, human
gtcgccgagagccgctgctg

SEQ ID NO: 320826 - DNA, 20 bp, human
gtccccgcagcctaaggcgc

SEQ ID NO: 320827 - DNA, 20 bp, human
gtaggctgcggggacagcag

SEQ ID NO: 320828 - DNA, 20 bp, human
gggaccggcgccttaggctg

SEQ ID NO: 320829 - DNA, 20 bp, human
ggcggggacagcagtggcgc

SEQ ID NO: 320830 - DNA, 20 bp, human
gtgccagggaccggcgcctt

SEQ ID NO: 320831 - DNA, 20 bp, human
gcggcagtgaggggccggtg

SEQ ID NO: 320832 - DNA, 20 bp, human
gggagcgcggcaggacgcac

SEQ ID NO: 320833 - DNA, 20 bp, human
ggggcgggatggggggtgac

SEQ ID NO: 320834 - DNA, 20 bp, human
ggcgccgctgcagagatcga

SEQ ID NO: 320835 - DNA, 20 bp, human
gccggacgcggcggcagtga

SEQ ID NO: 320836 - DNA, 20 bp, human
gtaaaggaaccggaacccgg

SEQ ID NO: 320837 - DNA, 20 bp, human
ggcggggcgcgtagagtgtg

SEQ ID NO: 320838 - DNA, 20 bp, human
gcggcgggagagagccccgg

SEQ ID NO: 320839 - DNA, 20 bp, human
gtggggccttgtaaaggaac

SEQ ID NO: 320840 - DNA, 20 bp, human
ggctctctcccgccgggttc

SEQ ID NO: 320841 - DNA, 20 bp, human
ggcgcgtagagtgtggggac

SEQ ID NO: 320842 - DNA, 20 bp, human
gcgggagagagccccggggg

SEQ ID NO: 320843 - DNA, 20 bp, human
gacctggcgagggacgaagc

SEQ ID NO: 320844 - DNA, 20 bp, human
gtccaggcgggacctggcga

SEQ ID NO: 320845 - DNA, 20 bp, human
ggccgactggggccttgtaa

SEQ ID NO: 320846 - DNA, 20 bp, human
gtggccatgcccattggcgg

SEQ ID NO: 320847 - DNA, 20 bp, human
ggccgctcccaggcctgcgg

SEQ ID NO: 320848 - DNA, 20 bp, human
ggggagcggcctgtgataac

SEQ ID NO: 320849 - DNA, 20 bp, human
gggcttgttgcgaattctca

SEQ ID NO: 320850 - DNA, 20 bp, human
ggctccagcagtcgcgccaa

SEQ ID NO: 320851 - DNA, 20 bp, human
gagcccgccaaggtaactcc

SEQ ID NO: 320852 - DNA, 20 bp, human
gggtaactccgggaattgag

SEQ ID NO: 320853 - DNA, 20 bp, human
gcaacaagccccgggcagca

SEQ ID NO: 320854 - DNA, 20 bp, human
gcagcctccgccaatgggca

SEQ ID NO: 320855 - DNA, 20 bp, human
gggctcctctctggtcgaaa

SEQ ID NO: 320856 - DNA, 20 bp, human
ggtgtcctcggggagcccgg

SEQ ID NO: 320857 - DNA, 20 bp, human
gcactggcccagcggaagga

SEQ ID NO: 320858 - DNA, 20 bp, human
gccccgaggacacctcgcac

SEQ ID NO: 320859 - DNA, 20 bp, human
gcaggcgcggggacccgttg

SEQ ID NO: 320860 - DNA, 20 bp, human
gggacacctcgcaccggagg

SEQ ID NO: 320861 - DNA, 20 bp, human
ggggcgcggtgcgagctgga

SEQ ID NO: 320862 - DNA, 20 bp, human
gcggggccgcactgcccaag

SEQ ID NO: 320863 - DNA, 20 bp, human
gcgagctggacggccccggg

SEQ ID NO: 320864 - DNA, 20 bp, human
gcccaagggggcaatccccg

SEQ ID NO: 320865 - DNA, 20 bp, human
gtccccgcggccgtccgcaa

SEQ ID NO: 320866 - DNA, 20 bp, human
ggcagcgcagccaattgcca

SEQ ID NO: 320867 - DNA, 20 bp, human
gtgcgaggacggggagtagg

SEQ ID NO: 320868 - DNA, 20 bp, human
gaggcaagtggctgcgagga

SEQ ID NO: 320869 - DNA, 20 bp, human
gtggagcggggaccccctag

SEQ ID NO: 320870 - DNA, 20 bp, human
gctgcctgccagtcagaagt

SEQ ID NO: 320871 - DNA, 20 bp, human
gagcgccaagctctagcccc

SEQ ID NO: 320872 - DNA, 20 bp, human
gctgtcccagagagcttagg

SEQ ID NO: 320873 - DNA, 20 bp, human
gaaagcttgcttgaagcata

SEQ ID NO: 320874 - DNA, 20 bp, human
gaagcataagggagcgacct

SEQ ID NO: 320875 - DNA, 20 bp, human
gctagagcttggcgctcacc

SEQ ID NO: 320876 - DNA, 20 bp, human
ggaggggcgcatgccttcct

SEQ ID NO: 320877 - DNA, 20 bp, human
gggctggggccgcccgcaga

SEQ ID NO: 320878 - DNA, 20 bp, human
gcgccggggtccggacccag

SEQ ID NO: 320879 - DNA, 20 bp, human
gagagtacaggggacctaga

SEQ ID NO: 320880 - DNA, 20 bp, human
ggagtcaccgccccgtgcta

SEQ ID NO: 320881 - DNA, 20 bp, human
gacctcttgcccctagcacg

SEQ ID NO: 320882 - DNA, 20 bp, human
gtacaggggacctagatggc

SEQ ID NO: 320883 - DNA, 20 bp, human
gtccccggggaggagtcacc

SEQ ID NO: 320884 - DNA, 20 bp, human
ggaaggcatgcgcccctctg

SEQ ID NO: 320885 - DNA, 20 bp, human
gcagagtgggagagtccccg

SEQ ID NO: 320886 - DNA, 20 bp, human
gcggtggcggaagtggagtg

SEQ ID NO: 320887 - DNA, 20 bp, human
gcgagcccaagtggcggcag

SEQ ID NO: 320888 - DNA, 20 bp, human
gaggacgcgagcccaagtgg

SEQ ID NO: 320889 - DNA, 20 bp, human
gcacagccgccctgagggga

SEQ ID NO: 320890 - DNA, 20 bp, human
gcaggaatgactccctccgc

SEQ ID NO: 320891 - DNA, 20 bp, human
gtacgcccgtcccctcaggg

SEQ ID NO: 320892 - DNA, 20 bp, human
gctcccccccctccctccgt

SEQ ID NO: 320893 - DNA, 20 bp, human
ggctgggcccgggtgccgcg

SEQ ID NO: 320894 - DNA, 20 bp, human
gccgaggacgcgagcccaag

SEQ ID NO: 320895 - DNA, 20 bp, human
gccggcccgcctgtgtcgca

SEQ ID NO: 320896 - DNA, 20 bp, human
gaggtgctggacggaagtca

SEQ ID NO: 320897 - DNA, 20 bp, human
gcaactccgcaggtgctgga

SEQ ID NO: 320898 - DNA, 20 bp, human
gtcaggtgggcgtttcctgt

SEQ ID NO: 320899 - DNA, 20 bp, human
gcacctgaccgggtgagtga

SEQ ID NO: 320900 - DNA, 20 bp, human
gaggaaacgcccacctgacc

SEQ ID NO: 320901 - DNA, 20 bp, human
gaaggtcgcagagcgcgcag

SEQ ID NO: 320902 - DNA, 20 bp, human
gcggagttggagacgcccac

SEQ ID NO: 320903 - DNA, 20 bp, human
gcgaataaactccacccctc

SEQ ID NO: 320904 - DNA, 20 bp, human
gccacgctcccattttaccg

SEQ ID NO: 320905 - DNA, 20 bp, human
gcctccgccaccagggcttg

SEQ ID NO: 320906 - DNA, 20 bp, human
gggagcggctcctggatcat

SEQ ID NO: 320907 - DNA, 20 bp, human
ggagcgaatgaggtgagtga

SEQ ID NO: 320908 - DNA, 20 bp, human
gtgacgttaggattaactga

SEQ ID NO: 320909 - DNA, 20 bp, human
gcgcggcgggtcccgtagct

SEQ ID NO: 320910 - DNA, 20 bp, human
ggggcccagaaagttgaagc

SEQ ID NO: 320911 - DNA, 20 bp, human
gctgcgtctgccaatgatcc

SEQ ID NO: 320912 - DNA, 20 bp, human
gagagaaagacaccaagcta

SEQ ID NO: 320913 - DNA, 20 bp, human
gccactcgggaaaccttcag

SEQ ID NO: 320914 - DNA, 20 bp, human
gtgttgaccatggggaaaga

SEQ ID NO: 320915 - DNA, 20 bp, human
gaaacgttagaggtgacgtt

SEQ ID NO: 320916 - DNA, 20 bp, human
gctgtcacctctaacgtctg

SEQ ID NO: 320917 - DNA, 20 bp, human
gaggcaggggcgggactcgg

SEQ ID NO: 320918 - DNA, 20 bp, human
gccctgcctgagttcgccag

SEQ ID NO: 320919 - DNA, 20 bp, human
gcagttggcgtctttctctt

SEQ ID NO: 320920 - DNA, 20 bp, human
gaccactggcgaactcaggc

SEQ ID NO: 320921 - DNA, 20 bp, human
gcatcggagcgaatgaggtc

SEQ ID NO: 320922 - DNA, 20 bp, human
ggcgcgacaggtcccgcagt

SEQ ID NO: 320923 - DNA, 20 bp, human
gaggaaaccaagggggaccg

SEQ ID NO: 320924 - DNA, 20 bp, human
ggacagaattagctgaaggc

SEQ ID NO: 320925 - DNA, 20 bp, human
gctggaccactggcgaactc

SEQ ID NO: 320926 - DNA, 20 bp, human
gcccccgcgcgtgactgaca

SEQ ID NO: 320927 - DNA, 20 bp, human
gaggctgtgcagggtaccgc

SEQ ID NO: 320928 - DNA, 20 bp, human
gaccgccggcggcgccacgc

SEQ ID NO: 320929 - DNA, 20 bp, human
ggcccctgtcagtcacgcgc

SEQ ID NO: 320930 - DNA, 20 bp, human
ggcatcgcccctgggtcctc

SEQ ID NO: 320931 - DNA, 20 bp, human
gtctcagagaggttcagaac

SEQ ID NO: 320932 - DNA, 20 bp, human
ggaaggcggggccaagatgg

SEQ ID NO: 320933 - DNA, 20 bp, human
gcggggtctcagtttctagc

SEQ ID NO: 320934 - DNA, 20 bp, human
gcccctgggtcctcgggaag

SEQ ID NO: 320935 - DNA, 20 bp, human
ggccaggtgaggcactatta

SEQ ID NO: 320936 - DNA, 20 bp, human
gcgaagatggcggagaacag

SEQ ID NO: 320937 - DNA, 20 bp, human
gccggcaagagcagcgggag

SEQ ID NO: 320938 - DNA, 20 bp, human
gcggacgtgacgcaaggcgg

SEQ ID NO: 320939 - DNA, 20 bp, human
ggtcgcgccggcaagagcag

SEQ ID NO: 320940 - DNA, 20 bp, human
ggggaaagccctgacatgta

SEQ ID NO: 320941 - DNA, 20 bp, human
gcggccggaaacccagcagg

SEQ ID NO: 320942 - DNA, 20 bp, human
gcgaagcagggtacccacct

SEQ ID NO: 320943 - DNA, 20 bp, human
gcgagtgggcggtaactcgc

SEQ ID NO: 320944 - DNA, 20 bp, human
gcgccggccggaaacccagc

SEQ ID NO: 320945 - DNA, 20 bp, human
gtgtgcgtggcacctagaga

SEQ ID NO: 320946 - DNA, 20 bp, human
gccccggccgggaggagaga

SEQ ID NO: 320947 - DNA, 20 bp, human
gggaacggcctaagtcgagg

SEQ ID NO: 320948 - DNA, 20 bp, human
gccgcggcgtcgctacggtg

SEQ ID NO: 320949 - DNA, 20 bp, human
gaggacggaccaacgagaaa

SEQ ID NO: 320950 - DNA, 20 bp, human
gctaagtcgaggtggtgtgc

SEQ ID NO: 320951 - DNA, 20 bp, human
gtggtccgtcctggtgttac

SEQ ID NO: 320952 - DNA, 20 bp, human
gggggcggggaccgcgtcag

SEQ ID NO: 320953 - DNA, 20 bp, human
ggcgtcgctacggtggggcg

SEQ ID NO: 320954 - DNA, 20 bp, human
ggcaattaaccatttctcgt

SEQ ID NO: 320955 - DNA, 20 bp, human
ggggacggaatgaccctggt

SEQ ID NO: 320956 - DNA, 20 bp, human
gaccgacagggagggagttg

SEQ ID NO: 320957 - DNA, 20 bp, human
ggaagagtgcgtgcgggctt

SEQ ID NO: 320958 - DNA, 20 bp, human
ggaagtggaagagtgcgtgc

SEQ ID NO: 320959 - DNA, 20 bp, human
gccgccgccaccgacaggga

SEQ ID NO: 320960 - DNA, 20 bp, human
ggcttcccggccccaccacg

SEQ ID NO: 320961 - DNA, 20 bp, human
gggggggaacggcagagggg

SEQ ID NO: 320962 - DNA, 20 bp, human
gtgactgcatacacacccct

SEQ ID NO: 320963 - DNA, 20 bp, human
ggggctccagggttccaact

SEQ ID NO: 320964 - DNA, 20 bp, human
ggtgttgcaggtctcatctc

SEQ ID NO: 320965 - DNA, 20 bp, human
gccgcggccgacgagagccc

SEQ ID NO: 320966 - DNA, 20 bp, human
gaaacctgccgagggctcgg

SEQ ID NO: 320967 - DNA, 20 bp, human
ggcaggcggcggtgtctagg

SEQ ID NO: 320968 - DNA, 20 bp, human
ggatctgattggataaagtg

SEQ ID NO: 320969 - DNA, 20 bp, human
ggcctcggggcgaggagtct

SEQ ID NO: 320970 - DNA, 20 bp, human
gagtctgggcggcatgaccg

SEQ ID NO: 320971 - DNA, 20 bp, human
gtaaagtgggggctcgacgg

SEQ ID NO: 320972 - DNA, 20 bp, human
ggggctcccgaggatctgaa

SEQ ID NO: 320973 - DNA, 20 bp, human
gggcaggggcgaaacttcgc

SEQ ID NO: 320974 - DNA, 20 bp, human
ggtgtgcaccgagcgagtga

SEQ ID NO: 320975 - DNA, 20 bp, human
ggagcgagtgaaggtatgtg

SEQ ID NO: 320976 - DNA, 20 bp, human
ggaggtgggcgtctggaaag

SEQ ID NO: 320977 - DNA, 20 bp, human
gggacccccgccagacgctc

SEQ ID NO: 320978 - DNA, 20 bp, human
gaaagtggagtgggctgtct

SEQ ID NO: 320979 - DNA, 20 bp, human
gtgggtgaatgtctgtttag

SEQ ID NO: 320980 - DNA, 20 bp, human
gatgaaagggagtgccgctg

SEQ ID NO: 320981 - DNA, 20 bp, human
gcgacccgagcgtctggcgg

SEQ ID NO: 320982 - DNA, 20 bp, human
ggagtgggctgtctgggtcc

SEQ ID NO: 320983 - DNA, 20 bp, human
gaaagggagtgccgctgggg

SEQ ID NO: 320984 - DNA, 20 bp, human
ggaggctacagatggcgagt

SEQ ID NO: 320985 - DNA, 20 bp, human
gggggaggggagtatgtagg

SEQ ID NO: 320986 - DNA, 20 bp, human
ggagggggaccgttcttaaa

SEQ ID NO: 320987 - DNA, 20 bp, human
gtaagaacggtccccctctc

SEQ ID NO: 320988 - DNA, 20 bp, human
gcccccaggggccgcaggcg

SEQ ID NO: 320989 - DNA, 20 bp, human
ggcccctgggggcttcgcgc

SEQ ID NO: 320990 - DNA, 20 bp, human
ggcagcgcagctgttacccg

SEQ ID NO: 320991 - DNA, 20 bp, human
ggcttcgcgccggccggaga

SEQ ID NO: 320992 - DNA, 20 bp, human
ggccggcgcgaagcccccag

SEQ ID NO: 320993 - DNA, 20 bp, human
gaggggggaacgggatgcgg

SEQ ID NO: 320994 - DNA, 20 bp, human
gtggacgcggcagggatgac

SEQ ID NO: 320995 - DNA, 20 bp, human
gccgagcgcggggcacccgg

SEQ ID NO: 320996 - DNA, 20 bp, human
gtcaggccagggccgaggta

SEQ ID NO: 320997 - DNA, 20 bp, human
gaaggccggggacgacgccg

SEQ ID NO: 320998 - DNA, 20 bp, human
gggtccgcccgcgaaggccg

SEQ ID NO: 320999 - DNA, 20 bp, human
gaccagccgccaccagcttc

SEQ ID NO: 321000 - DNA, 20 bp, human
gcgcgcttacctggagggag

SEQ ID NO: 321001 - DNA, 20 bp, human
gcatcctcattgcagtgcgg

SEQ ID NO: 321002 - DNA, 20 bp, human
gagccgcgcgcttacctgga

SEQ ID NO: 321003 - DNA, 20 bp, human
ggcccagcgccgagggaact

SEQ ID NO: 321004 - DNA, 20 bp, human
ggtctcacgggagccggcaa

SEQ ID NO: 321005 - DNA, 20 bp, human
gccgcggcagccggggcctc

SEQ ID NO: 321006 - DNA, 20 bp, human
gagcctcactcggaactgga

SEQ ID NO: 321007 - DNA, 20 bp, human
ggcggaacagcccaaatctg

SEQ ID NO: 321008 - DNA, 20 bp, human
ggaggagcctcactcggaac

SEQ ID NO: 321009 - DNA, 20 bp, human
ggtacccagaactgtgtcca

SEQ ID NO: 321010 - DNA, 20 bp, human
gaccgcctagatccggggaa

SEQ ID NO: 321011 - DNA, 20 bp, human
gtgacgaccgcctagatccg

SEQ ID NO: 321012 - DNA, 20 bp, human
gctaggcggtcgtcaccgac

SEQ ID NO: 321013 - DNA, 20 bp, human
gcggcaggtcccgggaacca

SEQ ID NO: 321014 - DNA, 20 bp, human
gaaaccttggacacagttct

SEQ ID NO: 321015 - DNA, 20 bp, human
gtgaacttgaaacacttgaa

SEQ ID NO: 321016 - DNA, 20 bp, human
gtccccaacttgagccgtgt

SEQ ID NO: 321017 - DNA, 20 bp, human
ggggtgttccaacagtagag

SEQ ID NO: 321018 - DNA, 20 bp, human
gagccgtgtgggaacataaa

SEQ ID NO: 321019 - DNA, 20 bp, human
gctgcgtgaaggcttcttgt

SEQ ID NO: 321020 - DNA, 20 bp, human
gccacagaggggtaaagtta

SEQ ID NO: 321021 - DNA, 20 bp, human
ggcgggccttggctgcgtga

SEQ ID NO: 321022 - DNA, 20 bp, human
gcacgcaggcgcactagaat

SEQ ID NO: 321023 - DNA, 20 bp, human
gaatccgcgcgtgtgctatg

SEQ ID NO: 321024 - DNA, 20 bp, human
gttagggtgcgcctgttttt

SEQ ID NO: 321025 - DNA, 20 bp, human
gtgctatgtggggcgggcct

SEQ ID NO: 321026 - DNA, 20 bp, human
gggcagggcggggacgaggg

SEQ ID NO: 321027 - DNA, 20 bp, human
ggacgagggcggggcgctga

SEQ ID NO: 321028 - DNA, 20 bp, human
gggccggtgcggcgcatcaa

SEQ ID NO: 321029 - DNA, 20 bp, human
gggcggggcgctgacgggag

SEQ ID NO: 321030 - DNA, 20 bp, human
gccctgccgcggtctggggc

SEQ ID NO: 321031 - DNA, 20 bp, human
gtctgcagaaggtaggtcgt

SEQ ID NO: 321032 - DNA, 20 bp, human
gcgctccctgccgcggtctg

SEQ ID NO: 321033 - DNA, 20 bp, human
gcagtccgcgctccctgccg

SEQ ID NO: 321034 - DNA, 20 bp, human
gggccgggggccgagctcca

SEQ ID NO: 321035 - DNA, 20 bp, human
gtagagagaacgtggagcgg

SEQ ID NO: 321036 - DNA, 20 bp, human
gcccaccagcgatgaggacc

SEQ ID NO: 321037 - DNA, 20 bp, human
gtggagccccaccagcgatg

SEQ ID NO: 321038 - DNA, 20 bp, human
ggccgctgcccgcagcgcat

SEQ ID NO: 321039 - DNA, 20 bp, human
gcaaaccaaggacaaagtga

SEQ ID NO: 321040 - DNA, 20 bp, human
gcagcgatgaggacccggcc

SEQ ID NO: 321041 - DNA, 20 bp, human
ggcccccgcagcgcccccgg

SEQ ID NO: 321042 - DNA, 20 bp, human
ggggaggagagtcatgggta

SEQ ID NO: 321043 - DNA, 20 bp, human
ggacccaggacggcctggtg

SEQ ID NO: 321044 - DNA, 20 bp, human
gccctcaaggcacaggtcgg

SEQ ID NO: 321045 - DNA, 20 bp, human
gaggtacccagcagggtagg

SEQ ID NO: 321046 - DNA, 20 bp, human
gtccccgcttagtgtgtgat

SEQ ID NO: 321047 - DNA, 20 bp, human
ggagggtgtcagatcatcag

SEQ ID NO: 321048 - DNA, 20 bp, human
gaggctagggtgtacattaa

SEQ ID NO: 321049 - DNA, 20 bp, human
gaagcggggaactggacccc

SEQ ID NO: 321050 - DNA, 20 bp, human
gtcccccatcacacactaag

SEQ ID NO: 321051 - DNA, 20 bp, human
gtgtgcaatccaggaaggga

SEQ ID NO: 321052 - DNA, 20 bp, human
gtgcctgtgcaatccaggaa

SEQ ID NO: 321053 - DNA, 20 bp, human
gtgtcagatcatcagtggtt

SEQ ID NO: 321054 - DNA, 20 bp, human
ggaggaagccaatcaggcta

SEQ ID NO: 321055 - DNA, 20 bp, human
ggaaccttcaacaccaagtc

SEQ ID NO: 321056 - DNA, 20 bp, human
gcggcctcccagagcgtcat

SEQ ID NO: 321057 - DNA, 20 bp, human
gctcaacgcagcctacctga

SEQ ID NO: 321058 - DNA, 20 bp, human
gtgaagaggaagacgatcaa

SEQ ID NO: 321059 - DNA, 20 bp, human
gggagcccaaaaggcattgt

SEQ ID NO: 321060 - DNA, 20 bp, human
gctttccaccggaaagaggg

SEQ ID NO: 321061 - DNA, 20 bp, human
gcggacctggatggctgaag

SEQ ID NO: 321062 - DNA, 20 bp, human
gtgtcccatgacgctctggg

SEQ ID NO: 321063 - DNA, 20 bp, human
gtccgaggacgcagggtccc

SEQ ID NO: 321064 - DNA, 20 bp, human
gtacatgtcccatgacgctc

SEQ ID NO: 321065 - DNA, 20 bp, human
ggtcatgggacatgtagttc

SEQ ID NO: 321066 - DNA, 20 bp, human
ggaggccggcgggagaatga

SEQ ID NO: 321067 - DNA, 20 bp, human
gacctggcctgggtgtgcgc

SEQ ID NO: 321068 - DNA, 20 bp, human
gacccagcggcccgcgtcca

SEQ ID NO: 321069 - DNA, 20 bp, human
ggaccgcgcagctcccccag

SEQ ID NO: 321070 - DNA, 20 bp, human
gccagggagtctagaacctt

SEQ ID NO: 321071 - DNA, 20 bp, human
ggagaatgacggccaggacc

SEQ ID NO: 321072 - DNA, 20 bp, human
gattctcccgccggcctctg

SEQ ID NO: 321073 - DNA, 20 bp, human
gcggcgggagaatgacggcc

SEQ ID NO: 321074 - DNA, 20 bp, human
gcgtcaggcaagacgaattc

SEQ ID NO: 321075 - DNA, 20 bp, human
ggcaagacgaattccggcag

SEQ ID NO: 321076 - DNA, 20 bp, human
gcacgcccccgcttctgcac

SEQ ID NO: 321077 - DNA, 20 bp, human
gcaggctgtggggtcgggat

SEQ ID NO: 321078 - DNA, 20 bp, human
ggggcctagtacgggcaggg

SEQ ID NO: 321079 - DNA, 20 bp, human
gggtgggcggggcctagtac

SEQ ID NO: 321080 - DNA, 20 bp, human
ggcggggcctagtacgggca

SEQ ID NO: 321081 - DNA, 20 bp, human
gaggggctggaagcgagccg

SEQ ID NO: 321082 - DNA, 20 bp, human
ggggcggagcgctcctggag

SEQ ID NO: 321083 - DNA, 20 bp, human
gtggaccggaagcggtctga

SEQ ID NO: 321084 - DNA, 20 bp, human
ggcagacccgccggggtggg

SEQ ID NO: 321085 - DNA, 20 bp, human
ggggacaagtggtcggtgta

SEQ ID NO: 321086 - DNA, 20 bp, human
gctagctcgcggtccgtagt

SEQ ID NO: 321087 - DNA, 20 bp, human
gggaggggccgggtaaggag

SEQ ID NO: 321088 - DNA, 20 bp, human
gtaaggaggggcgcgctgag

SEQ ID NO: 321089 - DNA, 20 bp, human
gagcaagcgggcggaaacgg

SEQ ID NO: 321090 - DNA, 20 bp, human
gtaggcagctagcaagcggg

SEQ ID NO: 321091 - DNA, 20 bp, human
gcctacccgcgtgccgtccg

SEQ ID NO: 321092 - DNA, 20 bp, human
gtgggggcggagaagatggc

SEQ ID NO: 321093 - DNA, 20 bp, human
gcggtgggaggggccgggta

SEQ ID NO: 321094 - DNA, 20 bp, human
ggagaagatcaactctcggg

SEQ ID NO: 321095 - DNA, 20 bp, human
gtgggtctgcggatccgtgg

SEQ ID NO: 321096 - DNA, 20 bp, human
gcgtgtctggggagctctcg

SEQ ID NO: 321097 - DNA, 20 bp, human
gccctccatctcgtcaggtg

SEQ ID NO: 321098 - DNA, 20 bp, human
ggcagcgggggcgtacgcac

SEQ ID NO: 321099 - DNA, 20 bp, human
ggggcgactgacttcaaagg

SEQ ID NO: 321100 - DNA, 20 bp, human
gcaaccgaaggtggcggcag

SEQ ID NO: 321101 - DNA, 20 bp, human
gcccccgctgccgccacctt

SEQ ID NO: 321102 - DNA, 20 bp, human
ggagggcgcaggcgcatcca

SEQ ID NO: 321103 - DNA, 20 bp, human
gacagggaacgcgcaggtat

SEQ ID NO: 321104 - DNA, 20 bp, human
gtcaaaggggggggcaaaca

SEQ ID NO: 321105 - DNA, 20 bp, human
ggtataggagcgctggctgg

SEQ ID NO: 321106 - DNA, 20 bp, human
gtcgggccccgccacctact

SEQ ID NO: 321107 - DNA, 20 bp, human
gccgagagcgagcggagcag

SEQ ID NO: 321108 - DNA, 20 bp, human
gtaggcgcgcgcgctaacga

SEQ ID NO: 321109 - DNA, 20 bp, human
ggcgccgcgggcgcctaagg

SEQ ID NO: 321110 - DNA, 20 bp, human
gccgcgggcgcctaaggcgg

SEQ ID NO: 321111 - DNA, 20 bp, human
gccgcctgcgcggggtcgtg

SEQ ID NO: 321112 - DNA, 20 bp, human
ggggatgggagcccagtagg

SEQ ID NO: 321113 - DNA, 20 bp, human
ggtagcgcgggaatgtcccc

SEQ ID NO: 321114 - DNA, 20 bp, human
gcgggccccgaacctggctg

SEQ ID NO: 321115 - DNA, 20 bp, human
ggcggtgcgggccccgaacc

SEQ ID NO: 321116 - DNA, 20 bp, human
gcgcctccgcccaaccctct

SEQ ID NO: 321117 - DNA, 20 bp, human
gcggaggcttccccgagccc

SEQ ID NO: 321118 - DNA, 20 bp, human
ggtgccgcggccgcttgcct

SEQ ID NO: 321119 - DNA, 20 bp, human
gcgcccggtgcgcgcgaccg

SEQ ID NO: 321120 - DNA, 20 bp, human
gacagcgcctgatagtcccg

SEQ ID NO: 321121 - DNA, 20 bp, human
gcggccgcttgcctgggctc

SEQ ID NO: 321122 - DNA, 20 bp, human
gtccccgcggtcgcgcgcac

SEQ ID NO: 321123 - DNA, 20 bp, human
ggctgcgcgccgattggcac

SEQ ID NO: 321124 - DNA, 20 bp, human
ggggctgcgccggtgccaat

SEQ ID NO: 321125 - DNA, 20 bp, human
gaaccctctgggactctccg

SEQ ID NO: 321126 - DNA, 20 bp, human
gcggagggggcgctgagtag

SEQ ID NO: 321127 - DNA, 20 bp, human
ggacacccccgattccgctg

SEQ ID NO: 321128 - DNA, 20 bp, human
gtccccgcgtgtctgggaga

SEQ ID NO: 321129 - DNA, 20 bp, human
ggtgtctgggagatgggcga

SEQ ID NO: 321130 - DNA, 20 bp, human
gcggaactgagcctgaaccc

SEQ ID NO: 321131 - DNA, 20 bp, human
gcagctcaggggtttttcag

SEQ ID NO: 321132 - DNA, 20 bp, human
gacacgcggggatctggggc

SEQ ID NO: 321133 - DNA, 20 bp, human
gcctggccggagcaacgcgg

SEQ ID NO: 321134 - DNA, 20 bp, human
ggggatcgactgcctcccgg

SEQ ID NO: 321135 - DNA, 20 bp, human
gccgcccggcaacagacaga

SEQ ID NO: 321136 - DNA, 20 bp, human
ggcaaaggttggccacgtgt

SEQ ID NO: 321137 - DNA, 20 bp, human
gggggcggggaggtaggaac

SEQ ID NO: 321138 - DNA, 20 bp, human
gccctctagagcaagatgag

SEQ ID NO: 321139 - DNA, 20 bp, human
gtccactcacgaacctgggg

SEQ ID NO: 321140 - DNA, 20 bp, human
gggctccactcacgaacctg

SEQ ID NO: 321141 - DNA, 20 bp, human
gcgagcgatcagtccatata

SEQ ID NO: 321142 - DNA, 20 bp, human
ggcctccccaggttcgtgag

SEQ ID NO: 321143 - DNA, 20 bp, human
gccacgtgtgggcgggtctt

SEQ ID NO: 321144 - DNA, 20 bp, human
gaaggttggccacgtgtggg

SEQ ID NO: 321145 - DNA, 20 bp, human
gagtggagcccagccttata

SEQ ID NO: 321146 - DNA, 20 bp, human
ggccccctgctctctgcgag

SEQ ID NO: 321147 - DNA, 20 bp, human
gcctccctccctataggttc

SEQ ID NO: 321148 - DNA, 20 bp, human
ggagccagaacctataggga

SEQ ID NO: 321149 - DNA, 20 bp, human
gccgcagcgtctcggacttc

SEQ ID NO: 321150 - DNA, 20 bp, human
gcacatgagccagaacctat

SEQ ID NO: 321151 - DNA, 20 bp, human
gtcccactcgcagagagcag

SEQ ID NO: 321152 - DNA, 20 bp, human
gccccaacctccctccctat

SEQ ID NO: 321153 - DNA, 20 bp, human
gcttccctggcgttggttcg

SEQ ID NO: 321154 - DNA, 20 bp, human
ggcagccacgcgggaatcaa

SEQ ID NO: 321155 - DNA, 20 bp, human
ggaatcaatggttcaggaac

SEQ ID NO: 321156 - DNA, 20 bp, human
ggccgcggatggaggagcga

SEQ ID NO: 321157 - DNA, 20 bp, human
gagggctggggtaacggccg

SEQ ID NO: 321158 - DNA, 20 bp, human
gaacccccgccccataatgg

SEQ ID NO: 321159 - DNA, 20 bp, human
gccaaagtccggtataattg

SEQ ID NO: 321160 - DNA, 20 bp, human
gcaaagatgggaaaagcaac

SEQ ID NO: 321161 - DNA, 20 bp, human
gggaacgtgctgctaagttt

SEQ ID NO: 321162 - DNA, 20 bp, human
gctggggtaacggccgcgga

SEQ ID NO: 321163 - DNA, 20 bp, human
gaccagaaatagaaactcgg

SEQ ID NO: 321164 - DNA, 20 bp, human
gcgtaagagcgcataaagag

SEQ ID NO: 321165 - DNA, 20 bp, human
gctggcgtcgaggctagaca

SEQ ID NO: 321166 - DNA, 20 bp, human
gaggcccctggcccaatggc

SEQ ID NO: 321167 - DNA, 20 bp, human
gagcctgaaaagcctaccag

SEQ ID NO: 321168 - DNA, 20 bp, human
gctgcccagcttttttaaag

SEQ ID NO: 321169 - DNA, 20 bp, human
gggccaggggcctcgatgac

SEQ ID NO: 321170 - DNA, 20 bp, human
gagagtcaggcctctgggca

SEQ ID NO: 321171 - DNA, 20 bp, human
gtgcctctggtaggcttttc

SEQ ID NO: 321172 - DNA, 20 bp, human
gtcagcctgccattgggcca

SEQ ID NO: 321173 - DNA, 20 bp, human
ggatgagggagagtctgaat

SEQ ID NO: 321174 - DNA, 20 bp, human
gggccacgacgcatttggaa

SEQ ID NO: 321175 - DNA, 20 bp, human
gcgcaggctgcaggagcaaa

SEQ ID NO: 321176 - DNA, 20 bp, human
ggctggtaggcccgggtcca

SEQ ID NO: 321177 - DNA, 20 bp, human
gcctcccaggaaggcgactg

SEQ ID NO: 321178 - DNA, 20 bp, human
gcgaaccaaacctcccagga

SEQ ID NO: 321179 - DNA, 20 bp, human
ggggccatgctggtaggccc

SEQ ID NO: 321180 - DNA, 20 bp, human
gtaggcccgggtccagggcc

SEQ ID NO: 321181 - DNA, 20 bp, human
gcccagacagcgccttcctc

SEQ ID NO: 321182 - DNA, 20 bp, human
gggactggagaggattcgac

SEQ ID NO: 321183 - DNA, 20 bp, human
ggggctacggtctcgtcacc

SEQ ID NO: 321184 - DNA, 20 bp, human
gaaggcgctgtctgggacgc

SEQ ID NO: 321185 - DNA, 20 bp, human
ggcgacaagacgggaagttc

SEQ ID NO: 321186 - DNA, 20 bp, human
gaaagtggggacagataatg

SEQ ID NO: 321187 - DNA, 20 bp, human
ggtaactgggcgccaagggg

SEQ ID NO: 321188 - DNA, 20 bp, human
gaccctggagacccggacct

SEQ ID NO: 321189 - DNA, 20 bp, human
gcacccaagatgttattcac

SEQ ID NO: 321190 - DNA, 20 bp, human
gtgtctgattagcccaaagt

SEQ ID NO: 321191 - DNA, 20 bp, human
ggcaccttccgggctcgccc

SEQ ID NO: 321192 - DNA, 20 bp, human
gggaggtaactgggcgccaa

SEQ ID NO: 321193 - DNA, 20 bp, human
gacaaagcggcgttaaactc

SEQ ID NO: 321194 - DNA, 20 bp, human
ggagcactggaccagagccg

SEQ ID NO: 321195 - DNA, 20 bp, human
ggggacgccgctcctacgga

SEQ ID NO: 321196 - DNA, 20 bp, human
gctggggaaggaatccccta

SEQ ID NO: 321197 - DNA, 20 bp, human
ggggaggcggaaagtgaaag

SEQ ID NO: 321198 - DNA, 20 bp, human
ggaaaacggctcagggcgga

SEQ ID NO: 321199 - DNA, 20 bp, human
gcagggctcgcagatcggcg

SEQ ID NO: 321200 - DNA, 20 bp, human
ggctcagggcggccaatccg

SEQ ID NO: 321201 - DNA, 20 bp, human
gcgccctgagccgttttccc

SEQ ID NO: 321202 - DNA, 20 bp, human
gctcccattggccgcgggac

SEQ ID NO: 321203 - DNA, 20 bp, human
ggtgctcagggctcgcagat

SEQ ID NO: 321204 - DNA, 20 bp, human
gcccgctccgctcctcccta

SEQ ID NO: 321205 - DNA, 20 bp, human
ggggctataagcgagccggg

SEQ ID NO: 321206 - DNA, 20 bp, human
gggcgctcccggccgtccat

SEQ ID NO: 321207 - DNA, 20 bp, human
gctcccggccgtccattggc

SEQ ID NO: 321208 - DNA, 20 bp, human
gcccgggacagcccagtgga

SEQ ID NO: 321209 - DNA, 20 bp, human
gccattggctggctccagtt

SEQ ID NO: 321210 - DNA, 20 bp, human
gtgaggccacacccctccac

SEQ ID NO: 321211 - DNA, 20 bp, human
gaagaagcggcgaaactgta

SEQ ID NO: 321212 - DNA, 20 bp, human
ggagcctccttgttgctgga

SEQ ID NO: 321213 - DNA, 20 bp, human
ggagccagccaatggacggc

SEQ ID NO: 321214 - DNA, 20 bp, human
ggcaccctccagcaacaagg

SEQ ID NO: 321215 - DNA, 20 bp, human
ggtgaggaatgacacccggg

SEQ ID NO: 321216 - DNA, 20 bp, human
gctgccgcctcccgcgtgga

SEQ ID NO: 321217 - DNA, 20 bp, human
gctggctggtgccccccgcg

SEQ ID NO: 321218 - DNA, 20 bp, human
gagagcccccccgtggccgg

SEQ ID NO: 321219 - DNA, 20 bp, human
gttcaggccgcctgggttgt

SEQ ID NO: 321220 - DNA, 20 bp, human
gcgccctcgctgcaaggcta

SEQ ID NO: 321221 - DNA, 20 bp, human
ggatacgcggcagggtacag

SEQ ID NO: 321222 - DNA, 20 bp, human
gtgccccccgcggggctcag

SEQ ID NO: 321223 - DNA, 20 bp, human
ggcaggcagcgggggatacg

SEQ ID NO: 321224 - DNA, 20 bp, human
gtccaaaccctccacgcggg

SEQ ID NO: 321225 - DNA, 20 bp, human
gatgtccaaaccctccacgc

SEQ ID NO: 321226 - DNA, 20 bp, human
gtccccggggagataaatcg

SEQ ID NO: 321227 - DNA, 20 bp, human
gcggccgcgcactccatgaa

SEQ ID NO: 321228 - DNA, 20 bp, human
gtagcgcggcaggtgcctcc

SEQ ID NO: 321229 - DNA, 20 bp, human
ggggcccttcatggagtgcg

SEQ ID NO: 321230 - DNA, 20 bp, human
gaagggcccattagcgcggc

SEQ ID NO: 321231 - DNA, 20 bp, human
ggggacggacgcgctgataa

SEQ ID NO: 321232 - DNA, 20 bp, human
gcgctcggagcgccccactc

SEQ ID NO: 321233 - DNA, 20 bp, human
ggaccccgcggtccggccat

SEQ ID NO: 321234 - DNA, 20 bp, human
gtcgccccgatttatctccc

SEQ ID NO: 321235 - DNA, 20 bp, human
gggcgaatttacagcccggg

SEQ ID NO: 321236 - DNA, 20 bp, human
ggaccctccggcgatgagta

SEQ ID NO: 321237 - DNA, 20 bp, human
ggagccgcgccgccattggt

SEQ ID NO: 321238 - DNA, 20 bp, human
gaagccctactcatcgccgg

SEQ ID NO: 321239 - DNA, 20 bp, human
gaggaaaaggtgagcgtctg

SEQ ID NO: 321240 - DNA, 20 bp, human
gtccctaggggagcagctgt

SEQ ID NO: 321241 - DNA, 20 bp, human
gtgctcccctagggaagagg

SEQ ID NO: 321242 - DNA, 20 bp, human
gggggagcaaatggaccctc

SEQ ID NO: 321243 - DNA, 20 bp, human
ggcgcacacgggcctcacat

SEQ ID NO: 321244 - DNA, 20 bp, human
gaagtctagcatctaggaaa

SEQ ID NO: 321245 - DNA, 20 bp, human
gtagaatacaggccggagac

SEQ ID NO: 321246 - DNA, 20 bp, human
gcccgctgcgcacggcctca

SEQ ID NO: 321247 - DNA, 20 bp, human
gtcgccctctgctgttgggg

SEQ ID NO: 321248 - DNA, 20 bp, human
gagacagagcgccgtctccg

SEQ ID NO: 321249 - DNA, 20 bp, human
gcggcctcagggattagaaa

SEQ ID NO: 321250 - DNA, 20 bp, human
gcagcagagggcgatgtggc

SEQ ID NO: 321251 - DNA, 20 bp, human
gccaacagcagagggcgatg

SEQ ID NO: 321252 - DNA, 20 bp, human
gagagcgccgtctccgtggt

SEQ ID NO: 321253 - DNA, 20 bp, human
gacgtggggacgcaggatgg

SEQ ID NO: 321254 - DNA, 20 bp, human
gccgtctccgtggtcgggcg

SEQ ID NO: 321255 - DNA, 20 bp, human
gagacggcgctctgtctgcc

SEQ ID NO: 321256 - DNA, 20 bp, human
gctcccctgtaagaaatcgg

SEQ ID NO: 321257 - DNA, 20 bp, human
gttagcagtgtggcaagagt

SEQ ID NO: 321258 - DNA, 20 bp, human
gaagctcccctgtaagaaat

SEQ ID NO: 321259 - DNA, 20 bp, human
gtatacctccgatttcttac

SEQ ID NO: 321260 - DNA, 20 bp, human
gcagaatgttcaataggata

SEQ ID NO: 321261 - DNA, 20 bp, human
gcaatacatgtgaaatcaat

SEQ ID NO: 321262 - DNA, 20 bp, human
gcttgagaaagactgtataa

SEQ ID NO: 321263 - DNA, 20 bp, human
gatatagacctgcagctaac

SEQ ID NO: 321264 - DNA, 20 bp, human
ggtaagttaaatgttaccat

SEQ ID NO: 321265 - DNA, 20 bp, human
gatcaaatccagttagctgc

SEQ ID NO: 321266 - DNA, 20 bp, human
gagctgacccgcctctcctc

SEQ ID NO: 321267 - DNA, 20 bp, human
gctctcctctggctgggtcc

SEQ ID NO: 321268 - DNA, 20 bp, human
gtcccaggcaggttctcctc

SEQ ID NO: 321269 - DNA, 20 bp, human
ggcgtctgctgaggggagaa

SEQ ID NO: 321270 - DNA, 20 bp, human
gtgaggctggggttagagta

SEQ ID NO: 321271 - DNA, 20 bp, human
gccagactcaggcctttctt

SEQ ID NO: 321272 - DNA, 20 bp, human
gggagtggggaggtgtcagg

SEQ ID NO: 321273 - DNA, 20 bp, human
gctcccctcagcagacgcct

SEQ ID NO: 321274 - DNA, 20 bp, human
gcagacgcctaggttggggg

SEQ ID NO: 321275 - DNA, 20 bp, human
gcagctgatgtatccctccc

SEQ ID NO: 321276 - DNA, 20 bp, human
gcgcgcccgcgtgagagaga

SEQ ID NO: 321277 - DNA, 20 bp, human
ggaacgtgcctgagcatggg

SEQ ID NO: 321278 - DNA, 20 bp, human
gaacgcgcagcgcgccccct

SEQ ID NO: 321279 - DNA, 20 bp, human
ggcggaacgtgcctgagcat

SEQ ID NO: 321280 - DNA, 20 bp, human
gagagatggctcaagtcctg

SEQ ID NO: 321281 - DNA, 20 bp, human
ggggaattgggccatgcccc

SEQ ID NO: 321282 - DNA, 20 bp, human
gaccgcgcccccccgtgtcc

SEQ ID NO: 321283 - DNA, 20 bp, human
gctgtgcccgcgcaccgagg

SEQ ID NO: 321284 - DNA, 20 bp, human
gacccaagcagcaaccagtg

SEQ ID NO: 321285 - DNA, 20 bp, human
gcgcgttcccggacacgggg

SEQ ID NO: 321286 - DNA, 20 bp, human
gcggagagatcccgggtact

SEQ ID NO: 321287 - DNA, 20 bp, human
ggatgtggtttctgtagtga

SEQ ID NO: 321288 - DNA, 20 bp, human
gttgctgtacgcgtctggtg

SEQ ID NO: 321289 - DNA, 20 bp, human
gagaggtcctgctgtctccg

SEQ ID NO: 321290 - DNA, 20 bp, human
gctgtacgcgtctggtgcgg

SEQ ID NO: 321291 - DNA, 20 bp, human
ggtagtgatggggccgactc

SEQ ID NO: 321292 - DNA, 20 bp, human
ggctgtaacggagagatccc

SEQ ID NO: 321293 - DNA, 20 bp, human
gaaggtttgctgtacgcgtc

SEQ ID NO: 321294 - DNA, 20 bp, human
gctcgggagatagagcaggt

SEQ ID NO: 321295 - DNA, 20 bp, human
gtactgcagcatgtttggtg

SEQ ID NO: 321296 - DNA, 20 bp, human
gtccgccagtccccgaggtg

SEQ ID NO: 321297 - DNA, 20 bp, human
gcgagaaggggtgttctcag

SEQ ID NO: 321298 - DNA, 20 bp, human
gtcccccgagacccagacca

SEQ ID NO: 321299 - DNA, 20 bp, human
gagtccccgaggtggggacg

SEQ ID NO: 321300 - DNA, 20 bp, human
gctcggagcgagggtgtcgg

SEQ ID NO: 321301 - DNA, 20 bp, human
ggacaccctcgctccgagaa

SEQ ID NO: 321302 - DNA, 20 bp, human
ggtggcggttgcgttttcca

SEQ ID NO: 321303 - DNA, 20 bp, human
gcacggtccgccagtccccg

SEQ ID NO: 321304 - DNA, 20 bp, human
gacaccccttctcggagcga

SEQ ID NO: 321305 - DNA, 20 bp, human
gtccccacctcggggactgg

SEQ ID NO: 321306 - DNA, 20 bp, human
gtcagcagagagccttgaga

SEQ ID NO: 321307 - DNA, 20 bp, human
gtctcccatcgggggttcgg

SEQ ID NO: 321308 - DNA, 20 bp, human
gggagaaggggtgttcttag

SEQ ID NO: 321309 - DNA, 20 bp, human
gtcacctgatacctagacca

SEQ ID NO: 321310 - DNA, 20 bp, human
gacaccccttctcccatcgg

SEQ ID NO: 321311 - DNA, 20 bp, human
ggaacccccgatgggagaag

SEQ ID NO: 321312 - DNA, 20 bp, human
gccttgagatgggatggtgc

SEQ ID NO: 321313 - DNA, 20 bp, human
ggtggggatggtgtgcctat

SEQ ID NO: 321314 - DNA, 20 bp, human
ggtctgccagtccctaaggt

SEQ ID NO: 321315 - DNA, 20 bp, human
ggcgggtctgccagtcccta

SEQ ID NO: 321316 - DNA, 20 bp, human
ggtaccctgctctatctcca

SEQ ID NO: 321317 - DNA, 20 bp, human
ggtagcgattgggacgactc

SEQ ID NO: 321318 - DNA, 20 bp, human
ggctgtaacagagagatcct

SEQ ID NO: 321319 - DNA, 20 bp, human
gcgtgggttttgtagcgatt

SEQ ID NO: 321320 - DNA, 20 bp, human
gaatggcagaaggagagcgc

SEQ ID NO: 321321 - DNA, 20 bp, human
gccgaggttatggttgaaag

SEQ ID NO: 321322 - DNA, 20 bp, human
ggttgaaagaggatgaatga

SEQ ID NO: 321323 - DNA, 20 bp, human
gaaggtttgctgtgcgcatc

SEQ ID NO: 321324 - DNA, 20 bp, human
ggcatatacgacatcatgtt

SEQ ID NO: 321325 - DNA, 20 bp, human
gtgcttttttaggaatctct

SEQ ID NO: 321326 - DNA, 20 bp, human
gcccgcccccgatccgggat

SEQ ID NO: 321327 - DNA, 20 bp, human
gtgggccaggagcttcagac

SEQ ID NO: 321328 - DNA, 20 bp, human
gtatctgcccatcccggatc

SEQ ID NO: 321329 - DNA, 20 bp, human
gacaaggtgtgggtcttccg

SEQ ID NO: 321330 - DNA, 20 bp, human
gggaaatcccgcccccgatc

SEQ ID NO: 321331 - DNA, 20 bp, human
gtgttcggccagtggcaaca

SEQ ID NO: 321332 - DNA, 20 bp, human
gggtgggcgtggattggcta

SEQ ID NO: 321333 - DNA, 20 bp, human
gcggacaggtgggcgtggat

SEQ ID NO: 321334 - DNA, 20 bp, human
ggaagctcctggcccaggat

SEQ ID NO: 321335 - DNA, 20 bp, human
gccggccgcggcggaaccgg

SEQ ID NO: 321336 - DNA, 20 bp, human
ggggccggacgcgagggctg

SEQ ID NO: 321337 - DNA, 20 bp, human
ggggcggggctggtaggcgc

SEQ ID NO: 321338 - DNA, 20 bp, human
gtggtgggttctggggtcta

SEQ ID NO: 321339 - DNA, 20 bp, human
ggggccagacacgcgagctg

SEQ ID NO: 321340 - DNA, 20 bp, human
gtggagctgccgcacgtggg

SEQ ID NO: 321341 - DNA, 20 bp, human
gctggccagcaccgcccctg

SEQ ID NO: 321342 - DNA, 20 bp, human
gtacctgagggaggacggaa

SEQ ID NO: 321343 - DNA, 20 bp, human
gccaggctgtgctctctctc

SEQ ID NO: 321344 - DNA, 20 bp, human
gctggcccgcggggttccgt

SEQ ID NO: 321345 - DNA, 20 bp, human
gtgctctctctcaggcggca

SEQ ID NO: 321346 - DNA, 20 bp, human
gcccccgtgcaagttaagtg

SEQ ID NO: 321347 - DNA, 20 bp, human
gtaagtgcgggggcgatgct

SEQ ID NO: 321348 - DNA, 20 bp, human
gagggtgaccccagcaggac

SEQ ID NO: 321349 - DNA, 20 bp, human
gcccgcacttaacttgcacg

SEQ ID NO: 321350 - DNA, 20 bp, human
gctgaggtcacgcaactaga

SEQ ID NO: 321351 - DNA, 20 bp, human
gcagcctcgcagacacatcg

SEQ ID NO: 321352 - DNA, 20 bp, human
gtgctgggggtcttgactct

SEQ ID NO: 321353 - DNA, 20 bp, human
ggggcagcttcctttgtggc

SEQ ID NO: 321354 - DNA, 20 bp, human
gcacctccatcccgccacaa

SEQ ID NO: 321355 - DNA, 20 bp, human
gttggctgttgaaatcagac

SEQ ID NO: 321356 - DNA, 20 bp, human
ggacgcacggggacaccctc

SEQ ID NO: 321357 - DNA, 20 bp, human
ggggtgtccccgtgcgtcat

SEQ ID NO: 321358 - DNA, 20 bp, human
gtgtccccgtgcgtcatcgg

SEQ ID NO: 321359 - DNA, 20 bp, human
gcagttcagaaagggaagat

SEQ ID NO: 321360 - DNA, 20 bp, human
gaaactttggtatccctcta

SEQ ID NO: 321361 - DNA, 20 bp, human
ggtagcctatctgccataga

SEQ ID NO: 321362 - DNA, 20 bp, human
gtgcacaggcacactcacat

SEQ ID NO: 321363 - DNA, 20 bp, human
gggtgtaggcaggagtagcc

SEQ ID NO: 321364 - DNA, 20 bp, human
ggtaatgatgcttattgctg

SEQ ID NO: 321365 - DNA, 20 bp, human
gtctctctgcacttcccttg

SEQ ID NO: 321366 - DNA, 20 bp, human
gcggacccaaggacagtccc

SEQ ID NO: 321367 - DNA, 20 bp, human
gacagtcccaggagacgtgg

SEQ ID NO: 321368 - DNA, 20 bp, human
gtgccagcccgagccagatg

SEQ ID NO: 321369 - DNA, 20 bp, human
gccagatggggctcgggcgc

SEQ ID NO: 321370 - DNA, 20 bp, human
gtggggctcgggcgcgggat

SEQ ID NO: 321371 - DNA, 20 bp, human
gggtccgatgcggggctgtg

SEQ ID NO: 321372 - DNA, 20 bp, human
ggtctcctgggactgtcctt

SEQ ID NO: 321373 - DNA, 20 bp, human
ggaggaggggacttagaacc

SEQ ID NO: 321374 - DNA, 20 bp, human
ggagcctccaggatgaacta

SEQ ID NO: 321375 - DNA, 20 bp, human
gtggggaggtgccagggtgt

SEQ ID NO: 321376 - DNA, 20 bp, human
gcagacaggctctagatgat

SEQ ID NO: 321377 - DNA, 20 bp, human
ggggccccacccatcctgag

SEQ ID NO: 321378 - DNA, 20 bp, human
gataggcggaccaggagcac

SEQ ID NO: 321379 - DNA, 20 bp, human
gtggcggagtgcccatgtgg

SEQ ID NO: 321380 - DNA, 20 bp, human
gctgcagcgtcagctggtct

SEQ ID NO: 321381 - DNA, 20 bp, human
ggctgcccgggcagacacag

SEQ ID NO: 321382 - DNA, 20 bp, human
gcacacaccgtgtttagtat

SEQ ID NO: 321383 - DNA, 20 bp, human
gaggcccagcctctcaggat

SEQ ID NO: 321384 - DNA, 20 bp, human
gaagctcccaaaaccatgag

SEQ ID NO: 321385 - DNA, 20 bp, human
gtccgcctatagatgccatg

SEQ ID NO: 321386 - DNA, 20 bp, human
gtcagtgggatgactgtcaa

SEQ ID NO: 321387 - DNA, 20 bp, human
gaggaggagtgtgggttcca

SEQ ID NO: 321388 - DNA, 20 bp, human
gaagttgagaaacaagggag

SEQ ID NO: 321389 - DNA, 20 bp, human
gggctggggttaagtggtag

SEQ ID NO: 321390 - DNA, 20 bp, human
ggggtggttctgcttcacag

SEQ ID NO: 321391 - DNA, 20 bp, human
gcagaggcttggggcagatg

SEQ ID NO: 321392 - DNA, 20 bp, human
gagggatgtgggaagtctcc

SEQ ID NO: 321393 - DNA, 20 bp, human
gatgggcaattgctcaccag

SEQ ID NO: 321394 - DNA, 20 bp, human
gaccacccactgaatgtcag

SEQ ID NO: 321395 - DNA, 20 bp, human
gatgaggtcaagtttcccac

SEQ ID NO: 321396 - DNA, 20 bp, human
ggggtctgctgattaggaga

SEQ ID NO: 321397 - DNA, 20 bp, human
gagcagaccctgtttagtcc

SEQ ID NO: 321398 - DNA, 20 bp, human
gtaaacagggtctgctgatt

SEQ ID NO: 321399 - DNA, 20 bp, human
ggagctccaacatcataaac

SEQ ID NO: 321400 - DNA, 20 bp, human
gcatctgggcagaaacacgc

SEQ ID NO: 321401 - DNA, 20 bp, human
gccaagacgggccccccggg

SEQ ID NO: 321402 - DNA, 20 bp, human
gcaacatcataaacggggtg

SEQ ID NO: 321403 - DNA, 20 bp, human
ggagtcagctggctaatcac

SEQ ID NO: 321404 - DNA, 20 bp, human
gccccccgggtggaggatct

SEQ ID NO: 321405 - DNA, 20 bp, human
gttcttgatgaccttcgcga

SEQ ID NO: 321406 - DNA, 20 bp, human
ggcagctgtcgaatgggaag

SEQ ID NO: 321407 - DNA, 20 bp, human
ggaccttgcagctgtcgaat

SEQ ID NO: 321408 - DNA, 20 bp, human
gctcctcaaggcccacacgt

SEQ ID NO: 321409 - DNA, 20 bp, human
ggccctccagcttgtacatg

SEQ ID NO: 321410 - DNA, 20 bp, human
gcacgtgtactgtcctgaag

SEQ ID NO: 321411 - DNA, 20 bp, human
gccagcataagatggcgact

SEQ ID NO: 321412 - DNA, 20 bp, human
gcatgaggatgaaatactcg

SEQ ID NO: 321413 - DNA, 20 bp, human
ggcaaactgaccaggagaac

SEQ ID NO: 321414 - DNA, 20 bp, human
gcacgtgatccagcataaga

SEQ ID NO: 321415 - DNA, 20 bp, human
ggtaaaaacgttcttgaaag

SEQ ID NO: 321416 - DNA, 20 bp, human
ggccctgccccactcaccaa

SEQ ID NO: 321417 - DNA, 20 bp, human
gcagaacagccattggtgag

SEQ ID NO: 321418 - DNA, 20 bp, human
gcaccaatggctgttctggg

SEQ ID NO: 321419 - DNA, 20 bp, human
gggggagattaagaaatccg

SEQ ID NO: 321420 - DNA, 20 bp, human
gagaaatccgaggagccact

SEQ ID NO: 321421 - DNA, 20 bp, human
gcatcagccaagtggctcct

SEQ ID NO: 321422 - DNA, 20 bp, human
gtgcgactgcgcctcttcca

SEQ ID NO: 321423 - DNA, 20 bp, human
gctcctatgcacgggacaca

SEQ ID NO: 321424 - DNA, 20 bp, human
gatgcaatggaaggtgtgct

SEQ ID NO: 321425 - DNA, 20 bp, human
gagccaagatcgcagagcca

SEQ ID NO: 321426 - DNA, 20 bp, human
gacaagtgtcctgtggatat

SEQ ID NO: 321427 - DNA, 20 bp, human
ggtgtactaacacaagtagc

SEQ ID NO: 321428 - DNA, 20 bp, human
ggcaggtcacaagtgtcctg

SEQ ID NO: 321429 - DNA, 20 bp, human
gtacctagactcgagatcac

SEQ ID NO: 321430 - DNA, 20 bp, human
gagccagtgatctcgagtct

SEQ ID NO: 321431 - DNA, 20 bp, human
ggaaaatacccagttgaggc

SEQ ID NO: 321432 - DNA, 20 bp, human
gtagagaaaatacccagttg

SEQ ID NO: 321433 - DNA, 20 bp, human
ggtgtaggcaagacagtgag

SEQ ID NO: 321434 - DNA, 20 bp, human
gtgagaggaggtgatattta

SEQ ID NO: 321435 - DNA, 20 bp, human
gtaggcaagacagtgagagg

SEQ ID NO: 321436 - DNA, 20 bp, human
gcagcccggctggaccgaaa

SEQ ID NO: 321437 - DNA, 20 bp, human
gggagcctgtgagagtggac

SEQ ID NO: 321438 - DNA, 20 bp, human
ggggaggcgcgggatacttc

SEQ ID NO: 321439 - DNA, 20 bp, human
gggaccgaaacggaagtccc

SEQ ID NO: 321440 - DNA, 20 bp, human
gcatcccggtccactctcac

SEQ ID NO: 321441 - DNA, 20 bp, human
ggggcgggaagagagagcgc

SEQ ID NO: 321442 - DNA, 20 bp, human
gccagcggccaaaggtcggg

SEQ ID NO: 321443 - DNA, 20 bp, human
ggacactcgcagtgtttcca

SEQ ID NO: 321444 - DNA, 20 bp, human
gttaagtgacatgaactctc

SEQ ID NO: 321445 - DNA, 20 bp, human
gaagaggggcagaaaatcga

SEQ ID NO: 321446 - DNA, 20 bp, human
ggccgcaatcacagttatct

SEQ ID NO: 321447 - DNA, 20 bp, human
gagtcaagatggaggaccac

SEQ ID NO: 321448 - DNA, 20 bp, human
gtaacaggcagtcaagatgg

SEQ ID NO: 321449 - DNA, 20 bp, human
gggtggagatccggaagctc

SEQ ID NO: 321450 - DNA, 20 bp, human
ggatccggaagctcaggtga

SEQ ID NO: 321451 - DNA, 20 bp, human
gataactgtgattgcggccg

SEQ ID NO: 321452 - DNA, 20 bp, human
gtagaagcctcagctgtgat

SEQ ID NO: 321453 - DNA, 20 bp, human
gcgccccgagggccaatcac

SEQ ID NO: 321454 - DNA, 20 bp, human
gcaagatggaggaccacagg

SEQ ID NO: 321455 - DNA, 20 bp, human
ggactctcgaaagaactcca

SEQ ID NO: 321456 - DNA, 20 bp, human
ggggaggccagtatgagatg

SEQ ID NO: 321457 - DNA, 20 bp, human
gccagtatggaaccgagaca

SEQ ID NO: 321458 - DNA, 20 bp, human
ggcctcccaccctgcttctg

SEQ ID NO: 321459 - DNA, 20 bp, human
gagcaaggtgaaccccagta

SEQ ID NO: 321460 - DNA, 20 bp, human
gttgcagcgggcagtgtcag

SEQ ID NO: 321461 - DNA, 20 bp, human
gtcacggaatggctggtatg

SEQ ID NO: 321462 - DNA, 20 bp, human
ggaggcaccccacagaagca

SEQ ID NO: 321463 - DNA, 20 bp, human
gggaatggctggtatgtggc

SEQ ID NO: 321464 - DNA, 20 bp, human
gttcaccttgctctcctctg

SEQ ID NO: 321465 - DNA, 20 bp, human
gtcgcagccccagaaggggc

SEQ ID NO: 321466 - DNA, 20 bp, human
gtgactcacaaagcctaaaa

SEQ ID NO: 321467 - DNA, 20 bp, human
gcctaggtcaggtccttttt

SEQ ID NO: 321468 - DNA, 20 bp, human
gggaggcaactgcctaggtc

SEQ ID NO: 321469 - DNA, 20 bp, human
gtctgaaagtccacctaaaa

SEQ ID NO: 321470 - DNA, 20 bp, human
ggagaggagatgcagtagag

SEQ ID NO: 321471 - DNA, 20 bp, human
gcttctggaggcaactgcct

SEQ ID NO: 321472 - DNA, 20 bp, human
ggtctcataaattatttaac

SEQ ID NO: 321473 - DNA, 20 bp, human
gtttcaatagacacatacac

SEQ ID NO: 321474 - DNA, 20 bp, human
gactcaatttgcataaacaa

SEQ ID NO: 321475 - DNA, 20 bp, human
gaggtcaggtcctttttagg

SEQ ID NO: 321476 - DNA, 20 bp, human
gagagtacctgcctcttcaa

SEQ ID NO: 321477 - DNA, 20 bp, human
gtgctcaggacgtctcggtc

SEQ ID NO: 321478 - DNA, 20 bp, human
gtggcaggtagctttagagc

SEQ ID NO: 321479 - DNA, 20 bp, human
gtgagcagaagagtatgtca

SEQ ID NO: 321480 - DNA, 20 bp, human
gtcacggtacacaagcgctc

SEQ ID NO: 321481 - DNA, 20 bp, human
gacaagtgagccggtcggaa

SEQ ID NO: 321482 - DNA, 20 bp, human
gcaggacgtctcggtctggc

SEQ ID NO: 321483 - DNA, 20 bp, human
gctgtgccagcccttccgac

SEQ ID NO: 321484 - DNA, 20 bp, human
gtcttctgctcaggacgtct

SEQ ID NO: 321485 - DNA, 20 bp, human
gggctggcacagagcatgca

SEQ ID NO: 321486 - DNA, 20 bp, human
ggcgggcgggggtcacccga

SEQ ID NO: 321487 - DNA, 20 bp, human
gccgcccccgactctggcgc

SEQ ID NO: 321488 - DNA, 20 bp, human
gccaccgcgggcagggcctc

SEQ ID NO: 321489 - DNA, 20 bp, human
gacgccccgacccgggtccg

SEQ ID NO: 321490 - DNA, 20 bp, human
gtctccggcgccagagtcgg

SEQ ID NO: 321491 - DNA, 20 bp, human
gctgcccgcggtgggttctc

SEQ ID NO: 321492 - DNA, 20 bp, human
ggcgggcgggcgcgggtcat

SEQ ID NO: 321493 - DNA, 20 bp, human
gcttggcccgggactccctg

SEQ ID NO: 321494 - DNA, 20 bp, human
ggcgccggagaacccaccgc

SEQ ID NO: 321495 - DNA, 20 bp, human
gtcccgggccaagcatcgtc

SEQ ID NO: 321496 - DNA, 20 bp, human
gcacccgggccaggtgtgat

SEQ ID NO: 321497 - DNA, 20 bp, human
gggcccgggtggtctaggaa

SEQ ID NO: 321498 - DNA, 20 bp, human
gcagtggggcggttccaccc

SEQ ID NO: 321499 - DNA, 20 bp, human
gcactgagattaacattggg

SEQ ID NO: 321500 - DNA, 20 bp, human
gtctccacctagcgtaccaa

SEQ ID NO: 321501 - DNA, 20 bp, human
ggccccactgagattaacat

SEQ ID NO: 321502 - DNA, 20 bp, human
ggagcctgaggtcagtggtt

SEQ ID NO: 321503 - DNA, 20 bp, human
gcggcttgctgaatctcccc

SEQ ID NO: 321504 - DNA, 20 bp, human
gtggcccttggtacgctagg

SEQ ID NO: 321505 - DNA, 20 bp, human
gacagctttcccgcccaggg

SEQ ID NO: 321506 - DNA, 20 bp, human
ggcaggaacagtcttgttct

SEQ ID NO: 321507 - DNA, 20 bp, human
gagtatgagaccttaggtta

SEQ ID NO: 321508 - DNA, 20 bp, human
gggttaaggctgaagaactg

SEQ ID NO: 321509 - DNA, 20 bp, human
gagtctcttaattcagtctt

SEQ ID NO: 321510 - DNA, 20 bp, human
gtgcagagtccactctagct

SEQ ID NO: 321511 - DNA, 20 bp, human
ggctccgagtatgagacctt

SEQ ID NO: 321512 - DNA, 20 bp, human
ggttcctgctgtacagtgag

SEQ ID NO: 321513 - DNA, 20 bp, human
gggtaaaaagaacgaacaaa

SEQ ID NO: 321514 - DNA, 20 bp, human
gaaaagaacgaacaaaaggc

SEQ ID NO: 321515 - DNA, 20 bp, human
ggacatcgccccagctagag

SEQ ID NO: 321516 - DNA, 20 bp, human
ggattcgtgtaatgcttact

SEQ ID NO: 321517 - DNA, 20 bp, human
gttctccatgacttcttttg

SEQ ID NO: 321518 - DNA, 20 bp, human
gcgtgtaatgcttacttggc

SEQ ID NO: 321519 - DNA, 20 bp, human
ggcagagaatctttgaggaa

SEQ ID NO: 321520 - DNA, 20 bp, human
gaggaggtaaagggagtacc

SEQ ID NO: 321521 - DNA, 20 bp, human
gtcaaagattctctgcccta

SEQ ID NO: 321522 - DNA, 20 bp, human
gttcgctaaaccttttgtga

SEQ ID NO: 321523 - DNA, 20 bp, human
gctaaaatctagaaaatata

SEQ ID NO: 321524 - DNA, 20 bp, human
gtggcaggtattctgcgtgc

SEQ ID NO: 321525 - DNA, 20 bp, human
gctttgaggaaaggaggtaa

SEQ ID NO: 321526 - DNA, 20 bp, human
gttgcaccaaacatcatcta

SEQ ID NO: 321527 - DNA, 20 bp, human
ggagtgttatgtagcaaaca

SEQ ID NO: 321528 - DNA, 20 bp, human
gtcagtaattatatacacaa

SEQ ID NO: 321529 - DNA, 20 bp, human
gataaagaataaatgatacc

SEQ ID NO: 321530 - DNA, 20 bp, human
ggactatactaaggatggga

SEQ ID NO: 321531 - DNA, 20 bp, human
gttcaggaagatgaaaataa

SEQ ID NO: 321532 - DNA, 20 bp, human
gtaggtcaaacagcaaacac

SEQ ID NO: 321533 - DNA, 20 bp, human
ggattagactatactaagga

SEQ ID NO: 321534 - DNA, 20 bp, human
gctctagatttataaattat

SEQ ID NO: 321535 - DNA, 20 bp, human
gattacagatgatcacattc

SEQ ID NO: 321536 - DNA, 20 bp, human
gggaggcccaggggtaaggt

SEQ ID NO: 321537 - DNA, 20 bp, human
ggggtaaggtaggaagactc

SEQ ID NO: 321538 - DNA, 20 bp, human
gtcagggaggcccaggggta

SEQ ID NO: 321539 - DNA, 20 bp, human
gaggtggttagtgaggtcac

SEQ ID NO: 321540 - DNA, 20 bp, human
gagggtgaaatgacttgtgc

SEQ ID NO: 321541 - DNA, 20 bp, human
gacctcactaaccacctccc

SEQ ID NO: 321542 - DNA, 20 bp, human
gcaggcccgggatgttgttc

SEQ ID NO: 321543 - DNA, 20 bp, human
gctgcagagggcagtactag

SEQ ID NO: 321544 - DNA, 20 bp, human
gtgagccagaacaacatccc

SEQ ID NO: 321545 - DNA, 20 bp, human
gtccctgaggcgcggtgtcc

SEQ ID NO: 321546 - DNA, 20 bp, human
gtctctgggcggcccaaagg

SEQ ID NO: 321547 - DNA, 20 bp, human
gcccctgcctggtaacctag

SEQ ID NO: 321548 - DNA, 20 bp, human
gcgcgtgcgggccagagtgt

SEQ ID NO: 321549 - DNA, 20 bp, human
ggacctgcacacccacactc

SEQ ID NO: 321550 - DNA, 20 bp, human
gcctctaccctcatgaagag

SEQ ID NO: 321551 - DNA, 20 bp, human
ggtaacctagcgggagggtg

SEQ ID NO: 321552 - DNA, 20 bp, human
ggcctggtaacctagcggga

SEQ ID NO: 321553 - DNA, 20 bp, human
gcaggcaggggcaccccctt

SEQ ID NO: 321554 - DNA, 20 bp, human
gaccgggcaccggccaaaca

SEQ ID NO: 321555 - DNA, 20 bp, human
gccggggccgggcccctgtt

SEQ ID NO: 321556 - DNA, 20 bp, human
ggggccgcagctgaaatccc

SEQ ID NO: 321557 - DNA, 20 bp, human
gggtaaggatggatgtatat

SEQ ID NO: 321558 - DNA, 20 bp, human
gaacaaggagctgtcccttg

SEQ ID NO: 321559 - DNA, 20 bp, human
gacagctccttgttcctgaa

SEQ ID NO: 321560 - DNA, 20 bp, human
ggagctccaggcaagaactt

SEQ ID NO: 321561 - DNA, 20 bp, human
gtgttctcgcggttatctag

SEQ ID NO: 321562 - DNA, 20 bp, human
gtcatcctggcgctgtccag

SEQ ID NO: 321563 - DNA, 20 bp, human
ggtggccccgcctagttccc

SEQ ID NO: 321564 - DNA, 20 bp, human
gtagcggaaaacagcctttc

SEQ ID NO: 321565 - DNA, 20 bp, human
gtccaagcaggaggagctcc

SEQ ID NO: 321566 - DNA, 20 bp, human
gtcgcggagagaagtcccag

SEQ ID NO: 321567 - DNA, 20 bp, human
gccgacgggcggaagggtga

SEQ ID NO: 321568 - DNA, 20 bp, human
ggctcgcgagatcttctctg

SEQ ID NO: 321569 - DNA, 20 bp, human
gaaggggcggcaccgacggg

SEQ ID NO: 321570 - DNA, 20 bp, human
gaggaaaggggcggcaccga

SEQ ID NO: 321571 - DNA, 20 bp, human
ggtcccgtcagctgccaacc

SEQ ID NO: 321572 - DNA, 20 bp, human
gacggggtggggacgaggaa

SEQ ID NO: 321573 - DNA, 20 bp, human
gcccgagtgacgtattaaaa

SEQ ID NO: 321574 - DNA, 20 bp, human
gactgaaaagcagtcactga

SEQ ID NO: 321575 - DNA, 20 bp, human
gtgacgtattaaaagggacg

SEQ ID NO: 321576 - DNA, 20 bp, human
gggagtaggcagtcattcta

SEQ ID NO: 321577 - DNA, 20 bp, human
gtactcccaagaggaagcgt

SEQ ID NO: 321578 - DNA, 20 bp, human
gctcgcccacgcttcctctt

SEQ ID NO: 321579 - DNA, 20 bp, human
gcgtgtgagcgccacctctc

SEQ ID NO: 321580 - DNA, 20 bp, human
gagcaagcagctaaccggaa

SEQ ID NO: 321581 - DNA, 20 bp, human
gagcaaattggcttcccgag

SEQ ID NO: 321582 - DNA, 20 bp, human
gcaagtgctgcgaaccacgt

SEQ ID NO: 321583 - DNA, 20 bp, human
gaacgcgcccgggacccacg

SEQ ID NO: 321584 - DNA, 20 bp, human
gggtctgaaaaagctagcgc

SEQ ID NO: 321585 - DNA, 20 bp, human
ggagcggtgttctgcaaaat

SEQ ID NO: 321586 - DNA, 20 bp, human
gtcagctccaggtctccctc

SEQ ID NO: 321587 - DNA, 20 bp, human
gtgaactaatatgtcaatgt

SEQ ID NO: 321588 - DNA, 20 bp, human
gagttcatagatcaggggac

SEQ ID NO: 321589 - DNA, 20 bp, human
gttgagacggatgacgctgt

SEQ ID NO: 321590 - DNA, 20 bp, human
gtgggataatccgcttgaga

SEQ ID NO: 321591 - DNA, 20 bp, human
gaagctggtttaaatctgtc

SEQ ID NO: 321592 - DNA, 20 bp, human
gatattagttcatagatcag

SEQ ID NO: 321593 - DNA, 20 bp, human
ggaattgggtttttaccaga

SEQ ID NO: 321594 - DNA, 20 bp, human
gaaattatagtccttgcttt

SEQ ID NO: 321595 - DNA, 20 bp, human
ggcggattatcccataaagc

SEQ ID NO: 321596 - DNA, 20 bp, human
gtcgagacggatccagagac

SEQ ID NO: 321597 - DNA, 20 bp, human
gcgccaggcagagatcgaga

SEQ ID NO: 321598 - DNA, 20 bp, human
ggcctggcgagggcgcgccc

SEQ ID NO: 321599 - DNA, 20 bp, human
gaggaccgtgggtgcacgac

SEQ ID NO: 321600 - DNA, 20 bp, human
gaggaatcacttcctgtctc

SEQ ID NO: 321601 - DNA, 20 bp, human
gtggggcgttcctgcgggtt

SEQ ID NO: 321602 - DNA, 20 bp, human
gggtcacgggaagtactgag

SEQ ID NO: 321603 - DNA, 20 bp, human
gagaactcgagcacaggagc

SEQ ID NO: 321604 - DNA, 20 bp, human
gaactcataggacgtccagg

SEQ ID NO: 321605 - DNA, 20 bp, human
gccacccgcccggcccgacg

SEQ ID NO: 321606 - DNA, 20 bp, human
gtcgagacggatccagagac

SEQ ID NO: 321607 - DNA, 20 bp, human
gcgccaggcagagatcgaga

SEQ ID NO: 321608 - DNA, 20 bp, human
ggcctggcgagggcgcgccc

SEQ ID NO: 321609 - DNA, 20 bp, human
gaggaccgtgggtgcacgac

SEQ ID NO: 321610 - DNA, 20 bp, human
gaggaatcacttcctgtctc

SEQ ID NO: 321611 - DNA, 20 bp, human
gtggggcgttcctgcgggtt

SEQ ID NO: 321612 - DNA, 20 bp, human
gggtcacgggaagtactgag

SEQ ID NO: 321613 - DNA, 20 bp, human
gagaactcgagcacaggagc

SEQ ID NO: 321614 - DNA, 20 bp, human
gaactcataggacgtccagg

SEQ ID NO: 321615 - DNA, 20 bp, human
gccacccgcccggcccgacg

SEQ ID NO: 321616 - DNA, 20 bp, human
gcggaacccggcagccgtgg

SEQ ID NO: 321617 - DNA, 20 bp, human
ggaaccacctgggcgggttg

SEQ ID NO: 321618 - DNA, 20 bp, human
gtttaggaccggggagagaa

SEQ ID NO: 321619 - DNA, 20 bp, human
gaggcctggtcggggcgctg

SEQ ID NO: 321620 - DNA, 20 bp, human
gcccccacacccaactccga

SEQ ID NO: 321621 - DNA, 20 bp, human
gccaggtggttccacccacg

SEQ ID NO: 321622 - DNA, 20 bp, human
gcgagctgctggaggagact

SEQ ID NO: 321623 - DNA, 20 bp, human
gggcctccgcagctgccctc

SEQ ID NO: 321624 - DNA, 20 bp, human
gaaccagcgggtggccttag

SEQ ID NO: 321625 - DNA, 20 bp, human
gaggccgcagcgccccgacc

SEQ ID NO: 321626 - DNA, 20 bp, human
gggaggaaggcccactcggg

SEQ ID NO: 321627 - DNA, 20 bp, human
gtgagccccagggcgggaga

SEQ ID NO: 321628 - DNA, 20 bp, human
gtccggagacgctgactctg

SEQ ID NO: 321629 - DNA, 20 bp, human
ggccgcagagtcagcgtctc

SEQ ID NO: 321630 - DNA, 20 bp, human
gcccgtggcccggcgctcac

SEQ ID NO: 321631 - DNA, 20 bp, human
ggccccggacccccgtggcc

SEQ ID NO: 321632 - DNA, 20 bp, human
gcgagtgggccttcctccgt

SEQ ID NO: 321633 - DNA, 20 bp, human
ggcgttaaaacgatagttaa

SEQ ID NO: 321634 - DNA, 20 bp, human
gtagtcccgcctactcgtcc

SEQ ID NO: 321635 - DNA, 20 bp, human
ggccgggccacgggggtccg

SEQ ID NO: 321636 - DNA, 20 bp, human
gagacctgaagccccagcgt

SEQ ID NO: 321637 - DNA, 20 bp, human
gccgcctggaaaggaatggt

SEQ ID NO: 321638 - DNA, 20 bp, human
gcctggaaaggaatggttgg

SEQ ID NO: 321639 - DNA, 20 bp, human
gtagtgctctaagattcaca

SEQ ID NO: 321640 - DNA, 20 bp, human
gagccaccgtccccacgctg

SEQ ID NO: 321641 - DNA, 20 bp, human
gcatccttcaaacgggaaga

SEQ ID NO: 321642 - DNA, 20 bp, human
gcagagagccaatcccagca

SEQ ID NO: 321643 - DNA, 20 bp, human
gcatccttcttcccgtttga

SEQ ID NO: 321644 - DNA, 20 bp, human
ggcatcatctggtgaaacga

SEQ ID NO: 321645 - DNA, 20 bp, human
gcaaggttccttgctgggat

SEQ ID NO: 321646 - DNA, 20 bp, human
gtgcgccgcggcgtgaggtg

SEQ ID NO: 321647 - DNA, 20 bp, human
ggaggtgtgagttgccctgg

SEQ ID NO: 321648 - DNA, 20 bp, human
gcctgctcggggtcctagtc

SEQ ID NO: 321649 - DNA, 20 bp, human
gttgccgcggacgggacgag

SEQ ID NO: 321650 - DNA, 20 bp, human
gcatcctctcgtcccgtccg

SEQ ID NO: 321651 - DNA, 20 bp, human
gggaacccagaggaccggac

SEQ ID NO: 321652 - DNA, 20 bp, human
gcaggcgcatgcatttgccg

SEQ ID NO: 321653 - DNA, 20 bp, human
gcctgggcgccctcggaagc

SEQ ID NO: 321654 - DNA, 20 bp, human
gctgggcgccctcggcggga

SEQ ID NO: 321655 - DNA, 20 bp, human
gcacacctcacctcacgccg

SEQ ID NO: 321656 - DNA, 20 bp, human
gccctccacgctgtcgcctg

SEQ ID NO: 321657 - DNA, 20 bp, human
ggaggggcgggtctgtcgat

SEQ ID NO: 321658 - DNA, 20 bp, human
gccactaaggacgaagaggt

SEQ ID NO: 321659 - DNA, 20 bp, human
gactgccggaaacagaataa

SEQ ID NO: 321660 - DNA, 20 bp, human
gccactgtcgcacgaggcgt

SEQ ID NO: 321661 - DNA, 20 bp, human
ggtagccccaggcgacagcg

SEQ ID NO: 321662 - DNA, 20 bp, human
ggccccaggcgacagcgtgg

SEQ ID NO: 321663 - DNA, 20 bp, human
gagagctgctggatatgcgg

SEQ ID NO: 321664 - DNA, 20 bp, human
gcctcgtgcgacagtgggcg

SEQ ID NO: 321665 - DNA, 20 bp, human
gaaccctgagtaatcggaag

SEQ ID NO: 321666 - DNA, 20 bp, human
ggacgccgctcaagtctcac

SEQ ID NO: 321667 - DNA, 20 bp, human
gtcagcctcgggccctacca

SEQ ID NO: 321668 - DNA, 20 bp, human
gccagacagcagctatacct

SEQ ID NO: 321669 - DNA, 20 bp, human
gagggtcctaggtactggaa

SEQ ID NO: 321670 - DNA, 20 bp, human
ggtaaagcgtggccagtcac

SEQ ID NO: 321671 - DNA, 20 bp, human
gctaccagggtcctaggtac

SEQ ID NO: 321672 - DNA, 20 bp, human
gtctggggatagaggaacgt

SEQ ID NO: 321673 - DNA, 20 bp, human
ggatagaggaacgtagggat

SEQ ID NO: 321674 - DNA, 20 bp, human
ggctcaaacggccacaacga

SEQ ID NO: 321675 - DNA, 20 bp, human
gtatagctgctgtctggagc

SEQ ID NO: 321676 - DNA, 20 bp, human
gcaacgcagtctctccgcgg

SEQ ID NO: 321677 - DNA, 20 bp, human
ggccctccatatcggaccat

SEQ ID NO: 321678 - DNA, 20 bp, human
gggtccgatatggagggcaa

SEQ ID NO: 321679 - DNA, 20 bp, human
gaacactgcagccaatgagt

SEQ ID NO: 321680 - DNA, 20 bp, human
gcgccccttgccctccatat

SEQ ID NO: 321681 - DNA, 20 bp, human
gccaggcctgccaggaaagc

SEQ ID NO: 321682 - DNA, 20 bp, human
gaccataggaacccactcat

SEQ ID NO: 321683 - DNA, 20 bp, human
ggcaacctggcccccccgcc

SEQ ID NO: 321684 - DNA, 20 bp, human
gggcctgccaggaaagccgg

SEQ ID NO: 321685 - DNA, 20 bp, human
ggccaatgagtgggttccta

SEQ ID NO: 321686 - DNA, 20 bp, human
gaacccagctgttcctgcga

SEQ ID NO: 321687 - DNA, 20 bp, human
gtggccctcgcaggaacagc

SEQ ID NO: 321688 - DNA, 20 bp, human
ggcctcctgcagaagcgccg

SEQ ID NO: 321689 - DNA, 20 bp, human
gctgcggggtcttcctgagg

SEQ ID NO: 321690 - DNA, 20 bp, human
gcggaaccccgggaggcact

SEQ ID NO: 321691 - DNA, 20 bp, human
gaaaaggggtggttttgcgg

SEQ ID NO: 321692 - DNA, 20 bp, human
ggcgccgcgggagagctgcg

SEQ ID NO: 321693 - DNA, 20 bp, human
ggaaacgccggaaccccggg

SEQ ID NO: 321694 - DNA, 20 bp, human
gtctcccgcggcgcttctgc

SEQ ID NO: 321695 - DNA, 20 bp, human
gtcccccggggccatgaagt

SEQ ID NO: 321696 - DNA, 20 bp, human
gggcacagggggaatcccgg

SEQ ID NO: 321697 - DNA, 20 bp, human
gccgccaggccagtgccctc

SEQ ID NO: 321698 - DNA, 20 bp, human
gaggcccggaaggagtttcg

SEQ ID NO: 321699 - DNA, 20 bp, human
gccagtgccctcaggtaggc

SEQ ID NO: 321700 - DNA, 20 bp, human
gtccagcggaagtgctcccc

SEQ ID NO: 321701 - DNA, 20 bp, human
gtggccctaaactctgggac

SEQ ID NO: 321702 - DNA, 20 bp, human
ggcgggcggtcaggcggcac

SEQ ID NO: 321703 - DNA, 20 bp, human
gggactggcgggcggtcagg

SEQ ID NO: 321704 - DNA, 20 bp, human
gggtccccgaaactccttcc

SEQ ID NO: 321705 - DNA, 20 bp, human
gaaggagtttcggggaccat

SEQ ID NO: 321706 - DNA, 20 bp, human
gcaccaggcgagagatgcga

SEQ ID NO: 321707 - DNA, 20 bp, human
gagctgcaagcgttaagggg

SEQ ID NO: 321708 - DNA, 20 bp, human
ggacagtgatggagtgaagt

SEQ ID NO: 321709 - DNA, 20 bp, human
ggatggagtgaagtgggctg

SEQ ID NO: 321710 - DNA, 20 bp, human
ggccttctggataaactcta

SEQ ID NO: 321711 - DNA, 20 bp, human
gactctaaggaagacagtga

SEQ ID NO: 321712 - DNA, 20 bp, human
gtgggctgggggcgatagag

SEQ ID NO: 321713 - DNA, 20 bp, human
ggcagctccggctagatccg

SEQ ID NO: 321714 - DNA, 20 bp, human
gtgggggcgatagagaggat

SEQ ID NO: 321715 - DNA, 20 bp, human
gacgcggtttgcgtctggag

SEQ ID NO: 321716 - DNA, 20 bp, human
gcgctggctcccaaccgcca

SEQ ID NO: 321717 - DNA, 20 bp, human
gcaacacaaaagagccttgg

SEQ ID NO: 321718 - DNA, 20 bp, human
gagggcccgccccagcgaag

SEQ ID NO: 321719 - DNA, 20 bp, human
gcaaaagagccttggcggtt

SEQ ID NO: 321720 - DNA, 20 bp, human
gccagggccgggtctcctta

SEQ ID NO: 321721 - DNA, 20 bp, human
ggggcggggcttaggaccct

SEQ ID NO: 321722 - DNA, 20 bp, human
gcggttgggagccagcgggc

SEQ ID NO: 321723 - DNA, 20 bp, human
gaagcagggaaggatttctg

SEQ ID NO: 321724 - DNA, 20 bp, human
gtgcgccccgccccttcgct

SEQ ID NO: 321725 - DNA, 20 bp, human
gcccgccccagcgaaggggc

SEQ ID NO: 321726 - DNA, 20 bp, human
gtgcctggggcgggcaaacc

SEQ ID NO: 321727 - DNA, 20 bp, human
gcacggaagcccagcgtcgg

SEQ ID NO: 321728 - DNA, 20 bp, human
gcaggaggagccaactgcgc

SEQ ID NO: 321729 - DNA, 20 bp, human
ggggactcggcgtcgtttcc

SEQ ID NO: 321730 - DNA, 20 bp, human
ggagtcccgcgggatccagg

SEQ ID NO: 321731 - DNA, 20 bp, human
gaaacgacgccgagtcccgc

SEQ ID NO: 321732 - DNA, 20 bp, human
gaggtggagagcctcttaac

SEQ ID NO: 321733 - DNA, 20 bp, human
gactgtgcacgtgcctgggg

SEQ ID NO: 321734 - DNA, 20 bp, human
gtcggccgaaacccctcctc

SEQ ID NO: 321735 - DNA, 20 bp, human
gtgcgccggaggaggggttt

SEQ ID NO: 321736 - DNA, 20 bp, human
ggccgcgcgcgctcccgata

SEQ ID NO: 321737 - DNA, 20 bp, human
ggcggcccgcggcactgcac

SEQ ID NO: 321738 - DNA, 20 bp, human
ggcgcgctcccgatagggaa

SEQ ID NO: 321739 - DNA, 20 bp, human
gaccagccggagccgagcga

SEQ ID NO: 321740 - DNA, 20 bp, human
gaagggccggagctgcgcag

SEQ ID NO: 321741 - DNA, 20 bp, human
gagctccggcccttccctat

SEQ ID NO: 321742 - DNA, 20 bp, human
gagccgagcgagggcgaagc

SEQ ID NO: 321743 - DNA, 20 bp, human
ggctcccgatagggaagggc

SEQ ID NO: 321744 - DNA, 20 bp, human
gtgcgccagtgcagtgccgc

SEQ ID NO: 321745 - DNA, 20 bp, human
ggcggggtccacttcctcgt

SEQ ID NO: 321746 - DNA, 20 bp, human
gcatcccgtgcctgccttgt

SEQ ID NO: 321747 - DNA, 20 bp, human
gcacgagctggccgggcagg

SEQ ID NO: 321748 - DNA, 20 bp, human
gagagagcgggatattttta

SEQ ID NO: 321749 - DNA, 20 bp, human
gtgaccgggggcccagccac

SEQ ID NO: 321750 - DNA, 20 bp, human
gccgggggaggcggcccctg

SEQ ID NO: 321751 - DNA, 20 bp, human
gagaaccagtcttaatgtca

SEQ ID NO: 321752 - DNA, 20 bp, human
gcgcagggtcccggcctcta

SEQ ID NO: 321753 - DNA, 20 bp, human
gagcgggatatttttaggga

SEQ ID NO: 321754 - DNA, 20 bp, human
ggccttgcccaggtgaccgg

SEQ ID NO: 321755 - DNA, 20 bp, human
gaaggcaggcacgggatgaa

SEQ ID NO: 321756 - DNA, 20 bp, human
ggcagcgccccggaacccac

SEQ ID NO: 321757 - DNA, 20 bp, human
gggaaaataaacagcttcgt

SEQ ID NO: 321758 - DNA, 20 bp, human
ggtgatcagccagtgggttc

SEQ ID NO: 321759 - DNA, 20 bp, human
gcctcctgtgcaaagctgat

SEQ ID NO: 321760 - DNA, 20 bp, human
gtccggggcgctgcaaataa

SEQ ID NO: 321761 - DNA, 20 bp, human
gattgctgggttgtaaaaca

SEQ ID NO: 321762 - DNA, 20 bp, human
gttgtagaataatatctttc

SEQ ID NO: 321763 - DNA, 20 bp, human
gcaacatcctttgttagagg

SEQ ID NO: 321764 - DNA, 20 bp, human
gtcattatagaataacaatc

SEQ ID NO: 321765 - DNA, 20 bp, human
ggacatttatgagaaagccg

SEQ ID NO: 321766 - DNA, 20 bp, human
gaggcggggccactgatacc

SEQ ID NO: 321767 - DNA, 20 bp, human
ggaatcacgagggacggctc

SEQ ID NO: 321768 - DNA, 20 bp, human
gacccaggaatcacgaggga

SEQ ID NO: 321769 - DNA, 20 bp, human
gaggaaccccccatgtagtg

SEQ ID NO: 321770 - DNA, 20 bp, human
ggggaccgacccttgggaac

SEQ ID NO: 321771 - DNA, 20 bp, human
ggcggccgcccggttcccaa

SEQ ID NO: 321772 - DNA, 20 bp, human
ggccgtccctcgtgattcct

SEQ ID NO: 321773 - DNA, 20 bp, human
gcggctccggtcggattaag

SEQ ID NO: 321774 - DNA, 20 bp, human
gctccggtcggattaagagg

SEQ ID NO: 321775 - DNA, 20 bp, human
gcacgagggacggctccggt

SEQ ID NO: 321776 - DNA, 20 bp, human
gggctgggcgcggacggtga

SEQ ID NO: 321777 - DNA, 20 bp, human
gttggtggggagggacgaag

SEQ ID NO: 321778 - DNA, 20 bp, human
ggggttcaagcccgtggggc

SEQ ID NO: 321779 - DNA, 20 bp, human
gtacggcgggaggcactaga

SEQ ID NO: 321780 - DNA, 20 bp, human
ggggcggggttcaagcccgt

SEQ ID NO: 321781 - DNA, 20 bp, human
gcggcggtgggcggggttag

SEQ ID NO: 321782 - DNA, 20 bp, human
gccgccgtactgcttggagt

SEQ ID NO: 321783 - DNA, 20 bp, human
ggctccgactccaagcagta

SEQ ID NO: 321784 - DNA, 20 bp, human
ggtgggcggggttagagggc

SEQ ID NO: 321785 - DNA, 20 bp, human
gggattgaagccggcgggac

SEQ ID NO: 321786 - DNA, 20 bp, human
ggtactcgggtcagaaactc

SEQ ID NO: 321787 - DNA, 20 bp, human
gaaggactggactgggaaca

SEQ ID NO: 321788 - DNA, 20 bp, human
gcaggcggcgaggtgacgcg

SEQ ID NO: 321789 - DNA, 20 bp, human
gagcgaaaatgcgtggtact

SEQ ID NO: 321790 - DNA, 20 bp, human
gtggtgtcctgggtctacgt

SEQ ID NO: 321791 - DNA, 20 bp, human
gcaccattcccacctttgga

SEQ ID NO: 321792 - DNA, 20 bp, human
gtcgggtcctgctgcagggt

SEQ ID NO: 321793 - DNA, 20 bp, human
ggtgaggcgaggtaggccgg

SEQ ID NO: 321794 - DNA, 20 bp, human
gactgccggagctctggaag

SEQ ID NO: 321795 - DNA, 20 bp, human
gagggtgtggatggcaaacc

SEQ ID NO: 321796 - DNA, 20 bp, human
ggtaaaacgggttgttgtga

SEQ ID NO: 321797 - DNA, 20 bp, human
gtcctccgccagtgcgggag

SEQ ID NO: 321798 - DNA, 20 bp, human
gccccgacgccccgcctgtc

SEQ ID NO: 321799 - DNA, 20 bp, human
ggacacctccacaagcagcg

SEQ ID NO: 321800 - DNA, 20 bp, human
gacgccccgcctgtccggcc

SEQ ID NO: 321801 - DNA, 20 bp, human
gcacaagcagcgttatctga

SEQ ID NO: 321802 - DNA, 20 bp, human
gcccgcactggcggaggacg

SEQ ID NO: 321803 - DNA, 20 bp, human
gccggccgggaacgccgcca

SEQ ID NO: 321804 - DNA, 20 bp, human
gcctcctctgcggctctctg

SEQ ID NO: 321805 - DNA, 20 bp, human
gcggggcatgtcgacttcaa

SEQ ID NO: 321806 - DNA, 20 bp, human
gagagtgtgttaggctgcac

SEQ ID NO: 321807 - DNA, 20 bp, human
gttaggctgcactggaggag

SEQ ID NO: 321808 - DNA, 20 bp, human
gcagcctaacacactctcat

SEQ ID NO: 321809 - DNA, 20 bp, human
gcagagacctctccctgaat

SEQ ID NO: 321810 - DNA, 20 bp, human
gtggccctcagcctgtcaag

SEQ ID NO: 321811 - DNA, 20 bp, human
gtacggctgacaagggttag

SEQ ID NO: 321812 - DNA, 20 bp, human
gccactcgaacttcatggat

SEQ ID NO: 321813 - DNA, 20 bp, human
gggaggggcttgtgtctccg

SEQ ID NO: 321814 - DNA, 20 bp, human
gtgcaaagttgtgggaatct

SEQ ID NO: 321815 - DNA, 20 bp, human
ggggccaatgagagtgtgtt

SEQ ID NO: 321816 - DNA, 20 bp, human
gggctaagatggaactcagg

SEQ ID NO: 321817 - DNA, 20 bp, human
gttctggaagggggctaaga

SEQ ID NO: 321818 - DNA, 20 bp, human
gggcggaatcttctggaagg

SEQ ID NO: 321819 - DNA, 20 bp, human
gcacggcggaatcttctgga

SEQ ID NO: 321820 - DNA, 20 bp, human
ggggggctaagatggaactc

SEQ ID NO: 321821 - DNA, 20 bp, human
gcaagcacggcggaatcttc

SEQ ID NO: 321822 - DNA, 20 bp, human
gcaggaggcgggggtcggta

SEQ ID NO: 321823 - DNA, 20 bp, human
gcgcatgcgcacttaggtgg

SEQ ID NO: 321824 - DNA, 20 bp, human
gggaggggtaccacgactct

SEQ ID NO: 321825 - DNA, 20 bp, human
gggggcgctcctcattcgcc

SEQ ID NO: 321826 - DNA, 20 bp, human
gggatgaaggccagccgcca

SEQ ID NO: 321827 - DNA, 20 bp, human
gccctctggtctacaatccc

SEQ ID NO: 321828 - DNA, 20 bp, human
gcggctggccttcatccctt

SEQ ID NO: 321829 - DNA, 20 bp, human
ggtatgcaatgcttgcccaa

SEQ ID NO: 321830 - DNA, 20 bp, human
gtctggtctacaatccctgg

SEQ ID NO: 321831 - DNA, 20 bp, human
gttaggcgaacgggggtgga

SEQ ID NO: 321832 - DNA, 20 bp, human
gagggagcttaggcgaacgg

SEQ ID NO: 321833 - DNA, 20 bp, human
gcgagctcaagtgctccctc

SEQ ID NO: 321834 - DNA, 20 bp, human
ggtctacaatccctggcggc

SEQ ID NO: 321835 - DNA, 20 bp, human
ggggagcacttgagctcgtc

SEQ ID NO: 321836 - DNA, 20 bp, human
gcgcggcgatcgggtggagg

SEQ ID NO: 321837 - DNA, 20 bp, human
gagagcgcgcggcgatcggg

SEQ ID NO: 321838 - DNA, 20 bp, human
gagaaagctggggcggggaa

SEQ ID NO: 321839 - DNA, 20 bp, human
ggactggcggagggaaagcg

SEQ ID NO: 321840 - DNA, 20 bp, human
gaggggcccttccactctcg

SEQ ID NO: 321841 - DNA, 20 bp, human
ggagggaaagcgcggaggct

SEQ ID NO: 321842 - DNA, 20 bp, human
gaagaacagccccaactccg

SEQ ID NO: 321843 - DNA, 20 bp, human
gcctgtccccgagagtggaa

SEQ ID NO: 321844 - DNA, 20 bp, human
ggagttggggctgttcttcc

SEQ ID NO: 321845 - DNA, 20 bp, human
ggcgcgcggcgatcgggtgg

SEQ ID NO: 321846 - DNA, 20 bp, human
gcgaaagcgcgtgggtactt

SEQ ID NO: 321847 - DNA, 20 bp, human
gctggaggattgagctaggt

SEQ ID NO: 321848 - DNA, 20 bp, human
gtacccacgcgctttcgtct

SEQ ID NO: 321849 - DNA, 20 bp, human
gtgaggaagtagctccaaag

SEQ ID NO: 321850 - DNA, 20 bp, human
gacccgagacgaaagcgcgt

SEQ ID NO: 321851 - DNA, 20 bp, human
gttaaatcgcgagaactgac

SEQ ID NO: 321852 - DNA, 20 bp, human
gggcactggaggattgagct

SEQ ID NO: 321853 - DNA, 20 bp, human
ggcacgcgcactagggtccg

SEQ ID NO: 321854 - DNA, 20 bp, human
ggagaacctacttaaagcta

SEQ ID NO: 321855 - DNA, 20 bp, human
gccagcgcgcacgcgcacta

SEQ ID NO: 321856 - DNA, 20 bp, human
gcatgcgcgcgagtagagca

SEQ ID NO: 321857 - DNA, 20 bp, human
ggaccccgcccacacttctc

SEQ ID NO: 321858 - DNA, 20 bp, human
ggggcggggtcaaaccttgg

SEQ ID NO: 321859 - DNA, 20 bp, human
gtgtgggcggggtcaaacct

SEQ ID NO: 321860 - DNA, 20 bp, human
gatagccagagaagtgtggg

SEQ ID NO: 321861 - DNA, 20 bp, human
gacttctctggctatgcggg

SEQ ID NO: 321862 - DNA, 20 bp, human
ggcgcgcgagtagagcaggg

SEQ ID NO: 321863 - DNA, 20 bp, human
gtgggggacacctgggaaat

SEQ ID NO: 321864 - DNA, 20 bp, human
gatgctgaagccgatttccc

SEQ ID NO: 321865 - DNA, 20 bp, human
gaggctggtttcacattcca

SEQ ID NO: 321866 - DNA, 20 bp, human
gtcggctggggcagctgcga

SEQ ID NO: 321867 - DNA, 20 bp, human
ggctacccggtggtcttcgg

SEQ ID NO: 321868 - DNA, 20 bp, human
ggagacccgcacctgggcct

SEQ ID NO: 321869 - DNA, 20 bp, human
gccgggggagccgtagcccg

SEQ ID NO: 321870 - DNA, 20 bp, human
gtccagccccgccacgggag

SEQ ID NO: 321871 - DNA, 20 bp, human
gggggctcacccacacccta

SEQ ID NO: 321872 - DNA, 20 bp, human
gcacgggaggggccgcctga

SEQ ID NO: 321873 - DNA, 20 bp, human
gcggcccgggaggctcggct

SEQ ID NO: 321874 - DNA, 20 bp, human
gctggggcagctgcgagggc

SEQ ID NO: 321875 - DNA, 20 bp, human
gcaggactgagtcctccata

SEQ ID NO: 321876 - DNA, 20 bp, human
ggagggcaagatcagtagtg

SEQ ID NO: 321877 - DNA, 20 bp, human
ggggagcagcttcctttgca

SEQ ID NO: 321878 - DNA, 20 bp, human
gagtagtgtgggttagaagc

SEQ ID NO: 321879 - DNA, 20 bp, human
gagcagcttcctttgcacgg

SEQ ID NO: 321880 - DNA, 20 bp, human
ggattacctgacaaataatt

SEQ ID NO: 321881 - DNA, 20 bp, human
gctttgcttgatgtcaattg

SEQ ID NO: 321882 - DNA, 20 bp, human
gtggaaggaagcaatcaaac

SEQ ID NO: 321883 - DNA, 20 bp, human
gattaggcttgcgtttagtg

SEQ ID NO: 321884 - DNA, 20 bp, human
gctttgcacggaggagagaa

SEQ ID NO: 321885 - DNA, 20 bp, human
ggcaggcctaattatttgtc

SEQ ID NO: 321886 - DNA, 20 bp, human
gacgccggcggcctcagggc

SEQ ID NO: 321887 - DNA, 20 bp, human
gggaagtggggtgcacgctt

SEQ ID NO: 321888 - DNA, 20 bp, human
ggtgacgccggtgtccgccc

SEQ ID NO: 321889 - DNA, 20 bp, human
gtctccgaccgcaacgccgg

SEQ ID NO: 321890 - DNA, 20 bp, human
gggactcccggtcttccccg

SEQ ID NO: 321891 - DNA, 20 bp, human
gaggccgccggcgttgcggt

SEQ ID NO: 321892 - DNA, 20 bp, human
gacccgcggcttacctcttg

SEQ ID NO: 321893 - DNA, 20 bp, human
gtcaccgcgtcctacggagc

SEQ ID NO: 321894 - DNA, 20 bp, human
gagccgcaagaggtaagccg

SEQ ID NO: 321895 - DNA, 20 bp, human
gaggtaagccgcgggtccga

SEQ ID NO: 321896 - DNA, 20 bp, human
gcgcgcgcggactggcacga

SEQ ID NO: 321897 - DNA, 20 bp, human
gccggggggcaaccggtcca

SEQ ID NO: 321898 - DNA, 20 bp, human
gagggaagccccgagggcgt

SEQ ID NO: 321899 - DNA, 20 bp, human
gccgcccggcttcccgcctt

SEQ ID NO: 321900 - DNA, 20 bp, human
ggccccccggcgtgcgcgcg

SEQ ID NO: 321901 - DNA, 20 bp, human
gagggcgtcggtgccaaagg

SEQ ID NO: 321902 - DNA, 20 bp, human
ggggaggggcgcattttgca

SEQ ID NO: 321903 - DNA, 20 bp, human
gagtccgcgcgcgcacgccg

SEQ ID NO: 321904 - DNA, 20 bp, human
ggaagtcccgccctcacttc

SEQ ID NO: 321905 - DNA, 20 bp, human
gctgtctcgcggccctggac

SEQ ID NO: 321906 - DNA, 20 bp, human
gcgcgctgcgatgacgtcgg

SEQ ID NO: 321907 - DNA, 20 bp, human
ggggctccgcgcaaaagatg

SEQ ID NO: 321908 - DNA, 20 bp, human
gcgcgccacgcccgagtccc

SEQ ID NO: 321909 - DNA, 20 bp, human
gggcccgcgcgctgctcgag

SEQ ID NO: 321910 - DNA, 20 bp, human
gtggcgcgctgcgatgacgt

SEQ ID NO: 321911 - DNA, 20 bp, human
gtgcgcggagcccgagtcgc

SEQ ID NO: 321912 - DNA, 20 bp, human
gcgcccgagtcccaggcgtg

SEQ ID NO: 321913 - DNA, 20 bp, human
gcgcgcaaaagatggggttg

SEQ ID NO: 321914 - DNA, 20 bp, human
gagccgcacgcctgggactc

SEQ ID NO: 321915 - DNA, 20 bp, human
gcggtacccgggccccgatg

SEQ ID NO: 321916 - DNA, 20 bp, human
gagaggccgccgaagggcgg

SEQ ID NO: 321917 - DNA, 20 bp, human
gggcgcgcccaagagcctgc

SEQ ID NO: 321918 - DNA, 20 bp, human
ggctgggagaggccgccgaa

SEQ ID NO: 321919 - DNA, 20 bp, human
gcgcagccgcgcccctctgt

SEQ ID NO: 321920 - DNA, 20 bp, human
ggggcgggggcggtcaaggc

SEQ ID NO: 321921 - DNA, 20 bp, human
gcgaagggcgggggcggtca

SEQ ID NO: 321922 - DNA, 20 bp, human
gcggccctgcgcggtggcca

SEQ ID NO: 321923 - DNA, 20 bp, human
gtgcctcgcgggcccggaac

SEQ ID NO: 321924 - DNA, 20 bp, human
gaccggggcggctgcctcgc

SEQ ID NO: 321925 - DNA, 20 bp, human
gcttgggcgcgccaacagag

SEQ ID NO: 321926 - DNA, 20 bp, human
gaagagaggcacactggcta

SEQ ID NO: 321927 - DNA, 20 bp, human
gaggaccggggcttcctgcg

SEQ ID NO: 321928 - DNA, 20 bp, human
ggagggaatcggggagtcct

SEQ ID NO: 321929 - DNA, 20 bp, human
gggctgcggggccacgggac

SEQ ID NO: 321930 - DNA, 20 bp, human
gctgcggggctggacggccc

SEQ ID NO: 321931 - DNA, 20 bp, human
ggggaaacatgtttgcgtgt

SEQ ID NO: 321932 - DNA, 20 bp, human
ggggctggccaggcttacct

SEQ ID NO: 321933 - DNA, 20 bp, human
gttccctcctggttgaaacg

SEQ ID NO: 321934 - DNA, 20 bp, human
gtgcggtcccggcagagcag

SEQ ID NO: 321935 - DNA, 20 bp, human
gtgggaagcgggttgttccg

SEQ ID NO: 321936 - DNA, 20 bp, human
ggatgggcgagacctgagcc

SEQ ID NO: 321937 - DNA, 20 bp, human
gaggcccgcaaagctggcgg

SEQ ID NO: 321938 - DNA, 20 bp, human
gggcggaggacctagttcca

SEQ ID NO: 321939 - DNA, 20 bp, human
ggagccctagatcccgtccc

SEQ ID NO: 321940 - DNA, 20 bp, human
gctcgcccatccccagcagg

SEQ ID NO: 321941 - DNA, 20 bp, human
ggttccagggacgggatcta

SEQ ID NO: 321942 - DNA, 20 bp, human
gtgtccagaccgggcaaacc

SEQ ID NO: 321943 - DNA, 20 bp, human
gcggaggaggcccgcaaagc

SEQ ID NO: 321944 - DNA, 20 bp, human
gggtgccagggtgtccagac

SEQ ID NO: 321945 - DNA, 20 bp, human
ggggcagagagacctcctgc

SEQ ID NO: 321946 - DNA, 20 bp, human
ggcaacgccgagagagtcag

SEQ ID NO: 321947 - DNA, 20 bp, human
gcctccgcggcgagtacagg

SEQ ID NO: 321948 - DNA, 20 bp, human
gtgtgcagctccagctcctc

SEQ ID NO: 321949 - DNA, 20 bp, human
gcgtccgcgcacgttggcac

SEQ ID NO: 321950 - DNA, 20 bp, human
gaagccgcctgtactcgccg

SEQ ID NO: 321951 - DNA, 20 bp, human
gaaaccggtgccaacgtgcg

SEQ ID NO: 321952 - DNA, 20 bp, human
ggccgccgctggagtccgcc

SEQ ID NO: 321953 - DNA, 20 bp, human
gccccgggaagccgacagtc

SEQ ID NO: 321954 - DNA, 20 bp, human
ggcgctggagccgggctgga

SEQ ID NO: 321955 - DNA, 20 bp, human
gtccggcggggcacagccct

SEQ ID NO: 321956 - DNA, 20 bp, human
ggctgtcggcgacgctgcta

SEQ ID NO: 321957 - DNA, 20 bp, human
gcgggcaagttcccggaaga

SEQ ID NO: 321958 - DNA, 20 bp, human
gaggctctgacaacccggcg

SEQ ID NO: 321959 - DNA, 20 bp, human
gctgaatccgggaagagcgg

SEQ ID NO: 321960 - DNA, 20 bp, human
ggcaagactagacacaagcc

SEQ ID NO: 321961 - DNA, 20 bp, human
gggaacttgcccgcgtgttc

SEQ ID NO: 321962 - DNA, 20 bp, human
ggctcgggatgctaacagca

SEQ ID NO: 321963 - DNA, 20 bp, human
ggcgtcgccgacagccacgc

SEQ ID NO: 321964 - DNA, 20 bp, human
ggcccgggaggatgacatct

SEQ ID NO: 321965 - DNA, 20 bp, human
ggccgagatgtcatcctccc

SEQ ID NO: 321966 - DNA, 20 bp, human
gaccacgcctcgccgagtcc

SEQ ID NO: 321967 - DNA, 20 bp, human
gcaagccggcccagcccacc

SEQ ID NO: 321968 - DNA, 20 bp, human
gatgtgctccaggaagggat

SEQ ID NO: 321969 - DNA, 20 bp, human
gactgtgaatttagccaggt

SEQ ID NO: 321970 - DNA, 20 bp, human
ggcagcctgcgacctctggc

SEQ ID NO: 321971 - DNA, 20 bp, human
gcgagtcccggatgtgctcc

SEQ ID NO: 321972 - DNA, 20 bp, human
ggctgcgtgctgttctaggt

SEQ ID NO: 321973 - DNA, 20 bp, human
gctcggcgaggcgtggtctc

SEQ ID NO: 321974 - DNA, 20 bp, human
ggagactgtagatgggtcta

SEQ ID NO: 321975 - DNA, 20 bp, human
gtcccggatgtgctccagga

SEQ ID NO: 321976 - DNA, 20 bp, human
gacacccggaagtgtcttca

SEQ ID NO: 321977 - DNA, 20 bp, human
ggggagtcacggagagatca

SEQ ID NO: 321978 - DNA, 20 bp, human
gggaccagcgcgtcatgcat

SEQ ID NO: 321979 - DNA, 20 bp, human
gcgcgtcatgcatgggaaga

SEQ ID NO: 321980 - DNA, 20 bp, human
ggtagcgtactcatcctccc

SEQ ID NO: 321981 - DNA, 20 bp, human
ggctaaagtgtgcgcccggg

SEQ ID NO: 321982 - DNA, 20 bp, human
gaggatgagtacgctacacc

SEQ ID NO: 321983 - DNA, 20 bp, human
gtctccctgaagacacttcc

SEQ ID NO: 321984 - DNA, 20 bp, human
gcctaggcagtggggtccag

SEQ ID NO: 321985 - DNA, 20 bp, human
ggctgggaggtccctttaaa

SEQ ID NO: 321986 - DNA, 20 bp, human
gcggggcgcaccaggagatg

SEQ ID NO: 321987 - DNA, 20 bp, human
gtcctggtgcgccccgggtg

SEQ ID NO: 321988 - DNA, 20 bp, human
ggggctgctgggaataggga

SEQ ID NO: 321989 - DNA, 20 bp, human
gactaggagccacaccgcgg

SEQ ID NO: 321990 - DNA, 20 bp, human
ggggtcgatgacaagataga

SEQ ID NO: 321991 - DNA, 20 bp, human
gggcactaggagccacaccg

SEQ ID NO: 321992 - DNA, 20 bp, human
ggagggtgagggttcttccc

SEQ ID NO: 321993 - DNA, 20 bp, human
gcgcaccaggagatgaggcc

SEQ ID NO: 321994 - DNA, 20 bp, human
gtggtgcgccccgggtgggg

SEQ ID NO: 321995 - DNA, 20 bp, human
ggtgtggctcctagtgcccg

SEQ ID NO: 321996 - DNA, 20 bp, human
ggacgcttggggacagaagg

SEQ ID NO: 321997 - DNA, 20 bp, human
gtccacccccggcaaatccg

SEQ ID NO: 321998 - DNA, 20 bp, human
ggaaggctggacttagtaag

SEQ ID NO: 321999 - DNA, 20 bp, human
gctcgcctcggatttgccgg

SEQ ID NO: 322000 - DNA, 20 bp, human
gtgtccccaagcgtcagccg

SEQ ID NO: 322001 - DNA, 20 bp, human
gtgagagaaagaccttagtt

SEQ ID NO: 322002 - DNA, 20 bp, human
gagagccacggctgacgctt

SEQ ID NO: 322003 - DNA, 20 bp, human
ggggactggaggatagagta

SEQ ID NO: 322004 - DNA, 20 bp, human
ggctgacgcttggggacaga

SEQ ID NO: 322005 - DNA, 20 bp, human
gctggacttagtaagtggtg

SEQ ID NO: 322006 - DNA, 20 bp, human
ggactcaggcaagaccaaga

SEQ ID NO: 322007 - DNA, 20 bp, human
gggatcgtccagctcctcaa

SEQ ID NO: 322008 - DNA, 20 bp, human
gcatccctgcaacgtggccg

SEQ ID NO: 322009 - DNA, 20 bp, human
ggacccgtaaaaaatacgaa

SEQ ID NO: 322010 - DNA, 20 bp, human
gagcacggggcattgattgc

SEQ ID NO: 322011 - DNA, 20 bp, human
gtcaggacttacggggactc

SEQ ID NO: 322012 - DNA, 20 bp, human
ggcagccccggccacgttgc

SEQ ID NO: 322013 - DNA, 20 bp, human
gctggtgcctcaggacttac

SEQ ID NO: 322014 - DNA, 20 bp, human
gaacaggtgcgaagtgcgct

SEQ ID NO: 322015 - DNA, 20 bp, human
gacctcgcatccctgcaacg

SEQ ID NO: 322016 - DNA, 20 bp, human
gaaggcccgcccattagggg

SEQ ID NO: 322017 - DNA, 20 bp, human
gctcaaggcccgcccattag

SEQ ID NO: 322018 - DNA, 20 bp, human
gcaaaggcctagctacgggc

SEQ ID NO: 322019 - DNA, 20 bp, human
ggtcccctcccctaatgggc

SEQ ID NO: 322020 - DNA, 20 bp, human
gcagccacgcgaaggaagtg

SEQ ID NO: 322021 - DNA, 20 bp, human
ggcgtggctgcaatcgggaa

SEQ ID NO: 322022 - DNA, 20 bp, human
gagtcctgaggaattggggt

SEQ ID NO: 322023 - DNA, 20 bp, human
gaaagcaaaggcctagctac

SEQ ID NO: 322024 - DNA, 20 bp, human
gcccgattgcagccacgcga

SEQ ID NO: 322025 - DNA, 20 bp, human
gggcgggccttgagactgcc

SEQ ID NO: 322026 - DNA, 20 bp, human
gggtggggcgcatgcgcgaa

SEQ ID NO: 322027 - DNA, 20 bp, human
gtgcagggggcgatgaaagt

SEQ ID NO: 322028 - DNA, 20 bp, human
ggaggaagggcgtggcctgt

SEQ ID NO: 322029 - DNA, 20 bp, human
gggggcgcatgcgcgaaggg

SEQ ID NO: 322030 - DNA, 20 bp, human
ggctccaaggcggcctgcgc

SEQ ID NO: 322031 - DNA, 20 bp, human
gtgcaggttcggaggtcctc

SEQ ID NO: 322032 - DNA, 20 bp, human
gcggaggtcctcaggacggg

SEQ ID NO: 322033 - DNA, 20 bp, human
gcggaggcgatggtggacga

SEQ ID NO: 322034 - DNA, 20 bp, human
ggcatgcgcgaagggaggaa

SEQ ID NO: 322035 - DNA, 20 bp, human
gtggagccggatggacccca

SEQ ID NO: 322036 - DNA, 20 bp, human
gagggctgggatcacgtgga

SEQ ID NO: 322037 - DNA, 20 bp, human
gaggcagggctgggatcacg

SEQ ID NO: 322038 - DNA, 20 bp, human
gacagccagggaaacgtgtg

SEQ ID NO: 322039 - DNA, 20 bp, human
gggtgagcagcggagcgctt

SEQ ID NO: 322040 - DNA, 20 bp, human
ggctccaaggctgccggcta

SEQ ID NO: 322041 - DNA, 20 bp, human
ggccgcgtgcctcactaaag

SEQ ID NO: 322042 - DNA, 20 bp, human
ggtgacggaggcgtcaggga

SEQ ID NO: 322043 - DNA, 20 bp, human
gtcccctccgcgtgagctct

SEQ ID NO: 322044 - DNA, 20 bp, human
gtcggcgtaagagaggaagt

SEQ ID NO: 322045 - DNA, 20 bp, human
gacgcggccgggcggctcca

SEQ ID NO: 322046 - DNA, 20 bp, human
gttccagccgatctggtcga

SEQ ID NO: 322047 - DNA, 20 bp, human
gtaggaggttccagccgatc

SEQ ID NO: 322048 - DNA, 20 bp, human
gtggagcccctcgaccagat

SEQ ID NO: 322049 - DNA, 20 bp, human
gcaacctccggaagcacact

SEQ ID NO: 322050 - DNA, 20 bp, human
ggcccctcgaccagatcggc

SEQ ID NO: 322051 - DNA, 20 bp, human
gcctccggaagcacactagg

SEQ ID NO: 322052 - DNA, 20 bp, human
ggggcagcggggcggaccga

SEQ ID NO: 322053 - DNA, 20 bp, human
ggaacctcctagtgtgcttc

SEQ ID NO: 322054 - DNA, 20 bp, human
ggctcggaggcccctctttt

SEQ ID NO: 322055 - DNA, 20 bp, human
gaaacctcgcgaccagccat

SEQ ID NO: 322056 - DNA, 20 bp, human
ggtaccttttctcagagcag

SEQ ID NO: 322057 - DNA, 20 bp, human
gcgcgggcgcataacggaaa

SEQ ID NO: 322058 - DNA, 20 bp, human
gctacctctgaggtgaaggt

SEQ ID NO: 322059 - DNA, 20 bp, human
gcccacgcgtatcgccatct

SEQ ID NO: 322060 - DNA, 20 bp, human
gggaaagggtgggctccaca

SEQ ID NO: 322061 - DNA, 20 bp, human
gacctcagaggtagggtaga

SEQ ID NO: 322062 - DNA, 20 bp, human
gagtcccaccttcacctcag

SEQ ID NO: 322063 - DNA, 20 bp, human
gttcccgcgcagtctttctg

SEQ ID NO: 322064 - DNA, 20 bp, human
gggccgccagcttgtggagg

SEQ ID NO: 322065 - DNA, 20 bp, human
gatggcgatacgcgtgggac

SEQ ID NO: 322066 - DNA, 20 bp, human
gggcaggcgcgcccgcgggt

SEQ ID NO: 322067 - DNA, 20 bp, human
ggcgccccctgctggccgga

SEQ ID NO: 322068 - DNA, 20 bp, human
gtgggcgccgcgtggacgtc

SEQ ID NO: 322069 - DNA, 20 bp, human
gccggcccgggcggctccca

SEQ ID NO: 322070 - DNA, 20 bp, human
gtccacgcggcgcccacccg

SEQ ID NO: 322071 - DNA, 20 bp, human
gtctgcacgctgtcgccctc

SEQ ID NO: 322072 - DNA, 20 bp, human
gcacgcgtttcgaaagatgg

SEQ ID NO: 322073 - DNA, 20 bp, human
gcgcgtggacgcacgacttc

SEQ ID NO: 322074 - DNA, 20 bp, human
gtgcagagctgcgcggagcc

SEQ ID NO: 322075 - DNA, 20 bp, human
gagcgcgggagaggccggcc

SEQ ID NO: 322076 - DNA, 20 bp, human
gaagtatcgatcatttatca

SEQ ID NO: 322077 - DNA, 20 bp, human
gactccgcgcgacatctggc

SEQ ID NO: 322078 - DNA, 20 bp, human
gagtcctccaggcctctaga

SEQ ID NO: 322079 - DNA, 20 bp, human
gacgcaaggtgcatgcctac

SEQ ID NO: 322080 - DNA, 20 bp, human
gatgtcgcgcggagtcctcc

SEQ ID NO: 322081 - DNA, 20 bp, human
ggccccagaagagagaacta

SEQ ID NO: 322082 - DNA, 20 bp, human
gctaaagtagaattcatctt

SEQ ID NO: 322083 - DNA, 20 bp, human
ggcgcctgccagatgtcgcg

SEQ ID NO: 322084 - DNA, 20 bp, human
ggccttagttctctcttctg

SEQ ID NO: 322085 - DNA, 20 bp, human
gccgtcctttccagctgtga

SEQ ID NO: 322086 - DNA, 20 bp, human
gaagtatcgatcatttatca

SEQ ID NO: 322087 - DNA, 20 bp, human
gagtcctccaggcctctaga

SEQ ID NO: 322088 - DNA, 20 bp, human
gactccgcgcgacatctggc

SEQ ID NO: 322089 - DNA, 20 bp, human
gaaaggacgggagattttgt

SEQ ID NO: 322090 - DNA, 20 bp, human
gatgtcgcgcggagtcctcc

SEQ ID NO: 322091 - DNA, 20 bp, human
gccgtcctttccagctgtga

SEQ ID NO: 322092 - DNA, 20 bp, human
gctaaagtagaattcatctt

SEQ ID NO: 322093 - DNA, 20 bp, human
gacgcaaggtgcatgcctac

SEQ ID NO: 322094 - DNA, 20 bp, human
gtagaattcaccatcacagc

SEQ ID NO: 322095 - DNA, 20 bp, human
ggcacctgccagatgtcgcg

SEQ ID NO: 322096 - DNA, 20 bp, human
gggacgggagatttcgttgg

SEQ ID NO: 322097 - DNA, 20 bp, human
gaagtatcgatcatttatca

SEQ ID NO: 322098 - DNA, 20 bp, human
gactccgcgcgacatctggc

SEQ ID NO: 322099 - DNA, 20 bp, human
gagtcctccaggcctctaga

SEQ ID NO: 322100 - DNA, 20 bp, human
gacgcaaggtgcatgcctac

SEQ ID NO: 322101 - DNA, 20 bp, human
gaaaggacgggagatttcgt

SEQ ID NO: 322102 - DNA, 20 bp, human
ggcacctgccagatgtcgcg

SEQ ID NO: 322103 - DNA, 20 bp, human
ggccccagaagagagaacta

SEQ ID NO: 322104 - DNA, 20 bp, human
gatgtcgcgcggagtcctcc

SEQ ID NO: 322105 - DNA, 20 bp, human
ggccttagttctctcttctg

SEQ ID NO: 322106 - DNA, 20 bp, human
gttcgtgtgaacgacagatg

SEQ ID NO: 322107 - DNA, 20 bp, human
gctggcgcgtgagacgggaa

SEQ ID NO: 322108 - DNA, 20 bp, human
gcagatggggacaaagagcg

SEQ ID NO: 322109 - DNA, 20 bp, human
gaactcaagcctttggcatt

SEQ ID NO: 322110 - DNA, 20 bp, human
gaccgccggaaacgagacga

SEQ ID NO: 322111 - DNA, 20 bp, human
gcctgccaaggggtacaaaa

SEQ ID NO: 322112 - DNA, 20 bp, human
gtcgggagctaaaccttgat

SEQ ID NO: 322113 - DNA, 20 bp, human
ggcggcctggcgcgtgagac

SEQ ID NO: 322114 - DNA, 20 bp, human
gggtcgcgcgctcttttctc

SEQ ID NO: 322115 - DNA, 20 bp, human
gtcacacgaactcaagcctt

SEQ ID NO: 322116 - DNA, 20 bp, human
gggtacacggcgttagaggg

SEQ ID NO: 322117 - DNA, 20 bp, human
ggggaactggatgtaaaaga

SEQ ID NO: 322118 - DNA, 20 bp, human
gaagggggcgcacgagagca

SEQ ID NO: 322119 - DNA, 20 bp, human
ggacgaacacgtgacgcggt

SEQ ID NO: 322120 - DNA, 20 bp, human
ggccctacttgcaactttgc

SEQ ID NO: 322121 - DNA, 20 bp, human
gaacacgtgacgcggtcggg

SEQ ID NO: 322122 - DNA, 20 bp, human
gacggcgttagaggggggta

SEQ ID NO: 322123 - DNA, 20 bp, human
ggcctgcaaagttgcaagta

SEQ ID NO: 322124 - DNA, 20 bp, human
gctaggtacacggcgttaga

SEQ ID NO: 322125 - DNA, 20 bp, human
gcgttagaggggggtaggga

SEQ ID NO: 322126 - DNA, 20 bp, human
ggcggcccgccgtgtactct

SEQ ID NO: 322127 - DNA, 20 bp, human
ggccctgcgccaagagtaca

SEQ ID NO: 322128 - DNA, 20 bp, human
gtgcgccaagagtacacggc

SEQ ID NO: 322129 - DNA, 20 bp, human
ggcggccggcgacccgctcc

SEQ ID NO: 322130 - DNA, 20 bp, human
gcagccccgagtcaatgccg

SEQ ID NO: 322131 - DNA, 20 bp, human
gcgggcgggctcggcgctaa

SEQ ID NO: 322132 - DNA, 20 bp, human
ggctcggcttactcgccgat

SEQ ID NO: 322133 - DNA, 20 bp, human
gccgtggctcacttcggaca

SEQ ID NO: 322134 - DNA, 20 bp, human
gccggcgacccgctcccggg

SEQ ID NO: 322135 - DNA, 20 bp, human
gaacaccgcgcccgcaggct

SEQ ID NO: 322136 - DNA, 20 bp, human
gtcccggtgaaggtcatgaa

SEQ ID NO: 322137 - DNA, 20 bp, human
gtgaaggtcatgaaaggggc

SEQ ID NO: 322138 - DNA, 20 bp, human
gcggactagagaagagacga

SEQ ID NO: 322139 - DNA, 20 bp, human
ggagaggacagtgatgtcgg

SEQ ID NO: 322140 - DNA, 20 bp, human
gagcgctagcggggagcgga

SEQ ID NO: 322141 - DNA, 20 bp, human
gactcccggccctgtgattc

SEQ ID NO: 322142 - DNA, 20 bp, human
gcaaatgctcgttgcatcct

SEQ ID NO: 322143 - DNA, 20 bp, human
gtccccaaagccaagatctc

SEQ ID NO: 322144 - DNA, 20 bp, human
gggtgaggggcgaaactgat

SEQ ID NO: 322145 - DNA, 20 bp, human
ggtaggaactgcacaaggag

SEQ ID NO: 322146 - DNA, 20 bp, human
gtacacccgcggcgggtgga

SEQ ID NO: 322147 - DNA, 20 bp, human
gcgagtagggggcaattcga

SEQ ID NO: 322148 - DNA, 20 bp, human
ggagccggcggcggcgagta

SEQ ID NO: 322149 - DNA, 20 bp, human
gggctccgctggcgttccca

SEQ ID NO: 322150 - DNA, 20 bp, human
ggacgcgcagcttacacccg

SEQ ID NO: 322151 - DNA, 20 bp, human
ggcgcagcttacacccgcgg

SEQ ID NO: 322152 - DNA, 20 bp, human
gctcgccctgggaacgccag

SEQ ID NO: 322153 - DNA, 20 bp, human
ggccccctactcgccgccgc

SEQ ID NO: 322154 - DNA, 20 bp, human
gcgagcgtaagttccgggtg

SEQ ID NO: 322155 - DNA, 20 bp, human
gcaactccatgagggaaggt

SEQ ID NO: 322156 - DNA, 20 bp, human
gcgggcgggcgtggttgccg

SEQ ID NO: 322157 - DNA, 20 bp, human
ggtggtatcgcccggagcgc

SEQ ID NO: 322158 - DNA, 20 bp, human
gcgggcgataccaccctggg

SEQ ID NO: 322159 - DNA, 20 bp, human
gctccgggcgataccaccct

SEQ ID NO: 322160 - DNA, 20 bp, human
ggcccccggtcgggcactgc

SEQ ID NO: 322161 - DNA, 20 bp, human
gccggcctctgcagctgcgc

SEQ ID NO: 322162 - DNA, 20 bp, human
gcgggcgagcgggccttttc

SEQ ID NO: 322163 - DNA, 20 bp, human
ggggacgcgcggcccccggt

SEQ ID NO: 322164 - DNA, 20 bp, human
ggcctgcagtgcccgaccgg

SEQ ID NO: 322165 - DNA, 20 bp, human
gcccctccaaaggccggaga

SEQ ID NO: 322166 - DNA, 20 bp, human
gcgctgtggcgggaacattc

SEQ ID NO: 322167 - DNA, 20 bp, human
gttcccgccacagcgggctg

SEQ ID NO: 322168 - DNA, 20 bp, human
ggaagtgacggcaatctctg

SEQ ID NO: 322169 - DNA, 20 bp, human
gcgccccagcccgctgtggc

SEQ ID NO: 322170 - DNA, 20 bp, human
ggccgagaaagtttgtatcg

SEQ ID NO: 322171 - DNA, 20 bp, human
gctctgcggcagtcttctgt

SEQ ID NO: 322172 - DNA, 20 bp, human
gacgcgctactccttctctg

SEQ ID NO: 322173 - DNA, 20 bp, human
gaggcgcaaaggctccgttc

SEQ ID NO: 322174 - DNA, 20 bp, human
gcccgcgatacaaactttct

SEQ ID NO: 322175 - DNA, 20 bp, human
ggggaacattctggaagtga

SEQ ID NO: 322176 - DNA, 20 bp, human
ggacgtggaggcagtgttca

SEQ ID NO: 322177 - DNA, 20 bp, human
ggatgggggcggagcgatct

SEQ ID NO: 322178 - DNA, 20 bp, human
gccggggcgattctgtgctg

SEQ ID NO: 322179 - DNA, 20 bp, human
gtcgctccgcccccatccgc

SEQ ID NO: 322180 - DNA, 20 bp, human
ggtgacacacccaccccgcc

SEQ ID NO: 322181 - DNA, 20 bp, human
gaggccaaagttagaacctg

SEQ ID NO: 322182 - DNA, 20 bp, human
gcacgtcgccggctcaatct

SEQ ID NO: 322183 - DNA, 20 bp, human
gaacactgcctccacgtcgc

SEQ ID NO: 322184 - DNA, 20 bp, human
gccgcgccgccccagccggg

SEQ ID NO: 322185 - DNA, 20 bp, human
gaaagttagaacctgcggat

SEQ ID NO: 322186 - DNA, 20 bp, human
ggggcagggcaggtctattt

SEQ ID NO: 322187 - DNA, 20 bp, human
gtgggcagagaaggccccat

SEQ ID NO: 322188 - DNA, 20 bp, human
gacccaggctgcaacctctg

SEQ ID NO: 322189 - DNA, 20 bp, human
ggaaggccccatgggaggca

SEQ ID NO: 322190 - DNA, 20 bp, human
gactacattcagccctatcc

SEQ ID NO: 322191 - DNA, 20 bp, human
gagagcggctcttttaatga

SEQ ID NO: 322192 - DNA, 20 bp, human
gcccacacccataaaccagt

SEQ ID NO: 322193 - DNA, 20 bp, human
ggtagtagccacgcagggca

SEQ ID NO: 322194 - DNA, 20 bp, human
gcagtgacgtccaacccgac

SEQ ID NO: 322195 - DNA, 20 bp, human
gtctgcctctacatcagtgt

SEQ ID NO: 322196 - DNA, 20 bp, human
gccgagcaggtgaaagtccc

SEQ ID NO: 322197 - DNA, 20 bp, human
ggggccgggcgcgactctcc

SEQ ID NO: 322198 - DNA, 20 bp, human
gcccgcgctgccagccgagc

SEQ ID NO: 322199 - DNA, 20 bp, human
gtccccgggagagtcgcgcc

SEQ ID NO: 322200 - DNA, 20 bp, human
gccgcggccatcagtagctc

SEQ ID NO: 322201 - DNA, 20 bp, human
gcccagactgccgggatctg

SEQ ID NO: 322202 - DNA, 20 bp, human
ggacgccggcaacttcgccc

SEQ ID NO: 322203 - DNA, 20 bp, human
gtggatcagccgccagcgag

SEQ ID NO: 322204 - DNA, 20 bp, human
gtggcggtggcggcggagca

SEQ ID NO: 322205 - DNA, 20 bp, human
ggatcccggcagtctggggc

SEQ ID NO: 322206 - DNA, 20 bp, human
gaagctggggacactccctt

SEQ ID NO: 322207 - DNA, 20 bp, human
gtgtgactgccagggcctgt

SEQ ID NO: 322208 - DNA, 20 bp, human
ggaactgccaccttggactt

SEQ ID NO: 322209 - DNA, 20 bp, human
ggcaagatcaggtcacccac

SEQ ID NO: 322210 - DNA, 20 bp, human
gagggtggctgctaagatag

SEQ ID NO: 322211 - DNA, 20 bp, human
gcttgggaccagaaagaggt

SEQ ID NO: 322212 - DNA, 20 bp, human
gcaactctctggatggcatg

SEQ ID NO: 322213 - DNA, 20 bp, human
ggctgttacatcactctgtg

SEQ ID NO: 322214 - DNA, 20 bp, human
ggctaactgtacacaagctg

SEQ ID NO: 322215 - DNA, 20 bp, human
ggcaaaaacaactctctgga

SEQ ID NO: 322216 - DNA, 20 bp, human
gaggactgaggctgataagt

SEQ ID NO: 322217 - DNA, 20 bp, human
gcccctatcccatacacaat

SEQ ID NO: 322218 - DNA, 20 bp, human
gggacaggaacaagcccggc

SEQ ID NO: 322219 - DNA, 20 bp, human
gagtcctcacagcggaaccc

SEQ ID NO: 322220 - DNA, 20 bp, human
gtccacgcccgctggcctga

SEQ ID NO: 322221 - DNA, 20 bp, human
ggtccggccccccacccttc

SEQ ID NO: 322222 - DNA, 20 bp, human
gaatgggacaggaacaagcc

SEQ ID NO: 322223 - DNA, 20 bp, human
gcgctggcctgaagggtggg

SEQ ID NO: 322224 - DNA, 20 bp, human
gtgtgtatgggataggggcg

SEQ ID NO: 322225 - DNA, 20 bp, human
gacgcctgggttccgctgtg

SEQ ID NO: 322226 - DNA, 20 bp, human
gtgggcttcccgatctctag

SEQ ID NO: 322227 - DNA, 20 bp, human
gtccggatattgaaactggt

SEQ ID NO: 322228 - DNA, 20 bp, human
ggaggcacttccgcaactag

SEQ ID NO: 322229 - DNA, 20 bp, human
gtgggcggaagtgggcggag

SEQ ID NO: 322230 - DNA, 20 bp, human
gaggaaaaaacgatctccct

SEQ ID NO: 322231 - DNA, 20 bp, human
gtatgtacgaggcatttccc

SEQ ID NO: 322232 - DNA, 20 bp, human
ggttgcggaagtgcctcgcc

SEQ ID NO: 322233 - DNA, 20 bp, human
gggaacgcttactatgtacg

SEQ ID NO: 322234 - DNA, 20 bp, human
ggtagagctgcccctagttg

SEQ ID NO: 322235 - DNA, 20 bp, human
gtccggtgccttctgctggg

SEQ ID NO: 322236 - DNA, 20 bp, human
ggaactgctctgggtcaaga

SEQ ID NO: 322237 - DNA, 20 bp, human
ggacttctgtaaaccctcag

SEQ ID NO: 322238 - DNA, 20 bp, human
gcaaacgggatgaaagtcca

SEQ ID NO: 322239 - DNA, 20 bp, human
gtggacttccgggattcaaa

SEQ ID NO: 322240 - DNA, 20 bp, human
gagaaagtaaagaactgctc

SEQ ID NO: 322241 - DNA, 20 bp, human
gactttctcgggacacaaac

SEQ ID NO: 322242 - DNA, 20 bp, human
gtgggtgtgtcctggacttc

SEQ ID NO: 322243 - DNA, 20 bp, human
gtggacactgtaatcaaggt

SEQ ID NO: 322244 - DNA, 20 bp, human
gattctggacactgtaatca

SEQ ID NO: 322245 - DNA, 20 bp, human
gcttgtcaaacattccaagg

SEQ ID NO: 322246 - DNA, 20 bp, human
gcccgagcccagcctctccg

SEQ ID NO: 322247 - DNA, 20 bp, human
gtcagctcggggaggcgcaa

SEQ ID NO: 322248 - DNA, 20 bp, human
ggcgcggcgtgggtcgggag

SEQ ID NO: 322249 - DNA, 20 bp, human
gccagcctctccggggagga

SEQ ID NO: 322250 - DNA, 20 bp, human
gtctccggggaggagggacc

SEQ ID NO: 322251 - DNA, 20 bp, human
gaggctgggctcgggacgcg

SEQ ID NO: 322252 - DNA, 20 bp, human
gagcccggggcggaatgggg

SEQ ID NO: 322253 - DNA, 20 bp, human
gggaggcgcaaaggcggacg

SEQ ID NO: 322254 - DNA, 20 bp, human
gcaaaggcggacggggcgtg

SEQ ID NO: 322255 - DNA, 20 bp, human
ggaggagcccggggcggaat

SEQ ID NO: 322256 - DNA, 20 bp, human
gagcaccgggaacctgtcat

SEQ ID NO: 322257 - DNA, 20 bp, human
gaccccgggcacgggcacaa

SEQ ID NO: 322258 - DNA, 20 bp, human
gcgcccccgccactcagcac

SEQ ID NO: 322259 - DNA, 20 bp, human
gaaggccccgccacagctgt

SEQ ID NO: 322260 - DNA, 20 bp, human
ggggcacaacggctgcttag

SEQ ID NO: 322261 - DNA, 20 bp, human
ggccgcgattgcacaacttt

SEQ ID NO: 322262 - DNA, 20 bp, human
gtcccggtgctgagtggcgg

SEQ ID NO: 322263 - DNA, 20 bp, human
gcagccgttgtgcccgtgcc

SEQ ID NO: 322264 - DNA, 20 bp, human
gtgcaatcgcggcatgtgtc

SEQ ID NO: 322265 - DNA, 20 bp, human
gtgtgcccatgacaggttcc

SEQ ID NO: 322266 - DNA, 20 bp, human
ggcgctacgctccgaagccc

SEQ ID NO: 322267 - DNA, 20 bp, human
gagtcgaggcatttgcgcct

SEQ ID NO: 322268 - DNA, 20 bp, human
gggcatttgcgcctgggctt

SEQ ID NO: 322269 - DNA, 20 bp, human
gttaagaaatattcgctaca

SEQ ID NO: 322270 - DNA, 20 bp, human
gggcccgagctccgcgcgga

SEQ ID NO: 322271 - DNA, 20 bp, human
gtcagccgccgcccgaagtt

SEQ ID NO: 322272 - DNA, 20 bp, human
gttaaggcgcggcggccccc

SEQ ID NO: 322273 - DNA, 20 bp, human
gggcttgaccagtgcagaag

SEQ ID NO: 322274 - DNA, 20 bp, human
ggctggagaaggatgcggac

SEQ ID NO: 322275 - DNA, 20 bp, human
ggccgcgccttaactcgatc

SEQ ID NO: 322276 - DNA, 20 bp, human
gctggagaaggatgcggacg

SEQ ID NO: 322277 - DNA, 20 bp, human
gttaagaaatattcgctaca

SEQ ID NO: 322278 - DNA, 20 bp, human
gggcccgagctccgcgcgga

SEQ ID NO: 322279 - DNA, 20 bp, human
gccgccgccttgggcaccca

SEQ ID NO: 322280 - DNA, 20 bp, human
ggccgcgccttaactcgatc

SEQ ID NO: 322281 - DNA, 20 bp, human
gcttcctgcgggaaacccct

SEQ ID NO: 322282 - DNA, 20 bp, human
ggggatctactacgagtcac

SEQ ID NO: 322283 - DNA, 20 bp, human
gccgcggcgacagtggggcg

SEQ ID NO: 322284 - DNA, 20 bp, human
gttaaggcgcggcggccccc

SEQ ID NO: 322285 - DNA, 20 bp, human
gcgaggccgcggcgacagtg

SEQ ID NO: 322286 - DNA, 20 bp, human
gcgagcatgcagtgagacgc

SEQ ID NO: 322287 - DNA, 20 bp, human
ggggtgcgtgggcgttcacg

SEQ ID NO: 322288 - DNA, 20 bp, human
gcggctctgggtgtgtactg

SEQ ID NO: 322289 - DNA, 20 bp, human
ggggcggggcgagccttcga

SEQ ID NO: 322290 - DNA, 20 bp, human
gctccagaggtgtccggctc

SEQ ID NO: 322291 - DNA, 20 bp, human
ggggcagaacccggagtggc

SEQ ID NO: 322292 - DNA, 20 bp, human
gcgtgggcgttcacgaggtt

SEQ ID NO: 322293 - DNA, 20 bp, human
ggtgagacgcgggcagaacc

SEQ ID NO: 322294 - DNA, 20 bp, human
gacccagagccggacacctc

SEQ ID NO: 322295 - DNA, 20 bp, human
gacgcgggcagaacccggag

SEQ ID NO: 322296 - DNA, 20 bp, human
gtgcctggagggcaggtgat

SEQ ID NO: 322297 - DNA, 20 bp, human
gaccagatcaacaaacagca

SEQ ID NO: 322298 - DNA, 20 bp, human
gctgtccctgacaacccctg

SEQ ID NO: 322299 - DNA, 20 bp, human
gcaacccctggggaagtagg

SEQ ID NO: 322300 - DNA, 20 bp, human
gagggatgagaattgcaagg

SEQ ID NO: 322301 - DNA, 20 bp, human
gtcctggacaccctagtaat

SEQ ID NO: 322302 - DNA, 20 bp, human
gaggggcaggacctggaaac

SEQ ID NO: 322303 - DNA, 20 bp, human
gagagtggaggaacactagg

SEQ ID NO: 322304 - DNA, 20 bp, human
gaggaatctcggaaccccct

SEQ ID NO: 322305 - DNA, 20 bp, human
gggacctggaaacaggtatt

SEQ ID NO: 322306 - DNA, 20 bp, human
ggggccggctggtccctcaa

SEQ ID NO: 322307 - DNA, 20 bp, human
gtgcaggccggtggtctcct

SEQ ID NO: 322308 - DNA, 20 bp, human
gaaggcgggaagcgttgccc

SEQ ID NO: 322309 - DNA, 20 bp, human
gcgcactggtgacgtcacca

SEQ ID NO: 322310 - DNA, 20 bp, human
ggtgcgcgggagggacaatg

SEQ ID NO: 322311 - DNA, 20 bp, human
gccggctggtccctcaaagg

SEQ ID NO: 322312 - DNA, 20 bp, human
gcaacgcttcccgcctttga

SEQ ID NO: 322313 - DNA, 20 bp, human
gggggaagggctattcgggc

SEQ ID NO: 322314 - DNA, 20 bp, human
ggcagcccaagcagacgtgg

SEQ ID NO: 322315 - DNA, 20 bp, human
gaacacagtgtctgtggaaa

SEQ ID NO: 322316 - DNA, 20 bp, human
gccaccctggggcggtcgtg

SEQ ID NO: 322317 - DNA, 20 bp, human
gcagaggcggagctgtgatc

SEQ ID NO: 322318 - DNA, 20 bp, human
gttaaaagcggaggaaggga

SEQ ID NO: 322319 - DNA, 20 bp, human
gtgggcatttttaaaagcgg

SEQ ID NO: 322320 - DNA, 20 bp, human
gtgagcgcccgctctgtgcg

SEQ ID NO: 322321 - DNA, 20 bp, human
gagcgggcgctcacaggctt

SEQ ID NO: 322322 - DNA, 20 bp, human
gcctccccacgaccgcccca

SEQ ID NO: 322323 - DNA, 20 bp, human
gcagctgaggccaagaccgc

SEQ ID NO: 322324 - DNA, 20 bp, human
ggccccgcccggaccgcagt

SEQ ID NO: 322325 - DNA, 20 bp, human
gtgtgatctggagagcggta

SEQ ID NO: 322326 - DNA, 20 bp, human
gtagtccaggcccctccgtc

SEQ ID NO: 322327 - DNA, 20 bp, human
gggccgcggcggggtagtcc

SEQ ID NO: 322328 - DNA, 20 bp, human
gcaaaccgcaagcctgacgg

SEQ ID NO: 322329 - DNA, 20 bp, human
ggggccgggagcgcctccgg

SEQ ID NO: 322330 - DNA, 20 bp, human
gtcccggcccggctccgtgg

SEQ ID NO: 322331 - DNA, 20 bp, human
gggcccctccgtcaggcttg

SEQ ID NO: 322332 - DNA, 20 bp, human
gctcgctcttttcttggcgg

SEQ ID NO: 322333 - DNA, 20 bp, human
gcccccccacggagccgggc

SEQ ID NO: 322334 - DNA, 20 bp, human
ggcgctcgctcttttcttgg

SEQ ID NO: 322335 - DNA, 20 bp, human
gggcctggactaccccgccg

SEQ ID NO: 322336 - DNA, 20 bp, human
ggccccggcgccgcgcccta

SEQ ID NO: 322337 - DNA, 20 bp, human
ggggaagtggaacgaacccc

SEQ ID NO: 322338 - DNA, 20 bp, human
gcaccctgaccgttccaacc

SEQ ID NO: 322339 - DNA, 20 bp, human
ggccctggttggaacggtca

SEQ ID NO: 322340 - DNA, 20 bp, human
gcacccacagccaattgcca

SEQ ID NO: 322341 - DNA, 20 bp, human
ggggacgcgcacaagccggt

SEQ ID NO: 322342 - DNA, 20 bp, human
ggcgactggcttttcccaga

SEQ ID NO: 322343 - DNA, 20 bp, human
gttgccatggcaattggctg

SEQ ID NO: 322344 - DNA, 20 bp, human
gtccctgcactgcagccaac

SEQ ID NO: 322345 - DNA, 20 bp, human
gtgtgcctgtgtgtggcgac

SEQ ID NO: 322346 - DNA, 20 bp, human
gacccgagcgcgaagtgtgt

SEQ ID NO: 322347 - DNA, 20 bp, human
ggccccgccggctgaagcat

SEQ ID NO: 322348 - DNA, 20 bp, human
gaacgcgctaggctagaagg

SEQ ID NO: 322349 - DNA, 20 bp, human
gcggctcaggcaaacgtaag

SEQ ID NO: 322350 - DNA, 20 bp, human
gccggctgaagcatcggcgc

SEQ ID NO: 322351 - DNA, 20 bp, human
gcagccggcggggcggctga

SEQ ID NO: 322352 - DNA, 20 bp, human
gctgaagcatcggcgctggg

SEQ ID NO: 322353 - DNA, 20 bp, human
gcgagcgtgtgcgcgcgcga

SEQ ID NO: 322354 - DNA, 20 bp, human
gcgcgcgccggcggttgggg

SEQ ID NO: 322355 - DNA, 20 bp, human
gtgagggggaactccgcggg

SEQ ID NO: 322356 - DNA, 20 bp, human
gccgaggggggtctccgata

SEQ ID NO: 322357 - DNA, 20 bp, human
gagcaggatggcagggccga

SEQ ID NO: 322358 - DNA, 20 bp, human
gaagaggccgtgcaccgcgc

SEQ ID NO: 322359 - DNA, 20 bp, human
gggggggagccggttctcgg

SEQ ID NO: 322360 - DNA, 20 bp, human
ggtcacgcccatgccgggta

SEQ ID NO: 322361 - DNA, 20 bp, human
gcccccgccttccctctccg

SEQ ID NO: 322362 - DNA, 20 bp, human
gggcatgggcgtgacctcgt

SEQ ID NO: 322363 - DNA, 20 bp, human
gccccccgggcccccactag

SEQ ID NO: 322364 - DNA, 20 bp, human
ggtaggggggagccggttct

SEQ ID NO: 322365 - DNA, 20 bp, human
gctgtcagccccccgagaac

SEQ ID NO: 322366 - DNA, 20 bp, human
gacttcaggagaagtaggga

SEQ ID NO: 322367 - DNA, 20 bp, human
ggaaggcaatgcttcacatt

SEQ ID NO: 322368 - DNA, 20 bp, human
ggagggaagcgtgtgtggta

SEQ ID NO: 322369 - DNA, 20 bp, human
ggattacttcaggagaagta

SEQ ID NO: 322370 - DNA, 20 bp, human
gcccacaggtaaaacccttg

SEQ ID NO: 322371 - DNA, 20 bp, human
gtctgtaaacagattacttc

SEQ ID NO: 322372 - DNA, 20 bp, human
gcaggaaatagcaacattct

SEQ ID NO: 322373 - DNA, 20 bp, human
ggctttggggagaacttgac

SEQ ID NO: 322374 - DNA, 20 bp, human
gaaactgttgccacatctgc

SEQ ID NO: 322375 - DNA, 20 bp, human
gaaccacagatcatcctcca

SEQ ID NO: 322376 - DNA, 20 bp, human
ggtcatgaggcatgtcagtg

SEQ ID NO: 322377 - DNA, 20 bp, human
gaacgggtataaagtacatg

SEQ ID NO: 322378 - DNA, 20 bp, human
ggaaataacctaagtgctga

SEQ ID NO: 322379 - DNA, 20 bp, human
gattaaggacttcttgccaa

SEQ ID NO: 322380 - DNA, 20 bp, human
gttataaaatctctgacgaa

SEQ ID NO: 322381 - DNA, 20 bp, human
gtatgcagccttcagcactt

SEQ ID NO: 322382 - DNA, 20 bp, human
gtattttgtctttgtgtcat

SEQ ID NO: 322383 - DNA, 20 bp, human
gctgacatgcctcatgacct

SEQ ID NO: 322384 - DNA, 20 bp, human
gacttgccttgtatttaccc

SEQ ID NO: 322385 - DNA, 20 bp, human
gcagtgtggtgatgtgcctt

SEQ ID NO: 322386 - DNA, 20 bp, human
ggcgccggcccctttgtcta

SEQ ID NO: 322387 - DNA, 20 bp, human
gctgctgttcaggatgtccc

SEQ ID NO: 322388 - DNA, 20 bp, human
ggacaaaggggccggcgcgg

SEQ ID NO: 322389 - DNA, 20 bp, human
ggagcagactggtgcagcct

SEQ ID NO: 322390 - DNA, 20 bp, human
gccggcgcggcggagcagac

SEQ ID NO: 322391 - DNA, 20 bp, human
gggctcgcccctagacaaag

SEQ ID NO: 322392 - DNA, 20 bp, human
ggggcagagctgacccggtg

SEQ ID NO: 322393 - DNA, 20 bp, human
gacgcctccaagttcccacc

SEQ ID NO: 322394 - DNA, 20 bp, human
gcgcccggaaaacccggctc

SEQ ID NO: 322395 - DNA, 20 bp, human
gcgcccctagacaaaggggc

SEQ ID NO: 322396 - DNA, 20 bp, human
ggggctcggcccatcctgcg

SEQ ID NO: 322397 - DNA, 20 bp, human
gcgagcatgcgcactaggaa

SEQ ID NO: 322398 - DNA, 20 bp, human
gcctcctgggaccgcgtgca

SEQ ID NO: 322399 - DNA, 20 bp, human
gtatccctaccgcgcaggat

SEQ ID NO: 322400 - DNA, 20 bp, human
gcatgcgcactaggaagggg

SEQ ID NO: 322401 - DNA, 20 bp, human
gtgggaccgcgtgcaggggg

SEQ ID NO: 322402 - DNA, 20 bp, human
ggtaggtccgcgcctggtgt

SEQ ID NO: 322403 - DNA, 20 bp, human
gcgcgcaagcgcagcggcat

SEQ ID NO: 322404 - DNA, 20 bp, human
gaggcgcggacctacgaagg

SEQ ID NO: 322405 - DNA, 20 bp, human
ggacgcccggctactgcgtg

SEQ ID NO: 322406 - DNA, 20 bp, human
ggggcgcacaaagctcccgg

SEQ ID NO: 322407 - DNA, 20 bp, human
gacgcccactccagaccctc

SEQ ID NO: 322408 - DNA, 20 bp, human
gcccggcggaagtccggccg

SEQ ID NO: 322409 - DNA, 20 bp, human
gaaagctcccggcggaagtc

SEQ ID NO: 322410 - DNA, 20 bp, human
ggcgggggccgaatgggagg

SEQ ID NO: 322411 - DNA, 20 bp, human
gtgggcgaggcctgagggtc

SEQ ID NO: 322412 - DNA, 20 bp, human
ggccacgcccccgccagaaa

SEQ ID NO: 322413 - DNA, 20 bp, human
ggccccggccggacttccgc

SEQ ID NO: 322414 - DNA, 20 bp, human
gcgcccgcccctccccggta

SEQ ID NO: 322415 - DNA, 20 bp, human
ggccgggcgcacaaagctcc

SEQ ID NO: 322416 - DNA, 20 bp, human
gagactgaagaaggggcgaa

SEQ ID NO: 322417 - DNA, 20 bp, human
gggcagggcaattacctcac

SEQ ID NO: 322418 - DNA, 20 bp, human
gttgttgggcgcaccctggc

SEQ ID NO: 322419 - DNA, 20 bp, human
gcaattacctcacagggtag

SEQ ID NO: 322420 - DNA, 20 bp, human
ggaaggggcgaagggtaggc

SEQ ID NO: 322421 - DNA, 20 bp, human
gtgaagaaggggcgaagggt

SEQ ID NO: 322422 - DNA, 20 bp, human
gcactgcaggggaacccctg

SEQ ID NO: 322423 - DNA, 20 bp, human
ggttctgcacagaaatcccc

SEQ ID NO: 322424 - DNA, 20 bp, human
ggcgcccaacaactttgaac

SEQ ID NO: 322425 - DNA, 20 bp, human
ggtcagggaagtggtcacta

SEQ ID NO: 322426 - DNA, 20 bp, human
gtcaggaaaacctctaagtg

SEQ ID NO: 322427 - DNA, 20 bp, human
gtactcctagaaatagtgga

SEQ ID NO: 322428 - DNA, 20 bp, human
gagaatcttctgttgggaaa

SEQ ID NO: 322429 - DNA, 20 bp, human
gagttccttccactatttct

SEQ ID NO: 322430 - DNA, 20 bp, human
gagaggccagccccacttag

SEQ ID NO: 322431 - DNA, 20 bp, human
ggggtgtaggcgttcctttt

SEQ ID NO: 322432 - DNA, 20 bp, human
ggactgtaatctggtagtta

SEQ ID NO: 322433 - DNA, 20 bp, human
gcagtctctaagtcttaaag

SEQ ID NO: 322434 - DNA, 20 bp, human
gatgtcctgatacgcagctc

SEQ ID NO: 322435 - DNA, 20 bp, human
gttttcctgagctgcgtatc

SEQ ID NO: 322436 - DNA, 20 bp, human
gtgacaagagctctggcgat

SEQ ID NO: 322437 - DNA, 20 bp, human
gccactgcgtgcaacagcgc

SEQ ID NO: 322438 - DNA, 20 bp, human
gcgggccagggctaaggaac

SEQ ID NO: 322439 - DNA, 20 bp, human
gcaccgcgtggcctctatga

SEQ ID NO: 322440 - DNA, 20 bp, human
gaatggggacggccgacaca

SEQ ID NO: 322441 - DNA, 20 bp, human
gaagccccgctgccggtggc

SEQ ID NO: 322442 - DNA, 20 bp, human
gggcgctccctggttctgtg

SEQ ID NO: 322443 - DNA, 20 bp, human
gaaccagggagcgccagcgg

SEQ ID NO: 322444 - DNA, 20 bp, human
ggaccctggcgccacagaga

SEQ ID NO: 322445 - DNA, 20 bp, human
gactgccaaggtcctagagg

SEQ ID NO: 322446 - DNA, 20 bp, human
ggtagcttggccccctacca

SEQ ID NO: 322447 - DNA, 20 bp, human
gagggggccaagctaccctg

SEQ ID NO: 322448 - DNA, 20 bp, human
ggacccccgacgttaccgtg

SEQ ID NO: 322449 - DNA, 20 bp, human
ggcgagcagggcgggtccgg

SEQ ID NO: 322450 - DNA, 20 bp, human
ggggtcagaatgtagcacct

SEQ ID NO: 322451 - DNA, 20 bp, human
gggtacctgtcttgtcccga

SEQ ID NO: 322452 - DNA, 20 bp, human
gggagctaccccactccaaa

SEQ ID NO: 322453 - DNA, 20 bp, human
gtgccccacggtaacgtcgg

SEQ ID NO: 322454 - DNA, 20 bp, human
gtaccagggaaaggcgagca

SEQ ID NO: 322455 - DNA, 20 bp, human
gttggccccctaccagggaa

SEQ ID NO: 322456 - DNA, 20 bp, human
gcgcgcggggtgcttgtccc

SEQ ID NO: 322457 - DNA, 20 bp, human
ggtcccgcgcaggggatgaa

SEQ ID NO: 322458 - DNA, 20 bp, human
ggggccaggagagaccccgc

SEQ ID NO: 322459 - DNA, 20 bp, human
gcagggaagccgggggtcta

SEQ ID NO: 322460 - DNA, 20 bp, human
gcttgtcccaggctgggtcg

SEQ ID NO: 322461 - DNA, 20 bp, human
gcgcaggcggaggcaggcga

SEQ ID NO: 322462 - DNA, 20 bp, human
gcgccgcccagggaagccgg

SEQ ID NO: 322463 - DNA, 20 bp, human
gccgcctgcggggtctctcc

SEQ ID NO: 322464 - DNA, 20 bp, human
gcggcggcctggggactcgc

SEQ ID NO: 322465 - DNA, 20 bp, human
gagaccccgcaggcggaggc

SEQ ID NO: 322466 - DNA, 20 bp, human
ggccgcgcgagcccagctga

SEQ ID NO: 322467 - DNA, 20 bp, human
gtggcggaggaaggatgcac

SEQ ID NO: 322468 - DNA, 20 bp, human
ggcaaacagcaaaacgtgtc

SEQ ID NO: 322469 - DNA, 20 bp, human
gggaggaaggatgcaccggg

SEQ ID NO: 322470 - DNA, 20 bp, human
gtccaggatgttgctctcac

SEQ ID NO: 322471 - DNA, 20 bp, human
gtccctcagctgggctcgcg

SEQ ID NO: 322472 - DNA, 20 bp, human
gagcaacatcctggaaagag

SEQ ID NO: 322473 - DNA, 20 bp, human
gagcccgcgtgtgcaggaat

SEQ ID NO: 322474 - DNA, 20 bp, human
ggcaagggaatgaccggcag

SEQ ID NO: 322475 - DNA, 20 bp, human
gggtgctcccccctctttcc

SEQ ID NO: 322476 - DNA, 20 bp, human
gtcatgacgtagaatgagag

SEQ ID NO: 322477 - DNA, 20 bp, human
gtctgaatgcgttcagttga

SEQ ID NO: 322478 - DNA, 20 bp, human
gctacgtcatgagatgacgt

SEQ ID NO: 322479 - DNA, 20 bp, human
gtgaacgcattcagacgcca

SEQ ID NO: 322480 - DNA, 20 bp, human
gatgacgtcggaagccgggc

SEQ ID NO: 322481 - DNA, 20 bp, human
gcagcgggagccgctgactg

SEQ ID NO: 322482 - DNA, 20 bp, human
ggggccttggcggcttatca

SEQ ID NO: 322483 - DNA, 20 bp, human
ggcctggcaggagctatata

SEQ ID NO: 322484 - DNA, 20 bp, human
ggagaggaaggcgctgcgtt

SEQ ID NO: 322485 - DNA, 20 bp, human
gtgcgttaggaaagcttgaa

SEQ ID NO: 322486 - DNA, 20 bp, human
gagggcggggaggacgacga

SEQ ID NO: 322487 - DNA, 20 bp, human
gaggacgacgagggcgaaga

SEQ ID NO: 322488 - DNA, 20 bp, human
gccccggagcccgagccgaa

SEQ ID NO: 322489 - DNA, 20 bp, human
ggaagtgacgacagttccga

SEQ ID NO: 322490 - DNA, 20 bp, human
ggtcctcagacttggagggg

SEQ ID NO: 322491 - DNA, 20 bp, human
gcctgcgccatgtccaccaa

SEQ ID NO: 322492 - DNA, 20 bp, human
gcagttccgaaggcgaacgg

SEQ ID NO: 322493 - DNA, 20 bp, human
ggccagcgacttagcgtttg

SEQ ID NO: 322494 - DNA, 20 bp, human
gacgctaagtcgctggccat

SEQ ID NO: 322495 - DNA, 20 bp, human
gttccgaaggcgaacggagg

SEQ ID NO: 322496 - DNA, 20 bp, human
gtgaagggcgcgagcggcat

SEQ ID NO: 322497 - DNA, 20 bp, human
gggcgcgagcggcatgggtg

SEQ ID NO: 322498 - DNA, 20 bp, human
gcacgcaagccgggcctgaa

SEQ ID NO: 322499 - DNA, 20 bp, human
gagtactggggattgcctgg

SEQ ID NO: 322500 - DNA, 20 bp, human
gctggaggcgcgcaaggatc

SEQ ID NO: 322501 - DNA, 20 bp, human
gcccggggcactgtgcagtg

SEQ ID NO: 322502 - DNA, 20 bp, human
gcaaggatctggcgcttggt

SEQ ID NO: 322503 - DNA, 20 bp, human
gcgggcctgaagggcgcgag

SEQ ID NO: 322504 - DNA, 20 bp, human
ggagaggggcctccaatcga

SEQ ID NO: 322505 - DNA, 20 bp, human
gcccgcgcggctggttcctt

SEQ ID NO: 322506 - DNA, 20 bp, human
ggctggagaaggtgttgtac

SEQ ID NO: 322507 - DNA, 20 bp, human
gggaagtcggcgatgttgat

SEQ ID NO: 322508 - DNA, 20 bp, human
gacccggcgcgactccgcag

SEQ ID NO: 322509 - DNA, 20 bp, human
gtagcggtcggcgctcatga

SEQ ID NO: 322510 - DNA, 20 bp, human
gctgcggcagtggcccttcg

SEQ ID NO: 322511 - DNA, 20 bp, human
gactctggcgaactcggggg

SEQ ID NO: 322512 - DNA, 20 bp, human
ggccactgcgggattctgtg

SEQ ID NO: 322513 - DNA, 20 bp, human
gagcgccgaccgctacctgg

SEQ ID NO: 322514 - DNA, 20 bp, human
ggtcggcgctcatgacggtg

SEQ ID NO: 322515 - DNA, 20 bp, human
gaacaccaccaggtagcggt

SEQ ID NO: 322516 - DNA, 20 bp, human
gcctgggtaagtgaatgctg

SEQ ID NO: 322517 - DNA, 20 bp, human
gacccaggcagactcctcag

SEQ ID NO: 322518 - DNA, 20 bp, human
gtgggtgtgcccaggtcttc

SEQ ID NO: 322519 - DNA, 20 bp, human
gcctgcagtcggctgtccca

SEQ ID NO: 322520 - DNA, 20 bp, human
gactccatgcaggggcctct

SEQ ID NO: 322521 - DNA, 20 bp, human
ggcccactgaggagtctgcc

SEQ ID NO: 322522 - DNA, 20 bp, human
gtgaatgctgaggagaccct

SEQ ID NO: 322523 - DNA, 20 bp, human
gaggaagggactccatgcag

SEQ ID NO: 322524 - DNA, 20 bp, human
ggccctctgcccgaagacct

SEQ ID NO: 322525 - DNA, 20 bp, human
gcacccttatctgtgaacat

SEQ ID NO: 322526 - DNA, 20 bp, human
gtggcccccggggattgcag

SEQ ID NO: 322527 - DNA, 20 bp, human
gcggcccgggagagtatctg

SEQ ID NO: 322528 - DNA, 20 bp, human
gcagcggcacctcccagaaa

SEQ ID NO: 322529 - DNA, 20 bp, human
gaaccccgaggtggggacca

SEQ ID NO: 322530 - DNA, 20 bp, human
gtgggcgcgaggaaaccccg

SEQ ID NO: 322531 - DNA, 20 bp, human
gcggctccgccctttctggg

SEQ ID NO: 322532 - DNA, 20 bp, human
gggaaggaagaaggcgtcgt

SEQ ID NO: 322533 - DNA, 20 bp, human
ggggccaggcgcgggactta

SEQ ID NO: 322534 - DNA, 20 bp, human
gtgccgggactccctggccc

SEQ ID NO: 322535 - DNA, 20 bp, human
ggctgaggagaagggcaaca

SEQ ID NO: 322536 - DNA, 20 bp, human
gtggactggggccaaacagt

SEQ ID NO: 322537 - DNA, 20 bp, human
gactgggttagggaccaatg

SEQ ID NO: 322538 - DNA, 20 bp, human
gaggccagggttgtcatcga

SEQ ID NO: 322539 - DNA, 20 bp, human
gaaagcgggggcctgtggac

SEQ ID NO: 322540 - DNA, 20 bp, human
gcaaagcgaccgaagccaga

SEQ ID NO: 322541 - DNA, 20 bp, human
gccctagcacctgcgtgatg

SEQ ID NO: 322542 - DNA, 20 bp, human
gtccccttcgatgacaaccc

SEQ ID NO: 322543 - DNA, 20 bp, human
gcatctaaagcgggggcctg

SEQ ID NO: 322544 - DNA, 20 bp, human
gccaactccagcagtgttag

SEQ ID NO: 322545 - DNA, 20 bp, human
gatgaggctcatctaaagcg

SEQ ID NO: 322546 - DNA, 20 bp, human
gtctgaggggatggcatggg

SEQ ID NO: 322547 - DNA, 20 bp, human
gagccggagaggtgctctaa

SEQ ID NO: 322548 - DNA, 20 bp, human
gtcctcccgcactacccaat

SEQ ID NO: 322549 - DNA, 20 bp, human
gtaaagggaaggaacggggc

SEQ ID NO: 322550 - DNA, 20 bp, human
gcccccccaacatgcctatt

SEQ ID NO: 322551 - DNA, 20 bp, human
ggcggagactgcaggcttct

SEQ ID NO: 322552 - DNA, 20 bp, human
gcgcgggcgggcctcagctg

SEQ ID NO: 322553 - DNA, 20 bp, human
gaggtgggtccgggcgggtc

SEQ ID NO: 322554 - DNA, 20 bp, human
ggagaggtgctctaaaggga

SEQ ID NO: 322555 - DNA, 20 bp, human
ggggcctcagctgtggttac

SEQ ID NO: 322556 - DNA, 20 bp, human
gcctgcgcgctccacctgag

SEQ ID NO: 322557 - DNA, 20 bp, human
gcaggtgccgagacaccctg

SEQ ID NO: 322558 - DNA, 20 bp, human
ggtccagcgaggcccggaga

SEQ ID NO: 322559 - DNA, 20 bp, human
gggtgcggttcccagaagtc

SEQ ID NO: 322560 - DNA, 20 bp, human
gtcggcacctgcggtctctg

SEQ ID NO: 322561 - DNA, 20 bp, human
gcaccggccccagagaccgc

SEQ ID NO: 322562 - DNA, 20 bp, human
gccggagaggggaccagaac

SEQ ID NO: 322563 - DNA, 20 bp, human
gcgcacccgcgatggggcag

SEQ ID NO: 322564 - DNA, 20 bp, human
gaggtcctctgccccatcgc

SEQ ID NO: 322565 - DNA, 20 bp, human
gcgcgaggctaggcccacac

SEQ ID NO: 322566 - DNA, 20 bp, human
gcggccctgcccaacacgcg

SEQ ID NO: 322567 - DNA, 20 bp, human
ggcccgcccggggcgcgagg

SEQ ID NO: 322568 - DNA, 20 bp, human
gtcgccccgcgtgttgggca

SEQ ID NO: 322569 - DNA, 20 bp, human
ggcgcgggccctactcggca

SEQ ID NO: 322570 - DNA, 20 bp, human
gcccctccggcctaactgat

SEQ ID NO: 322571 - DNA, 20 bp, human
ggctgctcgcgagacgtgca

SEQ ID NO: 322572 - DNA, 20 bp, human
gtgaccgggcggaactgcgt

SEQ ID NO: 322573 - DNA, 20 bp, human
gcgggcgcgcgggccctact

SEQ ID NO: 322574 - DNA, 20 bp, human
ggggcggaactgcgtcgggt

SEQ ID NO: 322575 - DNA, 20 bp, human
ggaggccaggcccgtccggg

SEQ ID NO: 322576 - DNA, 20 bp, human
gtgctacttaacaggaacta

SEQ ID NO: 322577 - DNA, 20 bp, human
gtgttaagtagcaaattcaa

SEQ ID NO: 322578 - DNA, 20 bp, human
gcactgcgcccggctattaa

SEQ ID NO: 322579 - DNA, 20 bp, human
gtataaaacctttaatagcc

SEQ ID NO: 322580 - DNA, 20 bp, human
ggggaggagggcccgcaagg

SEQ ID NO: 322581 - DNA, 20 bp, human
gcgcgcgcacgcctgggcag

SEQ ID NO: 322582 - DNA, 20 bp, human
gggagggcccgcaaggaggg

SEQ ID NO: 322583 - DNA, 20 bp, human
gggagtgcgcgcgcacgcct

SEQ ID NO: 322584 - DNA, 20 bp, human
gaaggggaggagggcccgca

SEQ ID NO: 322585 - DNA, 20 bp, human
gcggcggggcgggagggcgt

SEQ ID NO: 322586 - DNA, 20 bp, human
gcgccatgggaggagatccc

SEQ ID NO: 322587 - DNA, 20 bp, human
gtgagagcatgaagtcctgg

SEQ ID NO: 322588 - DNA, 20 bp, human
gactccaggcttaggggccg

SEQ ID NO: 322589 - DNA, 20 bp, human
gcctgctctagattccccta

SEQ ID NO: 322590 - DNA, 20 bp, human
ggaagtcctgggggcgccat

SEQ ID NO: 322591 - DNA, 20 bp, human
gccagcctcacagtagcctt

SEQ ID NO: 322592 - DNA, 20 bp, human
gccaacctgttgagggatta

SEQ ID NO: 322593 - DNA, 20 bp, human
gccaagaggcacacaagcag

SEQ ID NO: 322594 - DNA, 20 bp, human
gggctcattaggagccacct

SEQ ID NO: 322595 - DNA, 20 bp, human
ggggattaggggttcgtcta

SEQ ID NO: 322596 - DNA, 20 bp, human
gcgagcgcccctccgaagta

SEQ ID NO: 322597 - DNA, 20 bp, human
gagtgctggaccccaggcta

SEQ ID NO: 322598 - DNA, 20 bp, human
gggtgtgtcccctacttcgg

SEQ ID NO: 322599 - DNA, 20 bp, human
ggaggctggcatatgaggca

SEQ ID NO: 322600 - DNA, 20 bp, human
gggcccggggcgccctcgct

SEQ ID NO: 322601 - DNA, 20 bp, human
gcatatgaggcacgggagag

SEQ ID NO: 322602 - DNA, 20 bp, human
gtctgggccttcctgagaag

SEQ ID NO: 322603 - DNA, 20 bp, human
gctggaccccaggctagggt

SEQ ID NO: 322604 - DNA, 20 bp, human
gccggggcgccctcgctcgg

SEQ ID NO: 322605 - DNA, 20 bp, human
gctcccgaccaggggaagga

SEQ ID NO: 322606 - DNA, 20 bp, human
gtctgcttcagacagagaga

SEQ ID NO: 322607 - DNA, 20 bp, human
gtacctgggtgccccttagc

SEQ ID NO: 322608 - DNA, 20 bp, human
gccggacaaggaggcgggga

SEQ ID NO: 322609 - DNA, 20 bp, human
ggggatatgaatagcttctt

SEQ ID NO: 322610 - DNA, 20 bp, human
gtccgagcgcggcaaagaaa

SEQ ID NO: 322611 - DNA, 20 bp, human
gagcttcttcggaaccccag

SEQ ID NO: 322612 - DNA, 20 bp, human
gatcccgctaaggggcaccc

SEQ ID NO: 322613 - DNA, 20 bp, human
ggaaactcagaatccgagcg

SEQ ID NO: 322614 - DNA, 20 bp, human
ggtctcatctgcaccggaca

SEQ ID NO: 322615 - DNA, 20 bp, human
gtctgcaccggacaaggagg

SEQ ID NO: 322616 - DNA, 20 bp, human
gccaccaggcaggtcacagc

SEQ ID NO: 322617 - DNA, 20 bp, human
gggaggcgggcgcacatcga

SEQ ID NO: 322618 - DNA, 20 bp, human
gagggtcaaatgttctcttg

SEQ ID NO: 322619 - DNA, 20 bp, human
gccaggcaggtcacagccgg

SEQ ID NO: 322620 - DNA, 20 bp, human
gtcatcccacgccaccaggc

SEQ ID NO: 322621 - DNA, 20 bp, human
ggggacgttcccctatcctt

SEQ ID NO: 322622 - DNA, 20 bp, human
gcgggggagtcacttttcct

SEQ ID NO: 322623 - DNA, 20 bp, human
ggtggtcatcccacgccacc

SEQ ID NO: 322624 - DNA, 20 bp, human
gtgtgacctgcctggtggcg

SEQ ID NO: 322625 - DNA, 20 bp, human
gaatgtagtttcagacgccg

SEQ ID NO: 322626 - DNA, 20 bp, human
ggaactggggggatgggcga

SEQ ID NO: 322627 - DNA, 20 bp, human
gtgggcggagcagcgggacg

SEQ ID NO: 322628 - DNA, 20 bp, human
gagggggtggggcaactgga

SEQ ID NO: 322629 - DNA, 20 bp, human
gggacggggcagcggaactg

SEQ ID NO: 322630 - DNA, 20 bp, human
ggcagcggaactggggggat

SEQ ID NO: 322631 - DNA, 20 bp, human
gcaggactgggcggagcagc

SEQ ID NO: 322632 - DNA, 20 bp, human
gccaggcgggctagcaagaa

SEQ ID NO: 322633 - DNA, 20 bp, human
ggggcggggcagggcaaacg

SEQ ID NO: 322634 - DNA, 20 bp, human
gtccgctgcctcgcctcgtc

SEQ ID NO: 322635 - DNA, 20 bp, human
gtccgcccagtcctgctctc

SEQ ID NO: 322636 - DNA, 20 bp, human
gggcccgccgccgcaccgat

SEQ ID NO: 322637 - DNA, 20 bp, human
gaaagcgcagccctcgactt

SEQ ID NO: 322638 - DNA, 20 bp, human
gcaatcagagcccaagtcga

SEQ ID NO: 322639 - DNA, 20 bp, human
gtggccccgggcgtcccacg

SEQ ID NO: 322640 - DNA, 20 bp, human
gcggacatgcaaatcaggat

SEQ ID NO: 322641 - DNA, 20 bp, human
gtcacattaccattggttga

SEQ ID NO: 322642 - DNA, 20 bp, human
ggagcgccagccaatcggtg

SEQ ID NO: 322643 - DNA, 20 bp, human
ggtcgtcggacatgcaaatc

SEQ ID NO: 322644 - DNA, 20 bp, human
gcgccagccaatcggtgcgg

SEQ ID NO: 322645 - DNA, 20 bp, human
gcagccaatcggtgcggcgg

SEQ ID NO: 322646 - DNA, 20 bp, human
gccaggccctggggtcacgg

SEQ ID NO: 322647 - DNA, 20 bp, human
gttgccaaggtcatgtatca

SEQ ID NO: 322648 - DNA, 20 bp, human
gcccagcctccgtgacccca

SEQ ID NO: 322649 - DNA, 20 bp, human
gaggcaccgaggaacgcgcc

SEQ ID NO: 322650 - DNA, 20 bp, human
ggggagaagtcagatcaagg

SEQ ID NO: 322651 - DNA, 20 bp, human
gggctctggaaggtacctgg

SEQ ID NO: 322652 - DNA, 20 bp, human
gtcctcccagctggcccagc

SEQ ID NO: 322653 - DNA, 20 bp, human
gagcaggggagcagccagct

SEQ ID NO: 322654 - DNA, 20 bp, human
gtcacagtgcaacctccccc

SEQ ID NO: 322655 - DNA, 20 bp, human
ggggaggttcaagccatggg

SEQ ID NO: 322656 - DNA, 20 bp, human
gggcgaggccagaccagaga

SEQ ID NO: 322657 - DNA, 20 bp, human
gggggcgggacatgcgtgga

SEQ ID NO: 322658 - DNA, 20 bp, human
gaggctggagaggcactagg

SEQ ID NO: 322659 - DNA, 20 bp, human
ggggcgcagtgcggatgcgt

SEQ ID NO: 322660 - DNA, 20 bp, human
gctggagaggcactaggcgg

SEQ ID NO: 322661 - DNA, 20 bp, human
gatccctcccctctctggtc

SEQ ID NO: 322662 - DNA, 20 bp, human
gtgtcccaggacaagttgac

SEQ ID NO: 322663 - DNA, 20 bp, human
gcctccagcctgtggaaccg

SEQ ID NO: 322664 - DNA, 20 bp, human
gcccaggacaagttgaccgg

SEQ ID NO: 322665 - DNA, 20 bp, human
ggagaggcactaggcggggg

SEQ ID NO: 322666 - DNA, 20 bp, human
ggcggcgctgaagcagagag

SEQ ID NO: 322667 - DNA, 20 bp, human
gcctaaagaccgtcgggtgg

SEQ ID NO: 322668 - DNA, 20 bp, human
gagccctctagcatgacatt

SEQ ID NO: 322669 - DNA, 20 bp, human
gcgcccggcagctctgagga

SEQ ID NO: 322670 - DNA, 20 bp, human
ggacccgcagcgactccaca

SEQ ID NO: 322671 - DNA, 20 bp, human
gtgaagactcatctcctgga

SEQ ID NO: 322672 - DNA, 20 bp, human
gcaccaagacacagctgtcg

SEQ ID NO: 322673 - DNA, 20 bp, human
gtcaacgcccgcaccctgcc

SEQ ID NO: 322674 - DNA, 20 bp, human
gctctgcttcagcgccgccc

SEQ ID NO: 322675 - DNA, 20 bp, human
ggcgggagcgctaggggcac

SEQ ID NO: 322676 - DNA, 20 bp, human
gagcaggcgggcaggaccca

SEQ ID NO: 322677 - DNA, 20 bp, human
ggtggggagctccaagcagg

SEQ ID NO: 322678 - DNA, 20 bp, human
ggagctccaagcaggcgggc

SEQ ID NO: 322679 - DNA, 20 bp, human
gtcctggtcaccaggcccct

SEQ ID NO: 322680 - DNA, 20 bp, human
ggagctctcagggacgtcca

SEQ ID NO: 322681 - DNA, 20 bp, human
gtgggtggggagctccaagc

SEQ ID NO: 322682 - DNA, 20 bp, human
gcgggcaggacccaggggcc

SEQ ID NO: 322683 - DNA, 20 bp, human
gccacccatcacacatgatg

SEQ ID NO: 322684 - DNA, 20 bp, human
gcaagccctctgggtattgt

SEQ ID NO: 322685 - DNA, 20 bp, human
gtttgcccacaatacccaga

SEQ ID NO: 322686 - DNA, 20 bp, human
ggggcctgaggcccaaccct

SEQ ID NO: 322687 - DNA, 20 bp, human
gagcacggtgagctgttccg

SEQ ID NO: 322688 - DNA, 20 bp, human
gaacagctcaccgtgctgct

SEQ ID NO: 322689 - DNA, 20 bp, human
ggcagccgcagggcacaggc

SEQ ID NO: 322690 - DNA, 20 bp, human
ggtggctgcaagcagccgca

SEQ ID NO: 322691 - DNA, 20 bp, human
gcacgtgatggacgttgtgg

SEQ ID NO: 322692 - DNA, 20 bp, human
ggagcacgtgatggacgttg

SEQ ID NO: 322693 - DNA, 20 bp, human
gagggcaggcattctcaaag

SEQ ID NO: 322694 - DNA, 20 bp, human
gggtgagggggagcacgtga

SEQ ID NO: 322695 - DNA, 20 bp, human
gcctgggcgctatgaggtcc

SEQ ID NO: 322696 - DNA, 20 bp, human
ggcagcagaaaccaccaggc

SEQ ID NO: 322697 - DNA, 20 bp, human
gacactatgctaaaagtcca

SEQ ID NO: 322698 - DNA, 20 bp, human
gtatgctaaaagtccaaggc

SEQ ID NO: 322699 - DNA, 20 bp, human
gacttttagcatagtgtgtc

SEQ ID NO: 322700 - DNA, 20 bp, human
gagcctgaaccccatctgtg

SEQ ID NO: 322701 - DNA, 20 bp, human
ggggctctgggcagatgcca

SEQ ID NO: 322702 - DNA, 20 bp, human
gcatctgtggggatgcgagg

SEQ ID NO: 322703 - DNA, 20 bp, human
ggatcctccagctacctcac

SEQ ID NO: 322704 - DNA, 20 bp, human
gagccctgtgaggtagctgg

SEQ ID NO: 322705 - DNA, 20 bp, human
ggcccagagcccgagaagga

SEQ ID NO: 322706 - DNA, 20 bp, human
ggaggcgcgcccggaaccgc

SEQ ID NO: 322707 - DNA, 20 bp, human
ggaggtgcccgcacgcggga

SEQ ID NO: 322708 - DNA, 20 bp, human
gccgcgtgcgggcacctcct

SEQ ID NO: 322709 - DNA, 20 bp, human
gcccacgtgccgccacgcca

SEQ ID NO: 322710 - DNA, 20 bp, human
gaaggactggcgtgcagacg

SEQ ID NO: 322711 - DNA, 20 bp, human
ggggtgagccgcgtgctctc

SEQ ID NO: 322712 - DNA, 20 bp, human
gtgactccggcgcagcgccc

SEQ ID NO: 322713 - DNA, 20 bp, human
ggccccggctccccgaggat

SEQ ID NO: 322714 - DNA, 20 bp, human
gccgggtgcccgagagcacg

SEQ ID NO: 322715 - DNA, 20 bp, human
gcggccgcggatataaagcg

SEQ ID NO: 322716 - DNA, 20 bp, human
gcatccctgcaactggagga

SEQ ID NO: 322717 - DNA, 20 bp, human
gcaactggaggaggggattt

SEQ ID NO: 322718 - DNA, 20 bp, human
gaggccgggaaaccaggttc

SEQ ID NO: 322719 - DNA, 20 bp, human
gcatgcgtcgagccgttggt

SEQ ID NO: 322720 - DNA, 20 bp, human
gccgccatccctgcaactgg

SEQ ID NO: 322721 - DNA, 20 bp, human
ggagcgaggcaccgggacgt

SEQ ID NO: 322722 - DNA, 20 bp, human
ggctcgacgcatgcgcaggg

SEQ ID NO: 322723 - DNA, 20 bp, human
gcgaggcaccgggacgtcgg

SEQ ID NO: 322724 - DNA, 20 bp, human
gggcacaggaaagtccaaaa

SEQ ID NO: 322725 - DNA, 20 bp, human
gggcgcgaggccgggaaacc

SEQ ID NO: 322726 - DNA, 20 bp, human
gcagactcttggcgggaggc

SEQ ID NO: 322727 - DNA, 20 bp, human
ggagcgggagaggacgtgga

SEQ ID NO: 322728 - DNA, 20 bp, human
gtacgagtgcgcgtgctcgg

SEQ ID NO: 322729 - DNA, 20 bp, human
gtgggagcccgcggagtacc

SEQ ID NO: 322730 - DNA, 20 bp, human
ggcgacagcagcggaggggt

SEQ ID NO: 322731 - DNA, 20 bp, human
gccgcggagtacctggaagg

SEQ ID NO: 322732 - DNA, 20 bp, human
gagcacgcgcactcgtacac

SEQ ID NO: 322733 - DNA, 20 bp, human
gccaccctgcaaaatggcgt

SEQ ID NO: 322734 - DNA, 20 bp, human
gggggagtgcgcgttacgac

SEQ ID NO: 322735 - DNA, 20 bp, human
gcgcttgcgcaggacggcta

SEQ ID NO: 322736 - DNA, 20 bp, human
ggcaatgagcccctgtccca

SEQ ID NO: 322737 - DNA, 20 bp, human
gagctggtcccaggctcagt

SEQ ID NO: 322738 - DNA, 20 bp, human
ggctggggatagggagccta

SEQ ID NO: 322739 - DNA, 20 bp, human
gggctcagtgggcagtgaag

SEQ ID NO: 322740 - DNA, 20 bp, human
ggagacacctcagataacca

SEQ ID NO: 322741 - DNA, 20 bp, human
gggtcagcctccctgtgaat

SEQ ID NO: 322742 - DNA, 20 bp, human
gtcctggccaattcacaggg

SEQ ID NO: 322743 - DNA, 20 bp, human
ggttatctgaggtgtctcca

SEQ ID NO: 322744 - DNA, 20 bp, human
gggggtgtgcgggagatccc

SEQ ID NO: 322745 - DNA, 20 bp, human
ggacaacccaggagaggctt

SEQ ID NO: 322746 - DNA, 20 bp, human
gaagctgcgggctccgggta

SEQ ID NO: 322747 - DNA, 20 bp, human
gtaaaggagacgcacagtcc

SEQ ID NO: 322748 - DNA, 20 bp, human
gggaactggccgagggtccc

SEQ ID NO: 322749 - DNA, 20 bp, human
gttaccctgggttggaagag

SEQ ID NO: 322750 - DNA, 20 bp, human
gcacagtcctggaaaagaaa

SEQ ID NO: 322751 - DNA, 20 bp, human
ggagaccccgcagccctacc

SEQ ID NO: 322752 - DNA, 20 bp, human
ggacacagagcgaggagctt

SEQ ID NO: 322753 - DNA, 20 bp, human
gcgggggcggagtttgaaga

SEQ ID NO: 322754 - DNA, 20 bp, human
gcggggccggaactggccga

SEQ ID NO: 322755 - DNA, 20 bp, human
ggcacaaagccggggaccct

SEQ ID NO: 322756 - DNA, 20 bp, human
gccttcgcccggggctggga

SEQ ID NO: 322757 - DNA, 20 bp, human
gccagcggggcaggcaactc

SEQ ID NO: 322758 - DNA, 20 bp, human
gcgcgctcacccttcgcccg

SEQ ID NO: 322759 - DNA, 20 bp, human
ggggcgctgcgggacggcag

SEQ ID NO: 322760 - DNA, 20 bp, human
ggagcgtgcacctacgcctc

SEQ ID NO: 322761 - DNA, 20 bp, human
gggaaagcagggtgcccagc

SEQ ID NO: 322762 - DNA, 20 bp, human
ggcgcctcccctagctagaa

SEQ ID NO: 322763 - DNA, 20 bp, human
gcgaacaggtggtgactgca

SEQ ID NO: 322764 - DNA, 20 bp, human
gggaaaggagcccgaggcgt

SEQ ID NO: 322765 - DNA, 20 bp, human
ggggacggcagtggctcttg

SEQ ID NO: 322766 - DNA, 20 bp, human
gcgggatgataactttaaaa

SEQ ID NO: 322767 - DNA, 20 bp, human
gtcactgcaagtgacagaat

SEQ ID NO: 322768 - DNA, 20 bp, human
gtacccgtgcggggaaacag

SEQ ID NO: 322769 - DNA, 20 bp, human
gtcgaggagaaagaatcctg

SEQ ID NO: 322770 - DNA, 20 bp, human
gcagaggtctgcccacgtgg

SEQ ID NO: 322771 - DNA, 20 bp, human
gcaagaggctcccacttcaa

SEQ ID NO: 322772 - DNA, 20 bp, human
gttaaagttatcatcccgca

SEQ ID NO: 322773 - DNA, 20 bp, human
gcatctggatccatttgtct

SEQ ID NO: 322774 - DNA, 20 bp, human
gggaaacagagggtgacgct

SEQ ID NO: 322775 - DNA, 20 bp, human
gcctccaaataagggtggag

SEQ ID NO: 322776 - DNA, 20 bp, human
gcctgcctgcgggtcctcgg

SEQ ID NO: 322777 - DNA, 20 bp, human
gtccgcgcctgcgacgtggg

SEQ ID NO: 322778 - DNA, 20 bp, human
gtctccacctcccacgtcgc

SEQ ID NO: 322779 - DNA, 20 bp, human
ggcgcggaggggctcattcc

SEQ ID NO: 322780 - DNA, 20 bp, human
gatctcagaggcccggaatg

SEQ ID NO: 322781 - DNA, 20 bp, human
gtatagaaatgggccgggtc

SEQ ID NO: 322782 - DNA, 20 bp, human
gggtggcggggtcttggccg

SEQ ID NO: 322783 - DNA, 20 bp, human
ggcaccacggacagcggcca

SEQ ID NO: 322784 - DNA, 20 bp, human
gttccagcaacggtggggtg

SEQ ID NO: 322785 - DNA, 20 bp, human
gctgccttttccagcaacgg

SEQ ID NO: 322786 - DNA, 20 bp, human
ggagccgcgggatccctccg

SEQ ID NO: 322787 - DNA, 20 bp, human
gccaccccggagggatcccg

SEQ ID NO: 322788 - DNA, 20 bp, human
gtccctccggggtgggataa

SEQ ID NO: 322789 - DNA, 20 bp, human
ggccgcgtgcgtggtgtcat

SEQ ID NO: 322790 - DNA, 20 bp, human
gagtgcgatgaggacctagt

SEQ ID NO: 322791 - DNA, 20 bp, human
gtaagggaggggagcccccg

SEQ ID NO: 322792 - DNA, 20 bp, human
gctcccttatcccaccccgg

SEQ ID NO: 322793 - DNA, 20 bp, human
gagggctacgtatcccttcc

SEQ ID NO: 322794 - DNA, 20 bp, human
gaggacctagtgggtgcaca

SEQ ID NO: 322795 - DNA, 20 bp, human
gtgcgtggtgtcattggccc

SEQ ID NO: 322796 - DNA, 20 bp, human
gaccggggaagatggtccac

SEQ ID NO: 322797 - DNA, 20 bp, human
gcgccccacgcctacctctt

SEQ ID NO: 322798 - DNA, 20 bp, human
gggaaaggacggctgaacgg

SEQ ID NO: 322799 - DNA, 20 bp, human
gcgccctcgccgggatggaa

SEQ ID NO: 322800 - DNA, 20 bp, human
gtcccccgaggagaccaggt

SEQ ID NO: 322801 - DNA, 20 bp, human
gggtccacggggaagcgcgc

SEQ ID NO: 322802 - DNA, 20 bp, human
gcccacgcctacctctttgg

SEQ ID NO: 322803 - DNA, 20 bp, human
gtcctgtcctccaaagaggt

SEQ ID NO: 322804 - DNA, 20 bp, human
gggcgagggcgcaccttcag

SEQ ID NO: 322805 - DNA, 20 bp, human
gtcctacctggtctcctcgg

SEQ ID NO: 322806 - DNA, 20 bp, human
gcggccgagtgcgactcccc

SEQ ID NO: 322807 - DNA, 20 bp, human
gcggccccaccctccggcgc

SEQ ID NO: 322808 - DNA, 20 bp, human
ggggccgaggcgacctgacc

SEQ ID NO: 322809 - DNA, 20 bp, human
gcgcgccgctcgtccgggtc

SEQ ID NO: 322810 - DNA, 20 bp, human
ggaggagaggcagcggggga

SEQ ID NO: 322811 - DNA, 20 bp, human
gcccaagtgctcaccggggt

SEQ ID NO: 322812 - DNA, 20 bp, human
ggtcccgagcgcccgggtgg

SEQ ID NO: 322813 - DNA, 20 bp, human
gtgcccgggggagtcgcact

SEQ ID NO: 322814 - DNA, 20 bp, human
ggcagccggcgccggagggt

SEQ ID NO: 322815 - DNA, 20 bp, human
gaggggagacccaagaagaa

SEQ ID NO: 322816 - DNA, 20 bp, human
gggcgcgatgggtagtgaag

SEQ ID NO: 322817 - DNA, 20 bp, human
gttgttgctcccaaaggcga

SEQ ID NO: 322818 - DNA, 20 bp, human
ggactcccgcgatgctcctc

SEQ ID NO: 322819 - DNA, 20 bp, human
gcctgcggggagtggtggtt

SEQ ID NO: 322820 - DNA, 20 bp, human
ggcggcggggcgggtcaaaa

SEQ ID NO: 322821 - DNA, 20 bp, human
gttagggacaggggcgcgat

SEQ ID NO: 322822 - DNA, 20 bp, human
gtgggtagtgaaggggtgca

SEQ ID NO: 322823 - DNA, 20 bp, human
gccgcgtcggtgcttcagga

SEQ ID NO: 322824 - DNA, 20 bp, human
ggggcgggtcaaaatggaac

SEQ ID NO: 322825 - DNA, 20 bp, human
gcaaacctgcgtggcccagg

SEQ ID NO: 322826 - DNA, 20 bp, human
ggtcgcacccggaagtaaag

SEQ ID NO: 322827 - DNA, 20 bp, human
gaagtaaagcggctccgtga

SEQ ID NO: 322828 - DNA, 20 bp, human
ggctcgtcccaggaagtcct

SEQ ID NO: 322829 - DNA, 20 bp, human
gtggggaggcggtgcgctaa

SEQ ID NO: 322830 - DNA, 20 bp, human
gccgcagcgcagatctgatg

SEQ ID NO: 322831 - DNA, 20 bp, human
gcggctccgtgacggagcgg

SEQ ID NO: 322832 - DNA, 20 bp, human
gaagcggctccgtgacggag

SEQ ID NO: 322833 - DNA, 20 bp, human
gcctgcgcagcgcgactcag

SEQ ID NO: 322834 - DNA, 20 bp, human
ggctggcccgccttccaggt

SEQ ID NO: 322835 - DNA, 20 bp, human
gcagaggcgtggctggggcg

SEQ ID NO: 322836 - DNA, 20 bp, human
gacagcaccgcggaactcgg

SEQ ID NO: 322837 - DNA, 20 bp, human
ggaactcggtggcttccaga

SEQ ID NO: 322838 - DNA, 20 bp, human
gtggaagccaccgagttccg

SEQ ID NO: 322839 - DNA, 20 bp, human
gggaggaggtgctaaggcgg

SEQ ID NO: 322840 - DNA, 20 bp, human
gagcccggagcgtggcacgt

SEQ ID NO: 322841 - DNA, 20 bp, human
gcgcaggcagcggaatgcgc

SEQ ID NO: 322842 - DNA, 20 bp, human
gtccggaggaggtgctaagg

SEQ ID NO: 322843 - DNA, 20 bp, human
ggccccaaacgcgaaccgta

SEQ ID NO: 322844 - DNA, 20 bp, human
ggccgtacggttcgcgtttg

SEQ ID NO: 322845 - DNA, 20 bp, human
gacggctccagacagcaccg

SEQ ID NO: 322846 - DNA, 20 bp, human
gaacaattagtcatatagga

SEQ ID NO: 322847 - DNA, 20 bp, human
gggtggccagaggtctcaaa

SEQ ID NO: 322848 - DNA, 20 bp, human
gtgaatcattgtggcatggg

SEQ ID NO: 322849 - DNA, 20 bp, human
gtgactaattgttctgtctg

SEQ ID NO: 322850 - DNA, 20 bp, human
gacagaacaattagtcatat

SEQ ID NO: 322851 - DNA, 20 bp, human
gagaaaaggacataacatat

SEQ ID NO: 322852 - DNA, 20 bp, human
gttgtggcatgggtggccag

SEQ ID NO: 322853 - DNA, 20 bp, human
gtcttcttaacaagaacaaa

SEQ ID NO: 322854 - DNA, 20 bp, human
ggattcagtctcgaagacaa

SEQ ID NO: 322855 - DNA, 20 bp, human
gttttgaaggacattcttaa

SEQ ID NO: 322856 - DNA, 20 bp, human
gcagaagtgggggtccaccg

SEQ ID NO: 322857 - DNA, 20 bp, human
gggggtccaccgtggaagta

SEQ ID NO: 322858 - DNA, 20 bp, human
ggggccccaccccaagagca

SEQ ID NO: 322859 - DNA, 20 bp, human
gccaccttgctcttggggtg

SEQ ID NO: 322860 - DNA, 20 bp, human
gcagaacaggggtctcatcc

SEQ ID NO: 322861 - DNA, 20 bp, human
gctccccatagccatcgaca

SEQ ID NO: 322862 - DNA, 20 bp, human
gatccagggagccatgtcga

SEQ ID NO: 322863 - DNA, 20 bp, human
ggagctccaccttgctcttg

SEQ ID NO: 322864 - DNA, 20 bp, human
ggagcacatgacacagtaga

SEQ ID NO: 322865 - DNA, 20 bp, human
gtggtcctaggtagaagctg

SEQ ID NO: 322866 - DNA, 20 bp, human
gcaaggatcgcgagaagagg

SEQ ID NO: 322867 - DNA, 20 bp, human
ggcggggccaccgagtccgc

SEQ ID NO: 322868 - DNA, 20 bp, human
gcgagaagaggcggctccga

SEQ ID NO: 322869 - DNA, 20 bp, human
gggcgcctctggccatgtga

SEQ ID NO: 322870 - DNA, 20 bp, human
ggattggcctagcgcgaggt

SEQ ID NO: 322871 - DNA, 20 bp, human
gcacgtgccgagggcgcctc

SEQ ID NO: 322872 - DNA, 20 bp, human
gcgaggtaggtcacgtgccg

SEQ ID NO: 322873 - DNA, 20 bp, human
gcgggactccgctagctctc

SEQ ID NO: 322874 - DNA, 20 bp, human
gagaccttcgctccgggtcg

SEQ ID NO: 322875 - DNA, 20 bp, human
gggggcgggcgagtgcgcga

SEQ ID NO: 322876 - DNA, 20 bp, human
ggcagctcccagaagggcgg

SEQ ID NO: 322877 - DNA, 20 bp, human
ggagccgccgacgtcagcgg

SEQ ID NO: 322878 - DNA, 20 bp, human
gaaggctccgagagctcagg

SEQ ID NO: 322879 - DNA, 20 bp, human
gccgcctggagccccgtcgg

SEQ ID NO: 322880 - DNA, 20 bp, human
gtctcacgagcgcgccaccg

SEQ ID NO: 322881 - DNA, 20 bp, human
ggggccgcggacaattaaag

SEQ ID NO: 322882 - DNA, 20 bp, human
gctcgagccgccgacgtcag

SEQ ID NO: 322883 - DNA, 20 bp, human
gacgcgagcggaggcagccc

SEQ ID NO: 322884 - DNA, 20 bp, human
ggagccccgtcggaggttcg

SEQ ID NO: 322885 - DNA, 20 bp, human
gccggccccggactcgagga

SEQ ID NO: 322886 - DNA, 20 bp, human
gcgggtgcgcgtcacgcagt

SEQ ID NO: 322887 - DNA, 20 bp, human
gccgaggacgcgggcgtcac

SEQ ID NO: 322888 - DNA, 20 bp, human
ggacctcgcgctctcgcctc

SEQ ID NO: 322889 - DNA, 20 bp, human
gcgcccctcgaacccacccg

SEQ ID NO: 322890 - DNA, 20 bp, human
ggacgcccgcgtcctcgggt

SEQ ID NO: 322891 - DNA, 20 bp, human
gcgccctttcttaagctgag

SEQ ID NO: 322892 - DNA, 20 bp, human
gcgtcctcgggtgggttcga

SEQ ID NO: 322893 - DNA, 20 bp, human
gacgcgggcgtcacaggctg

SEQ ID NO: 322894 - DNA, 20 bp, human
gcgcccctcagcttaagaaa

SEQ ID NO: 322895 - DNA, 20 bp, human
ggcgctctcgcctcaggctc

SEQ ID NO: 322896 - DNA, 20 bp, human
ggggatgcggcgaggagcga

SEQ ID NO: 322897 - DNA, 20 bp, human
gcgggcgcccggcactgaac

SEQ ID NO: 322898 - DNA, 20 bp, human
gggcccctgcgctgtgaccg

SEQ ID NO: 322899 - DNA, 20 bp, human
gaagaaagctccctcccggg

SEQ ID NO: 322900 - DNA, 20 bp, human
gcgcggcgagataaggtccc

SEQ ID NO: 322901 - DNA, 20 bp, human
gagggggcccgagcacggga

SEQ ID NO: 322902 - DNA, 20 bp, human
gcggcccggggaagcgagtg

SEQ ID NO: 322903 - DNA, 20 bp, human
gcgcaggggccggcgacccg

SEQ ID NO: 322904 - DNA, 20 bp, human
gctgtgaccgcggcgagata

SEQ ID NO: 322905 - DNA, 20 bp, human
gcggggaagcgagtggggcg

SEQ ID NO: 322906 - DNA, 20 bp, human
gaatgtgaataattcattct

SEQ ID NO: 322907 - DNA, 20 bp, human
gcaactaaaatatgcatgta

SEQ ID NO: 322908 - DNA, 20 bp, human
gtagaagctcttttataatg

SEQ ID NO: 322909 - DNA, 20 bp, human
gtgtgtcaattcttgaggga

SEQ ID NO: 322910 - DNA, 20 bp, human
gtataaaagagcttctaatt

SEQ ID NO: 322911 - DNA, 20 bp, human
gatgaagcattctgtctgtt

SEQ ID NO: 322912 - DNA, 20 bp, human
gctaattaggtaagtttggg

SEQ ID NO: 322913 - DNA, 20 bp, human
ggtgtttgtgtcaattcttg

SEQ ID NO: 322914 - DNA, 20 bp, human
gaaaaaaaacatagctagca

SEQ ID NO: 322915 - DNA, 20 bp, human
ggcttctaattaggtaagtt

SEQ ID NO: 322916 - DNA, 20 bp, human
ggagcccagcggtactgagg

SEQ ID NO: 322917 - DNA, 20 bp, human
gggctcgaggctcctctgag

SEQ ID NO: 322918 - DNA, 20 bp, human
ggccagcggcccactcagtg

SEQ ID NO: 322919 - DNA, 20 bp, human
ggggaaccctggcagctggc

SEQ ID NO: 322920 - DNA, 20 bp, human
gccaccgagcggttatagct

SEQ ID NO: 322921 - DNA, 20 bp, human
gaccgctgggctccccagat

SEQ ID NO: 322922 - DNA, 20 bp, human
gcacccagaggggtcttgaa

SEQ ID NO: 322923 - DNA, 20 bp, human
gcttgagcacctcactgagt

SEQ ID NO: 322924 - DNA, 20 bp, human
gcttctgcggggagatgggt

SEQ ID NO: 322925 - DNA, 20 bp, human
ggtactgggaacactgatga

SEQ ID NO: 322926 - DNA, 20 bp, human
gccgcacgagtgtcgactta

SEQ ID NO: 322927 - DNA, 20 bp, human
gtgcctggggcgggagggtt

SEQ ID NO: 322928 - DNA, 20 bp, human
gactcaggggcgggaagtgg

SEQ ID NO: 322929 - DNA, 20 bp, human
ggcctcgggcagtcacgctt

SEQ ID NO: 322930 - DNA, 20 bp, human
gccctccccccgccactcag

SEQ ID NO: 322931 - DNA, 20 bp, human
ggggatcgggcactgcccga

SEQ ID NO: 322932 - DNA, 20 bp, human
gacttcccgcccctgagtgg

SEQ ID NO: 322933 - DNA, 20 bp, human
gagggcagatacttgggctt

SEQ ID NO: 322934 - DNA, 20 bp, human
gtcccgcccctgagtggcgg

SEQ ID NO: 322935 - DNA, 20 bp, human
gtctctggcaggactagacg

SEQ ID NO: 322936 - DNA, 20 bp, human
gcagaggggcaggtcccgac

SEQ ID NO: 322937 - DNA, 20 bp, human
gcacctcggggtgacgactg

SEQ ID NO: 322938 - DNA, 20 bp, human
ggggttctctctgcgggact

SEQ ID NO: 322939 - DNA, 20 bp, human
gtgggacgagagcggattgg

SEQ ID NO: 322940 - DNA, 20 bp, human
gtgcgggactgggacgagag

SEQ ID NO: 322941 - DNA, 20 bp, human
gcgcggcgagagtgcaaggt

SEQ ID NO: 322942 - DNA, 20 bp, human
ggctccgggcgccgtccggt

SEQ ID NO: 322943 - DNA, 20 bp, human
gacggcgcccggagcccgca

SEQ ID NO: 322944 - DNA, 20 bp, human
gggggcaggtcccgaccgga

SEQ ID NO: 322945 - DNA, 20 bp, human
gactcctgggttctctctgc

SEQ ID NO: 322946 - DNA, 20 bp, human
gaaggcagggcagtttcccg

SEQ ID NO: 322947 - DNA, 20 bp, human
gcccacagtcctcgactccg

SEQ ID NO: 322948 - DNA, 20 bp, human
ggacctcccgcgcaggggaa

SEQ ID NO: 322949 - DNA, 20 bp, human
gttgtggccgaagtcatacc

SEQ ID NO: 322950 - DNA, 20 bp, human
ggggacgccgtcacgtgatc

SEQ ID NO: 322951 - DNA, 20 bp, human
gcctaggcaatgcttccccg

SEQ ID NO: 322952 - DNA, 20 bp, human
gctcgactccggggaaggca

SEQ ID NO: 322953 - DNA, 20 bp, human
gctccagccgggtatgactt

SEQ ID NO: 322954 - DNA, 20 bp, human
ggtcgaggactgtggggatt

SEQ ID NO: 322955 - DNA, 20 bp, human
gtatgacttcggccacaaga

SEQ ID NO: 322956 - DNA, 20 bp, human
gcagctctcgcggaactggg

SEQ ID NO: 322957 - DNA, 20 bp, human
ggcccagagtatcaaacttg

SEQ ID NO: 322958 - DNA, 20 bp, human
gcagaggggcgccccctcgc

SEQ ID NO: 322959 - DNA, 20 bp, human
gttcgccgggccagctctcg

SEQ ID NO: 322960 - DNA, 20 bp, human
ggggccagctctcgcggaac

SEQ ID NO: 322961 - DNA, 20 bp, human
gaagggagagattcgtggaa

SEQ ID NO: 322962 - DNA, 20 bp, human
ggagcaaagggagagattcg

SEQ ID NO: 322963 - DNA, 20 bp, human
gtggtggctggggacccgcg

SEQ ID NO: 322964 - DNA, 20 bp, human
ggggagcaggaacagtgtcc

SEQ ID NO: 322965 - DNA, 20 bp, human
gccggcgaagacagacctcc

SEQ ID NO: 322966 - DNA, 20 bp, human
gtccagcctgcctgtatcca

SEQ ID NO: 322967 - DNA, 20 bp, human
ggaccccagcactcgccctg

SEQ ID NO: 322968 - DNA, 20 bp, human
ggggcgtgagagacacacgc

SEQ ID NO: 322969 - DNA, 20 bp, human
gcagggctgcagttccgggc

SEQ ID NO: 322970 - DNA, 20 bp, human
gggcgagtgctggggtcccg

SEQ ID NO: 322971 - DNA, 20 bp, human
gctgcctgtatccagggttg

SEQ ID NO: 322972 - DNA, 20 bp, human
gcaccagagctggacaagac

SEQ ID NO: 322973 - DNA, 20 bp, human
ggcggctggagcgctctcgt

SEQ ID NO: 322974 - DNA, 20 bp, human
ggccttgggggctcaagatg

SEQ ID NO: 322975 - DNA, 20 bp, human
ggccgcatcttgagccccca

SEQ ID NO: 322976 - DNA, 20 bp, human
ggtgaagggacgacatcccg

SEQ ID NO: 322977 - DNA, 20 bp, human
gagcgcccaaacagcggcgt

SEQ ID NO: 322978 - DNA, 20 bp, human
gcaaacagcggcgtaggtct

SEQ ID NO: 322979 - DNA, 20 bp, human
gcggcccccggctttggaag

SEQ ID NO: 322980 - DNA, 20 bp, human
gcagcctcttccaaagccgg

SEQ ID NO: 322981 - DNA, 20 bp, human
gacgacatcccggggccctg

SEQ ID NO: 322982 - DNA, 20 bp, human
gggagaggcaacagcgtctg

SEQ ID NO: 322983 - DNA, 20 bp, human
gccgaccaagttaacttgat

SEQ ID NO: 322984 - DNA, 20 bp, human
gccgctgtttgggcgctcta

SEQ ID NO: 322985 - DNA, 20 bp, human
gcgctctagggagaagccac

SEQ ID NO: 322986 - DNA, 20 bp, human
gggacccaacgcctgaatcc

SEQ ID NO: 322987 - DNA, 20 bp, human
gcacccgccggagcaactgg

SEQ ID NO: 322988 - DNA, 20 bp, human
ggctgggggaggggattgta

SEQ ID NO: 322989 - DNA, 20 bp, human
gaagtcaagaaaagtctctc

SEQ ID NO: 322990 - DNA, 20 bp, human
gttgctccggcgggtgagag

SEQ ID NO: 322991 - DNA, 20 bp, human
gatcctggggtgctgggcgg

SEQ ID NO: 322992 - DNA, 20 bp, human
gtggaaggctgagagtcctg

SEQ ID NO: 322993 - DNA, 20 bp, human
gcctctccactctcacccgc

SEQ ID NO: 322994 - DNA, 20 bp, human
gcaccccaggattcaggcgt

SEQ ID NO: 322995 - DNA, 20 bp, human
gcttccaccagttgctccgg

SEQ ID NO: 322996 - DNA, 20 bp, human
gttgcagtctgtaaaggagg

SEQ ID NO: 322997 - DNA, 20 bp, human
gtaaggggaaaatacatttc

SEQ ID NO: 322998 - DNA, 20 bp, human
ggagttgcagtctgtaaagg

SEQ ID NO: 322999 - DNA, 20 bp, human
gcagtctgtaaaggaggggg

SEQ ID NO: 323000 - DNA, 20 bp, human
gggggagttgcagtctgtaa

SEQ ID NO: 323001 - DNA, 20 bp, human
gtaaaagcactgaagattaa

SEQ ID NO: 323002 - DNA, 20 bp, human
gggcggctttgtttgacatt

SEQ ID NO: 323003 - DNA, 20 bp, human
gtagctgaaggtttgctggt

SEQ ID NO: 323004 - DNA, 20 bp, human
gcagcaaaccttcagctaca

SEQ ID NO: 323005 - DNA, 20 bp, human
gatgctctgcgtgacctgtc

SEQ ID NO: 323006 - DNA, 20 bp, human
ggggcctcgcccggcgatct

SEQ ID NO: 323007 - DNA, 20 bp, human
gccgaggcgaggtgtgggtg

SEQ ID NO: 323008 - DNA, 20 bp, human
gcgcccctgaggtccatctg

SEQ ID NO: 323009 - DNA, 20 bp, human
gtaggggccgaggcgaggtg

SEQ ID NO: 323010 - DNA, 20 bp, human
gaggcaccgcaccgccgggg

SEQ ID NO: 323011 - DNA, 20 bp, human
gtcgcccggcgatctgggac

SEQ ID NO: 323012 - DNA, 20 bp, human
gaggccccagatggacctca

SEQ ID NO: 323013 - DNA, 20 bp, human
ggggacgccgctgtggaggc

SEQ ID NO: 323014 - DNA, 20 bp, human
gcggcgatctgggactgggg

SEQ ID NO: 323015 - DNA, 20 bp, human
ggagcgaggcaccgcaccgc

SEQ ID NO: 323016 - DNA, 20 bp, human
gaggtcatgggcgaacacac

SEQ ID NO: 323017 - DNA, 20 bp, human
gggggcgcggtgctgcgctc

SEQ ID NO: 323018 - DNA, 20 bp, human
gtgttcgcccatgacctcgg

SEQ ID NO: 323019 - DNA, 20 bp, human
gagcgcccgaggcacggcca

SEQ ID NO: 323020 - DNA, 20 bp, human
ggaaaggggtaatgagagga

SEQ ID NO: 323021 - DNA, 20 bp, human
gcatgacctcggtggttcga

SEQ ID NO: 323022 - DNA, 20 bp, human
gcctgtctcaggaagaccgg

SEQ ID NO: 323023 - DNA, 20 bp, human
ggccgcctcggtctgggcaa

SEQ ID NO: 323024 - DNA, 20 bp, human
gcaaacgcgcgcggctcctg

SEQ ID NO: 323025 - DNA, 20 bp, human
gcagggaaaggggtaatgag

SEQ ID NO: 323026 - DNA, 20 bp, human
ggggcattgggaaccccacg

SEQ ID NO: 323027 - DNA, 20 bp, human
ggggcagctgagtgagcggc

SEQ ID NO: 323028 - DNA, 20 bp, human
gtaaggggcagctgagtgag

SEQ ID NO: 323029 - DNA, 20 bp, human
gcacttgagtcatctgataa

SEQ ID NO: 323030 - DNA, 20 bp, human
gcaatgaagtggccggtgca

SEQ ID NO: 323031 - DNA, 20 bp, human
gccggccacttcattgactg

SEQ ID NO: 323032 - DNA, 20 bp, human
gcagccagaagcaggctaca

SEQ ID NO: 323033 - DNA, 20 bp, human
gcttccctgtagcctgcttc

SEQ ID NO: 323034 - DNA, 20 bp, human
gaacatgacttctggagtca

SEQ ID NO: 323035 - DNA, 20 bp, human
gggtgatatcagtgccacgt

SEQ ID NO: 323036 - DNA, 20 bp, human
gagtccgcccactttgtcgg

SEQ ID NO: 323037 - DNA, 20 bp, human
gggggtgcgctgaagagtca

SEQ ID NO: 323038 - DNA, 20 bp, human
gtgtagtccaccgacaaagt

SEQ ID NO: 323039 - DNA, 20 bp, human
ggaaaggctcgggcaaaagg

SEQ ID NO: 323040 - DNA, 20 bp, human
gtgttggaaaagtgtgtcac

SEQ ID NO: 323041 - DNA, 20 bp, human
gcgtgcggcccgggaaccct

SEQ ID NO: 323042 - DNA, 20 bp, human
gtgccaggcagaaaggggaa

SEQ ID NO: 323043 - DNA, 20 bp, human
gtgcgcaacgacaagactgt

SEQ ID NO: 323044 - DNA, 20 bp, human
gccgcacgcggcactggagc

SEQ ID NO: 323045 - DNA, 20 bp, human
ggcgcaagagctcaacgtgc

SEQ ID NO: 323046 - DNA, 20 bp, human
gcagaggcgggaaaggcagc

SEQ ID NO: 323047 - DNA, 20 bp, human
gccgaaccagccggcccagc

SEQ ID NO: 323048 - DNA, 20 bp, human
gtagccggggagccgggaag

SEQ ID NO: 323049 - DNA, 20 bp, human
ggtggcttggcgccgagcaa

SEQ ID NO: 323050 - DNA, 20 bp, human
gcgagggcggctgacgggga

SEQ ID NO: 323051 - DNA, 20 bp, human
gaatatgcggcggagggaaa

SEQ ID NO: 323052 - DNA, 20 bp, human
ggcacggaggggaaaaacga

SEQ ID NO: 323053 - DNA, 20 bp, human
gcaggagaaaagggtagccg

SEQ ID NO: 323054 - DNA, 20 bp, human
ggcggcgagggcggctgacg

SEQ ID NO: 323055 - DNA, 20 bp, human
ggggaggaatatgcggcgga

SEQ ID NO: 323056 - DNA, 20 bp, human
ggatctacccggtaaacttc

SEQ ID NO: 323057 - DNA, 20 bp, human
gcgacaagcagctatagcta

SEQ ID NO: 323058 - DNA, 20 bp, human
gacggaagttggaaactcac

SEQ ID NO: 323059 - DNA, 20 bp, human
gaactcaccggaagtttacc

SEQ ID NO: 323060 - DNA, 20 bp, human
gtgctgccccgcacggaagt

SEQ ID NO: 323061 - DNA, 20 bp, human
ggtcacgtccggaagagggg

SEQ ID NO: 323062 - DNA, 20 bp, human
gaagtcccagtagatctacc

SEQ ID NO: 323063 - DNA, 20 bp, human
gctcccaagaagcgaggaaa

SEQ ID NO: 323064 - DNA, 20 bp, human
ggcggggttgccggaagaag

SEQ ID NO: 323065 - DNA, 20 bp, human
gcggacgtgacgcaagggcg

SEQ ID NO: 323066 - DNA, 20 bp, human
gaggggagagacatggaact

SEQ ID NO: 323067 - DNA, 20 bp, human
ggagagacatggaacttggc

SEQ ID NO: 323068 - DNA, 20 bp, human
gctgctaagagcgctgggta

SEQ ID NO: 323069 - DNA, 20 bp, human
gagaagctgccctgtgggcg

SEQ ID NO: 323070 - DNA, 20 bp, human
gtgaggggagggactgccga

SEQ ID NO: 323071 - DNA, 20 bp, human
gggtggagaagctgccctgt

SEQ ID NO: 323072 - DNA, 20 bp, human
gaggggagggaacacgattc

SEQ ID NO: 323073 - DNA, 20 bp, human
gcaagctggtagaaatccag

SEQ ID NO: 323074 - DNA, 20 bp, human
gggaacttggctggtctgca

SEQ ID NO: 323075 - DNA, 20 bp, human
gccacgaggtgcctatggag

SEQ ID NO: 323076 - DNA, 20 bp, human
gaagcggtccggctggagcc

SEQ ID NO: 323077 - DNA, 20 bp, human
gtgatggcgggcaagcggtc

SEQ ID NO: 323078 - DNA, 20 bp, human
gggaacagctggtttaggag

SEQ ID NO: 323079 - DNA, 20 bp, human
ggaggtcgaggatctcggga

SEQ ID NO: 323080 - DNA, 20 bp, human
ggtaacgaagcgcagactcc

SEQ ID NO: 323081 - DNA, 20 bp, human
gcacccgtaaggacacacgc

SEQ ID NO: 323082 - DNA, 20 bp, human
gtggtggaggtcgaggatct

SEQ ID NO: 323083 - DNA, 20 bp, human
gcaaacaagctggaacccgc

SEQ ID NO: 323084 - DNA, 20 bp, human
ggcatagattacaacggtga

SEQ ID NO: 323085 - DNA, 20 bp, human
ggaagcgcagactccgggcc

SEQ ID NO: 323086 - DNA, 20 bp, human
gtctcctctggccgttttgt

SEQ ID NO: 323087 - DNA, 20 bp, human
ggagcccacaaaacggccag

SEQ ID NO: 323088 - DNA, 20 bp, human
ggaatctcgaggctctccca

SEQ ID NO: 323089 - DNA, 20 bp, human
gctttcaaaggcaagctgca

SEQ ID NO: 323090 - DNA, 20 bp, human
gaccgcaaagccccagaatg

SEQ ID NO: 323091 - DNA, 20 bp, human
gtacagaaatacgggtgccc

SEQ ID NO: 323092 - DNA, 20 bp, human
gatgctgctgctagcccaga

SEQ ID NO: 323093 - DNA, 20 bp, human
gagaagttgtagtgagagag

SEQ ID NO: 323094 - DNA, 20 bp, human
gtgtcacattcctcattctg

SEQ ID NO: 323095 - DNA, 20 bp, human
ggggctttgcggttttgtct

SEQ ID NO: 323096 - DNA, 20 bp, human
gctggacttgggacttagga

SEQ ID NO: 323097 - DNA, 20 bp, human
ggtcagatgtaggcactaag

SEQ ID NO: 323098 - DNA, 20 bp, human
gcaacaaaggaggaagtata

SEQ ID NO: 323099 - DNA, 20 bp, human
ggaggtggtttcaacaaagg

SEQ ID NO: 323100 - DNA, 20 bp, human
gagggaggtggtttcaacaa

SEQ ID NO: 323101 - DNA, 20 bp, human
gggaaagggtgtgagatgag

SEQ ID NO: 323102 - DNA, 20 bp, human
gacagaaggctgaccaggag

SEQ ID NO: 323103 - DNA, 20 bp, human
gtctctgtcctttaccacta

SEQ ID NO: 323104 - DNA, 20 bp, human
ggggaggatggaccagctga

SEQ ID NO: 323105 - DNA, 20 bp, human
gcaagtaacactatccaggg

SEQ ID NO: 323106 - DNA, 20 bp, human
gacacggggagggactccag

SEQ ID NO: 323107 - DNA, 20 bp, human
gggttggtggcacacgggga

SEQ ID NO: 323108 - DNA, 20 bp, human
gttccctgttgatgagttta

SEQ ID NO: 323109 - DNA, 20 bp, human
gtgggaaccttgtgactcat

SEQ ID NO: 323110 - DNA, 20 bp, human
gctcagtgactgtggggtta

SEQ ID NO: 323111 - DNA, 20 bp, human
gtcacaaggttcccacccac

SEQ ID NO: 323112 - DNA, 20 bp, human
ggaccctggactcagggcaa

SEQ ID NO: 323113 - DNA, 20 bp, human
gcagcttccaatgagtcaca

SEQ ID NO: 323114 - DNA, 20 bp, human
ggtgctggttggtggcacac

SEQ ID NO: 323115 - DNA, 20 bp, human
gcagagatcctgaacaagct

SEQ ID NO: 323116 - DNA, 20 bp, human
ggtggggtggagggatcgga

SEQ ID NO: 323117 - DNA, 20 bp, human
gggaacgcgtagctctggcg

SEQ ID NO: 323118 - DNA, 20 bp, human
gtgagtccactgcccccttt

SEQ ID NO: 323119 - DNA, 20 bp, human
gaggaggtcgtgacgttccc

SEQ ID NO: 323120 - DNA, 20 bp, human
gcattagcaacggggagaag

SEQ ID NO: 323121 - DNA, 20 bp, human
gtcgtgacgttcccagggtg

SEQ ID NO: 323122 - DNA, 20 bp, human
gagcgcctgcgcattagcaa

SEQ ID NO: 323123 - DNA, 20 bp, human
gcgccgccgagccgagaaag

SEQ ID NO: 323124 - DNA, 20 bp, human
gctctgcctccaagccaaaa

SEQ ID NO: 323125 - DNA, 20 bp, human
ggactcacagagccgctgct

SEQ ID NO: 323126 - DNA, 20 bp, human
gtcggggcctagaggctgaa

SEQ ID NO: 323127 - DNA, 20 bp, human
ggggcgggcgagaacgcgat

SEQ ID NO: 323128 - DNA, 20 bp, human
gctcggtccatccggcccgt

SEQ ID NO: 323129 - DNA, 20 bp, human
gctgccgccggccttggccg

SEQ ID NO: 323130 - DNA, 20 bp, human
gagccggcgctcggtccatc

SEQ ID NO: 323131 - DNA, 20 bp, human
gggccggatggaccgagcgc

SEQ ID NO: 323132 - DNA, 20 bp, human
gttaaatggcgcaggcgtcg

SEQ ID NO: 323133 - DNA, 20 bp, human
gggccgggcgggcggatatg

SEQ ID NO: 323134 - DNA, 20 bp, human
gccacagcccacgggccgga

SEQ ID NO: 323135 - DNA, 20 bp, human
gcgcaggcgtcggggcctag

SEQ ID NO: 323136 - DNA, 20 bp, human
gcgcggacgctccagaggtg

SEQ ID NO: 323137 - DNA, 20 bp, human
gttgggacccggaaccgcgt

SEQ ID NO: 323138 - DNA, 20 bp, human
gagaagcgagcatgaagggg

SEQ ID NO: 323139 - DNA, 20 bp, human
gccgaccgcggacgctccag

SEQ ID NO: 323140 - DNA, 20 bp, human
gcgcacggggcgctgtccct

SEQ ID NO: 323141 - DNA, 20 bp, human
gttaagaagcgagcatgaag

SEQ ID NO: 323142 - DNA, 20 bp, human
gtcgaaccaaaccccacctc

SEQ ID NO: 323143 - DNA, 20 bp, human
gctacaccttcgggcgccga

SEQ ID NO: 323144 - DNA, 20 bp, human
gctcgcttcttaaagggccc

SEQ ID NO: 323145 - DNA, 20 bp, human
gcgcatgcgtgttgtaattc

SEQ ID NO: 323146 - DNA, 20 bp, human
gagccgcggggaggggaata

SEQ ID NO: 323147 - DNA, 20 bp, human
gcgtgatggtgaggacggtg

SEQ ID NO: 323148 - DNA, 20 bp, human
ggaggggaatagggcgtccc

SEQ ID NO: 323149 - DNA, 20 bp, human
gtggctctgtgcgtgcgtga

SEQ ID NO: 323150 - DNA, 20 bp, human
gcggctcccaaagaaaatgc

SEQ ID NO: 323151 - DNA, 20 bp, human
gacgtcagccatgtgcgggg

SEQ ID NO: 323152 - DNA, 20 bp, human
gctgacgtcagccatgtgcg

SEQ ID NO: 323153 - DNA, 20 bp, human
gatattaatgaacctccaag

SEQ ID NO: 323154 - DNA, 20 bp, human
gcagaccccgccaggagttg

SEQ ID NO: 323155 - DNA, 20 bp, human
gctgacaggcagccgcgggg

SEQ ID NO: 323156 - DNA, 20 bp, human
gcacacctgcagcattacca

SEQ ID NO: 323157 - DNA, 20 bp, human
ggcagcccgggaaccagcat

SEQ ID NO: 323158 - DNA, 20 bp, human
ggagggccccgggggacctt

SEQ ID NO: 323159 - DNA, 20 bp, human
gaccggctcccggggcacct

SEQ ID NO: 323160 - DNA, 20 bp, human
ggtggccagttgatcccctg

SEQ ID NO: 323161 - DNA, 20 bp, human
gcaggactgaccggctcccg

SEQ ID NO: 323162 - DNA, 20 bp, human
gcagtcctgctaccccatgc

SEQ ID NO: 323163 - DNA, 20 bp, human
gcctgtgctgtgaggggctt

SEQ ID NO: 323164 - DNA, 20 bp, human
gggcaccttggtaatgctgc

SEQ ID NO: 323165 - DNA, 20 bp, human
gttcaagatgtggcatgaaa

SEQ ID NO: 323166 - DNA, 20 bp, human
gggtcagagccctgaatcgg

SEQ ID NO: 323167 - DNA, 20 bp, human
gaatcggggggagagaaaat

SEQ ID NO: 323168 - DNA, 20 bp, human
gggaggggctctccaaccaa

SEQ ID NO: 323169 - DNA, 20 bp, human
gccaaccaatggcgtgcagg

SEQ ID NO: 323170 - DNA, 20 bp, human
gtttctctccccccgattca

SEQ ID NO: 323171 - DNA, 20 bp, human
gcaatggcgtgcaggaggct

SEQ ID NO: 323172 - DNA, 20 bp, human
gactggtcagagccctgaat

SEQ ID NO: 323173 - DNA, 20 bp, human
gcagtctgtaggtagctaag

SEQ ID NO: 323174 - DNA, 20 bp, human
gccacaccatcccagtctgt

SEQ ID NO: 323175 - DNA, 20 bp, human
ggagagaaaatgggaggcta

SEQ ID NO: 323176 - DNA, 20 bp, human
gagcccggtcctagcgcgag

SEQ ID NO: 323177 - DNA, 20 bp, human
gcgccgctcgcgctaggacc

SEQ ID NO: 323178 - DNA, 20 bp, human
ggtccggccaatgacggcga

SEQ ID NO: 323179 - DNA, 20 bp, human
gccccctcgccgtcattggc

SEQ ID NO: 323180 - DNA, 20 bp, human
ggccgccccctcgccgtcat

SEQ ID NO: 323181 - DNA, 20 bp, human
gataaggcagcagccggggt

SEQ ID NO: 323182 - DNA, 20 bp, human
gtaggaccgggctgcgcccg

SEQ ID NO: 323183 - DNA, 20 bp, human
gggggcggaaacctcgggtg

SEQ ID NO: 323184 - DNA, 20 bp, human
gctagcgcgagcggcgtcgc

SEQ ID NO: 323185 - DNA, 20 bp, human
ggccgtcattggccggactg

SEQ ID NO: 323186 - DNA, 20 bp, human
gtaaggcccgagctgggcga

SEQ ID NO: 323187 - DNA, 20 bp, human
ggccgcccttataagggcat

SEQ ID NO: 323188 - DNA, 20 bp, human
gaggggttaaggcccgagct

SEQ ID NO: 323189 - DNA, 20 bp, human
gaggaagcaaacacaatcta

SEQ ID NO: 323190 - DNA, 20 bp, human
gcgcgcggcgccgggcgaac

SEQ ID NO: 323191 - DNA, 20 bp, human
gcgccgggcgaacgggccgg

SEQ ID NO: 323192 - DNA, 20 bp, human
ggcccttataagggcatggg

SEQ ID NO: 323193 - DNA, 20 bp, human
gataagggcggccgtcgccg

SEQ ID NO: 323194 - DNA, 20 bp, human
gggccacccatgcccttata

SEQ ID NO: 323195 - DNA, 20 bp, human
gcgcgcacgcgtgggaaagt

SEQ ID NO: 323196 - DNA, 20 bp, human
ggggcccgcgcggagggcgt

SEQ ID NO: 323197 - DNA, 20 bp, human
gggccgccgcgcggcccctc

SEQ ID NO: 323198 - DNA, 20 bp, human
gcggcctgacacgccctctg

SEQ ID NO: 323199 - DNA, 20 bp, human
ggcagagcgagctcccgagt

SEQ ID NO: 323200 - DNA, 20 bp, human
gtgacgcttggcaactgcag

SEQ ID NO: 323201 - DNA, 20 bp, human
gccaatgtgctcacactcga

SEQ ID NO: 323202 - DNA, 20 bp, human
gcccctcagtccaaggggaa

SEQ ID NO: 323203 - DNA, 20 bp, human
ggggtcctatgaacgtgata

SEQ ID NO: 323204 - DNA, 20 bp, human
ggcaactgcaggggcgcccg

SEQ ID NO: 323205 - DNA, 20 bp, human
gccgccgcctcgcagactcg

SEQ ID NO: 323206 - DNA, 20 bp, human
ggaagcccgcctgacccgtg

SEQ ID NO: 323207 - DNA, 20 bp, human
gagggcgggcgaaagcccgg

SEQ ID NO: 323208 - DNA, 20 bp, human
gaggaagggttcaggggggc

SEQ ID NO: 323209 - DNA, 20 bp, human
gcgaaagcccggagggggag

SEQ ID NO: 323210 - DNA, 20 bp, human
ggctccacgccgcacgggtc

SEQ ID NO: 323211 - DNA, 20 bp, human
gggtcaggcgggcttcttat

SEQ ID NO: 323212 - DNA, 20 bp, human
gggccaataggaagggttca

SEQ ID NO: 323213 - DNA, 20 bp, human
ggggccagggcgggcaaaaa

SEQ ID NO: 323214 - DNA, 20 bp, human
gctcttcgggccaataggaa

SEQ ID NO: 323215 - DNA, 20 bp, human
gcacgccgcacgggtcaggc

SEQ ID NO: 323216 - DNA, 20 bp, human
gtccagaataaccagcggga

SEQ ID NO: 323217 - DNA, 20 bp, human
ggcggggttccattgacgca

SEQ ID NO: 323218 - DNA, 20 bp, human
gttccggcgggaggcggcca

SEQ ID NO: 323219 - DNA, 20 bp, human
gtccgcgctccctgcgtcaa

SEQ ID NO: 323220 - DNA, 20 bp, human
gtccggtgcggggagcctag

SEQ ID NO: 323221 - DNA, 20 bp, human
gaaggggcgctgtagagacg

SEQ ID NO: 323222 - DNA, 20 bp, human
gcgccccccgcgcccttgta

SEQ ID NO: 323223 - DNA, 20 bp, human
ggggggcggtgcggttccgg

SEQ ID NO: 323224 - DNA, 20 bp, human
gtggccatacaagggcgcgg

SEQ ID NO: 323225 - DNA, 20 bp, human
gtcacgcgcgcagacattcc

SEQ ID NO: 323226 - DNA, 20 bp, human
ggcagggccgattttaaggt

SEQ ID NO: 323227 - DNA, 20 bp, human
gcgacctgacgtcacgagca

SEQ ID NO: 323228 - DNA, 20 bp, human
gtcctggcccgcgctcgctt

SEQ ID NO: 323229 - DNA, 20 bp, human
gcagcgcggcgattgggcgg

SEQ ID NO: 323230 - DNA, 20 bp, human
ggcggttcccaccttaaaat

SEQ ID NO: 323231 - DNA, 20 bp, human
gcggccgctcacatgtgggg

SEQ ID NO: 323232 - DNA, 20 bp, human
gaaccgctctgcgttcacct

SEQ ID NO: 323233 - DNA, 20 bp, human
ggagcgcgggccaggagtcc

SEQ ID NO: 323234 - DNA, 20 bp, human
gacgagcagggccgatttta

SEQ ID NO: 323235 - DNA, 20 bp, human
gtaccaaggtgaacgcagag

SEQ ID NO: 323236 - DNA, 20 bp, human
ggcctccgccccagcgtcac

SEQ ID NO: 323237 - DNA, 20 bp, human
gtccagtgacgctggggcgg

SEQ ID NO: 323238 - DNA, 20 bp, human
gcggctttccagtgacgctg

SEQ ID NO: 323239 - DNA, 20 bp, human
ggctggggcggaggcgcggt

SEQ ID NO: 323240 - DNA, 20 bp, human
gccgcggccaagcgcgtcag

SEQ ID NO: 323241 - DNA, 20 bp, human
gaaaaaggagctcgacgcga

SEQ ID NO: 323242 - DNA, 20 bp, human
gaaccgcgctccccgcaggg

SEQ ID NO: 323243 - DNA, 20 bp, human
gacctgccgccgggcggctc

SEQ ID NO: 323244 - DNA, 20 bp, human
ggaaagccgcccgagccgcc

SEQ ID NO: 323245 - DNA, 20 bp, human
ggagcccggcccggctgacg

SEQ ID NO: 323246 - DNA, 20 bp, human
gtatgccacaggagccctag

SEQ ID NO: 323247 - DNA, 20 bp, human
gtcgcattccaggcactcta

SEQ ID NO: 323248 - DNA, 20 bp, human
gtccctcgcacacgcggaac

SEQ ID NO: 323249 - DNA, 20 bp, human
gagggcgtgcgtctgcggga

SEQ ID NO: 323250 - DNA, 20 bp, human
ggacgtcaatgtgacgccat

SEQ ID NO: 323251 - DNA, 20 bp, human
gggcctctccatagagtgcc

SEQ ID NO: 323252 - DNA, 20 bp, human
ggaggccgctagggctcctg

SEQ ID NO: 323253 - DNA, 20 bp, human
gctctatggagaggccgcta

SEQ ID NO: 323254 - DNA, 20 bp, human
gcgcacacgcggaaccggct

SEQ ID NO: 323255 - DNA, 20 bp, human
gagggtgacgtagcgtccca

SEQ ID NO: 323256 - DNA, 20 bp, human
gagagaaacaccaacaaaga

SEQ ID NO: 323257 - DNA, 20 bp, human
gggcctgcagagtcacgtgg

SEQ ID NO: 323258 - DNA, 20 bp, human
gtgcccccacgtgactctgc

SEQ ID NO: 323259 - DNA, 20 bp, human
gaatacccctatctatctgg

SEQ ID NO: 323260 - DNA, 20 bp, human
ggggccaccggaggcccaat

SEQ ID NO: 323261 - DNA, 20 bp, human
gagtgggcaccaggggtcca

SEQ ID NO: 323262 - DNA, 20 bp, human
gtccggtggcccccccacca

SEQ ID NO: 323263 - DNA, 20 bp, human
gaaaccccctcacaccacgg

SEQ ID NO: 323264 - DNA, 20 bp, human
gggaccccacagaggcgggt

SEQ ID NO: 323265 - DNA, 20 bp, human
gtcctccccgccctggtggg

SEQ ID NO: 323266 - DNA, 20 bp, human
gtgctatgcagcacagagag

SEQ ID NO: 323267 - DNA, 20 bp, human
gtggaaagttgtaaaactga

SEQ ID NO: 323268 - DNA, 20 bp, human
gtcatcacatgactctatgc

SEQ ID NO: 323269 - DNA, 20 bp, human
gaaagaggtgatgacatcaa

SEQ ID NO: 323270 - DNA, 20 bp, human
gcaaaccagctaactaactt

SEQ ID NO: 323271 - DNA, 20 bp, human
gctctatgcaggttgataag

SEQ ID NO: 323272 - DNA, 20 bp, human
ggattaactcagaagtggag

SEQ ID NO: 323273 - DNA, 20 bp, human
ggaaatgattaactcagaag

SEQ ID NO: 323274 - DNA, 20 bp, human
ggtcagaagatcagacttag

SEQ ID NO: 323275 - DNA, 20 bp, human
gaagaattcttgccagataa

SEQ ID NO: 323276 - DNA, 20 bp, human
gaggaggtcagggttaaaaa

SEQ ID NO: 323277 - DNA, 20 bp, human
gggagctgcgagaccggaca

SEQ ID NO: 323278 - DNA, 20 bp, human
gaagctgcgaggaggaggtc

SEQ ID NO: 323279 - DNA, 20 bp, human
gaggtcagggttaaaaaagg

SEQ ID NO: 323280 - DNA, 20 bp, human
gcttgcggagccgaaccaga

SEQ ID NO: 323281 - DNA, 20 bp, human
ggccgccgcctgcgcccttg

SEQ ID NO: 323282 - DNA, 20 bp, human
gcggagccgaaccagagggc

SEQ ID NO: 323283 - DNA, 20 bp, human
gaggaggcggaggcacgctc

SEQ ID NO: 323284 - DNA, 20 bp, human
ggagccgcccccaagctgcg

SEQ ID NO: 323285 - DNA, 20 bp, human
gacgctccggcgaggcgaga

SEQ ID NO: 323286 - DNA, 20 bp, human
gccgaccgcaccaactgaag

SEQ ID NO: 323287 - DNA, 20 bp, human
ggcagcggcgtgtgacgtca

SEQ ID NO: 323288 - DNA, 20 bp, human
gggcgtgtgacgtcagggga

SEQ ID NO: 323289 - DNA, 20 bp, human
gctgccgcgcaaggccctgc

SEQ ID NO: 323290 - DNA, 20 bp, human
gcaccaactgaaggggtgga

SEQ ID NO: 323291 - DNA, 20 bp, human
gacaatgagtctttgcgagg

SEQ ID NO: 323292 - DNA, 20 bp, human
gtgccccgcagggccttgcg

SEQ ID NO: 323293 - DNA, 20 bp, human
ggggcttgaaggtactcacg

SEQ ID NO: 323294 - DNA, 20 bp, human
ggggggttacgaggactctt

SEQ ID NO: 323295 - DNA, 20 bp, human
gggataagaagtcctgagaa

SEQ ID NO: 323296 - DNA, 20 bp, human
gcaaaccctggtgtatgatc

SEQ ID NO: 323297 - DNA, 20 bp, human
gacccaagaaaagaacctaa

SEQ ID NO: 323298 - DNA, 20 bp, human
gaaagctgccacttactcaa

SEQ ID NO: 323299 - DNA, 20 bp, human
gtatgtggataaccaaaccc

SEQ ID NO: 323300 - DNA, 20 bp, human
gcacatgcgtgctgagtgag

SEQ ID NO: 323301 - DNA, 20 bp, human
gactcagcacgcatgtgtct

SEQ ID NO: 323302 - DNA, 20 bp, human
gcgcatgtgtctgggaaata

SEQ ID NO: 323303 - DNA, 20 bp, human
gggtgtatgatcaggcagca

SEQ ID NO: 323304 - DNA, 20 bp, human
gtgattgttggatgacggtg

SEQ ID NO: 323305 - DNA, 20 bp, human
gtcctatgactaaagcagaa

SEQ ID NO: 323306 - DNA, 20 bp, human
gaaactactccctggcttca

SEQ ID NO: 323307 - DNA, 20 bp, human
gaggcgggtgtgatcatcgc

SEQ ID NO: 323308 - DNA, 20 bp, human
ggtaaaagtgaatgtcttaa

SEQ ID NO: 323309 - DNA, 20 bp, human
ggcaaaagtcaacaggaagt

SEQ ID NO: 323310 - DNA, 20 bp, human
gttagtgagatgctctgcta

SEQ ID NO: 323311 - DNA, 20 bp, human
gggactatgaacaacaaaga

SEQ ID NO: 323312 - DNA, 20 bp, human
gagttggactcctcagaccc

SEQ ID NO: 323313 - DNA, 20 bp, human
gggtcatgttagggagaaag

SEQ ID NO: 323314 - DNA, 20 bp, human
gtctcagacataaaagtgcc

SEQ ID NO: 323315 - DNA, 20 bp, human
gatgagctatgacaggagat

SEQ ID NO: 323316 - DNA, 20 bp, human
gccgccggcgcgcgcgtcac

SEQ ID NO: 323317 - DNA, 20 bp, human
gtccctactcggttcggctg

SEQ ID NO: 323318 - DNA, 20 bp, human
gcggcggcgcgcttcgcggc

SEQ ID NO: 323319 - DNA, 20 bp, human
gcggagctggacccccccgg

SEQ ID NO: 323320 - DNA, 20 bp, human
gtgggcggtgccgtgcgcag

SEQ ID NO: 323321 - DNA, 20 bp, human
gcgccggcggccccgggatt

SEQ ID NO: 323322 - DNA, 20 bp, human
gagccgcagccgaaccgagt

SEQ ID NO: 323323 - DNA, 20 bp, human
gggcgggcgagctagtgctg

SEQ ID NO: 323324 - DNA, 20 bp, human
gaggccaggtggccgccggg

SEQ ID NO: 323325 - DNA, 20 bp, human
gttgggccgcgcccacatgg

SEQ ID NO: 323326 - DNA, 20 bp, human
gcggcctgccgcatgactcg

SEQ ID NO: 323327 - DNA, 20 bp, human
gtgaaacgtcccgtgtggga

SEQ ID NO: 323328 - DNA, 20 bp, human
gacgtcccgtgtgggagggg

SEQ ID NO: 323329 - DNA, 20 bp, human
gaaaacctcaaacgacaagg

SEQ ID NO: 323330 - DNA, 20 bp, human
ggtccccgccccggccacgt

SEQ ID NO: 323331 - DNA, 20 bp, human
gcgcatgactcgtggttcgg

SEQ ID NO: 323332 - DNA, 20 bp, human
gtggccagggaccctgtata

SEQ ID NO: 323333 - DNA, 20 bp, human
gtcggaggcccacgtggccg

SEQ ID NO: 323334 - DNA, 20 bp, human
gcggaagtgccgctccttgg

SEQ ID NO: 323335 - DNA, 20 bp, human
ggaaccacgagtcatgcggc

SEQ ID NO: 323336 - DNA, 20 bp, human
ggcgccgtgcgtggcctcgg

SEQ ID NO: 323337 - DNA, 20 bp, human
gcgcgcaaaaggctggttca

SEQ ID NO: 323338 - DNA, 20 bp, human
gccaccgccgaggccacgca

SEQ ID NO: 323339 - DNA, 20 bp, human
gctcgcaagcgtacatcagc

SEQ ID NO: 323340 - DNA, 20 bp, human
gggcctcggcggtggcgcag

SEQ ID NO: 323341 - DNA, 20 bp, human
gcgtcacacgcgcaaaaggc

SEQ ID NO: 323342 - DNA, 20 bp, human
gcgcctatcgctggctcttg

SEQ ID NO: 323343 - DNA, 20 bp, human
gtcgcgagaagcgttagttt

SEQ ID NO: 323344 - DNA, 20 bp, human
gtggacaggaccacaagtaa

SEQ ID NO: 323345 - DNA, 20 bp, human
gtctacactgaagtcacgtg

SEQ ID NO: 323346 - DNA, 20 bp, human
gaaacatcgacccctccgag

SEQ ID NO: 323347 - DNA, 20 bp, human
gccggccgagacctctcgga

SEQ ID NO: 323348 - DNA, 20 bp, human
gggccctcgggcgttcgctg

SEQ ID NO: 323349 - DNA, 20 bp, human
gcaccccagcgaacgcccga

SEQ ID NO: 323350 - DNA, 20 bp, human
gcggtccggccgagacctct

SEQ ID NO: 323351 - DNA, 20 bp, human
gcacccagaacgtcacccaa

SEQ ID NO: 323352 - DNA, 20 bp, human
gtcggccggaccggcgcaag

SEQ ID NO: 323353 - DNA, 20 bp, human
gtcctccccttgcgccggtc

SEQ ID NO: 323354 - DNA, 20 bp, human
gcgacccctccgagaggtct

SEQ ID NO: 323355 - DNA, 20 bp, human
gcgtccagcagaaccatctg

SEQ ID NO: 323356 - DNA, 20 bp, human
ggggcggggcttcgcgaagg

SEQ ID NO: 323357 - DNA, 20 bp, human
gctggggcggggcttcgcga

SEQ ID NO: 323358 - DNA, 20 bp, human
gggagcaggcctgggagacg

SEQ ID NO: 323359 - DNA, 20 bp, human
gacgaggaggaaacagggac

SEQ ID NO: 323360 - DNA, 20 bp, human
gacggggcggggattcgcgg

SEQ ID NO: 323361 - DNA, 20 bp, human
ggactggggcggggcttcgc

SEQ ID NO: 323362 - DNA, 20 bp, human
gcccgggctcggcagctctc

SEQ ID NO: 323363 - DNA, 20 bp, human
gcggctcgggaggtgcgcgc

SEQ ID NO: 323364 - DNA, 20 bp, human
gctggggtggggcttcgcgg

SEQ ID NO: 323365 - DNA, 20 bp, human
gcgggggcggggactaaaac

SEQ ID NO: 323366 - DNA, 20 bp, human
gaggacgcccgcagggagtg

SEQ ID NO: 323367 - DNA, 20 bp, human
gacgcccgcagggagtgcgg

SEQ ID NO: 323368 - DNA, 20 bp, human
gcaaaagcacggcgcgggga

SEQ ID NO: 323369 - DNA, 20 bp, human
gaggggcaaaagcacggcgc

SEQ ID NO: 323370 - DNA, 20 bp, human
gccagccgccggcgcctcga

SEQ ID NO: 323371 - DNA, 20 bp, human
gcagtccctcgaggcgccgg

SEQ ID NO: 323372 - DNA, 20 bp, human
ggggcggccgctcaggtgag

SEQ ID NO: 323373 - DNA, 20 bp, human
ggaggcggaggacgcccgca

SEQ ID NO: 323374 - DNA, 20 bp, human
gctgctgcgacggcagcgaa

SEQ ID NO: 323375 - DNA, 20 bp, human
gtcttgccctgctgctgcga

SEQ ID NO: 323376 - DNA, 20 bp, human
gaacatttcgaaacccaaag

SEQ ID NO: 323377 - DNA, 20 bp, human
ggtaagcaaccaatcagaac

SEQ ID NO: 323378 - DNA, 20 bp, human
ggagaggcaccaacgtgacc

SEQ ID NO: 323379 - DNA, 20 bp, human
ggagtggcgcggaggacgac

SEQ ID NO: 323380 - DNA, 20 bp, human
ggcggaggacgacgggagaa

SEQ ID NO: 323381 - DNA, 20 bp, human
gtgggtttcgaaatgttcgc

SEQ ID NO: 323382 - DNA, 20 bp, human
gagcggagagagtggcgcgg

SEQ ID NO: 323383 - DNA, 20 bp, human
gaaatcagtagcgtcatcgg

SEQ ID NO: 323384 - DNA, 20 bp, human
gtcgaaacccaaagtgggcg

SEQ ID NO: 323385 - DNA, 20 bp, human
ggaatcagtccgggtcacgt

SEQ ID NO: 323386 - DNA, 20 bp, human
gcagagaggagggtcgtcaa

SEQ ID NO: 323387 - DNA, 20 bp, human
gaggagtgacgggttcctag

SEQ ID NO: 323388 - DNA, 20 bp, human
gaggagggtcgtcaagggac

SEQ ID NO: 323389 - DNA, 20 bp, human
gcaagggactggggcgcggc

SEQ ID NO: 323390 - DNA, 20 bp, human
ggcttgaccccgaagcggga

SEQ ID NO: 323391 - DNA, 20 bp, human
gaactgcgaaaaccggagaa

SEQ ID NO: 323392 - DNA, 20 bp, human
gtcgtcaagggactggggcg

SEQ ID NO: 323393 - DNA, 20 bp, human
gctggggcttgaccccgaag

SEQ ID NO: 323394 - DNA, 20 bp, human
ggtgacgggttcctagtggt

SEQ ID NO: 323395 - DNA, 20 bp, human
gtcacagggtcccaaccact

SEQ ID NO: 323396 - DNA, 20 bp, human
gtgcgcgcgccgtgctcccg

SEQ ID NO: 323397 - DNA, 20 bp, human
ggcaccctagcgggagagag

SEQ ID NO: 323398 - DNA, 20 bp, human
gttgttcactagcaccctag

SEQ ID NO: 323399 - DNA, 20 bp, human
gtggagagagagcgcgaggc

SEQ ID NO: 323400 - DNA, 20 bp, human
gaggcggagaggctggccgg

SEQ ID NO: 323401 - DNA, 20 bp, human
gcttactcggcaggaatcgg

SEQ ID NO: 323402 - DNA, 20 bp, human
gtctgggccccgtcggcgag

SEQ ID NO: 323403 - DNA, 20 bp, human
gccgcgcggtgcagtgggga

SEQ ID NO: 323404 - DNA, 20 bp, human
gcagccttggaaaaaggagg

SEQ ID NO: 323405 - DNA, 20 bp, human
gtcctgccgagtaagcagtc

SEQ ID NO: 323406 - DNA, 20 bp, human
gcggagagggctcgcggcga

SEQ ID NO: 323407 - DNA, 20 bp, human
ggccgccatgatgaggaggt

SEQ ID NO: 323408 - DNA, 20 bp, human
gcgtgcacggagcgcttcag

SEQ ID NO: 323409 - DNA, 20 bp, human
gcatgatgaggaggtcggcg

SEQ ID NO: 323410 - DNA, 20 bp, human
gggtcccaattcccgcggta

SEQ ID NO: 323411 - DNA, 20 bp, human
gagcgcttcagaggtttgga

SEQ ID NO: 323412 - DNA, 20 bp, human
gagggcacgcacgcgacgca

SEQ ID NO: 323413 - DNA, 20 bp, human
gctccgtgcacgcgacgcgg

SEQ ID NO: 323414 - DNA, 20 bp, human
gtggttgctgatcagacgag

SEQ ID NO: 323415 - DNA, 20 bp, human
gctcctgccaccagcggcaa

SEQ ID NO: 323416 - DNA, 20 bp, human
gtgtccgcgcctcggggtgg

SEQ ID NO: 323417 - DNA, 20 bp, human
gaacccccgacaggggtcgc

SEQ ID NO: 323418 - DNA, 20 bp, human
ggaacccaggcggagacccg

SEQ ID NO: 323419 - DNA, 20 bp, human
ggtccagcgacccctgtcgg

SEQ ID NO: 323420 - DNA, 20 bp, human
gggccagcgcgggaggaaaa

SEQ ID NO: 323421 - DNA, 20 bp, human
gaggccaggggagggtgcga

SEQ ID NO: 323422 - DNA, 20 bp, human
gctgccgggaacccccgaca

SEQ ID NO: 323423 - DNA, 20 bp, human
gccaggggagggtgcgaagg

SEQ ID NO: 323424 - DNA, 20 bp, human
gacgccaccgggaggagcct

SEQ ID NO: 323425 - DNA, 20 bp, human
gacacccccaccccgaggcg

SEQ ID NO: 323426 - DNA, 20 bp, human
gctggccatggcaacctctc

SEQ ID NO: 323427 - DNA, 20 bp, human
ggggagcgcggcttctgcag

SEQ ID NO: 323428 - DNA, 20 bp, human
gtctgcccccggaccgagta

SEQ ID NO: 323429 - DNA, 20 bp, human
gacagtgggggtggtgcgtg

SEQ ID NO: 323430 - DNA, 20 bp, human
ggattcctcccgcgcccctg

SEQ ID NO: 323431 - DNA, 20 bp, human
ggatttatcggcatgacagt

SEQ ID NO: 323432 - DNA, 20 bp, human
gggccagcctctcgcctctt

SEQ ID NO: 323433 - DNA, 20 bp, human
gtgtcatgccgataaatccc

SEQ ID NO: 323434 - DNA, 20 bp, human
gcttcagcccgcaggggcgc

SEQ ID NO: 323435 - DNA, 20 bp, human
gagggcgtgccccctgcctt

SEQ ID NO: 323436 - DNA, 20 bp, human
gtggccgccgcgatcttcgg

SEQ ID NO: 323437 - DNA, 20 bp, human
gcggtaaggagctcggaaga

SEQ ID NO: 323438 - DNA, 20 bp, human
gggcccccggcgcctccggt

SEQ ID NO: 323439 - DNA, 20 bp, human
gagggccgcggcagaggcat

SEQ ID NO: 323440 - DNA, 20 bp, human
ggcgcaggaggcggcttgga

SEQ ID NO: 323441 - DNA, 20 bp, human
gaaggtgaagaccggctcct

SEQ ID NO: 323442 - DNA, 20 bp, human
gctcggaagaggggcgagac

SEQ ID NO: 323443 - DNA, 20 bp, human
gctcctggagcgcacgcagg

SEQ ID NO: 323444 - DNA, 20 bp, human
gcctccggtcggtcagagag

SEQ ID NO: 323445 - DNA, 20 bp, human
gcggccgccggggccactga

SEQ ID NO: 323446 - DNA, 20 bp, human
gaacacgtaaattgaagggg

SEQ ID NO: 323447 - DNA, 20 bp, human
gcagaccaaggtgtgcacag

SEQ ID NO: 323448 - DNA, 20 bp, human
ggtgcacagaggtcaggcac

SEQ ID NO: 323449 - DNA, 20 bp, human
gtcaagacgtagtgtaagtt

SEQ ID NO: 323450 - DNA, 20 bp, human
ggagtctaaggaatgtggtt

SEQ ID NO: 323451 - DNA, 20 bp, human
gaagataagtaaggagtcta

SEQ ID NO: 323452 - DNA, 20 bp, human
gctgaacacgtaaattgaag

SEQ ID NO: 323453 - DNA, 20 bp, human
gacgtgttcagagttgcaaa

SEQ ID NO: 323454 - DNA, 20 bp, human
gggtttttacctttaaaacg

SEQ ID NO: 323455 - DNA, 20 bp, human
gattactgtccacgttttaa

SEQ ID NO: 323456 - DNA, 20 bp, human
gtacaagcgtgtaggcggag

SEQ ID NO: 323457 - DNA, 20 bp, human
gggagggccacgccctctcg

SEQ ID NO: 323458 - DNA, 20 bp, human
gggcgcagagagccgcgaga

SEQ ID NO: 323459 - DNA, 20 bp, human
gaagccaggggattgcgccc

SEQ ID NO: 323460 - DNA, 20 bp, human
ggagcagcctccggcagggt

SEQ ID NO: 323461 - DNA, 20 bp, human
gcctcccgggcgcaatcccc

SEQ ID NO: 323462 - DNA, 20 bp, human
gcgtgtaggcggaggggctg

SEQ ID NO: 323463 - DNA, 20 bp, human
gtccccgcccaccctgccgg

SEQ ID NO: 323464 - DNA, 20 bp, human
gctgccgcctagcaagccag

SEQ ID NO: 323465 - DNA, 20 bp, human
gaatcccctggcttgctagg

SEQ ID NO: 323466 - DNA, 20 bp, human
ggaagccgcgcggatccggg

SEQ ID NO: 323467 - DNA, 20 bp, human
gcgcgcggcttcctcctgac

SEQ ID NO: 323468 - DNA, 20 bp, human
gcctcctgaccgggtgacaa

SEQ ID NO: 323469 - DNA, 20 bp, human
gctgaagagctgaatggcgt

SEQ ID NO: 323470 - DNA, 20 bp, human
gctgaccgggtgacaatggg

SEQ ID NO: 323471 - DNA, 20 bp, human
ggggagggactgggccgcgg

SEQ ID NO: 323472 - DNA, 20 bp, human
gtgagccgcccggatccgcg

SEQ ID NO: 323473 - DNA, 20 bp, human
gagaaaagggttaagaaact

SEQ ID NO: 323474 - DNA, 20 bp, human
gcgcgcccgggccgtccccc

SEQ ID NO: 323475 - DNA, 20 bp, human
gaatggcgtggggcggcgag

SEQ ID NO: 323476 - DNA, 20 bp, human
gtcagagcgggcggtggatg

SEQ ID NO: 323477 - DNA, 20 bp, human
gcacgctgggaggtgcacta

SEQ ID NO: 323478 - DNA, 20 bp, human
gctcgcaaaccacctggcac

SEQ ID NO: 323479 - DNA, 20 bp, human
gctggggtcctggtcagagc

SEQ ID NO: 323480 - DNA, 20 bp, human
gggcgcgcaggccagtaact

SEQ ID NO: 323481 - DNA, 20 bp, human
gtcagggtgcccgtgccagg

SEQ ID NO: 323482 - DNA, 20 bp, human
gtcctggtcagagcgggcgg

SEQ ID NO: 323483 - DNA, 20 bp, human
gacctaacaaggtaaggcta

SEQ ID NO: 323484 - DNA, 20 bp, human
gaaacccagtcctagaagag

SEQ ID NO: 323485 - DNA, 20 bp, human
ggacagtgctgtaaactgtc

SEQ ID NO: 323486 - DNA, 20 bp, human
ggctcacccggtggcaaagc

SEQ ID NO: 323487 - DNA, 20 bp, human
gcggggcccccacgcaggag

SEQ ID NO: 323488 - DNA, 20 bp, human
gcgcgggacgcgggacgcga

SEQ ID NO: 323489 - DNA, 20 bp, human
ggggacgcgagggagccgcg

SEQ ID NO: 323490 - DNA, 20 bp, human
ggcgtcccctgctcacccgg

SEQ ID NO: 323491 - DNA, 20 bp, human
gatagccgagcgtgacgtcg

SEQ ID NO: 323492 - DNA, 20 bp, human
gccagcggcagagatggccg

SEQ ID NO: 323493 - DNA, 20 bp, human
gacagagtccacgccccgcg

SEQ ID NO: 323494 - DNA, 20 bp, human
gcacgccagtccaggggatg

SEQ ID NO: 323495 - DNA, 20 bp, human
gtttgccaccgggtgagcag

SEQ ID NO: 323496 - DNA, 20 bp, human
gaggtgctgaaggactataa

SEQ ID NO: 323497 - DNA, 20 bp, human
gacccgggagcagctcgaaa

SEQ ID NO: 323498 - DNA, 20 bp, human
gctggcgcagcagtggacgt

SEQ ID NO: 323499 - DNA, 20 bp, human
gtaggagggccaccggccga

SEQ ID NO: 323500 - DNA, 20 bp, human
ggagcgagaccggttttccg

SEQ ID NO: 323501 - DNA, 20 bp, human
gtgaaagaggcgcaccctga

SEQ ID NO: 323502 - DNA, 20 bp, human
gggggggcggtgcaaggaga

SEQ ID NO: 323503 - DNA, 20 bp, human
gggagcagctcgaaagggat

SEQ ID NO: 323504 - DNA, 20 bp, human
gcagcagtggacgtgggagg

SEQ ID NO: 323505 - DNA, 20 bp, human
gagcctgcctccccgccggg

SEQ ID NO: 323506 - DNA, 20 bp, human
gcatcagtgaggagctttgt

SEQ ID NO: 323507 - DNA, 20 bp, human
gagctctctgaggtcatctg

SEQ ID NO: 323508 - DNA, 20 bp, human
ggggagtcggatcatcagtg

SEQ ID NO: 323509 - DNA, 20 bp, human
gctgcagggccttggaaggt

SEQ ID NO: 323510 - DNA, 20 bp, human
gcaaaaggcccggtgagagt

SEQ ID NO: 323511 - DNA, 20 bp, human
gctgaggcctccaaccaata

SEQ ID NO: 323512 - DNA, 20 bp, human
gtatgcatggctagggctga

SEQ ID NO: 323513 - DNA, 20 bp, human
gcccaggctatgcatggcta

SEQ ID NO: 323514 - DNA, 20 bp, human
gtgcatatcttattggcctg

SEQ ID NO: 323515 - DNA, 20 bp, human
ggaggtcatctgtggtcctg

SEQ ID NO: 323516 - DNA, 20 bp, human
gcacccccggcgcaccacgt

SEQ ID NO: 323517 - DNA, 20 bp, human
gtgtaagggggcgctctgat

SEQ ID NO: 323518 - DNA, 20 bp, human
ggctgccggcctttgtaagg

SEQ ID NO: 323519 - DNA, 20 bp, human
gtgattggtcgataaggtgg

SEQ ID NO: 323520 - DNA, 20 bp, human
ggagtcctaaggcttctaat

SEQ ID NO: 323521 - DNA, 20 bp, human
ggcgaggaaggaggggtgtt

SEQ ID NO: 323522 - DNA, 20 bp, human
gcgcccacgtggtgcgccgg

SEQ ID NO: 323523 - DNA, 20 bp, human
gctctgattggtcgataagg

SEQ ID NO: 323524 - DNA, 20 bp, human
gagcgcccccttacaaaggc

SEQ ID NO: 323525 - DNA, 20 bp, human
gactgctgccggcctttgta

SEQ ID NO: 323526 - DNA, 20 bp, human
gcgtcctgggatgcgtgtcc

SEQ ID NO: 323527 - DNA, 20 bp, human
gccagctgtggatccgtcct

SEQ ID NO: 323528 - DNA, 20 bp, human
ggctctgcagccgctcacgt

SEQ ID NO: 323529 - DNA, 20 bp, human
gaggcgggccggaagcctgg

SEQ ID NO: 323530 - DNA, 20 bp, human
gacggatccacagctggatg

SEQ ID NO: 323531 - DNA, 20 bp, human
gaagcctggcggtggcgtgc

SEQ ID NO: 323532 - DNA, 20 bp, human
gctgtctctccgtcacagaa

SEQ ID NO: 323533 - DNA, 20 bp, human
gccccggctgaatccagccc

SEQ ID NO: 323534 - DNA, 20 bp, human
gaaggctgcgccaggcgggc

SEQ ID NO: 323535 - DNA, 20 bp, human
ggagattcaacccacgtgag

SEQ ID NO: 323536 - DNA, 20 bp, human
gacgagcaggcctgacgtgg

SEQ ID NO: 323537 - DNA, 20 bp, human
gcccacgagcaggcctgacg

SEQ ID NO: 323538 - DNA, 20 bp, human
gccgtgtcatcccccacgtc

SEQ ID NO: 323539 - DNA, 20 bp, human
gaggcctgctcgtgggcgtg

SEQ ID NO: 323540 - DNA, 20 bp, human
gcagcctcacgcccacgagc

SEQ ID NO: 323541 - DNA, 20 bp, human
gccttccccgccaggagctg

SEQ ID NO: 323542 - DNA, 20 bp, human
gcaggggtgaccgctagaat

SEQ ID NO: 323543 - DNA, 20 bp, human
gggttcactccattagaagg

SEQ ID NO: 323544 - DNA, 20 bp, human
ggcctccctgcgcagaacag

SEQ ID NO: 323545 - DNA, 20 bp, human
gctggggggcccccggaacg

SEQ ID NO: 323546 - DNA, 20 bp, human
gtgaactcggaggtttgaga

SEQ ID NO: 323547 - DNA, 20 bp, human
gttaacttcgacctccgctg

SEQ ID NO: 323548 - DNA, 20 bp, human
gcgttatagaggaagatgtg

SEQ ID NO: 323549 - DNA, 20 bp, human
gcgctgtaaggtgaactcgg

SEQ ID NO: 323550 - DNA, 20 bp, human
ggaacgggaagcactgggga

SEQ ID NO: 323551 - DNA, 20 bp, human
gtacgtatctgccccagcgg

SEQ ID NO: 323552 - DNA, 20 bp, human
gcggaggtcgaagttaacct

SEQ ID NO: 323553 - DNA, 20 bp, human
gaattgctgcaggaagagcg

SEQ ID NO: 323554 - DNA, 20 bp, human
ggtcttctccagcagcgcct

SEQ ID NO: 323555 - DNA, 20 bp, human
gaatccggaacgggaagcac

SEQ ID NO: 323556 - DNA, 20 bp, human
ggggctccgaacccagccgg

SEQ ID NO: 323557 - DNA, 20 bp, human
ggggagggacggtgattgga

SEQ ID NO: 323558 - DNA, 20 bp, human
ggtggggctccgaacccagc

SEQ ID NO: 323559 - DNA, 20 bp, human
gcggagggagggacggtgat

SEQ ID NO: 323560 - DNA, 20 bp, human
gccaacacccagatgggaaa

SEQ ID NO: 323561 - DNA, 20 bp, human
gtcagagagcagaaattcgc

SEQ ID NO: 323562 - DNA, 20 bp, human
gacggtgattggatgggagc

SEQ ID NO: 323563 - DNA, 20 bp, human
gccagatgggaaaaggagcg

SEQ ID NO: 323564 - DNA, 20 bp, human
gtgcccgtggagctctgtcg

SEQ ID NO: 323565 - DNA, 20 bp, human
gcagaaattcgcaggagcac

SEQ ID NO: 323566 - DNA, 20 bp, human
ggaggggcgggaggaagcga

SEQ ID NO: 323567 - DNA, 20 bp, human
gcgggtgtctgcgggaagga

SEQ ID NO: 323568 - DNA, 20 bp, human
gtgcctgacaggagactggg

SEQ ID NO: 323569 - DNA, 20 bp, human
ggggaggtccgggtgtctgc

SEQ ID NO: 323570 - DNA, 20 bp, human
gtggcgcccaggggaggtcc

SEQ ID NO: 323571 - DNA, 20 bp, human
gtccgcgggaaggaaggcgc

SEQ ID NO: 323572 - DNA, 20 bp, human
gttcccgcggagatccctgc

SEQ ID NO: 323573 - DNA, 20 bp, human
gctgcggcctccccccactc

SEQ ID NO: 323574 - DNA, 20 bp, human
ggggatctccgcgggaagga

SEQ ID NO: 323575 - DNA, 20 bp, human
gctgcccagctctccctcta

SEQ ID NO: 323576 - DNA, 20 bp, human
gccgcccgagctgggtgccg

SEQ ID NO: 323577 - DNA, 20 bp, human
gccgccggtgcgtaacgccc

SEQ ID NO: 323578 - DNA, 20 bp, human
gagtgccgcggcacccagct

SEQ ID NO: 323579 - DNA, 20 bp, human
gccctgagccggcgcgtaat

SEQ ID NO: 323580 - DNA, 20 bp, human
gtccccccggggtctccctt

SEQ ID NO: 323581 - DNA, 20 bp, human
gcatgtggatgtcagagccg

SEQ ID NO: 323582 - DNA, 20 bp, human
gcgcggctgcctctttaatc

SEQ ID NO: 323583 - DNA, 20 bp, human
gtctgcgccgcgcgtctccg

SEQ ID NO: 323584 - DNA, 20 bp, human
ggagctatccgattacgcgc

SEQ ID NO: 323585 - DNA, 20 bp, human
gtccccagggcgttacgcac

SEQ ID NO: 323586 - DNA, 20 bp, human
gtcagacccggcctcttaga

SEQ ID NO: 323587 - DNA, 20 bp, human
gctgctcggcgactcagcac

SEQ ID NO: 323588 - DNA, 20 bp, human
gtaggggccccttgcctatg

SEQ ID NO: 323589 - DNA, 20 bp, human
ggcggggcccgaacacctgc

SEQ ID NO: 323590 - DNA, 20 bp, human
gggagcctcggtcgcattgc

SEQ ID NO: 323591 - DNA, 20 bp, human
gcgccgcgcttccctctaag

SEQ ID NO: 323592 - DNA, 20 bp, human
gcgaacacctgccggcctag

SEQ ID NO: 323593 - DNA, 20 bp, human
gtaggcaaggggcccctagc

SEQ ID NO: 323594 - DNA, 20 bp, human
gcaccaacgcaagaaagccg

SEQ ID NO: 323595 - DNA, 20 bp, human
gggcctcttagagggaagcg

SEQ ID NO: 323596 - DNA, 20 bp, human
gcagctgtcagggccatgga

SEQ ID NO: 323597 - DNA, 20 bp, human
ggaggctggagcttctgtta

SEQ ID NO: 323598 - DNA, 20 bp, human
gtggaaccctgcccctttgg

SEQ ID NO: 323599 - DNA, 20 bp, human
gccgagctgtctggcgcgcc

SEQ ID NO: 323600 - DNA, 20 bp, human
gctgccgaggctccccagga

SEQ ID NO: 323601 - DNA, 20 bp, human
gcccagtgaccagccttcca

SEQ ID NO: 323602 - DNA, 20 bp, human
ggccatggaaggctggtcac

SEQ ID NO: 323603 - DNA, 20 bp, human
gtggtcactgggccctgccg

SEQ ID NO: 323604 - DNA, 20 bp, human
gcgccgcctccccctccaaa

SEQ ID NO: 323605 - DNA, 20 bp, human
gctcgccgctctcggaaagc

SEQ ID NO: 323606 - DNA, 20 bp, human
gcgagcagggaactctggaa

SEQ ID NO: 323607 - DNA, 20 bp, human
gtggggcccagggagtccga

SEQ ID NO: 323608 - DNA, 20 bp, human
gtaggagcccggagacagat

SEQ ID NO: 323609 - DNA, 20 bp, human
ggatgggtagggactcaaag

SEQ ID NO: 323610 - DNA, 20 bp, human
gtggggaactgcgggagtga

SEQ ID NO: 323611 - DNA, 20 bp, human
gagtgacggcagcttcggtg

SEQ ID NO: 323612 - DNA, 20 bp, human
gctcccttctcaaggtacaa

SEQ ID NO: 323613 - DNA, 20 bp, human
ggagaggaaggctcggttaa

SEQ ID NO: 323614 - DNA, 20 bp, human
gttaagggatgggtcttcca

SEQ ID NO: 323615 - DNA, 20 bp, human
gcccgtaccagggatgggta

SEQ ID NO: 323616 - DNA, 20 bp, human
gcagagaggggcagagtcaa

SEQ ID NO: 323617 - DNA, 20 bp, human
gagaggggcagagtcaatgg

SEQ ID NO: 323618 - DNA, 20 bp, human
gtggaggacaccagcatgta

SEQ ID NO: 323619 - DNA, 20 bp, human
gcgcggggagggtggtgttt

SEQ ID NO: 323620 - DNA, 20 bp, human
ggataagcaggcccagaagt

SEQ ID NO: 323621 - DNA, 20 bp, human
ggcagtgtgggacaaaggcg

SEQ ID NO: 323622 - DNA, 20 bp, human
gcctgcttatccatctggat

SEQ ID NO: 323623 - DNA, 20 bp, human
gaggagaggtcattcccggc

SEQ ID NO: 323624 - DNA, 20 bp, human
ggtgggacaaaggcgcgggg

SEQ ID NO: 323625 - DNA, 20 bp, human
gagaggtcattcccggcagg

SEQ ID NO: 323626 - DNA, 20 bp, human
gaggggagaacaggcaacgg

SEQ ID NO: 323627 - DNA, 20 bp, human
gacgggcccgccgctctcca

SEQ ID NO: 323628 - DNA, 20 bp, human
ggatcaggctccccctgcaa

SEQ ID NO: 323629 - DNA, 20 bp, human
ggagcggcgggcccgtcctt

SEQ ID NO: 323630 - DNA, 20 bp, human
gtccgcagtaccatggagag

SEQ ID NO: 323631 - DNA, 20 bp, human
gcacgtaacccagccttctc

SEQ ID NO: 323632 - DNA, 20 bp, human
gcattccccagccaaaggac

SEQ ID NO: 323633 - DNA, 20 bp, human
ggtcgcagcccctccaggtc

SEQ ID NO: 323634 - DNA, 20 bp, human
gaggctgggttacgtgacgc

SEQ ID NO: 323635 - DNA, 20 bp, human
gggcgggcccgtcctttggc

SEQ ID NO: 323636 - DNA, 20 bp, human
gggcgcccgagaacctcgag

SEQ ID NO: 323637 - DNA, 20 bp, human
gagcagcgcagccaatgcaa

SEQ ID NO: 323638 - DNA, 20 bp, human
gacgcctgggtcccgcgcga

SEQ ID NO: 323639 - DNA, 20 bp, human
gctctcgcggcgtcccaagt

SEQ ID NO: 323640 - DNA, 20 bp, human
ggatgctccgcgagtcaggg

SEQ ID NO: 323641 - DNA, 20 bp, human
gtccctgcaacaccgactga

SEQ ID NO: 323642 - DNA, 20 bp, human
gtgtggagccgctggactgg

SEQ ID NO: 323643 - DNA, 20 bp, human
gccagcctctcgaggttctc

SEQ ID NO: 323644 - DNA, 20 bp, human
ggagcagccgccctgactcg

SEQ ID NO: 323645 - DNA, 20 bp, human
ggcgaggggcgagagtgctt

SEQ ID NO: 323646 - DNA, 20 bp, human
gggtcccgaggcaagagacg

SEQ ID NO: 323647 - DNA, 20 bp, human
gagaggccctgacctgcaga

SEQ ID NO: 323648 - DNA, 20 bp, human
gaggaaaggtccaacgagag

SEQ ID NO: 323649 - DNA, 20 bp, human
gtctcctaagtgctggcccc

SEQ ID NO: 323650 - DNA, 20 bp, human
gaatccgcgtctcttgcctc

SEQ ID NO: 323651 - DNA, 20 bp, human
gcgggaccctctgcaggtca

SEQ ID NO: 323652 - DNA, 20 bp, human
gcaagagacgcggattccgg

SEQ ID NO: 323653 - DNA, 20 bp, human
gttgcctcgggaccctctgc

SEQ ID NO: 323654 - DNA, 20 bp, human
ggctccccacgcatatcagc

SEQ ID NO: 323655 - DNA, 20 bp, human
ggacactggggtcctttgag

SEQ ID NO: 323656 - DNA, 20 bp, human
ggagacctgtgggctcttaa

SEQ ID NO: 323657 - DNA, 20 bp, human
gttgctgtagggagtgcctt

SEQ ID NO: 323658 - DNA, 20 bp, human
gtgctggatggcaattttct

SEQ ID NO: 323659 - DNA, 20 bp, human
ggccctaaattgcatcataa

SEQ ID NO: 323660 - DNA, 20 bp, human
ggtggtaatagactagctgg

SEQ ID NO: 323661 - DNA, 20 bp, human
gggcccttatgatgcaattt

SEQ ID NO: 323662 - DNA, 20 bp, human
gatggcagaacccagaatat

SEQ ID NO: 323663 - DNA, 20 bp, human
gtctgggtcaattgtgccca

SEQ ID NO: 323664 - DNA, 20 bp, human
gttaagaagcagagtatgtt

SEQ ID NO: 323665 - DNA, 20 bp, human
ggaagtttgttgatctcttg

SEQ ID NO: 323666 - DNA, 20 bp, human
gctgctctgggaaataccag

SEQ ID NO: 323667 - DNA, 20 bp, human
gaccgagggcggtgttagga

SEQ ID NO: 323668 - DNA, 20 bp, human
gcaaataaatcccctgggag

SEQ ID NO: 323669 - DNA, 20 bp, human
gctcgcattctgggaatctt

SEQ ID NO: 323670 - DNA, 20 bp, human
gtggggccccttcttcctat

SEQ ID NO: 323671 - DNA, 20 bp, human
gtaaccgtgggattgggtga

SEQ ID NO: 323672 - DNA, 20 bp, human
gccgggccccagatgtgtgc

SEQ ID NO: 323673 - DNA, 20 bp, human
ggcaaaatcacgaacaccga

SEQ ID NO: 323674 - DNA, 20 bp, human
gtggctgattcatagtttca

SEQ ID NO: 323675 - DNA, 20 bp, human
ggaacaccgagggcggtgtt

SEQ ID NO: 323676 - DNA, 20 bp, human
gcacacctccacacttccgg

SEQ ID NO: 323677 - DNA, 20 bp, human
gcatttggccggtacaccgc

SEQ ID NO: 323678 - DNA, 20 bp, human
ggctgcccgaggcggtagag

SEQ ID NO: 323679 - DNA, 20 bp, human
gagctaaaagcggaaaacag

SEQ ID NO: 323680 - DNA, 20 bp, human
gagccacacctccacacttc

SEQ ID NO: 323681 - DNA, 20 bp, human
gaagagcaagaaccacgcag

SEQ ID NO: 323682 - DNA, 20 bp, human
gggtacccagcgctgtgaca

SEQ ID NO: 323683 - DNA, 20 bp, human
gaacaccgaggggagtccgg

SEQ ID NO: 323684 - DNA, 20 bp, human
gctggcaggcggcatttggc

SEQ ID NO: 323685 - DNA, 20 bp, human
gctaggaggacggaagttgc

SEQ ID NO: 323686 - DNA, 20 bp, human
ggaacgcgcgcgctcggtgg

SEQ ID NO: 323687 - DNA, 20 bp, human
ggttcagggcgggtgaagtc

SEQ ID NO: 323688 - DNA, 20 bp, human
gaccccgaagagtgagagaa

SEQ ID NO: 323689 - DNA, 20 bp, human
gcgcgcgctcggtgggggaa

SEQ ID NO: 323690 - DNA, 20 bp, human
gcgggccggcccgtaggccc

SEQ ID NO: 323691 - DNA, 20 bp, human
ggagagcgccgcccaatcag

SEQ ID NO: 323692 - DNA, 20 bp, human
gcctcgcgccggcccgcgtg

SEQ ID NO: 323693 - DNA, 20 bp, human
gcgctcgcggccggggccta

SEQ ID NO: 323694 - DNA, 20 bp, human
ggtgccccgaggtaggtgag

SEQ ID NO: 323695 - DNA, 20 bp, human
ggcctgaggcgggctcccca

SEQ ID NO: 323696 - DNA, 20 bp, human
ggccctgcaccaatagggag

SEQ ID NO: 323697 - DNA, 20 bp, human
gcgtcgccgcctctccctat

SEQ ID NO: 323698 - DNA, 20 bp, human
gacagagccccgtctttatt

SEQ ID NO: 323699 - DNA, 20 bp, human
gtgatcttgcccaataaaga

SEQ ID NO: 323700 - DNA, 20 bp, human
gtattggtgcagggccgaag

SEQ ID NO: 323701 - DNA, 20 bp, human
ggcgcgcggggcggtgggaa

SEQ ID NO: 323702 - DNA, 20 bp, human
gtcacgcgggaggggagtaa

SEQ ID NO: 323703 - DNA, 20 bp, human
ggaagagggtgggactaacc

SEQ ID NO: 323704 - DNA, 20 bp, human
ggacgagcggacggccaatg

SEQ ID NO: 323705 - DNA, 20 bp, human
gaggcggcgtggccgagctg

SEQ ID NO: 323706 - DNA, 20 bp, human
gcctcggagctgatcttttt

SEQ ID NO: 323707 - DNA, 20 bp, human
gcggagctgatcttttttgg

SEQ ID NO: 323708 - DNA, 20 bp, human
ggaactcagaaccaactcct

SEQ ID NO: 323709 - DNA, 20 bp, human
gttgctggaattgtcatcgt

SEQ ID NO: 323710 - DNA, 20 bp, human
gaagatcagctccgaggagt

SEQ ID NO: 323711 - DNA, 20 bp, human
ggatgacaattccagcaact

SEQ ID NO: 323712 - DNA, 20 bp, human
gtacttgttttcctagttgc

SEQ ID NO: 323713 - DNA, 20 bp, human
gagaaaagtgagaaaattca

SEQ ID NO: 323714 - DNA, 20 bp, human
gtgaaaatactgagttttcc

SEQ ID NO: 323715 - DNA, 20 bp, human
gttttctcacttttctttgt

SEQ ID NO: 323716 - DNA, 20 bp, human
gaaccgcagcctaacggcgg

SEQ ID NO: 323717 - DNA, 20 bp, human
gtgggagcccgaaggatgag

SEQ ID NO: 323718 - DNA, 20 bp, human
ggggtcttacatacacctgt

SEQ ID NO: 323719 - DNA, 20 bp, human
ggcggggcttcccgcacgga

SEQ ID NO: 323720 - DNA, 20 bp, human
gagcggcggggcttcccgca

SEQ ID NO: 323721 - DNA, 20 bp, human
ggcgaaccgcagcctaacgg

SEQ ID NO: 323722 - DNA, 20 bp, human
gtcgcgccgcggtcgccaga

SEQ ID NO: 323723 - DNA, 20 bp, human
gtcacgcaaagccctccgtg

SEQ ID NO: 323724 - DNA, 20 bp, human
gcgacgaggcccagccgatg

SEQ ID NO: 323725 - DNA, 20 bp, human
ggcccgaaggatgagaggcg

SEQ ID NO: 323726 - DNA, 20 bp, human
gagtgccgcggggaagtccc

SEQ ID NO: 323727 - DNA, 20 bp, human
ggcacccgcggcaagttccc

SEQ ID NO: 323728 - DNA, 20 bp, human
gcgcggggaagtccccggaa

SEQ ID NO: 323729 - DNA, 20 bp, human
gagaccctggctggagagtt

SEQ ID NO: 323730 - DNA, 20 bp, human
gttccccgcggcactacgga

SEQ ID NO: 323731 - DNA, 20 bp, human
ggccgccgcccgagcatcct

SEQ ID NO: 323732 - DNA, 20 bp, human
gagggctagccgtctttgac

SEQ ID NO: 323733 - DNA, 20 bp, human
gcggaccctccgtagtgccg

SEQ ID NO: 323734 - DNA, 20 bp, human
gtgcggggatcggtgcctcc

SEQ ID NO: 323735 - DNA, 20 bp, human
gtgcccggacgcggagagaa

SEQ ID NO: 323736 - DNA, 20 bp, human
gcaatgcgagcggctggcgt

SEQ ID NO: 323737 - DNA, 20 bp, human
gtctgctggccggtctaaag

SEQ ID NO: 323738 - DNA, 20 bp, human
gcgagcggctggcgtaggct

SEQ ID NO: 323739 - DNA, 20 bp, human
gacgcggtcaaagtccgggg

SEQ ID NO: 323740 - DNA, 20 bp, human
gcatacgcggtcaaagtccg

SEQ ID NO: 323741 - DNA, 20 bp, human
gcgccggggcgcaatgcgag

SEQ ID NO: 323742 - DNA, 20 bp, human
gagccgctcgcattgcgccc

SEQ ID NO: 323743 - DNA, 20 bp, human
gggtctgggcgggggatatg

SEQ ID NO: 323744 - DNA, 20 bp, human
gcggctccggctctgctggc

SEQ ID NO: 323745 - DNA, 20 bp, human
gcggaaaagcgggttcacac

SEQ ID NO: 323746 - DNA, 20 bp, human
gtggccctggcgatcctctg

SEQ ID NO: 323747 - DNA, 20 bp, human
gccgcctcagaggatcgcca

SEQ ID NO: 323748 - DNA, 20 bp, human
gaggggcgcgcggtgacacg

SEQ ID NO: 323749 - DNA, 20 bp, human
gcaaactcaggccgcctcag

SEQ ID NO: 323750 - DNA, 20 bp, human
gcctcgcgtggggactccgg

SEQ ID NO: 323751 - DNA, 20 bp, human
gagtgtgtgaggtcggatcc

SEQ ID NO: 323752 - DNA, 20 bp, human
gcatcctcgcgtggggactc

SEQ ID NO: 323753 - DNA, 20 bp, human
gtccggcggcaccgtgactc

SEQ ID NO: 323754 - DNA, 20 bp, human
gcaccgcagcatcctcgcgt

SEQ ID NO: 323755 - DNA, 20 bp, human
gcccctgcggcgccgctggg

SEQ ID NO: 323756 - DNA, 20 bp, human
gagtgcgtcactcaacggac

SEQ ID NO: 323757 - DNA, 20 bp, human
gtgggatctaacccacgagg

SEQ ID NO: 323758 - DNA, 20 bp, human
gaacgcggcgttcccattgg

SEQ ID NO: 323759 - DNA, 20 bp, human
ggatccttaataatgggaag

SEQ ID NO: 323760 - DNA, 20 bp, human
gaagaattggcgtgcagcct

SEQ ID NO: 323761 - DNA, 20 bp, human
gaagccccttcccattatta

SEQ ID NO: 323762 - DNA, 20 bp, human
gggacgggcgaataagccgc

SEQ ID NO: 323763 - DNA, 20 bp, human
gcgttcccattggtggcctg

SEQ ID NO: 323764 - DNA, 20 bp, human
ggctctcgatccttaataat

SEQ ID NO: 323765 - DNA, 20 bp, human
gtaagccgcaggccaccaat

SEQ ID NO: 323766 - DNA, 20 bp, human
gtgaccgcctggggagtcag

SEQ ID NO: 323767 - DNA, 20 bp, human
ggagtcaggggcggaagtcg

SEQ ID NO: 323768 - DNA, 20 bp, human
gaggaccgccgccttgaggg

SEQ ID NO: 323769 - DNA, 20 bp, human
gtctgacccgctccaggtcc

SEQ ID NO: 323770 - DNA, 20 bp, human
gcgcagtcccggacctggag

SEQ ID NO: 323771 - DNA, 20 bp, human
gcacccctccctcaaggcgg

SEQ ID NO: 323772 - DNA, 20 bp, human
gggcggtcacatgaccgaag

SEQ ID NO: 323773 - DNA, 20 bp, human
gaagaggaccgccgccttga

SEQ ID NO: 323774 - DNA, 20 bp, human
gccgggactgcggatagaag

SEQ ID NO: 323775 - DNA, 20 bp, human
gtcggggtctgacccgctcc

SEQ ID NO: 323776 - DNA, 20 bp, human
gaccgctgggtgcacaagag

SEQ ID NO: 323777 - DNA, 20 bp, human
ggggcaggcaaagggaccta

SEQ ID NO: 323778 - DNA, 20 bp, human
gacccggccgggcccgtcgc

SEQ ID NO: 323779 - DNA, 20 bp, human
gggtctccaaggcgcctggg

SEQ ID NO: 323780 - DNA, 20 bp, human
gtgcacccagcggtcccccc

SEQ ID NO: 323781 - DNA, 20 bp, human
gtgtggctggaggccggcga

SEQ ID NO: 323782 - DNA, 20 bp, human
ggagcgcacagcgacgcctg

SEQ ID NO: 323783 - DNA, 20 bp, human
ggcccctcttgtgcacccag

SEQ ID NO: 323784 - DNA, 20 bp, human
ggcctgctcccggcggaacg

SEQ ID NO: 323785 - DNA, 20 bp, human
gagctcttactccacactgc

SEQ ID NO: 323786 - DNA, 20 bp, human
gcccgcccccaactcaaccc

SEQ ID NO: 323787 - DNA, 20 bp, human
gcaccgtgacgtccgggccc

SEQ ID NO: 323788 - DNA, 20 bp, human
gccgggcccgggttgagttg

SEQ ID NO: 323789 - DNA, 20 bp, human
gcccacctaccgtgacgtca

SEQ ID NO: 323790 - DNA, 20 bp, human
gtctggaggcctggacgaga

SEQ ID NO: 323791 - DNA, 20 bp, human
gcccctggtcgcaaagtcct

SEQ ID NO: 323792 - DNA, 20 bp, human
ggccctgacgtcacggtagg

SEQ ID NO: 323793 - DNA, 20 bp, human
gcgggccctgacgtcacgat

SEQ ID NO: 323794 - DNA, 20 bp, human
gaacccgggcccggacgtca

SEQ ID NO: 323795 - DNA, 20 bp, human
gctccggggccctgacgtca

SEQ ID NO: 323796 - DNA, 20 bp, human
ggaaacaaaacagaggtcac

SEQ ID NO: 323797 - DNA, 20 bp, human
gcggctgcctcaaaatctgt

SEQ ID NO: 323798 - DNA, 20 bp, human
gaaaggaatgacaacgttct

SEQ ID NO: 323799 - DNA, 20 bp, human
gtggcccggatcctgcttgt

SEQ ID NO: 323800 - DNA, 20 bp, human
gtcaaccgacaagcaggatc

SEQ ID NO: 323801 - DNA, 20 bp, human
gagattttgaggcagccggt

SEQ ID NO: 323802 - DNA, 20 bp, human
gagagtttacgtgacgacat

SEQ ID NO: 323803 - DNA, 20 bp, human
ggagtcacttctatggtact

SEQ ID NO: 323804 - DNA, 20 bp, human
ggacatcggcgtcagcgtca

SEQ ID NO: 323805 - DNA, 20 bp, human
gtgcttgtcggttgaatcgc

SEQ ID NO: 323806 - DNA, 20 bp, human
ggagctccttgagcccgcgt

SEQ ID NO: 323807 - DNA, 20 bp, human
ggagcggcgcggggttactg

SEQ ID NO: 323808 - DNA, 20 bp, human
ggcggggcgagcacttgcgc

SEQ ID NO: 323809 - DNA, 20 bp, human
gctccaggaagcagccacaa

SEQ ID NO: 323810 - DNA, 20 bp, human
gtgccgggactctgcagaaa

SEQ ID NO: 323811 - DNA, 20 bp, human
gggaagtcccgggaggtgta

SEQ ID NO: 323812 - DNA, 20 bp, human
ggagcccgcgtgggaaacct

SEQ ID NO: 323813 - DNA, 20 bp, human
gtgtccgggcctggtccttt

SEQ ID NO: 323814 - DNA, 20 bp, human
gcagaaagggttctcaagtc

SEQ ID NO: 323815 - DNA, 20 bp, human
gcacgtggggccttggtttc

SEQ ID NO: 323816 - DNA, 20 bp, human
gtcccaggacgcggaggtaa

SEQ ID NO: 323817 - DNA, 20 bp, human
ggatacttcccaggacgcgg

SEQ ID NO: 323818 - DNA, 20 bp, human
gtacttccggtagctggtaa

SEQ ID NO: 323819 - DNA, 20 bp, human
gacgcggaggtaacgggcca

SEQ ID NO: 323820 - DNA, 20 bp, human
ggcagaagcaggggccgcac

SEQ ID NO: 323821 - DNA, 20 bp, human
gtgcgcacgaaatctcccgc

SEQ ID NO: 323822 - DNA, 20 bp, human
ggcccgttacctccgcgtcc

SEQ ID NO: 323823 - DNA, 20 bp, human
ggctgatacttcccaggacg

SEQ ID NO: 323824 - DNA, 20 bp, human
gatctcgcgagaaattgaag

SEQ ID NO: 323825 - DNA, 20 bp, human
gtatagaattcttgtcgaag

SEQ ID NO: 323826 - DNA, 20 bp, human
gccagccaggagtcccctga

SEQ ID NO: 323827 - DNA, 20 bp, human
gcgggacacgagcgaaaaaa

SEQ ID NO: 323828 - DNA, 20 bp, human
gtagaggcgcgcggagtcct

SEQ ID NO: 323829 - DNA, 20 bp, human
gaggcgaaaaggggcgggaa

SEQ ID NO: 323830 - DNA, 20 bp, human
gaagcccctagcccacttgg

SEQ ID NO: 323831 - DNA, 20 bp, human
gcaggcagagtcattattcc

SEQ ID NO: 323832 - DNA, 20 bp, human
gggctgggcggagtctgtag

SEQ ID NO: 323833 - DNA, 20 bp, human
gagactcgcgtgttccgggg

SEQ ID NO: 323834 - DNA, 20 bp, human
gagtgggctaggggcttctt

SEQ ID NO: 323835 - DNA, 20 bp, human
ggatgcttagagcagtgcga

SEQ ID NO: 323836 - DNA, 20 bp, human
gtgtgatcgcgcacctgccg

SEQ ID NO: 323837 - DNA, 20 bp, human
gatcacacacacgccttgca

SEQ ID NO: 323838 - DNA, 20 bp, human
gtggcaaaacgcacccggct

SEQ ID NO: 323839 - DNA, 20 bp, human
gtcaaaaagcacgaccttcc

SEQ ID NO: 323840 - DNA, 20 bp, human
gaagcacgaccttccgggac

SEQ ID NO: 323841 - DNA, 20 bp, human
gttaagaaccagagaagaag

SEQ ID NO: 323842 - DNA, 20 bp, human
gtcgcgcagtgtcgcaatcg

SEQ ID NO: 323843 - DNA, 20 bp, human
gcaatctgatgggcaaataa

SEQ ID NO: 323844 - DNA, 20 bp, human
gtgtttaactgaagttactg

SEQ ID NO: 323845 - DNA, 20 bp, human
gcaaaattatggccagcgcg

SEQ ID NO: 323846 - DNA, 20 bp, human
ggcagggttaggaacctccg

SEQ ID NO: 323847 - DNA, 20 bp, human
ggaaacttgcggctgtggat

SEQ ID NO: 323848 - DNA, 20 bp, human
ggtagcgtaacgcagtgttg

SEQ ID NO: 323849 - DNA, 20 bp, human
gcacctgcctcaggttaagt

SEQ ID NO: 323850 - DNA, 20 bp, human
gggtgaaagagcctcacgca

SEQ ID NO: 323851 - DNA, 20 bp, human
gggtctgcctacttaacctg

SEQ ID NO: 323852 - DNA, 20 bp, human
gaggttcctaaccctgcgtg

SEQ ID NO: 323853 - DNA, 20 bp, human
gttggggaaacttgcggctg

SEQ ID NO: 323854 - DNA, 20 bp, human
ggcacctagccctccggtac

SEQ ID NO: 323855 - DNA, 20 bp, human
gggaaacagccaaatggcgt

SEQ ID NO: 323856 - DNA, 20 bp, human
gcgactgccggagactcggg

SEQ ID NO: 323857 - DNA, 20 bp, human
gcaagaggcctctggctcgg

SEQ ID NO: 323858 - DNA, 20 bp, human
ggcaaccgcgagcggaggtg

SEQ ID NO: 323859 - DNA, 20 bp, human
ggcgcgagggccgttcccgc

SEQ ID NO: 323860 - DNA, 20 bp, human
gaagccaagggcacgcactc

SEQ ID NO: 323861 - DNA, 20 bp, human
gcggacgtggcggcgaagag

SEQ ID NO: 323862 - DNA, 20 bp, human
ggggcctgagtgcgtgccct

SEQ ID NO: 323863 - DNA, 20 bp, human
gtccgggagcagtcgactgc

SEQ ID NO: 323864 - DNA, 20 bp, human
gtagcacccgccaaatcccg

SEQ ID NO: 323865 - DNA, 20 bp, human
gccgttcccgcgggatttgg

SEQ ID NO: 323866 - DNA, 20 bp, human
gaggcggctgatggggacaa

SEQ ID NO: 323867 - DNA, 20 bp, human
ggttgcgcgaggccatccta

SEQ ID NO: 323868 - DNA, 20 bp, human
gagtaacgtggggtgaacgg

SEQ ID NO: 323869 - DNA, 20 bp, human
gtcaccccacgttactagta

SEQ ID NO: 323870 - DNA, 20 bp, human
gtagggttcgggtgcaggga

SEQ ID NO: 323871 - DNA, 20 bp, human
gtgggtcccgaagaagcgca

SEQ ID NO: 323872 - DNA, 20 bp, human
ggggctcggccggaagcgga

SEQ ID NO: 323873 - DNA, 20 bp, human
gaccgcagggccgtcggcac

SEQ ID NO: 323874 - DNA, 20 bp, human
gatggcctcgcgcaaccgca

SEQ ID NO: 323875 - DNA, 20 bp, human
gcgaggccatcctagggttc

SEQ ID NO: 323876 - DNA, 20 bp, human
gggcgtgggtcggtcgggga

SEQ ID NO: 323877 - DNA, 20 bp, human
ggagggaaggggacatcgtc

SEQ ID NO: 323878 - DNA, 20 bp, human
gcccacgccagcagccggtt

SEQ ID NO: 323879 - DNA, 20 bp, human
gtgctggcgtgggtcggtcg

SEQ ID NO: 323880 - DNA, 20 bp, human
gcctccgaggccagtccatc

SEQ ID NO: 323881 - DNA, 20 bp, human
gcagcagcggcagcgacaca

SEQ ID NO: 323882 - DNA, 20 bp, human
ggacacacgggcgaccgaga

SEQ ID NO: 323883 - DNA, 20 bp, human
gctactgctgtacggtatga

SEQ ID NO: 323884 - DNA, 20 bp, human
gaaagggccagcaagaattc

SEQ ID NO: 323885 - DNA, 20 bp, human
gtcaccacccaaccggctgc

SEQ ID NO: 323886 - DNA, 20 bp, human
ggaaacagacagtcacaaat

SEQ ID NO: 323887 - DNA, 20 bp, human
gctgccagacagactttgga

SEQ ID NO: 323888 - DNA, 20 bp, human
gaagccctccaaagtctgtc

SEQ ID NO: 323889 - DNA, 20 bp, human
gctgtctggcagaatgaaca

SEQ ID NO: 323890 - DNA, 20 bp, human
ggagtctagccatggggaag

SEQ ID NO: 323891 - DNA, 20 bp, human
gtcaatggcaaaacctgttg

SEQ ID NO: 323892 - DNA, 20 bp, human
gatgggattaatataatgaa

SEQ ID NO: 323893 - DNA, 20 bp, human
gctacactgagtctagccat

SEQ ID NO: 323894 - DNA, 20 bp, human
gtgacagtgtcttcctcaac

SEQ ID NO: 323895 - DNA, 20 bp, human
gtgggattttgttccagaca

SEQ ID NO: 323896 - DNA, 20 bp, human
ggaaacagacagtcacaaat

SEQ ID NO: 323897 - DNA, 20 bp, human
gctgccagacagactttgga

SEQ ID NO: 323898 - DNA, 20 bp, human
gaagccctccaaagtctgtc

SEQ ID NO: 323899 - DNA, 20 bp, human
gctgtctggcagaatgaaca

SEQ ID NO: 323900 - DNA, 20 bp, human
ggagtctagccatggggaag

SEQ ID NO: 323901 - DNA, 20 bp, human
gtcaatggcaaaacctgttg

SEQ ID NO: 323902 - DNA, 20 bp, human
gatgggattaatataatgaa

SEQ ID NO: 323903 - DNA, 20 bp, human
gctacactgagtctagccat

SEQ ID NO: 323904 - DNA, 20 bp, human
gtgacagtgtcttcctcaac

SEQ ID NO: 323905 - DNA, 20 bp, human
gtgggattttgttccagaca

SEQ ID NO: 323906 - DNA, 20 bp, human
ggacagacgcagcgcggtca

SEQ ID NO: 323907 - DNA, 20 bp, human
gtcggcttcgccgaactctg

SEQ ID NO: 323908 - DNA, 20 bp, human
gcagcgcggtcagggagcgt

SEQ ID NO: 323909 - DNA, 20 bp, human
gctgcgtctgtctgtcccgc

SEQ ID NO: 323910 - DNA, 20 bp, human
ggggcgcaggcagaatgcca

SEQ ID NO: 323911 - DNA, 20 bp, human
gtctgtctgtcccgcgggtc

SEQ ID NO: 323912 - DNA, 20 bp, human
ggcttcgccgaactctgcgg

SEQ ID NO: 323913 - DNA, 20 bp, human
gaactctgcggcggagctgg

SEQ ID NO: 323914 - DNA, 20 bp, human
ggggatggagaccctcagaa

SEQ ID NO: 323915 - DNA, 20 bp, human
gtctggagatcttcaaacga

SEQ ID NO: 323916 - DNA, 20 bp, human
gtcctggcctctcccatcga

SEQ ID NO: 323917 - DNA, 20 bp, human
gcacacgccatcgatgggag

SEQ ID NO: 323918 - DNA, 20 bp, human
gcccacccacacgccatcga

SEQ ID NO: 323919 - DNA, 20 bp, human
gggagaggccaggacgcggc

SEQ ID NO: 323920 - DNA, 20 bp, human
gcgtgccgcgcagccttctg

SEQ ID NO: 323921 - DNA, 20 bp, human
ggcggccttcagcagactca

SEQ ID NO: 323922 - DNA, 20 bp, human
gaggggctgaggcgcgaagg

SEQ ID NO: 323923 - DNA, 20 bp, human
ggggcggggcgtcgctgcgc

SEQ ID NO: 323924 - DNA, 20 bp, human
gcagcctgggctccgggcac

SEQ ID NO: 323925 - DNA, 20 bp, human
gacgagctgctgtcagggca

SEQ ID NO: 323926 - DNA, 20 bp, human
gaaaccactgacaaaccagg

SEQ ID NO: 323927 - DNA, 20 bp, human
gatagcacaaggtgcaactg

SEQ ID NO: 323928 - DNA, 20 bp, human
gcacaaggtgcaactgaggg

SEQ ID NO: 323929 - DNA, 20 bp, human
gcgtcacaaggtttttgcat

SEQ ID NO: 323930 - DNA, 20 bp, human
ggactagctcagagctagcg

SEQ ID NO: 323931 - DNA, 20 bp, human
gtactattagaactggcaac

SEQ ID NO: 323932 - DNA, 20 bp, human
ggacaaaccactgacaaacc

SEQ ID NO: 323933 - DNA, 20 bp, human
gtttccacctggtttgtcag

SEQ ID NO: 323934 - DNA, 20 bp, human
gctggagtggacagtggtta

SEQ ID NO: 323935 - DNA, 20 bp, human
gaaatctgtactattagaac

SEQ ID NO: 323936 - DNA, 20 bp, human
gagatggccgcgatccgggt

SEQ ID NO: 323937 - DNA, 20 bp, human
gaatcgagcggtcccggaga

SEQ ID NO: 323938 - DNA, 20 bp, human
gggtggggccgagaatcgag

SEQ ID NO: 323939 - DNA, 20 bp, human
ggcgctaggcaaactggagg

SEQ ID NO: 323940 - DNA, 20 bp, human
ggccgagaatcgagcggtcc

SEQ ID NO: 323941 - DNA, 20 bp, human
gcccggagatggccgcgatc

SEQ ID NO: 323942 - DNA, 20 bp, human
ggtgaaggtcccaaggtgtt

SEQ ID NO: 323943 - DNA, 20 bp, human
gtccgggaccgctcgattct

SEQ ID NO: 323944 - DNA, 20 bp, human
gtgggcttgccggttgcgct

SEQ ID NO: 323945 - DNA, 20 bp, human
ggtgttggggttacgtgggt

SEQ ID NO: 323946 - DNA, 20 bp, human
gtcctgcgccgcccggagtc

SEQ ID NO: 323947 - DNA, 20 bp, human
gacgcccgccgcgcgagggg

SEQ ID NO: 323948 - DNA, 20 bp, human
gcaggacgcccgccgcgcga

SEQ ID NO: 323949 - DNA, 20 bp, human
gcctcctggtaccccaatgc

SEQ ID NO: 323950 - DNA, 20 bp, human
gtaggcttgcggaacagatc

SEQ ID NO: 323951 - DNA, 20 bp, human
gtggacccctactgccttct

SEQ ID NO: 323952 - DNA, 20 bp, human
gtcgccggcattggggtacc

SEQ ID NO: 323953 - DNA, 20 bp, human
ggctgccagggcacacggcg

SEQ ID NO: 323954 - DNA, 20 bp, human
gggaacagatcaggagtcgc

SEQ ID NO: 323955 - DNA, 20 bp, human
gcgagctgactacctgactc

SEQ ID NO: 323956 - DNA, 20 bp, human
gaggactctgcgcccccctt

SEQ ID NO: 323957 - DNA, 20 bp, human
gccagtctccggcgcggtcc

SEQ ID NO: 323958 - DNA, 20 bp, human
gaccgcgccggagactggct

SEQ ID NO: 323959 - DNA, 20 bp, human
gccccagccagtctccggcg

SEQ ID NO: 323960 - DNA, 20 bp, human
gttaggcccgctgacttcca

SEQ ID NO: 323961 - DNA, 20 bp, human
ggtggcgggcgcgcagtcgg

SEQ ID NO: 323962 - DNA, 20 bp, human
ggccggcgtgacggccgaag

SEQ ID NO: 323963 - DNA, 20 bp, human
gggcggccggccaatgggtg

SEQ ID NO: 323964 - DNA, 20 bp, human
gcggagcccggcctgccaat

SEQ ID NO: 323965 - DNA, 20 bp, human
gcggccgtccggagcctctc

SEQ ID NO: 323966 - DNA, 20 bp, human
gcggaggcggggtctaacgg

SEQ ID NO: 323967 - DNA, 20 bp, human
gggcggggtcgatggggagt

SEQ ID NO: 323968 - DNA, 20 bp, human
gaggcggggtctaacggggg

SEQ ID NO: 323969 - DNA, 20 bp, human
ggcgcgcaggccacatggga

SEQ ID NO: 323970 - DNA, 20 bp, human
gaacgggggcggggtcgatg

SEQ ID NO: 323971 - DNA, 20 bp, human
ggggtggccgtgtggtgtgg

SEQ ID NO: 323972 - DNA, 20 bp, human
gaccgcagcaggctgggcgt

SEQ ID NO: 323973 - DNA, 20 bp, human
gagtgggcgggtctgggacg

SEQ ID NO: 323974 - DNA, 20 bp, human
gtggcgcgggggtggccgtg

SEQ ID NO: 323975 - DNA, 20 bp, human
gagccggaggcggggtctaa

SEQ ID NO: 323976 - DNA, 20 bp, human
ggacttgaagtcatcctcca

SEQ ID NO: 323977 - DNA, 20 bp, human
gactgaggcagggacagcat

SEQ ID NO: 323978 - DNA, 20 bp, human
gcccaaggatgttcagtgag

SEQ ID NO: 323979 - DNA, 20 bp, human
ggggtctggaacagtcagag

SEQ ID NO: 323980 - DNA, 20 bp, human
ggaaacaccacgggattctt

SEQ ID NO: 323981 - DNA, 20 bp, human
ggtgtgagcccacacaattt

SEQ ID NO: 323982 - DNA, 20 bp, human
gtaggccccgtaggccccat

SEQ ID NO: 323983 - DNA, 20 bp, human
gtgggacaggtgagggagtc

SEQ ID NO: 323984 - DNA, 20 bp, human
gctgtcccatggggcctacg

SEQ ID NO: 323985 - DNA, 20 bp, human
gtgagactctgcccagactg

SEQ ID NO: 323986 - DNA, 20 bp, human
gccgggtaccagggtcggat

SEQ ID NO: 323987 - DNA, 20 bp, human
gccgaccctggtacccggag

SEQ ID NO: 323988 - DNA, 20 bp, human
gagggccgctccgggtacca

SEQ ID NO: 323989 - DNA, 20 bp, human
gacgtcacccgatccgaccc

SEQ ID NO: 323990 - DNA, 20 bp, human
gagccgcgccagggccgctc

SEQ ID NO: 323991 - DNA, 20 bp, human
gccctggcgcggctgtcggc

SEQ ID NO: 323992 - DNA, 20 bp, human
gccggcctccaggctgaaga

SEQ ID NO: 323993 - DNA, 20 bp, human
ggcgcccaggctccctggtc

SEQ ID NO: 323994 - DNA, 20 bp, human
gctggtgcgccgctctttcg

SEQ ID NO: 323995 - DNA, 20 bp, human
ggagtaggggcgagcagcta

SEQ ID NO: 323996 - DNA, 20 bp, human
gaaggaacacgcgccggcgg

SEQ ID NO: 323997 - DNA, 20 bp, human
ggagaaggcagcccgggccc

SEQ ID NO: 323998 - DNA, 20 bp, human
gagcgccgcgcgcctccaga

SEQ ID NO: 323999 - DNA, 20 bp, human
ggggagcgcggaccttctgg

SEQ ID NO: 324000 - DNA, 20 bp, human
gaagacgcaaatcgacagcg

SEQ ID NO: 324001 - DNA, 20 bp, human
gcggcgcgcgcggtccctaa

SEQ ID NO: 324002 - DNA, 20 bp, human
gcgcgggagcgcggaccttc

SEQ ID NO: 324003 - DNA, 20 bp, human
gcgtcttctccgtggaccct

SEQ ID NO: 324004 - DNA, 20 bp, human
gcgcgccgcggcctcgctct

SEQ ID NO: 324005 - DNA, 20 bp, human
gcccactgcacagactacca

SEQ ID NO: 324006 - DNA, 20 bp, human
gaggccttgcggccatgtcc

SEQ ID NO: 324007 - DNA, 20 bp, human
gcggtgccggccgaagagac

SEQ ID NO: 324008 - DNA, 20 bp, human
gggaagtggagtccaggcgg

SEQ ID NO: 324009 - DNA, 20 bp, human
gccgggaagtggagtccagg

SEQ ID NO: 324010 - DNA, 20 bp, human
gtcccggcagcgcccgcggt

SEQ ID NO: 324011 - DNA, 20 bp, human
gggcccgcctcctccgcaag

SEQ ID NO: 324012 - DNA, 20 bp, human
gcaccagccaagagagcctc

SEQ ID NO: 324013 - DNA, 20 bp, human
gcatggccgcaaggcctcac

SEQ ID NO: 324014 - DNA, 20 bp, human
gttcccagcgccccttgcgg

SEQ ID NO: 324015 - DNA, 20 bp, human
gagtgtagtcccaaaagcgt

SEQ ID NO: 324016 - DNA, 20 bp, human
gggtcccgaagtgagggcgg

SEQ ID NO: 324017 - DNA, 20 bp, human
ggccctcacttcgggacccg

SEQ ID NO: 324018 - DNA, 20 bp, human
gctcacttcgggacccgtgg

SEQ ID NO: 324019 - DNA, 20 bp, human
gccgaagtgagggcgggggg

SEQ ID NO: 324020 - DNA, 20 bp, human
gagcgcggagccatctggcc

SEQ ID NO: 324021 - DNA, 20 bp, human
gcggagccatctggccgggt

SEQ ID NO: 324022 - DNA, 20 bp, human
gctaaaagggaactcaaggg

SEQ ID NO: 324023 - DNA, 20 bp, human
gggggggaggagtggcgggt

SEQ ID NO: 324024 - DNA, 20 bp, human
gttaacgtttcgttttttcc

SEQ ID NO: 324025 - DNA, 20 bp, human
gagttcccttttagagatcc

SEQ ID NO: 324026 - DNA, 20 bp, human
gctcccagatggggcggaac

SEQ ID NO: 324027 - DNA, 20 bp, human
gccagccaggagccatcacc

SEQ ID NO: 324028 - DNA, 20 bp, human
ggggagatgaatgggccgag

SEQ ID NO: 324029 - DNA, 20 bp, human
gccccatctgggagatgaat

SEQ ID NO: 324030 - DNA, 20 bp, human
gtgccctggctcctcggtac

SEQ ID NO: 324031 - DNA, 20 bp, human
ggaagcagcttggggaacca

SEQ ID NO: 324032 - DNA, 20 bp, human
ggctcctcggtacaggaaag

SEQ ID NO: 324033 - DNA, 20 bp, human
gggaactggcctggacaccc

SEQ ID NO: 324034 - DNA, 20 bp, human
ggtcctggttgggtcagcct

SEQ ID NO: 324035 - DNA, 20 bp, human
gtgtgaggagggaacattcc

SEQ ID NO: 324036 - DNA, 20 bp, human
gttgggggaccctatatcta

SEQ ID NO: 324037 - DNA, 20 bp, human
gagggggtaaaaacttcagt

SEQ ID NO: 324038 - DNA, 20 bp, human
gttcagtggggaaagaagtt

SEQ ID NO: 324039 - DNA, 20 bp, human
gtattcaactactacaggcc

SEQ ID NO: 324040 - DNA, 20 bp, human
ggcaccactcccctgccacc

SEQ ID NO: 324041 - DNA, 20 bp, human
ggggaggctgggattagaga

SEQ ID NO: 324042 - DNA, 20 bp, human
gggcttgcctgccaggattg

SEQ ID NO: 324043 - DNA, 20 bp, human
gtgtctcaaaagtaaaaata

SEQ ID NO: 324044 - DNA, 20 bp, human
gcttgtcgcccaggtggcag

SEQ ID NO: 324045 - DNA, 20 bp, human
gaggctgggattagagaagg

SEQ ID NO: 324046 - DNA, 20 bp, human
ggccgccccgacgcggagaa

SEQ ID NO: 324047 - DNA, 20 bp, human
gcggcctttccgccagaggg

SEQ ID NO: 324048 - DNA, 20 bp, human
gcggtcatgccggactcctg

SEQ ID NO: 324049 - DNA, 20 bp, human
ggatccttgcatcacgtgac

SEQ ID NO: 324050 - DNA, 20 bp, human
gcgacccgcacttccggtag

SEQ ID NO: 324051 - DNA, 20 bp, human
ggaagcgcgacccgcacttc

SEQ ID NO: 324052 - DNA, 20 bp, human
gtcccagcaagctcccaagg

SEQ ID NO: 324053 - DNA, 20 bp, human
gaatgccgctaccggaagtg

SEQ ID NO: 324054 - DNA, 20 bp, human
gggtagcggcattgcgcgga

SEQ ID NO: 324055 - DNA, 20 bp, human
gtcacgtgacggggccgcat

SEQ ID NO: 324056 - DNA, 20 bp, human
ggcggctgccgcaggatccc

SEQ ID NO: 324057 - DNA, 20 bp, human
gcgtccgcgcggctccggtg

SEQ ID NO: 324058 - DNA, 20 bp, human
ggatcctgcggcagccgcct

SEQ ID NO: 324059 - DNA, 20 bp, human
gcggccgccgctgtccggcg

SEQ ID NO: 324060 - DNA, 20 bp, human
ggaggcgcaggggtggcgcg

SEQ ID NO: 324061 - DNA, 20 bp, human
gccgaggaagttgaccgagg

SEQ ID NO: 324062 - DNA, 20 bp, human
ggggaagtggagctcgcggg

SEQ ID NO: 324063 - DNA, 20 bp, human
ggcggccgcagcgcgcattt

SEQ ID NO: 324064 - DNA, 20 bp, human
gcccaagctcggtagctcgc

SEQ ID NO: 324065 - DNA, 20 bp, human
ggactgcgctctcatcccgg

SEQ ID NO: 324066 - DNA, 20 bp, human
gaaacgcccggaagtgacgt

SEQ ID NO: 324067 - DNA, 20 bp, human
gcgcccggaagtgacgttgg

SEQ ID NO: 324068 - DNA, 20 bp, human
ggtcgcgtctggtcgtggtc

SEQ ID NO: 324069 - DNA, 20 bp, human
ggggcccgcccctaaacgcc

SEQ ID NO: 324070 - DNA, 20 bp, human
gaaatccggagcccgcgcgg

SEQ ID NO: 324071 - DNA, 20 bp, human
gaagtgacgttggcggacaa

SEQ ID NO: 324072 - DNA, 20 bp, human
ggagctgtcgcgtctggtcg

SEQ ID NO: 324073 - DNA, 20 bp, human
gacttccgggcgtttagggg

SEQ ID NO: 324074 - DNA, 20 bp, human
gcgccgcgagctgtcgcgtc

SEQ ID NO: 324075 - DNA, 20 bp, human
gcggagctgcggttggcttg

SEQ ID NO: 324076 - DNA, 20 bp, human
gagggagagcacaggcgggt

SEQ ID NO: 324077 - DNA, 20 bp, human
gcacaggcgggtgggaaccc

SEQ ID NO: 324078 - DNA, 20 bp, human
gcccctctccggggtttccc

SEQ ID NO: 324079 - DNA, 20 bp, human
gaaagcgaggagagcacccg

SEQ ID NO: 324080 - DNA, 20 bp, human
gggccaggcgcgcaccccgt

SEQ ID NO: 324081 - DNA, 20 bp, human
gcactcgcgctgggagtgag

SEQ ID NO: 324082 - DNA, 20 bp, human
gagagcacccggggaaaccc

SEQ ID NO: 324083 - DNA, 20 bp, human
gcccggggaaaccccggaga

SEQ ID NO: 324084 - DNA, 20 bp, human
gccgagagggagagcacagg

SEQ ID NO: 324085 - DNA, 20 bp, human
gccggcccggacgcccgaga

SEQ ID NO: 324086 - DNA, 20 bp, human
gctcctcccggctgcagcga

SEQ ID NO: 324087 - DNA, 20 bp, human
ggggcggggctgctcgggtc

SEQ ID NO: 324088 - DNA, 20 bp, human
gggtcccccacgggctgcga

SEQ ID NO: 324089 - DNA, 20 bp, human
ggaccacccagcagggtcct

SEQ ID NO: 324090 - DNA, 20 bp, human
gagggcggacgagctgtgcc

SEQ ID NO: 324091 - DNA, 20 bp, human
gcagaagcagattcagacgc

SEQ ID NO: 324092 - DNA, 20 bp, human
ggcaagcccgggcccagccg

SEQ ID NO: 324093 - DNA, 20 bp, human
gcctacctggggaacatcca

SEQ ID NO: 324094 - DNA, 20 bp, human
gcagcgcattcctggctccc

SEQ ID NO: 324095 - DNA, 20 bp, human
gggcggggcctgcggtgcac

SEQ ID NO: 324096 - DNA, 20 bp, human
ggcggcgcagcccgcgggat

SEQ ID NO: 324097 - DNA, 20 bp, human
gcccgcgggctgcgccgccc

SEQ ID NO: 324098 - DNA, 20 bp, human
gggaaggggtggaggtgcga

SEQ ID NO: 324099 - DNA, 20 bp, human
gccgcccgggctgtcaagcg

SEQ ID NO: 324100 - DNA, 20 bp, human
gcccccgcgcttgacagccc

SEQ ID NO: 324101 - DNA, 20 bp, human
gagcggcgatccgatcccgc

SEQ ID NO: 324102 - DNA, 20 bp, human
gccagcgggcagccgggcgt

SEQ ID NO: 324103 - DNA, 20 bp, human
gcgggccaggaggggcgcca

SEQ ID NO: 324104 - DNA, 20 bp, human
ggggccaggctgaggcgacc

SEQ ID NO: 324105 - DNA, 20 bp, human
ggggcgtcgggggcgtcggt

SEQ ID NO: 324106 - DNA, 20 bp, human
gaggccacccgcaacggtgt

SEQ ID NO: 324107 - DNA, 20 bp, human
gccagccaggccacccgcaa

SEQ ID NO: 324108 - DNA, 20 bp, human
gtcaccgcaggtaggacggg

SEQ ID NO: 324109 - DNA, 20 bp, human
gtacctgcggtgagcctcct

SEQ ID NO: 324110 - DNA, 20 bp, human
gggtccctgtggggatagcg

SEQ ID NO: 324111 - DNA, 20 bp, human
gaggctcaccgcaggtagga

SEQ ID NO: 324112 - DNA, 20 bp, human
gtgtggggatagcgtggctg

SEQ ID NO: 324113 - DNA, 20 bp, human
gtggcggccaccacaaggcg

SEQ ID NO: 324114 - DNA, 20 bp, human
gacgggaggctgtcagtcgg

SEQ ID NO: 324115 - DNA, 20 bp, human
ggctgcggttggtgagggat

SEQ ID NO: 324116 - DNA, 20 bp, human
gtgtaggggcctccgggcaa

SEQ ID NO: 324117 - DNA, 20 bp, human
gtgtgcttgggaacggtttg

SEQ ID NO: 324118 - DNA, 20 bp, human
gcttgggaacggtttgggga

SEQ ID NO: 324119 - DNA, 20 bp, human
gggcccctacagccctagac

SEQ ID NO: 324120 - DNA, 20 bp, human
gtagggctgtaggggcctcc

SEQ ID NO: 324121 - DNA, 20 bp, human
gtggaggagccgggggggat

SEQ ID NO: 324122 - DNA, 20 bp, human
gggaaacggcgcttctgtgg

SEQ ID NO: 324123 - DNA, 20 bp, human
gcttctgtggaggagccggg

SEQ ID NO: 324124 - DNA, 20 bp, human
ggatggacggcggcagaagt

SEQ ID NO: 324125 - DNA, 20 bp, human
gttaaaaagttgaagttcaa

SEQ ID NO: 324126 - DNA, 20 bp, human
ggggctggcacgacctccga

SEQ ID NO: 324127 - DNA, 20 bp, human
gttaaggcgagaagtgtcag

SEQ ID NO: 324128 - DNA, 20 bp, human
gactttgacaggtagatgag

SEQ ID NO: 324129 - DNA, 20 bp, human
ggaaccagaaaatcgtcctg

SEQ ID NO: 324130 - DNA, 20 bp, human
gtgacaggtagatgaggggg

SEQ ID NO: 324131 - DNA, 20 bp, human
gagcccagtcccctgctcgc

SEQ ID NO: 324132 - DNA, 20 bp, human
gtcactgatcttttgcattt

SEQ ID NO: 324133 - DNA, 20 bp, human
gggaggcgaaggtaattaag

SEQ ID NO: 324134 - DNA, 20 bp, human
gtcggagcccgcacccagag

SEQ ID NO: 324135 - DNA, 20 bp, human
gggccgctggttctgatccc

SEQ ID NO: 324136 - DNA, 20 bp, human
gtgccagcgcccatgggtgt

SEQ ID NO: 324137 - DNA, 20 bp, human
ggggggacgcgccacggccc

SEQ ID NO: 324138 - DNA, 20 bp, human
ggggccgggaggcgatgttt

SEQ ID NO: 324139 - DNA, 20 bp, human
ggcggcgagcaggggcgtcc

SEQ ID NO: 324140 - DNA, 20 bp, human
gggagcaacggtcttcttaa

SEQ ID NO: 324141 - DNA, 20 bp, human
gcccagagcgcatcctcagc

SEQ ID NO: 324142 - DNA, 20 bp, human
gcggctcgggggacgcgcca

SEQ ID NO: 324143 - DNA, 20 bp, human
gtcctcagccggctccggtc

SEQ ID NO: 324144 - DNA, 20 bp, human
ggcaggaaggaaatattgcg

SEQ ID NO: 324145 - DNA, 20 bp, human
gcatcggggcttttatctct

SEQ ID NO: 324146 - DNA, 20 bp, human
ggcacaggcgccaatgccga

SEQ ID NO: 324147 - DNA, 20 bp, human
gccgcctataggaactgccg

SEQ ID NO: 324148 - DNA, 20 bp, human
ggtgccgcggcagttcctat

SEQ ID NO: 324149 - DNA, 20 bp, human
gcaggcgcggaccggggact

SEQ ID NO: 324150 - DNA, 20 bp, human
gtgccgagggctgaatgcgc

SEQ ID NO: 324151 - DNA, 20 bp, human
gggaccggggactcgggaga

SEQ ID NO: 324152 - DNA, 20 bp, human
gtgaatgcgcaggcgcggac

SEQ ID NO: 324153 - DNA, 20 bp, human
gggcgcatgcgtggtcttga

SEQ ID NO: 324154 - DNA, 20 bp, human
gagggctgaatgcgcaggcg

SEQ ID NO: 324155 - DNA, 20 bp, human
ggcagttcctataggcggag

SEQ ID NO: 324156 - DNA, 20 bp, human
ggggagaaggctgacgctgg

SEQ ID NO: 324157 - DNA, 20 bp, human
ggggcccctaacaggggagg

SEQ ID NO: 324158 - DNA, 20 bp, human
ggacgctgggggcccctaac

SEQ ID NO: 324159 - DNA, 20 bp, human
ggggccgcagcagaacgcct

SEQ ID NO: 324160 - DNA, 20 bp, human
gaggcggatcctcggggaga

SEQ ID NO: 324161 - DNA, 20 bp, human
gggggggggcgtcagagagt

SEQ ID NO: 324162 - DNA, 20 bp, human
gcgcccagcgcacatgtcgg

SEQ ID NO: 324163 - DNA, 20 bp, human
gagacccagccgccaggaaa

SEQ ID NO: 324164 - DNA, 20 bp, human
gagggaagatgactgcgttg

SEQ ID NO: 324165 - DNA, 20 bp, human
gtggctccgccctttcctgg

SEQ ID NO: 324166 - DNA, 20 bp, human
gggaggggaggggaatctgg

SEQ ID NO: 324167 - DNA, 20 bp, human
ggggaatctgggggcgagca

SEQ ID NO: 324168 - DNA, 20 bp, human
gcctccagacaaaagcacca

SEQ ID NO: 324169 - DNA, 20 bp, human
gggaaaggagaacgcgggga

SEQ ID NO: 324170 - DNA, 20 bp, human
gccaccctgcctaaaaggga

SEQ ID NO: 324171 - DNA, 20 bp, human
gcctccctggtgcttttgtc

SEQ ID NO: 324172 - DNA, 20 bp, human
ggcagacagcagcagcatgt

SEQ ID NO: 324173 - DNA, 20 bp, human
ggggtgggaaaggagaacgc

SEQ ID NO: 324174 - DNA, 20 bp, human
gcgtgcatgtctacacggcc

SEQ ID NO: 324175 - DNA, 20 bp, human
gacgcgcgtgcatgtctaca

SEQ ID NO: 324176 - DNA, 20 bp, human
gcggggagagagacgggtgt

SEQ ID NO: 324177 - DNA, 20 bp, human
gggggaggaggccgcgacga

SEQ ID NO: 324178 - DNA, 20 bp, human
gataacccgtgcgtttcgta

SEQ ID NO: 324179 - DNA, 20 bp, human
gaggaggccgcgacgaggga

SEQ ID NO: 324180 - DNA, 20 bp, human
gcacccacccacccactcgc

SEQ ID NO: 324181 - DNA, 20 bp, human
ggcgctgcgaggcgtggagc

SEQ ID NO: 324182 - DNA, 20 bp, human
gcgcgagccggcgagtgggt

SEQ ID NO: 324183 - DNA, 20 bp, human
gcccgctagccgcagcccgg

SEQ ID NO: 324184 - DNA, 20 bp, human
gtagcgcgagggccaaaaag

SEQ ID NO: 324185 - DNA, 20 bp, human
gaacgtggcggaggtgattg

SEQ ID NO: 324186 - DNA, 20 bp, human
gtcactcaaggttcagaaat

SEQ ID NO: 324187 - DNA, 20 bp, human
ggcaggggggacaaaggaaa

SEQ ID NO: 324188 - DNA, 20 bp, human
gctcctgcttatatatatag

SEQ ID NO: 324189 - DNA, 20 bp, human
gtgggaaaaggatgatactg

SEQ ID NO: 324190 - DNA, 20 bp, human
gcaaggttcagaaatggggg

SEQ ID NO: 324191 - DNA, 20 bp, human
gagatcgtcactttcactca

SEQ ID NO: 324192 - DNA, 20 bp, human
gaatccatgctggaataaga

SEQ ID NO: 324193 - DNA, 20 bp, human
gaatgacaacttttggagtg

SEQ ID NO: 324194 - DNA, 20 bp, human
gtggaagttcttgaagagtt

SEQ ID NO: 324195 - DNA, 20 bp, human
gaagagttagggtgcttctc

SEQ ID NO: 324196 - DNA, 20 bp, human
ggcgcggcgcgcccagcagt

SEQ ID NO: 324197 - DNA, 20 bp, human
gtgggccgacccccactcct

SEQ ID NO: 324198 - DNA, 20 bp, human
ggggaggagattctgagcga

SEQ ID NO: 324199 - DNA, 20 bp, human
gactgagcgagcccagggtt

SEQ ID NO: 324200 - DNA, 20 bp, human
gcgagaaattgcggagaaca

SEQ ID NO: 324201 - DNA, 20 bp, human
gctgcgcgtctccacggagc

SEQ ID NO: 324202 - DNA, 20 bp, human
ggggtgagggtgtatccgga

SEQ ID NO: 324203 - DNA, 20 bp, human
gtagccggtgcgagaaattg

SEQ ID NO: 324204 - DNA, 20 bp, human
ggctcgctcagttggggtga

SEQ ID NO: 324205 - DNA, 20 bp, human
ggccaggctgcacccgggcg

SEQ ID NO: 324206 - DNA, 20 bp, human
gggcactcgcggtcccacgt

SEQ ID NO: 324207 - DNA, 20 bp, human
gagtgccagcccgttagcgt

SEQ ID NO: 324208 - DNA, 20 bp, human
ggaagcgcgtgctggtggaa

SEQ ID NO: 324209 - DNA, 20 bp, human
gtgctggtggaaagggggtt

SEQ ID NO: 324210 - DNA, 20 bp, human
gtagcgtcggtcacacgtct

SEQ ID NO: 324211 - DNA, 20 bp, human
ggggctgatagtcccgagtt

SEQ ID NO: 324212 - DNA, 20 bp, human
gagggggttgggttccttca

SEQ ID NO: 324213 - DNA, 20 bp, human
gcaccagcacgcgcttccct

SEQ ID NO: 324214 - DNA, 20 bp, human
ggtggagttcggcccaactc

SEQ ID NO: 324215 - DNA, 20 bp, human
gtctgggttcagttcaaccc

SEQ ID NO: 324216 - DNA, 20 bp, human
ggggccgccgtgagctggga

SEQ ID NO: 324217 - DNA, 20 bp, human
ggctcgcgcggccccagggg

SEQ ID NO: 324218 - DNA, 20 bp, human
gcgtcctcccggggaggggt

SEQ ID NO: 324219 - DNA, 20 bp, human
gccggcgccagcaggaatcc

SEQ ID NO: 324220 - DNA, 20 bp, human
gctacgccgcgccgcacaaa

SEQ ID NO: 324221 - DNA, 20 bp, human
gtgtcctcgctgggccggaa

SEQ ID NO: 324222 - DNA, 20 bp, human
gcccgtctgcgcgtcctccc

SEQ ID NO: 324223 - DNA, 20 bp, human
gtgcggcgcggcgtaggcca

SEQ ID NO: 324224 - DNA, 20 bp, human
gtcgccagtcgcagctaccg

SEQ ID NO: 324225 - DNA, 20 bp, human
gcgcccggcttggaatttcc

SEQ ID NO: 324226 - DNA, 20 bp, human
gtggccgggaaaggtgtcaa

SEQ ID NO: 324227 - DNA, 20 bp, human
ggaacccgcccaccaggaat

SEQ ID NO: 324228 - DNA, 20 bp, human
gtgaccacggccgtccacat

SEQ ID NO: 324229 - DNA, 20 bp, human
gcaccaggaatggggactag

SEQ ID NO: 324230 - DNA, 20 bp, human
ggagccccggagagccaatg

SEQ ID NO: 324231 - DNA, 20 bp, human
gcgcccattggcctgctcga

SEQ ID NO: 324232 - DNA, 20 bp, human
gcgtccacattggctctccg

SEQ ID NO: 324233 - DNA, 20 bp, human
ggactaggggattccagcga

SEQ ID NO: 324234 - DNA, 20 bp, human
gcaggccaatgggcgccggg

SEQ ID NO: 324235 - DNA, 20 bp, human
ggagccaatgtggacggccg

SEQ ID NO: 324236 - DNA, 20 bp, human
gggcggggatacggttgtgt

SEQ ID NO: 324237 - DNA, 20 bp, human
gcgcttggaaagagggttgt

SEQ ID NO: 324238 - DNA, 20 bp, human
ggcggggcggagccgcgacg

SEQ ID NO: 324239 - DNA, 20 bp, human
gactgagcctggggtggcgt

SEQ ID NO: 324240 - DNA, 20 bp, human
gccgccgccgcttggaaaga

SEQ ID NO: 324241 - DNA, 20 bp, human
gtgtgggcgtggttaccgcg

SEQ ID NO: 324242 - DNA, 20 bp, human
gtggaaagagggttgtgggc

SEQ ID NO: 324243 - DNA, 20 bp, human
gggcgaggatgtggccgtgt

SEQ ID NO: 324244 - DNA, 20 bp, human
ggccaaggcgaagccagctg

SEQ ID NO: 324245 - DNA, 20 bp, human
gggcgcgaaggcgacagcgg

SEQ ID NO: 324246 - DNA, 20 bp, human
ggaaccttgggccgaaagac

SEQ ID NO: 324247 - DNA, 20 bp, human
gaggcggaaatgtacgacag

SEQ ID NO: 324248 - DNA, 20 bp, human
gcgaaataagtctcggaaag

SEQ ID NO: 324249 - DNA, 20 bp, human
gacgttgagtcccagtcttt

SEQ ID NO: 324250 - DNA, 20 bp, human
gtgtgcgcacgcgcgaacct

SEQ ID NO: 324251 - DNA, 20 bp, human
gagtgaatccagcaggggag

SEQ ID NO: 324252 - DNA, 20 bp, human
gaccgaagagaaataactcc

SEQ ID NO: 324253 - DNA, 20 bp, human
ggcagtgagtgaatccagca

SEQ ID NO: 324254 - DNA, 20 bp, human
gtgaaatataaactgtctat

SEQ ID NO: 324255 - DNA, 20 bp, human
gtcagattgtgcccacaagg

SEQ ID NO: 324256 - DNA, 20 bp, human
gcgtctgcgccggaacctgc

SEQ ID NO: 324257 - DNA, 20 bp, human
gctcgcgcgcacattggacc

SEQ ID NO: 324258 - DNA, 20 bp, human
gcccctgcgcccattggctc

SEQ ID NO: 324259 - DNA, 20 bp, human
ggatccggtcccgcaggttc

SEQ ID NO: 324260 - DNA, 20 bp, human
ggccgcgttgaccggaaagt

SEQ ID NO: 324261 - DNA, 20 bp, human
ggcgccggaacctgcgggac

SEQ ID NO: 324262 - DNA, 20 bp, human
ggcgcacattggacccgggt

SEQ ID NO: 324263 - DNA, 20 bp, human
gcgcttgggaactgaccaat

SEQ ID NO: 324264 - DNA, 20 bp, human
gacctactttccggtcaacg

SEQ ID NO: 324265 - DNA, 20 bp, human
ggctctcgatccggtcccgc

SEQ ID NO: 324266 - DNA, 20 bp, human
gccaaagaagaccggttgct

SEQ ID NO: 324267 - DNA, 20 bp, human
ggatacttacagaagtcccg

SEQ ID NO: 324268 - DNA, 20 bp, human
gcctgctgggaaactgtcgc

SEQ ID NO: 324269 - DNA, 20 bp, human
gcggtcttctttgggtttgt

SEQ ID NO: 324270 - DNA, 20 bp, human
gctgccaaatccccatgacg

SEQ ID NO: 324271 - DNA, 20 bp, human
ggctgggaaactgtcgcggg

SEQ ID NO: 324272 - DNA, 20 bp, human
ggttccgcgtcatggggatt

SEQ ID NO: 324273 - DNA, 20 bp, human
ggacgtcacggagcaacgct

SEQ ID NO: 324274 - DNA, 20 bp, human
ggaaactgtcgcgggtggcg

SEQ ID NO: 324275 - DNA, 20 bp, human
gcagcagcgttccgcgtcat

SEQ ID NO: 324276 - DNA, 20 bp, human
gtggaccaatcagacctctt

SEQ ID NO: 324277 - DNA, 20 bp, human
gcgggaaatgtggcgtcaag

SEQ ID NO: 324278 - DNA, 20 bp, human
gaatgtggcgtcaagaggct

SEQ ID NO: 324279 - DNA, 20 bp, human
gttggcataggcgggaaatg

SEQ ID NO: 324280 - DNA, 20 bp, human
gaggtctgattggtccacgc

SEQ ID NO: 324281 - DNA, 20 bp, human
gacgaaaatgcgagcggctt

SEQ ID NO: 324282 - DNA, 20 bp, human
ggcggcttcggcaaggggcg

SEQ ID NO: 324283 - DNA, 20 bp, human
gggggcctctgtggataagt

SEQ ID NO: 324284 - DNA, 20 bp, human
gatgcgagcggcttcggcaa

SEQ ID NO: 324285 - DNA, 20 bp, human
gctatgccaaaagagagaga

SEQ ID NO: 324286 - DNA, 20 bp, human
gtggaggcgggcggtgagga

SEQ ID NO: 324287 - DNA, 20 bp, human
gagcagggacaaggccgcgc

SEQ ID NO: 324288 - DNA, 20 bp, human
gacgccgattggcgggagca

SEQ ID NO: 324289 - DNA, 20 bp, human
gagtgtgggaactgtcgcca

SEQ ID NO: 324290 - DNA, 20 bp, human
gccaccaggctccacagctt

SEQ ID NO: 324291 - DNA, 20 bp, human
gtgtccctgctcccgccaat

SEQ ID NO: 324292 - DNA, 20 bp, human
gctgtggagcaggactcggg

SEQ ID NO: 324293 - DNA, 20 bp, human
gaatcagcggccgcagagtg

SEQ ID NO: 324294 - DNA, 20 bp, human
ggctgacgacgccgattggc

SEQ ID NO: 324295 - DNA, 20 bp, human
gaagggagaggcgatccctg

SEQ ID NO: 324296 - DNA, 20 bp, human
gaggacccccacggtgaagg

SEQ ID NO: 324297 - DNA, 20 bp, human
ggtggagcctatcagagagc

SEQ ID NO: 324298 - DNA, 20 bp, human
gggagcgcacaaaccctagt

SEQ ID NO: 324299 - DNA, 20 bp, human
gttgactaacaggaccccca

SEQ ID NO: 324300 - DNA, 20 bp, human
ggggctgctacagaattgga

SEQ ID NO: 324301 - DNA, 20 bp, human
gatgagcaggcgtgttgggg

SEQ ID NO: 324302 - DNA, 20 bp, human
gcgtgcaaccaaacccacta

SEQ ID NO: 324303 - DNA, 20 bp, human
gcacggccgcaaaacaaaaa

SEQ ID NO: 324304 - DNA, 20 bp, human
gcggggggctcgtctgttcc

SEQ ID NO: 324305 - DNA, 20 bp, human
gtgaagagacgggggagcgg

SEQ ID NO: 324306 - DNA, 20 bp, human
gaacccgcttcgccgaccat

SEQ ID NO: 324307 - DNA, 20 bp, human
gcgtggacgcgcttgttgat

SEQ ID NO: 324308 - DNA, 20 bp, human
gaacaagcgcgtccacgaag

SEQ ID NO: 324309 - DNA, 20 bp, human
gggctccgaatgtcgaccaa

SEQ ID NO: 324310 - DNA, 20 bp, human
ggcgtccacgaagcggtagg

SEQ ID NO: 324311 - DNA, 20 bp, human
gccgaccattggtcgacatt

SEQ ID NO: 324312 - DNA, 20 bp, human
gtcaatggccgcaaaccggg

SEQ ID NO: 324313 - DNA, 20 bp, human
gagcgcgtccacgaagcggt

SEQ ID NO: 324314 - DNA, 20 bp, human
ggaagcggtaggcggagccg

SEQ ID NO: 324315 - DNA, 20 bp, human
gaagcgggttgcttgccgca

SEQ ID NO: 324316 - DNA, 20 bp, human
gcgcgcgcgcgttaagtacc

SEQ ID NO: 324317 - DNA, 20 bp, human
gtaggtgcccgagctactga

SEQ ID NO: 324318 - DNA, 20 bp, human
gagaacacgcatttccgggg

SEQ ID NO: 324319 - DNA, 20 bp, human
gtcgcacagagactgggaag

SEQ ID NO: 324320 - DNA, 20 bp, human
gctgggctatgtagttctcc

SEQ ID NO: 324321 - DNA, 20 bp, human
gagaggccctagcaaccagg

SEQ ID NO: 324322 - DNA, 20 bp, human
ggggccgcctcctggttgct

SEQ ID NO: 324323 - DNA, 20 bp, human
gccgcgctcgcgggcctgta

SEQ ID NO: 324324 - DNA, 20 bp, human
gtctgaactctgttacccag

SEQ ID NO: 324325 - DNA, 20 bp, human
gtaacgcgcgcgcgacggca

SEQ ID NO: 324326 - DNA, 20 bp, human
ggtggggcggggaacagtaa

SEQ ID NO: 324327 - DNA, 20 bp, human
ggacccgagcggagaggccg

SEQ ID NO: 324328 - DNA, 20 bp, human
gactccgggaatgactgggt

SEQ ID NO: 324329 - DNA, 20 bp, human
ggggacggtgtagtgagttc

SEQ ID NO: 324330 - DNA, 20 bp, human
ggcgcaagcgcacttccctc

SEQ ID NO: 324331 - DNA, 20 bp, human
gaacagtaacggtctcctat

SEQ ID NO: 324332 - DNA, 20 bp, human
gcgcagtgacccgagcggag

SEQ ID NO: 324333 - DNA, 20 bp, human
gcgcgcggaatcccacgctt

SEQ ID NO: 324334 - DNA, 20 bp, human
gggaacgcaagctagcgctt

SEQ ID NO: 324335 - DNA, 20 bp, human
ggccgtaaacggccattcaa

SEQ ID NO: 324336 - DNA, 20 bp, human
gggcttctgctgcgctgcga

SEQ ID NO: 324337 - DNA, 20 bp, human
gaaacagcccggggccgcgg

SEQ ID NO: 324338 - DNA, 20 bp, human
gcgggcggaaaaaaattatg

SEQ ID NO: 324339 - DNA, 20 bp, human
ggggccgaacgagcacggac

SEQ ID NO: 324340 - DNA, 20 bp, human
ggcagcgcagcagaagccac

SEQ ID NO: 324341 - DNA, 20 bp, human
gtgaccgccatgtttgaagc

SEQ ID NO: 324342 - DNA, 20 bp, human
gccagtcggcaggtctgagg

SEQ ID NO: 324343 - DNA, 20 bp, human
gacctcaaggcaaagcccgt

SEQ ID NO: 324344 - DNA, 20 bp, human
gagacaaaagagcccgacaa

SEQ ID NO: 324345 - DNA, 20 bp, human
gcccgtggggcagctgggtc

SEQ ID NO: 324346 - DNA, 20 bp, human
gcgctcgctgagtgcgggga

SEQ ID NO: 324347 - DNA, 20 bp, human
gccggcggcggagtccaggt

SEQ ID NO: 324348 - DNA, 20 bp, human
gcaggcgcggggaacaccaa

SEQ ID NO: 324349 - DNA, 20 bp, human
gcctgcccctggagacctga

SEQ ID NO: 324350 - DNA, 20 bp, human
gcactcagcgagcgcgacag

SEQ ID NO: 324351 - DNA, 20 bp, human
gccgaggccaggaccgagga

SEQ ID NO: 324352 - DNA, 20 bp, human
gctcccggggaactgcgacc

SEQ ID NO: 324353 - DNA, 20 bp, human
ggcgcggggaacaccaatgg

SEQ ID NO: 324354 - DNA, 20 bp, human
ggggcgccctcaggtctcca

SEQ ID NO: 324355 - DNA, 20 bp, human
gcggtcgccttcctcggtcc

SEQ ID NO: 324356 - DNA, 20 bp, human
ggggctctgtggagagtcgc

SEQ ID NO: 324357 - DNA, 20 bp, human
gcaggcgcttcgcactcctg

SEQ ID NO: 324358 - DNA, 20 bp, human
gccgcagcgcgcaacgcctg

SEQ ID NO: 324359 - DNA, 20 bp, human
ggaaccggggcgaggggcca

SEQ ID NO: 324360 - DNA, 20 bp, human
ggcgaggtgaagcgcattct

SEQ ID NO: 324361 - DNA, 20 bp, human
ggagcccacccgcttctgcg

SEQ ID NO: 324362 - DNA, 20 bp, human
ggggctgaggggcgaggaac

SEQ ID NO: 324363 - DNA, 20 bp, human
gggcgaggaaccggggcgag

SEQ ID NO: 324364 - DNA, 20 bp, human
gctcgggggcagacggcaga

SEQ ID NO: 324365 - DNA, 20 bp, human
ggggggcagacggcagacgg

SEQ ID NO: 324366 - DNA, 20 bp, human
ggcgaggcgcgtcagccagt

SEQ ID NO: 324367 - DNA, 20 bp, human
gcgcccccgacaagcgagtg

SEQ ID NO: 324368 - DNA, 20 bp, human
ggacaagcgagtggggtctg

SEQ ID NO: 324369 - DNA, 20 bp, human
ggaccccactcgcttgtcgg

SEQ ID NO: 324370 - DNA, 20 bp, human
gtcgtgcagcgcggtgggga

SEQ ID NO: 324371 - DNA, 20 bp, human
gggggtctgtggacagtcgc

SEQ ID NO: 324372 - DNA, 20 bp, human
gtctcggcccccaggggtgc

SEQ ID NO: 324373 - DNA, 20 bp, human
gcctccctccgccgccgggt

SEQ ID NO: 324374 - DNA, 20 bp, human
gtcgctcaaaccctacccgg

SEQ ID NO: 324375 - DNA, 20 bp, human
gaggcgccccgcacccctgg

SEQ ID NO: 324376 - DNA, 20 bp, human
ggttgtgcgcaagggagaag

SEQ ID NO: 324377 - DNA, 20 bp, human
ggggagagatcgcggtctaa

SEQ ID NO: 324378 - DNA, 20 bp, human
ggagaaggggtggagattgg

SEQ ID NO: 324379 - DNA, 20 bp, human
gagatcgcggtctaaaggat

SEQ ID NO: 324380 - DNA, 20 bp, human
gctcccttgcgcacaacctg

SEQ ID NO: 324381 - DNA, 20 bp, human
gagaacgtggtgcaggcgat

SEQ ID NO: 324382 - DNA, 20 bp, human
gcccacccccggatctccac

SEQ ID NO: 324383 - DNA, 20 bp, human
ggtgatgtgtagatagaacg

SEQ ID NO: 324384 - DNA, 20 bp, human
gggggcccccgcggttttat

SEQ ID NO: 324385 - DNA, 20 bp, human
gggtggaagtgtttgggagc

SEQ ID NO: 324386 - DNA, 20 bp, human
gcccagagtgcatctctagg

SEQ ID NO: 324387 - DNA, 20 bp, human
gctggggagaggatgaagca

SEQ ID NO: 324388 - DNA, 20 bp, human
gagcagcaatggtccctcca

SEQ ID NO: 324389 - DNA, 20 bp, human
ggaattgtagttcagttccc

SEQ ID NO: 324390 - DNA, 20 bp, human
gacggcttccgttccctgga

SEQ ID NO: 324391 - DNA, 20 bp, human
gttcaacggcttccgttccc

SEQ ID NO: 324392 - DNA, 20 bp, human
ggagaggatgaagcaggggt

SEQ ID NO: 324393 - DNA, 20 bp, human
gtgcatctctaggaggattc

SEQ ID NO: 324394 - DNA, 20 bp, human
gtcctcctagagatgcactc

SEQ ID NO: 324395 - DNA, 20 bp, human
gaagagaactactgtatcct

SEQ ID NO: 324396 - DNA, 20 bp, human
gggaagccgcgcaggcacgt

SEQ ID NO: 324397 - DNA, 20 bp, human
ggaggcgcgcggcacccgac

SEQ ID NO: 324398 - DNA, 20 bp, human
ggcgcgcggcacccgacagg

SEQ ID NO: 324399 - DNA, 20 bp, human
gctcgcaggtgccacctgtc

SEQ ID NO: 324400 - DNA, 20 bp, human
gccgcccgaaggctcctgtc

SEQ ID NO: 324401 - DNA, 20 bp, human
gcgacgcccacgtgcctgcg

SEQ ID NO: 324402 - DNA, 20 bp, human
gcggatgcctccccactctg

SEQ ID NO: 324403 - DNA, 20 bp, human
gcaggcacgtgggcgtcgcc

SEQ ID NO: 324404 - DNA, 20 bp, human
gccggcggccggggtcgacc

SEQ ID NO: 324405 - DNA, 20 bp, human
gcgaaggctcctgtcgggac

SEQ ID NO: 324406 - DNA, 20 bp, human
gcgccctcgcggggagagat

SEQ ID NO: 324407 - DNA, 20 bp, human
ggcaccgcggacagctggag

SEQ ID NO: 324408 - DNA, 20 bp, human
ggtgcgtaatgcgtcgcgga

SEQ ID NO: 324409 - DNA, 20 bp, human
gtcgcggagggctatcaggt

SEQ ID NO: 324410 - DNA, 20 bp, human
gcggcctctccagctgtccg

SEQ ID NO: 324411 - DNA, 20 bp, human
gagccaatctctccccgcga

SEQ ID NO: 324412 - DNA, 20 bp, human
gagaatgtgcagtggtgccg

SEQ ID NO: 324413 - DNA, 20 bp, human
gtgggagtggataggctgac

SEQ ID NO: 324414 - DNA, 20 bp, human
gaggcacgctgcccttcgga

SEQ ID NO: 324415 - DNA, 20 bp, human
gggcgctctcgctttgattt

SEQ ID NO: 324416 - DNA, 20 bp, human
ggggccttgcagcaccgccc

SEQ ID NO: 324417 - DNA, 20 bp, human
gagggcggggcttgcagacc

SEQ ID NO: 324418 - DNA, 20 bp, human
gtgcgggaggcagctaatca

SEQ ID NO: 324419 - DNA, 20 bp, human
gccagggcccaggaacccta

SEQ ID NO: 324420 - DNA, 20 bp, human
gtgggccctggacttcaacc

SEQ ID NO: 324421 - DNA, 20 bp, human
gcagaccgggttgaagtcca

SEQ ID NO: 324422 - DNA, 20 bp, human
ggctgctttcggttacccta

SEQ ID NO: 324423 - DNA, 20 bp, human
gcggggcgccgcgaccggtg

SEQ ID NO: 324424 - DNA, 20 bp, human
ggggataaggggaggaacct

SEQ ID NO: 324425 - DNA, 20 bp, human
gctgcctcccgcaccggtcg

SEQ ID NO: 324426 - DNA, 20 bp, human
gacgggagagcctagacgac

SEQ ID NO: 324427 - DNA, 20 bp, human
gtggctcaaggttgacattg

SEQ ID NO: 324428 - DNA, 20 bp, human
ggtgtgcgactattgggtga

SEQ ID NO: 324429 - DNA, 20 bp, human
ggcccagggtgtgcgactat

SEQ ID NO: 324430 - DNA, 20 bp, human
gacgcaccgcggcgctgcga

SEQ ID NO: 324431 - DNA, 20 bp, human
gtgctgcgggcggtgtgcaa

SEQ ID NO: 324432 - DNA, 20 bp, human
gctgcgaggggctcggtccc

SEQ ID NO: 324433 - DNA, 20 bp, human
ggcgggcggtgtgcaaagga

SEQ ID NO: 324434 - DNA, 20 bp, human
ggattggcgaggcacggcgg

SEQ ID NO: 324435 - DNA, 20 bp, human
gcggcggccccgcctccgac

SEQ ID NO: 324436 - DNA, 20 bp, human
gaccccgcggaacgttccgt

SEQ ID NO: 324437 - DNA, 20 bp, human
gaaagtccccggggaaataa

SEQ ID NO: 324438 - DNA, 20 bp, human
gctgtcccggcgtccggagt

SEQ ID NO: 324439 - DNA, 20 bp, human
ggatgcttacagttcagctt

SEQ ID NO: 324440 - DNA, 20 bp, human
gtagcggaggcgcctgggaa

SEQ ID NO: 324441 - DNA, 20 bp, human
gtccgtggggaagcttctct

SEQ ID NO: 324442 - DNA, 20 bp, human
gtccccacggaacgttccgc

SEQ ID NO: 324443 - DNA, 20 bp, human
ggggcccccttctgccgacc

SEQ ID NO: 324444 - DNA, 20 bp, human
gggtgtgcatagtgctgtag

SEQ ID NO: 324445 - DNA, 20 bp, human
ggcctcctgggagccggacc

SEQ ID NO: 324446 - DNA, 20 bp, human
ggcgccgcgcagcctatcag

SEQ ID NO: 324447 - DNA, 20 bp, human
gcggggccgccctggaactg

SEQ ID NO: 324448 - DNA, 20 bp, human
gaagccgggcggggtccgct

SEQ ID NO: 324449 - DNA, 20 bp, human
gaactgggggggcacgggtc

SEQ ID NO: 324450 - DNA, 20 bp, human
gcggcccgcggcattcaccg

SEQ ID NO: 324451 - DNA, 20 bp, human
gcggaagcgcacgcgagctc

SEQ ID NO: 324452 - DNA, 20 bp, human
gagcgcacgggactgacagg

SEQ ID NO: 324453 - DNA, 20 bp, human
gtcaccgtcgcctaccccgg

SEQ ID NO: 324454 - DNA, 20 bp, human
gcccgcggcattcaccgagg

SEQ ID NO: 324455 - DNA, 20 bp, human
gctgacaggcggcagaagcc

SEQ ID NO: 324456 - DNA, 20 bp, human
gccagctagggcactctcgc

SEQ ID NO: 324457 - DNA, 20 bp, human
ggtgaatgacaaacggtcgc

SEQ ID NO: 324458 - DNA, 20 bp, human
ggggcactctcgcgggacaa

SEQ ID NO: 324459 - DNA, 20 bp, human
gggccccagtgcactcgagg

SEQ ID NO: 324460 - DNA, 20 bp, human
gtgggaggggcacccgagca

SEQ ID NO: 324461 - DNA, 20 bp, human
gacggcgcctgcctgtggga

SEQ ID NO: 324462 - DNA, 20 bp, human
gagggagagaggacattcga

SEQ ID NO: 324463 - DNA, 20 bp, human
gcgcgggacaatgggtgtca

SEQ ID NO: 324464 - DNA, 20 bp, human
gctgggccccagtgcactcg

SEQ ID NO: 324465 - DNA, 20 bp, human
gcaaaagcaggaatgcttaa

SEQ ID NO: 324466 - DNA, 20 bp, human
gttccctcaagcggaacgat

SEQ ID NO: 324467 - DNA, 20 bp, human
gggaacgattggctgaaggt

SEQ ID NO: 324468 - DNA, 20 bp, human
gcctctggaagaccaatcag

SEQ ID NO: 324469 - DNA, 20 bp, human
gagccaatcgttccgcttga

SEQ ID NO: 324470 - DNA, 20 bp, human
gacagcgcgggcgttcgaac

SEQ ID NO: 324471 - DNA, 20 bp, human
gaagcggaacgattggctga

SEQ ID NO: 324472 - DNA, 20 bp, human
gtgggcccatcaatagaatt

SEQ ID NO: 324473 - DNA, 20 bp, human
gagaggtctgaagaaaccgt

SEQ ID NO: 324474 - DNA, 20 bp, human
ggatcttcgacccgcctcaa

SEQ ID NO: 324475 - DNA, 20 bp, human
gtccttggatgcccattggt

SEQ ID NO: 324476 - DNA, 20 bp, human
gtggtgcttcccattgggta

SEQ ID NO: 324477 - DNA, 20 bp, human
gggccgggaaacacgataaa

SEQ ID NO: 324478 - DNA, 20 bp, human
gagaaggcggaacctatacc

SEQ ID NO: 324479 - DNA, 20 bp, human
gtttcccggccctacccaat

SEQ ID NO: 324480 - DNA, 20 bp, human
ggaagcaccaaagtaagaga

SEQ ID NO: 324481 - DNA, 20 bp, human
ggcaggaagtagaggggcgg

SEQ ID NO: 324482 - DNA, 20 bp, human
gcgggagttgcagtaccctc

SEQ ID NO: 324483 - DNA, 20 bp, human
gccaccagcaattggcccac

SEQ ID NO: 324484 - DNA, 20 bp, human
ggccgccacgcagaggtcta

SEQ ID NO: 324485 - DNA, 20 bp, human
gctctggcggcaggaagtag

SEQ ID NO: 324486 - DNA, 20 bp, human
gggaccgggcggaagcgtcg

SEQ ID NO: 324487 - DNA, 20 bp, human
gccccgcagggtggtccggg

SEQ ID NO: 324488 - DNA, 20 bp, human
ggcggcggggacaaacctcc

SEQ ID NO: 324489 - DNA, 20 bp, human
ggacgtgccgacggaccggg

SEQ ID NO: 324490 - DNA, 20 bp, human
gcggggcgcaccagcgatct

SEQ ID NO: 324491 - DNA, 20 bp, human
gagcgctgggtgggagtata

SEQ ID NO: 324492 - DNA, 20 bp, human
gccgccccgacgcttccgcc

SEQ ID NO: 324493 - DNA, 20 bp, human
gacgcttccgcccggtccgt

SEQ ID NO: 324494 - DNA, 20 bp, human
ggaaaagccgcgtggaaagg

SEQ ID NO: 324495 - DNA, 20 bp, human
gccgccgcggtcgaggatcc

SEQ ID NO: 324496 - DNA, 20 bp, human
gcgtaggcgtagaactggtg

SEQ ID NO: 324497 - DNA, 20 bp, human
gggcagcgtaggcgtagaac

SEQ ID NO: 324498 - DNA, 20 bp, human
ggtccagccgcgcaagtctg

SEQ ID NO: 324499 - DNA, 20 bp, human
ggaactggtggggtgcgcgg

SEQ ID NO: 324500 - DNA, 20 bp, human
gtccaccgcgcgaactggga

SEQ ID NO: 324501 - DNA, 20 bp, human
ggagagggacgcgcgactcc

SEQ ID NO: 324502 - DNA, 20 bp, human
ggaccgctcggtctccgctc

SEQ ID NO: 324503 - DNA, 20 bp, human
ggagataagaacagcggcgc

SEQ ID NO: 324504 - DNA, 20 bp, human
gggccggagcggagaccgag

SEQ ID NO: 324505 - DNA, 20 bp, human
gccgggggagataagaacag

SEQ ID NO: 324506 - DNA, 20 bp, human
ggggacctcggccgcccggt

SEQ ID NO: 324507 - DNA, 20 bp, human
gggctccagcgccagtccca

SEQ ID NO: 324508 - DNA, 20 bp, human
ggcactcccgggctggagtt

SEQ ID NO: 324509 - DNA, 20 bp, human
gtgggtgggtaggtgtggcg

SEQ ID NO: 324510 - DNA, 20 bp, human
gcggggagaggcgagagtga

SEQ ID NO: 324511 - DNA, 20 bp, human
gcccgcccaccgggcggccg

SEQ ID NO: 324512 - DNA, 20 bp, human
ggaggccttgggactggcgc

SEQ ID NO: 324513 - DNA, 20 bp, human
gggggaggcggggcgcatgt

SEQ ID NO: 324514 - DNA, 20 bp, human
ggggcacggtcatcccacgc

SEQ ID NO: 324515 - DNA, 20 bp, human
gcgtgcagagaccattgcaa

SEQ ID NO: 324516 - DNA, 20 bp, human
gggcgcccagagttccggga

SEQ ID NO: 324517 - DNA, 20 bp, human
gcgtgcgtttagggcgaaga

SEQ ID NO: 324518 - DNA, 20 bp, human
gccgggtcagcgtgcgttta

SEQ ID NO: 324519 - DNA, 20 bp, human
gtgggcgcgcaccctccttc

SEQ ID NO: 324520 - DNA, 20 bp, human
gtctacggatgccggaagga

SEQ ID NO: 324521 - DNA, 20 bp, human
ggggccggcgcccagagttc

SEQ ID NO: 324522 - DNA, 20 bp, human
ggaccgagaaaaggaagcgg

SEQ ID NO: 324523 - DNA, 20 bp, human
ggggttctacggatgccgga

SEQ ID NO: 324524 - DNA, 20 bp, human
gctcgcggtgctaaaaggat

SEQ ID NO: 324525 - DNA, 20 bp, human
gagctcggcgggcacttccg

SEQ ID NO: 324526 - DNA, 20 bp, human
gccggggcagaagtcagcga

SEQ ID NO: 324527 - DNA, 20 bp, human
gagtgcacagcgtggtggga

SEQ ID NO: 324528 - DNA, 20 bp, human
ggcggggcaaattgctgaga

SEQ ID NO: 324529 - DNA, 20 bp, human
gactcaggggattacggcgc

SEQ ID NO: 324530 - DNA, 20 bp, human
ggggcaacggacgaattaag

SEQ ID NO: 324531 - DNA, 20 bp, human
ggcaacctccgggactctga

SEQ ID NO: 324532 - DNA, 20 bp, human
gtaccctcagagttgagctg

SEQ ID NO: 324533 - DNA, 20 bp, human
gggggcgcaacctgaggggc

SEQ ID NO: 324534 - DNA, 20 bp, human
gactctgcagagctatgcca

SEQ ID NO: 324535 - DNA, 20 bp, human
gtgaagcgcgcacattgagt

SEQ ID NO: 324536 - DNA, 20 bp, human
gcgaggcggggtggtgtctg

SEQ ID NO: 324537 - DNA, 20 bp, human
ggtgcgagatctgggatcgg

SEQ ID NO: 324538 - DNA, 20 bp, human
gaggcgcggggcgggactta

SEQ ID NO: 324539 - DNA, 20 bp, human
ggcggtgcgagatctgggat

SEQ ID NO: 324540 - DNA, 20 bp, human
ggcggggcggtgcgagatct

SEQ ID NO: 324541 - DNA, 20 bp, human
gagaggcgggacttgaggtg

SEQ ID NO: 324542 - DNA, 20 bp, human
gggtgtctggggcggagaca

SEQ ID NO: 324543 - DNA, 20 bp, human
gggggcttatagccagaggc

SEQ ID NO: 324544 - DNA, 20 bp, human
ggggcttagagcacgaggcg

SEQ ID NO: 324545 - DNA, 20 bp, human
ggggatcggaggccgggatc

SEQ ID NO: 324546 - DNA, 20 bp, human
gccaccgaggccccgtctcc

SEQ ID NO: 324547 - DNA, 20 bp, human
gtgggactgggtctgttcgg

SEQ ID NO: 324548 - DNA, 20 bp, human
ggcgtcggggggcctcagtg

SEQ ID NO: 324549 - DNA, 20 bp, human
ggtgggacggggtccgttag

SEQ ID NO: 324550 - DNA, 20 bp, human
gacggggcctcggtgggact

SEQ ID NO: 324551 - DNA, 20 bp, human
ggacactgagggcgcgggat

SEQ ID NO: 324552 - DNA, 20 bp, human
ggtggggtgggtctgttcgt

SEQ ID NO: 324553 - DNA, 20 bp, human
ggggtgggtctgttcgtggg

SEQ ID NO: 324554 - DNA, 20 bp, human
gtgcagagcggcagcggcgt

SEQ ID NO: 324555 - DNA, 20 bp, human
gtcagctttcggagggaccc

SEQ ID NO: 324556 - DNA, 20 bp, human
gcaggcttacttggggacgc

SEQ ID NO: 324557 - DNA, 20 bp, human
gtgcgcagactgggaagtct

SEQ ID NO: 324558 - DNA, 20 bp, human
gaagtctgggaagtcggaga

SEQ ID NO: 324559 - DNA, 20 bp, human
gagtctgcgcaggcttactt

SEQ ID NO: 324560 - DNA, 20 bp, human
ggaactggaacgggaataag

SEQ ID NO: 324561 - DNA, 20 bp, human
gagcaaaggtcgtgcgttgc

SEQ ID NO: 324562 - DNA, 20 bp, human
gactaccaagaaagtgtcag

SEQ ID NO: 324563 - DNA, 20 bp, human
gccggccgcgggtatctgat

SEQ ID NO: 324564 - DNA, 20 bp, human
gctcccgttcgggaacccaa

SEQ ID NO: 324565 - DNA, 20 bp, human
gacgcagagagaaagttacg

SEQ ID NO: 324566 - DNA, 20 bp, human
gatccgtcgcggttggacgt

SEQ ID NO: 324567 - DNA, 20 bp, human
gagcccacgtccaaccgcga

SEQ ID NO: 324568 - DNA, 20 bp, human
gggcggaagtcacgcagaga

SEQ ID NO: 324569 - DNA, 20 bp, human
gtgggagcaccgcggtttcg

SEQ ID NO: 324570 - DNA, 20 bp, human
ggggcgggacttccagtagg

SEQ ID NO: 324571 - DNA, 20 bp, human
ggcccaaccggcatccgtcg

SEQ ID NO: 324572 - DNA, 20 bp, human
ggacgtgggcttggcggaat

SEQ ID NO: 324573 - DNA, 20 bp, human
gacgccagctccgcgagcaa

SEQ ID NO: 324574 - DNA, 20 bp, human
gcgcggagctggcgtcgagt

SEQ ID NO: 324575 - DNA, 20 bp, human
gtcaagagacgccaggcagg

SEQ ID NO: 324576 - DNA, 20 bp, human
gcggcagggccggtccgatc

SEQ ID NO: 324577 - DNA, 20 bp, human
gtggatagggttgacgttcg

SEQ ID NO: 324578 - DNA, 20 bp, human
ggcgggattctttttggata

SEQ ID NO: 324579 - DNA, 20 bp, human
ggcaagagacctgatcggac

SEQ ID NO: 324580 - DNA, 20 bp, human
gaaggcccgcggaacagcgg

SEQ ID NO: 324581 - DNA, 20 bp, human
gaacagcggaggacgaagag

SEQ ID NO: 324582 - DNA, 20 bp, human
gcgaagaatggcaggtttcc

SEQ ID NO: 324583 - DNA, 20 bp, human
gggtctcttgccatccgcgg

SEQ ID NO: 324584 - DNA, 20 bp, human
ggttccgcgggccttgaagc

SEQ ID NO: 324585 - DNA, 20 bp, human
ggagacgccgccgcttacca

SEQ ID NO: 324586 - DNA, 20 bp, human
gtgaggttgcacagggtaag

SEQ ID NO: 324587 - DNA, 20 bp, human
gtgcacagggtaagtggcgt

SEQ ID NO: 324588 - DNA, 20 bp, human
ggctcctgattgttggagtg

SEQ ID NO: 324589 - DNA, 20 bp, human
ggcggcagcggcgaagggga

SEQ ID NO: 324590 - DNA, 20 bp, human
gcggccctgtgaggttgcac

SEQ ID NO: 324591 - DNA, 20 bp, human
gggcgttggccaggcggcag

SEQ ID NO: 324592 - DNA, 20 bp, human
ggccaggcggcagcggcgaa

SEQ ID NO: 324593 - DNA, 20 bp, human
gtaccctgtgcaacctcaca

SEQ ID NO: 324594 - DNA, 20 bp, human
gagtgctgacgttgaaggcc

SEQ ID NO: 324595 - DNA, 20 bp, human
gagggtaagtggcgttggcc

SEQ ID NO: 324596 - DNA, 20 bp, human
gatggtaaatagctccctga

SEQ ID NO: 324597 - DNA, 20 bp, human
gataaatcagtatctgtggg

SEQ ID NO: 324598 - DNA, 20 bp, human
gtagctccctgatggcaagt

SEQ ID NO: 324599 - DNA, 20 bp, human
gtttgtgattgtggcccaaa

SEQ ID NO: 324600 - DNA, 20 bp, human
gctaaatggtacatgaaacg

SEQ ID NO: 324601 - DNA, 20 bp, human
gcacttctgctgtgtaaacg

SEQ ID NO: 324602 - DNA, 20 bp, human
gaaggatgcagtgatgcact

SEQ ID NO: 324603 - DNA, 20 bp, human
gaagacatctgtctacttgt

SEQ ID NO: 324604 - DNA, 20 bp, human
ggtgaaaccaacttgccatc

SEQ ID NO: 324605 - DNA, 20 bp, human
gattcagatgactggttcac

SEQ ID NO: 324606 - DNA, 20 bp, human
gtgggacgccaagactggag

SEQ ID NO: 324607 - DNA, 20 bp, human
ggggaccttcagtttgtcag

SEQ ID NO: 324608 - DNA, 20 bp, human
ggaagcgactgcgggtgagt

SEQ ID NO: 324609 - DNA, 20 bp, human
gggcagtgggacgccaagac

SEQ ID NO: 324610 - DNA, 20 bp, human
gctaggggacaagagatcta

SEQ ID NO: 324611 - DNA, 20 bp, human
ggaccccggcctgtacttga

SEQ ID NO: 324612 - DNA, 20 bp, human
gtatggcgcctgccgggttg

SEQ ID NO: 324613 - DNA, 20 bp, human
gacaggccggggtccggaag

SEQ ID NO: 324614 - DNA, 20 bp, human
gttggcgtcccactgcctca

SEQ ID NO: 324615 - DNA, 20 bp, human
gctggagaggaagcgactgc

SEQ ID NO: 324616 - DNA, 20 bp, human
ggggcggtaaagagcgatga

SEQ ID NO: 324617 - DNA, 20 bp, human
ggcaagagacgtgacggtta

SEQ ID NO: 324618 - DNA, 20 bp, human
gaggacgctccaggtccggg

SEQ ID NO: 324619 - DNA, 20 bp, human
ggtaaagagcgatgacgggc

SEQ ID NO: 324620 - DNA, 20 bp, human
gccgggtttaggaaaagggg

SEQ ID NO: 324621 - DNA, 20 bp, human
gcccaagctttagttgtaat

SEQ ID NO: 324622 - DNA, 20 bp, human
gtccgggcgggggcgaatac

SEQ ID NO: 324623 - DNA, 20 bp, human
gagggtgggcctgttgtcat

SEQ ID NO: 324624 - DNA, 20 bp, human
gtatactaaaccaatcagag

SEQ ID NO: 324625 - DNA, 20 bp, human
gggcagctctcctctctgat

SEQ ID NO: 324626 - DNA, 20 bp, human
gaggatgtggcaacagtgat

SEQ ID NO: 324627 - DNA, 20 bp, human
ggggatgtcacatctgtgat

SEQ ID NO: 324628 - DNA, 20 bp, human
gagaccagcaagaggatcat

SEQ ID NO: 324629 - DNA, 20 bp, human
ggagttagaagtaagtcatt

SEQ ID NO: 324630 - DNA, 20 bp, human
gtaaattagagactgcatgg

SEQ ID NO: 324631 - DNA, 20 bp, human
gctcccaatgatcctcttgc

SEQ ID NO: 324632 - DNA, 20 bp, human
gacttctaactcacaggatg

SEQ ID NO: 324633 - DNA, 20 bp, human
gttctcccctagctcctaga

SEQ ID NO: 324634 - DNA, 20 bp, human
gtagaaggaacccttttatg

SEQ ID NO: 324635 - DNA, 20 bp, human
gttattgactatataatggc

SEQ ID NO: 324636 - DNA, 20 bp, human
gagcccaggccaggacggac

SEQ ID NO: 324637 - DNA, 20 bp, human
gaggactcggcgatgttcat

SEQ ID NO: 324638 - DNA, 20 bp, human
ggggtcttcaggccaagggg

SEQ ID NO: 324639 - DNA, 20 bp, human
gcccggaacggaatcctccc

SEQ ID NO: 324640 - DNA, 20 bp, human
gcggaccgggggaaaggact

SEQ ID NO: 324641 - DNA, 20 bp, human
gcagctcgggactggccaat

SEQ ID NO: 324642 - DNA, 20 bp, human
ggactggccaatgggcgtgg

SEQ ID NO: 324643 - DNA, 20 bp, human
gaccgccccgccacgcccat

SEQ ID NO: 324644 - DNA, 20 bp, human
gcgggactggccaatgggcg

SEQ ID NO: 324645 - DNA, 20 bp, human
ggggttagcgggaagatttg

SEQ ID NO: 324646 - DNA, 20 bp, human
gccaccgggcgtgcacctgt

SEQ ID NO: 324647 - DNA, 20 bp, human
gacccacagaaaaggggtag

SEQ ID NO: 324648 - DNA, 20 bp, human
gggccctgggttctcctact

SEQ ID NO: 324649 - DNA, 20 bp, human
gttcccagtaggagaaccca

SEQ ID NO: 324650 - DNA, 20 bp, human
gcagcctacaggtgcacgcc

SEQ ID NO: 324651 - DNA, 20 bp, human
gaagcggccgcagggcgtct

SEQ ID NO: 324652 - DNA, 20 bp, human
gtgggcgtggaacaggccct

SEQ ID NO: 324653 - DNA, 20 bp, human
gaacgcaaccaggaacacat

SEQ ID NO: 324654 - DNA, 20 bp, human
ggtgcacgcccggtgggcgc

SEQ ID NO: 324655 - DNA, 20 bp, human
ggatagagatccccgaggtg

SEQ ID NO: 324656 - DNA, 20 bp, human
gggcgggatcgtgacgttaa

SEQ ID NO: 324657 - DNA, 20 bp, human
gggtgcccagtcagcgaggt

SEQ ID NO: 324658 - DNA, 20 bp, human
gtcagcgaggtaggtcggga

SEQ ID NO: 324659 - DNA, 20 bp, human
gctgcagtgccgagcttcca

SEQ ID NO: 324660 - DNA, 20 bp, human
gggctcccgcgggttgtggt

SEQ ID NO: 324661 - DNA, 20 bp, human
ggggatcgtgacgttaaggg

SEQ ID NO: 324662 - DNA, 20 bp, human
gaggtcgggaaggcagccgg

SEQ ID NO: 324663 - DNA, 20 bp, human
ggaactaccagtgtgaaaag

SEQ ID NO: 324664 - DNA, 20 bp, human
gccagtcagcgaggtaggtc

SEQ ID NO: 324665 - DNA, 20 bp, human
gtcaaacgcaatggctcccg

SEQ ID NO: 324666 - DNA, 20 bp, human
gggaacgcggcttctcggaa

SEQ ID NO: 324667 - DNA, 20 bp, human
gggacggggaaggagatctc

SEQ ID NO: 324668 - DNA, 20 bp, human
ggcgctgtgcgcacagggga

SEQ ID NO: 324669 - DNA, 20 bp, human
gcatgatgatgcaaatgcgt

SEQ ID NO: 324670 - DNA, 20 bp, human
ggtaataggcgcaacggcgg

SEQ ID NO: 324671 - DNA, 20 bp, human
gcatgctgcgacgagctgat

SEQ ID NO: 324672 - DNA, 20 bp, human
gggcttctcggaaaggaaga

SEQ ID NO: 324673 - DNA, 20 bp, human
gctggtcgagtccacgctct

SEQ ID NO: 324674 - DNA, 20 bp, human
gccagaatgtcgtcactcat

SEQ ID NO: 324675 - DNA, 20 bp, human
ggtagttcaacaacggaacg

SEQ ID NO: 324676 - DNA, 20 bp, human
ggctgctgatgctttcgagg

SEQ ID NO: 324677 - DNA, 20 bp, human
gggaacctgaccaacctcct

SEQ ID NO: 324678 - DNA, 20 bp, human
ggaagaggaagctgttggga

SEQ ID NO: 324679 - DNA, 20 bp, human
gggtgtggcagggtaaaatt

SEQ ID NO: 324680 - DNA, 20 bp, human
ggatggggttggatagggtg

SEQ ID NO: 324681 - DNA, 20 bp, human
gtcctcttcccaggccagaa

SEQ ID NO: 324682 - DNA, 20 bp, human
ggggtaggttatttagggaa

SEQ ID NO: 324683 - DNA, 20 bp, human
gggagggggctagaggttgt

SEQ ID NO: 324684 - DNA, 20 bp, human
ggaactggaagacgccgttc

SEQ ID NO: 324685 - DNA, 20 bp, human
ggagggaggagggatacggt

SEQ ID NO: 324686 - DNA, 20 bp, human
ggggaggcagactctatctg

SEQ ID NO: 324687 - DNA, 20 bp, human
ggggctcagtcgaccaggag

SEQ ID NO: 324688 - DNA, 20 bp, human
gcggctggaacgcctccgga

SEQ ID NO: 324689 - DNA, 20 bp, human
gtggccggctggaacgcctc

SEQ ID NO: 324690 - DNA, 20 bp, human
ggcttccaccgggagaatga

SEQ ID NO: 324691 - DNA, 20 bp, human
gccgaaaggccgggactccc

SEQ ID NO: 324692 - DNA, 20 bp, human
ggctccggcccttcgttgcg

SEQ ID NO: 324693 - DNA, 20 bp, human
gagaaaagagcaccgccctc

SEQ ID NO: 324694 - DNA, 20 bp, human
gccaggaggggcgaggtccg

SEQ ID NO: 324695 - DNA, 20 bp, human
gggtggaagcctcgcaacga

SEQ ID NO: 324696 - DNA, 20 bp, human
ggcggctgtaactgtgagga

SEQ ID NO: 324697 - DNA, 20 bp, human
ggccggctcctcacctcttt

SEQ ID NO: 324698 - DNA, 20 bp, human
gcacgtgggcatggcgtctg

SEQ ID NO: 324699 - DNA, 20 bp, human
gctgaggggcccgaagtcta

SEQ ID NO: 324700 - DNA, 20 bp, human
gcgtctacgccgtaggttgg

SEQ ID NO: 324701 - DNA, 20 bp, human
gcgggggcgagcggtcacgt

SEQ ID NO: 324702 - DNA, 20 bp, human
gttacagccgcccccgctgc

SEQ ID NO: 324703 - DNA, 20 bp, human
gtcgtcacgtgacgttgccg

SEQ ID NO: 324704 - DNA, 20 bp, human
ggcccacgctccgggtccgg

SEQ ID NO: 324705 - DNA, 20 bp, human
gccatcttggcaccgccccg

SEQ ID NO: 324706 - DNA, 20 bp, human
gggacctcgtgtctctgaag

SEQ ID NO: 324707 - DNA, 20 bp, human
gtgcactacacgatgaacgt

SEQ ID NO: 324708 - DNA, 20 bp, human
gtcatcgtgtagtgcatcct

SEQ ID NO: 324709 - DNA, 20 bp, human
ggcatggaggccccgggaaa

SEQ ID NO: 324710 - DNA, 20 bp, human
gcacgatgaacgtcggatcg

SEQ ID NO: 324711 - DNA, 20 bp, human
gctccacgctgggccgtccc

SEQ ID NO: 324712 - DNA, 20 bp, human
gaaggctccagaatctgctc

SEQ ID NO: 324713 - DNA, 20 bp, human
gcaaccacttcagagacacg

SEQ ID NO: 324714 - DNA, 20 bp, human
gtcccattcaaataaggcga

SEQ ID NO: 324715 - DNA, 20 bp, human
ggccctcgccttatttgaat

SEQ ID NO: 324716 - DNA, 20 bp, human
gcctgagcgcgggaactctg

SEQ ID NO: 324717 - DNA, 20 bp, human
gagttcccgcgctcaggccc

SEQ ID NO: 324718 - DNA, 20 bp, human
ggccccgcgtccctgcgcga

SEQ ID NO: 324719 - DNA, 20 bp, human
ggcggggcgagggccgtcgg

SEQ ID NO: 324720 - DNA, 20 bp, human
gggccctcgcgcagggacgc

SEQ ID NO: 324721 - DNA, 20 bp, human
gcccgggcccccggagctga

SEQ ID NO: 324722 - DNA, 20 bp, human
gccgccaggggcaaatacca

SEQ ID NO: 324723 - DNA, 20 bp, human
gcccagcccggccctcgcgc

SEQ ID NO: 324724 - DNA, 20 bp, human
gctcccccttgggacttcta

SEQ ID NO: 324725 - DNA, 20 bp, human
gacccacggtcagcaaggaa

SEQ ID NO: 324726 - DNA, 20 bp, human
ggacgtcagcagagggggat

SEQ ID NO: 324727 - DNA, 20 bp, human
gcacctcaaactctcttaaa

SEQ ID NO: 324728 - DNA, 20 bp, human
gggctgatggagctgtgagc

SEQ ID NO: 324729 - DNA, 20 bp, human
gaggcgtgacgtcagcagag

SEQ ID NO: 324730 - DNA, 20 bp, human
gaacagctcgactttgtcaa

SEQ ID NO: 324731 - DNA, 20 bp, human
ggcttcttgctcggatgtgt

SEQ ID NO: 324732 - DNA, 20 bp, human
gtgacgtcacgcctgtggat

SEQ ID NO: 324733 - DNA, 20 bp, human
ggctccatcagccaatccac

SEQ ID NO: 324734 - DNA, 20 bp, human
gagccctttaagagagtttg

SEQ ID NO: 324735 - DNA, 20 bp, human
gcttcagcaagccaatataa

SEQ ID NO: 324736 - DNA, 20 bp, human
gcagcccgagctggccaatg

SEQ ID NO: 324737 - DNA, 20 bp, human
gctggctgcgaaggcgggag

SEQ ID NO: 324738 - DNA, 20 bp, human
ggcggcaccaggaccatcca

SEQ ID NO: 324739 - DNA, 20 bp, human
ggccagctcgggctgagtag

SEQ ID NO: 324740 - DNA, 20 bp, human
gtccggccgccgctccccat

SEQ ID NO: 324741 - DNA, 20 bp, human
gctcgggctgagtagtggcg

SEQ ID NO: 324742 - DNA, 20 bp, human
gaagcccgcgctggctgcga

SEQ ID NO: 324743 - DNA, 20 bp, human
gcggcggccggaagaacgcg

SEQ ID NO: 324744 - DNA, 20 bp, human
ggcggcttcgctaggttccg

SEQ ID NO: 324745 - DNA, 20 bp, human
gtgacgtcaagcttggtcag

SEQ ID NO: 324746 - DNA, 20 bp, human
gtaacggcgtgctaccttat

SEQ ID NO: 324747 - DNA, 20 bp, human
ggtagcacgccgttacccgt

SEQ ID NO: 324748 - DNA, 20 bp, human
gaaggtggcgaaccagcgta

SEQ ID NO: 324749 - DNA, 20 bp, human
gcgctggttcgccaccttcc

SEQ ID NO: 324750 - DNA, 20 bp, human
gaaacgctccccacgggtaa

SEQ ID NO: 324751 - DNA, 20 bp, human
gtgcgctatgcttaagttgt

SEQ ID NO: 324752 - DNA, 20 bp, human
gtatggggttgcgtaacttc

SEQ ID NO: 324753 - DNA, 20 bp, human
gaagggtttttgcaccggga

SEQ ID NO: 324754 - DNA, 20 bp, human
gtgaccgatgatagagcact

SEQ ID NO: 324755 - DNA, 20 bp, human
gtttgcgctgagaatttccg

SEQ ID NO: 324756 - DNA, 20 bp, human
ggcgagacttacgtgattag

SEQ ID NO: 324757 - DNA, 20 bp, human
ggcgggagggcatcccgttg

SEQ ID NO: 324758 - DNA, 20 bp, human
gacactgaagagtacgtctt

SEQ ID NO: 324759 - DNA, 20 bp, human
gaggtttgaactgtattcag

SEQ ID NO: 324760 - DNA, 20 bp, human
gtcactgcaccataatactt

SEQ ID NO: 324761 - DNA, 20 bp, human
gcgagcctggttgggcctgg

SEQ ID NO: 324762 - DNA, 20 bp, human
gcggtcgtagcaaagtgccg

SEQ ID NO: 324763 - DNA, 20 bp, human
gatggagctggtaggtcctg

SEQ ID NO: 324764 - DNA, 20 bp, human
ggggctgccgcgacgcgctg

SEQ ID NO: 324765 - DNA, 20 bp, human
gaatacagttcaaacctcgc

SEQ ID NO: 324766 - DNA, 20 bp, human
gagggttccgcgggaagagg

SEQ ID NO: 324767 - DNA, 20 bp, human
ggactttaggacggagacgg

SEQ ID NO: 324768 - DNA, 20 bp, human
gcagtgacctgcaactgctt

SEQ ID NO: 324769 - DNA, 20 bp, human
gtgggactttaggacggaga

SEQ ID NO: 324770 - DNA, 20 bp, human
gcttcccgcggaaccctgat

SEQ ID NO: 324771 - DNA, 20 bp, human
ggctgctctgtgagatgggt

SEQ ID NO: 324772 - DNA, 20 bp, human
gcgcggaaccctgattggat

SEQ ID NO: 324773 - DNA, 20 bp, human
gagtcagtacctagactgag

SEQ ID NO: 324774 - DNA, 20 bp, human
gagcaaaggcaagagcgctt

SEQ ID NO: 324775 - DNA, 20 bp, human
gtctcgtcgatagccagtgt

SEQ ID NO: 324776 - DNA, 20 bp, human
gggcgccggctacgagatca

SEQ ID NO: 324777 - DNA, 20 bp, human
gctccctggaaaccggcgcg

SEQ ID NO: 324778 - DNA, 20 bp, human
gtggggcgtcggctcacgtg

SEQ ID NO: 324779 - DNA, 20 bp, human
gccgaccttgatctcgtagc

SEQ ID NO: 324780 - DNA, 20 bp, human
gcagccgcgctttggggcgt

SEQ ID NO: 324781 - DNA, 20 bp, human
ggagccgacgccccaaagcg

SEQ ID NO: 324782 - DNA, 20 bp, human
gggcgcatgcgccgcgtaag

SEQ ID NO: 324783 - DNA, 20 bp, human
gcgcatcgccggcccctcag

SEQ ID NO: 324784 - DNA, 20 bp, human
gggcgccagcagccgcgctt

SEQ ID NO: 324785 - DNA, 20 bp, human
gaaggggcccggccggcgga

SEQ ID NO: 324786 - DNA, 20 bp, human
gaaggcgccaagggcgtagg

SEQ ID NO: 324787 - DNA, 20 bp, human
gcccccagccagctcacttc

SEQ ID NO: 324788 - DNA, 20 bp, human
gaagcccaccggaagtgagc

SEQ ID NO: 324789 - DNA, 20 bp, human
gccaccggaagtgagctggc

SEQ ID NO: 324790 - DNA, 20 bp, human
gcggaaggcgccaagggcgt

SEQ ID NO: 324791 - DNA, 20 bp, human
gtaggaggtgggtggttgtg

SEQ ID NO: 324792 - DNA, 20 bp, human
gcgccaagggcgtaggaggt

SEQ ID NO: 324793 - DNA, 20 bp, human
gcacagcatgtgaagcccac

SEQ ID NO: 324794 - DNA, 20 bp, human
gtcccggccggactgagaag

SEQ ID NO: 324795 - DNA, 20 bp, human
gtggcgccttccggcctctt

SEQ ID NO: 324796 - DNA, 20 bp, human
gggcgcagaagtagtacggt

SEQ ID NO: 324797 - DNA, 20 bp, human
gccccagggctccctaaaga

SEQ ID NO: 324798 - DNA, 20 bp, human
gactgggcccggggccgggt

SEQ ID NO: 324799 - DNA, 20 bp, human
gagtctagaactctcccacc

SEQ ID NO: 324800 - DNA, 20 bp, human
ggcctgagcactccagggga

SEQ ID NO: 324801 - DNA, 20 bp, human
gagtcgcgagcggggaatca

SEQ ID NO: 324802 - DNA, 20 bp, human
gcggggaatcacggtcgcgc

SEQ ID NO: 324803 - DNA, 20 bp, human
gaccctcccctggagtgctc

SEQ ID NO: 324804 - DNA, 20 bp, human
gcagaggcaaccctctaagt

SEQ ID NO: 324805 - DNA, 20 bp, human
gagggccacgagctgcgaaa

SEQ ID NO: 324806 - DNA, 20 bp, human
gaacccggaggttggcaggt

SEQ ID NO: 324807 - DNA, 20 bp, human
gaagtcaagcgggaacccgg

SEQ ID NO: 324808 - DNA, 20 bp, human
gcaagcgggaacccggaggt

SEQ ID NO: 324809 - DNA, 20 bp, human
gcgggaacccggaggttggc

SEQ ID NO: 324810 - DNA, 20 bp, human
ggcgaccagtgaccctgacc

SEQ ID NO: 324811 - DNA, 20 bp, human
ggtctcatctgagactgcac

SEQ ID NO: 324812 - DNA, 20 bp, human
ggggaaaactgaccaaggtg

SEQ ID NO: 324813 - DNA, 20 bp, human
ggacctggacgcgctcggat

SEQ ID NO: 324814 - DNA, 20 bp, human
ggtggctatcagaaaaacta

SEQ ID NO: 324815 - DNA, 20 bp, human
gaccctgacctggacgcgct

SEQ ID NO: 324816 - DNA, 20 bp, human
gcaggcctcccgctcagagc

SEQ ID NO: 324817 - DNA, 20 bp, human
ggggacaccctggtgccgag

SEQ ID NO: 324818 - DNA, 20 bp, human
gggtgcgaatgcgcgtgcgt

SEQ ID NO: 324819 - DNA, 20 bp, human
gctggtgccgagcggagaaa

SEQ ID NO: 324820 - DNA, 20 bp, human
ggaggggcaggaggaccccg

SEQ ID NO: 324821 - DNA, 20 bp, human
gtctgagtgcagtcagtcct

SEQ ID NO: 324822 - DNA, 20 bp, human
gtgcacgcgtccttccttcc

SEQ ID NO: 324823 - DNA, 20 bp, human
gtggcgtcgacagcaaatca

SEQ ID NO: 324824 - DNA, 20 bp, human
gggggcggcggcacttgggt

SEQ ID NO: 324825 - DNA, 20 bp, human
gccgcctgatcctgttagcg

SEQ ID NO: 324826 - DNA, 20 bp, human
gaggccagcccaccaagcag

SEQ ID NO: 324827 - DNA, 20 bp, human
gcaagcaggggcgtcaccaa

SEQ ID NO: 324828 - DNA, 20 bp, human
gaggctcgtgccaggtcggg

SEQ ID NO: 324829 - DNA, 20 bp, human
ggacggcccggaagctcgag

SEQ ID NO: 324830 - DNA, 20 bp, human
ggagaggctcgtgccaggtc

SEQ ID NO: 324831 - DNA, 20 bp, human
gggacgagaagtcaacataa

SEQ ID NO: 324832 - DNA, 20 bp, human
gagctcgagaggctcgtgcc

SEQ ID NO: 324833 - DNA, 20 bp, human
gggccgaaacagtgagtgga

SEQ ID NO: 324834 - DNA, 20 bp, human
ggtgccaggtcggggggcga

SEQ ID NO: 324835 - DNA, 20 bp, human
gaatcaccgagcagacggcc

SEQ ID NO: 324836 - DNA, 20 bp, human
gtggcccaggggtgacggtt

SEQ ID NO: 324837 - DNA, 20 bp, human
ggggccaaaccgtcacccct

SEQ ID NO: 324838 - DNA, 20 bp, human
ggaactttatggagacccgt

SEQ ID NO: 324839 - DNA, 20 bp, human
ggctcccagaagccctcgcg

SEQ ID NO: 324840 - DNA, 20 bp, human
gttggccaatcaggaagcgg

SEQ ID NO: 324841 - DNA, 20 bp, human
ggagccgactctaaccaagt

SEQ ID NO: 324842 - DNA, 20 bp, human
gcgtgggggaggacaagaac

SEQ ID NO: 324843 - DNA, 20 bp, human
gagagcggcgcgagaagcgg

SEQ ID NO: 324844 - DNA, 20 bp, human
gttggcgtcgcaccgcgcga

SEQ ID NO: 324845 - DNA, 20 bp, human
ggaggacaagaacaggggcg

SEQ ID NO: 324846 - DNA, 20 bp, human
gacacagggcctctcgaagt

SEQ ID NO: 324847 - DNA, 20 bp, human
gcaccggcggggtgtcggga

SEQ ID NO: 324848 - DNA, 20 bp, human
gggagctcgggccaatcaga

SEQ ID NO: 324849 - DNA, 20 bp, human
gacgctcccgccaaccgcgg

SEQ ID NO: 324850 - DNA, 20 bp, human
gggaggggcagaaggagttc

SEQ ID NO: 324851 - DNA, 20 bp, human
gtccgccggcgctgctggga

SEQ ID NO: 324852 - DNA, 20 bp, human
gccttggagcgccgcgactc

SEQ ID NO: 324853 - DNA, 20 bp, human
gtcgcggcgctccaaggaag

SEQ ID NO: 324854 - DNA, 20 bp, human
ggacacgctcccgccaaccg

SEQ ID NO: 324855 - DNA, 20 bp, human
gcagagggacggccccagaa

SEQ ID NO: 324856 - DNA, 20 bp, human
gagccctggtacgtgagtgg

SEQ ID NO: 324857 - DNA, 20 bp, human
ggtcccccactcacgtacca

SEQ ID NO: 324858 - DNA, 20 bp, human
ggagccgcgcaaggtacgct

SEQ ID NO: 324859 - DNA, 20 bp, human
ggctgggaccaggcgagaat

SEQ ID NO: 324860 - DNA, 20 bp, human
gggtcccagcgtaccttgcg

SEQ ID NO: 324861 - DNA, 20 bp, human
ggtactgcctaatctcttaa

SEQ ID NO: 324862 - DNA, 20 bp, human
gatgagccctggtacgtgag

SEQ ID NO: 324863 - DNA, 20 bp, human
gaccagggctcattgcgtga

SEQ ID NO: 324864 - DNA, 20 bp, human
gcctaatctcttaaaggagt

SEQ ID NO: 324865 - DNA, 20 bp, human
gtgacggttacacttccggc

SEQ ID NO: 324866 - DNA, 20 bp, human
gggcactgccgggtgagagg

SEQ ID NO: 324867 - DNA, 20 bp, human
ggggcgccgaggttgcctta

SEQ ID NO: 324868 - DNA, 20 bp, human
gtgaacggttacgtgaagac

SEQ ID NO: 324869 - DNA, 20 bp, human
gagacggtaaaacttagctt

SEQ ID NO: 324870 - DNA, 20 bp, human
gcgctcttctcaagtcctat

SEQ ID NO: 324871 - DNA, 20 bp, human
gcacactcaaagcgtcagag

SEQ ID NO: 324872 - DNA, 20 bp, human
gggcagtgccatgagacgca

SEQ ID NO: 324873 - DNA, 20 bp, human
gagggcctcggactacagga

SEQ ID NO: 324874 - DNA, 20 bp, human
gccggaggcgcgtttgaccc

SEQ ID NO: 324875 - DNA, 20 bp, human
gtgaccccggtgcagggcct

SEQ ID NO: 324876 - DNA, 20 bp, human
gtgaagccctcgatcaggtg

SEQ ID NO: 324877 - DNA, 20 bp, human
gagaagcgggacctcctcta

SEQ ID NO: 324878 - DNA, 20 bp, human
ggtgagttgggctggactca

SEQ ID NO: 324879 - DNA, 20 bp, human
ggcatcagacagggcctgat

SEQ ID NO: 324880 - DNA, 20 bp, human
gtgtgccagggacaagtcag

SEQ ID NO: 324881 - DNA, 20 bp, human
gggccagattgcatcagaca

SEQ ID NO: 324882 - DNA, 20 bp, human
gccaggtgaagccctcgatc

SEQ ID NO: 324883 - DNA, 20 bp, human
gtctgggctaaaacactcgt

SEQ ID NO: 324884 - DNA, 20 bp, human
gcatggcctcacctgatcga

SEQ ID NO: 324885 - DNA, 20 bp, human
gtggccgtcatcccaggccc

SEQ ID NO: 324886 - DNA, 20 bp, human
gcaggctggggtgatgtagt

SEQ ID NO: 324887 - DNA, 20 bp, human
ggttaccaggctgcactcca

SEQ ID NO: 324888 - DNA, 20 bp, human
gcagcaacaacaggacctgg

SEQ ID NO: 324889 - DNA, 20 bp, human
gttcgacgacgtcacagtgg

SEQ ID NO: 324890 - DNA, 20 bp, human
gcgtcgaaggtccgcctctg

SEQ ID NO: 324891 - DNA, 20 bp, human
gaggaaactatgttcaggcg

SEQ ID NO: 324892 - DNA, 20 bp, human
gtacctcagtctcgcaggct

SEQ ID NO: 324893 - DNA, 20 bp, human
ggttcaggcgcggcggaggt

SEQ ID NO: 324894 - DNA, 20 bp, human
gttctccttggagtgcagcc

SEQ ID NO: 324895 - DNA, 20 bp, human
gaaaataggaaactatgttc

SEQ ID NO: 324896 - DNA, 20 bp, human
ggcgccccctggtcgcgtgg

SEQ ID NO: 324897 - DNA, 20 bp, human
gacccgggacttgtctgaat

SEQ ID NO: 324898 - DNA, 20 bp, human
gggcgcccgcggtatcggcc

SEQ ID NO: 324899 - DNA, 20 bp, human
gggcgatgagcgaacgaccc

SEQ ID NO: 324900 - DNA, 20 bp, human
gtcccattcagacaagtccc

SEQ ID NO: 324901 - DNA, 20 bp, human
gcgggcgccccctggtcgcg

SEQ ID NO: 324902 - DNA, 20 bp, human
ggcccgttccggcgcagtga

SEQ ID NO: 324903 - DNA, 20 bp, human
gcgccctccacgcgaccagg

SEQ ID NO: 324904 - DNA, 20 bp, human
ggcacgcctgcgaactagcc

SEQ ID NO: 324905 - DNA, 20 bp, human
gaggggacccggcgtccctt

SEQ ID NO: 324906 - DNA, 20 bp, human
ggggcctgtaacgcctgttc

SEQ ID NO: 324907 - DNA, 20 bp, human
gcgaatacgcaggcgccaaa

SEQ ID NO: 324908 - DNA, 20 bp, human
gttacctgaacaggcgttac

SEQ ID NO: 324909 - DNA, 20 bp, human
gaaaaaagcgcgcctctgtt

SEQ ID NO: 324910 - DNA, 20 bp, human
gaacgtgagcgatgccgcag

SEQ ID NO: 324911 - DNA, 20 bp, human
gcgtcctcattggacatcat

SEQ ID NO: 324912 - DNA, 20 bp, human
gacagctcctgcgtcctcat

SEQ ID NO: 324913 - DNA, 20 bp, human
gggtaacgagtgcgcggact

SEQ ID NO: 324914 - DNA, 20 bp, human
gaaaggaaggcgccggctgc

SEQ ID NO: 324915 - DNA, 20 bp, human
gagcgcgcctctgttgggac

SEQ ID NO: 324916 - DNA, 20 bp, human
gacacggcccgcagcgcggg

SEQ ID NO: 324917 - DNA, 20 bp, human
ggctagaccacaattctcag

SEQ ID NO: 324918 - DNA, 20 bp, human
gccaacctctagtgttccag

SEQ ID NO: 324919 - DNA, 20 bp, human
gggcaagcccctgagaattg

SEQ ID NO: 324920 - DNA, 20 bp, human
gcgctcatgccggaaagggg

SEQ ID NO: 324921 - DNA, 20 bp, human
gcctccgcgcatagcacgcc

SEQ ID NO: 324922 - DNA, 20 bp, human
gccgcccagtctgtgcactg

SEQ ID NO: 324923 - DNA, 20 bp, human
ggtggtctagcggaagcctc

SEQ ID NO: 324924 - DNA, 20 bp, human
gttggcgccaggctagggtc

SEQ ID NO: 324925 - DNA, 20 bp, human
gagaggttggcgccaggcta

SEQ ID NO: 324926 - DNA, 20 bp, human
gaccgaggtggggaagaacc

SEQ ID NO: 324927 - DNA, 20 bp, human
gagaaagtccagaaccgagg

SEQ ID NO: 324928 - DNA, 20 bp, human
ggagaaaacagggtgtaaat

SEQ ID NO: 324929 - DNA, 20 bp, human
gaccagaaagtccagaaccg

SEQ ID NO: 324930 - DNA, 20 bp, human
ggagttacctagctgggtgc

SEQ ID NO: 324931 - DNA, 20 bp, human
gttcttccccacctcggttc

SEQ ID NO: 324932 - DNA, 20 bp, human
gggcgagaaatgtagatggg

SEQ ID NO: 324933 - DNA, 20 bp, human
gaaaatgagtcgcgcggtcc

SEQ ID NO: 324934 - DNA, 20 bp, human
ggagtgggtgaggtcatacg

SEQ ID NO: 324935 - DNA, 20 bp, human
gtacgtggagttacctagct

SEQ ID NO: 324936 - DNA, 20 bp, human
gccctgctccacttggactc

SEQ ID NO: 324937 - DNA, 20 bp, human
gcaggaggatctgctgagtc

SEQ ID NO: 324938 - DNA, 20 bp, human
gtggcaaccaactgaaccaa

SEQ ID NO: 324939 - DNA, 20 bp, human
ggccagtaggcaagaacctg

SEQ ID NO: 324940 - DNA, 20 bp, human
gcaagaacctgaggttccct

SEQ ID NO: 324941 - DNA, 20 bp, human
gggataatttgcatataaac

SEQ ID NO: 324942 - DNA, 20 bp, human
gtgtgttgctgccatccagt

SEQ ID NO: 324943 - DNA, 20 bp, human
ggtgggcagccgggcttggc

SEQ ID NO: 324944 - DNA, 20 bp, human
gtgctccacttggactcagg

SEQ ID NO: 324945 - DNA, 20 bp, human
gagacagtgtgcgcctcttt

SEQ ID NO: 324946 - DNA, 20 bp, human
ggtggccagagaaaagaggt

SEQ ID NO: 324947 - DNA, 20 bp, human
ggccagagaaaagaggtggg

SEQ ID NO: 324948 - DNA, 20 bp, human
gtgtggtggccagagaaaag

SEQ ID NO: 324949 - DNA, 20 bp, human
gtcctcccacctcttttctc

SEQ ID NO: 324950 - DNA, 20 bp, human
gaagagaggaaccacattac

SEQ ID NO: 324951 - DNA, 20 bp, human
gggaaagatgaaaaagaatc

SEQ ID NO: 324952 - DNA, 20 bp, human
gtgattgcataatatatctc

SEQ ID NO: 324953 - DNA, 20 bp, human
gtacctacagaaataaagag

SEQ ID NO: 324954 - DNA, 20 bp, human
gaattgctagaatgagatgt

SEQ ID NO: 324955 - DNA, 20 bp, human
gaatacatgaaagaacatag

SEQ ID NO: 324956 - DNA, 20 bp, human
gccctgctccacttggactc

SEQ ID NO: 324957 - DNA, 20 bp, human
ggccagtaggcaagaacctg

SEQ ID NO: 324958 - DNA, 20 bp, human
gcaggaggatctgctgagtc

SEQ ID NO: 324959 - DNA, 20 bp, human
gtggcaaccaactgaaccaa

SEQ ID NO: 324960 - DNA, 20 bp, human
gcaagaacctgaggttccct

SEQ ID NO: 324961 - DNA, 20 bp, human
gggataatttgcatataaac

SEQ ID NO: 324962 - DNA, 20 bp, human
ggtgggcagccgggcttggc

SEQ ID NO: 324963 - DNA, 20 bp, human
gtgtgttgctgccatccagt

SEQ ID NO: 324964 - DNA, 20 bp, human
gtgctccacttggactcagg

SEQ ID NO: 324965 - DNA, 20 bp, human
ggtgaagggctctggccagt

SEQ ID NO: 324966 - DNA, 20 bp, human
gtgaacgcgctcaactttat

SEQ ID NO: 324967 - DNA, 20 bp, human
gtgtgcggagacgctgtcaa

SEQ ID NO: 324968 - DNA, 20 bp, human
gcccgccgggcgaaccaggt

SEQ ID NO: 324969 - DNA, 20 bp, human
gtgggcaggcctgcaaaata

SEQ ID NO: 324970 - DNA, 20 bp, human
gcctaccccggcgcggtgtg

SEQ ID NO: 324971 - DNA, 20 bp, human
gaagttgagcgcgttcaaag

SEQ ID NO: 324972 - DNA, 20 bp, human
gtgggaggaagttcctaccc

SEQ ID NO: 324973 - DNA, 20 bp, human
gaaggggtcctaatcttcca

SEQ ID NO: 324974 - DNA, 20 bp, human
gtcaaccgggggcctcgtag

SEQ ID NO: 324975 - DNA, 20 bp, human
ggcggcgggcaacccctacg

SEQ ID NO: 324976 - DNA, 20 bp, human
gaaagcgattgtttgcacta

SEQ ID NO: 324977 - DNA, 20 bp, human
gttgctgggagaattgggca

SEQ ID NO: 324978 - DNA, 20 bp, human
gcaggggcttgtcttccggg

SEQ ID NO: 324979 - DNA, 20 bp, human
gtagccaggggcttgtcttc

SEQ ID NO: 324980 - DNA, 20 bp, human
gaagttactaggatagccag

SEQ ID NO: 324981 - DNA, 20 bp, human
ggtctcttggggtaataatg

SEQ ID NO: 324982 - DNA, 20 bp, human
gacgaggagccgtatcagcc

SEQ ID NO: 324983 - DNA, 20 bp, human
gtcccagttgctgggagaat

SEQ ID NO: 324984 - DNA, 20 bp, human
gtagactcctctggggaaat

SEQ ID NO: 324985 - DNA, 20 bp, human
ggcattcagcccagacttag

SEQ ID NO: 324986 - DNA, 20 bp, human
gcgcgcgccgctgacgtccc

SEQ ID NO: 324987 - DNA, 20 bp, human
gccgccgcccggagaaagcg

SEQ ID NO: 324988 - DNA, 20 bp, human
gacctgaacttgcggaaccc

SEQ ID NO: 324989 - DNA, 20 bp, human
gcacttaaggccgtcgttcg

SEQ ID NO: 324990 - DNA, 20 bp, human
ggggccgcgctttctccggg

SEQ ID NO: 324991 - DNA, 20 bp, human
ggctgccagggcagcgtcag

SEQ ID NO: 324992 - DNA, 20 bp, human
gggccccgcccctcgaacga

SEQ ID NO: 324993 - DNA, 20 bp, human
gttccgcaagttcaggtctt

SEQ ID NO: 324994 - DNA, 20 bp, human
gcgtcagcggacagatgaaa

SEQ ID NO: 324995 - DNA, 20 bp, human
gcgcaagttcaggtcttggg

SEQ ID NO: 324996 - DNA, 20 bp, human
ggggaagcaaagcagccatg

SEQ ID NO: 324997 - DNA, 20 bp, human
gatggggcagctgaaagaaa

SEQ ID NO: 324998 - DNA, 20 bp, human
gagacgggtaagattcctca

SEQ ID NO: 324999 - DNA, 20 bp, human
gggcccctgtaggattgtgg

SEQ ID NO: 325000 - DNA, 20 bp, human
gcacccccacaatcctacag

SEQ ID NO: 325001 - DNA, 20 bp, human
ggaaccctcacaccttctga

SEQ ID NO: 325002 - DNA, 20 bp, human
gcatccaccggggccaaaca

SEQ ID NO: 325003 - DNA, 20 bp, human
gtgagggttcaggcccctgt

SEQ ID NO: 325004 - DNA, 20 bp, human
gcccacgcccagttcagatc

SEQ ID NO: 325005 - DNA, 20 bp, human
gcctccctcagaaggtgtga

SEQ ID NO: 325006 - DNA, 20 bp, human
gtacaaatgaagaaccaaca

SEQ ID NO: 325007 - DNA, 20 bp, human
gtggaattttgtagccctgt

SEQ ID NO: 325008 - DNA, 20 bp, human
gaagagaggggagatcatca

SEQ ID NO: 325009 - DNA, 20 bp, human
gcctacctgtgacacaagat

SEQ ID NO: 325010 - DNA, 20 bp, human
gggtgccttggaaaccaaga

SEQ ID NO: 325011 - DNA, 20 bp, human
gggctgagatagacgtaagg

SEQ ID NO: 325012 - DNA, 20 bp, human
gcaccccgctaccctggaaa

SEQ ID NO: 325013 - DNA, 20 bp, human
gagaggggagatcatcaggg

SEQ ID NO: 325014 - DNA, 20 bp, human
ggggaagtaccattgtagcc

SEQ ID NO: 325015 - DNA, 20 bp, human
ggagcctgggcgggagggta

SEQ ID NO: 325016 - DNA, 20 bp, human
gaggcagaggttgcatgaga

SEQ ID NO: 325017 - DNA, 20 bp, human
gtatggagatgattggtcaa

SEQ ID NO: 325018 - DNA, 20 bp, human
gctggggctcgggggacggg

SEQ ID NO: 325019 - DNA, 20 bp, human
gcgtcccccgagccccagga

SEQ ID NO: 325020 - DNA, 20 bp, human
ggaggggcaggaaggattgt

SEQ ID NO: 325021 - DNA, 20 bp, human
gctggctccgcctcccagta

SEQ ID NO: 325022 - DNA, 20 bp, human
ggtggggagaggacttcaat

SEQ ID NO: 325023 - DNA, 20 bp, human
gggagtgtgtgaggtggaaa

SEQ ID NO: 325024 - DNA, 20 bp, human
gggagatgattggtcaaagg

SEQ ID NO: 325025 - DNA, 20 bp, human
gcaatcatctccatactggg

SEQ ID NO: 325026 - DNA, 20 bp, human
gaggagacctacgacgagaa

SEQ ID NO: 325027 - DNA, 20 bp, human
gcatattcccttctcgtcgt

SEQ ID NO: 325028 - DNA, 20 bp, human
gttccaaggcttaaagatga

SEQ ID NO: 325029 - DNA, 20 bp, human
gagccatcatctttaagcct

SEQ ID NO: 325030 - DNA, 20 bp, human
gtggctctgagacatactct

SEQ ID NO: 325031 - DNA, 20 bp, human
gcaggtagggtcgaaagctc

SEQ ID NO: 325032 - DNA, 20 bp, human
gggcgtgttcacttccaagc

SEQ ID NO: 325033 - DNA, 20 bp, human
gagcctctattgctataaga

SEQ ID NO: 325034 - DNA, 20 bp, human
gtagggtcgaaagctctgga

SEQ ID NO: 325035 - DNA, 20 bp, human
gctataagaaggcagacctg

SEQ ID NO: 325036 - DNA, 20 bp, human
gaggcagaggttgcatgaga

SEQ ID NO: 325037 - DNA, 20 bp, human
gtatggagatgattggtcaa

SEQ ID NO: 325038 - DNA, 20 bp, human
gctggggctcgggggacggg

SEQ ID NO: 325039 - DNA, 20 bp, human
gcgtcccccgagccccagga

SEQ ID NO: 325040 - DNA, 20 bp, human
ggaggggcaggaaggattgt

SEQ ID NO: 325041 - DNA, 20 bp, human
ggtggggagaggacttcaat

SEQ ID NO: 325042 - DNA, 20 bp, human
gctggctccgcctcccagta

SEQ ID NO: 325043 - DNA, 20 bp, human
gggagtgtgtgaggtggaaa

SEQ ID NO: 325044 - DNA, 20 bp, human
gggagatgattggtcaaagg

SEQ ID NO: 325045 - DNA, 20 bp, human
gaggcgggtgggagtgtgtg

SEQ ID NO: 325046 - DNA, 20 bp, human
gaggagacctacgacgagaa

SEQ ID NO: 325047 - DNA, 20 bp, human
gcatattcccttctcgtcgt

SEQ ID NO: 325048 - DNA, 20 bp, human
gcaggtagggtcgaaagctc

SEQ ID NO: 325049 - DNA, 20 bp, human
gtggctctgagacatactct

SEQ ID NO: 325050 - DNA, 20 bp, human
gttccaaggcttaaagatga

SEQ ID NO: 325051 - DNA, 20 bp, human
gtagggtcgaaagctctgga

SEQ ID NO: 325052 - DNA, 20 bp, human
gagcctctattgctataaga

SEQ ID NO: 325053 - DNA, 20 bp, human
gagccatcatctttaagcct

SEQ ID NO: 325054 - DNA, 20 bp, human
gctataagaaggcagacctg

SEQ ID NO: 325055 - DNA, 20 bp, human
gggcgtgttcacttccaagc

SEQ ID NO: 325056 - DNA, 20 bp, human
gtacaaatgaagaaccaaca

SEQ ID NO: 325057 - DNA, 20 bp, human
gtggaattttgtagccctgt

SEQ ID NO: 325058 - DNA, 20 bp, human
gaagagaggggagatcatca

SEQ ID NO: 325059 - DNA, 20 bp, human
gcaccccgctaccctggaaa

SEQ ID NO: 325060 - DNA, 20 bp, human
gggtgccttggaaaccaaga

SEQ ID NO: 325061 - DNA, 20 bp, human
gcctacctgtgacacaagat

SEQ ID NO: 325062 - DNA, 20 bp, human
ggcaagcagagcctcaccat

SEQ ID NO: 325063 - DNA, 20 bp, human
gagaggggagatcatcaggg

SEQ ID NO: 325064 - DNA, 20 bp, human
ggggaagtaccattgtagcc

SEQ ID NO: 325065 - DNA, 20 bp, human
gggctgagatagacgtaagg

SEQ ID NO: 325066 - DNA, 20 bp, human
gaggctggcagcaaactttg

SEQ ID NO: 325067 - DNA, 20 bp, human
ggtagccactcctgcaaagg

SEQ ID NO: 325068 - DNA, 20 bp, human
ggacactcctctctatgctt

SEQ ID NO: 325069 - DNA, 20 bp, human
gaaggtgctgaggcttaatg

SEQ ID NO: 325070 - DNA, 20 bp, human
gaatgtagccactcctgcaa

SEQ ID NO: 325071 - DNA, 20 bp, human
gtgttgctaaccacctttgc

SEQ ID NO: 325072 - DNA, 20 bp, human
gtacattagaaacatctccc

SEQ ID NO: 325073 - DNA, 20 bp, human
gagcaacaatcacaatcatg

SEQ ID NO: 325074 - DNA, 20 bp, human
gggggtcacccactattcca

SEQ ID NO: 325075 - DNA, 20 bp, human
gaatcacaatcatgaggcct

SEQ ID NO: 325076 - DNA, 20 bp, human
gttaccatgtctcatgttgt

SEQ ID NO: 325077 - DNA, 20 bp, human
gtagcccacaacatgagaca

SEQ ID NO: 325078 - DNA, 20 bp, human
ggtgatcggtcccttggggc

SEQ ID NO: 325079 - DNA, 20 bp, human
gaggggagaaatcctggaag

SEQ ID NO: 325080 - DNA, 20 bp, human
gaaagtgtcaacctgcccca

SEQ ID NO: 325081 - DNA, 20 bp, human
gaaggtgggagtcatttcca

SEQ ID NO: 325082 - DNA, 20 bp, human
gttgtgtgatcggtcccttg

SEQ ID NO: 325083 - DNA, 20 bp, human
ggggactggaggtgcgattt

SEQ ID NO: 325084 - DNA, 20 bp, human
gtatacggcattctgcaatt

SEQ ID NO: 325085 - DNA, 20 bp, human
gtagtagcacttttcaaaga

SEQ ID NO: 325086 - DNA, 20 bp, human
ggttagaaaaattggagcga

SEQ ID NO: 325087 - DNA, 20 bp, human
gtgcagaagaaaatagtgtc

SEQ ID NO: 325088 - DNA, 20 bp, human
ggaagaaaatagtgtctggc

SEQ ID NO: 325089 - DNA, 20 bp, human
gcccaagcacaacaagatta

SEQ ID NO: 325090 - DNA, 20 bp, human
ggccataatcttgttgtgct

SEQ ID NO: 325091 - DNA, 20 bp, human
gttgattttgtaaagaggga

SEQ ID NO: 325092 - DNA, 20 bp, human
gatttcgagtcttcacctga

SEQ ID NO: 325093 - DNA, 20 bp, human
gatttgttcttatgtttact

SEQ ID NO: 325094 - DNA, 20 bp, human
gaaattggagcgaggggttg

SEQ ID NO: 325095 - DNA, 20 bp, human
gaaagtgagagttttcaaga

SEQ ID NO: 325096 - DNA, 20 bp, human
gggcccgcgccacgcccctt

SEQ ID NO: 325097 - DNA, 20 bp, human
ggtggcgagggcagccgaag

SEQ ID NO: 325098 - DNA, 20 bp, human
gccaccgccggccgcaaacg

SEQ ID NO: 325099 - DNA, 20 bp, human
ggtgcgcggggtgactgctt

SEQ ID NO: 325100 - DNA, 20 bp, human
gctgcagcccgggaaagcgc

SEQ ID NO: 325101 - DNA, 20 bp, human
ggccacgccccgtttgcggc

SEQ ID NO: 325102 - DNA, 20 bp, human
gacgccccgtttgcggccgg

SEQ ID NO: 325103 - DNA, 20 bp, human
gccggagcggcctaagggtc

SEQ ID NO: 325104 - DNA, 20 bp, human
gagcagagcccggcccagta

SEQ ID NO: 325105 - DNA, 20 bp, human
gcgaaacgccgcactctccc

SEQ ID NO: 325106 - DNA, 20 bp, human
gaagaaaacacgtaacagat

SEQ ID NO: 325107 - DNA, 20 bp, human
gtgacctgaggggcctctaa

SEQ ID NO: 325108 - DNA, 20 bp, human
gcctgaggggcctctaaggg

SEQ ID NO: 325109 - DNA, 20 bp, human
gctgcctaaaccttgacctg

SEQ ID NO: 325110 - DNA, 20 bp, human
ggcccctcaggtcaaggttt

SEQ ID NO: 325111 - DNA, 20 bp, human
ggaggggcctctaagggcgg

SEQ ID NO: 325112 - DNA, 20 bp, human
gcctctaagggcggggggca

SEQ ID NO: 325113 - DNA, 20 bp, human
ggaggagccagtcagcagac

SEQ ID NO: 325114 - DNA, 20 bp, human
gtgttttcttaatgcgtttg

SEQ ID NO: 325115 - DNA, 20 bp, human
gtctaaagatttctatttct

SEQ ID NO: 325116 - DNA, 20 bp, human
ggggagcttgcggggaatgt

SEQ ID NO: 325117 - DNA, 20 bp, human
gcgcagttggggagcttgcg

SEQ ID NO: 325118 - DNA, 20 bp, human
gtcggcgggccgcagtgagg

SEQ ID NO: 325119 - DNA, 20 bp, human
ggggcggggcgcagtcggga

SEQ ID NO: 325120 - DNA, 20 bp, human
gcgggggcgcgggatgtcgg

SEQ ID NO: 325121 - DNA, 20 bp, human
gaggtgggcggggcgcagtc

SEQ ID NO: 325122 - DNA, 20 bp, human
gcgggccgcagtgaggggga

SEQ ID NO: 325123 - DNA, 20 bp, human
ggggcgggggcgcgggatgt

SEQ ID NO: 325124 - DNA, 20 bp, human
gacactgtcccccactgcgc

SEQ ID NO: 325125 - DNA, 20 bp, human
ggatgtgggcccagcgcagt

SEQ ID NO: 325126 - DNA, 20 bp, human
gcatgttactggtgaccctt

SEQ ID NO: 325127 - DNA, 20 bp, human
gacccagttaacagaggctg

SEQ ID NO: 325128 - DNA, 20 bp, human
gagtaacacccagttaacag

SEQ ID NO: 325129 - DNA, 20 bp, human
gacaccatgcagagaactgg

SEQ ID NO: 325130 - DNA, 20 bp, human
gagaggttttccattcccaa

SEQ ID NO: 325131 - DNA, 20 bp, human
gccttctctctccatgttac

SEQ ID NO: 325132 - DNA, 20 bp, human
gtccacagcctctgttaact

SEQ ID NO: 325133 - DNA, 20 bp, human
gaataccccaagtgactcta

SEQ ID NO: 325134 - DNA, 20 bp, human
gcccaagtgactctatggat

SEQ ID NO: 325135 - DNA, 20 bp, human
gcgtaaattggcttatcttg

SEQ ID NO: 325136 - DNA, 20 bp, human
gcatacaaaggcatgagcaa

SEQ ID NO: 325137 - DNA, 20 bp, human
gtccttctggctctgtggtg

SEQ ID NO: 325138 - DNA, 20 bp, human
gtagtcacctccacagtagc

SEQ ID NO: 325139 - DNA, 20 bp, human
ggcacgctgtggccacaaat

SEQ ID NO: 325140 - DNA, 20 bp, human
gcccagctgaatcaattctc

SEQ ID NO: 325141 - DNA, 20 bp, human
gctcaggccttcaggaaccg

SEQ ID NO: 325142 - DNA, 20 bp, human
gttcaggaaccgtggactca

SEQ ID NO: 325143 - DNA, 20 bp, human
ggaacagatcataataaggg

SEQ ID NO: 325144 - DNA, 20 bp, human
gcccacaccacagagccaga

SEQ ID NO: 325145 - DNA, 20 bp, human
ggcaggaacagatcataata

SEQ ID NO: 325146 - DNA, 20 bp, human
gcgcgccgggcggaacccac

SEQ ID NO: 325147 - DNA, 20 bp, human
ggggccagacctcgatccgc

SEQ ID NO: 325148 - DNA, 20 bp, human
gaatcgtagccgggggtcgg

SEQ ID NO: 325149 - DNA, 20 bp, human
gggaggtgaggagacgtcgc

SEQ ID NO: 325150 - DNA, 20 bp, human
gaggagttgggtcgtgagag

SEQ ID NO: 325151 - DNA, 20 bp, human
ggacccccggctacgattgg

SEQ ID NO: 325152 - DNA, 20 bp, human
gcccaactcctcgtgaactt

SEQ ID NO: 325153 - DNA, 20 bp, human
gacgattggtggagcttcgg

SEQ ID NO: 325154 - DNA, 20 bp, human
ggctccaccaatcgtagccg

SEQ ID NO: 325155 - DNA, 20 bp, human
ggcagtgtcgcgtcgcgagc

SEQ ID NO: 325156 - DNA, 20 bp, human
gagctcaagcagaggtagga

SEQ ID NO: 325157 - DNA, 20 bp, human
gtcagctccaccttaaggag

SEQ ID NO: 325158 - DNA, 20 bp, human
gtgatccaggcccctcctta

SEQ ID NO: 325159 - DNA, 20 bp, human
gtccaccttaaggaggggcc

SEQ ID NO: 325160 - DNA, 20 bp, human
gagtgacagcttgtagtcat

SEQ ID NO: 325161 - DNA, 20 bp, human
gcacttgaatcctgccaact

SEQ ID NO: 325162 - DNA, 20 bp, human
gatgaagtgctctgcatagt

SEQ ID NO: 325163 - DNA, 20 bp, human
gtccaggcccctccttaagg

SEQ ID NO: 325164 - DNA, 20 bp, human
ggaacttcaaatataacata

SEQ ID NO: 325165 - DNA, 20 bp, human
gtagttattagctcaagcag

SEQ ID NO: 325166 - DNA, 20 bp, human
gaaccagcgtctcccagact

SEQ ID NO: 325167 - DNA, 20 bp, human
gtgggaggtgtcagtagcga

SEQ ID NO: 325168 - DNA, 20 bp, human
ggccgggcgcctccgacctg

SEQ ID NO: 325169 - DNA, 20 bp, human
gacgaacagtccaggactct

SEQ ID NO: 325170 - DNA, 20 bp, human
ggagcacagaggccgagtct

SEQ ID NO: 325171 - DNA, 20 bp, human
gacagcgcccgggactccac

SEQ ID NO: 325172 - DNA, 20 bp, human
gcggccacccggggacgctc

SEQ ID NO: 325173 - DNA, 20 bp, human
ggcacccggacgaacagtcc

SEQ ID NO: 325174 - DNA, 20 bp, human
gtgggagacgctggttgagt

SEQ ID NO: 325175 - DNA, 20 bp, human
gagtcgcgtagggcggggaa

SEQ ID NO: 325176 - DNA, 20 bp, human
gcggcgggatcggatctgga

SEQ ID NO: 325177 - DNA, 20 bp, human
gcgcccggcgggatcggatc

SEQ ID NO: 325178 - DNA, 20 bp, human
gctcccgcttggccgggctt

SEQ ID NO: 325179 - DNA, 20 bp, human
gcggccaggcatccgcccgg

SEQ ID NO: 325180 - DNA, 20 bp, human
gggccaagcgggagagtcca

SEQ ID NO: 325181 - DNA, 20 bp, human
ggctcgggcgcttgggtgat

SEQ ID NO: 325182 - DNA, 20 bp, human
gggagctcgagctgccccgc

SEQ ID NO: 325183 - DNA, 20 bp, human
gcacgcgctcaccccaagcc

SEQ ID NO: 325184 - DNA, 20 bp, human
gaggaggcacccggcctctc

SEQ ID NO: 325185 - DNA, 20 bp, human
gtgccggccccctccgagga

SEQ ID NO: 325186 - DNA, 20 bp, human
gcgccaggagcgctctagtc

SEQ ID NO: 325187 - DNA, 20 bp, human
ggcgccgctggagccgaggg

SEQ ID NO: 325188 - DNA, 20 bp, human
gcaggagcgctctagtctgg

SEQ ID NO: 325189 - DNA, 20 bp, human
gaactccggaggtaccggct

SEQ ID NO: 325190 - DNA, 20 bp, human
gctctcgcccagatgtgctg

SEQ ID NO: 325191 - DNA, 20 bp, human
gtagagcgctcctggcgccc

SEQ ID NO: 325192 - DNA, 20 bp, human
gtcctcgtccctcccaccgg

SEQ ID NO: 325193 - DNA, 20 bp, human
gtgcgccccgagcgcctcga

SEQ ID NO: 325194 - DNA, 20 bp, human
gggggcgccgagcgcagatc

SEQ ID NO: 325195 - DNA, 20 bp, human
gaggagaggacggcacgcgg

SEQ ID NO: 325196 - DNA, 20 bp, human
gcacagacgcggcctctcgg

SEQ ID NO: 325197 - DNA, 20 bp, human
ggcgaagcggagggggtcga

SEQ ID NO: 325198 - DNA, 20 bp, human
gcccaggtgcgaagcggagg

SEQ ID NO: 325199 - DNA, 20 bp, human
gccctggcccaggtgcgaag

SEQ ID NO: 325200 - DNA, 20 bp, human
gcctcctgggcgcacagacg

SEQ ID NO: 325201 - DNA, 20 bp, human
gcgcgggcgggggagaaagt

SEQ ID NO: 325202 - DNA, 20 bp, human
gccggtgtgaaagtcacctt

SEQ ID NO: 325203 - DNA, 20 bp, human
gggtcgaggggctcaggcac

SEQ ID NO: 325204 - DNA, 20 bp, human
ggcccccactccaggtgcac

SEQ ID NO: 325205 - DNA, 20 bp, human
gctccgcggcgctccaatcc

SEQ ID NO: 325206 - DNA, 20 bp, human
gcctccaagcgtgtcgagtt

SEQ ID NO: 325207 - DNA, 20 bp, human
gagcgtagactgcagagggt

SEQ ID NO: 325208 - DNA, 20 bp, human
gggcgagcgtagactgcaga

SEQ ID NO: 325209 - DNA, 20 bp, human
gtgggctggggcccccgctg

SEQ ID NO: 325210 - DNA, 20 bp, human
gtgtcgagttcggaggagtc

SEQ ID NO: 325211 - DNA, 20 bp, human
gcggcacgatgctgacactg

SEQ ID NO: 325212 - DNA, 20 bp, human
gctgctgccatccccagcgg

SEQ ID NO: 325213 - DNA, 20 bp, human
gcgcgcgccaaaaagatctt

SEQ ID NO: 325214 - DNA, 20 bp, human
gtctacgctcgccctggagg

SEQ ID NO: 325215 - DNA, 20 bp, human
gaggaagccgtccatcaagg

SEQ ID NO: 325216 - DNA, 20 bp, human
gtggaccaacgaaaactcta

SEQ ID NO: 325217 - DNA, 20 bp, human
gttccggcccgcagtcccac

SEQ ID NO: 325218 - DNA, 20 bp, human
ggaggccgctaggctggaga

SEQ ID NO: 325219 - DNA, 20 bp, human
gccaaccgggccacagactc

SEQ ID NO: 325220 - DNA, 20 bp, human
gtctgggaaagtgacactcc

SEQ ID NO: 325221 - DNA, 20 bp, human
gccggcccgtctggttaggt

SEQ ID NO: 325222 - DNA, 20 bp, human
gataagaggcggtagcttcc

SEQ ID NO: 325223 - DNA, 20 bp, human
gctactccccgctctaggtg

SEQ ID NO: 325224 - DNA, 20 bp, human
gccacagactccggcccgtc

SEQ ID NO: 325225 - DNA, 20 bp, human
gggcagcgaagtcagccagt

SEQ ID NO: 325226 - DNA, 20 bp, human
ggctgggcgccggactccag

SEQ ID NO: 325227 - DNA, 20 bp, human
ggctgagaggagggattccg

SEQ ID NO: 325228 - DNA, 20 bp, human
gggctgctgctcacgtggat

SEQ ID NO: 325229 - DNA, 20 bp, human
gagggcgggcagcaaagcgt

SEQ ID NO: 325230 - DNA, 20 bp, human
gtcccagatggccacgtctc

SEQ ID NO: 325231 - DNA, 20 bp, human
gacttccgggagagaatggg

SEQ ID NO: 325232 - DNA, 20 bp, human
gggtctggctgctgctcacg

SEQ ID NO: 325233 - DNA, 20 bp, human
ggcgcccagccgtcctgcca

SEQ ID NO: 325234 - DNA, 20 bp, human
gccggactccagtggctgag

SEQ ID NO: 325235 - DNA, 20 bp, human
gtgggccgtggcaggacggc

SEQ ID NO: 325236 - DNA, 20 bp, human
gctcccgttccgtccttgga

SEQ ID NO: 325237 - DNA, 20 bp, human
gcgtgcggcgcggggccgtg

SEQ ID NO: 325238 - DNA, 20 bp, human
gcacccttccacaccctcca

SEQ ID NO: 325239 - DNA, 20 bp, human
gggaggcggggctgtctctg

SEQ ID NO: 325240 - DNA, 20 bp, human
ggagcctgcgggggcagatt

SEQ ID NO: 325241 - DNA, 20 bp, human
gcaccctccaaggacggaac

SEQ ID NO: 325242 - DNA, 20 bp, human
ggacgcccaaagaccgcgac

SEQ ID NO: 325243 - DNA, 20 bp, human
gtccgcacccagcgtcggtc

SEQ ID NO: 325244 - DNA, 20 bp, human
gcgagggtggggaacgggac

SEQ ID NO: 325245 - DNA, 20 bp, human
ggccgctcccgttccgtcct

SEQ ID NO: 325246 - DNA, 20 bp, human
gagagagagctggttgtcac

SEQ ID NO: 325247 - DNA, 20 bp, human
gagggactatgccacaagct

SEQ ID NO: 325248 - DNA, 20 bp, human
gccttgccgttcaatgcaga

SEQ ID NO: 325249 - DNA, 20 bp, human
gtcactaggcccattggaaa

SEQ ID NO: 325250 - DNA, 20 bp, human
gagctggttgtcacggggga

SEQ ID NO: 325251 - DNA, 20 bp, human
gaagctgctgctgattaatc

SEQ ID NO: 325252 - DNA, 20 bp, human
gtcctgctcactaggcccat

SEQ ID NO: 325253 - DNA, 20 bp, human
gaagcggcatcgttctactt

SEQ ID NO: 325254 - DNA, 20 bp, human
gtccaatgggcctagtgagc

SEQ ID NO: 325255 - DNA, 20 bp, human
ggcaatccgtctgcattgaa

SEQ ID NO: 325256 - DNA, 20 bp, human
gtaaaggggcgcggaggaga

SEQ ID NO: 325257 - DNA, 20 bp, human
gctgcccggggttgtagcta

SEQ ID NO: 325258 - DNA, 20 bp, human
gtctgctggatagcttaaag

SEQ ID NO: 325259 - DNA, 20 bp, human
gcggggttgtagctaggggt

SEQ ID NO: 325260 - DNA, 20 bp, human
gatagcttaaaggggcgcgg

SEQ ID NO: 325261 - DNA, 20 bp, human
gcactagcaagaggggaacg

SEQ ID NO: 325262 - DNA, 20 bp, human
ggacagagttgatccaggag

SEQ ID NO: 325263 - DNA, 20 bp, human
gacggagacagagttgatcc

SEQ ID NO: 325264 - DNA, 20 bp, human
gttcccctcttgctagtgga

SEQ ID NO: 325265 - DNA, 20 bp, human
gaaagggttaaggtagagta

SEQ ID NO: 325266 - DNA, 20 bp, human
gtcaggctacatattgcttg

SEQ ID NO: 325267 - DNA, 20 bp, human
ggcccggggataaagccgat

SEQ ID NO: 325268 - DNA, 20 bp, human
gtaccaatcggctttatccc

SEQ ID NO: 325269 - DNA, 20 bp, human
gccccgggccttgaccaccc

SEQ ID NO: 325270 - DNA, 20 bp, human
ggcaatatgtagcctgaaat

SEQ ID NO: 325271 - DNA, 20 bp, human
gaggcagtgggtccaggaat

SEQ ID NO: 325272 - DNA, 20 bp, human
gggccagggtggtcaaggcc

SEQ ID NO: 325273 - DNA, 20 bp, human
gtaccagccctaaccccagt

SEQ ID NO: 325274 - DNA, 20 bp, human
gaaggcaagaggttcccact

SEQ ID NO: 325275 - DNA, 20 bp, human
ggaggttcccactggggtta

SEQ ID NO: 325276 - DNA, 20 bp, human
gcgcgcggagtcagcgaccc

SEQ ID NO: 325277 - DNA, 20 bp, human
ggcacctcgcggcccttaaa

SEQ ID NO: 325278 - DNA, 20 bp, human
ggctctccgcacttcggcgt

SEQ ID NO: 325279 - DNA, 20 bp, human
gcactgggagggtggatcgg

SEQ ID NO: 325280 - DNA, 20 bp, human
gccacactgggagggtggat

SEQ ID NO: 325281 - DNA, 20 bp, human
ggcagccgcgggccctttaa

SEQ ID NO: 325282 - DNA, 20 bp, human
ggaaggaagggatttgcccc

SEQ ID NO: 325283 - DNA, 20 bp, human
ggaggtgcgcggtctcttta

SEQ ID NO: 325284 - DNA, 20 bp, human
gccttccttccagcaggggc

SEQ ID NO: 325285 - DNA, 20 bp, human
gaggggctcacaaaacctga

SEQ ID NO: 325286 - DNA, 20 bp, human
gtggccacttggaaaggggt

SEQ ID NO: 325287 - DNA, 20 bp, human
gctcggctagcaagctagag

SEQ ID NO: 325288 - DNA, 20 bp, human
gggccgcccccgcccggtag

SEQ ID NO: 325289 - DNA, 20 bp, human
ggggtgggcagctggcaaag

SEQ ID NO: 325290 - DNA, 20 bp, human
gcggccttcgccaaagagtg

SEQ ID NO: 325291 - DNA, 20 bp, human
gccgcaggggtgtgtcctag

SEQ ID NO: 325292 - DNA, 20 bp, human
gtcgccaaagagtgtgggct

SEQ ID NO: 325293 - DNA, 20 bp, human
gctagtggccacttggaaag

SEQ ID NO: 325294 - DNA, 20 bp, human
gtaagatggccgcccccgcc

SEQ ID NO: 325295 - DNA, 20 bp, human
gccgccccgctaccgggcgg

SEQ ID NO: 325296 - DNA, 20 bp, human
gaaattcagcactgggatca

SEQ ID NO: 325297 - DNA, 20 bp, human
gttgctggctaaaggacaaa

SEQ ID NO: 325298 - DNA, 20 bp, human
gcagagttcagagaaaggct

SEQ ID NO: 325299 - DNA, 20 bp, human
gaggacaaagggtaagtttc

SEQ ID NO: 325300 - DNA, 20 bp, human
gactgagcttggactgctgt

SEQ ID NO: 325301 - DNA, 20 bp, human
ggctgcttgttgctggctaa

SEQ ID NO: 325302 - DNA, 20 bp, human
gtggtttcgtttcctcagaa

SEQ ID NO: 325303 - DNA, 20 bp, human
gtgttaaataagatttatgt

SEQ ID NO: 325304 - DNA, 20 bp, human
ggcagatgaaattcagcact

SEQ ID NO: 325305 - DNA, 20 bp, human
gtgcagtgggcatgtattgc

SEQ ID NO: 325306 - DNA, 20 bp, human
gaactcctgcatccggggca

SEQ ID NO: 325307 - DNA, 20 bp, human
gttaccaactcctgcatccg

SEQ ID NO: 325308 - DNA, 20 bp, human
gaggggctccccaaaacttg

SEQ ID NO: 325309 - DNA, 20 bp, human
gaactcttgtatccgggaca

SEQ ID NO: 325310 - DNA, 20 bp, human
gaaccttgctgcaaggggcg

SEQ ID NO: 325311 - DNA, 20 bp, human
gttggtaaactcactgcaag

SEQ ID NO: 325312 - DNA, 20 bp, human
gtcccccagcttacagatgg

SEQ ID NO: 325313 - DNA, 20 bp, human
gttggtaagctcgctgcagt

SEQ ID NO: 325314 - DNA, 20 bp, human
ggtaagctcgctgcagtggg

SEQ ID NO: 325315 - DNA, 20 bp, human
ggtggtgaccagcccttcag

SEQ ID NO: 325316 - DNA, 20 bp, human
ggcgtggcgtgaaacgggga

SEQ ID NO: 325317 - DNA, 20 bp, human
gagggaatttcccaagtttg

SEQ ID NO: 325318 - DNA, 20 bp, human
gcccgcgcgtggcgtgaaac

SEQ ID NO: 325319 - DNA, 20 bp, human
gaaggagaggaagtcgtagc

SEQ ID NO: 325320 - DNA, 20 bp, human
gtggccaggtcctaggtcct

SEQ ID NO: 325321 - DNA, 20 bp, human
gaggaagtcgtagctgggaa

SEQ ID NO: 325322 - DNA, 20 bp, human
gaggtcctcggtcccgcgcg

SEQ ID NO: 325323 - DNA, 20 bp, human
gtctgtgggtatactttgtt

SEQ ID NO: 325324 - DNA, 20 bp, human
gtatgtacccatatgttctg

SEQ ID NO: 325325 - DNA, 20 bp, human
gtacctcgctgtctgactga

SEQ ID NO: 325326 - DNA, 20 bp, human
gtagtgtttgaccccaaagg

SEQ ID NO: 325327 - DNA, 20 bp, human
gtgtgcccctactgcagcaa

SEQ ID NO: 325328 - DNA, 20 bp, human
ggggctgaggctggaatatc

SEQ ID NO: 325329 - DNA, 20 bp, human
gtatctggggccaccttaac

SEQ ID NO: 325330 - DNA, 20 bp, human
ggcaagggtgtctccaagaa

SEQ ID NO: 325331 - DNA, 20 bp, human
gagaggaaaccaggtgtgac

SEQ ID NO: 325332 - DNA, 20 bp, human
ggcaacttgcccagtaggtt

SEQ ID NO: 325333 - DNA, 20 bp, human
gggactcactagtgttcagg

SEQ ID NO: 325334 - DNA, 20 bp, human
gggagtcagcccgtcacacc

SEQ ID NO: 325335 - DNA, 20 bp, human
gagaggttagagtctggcac

SEQ ID NO: 325336 - DNA, 20 bp, human
gcgagcgcggatcgaatccg

SEQ ID NO: 325337 - DNA, 20 bp, human
gaggacgggacccacgcgat

SEQ ID NO: 325338 - DNA, 20 bp, human
gggcaggataccaatcgcgt

SEQ ID NO: 325339 - DNA, 20 bp, human
gagcggcgagggtgtcttgg

SEQ ID NO: 325340 - DNA, 20 bp, human
gggctcaggaggcgcgagcg

SEQ ID NO: 325341 - DNA, 20 bp, human
gagctcaggtacaggccggc

SEQ ID NO: 325342 - DNA, 20 bp, human
gttgatgcgcggccggaggg

SEQ ID NO: 325343 - DNA, 20 bp, human
gcgccagaggaggcgaccga

SEQ ID NO: 325344 - DNA, 20 bp, human
gacaggccggcgggctcagg

SEQ ID NO: 325345 - DNA, 20 bp, human
gagacaccctcgccgctcat

SEQ ID NO: 325346 - DNA, 20 bp, human
gccagcgcctgattggtgaa

SEQ ID NO: 325347 - DNA, 20 bp, human
gaggctctctggagattggt

SEQ ID NO: 325348 - DNA, 20 bp, human
gcctgattggtgaaagggaa

SEQ ID NO: 325349 - DNA, 20 bp, human
ggggaacgcgaccgcacgag

SEQ ID NO: 325350 - DNA, 20 bp, human
gcctgcgcgcgtccttctgg

SEQ ID NO: 325351 - DNA, 20 bp, human
gccccaaggcacgattgtgg

SEQ ID NO: 325352 - DNA, 20 bp, human
ggcccctcccagcgcctgat

SEQ ID NO: 325353 - DNA, 20 bp, human
gcaccaatcaggcgctggga

SEQ ID NO: 325354 - DNA, 20 bp, human
gggcgcgcgcagcgcgtacc

SEQ ID NO: 325355 - DNA, 20 bp, human
gcgcccccaaggcacgattg

SEQ ID NO: 325356 - DNA, 20 bp, human
gaggccatgaccaaggcggt

SEQ ID NO: 325357 - DNA, 20 bp, human
gcgcaccacggaccgatcgt

SEQ ID NO: 325358 - DNA, 20 bp, human
gcggaccgatcgtgggggta

SEQ ID NO: 325359 - DNA, 20 bp, human
ggctagggggtccgaacgaa

SEQ ID NO: 325360 - DNA, 20 bp, human
gacaccgcgcggcgctgggg

SEQ ID NO: 325361 - DNA, 20 bp, human
gcctccgcgcaggcgcacca

SEQ ID NO: 325362 - DNA, 20 bp, human
gcccacgccaacaaggaata

SEQ ID NO: 325363 - DNA, 20 bp, human
gaaactggggcccacaacaa

SEQ ID NO: 325364 - DNA, 20 bp, human
gcagcgccgcgcggtgtcct

SEQ ID NO: 325365 - DNA, 20 bp, human
ggcggtgtcctgggaaactg

SEQ ID NO: 325366 - DNA, 20 bp, human
gtaccctaatcccttatcca

SEQ ID NO: 325367 - DNA, 20 bp, human
gtcgactagtatgcatgtta

SEQ ID NO: 325368 - DNA, 20 bp, human
ggagccttggataagggatt

SEQ ID NO: 325369 - DNA, 20 bp, human
gggcactatgacatggataa

SEQ ID NO: 325370 - DNA, 20 bp, human
gggaaggggagtgtccacag

SEQ ID NO: 325371 - DNA, 20 bp, human
gaataacccaggatccttgt

SEQ ID NO: 325372 - DNA, 20 bp, human
gtgggcacaagtgctcaggc

SEQ ID NO: 325373 - DNA, 20 bp, human
gggagtcctgaggtgacata

SEQ ID NO: 325374 - DNA, 20 bp, human
gaaggatcctgggttattaa

SEQ ID NO: 325375 - DNA, 20 bp, human
gcaccactggatcagagcct

SEQ ID NO: 325376 - DNA, 20 bp, human
gtcggtggagagtaaggccc

SEQ ID NO: 325377 - DNA, 20 bp, human
gcaactctatatgtgagaag

SEQ ID NO: 325378 - DNA, 20 bp, human
gacgcagtcggtggagagta

SEQ ID NO: 325379 - DNA, 20 bp, human
ggagctcatcctgacgcagt

SEQ ID NO: 325380 - DNA, 20 bp, human
gcaaaccggaccagcctgag

SEQ ID NO: 325381 - DNA, 20 bp, human
ggcaaggcaaatagttgagg

SEQ ID NO: 325382 - DNA, 20 bp, human
gcgcgtctataagctggtgg

SEQ ID NO: 325383 - DNA, 20 bp, human
ggaaaaagctgatgccaaac

SEQ ID NO: 325384 - DNA, 20 bp, human
gcatcggcccaaagaaaacc

SEQ ID NO: 325385 - DNA, 20 bp, human
gaaagcaaggcaaatagttg

SEQ ID NO: 325386 - DNA, 20 bp, human
gctgaggcggggcacggaac

SEQ ID NO: 325387 - DNA, 20 bp, human
gcgggacttcgggagagatg

SEQ ID NO: 325388 - DNA, 20 bp, human
gcacggaacgggctggactt

SEQ ID NO: 325389 - DNA, 20 bp, human
gccggaagggccaggtctca

SEQ ID NO: 325390 - DNA, 20 bp, human
gccccgccagggaccaaccc

SEQ ID NO: 325391 - DNA, 20 bp, human
gctgctgcagcgcctcgcca

SEQ ID NO: 325392 - DNA, 20 bp, human
gcagcagaaaggaaatgcgc

SEQ ID NO: 325393 - DNA, 20 bp, human
gggcgggaggggctacaagt

SEQ ID NO: 325394 - DNA, 20 bp, human
gcagaaaggaaatgcgctgg

SEQ ID NO: 325395 - DNA, 20 bp, human
ggtgggatgaggcgggactt

SEQ ID NO: 325396 - DNA, 20 bp, human
gctgtcctctggagtcctcc

SEQ ID NO: 325397 - DNA, 20 bp, human
ggccgtgggccctccctctg

SEQ ID NO: 325398 - DNA, 20 bp, human
gcaccccgagccacagaggg

SEQ ID NO: 325399 - DNA, 20 bp, human
gaggaagaattccgagccgt

SEQ ID NO: 325400 - DNA, 20 bp, human
ggccctccctctgtggctcg

SEQ ID NO: 325401 - DNA, 20 bp, human
ggcatccaaatgcgcccact

SEQ ID NO: 325402 - DNA, 20 bp, human
gtcatccaagtgggcgcatt

SEQ ID NO: 325403 - DNA, 20 bp, human
gaagacacacgatgctgtcc

SEQ ID NO: 325404 - DNA, 20 bp, human
gtgggagggctcaggggtga

SEQ ID NO: 325405 - DNA, 20 bp, human
gtgagcccggaggactccag

SEQ ID NO: 325406 - DNA, 20 bp, human
gctgtcctctcgagtcctct

SEQ ID NO: 325407 - DNA, 20 bp, human
ggggtggtgcaaactctgga

SEQ ID NO: 325408 - DNA, 20 bp, human
gtgagcccagaggactcgag

SEQ ID NO: 325409 - DNA, 20 bp, human
gcccactcagatgagcccag

SEQ ID NO: 325410 - DNA, 20 bp, human
gttggtgagggagtatcccg

SEQ ID NO: 325411 - DNA, 20 bp, human
gagggagtatcccgaggctg

SEQ ID NO: 325412 - DNA, 20 bp, human
gcatctgagtgggcgcgttc

SEQ ID NO: 325413 - DNA, 20 bp, human
ggttcgggtggtgcaaactc

SEQ ID NO: 325414 - DNA, 20 bp, human
gctgagtgggcgcgttcggg

SEQ ID NO: 325415 - DNA, 20 bp, human
gaggcagggcccacagcctc

SEQ ID NO: 325416 - DNA, 20 bp, human
gcggccctgtgggaggcaaa

SEQ ID NO: 325417 - DNA, 20 bp, human
gtcaccctcggccctgtggg

SEQ ID NO: 325418 - DNA, 20 bp, human
gggggccacagcaagggaga

SEQ ID NO: 325419 - DNA, 20 bp, human
gccgagggtgaaactgaatc

SEQ ID NO: 325420 - DNA, 20 bp, human
gagcccgggtgtcactgtcc

SEQ ID NO: 325421 - DNA, 20 bp, human
gtgacacccgggctattttg

SEQ ID NO: 325422 - DNA, 20 bp, human
gagccagggggcaacggcca

SEQ ID NO: 325423 - DNA, 20 bp, human
gccggcctggccggcacagg

SEQ ID NO: 325424 - DNA, 20 bp, human
ggtccccctctcccttgctg

SEQ ID NO: 325425 - DNA, 20 bp, human
gggcaaagggcagatgcttg

SEQ ID NO: 325426 - DNA, 20 bp, human
gggaaccggggctagaaccg

SEQ ID NO: 325427 - DNA, 20 bp, human
gcagccccctcccacagctt

SEQ ID NO: 325428 - DNA, 20 bp, human
ggggccccagaaggtctgag

SEQ ID NO: 325429 - DNA, 20 bp, human
gggacctggcggctggaggt

SEQ ID NO: 325430 - DNA, 20 bp, human
gcaggcccaagcctggcggg

SEQ ID NO: 325431 - DNA, 20 bp, human
gggggctagaaccggggcta

SEQ ID NO: 325432 - DNA, 20 bp, human
gtcacccctcagaccttctg

SEQ ID NO: 325433 - DNA, 20 bp, human
gtagaccagtggagccagtc

SEQ ID NO: 325434 - DNA, 20 bp, human
gaggctgcggggccactcgc

SEQ ID NO: 325435 - DNA, 20 bp, human
gaagagaggctcctaagagc

SEQ ID NO: 325436 - DNA, 20 bp, human
gctaccccacctcacctcaa

SEQ ID NO: 325437 - DNA, 20 bp, human
gtatagcttggaacaggtga

SEQ ID NO: 325438 - DNA, 20 bp, human
gggtgaggtggggtagaaca

SEQ ID NO: 325439 - DNA, 20 bp, human
gaccctgagacataatccat

SEQ ID NO: 325440 - DNA, 20 bp, human
gggtcatcatgggaactctc

SEQ ID NO: 325441 - DNA, 20 bp, human
gtctcctctgaggctcaaga

SEQ ID NO: 325442 - DNA, 20 bp, human
gcccactcctcacatcaaga

SEQ ID NO: 325443 - DNA, 20 bp, human
gtagcctttgaggtgaggtg

SEQ ID NO: 325444 - DNA, 20 bp, human
gtatgtctcagggtcatcat

SEQ ID NO: 325445 - DNA, 20 bp, human
gtctgcccaagctgtggggt

SEQ ID NO: 325446 - DNA, 20 bp, human
ggccatgtgggcagctttgt

SEQ ID NO: 325447 - DNA, 20 bp, human
ggtgcggagcgggcgagctg

SEQ ID NO: 325448 - DNA, 20 bp, human
ggccgggaggggcgtgctac

SEQ ID NO: 325449 - DNA, 20 bp, human
ggagcgggcgagctgtgggc

SEQ ID NO: 325450 - DNA, 20 bp, human
gcccgcggagagcgctgtcg

SEQ ID NO: 325451 - DNA, 20 bp, human
gctgagagcagctccgtcta

SEQ ID NO: 325452 - DNA, 20 bp, human
ggcccacaaagctgcccaca

SEQ ID NO: 325453 - DNA, 20 bp, human
gtacgggcgtggccgcactg

SEQ ID NO: 325454 - DNA, 20 bp, human
gtctcagcccgcgccgccgg

SEQ ID NO: 325455 - DNA, 20 bp, human
ggcccgtagcacgcccctcc

SEQ ID NO: 325456 - DNA, 20 bp, human
gcaaacttgagggtcgaggt

SEQ ID NO: 325457 - DNA, 20 bp, human
gggcggggtctgacgaaagg

SEQ ID NO: 325458 - DNA, 20 bp, human
gggagtcgaccatgtttcga

SEQ ID NO: 325459 - DNA, 20 bp, human
gtgggacaggtgacccgggg

SEQ ID NO: 325460 - DNA, 20 bp, human
gtcgccgcgcagcctgggac

SEQ ID NO: 325461 - DNA, 20 bp, human
gctcgggcgcggtcgtctgt

SEQ ID NO: 325462 - DNA, 20 bp, human
gacgctgggacaggtgaccc

SEQ ID NO: 325463 - DNA, 20 bp, human
ggggctgggcctgacggcct

SEQ ID NO: 325464 - DNA, 20 bp, human
ggccacacaccttcgaaaca

SEQ ID NO: 325465 - DNA, 20 bp, human
gctgcgcgccctggaggtcg

SEQ ID NO: 325466 - DNA, 20 bp, human
gactgcgcaggcgacagcgg

SEQ ID NO: 325467 - DNA, 20 bp, human
ggcgactgcgcaggcgacag

SEQ ID NO: 325468 - DNA, 20 bp, human
gtggccgcagctgcctgaaa

SEQ ID NO: 325469 - DNA, 20 bp, human
gagccgcactgcgactgcgc

SEQ ID NO: 325470 - DNA, 20 bp, human
gtgggagtaggcttgacttt

SEQ ID NO: 325471 - DNA, 20 bp, human
gcacctctctggtcttctcg

SEQ ID NO: 325472 - DNA, 20 bp, human
gcggaggcactgtatactta

SEQ ID NO: 325473 - DNA, 20 bp, human
gtacgcatgcgtctattcct

SEQ ID NO: 325474 - DNA, 20 bp, human
gcaaaatgaccgcgacccgg

SEQ ID NO: 325475 - DNA, 20 bp, human
gggctctcagacccgcagtg

SEQ ID NO: 325476 - DNA, 20 bp, human
gtcgctgttggtggcaaccc

SEQ ID NO: 325477 - DNA, 20 bp, human
ggcgcaatacatggctgttg

SEQ ID NO: 325478 - DNA, 20 bp, human
gaacccctgccccatccttg

SEQ ID NO: 325479 - DNA, 20 bp, human
gcccaactctgacttgtgga

SEQ ID NO: 325480 - DNA, 20 bp, human
gcaggggttccggcaagagc

SEQ ID NO: 325481 - DNA, 20 bp, human
gaccacacacggctgcagaa

SEQ ID NO: 325482 - DNA, 20 bp, human
gggagcctggagtcaacccc

SEQ ID NO: 325483 - DNA, 20 bp, human
gctggaggaagggagtcatt

SEQ ID NO: 325484 - DNA, 20 bp, human
gggagacaggtggggtactc

SEQ ID NO: 325485 - DNA, 20 bp, human
ggagttgtgcaggccactaa

SEQ ID NO: 325486 - DNA, 20 bp, human
gacaaagccacactgagatg

SEQ ID NO: 325487 - DNA, 20 bp, human
ggatggggctgctagactga

SEQ ID NO: 325488 - DNA, 20 bp, human
gtggtgtaaatcattgcttc

SEQ ID NO: 325489 - DNA, 20 bp, human
gactgatggactatgtgaac

SEQ ID NO: 325490 - DNA, 20 bp, human
gagggttgtgaattacgaga

SEQ ID NO: 325491 - DNA, 20 bp, human
gcaattggattgagagtttt

SEQ ID NO: 325492 - DNA, 20 bp, human
gttcaggatttgcagggtat

SEQ ID NO: 325493 - DNA, 20 bp, human
ggcaggtttcaggatttgca

SEQ ID NO: 325494 - DNA, 20 bp, human
ggtatgctggattctatgat

SEQ ID NO: 325495 - DNA, 20 bp, human
gttcccttcaaaagctaatg

SEQ ID NO: 325496 - DNA, 20 bp, human
gacgcagcaggtgggactcg

SEQ ID NO: 325497 - DNA, 20 bp, human
gcatgcgcaccaacgtggaa

SEQ ID NO: 325498 - DNA, 20 bp, human
gcacctgctgcgtcctagac

SEQ ID NO: 325499 - DNA, 20 bp, human
gggacgcgggagtgtaggtg

SEQ ID NO: 325500 - DNA, 20 bp, human
gagcgccgaggagccggtct

SEQ ID NO: 325501 - DNA, 20 bp, human
ggcgtcctagaccggctcct

SEQ ID NO: 325502 - DNA, 20 bp, human
gagccggtctaggacgcagc

SEQ ID NO: 325503 - DNA, 20 bp, human
ggaggtggacgcgggagtgt

SEQ ID NO: 325504 - DNA, 20 bp, human
ggcggcaggaaccgagagcc

SEQ ID NO: 325505 - DNA, 20 bp, human
gcaggtgggactcgcggcgc

SEQ ID NO: 325506 - DNA, 20 bp, human
gctggggtgttttccgtatc

SEQ ID NO: 325507 - DNA, 20 bp, human
gtccaaattaaaaccagata

SEQ ID NO: 325508 - DNA, 20 bp, human
gtttgaatacatgccaaaaa

SEQ ID NO: 325509 - DNA, 20 bp, human
ggaaggctctgagacaaaaa

SEQ ID NO: 325510 - DNA, 20 bp, human
ggctctgagacaaaaaaggc

SEQ ID NO: 325511 - DNA, 20 bp, human
gttggcatgtattcaaaaga

SEQ ID NO: 325512 - DNA, 20 bp, human
gaaaaaaaatgacccaaaga

SEQ ID NO: 325513 - DNA, 20 bp, human
gtccgtatctggttttaatt

SEQ ID NO: 325514 - DNA, 20 bp, human
gatggttttgtattaagtga

SEQ ID NO: 325515 - DNA, 20 bp, human
gattctagacaggcctggct

SEQ ID NO: 325516 - DNA, 20 bp, human
gatgcctggtaaggtggaga

SEQ ID NO: 325517 - DNA, 20 bp, human
gaggttctagatgcctggta

SEQ ID NO: 325518 - DNA, 20 bp, human
gtgcacacacaggtctcacc

SEQ ID NO: 325519 - DNA, 20 bp, human
gcacaggtctcacccggcac

SEQ ID NO: 325520 - DNA, 20 bp, human
gaggctcccctgatattagc

SEQ ID NO: 325521 - DNA, 20 bp, human
gcggtacctgctaatatcag

SEQ ID NO: 325522 - DNA, 20 bp, human
gttctagatgcctggtaagg

SEQ ID NO: 325523 - DNA, 20 bp, human
gtttcagctttgggaactat

SEQ ID NO: 325524 - DNA, 20 bp, human
gggtgctctgtaagctgaaa

SEQ ID NO: 325525 - DNA, 20 bp, human
gtagccctgtctcctgtgcc

SEQ ID NO: 325526 - DNA, 20 bp, human
gctggggtctttttggtatc

SEQ ID NO: 325527 - DNA, 20 bp, human
gaaaagggctggggtctttt

SEQ ID NO: 325528 - DNA, 20 bp, human
gctctgagacaaaaagggct

SEQ ID NO: 325529 - DNA, 20 bp, human
gctagacaggcctggcttgg

SEQ ID NO: 325530 - DNA, 20 bp, human
ggaaggctctgagacaaaaa

SEQ ID NO: 325531 - DNA, 20 bp, human
gttggcatatattcaaaaga

SEQ ID NO: 325532 - DNA, 20 bp, human
gatggttttgtattaagtga

SEQ ID NO: 325533 - DNA, 20 bp, human
gttggtatctggttttaatt

SEQ ID NO: 325534 - DNA, 20 bp, human
gaaaaaacatgacccaaaga

SEQ ID NO: 325535 - DNA, 20 bp, human
gattctagacaggcctggct

SEQ ID NO: 325536 - DNA, 20 bp, human
gactgcagcgagagacctga

SEQ ID NO: 325537 - DNA, 20 bp, human
ggcgagagacctgacggact

SEQ ID NO: 325538 - DNA, 20 bp, human
gcaggggacggaatctgcgg

SEQ ID NO: 325539 - DNA, 20 bp, human
ggtcccctgcggtcaaactg

SEQ ID NO: 325540 - DNA, 20 bp, human
gccgcaggggacggaatctg

SEQ ID NO: 325541 - DNA, 20 bp, human
ggcggcctggaaaactggcg

SEQ ID NO: 325542 - DNA, 20 bp, human
ggcgcccccgccagttttcc

SEQ ID NO: 325543 - DNA, 20 bp, human
ggtctctaccaggtccagca

SEQ ID NO: 325544 - DNA, 20 bp, human
ggcgaggcgccgctctctct

SEQ ID NO: 325545 - DNA, 20 bp, human
ggactgggggcgtctctacc

SEQ ID NO: 325546 - DNA, 20 bp, human
gtgggaggtgggccccgaaa

SEQ ID NO: 325547 - DNA, 20 bp, human
gtagagacatcgcttggaaa

SEQ ID NO: 325548 - DNA, 20 bp, human
ggcccacctcccagagggtt

SEQ ID NO: 325549 - DNA, 20 bp, human
gcagacccctgccaagtact

SEQ ID NO: 325550 - DNA, 20 bp, human
gcgctcttgcttgtgggcag

SEQ ID NO: 325551 - DNA, 20 bp, human
gcccttggggcacacaacta

SEQ ID NO: 325552 - DNA, 20 bp, human
gtctaatcttggtagcagga

SEQ ID NO: 325553 - DNA, 20 bp, human
gcaagcgatgtctctaatct

SEQ ID NO: 325554 - DNA, 20 bp, human
ggggcacacaactatggagt

SEQ ID NO: 325555 - DNA, 20 bp, human
gagtcccaagagcagggatc

SEQ ID NO: 325556 - DNA, 20 bp, human
gttagggcccacttaattca

SEQ ID NO: 325557 - DNA, 20 bp, human
ggtggaatccatgaattaag

SEQ ID NO: 325558 - DNA, 20 bp, human
gtgggagcagtccagcaaac

SEQ ID NO: 325559 - DNA, 20 bp, human
gaactggcctctcctgttaa

SEQ ID NO: 325560 - DNA, 20 bp, human
ggccatgagaaatatggggc

SEQ ID NO: 325561 - DNA, 20 bp, human
gctgttaagggtatctgatt

SEQ ID NO: 325562 - DNA, 20 bp, human
gcagatacccttaacaggag

SEQ ID NO: 325563 - DNA, 20 bp, human
gtagagctgataaagagaac

SEQ ID NO: 325564 - DNA, 20 bp, human
gctgctgttactggttaact

SEQ ID NO: 325565 - DNA, 20 bp, human
ggcaaatgctaaattcccga

SEQ ID NO: 325566 - DNA, 20 bp, human
gtgcgcggaccagttccagg

SEQ ID NO: 325567 - DNA, 20 bp, human
gtgctcggctcggctgacgt

SEQ ID NO: 325568 - DNA, 20 bp, human
ggggcccgcgcggagctggt

SEQ ID NO: 325569 - DNA, 20 bp, human
gggcccggcggtggccaacc

SEQ ID NO: 325570 - DNA, 20 bp, human
gtcccggccggaaccgatcg

SEQ ID NO: 325571 - DNA, 20 bp, human
ggagctggtggggcgccggc

SEQ ID NO: 325572 - DNA, 20 bp, human
gccggcccgcggcagctgaa

SEQ ID NO: 325573 - DNA, 20 bp, human
ggggggcgggggccacgcgt

SEQ ID NO: 325574 - DNA, 20 bp, human
ggcaccgcctgccccacgcg

SEQ ID NO: 325575 - DNA, 20 bp, human
gacccgccggtgctataagt

SEQ ID NO: 325576 - DNA, 20 bp, human
gggtccccagagcacacaca

SEQ ID NO: 325577 - DNA, 20 bp, human
gccaagcgagcatagctcat

SEQ ID NO: 325578 - DNA, 20 bp, human
ggacttgaggatgacttggt

SEQ ID NO: 325579 - DNA, 20 bp, human
gtgaaatctcaacacgagta

SEQ ID NO: 325580 - DNA, 20 bp, human
gcacaaggcaaggatgttag

SEQ ID NO: 325581 - DNA, 20 bp, human
gaggtcatggagaaaggcgt

SEQ ID NO: 325582 - DNA, 20 bp, human
gatagctcatcggggtgcat

SEQ ID NO: 325583 - DNA, 20 bp, human
gtcatcggggtgcatggggc

SEQ ID NO: 325584 - DNA, 20 bp, human
gaccacagctggcgcagaat

SEQ ID NO: 325585 - DNA, 20 bp, human
gttgaacttggtgcaggcga

SEQ ID NO: 325586 - DNA, 20 bp, human
gcgggaaaggccttgaatgg

SEQ ID NO: 325587 - DNA, 20 bp, human
ggggacgcgtggcccggaag

SEQ ID NO: 325588 - DNA, 20 bp, human
ggggcatctctgtgacgcta

SEQ ID NO: 325589 - DNA, 20 bp, human
ggacgcgtagcacgtctcct

SEQ ID NO: 325590 - DNA, 20 bp, human
gcgggtgtcggaaaaggagg

SEQ ID NO: 325591 - DNA, 20 bp, human
gcggaagtgggcggcccttc

SEQ ID NO: 325592 - DNA, 20 bp, human
ggccacgcgtcccgtcacca

SEQ ID NO: 325593 - DNA, 20 bp, human
gatgccccgccccgccagaa

SEQ ID NO: 325594 - DNA, 20 bp, human
ggctaggggctgggcctcga

SEQ ID NO: 325595 - DNA, 20 bp, human
gagcacgtctccttggtgac

SEQ ID NO: 325596 - DNA, 20 bp, human
ggggcagcgcctatagctat

SEQ ID NO: 325597 - DNA, 20 bp, human
gtgctgcgggcctgacggga

SEQ ID NO: 325598 - DNA, 20 bp, human
ggtccctaacccggaccaat

SEQ ID NO: 325599 - DNA, 20 bp, human
gcgcctatagctattggaga

SEQ ID NO: 325600 - DNA, 20 bp, human
gagcctgctgcgggcctgac

SEQ ID NO: 325601 - DNA, 20 bp, human
ggcaggctgccgattggtcc

SEQ ID NO: 325602 - DNA, 20 bp, human
gaaccggctagtggcttctc

SEQ ID NO: 325603 - DNA, 20 bp, human
ggcagctagtaaccggctag

SEQ ID NO: 325604 - DNA, 20 bp, human
gtgccagagaagccactagc

SEQ ID NO: 325605 - DNA, 20 bp, human
gacgcagggggcactacagt

SEQ ID NO: 325606 - DNA, 20 bp, human
ggatctggtgaggggatcaa

SEQ ID NO: 325607 - DNA, 20 bp, human
gatggtcagggggacttata

SEQ ID NO: 325608 - DNA, 20 bp, human
gtataggggtgtcctgttgg

SEQ ID NO: 325609 - DNA, 20 bp, human
gtgaggggaacatggtcagg

SEQ ID NO: 325610 - DNA, 20 bp, human
ggggtggggagccttggtga

SEQ ID NO: 325611 - DNA, 20 bp, human
gctggtggtgagatctggtg

SEQ ID NO: 325612 - DNA, 20 bp, human
ggtctatgtgaccaagacaa

SEQ ID NO: 325613 - DNA, 20 bp, human
gaaggcagaagccattgtct

SEQ ID NO: 325614 - DNA, 20 bp, human
gactctagaatgtggctctg

SEQ ID NO: 325615 - DNA, 20 bp, human
ggggacctggtggtgagatc

SEQ ID NO: 325616 - DNA, 20 bp, human
gactccaggcgcattaggca

SEQ ID NO: 325617 - DNA, 20 bp, human
gccgccccgcgctgatccca

SEQ ID NO: 325618 - DNA, 20 bp, human
gggggccgggagcggatcca

SEQ ID NO: 325619 - DNA, 20 bp, human
gaggcagggacgtgaactcg

SEQ ID NO: 325620 - DNA, 20 bp, human
gcagggacgtgaactcgcgg

SEQ ID NO: 325621 - DNA, 20 bp, human
gaaagggccacaatggggtc

SEQ ID NO: 325622 - DNA, 20 bp, human
gcccacgcaggcccttcccg

SEQ ID NO: 325623 - DNA, 20 bp, human
ggggccatcacccggactcc

SEQ ID NO: 325624 - DNA, 20 bp, human
gcctaatgcgcctggagtcc

SEQ ID NO: 325625 - DNA, 20 bp, human
ggcgcctggagtccgggtga

SEQ ID NO: 325626 - DNA, 20 bp, human
gtgccatggcgcctgaactg

SEQ ID NO: 325627 - DNA, 20 bp, human
gggagctggagatgacgtca

SEQ ID NO: 325628 - DNA, 20 bp, human
ggtgccctaaggttggggaa

SEQ ID NO: 325629 - DNA, 20 bp, human
gctagcgcttcactcccagt

SEQ ID NO: 325630 - DNA, 20 bp, human
ggaaagggttggtgggtcac

SEQ ID NO: 325631 - DNA, 20 bp, human
gcggcgtggaaattctatgc

SEQ ID NO: 325632 - DNA, 20 bp, human
gacttggcctggttggtgat

SEQ ID NO: 325633 - DNA, 20 bp, human
gccaaccttagggcacccac

SEQ ID NO: 325634 - DNA, 20 bp, human
ggggggacagtgggatagtc

SEQ ID NO: 325635 - DNA, 20 bp, human
gaccaggccaagtggcctgg

SEQ ID NO: 325636 - DNA, 20 bp, human
gcctcctgctgcaaggctgt

SEQ ID NO: 325637 - DNA, 20 bp, human
gacacccacagccttgcagc

SEQ ID NO: 325638 - DNA, 20 bp, human
ggagggcctggcggggtcgt

SEQ ID NO: 325639 - DNA, 20 bp, human
gaaaagaaggagatgttctc

SEQ ID NO: 325640 - DNA, 20 bp, human
ggggcccagggtagcagtgt

SEQ ID NO: 325641 - DNA, 20 bp, human
gtcagcagagtgcgtctccc

SEQ ID NO: 325642 - DNA, 20 bp, human
gtttggcaggaatgagtgac

SEQ ID NO: 325643 - DNA, 20 bp, human
gagaactggacacgaacaga

SEQ ID NO: 325644 - DNA, 20 bp, human
gggccccgtttctacacctg

SEQ ID NO: 325645 - DNA, 20 bp, human
ggaaactgaggcacagccca

SEQ ID NO: 325646 - DNA, 20 bp, human
ggctccaaaccaccttgtcg

SEQ ID NO: 325647 - DNA, 20 bp, human
gaaccaggcagcatgaagca

SEQ ID NO: 325648 - DNA, 20 bp, human
gggttttagtccaggaacaa

SEQ ID NO: 325649 - DNA, 20 bp, human
gttaaatgaacctttgttcc

SEQ ID NO: 325650 - DNA, 20 bp, human
gttcctggactaaaaccaaa

SEQ ID NO: 325651 - DNA, 20 bp, human
gaaacaggaagcctttaacc

SEQ ID NO: 325652 - DNA, 20 bp, human
gaacacaggcaagtagtaca

SEQ ID NO: 325653 - DNA, 20 bp, human
gctccacaacagcctcgaca

SEQ ID NO: 325654 - DNA, 20 bp, human
gcaccttgtcgaggctgttg

SEQ ID NO: 325655 - DNA, 20 bp, human
gcagcctcgacaaggtggtt

SEQ ID NO: 325656 - DNA, 20 bp, human
gggcggggacccagacacta

SEQ ID NO: 325657 - DNA, 20 bp, human
gatcgcgagagcacatccca

SEQ ID NO: 325658 - DNA, 20 bp, human
gtgctctcgcgatacgtagg

SEQ ID NO: 325659 - DNA, 20 bp, human
gaatggagcaagtgcggcgg

SEQ ID NO: 325660 - DNA, 20 bp, human
gttcccgagctgaagagcta

SEQ ID NO: 325661 - DNA, 20 bp, human
gggtatcgcgagaactgctt

SEQ ID NO: 325662 - DNA, 20 bp, human
gcgccgtagctcttcagctc

SEQ ID NO: 325663 - DNA, 20 bp, human
gcggacgtctgcaggtggaa

SEQ ID NO: 325664 - DNA, 20 bp, human
gatgtgctctcgcgatacgt

SEQ ID NO: 325665 - DNA, 20 bp, human
ggagaactgcttcggcgttc

SEQ ID NO: 325666 - DNA, 20 bp, human
ggctctgtgacgtcacgaat

SEQ ID NO: 325667 - DNA, 20 bp, human
ggcttctgcaactgcgcagt

SEQ ID NO: 325668 - DNA, 20 bp, human
gtcaacacgtagccctcccc

SEQ ID NO: 325669 - DNA, 20 bp, human
gaatcggtcctctgtaagag

SEQ ID NO: 325670 - DNA, 20 bp, human
gcagtcggcgctgtgacgcc

SEQ ID NO: 325671 - DNA, 20 bp, human
ggacaacctcatctctctag

SEQ ID NO: 325672 - DNA, 20 bp, human
gtgacgtcacagagccgcgc

SEQ ID NO: 325673 - DNA, 20 bp, human
gtctagcggagcaaacagct

SEQ ID NO: 325674 - DNA, 20 bp, human
gggagggcattcttctccag

SEQ ID NO: 325675 - DNA, 20 bp, human
gggcgctgtgacgcccggcg

SEQ ID NO: 325676 - DNA, 20 bp, human
gacgacgcgcggagtctcag

SEQ ID NO: 325677 - DNA, 20 bp, human
gcgcgccgtgccaattacct

SEQ ID NO: 325678 - DNA, 20 bp, human
gccgctcctggcgctgtcca

SEQ ID NO: 325679 - DNA, 20 bp, human
gccgttctgcggtctcagag

SEQ ID NO: 325680 - DNA, 20 bp, human
ggagtccccccttcggccgt

SEQ ID NO: 325681 - DNA, 20 bp, human
gccaggcccgaggtcgccca

SEQ ID NO: 325682 - DNA, 20 bp, human
gttcggccgtgggcgacctc

SEQ ID NO: 325683 - DNA, 20 bp, human
gggtcgcccacggccgaagg

SEQ ID NO: 325684 - DNA, 20 bp, human
ggcctgggccgccagcaccg

SEQ ID NO: 325685 - DNA, 20 bp, human
ggggcctcagccccgttctg

SEQ ID NO: 325686 - DNA, 20 bp, human
ggcaggaagtagaggggcgg

SEQ ID NO: 325687 - DNA, 20 bp, human
gctctggcggcaggaagtag

SEQ ID NO: 325688 - DNA, 20 bp, human
gccaccagcaattggcccac

SEQ ID NO: 325689 - DNA, 20 bp, human
gagaggaggcgtaggcacgc

SEQ ID NO: 325690 - DNA, 20 bp, human
ggctactgcccgccattaac

SEQ ID NO: 325691 - DNA, 20 bp, human
ggcgggcagtagccgctgag

SEQ ID NO: 325692 - DNA, 20 bp, human
gacggcgagcagaaagtggc

SEQ ID NO: 325693 - DNA, 20 bp, human
gggcccactggagctcggtc

SEQ ID NO: 325694 - DNA, 20 bp, human
gggcacgccggaagtgaacc

SEQ ID NO: 325695 - DNA, 20 bp, human
gtggtgcttcccattgggta

SEQ ID NO: 325696 - DNA, 20 bp, human
gggccgctctaagttcccaa

SEQ ID NO: 325697 - DNA, 20 bp, human
gaaaactgggaggcggaacg

SEQ ID NO: 325698 - DNA, 20 bp, human
gtagtgggaaaactgggagg

SEQ ID NO: 325699 - DNA, 20 bp, human
gagaaagatgctcctgggcc

SEQ ID NO: 325700 - DNA, 20 bp, human
gcgtgcccgaagtctctcta

SEQ ID NO: 325701 - DNA, 20 bp, human
gctcgccaggaaacggtctg

SEQ ID NO: 325702 - DNA, 20 bp, human
gttggtggagacactcactg

SEQ ID NO: 325703 - DNA, 20 bp, human
gaaactgaaacgtacagggc

SEQ ID NO: 325704 - DNA, 20 bp, human
gactgggaggcggaacgagg

SEQ ID NO: 325705 - DNA, 20 bp, human
ggaggccgccggtcccaacc

SEQ ID NO: 325706 - DNA, 20 bp, human
gcgcaggtgaggtgcgggtg

SEQ ID NO: 325707 - DNA, 20 bp, human
ggccaggcccgagcaatcgg

SEQ ID NO: 325708 - DNA, 20 bp, human
gggacctcgcgggaccgcgg

SEQ ID NO: 325709 - DNA, 20 bp, human
gtgaggtgcgggtgcggctc

SEQ ID NO: 325710 - DNA, 20 bp, human
ggctgcgcccccggacctcg

SEQ ID NO: 325711 - DNA, 20 bp, human
ggcggccaggcccgagcaat

SEQ ID NO: 325712 - DNA, 20 bp, human
gcagccccgcatcgccgctg

SEQ ID NO: 325713 - DNA, 20 bp, human
gtgtcccgcagcggcgatgc

SEQ ID NO: 325714 - DNA, 20 bp, human
gtacctgaagagggacggcc

SEQ ID NO: 325715 - DNA, 20 bp, human
gcgctcggccatcggcccct

SEQ ID NO: 325716 - DNA, 20 bp, human
gccgcgaggggcatcctccc

SEQ ID NO: 325717 - DNA, 20 bp, human
gcctcccgggcggacgttgg

SEQ ID NO: 325718 - DNA, 20 bp, human
gccccagaggacggtctccc

SEQ ID NO: 325719 - DNA, 20 bp, human
gcctcccgggtgggcatcgt

SEQ ID NO: 325720 - DNA, 20 bp, human
gaatcccccaacgtccgccc

SEQ ID NO: 325721 - DNA, 20 bp, human
gcgggcgtcccggggaggga

SEQ ID NO: 325722 - DNA, 20 bp, human
ggtacccggctcatcttccg

SEQ ID NO: 325723 - DNA, 20 bp, human
gctgctgggaggacatcgtc

SEQ ID NO: 325724 - DNA, 20 bp, human
ggacgttgggggattctcgg

SEQ ID NO: 325725 - DNA, 20 bp, human
ggggtggggcgaatcctccc

SEQ ID NO: 325726 - DNA, 20 bp, human
ggccgcagttggctcccctg

SEQ ID NO: 325727 - DNA, 20 bp, human
ggcccccagccgagcgccac

SEQ ID NO: 325728 - DNA, 20 bp, human
gccccggagtggattggggt

SEQ ID NO: 325729 - DNA, 20 bp, human
gcggcggcagctcccgcctg

SEQ ID NO: 325730 - DNA, 20 bp, human
ggcggcccccggagtggatt

SEQ ID NO: 325731 - DNA, 20 bp, human
gttccggggagaaacgtgga

SEQ ID NO: 325732 - DNA, 20 bp, human
ggcgcctgaacccgcccatc

SEQ ID NO: 325733 - DNA, 20 bp, human
ggacaggcaccctcgcgggg

SEQ ID NO: 325734 - DNA, 20 bp, human
ggccccgggagggcgtcccc

SEQ ID NO: 325735 - DNA, 20 bp, human
gccactccgggggccgccgg

SEQ ID NO: 325736 - DNA, 20 bp, human
gctgctcgcctttccccctc

SEQ ID NO: 325737 - DNA, 20 bp, human
ggaaccgcggggcgcccaga

SEQ ID NO: 325738 - DNA, 20 bp, human
gagaattggggcacgaagcg

SEQ ID NO: 325739 - DNA, 20 bp, human
gcgtgtgggcgaggccttaa

SEQ ID NO: 325740 - DNA, 20 bp, human
gggcgccccgcggttcctca

SEQ ID NO: 325741 - DNA, 20 bp, human
gacaaggaccacgaccctta

SEQ ID NO: 325742 - DNA, 20 bp, human
gaaagggcgaggcatgcagg

SEQ ID NO: 325743 - DNA, 20 bp, human
gaggcctggttctgggtagg

SEQ ID NO: 325744 - DNA, 20 bp, human
gcaggaaagccggagaattg

SEQ ID NO: 325745 - DNA, 20 bp, human
gagaagataagtcgcaagga

SEQ ID NO: 325746 - DNA, 20 bp, human
gcaccctagagaaagaatgc

SEQ ID NO: 325747 - DNA, 20 bp, human
gtttaagaacagtttccatg

SEQ ID NO: 325748 - DNA, 20 bp, human
ggcagattgtttgatctcct

SEQ ID NO: 325749 - DNA, 20 bp, human
gaaactgttcttaaagctgc

SEQ ID NO: 325750 - DNA, 20 bp, human
gtctgctttttgaatgaaat

SEQ ID NO: 325751 - DNA, 20 bp, human
gttcattttggtgatttccc

SEQ ID NO: 325752 - DNA, 20 bp, human
gaactgctgagtaaaatttc

SEQ ID NO: 325753 - DNA, 20 bp, human
gcatggactatgttgtcatt

SEQ ID NO: 325754 - DNA, 20 bp, human
gcctcataaaattaacaaca

SEQ ID NO: 325755 - DNA, 20 bp, human
gctaaaactaatttttacac

SEQ ID NO: 325756 - DNA, 20 bp, human
gtggcagggtgtgcgcagta

SEQ ID NO: 325757 - DNA, 20 bp, human
gtcacatgagacaggatctt

SEQ ID NO: 325758 - DNA, 20 bp, human
gcttagaggatgttttggca

SEQ ID NO: 325759 - DNA, 20 bp, human
gtctaattaaagatcactaa

SEQ ID NO: 325760 - DNA, 20 bp, human
gagggttaaatactgttctc

SEQ ID NO: 325761 - DNA, 20 bp, human
gcttttaaatattgcttcga

SEQ ID NO: 325762 - DNA, 20 bp, human
gagtcattaacacctttagg

SEQ ID NO: 325763 - DNA, 20 bp, human
gaagaactcttgatttatat

SEQ ID NO: 325764 - DNA, 20 bp, human
ggcaatatttaaaagcttag

SEQ ID NO: 325765 - DNA, 20 bp, human
gtttttaactcacatgagac

SEQ ID NO: 325766 - DNA, 20 bp, human
gagtgccctaaccacgagtc

SEQ ID NO: 325767 - DNA, 20 bp, human
gaccacgagtcgggttgaca

SEQ ID NO: 325768 - DNA, 20 bp, human
ggcactctctggggcggaag

SEQ ID NO: 325769 - DNA, 20 bp, human
gtcaacccgactcgtggtta

SEQ ID NO: 325770 - DNA, 20 bp, human
gtcgtggttagggcactctc

SEQ ID NO: 325771 - DNA, 20 bp, human
ggccctgtcaacccgactcg

SEQ ID NO: 325772 - DNA, 20 bp, human
gcccattgcgacaaacacca

SEQ ID NO: 325773 - DNA, 20 bp, human
gtgttggcggcgctggttac

SEQ ID NO: 325774 - DNA, 20 bp, human
gcgctgcgcggaggactaca

SEQ ID NO: 325775 - DNA, 20 bp, human
gacagggctgctcgcatgcg

SEQ ID NO: 325776 - DNA, 20 bp, human
ggggcctgtaacgcctgttc

SEQ ID NO: 325777 - DNA, 20 bp, human
gcgaatacgcaggcgccaaa

SEQ ID NO: 325778 - DNA, 20 bp, human
gaacgtgagcgatgccgcag

SEQ ID NO: 325779 - DNA, 20 bp, human
gttacctgaacaggcgttac

SEQ ID NO: 325780 - DNA, 20 bp, human
gaaaaaagcgcgcctctgtt

SEQ ID NO: 325781 - DNA, 20 bp, human
gaaaggaaggcgccggctgc

SEQ ID NO: 325782 - DNA, 20 bp, human
gacagctcctgcgtcctcat

SEQ ID NO: 325783 - DNA, 20 bp, human
gcgtcctcattggacatcat

SEQ ID NO: 325784 - DNA, 20 bp, human
gagcgcgcctctgttgggac

SEQ ID NO: 325785 - DNA, 20 bp, human
gggtaacgagtgcgcggact

SEQ ID NO: 325786 - DNA, 20 bp, human
ggatgaggatgagtgggata

SEQ ID NO: 325787 - DNA, 20 bp, human
gctggtaggggctttatcag

SEQ ID NO: 325788 - DNA, 20 bp, human
ggaaaacaataggaggatga

SEQ ID NO: 325789 - DNA, 20 bp, human
gcccttctggataagatact

SEQ ID NO: 325790 - DNA, 20 bp, human
gaaagcagtgcttctctctg

SEQ ID NO: 325791 - DNA, 20 bp, human
gactgctttacactgtcaac

SEQ ID NO: 325792 - DNA, 20 bp, human
gatactggggtttcattgca

SEQ ID NO: 325793 - DNA, 20 bp, human
gactttatcagcactggtag

SEQ ID NO: 325794 - DNA, 20 bp, human
gagcaagaatttgacgtgaa

SEQ ID NO: 325795 - DNA, 20 bp, human
gtaaggacaggtatgagaca

SEQ ID NO: 325796 - DNA, 20 bp, human
ggcgcggctcctcccaccct

SEQ ID NO: 325797 - DNA, 20 bp, human
ggggcccatggtctgcgcgc

SEQ ID NO: 325798 - DNA, 20 bp, human
ggggacgcgcgggcaaggcg

SEQ ID NO: 325799 - DNA, 20 bp, human
gcccgcctccccggccggtt

SEQ ID NO: 325800 - DNA, 20 bp, human
ggcacctgcgcgcagaccat

SEQ ID NO: 325801 - DNA, 20 bp, human
gcgcgcgggcaaggcgggga

SEQ ID NO: 325802 - DNA, 20 bp, human
ggctggagaggggaaggcgc

SEQ ID NO: 325803 - DNA, 20 bp, human
gcgagcggcacgcacgacgg

SEQ ID NO: 325804 - DNA, 20 bp, human
gcgccgagcggcacgcacga

SEQ ID NO: 325805 - DNA, 20 bp, human
gtcccgcccattggcctaac

SEQ ID NO: 325806 - DNA, 20 bp, human
gttaactaaactggaaggca

SEQ ID NO: 325807 - DNA, 20 bp, human
gctaaactggaaggcaaggc

SEQ ID NO: 325808 - DNA, 20 bp, human
gggtacattgtgtctcctct

SEQ ID NO: 325809 - DNA, 20 bp, human
gagaagttaactaaactgga

SEQ ID NO: 325810 - DNA, 20 bp, human
gtaggcacctgctactgagg

SEQ ID NO: 325811 - DNA, 20 bp, human
gaaagcaggaagaatgacat

SEQ ID NO: 325812 - DNA, 20 bp, human
gggaagaatgacatgggctg

SEQ ID NO: 325813 - DNA, 20 bp, human
gtccactggaaggtggaaaa

SEQ ID NO: 325814 - DNA, 20 bp, human
gtaaaagaagttaactaaac

SEQ ID NO: 325815 - DNA, 20 bp, human
gaagagaatccactggaagg

SEQ ID NO: 325816 - DNA, 20 bp, human
gccgcccaggagttgggatc

SEQ ID NO: 325817 - DNA, 20 bp, human
gcaccctgatcccaactcct

SEQ ID NO: 325818 - DNA, 20 bp, human
gcctctgcggggatcggaga

SEQ ID NO: 325819 - DNA, 20 bp, human
gtcagggtgacatgaggaga

SEQ ID NO: 325820 - DNA, 20 bp, human
gttgggatcagggtgacatg

SEQ ID NO: 325821 - DNA, 20 bp, human
gtccagtccgcccaggagtt

SEQ ID NO: 325822 - DNA, 20 bp, human
gggaccgacgcaatccgccc

SEQ ID NO: 325823 - DNA, 20 bp, human
ggatgccccggcgtgaggat

SEQ ID NO: 325824 - DNA, 20 bp, human
gccgcggccctcccgtcccg

SEQ ID NO: 325825 - DNA, 20 bp, human
gcgcaatccgcccaggaaat

SEQ ID NO: 325826 - DNA, 20 bp, human
gtcccccgcgcgcctggcat

SEQ ID NO: 325827 - DNA, 20 bp, human
ggcgcgggggagccattagg

SEQ ID NO: 325828 - DNA, 20 bp, human
gacgaacgcgcgctgggctg

SEQ ID NO: 325829 - DNA, 20 bp, human
gggagtgggccgaagattgg

SEQ ID NO: 325830 - DNA, 20 bp, human
gttccggcgcgtctgcctcc

SEQ ID NO: 325831 - DNA, 20 bp, human
gaggcagacgcgccggaacc

SEQ ID NO: 325832 - DNA, 20 bp, human
gacaggatgtgacatcaaaa

SEQ ID NO: 325833 - DNA, 20 bp, human
gcgcgcgcctcgctctctcc

SEQ ID NO: 325834 - DNA, 20 bp, human
gccccttccgagcaaacttt

SEQ ID NO: 325835 - DNA, 20 bp, human
gtgggccgaagattgggggg

SEQ ID NO: 325836 - DNA, 20 bp, human
gggagcagctcgagcagggt

SEQ ID NO: 325837 - DNA, 20 bp, human
gccgctcccggaatggcctg

SEQ ID NO: 325838 - DNA, 20 bp, human
ggggacggggacgaatggtt

SEQ ID NO: 325839 - DNA, 20 bp, human
gcagctcgagcagggtcggg

SEQ ID NO: 325840 - DNA, 20 bp, human
gcacctccgcgacccgctcc

SEQ ID NO: 325841 - DNA, 20 bp, human
gttcgggagcagctcgagca

SEQ ID NO: 325842 - DNA, 20 bp, human
ggaagtgggggagccagcgc

SEQ ID NO: 325843 - DNA, 20 bp, human
gcaggtgggacggggacgaa

SEQ ID NO: 325844 - DNA, 20 bp, human
gtgtcctcaggtcccctcgc

SEQ ID NO: 325845 - DNA, 20 bp, human
gccgcgacccgctcccggaa

SEQ ID NO: 325846 - DNA, 20 bp, human
gcaaacaaaatattcttgat

SEQ ID NO: 325847 - DNA, 20 bp, human
ggggcacttcccacgaggat

SEQ ID NO: 325848 - DNA, 20 bp, human
gaggaaatggattctgttga

SEQ ID NO: 325849 - DNA, 20 bp, human
ggggcagggcacttcccacg

SEQ ID NO: 325850 - DNA, 20 bp, human
gctccttcccccatcctcgt

SEQ ID NO: 325851 - DNA, 20 bp, human
gtattcttgataggcttggt

SEQ ID NO: 325852 - DNA, 20 bp, human
gttcctgggtgattagagct

SEQ ID NO: 325853 - DNA, 20 bp, human
ggcaaaatgtctggtaaggg

SEQ ID NO: 325854 - DNA, 20 bp, human
gttggcagacctccatttaa

SEQ ID NO: 325855 - DNA, 20 bp, human
gaacagaatccatttcctct

SEQ ID NO: 325856 - DNA, 20 bp, human
gggcctcactgacaaggtgt

SEQ ID NO: 325857 - DNA, 20 bp, human
gggcccacaccttgtcagtg

SEQ ID NO: 325858 - DNA, 20 bp, human
gccaagggcagctcacagag

SEQ ID NO: 325859 - DNA, 20 bp, human
gaggggatatctggatccaa

SEQ ID NO: 325860 - DNA, 20 bp, human
ggggcagttcacacgttccc

SEQ ID NO: 325861 - DNA, 20 bp, human
ggggccatgactcagattcc

SEQ ID NO: 325862 - DNA, 20 bp, human
gaggagagccacagtcccta

SEQ ID NO: 325863 - DNA, 20 bp, human
gtggatgacacagagtttgg

SEQ ID NO: 325864 - DNA, 20 bp, human
ggaactgccccaggaggttc

SEQ ID NO: 325865 - DNA, 20 bp, human
ggagaccaaagtagtctttg

SEQ ID NO: 325866 - DNA, 20 bp, human
gaggggtggggtctcccaat

SEQ ID NO: 325867 - DNA, 20 bp, human
gtggactgcagaatccacta

SEQ ID NO: 325868 - DNA, 20 bp, human
gggtctcccaataggacttc

SEQ ID NO: 325869 - DNA, 20 bp, human
gacttctggaaaaggatcct

SEQ ID NO: 325870 - DNA, 20 bp, human
ggtgaagggagtctggatga

SEQ ID NO: 325871 - DNA, 20 bp, human
gcagggctacatcgcccctt

SEQ ID NO: 325872 - DNA, 20 bp, human
gcttttccagaagtcctatt

SEQ ID NO: 325873 - DNA, 20 bp, human
ggcagaatccactagggagg

SEQ ID NO: 325874 - DNA, 20 bp, human
gtggcctgcagctacatgaa

SEQ ID NO: 325875 - DNA, 20 bp, human
ggttggggaaggcctgcgat

SEQ ID NO: 325876 - DNA, 20 bp, human
gcctgcccgcgcgccagggt

SEQ ID NO: 325877 - DNA, 20 bp, human
ggcagccggcaggagcaacg

SEQ ID NO: 325878 - DNA, 20 bp, human
ggggcctccccgtcgtcggg

SEQ ID NO: 325879 - DNA, 20 bp, human
gccaaggtcccacgactcac

SEQ ID NO: 325880 - DNA, 20 bp, human
gctggccccgttgctcctgc

SEQ ID NO: 325881 - DNA, 20 bp, human
ggagacccaccctggcgcgc

SEQ ID NO: 325882 - DNA, 20 bp, human
gcaggacctgagtccgtgag

SEQ ID NO: 325883 - DNA, 20 bp, human
gcatccctgcccgcgcgcca

SEQ ID NO: 325884 - DNA, 20 bp, human
gcgtcgggcggctctcccaa

SEQ ID NO: 325885 - DNA, 20 bp, human
gggtgggtctcgatcgcagc

SEQ ID NO: 325886 - DNA, 20 bp, human
ggaagcgcacagggctcggg

SEQ ID NO: 325887 - DNA, 20 bp, human
gagctcgcgcggaaggaggg

SEQ ID NO: 325888 - DNA, 20 bp, human
ggcagccagtgaccgcgcgg

SEQ ID NO: 325889 - DNA, 20 bp, human
ggaggacctggaagcgcaca

SEQ ID NO: 325890 - DNA, 20 bp, human
gctggaagcgcacagggctc

SEQ ID NO: 325891 - DNA, 20 bp, human
gggcgcgggctgctgggcga

SEQ ID NO: 325892 - DNA, 20 bp, human
gcgccgccccggcacaatag

SEQ ID NO: 325893 - DNA, 20 bp, human
ggacgcacggggaccggaca

SEQ ID NO: 325894 - DNA, 20 bp, human
ggctcgggcggaggggtacc

SEQ ID NO: 325895 - DNA, 20 bp, human
ggcacccagcgctcgctcca

SEQ ID NO: 325896 - DNA, 20 bp, human
gtgtgtttgatcaatcctgg

SEQ ID NO: 325897 - DNA, 20 bp, human
gcaatcctggcggaaaggag

SEQ ID NO: 325898 - DNA, 20 bp, human
gttagctttggaggcggggt

SEQ ID NO: 325899 - DNA, 20 bp, human
gcctaggcgggaggtggtta

SEQ ID NO: 325900 - DNA, 20 bp, human
gacctcccgcctaggctgta

SEQ ID NO: 325901 - DNA, 20 bp, human
gcctcgggcttgaggggaag

SEQ ID NO: 325902 - DNA, 20 bp, human
gccaccccctcctttccgcc

SEQ ID NO: 325903 - DNA, 20 bp, human
gccttctaggcagtcaagca

SEQ ID NO: 325904 - DNA, 20 bp, human
ggcctccaaagctaaccctc

SEQ ID NO: 325905 - DNA, 20 bp, human
gggctgtagggtcctctgga

SEQ ID NO: 325906 - DNA, 20 bp, human
gccggggccgcgcggaggtg

SEQ ID NO: 325907 - DNA, 20 bp, human
gtgtcccgcgcggctggcac

SEQ ID NO: 325908 - DNA, 20 bp, human
gcctgcgcgcggggaaacga

SEQ ID NO: 325909 - DNA, 20 bp, human
gggccccctgagcggagtaa

SEQ ID NO: 325910 - DNA, 20 bp, human
gcgcccttactccgctcagg

SEQ ID NO: 325911 - DNA, 20 bp, human
gacgcccttcaggaacgccc

SEQ ID NO: 325912 - DNA, 20 bp, human
gggcgcagccgcgtgttcat

SEQ ID NO: 325913 - DNA, 20 bp, human
gggtggcggggcgcagccaa

SEQ ID NO: 325914 - DNA, 20 bp, human
gcaccccagggcgttcctga

SEQ ID NO: 325915 - DNA, 20 bp, human
gcgcgcggggaaacgatggt

SEQ ID NO: 325916 - DNA, 20 bp, human
ggccgggagattcttgggga

SEQ ID NO: 325917 - DNA, 20 bp, human
ggcgcccattggttgtgcgc

SEQ ID NO: 325918 - DNA, 20 bp, human
gaggagaagggcggctcaag

SEQ ID NO: 325919 - DNA, 20 bp, human
ggagggacccgaggaggcga

SEQ ID NO: 325920 - DNA, 20 bp, human
gctccctgcgcacaaccaat

SEQ ID NO: 325921 - DNA, 20 bp, human
gccgtggccgggagattctt

SEQ ID NO: 325922 - DNA, 20 bp, human
ggccaccgggctataaaaac

SEQ ID NO: 325923 - DNA, 20 bp, human
ggggaacaatgtgcgtgtcc

SEQ ID NO: 325924 - DNA, 20 bp, human
gtgagcgcgcttgggaccaa

SEQ ID NO: 325925 - DNA, 20 bp, human
gccgctcaatgaaactcgcc

SEQ ID NO: 325926 - DNA, 20 bp, human
gtcggagcagaggtgtccca

SEQ ID NO: 325927 - DNA, 20 bp, human
gtaaccagagagaggggcgt

SEQ ID NO: 325928 - DNA, 20 bp, human
gaagcagcctaaccagagag

SEQ ID NO: 325929 - DNA, 20 bp, human
gggtgagtgtgtcaatcaga

SEQ ID NO: 325930 - DNA, 20 bp, human
ggagccctcctatctatcct

SEQ ID NO: 325931 - DNA, 20 bp, human
gccccacaatgaatatgaat

SEQ ID NO: 325932 - DNA, 20 bp, human
gcagcccaggatagatagga

SEQ ID NO: 325933 - DNA, 20 bp, human
gtaaccagcccaggatagat

SEQ ID NO: 325934 - DNA, 20 bp, human
ggacgtgccatcattcaggg

SEQ ID NO: 325935 - DNA, 20 bp, human
gtgtgcctgggggctcctag

SEQ ID NO: 325936 - DNA, 20 bp, human
gagaggctttgcttcatatt

SEQ ID NO: 325937 - DNA, 20 bp, human
gcttgagttatgtgtattgc

SEQ ID NO: 325938 - DNA, 20 bp, human
ggagttatgtgtattgcagg

SEQ ID NO: 325939 - DNA, 20 bp, human
gtcaatcattggtaggagga

SEQ ID NO: 325940 - DNA, 20 bp, human
gtgactcaatcattggtagg

SEQ ID NO: 325941 - DNA, 20 bp, human
gtccagcgatggtgtgtcct

SEQ ID NO: 325942 - DNA, 20 bp, human
gacccaggacacaccatcgc

SEQ ID NO: 325943 - DNA, 20 bp, human
gacacaccatcgctggaaat

SEQ ID NO: 325944 - DNA, 20 bp, human
ggaatgactcaatcattggt

SEQ ID NO: 325945 - DNA, 20 bp, human
gagtttctgtctctgaagag

SEQ ID NO: 325946 - DNA, 20 bp, human
ggcagctgggagaacgactc

SEQ ID NO: 325947 - DNA, 20 bp, human
gtaaggcgggacatggccct

SEQ ID NO: 325948 - DNA, 20 bp, human
gctgggagaacgactctggg

SEQ ID NO: 325949 - DNA, 20 bp, human
gtagagcgccacagtctccg

SEQ ID NO: 325950 - DNA, 20 bp, human
gcccgccttaagccacacgg

SEQ ID NO: 325951 - DNA, 20 bp, human
gaagggcgccccggccggta

SEQ ID NO: 325952 - DNA, 20 bp, human
ggcgctctagcgcctccgtg

SEQ ID NO: 325953 - DNA, 20 bp, human
gcgggtgtgggcggagcgaa

SEQ ID NO: 325954 - DNA, 20 bp, human
ggcgccccggccggtatggc

SEQ ID NO: 325955 - DNA, 20 bp, human
gctgcccgccataccggccg

SEQ ID NO: 325956 - DNA, 20 bp, human
gtaagcaaatacaatcttct

SEQ ID NO: 325957 - DNA, 20 bp, human
gtggagttccctgtcacagt

SEQ ID NO: 325958 - DNA, 20 bp, human
gccagagtctcagcaactta

SEQ ID NO: 325959 - DNA, 20 bp, human
ggagtctcagcaacttaagg

SEQ ID NO: 325960 - DNA, 20 bp, human
gacacctcaaaccaaaatta

SEQ ID NO: 325961 - DNA, 20 bp, human
gaattaaggcccactgtgac

SEQ ID NO: 325962 - DNA, 20 bp, human
gatcttcttggaaaacactc

SEQ ID NO: 325963 - DNA, 20 bp, human
gtccccttaattttggtttg

SEQ ID NO: 325964 - DNA, 20 bp, human
gcaaagaattcttcaaatta

SEQ ID NO: 325965 - DNA, 20 bp, human
gctaggtgttgaataaccaa

SEQ ID NO: 325966 - DNA, 20 bp, human
gaggactgcagagctgtcgc

SEQ ID NO: 325967 - DNA, 20 bp, human
gcacctgatcagtaccacat

SEQ ID NO: 325968 - DNA, 20 bp, human
gtatagcaaatcagatatat

SEQ ID NO: 325969 - DNA, 20 bp, human
gaggtgcacacgcaacaaaa

SEQ ID NO: 325970 - DNA, 20 bp, human
gctcagacaaatacatagaa

SEQ ID NO: 325971 - DNA, 20 bp, human
gtggtgctgactcaaattta

SEQ ID NO: 325972 - DNA, 20 bp, human
ggactcaaatttatggcaag

SEQ ID NO: 325973 - DNA, 20 bp, human
gctcctatgtggtactgatc

SEQ ID NO: 325974 - DNA, 20 bp, human
ggggccaactctcatgcata

SEQ ID NO: 325975 - DNA, 20 bp, human
gtatgtatttgtctgagatt

SEQ ID NO: 325976 - DNA, 20 bp, human
gcaaaatggggtgtgtgtca

SEQ ID NO: 325977 - DNA, 20 bp, human
ggggaagagccagtggcaaa

SEQ ID NO: 325978 - DNA, 20 bp, human
ggcaaccgccctgactacca

SEQ ID NO: 325979 - DNA, 20 bp, human
gttgagaactgagtggggct

SEQ ID NO: 325980 - DNA, 20 bp, human
gttatcgcttctgcggggac

SEQ ID NO: 325981 - DNA, 20 bp, human
gccccactcagttctcaaaa

SEQ ID NO: 325982 - DNA, 20 bp, human
gctgcattatcgcttctgcg

SEQ ID NO: 325983 - DNA, 20 bp, human
gccagccctggtagtcaggg

SEQ ID NO: 325984 - DNA, 20 bp, human
gtcgctgatgtcaattgctg

SEQ ID NO: 325985 - DNA, 20 bp, human
gcggaaggtggcaggttcct

SEQ ID NO: 325986 - DNA, 20 bp, human
gtcccggtacaaatgaagga

SEQ ID NO: 325987 - DNA, 20 bp, human
gggcgtcccggtacaaatga

SEQ ID NO: 325988 - DNA, 20 bp, human
ggggccgccgctgcaatccc

SEQ ID NO: 325989 - DNA, 20 bp, human
gtggcgcgccgcgacctagg

SEQ ID NO: 325990 - DNA, 20 bp, human
gtcgcggcgcgccaggccct

SEQ ID NO: 325991 - DNA, 20 bp, human
gacagagcccactcaagcaa

SEQ ID NO: 325992 - DNA, 20 bp, human
gctgcggcgctggatggcca

SEQ ID NO: 325993 - DNA, 20 bp, human
gcccctccttcatttgtacc

SEQ ID NO: 325994 - DNA, 20 bp, human
gtgagggcgggccgctgcgg

SEQ ID NO: 325995 - DNA, 20 bp, human
gcgcgccgcgacctaggggg

SEQ ID NO: 325996 - DNA, 20 bp, human
ggggcggggccgcacttttc

SEQ ID NO: 325997 - DNA, 20 bp, human
ggggccgcacttttcaggtt

SEQ ID NO: 325998 - DNA, 20 bp, human
ggggaagctaccagtggctg

SEQ ID NO: 325999 - DNA, 20 bp, human
gcgtggaaggcccgcctccc

SEQ ID NO: 326000 - DNA, 20 bp, human
gttccacgggaagctaccag

SEQ ID NO: 326001 - DNA, 20 bp, human
ggccaagcgcaaccactccg

SEQ ID NO: 326002 - DNA, 20 bp, human
ggtagcaaaggaggtaaaaa

SEQ ID NO: 326003 - DNA, 20 bp, human
gcccggggcagctgcggcct

SEQ ID NO: 326004 - DNA, 20 bp, human
gccccgccccaggtccggga

SEQ ID NO: 326005 - DNA, 20 bp, human
ggccccaggtccgggagggt

SEQ ID NO: 326006 - DNA, 20 bp, human
ggacgccgaagccccaagtc

SEQ ID NO: 326007 - DNA, 20 bp, human
gcgggcgggcgcagtggcca

SEQ ID NO: 326008 - DNA, 20 bp, human
gccgaagtcggccagacttg

SEQ ID NO: 326009 - DNA, 20 bp, human
gccccactcgagcaccaagc

SEQ ID NO: 326010 - DNA, 20 bp, human
gtcggccagacttggggctt

SEQ ID NO: 326011 - DNA, 20 bp, human
gtggggcaggccgtacccgg

SEQ ID NO: 326012 - DNA, 20 bp, human
gcgctggggcaggccgtacc

SEQ ID NO: 326013 - DNA, 20 bp, human
ggacagactctgcccaggtg

SEQ ID NO: 326014 - DNA, 20 bp, human
gacgcgaaatcggagactct

SEQ ID NO: 326015 - DNA, 20 bp, human
gctctccagagtcccagatg

SEQ ID NO: 326016 - DNA, 20 bp, human
gctgccacctagtgaggttc

SEQ ID NO: 326017 - DNA, 20 bp, human
gtcactaggtggcagctgat

SEQ ID NO: 326018 - DNA, 20 bp, human
gtggcagggcaggataggtg

SEQ ID NO: 326019 - DNA, 20 bp, human
gagacctgaacctcactagg

SEQ ID NO: 326020 - DNA, 20 bp, human
gtgaacccggcggcagaagt

SEQ ID NO: 326021 - DNA, 20 bp, human
gtaatcggtgagaatgggag

SEQ ID NO: 326022 - DNA, 20 bp, human
gctaggtggcagctgattgg

SEQ ID NO: 326023 - DNA, 20 bp, human
gcgcggtaatcggtgagaat

SEQ ID NO: 326024 - DNA, 20 bp, human
ggggcaggataggtggggcc

SEQ ID NO: 326025 - DNA, 20 bp, human
gggaggaaatgccttcgccc

SEQ ID NO: 326026 - DNA, 20 bp, human
gtgaagccacacataggtgt

SEQ ID NO: 326027 - DNA, 20 bp, human
gaattacccacacctatgtg

SEQ ID NO: 326028 - DNA, 20 bp, human
gtgaacacgaaagaaataac

SEQ ID NO: 326029 - DNA, 20 bp, human
ggcaatagaagtacaacaga

SEQ ID NO: 326030 - DNA, 20 bp, human
ggggtaattaattacaactt

SEQ ID NO: 326031 - DNA, 20 bp, human
gataactatatctgatgctt

SEQ ID NO: 326032 - DNA, 20 bp, human
gacagatgttataggatatt

SEQ ID NO: 326033 - DNA, 20 bp, human
gtcaggcattttggcatata

SEQ ID NO: 326034 - DNA, 20 bp, human
gtagttatttttatgcacta

SEQ ID NO: 326035 - DNA, 20 bp, human
gttgttctgtgcatctcaga

SEQ ID NO: 326036 - DNA, 20 bp, human
ggcgcacagtgcgtcgggaa

SEQ ID NO: 326037 - DNA, 20 bp, human
gggggccccgtgagaggcga

SEQ ID NO: 326038 - DNA, 20 bp, human
gtctaggcgggcagcacgaa

SEQ ID NO: 326039 - DNA, 20 bp, human
ggggcagcacgaacggtccg

SEQ ID NO: 326040 - DNA, 20 bp, human
gcgcatgcgcacagtgcgtc

SEQ ID NO: 326041 - DNA, 20 bp, human
gcagcacgaacggtccgcgg

SEQ ID NO: 326042 - DNA, 20 bp, human
gcgtgctgcccgcctagaaa

SEQ ID NO: 326043 - DNA, 20 bp, human
gcgcatgcgctggtcctccg

SEQ ID NO: 326044 - DNA, 20 bp, human
gcgggaacgggaagggctaa

SEQ ID NO: 326045 - DNA, 20 bp, human
ggcaatccatcgcctctcac

SEQ ID NO: 326046 - DNA, 20 bp, human
gcgctcgagggaaacttcag

SEQ ID NO: 326047 - DNA, 20 bp, human
gtcgctacgccagcgtcgac

SEQ ID NO: 326048 - DNA, 20 bp, human
gtcggaacgtgacatcacga

SEQ ID NO: 326049 - DNA, 20 bp, human
gcacggaagtgaggcgggtc

SEQ ID NO: 326050 - DNA, 20 bp, human
gcgaaggagtacagtgacgt

SEQ ID NO: 326051 - DNA, 20 bp, human
ggacgtcaccccgtcgacgc

SEQ ID NO: 326052 - DNA, 20 bp, human
gcgtatgtacgtacgctcga

SEQ ID NO: 326053 - DNA, 20 bp, human
gcatggccacgagagggcgg

SEQ ID NO: 326054 - DNA, 20 bp, human
gagggggcggtgccgttaaa

SEQ ID NO: 326055 - DNA, 20 bp, human
gcgcacgcatggccacgaga

SEQ ID NO: 326056 - DNA, 20 bp, human
gcccccgcggggcagaacag

SEQ ID NO: 326057 - DNA, 20 bp, human
ggcaaaggtggggttaatgg

SEQ ID NO: 326058 - DNA, 20 bp, human
ggaagcctgaaaggggttaa

SEQ ID NO: 326059 - DNA, 20 bp, human
gggttaaggggcagcggcaa

SEQ ID NO: 326060 - DNA, 20 bp, human
gtggctggaggcgtttaatg

SEQ ID NO: 326061 - DNA, 20 bp, human
gatggggtgaagcctgaaag

SEQ ID NO: 326062 - DNA, 20 bp, human
gacgcctccagccacgggtg

SEQ ID NO: 326063 - DNA, 20 bp, human
gtggggacttggaaggattc

SEQ ID NO: 326064 - DNA, 20 bp, human
gggtgaggctcatctgctac

SEQ ID NO: 326065 - DNA, 20 bp, human
gagcagatgagcctcacccg

SEQ ID NO: 326066 - DNA, 20 bp, human
ggctgcatggccgacgtgta

SEQ ID NO: 326067 - DNA, 20 bp, human
gtgaaccaggccatacacgt

SEQ ID NO: 326068 - DNA, 20 bp, human
gttcccgagggatggactga

SEQ ID NO: 326069 - DNA, 20 bp, human
gttaactgacaaagctgcag

SEQ ID NO: 326070 - DNA, 20 bp, human
gcagcagcccatctttcccg

SEQ ID NO: 326071 - DNA, 20 bp, human
gcagaagcccccaagctctc

SEQ ID NO: 326072 - DNA, 20 bp, human
gtccatccctcgggaaagat

SEQ ID NO: 326073 - DNA, 20 bp, human
ggactcccgtcagctgggga

SEQ ID NO: 326074 - DNA, 20 bp, human
gaagccctcagtccatccct

SEQ ID NO: 326075 - DNA, 20 bp, human
gggacattcgggatgtctgg

SEQ ID NO: 326076 - DNA, 20 bp, human
gactgcgcgctcatcccgac

SEQ ID NO: 326077 - DNA, 20 bp, human
gtggccgcgagtcgccgacc

SEQ ID NO: 326078 - DNA, 20 bp, human
gtgtcgggacggagcgaagt

SEQ ID NO: 326079 - DNA, 20 bp, human
ggcagccagggtcgtccggt

SEQ ID NO: 326080 - DNA, 20 bp, human
gcggacgaccctggctgcgc

SEQ ID NO: 326081 - DNA, 20 bp, human
ggccaccgaccggacgaccc

SEQ ID NO: 326082 - DNA, 20 bp, human
ggcgtctcgtgccgcgtccc

SEQ ID NO: 326083 - DNA, 20 bp, human
gtctgcgctggcatcggcga

SEQ ID NO: 326084 - DNA, 20 bp, human
gggtgcgggctcatccccgc

SEQ ID NO: 326085 - DNA, 20 bp, human
gaacgcggcgcccctcgcag

SEQ ID NO: 326086 - DNA, 20 bp, human
gccctggtcaggaaactcta

SEQ ID NO: 326087 - DNA, 20 bp, human
gcagccagcgggccctggtc

SEQ ID NO: 326088 - DNA, 20 bp, human
gggaccaaaccggagcgctc

SEQ ID NO: 326089 - DNA, 20 bp, human
gcgaagcccgaggaccaaac

SEQ ID NO: 326090 - DNA, 20 bp, human
gcggccggctcccttgcacc

SEQ ID NO: 326091 - DNA, 20 bp, human
gacactgcagcgggaagagg

SEQ ID NO: 326092 - DNA, 20 bp, human
ggtagcccagcgcttcccta

SEQ ID NO: 326093 - DNA, 20 bp, human
gggaggggacagtgcaatcc

SEQ ID NO: 326094 - DNA, 20 bp, human
gggaaggagccagagcgctc

SEQ ID NO: 326095 - DNA, 20 bp, human
gtgcccgcggagttcggcca

SEQ ID NO: 326096 - DNA, 20 bp, human
ggccacgggcgcaggatcaa

SEQ ID NO: 326097 - DNA, 20 bp, human
gccactggtcccggcactcg

SEQ ID NO: 326098 - DNA, 20 bp, human
gcgtggcccggggaagcgca

SEQ ID NO: 326099 - DNA, 20 bp, human
gcctcggggaggagcctaca

SEQ ID NO: 326100 - DNA, 20 bp, human
gtctgcggccctcgggtctc

SEQ ID NO: 326101 - DNA, 20 bp, human
gttccccgggccacgggcgc

SEQ ID NO: 326102 - DNA, 20 bp, human
gccccccgcgccactggtcc

SEQ ID NO: 326103 - DNA, 20 bp, human
ggggaaggacgtccgccagt

SEQ ID NO: 326104 - DNA, 20 bp, human
gccacaacagggcttcccac

SEQ ID NO: 326105 - DNA, 20 bp, human
gagtgccgggaccagtggcg

SEQ ID NO: 326106 - DNA, 20 bp, human
gtcaggagcaggggagcaag

SEQ ID NO: 326107 - DNA, 20 bp, human
ggggctcgcctcaggagcag

SEQ ID NO: 326108 - DNA, 20 bp, human
gtgggtggggcgtctgagtt

SEQ ID NO: 326109 - DNA, 20 bp, human
gccacccatccccgccagga

SEQ ID NO: 326110 - DNA, 20 bp, human
gtgaggcgagcccgcaaggg

SEQ ID NO: 326111 - DNA, 20 bp, human
gtcctgaggcgagcccgcaa

SEQ ID NO: 326112 - DNA, 20 bp, human
gtctgcaaatcctgacccgt

SEQ ID NO: 326113 - DNA, 20 bp, human
gtagggccgaggcctggaac

SEQ ID NO: 326114 - DNA, 20 bp, human
ggcggacgcaggacagtaga

SEQ ID NO: 326115 - DNA, 20 bp, human
gtggcctcgcaaggaggatc

SEQ ID NO: 326116 - DNA, 20 bp, human
ggagcaaggaagcaaggggt

SEQ ID NO: 326117 - DNA, 20 bp, human
gcaaggaagcaaggggtggg

SEQ ID NO: 326118 - DNA, 20 bp, human
gctcctgaggcgagcccccg

SEQ ID NO: 326119 - DNA, 20 bp, human
ggcccccgggggctcgcctc

SEQ ID NO: 326120 - DNA, 20 bp, human
gtcaggagcaaggaagcaag

SEQ ID NO: 326121 - DNA, 20 bp, human
gaatccctctgagccgcccc

SEQ ID NO: 326122 - DNA, 20 bp, human
ggcccaattaagagatcaga

SEQ ID NO: 326123 - DNA, 20 bp, human
gttaagagatcagatggtgt

SEQ ID NO: 326124 - DNA, 20 bp, human
gtgtctaaaaaaaagtggct

SEQ ID NO: 326125 - DNA, 20 bp, human
ggatcagatggtgtaggatt

SEQ ID NO: 326126 - DNA, 20 bp, human
ggagcaaggaagcaaggggt

SEQ ID NO: 326127 - DNA, 20 bp, human
gctcctgaggcgagcccccg

SEQ ID NO: 326128 - DNA, 20 bp, human
gcaaggaagcaaggggtggg

SEQ ID NO: 326129 - DNA, 20 bp, human
ggcccccgggggctcgcctc

SEQ ID NO: 326130 - DNA, 20 bp, human
gtcaggagcaaggaagcaag

SEQ ID NO: 326131 - DNA, 20 bp, human
gaatccctctgagccgcccc

SEQ ID NO: 326132 - DNA, 20 bp, human
ggcccaattaagagatcaga

SEQ ID NO: 326133 - DNA, 20 bp, human
gttaagagatcagatggtgt

SEQ ID NO: 326134 - DNA, 20 bp, human
gtgtctaaaaaaaagtggct

SEQ ID NO: 326135 - DNA, 20 bp, human
ggatcagatggtgtaggatt

SEQ ID NO: 326136 - DNA, 20 bp, human
gaacagaagtggactccctg

SEQ ID NO: 326137 - DNA, 20 bp, human
gccctcctctaaaaacactt

SEQ ID NO: 326138 - DNA, 20 bp, human
gttggggccacaaaaggttt

SEQ ID NO: 326139 - DNA, 20 bp, human
gcctcccaaggacaaagttt

SEQ ID NO: 326140 - DNA, 20 bp, human
gccactacctaaaccttttg

SEQ ID NO: 326141 - DNA, 20 bp, human
gcaaaggggcagatgagttg

SEQ ID NO: 326142 - DNA, 20 bp, human
gtgaagaacacaatcggctt

SEQ ID NO: 326143 - DNA, 20 bp, human
gttagaggaggggttttgtg

SEQ ID NO: 326144 - DNA, 20 bp, human
gaatcccaaactttgtcctt

SEQ ID NO: 326145 - DNA, 20 bp, human
gcagccctgggctgcaggaa

SEQ ID NO: 326146 - DNA, 20 bp, human
gggaaggtgcccagccagtg

SEQ ID NO: 326147 - DNA, 20 bp, human
gccccgcgggcgcgtcctcg

SEQ ID NO: 326148 - DNA, 20 bp, human
gcgggcccctcagtgcacaa

SEQ ID NO: 326149 - DNA, 20 bp, human
ggcagcggagcgacgaggac

SEQ ID NO: 326150 - DNA, 20 bp, human
gggccgcagggtagcctcga

SEQ ID NO: 326151 - DNA, 20 bp, human
gcgggagcagcggagcgacg

SEQ ID NO: 326152 - DNA, 20 bp, human
gggggtgtgaagagccatcg

SEQ ID NO: 326153 - DNA, 20 bp, human
ggagcgacgaggacaggccg

SEQ ID NO: 326154 - DNA, 20 bp, human
gcgcgtcgcgggatagcctg

SEQ ID NO: 326155 - DNA, 20 bp, human
ggtccacgccgaccagcgga

SEQ ID NO: 326156 - DNA, 20 bp, human
gtacgaaggtctgatgatgg

SEQ ID NO: 326157 - DNA, 20 bp, human
gaagatggggatgaactctg

SEQ ID NO: 326158 - DNA, 20 bp, human
gcactcagaccaaggtctct

SEQ ID NO: 326159 - DNA, 20 bp, human
gtctgggtgtctatctacga

SEQ ID NO: 326160 - DNA, 20 bp, human
gatctacgaaggtctgatga

SEQ ID NO: 326161 - DNA, 20 bp, human
gccacatcgctatataaaga

SEQ ID NO: 326162 - DNA, 20 bp, human
ggaccttggtctgagtgagc

SEQ ID NO: 326163 - DNA, 20 bp, human
gtctgagtgagctggcggca

SEQ ID NO: 326164 - DNA, 20 bp, human
ggagacttctggaatgatgg

SEQ ID NO: 326165 - DNA, 20 bp, human
ggatagacacccagagacct

SEQ ID NO: 326166 - DNA, 20 bp, human
gaagtcaatggggtgctgtc

SEQ ID NO: 326167 - DNA, 20 bp, human
ggagtggaaggagatgtgaa

SEQ ID NO: 326168 - DNA, 20 bp, human
gtacacctcttcaaccctta

SEQ ID NO: 326169 - DNA, 20 bp, human
ggattcagaaatcagaaatc

SEQ ID NO: 326170 - DNA, 20 bp, human
gaaatcaggaggcaaatccc

SEQ ID NO: 326171 - DNA, 20 bp, human
gcagatgtctcaaagtgtag

SEQ ID NO: 326172 - DNA, 20 bp, human
gcaggcatgttagatgctga

SEQ ID NO: 326173 - DNA, 20 bp, human
gacttccataagggttgaag

SEQ ID NO: 326174 - DNA, 20 bp, human
gttgtgaagcgaagagtgga

SEQ ID NO: 326175 - DNA, 20 bp, human
gtcgtctagaagacatgtaa

SEQ ID NO: 326176 - DNA, 20 bp, human
gagccggcggagcatcccta

SEQ ID NO: 326177 - DNA, 20 bp, human
ggcggagcatccctagggag

SEQ ID NO: 326178 - DNA, 20 bp, human
gagtctgcgcccgcgaccgg

SEQ ID NO: 326179 - DNA, 20 bp, human
ggggagtccaggttgggacg

SEQ ID NO: 326180 - DNA, 20 bp, human
gggggcggacgctgcaccac

SEQ ID NO: 326181 - DNA, 20 bp, human
gtgacaccaaagtggcaagg

SEQ ID NO: 326182 - DNA, 20 bp, human
gctcccgcccctgcactaac

SEQ ID NO: 326183 - DNA, 20 bp, human
gccgcccctgcactaacagg

SEQ ID NO: 326184 - DNA, 20 bp, human
gaatgaatggggtgcaagaa

SEQ ID NO: 326185 - DNA, 20 bp, human
gcagactggcggccgcctcc

SEQ ID NO: 326186 - DNA, 20 bp, human
gtgcgggcggagagctcgtc

SEQ ID NO: 326187 - DNA, 20 bp, human
ggcgcccgccccaggccggc

SEQ ID NO: 326188 - DNA, 20 bp, human
gcgtctggtgcgcccgcccc

SEQ ID NO: 326189 - DNA, 20 bp, human
gcggcacaccgcctggtccc

SEQ ID NO: 326190 - DNA, 20 bp, human
gcagagccgccgccagtagt

SEQ ID NO: 326191 - DNA, 20 bp, human
gggcccactaactgcccgag

SEQ ID NO: 326192 - DNA, 20 bp, human
gagtgggccgggcgagcctg

SEQ ID NO: 326193 - DNA, 20 bp, human
ggcagggacctgccggcctg

SEQ ID NO: 326194 - DNA, 20 bp, human
gtgccgctcgggcagttagt

SEQ ID NO: 326195 - DNA, 20 bp, human
gccagccccgcaggctcgcc

SEQ ID NO: 326196 - DNA, 20 bp, human
gcgccggccccacactggac

SEQ ID NO: 326197 - DNA, 20 bp, human
gcccacgggttcacagacac

SEQ ID NO: 326198 - DNA, 20 bp, human
gcacacagagatgaaaaagg

SEQ ID NO: 326199 - DNA, 20 bp, human
ggctgcagctccagaagggg

SEQ ID NO: 326200 - DNA, 20 bp, human
gaaggtgggtcaccgcaccc

SEQ ID NO: 326201 - DNA, 20 bp, human
gtctgtccccgtccagtgtg

SEQ ID NO: 326202 - DNA, 20 bp, human
ggtccgggccagtctgtcca

SEQ ID NO: 326203 - DNA, 20 bp, human
ggaggctgcagctccagaag

SEQ ID NO: 326204 - DNA, 20 bp, human
gggggacagacacacagtcc

SEQ ID NO: 326205 - DNA, 20 bp, human
gcacggacagagatgcccac

SEQ ID NO: 326206 - DNA, 20 bp, human
gccggcccgacagtcgggga

SEQ ID NO: 326207 - DNA, 20 bp, human
gaagtcccggcccctggctt

SEQ ID NO: 326208 - DNA, 20 bp, human
gcagtgcgcaggcgcctcgg

SEQ ID NO: 326209 - DNA, 20 bp, human
gcacgggactcgaaccccaa

SEQ ID NO: 326210 - DNA, 20 bp, human
gcaaggtccggcccgacagt

SEQ ID NO: 326211 - DNA, 20 bp, human
gcgggcccggggaccgtgct

SEQ ID NO: 326212 - DNA, 20 bp, human
ggcgccccctccccgactgt

SEQ ID NO: 326213 - DNA, 20 bp, human
gcgccggcgcgaggaagtcc

SEQ ID NO: 326214 - DNA, 20 bp, human
gtcctcgcgccggcggtcgc

SEQ ID NO: 326215 - DNA, 20 bp, human
gcgcgagtggctcgggagcg

SEQ ID NO: 326216 - DNA, 20 bp, human
gtgggccatgcgggattcgg

SEQ ID NO: 326217 - DNA, 20 bp, human
ggaagagcattggggtttta

SEQ ID NO: 326218 - DNA, 20 bp, human
ggccccgcaccgctgcagga

SEQ ID NO: 326219 - DNA, 20 bp, human
gaaggagtaggtctcttcac

SEQ ID NO: 326220 - DNA, 20 bp, human
ggtgcaaacacatctaaagg

SEQ ID NO: 326221 - DNA, 20 bp, human
gtctgtgcaaacacatctaa

SEQ ID NO: 326222 - DNA, 20 bp, human
gtattccctgccagatttta

SEQ ID NO: 326223 - DNA, 20 bp, human
gaatctggcagggaatacat

SEQ ID NO: 326224 - DNA, 20 bp, human
gtcccctcctgcagcggtgc

SEQ ID NO: 326225 - DNA, 20 bp, human
gtggggttttagggctgtta

SEQ ID NO: 326226 - DNA, 20 bp, human
gaaggagctgacagagtaag

SEQ ID NO: 326227 - DNA, 20 bp, human
gtcaaagagaaggtgtatgg

SEQ ID NO: 326228 - DNA, 20 bp, human
gtggggggtgaagcggaagg

SEQ ID NO: 326229 - DNA, 20 bp, human
ggagaagtctgattggtcgc

SEQ ID NO: 326230 - DNA, 20 bp, human
gactcagaatctgagggatg

SEQ ID NO: 326231 - DNA, 20 bp, human
ggttagacagtggtgcccgg

SEQ ID NO: 326232 - DNA, 20 bp, human
gtgtggccttatcaggagag

SEQ ID NO: 326233 - DNA, 20 bp, human
gatggggccccttccttgca

SEQ ID NO: 326234 - DNA, 20 bp, human
ggtgctggcgctctaggtga

SEQ ID NO: 326235 - DNA, 20 bp, human
gtcaaagatgtggccttatc

SEQ ID NO: 326236 - DNA, 20 bp, human
gaggctctccagagtgttgt

SEQ ID NO: 326237 - DNA, 20 bp, human
gcaagtggggcggtggaggg

SEQ ID NO: 326238 - DNA, 20 bp, human
gaggaagggcagcgatctga

SEQ ID NO: 326239 - DNA, 20 bp, human
gcagctgggactatgtcttg

SEQ ID NO: 326240 - DNA, 20 bp, human
gctccagagtgttgtgggaa

SEQ ID NO: 326241 - DNA, 20 bp, human
gcgtgtaaaaacactcaagt

SEQ ID NO: 326242 - DNA, 20 bp, human
gagccattcccacaacactc

SEQ ID NO: 326243 - DNA, 20 bp, human
ggcactgagtctgcaagtgt

SEQ ID NO: 326244 - DNA, 20 bp, human
ggagtctgcaagtgtggggg

SEQ ID NO: 326245 - DNA, 20 bp, human
ggacatagtcccagctggta

SEQ ID NO: 326246 - DNA, 20 bp, human
ggaggggcggggccttggtc

SEQ ID NO: 326247 - DNA, 20 bp, human
ggccttggtcgggtggggta

SEQ ID NO: 326248 - DNA, 20 bp, human
ggatgggcggggtatgggat

SEQ ID NO: 326249 - DNA, 20 bp, human
ggctgggacccgggtgaaca

SEQ ID NO: 326250 - DNA, 20 bp, human
ggaccccgcacggacagcga

SEQ ID NO: 326251 - DNA, 20 bp, human
ggggcggggccttggtcggg

SEQ ID NO: 326252 - DNA, 20 bp, human
gcccgcgccggggaatttcc

SEQ ID NO: 326253 - DNA, 20 bp, human
gcccgcacggacagcgaggg

SEQ ID NO: 326254 - DNA, 20 bp, human
gacagcgagggtgggtagct

SEQ ID NO: 326255 - DNA, 20 bp, human
ggggatctgcgggaagacac

SEQ ID NO: 326256 - DNA, 20 bp, human
gcaggcccatctcagagatt

SEQ ID NO: 326257 - DNA, 20 bp, human
gcatctcagagattaggctc

SEQ ID NO: 326258 - DNA, 20 bp, human
gggcctgaatcagcttctag

SEQ ID NO: 326259 - DNA, 20 bp, human
gctcctctagaagctgattc

SEQ ID NO: 326260 - DNA, 20 bp, human
ggaaaggttagcatgtattg

SEQ ID NO: 326261 - DNA, 20 bp, human
gtttctgaagggtccatcaa

SEQ ID NO: 326262 - DNA, 20 bp, human
gagaatcacaagtttctgaa

SEQ ID NO: 326263 - DNA, 20 bp, human
gcagactcgttcttactgtc

SEQ ID NO: 326264 - DNA, 20 bp, human
gaatttgagaggagggtgaa

SEQ ID NO: 326265 - DNA, 20 bp, human
gaccttaagttattcagaaa

SEQ ID NO: 326266 - DNA, 20 bp, human
ggggaacccaagtgcagcag

SEQ ID NO: 326267 - DNA, 20 bp, human
ggggaacttggcattaagag

SEQ ID NO: 326268 - DNA, 20 bp, human
gcaactaagggaagaggtat

SEQ ID NO: 326269 - DNA, 20 bp, human
gcagaggcagagacccatct

SEQ ID NO: 326270 - DNA, 20 bp, human
gagacccatcttggagacag

SEQ ID NO: 326271 - DNA, 20 bp, human
gaagcagtgtccttaaaggc

SEQ ID NO: 326272 - DNA, 20 bp, human
gaataacagtaaatgttatc

SEQ ID NO: 326273 - DNA, 20 bp, human
ggcttctaacccatacagat

SEQ ID NO: 326274 - DNA, 20 bp, human
gtctgccactgtctccaaga

SEQ ID NO: 326275 - DNA, 20 bp, human
gattcactattacaagtcat

SEQ ID NO: 326276 - DNA, 20 bp, human
gaaaagtggtgaggtcaggc

SEQ ID NO: 326277 - DNA, 20 bp, human
gtattgaagagagataaggt

SEQ ID NO: 326278 - DNA, 20 bp, human
gttataaaggggacctcctg

SEQ ID NO: 326279 - DNA, 20 bp, human
gatcctcaacaactctaaca

SEQ ID NO: 326280 - DNA, 20 bp, human
gaagaagcccatactcagga

SEQ ID NO: 326281 - DNA, 20 bp, human
gtaaagaatgaggccacagg

SEQ ID NO: 326282 - DNA, 20 bp, human
gcgtgacacataatgaaaag

SEQ ID NO: 326283 - DNA, 20 bp, human
gtctcaagaagcccatactc

SEQ ID NO: 326284 - DNA, 20 bp, human
ggtgaaaccttcctgagtat

SEQ ID NO: 326285 - DNA, 20 bp, human
gttccttgttagagttgttg

SEQ ID NO: 326286 - DNA, 20 bp, human
gaagaggaagggtcttgtgt

SEQ ID NO: 326287 - DNA, 20 bp, human
gaagcagtgaaatgagcaat

SEQ ID NO: 326288 - DNA, 20 bp, human
ggcaaggtcagcacctcagc

SEQ ID NO: 326289 - DNA, 20 bp, human
gaattcttacggtgagtgag

SEQ ID NO: 326290 - DNA, 20 bp, human
gtgagaatgtttatagggtg

SEQ ID NO: 326291 - DNA, 20 bp, human
gatgagtgagaatgtttata

SEQ ID NO: 326292 - DNA, 20 bp, human
gctcttaatgtcagggatag

SEQ ID NO: 326293 - DNA, 20 bp, human
gataaagacacaataaaacg

SEQ ID NO: 326294 - DNA, 20 bp, human
gctcaaaattaagatcggag

SEQ ID NO: 326295 - DNA, 20 bp, human
gtgactctcaaaattaagat

SEQ ID NO: 326296 - DNA, 20 bp, human
gacacttgcaccaatgttat

SEQ ID NO: 326297 - DNA, 20 bp, human
gtagacaatgaccaaatact

SEQ ID NO: 326298 - DNA, 20 bp, human
ggactggaactcttagctaa

SEQ ID NO: 326299 - DNA, 20 bp, human
gtcctgacagaaattttctt

SEQ ID NO: 326300 - DNA, 20 bp, human
ggcattcaccccagaaattc

SEQ ID NO: 326301 - DNA, 20 bp, human
gactcttagctaatggactg

SEQ ID NO: 326302 - DNA, 20 bp, human
gggttccaatcccataacat

SEQ ID NO: 326303 - DNA, 20 bp, human
gggaatataatccaagtatt

SEQ ID NO: 326304 - DNA, 20 bp, human
ggttatgggattggaaccta

SEQ ID NO: 326305 - DNA, 20 bp, human
gaaagtacctatatatgact

SEQ ID NO: 326306 - DNA, 20 bp, human
gtgctcatattcttcaacgt

SEQ ID NO: 326307 - DNA, 20 bp, human
ggaaaaaaattacatctagg

SEQ ID NO: 326308 - DNA, 20 bp, human
gtgcaataaagataaataat

SEQ ID NO: 326309 - DNA, 20 bp, human
gttatgataagataaaatta

SEQ ID NO: 326310 - DNA, 20 bp, human
ggggtattaaatcaatatag

SEQ ID NO: 326311 - DNA, 20 bp, human
ggtgtgtgtactgggcatgt

SEQ ID NO: 326312 - DNA, 20 bp, human
gtgagaaaaaaattacatct

SEQ ID NO: 326313 - DNA, 20 bp, human
gtgagaataaagatgtttta

SEQ ID NO: 326314 - DNA, 20 bp, human
gtcaaagtatgtgcatcaaa

SEQ ID NO: 326315 - DNA, 20 bp, human
gtatatgtatatatttatag

SEQ ID NO: 326316 - DNA, 20 bp, human
gaaaatgccagggtcatcac

SEQ ID NO: 326317 - DNA, 20 bp, human
ggctaatccttcaatattga

SEQ ID NO: 326318 - DNA, 20 bp, human
gccagagccctcaatattga

SEQ ID NO: 326319 - DNA, 20 bp, human
gaatggagtgtgtgagggaa

SEQ ID NO: 326320 - DNA, 20 bp, human
ggcaaatcactgttagctga

SEQ ID NO: 326321 - DNA, 20 bp, human
gtctgggaccatgccaactg

SEQ ID NO: 326322 - DNA, 20 bp, human
ggaaggattagccattaacc

SEQ ID NO: 326323 - DNA, 20 bp, human
gtagctgagggacaattgtg

SEQ ID NO: 326324 - DNA, 20 bp, human
gcggggtggtgaaaatgcca

SEQ ID NO: 326325 - DNA, 20 bp, human
gttaaccaggatgtattcag

SEQ ID NO: 326326 - DNA, 20 bp, human
gtgggatataatgcaaccag

SEQ ID NO: 326327 - DNA, 20 bp, human
ggaaaatattgttcaaaata

SEQ ID NO: 326328 - DNA, 20 bp, human
gctagaaacagagcaagtac

SEQ ID NO: 326329 - DNA, 20 bp, human
gtaagataattgattctcac

SEQ ID NO: 326330 - DNA, 20 bp, human
ggcatgcttctcaatgcctc

SEQ ID NO: 326331 - DNA, 20 bp, human
gctcatttagttaacccaag

SEQ ID NO: 326332 - DNA, 20 bp, human
gtgttgtttagaaaatatta

SEQ ID NO: 326333 - DNA, 20 bp, human
gaattaatcgtaatattcaa

SEQ ID NO: 326334 - DNA, 20 bp, human
gattctcactggtgcataaa

SEQ ID NO: 326335 - DNA, 20 bp, human
gttgaacaatattttcctct

SEQ ID NO: 326336 - DNA, 20 bp, human
gcccagaggagaatgaacca

SEQ ID NO: 326337 - DNA, 20 bp, human
gtcttgaggaagcctctctt

SEQ ID NO: 326338 - DNA, 20 bp, human
ggcaaaaggatatcagtgtg

SEQ ID NO: 326339 - DNA, 20 bp, human
gtctggcatctgggaatatt

SEQ ID NO: 326340 - DNA, 20 bp, human
gacacaaccttgaatatggc

SEQ ID NO: 326341 - DNA, 20 bp, human
gccagaagatattatctcaa

SEQ ID NO: 326342 - DNA, 20 bp, human
gtatattcaagtgtatcttt

SEQ ID NO: 326343 - DNA, 20 bp, human
gttagataaatctggcatct

SEQ ID NO: 326344 - DNA, 20 bp, human
gacatagtggatccctcttg

SEQ ID NO: 326345 - DNA, 20 bp, human
gttcatgtttacaatgtaag

SEQ ID NO: 326346 - DNA, 20 bp, human
gaaaaggggacaatgatagt

SEQ ID NO: 326347 - DNA, 20 bp, human
gtgggcactacctatgtgaa

SEQ ID NO: 326348 - DNA, 20 bp, human
ggccaggatttgccagatga

SEQ ID NO: 326349 - DNA, 20 bp, human
gggttagtttcctagatggg

SEQ ID NO: 326350 - DNA, 20 bp, human
ggctggttagtttcctagat

SEQ ID NO: 326351 - DNA, 20 bp, human
gcaagagtttcctcccatct

SEQ ID NO: 326352 - DNA, 20 bp, human
gaagtgagttcgccaaggag

SEQ ID NO: 326353 - DNA, 20 bp, human
gtccttcatctggcaaatcc

SEQ ID NO: 326354 - DNA, 20 bp, human
ggtgtcaccattagttattt

SEQ ID NO: 326355 - DNA, 20 bp, human
gccttggcgaactcactttt

SEQ ID NO: 326356 - DNA, 20 bp, human
gagggagaaacaatgttctc

SEQ ID NO: 326357 - DNA, 20 bp, human
gacgtggaaagatgacaagt

SEQ ID NO: 326358 - DNA, 20 bp, human
gctactatgacagagatgag

SEQ ID NO: 326359 - DNA, 20 bp, human
ggagaagtttctttcttacg

SEQ ID NO: 326360 - DNA, 20 bp, human
gcataaacttacatagagtg

SEQ ID NO: 326361 - DNA, 20 bp, human
ggaaagagattgtaaaaact

SEQ ID NO: 326362 - DNA, 20 bp, human
gttgactgttgtgttagtac

SEQ ID NO: 326363 - DNA, 20 bp, human
ggaattaacatagaggtgag

SEQ ID NO: 326364 - DNA, 20 bp, human
gagtacaggccaggatttcc

SEQ ID NO: 326365 - DNA, 20 bp, human
gtagaaaaagtttgcaccga

SEQ ID NO: 326366 - DNA, 20 bp, human
ggaagctgaaatctcatggg

SEQ ID NO: 326367 - DNA, 20 bp, human
ggcagagggtccagctgacc

SEQ ID NO: 326368 - DNA, 20 bp, human
gcctgcaatagacttggaag

SEQ ID NO: 326369 - DNA, 20 bp, human
gtttgtaacaagcgaagtgc

SEQ ID NO: 326370 - DNA, 20 bp, human
gtgcccaaaaactgcaagaa

SEQ ID NO: 326371 - DNA, 20 bp, human
gcccagaagctgaaatctca

SEQ ID NO: 326372 - DNA, 20 bp, human
gttcatcatcatctctgtga

SEQ ID NO: 326373 - DNA, 20 bp, human
gccaacacctgcaatagact

SEQ ID NO: 326374 - DNA, 20 bp, human
gaaaaattttacacgtttta

SEQ ID NO: 326375 - DNA, 20 bp, human
gtttatctcaccctctctgt

SEQ ID NO: 326376 - DNA, 20 bp, human
ggagagagatgcttgaataa

SEQ ID NO: 326377 - DNA, 20 bp, human
gaagccatatacaaaagagg

SEQ ID NO: 326378 - DNA, 20 bp, human
gtctaaagcaagcttcattc

SEQ ID NO: 326379 - DNA, 20 bp, human
gtgctggcaagctctttccg

SEQ ID NO: 326380 - DNA, 20 bp, human
gtcagtataggtctttgaag

SEQ ID NO: 326381 - DNA, 20 bp, human
gactcaaattaacaacactt

SEQ ID NO: 326382 - DNA, 20 bp, human
gttgaataaaggcttatccc

SEQ ID NO: 326383 - DNA, 20 bp, human
gaagcttcattctggatggc

SEQ ID NO: 326384 - DNA, 20 bp, human
gcttccttttgcttcagtat

SEQ ID NO: 326385 - DNA, 20 bp, human
gtttcctcctcttttgtata

SEQ ID NO: 326386 - DNA, 20 bp, human
gctgatgagagctaaacaga

SEQ ID NO: 326387 - DNA, 20 bp, human
gcattgtcttagattttaat

SEQ ID NO: 326388 - DNA, 20 bp, human
gtgtggttgttggcacgatt

SEQ ID NO: 326389 - DNA, 20 bp, human
gcgtaactctcaacttactg

SEQ ID NO: 326390 - DNA, 20 bp, human
gaacttactgaggtcaccct

SEQ ID NO: 326391 - DNA, 20 bp, human
ggataattctggagttattg

SEQ ID NO: 326392 - DNA, 20 bp, human
gtttaatcaacatatcacca

SEQ ID NO: 326393 - DNA, 20 bp, human
gtcattctccaagcttcttg

SEQ ID NO: 326394 - DNA, 20 bp, human
ggacatatgcggaagaaatt

SEQ ID NO: 326395 - DNA, 20 bp, human
gtgtgagacagagaaagact

SEQ ID NO: 326396 - DNA, 20 bp, human
gtcagctgggttccctgttc

SEQ ID NO: 326397 - DNA, 20 bp, human
gcacacaacccccataaggt

SEQ ID NO: 326398 - DNA, 20 bp, human
gacattgtctcgatttcaat

SEQ ID NO: 326399 - DNA, 20 bp, human
ggacatacgcagaataaatt

SEQ ID NO: 326400 - DNA, 20 bp, human
gacctggtgagaccctgaac

SEQ ID NO: 326401 - DNA, 20 bp, human
gttctcagttatcaattaat

SEQ ID NO: 326402 - DNA, 20 bp, human
ggataattctggagttttca

SEQ ID NO: 326403 - DNA, 20 bp, human
ggatcatcttccaaccttat

SEQ ID NO: 326404 - DNA, 20 bp, human
gcatgcacacaacccccata

SEQ ID NO: 326405 - DNA, 20 bp, human
gcaattaattggtaaatgct

SEQ ID NO: 326406 - DNA, 20 bp, human
gctcaaggtacttcaaaagg

SEQ ID NO: 326407 - DNA, 20 bp, human
gcaaggccaagctgttgaaa

SEQ ID NO: 326408 - DNA, 20 bp, human
gagagactggaacccatagc

SEQ ID NO: 326409 - DNA, 20 bp, human
ggaaatgtagagcttgctca

SEQ ID NO: 326410 - DNA, 20 bp, human
gagcctggagcattttcgtt

SEQ ID NO: 326411 - DNA, 20 bp, human
gctggaacccatagctgggc

SEQ ID NO: 326412 - DNA, 20 bp, human
gttagagccagcccagctat

SEQ ID NO: 326413 - DNA, 20 bp, human
gccccaaacgaaaatgctcc

SEQ ID NO: 326414 - DNA, 20 bp, human
gttctcaatgactatgctca

SEQ ID NO: 326415 - DNA, 20 bp, human
gatgctcaaggtacttcaaa

SEQ ID NO: 326416 - DNA, 20 bp, human
ggacctgcacaaagcactta

SEQ ID NO: 326417 - DNA, 20 bp, human
gtggacgtttccatgacata

SEQ ID NO: 326418 - DNA, 20 bp, human
gcaccttaagtgctttgtgc

SEQ ID NO: 326419 - DNA, 20 bp, human
gaaaagcaaggtgtaggtgg

SEQ ID NO: 326420 - DNA, 20 bp, human
gcagaaaagcaaggtgtagg

SEQ ID NO: 326421 - DNA, 20 bp, human
gcagctgaaggtggcaatca

SEQ ID NO: 326422 - DNA, 20 bp, human
gaggcagaaaagcaaggtgt

SEQ ID NO: 326423 - DNA, 20 bp, human
ggtgtctagtgattcctgcc

SEQ ID NO: 326424 - DNA, 20 bp, human
gtcatctcttccctatgtca

SEQ ID NO: 326425 - DNA, 20 bp, human
gcagcttgctcataaaattc

SEQ ID NO: 326426 - DNA, 20 bp, human
gagaactggcacattttcag

SEQ ID NO: 326427 - DNA, 20 bp, human
gagatgaccaagtcagatgt

SEQ ID NO: 326428 - DNA, 20 bp, human
ggagacaggcatggatgatc

SEQ ID NO: 326429 - DNA, 20 bp, human
ggagctgttgggtttccatt

SEQ ID NO: 326430 - DNA, 20 bp, human
gaacaactggtggaactttc

SEQ ID NO: 326431 - DNA, 20 bp, human
gtatgctattcaacaactgg

SEQ ID NO: 326432 - DNA, 20 bp, human
gtagtagccaacatctgact

SEQ ID NO: 326433 - DNA, 20 bp, human
gcttggggaacaaaaattta

SEQ ID NO: 326434 - DNA, 20 bp, human
gttgaatagcatagagctgt

SEQ ID NO: 326435 - DNA, 20 bp, human
gtgtgtaatttgaaataaga

SEQ ID NO: 326436 - DNA, 20 bp, human
gtgaccctgatcatctatgc

SEQ ID NO: 326437 - DNA, 20 bp, human
gagaccagcatagatgatca

SEQ ID NO: 326438 - DNA, 20 bp, human
gtaaaagacaaagactccca

SEQ ID NO: 326439 - DNA, 20 bp, human
gactgactaacataaagaaa

SEQ ID NO: 326440 - DNA, 20 bp, human
gaaaacatgtattttgatct

SEQ ID NO: 326441 - DNA, 20 bp, human
gtattttaatactgttttat

SEQ ID NO: 326442 - DNA, 20 bp, human
gtgcaccatttgaaattaga

SEQ ID NO: 326443 - DNA, 20 bp, human
gcatctatgctggtctctaa

SEQ ID NO: 326444 - DNA, 20 bp, human
gagatgatcaagtcagattt

SEQ ID NO: 326445 - DNA, 20 bp, human
ggagctgttgagttgccatt

SEQ ID NO: 326446 - DNA, 20 bp, human
gaggtgaggcagcaataatg

SEQ ID NO: 326447 - DNA, 20 bp, human
gagaacctctgagtgtaata

SEQ ID NO: 326448 - DNA, 20 bp, human
gggaagagtagatatgaagt

SEQ ID NO: 326449 - DNA, 20 bp, human
gactcttcctccctgacatc

SEQ ID NO: 326450 - DNA, 20 bp, human
gtatgaagtaggagcatgta

SEQ ID NO: 326451 - DNA, 20 bp, human
ggcactcatctctgaagagt

SEQ ID NO: 326452 - DNA, 20 bp, human
ggagatgagtgcacattttc

SEQ ID NO: 326453 - DNA, 20 bp, human
gtatatgattctatgatgca

SEQ ID NO: 326454 - DNA, 20 bp, human
ggccattccagatgtcaggg

SEQ ID NO: 326455 - DNA, 20 bp, human
gaaaaccgtattacactcag

SEQ ID NO: 326456 - DNA, 20 bp, human
ggaagcatagaaggctaccc

SEQ ID NO: 326457 - DNA, 20 bp, human
gcaagtagacaacaggtcta

SEQ ID NO: 326458 - DNA, 20 bp, human
gtatctctgctctcaatccc

SEQ ID NO: 326459 - DNA, 20 bp, human
gagcagagatagtgatcaga

SEQ ID NO: 326460 - DNA, 20 bp, human
gctgtccccaccctcttctt

SEQ ID NO: 326461 - DNA, 20 bp, human
gctctggatcatatacctct

SEQ ID NO: 326462 - DNA, 20 bp, human
ggatccagaggtgtgcttgc

SEQ ID NO: 326463 - DNA, 20 bp, human
gggtctagggcattgctcag

SEQ ID NO: 326464 - DNA, 20 bp, human
gatgcttccaaagaagaggg

SEQ ID NO: 326465 - DNA, 20 bp, human
gagagatagtgatcagaagg

SEQ ID NO: 326466 - DNA, 20 bp, human
ggccccaaagaggcacaagt

SEQ ID NO: 326467 - DNA, 20 bp, human
gaagcctacttgtgcctctt

SEQ ID NO: 326468 - DNA, 20 bp, human
gcatatgaacattgtcactg

SEQ ID NO: 326469 - DNA, 20 bp, human
gtatgtataaagccccaaag

SEQ ID NO: 326470 - DNA, 20 bp, human
gtggagtcctccttgttaag

SEQ ID NO: 326471 - DNA, 20 bp, human
gggtcactggatttcataac

SEQ ID NO: 326472 - DNA, 20 bp, human
gttaaaccctcttaacaagg

SEQ ID NO: 326473 - DNA, 20 bp, human
ggttaagagggtttaaagag

SEQ ID NO: 326474 - DNA, 20 bp, human
gagcatcatgatcaaaaaga

SEQ ID NO: 326475 - DNA, 20 bp, human
gttgatcatgatgctcatgc

SEQ ID NO: 326476 - DNA, 20 bp, human
gttggagagtgagttgcctt

SEQ ID NO: 326477 - DNA, 20 bp, human
gatctctctgaccaaggatt

SEQ ID NO: 326478 - DNA, 20 bp, human
gggcaactcactctccaaag

SEQ ID NO: 326479 - DNA, 20 bp, human
gtgagcacacatctatttac

SEQ ID NO: 326480 - DNA, 20 bp, human
gtaactgatagccagtttgg

SEQ ID NO: 326481 - DNA, 20 bp, human
ggaacaataagaaatactat

SEQ ID NO: 326482 - DNA, 20 bp, human
gtagcaaatttcctaatcct

SEQ ID NO: 326483 - DNA, 20 bp, human
gctatattctgatcagcttc

SEQ ID NO: 326484 - DNA, 20 bp, human
ggtcacttactataaaccca

SEQ ID NO: 326485 - DNA, 20 bp, human
gcttctctaatgtgaagaac

SEQ ID NO: 326486 - DNA, 20 bp, human
gtgagcaacagcctcatgat

SEQ ID NO: 326487 - DNA, 20 bp, human
gtcttggaaaaacaagaggg

SEQ ID NO: 326488 - DNA, 20 bp, human
gacatgatgttgctaaaatc

SEQ ID NO: 326489 - DNA, 20 bp, human
gcacctccattcccatcatg

SEQ ID NO: 326490 - DNA, 20 bp, human
gcatgtcttggaaaaacaag

SEQ ID NO: 326491 - DNA, 20 bp, human
ggagagactaaaactaagag

SEQ ID NO: 326492 - DNA, 20 bp, human
gtattttcagggatttcttt

SEQ ID NO: 326493 - DNA, 20 bp, human
gatcaagaactttttggcta

SEQ ID NO: 326494 - DNA, 20 bp, human
gaaactaagagtgggggttt

SEQ ID NO: 326495 - DNA, 20 bp, human
gttttagcaacatcatgtct

SEQ ID NO: 326496 - DNA, 20 bp, human
ggtaatatctagaaagtggc

SEQ ID NO: 326497 - DNA, 20 bp, human
gaggcctggaacttgaatcc

SEQ ID NO: 326498 - DNA, 20 bp, human
gggctctcgtcctgtgtctg

SEQ ID NO: 326499 - DNA, 20 bp, human
ggtgagaaaggcgtcgaatt

SEQ ID NO: 326500 - DNA, 20 bp, human
gttaatctctctgagaccca

SEQ ID NO: 326501 - DNA, 20 bp, human
ggaagcagctgctatgacct

SEQ ID NO: 326502 - DNA, 20 bp, human
ggatctctctccagagtgag

SEQ ID NO: 326503 - DNA, 20 bp, human
gaccagggactgtcccgaac

SEQ ID NO: 326504 - DNA, 20 bp, human
ggttcaccatagtgagctgt

SEQ ID NO: 326505 - DNA, 20 bp, human
gaagaaactgggtagcacca

SEQ ID NO: 326506 - DNA, 20 bp, human
gccattcatgaggatttcca

SEQ ID NO: 326507 - DNA, 20 bp, human
gcattctcatgcaccgtgat

SEQ ID NO: 326508 - DNA, 20 bp, human
gactgtctatcccattcatg

SEQ ID NO: 326509 - DNA, 20 bp, human
gtcatctgcagaaattcctg

SEQ ID NO: 326510 - DNA, 20 bp, human
gactaaagaaataaagcggc

SEQ ID NO: 326511 - DNA, 20 bp, human
ggaattcacgatatagggtt

SEQ ID NO: 326512 - DNA, 20 bp, human
ggagaatgaattcacgatat

SEQ ID NO: 326513 - DNA, 20 bp, human
gttatttctttagtaaaagc

SEQ ID NO: 326514 - DNA, 20 bp, human
gtggggggagatatttcaca

SEQ ID NO: 326515 - DNA, 20 bp, human
gaggagtgtacaattttatt

SEQ ID NO: 326516 - DNA, 20 bp, human
gatgagaggtagttaggaac

SEQ ID NO: 326517 - DNA, 20 bp, human
gggtagttaggaaccggaaa

SEQ ID NO: 326518 - DNA, 20 bp, human
gatgaaccaatgaacatgag

SEQ ID NO: 326519 - DNA, 20 bp, human
gatacaagctcaaggaatta

SEQ ID NO: 326520 - DNA, 20 bp, human
ggccttttattcaccttttc

SEQ ID NO: 326521 - DNA, 20 bp, human
gttttgttgcttgttgtagt

SEQ ID NO: 326522 - DNA, 20 bp, human
ggttagattatacaagctca

SEQ ID NO: 326523 - DNA, 20 bp, human
ggggcccaaagtaatcataa

SEQ ID NO: 326524 - DNA, 20 bp, human
gcataagggttcttaaaatt

SEQ ID NO: 326525 - DNA, 20 bp, human
gaactacctctcatgttcat

SEQ ID NO: 326526 - DNA, 20 bp, human
gctcaagtgtgtaacaattg

SEQ ID NO: 326527 - DNA, 20 bp, human
ggttacacacttgaggattg

SEQ ID NO: 326528 - DNA, 20 bp, human
gaactcctctggttgagtaa

SEQ ID NO: 326529 - DNA, 20 bp, human
gtggaaaggctcaacaagaa

SEQ ID NO: 326530 - DNA, 20 bp, human
gctctggttgagtaatgggt

SEQ ID NO: 326531 - DNA, 20 bp, human
gaggctaacgaggtgaaaga

SEQ ID NO: 326532 - DNA, 20 bp, human
gcagggagtaaggaagagat

SEQ ID NO: 326533 - DNA, 20 bp, human
gaggaattgaagagacaaca

SEQ ID NO: 326534 - DNA, 20 bp, human
gaacatctgttaggctaacg

SEQ ID NO: 326535 - DNA, 20 bp, human
gaatctcaattacagtccag

SEQ ID NO: 326536 - DNA, 20 bp, human
gtacttaaagtgaaggcgtt

SEQ ID NO: 326537 - DNA, 20 bp, human
gtacaataatgctaattaaa

SEQ ID NO: 326538 - DNA, 20 bp, human
gactgtatgtatttggtcct

SEQ ID NO: 326539 - DNA, 20 bp, human
gtgaagttcatagctctaag

SEQ ID NO: 326540 - DNA, 20 bp, human
ggacaatatacttaaagtga

SEQ ID NO: 326541 - DNA, 20 bp, human
gtttcactttgtcaaatagt

SEQ ID NO: 326542 - DNA, 20 bp, human
ggttggatccttttaacttt

SEQ ID NO: 326543 - DNA, 20 bp, human
gttcttgtactgtatgtatt

SEQ ID NO: 326544 - DNA, 20 bp, human
gatattctatcctagtaatt

SEQ ID NO: 326545 - DNA, 20 bp, human
gtgcctcagagcatgaactc

SEQ ID NO: 326546 - DNA, 20 bp, human
ggcacttgctgagaaacctc

SEQ ID NO: 326547 - DNA, 20 bp, human
gaacatgcacatcatccctg

SEQ ID NO: 326548 - DNA, 20 bp, human
gctgaaaaatcctcagtggc

SEQ ID NO: 326549 - DNA, 20 bp, human
gctgaggatttttcagtctt

SEQ ID NO: 326550 - DNA, 20 bp, human
ggaatactgaatggagaagt

SEQ ID NO: 326551 - DNA, 20 bp, human
gtcagtctttggtacttggg

SEQ ID NO: 326552 - DNA, 20 bp, human
gtctttggtacttgggaggt

SEQ ID NO: 326553 - DNA, 20 bp, human
gttttcagtctttggtactt

SEQ ID NO: 326554 - DNA, 20 bp, human
gcaagtgcctgaatactgaa

SEQ ID NO: 326555 - DNA, 20 bp, human
gaggtgggagaggaaagatg

SEQ ID NO: 326556 - DNA, 20 bp, human
gtaactctcaaaactagtga

SEQ ID NO: 326557 - DNA, 20 bp, human
gcctgagtatgacagtgtca

SEQ ID NO: 326558 - DNA, 20 bp, human
ggaaaaaccaatagtagaca

SEQ ID NO: 326559 - DNA, 20 bp, human
gttcctcctggcgtgggtgg

SEQ ID NO: 326560 - DNA, 20 bp, human
gtgttagccctttgcttcat

SEQ ID NO: 326561 - DNA, 20 bp, human
gttatctgaccagaagtata

SEQ ID NO: 326562 - DNA, 20 bp, human
ggcaaagccctgtctactat

SEQ ID NO: 326563 - DNA, 20 bp, human
gataaggcttgaaggaaaca

SEQ ID NO: 326564 - DNA, 20 bp, human
gatcacttattcaatacccc

SEQ ID NO: 326565 - DNA, 20 bp, human
gcttagatttccaacatctt

SEQ ID NO: 326566 - DNA, 20 bp, human
gatgacaagaaggcttgctc

SEQ ID NO: 326567 - DNA, 20 bp, human
gtaagtggctaatagagtca

SEQ ID NO: 326568 - DNA, 20 bp, human
gaaggaggttcagatgcatt

SEQ ID NO: 326569 - DNA, 20 bp, human
ggcattaggtgagctttatt

SEQ ID NO: 326570 - DNA, 20 bp, human
ggaaacttccacacaatgta

SEQ ID NO: 326571 - DNA, 20 bp, human
ggttgatgctcagataaagg

SEQ ID NO: 326572 - DNA, 20 bp, human
gatgagcatgtggtataata

SEQ ID NO: 326573 - DNA, 20 bp, human
gcaagaagggttaatgactt

SEQ ID NO: 326574 - DNA, 20 bp, human
gccagttgatgctcagataa

SEQ ID NO: 326575 - DNA, 20 bp, human
gaactacaagaaaaagcagt

SEQ ID NO: 326576 - DNA, 20 bp, human
gtaggcatctactggcaagg

SEQ ID NO: 326577 - DNA, 20 bp, human
gtgtatgactacatacatgc

SEQ ID NO: 326578 - DNA, 20 bp, human
gaaagaagttaggcatctac

SEQ ID NO: 326579 - DNA, 20 bp, human
ggatgcctaacttctttaaa

SEQ ID NO: 326580 - DNA, 20 bp, human
gaaattagacacaaatgtat

SEQ ID NO: 326581 - DNA, 20 bp, human
gttcctgttgcaacttaaaa

SEQ ID NO: 326582 - DNA, 20 bp, human
ggcctaacttctttaaaagg

SEQ ID NO: 326583 - DNA, 20 bp, human
gtgcctgcctgatatatttg

SEQ ID NO: 326584 - DNA, 20 bp, human
gtgcctttttaagttgcaac

SEQ ID NO: 326585 - DNA, 20 bp, human
gagttaggcatctactggca

SEQ ID NO: 326586 - DNA, 20 bp, human
ggtaggctctactttgtgaa

SEQ ID NO: 326587 - DNA, 20 bp, human
gagctcccatgcaaaggtaa

SEQ ID NO: 326588 - DNA, 20 bp, human
ggaaggggatataagaaaat

SEQ ID NO: 326589 - DNA, 20 bp, human
ggggatgattctccaaactg

SEQ ID NO: 326590 - DNA, 20 bp, human
gagaatctggtagaaacgat

SEQ ID NO: 326591 - DNA, 20 bp, human
gatgcaaaggtaagggaagt

SEQ ID NO: 326592 - DNA, 20 bp, human
gcagtacagctcccatgcaa

SEQ ID NO: 326593 - DNA, 20 bp, human
gcagtggttgcctagagcat

SEQ ID NO: 326594 - DNA, 20 bp, human
gagttttaacaaatagaatc

SEQ ID NO: 326595 - DNA, 20 bp, human
gtgatgaacattcaggtttg

SEQ ID NO: 326596 - DNA, 20 bp, human
gaaatcattgcagctttttg

SEQ ID NO: 326597 - DNA, 20 bp, human
gttaaactgacgtattgatc

SEQ ID NO: 326598 - DNA, 20 bp, human
ggcgttcacatttttaccat

SEQ ID NO: 326599 - DNA, 20 bp, human
gtttatacaaaggctcttga

SEQ ID NO: 326600 - DNA, 20 bp, human
gaaaagttttcttgagccta

SEQ ID NO: 326601 - DNA, 20 bp, human
gtttatggtctcatattaca

SEQ ID NO: 326602 - DNA, 20 bp, human
gaatgaatttcattttcaga

SEQ ID NO: 326603 - DNA, 20 bp, human
gacacagtcaaatcaattag

SEQ ID NO: 326604 - DNA, 20 bp, human
gctgtcatttacattttact

SEQ ID NO: 326605 - DNA, 20 bp, human
gctgttatatatttatacaa

SEQ ID NO: 326606 - DNA, 20 bp, human
gtcaaaaattctagctgcat

SEQ ID NO: 326607 - DNA, 20 bp, human
ggaaagcagggtattgtctg

SEQ ID NO: 326608 - DNA, 20 bp, human
gtagaatttttgacactgta

SEQ ID NO: 326609 - DNA, 20 bp, human
ggagataatctgagaccagg

SEQ ID NO: 326610 - DNA, 20 bp, human
gggtaggacatattcccacc

SEQ ID NO: 326611 - DNA, 20 bp, human
gccacaatcaattcaaaatt

SEQ ID NO: 326612 - DNA, 20 bp, human
gcgtgtgttgtataaaatcc

SEQ ID NO: 326613 - DNA, 20 bp, human
gcatgagataatctgagacc

SEQ ID NO: 326614 - DNA, 20 bp, human
ggacaataccctgctttcaa

SEQ ID NO: 326615 - DNA, 20 bp, human
ggacctctgcccttgaaagc

SEQ ID NO: 326616 - DNA, 20 bp, human
gcactggcctatttggagat

SEQ ID NO: 326617 - DNA, 20 bp, human
gagggagaatgtgatctggg

SEQ ID NO: 326618 - DNA, 20 bp, human
gtccaaaccaatctccaaat

SEQ ID NO: 326619 - DNA, 20 bp, human
gcaaataggccagtgtatct

SEQ ID NO: 326620 - DNA, 20 bp, human
gtgaaacattactgagactc

SEQ ID NO: 326621 - DNA, 20 bp, human
gcagtaacgcccagatacac

SEQ ID NO: 326622 - DNA, 20 bp, human
gaccagggagaatgtgatct

SEQ ID NO: 326623 - DNA, 20 bp, human
ggcctatttggagattggtt

SEQ ID NO: 326624 - DNA, 20 bp, human
gagtaatgtttcatctttaa

SEQ ID NO: 326625 - DNA, 20 bp, human
gcctccctgagagtagcaaa

SEQ ID NO: 326626 - DNA, 20 bp, human
gcagcaagtttcattcatct

SEQ ID NO: 326627 - DNA, 20 bp, human
ggtgaatattagatcttgta

SEQ ID NO: 326628 - DNA, 20 bp, human
gtattcttacgaaagagata

SEQ ID NO: 326629 - DNA, 20 bp, human
gttccaaagacaggcaaaaa

SEQ ID NO: 326630 - DNA, 20 bp, human
ggtatgcacagctttttaga

SEQ ID NO: 326631 - DNA, 20 bp, human
gaaaaaaatcctgcacggcc

SEQ ID NO: 326632 - DNA, 20 bp, human
ggaagtctccttccaaagac

SEQ ID NO: 326633 - DNA, 20 bp, human
gccactgcgcccggccgtgc

SEQ ID NO: 326634 - DNA, 20 bp, human
ggtccttttttgcctgtctt

SEQ ID NO: 326635 - DNA, 20 bp, human
gctttaaaaaaaatcctgca

SEQ ID NO: 326636 - DNA, 20 bp, human
gagcttctatacaacttctg

SEQ ID NO: 326637 - DNA, 20 bp, human
gtgctaacttacatcttctc

SEQ ID NO: 326638 - DNA, 20 bp, human
gcccctattaatgctgactt

SEQ ID NO: 326639 - DNA, 20 bp, human
gattaatgctgacttgggat

SEQ ID NO: 326640 - DNA, 20 bp, human
gtgctgacttgggataggaa

SEQ ID NO: 326641 - DNA, 20 bp, human
gtaaggattcatgcatatta

SEQ ID NO: 326642 - DNA, 20 bp, human
gatctcttgacccaggaaaa

SEQ ID NO: 326643 - DNA, 20 bp, human
gcttggatatctcttgaccc

SEQ ID NO: 326644 - DNA, 20 bp, human
gaaattttttgacttaagag

SEQ ID NO: 326645 - DNA, 20 bp, human
gttttaagtgcaccaccact

SEQ ID NO: 326646 - DNA, 20 bp, human
gcacactgttgctcacccct

SEQ ID NO: 326647 - DNA, 20 bp, human
gttactatttggaggaacct

SEQ ID NO: 326648 - DNA, 20 bp, human
gaaattctgagctgttaaaa

SEQ ID NO: 326649 - DNA, 20 bp, human
gaattctaatgccatacatg

SEQ ID NO: 326650 - DNA, 20 bp, human
gataaagcaagtttactatt

SEQ ID NO: 326651 - DNA, 20 bp, human
gaacttatgattctaggttc

SEQ ID NO: 326652 - DNA, 20 bp, human
ggacatgtgttactctcttg

SEQ ID NO: 326653 - DNA, 20 bp, human
gaattcagatgtagctcagt

SEQ ID NO: 326654 - DNA, 20 bp, human
gcatacaacatttggtttgt

SEQ ID NO: 326655 - DNA, 20 bp, human
gcttactttcactgaaagtt

SEQ ID NO: 326656 - DNA, 20 bp, human
gcagaagcttgagtgcccaa

SEQ ID NO: 326657 - DNA, 20 bp, human
gagtaatactcttgtaatgc

SEQ ID NO: 326658 - DNA, 20 bp, human
gggcactcaagcttctgaag

SEQ ID NO: 326659 - DNA, 20 bp, human
gattacaagagtattactaa

SEQ ID NO: 326660 - DNA, 20 bp, human
gaggctgtaaagaaatcttg

SEQ ID NO: 326661 - DNA, 20 bp, human
gaatgccctatgaaactcaa

SEQ ID NO: 326662 - DNA, 20 bp, human
gcccaagggtttgataaatg

SEQ ID NO: 326663 - DNA, 20 bp, human
gcgctgttcgaatatcctgt

SEQ ID NO: 326664 - DNA, 20 bp, human
gatctcaccagcaggccaac

SEQ ID NO: 326665 - DNA, 20 bp, human
gaatcttgtggtcattctca

SEQ ID NO: 326666 - DNA, 20 bp, human
gtatctaggctcaaggctgt

SEQ ID NO: 326667 - DNA, 20 bp, human
gccagaatcgcatatgttca

SEQ ID NO: 326668 - DNA, 20 bp, human
gaaaggacattagattaata

SEQ ID NO: 326669 - DNA, 20 bp, human
gagtgacacagctagtatct

SEQ ID NO: 326670 - DNA, 20 bp, human
gcagctagtatctaggctca

SEQ ID NO: 326671 - DNA, 20 bp, human
gtcattgctgtgtaatttgt

SEQ ID NO: 326672 - DNA, 20 bp, human
gtaccttcatatacaataaa

SEQ ID NO: 326673 - DNA, 20 bp, human
gattacacagcaatgaattc

SEQ ID NO: 326674 - DNA, 20 bp, human
gtatgactttccaaatcaat

SEQ ID NO: 326675 - DNA, 20 bp, human
gtttgtccaacctattgatt

SEQ ID NO: 326676 - DNA, 20 bp, human
gggaactattaaacaaattc

SEQ ID NO: 326677 - DNA, 20 bp, human
gtacaagccttttatttccc

SEQ ID NO: 326678 - DNA, 20 bp, human
gacttagccagggaaataaa

SEQ ID NO: 326679 - DNA, 20 bp, human
ggtaaagacattggtattca

SEQ ID NO: 326680 - DNA, 20 bp, human
ggggaatacatctgatattt

SEQ ID NO: 326681 - DNA, 20 bp, human
gttaactataaacaatccaa

SEQ ID NO: 326682 - DNA, 20 bp, human
gttatagttaatttatagaa

SEQ ID NO: 326683 - DNA, 20 bp, human
gttattttcttaattacctt

SEQ ID NO: 326684 - DNA, 20 bp, human
ggatttttgtgtgtcgattt

SEQ ID NO: 326685 - DNA, 20 bp, human
gtctaggattttatgcatat

SEQ ID NO: 326686 - DNA, 20 bp, human
ggagagagcataaagaaaag

SEQ ID NO: 326687 - DNA, 20 bp, human
gaatatgtatcataatcccc

SEQ ID NO: 326688 - DNA, 20 bp, human
gcatcacatacataaactgt

SEQ ID NO: 326689 - DNA, 20 bp, human
ggaaaagtggacagaaaaga

SEQ ID NO: 326690 - DNA, 20 bp, human
gagagcatcgatctattgtg

SEQ ID NO: 326691 - DNA, 20 bp, human
gaacactaaactatttttat

SEQ ID NO: 326692 - DNA, 20 bp, human
ggtaacatagtataatttca

SEQ ID NO: 326693 - DNA, 20 bp, human
gggaattatgaatggagaga

SEQ ID NO: 326694 - DNA, 20 bp, human
gtgaatgagtgaatggagag

SEQ ID NO: 326695 - DNA, 20 bp, human
gaaaaagttcagacttcaac

SEQ ID NO: 326696 - DNA, 20 bp, human
gtgcatgtgtgtctgatcgt

SEQ ID NO: 326697 - DNA, 20 bp, human
ggggagagtgtcctcaactc

SEQ ID NO: 326698 - DNA, 20 bp, human
gagcaaacaagcagtaaagg

SEQ ID NO: 326699 - DNA, 20 bp, human
gtgggcaatggtcttgtcat

SEQ ID NO: 326700 - DNA, 20 bp, human
gatgtcctcaacagcaggaa

SEQ ID NO: 326701 - DNA, 20 bp, human
ggttttagaaacctcagctc

SEQ ID NO: 326702 - DNA, 20 bp, human
ggatcagacacacatgcaga

SEQ ID NO: 326703 - DNA, 20 bp, human
gtaagcttagagttgttgat

SEQ ID NO: 326704 - DNA, 20 bp, human
gtcttcacatattggcgatg

SEQ ID NO: 326705 - DNA, 20 bp, human
gggaacatgtcctcaacagc

SEQ ID NO: 326706 - DNA, 20 bp, human
gttgaataaacattactcta

SEQ ID NO: 326707 - DNA, 20 bp, human
gaactctaaacatcctagtg

SEQ ID NO: 326708 - DNA, 20 bp, human
gtcttcacatattagataca

SEQ ID NO: 326709 - DNA, 20 bp, human
gactattgaagataactcaa

SEQ ID NO: 326710 - DNA, 20 bp, human
gaatatgtgaagatctacct

SEQ ID NO: 326711 - DNA, 20 bp, human
gaaacgctgggtcaaaattc

SEQ ID NO: 326712 - DNA, 20 bp, human
gcctagtgtggctgtattct

SEQ ID NO: 326713 - DNA, 20 bp, human
gtgtatttacttctgatcct

SEQ ID NO: 326714 - DNA, 20 bp, human
gtgttgtctgcaataatcta

SEQ ID NO: 326715 - DNA, 20 bp, human
gcttttagaaaactcaactt

SEQ ID NO: 326716 - DNA, 20 bp, human
gtcatcacagttctaggaaa

SEQ ID NO: 326717 - DNA, 20 bp, human
gtcatcacatagtaaactga

SEQ ID NO: 326718 - DNA, 20 bp, human
gtagaatgtaaacttcataa

SEQ ID NO: 326719 - DNA, 20 bp, human
ggtaacatagtataatttca

SEQ ID NO: 326720 - DNA, 20 bp, human
gagagcattgatctattgtg

SEQ ID NO: 326721 - DNA, 20 bp, human
gatgaagtttacattctact

SEQ ID NO: 326722 - DNA, 20 bp, human
ggaacactaaactattttat

SEQ ID NO: 326723 - DNA, 20 bp, human
ggctatatagtatgtacctt

SEQ ID NO: 326724 - DNA, 20 bp, human
gagaaaagtctacagaaaag

SEQ ID NO: 326725 - DNA, 20 bp, human
gggaattatgaatggagaga

SEQ ID NO: 326726 - DNA, 20 bp, human
gaaacccaggccactagagt

SEQ ID NO: 326727 - DNA, 20 bp, human
gtctctcttaactctgagac

SEQ ID NO: 326728 - DNA, 20 bp, human
ggttaggattcctactctag

SEQ ID NO: 326729 - DNA, 20 bp, human
gctagtggcctgggttttac

SEQ ID NO: 326730 - DNA, 20 bp, human
gagagagaacacatgattat

SEQ ID NO: 326731 - DNA, 20 bp, human
gacacctgtctgctgaatcc

SEQ ID NO: 326732 - DNA, 20 bp, human
gaaagtggattgggatccaa

SEQ ID NO: 326733 - DNA, 20 bp, human
gaacagcaataaagtggatt

SEQ ID NO: 326734 - DNA, 20 bp, human
gcacatgattataggacctt

SEQ ID NO: 326735 - DNA, 20 bp, human
gattcctactctagtggcct

SEQ ID NO: 326736 - DNA, 20 bp, human
gaggaaggaatatacggaaa

SEQ ID NO: 326737 - DNA, 20 bp, human
gaagaggaggaaggaatata

SEQ ID NO: 326738 - DNA, 20 bp, human
ggcaggaagagaaatatgag

SEQ ID NO: 326739 - DNA, 20 bp, human
ggcaagtatgggacacaaac

SEQ ID NO: 326740 - DNA, 20 bp, human
gaaaacctcactcccaggtc

SEQ ID NO: 326741 - DNA, 20 bp, human
ggatattgatcactcattct

SEQ ID NO: 326742 - DNA, 20 bp, human
gtctttcttcaatactttta

SEQ ID NO: 326743 - DNA, 20 bp, human
gttctcctgacctgggagtg

SEQ ID NO: 326744 - DNA, 20 bp, human
gggctgaactctctcacttt

SEQ ID NO: 326745 - DNA, 20 bp, human
gactttaaaacctcactccc

SEQ ID NO: 326746 - DNA, 20 bp, human
gaggttaaatgatatgtcac

SEQ ID NO: 326747 - DNA, 20 bp, human
ggagaaacccaatatatctt

SEQ ID NO: 326748 - DNA, 20 bp, human
gaatactgccagaattattc

SEQ ID NO: 326749 - DNA, 20 bp, human
gtgtagtcctaagatatatt

SEQ ID NO: 326750 - DNA, 20 bp, human
ggaacctaatggttccaaca

SEQ ID NO: 326751 - DNA, 20 bp, human
gacttaccaaagctacatcc

SEQ ID NO: 326752 - DNA, 20 bp, human
gatgccatgttggaaccatt

SEQ ID NO: 326753 - DNA, 20 bp, human
gttaggtgcctagaacctaa

SEQ ID NO: 326754 - DNA, 20 bp, human
gagatagttcatagtaagct

SEQ ID NO: 326755 - DNA, 20 bp, human
ggaagtgtcaaataaagttt

SEQ ID NO: 326756 - DNA, 20 bp, human
gttgctgtaagattttcttt

SEQ ID NO: 326757 - DNA, 20 bp, human
gggaggatggtgtatttaat

SEQ ID NO: 326758 - DNA, 20 bp, human
gaatcatgccaatggtacag

SEQ ID NO: 326759 - DNA, 20 bp, human
gtgttcttcaatggttctct

SEQ ID NO: 326760 - DNA, 20 bp, human
gaagattattaccaaatcag

SEQ ID NO: 326761 - DNA, 20 bp, human
ggcagaagaaactgtgaact

SEQ ID NO: 326762 - DNA, 20 bp, human
gggtaataatcttcttactt

SEQ ID NO: 326763 - DNA, 20 bp, human
gcaaagtctctgttacttta

SEQ ID NO: 326764 - DNA, 20 bp, human
gtctcatgctaggagacaca

SEQ ID NO: 326765 - DNA, 20 bp, human
gaaatagatcagttaaaatg

SEQ ID NO: 326766 - DNA, 20 bp, human
gtcagagaatgggattagtc

SEQ ID NO: 326767 - DNA, 20 bp, human
gtagggacttaattcttgat

SEQ ID NO: 326768 - DNA, 20 bp, human
gtgactcaaactgaagccag

SEQ ID NO: 326769 - DNA, 20 bp, human
gtgaggagtgtgtgtactta

SEQ ID NO: 326770 - DNA, 20 bp, human
gagcaggaattcccatttga

SEQ ID NO: 326771 - DNA, 20 bp, human
ggttgttaggagataacatg

SEQ ID NO: 326772 - DNA, 20 bp, human
gtttgctcgtgtatatctca

SEQ ID NO: 326773 - DNA, 20 bp, human
gatacagaactccatcaaat

SEQ ID NO: 326774 - DNA, 20 bp, human
ggacagggctaattatagtg

SEQ ID NO: 326775 - DNA, 20 bp, human
gaaagaatccctgtgttgtt

SEQ ID NO: 326776 - DNA, 20 bp, human
gagaagacctctagtggagg

SEQ ID NO: 326777 - DNA, 20 bp, human
gtcaagaagacctctagtgg

SEQ ID NO: 326778 - DNA, 20 bp, human
ggtgtcagaaggtaccctgt

SEQ ID NO: 326779 - DNA, 20 bp, human
gtattcaagaagacctctag
